United States Patent 8,822,426 (PREVENTION AND TREATMENT OF NOSEMA DISEASE IN BEES) - sequence listing, part 6

SEQ ID NO: 163239 - DNA, 23 bp, Artificial sequence
  SiRNA target sequence
cttaaagaaataggaagaatatg

SEQ ID NO: 163240 - DNA, 23 bp, Artificial sequence
  SiRNA target sequence
ttaaagaaataggaagaatatgt

SEQ ID NO: 163241 - DNA, 23 bp, Artificial sequence
  SiRNA target sequence
taaagaaataggaagaatatgta

SEQ ID NO: 163242 - DNA, 23 bp, Artificial sequence
  SiRNA target sequence
aaagaaataggaagaatatgtaa

SEQ ID NO: 163243 - DNA, 23 bp, Artificial sequence
  SiRNA target sequence
aagaaataggaagaatatgtaaa

SEQ ID NO: 163244 - DNA, 23 bp, Artificial sequence
  SiRNA target sequence
agaaataggaagaatatgtaaag

SEQ ID NO: 163245 - DNA, 23 bp, Artificial sequence
  SiRNA target sequence
gaaataggaagaatatgtaaaga

SEQ ID NO: 163246 - DNA, 23 bp, Artificial sequence
  SiRNA target sequence
aaataggaagaatatgtaaagaa

SEQ ID NO: 163247 - DNA, 23 bp, Artificial sequence
  SiRNA target sequence
aataggaagaatatgtaaagaaa

SEQ ID NO: 163248 - DNA, 23 bp, Artificial sequence
  SiRNA target sequence
ataggaagaatatgtaaagaaaa

SEQ ID NO: 163249 - DNA, 23 bp, Artificial sequence
  SiRNA target sequence
taggaagaatatgtaaagaaaat

SEQ ID NO: 163250 - DNA, 23 bp, Artificial sequence
  SiRNA target sequence
aggaagaatatgtaaagaaaata

SEQ ID NO: 163251 - DNA, 23 bp, Artificial sequence
  SiRNA target sequence
ggaagaatatgtaaagaaaataa

SEQ ID NO: 163252 - DNA, 23 bp, Artificial sequence
  SiRNA target sequence
gaagaatatgtaaagaaaataat

SEQ ID NO: 163253 - DNA, 23 bp, Artificial sequence
  SiRNA target sequence
aagaatatgtaaagaaaataata

SEQ ID NO: 163254 - DNA, 23 bp, Artificial sequence
  SiRNA target sequence
agaatatgtaaagaaaataatat

SEQ ID NO: 163255 - DNA, 23 bp, Artificial sequence
  SiRNA target sequence
gaatatgtaaagaaaataatatt

SEQ ID NO: 163256 - DNA, 23 bp, Artificial sequence
  SiRNA target sequence
aatatgtaaagaaaataatattt

SEQ ID NO: 163257 - DNA, 23 bp, Artificial sequence
  SiRNA target sequence
atatgtaaagaaaataatatttt

SEQ ID NO: 163258 - DNA, 23 bp, Artificial sequence
  SiRNA target sequence
tatgtaaagaaaataatatttta

SEQ ID NO: 163259 - DNA, 23 bp, Artificial sequence
  SiRNA target sequence
atgtaaagaaaataatattttat

SEQ ID NO: 163260 - DNA, 23 bp, Artificial sequence
  SiRNA target sequence
tgtaaagaaaataatattttatt

SEQ ID NO: 163261 - DNA, 23 bp, Artificial sequence
  SiRNA target sequence
gtaaagaaaataatattttattt

SEQ ID NO: 163262 - DNA, 23 bp, Artificial sequence
  SiRNA target sequence
taaagaaaataatattttatttc

SEQ ID NO: 163263 - DNA, 23 bp, Artificial sequence
  SiRNA target sequence
aaagaaaataatattttatttca

SEQ ID NO: 163264 - DNA, 23 bp, Artificial sequence
  SiRNA target sequence
aagaaaataatattttatttcac

SEQ ID NO: 163265 - DNA, 23 bp, Artificial sequence
  SiRNA target sequence
agaaaataatattttatttcaca

SEQ ID NO: 163266 - DNA, 23 bp, Artificial sequence
  SiRNA target sequence
gaaaataatattttatttcacac

SEQ ID NO: 163267 - DNA, 23 bp, Artificial sequence
  SiRNA target sequence
aaaataatattttatttcacact

SEQ ID NO: 163268 - DNA, 23 bp, Artificial sequence
  SiRNA target sequence
aaataatattttatttcacactg

SEQ ID NO: 163269 - DNA, 23 bp, Artificial sequence
  SiRNA target sequence
aataatattttatttcacactga

SEQ ID NO: 163270 - DNA, 23 bp, Artificial sequence
  SiRNA target sequence
ataatattttatttcacactgat

SEQ ID NO: 163271 - DNA, 23 bp, Artificial sequence
  SiRNA target sequence
taatattttatttcacactgatg

SEQ ID NO: 163272 - DNA, 23 bp, Artificial sequence
  SiRNA target sequence
aatattttatttcacactgatgc

SEQ ID NO: 163273 - DNA, 23 bp, Artificial sequence
  SiRNA target sequence
atattttatttcacactgatgca

SEQ ID NO: 163274 - DNA, 23 bp, Artificial sequence
  SiRNA target sequence
tattttatttcacactgatgcag

SEQ ID NO: 163275 - DNA, 23 bp, Artificial sequence
  SiRNA target sequence
attttatttcacactgatgcagc

SEQ ID NO: 163276 - DNA, 23 bp, Artificial sequence
  SiRNA target sequence
ttttatttcacactgatgcagca

SEQ ID NO: 163277 - DNA, 23 bp, Artificial sequence
  SiRNA target sequence
tttatttcacactgatgcagcac

SEQ ID NO: 163278 - DNA, 23 bp, Artificial sequence
  SiRNA target sequence
ttatttcacactgatgcagcaca

SEQ ID NO: 163279 - DNA, 23 bp, Artificial sequence
  SiRNA target sequence
tatttcacactgatgcagcacaa

SEQ ID NO: 163280 - DNA, 23 bp, Artificial sequence
  SiRNA target sequence
atttcacactgatgcagcacaag

SEQ ID NO: 163281 - DNA, 23 bp, Artificial sequence
  SiRNA target sequence
tttcacactgatgcagcacaagc

SEQ ID NO: 163282 - DNA, 23 bp, Artificial sequence
  SiRNA target sequence
ttcacactgatgcagcacaagca

SEQ ID NO: 163283 - DNA, 23 bp, Artificial sequence
  SiRNA target sequence
tcacactgatgcagcacaagcag

SEQ ID NO: 163284 - DNA, 23 bp, Artificial sequence
  SiRNA target sequence
cacactgatgcagcacaagcagt

SEQ ID NO: 163285 - DNA, 23 bp, Artificial sequence
  SiRNA target sequence
acactgatgcagcacaagcagtt

SEQ ID NO: 163286 - DNA, 23 bp, Artificial sequence
  SiRNA target sequence
cactgatgcagcacaagcagttg

SEQ ID NO: 163287 - DNA, 23 bp, Artificial sequence
  SiRNA target sequence
actgatgcagcacaagcagttgg

SEQ ID NO: 163288 - DNA, 23 bp, Artificial sequence
  SiRNA target sequence
ctgatgcagcacaagcagttggt

SEQ ID NO: 163289 - DNA, 23 bp, Artificial sequence
  SiRNA target sequence
tgatgcagcacaagcagttggta

SEQ ID NO: 163290 - DNA, 23 bp, Artificial sequence
  SiRNA target sequence
gatgcagcacaagcagttggtaa

SEQ ID NO: 163291 - DNA, 23 bp, Artificial sequence
  SiRNA target sequence
atgcagcacaagcagttggtaat

SEQ ID NO: 163292 - DNA, 23 bp, Artificial sequence
  SiRNA target sequence
tgcagcacaagcagttggtaata

SEQ ID NO: 163293 - DNA, 23 bp, Artificial sequence
  SiRNA target sequence
gcagcacaagcagttggtaatat

SEQ ID NO: 163294 - DNA, 23 bp, Artificial sequence
  SiRNA target sequence
cagcacaagcagttggtaatata

SEQ ID NO: 163295 - DNA, 23 bp, Artificial sequence
  SiRNA target sequence
agcacaagcagttggtaatatag

SEQ ID NO: 163296 - DNA, 23 bp, Artificial sequence
  SiRNA target sequence
gcacaagcagttggtaatataga

SEQ ID NO: 163297 - DNA, 23 bp, Artificial sequence
  SiRNA target sequence
cacaagcagttggtaatatagat

SEQ ID NO: 163298 - DNA, 23 bp, Artificial sequence
  SiRNA target sequence
acaagcagttggtaatatagata

SEQ ID NO: 163299 - DNA, 23 bp, Artificial sequence
  SiRNA target sequence
caagcagttggtaatatagatat

SEQ ID NO: 163300 - DNA, 23 bp, Artificial sequence
  SiRNA target sequence
aagcagttggtaatatagatatt

SEQ ID NO: 163301 - DNA, 23 bp, Artificial sequence
  SiRNA target sequence
agcagttggtaatatagatattg

SEQ ID NO: 163302 - DNA, 23 bp, Artificial sequence
  SiRNA target sequence
gcagttggtaatatagatattga

SEQ ID NO: 163303 - DNA, 23 bp, Artificial sequence
  SiRNA target sequence
cagttggtaatatagatattgat

SEQ ID NO: 163304 - DNA, 23 bp, Artificial sequence
  SiRNA target sequence
agttggtaatatagatattgatg

SEQ ID NO: 163305 - DNA, 23 bp, Artificial sequence
  SiRNA target sequence
gttggtaatatagatattgatgt

SEQ ID NO: 163306 - DNA, 23 bp, Artificial sequence
  SiRNA target sequence
ttggtaatatagatattgatgtc

SEQ ID NO: 163307 - DNA, 23 bp, Artificial sequence
  SiRNA target sequence
tggtaatatagatattgatgtca

SEQ ID NO: 163308 - DNA, 23 bp, Artificial sequence
  SiRNA target sequence
ggtaatatagatattgatgtcaa

SEQ ID NO: 163309 - DNA, 23 bp, Artificial sequence
  SiRNA target sequence
gtaatatagatattgatgtcaat

SEQ ID NO: 163310 - DNA, 23 bp, Artificial sequence
  SiRNA target sequence
taatatagatattgatgtcaatg

SEQ ID NO: 163311 - DNA, 23 bp, Artificial sequence
  SiRNA target sequence
aatatagatattgatgtcaatga

SEQ ID NO: 163312 - DNA, 23 bp, Artificial sequence
  SiRNA target sequence
atatagatattgatgtcaatgat

SEQ ID NO: 163313 - DNA, 23 bp, Artificial sequence
  SiRNA target sequence
tatagatattgatgtcaatgata

SEQ ID NO: 163314 - DNA, 23 bp, Artificial sequence
  SiRNA target sequence
atagatattgatgtcaatgatat

SEQ ID NO: 163315 - DNA, 23 bp, Artificial sequence
  SiRNA target sequence
tagatattgatgtcaatgatatg

SEQ ID NO: 163316 - DNA, 23 bp, Artificial sequence
  SiRNA target sequence
agatattgatgtcaatgatatga

SEQ ID NO: 163317 - DNA, 23 bp, Artificial sequence
  SiRNA target sequence
gatattgatgtcaatgatatgaa

SEQ ID NO: 163318 - DNA, 23 bp, Artificial sequence
  SiRNA target sequence
atattgatgtcaatgatatgaat

SEQ ID NO: 163319 - DNA, 23 bp, Artificial sequence
  SiRNA target sequence
tattgatgtcaatgatatgaata

SEQ ID NO: 163320 - DNA, 23 bp, Artificial sequence
  SiRNA target sequence
attgatgtcaatgatatgaatat

SEQ ID NO: 163321 - DNA, 23 bp, Artificial sequence
  SiRNA target sequence
ttgatgtcaatgatatgaatatt

SEQ ID NO: 163322 - DNA, 23 bp, Artificial sequence
  SiRNA target sequence
tgatgtcaatgatatgaatattg

SEQ ID NO: 163323 - DNA, 23 bp, Artificial sequence
  SiRNA target sequence
gatgtcaatgatatgaatattga

SEQ ID NO: 163324 - DNA, 23 bp, Artificial sequence
  SiRNA target sequence
atgtcaatgatatgaatattgat

SEQ ID NO: 163325 - DNA, 23 bp, Artificial sequence
  SiRNA target sequence
tgtcaatgatatgaatattgatt

SEQ ID NO: 163326 - DNA, 23 bp, Artificial sequence
  SiRNA target sequence
gtcaatgatatgaatattgattt

SEQ ID NO: 163327 - DNA, 23 bp, Artificial sequence
  SiRNA target sequence
tcaatgatatgaatattgattta

SEQ ID NO: 163328 - DNA, 23 bp, Artificial sequence
  SiRNA target sequence
caatgatatgaatattgatttac

SEQ ID NO: 163329 - DNA, 23 bp, Artificial sequence
  SiRNA target sequence
aatgatatgaatattgatttact

SEQ ID NO: 163330 - DNA, 23 bp, Artificial sequence
  SiRNA target sequence
atgatatgaatattgatttacta

SEQ ID NO: 163331 - DNA, 23 bp, Artificial sequence
  SiRNA target sequence
tgatatgaatattgatttactaa

SEQ ID NO: 163332 - DNA, 23 bp, Artificial sequence
  SiRNA target sequence
gatatgaatattgatttactaag

SEQ ID NO: 163333 - DNA, 23 bp, Artificial sequence
  SiRNA target sequence
atatgaatattgatttactaagt

SEQ ID NO: 163334 - DNA, 23 bp, Artificial sequence
  SiRNA target sequence
tatgaatattgatttactaagtt

SEQ ID NO: 163335 - DNA, 23 bp, Artificial sequence
  SiRNA target sequence
atgaatattgatttactaagttt

SEQ ID NO: 163336 - DNA, 23 bp, Artificial sequence
  SiRNA target sequence
tgaatattgatttactaagttta

SEQ ID NO: 163337 - DNA, 23 bp, Artificial sequence
  SiRNA target sequence
gaatattgatttactaagtttat

SEQ ID NO: 163338 - DNA, 23 bp, Artificial sequence
  SiRNA target sequence
aatattgatttactaagtttatc

SEQ ID NO: 163339 - DNA, 23 bp, Artificial sequence
  SiRNA target sequence
atattgatttactaagtttatca

SEQ ID NO: 163340 - DNA, 23 bp, Artificial sequence
  SiRNA target sequence
tattgatttactaagtttatcaa

SEQ ID NO: 163341 - DNA, 23 bp, Artificial sequence
  SiRNA target sequence
attgatttactaagtttatcaag

SEQ ID NO: 163342 - DNA, 23 bp, Artificial sequence
  SiRNA target sequence
ttgatttactaagtttatcaagt

SEQ ID NO: 163343 - DNA, 23 bp, Artificial sequence
  SiRNA target sequence
tgatttactaagtttatcaagtc

SEQ ID NO: 163344 - DNA, 23 bp, Artificial sequence
  SiRNA target sequence
gatttactaagtttatcaagtca

SEQ ID NO: 163345 - DNA, 23 bp, Artificial sequence
  SiRNA target sequence
atttactaagtttatcaagtcat

SEQ ID NO: 163346 - DNA, 23 bp, Artificial sequence
  SiRNA target sequence
tttactaagtttatcaagtcata

SEQ ID NO: 163347 - DNA, 23 bp, Artificial sequence
  SiRNA target sequence
ttactaagtttatcaagtcataa

SEQ ID NO: 163348 - DNA, 23 bp, Artificial sequence
  SiRNA target sequence
tactaagtttatcaagtcataaa

SEQ ID NO: 163349 - DNA, 23 bp, Artificial sequence
  SiRNA target sequence
actaagtttatcaagtcataaaa

SEQ ID NO: 163350 - DNA, 23 bp, Artificial sequence
  SiRNA target sequence
ctaagtttatcaagtcataaaat

SEQ ID NO: 163351 - DNA, 23 bp, Artificial sequence
  SiRNA target sequence
taagtttatcaagtcataaaatt

SEQ ID NO: 163352 - DNA, 23 bp, Artificial sequence
  SiRNA target sequence
aagtttatcaagtcataaaattt

SEQ ID NO: 163353 - DNA, 23 bp, Artificial sequence
  SiRNA target sequence
agtttatcaagtcataaaattta

SEQ ID NO: 163354 - DNA, 23 bp, Artificial sequence
  SiRNA target sequence
gtttatcaagtcataaaatttat

SEQ ID NO: 163355 - DNA, 23 bp, Artificial sequence
  SiRNA target sequence
tttatcaagtcataaaatttatg

SEQ ID NO: 163356 - DNA, 23 bp, Artificial sequence
  SiRNA target sequence
ttatcaagtcataaaatttatgg

SEQ ID NO: 163357 - DNA, 23 bp, Artificial sequence
  SiRNA target sequence
tatcaagtcataaaatttatggt

SEQ ID NO: 163358 - DNA, 23 bp, Artificial sequence
  SiRNA target sequence
atcaagtcataaaatttatggtc

SEQ ID NO: 163359 - DNA, 23 bp, Artificial sequence
  SiRNA target sequence
tcaagtcataaaatttatggtcc

SEQ ID NO: 163360 - DNA, 23 bp, Artificial sequence
  SiRNA target sequence
caagtcataaaatttatggtcca

SEQ ID NO: 163361 - DNA, 23 bp, Artificial sequence
  SiRNA target sequence
aagtcataaaatttatggtccaa

SEQ ID NO: 163362 - DNA, 23 bp, Artificial sequence
  SiRNA target sequence
agtcataaaatttatggtccaaa

SEQ ID NO: 163363 - DNA, 23 bp, Artificial sequence
  SiRNA target sequence
gtcataaaatttatggtccaaaa

SEQ ID NO: 163364 - DNA, 23 bp, Artificial sequence
  SiRNA target sequence
tcataaaatttatggtccaaaag

SEQ ID NO: 163365 - DNA, 23 bp, Artificial sequence
  SiRNA target sequence
cataaaatttatggtccaaaagg

SEQ ID NO: 163366 - DNA, 23 bp, Artificial sequence
  SiRNA target sequence
ataaaatttatggtccaaaaggt

SEQ ID NO: 163367 - DNA, 23 bp, Artificial sequence
  SiRNA target sequence
taaaatttatggtccaaaaggtg

SEQ ID NO: 163368 - DNA, 23 bp, Artificial sequence
  SiRNA target sequence
aaaatttatggtccaaaaggtgt

SEQ ID NO: 163369 - DNA, 23 bp, Artificial sequence
  SiRNA target sequence
aaatttatggtccaaaaggtgtt

SEQ ID NO: 163370 - DNA, 23 bp, Artificial sequence
  SiRNA target sequence
aatttatggtccaaaaggtgttg

SEQ ID NO: 163371 - DNA, 23 bp, Artificial sequence
  SiRNA target sequence
atttatggtccaaaaggtgttgg

SEQ ID NO: 163372 - DNA, 23 bp, Artificial sequence
  SiRNA target sequence
tttatggtccaaaaggtgttggt

SEQ ID NO: 163373 - DNA, 23 bp, Artificial sequence
  SiRNA target sequence
ttatggtccaaaaggtgttggtg

SEQ ID NO: 163374 - DNA, 23 bp, Artificial sequence
  SiRNA target sequence
tatggtccaaaaggtgttggtgc

SEQ ID NO: 163375 - DNA, 23 bp, Artificial sequence
  SiRNA target sequence
atggtccaaaaggtgttggtgcc

SEQ ID NO: 163376 - DNA, 23 bp, Artificial sequence
  SiRNA target sequence
tggtccaaaaggtgttggtgcct

SEQ ID NO: 163377 - DNA, 23 bp, Artificial sequence
  SiRNA target sequence
ggtccaaaaggtgttggtgcctt

SEQ ID NO: 163378 - DNA, 23 bp, Artificial sequence
  SiRNA target sequence
gtccaaaaggtgttggtgcctta

SEQ ID NO: 163379 - DNA, 23 bp, Artificial sequence
  SiRNA target sequence
tccaaaaggtgttggtgccttat

SEQ ID NO: 163380 - DNA, 23 bp, Artificial sequence
  SiRNA target sequence
ccaaaaggtgttggtgccttata

SEQ ID NO: 163381 - DNA, 23 bp, Artificial sequence
  SiRNA target sequence
caaaaggtgttggtgccttatac

SEQ ID NO: 163382 - DNA, 23 bp, Artificial sequence
  SiRNA target sequence
aaaaggtgttggtgccttatacg

SEQ ID NO: 163383 - DNA, 23 bp, Artificial sequence
  SiRNA target sequence
aaaggtgttggtgccttatacgt

SEQ ID NO: 163384 - DNA, 23 bp, Artificial sequence
  SiRNA target sequence
aaggtgttggtgccttatacgtc

SEQ ID NO: 163385 - DNA, 23 bp, Artificial sequence
  SiRNA target sequence
aggtgttggtgccttatacgtca

SEQ ID NO: 163386 - DNA, 23 bp, Artificial sequence
  SiRNA target sequence
ggtgttggtgccttatacgtcag

SEQ ID NO: 163387 - DNA, 23 bp, Artificial sequence
  SiRNA target sequence
gtgttggtgccttatacgtcaga

SEQ ID NO: 163388 - DNA, 23 bp, Artificial sequence
  SiRNA target sequence
tgttggtgccttatacgtcagaa

SEQ ID NO: 163389 - DNA, 23 bp, Artificial sequence
  SiRNA target sequence
gttggtgccttatacgtcagaag

SEQ ID NO: 163390 - DNA, 23 bp, Artificial sequence
  SiRNA target sequence
ttggtgccttatacgtcagaaga

SEQ ID NO: 163391 - DNA, 23 bp, Artificial sequence
  SiRNA target sequence
tggtgccttatacgtcagaagaa

SEQ ID NO: 163392 - DNA, 23 bp, Artificial sequence
  SiRNA target sequence
ggtgccttatacgtcagaagaag

SEQ ID NO: 163393 - DNA, 23 bp, Artificial sequence
  SiRNA target sequence
gtgccttatacgtcagaagaagg

SEQ ID NO: 163394 - DNA, 23 bp, Artificial sequence
  SiRNA target sequence
tgccttatacgtcagaagaaggc

SEQ ID NO: 163395 - DNA, 23 bp, Artificial sequence
  SiRNA target sequence
gccttatacgtcagaagaaggcc

SEQ ID NO: 163396 - DNA, 23 bp, Artificial sequence
  SiRNA target sequence
ccttatacgtcagaagaaggcct

SEQ ID NO: 163397 - DNA, 23 bp, Artificial sequence
  SiRNA target sequence
cttatacgtcagaagaaggccta

SEQ ID NO: 163398 - DNA, 23 bp, Artificial sequence
  SiRNA target sequence
ttatacgtcagaagaaggcctag

SEQ ID NO: 163399 - DNA, 23 bp, Artificial sequence
  SiRNA target sequence
tatacgtcagaagaaggcctagg

SEQ ID NO: 163400 - DNA, 23 bp, Artificial sequence
  SiRNA target sequence
atacgtcagaagaaggcctaggg

SEQ ID NO: 163401 - DNA, 23 bp, Artificial sequence
  SiRNA target sequence
tacgtcagaagaaggcctagggt

SEQ ID NO: 163402 - DNA, 23 bp, Artificial sequence
  SiRNA target sequence
acgtcagaagaaggcctagggtg

SEQ ID NO: 163403 - DNA, 23 bp, Artificial sequence
  SiRNA target sequence
cgtcagaagaaggcctagggtga

SEQ ID NO: 163404 - DNA, 23 bp, Artificial sequence
  SiRNA target sequence
gtcagaagaaggcctagggtgag

SEQ ID NO: 163405 - DNA, 23 bp, Artificial sequence
  SiRNA target sequence
tcagaagaaggcctagggtgaga

SEQ ID NO: 163406 - DNA, 23 bp, Artificial sequence
  SiRNA target sequence
cagaagaaggcctagggtgagaa

SEQ ID NO: 163407 - DNA, 23 bp, Artificial sequence
  SiRNA target sequence
agaagaaggcctagggtgagaat

SEQ ID NO: 163408 - DNA, 23 bp, Artificial sequence
  SiRNA target sequence
gaagaaggcctagggtgagaatg

SEQ ID NO: 163409 - DNA, 23 bp, Artificial sequence
  SiRNA target sequence
aagaaggcctagggtgagaatgt

SEQ ID NO: 163410 - DNA, 23 bp, Artificial sequence
  SiRNA target sequence
agaaggcctagggtgagaatgtt

SEQ ID NO: 163411 - DNA, 23 bp, Artificial sequence
  SiRNA target sequence
gaaggcctagggtgagaatgtta

SEQ ID NO: 163412 - DNA, 23 bp, Artificial sequence
  SiRNA target sequence
aaggcctagggtgagaatgttac

SEQ ID NO: 163413 - DNA, 23 bp, Artificial sequence
  SiRNA target sequence
aggcctagggtgagaatgttacc

SEQ ID NO: 163414 - DNA, 23 bp, Artificial sequence
  SiRNA target sequence
ggcctagggtgagaatgttacca

SEQ ID NO: 163415 - DNA, 23 bp, Artificial sequence
  SiRNA target sequence
gcctagggtgagaatgttaccac

SEQ ID NO: 163416 - DNA, 23 bp, Artificial sequence
  SiRNA target sequence
cctagggtgagaatgttaccact

SEQ ID NO: 163417 - DNA, 23 bp, Artificial sequence
  SiRNA target sequence
ctagggtgagaatgttaccactt

SEQ ID NO: 163418 - DNA, 23 bp, Artificial sequence
  SiRNA target sequence
tagggtgagaatgttaccacttt

SEQ ID NO: 163419 - DNA, 23 bp, Artificial sequence
  SiRNA target sequence
agggtgagaatgttaccactttt

SEQ ID NO: 163420 - DNA, 23 bp, Artificial sequence
  SiRNA target sequence
gggtgagaatgttaccacttttt

SEQ ID NO: 163421 - DNA, 23 bp, Artificial sequence
  SiRNA target sequence
ggtgagaatgttaccacttttta

SEQ ID NO: 163422 - DNA, 23 bp, Artificial sequence
  SiRNA target sequence
gtgagaatgttaccactttttaa

SEQ ID NO: 163423 - DNA, 23 bp, Artificial sequence
  SiRNA target sequence
tgagaatgttaccactttttaat

SEQ ID NO: 163424 - DNA, 23 bp, Artificial sequence
  SiRNA target sequence
gagaatgttaccactttttaatg

SEQ ID NO: 163425 - DNA, 23 bp, Artificial sequence
  SiRNA target sequence
agaatgttaccactttttaatgg

SEQ ID NO: 163426 - DNA, 23 bp, Artificial sequence
  SiRNA target sequence
gaatgttaccactttttaatggt

SEQ ID NO: 163427 - DNA, 23 bp, Artificial sequence
  SiRNA target sequence
aatgttaccactttttaatggtg

SEQ ID NO: 163428 - DNA, 23 bp, Artificial sequence
  SiRNA target sequence
atgttaccactttttaatggtgg

SEQ ID NO: 163429 - DNA, 23 bp, Artificial sequence
  SiRNA target sequence
tgttaccactttttaatggtggt

SEQ ID NO: 163430 - DNA, 23 bp, Artificial sequence
  SiRNA target sequence
gttaccactttttaatggtggtg

SEQ ID NO: 163431 - DNA, 23 bp, Artificial sequence
  SiRNA target sequence
ttaccactttttaatggtggtgg

SEQ ID NO: 163432 - DNA, 23 bp, Artificial sequence
  SiRNA target sequence
taccactttttaatggtggtgga

SEQ ID NO: 163433 - DNA, 23 bp, Artificial sequence
  SiRNA target sequence
accactttttaatggtggtggac

SEQ ID NO: 163434 - DNA, 23 bp, Artificial sequence
  SiRNA target sequence
ccactttttaatggtggtggaca

SEQ ID NO: 163435 - DNA, 23 bp, Artificial sequence
  SiRNA target sequence
cactttttaatggtggtggacaa

SEQ ID NO: 163436 - DNA, 23 bp, Artificial sequence
  SiRNA target sequence
actttttaatggtggtggacaag

SEQ ID NO: 163437 - DNA, 23 bp, Artificial sequence
  SiRNA target sequence
ctttttaatggtggtggacaaga

SEQ ID NO: 163438 - DNA, 23 bp, Artificial sequence
  SiRNA target sequence
tttttaatggtggtggacaagaa

SEQ ID NO: 163439 - DNA, 23 bp, Artificial sequence
  SiRNA target sequence
ttttaatggtggtggacaagaaa

SEQ ID NO: 163440 - DNA, 23 bp, Artificial sequence
  SiRNA target sequence
tttaatggtggtggacaagaaag

SEQ ID NO: 163441 - DNA, 23 bp, Artificial sequence
  SiRNA target sequence
ttaatggtggtggacaagaaaga

SEQ ID NO: 163442 - DNA, 23 bp, Artificial sequence
  SiRNA target sequence
taatggtggtggacaagaaagag

SEQ ID NO: 163443 - DNA, 23 bp, Artificial sequence
  SiRNA target sequence
aatggtggtggacaagaaagagg

SEQ ID NO: 163444 - DNA, 23 bp, Artificial sequence
  SiRNA target sequence
atggtggtggacaagaaagagga

SEQ ID NO: 163445 - DNA, 23 bp, Artificial sequence
  SiRNA target sequence
tggtggtggacaagaaagaggat

SEQ ID NO: 163446 - DNA, 23 bp, Artificial sequence
  SiRNA target sequence
ggtggtggacaagaaagaggatt

SEQ ID NO: 163447 - DNA, 23 bp, Artificial sequence
  SiRNA target sequence
gtggtggacaagaaagaggatta

SEQ ID NO: 163448 - DNA, 23 bp, Artificial sequence
  SiRNA target sequence
tggtggacaagaaagaggattaa

SEQ ID NO: 163449 - DNA, 23 bp, Artificial sequence
  SiRNA target sequence
ggtggacaagaaagaggattaag

SEQ ID NO: 163450 - DNA, 23 bp, Artificial sequence
  SiRNA target sequence
gtggacaagaaagaggattaaga

SEQ ID NO: 163451 - DNA, 23 bp, Artificial sequence
  SiRNA target sequence
tggacaagaaagaggattaagaa

SEQ ID NO: 163452 - DNA, 23 bp, Artificial sequence
  SiRNA target sequence
ggacaagaaagaggattaagaag

SEQ ID NO: 163453 - DNA, 23 bp, Artificial sequence
  SiRNA target sequence
gacaagaaagaggattaagaagt

SEQ ID NO: 163454 - DNA, 23 bp, Artificial sequence
  SiRNA target sequence
acaagaaagaggattaagaagtg

SEQ ID NO: 163455 - DNA, 23 bp, Artificial sequence
  SiRNA target sequence
caagaaagaggattaagaagtgg

SEQ ID NO: 163456 - DNA, 23 bp, Artificial sequence
  SiRNA target sequence
aagaaagaggattaagaagtggg

SEQ ID NO: 163457 - DNA, 23 bp, Artificial sequence
  SiRNA target sequence
agaaagaggattaagaagtggga

SEQ ID NO: 163458 - DNA, 23 bp, Artificial sequence
  SiRNA target sequence
gaaagaggattaagaagtgggac

SEQ ID NO: 163459 - DNA, 23 bp, Artificial sequence
  SiRNA target sequence
aaagaggattaagaagtgggaca

SEQ ID NO: 163460 - DNA, 23 bp, Artificial sequence
  SiRNA target sequence
aagaggattaagaagtgggacaa

SEQ ID NO: 163461 - DNA, 23 bp, Artificial sequence
  SiRNA target sequence
agaggattaagaagtgggacaac

SEQ ID NO: 163462 - DNA, 23 bp, Artificial sequence
  SiRNA target sequence
gaggattaagaagtgggacaact

SEQ ID NO: 163463 - DNA, 23 bp, Artificial sequence
  SiRNA target sequence
aggattaagaagtgggacaactt

SEQ ID NO: 163464 - DNA, 23 bp, Artificial sequence
  SiRNA target sequence
ggattaagaagtgggacaacttc

SEQ ID NO: 163465 - DNA, 23 bp, Artificial sequence
  SiRNA target sequence
gattaagaagtgggacaacttct

SEQ ID NO: 163466 - DNA, 23 bp, Artificial sequence
  SiRNA target sequence
attaagaagtgggacaacttctc

SEQ ID NO: 163467 - DNA, 23 bp, Artificial sequence
  SiRNA target sequence
ttaagaagtgggacaacttctcc

SEQ ID NO: 163468 - DNA, 23 bp, Artificial sequence
  SiRNA target sequence
taagaagtgggacaacttctcca

SEQ ID NO: 163469 - DNA, 23 bp, Artificial sequence
  SiRNA target sequence
aagaagtgggacaacttctccac

SEQ ID NO: 163470 - DNA, 23 bp, Artificial sequence
  SiRNA target sequence
agaagtgggacaacttctccacc

SEQ ID NO: 163471 - DNA, 23 bp, Artificial sequence
  SiRNA target sequence
gaagtgggacaacttctccacct

SEQ ID NO: 163472 - DNA, 23 bp, Artificial sequence
  SiRNA target sequence
aagtgggacaacttctccacctt

SEQ ID NO: 163473 - DNA, 23 bp, Artificial sequence
  SiRNA target sequence
agtgggacaacttctccaccttt

SEQ ID NO: 163474 - DNA, 23 bp, Artificial sequence
  SiRNA target sequence
gtgggacaacttctccaccttta

SEQ ID NO: 163475 - DNA, 23 bp, Artificial sequence
  SiRNA target sequence
tgggacaacttctccacctttag

SEQ ID NO: 163476 - DNA, 23 bp, Artificial sequence
  SiRNA target sequence
gggacaacttctccacctttagt

SEQ ID NO: 163477 - DNA, 23 bp, Artificial sequence
  SiRNA target sequence
ggacaacttctccacctttagtt

SEQ ID NO: 163478 - DNA, 23 bp, Artificial sequence
  SiRNA target sequence
gacaacttctccacctttagttg

SEQ ID NO: 163479 - DNA, 23 bp, Artificial sequence
  SiRNA target sequence
acaacttctccacctttagttgt

SEQ ID NO: 163480 - DNA, 23 bp, Artificial sequence
  SiRNA target sequence
caacttctccacctttagttgtt

SEQ ID NO: 163481 - DNA, 23 bp, Artificial sequence
  SiRNA target sequence
aacttctccacctttagttgttg

SEQ ID NO: 163482 - DNA, 23 bp, Artificial sequence
  SiRNA target sequence
acttctccacctttagttgttgg

SEQ ID NO: 163483 - DNA, 23 bp, Artificial sequence
  SiRNA target sequence
cttctccacctttagttgttgga

SEQ ID NO: 163484 - DNA, 23 bp, Artificial sequence
  SiRNA target sequence
ttctccacctttagttgttggat

SEQ ID NO: 163485 - DNA, 23 bp, Artificial sequence
  SiRNA target sequence
tctccacctttagttgttggatt

SEQ ID NO: 163486 - DNA, 23 bp, Artificial sequence
  SiRNA target sequence
ctccacctttagttgttggatta

SEQ ID NO: 163487 - DNA, 23 bp, Artificial sequence
  SiRNA target sequence
tccacctttagttgttggattag

SEQ ID NO: 163488 - DNA, 23 bp, Artificial sequence
  SiRNA target sequence
ccacctttagttgttggattagg

SEQ ID NO: 163489 - DNA, 23 bp, Artificial sequence
  SiRNA target sequence
cacctttagttgttggattaggc

SEQ ID NO: 163490 - DNA, 23 bp, Artificial sequence
  SiRNA target sequence
acctttagttgttggattaggca

SEQ ID NO: 163491 - DNA, 23 bp, Artificial sequence
  SiRNA target sequence
cctttagttgttggattaggcaa

SEQ ID NO: 163492 - DNA, 23 bp, Artificial sequence
  SiRNA target sequence
ctttagttgttggattaggcaaa

SEQ ID NO: 163493 - DNA, 23 bp, Artificial sequence
  SiRNA target sequence
tttagttgttggattaggcaaag

SEQ ID NO: 163494 - DNA, 23 bp, Artificial sequence
  SiRNA target sequence
ttagttgttggattaggcaaagc

SEQ ID NO: 163495 - DNA, 23 bp, Artificial sequence
  SiRNA target sequence
tagttgttggattaggcaaagct

SEQ ID NO: 163496 - DNA, 23 bp, Artificial sequence
  SiRNA target sequence
agttgttggattaggcaaagctg

SEQ ID NO: 163497 - DNA, 23 bp, Artificial sequence
  SiRNA target sequence
gttgttggattaggcaaagctgc

SEQ ID NO: 163498 - DNA, 23 bp, Artificial sequence
  SiRNA target sequence
ttgttggattaggcaaagctgct

SEQ ID NO: 163499 - DNA, 23 bp, Artificial sequence
  SiRNA target sequence
tgttggattaggcaaagctgctg

SEQ ID NO: 163500 - DNA, 23 bp, Artificial sequence
  SiRNA target sequence
gttggattaggcaaagctgctga

SEQ ID NO: 163501 - DNA, 23 bp, Artificial sequence
  SiRNA target sequence
ttggattaggcaaagctgctgag

SEQ ID NO: 163502 - DNA, 23 bp, Artificial sequence
  SiRNA target sequence
tggattaggcaaagctgctgaga

SEQ ID NO: 163503 - DNA, 23 bp, Artificial sequence
  SiRNA target sequence
ggattaggcaaagctgctgagat

SEQ ID NO: 163504 - DNA, 23 bp, Artificial sequence
  SiRNA target sequence
gattaggcaaagctgctgagata

SEQ ID NO: 163505 - DNA, 23 bp, Artificial sequence
  SiRNA target sequence
attaggcaaagctgctgagatat

SEQ ID NO: 163506 - DNA, 23 bp, Artificial sequence
  SiRNA target sequence
ttaggcaaagctgctgagatatg

SEQ ID NO: 163507 - DNA, 23 bp, Artificial sequence
  SiRNA target sequence
taggcaaagctgctgagatatgc

SEQ ID NO: 163508 - DNA, 23 bp, Artificial sequence
  SiRNA target sequence
aggcaaagctgctgagatatgct

SEQ ID NO: 163509 - DNA, 23 bp, Artificial sequence
  SiRNA target sequence
ggcaaagctgctgagatatgctc

SEQ ID NO: 163510 - DNA, 23 bp, Artificial sequence
  SiRNA target sequence
gcaaagctgctgagatatgctct

SEQ ID NO: 163511 - DNA, 23 bp, Artificial sequence
  SiRNA target sequence
caaagctgctgagatatgctctc

SEQ ID NO: 163512 - DNA, 23 bp, Artificial sequence
  SiRNA target sequence
aaagctgctgagatatgctctca

SEQ ID NO: 163513 - DNA, 23 bp, Artificial sequence
  SiRNA target sequence
aagctgctgagatatgctctcag

SEQ ID NO: 163514 - DNA, 23 bp, Artificial sequence
  SiRNA target sequence
agctgctgagatatgctctcagg

SEQ ID NO: 163515 - DNA, 23 bp, Artificial sequence
  SiRNA target sequence
gctgctgagatatgctctcagga

SEQ ID NO: 163516 - DNA, 23 bp, Artificial sequence
  SiRNA target sequence
ctgctgagatatgctctcaggag

SEQ ID NO: 163517 - DNA, 23 bp, Artificial sequence
  SiRNA target sequence
tgctgagatatgctctcaggaga

SEQ ID NO: 163518 - DNA, 23 bp, Artificial sequence
  SiRNA target sequence
gctgagatatgctctcaggagat

SEQ ID NO: 163519 - DNA, 23 bp, Artificial sequence
  SiRNA target sequence
ctgagatatgctctcaggagatg

SEQ ID NO: 163520 - DNA, 23 bp, Artificial sequence
  SiRNA target sequence
tgagatatgctctcaggagatgc

SEQ ID NO: 163521 - DNA, 23 bp, Artificial sequence
  SiRNA target sequence
gagatatgctctcaggagatgcg

SEQ ID NO: 163522 - DNA, 23 bp, Artificial sequence
  SiRNA target sequence
agatatgctctcaggagatgcgt

SEQ ID NO: 163523 - DNA, 23 bp, Artificial sequence
  SiRNA target sequence
gatatgctctcaggagatgcgta

SEQ ID NO: 163524 - DNA, 23 bp, Artificial sequence
  SiRNA target sequence
atatgctctcaggagatgcgtaa

SEQ ID NO: 163525 - DNA, 23 bp, Artificial sequence
  SiRNA target sequence
tatgctctcaggagatgcgtaag

SEQ ID NO: 163526 - DNA, 23 bp, Artificial sequence
  SiRNA target sequence
atgctctcaggagatgcgtaagg

SEQ ID NO: 163527 - DNA, 23 bp, Artificial sequence
  SiRNA target sequence
tgctctcaggagatgcgtaagga

SEQ ID NO: 163528 - DNA, 23 bp, Artificial sequence
  SiRNA target sequence
gctctcaggagatgcgtaaggac

SEQ ID NO: 163529 - DNA, 23 bp, Artificial sequence
  SiRNA target sequence
ctctcaggagatgcgtaaggact

SEQ ID NO: 163530 - DNA, 23 bp, Artificial sequence
  SiRNA target sequence
tctcaggagatgcgtaaggacta

SEQ ID NO: 163531 - DNA, 23 bp, Artificial sequence
  SiRNA target sequence
ctcaggagatgcgtaaggactat

SEQ ID NO: 163532 - DNA, 23 bp, Artificial sequence
  SiRNA target sequence
tcaggagatgcgtaaggactatg

SEQ ID NO: 163533 - DNA, 23 bp, Artificial sequence
  SiRNA target sequence
caggagatgcgtaaggactatga

SEQ ID NO: 163534 - DNA, 23 bp, Artificial sequence
  SiRNA target sequence
aggagatgcgtaaggactatgaa

SEQ ID NO: 163535 - DNA, 23 bp, Artificial sequence
  SiRNA target sequence
ggagatgcgtaaggactatgaat

SEQ ID NO: 163536 - DNA, 23 bp, Artificial sequence
  SiRNA target sequence
gagatgcgtaaggactatgaata

SEQ ID NO: 163537 - DNA, 23 bp, Artificial sequence
  SiRNA target sequence
agatgcgtaaggactatgaatat

SEQ ID NO: 163538 - DNA, 23 bp, Artificial sequence
  SiRNA target sequence
gatgcgtaaggactatgaatata

SEQ ID NO: 163539 - DNA, 23 bp, Artificial sequence
  SiRNA target sequence
atgcgtaaggactatgaatatat

SEQ ID NO: 163540 - DNA, 23 bp, Artificial sequence
  SiRNA target sequence
tgcgtaaggactatgaatatata

SEQ ID NO: 163541 - DNA, 23 bp, Artificial sequence
  SiRNA target sequence
gcgtaaggactatgaatatatac

SEQ ID NO: 163542 - DNA, 23 bp, Artificial sequence
  SiRNA target sequence
cgtaaggactatgaatatataca

SEQ ID NO: 163543 - DNA, 23 bp, Artificial sequence
  SiRNA target sequence
gtaaggactatgaatatatacaa

SEQ ID NO: 163544 - DNA, 23 bp, Artificial sequence
  SiRNA target sequence
taaggactatgaatatatacaaa

SEQ ID NO: 163545 - DNA, 23 bp, Artificial sequence
  SiRNA target sequence
aaggactatgaatatatacaaaa

SEQ ID NO: 163546 - DNA, 23 bp, Artificial sequence
  SiRNA target sequence
aggactatgaatatatacaaaaa

SEQ ID NO: 163547 - DNA, 23 bp, Artificial sequence
  SiRNA target sequence
ggactatgaatatatacaaaaat

SEQ ID NO: 163548 - DNA, 23 bp, Artificial sequence
  SiRNA target sequence
gactatgaatatatacaaaaatt

SEQ ID NO: 163549 - DNA, 23 bp, Artificial sequence
  SiRNA target sequence
actatgaatatatacaaaaatta

SEQ ID NO: 163550 - DNA, 23 bp, Artificial sequence
  SiRNA target sequence
ctatgaatatatacaaaaattat

SEQ ID NO: 163551 - DNA, 23 bp, Artificial sequence
  SiRNA target sequence
tatgaatatatacaaaaattatc

SEQ ID NO: 163552 - DNA, 23 bp, Artificial sequence
  SiRNA target sequence
atgaatatatacaaaaattatcg

SEQ ID NO: 163553 - DNA, 23 bp, Artificial sequence
  SiRNA target sequence
tgaatatatacaaaaattatcgg

SEQ ID NO: 163554 - DNA, 23 bp, Artificial sequence
  SiRNA target sequence
gaatatatacaaaaattatcgga

SEQ ID NO: 163555 - DNA, 23 bp, Artificial sequence
  SiRNA target sequence
aatatatacaaaaattatcggat

SEQ ID NO: 163556 - DNA, 23 bp, Artificial sequence
  SiRNA target sequence
atatatacaaaaattatcggata

SEQ ID NO: 163557 - DNA, 23 bp, Artificial sequence
  SiRNA target sequence
tatatacaaaaattatcggataa

SEQ ID NO: 163558 - DNA, 23 bp, Artificial sequence
  SiRNA target sequence
atatacaaaaattatcggataaa

SEQ ID NO: 163559 - DNA, 23 bp, Artificial sequence
  SiRNA target sequence
tatacaaaaattatcggataaac

SEQ ID NO: 163560 - DNA, 23 bp, Artificial sequence
  SiRNA target sequence
atacaaaaattatcggataaact

SEQ ID NO: 163561 - DNA, 23 bp, Artificial sequence
  SiRNA target sequence
tacaaaaattatcggataaacta

SEQ ID NO: 163562 - DNA, 23 bp, Artificial sequence
  SiRNA target sequence
acaaaaattatcggataaactaa

SEQ ID NO: 163563 - DNA, 23 bp, Artificial sequence
  SiRNA target sequence
caaaaattatcggataaactaaa

SEQ ID NO: 163564 - DNA, 23 bp, Artificial sequence
  SiRNA target sequence
aaaaattatcggataaactaaaa

SEQ ID NO: 163565 - DNA, 23 bp, Artificial sequence
  SiRNA target sequence
aaaattatcggataaactaaaaa

SEQ ID NO: 163566 - DNA, 23 bp, Artificial sequence
  SiRNA target sequence
aaattatcggataaactaaaaaa

SEQ ID NO: 163567 - DNA, 23 bp, Artificial sequence
  SiRNA target sequence
aattatcggataaactaaaaaat

SEQ ID NO: 163568 - DNA, 23 bp, Artificial sequence
  SiRNA target sequence
attatcggataaactaaaaaatc

SEQ ID NO: 163569 - DNA, 23 bp, Artificial sequence
  SiRNA target sequence
ttatcggataaactaaaaaatcg

SEQ ID NO: 163570 - DNA, 23 bp, Artificial sequence
  SiRNA target sequence
tatcggataaactaaaaaatcgc

SEQ ID NO: 163571 - DNA, 23 bp, Artificial sequence
  SiRNA target sequence
atcggataaactaaaaaatcgca

SEQ ID NO: 163572 - DNA, 23 bp, Artificial sequence
  SiRNA target sequence
tcggataaactaaaaaatcgcat

SEQ ID NO: 163573 - DNA, 23 bp, Artificial sequence
  SiRNA target sequence
cggataaactaaaaaatcgcatc

SEQ ID NO: 163574 - DNA, 23 bp, Artificial sequence
  SiRNA target sequence
ggataaactaaaaaatcgcatca

SEQ ID NO: 163575 - DNA, 23 bp, Artificial sequence
  SiRNA target sequence
gataaactaaaaaatcgcatcaa

SEQ ID NO: 163576 - DNA, 23 bp, Artificial sequence
  SiRNA target sequence
ataaactaaaaaatcgcatcaaa

SEQ ID NO: 163577 - DNA, 23 bp, Artificial sequence
  SiRNA target sequence
taaactaaaaaatcgcatcaaaa

SEQ ID NO: 163578 - DNA, 23 bp, Artificial sequence
  SiRNA target sequence
aaactaaaaaatcgcatcaaaac

SEQ ID NO: 163579 - DNA, 23 bp, Artificial sequence
  SiRNA target sequence
aactaaaaaatcgcatcaaaacg

SEQ ID NO: 163580 - DNA, 23 bp, Artificial sequence
  SiRNA target sequence
actaaaaaatcgcatcaaaacga

SEQ ID NO: 163581 - DNA, 23 bp, Artificial sequence
  SiRNA target sequence
ctaaaaaatcgcatcaaaacgaa

SEQ ID NO: 163582 - DNA, 23 bp, Artificial sequence
  SiRNA target sequence
taaaaaatcgcatcaaaacgaat

SEQ ID NO: 163583 - DNA, 23 bp, Artificial sequence
  SiRNA target sequence
aaaaaatcgcatcaaaacgaatg

SEQ ID NO: 163584 - DNA, 23 bp, Artificial sequence
  SiRNA target sequence
aaaaatcgcatcaaaacgaatgt

SEQ ID NO: 163585 - DNA, 23 bp, Artificial sequence
  SiRNA target sequence
aaaatcgcatcaaaacgaatgta

SEQ ID NO: 163586 - DNA, 23 bp, Artificial sequence
  SiRNA target sequence
aaatcgcatcaaaacgaatgtag

SEQ ID NO: 163587 - DNA, 23 bp, Artificial sequence
  SiRNA target sequence
aatcgcatcaaaacgaatgtaga

SEQ ID NO: 163588 - DNA, 23 bp, Artificial sequence
  SiRNA target sequence
atcgcatcaaaacgaatgtagaa

SEQ ID NO: 163589 - DNA, 23 bp, Artificial sequence
  SiRNA target sequence
tcgcatcaaaacgaatgtagaaa

SEQ ID NO: 163590 - DNA, 23 bp, Artificial sequence
  SiRNA target sequence
cgcatcaaaacgaatgtagaaaa

SEQ ID NO: 163591 - DNA, 23 bp, Artificial sequence
  SiRNA target sequence
gcatcaaaacgaatgtagaaaat

SEQ ID NO: 163592 - DNA, 23 bp, Artificial sequence
  SiRNA target sequence
catcaaaacgaatgtagaaaatg

SEQ ID NO: 163593 - DNA, 23 bp, Artificial sequence
  SiRNA target sequence
atcaaaacgaatgtagaaaatgt

SEQ ID NO: 163594 - DNA, 23 bp, Artificial sequence
  SiRNA target sequence
tcaaaacgaatgtagaaaatgtt

SEQ ID NO: 163595 - DNA, 23 bp, Artificial sequence
  SiRNA target sequence
caaaacgaatgtagaaaatgttg

SEQ ID NO: 163596 - DNA, 23 bp, Artificial sequence
  SiRNA target sequence
aaaacgaatgtagaaaatgttgt

SEQ ID NO: 163597 - DNA, 23 bp, Artificial sequence
  SiRNA target sequence
aaacgaatgtagaaaatgttgtt

SEQ ID NO: 163598 - DNA, 23 bp, Artificial sequence
  SiRNA target sequence
aacgaatgtagaaaatgttgtta

SEQ ID NO: 163599 - DNA, 23 bp, Artificial sequence
  SiRNA target sequence
acgaatgtagaaaatgttgttat

SEQ ID NO: 163600 - DNA, 23 bp, Artificial sequence
  SiRNA target sequence
cgaatgtagaaaatgttgttatt

SEQ ID NO: 163601 - DNA, 23 bp, Artificial sequence
  SiRNA target sequence
gaatgtagaaaatgttgttatta

SEQ ID NO: 163602 - DNA, 23 bp, Artificial sequence
  SiRNA target sequence
aatgtagaaaatgttgttattaa

SEQ ID NO: 163603 - DNA, 23 bp, Artificial sequence
  SiRNA target sequence
atgtagaaaatgttgttattaac

SEQ ID NO: 163604 - DNA, 23 bp, Artificial sequence
  SiRNA target sequence
tgtagaaaatgttgttattaacg

SEQ ID NO: 163605 - DNA, 23 bp, Artificial sequence
  SiRNA target sequence
gtagaaaatgttgttattaacgg

SEQ ID NO: 163606 - DNA, 23 bp, Artificial sequence
  SiRNA target sequence
tagaaaatgttgttattaacggc

SEQ ID NO: 163607 - DNA, 23 bp, Artificial sequence
  SiRNA target sequence
agaaaatgttgttattaacggcg

SEQ ID NO: 163608 - DNA, 23 bp, Artificial sequence
  SiRNA target sequence
gaaaatgttgttattaacggcga

SEQ ID NO: 163609 - DNA, 23 bp, Artificial sequence
  SiRNA target sequence
aaaatgttgttattaacggcgat

SEQ ID NO: 163610 - DNA, 23 bp, Artificial sequence
  SiRNA target sequence
aaatgttgttattaacggcgatg

SEQ ID NO: 163611 - DNA, 23 bp, Artificial sequence
  SiRNA target sequence
aatgttgttattaacggcgatga

SEQ ID NO: 163612 - DNA, 23 bp, Artificial sequence
  SiRNA target sequence
atgttgttattaacggcgatgat

SEQ ID NO: 163613 - DNA, 23 bp, Artificial sequence
  SiRNA target sequence
tgttgttattaacggcgatgatt

SEQ ID NO: 163614 - DNA, 23 bp, Artificial sequence
  SiRNA target sequence
gttgttattaacggcgatgattc

SEQ ID NO: 163615 - DNA, 23 bp, Artificial sequence
  SiRNA target sequence
ttgttattaacggcgatgattct

SEQ ID NO: 163616 - DNA, 23 bp, Artificial sequence
  SiRNA target sequence
tgttattaacggcgatgattcta

SEQ ID NO: 163617 - DNA, 23 bp, Artificial sequence
  SiRNA target sequence
gttattaacggcgatgattctaa

SEQ ID NO: 163618 - DNA, 23 bp, Artificial sequence
  SiRNA target sequence
ttattaacggcgatgattctaag

SEQ ID NO: 163619 - DNA, 23 bp, Artificial sequence
  SiRNA target sequence
tattaacggcgatgattctaaga

SEQ ID NO: 163620 - DNA, 23 bp, Artificial sequence
  SiRNA target sequence
attaacggcgatgattctaagac

SEQ ID NO: 163621 - DNA, 23 bp, Artificial sequence
  SiRNA target sequence
ttaacggcgatgattctaagact

SEQ ID NO: 163622 - DNA, 23 bp, Artificial sequence
  SiRNA target sequence
taacggcgatgattctaagactt

SEQ ID NO: 163623 - DNA, 23 bp, Artificial sequence
  SiRNA target sequence
aacggcgatgattctaagacttt

SEQ ID NO: 163624 - DNA, 23 bp, Artificial sequence
  SiRNA target sequence
acggcgatgattctaagactttt

SEQ ID NO: 163625 - DNA, 23 bp, Artificial sequence
  SiRNA target sequence
cggcgatgattctaagacttttc

SEQ ID NO: 163626 - DNA, 23 bp, Artificial sequence
  SiRNA target sequence
ggcgatgattctaagacttttcc

SEQ ID NO: 163627 - DNA, 23 bp, Artificial sequence
  SiRNA target sequence
gcgatgattctaagacttttcct

SEQ ID NO: 163628 - DNA, 23 bp, Artificial sequence
  SiRNA target sequence
cgatgattctaagacttttcctg

SEQ ID NO: 163629 - DNA, 23 bp, Artificial sequence
  SiRNA target sequence
gatgattctaagacttttcctgg

SEQ ID NO: 163630 - DNA, 23 bp, Artificial sequence
  SiRNA target sequence
atgattctaagacttttcctggc

SEQ ID NO: 163631 - DNA, 23 bp, Artificial sequence
  SiRNA target sequence
tgattctaagacttttcctggct

SEQ ID NO: 163632 - DNA, 23 bp, Artificial sequence
  SiRNA target sequence
gattctaagacttttcctggctg

SEQ ID NO: 163633 - DNA, 23 bp, Artificial sequence
  SiRNA target sequence
attctaagacttttcctggctgt

SEQ ID NO: 163634 - DNA, 23 bp, Artificial sequence
  SiRNA target sequence
ttctaagacttttcctggctgtc

SEQ ID NO: 163635 - DNA, 23 bp, Artificial sequence
  SiRNA target sequence
tctaagacttttcctggctgtct

SEQ ID NO: 163636 - DNA, 23 bp, Artificial sequence
  SiRNA target sequence
ctaagacttttcctggctgtctc

SEQ ID NO: 163637 - DNA, 23 bp, Artificial sequence
  SiRNA target sequence
taagacttttcctggctgtctca

SEQ ID NO: 163638 - DNA, 23 bp, Artificial sequence
  SiRNA target sequence
aagacttttcctggctgtctcaa

SEQ ID NO: 163639 - DNA, 23 bp, Artificial sequence
  SiRNA target sequence
agacttttcctggctgtctcaat

SEQ ID NO: 163640 - DNA, 23 bp, Artificial sequence
  SiRNA target sequence
gacttttcctggctgtctcaata

SEQ ID NO: 163641 - DNA, 23 bp, Artificial sequence
  SiRNA target sequence
acttttcctggctgtctcaatat

SEQ ID NO: 163642 - DNA, 23 bp, Artificial sequence
  SiRNA target sequence
cttttcctggctgtctcaatatt

SEQ ID NO: 163643 - DNA, 23 bp, Artificial sequence
  SiRNA target sequence
ttttcctggctgtctcaatattt

SEQ ID NO: 163644 - DNA, 23 bp, Artificial sequence
  SiRNA target sequence
tttcctggctgtctcaatatttc

SEQ ID NO: 163645 - DNA, 23 bp, Artificial sequence
  SiRNA target sequence
ttcctggctgtctcaatatttct

SEQ ID NO: 163646 - DNA, 23 bp, Artificial sequence
  SiRNA target sequence
tcctggctgtctcaatatttctt

SEQ ID NO: 163647 - DNA, 23 bp, Artificial sequence
  SiRNA target sequence
cctggctgtctcaatatttcttt

SEQ ID NO: 163648 - DNA, 23 bp, Artificial sequence
  SiRNA target sequence
ctggctgtctcaatatttctttt

SEQ ID NO: 163649 - DNA, 23 bp, Artificial sequence
  SiRNA target sequence
tggctgtctcaatatttcttttc

SEQ ID NO: 163650 - DNA, 23 bp, Artificial sequence
  SiRNA target sequence
ggctgtctcaatatttcttttcc

SEQ ID NO: 163651 - DNA, 23 bp, Artificial sequence
  SiRNA target sequence
gctgtctcaatatttcttttcca

SEQ ID NO: 163652 - DNA, 23 bp, Artificial sequence
  SiRNA target sequence
ctgtctcaatatttcttttccat

SEQ ID NO: 163653 - DNA, 23 bp, Artificial sequence
  SiRNA target sequence
tgtctcaatatttcttttccata

SEQ ID NO: 163654 - DNA, 23 bp, Artificial sequence
  SiRNA target sequence
gtctcaatatttcttttccatat

SEQ ID NO: 163655 - DNA, 23 bp, Artificial sequence
  SiRNA target sequence
tctcaatatttcttttccatatg

SEQ ID NO: 163656 - DNA, 23 bp, Artificial sequence
  SiRNA target sequence
ctcaatatttcttttccatatgt

SEQ ID NO: 163657 - DNA, 23 bp, Artificial sequence
  SiRNA target sequence
tcaatatttcttttccatatgta

SEQ ID NO: 163658 - DNA, 23 bp, Artificial sequence
  SiRNA target sequence
caatatttcttttccatatgtag

SEQ ID NO: 163659 - DNA, 23 bp, Artificial sequence
  SiRNA target sequence
aatatttcttttccatatgtaga

SEQ ID NO: 163660 - DNA, 23 bp, Artificial sequence
  SiRNA target sequence
atatttcttttccatatgtagaa

SEQ ID NO: 163661 - DNA, 23 bp, Artificial sequence
  SiRNA target sequence
tatttcttttccatatgtagaag

SEQ ID NO: 163662 - DNA, 23 bp, Artificial sequence
  SiRNA target sequence
atttcttttccatatgtagaagg

SEQ ID NO: 163663 - DNA, 23 bp, Artificial sequence
  SiRNA target sequence
tttcttttccatatgtagaaggt

SEQ ID NO: 163664 - DNA, 23 bp, Artificial sequence
  SiRNA target sequence
ttcttttccatatgtagaaggtg

SEQ ID NO: 163665 - DNA, 23 bp, Artificial sequence
  SiRNA target sequence
tcttttccatatgtagaaggtga

SEQ ID NO: 163666 - DNA, 23 bp, Artificial sequence
  SiRNA target sequence
cttttccatatgtagaaggtgaa

SEQ ID NO: 163667 - DNA, 23 bp, Artificial sequence
  SiRNA target sequence
ttttccatatgtagaaggtgaag

SEQ ID NO: 163668 - DNA, 23 bp, Artificial sequence
  SiRNA target sequence
tttccatatgtagaaggtgaagg

SEQ ID NO: 163669 - DNA, 23 bp, Artificial sequence
  SiRNA target sequence
ttccatatgtagaaggtgaaggg

SEQ ID NO: 163670 - DNA, 23 bp, Artificial sequence
  SiRNA target sequence
tccatatgtagaaggtgaagggc

SEQ ID NO: 163671 - DNA, 23 bp, Artificial sequence
  SiRNA target sequence
ccatatgtagaaggtgaagggct

SEQ ID NO: 163672 - DNA, 23 bp, Artificial sequence
  SiRNA target sequence
catatgtagaaggtgaagggctt

SEQ ID NO: 163673 - DNA, 23 bp, Artificial sequence
  SiRNA target sequence
atatgtagaaggtgaagggctta

SEQ ID NO: 163674 - DNA, 23 bp, Artificial sequence
  SiRNA target sequence
tatgtagaaggtgaagggcttat

SEQ ID NO: 163675 - DNA, 23 bp, Artificial sequence
  SiRNA target sequence
atgtagaaggtgaagggcttatg

SEQ ID NO: 163676 - DNA, 23 bp, Artificial sequence
  SiRNA target sequence
tgtagaaggtgaagggcttatga

SEQ ID NO: 163677 - DNA, 23 bp, Artificial sequence
  SiRNA target sequence
gtagaaggtgaagggcttatgat

SEQ ID NO: 163678 - DNA, 23 bp, Artificial sequence
  SiRNA target sequence
tagaaggtgaagggcttatgatg

SEQ ID NO: 163679 - DNA, 23 bp, Artificial sequence
  SiRNA target sequence
agaaggtgaagggcttatgatga

SEQ ID NO: 163680 - DNA, 23 bp, Artificial sequence
  SiRNA target sequence
gaaggtgaagggcttatgatgaa

SEQ ID NO: 163681 - DNA, 23 bp, Artificial sequence
  SiRNA target sequence
aaggtgaagggcttatgatgaat

SEQ ID NO: 163682 - DNA, 23 bp, Artificial sequence
  SiRNA target sequence
aggtgaagggcttatgatgaata

SEQ ID NO: 163683 - DNA, 23 bp, Artificial sequence
  SiRNA target sequence
ggtgaagggcttatgatgaatat

SEQ ID NO: 163684 - DNA, 23 bp, Artificial sequence
  SiRNA target sequence
gtgaagggcttatgatgaatatt

SEQ ID NO: 163685 - DNA, 23 bp, Artificial sequence
  SiRNA target sequence
tgaagggcttatgatgaatatta

SEQ ID NO: 163686 - DNA, 23 bp, Artificial sequence
  SiRNA target sequence
gaagggcttatgatgaatattaa

SEQ ID NO: 163687 - DNA, 23 bp, Artificial sequence
  SiRNA target sequence
aagggcttatgatgaatattaag

SEQ ID NO: 163688 - DNA, 23 bp, Artificial sequence
  SiRNA target sequence
agggcttatgatgaatattaagg

SEQ ID NO: 163689 - DNA, 23 bp, Artificial sequence
  SiRNA target sequence
gggcttatgatgaatattaagga

SEQ ID NO: 163690 - DNA, 23 bp, Artificial sequence
  SiRNA target sequence
ggcttatgatgaatattaaggat

SEQ ID NO: 163691 - DNA, 23 bp, Artificial sequence
  SiRNA target sequence
gcttatgatgaatattaaggata

SEQ ID NO: 163692 - DNA, 23 bp, Artificial sequence
  SiRNA target sequence
cttatgatgaatattaaggatat

SEQ ID NO: 163693 - DNA, 23 bp, Artificial sequence
  SiRNA target sequence
ttatgatgaatattaaggatatt

SEQ ID NO: 163694 - DNA, 23 bp, Artificial sequence
  SiRNA target sequence
tatgatgaatattaaggatattg

SEQ ID NO: 163695 - DNA, 23 bp, Artificial sequence
  SiRNA target sequence
atgatgaatattaaggatattgc

SEQ ID NO: 163696 - DNA, 23 bp, Artificial sequence
  SiRNA target sequence
tgatgaatattaaggatattgct

SEQ ID NO: 163697 - DNA, 23 bp, Artificial sequence
  SiRNA target sequence
gatgaatattaaggatattgctg

SEQ ID NO: 163698 - DNA, 23 bp, Artificial sequence
  SiRNA target sequence
atgaatattaaggatattgctgt

SEQ ID NO: 163699 - DNA, 23 bp, Artificial sequence
  SiRNA target sequence
tgaatattaaggatattgctgtt

SEQ ID NO: 163700 - DNA, 23 bp, Artificial sequence
  SiRNA target sequence
gaatattaaggatattgctgtta

SEQ ID NO: 163701 - DNA, 23 bp, Artificial sequence
  SiRNA target sequence
aatattaaggatattgctgttag

SEQ ID NO: 163702 - DNA, 23 bp, Artificial sequence
  SiRNA target sequence
atattaaggatattgctgttagt

SEQ ID NO: 163703 - DNA, 23 bp, Artificial sequence
  SiRNA target sequence
tattaaggatattgctgttagta

SEQ ID NO: 163704 - DNA, 23 bp, Artificial sequence
  SiRNA target sequence
attaaggatattgctgttagtag

SEQ ID NO: 163705 - DNA, 23 bp, Artificial sequence
  SiRNA target sequence
ttaaggatattgctgttagtagt

SEQ ID NO: 163706 - DNA, 23 bp, Artificial sequence
  SiRNA target sequence
taaggatattgctgttagtagtg

SEQ ID NO: 163707 - DNA, 23 bp, Artificial sequence
  SiRNA target sequence
aaggatattgctgttagtagtgg

SEQ ID NO: 163708 - DNA, 23 bp, Artificial sequence
  SiRNA target sequence
aggatattgctgttagtagtgga

SEQ ID NO: 163709 - DNA, 23 bp, Artificial sequence
  SiRNA target sequence
ggatattgctgttagtagtggaa

SEQ ID NO: 163710 - DNA, 23 bp, Artificial sequence
  SiRNA target sequence
gatattgctgttagtagtggaag

SEQ ID NO: 163711 - DNA, 23 bp, Artificial sequence
  SiRNA target sequence
atattgctgttagtagtggaagt

SEQ ID NO: 163712 - DNA, 23 bp, Artificial sequence
  SiRNA target sequence
tattgctgttagtagtggaagtg

SEQ ID NO: 163713 - DNA, 23 bp, Artificial sequence
  SiRNA target sequence
attgctgttagtagtggaagtgc

SEQ ID NO: 163714 - DNA, 23 bp, Artificial sequence
  SiRNA target sequence
ttgctgttagtagtggaagtgct

SEQ ID NO: 163715 - DNA, 23 bp, Artificial sequence
  SiRNA target sequence
tgctgttagtagtggaagtgctt

SEQ ID NO: 163716 - DNA, 23 bp, Artificial sequence
  SiRNA target sequence
gctgttagtagtggaagtgcttg

SEQ ID NO: 163717 - DNA, 23 bp, Artificial sequence
  SiRNA target sequence
ctgttagtagtggaagtgcttgc

SEQ ID NO: 163718 - DNA, 23 bp, Artificial sequence
  SiRNA target sequence
tgttagtagtggaagtgcttgca

SEQ ID NO: 163719 - DNA, 23 bp, Artificial sequence
  SiRNA target sequence
gttagtagtggaagtgcttgcac

SEQ ID NO: 163720 - DNA, 23 bp, Artificial sequence
  SiRNA target sequence
ttagtagtggaagtgcttgcact

SEQ ID NO: 163721 - DNA, 23 bp, Artificial sequence
  SiRNA target sequence
tagtagtggaagtgcttgcactt

SEQ ID NO: 163722 - DNA, 23 bp, Artificial sequence
  SiRNA target sequence
agtagtggaagtgcttgcacttc

SEQ ID NO: 163723 - DNA, 23 bp, Artificial sequence
  SiRNA target sequence
gtagtggaagtgcttgcacttca

SEQ ID NO: 163724 - DNA, 23 bp, Artificial sequence
  SiRNA target sequence
tagtggaagtgcttgcacttcat

SEQ ID NO: 163725 - DNA, 23 bp, Artificial sequence
  SiRNA target sequence
agtggaagtgcttgcacttcatc

SEQ ID NO: 163726 - DNA, 23 bp, Artificial sequence
  SiRNA target sequence
gtggaagtgcttgcacttcatca

SEQ ID NO: 163727 - DNA, 23 bp, Artificial sequence
  SiRNA target sequence
tggaagtgcttgcacttcatcat

SEQ ID NO: 163728 - DNA, 23 bp, Artificial sequence
  SiRNA target sequence
ggaagtgcttgcacttcatcatc

SEQ ID NO: 163729 - DNA, 23 bp, Artificial sequence
  SiRNA target sequence
gaagtgcttgcacttcatcatct

SEQ ID NO: 163730 - DNA, 23 bp, Artificial sequence
  SiRNA target sequence
aagtgcttgcacttcatcatctt

SEQ ID NO: 163731 - DNA, 23 bp, Artificial sequence
  SiRNA target sequence
agtgcttgcacttcatcatcttt

SEQ ID NO: 163732 - DNA, 23 bp, Artificial sequence
  SiRNA target sequence
gtgcttgcacttcatcatcttta

SEQ ID NO: 163733 - DNA, 23 bp, Artificial sequence
  SiRNA target sequence
tgcttgcacttcatcatctttag

SEQ ID NO: 163734 - DNA, 23 bp, Artificial sequence
  SiRNA target sequence
gcttgcacttcatcatctttaga

SEQ ID NO: 163735 - DNA, 23 bp, Artificial sequence
  SiRNA target sequence
cttgcacttcatcatctttagaa

SEQ ID NO: 163736 - DNA, 23 bp, Artificial sequence
  SiRNA target sequence
ttgcacttcatcatctttagaac

SEQ ID NO: 163737 - DNA, 23 bp, Artificial sequence
  SiRNA target sequence
tgcacttcatcatctttagaacc

SEQ ID NO: 163738 - DNA, 23 bp, Artificial sequence
  SiRNA target sequence
gcacttcatcatctttagaaccc

SEQ ID NO: 163739 - DNA, 23 bp, Artificial sequence
  SiRNA target sequence
cacttcatcatctttagaaccct

SEQ ID NO: 163740 - DNA, 23 bp, Artificial sequence
  SiRNA target sequence
acttcatcatctttagaaccctc

SEQ ID NO: 163741 - DNA, 23 bp, Artificial sequence
  SiRNA target sequence
cttcatcatctttagaaccctct

SEQ ID NO: 163742 - DNA, 23 bp, Artificial sequence
  SiRNA target sequence
ttcatcatctttagaaccctctt

SEQ ID NO: 163743 - DNA, 23 bp, Artificial sequence
  SiRNA target sequence
tcatcatctttagaaccctctta

SEQ ID NO: 163744 - DNA, 23 bp, Artificial sequence
  SiRNA target sequence
catcatctttagaaccctcttat

SEQ ID NO: 163745 - DNA, 23 bp, Artificial sequence
  SiRNA target sequence
atcatctttagaaccctcttatg

SEQ ID NO: 163746 - DNA, 23 bp, Artificial sequence
  SiRNA target sequence
tcatctttagaaccctcttatgt

SEQ ID NO: 163747 - DNA, 23 bp, Artificial sequence
  SiRNA target sequence
catctttagaaccctcttatgtt

SEQ ID NO: 163748 - DNA, 23 bp, Artificial sequence
  SiRNA target sequence
atctttagaaccctcttatgttt

SEQ ID NO: 163749 - DNA, 23 bp, Artificial sequence
  SiRNA target sequence
tctttagaaccctcttatgtttt

SEQ ID NO: 163750 - DNA, 23 bp, Artificial sequence
  SiRNA target sequence
ctttagaaccctcttatgttttg

SEQ ID NO: 163751 - DNA, 23 bp, Artificial sequence
  SiRNA target sequence
tttagaaccctcttatgttttgc

SEQ ID NO: 163752 - DNA, 23 bp, Artificial sequence
  SiRNA target sequence
ttagaaccctcttatgttttgcg

SEQ ID NO: 163753 - DNA, 23 bp, Artificial sequence
  SiRNA target sequence
tagaaccctcttatgttttgcga

SEQ ID NO: 163754 - DNA, 23 bp, Artificial sequence
  SiRNA target sequence
agaaccctcttatgttttgcgag

SEQ ID NO: 163755 - DNA, 23 bp, Artificial sequence
  SiRNA target sequence
gaaccctcttatgttttgcgagc

SEQ ID NO: 163756 - DNA, 23 bp, Artificial sequence
  SiRNA target sequence
aaccctcttatgttttgcgagct

SEQ ID NO: 163757 - DNA, 23 bp, Artificial sequence
  SiRNA target sequence
accctcttatgttttgcgagctt

SEQ ID NO: 163758 - DNA, 23 bp, Artificial sequence
  SiRNA target sequence
ccctcttatgttttgcgagcttt

SEQ ID NO: 163759 - DNA, 23 bp, Artificial sequence
  SiRNA target sequence
cctcttatgttttgcgagcttta

SEQ ID NO: 163760 - DNA, 23 bp, Artificial sequence
  SiRNA target sequence
ctcttatgttttgcgagctttag

SEQ ID NO: 163761 - DNA, 23 bp, Artificial sequence
  SiRNA target sequence
tcttatgttttgcgagctttagg

SEQ ID NO: 163762 - DNA, 23 bp, Artificial sequence
  SiRNA target sequence
cttatgttttgcgagctttaggc

SEQ ID NO: 163763 - DNA, 23 bp, Artificial sequence
  SiRNA target sequence
ttatgttttgcgagctttaggca

SEQ ID NO: 163764 - DNA, 23 bp, Artificial sequence
  SiRNA target sequence
tatgttttgcgagctttaggcaa

SEQ ID NO: 163765 - DNA, 23 bp, Artificial sequence
  SiRNA target sequence
atgttttgcgagctttaggcaaa

SEQ ID NO: 163766 - DNA, 23 bp, Artificial sequence
  SiRNA target sequence
tgttttgcgagctttaggcaaaa

SEQ ID NO: 163767 - DNA, 23 bp, Artificial sequence
  SiRNA target sequence
gttttgcgagctttaggcaaaaa

SEQ ID NO: 163768 - DNA, 23 bp, Artificial sequence
  SiRNA target sequence
ttttgcgagctttaggcaaaaat

SEQ ID NO: 163769 - DNA, 23 bp, Artificial sequence
  SiRNA target sequence
tttgcgagctttaggcaaaaatg

SEQ ID NO: 163770 - DNA, 23 bp, Artificial sequence
  SiRNA target sequence
ttgcgagctttaggcaaaaatga

SEQ ID NO: 163771 - DNA, 23 bp, Artificial sequence
  SiRNA target sequence
tgcgagctttaggcaaaaatgat

SEQ ID NO: 163772 - DNA, 23 bp, Artificial sequence
  SiRNA target sequence
gcgagctttaggcaaaaatgatg

SEQ ID NO: 163773 - DNA, 23 bp, Artificial sequence
  SiRNA target sequence
cgagctttaggcaaaaatgatga

SEQ ID NO: 163774 - DNA, 23 bp, Artificial sequence
  SiRNA target sequence
gagctttaggcaaaaatgatgat

SEQ ID NO: 163775 - DNA, 23 bp, Artificial sequence
  SiRNA target sequence
agctttaggcaaaaatgatgatc

SEQ ID NO: 163776 - DNA, 23 bp, Artificial sequence
  SiRNA target sequence
gctttaggcaaaaatgatgatct

SEQ ID NO: 163777 - DNA, 23 bp, Artificial sequence
  SiRNA target sequence
ctttaggcaaaaatgatgatctt

SEQ ID NO: 163778 - DNA, 23 bp, Artificial sequence
  SiRNA target sequence
tttaggcaaaaatgatgatcttg

SEQ ID NO: 163779 - DNA, 23 bp, Artificial sequence
  SiRNA target sequence
ttaggcaaaaatgatgatcttgc

SEQ ID NO: 163780 - DNA, 23 bp, Artificial sequence
  SiRNA target sequence
taggcaaaaatgatgatcttgcg

SEQ ID NO: 163781 - DNA, 23 bp, Artificial sequence
  SiRNA target sequence
aggcaaaaatgatgatcttgcgc

SEQ ID NO: 163782 - DNA, 23 bp, Artificial sequence
  SiRNA target sequence
ggcaaaaatgatgatcttgcgca

SEQ ID NO: 163783 - DNA, 23 bp, Artificial sequence
  SiRNA target sequence
gcaaaaatgatgatcttgcgcat

SEQ ID NO: 163784 - DNA, 23 bp, Artificial sequence
  SiRNA target sequence
caaaaatgatgatcttgcgcatt

SEQ ID NO: 163785 - DNA, 23 bp, Artificial sequence
  SiRNA target sequence
aaaaatgatgatcttgcgcattc

SEQ ID NO: 163786 - DNA, 23 bp, Artificial sequence
  SiRNA target sequence
aaaatgatgatcttgcgcattct

SEQ ID NO: 163787 - DNA, 23 bp, Artificial sequence
  SiRNA target sequence
aaatgatgatcttgcgcattctt

SEQ ID NO: 163788 - DNA, 23 bp, Artificial sequence
  SiRNA target sequence
aatgatgatcttgcgcattcttc

SEQ ID NO: 163789 - DNA, 23 bp, Artificial sequence
  SiRNA target sequence
atgatgatcttgcgcattcttct

SEQ ID NO: 163790 - DNA, 23 bp, Artificial sequence
  SiRNA target sequence
tgatgatcttgcgcattcttcta

SEQ ID NO: 163791 - DNA, 23 bp, Artificial sequence
  SiRNA target sequence
gatgatcttgcgcattcttctat

SEQ ID NO: 163792 - DNA, 23 bp, Artificial sequence
  SiRNA target sequence
atgatcttgcgcattcttctata

SEQ ID NO: 163793 - DNA, 23 bp, Artificial sequence
  SiRNA target sequence
tgatcttgcgcattcttctataa

SEQ ID NO: 163794 - DNA, 23 bp, Artificial sequence
  SiRNA target sequence
gatcttgcgcattcttctataag

SEQ ID NO: 163795 - DNA, 23 bp, Artificial sequence
  SiRNA target sequence
atcttgcgcattcttctataaga

SEQ ID NO: 163796 - DNA, 23 bp, Artificial sequence
  SiRNA target sequence
tcttgcgcattcttctataagat

SEQ ID NO: 163797 - DNA, 23 bp, Artificial sequence
  SiRNA target sequence
cttgcgcattcttctataagatt

SEQ ID NO: 163798 - DNA, 23 bp, Artificial sequence
  SiRNA target sequence
ttgcgcattcttctataagattt

SEQ ID NO: 163799 - DNA, 23 bp, Artificial sequence
  SiRNA target sequence
tgcgcattcttctataagatttg

SEQ ID NO: 163800 - DNA, 23 bp, Artificial sequence
  SiRNA target sequence
gcgcattcttctataagatttgg

SEQ ID NO: 163801 - DNA, 23 bp, Artificial sequence
  SiRNA target sequence
cgcattcttctataagatttgga

SEQ ID NO: 163802 - DNA, 23 bp, Artificial sequence
  SiRNA target sequence
gcattcttctataagatttggaa

SEQ ID NO: 163803 - DNA, 23 bp, Artificial sequence
  SiRNA target sequence
cattcttctataagatttggaat

SEQ ID NO: 163804 - DNA, 23 bp, Artificial sequence
  SiRNA target sequence
attcttctataagatttggaata

SEQ ID NO: 163805 - DNA, 23 bp, Artificial sequence
  SiRNA target sequence
ttcttctataagatttggaataa

SEQ ID NO: 163806 - DNA, 23 bp, Artificial sequence
  SiRNA target sequence
tcttctataagatttggaataaa

SEQ ID NO: 163807 - DNA, 23 bp, Artificial sequence
  SiRNA target sequence
cttctataagatttggaataaat

SEQ ID NO: 163808 - DNA, 23 bp, Artificial sequence
  SiRNA target sequence
ttctataagatttggaataaata

SEQ ID NO: 163809 - DNA, 23 bp, Artificial sequence
  SiRNA target sequence
tctataagatttggaataaataa

SEQ ID NO: 163810 - DNA, 23 bp, Artificial sequence
  SiRNA target sequence
ctataagatttggaataaataag

SEQ ID NO: 163811 - DNA, 23 bp, Artificial sequence
  SiRNA target sequence
tataagatttggaataaataagt

SEQ ID NO: 163812 - DNA, 23 bp, Artificial sequence
  SiRNA target sequence
ataagatttggaataaataagtt

SEQ ID NO: 163813 - DNA, 23 bp, Artificial sequence
  SiRNA target sequence
taagatttggaataaataagttt

SEQ ID NO: 163814 - DNA, 23 bp, Artificial sequence
  SiRNA target sequence
aagatttggaataaataagttta

SEQ ID NO: 163815 - DNA, 23 bp, Artificial sequence
  SiRNA target sequence
agatttggaataaataagtttac

SEQ ID NO: 163816 - DNA, 23 bp, Artificial sequence
  SiRNA target sequence
gatttggaataaataagtttaca

SEQ ID NO: 163817 - DNA, 23 bp, Artificial sequence
  SiRNA target sequence
atttggaataaataagtttacaa

SEQ ID NO: 163818 - DNA, 23 bp, Artificial sequence
  SiRNA target sequence
tttggaataaataagtttacaac

SEQ ID NO: 163819 - DNA, 23 bp, Artificial sequence
  SiRNA target sequence
ttggaataaataagtttacaact

SEQ ID NO: 163820 - DNA, 23 bp, Artificial sequence
  SiRNA target sequence
tggaataaataagtttacaactg

SEQ ID NO: 163821 - DNA, 23 bp, Artificial sequence
  SiRNA target sequence
ggaataaataagtttacaactga

SEQ ID NO: 163822 - DNA, 23 bp, Artificial sequence
  SiRNA target sequence
gaataaataagtttacaactgaa

SEQ ID NO: 163823 - DNA, 23 bp, Artificial sequence
  SiRNA target sequence
aataaataagtttacaactgaag

SEQ ID NO: 163824 - DNA, 23 bp, Artificial sequence
  SiRNA target sequence
ataaataagtttacaactgaaga

SEQ ID NO: 163825 - DNA, 23 bp, Artificial sequence
  SiRNA target sequence
taaataagtttacaactgaagaa

SEQ ID NO: 163826 - DNA, 23 bp, Artificial sequence
  SiRNA target sequence
aaataagtttacaactgaagaag

SEQ ID NO: 163827 - DNA, 23 bp, Artificial sequence
  SiRNA target sequence
aataagtttacaactgaagaaga

SEQ ID NO: 163828 - DNA, 23 bp, Artificial sequence
  SiRNA target sequence
ataagtttacaactgaagaagaa

SEQ ID NO: 163829 - DNA, 23 bp, Artificial sequence
  SiRNA target sequence
taagtttacaactgaagaagaaa

SEQ ID NO: 163830 - DNA, 23 bp, Artificial sequence
  SiRNA target sequence
aagtttacaactgaagaagaaat

SEQ ID NO: 163831 - DNA, 23 bp, Artificial sequence
  SiRNA target sequence
agtttacaactgaagaagaaatc

SEQ ID NO: 163832 - DNA, 23 bp, Artificial sequence
  SiRNA target sequence
gtttacaactgaagaagaaatca

SEQ ID NO: 163833 - DNA, 23 bp, Artificial sequence
  SiRNA target sequence
tttacaactgaagaagaaatcaa

SEQ ID NO: 163834 - DNA, 23 bp, Artificial sequence
  SiRNA target sequence
ttacaactgaagaagaaatcaat

SEQ ID NO: 163835 - DNA, 23 bp, Artificial sequence
  SiRNA target sequence
tacaactgaagaagaaatcaata

SEQ ID NO: 163836 - DNA, 23 bp, Artificial sequence
  SiRNA target sequence
acaactgaagaagaaatcaataa

SEQ ID NO: 163837 - DNA, 23 bp, Artificial sequence
  SiRNA target sequence
caactgaagaagaaatcaataaa

SEQ ID NO: 163838 - DNA, 23 bp, Artificial sequence
  SiRNA target sequence
aactgaagaagaaatcaataaag

SEQ ID NO: 163839 - DNA, 23 bp, Artificial sequence
  SiRNA target sequence
actgaagaagaaatcaataaagt

SEQ ID NO: 163840 - DNA, 23 bp, Artificial sequence
  SiRNA target sequence
ctgaagaagaaatcaataaagta

SEQ ID NO: 163841 - DNA, 23 bp, Artificial sequence
  SiRNA target sequence
tgaagaagaaatcaataaagtat

SEQ ID NO: 163842 - DNA, 23 bp, Artificial sequence
  SiRNA target sequence
gaagaagaaatcaataaagtatc

SEQ ID NO: 163843 - DNA, 23 bp, Artificial sequence
  SiRNA target sequence
aagaagaaatcaataaagtatct

SEQ ID NO: 163844 - DNA, 23 bp, Artificial sequence
  SiRNA target sequence
agaagaaatcaataaagtatcta

SEQ ID NO: 163845 - DNA, 23 bp, Artificial sequence
  SiRNA target sequence
gaagaaatcaataaagtatctag

SEQ ID NO: 163846 - DNA, 23 bp, Artificial sequence
  SiRNA target sequence
aagaaatcaataaagtatctagt

SEQ ID NO: 163847 - DNA, 23 bp, Artificial sequence
  SiRNA target sequence
agaaatcaataaagtatctagtg

SEQ ID NO: 163848 - DNA, 23 bp, Artificial sequence
  SiRNA target sequence
gaaatcaataaagtatctagtga

SEQ ID NO: 163849 - DNA, 23 bp, Artificial sequence
  SiRNA target sequence
aaatcaataaagtatctagtgat

SEQ ID NO: 163850 - DNA, 23 bp, Artificial sequence
  SiRNA target sequence
aatcaataaagtatctagtgata

SEQ ID NO: 163851 - DNA, 23 bp, Artificial sequence
  SiRNA target sequence
atcaataaagtatctagtgatac

SEQ ID NO: 163852 - DNA, 23 bp, Artificial sequence
  SiRNA target sequence
tcaataaagtatctagtgataca

SEQ ID NO: 163853 - DNA, 23 bp, Artificial sequence
  SiRNA target sequence
caataaagtatctagtgatacaa

SEQ ID NO: 163854 - DNA, 23 bp, Artificial sequence
  SiRNA target sequence
aataaagtatctagtgatacaat

SEQ ID NO: 163855 - DNA, 23 bp, Artificial sequence
  SiRNA target sequence
ataaagtatctagtgatacaatt

SEQ ID NO: 163856 - DNA, 23 bp, Artificial sequence
  SiRNA target sequence
taaagtatctagtgatacaatta

SEQ ID NO: 163857 - DNA, 23 bp, Artificial sequence
  SiRNA target sequence
aaagtatctagtgatacaattaa

SEQ ID NO: 163858 - DNA, 23 bp, Artificial sequence
  SiRNA target sequence
aagtatctagtgatacaattaaa

SEQ ID NO: 163859 - DNA, 23 bp, Artificial sequence
  SiRNA target sequence
agtatctagtgatacaattaaag

SEQ ID NO: 163860 - DNA, 23 bp, Artificial sequence
  SiRNA target sequence
gtatctagtgatacaattaaagc

SEQ ID NO: 163861 - DNA, 23 bp, Artificial sequence
  SiRNA target sequence
tatctagtgatacaattaaagct

SEQ ID NO: 163862 - DNA, 23 bp, Artificial sequence
  SiRNA target sequence
atctagtgatacaattaaagctg

SEQ ID NO: 163863 - DNA, 23 bp, Artificial sequence
  SiRNA target sequence
tctagtgatacaattaaagctgt

SEQ ID NO: 163864 - DNA, 23 bp, Artificial sequence
  SiRNA target sequence
ctagtgatacaattaaagctgtt

SEQ ID NO: 163865 - DNA, 23 bp, Artificial sequence
  SiRNA target sequence
tagtgatacaattaaagctgtta

SEQ ID NO: 163866 - DNA, 23 bp, Artificial sequence
  SiRNA target sequence
agtgatacaattaaagctgttaa

SEQ ID NO: 163867 - DNA, 23 bp, Artificial sequence
  SiRNA target sequence
gtgatacaattaaagctgttaat

SEQ ID NO: 163868 - DNA, 23 bp, Artificial sequence
  SiRNA target sequence
tgatacaattaaagctgttaata

SEQ ID NO: 163869 - DNA, 23 bp, Artificial sequence
  SiRNA target sequence
gatacaattaaagctgttaataa

SEQ ID NO: 163870 - DNA, 23 bp, Artificial sequence
  SiRNA target sequence
atacaattaaagctgttaataag

SEQ ID NO: 163871 - DNA, 23 bp, Artificial sequence
  SiRNA target sequence
tacaattaaagctgttaataagt

SEQ ID NO: 163872 - DNA, 23 bp, Artificial sequence
  SiRNA target sequence
acaattaaagctgttaataagtt

SEQ ID NO: 163873 - DNA, 23 bp, Artificial sequence
  SiRNA target sequence
caattaaagctgttaataagtta

SEQ ID NO: 163874 - DNA, 23 bp, Artificial sequence
  SiRNA target sequence
aattaaagctgttaataagttaa

SEQ ID NO: 163875 - DNA, 23 bp, Artificial sequence
  SiRNA target sequence
attaaagctgttaataagttaag

SEQ ID NO: 163876 - DNA, 23 bp, Artificial sequence
  SiRNA target sequence
ttaaagctgttaataagttaaga

SEQ ID NO: 163877 - DNA, 23 bp, Artificial sequence
  SiRNA target sequence
taaagctgttaataagttaagag

SEQ ID NO: 163878 - DNA, 23 bp, Artificial sequence
  SiRNA target sequence
aaagctgttaataagttaagaga

SEQ ID NO: 163879 - DNA, 23 bp, Artificial sequence
  SiRNA target sequence
aagctgttaataagttaagagat

SEQ ID NO: 163880 - DNA, 23 bp, Artificial sequence
  SiRNA target sequence
agctgttaataagttaagagata

SEQ ID NO: 163881 - DNA, 23 bp, Artificial sequence
  SiRNA target sequence
gctgttaataagttaagagatat

SEQ ID NO: 163882 - DNA, 23 bp, Artificial sequence
  SiRNA target sequence
ctgttaataagttaagagatatg

SEQ ID NO: 163883 - DNA, 23 bp, Artificial sequence
  SiRNA target sequence
tgttaataagttaagagatatgt

SEQ ID NO: 163884 - DNA, 23 bp, Artificial sequence
  SiRNA target sequence
gttaataagttaagagatatgtc

SEQ ID NO: 163885 - DNA, 23 bp, Artificial sequence
  SiRNA target sequence
ttaataagttaagagatatgtct

SEQ ID NO: 163886 - DNA, 23 bp, Artificial sequence
  SiRNA target sequence
taataagttaagagatatgtctc

SEQ ID NO: 163887 - DNA, 23 bp, Artificial sequence
  SiRNA target sequence
aataagttaagagatatgtctcc

SEQ ID NO: 163888 - DNA, 23 bp, Artificial sequence
  SiRNA target sequence
ataagttaagagatatgtctcct

SEQ ID NO: 163889 - DNA, 23 bp, Artificial sequence
  SiRNA target sequence
taagttaagagatatgtctcctt

SEQ ID NO: 163890 - DNA, 23 bp, Artificial sequence
  SiRNA target sequence
aagttaagagatatgtctccttt

SEQ ID NO: 163891 - DNA, 23 bp, Artificial sequence
  SiRNA target sequence
agttaagagatatgtctccttta

SEQ ID NO: 163892 - DNA, 23 bp, Artificial sequence
  SiRNA target sequence
gttaagagatatgtctcctttat

SEQ ID NO: 163893 - DNA, 23 bp, Artificial sequence
  SiRNA target sequence
ttaagagatatgtctcctttata

SEQ ID NO: 163894 - DNA, 23 bp, Artificial sequence
  SiRNA target sequence
taagagatatgtctcctttatat

SEQ ID NO: 163895 - DNA, 23 bp, Artificial sequence
  SiRNA target sequence
aagagatatgtctcctttatatg

SEQ ID NO: 163896 - DNA, 23 bp, Artificial sequence
  SiRNA target sequence
agagatatgtctcctttatatga

SEQ ID NO: 163897 - DNA, 23 bp, Artificial sequence
  SiRNA target sequence
gagatatgtctcctttatatgaa

SEQ ID NO: 163898 - DNA, 23 bp, Artificial sequence
  SiRNA target sequence
agatatgtctcctttatatgaaa

SEQ ID NO: 163899 - DNA, 23 bp, Artificial sequence
  SiRNA target sequence
gatatgtctcctttatatgaaat

SEQ ID NO: 163900 - DNA, 23 bp, Artificial sequence
  SiRNA target sequence
atatgtctcctttatatgaaatg

SEQ ID NO: 163901 - DNA, 23 bp, Artificial sequence
  SiRNA target sequence
tatgtctcctttatatgaaatgg

SEQ ID NO: 163902 - DNA, 23 bp, Artificial sequence
  SiRNA target sequence
atgtctcctttatatgaaatggt

SEQ ID NO: 163903 - DNA, 23 bp, Artificial sequence
  SiRNA target sequence
tgtctcctttatatgaaatggtc

SEQ ID NO: 163904 - DNA, 23 bp, Artificial sequence
  SiRNA target sequence
gtctcctttatatgaaatggtca

SEQ ID NO: 163905 - DNA, 23 bp, Artificial sequence
  SiRNA target sequence
tctcctttatatgaaatggtcaa

SEQ ID NO: 163906 - DNA, 23 bp, Artificial sequence
  SiRNA target sequence
ctcctttatatgaaatggtcaaa

SEQ ID NO: 163907 - DNA, 23 bp, Artificial sequence
  SiRNA target sequence
tcctttatatgaaatggtcaaag

SEQ ID NO: 163908 - DNA, 23 bp, Artificial sequence
  SiRNA target sequence
cctttatatgaaatggtcaaaga

SEQ ID NO: 163909 - DNA, 23 bp, Artificial sequence
  SiRNA target sequence
ctttatatgaaatggtcaaagaa

SEQ ID NO: 163910 - DNA, 23 bp, Artificial sequence
  SiRNA target sequence
tttatatgaaatggtcaaagaag

SEQ ID NO: 163911 - DNA, 23 bp, Artificial sequence
  SiRNA target sequence
ttatatgaaatggtcaaagaagg

SEQ ID NO: 163912 - DNA, 23 bp, Artificial sequence
  SiRNA target sequence
tatatgaaatggtcaaagaaggg

SEQ ID NO: 163913 - DNA, 23 bp, Artificial sequence
  SiRNA target sequence
atatgaaatggtcaaagaaggga

SEQ ID NO: 163914 - DNA, 23 bp, Artificial sequence
  SiRNA target sequence
tatgaaatggtcaaagaagggat

SEQ ID NO: 163915 - DNA, 23 bp, Artificial sequence
  SiRNA target sequence
atgaaatggtcaaagaagggata

SEQ ID NO: 163916 - DNA, 23 bp, Artificial sequence
  SiRNA target sequence
tgaaatggtcaaagaagggatag

SEQ ID NO: 163917 - DNA, 23 bp, Artificial sequence
  SiRNA target sequence
gaaatggtcaaagaagggataga

SEQ ID NO: 163918 - DNA, 23 bp, Artificial sequence
  SiRNA target sequence
aaatggtcaaagaagggatagat

SEQ ID NO: 163919 - DNA, 23 bp, Artificial sequence
  SiRNA target sequence
aatggtcaaagaagggatagatt

SEQ ID NO: 163920 - DNA, 23 bp, Artificial sequence
  SiRNA target sequence
atggtcaaagaagggatagattt

SEQ ID NO: 163921 - DNA, 23 bp, Artificial sequence
  SiRNA target sequence
tggtcaaagaagggatagattta

SEQ ID NO: 163922 - DNA, 23 bp, Artificial sequence
  SiRNA target sequence
ggtcaaagaagggatagatttag

SEQ ID NO: 163923 - DNA, 23 bp, Artificial sequence
  SiRNA target sequence
gtcaaagaagggatagatttaga

SEQ ID NO: 163924 - DNA, 23 bp, Artificial sequence
  SiRNA target sequence
tcaaagaagggatagatttagat

SEQ ID NO: 163925 - DNA, 23 bp, Artificial sequence
  SiRNA target sequence
caaagaagggatagatttagata

SEQ ID NO: 163926 - DNA, 23 bp, Artificial sequence
  SiRNA target sequence
aaagaagggatagatttagataa

SEQ ID NO: 163927 - DNA, 23 bp, Artificial sequence
  SiRNA target sequence
aagaagggatagatttagataaa

SEQ ID NO: 163928 - DNA, 23 bp, Artificial sequence
  SiRNA target sequence
agaagggatagatttagataaaa

SEQ ID NO: 163929 - DNA, 23 bp, Artificial sequence
  SiRNA target sequence
gaagggatagatttagataaaat

SEQ ID NO: 163930 - DNA, 23 bp, Artificial sequence
  SiRNA target sequence
aagggatagatttagataaaatt

SEQ ID NO: 163931 - DNA, 23 bp, Artificial sequence
  SiRNA target sequence
agggatagatttagataaaatta

SEQ ID NO: 163932 - DNA, 23 bp, Artificial sequence
  SiRNA target sequence
gggatagatttagataaaattaa

SEQ ID NO: 163933 - DNA, 23 bp, Artificial sequence
  SiRNA target sequence
ggatagatttagataaaattaat

SEQ ID NO: 163934 - DNA, 23 bp, Artificial sequence
  SiRNA target sequence
gatagatttagataaaattaatt

SEQ ID NO: 163935 - DNA, 23 bp, Artificial sequence
  SiRNA target sequence
atagatttagataaaattaattg

SEQ ID NO: 163936 - DNA, 23 bp, Artificial sequence
  SiRNA target sequence
tagatttagataaaattaattgg

SEQ ID NO: 163937 - DNA, 23 bp, Artificial sequence
  SiRNA target sequence
agatttagataaaattaattggt

SEQ ID NO: 163938 - DNA, 23 bp, Artificial sequence
  SiRNA target sequence
gatttagataaaattaattggtc

SEQ ID NO: 163939 - DNA, 23 bp, Artificial sequence
  SiRNA target sequence
atttagataaaattaattggtct

SEQ ID NO: 163940 - DNA, 23 bp, Artificial sequence
  SiRNA target sequence
tttagataaaattaattggtctg

SEQ ID NO: 163941 - DNA, 23 bp, Artificial sequence
  SiRNA target sequence
ttagataaaattaattggtctgc

SEQ ID NO: 163942 - DNA, 23 bp, Artificial sequence
  SiRNA target sequence
tagataaaattaattggtctgct

SEQ ID NO: 163943 - DNA, 23 bp, Artificial sequence
  SiRNA target sequence
agataaaattaattggtctgctt

SEQ ID NO: 163944 - DNA, 23 bp, Artificial sequence
  SiRNA target sequence
gataaaattaattggtctgctta

SEQ ID NO: 163945 - DNA, 23 bp, Artificial sequence
  SiRNA target sequence
ataaaattaattggtctgcttaa

SEQ ID NO: 163946 - DNA, 24 bp, Artificial sequence
  SiRNA target sequence
atgttatttttttatagccccatt

SEQ ID NO: 163947 - DNA, 24 bp, Artificial sequence
  SiRNA target sequence
tgttatttttttatagccccattt

SEQ ID NO: 163948 - DNA, 24 bp, Artificial sequence
  SiRNA target sequence
gttatttttttatagccccatttt

SEQ ID NO: 163949 - DNA, 24 bp, Artificial sequence
  SiRNA target sequence
ttatttttttatagccccattttt

SEQ ID NO: 163950 - DNA, 24 bp, Artificial sequence
  SiRNA target sequence
tatttttttatagccccattttta

SEQ ID NO: 163951 - DNA, 24 bp, Artificial sequence
  SiRNA target sequence
atttttttatagccccatttttat

SEQ ID NO: 163952 - DNA, 24 bp, Artificial sequence
  SiRNA target sequence
tttttttatagccccatttttatg

SEQ ID NO: 163953 - DNA, 24 bp, Artificial sequence
  SiRNA target sequence
ttttttatagccccatttttatga

SEQ ID NO: 163954 - DNA, 24 bp, Artificial sequence
  SiRNA target sequence
tttttatagccccatttttatgac

SEQ ID NO: 163955 - DNA, 24 bp, Artificial sequence
  SiRNA target sequence
ttttatagccccatttttatgact

SEQ ID NO: 163956 - DNA, 24 bp, Artificial sequence
  SiRNA target sequence
tttatagccccatttttatgacta

SEQ ID NO: 163957 - DNA, 24 bp, Artificial sequence
  SiRNA target sequence
ttatagccccatttttatgactaa

SEQ ID NO: 163958 - DNA, 24 bp, Artificial sequence
  SiRNA target sequence
tatagccccatttttatgactaaa

SEQ ID NO: 163959 - DNA, 24 bp, Artificial sequence
  SiRNA target sequence
atagccccatttttatgactaaaa

SEQ ID NO: 163960 - DNA, 24 bp, Artificial sequence
  SiRNA target sequence
tagccccatttttatgactaaaag

SEQ ID NO: 163961 - DNA, 24 bp, Artificial sequence
  SiRNA target sequence
agccccatttttatgactaaaagt

SEQ ID NO: 163962 - DNA, 24 bp, Artificial sequence
  SiRNA target sequence
gccccatttttatgactaaaagtt

SEQ ID NO: 163963 - DNA, 24 bp, Artificial sequence
  SiRNA target sequence
ccccatttttatgactaaaagttt

SEQ ID NO: 163964 - DNA, 24 bp, Artificial sequence
  SiRNA target sequence
cccatttttatgactaaaagttta

SEQ ID NO: 163965 - DNA, 24 bp, Artificial sequence
  SiRNA target sequence
ccatttttatgactaaaagtttaa

SEQ ID NO: 163966 - DNA, 24 bp, Artificial sequence
  SiRNA target sequence
catttttatgactaaaagtttaac

SEQ ID NO: 163967 - DNA, 24 bp, Artificial sequence
  SiRNA target sequence
atttttatgactaaaagtttaacg

SEQ ID NO: 163968 - DNA, 24 bp, Artificial sequence
  SiRNA target sequence
tttttatgactaaaagtttaacga

SEQ ID NO: 163969 - DNA, 24 bp, Artificial sequence
  SiRNA target sequence
ttttatgactaaaagtttaacgaa

SEQ ID NO: 163970 - DNA, 24 bp, Artificial sequence
  SiRNA target sequence
tttatgactaaaagtttaacgaat

SEQ ID NO: 163971 - DNA, 24 bp, Artificial sequence
  SiRNA target sequence
ttatgactaaaagtttaacgaatt

SEQ ID NO: 163972 - DNA, 24 bp, Artificial sequence
  SiRNA target sequence
tatgactaaaagtttaacgaattc

SEQ ID NO: 163973 - DNA, 24 bp, Artificial sequence
  SiRNA target sequence
atgactaaaagtttaacgaattct

SEQ ID NO: 163974 - DNA, 24 bp, Artificial sequence
  SiRNA target sequence
tgactaaaagtttaacgaattcta

SEQ ID NO: 163975 - DNA, 24 bp, Artificial sequence
  SiRNA target sequence
gactaaaagtttaacgaattctaa

SEQ ID NO: 163976 - DNA, 24 bp, Artificial sequence
  SiRNA target sequence
actaaaagtttaacgaattctaaa

SEQ ID NO: 163977 - DNA, 24 bp, Artificial sequence
  SiRNA target sequence
ctaaaagtttaacgaattctaaaa

SEQ ID NO: 163978 - DNA, 24 bp, Artificial sequence
  SiRNA target sequence
taaaagtttaacgaattctaaaac

SEQ ID NO: 163979 - DNA, 24 bp, Artificial sequence
  SiRNA target sequence
aaaagtttaacgaattctaaaact

SEQ ID NO: 163980 - DNA, 24 bp, Artificial sequence
  SiRNA target sequence
aaagtttaacgaattctaaaactt

SEQ ID NO: 163981 - DNA, 24 bp, Artificial sequence
  SiRNA target sequence
aagtttaacgaattctaaaacttt

SEQ ID NO: 163982 - DNA, 24 bp, Artificial sequence
  SiRNA target sequence
agtttaacgaattctaaaacttta

SEQ ID NO: 163983 - DNA, 24 bp, Artificial sequence
  SiRNA target sequence
gtttaacgaattctaaaactttaa

SEQ ID NO: 163984 - DNA, 24 bp, Artificial sequence
  SiRNA target sequence
tttaacgaattctaaaactttaaa

SEQ ID NO: 163985 - DNA, 24 bp, Artificial sequence
  SiRNA target sequence
ttaacgaattctaaaactttaaat

SEQ ID NO: 163986 - DNA, 24 bp, Artificial sequence
  SiRNA target sequence
taacgaattctaaaactttaaatt

SEQ ID NO: 163987 - DNA, 24 bp, Artificial sequence
  SiRNA target sequence
aacgaattctaaaactttaaattt

SEQ ID NO: 163988 - DNA, 24 bp, Artificial sequence
  SiRNA target sequence
acgaattctaaaactttaaattta

SEQ ID NO: 163989 - DNA, 24 bp, Artificial sequence
  SiRNA target sequence
cgaattctaaaactttaaatttaa

SEQ ID NO: 163990 - DNA, 24 bp, Artificial sequence
  SiRNA target sequence
gaattctaaaactttaaatttaat

SEQ ID NO: 163991 - DNA, 24 bp, Artificial sequence
  SiRNA target sequence
aattctaaaactttaaatttaatg

SEQ ID NO: 163992 - DNA, 24 bp, Artificial sequence
  SiRNA target sequence
attctaaaactttaaatttaatgt

SEQ ID NO: 163993 - DNA, 24 bp, Artificial sequence
  SiRNA target sequence
ttctaaaactttaaatttaatgtc

SEQ ID NO: 163994 - DNA, 24 bp, Artificial sequence
  SiRNA target sequence
tctaaaactttaaatttaatgtca

SEQ ID NO: 163995 - DNA, 24 bp, Artificial sequence
  SiRNA target sequence
ctaaaactttaaatttaatgtcaa

SEQ ID NO: 163996 - DNA, 24 bp, Artificial sequence
  SiRNA target sequence
taaaactttaaatttaatgtcaag

SEQ ID NO: 163997 - DNA, 24 bp, Artificial sequence
  SiRNA target sequence
aaaactttaaatttaatgtcaagt

SEQ ID NO: 163998 - DNA, 24 bp, Artificial sequence
  SiRNA target sequence
aaactttaaatttaatgtcaagtg

SEQ ID NO: 163999 - DNA, 24 bp, Artificial sequence
  SiRNA target sequence
aactttaaatttaatgtcaagtgt

SEQ ID NO: 164000 - DNA, 24 bp, Artificial sequence
  SiRNA target sequence
actttaaatttaatgtcaagtgta

SEQ ID NO: 164001 - DNA, 24 bp, Artificial sequence
  SiRNA target sequence
ctttaaatttaatgtcaagtgtac

SEQ ID NO: 164002 - DNA, 24 bp, Artificial sequence
  SiRNA target sequence
tttaaatttaatgtcaagtgtaca

SEQ ID NO: 164003 - DNA, 24 bp, Artificial sequence
  SiRNA target sequence
ttaaatttaatgtcaagtgtacaa

SEQ ID NO: 164004 - DNA, 24 bp, Artificial sequence
  SiRNA target sequence
taaatttaatgtcaagtgtacaat

SEQ ID NO: 164005 - DNA, 24 bp, Artificial sequence
  SiRNA target sequence
aaatttaatgtcaagtgtacaatc

SEQ ID NO: 164006 - DNA, 24 bp, Artificial sequence
  SiRNA target sequence
aatttaatgtcaagtgtacaatca

SEQ ID NO: 164007 - DNA, 24 bp, Artificial sequence
  SiRNA target sequence
atttaatgtcaagtgtacaatcac

SEQ ID NO: 164008 - DNA, 24 bp, Artificial sequence
  SiRNA target sequence
tttaatgtcaagtgtacaatcacc

SEQ ID NO: 164009 - DNA, 24 bp, Artificial sequence
  SiRNA target sequence
ttaatgtcaagtgtacaatcacca

SEQ ID NO: 164010 - DNA, 24 bp, Artificial sequence
  SiRNA target sequence
taatgtcaagtgtacaatcaccag

SEQ ID NO: 164011 - DNA, 24 bp, Artificial sequence
  SiRNA target sequence
aatgtcaagtgtacaatcaccagt

SEQ ID NO: 164012 - DNA, 24 bp, Artificial sequence
  SiRNA target sequence
atgtcaagtgtacaatcaccagtt

SEQ ID NO: 164013 - DNA, 24 bp, Artificial sequence
  SiRNA target sequence
tgtcaagtgtacaatcaccagtta

SEQ ID NO: 164014 - DNA, 24 bp, Artificial sequence
  SiRNA target sequence
gtcaagtgtacaatcaccagttat

SEQ ID NO: 164015 - DNA, 24 bp, Artificial sequence
  SiRNA target sequence
tcaagtgtacaatcaccagttata

SEQ ID NO: 164016 - DNA, 24 bp, Artificial sequence
  SiRNA target sequence
caagtgtacaatcaccagttataa

SEQ ID NO: 164017 - DNA, 24 bp, Artificial sequence
  SiRNA target sequence
aagtgtacaatcaccagttataaa

SEQ ID NO: 164018 - DNA, 24 bp, Artificial sequence
  SiRNA target sequence
agtgtacaatcaccagttataaat

SEQ ID NO: 164019 - DNA, 24 bp, Artificial sequence
  SiRNA target sequence
gtgtacaatcaccagttataaata

SEQ ID NO: 164020 - DNA, 24 bp, Artificial sequence
  SiRNA target sequence
tgtacaatcaccagttataaatac

SEQ ID NO: 164021 - DNA, 24 bp, Artificial sequence
  SiRNA target sequence
gtacaatcaccagttataaataca

SEQ ID NO: 164022 - DNA, 24 bp, Artificial sequence
  SiRNA target sequence
tacaatcaccagttataaatacaa

SEQ ID NO: 164023 - DNA, 24 bp, Artificial sequence
  SiRNA target sequence
acaatcaccagttataaatacaaa

SEQ ID NO: 164024 - DNA, 24 bp, Artificial sequence
  SiRNA target sequence
caatcaccagttataaatacaaaa

SEQ ID NO: 164025 - DNA, 24 bp, Artificial sequence
  SiRNA target sequence
aatcaccagttataaatacaaaaa

SEQ ID NO: 164026 - DNA, 24 bp, Artificial sequence
  SiRNA target sequence
atcaccagttataaatacaaaaaa

SEQ ID NO: 164027 - DNA, 24 bp, Artificial sequence
  SiRNA target sequence
tcaccagttataaatacaaaaaaa

SEQ ID NO: 164028 - DNA, 24 bp, Artificial sequence
  SiRNA target sequence
caccagttataaatacaaaaaaaa

SEQ ID NO: 164029 - DNA, 24 bp, Artificial sequence
  SiRNA target sequence
accagttataaatacaaaaaaaat

SEQ ID NO: 164030 - DNA, 24 bp, Artificial sequence
  SiRNA target sequence
ccagttataaatacaaaaaaaata

SEQ ID NO: 164031 - DNA, 24 bp, Artificial sequence
  SiRNA target sequence
cagttataaatacaaaaaaaatat

SEQ ID NO: 164032 - DNA, 24 bp, Artificial sequence
  SiRNA target sequence
agttataaatacaaaaaaaatata

SEQ ID NO: 164033 - DNA, 24 bp, Artificial sequence
  SiRNA target sequence
gttataaatacaaaaaaaatatat

SEQ ID NO: 164034 - DNA, 24 bp, Artificial sequence
  SiRNA target sequence
ttataaatacaaaaaaaatatatc

SEQ ID NO: 164035 - DNA, 24 bp, Artificial sequence
  SiRNA target sequence
tataaatacaaaaaaaatatatct

SEQ ID NO: 164036 - DNA, 24 bp, Artificial sequence
  SiRNA target sequence
ataaatacaaaaaaaatatatctt

SEQ ID NO: 164037 - DNA, 24 bp, Artificial sequence
  SiRNA target sequence
taaatacaaaaaaaatatatcttg

SEQ ID NO: 164038 - DNA, 24 bp, Artificial sequence
  SiRNA target sequence
aaatacaaaaaaaatatatcttga

SEQ ID NO: 164039 - DNA, 24 bp, Artificial sequence
  SiRNA target sequence
aatacaaaaaaaatatatcttgat

SEQ ID NO: 164040 - DNA, 24 bp, Artificial sequence
  SiRNA target sequence
atacaaaaaaaatatatcttgatg

SEQ ID NO: 164041 - DNA, 24 bp, Artificial sequence
  SiRNA target sequence
tacaaaaaaaatatatcttgatgc

SEQ ID NO: 164042 - DNA, 24 bp, Artificial sequence
  SiRNA target sequence
acaaaaaaaatatatcttgatgca

SEQ ID NO: 164043 - DNA, 24 bp, Artificial sequence
  SiRNA target sequence
caaaaaaaatatatcttgatgcac

SEQ ID NO: 164044 - DNA, 24 bp, Artificial sequence
  SiRNA target sequence
aaaaaaaatatatcttgatgcaca

SEQ ID NO: 164045 - DNA, 24 bp, Artificial sequence
  SiRNA target sequence
aaaaaaatatatcttgatgcacaa

SEQ ID NO: 164046 - DNA, 24 bp, Artificial sequence
  SiRNA target sequence
aaaaaatatatcttgatgcacaag

SEQ ID NO: 164047 - DNA, 24 bp, Artificial sequence
  SiRNA target sequence
aaaaatatatcttgatgcacaagc

SEQ ID NO: 164048 - DNA, 24 bp, Artificial sequence
  SiRNA target sequence
aaaatatatcttgatgcacaagcg

SEQ ID NO: 164049 - DNA, 24 bp, Artificial sequence
  SiRNA target sequence
aaatatatcttgatgcacaagcga

SEQ ID NO: 164050 - DNA, 24 bp, Artificial sequence
  SiRNA target sequence
aatatatcttgatgcacaagcgac

SEQ ID NO: 164051 - DNA, 24 bp, Artificial sequence
  SiRNA target sequence
atatatcttgatgcacaagcgacc

SEQ ID NO: 164052 - DNA, 24 bp, Artificial sequence
  SiRNA target sequence
tatatcttgatgcacaagcgacca

SEQ ID NO: 164053 - DNA, 24 bp, Artificial sequence
  SiRNA target sequence
atatcttgatgcacaagcgaccaa

SEQ ID NO: 164054 - DNA, 24 bp, Artificial sequence
  SiRNA target sequence
tatcttgatgcacaagcgaccaag

SEQ ID NO: 164055 - DNA, 24 bp, Artificial sequence
  SiRNA target sequence
atcttgatgcacaagcgaccaagc

SEQ ID NO: 164056 - DNA, 24 bp, Artificial sequence
  SiRNA target sequence
tcttgatgcacaagcgaccaagcc

SEQ ID NO: 164057 - DNA, 24 bp, Artificial sequence
  SiRNA target sequence
cttgatgcacaagcgaccaagcct

SEQ ID NO: 164058 - DNA, 24 bp, Artificial sequence
  SiRNA target sequence
ttgatgcacaagcgaccaagcctt

SEQ ID NO: 164059 - DNA, 24 bp, Artificial sequence
  SiRNA target sequence
tgatgcacaagcgaccaagccttt

SEQ ID NO: 164060 - DNA, 24 bp, Artificial sequence
  SiRNA target sequence
gatgcacaagcgaccaagccttta

SEQ ID NO: 164061 - DNA, 24 bp, Artificial sequence
  SiRNA target sequence
atgcacaagcgaccaagcctttag

SEQ ID NO: 164062 - DNA, 24 bp, Artificial sequence
  SiRNA target sequence
tgcacaagcgaccaagcctttaga

SEQ ID NO: 164063 - DNA, 24 bp, Artificial sequence
  SiRNA target sequence
gcacaagcgaccaagcctttagac

SEQ ID NO: 164064 - DNA, 24 bp, Artificial sequence
  SiRNA target sequence
cacaagcgaccaagcctttagacc

SEQ ID NO: 164065 - DNA, 24 bp, Artificial sequence
  SiRNA target sequence
acaagcgaccaagcctttagaccc

SEQ ID NO: 164066 - DNA, 24 bp, Artificial sequence
  SiRNA target sequence
caagcgaccaagcctttagacccg

SEQ ID NO: 164067 - DNA, 24 bp, Artificial sequence
  SiRNA target sequence
aagcgaccaagcctttagacccgc

SEQ ID NO: 164068 - DNA, 24 bp, Artificial sequence
  SiRNA target sequence
agcgaccaagcctttagacccgcg

SEQ ID NO: 164069 - DNA, 24 bp, Artificial sequence
  SiRNA target sequence
gcgaccaagcctttagacccgcgt

SEQ ID NO: 164070 - DNA, 24 bp, Artificial sequence
  SiRNA target sequence
cgaccaagcctttagacccgcgtg

SEQ ID NO: 164071 - DNA, 24 bp, Artificial sequence
  SiRNA target sequence
gaccaagcctttagacccgcgtgt

SEQ ID NO: 164072 - DNA, 24 bp, Artificial sequence
  SiRNA target sequence
accaagcctttagacccgcgtgtg

SEQ ID NO: 164073 - DNA, 24 bp, Artificial sequence
  SiRNA target sequence
ccaagcctttagacccgcgtgtgc

SEQ ID NO: 164074 - DNA, 24 bp, Artificial sequence
  SiRNA target sequence
caagcctttagacccgcgtgtgct

SEQ ID NO: 164075 - DNA, 24 bp, Artificial sequence
  SiRNA target sequence
aagcctttagacccgcgtgtgctt

SEQ ID NO: 164076 - DNA, 24 bp, Artificial sequence
  SiRNA target sequence
agcctttagacccgcgtgtgcttg

SEQ ID NO: 164077 - DNA, 24 bp, Artificial sequence
  SiRNA target sequence
gcctttagacccgcgtgtgcttga

SEQ ID NO: 164078 - DNA, 24 bp, Artificial sequence
  SiRNA target sequence
cctttagacccgcgtgtgcttgat

SEQ ID NO: 164079 - DNA, 24 bp, Artificial sequence
  SiRNA target sequence
ctttagacccgcgtgtgcttgatg

SEQ ID NO: 164080 - DNA, 24 bp, Artificial sequence
  SiRNA target sequence
tttagacccgcgtgtgcttgatgc

SEQ ID NO: 164081 - DNA, 24 bp, Artificial sequence
  SiRNA target sequence
ttagacccgcgtgtgcttgatgca

SEQ ID NO: 164082 - DNA, 24 bp, Artificial sequence
  SiRNA target sequence
tagacccgcgtgtgcttgatgcaa

SEQ ID NO: 164083 - DNA, 24 bp, Artificial sequence
  SiRNA target sequence
agacccgcgtgtgcttgatgcaat

SEQ ID NO: 164084 - DNA, 24 bp, Artificial sequence
  SiRNA target sequence
gacccgcgtgtgcttgatgcaatg

SEQ ID NO: 164085 - DNA, 24 bp, Artificial sequence
  SiRNA target sequence
acccgcgtgtgcttgatgcaatgc

SEQ ID NO: 164086 - DNA, 24 bp, Artificial sequence
  SiRNA target sequence
cccgcgtgtgcttgatgcaatgct

SEQ ID NO: 164087 - DNA, 24 bp, Artificial sequence
  SiRNA target sequence
ccgcgtgtgcttgatgcaatgctt

SEQ ID NO: 164088 - DNA, 24 bp, Artificial sequence
  SiRNA target sequence
cgcgtgtgcttgatgcaatgcttc

SEQ ID NO: 164089 - DNA, 24 bp, Artificial sequence
  SiRNA target sequence
gcgtgtgcttgatgcaatgcttcc

SEQ ID NO: 164090 - DNA, 24 bp, Artificial sequence
  SiRNA target sequence
cgtgtgcttgatgcaatgcttcca

SEQ ID NO: 164091 - DNA, 24 bp, Artificial sequence
  SiRNA target sequence
gtgtgcttgatgcaatgcttccat

SEQ ID NO: 164092 - DNA, 24 bp, Artificial sequence
  SiRNA target sequence
tgtgcttgatgcaatgcttccata

SEQ ID NO: 164093 - DNA, 24 bp, Artificial sequence
  SiRNA target sequence
gtgcttgatgcaatgcttccatac

SEQ ID NO: 164094 - DNA, 24 bp, Artificial sequence
  SiRNA target sequence
tgcttgatgcaatgcttccatact

SEQ ID NO: 164095 - DNA, 24 bp, Artificial sequence
  SiRNA target sequence
gcttgatgcaatgcttccatacta

SEQ ID NO: 164096 - DNA, 24 bp, Artificial sequence
  SiRNA target sequence
cttgatgcaatgcttccatactat

SEQ ID NO: 164097 - DNA, 24 bp, Artificial sequence
  SiRNA target sequence
ttgatgcaatgcttccatactata

SEQ ID NO: 164098 - DNA, 24 bp, Artificial sequence
  SiRNA target sequence
tgatgcaatgcttccatactatac

SEQ ID NO: 164099 - DNA, 24 bp, Artificial sequence
  SiRNA target sequence
gatgcaatgcttccatactataca

SEQ ID NO: 164100 - DNA, 24 bp, Artificial sequence
  SiRNA target sequence
atgcaatgcttccatactatacat

SEQ ID NO: 164101 - DNA, 24 bp, Artificial sequence
  SiRNA target sequence
tgcaatgcttccatactatacatc

SEQ ID NO: 164102 - DNA, 24 bp, Artificial sequence
  SiRNA target sequence
gcaatgcttccatactatacatcc

SEQ ID NO: 164103 - DNA, 24 bp, Artificial sequence
  SiRNA target sequence
caatgcttccatactatacatcca

SEQ ID NO: 164104 - DNA, 24 bp, Artificial sequence
  SiRNA target sequence
aatgcttccatactatacatccat

SEQ ID NO: 164105 - DNA, 24 bp, Artificial sequence
  SiRNA target sequence
atgcttccatactatacatccatt

SEQ ID NO: 164106 - DNA, 24 bp, Artificial sequence
  SiRNA target sequence
tgcttccatactatacatccattt

SEQ ID NO: 164107 - DNA, 24 bp, Artificial sequence
  SiRNA target sequence
gcttccatactatacatccatttt

SEQ ID NO: 164108 - DNA, 24 bp, Artificial sequence
  SiRNA target sequence
cttccatactatacatccattttt

SEQ ID NO: 164109 - DNA, 24 bp, Artificial sequence
  SiRNA target sequence
ttccatactatacatccatttttg

SEQ ID NO: 164110 - DNA, 24 bp, Artificial sequence
  SiRNA target sequence
tccatactatacatccatttttgg

SEQ ID NO: 164111 - DNA, 24 bp, Artificial sequence
  SiRNA target sequence
ccatactatacatccatttttgga

SEQ ID NO: 164112 - DNA, 24 bp, Artificial sequence
  SiRNA target sequence
catactatacatccatttttggaa

SEQ ID NO: 164113 - DNA, 24 bp, Artificial sequence
  SiRNA target sequence
atactatacatccatttttggaaa

SEQ ID NO: 164114 - DNA, 24 bp, Artificial sequence
  SiRNA target sequence
tactatacatccatttttggaaat

SEQ ID NO: 164115 - DNA, 24 bp, Artificial sequence
  SiRNA target sequence
actatacatccatttttggaaatc

SEQ ID NO: 164116 - DNA, 24 bp, Artificial sequence
  SiRNA target sequence
ctatacatccatttttggaaatcc

SEQ ID NO: 164117 - DNA, 24 bp, Artificial sequence
  SiRNA target sequence
tatacatccatttttggaaatcca

SEQ ID NO: 164118 - DNA, 24 bp, Artificial sequence
  SiRNA target sequence
atacatccatttttggaaatccac

SEQ ID NO: 164119 - DNA, 24 bp, Artificial sequence
  SiRNA target sequence
tacatccatttttggaaatccaca

SEQ ID NO: 164120 - DNA, 24 bp, Artificial sequence
  SiRNA target sequence
acatccatttttggaaatccacat

SEQ ID NO: 164121 - DNA, 24 bp, Artificial sequence
  SiRNA target sequence
catccatttttggaaatccacatt

SEQ ID NO: 164122 - DNA, 24 bp, Artificial sequence
  SiRNA target sequence
atccatttttggaaatccacattc

SEQ ID NO: 164123 - DNA, 24 bp, Artificial sequence
  SiRNA target sequence
tccatttttggaaatccacattct

SEQ ID NO: 164124 - DNA, 24 bp, Artificial sequence
  SiRNA target sequence
ccatttttggaaatccacattctc

SEQ ID NO: 164125 - DNA, 24 bp, Artificial sequence
  SiRNA target sequence
catttttggaaatccacattctcg

SEQ ID NO: 164126 - DNA, 24 bp, Artificial sequence
  SiRNA target sequence
atttttggaaatccacattctcgc

SEQ ID NO: 164127 - DNA, 24 bp, Artificial sequence
  SiRNA target sequence
tttttggaaatccacattctcgca

SEQ ID NO: 164128 - DNA, 24 bp, Artificial sequence
  SiRNA target sequence
ttttggaaatccacattctcgcac

SEQ ID NO: 164129 - DNA, 24 bp, Artificial sequence
  SiRNA target sequence
tttggaaatccacattctcgcacg

SEQ ID NO: 164130 - DNA, 24 bp, Artificial sequence
  SiRNA target sequence
ttggaaatccacattctcgcacgc

SEQ ID NO: 164131 - DNA, 24 bp, Artificial sequence
  SiRNA target sequence
tggaaatccacattctcgcacgca

SEQ ID NO: 164132 - DNA, 24 bp, Artificial sequence
  SiRNA target sequence
ggaaatccacattctcgcacgcat

SEQ ID NO: 164133 - DNA, 24 bp, Artificial sequence
  SiRNA target sequence
gaaatccacattctcgcacgcata

SEQ ID NO: 164134 - DNA, 24 bp, Artificial sequence
  SiRNA target sequence
aaatccacattctcgcacgcatac

SEQ ID NO: 164135 - DNA, 24 bp, Artificial sequence
  SiRNA target sequence
aatccacattctcgcacgcatacg

SEQ ID NO: 164136 - DNA, 24 bp, Artificial sequence
  SiRNA target sequence
atccacattctcgcacgcatacgt

SEQ ID NO: 164137 - DNA, 24 bp, Artificial sequence
  SiRNA target sequence
tccacattctcgcacgcatacgtt

SEQ ID NO: 164138 - DNA, 24 bp, Artificial sequence
  SiRNA target sequence
ccacattctcgcacgcatacgttt

SEQ ID NO: 164139 - DNA, 24 bp, Artificial sequence
  SiRNA target sequence
cacattctcgcacgcatacgtttg

SEQ ID NO: 164140 - DNA, 24 bp, Artificial sequence
  SiRNA target sequence
acattctcgcacgcatacgtttgg

SEQ ID NO: 164141 - DNA, 24 bp, Artificial sequence
  SiRNA target sequence
cattctcgcacgcatacgtttgga

SEQ ID NO: 164142 - DNA, 24 bp, Artificial sequence
  SiRNA target sequence
attctcgcacgcatacgtttggat

SEQ ID NO: 164143 - DNA, 24 bp, Artificial sequence
  SiRNA target sequence
ttctcgcacgcatacgtttggatg

SEQ ID NO: 164144 - DNA, 24 bp, Artificial sequence
  SiRNA target sequence
tctcgcacgcatacgtttggatgg

SEQ ID NO: 164145 - DNA, 24 bp, Artificial sequence
  SiRNA target sequence
ctcgcacgcatacgtttggatgga

SEQ ID NO: 164146 - DNA, 24 bp, Artificial sequence
  SiRNA target sequence
tcgcacgcatacgtttggatggaa

SEQ ID NO: 164147 - DNA, 24 bp, Artificial sequence
  SiRNA target sequence
cgcacgcatacgtttggatggaat

SEQ ID NO: 164148 - DNA, 24 bp, Artificial sequence
  SiRNA target sequence
gcacgcatacgtttggatggaatg

SEQ ID NO: 164149 - DNA, 24 bp, Artificial sequence
  SiRNA target sequence
cacgcatacgtttggatggaatgc

SEQ ID NO: 164150 - DNA, 24 bp, Artificial sequence
  SiRNA target sequence
acgcatacgtttggatggaatgca

SEQ ID NO: 164151 - DNA, 24 bp, Artificial sequence
  SiRNA target sequence
cgcatacgtttggatggaatgcag

SEQ ID NO: 164152 - DNA, 24 bp, Artificial sequence
  SiRNA target sequence
gcatacgtttggatggaatgcaga

SEQ ID NO: 164153 - DNA, 24 bp, Artificial sequence
  SiRNA target sequence
catacgtttggatggaatgcagaa

SEQ ID NO: 164154 - DNA, 24 bp, Artificial sequence
  SiRNA target sequence
atacgtttggatggaatgcagaaa

SEQ ID NO: 164155 - DNA, 24 bp, Artificial sequence
  SiRNA target sequence
tacgtttggatggaatgcagaaaa

SEQ ID NO: 164156 - DNA, 24 bp, Artificial sequence
  SiRNA target sequence
acgtttggatggaatgcagaaaaa

SEQ ID NO: 164157 - DNA, 24 bp, Artificial sequence
  SiRNA target sequence
cgtttggatggaatgcagaaaaag

SEQ ID NO: 164158 - DNA, 24 bp, Artificial sequence
  SiRNA target sequence
gtttggatggaatgcagaaaaagg

SEQ ID NO: 164159 - DNA, 24 bp, Artificial sequence
  SiRNA target sequence
tttggatggaatgcagaaaaaggc

SEQ ID NO: 164160 - DNA, 24 bp, Artificial sequence
  SiRNA target sequence
ttggatggaatgcagaaaaaggcg

SEQ ID NO: 164161 - DNA, 24 bp, Artificial sequence
  SiRNA target sequence
tggatggaatgcagaaaaaggcgt

SEQ ID NO: 164162 - DNA, 24 bp, Artificial sequence
  SiRNA target sequence
ggatggaatgcagaaaaaggcgta

SEQ ID NO: 164163 - DNA, 24 bp, Artificial sequence
  SiRNA target sequence
gatggaatgcagaaaaaggcgtag

SEQ ID NO: 164164 - DNA, 24 bp, Artificial sequence
  SiRNA target sequence
atggaatgcagaaaaaggcgtaga

SEQ ID NO: 164165 - DNA, 24 bp, Artificial sequence
  SiRNA target sequence
tggaatgcagaaaaaggcgtagaa

SEQ ID NO: 164166 - DNA, 24 bp, Artificial sequence
  SiRNA target sequence
ggaatgcagaaaaaggcgtagaaa

SEQ ID NO: 164167 - DNA, 24 bp, Artificial sequence
  SiRNA target sequence
gaatgcagaaaaaggcgtagaaat

SEQ ID NO: 164168 - DNA, 24 bp, Artificial sequence
  SiRNA target sequence
aatgcagaaaaaggcgtagaaatg

SEQ ID NO: 164169 - DNA, 24 bp, Artificial sequence
  SiRNA target sequence
atgcagaaaaaggcgtagaaatgg

SEQ ID NO: 164170 - DNA, 24 bp, Artificial sequence
  SiRNA target sequence
tgcagaaaaaggcgtagaaatggc

SEQ ID NO: 164171 - DNA, 24 bp, Artificial sequence
  SiRNA target sequence
gcagaaaaaggcgtagaaatggct

SEQ ID NO: 164172 - DNA, 24 bp, Artificial sequence
  SiRNA target sequence
cagaaaaaggcgtagaaatggctc

SEQ ID NO: 164173 - DNA, 24 bp, Artificial sequence
  SiRNA target sequence
agaaaaaggcgtagaaatggctcg

SEQ ID NO: 164174 - DNA, 24 bp, Artificial sequence
  SiRNA target sequence
gaaaaaggcgtagaaatggctcga

SEQ ID NO: 164175 - DNA, 24 bp, Artificial sequence
  SiRNA target sequence
aaaaaggcgtagaaatggctcgaa

SEQ ID NO: 164176 - DNA, 24 bp, Artificial sequence
  SiRNA target sequence
aaaaggcgtagaaatggctcgaaa

SEQ ID NO: 164177 - DNA, 24 bp, Artificial sequence
  SiRNA target sequence
aaaggcgtagaaatggctcgaaag

SEQ ID NO: 164178 - DNA, 24 bp, Artificial sequence
  SiRNA target sequence
aaggcgtagaaatggctcgaaagc

SEQ ID NO: 164179 - DNA, 24 bp, Artificial sequence
  SiRNA target sequence
aggcgtagaaatggctcgaaagca

SEQ ID NO: 164180 - DNA, 24 bp, Artificial sequence
  SiRNA target sequence
ggcgtagaaatggctcgaaagcaa

SEQ ID NO: 164181 - DNA, 24 bp, Artificial sequence
  SiRNA target sequence
gcgtagaaatggctcgaaagcaag

SEQ ID NO: 164182 - DNA, 24 bp, Artificial sequence
  SiRNA target sequence
cgtagaaatggctcgaaagcaagt

SEQ ID NO: 164183 - DNA, 24 bp, Artificial sequence
  SiRNA target sequence
gtagaaatggctcgaaagcaagta

SEQ ID NO: 164184 - DNA, 24 bp, Artificial sequence
  SiRNA target sequence
tagaaatggctcgaaagcaagtag

SEQ ID NO: 164185 - DNA, 24 bp, Artificial sequence
  SiRNA target sequence
agaaatggctcgaaagcaagtagc

SEQ ID NO: 164186 - DNA, 24 bp, Artificial sequence
  SiRNA target sequence
gaaatggctcgaaagcaagtagca

SEQ ID NO: 164187 - DNA, 24 bp, Artificial sequence
  SiRNA target sequence
aaatggctcgaaagcaagtagcag

SEQ ID NO: 164188 - DNA, 24 bp, Artificial sequence
  SiRNA target sequence
aatggctcgaaagcaagtagcaga

SEQ ID NO: 164189 - DNA, 24 bp, Artificial sequence
  SiRNA target sequence
atggctcgaaagcaagtagcagat

SEQ ID NO: 164190 - DNA, 24 bp, Artificial sequence
  SiRNA target sequence
tggctcgaaagcaagtagcagatt

SEQ ID NO: 164191 - DNA, 24 bp, Artificial sequence
  SiRNA target sequence
ggctcgaaagcaagtagcagattt

SEQ ID NO: 164192 - DNA, 24 bp, Artificial sequence
  SiRNA target sequence
gctcgaaagcaagtagcagattta

SEQ ID NO: 164193 - DNA, 24 bp, Artificial sequence
  SiRNA target sequence
ctcgaaagcaagtagcagatttac

SEQ ID NO: 164194 - DNA, 24 bp, Artificial sequence
  SiRNA target sequence
tcgaaagcaagtagcagatttact

SEQ ID NO: 164195 - DNA, 24 bp, Artificial sequence
  SiRNA target sequence
cgaaagcaagtagcagatttactg

SEQ ID NO: 164196 - DNA, 24 bp, Artificial sequence
  SiRNA target sequence
gaaagcaagtagcagatttactga

SEQ ID NO: 164197 - DNA, 24 bp, Artificial sequence
  SiRNA target sequence
aaagcaagtagcagatttactgaa

SEQ ID NO: 164198 - DNA, 24 bp, Artificial sequence
  SiRNA target sequence
aagcaagtagcagatttactgaat

SEQ ID NO: 164199 - DNA, 24 bp, Artificial sequence
  SiRNA target sequence
agcaagtagcagatttactgaatg

SEQ ID NO: 164200 - DNA, 24 bp, Artificial sequence
  SiRNA target sequence
gcaagtagcagatttactgaatgc

SEQ ID NO: 164201 - DNA, 24 bp, Artificial sequence
  SiRNA target sequence
caagtagcagatttactgaatgcc

SEQ ID NO: 164202 - DNA, 24 bp, Artificial sequence
  SiRNA target sequence
aagtagcagatttactgaatgcca

SEQ ID NO: 164203 - DNA, 24 bp, Artificial sequence
  SiRNA target sequence
agtagcagatttactgaatgccaa

SEQ ID NO: 164204 - DNA, 24 bp, Artificial sequence
  SiRNA target sequence
gtagcagatttactgaatgccaat

SEQ ID NO: 164205 - DNA, 24 bp, Artificial sequence
  SiRNA target sequence
tagcagatttactgaatgccaatg

SEQ ID NO: 164206 - DNA, 24 bp, Artificial sequence
  SiRNA target sequence
agcagatttactgaatgccaatga

SEQ ID NO: 164207 - DNA, 24 bp, Artificial sequence
  SiRNA target sequence
gcagatttactgaatgccaatgaa

SEQ ID NO: 164208 - DNA, 24 bp, Artificial sequence
  SiRNA target sequence
cagatttactgaatgccaatgaaa

SEQ ID NO: 164209 - DNA, 24 bp, Artificial sequence
  SiRNA target sequence
agatttactgaatgccaatgaaaa

SEQ ID NO: 164210 - DNA, 24 bp, Artificial sequence
  SiRNA target sequence
gatttactgaatgccaatgaaaaa

SEQ ID NO: 164211 - DNA, 24 bp, Artificial sequence
  SiRNA target sequence
atttactgaatgccaatgaaaaag

SEQ ID NO: 164212 - DNA, 24 bp, Artificial sequence
  SiRNA target sequence
tttactgaatgccaatgaaaaaga

SEQ ID NO: 164213 - DNA, 24 bp, Artificial sequence
  SiRNA target sequence
ttactgaatgccaatgaaaaagaa

SEQ ID NO: 164214 - DNA, 24 bp, Artificial sequence
  SiRNA target sequence
tactgaatgccaatgaaaaagaaa

SEQ ID NO: 164215 - DNA, 24 bp, Artificial sequence
  SiRNA target sequence
actgaatgccaatgaaaaagaaat

SEQ ID NO: 164216 - DNA, 24 bp, Artificial sequence
  SiRNA target sequence
ctgaatgccaatgaaaaagaaatt

SEQ ID NO: 164217 - DNA, 24 bp, Artificial sequence
  SiRNA target sequence
tgaatgccaatgaaaaagaaatta

SEQ ID NO: 164218 - DNA, 24 bp, Artificial sequence
  SiRNA target sequence
gaatgccaatgaaaaagaaattat

SEQ ID NO: 164219 - DNA, 24 bp, Artificial sequence
  SiRNA target sequence
aatgccaatgaaaaagaaattatt

SEQ ID NO: 164220 - DNA, 24 bp, Artificial sequence
  SiRNA target sequence
atgccaatgaaaaagaaattattt

SEQ ID NO: 164221 - DNA, 24 bp, Artificial sequence
  SiRNA target sequence
tgccaatgaaaaagaaattatttt

SEQ ID NO: 164222 - DNA, 24 bp, Artificial sequence
  SiRNA target sequence
gccaatgaaaaagaaattattttt

SEQ ID NO: 164223 - DNA, 24 bp, Artificial sequence
  SiRNA target sequence
ccaatgaaaaagaaattattttta

SEQ ID NO: 164224 - DNA, 24 bp, Artificial sequence
  SiRNA target sequence
caatgaaaaagaaattatttttac

SEQ ID NO: 164225 - DNA, 24 bp, Artificial sequence
  SiRNA target sequence
aatgaaaaagaaattatttttact

SEQ ID NO: 164226 - DNA, 24 bp, Artificial sequence
  SiRNA target sequence
atgaaaaagaaattatttttacta

SEQ ID NO: 164227 - DNA, 24 bp, Artificial sequence
  SiRNA target sequence
tgaaaaagaaattatttttactag

SEQ ID NO: 164228 - DNA, 24 bp, Artificial sequence
  SiRNA target sequence
gaaaaagaaattatttttactagc

SEQ ID NO: 164229 - DNA, 24 bp, Artificial sequence
  SiRNA target sequence
aaaaagaaattatttttactagcg

SEQ ID NO: 164230 - DNA, 24 bp, Artificial sequence
  SiRNA target sequence
aaaagaaattatttttactagcgg

SEQ ID NO: 164231 - DNA, 24 bp, Artificial sequence
  SiRNA target sequence
aaagaaattatttttactagcggt

SEQ ID NO: 164232 - DNA, 24 bp, Artificial sequence
  SiRNA target sequence
aagaaattatttttactagcggtg

SEQ ID NO: 164233 - DNA, 24 bp, Artificial sequence
  SiRNA target sequence
agaaattatttttactagcggtgc

SEQ ID NO: 164234 - DNA, 24 bp, Artificial sequence
  SiRNA target sequence
gaaattatttttactagcggtgct

SEQ ID NO: 164235 - DNA, 24 bp, Artificial sequence
  SiRNA target sequence
aaattatttttactagcggtgcta

SEQ ID NO: 164236 - DNA, 24 bp, Artificial sequence
  SiRNA target sequence
aattatttttactagcggtgctac

SEQ ID NO: 164237 - DNA, 24 bp, Artificial sequence
  SiRNA target sequence
attatttttactagcggtgctact

SEQ ID NO: 164238 - DNA, 24 bp, Artificial sequence
  SiRNA target sequence
ttatttttactagcggtgctactg

SEQ ID NO: 164239 - DNA, 24 bp, Artificial sequence
  SiRNA target sequence
tatttttactagcggtgctactga

SEQ ID NO: 164240 - DNA, 24 bp, Artificial sequence
  SiRNA target sequence
atttttactagcggtgctactgag

SEQ ID NO: 164241 - DNA, 24 bp, Artificial sequence
  SiRNA target sequence
tttttactagcggtgctactgaga

SEQ ID NO: 164242 - DNA, 24 bp, Artificial sequence
  SiRNA target sequence
ttttactagcggtgctactgagag

SEQ ID NO: 164243 - DNA, 24 bp, Artificial sequence
  SiRNA target sequence
tttactagcggtgctactgagagt

SEQ ID NO: 164244 - DNA, 24 bp, Artificial sequence
  SiRNA target sequence
ttactagcggtgctactgagagta

SEQ ID NO: 164245 - DNA, 24 bp, Artificial sequence
  SiRNA target sequence
tactagcggtgctactgagagtaa

SEQ ID NO: 164246 - DNA, 24 bp, Artificial sequence
  SiRNA target sequence
actagcggtgctactgagagtaac

SEQ ID NO: 164247 - DNA, 24 bp, Artificial sequence
  SiRNA target sequence
ctagcggtgctactgagagtaaca

SEQ ID NO: 164248 - DNA, 24 bp, Artificial sequence
  SiRNA target sequence
tagcggtgctactgagagtaacaa

SEQ ID NO: 164249 - DNA, 24 bp, Artificial sequence
  SiRNA target sequence
agcggtgctactgagagtaacaac

SEQ ID NO: 164250 - DNA, 24 bp, Artificial sequence
  SiRNA target sequence
gcggtgctactgagagtaacaacc

SEQ ID NO: 164251 - DNA, 24 bp, Artificial sequence
  SiRNA target sequence
cggtgctactgagagtaacaacct

SEQ ID NO: 164252 - DNA, 24 bp, Artificial sequence
  SiRNA target sequence
ggtgctactgagagtaacaacctt

SEQ ID NO: 164253 - DNA, 24 bp, Artificial sequence
  SiRNA target sequence
gtgctactgagagtaacaaccttg

SEQ ID NO: 164254 - DNA, 24 bp, Artificial sequence
  SiRNA target sequence
tgctactgagagtaacaaccttgc

SEQ ID NO: 164255 - DNA, 24 bp, Artificial sequence
  SiRNA target sequence
gctactgagagtaacaaccttgca

SEQ ID NO: 164256 - DNA, 24 bp, Artificial sequence
  SiRNA target sequence
ctactgagagtaacaaccttgcac

SEQ ID NO: 164257 - DNA, 24 bp, Artificial sequence
  SiRNA target sequence
tactgagagtaacaaccttgcact

SEQ ID NO: 164258 - DNA, 24 bp, Artificial sequence
  SiRNA target sequence
actgagagtaacaaccttgcacta

SEQ ID NO: 164259 - DNA, 24 bp, Artificial sequence
  SiRNA target sequence
ctgagagtaacaaccttgcactaa

SEQ ID NO: 164260 - DNA, 24 bp, Artificial sequence
  SiRNA target sequence
tgagagtaacaaccttgcactaaa

SEQ ID NO: 164261 - DNA, 24 bp, Artificial sequence
  SiRNA target sequence
gagagtaacaaccttgcactaaag

SEQ ID NO: 164262 - DNA, 24 bp, Artificial sequence
  SiRNA target sequence
agagtaacaaccttgcactaaagg

SEQ ID NO: 164263 - DNA, 24 bp, Artificial sequence
  SiRNA target sequence
gagtaacaaccttgcactaaaggg

SEQ ID NO: 164264 - DNA, 24 bp, Artificial sequence
  SiRNA target sequence
agtaacaaccttgcactaaagggt

SEQ ID NO: 164265 - DNA, 24 bp, Artificial sequence
  SiRNA target sequence
gtaacaaccttgcactaaagggtg

SEQ ID NO: 164266 - DNA, 24 bp, Artificial sequence
  SiRNA target sequence
taacaaccttgcactaaagggtgt

SEQ ID NO: 164267 - DNA, 24 bp, Artificial sequence
  SiRNA target sequence
aacaaccttgcactaaagggtgtc

SEQ ID NO: 164268 - DNA, 24 bp, Artificial sequence
  SiRNA target sequence
acaaccttgcactaaagggtgtct

SEQ ID NO: 164269 - DNA, 24 bp, Artificial sequence
  SiRNA target sequence
caaccttgcactaaagggtgtctt

SEQ ID NO: 164270 - DNA, 24 bp, Artificial sequence
  SiRNA target sequence
aaccttgcactaaagggtgtcttt

SEQ ID NO: 164271 - DNA, 24 bp, Artificial sequence
  SiRNA target sequence
accttgcactaaagggtgtctttg

SEQ ID NO: 164272 - DNA, 24 bp, Artificial sequence
  SiRNA target sequence
ccttgcactaaagggtgtctttgc

SEQ ID NO: 164273 - DNA, 24 bp, Artificial sequence
  SiRNA target sequence
cttgcactaaagggtgtctttgca

SEQ ID NO: 164274 - DNA, 24 bp, Artificial sequence
  SiRNA target sequence
ttgcactaaagggtgtctttgcat

SEQ ID NO: 164275 - DNA, 24 bp, Artificial sequence
  SiRNA target sequence
tgcactaaagggtgtctttgcatt

SEQ ID NO: 164276 - DNA, 24 bp, Artificial sequence
  SiRNA target sequence
gcactaaagggtgtctttgcattt

SEQ ID NO: 164277 - DNA, 24 bp, Artificial sequence
  SiRNA target sequence
cactaaagggtgtctttgcatttt

SEQ ID NO: 164278 - DNA, 24 bp, Artificial sequence
  SiRNA target sequence
actaaagggtgtctttgcattttt

SEQ ID NO: 164279 - DNA, 24 bp, Artificial sequence
  SiRNA target sequence
ctaaagggtgtctttgcattttta

SEQ ID NO: 164280 - DNA, 24 bp, Artificial sequence
  SiRNA target sequence
taaagggtgtctttgcatttttaa

SEQ ID NO: 164281 - DNA, 24 bp, Artificial sequence
  SiRNA target sequence
aaagggtgtctttgcatttttaaa

SEQ ID NO: 164282 - DNA, 24 bp, Artificial sequence
  SiRNA target sequence
aagggtgtctttgcatttttaaaa

SEQ ID NO: 164283 - DNA, 24 bp, Artificial sequence
  SiRNA target sequence
agggtgtctttgcatttttaaaaa

SEQ ID NO: 164284 - DNA, 24 bp, Artificial sequence
  SiRNA target sequence
gggtgtctttgcatttttaaaaaa

SEQ ID NO: 164285 - DNA, 24 bp, Artificial sequence
  SiRNA target sequence
ggtgtctttgcatttttaaaaaaa

SEQ ID NO: 164286 - DNA, 24 bp, Artificial sequence
  SiRNA target sequence
gtgtctttgcatttttaaaaaaag

SEQ ID NO: 164287 - DNA, 24 bp, Artificial sequence
  SiRNA target sequence
tgtctttgcatttttaaaaaaaga

SEQ ID NO: 164288 - DNA, 24 bp, Artificial sequence
  SiRNA target sequence
gtctttgcatttttaaaaaaagac

SEQ ID NO: 164289 - DNA, 24 bp, Artificial sequence
  SiRNA target sequence
tctttgcatttttaaaaaaagaca

SEQ ID NO: 164290 - DNA, 24 bp, Artificial sequence
  SiRNA target sequence
ctttgcatttttaaaaaaagacaa

SEQ ID NO: 164291 - DNA, 24 bp, Artificial sequence
  SiRNA target sequence
tttgcatttttaaaaaaagacaat

SEQ ID NO: 164292 - DNA, 24 bp, Artificial sequence
  SiRNA target sequence
ttgcatttttaaaaaaagacaata

SEQ ID NO: 164293 - DNA, 24 bp, Artificial sequence
  SiRNA target sequence
tgcatttttaaaaaaagacaatag

SEQ ID NO: 164294 - DNA, 24 bp, Artificial sequence
  SiRNA target sequence
gcatttttaaaaaaagacaatagg

SEQ ID NO: 164295 - DNA, 24 bp, Artificial sequence
  SiRNA target sequence
catttttaaaaaaagacaataggc

SEQ ID NO: 164296 - DNA, 24 bp, Artificial sequence
  SiRNA target sequence
atttttaaaaaaagacaataggcc

SEQ ID NO: 164297 - DNA, 24 bp, Artificial sequence
  SiRNA target sequence
tttttaaaaaaagacaataggcct

SEQ ID NO: 164298 - DNA, 24 bp, Artificial sequence
  SiRNA target sequence
ttttaaaaaaagacaataggcctg

SEQ ID NO: 164299 - DNA, 24 bp, Artificial sequence
  SiRNA target sequence
tttaaaaaaagacaataggcctgt

SEQ ID NO: 164300 - DNA, 24 bp, Artificial sequence
  SiRNA target sequence
ttaaaaaaagacaataggcctgtt

SEQ ID NO: 164301 - DNA, 24 bp, Artificial sequence
  SiRNA target sequence
taaaaaaagacaataggcctgttc

SEQ ID NO: 164302 - DNA, 24 bp, Artificial sequence
  SiRNA target sequence
aaaaaaagacaataggcctgttca

SEQ ID NO: 164303 - DNA, 24 bp, Artificial sequence
  SiRNA target sequence
aaaaaagacaataggcctgttcat

SEQ ID NO: 164304 - DNA, 24 bp, Artificial sequence
  SiRNA target sequence
aaaaagacaataggcctgttcata

SEQ ID NO: 164305 - DNA, 24 bp, Artificial sequence
  SiRNA target sequence
aaaagacaataggcctgttcatat

SEQ ID NO: 164306 - DNA, 24 bp, Artificial sequence
  SiRNA target sequence
aaagacaataggcctgttcatatc

SEQ ID NO: 164307 - DNA, 24 bp, Artificial sequence
  SiRNA target sequence
aagacaataggcctgttcatatca

SEQ ID NO: 164308 - DNA, 24 bp, Artificial sequence
  SiRNA target sequence
agacaataggcctgttcatatcat

SEQ ID NO: 164309 - DNA, 24 bp, Artificial sequence
  SiRNA target sequence
gacaataggcctgttcatatcatt

SEQ ID NO: 164310 - DNA, 24 bp, Artificial sequence
  SiRNA target sequence
acaataggcctgttcatatcatta

SEQ ID NO: 164311 - DNA, 24 bp, Artificial sequence
  SiRNA target sequence
caataggcctgttcatatcattac

SEQ ID NO: 164312 - DNA, 24 bp, Artificial sequence
  SiRNA target sequence
aataggcctgttcatatcattacc

SEQ ID NO: 164313 - DNA, 24 bp, Artificial sequence
  SiRNA target sequence
ataggcctgttcatatcattacca

SEQ ID NO: 164314 - DNA, 24 bp, Artificial sequence
  SiRNA target sequence
taggcctgttcatatcattaccac

SEQ ID NO: 164315 - DNA, 24 bp, Artificial sequence
  SiRNA target sequence
aggcctgttcatatcattaccaca

SEQ ID NO: 164316 - DNA, 24 bp, Artificial sequence
  SiRNA target sequence
ggcctgttcatatcattaccacac

SEQ ID NO: 164317 - DNA, 24 bp, Artificial sequence
  SiRNA target sequence
gcctgttcatatcattaccacaca

SEQ ID NO: 164318 - DNA, 24 bp, Artificial sequence
  SiRNA target sequence
cctgttcatatcattaccacacaa

SEQ ID NO: 164319 - DNA, 24 bp, Artificial sequence
  SiRNA target sequence
ctgttcatatcattaccacacaaa

SEQ ID NO: 164320 - DNA, 24 bp, Artificial sequence
  SiRNA target sequence
tgttcatatcattaccacacaaat

SEQ ID NO: 164321 - DNA, 24 bp, Artificial sequence
  SiRNA target sequence
gttcatatcattaccacacaaatt

SEQ ID NO: 164322 - DNA, 24 bp, Artificial sequence
  SiRNA target sequence
ttcatatcattaccacacaaattg

SEQ ID NO: 164323 - DNA, 24 bp, Artificial sequence
  SiRNA target sequence
tcatatcattaccacacaaattga

SEQ ID NO: 164324 - DNA, 24 bp, Artificial sequence
  SiRNA target sequence
catatcattaccacacaaattgaa

SEQ ID NO: 164325 - DNA, 24 bp, Artificial sequence
  SiRNA target sequence
atatcattaccacacaaattgaac

SEQ ID NO: 164326 - DNA, 24 bp, Artificial sequence
  SiRNA target sequence
tatcattaccacacaaattgaaca

SEQ ID NO: 164327 - DNA, 24 bp, Artificial sequence
  SiRNA target sequence
atcattaccacacaaattgaacat

SEQ ID NO: 164328 - DNA, 24 bp, Artificial sequence
  SiRNA target sequence
tcattaccacacaaattgaacata

SEQ ID NO: 164329 - DNA, 24 bp, Artificial sequence
  SiRNA target sequence
cattaccacacaaattgaacataa

SEQ ID NO: 164330 - DNA, 24 bp, Artificial sequence
  SiRNA target sequence
attaccacacaaattgaacataaa

SEQ ID NO: 164331 - DNA, 24 bp, Artificial sequence
  SiRNA target sequence
ttaccacacaaattgaacataaat

SEQ ID NO: 164332 - DNA, 24 bp, Artificial sequence
  SiRNA target sequence
taccacacaaattgaacataaatg

SEQ ID NO: 164333 - DNA, 24 bp, Artificial sequence
  SiRNA target sequence
accacacaaattgaacataaatgt

SEQ ID NO: 164334 - DNA, 24 bp, Artificial sequence
  SiRNA target sequence
ccacacaaattgaacataaatgtg

SEQ ID NO: 164335 - DNA, 24 bp, Artificial sequence
  SiRNA target sequence
cacacaaattgaacataaatgtgt

SEQ ID NO: 164336 - DNA, 24 bp, Artificial sequence
  SiRNA target sequence
acacaaattgaacataaatgtgta

SEQ ID NO: 164337 - DNA, 24 bp, Artificial sequence
  SiRNA target sequence
cacaaattgaacataaatgtgtat

SEQ ID NO: 164338 - DNA, 24 bp, Artificial sequence
  SiRNA target sequence
acaaattgaacataaatgtgtatt

SEQ ID NO: 164339 - DNA, 24 bp, Artificial sequence
  SiRNA target sequence
caaattgaacataaatgtgtattg

SEQ ID NO: 164340 - DNA, 24 bp, Artificial sequence
  SiRNA target sequence
aaattgaacataaatgtgtattgg

SEQ ID NO: 164341 - DNA, 24 bp, Artificial sequence
  SiRNA target sequence
aattgaacataaatgtgtattgga

SEQ ID NO: 164342 - DNA, 24 bp, Artificial sequence
  SiRNA target sequence
attgaacataaatgtgtattggac

SEQ ID NO: 164343 - DNA, 24 bp, Artificial sequence
  SiRNA target sequence
ttgaacataaatgtgtattggaca

SEQ ID NO: 164344 - DNA, 24 bp, Artificial sequence
  SiRNA target sequence
tgaacataaatgtgtattggacac

SEQ ID NO: 164345 - DNA, 24 bp, Artificial sequence
  SiRNA target sequence
gaacataaatgtgtattggacaca

SEQ ID NO: 164346 - DNA, 24 bp, Artificial sequence
  SiRNA target sequence
aacataaatgtgtattggacacat

SEQ ID NO: 164347 - DNA, 24 bp, Artificial sequence
  SiRNA target sequence
acataaatgtgtattggacacatg

SEQ ID NO: 164348 - DNA, 24 bp, Artificial sequence
  SiRNA target sequence
cataaatgtgtattggacacatgt

SEQ ID NO: 164349 - DNA, 24 bp, Artificial sequence
  SiRNA target sequence
ataaatgtgtattggacacatgta

SEQ ID NO: 164350 - DNA, 24 bp, Artificial sequence
  SiRNA target sequence
taaatgtgtattggacacatgtag

SEQ ID NO: 164351 - DNA, 24 bp, Artificial sequence
  SiRNA target sequence
aaatgtgtattggacacatgtaga

SEQ ID NO: 164352 - DNA, 24 bp, Artificial sequence
  SiRNA target sequence
aatgtgtattggacacatgtagaa

SEQ ID NO: 164353 - DNA, 24 bp, Artificial sequence
  SiRNA target sequence
atgtgtattggacacatgtagaag

SEQ ID NO: 164354 - DNA, 24 bp, Artificial sequence
  SiRNA target sequence
tgtgtattggacacatgtagaaga

SEQ ID NO: 164355 - DNA, 24 bp, Artificial sequence
  SiRNA target sequence
gtgtattggacacatgtagaagat

SEQ ID NO: 164356 - DNA, 24 bp, Artificial sequence
  SiRNA target sequence
tgtattggacacatgtagaagatt

SEQ ID NO: 164357 - DNA, 24 bp, Artificial sequence
  SiRNA target sequence
gtattggacacatgtagaagatta

SEQ ID NO: 164358 - DNA, 24 bp, Artificial sequence
  SiRNA target sequence
tattggacacatgtagaagattag

SEQ ID NO: 164359 - DNA, 24 bp, Artificial sequence
  SiRNA target sequence
attggacacatgtagaagattaga

SEQ ID NO: 164360 - DNA, 24 bp, Artificial sequence
  SiRNA target sequence
ttggacacatgtagaagattagaa

SEQ ID NO: 164361 - DNA, 24 bp, Artificial sequence
  SiRNA target sequence
tggacacatgtagaagattagaag

SEQ ID NO: 164362 - DNA, 24 bp, Artificial sequence
  SiRNA target sequence
ggacacatgtagaagattagaaga

SEQ ID NO: 164363 - DNA, 24 bp, Artificial sequence
  SiRNA target sequence
gacacatgtagaagattagaagaa

SEQ ID NO: 164364 - DNA, 24 bp, Artificial sequence
  SiRNA target sequence
acacatgtagaagattagaagaag

SEQ ID NO: 164365 - DNA, 24 bp, Artificial sequence
  SiRNA target sequence
cacatgtagaagattagaagaaga

SEQ ID NO: 164366 - DNA, 24 bp, Artificial sequence
  SiRNA target sequence
acatgtagaagattagaagaagaa

SEQ ID NO: 164367 - DNA, 24 bp, Artificial sequence
  SiRNA target sequence
catgtagaagattagaagaagaag

SEQ ID NO: 164368 - DNA, 24 bp, Artificial sequence
  SiRNA target sequence
atgtagaagattagaagaagaagg

SEQ ID NO: 164369 - DNA, 24 bp, Artificial sequence
  SiRNA target sequence
tgtagaagattagaagaagaagga

SEQ ID NO: 164370 - DNA, 24 bp, Artificial sequence
  SiRNA target sequence
gtagaagattagaagaagaaggag

SEQ ID NO: 164371 - DNA, 24 bp, Artificial sequence
  SiRNA target sequence
tagaagattagaagaagaaggagc

SEQ ID NO: 164372 - DNA, 24 bp, Artificial sequence
  SiRNA target sequence
agaagattagaagaagaaggagct

SEQ ID NO: 164373 - DNA, 24 bp, Artificial sequence
  SiRNA target sequence
gaagattagaagaagaaggagcta

SEQ ID NO: 164374 - DNA, 24 bp, Artificial sequence
  SiRNA target sequence
aagattagaagaagaaggagctac

SEQ ID NO: 164375 - DNA, 24 bp, Artificial sequence
  SiRNA target sequence
agattagaagaagaaggagctaca

SEQ ID NO: 164376 - DNA, 24 bp, Artificial sequence
  SiRNA target sequence
gattagaagaagaaggagctacag

SEQ ID NO: 164377 - DNA, 24 bp, Artificial sequence
  SiRNA target sequence
attagaagaagaaggagctacagt

SEQ ID NO: 164378 - DNA, 24 bp, Artificial sequence
  SiRNA target sequence
ttagaagaagaaggagctacagtg

SEQ ID NO: 164379 - DNA, 24 bp, Artificial sequence
  SiRNA target sequence
tagaagaagaaggagctacagtga

SEQ ID NO: 164380 - DNA, 24 bp, Artificial sequence
  SiRNA target sequence
agaagaagaaggagctacagtgac

SEQ ID NO: 164381 - DNA, 24 bp, Artificial sequence
  SiRNA target sequence
gaagaagaaggagctacagtgact

SEQ ID NO: 164382 - DNA, 24 bp, Artificial sequence
  SiRNA target sequence
aagaagaaggagctacagtgactt

SEQ ID NO: 164383 - DNA, 24 bp, Artificial sequence
  SiRNA target sequence
agaagaaggagctacagtgactta

SEQ ID NO: 164384 - DNA, 24 bp, Artificial sequence
  SiRNA target sequence
gaagaaggagctacagtgacttat

SEQ ID NO: 164385 - DNA, 24 bp, Artificial sequence
  SiRNA target sequence
aagaaggagctacagtgacttatt

SEQ ID NO: 164386 - DNA, 24 bp, Artificial sequence
  SiRNA target sequence
agaaggagctacagtgacttattt

SEQ ID NO: 164387 - DNA, 24 bp, Artificial sequence
  SiRNA target sequence
gaaggagctacagtgacttatttg

SEQ ID NO: 164388 - DNA, 24 bp, Artificial sequence
  SiRNA target sequence
aaggagctacagtgacttatttgc

SEQ ID NO: 164389 - DNA, 24 bp, Artificial sequence
  SiRNA target sequence
aggagctacagtgacttatttgcc

SEQ ID NO: 164390 - DNA, 24 bp, Artificial sequence
  SiRNA target sequence
ggagctacagtgacttatttgcct

SEQ ID NO: 164391 - DNA, 24 bp, Artificial sequence
  SiRNA target sequence
gagctacagtgacttatttgcctg

SEQ ID NO: 164392 - DNA, 24 bp, Artificial sequence
  SiRNA target sequence
agctacagtgacttatttgcctgt

SEQ ID NO: 164393 - DNA, 24 bp, Artificial sequence
  SiRNA target sequence
gctacagtgacttatttgcctgta

SEQ ID NO: 164394 - DNA, 24 bp, Artificial sequence
  SiRNA target sequence
ctacagtgacttatttgcctgtag

SEQ ID NO: 164395 - DNA, 24 bp, Artificial sequence
  SiRNA target sequence
tacagtgacttatttgcctgtaga

SEQ ID NO: 164396 - DNA, 24 bp, Artificial sequence
  SiRNA target sequence
acagtgacttatttgcctgtagat

SEQ ID NO: 164397 - DNA, 24 bp, Artificial sequence
  SiRNA target sequence
cagtgacttatttgcctgtagata

SEQ ID NO: 164398 - DNA, 24 bp, Artificial sequence
  SiRNA target sequence
agtgacttatttgcctgtagataa

SEQ ID NO: 164399 - DNA, 24 bp, Artificial sequence
  SiRNA target sequence
gtgacttatttgcctgtagataaa

SEQ ID NO: 164400 - DNA, 24 bp, Artificial sequence
  SiRNA target sequence
tgacttatttgcctgtagataaaa

SEQ ID NO: 164401 - DNA, 24 bp, Artificial sequence
  SiRNA target sequence
gacttatttgcctgtagataaaaa

SEQ ID NO: 164402 - DNA, 24 bp, Artificial sequence
  SiRNA target sequence
acttatttgcctgtagataaaaat

SEQ ID NO: 164403 - DNA, 24 bp, Artificial sequence
  SiRNA target sequence
cttatttgcctgtagataaaaatg

SEQ ID NO: 164404 - DNA, 24 bp, Artificial sequence
  SiRNA target sequence
ttatttgcctgtagataaaaatgg

SEQ ID NO: 164405 - DNA, 24 bp, Artificial sequence
  SiRNA target sequence
tatttgcctgtagataaaaatgga

SEQ ID NO: 164406 - DNA, 24 bp, Artificial sequence
  SiRNA target sequence
atttgcctgtagataaaaatggaa

SEQ ID NO: 164407 - DNA, 24 bp, Artificial sequence
  SiRNA target sequence
tttgcctgtagataaaaatggaat

SEQ ID NO: 164408 - DNA, 24 bp, Artificial sequence
  SiRNA target sequence
ttgcctgtagataaaaatggaata

SEQ ID NO: 164409 - DNA, 24 bp, Artificial sequence
  SiRNA target sequence
tgcctgtagataaaaatggaatag

SEQ ID NO: 164410 - DNA, 24 bp, Artificial sequence
  SiRNA target sequence
gcctgtagataaaaatggaatagt

SEQ ID NO: 164411 - DNA, 24 bp, Artificial sequence
  SiRNA target sequence
cctgtagataaaaatggaatagta

SEQ ID NO: 164412 - DNA, 24 bp, Artificial sequence
  SiRNA target sequence
ctgtagataaaaatggaatagtag

SEQ ID NO: 164413 - DNA, 24 bp, Artificial sequence
  SiRNA target sequence
tgtagataaaaatggaatagtaga

SEQ ID NO: 164414 - DNA, 24 bp, Artificial sequence
  SiRNA target sequence
gtagataaaaatggaatagtagat

SEQ ID NO: 164415 - DNA, 24 bp, Artificial sequence
  SiRNA target sequence
tagataaaaatggaatagtagatc

SEQ ID NO: 164416 - DNA, 24 bp, Artificial sequence
  SiRNA target sequence
agataaaaatggaatagtagatcc

SEQ ID NO: 164417 - DNA, 24 bp, Artificial sequence
  SiRNA target sequence
gataaaaatggaatagtagatccg

SEQ ID NO: 164418 - DNA, 24 bp, Artificial sequence
  SiRNA target sequence
ataaaaatggaatagtagatccgc

SEQ ID NO: 164419 - DNA, 24 bp, Artificial sequence
  SiRNA target sequence
taaaaatggaatagtagatccgca

SEQ ID NO: 164420 - DNA, 24 bp, Artificial sequence
  SiRNA target sequence
aaaaatggaatagtagatccgcaa

SEQ ID NO: 164421 - DNA, 24 bp, Artificial sequence
  SiRNA target sequence
aaaatggaatagtagatccgcaat

SEQ ID NO: 164422 - DNA, 24 bp, Artificial sequence
  SiRNA target sequence
aaatggaatagtagatccgcaatt

SEQ ID NO: 164423 - DNA, 24 bp, Artificial sequence
  SiRNA target sequence
aatggaatagtagatccgcaatta

SEQ ID NO: 164424 - DNA, 24 bp, Artificial sequence
  SiRNA target sequence
atggaatagtagatccgcaattaa

SEQ ID NO: 164425 - DNA, 24 bp, Artificial sequence
  SiRNA target sequence
tggaatagtagatccgcaattaat

SEQ ID NO: 164426 - DNA, 24 bp, Artificial sequence
  SiRNA target sequence
ggaatagtagatccgcaattaata

SEQ ID NO: 164427 - DNA, 24 bp, Artificial sequence
  SiRNA target sequence
gaatagtagatccgcaattaataa

SEQ ID NO: 164428 - DNA, 24 bp, Artificial sequence
  SiRNA target sequence
aatagtagatccgcaattaataaa

SEQ ID NO: 164429 - DNA, 24 bp, Artificial sequence
  SiRNA target sequence
atagtagatccgcaattaataaaa

SEQ ID NO: 164430 - DNA, 24 bp, Artificial sequence
  SiRNA target sequence
tagtagatccgcaattaataaaaa

SEQ ID NO: 164431 - DNA, 24 bp, Artificial sequence
  SiRNA target sequence
agtagatccgcaattaataaaaaa

SEQ ID NO: 164432 - DNA, 24 bp, Artificial sequence
  SiRNA target sequence
gtagatccgcaattaataaaaaac

SEQ ID NO: 164433 - DNA, 24 bp, Artificial sequence
  SiRNA target sequence
tagatccgcaattaataaaaaaca

SEQ ID NO: 164434 - DNA, 24 bp, Artificial sequence
  SiRNA target sequence
agatccgcaattaataaaaaacag

SEQ ID NO: 164435 - DNA, 24 bp, Artificial sequence
  SiRNA target sequence
gatccgcaattaataaaaaacagt

SEQ ID NO: 164436 - DNA, 24 bp, Artificial sequence
  SiRNA target sequence
atccgcaattaataaaaaacagta

SEQ ID NO: 164437 - DNA, 24 bp, Artificial sequence
  SiRNA target sequence
tccgcaattaataaaaaacagtat

SEQ ID NO: 164438 - DNA, 24 bp, Artificial sequence
  SiRNA target sequence
ccgcaattaataaaaaacagtatt

SEQ ID NO: 164439 - DNA, 24 bp, Artificial sequence
  SiRNA target sequence
cgcaattaataaaaaacagtatta

SEQ ID NO: 164440 - DNA, 24 bp, Artificial sequence
  SiRNA target sequence
gcaattaataaaaaacagtattac

SEQ ID NO: 164441 - DNA, 24 bp, Artificial sequence
  SiRNA target sequence
caattaataaaaaacagtattact

SEQ ID NO: 164442 - DNA, 24 bp, Artificial sequence
  SiRNA target sequence
aattaataaaaaacagtattacta

SEQ ID NO: 164443 - DNA, 24 bp, Artificial sequence
  SiRNA target sequence
attaataaaaaacagtattactaa

SEQ ID NO: 164444 - DNA, 24 bp, Artificial sequence
  SiRNA target sequence
ttaataaaaaacagtattactaaa

SEQ ID NO: 164445 - DNA, 24 bp, Artificial sequence
  SiRNA target sequence
taataaaaaacagtattactaaag

SEQ ID NO: 164446 - DNA, 24 bp, Artificial sequence
  SiRNA target sequence
aataaaaaacagtattactaaaga

SEQ ID NO: 164447 - DNA, 24 bp, Artificial sequence
  SiRNA target sequence
ataaaaaacagtattactaaagat

SEQ ID NO: 164448 - DNA, 24 bp, Artificial sequence
  SiRNA target sequence
taaaaaacagtattactaaagata

SEQ ID NO: 164449 - DNA, 24 bp, Artificial sequence
  SiRNA target sequence
aaaaaacagtattactaaagatac

SEQ ID NO: 164450 - DNA, 24 bp, Artificial sequence
  SiRNA target sequence
aaaaacagtattactaaagatacc

SEQ ID NO: 164451 - DNA, 24 bp, Artificial sequence
  SiRNA target sequence
aaaacagtattactaaagataccg

SEQ ID NO: 164452 - DNA, 24 bp, Artificial sequence
  SiRNA target sequence
aaacagtattactaaagataccgc

SEQ ID NO: 164453 - DNA, 24 bp, Artificial sequence
  SiRNA target sequence
aacagtattactaaagataccgct

SEQ ID NO: 164454 - DNA, 24 bp, Artificial sequence
  SiRNA target sequence
acagtattactaaagataccgctt

SEQ ID NO: 164455 - DNA, 24 bp, Artificial sequence
  SiRNA target sequence
cagtattactaaagataccgcttt

SEQ ID NO: 164456 - DNA, 24 bp, Artificial sequence
  SiRNA target sequence
agtattactaaagataccgctttg

SEQ ID NO: 164457 - DNA, 24 bp, Artificial sequence
  SiRNA target sequence
gtattactaaagataccgctttgg

SEQ ID NO: 164458 - DNA, 24 bp, Artificial sequence
  SiRNA target sequence
tattactaaagataccgctttggt

SEQ ID NO: 164459 - DNA, 24 bp, Artificial sequence
  SiRNA target sequence
attactaaagataccgctttggtg

SEQ ID NO: 164460 - DNA, 24 bp, Artificial sequence
  SiRNA target sequence
ttactaaagataccgctttggtgt

SEQ ID NO: 164461 - DNA, 24 bp, Artificial sequence
  SiRNA target sequence
tactaaagataccgctttggtgtc

SEQ ID NO: 164462 - DNA, 24 bp, Artificial sequence
  SiRNA target sequence
actaaagataccgctttggtgtct

SEQ ID NO: 164463 - DNA, 24 bp, Artificial sequence
  SiRNA target sequence
ctaaagataccgctttggtgtctg

SEQ ID NO: 164464 - DNA, 24 bp, Artificial sequence
  SiRNA target sequence
taaagataccgctttggtgtctgt

SEQ ID NO: 164465 - DNA, 24 bp, Artificial sequence
  SiRNA target sequence
aaagataccgctttggtgtctgtt

SEQ ID NO: 164466 - DNA, 24 bp, Artificial sequence
  SiRNA target sequence
aagataccgctttggtgtctgtta

SEQ ID NO: 164467 - DNA, 24 bp, Artificial sequence
  SiRNA target sequence
agataccgctttggtgtctgttat

SEQ ID NO: 164468 - DNA, 24 bp, Artificial sequence
  SiRNA target sequence
gataccgctttggtgtctgttatg

SEQ ID NO: 164469 - DNA, 24 bp, Artificial sequence
  SiRNA target sequence
ataccgctttggtgtctgttatgg

SEQ ID NO: 164470 - DNA, 24 bp, Artificial sequence
  SiRNA target sequence
taccgctttggtgtctgttatggc

SEQ ID NO: 164471 - DNA, 24 bp, Artificial sequence
  SiRNA target sequence
accgctttggtgtctgttatggct

SEQ ID NO: 164472 - DNA, 24 bp, Artificial sequence
  SiRNA target sequence
ccgctttggtgtctgttatggctg

SEQ ID NO: 164473 - DNA, 24 bp, Artificial sequence
  SiRNA target sequence
cgctttggtgtctgttatggctgt

SEQ ID NO: 164474 - DNA, 24 bp, Artificial sequence
  SiRNA target sequence
gctttggtgtctgttatggctgtt

SEQ ID NO: 164475 - DNA, 24 bp, Artificial sequence
  SiRNA target sequence
ctttggtgtctgttatggctgtta

SEQ ID NO: 164476 - DNA, 24 bp, Artificial sequence
  SiRNA target sequence
tttggtgtctgttatggctgttaa

SEQ ID NO: 164477 - DNA, 24 bp, Artificial sequence
  SiRNA target sequence
ttggtgtctgttatggctgttaac

SEQ ID NO: 164478 - DNA, 24 bp, Artificial sequence
  SiRNA target sequence
tggtgtctgttatggctgttaaca

SEQ ID NO: 164479 - DNA, 24 bp, Artificial sequence
  SiRNA target sequence
ggtgtctgttatggctgttaacaa

SEQ ID NO: 164480 - DNA, 24 bp, Artificial sequence
  SiRNA target sequence
gtgtctgttatggctgttaacaac

SEQ ID NO: 164481 - DNA, 24 bp, Artificial sequence
  SiRNA target sequence
tgtctgttatggctgttaacaacg

SEQ ID NO: 164482 - DNA, 24 bp, Artificial sequence
  SiRNA target sequence
gtctgttatggctgttaacaacga

SEQ ID NO: 164483 - DNA, 24 bp, Artificial sequence
  SiRNA target sequence
tctgttatggctgttaacaacgaa

SEQ ID NO: 164484 - DNA, 24 bp, Artificial sequence
  SiRNA target sequence
ctgttatggctgttaacaacgaaa

SEQ ID NO: 164485 - DNA, 24 bp, Artificial sequence
  SiRNA target sequence
tgttatggctgttaacaacgaaat

SEQ ID NO: 164486 - DNA, 24 bp, Artificial sequence
  SiRNA target sequence
gttatggctgttaacaacgaaatg

SEQ ID NO: 164487 - DNA, 24 bp, Artificial sequence
  SiRNA target sequence
ttatggctgttaacaacgaaatgg

SEQ ID NO: 164488 - DNA, 24 bp, Artificial sequence
  SiRNA target sequence
tatggctgttaacaacgaaatggg

SEQ ID NO: 164489 - DNA, 24 bp, Artificial sequence
  SiRNA target sequence
atggctgttaacaacgaaatggga

SEQ ID NO: 164490 - DNA, 24 bp, Artificial sequence
  SiRNA target sequence
tggctgttaacaacgaaatgggag

SEQ ID NO: 164491 - DNA, 24 bp, Artificial sequence
  SiRNA target sequence
ggctgttaacaacgaaatgggagc

SEQ ID NO: 164492 - DNA, 24 bp, Artificial sequence
  SiRNA target sequence
gctgttaacaacgaaatgggagca

SEQ ID NO: 164493 - DNA, 24 bp, Artificial sequence
  SiRNA target sequence
ctgttaacaacgaaatgggagcaa

SEQ ID NO: 164494 - DNA, 24 bp, Artificial sequence
  SiRNA target sequence
tgttaacaacgaaatgggagcaat

SEQ ID NO: 164495 - DNA, 24 bp, Artificial sequence
  SiRNA target sequence
gttaacaacgaaatgggagcaata

SEQ ID NO: 164496 - DNA, 24 bp, Artificial sequence
  SiRNA target sequence
ttaacaacgaaatgggagcaatac

SEQ ID NO: 164497 - DNA, 24 bp, Artificial sequence
  SiRNA target sequence
taacaacgaaatgggagcaataca

SEQ ID NO: 164498 - DNA, 24 bp, Artificial sequence
  SiRNA target sequence
aacaacgaaatgggagcaatacaa

SEQ ID NO: 164499 - DNA, 24 bp, Artificial sequence
  SiRNA target sequence
acaacgaaatgggagcaatacaac

SEQ ID NO: 164500 - DNA, 24 bp, Artificial sequence
  SiRNA target sequence
caacgaaatgggagcaatacaacc

SEQ ID NO: 164501 - DNA, 24 bp, Artificial sequence
  SiRNA target sequence
aacgaaatgggagcaatacaaccg

SEQ ID NO: 164502 - DNA, 24 bp, Artificial sequence
  SiRNA target sequence
acgaaatgggagcaatacaaccgc

SEQ ID NO: 164503 - DNA, 24 bp, Artificial sequence
  SiRNA target sequence
cgaaatgggagcaatacaaccgct

SEQ ID NO: 164504 - DNA, 24 bp, Artificial sequence
  SiRNA target sequence
gaaatgggagcaatacaaccgctt

SEQ ID NO: 164505 - DNA, 24 bp, Artificial sequence
  SiRNA target sequence
aaatgggagcaatacaaccgctta

SEQ ID NO: 164506 - DNA, 24 bp, Artificial sequence
  SiRNA target sequence
aatgggagcaatacaaccgcttaa

SEQ ID NO: 164507 - DNA, 24 bp, Artificial sequence
  SiRNA target sequence
atgggagcaatacaaccgcttaaa

SEQ ID NO: 164508 - DNA, 24 bp, Artificial sequence
  SiRNA target sequence
tgggagcaatacaaccgcttaaag

SEQ ID NO: 164509 - DNA, 24 bp, Artificial sequence
  SiRNA target sequence
gggagcaatacaaccgcttaaaga

SEQ ID NO: 164510 - DNA, 24 bp, Artificial sequence
  SiRNA target sequence
ggagcaatacaaccgcttaaagaa

SEQ ID NO: 164511 - DNA, 24 bp, Artificial sequence
  SiRNA target sequence
gagcaatacaaccgcttaaagaaa

SEQ ID NO: 164512 - DNA, 24 bp, Artificial sequence
  SiRNA target sequence
agcaatacaaccgcttaaagaaat

SEQ ID NO: 164513 - DNA, 24 bp, Artificial sequence
  SiRNA target sequence
gcaatacaaccgcttaaagaaata

SEQ ID NO: 164514 - DNA, 24 bp, Artificial sequence
  SiRNA target sequence
caatacaaccgcttaaagaaatag

SEQ ID NO: 164515 - DNA, 24 bp, Artificial sequence
  SiRNA target sequence
aatacaaccgcttaaagaaatagg

SEQ ID NO: 164516 - DNA, 24 bp, Artificial sequence
  SiRNA target sequence
atacaaccgcttaaagaaatagga

SEQ ID NO: 164517 - DNA, 24 bp, Artificial sequence
  SiRNA target sequence
tacaaccgcttaaagaaataggaa

SEQ ID NO: 164518 - DNA, 24 bp, Artificial sequence
  SiRNA target sequence
acaaccgcttaaagaaataggaag

SEQ ID NO: 164519 - DNA, 24 bp, Artificial sequence
  SiRNA target sequence
caaccgcttaaagaaataggaaga

SEQ ID NO: 164520 - DNA, 24 bp, Artificial sequence
  SiRNA target sequence
aaccgcttaaagaaataggaagaa

SEQ ID NO: 164521 - DNA, 24 bp, Artificial sequence
  SiRNA target sequence
accgcttaaagaaataggaagaat

SEQ ID NO: 164522 - DNA, 24 bp, Artificial sequence
  SiRNA target sequence
ccgcttaaagaaataggaagaata

SEQ ID NO: 164523 - DNA, 24 bp, Artificial sequence
  SiRNA target sequence
cgcttaaagaaataggaagaatat

SEQ ID NO: 164524 - DNA, 24 bp, Artificial sequence
  SiRNA target sequence
gcttaaagaaataggaagaatatg

SEQ ID NO: 164525 - DNA, 24 bp, Artificial sequence
  SiRNA target sequence
cttaaagaaataggaagaatatgt

SEQ ID NO: 164526 - DNA, 24 bp, Artificial sequence
  SiRNA target sequence
ttaaagaaataggaagaatatgta

SEQ ID NO: 164527 - DNA, 24 bp, Artificial sequence
  SiRNA target sequence
taaagaaataggaagaatatgtaa

SEQ ID NO: 164528 - DNA, 24 bp, Artificial sequence
  SiRNA target sequence
aaagaaataggaagaatatgtaaa

SEQ ID NO: 164529 - DNA, 24 bp, Artificial sequence
  SiRNA target sequence
aagaaataggaagaatatgtaaag

SEQ ID NO: 164530 - DNA, 24 bp, Artificial sequence
  SiRNA target sequence
agaaataggaagaatatgtaaaga

SEQ ID NO: 164531 - DNA, 24 bp, Artificial sequence
  SiRNA target sequence
gaaataggaagaatatgtaaagaa

SEQ ID NO: 164532 - DNA, 24 bp, Artificial sequence
  SiRNA target sequence
aaataggaagaatatgtaaagaaa

SEQ ID NO: 164533 - DNA, 24 bp, Artificial sequence
  SiRNA target sequence
aataggaagaatatgtaaagaaaa

SEQ ID NO: 164534 - DNA, 24 bp, Artificial sequence
  SiRNA target sequence
ataggaagaatatgtaaagaaaat

SEQ ID NO: 164535 - DNA, 24 bp, Artificial sequence
  SiRNA target sequence
taggaagaatatgtaaagaaaata

SEQ ID NO: 164536 - DNA, 24 bp, Artificial sequence
  SiRNA target sequence
aggaagaatatgtaaagaaaataa

SEQ ID NO: 164537 - DNA, 24 bp, Artificial sequence
  SiRNA target sequence
ggaagaatatgtaaagaaaataat

SEQ ID NO: 164538 - DNA, 24 bp, Artificial sequence
  SiRNA target sequence
gaagaatatgtaaagaaaataata

SEQ ID NO: 164539 - DNA, 24 bp, Artificial sequence
  SiRNA target sequence
aagaatatgtaaagaaaataatat

SEQ ID NO: 164540 - DNA, 24 bp, Artificial sequence
  SiRNA target sequence
agaatatgtaaagaaaataatatt

SEQ ID NO: 164541 - DNA, 24 bp, Artificial sequence
  SiRNA target sequence
gaatatgtaaagaaaataatattt

SEQ ID NO: 164542 - DNA, 24 bp, Artificial sequence
  SiRNA target sequence
aatatgtaaagaaaataatatttt

SEQ ID NO: 164543 - DNA, 24 bp, Artificial sequence
  SiRNA target sequence
atatgtaaagaaaataatatttta

SEQ ID NO: 164544 - DNA, 24 bp, Artificial sequence
  SiRNA target sequence
tatgtaaagaaaataatattttat

SEQ ID NO: 164545 - DNA, 24 bp, Artificial sequence
  SiRNA target sequence
atgtaaagaaaataatattttatt

SEQ ID NO: 164546 - DNA, 24 bp, Artificial sequence
  SiRNA target sequence
tgtaaagaaaataatattttattt

SEQ ID NO: 164547 - DNA, 24 bp, Artificial sequence
  SiRNA target sequence
gtaaagaaaataatattttatttc

SEQ ID NO: 164548 - DNA, 24 bp, Artificial sequence
  SiRNA target sequence
taaagaaaataatattttatttca

SEQ ID NO: 164549 - DNA, 24 bp, Artificial sequence
  SiRNA target sequence
aaagaaaataatattttatttcac

SEQ ID NO: 164550 - DNA, 24 bp, Artificial sequence
  SiRNA target sequence
aagaaaataatattttatttcaca

SEQ ID NO: 164551 - DNA, 24 bp, Artificial sequence
  SiRNA target sequence
agaaaataatattttatttcacac

SEQ ID NO: 164552 - DNA, 24 bp, Artificial sequence
  SiRNA target sequence
gaaaataatattttatttcacact

SEQ ID NO: 164553 - DNA, 24 bp, Artificial sequence
  SiRNA target sequence
aaaataatattttatttcacactg

SEQ ID NO: 164554 - DNA, 24 bp, Artificial sequence
  SiRNA target sequence
aaataatattttatttcacactga

SEQ ID NO: 164555 - DNA, 24 bp, Artificial sequence
  SiRNA target sequence
aataatattttatttcacactgat

SEQ ID NO: 164556 - DNA, 24 bp, Artificial sequence
  SiRNA target sequence
ataatattttatttcacactgatg

SEQ ID NO: 164557 - DNA, 24 bp, Artificial sequence
  SiRNA target sequence
taatattttatttcacactgatgc

SEQ ID NO: 164558 - DNA, 24 bp, Artificial sequence
  SiRNA target sequence
aatattttatttcacactgatgca

SEQ ID NO: 164559 - DNA, 24 bp, Artificial sequence
  SiRNA target sequence
atattttatttcacactgatgcag

SEQ ID NO: 164560 - DNA, 24 bp, Artificial sequence
  SiRNA target sequence
tattttatttcacactgatgcagc

SEQ ID NO: 164561 - DNA, 24 bp, Artificial sequence
  SiRNA target sequence
attttatttcacactgatgcagca

SEQ ID NO: 164562 - DNA, 24 bp, Artificial sequence
  SiRNA target sequence
ttttatttcacactgatgcagcac

SEQ ID NO: 164563 - DNA, 24 bp, Artificial sequence
  SiRNA target sequence
tttatttcacactgatgcagcaca

SEQ ID NO: 164564 - DNA, 24 bp, Artificial sequence
  SiRNA target sequence
ttatttcacactgatgcagcacaa

SEQ ID NO: 164565 - DNA, 24 bp, Artificial sequence
  SiRNA target sequence
tatttcacactgatgcagcacaag

SEQ ID NO: 164566 - DNA, 24 bp, Artificial sequence
  SiRNA target sequence
atttcacactgatgcagcacaagc

SEQ ID NO: 164567 - DNA, 24 bp, Artificial sequence
  SiRNA target sequence
tttcacactgatgcagcacaagca

SEQ ID NO: 164568 - DNA, 24 bp, Artificial sequence
  SiRNA target sequence
ttcacactgatgcagcacaagcag

SEQ ID NO: 164569 - DNA, 24 bp, Artificial sequence
  SiRNA target sequence
tcacactgatgcagcacaagcagt

SEQ ID NO: 164570 - DNA, 24 bp, Artificial sequence
  SiRNA target sequence
cacactgatgcagcacaagcagtt

SEQ ID NO: 164571 - DNA, 24 bp, Artificial sequence
  SiRNA target sequence
acactgatgcagcacaagcagttg

SEQ ID NO: 164572 - DNA, 24 bp, Artificial sequence
  SiRNA target sequence
cactgatgcagcacaagcagttgg

SEQ ID NO: 164573 - DNA, 24 bp, Artificial sequence
  SiRNA target sequence
actgatgcagcacaagcagttggt

SEQ ID NO: 164574 - DNA, 24 bp, Artificial sequence
  SiRNA target sequence
ctgatgcagcacaagcagttggta

SEQ ID NO: 164575 - DNA, 24 bp, Artificial sequence
  SiRNA target sequence
tgatgcagcacaagcagttggtaa

SEQ ID NO: 164576 - DNA, 24 bp, Artificial sequence
  SiRNA target sequence
gatgcagcacaagcagttggtaat

SEQ ID NO: 164577 - DNA, 24 bp, Artificial sequence
  SiRNA target sequence
atgcagcacaagcagttggtaata

SEQ ID NO: 164578 - DNA, 24 bp, Artificial sequence
  SiRNA target sequence
tgcagcacaagcagttggtaatat

SEQ ID NO: 164579 - DNA, 24 bp, Artificial sequence
  SiRNA target sequence
gcagcacaagcagttggtaatata

SEQ ID NO: 164580 - DNA, 24 bp, Artificial sequence
  SiRNA target sequence
cagcacaagcagttggtaatatag

SEQ ID NO: 164581 - DNA, 24 bp, Artificial sequence
  SiRNA target sequence
agcacaagcagttggtaatataga

SEQ ID NO: 164582 - DNA, 24 bp, Artificial sequence
  SiRNA target sequence
gcacaagcagttggtaatatagat

SEQ ID NO: 164583 - DNA, 24 bp, Artificial sequence
  SiRNA target sequence
cacaagcagttggtaatatagata

SEQ ID NO: 164584 - DNA, 24 bp, Artificial sequence
  SiRNA target sequence
acaagcagttggtaatatagatat

SEQ ID NO: 164585 - DNA, 24 bp, Artificial sequence
  SiRNA target sequence
caagcagttggtaatatagatatt

SEQ ID NO: 164586 - DNA, 24 bp, Artificial sequence
  SiRNA target sequence
aagcagttggtaatatagatattg

SEQ ID NO: 164587 - DNA, 24 bp, Artificial sequence
  SiRNA target sequence
agcagttggtaatatagatattga

SEQ ID NO: 164588 - DNA, 24 bp, Artificial sequence
  SiRNA target sequence
gcagttggtaatatagatattgat

SEQ ID NO: 164589 - DNA, 24 bp, Artificial sequence
  SiRNA target sequence
cagttggtaatatagatattgatg

SEQ ID NO: 164590 - DNA, 24 bp, Artificial sequence
  SiRNA target sequence
agttggtaatatagatattgatgt

SEQ ID NO: 164591 - DNA, 24 bp, Artificial sequence
  SiRNA target sequence
gttggtaatatagatattgatgtc

SEQ ID NO: 164592 - DNA, 24 bp, Artificial sequence
  SiRNA target sequence
ttggtaatatagatattgatgtca

SEQ ID NO: 164593 - DNA, 24 bp, Artificial sequence
  SiRNA target sequence
tggtaatatagatattgatgtcaa

SEQ ID NO: 164594 - DNA, 24 bp, Artificial sequence
  SiRNA target sequence
ggtaatatagatattgatgtcaat

SEQ ID NO: 164595 - DNA, 24 bp, Artificial sequence
  SiRNA target sequence
gtaatatagatattgatgtcaatg

SEQ ID NO: 164596 - DNA, 24 bp, Artificial sequence
  SiRNA target sequence
taatatagatattgatgtcaatga

SEQ ID NO: 164597 - DNA, 24 bp, Artificial sequence
  SiRNA target sequence
aatatagatattgatgtcaatgat

SEQ ID NO: 164598 - DNA, 24 bp, Artificial sequence
  SiRNA target sequence
atatagatattgatgtcaatgata

SEQ ID NO: 164599 - DNA, 24 bp, Artificial sequence
  SiRNA target sequence
tatagatattgatgtcaatgatat

SEQ ID NO: 164600 - DNA, 24 bp, Artificial sequence
  SiRNA target sequence
atagatattgatgtcaatgatatg

SEQ ID NO: 164601 - DNA, 24 bp, Artificial sequence
  SiRNA target sequence
tagatattgatgtcaatgatatga

SEQ ID NO: 164602 - DNA, 24 bp, Artificial sequence
  SiRNA target sequence
agatattgatgtcaatgatatgaa

SEQ ID NO: 164603 - DNA, 24 bp, Artificial sequence
  SiRNA target sequence
gatattgatgtcaatgatatgaat

SEQ ID NO: 164604 - DNA, 24 bp, Artificial sequence
  SiRNA target sequence
atattgatgtcaatgatatgaata

SEQ ID NO: 164605 - DNA, 24 bp, Artificial sequence
  SiRNA target sequence
tattgatgtcaatgatatgaatat

SEQ ID NO: 164606 - DNA, 24 bp, Artificial sequence
  SiRNA target sequence
attgatgtcaatgatatgaatatt

SEQ ID NO: 164607 - DNA, 24 bp, Artificial sequence
  SiRNA target sequence
ttgatgtcaatgatatgaatattg

SEQ ID NO: 164608 - DNA, 24 bp, Artificial sequence
  SiRNA target sequence
tgatgtcaatgatatgaatattga

SEQ ID NO: 164609 - DNA, 24 bp, Artificial sequence
  SiRNA target sequence
gatgtcaatgatatgaatattgat

SEQ ID NO: 164610 - DNA, 24 bp, Artificial sequence
  SiRNA target sequence
atgtcaatgatatgaatattgatt

SEQ ID NO: 164611 - DNA, 24 bp, Artificial sequence
  SiRNA target sequence
tgtcaatgatatgaatattgattt

SEQ ID NO: 164612 - DNA, 24 bp, Artificial sequence
  SiRNA target sequence
gtcaatgatatgaatattgattta

SEQ ID NO: 164613 - DNA, 24 bp, Artificial sequence
  SiRNA target sequence
tcaatgatatgaatattgatttac

SEQ ID NO: 164614 - DNA, 24 bp, Artificial sequence
  SiRNA target sequence
caatgatatgaatattgatttact

SEQ ID NO: 164615 - DNA, 24 bp, Artificial sequence
  SiRNA target sequence
aatgatatgaatattgatttacta

SEQ ID NO: 164616 - DNA, 24 bp, Artificial sequence
  SiRNA target sequence
atgatatgaatattgatttactaa

SEQ ID NO: 164617 - DNA, 24 bp, Artificial sequence
  SiRNA target sequence
tgatatgaatattgatttactaag

SEQ ID NO: 164618 - DNA, 24 bp, Artificial sequence
  SiRNA target sequence
gatatgaatattgatttactaagt

SEQ ID NO: 164619 - DNA, 24 bp, Artificial sequence
  SiRNA target sequence
atatgaatattgatttactaagtt

SEQ ID NO: 164620 - DNA, 24 bp, Artificial sequence
  SiRNA target sequence
tatgaatattgatttactaagttt

SEQ ID NO: 164621 - DNA, 24 bp, Artificial sequence
  SiRNA target sequence
atgaatattgatttactaagttta

SEQ ID NO: 164622 - DNA, 24 bp, Artificial sequence
  SiRNA target sequence
tgaatattgatttactaagtttat

SEQ ID NO: 164623 - DNA, 24 bp, Artificial sequence
  SiRNA target sequence
gaatattgatttactaagtttatc

SEQ ID NO: 164624 - DNA, 24 bp, Artificial sequence
  SiRNA target sequence
aatattgatttactaagtttatca

SEQ ID NO: 164625 - DNA, 24 bp, Artificial sequence
  SiRNA target sequence
atattgatttactaagtttatcaa

SEQ ID NO: 164626 - DNA, 24 bp, Artificial sequence
  SiRNA target sequence
tattgatttactaagtttatcaag

SEQ ID NO: 164627 - DNA, 24 bp, Artificial sequence
  SiRNA target sequence
attgatttactaagtttatcaagt

SEQ ID NO: 164628 - DNA, 24 bp, Artificial sequence
  SiRNA target sequence
ttgatttactaagtttatcaagtc

SEQ ID NO: 164629 - DNA, 24 bp, Artificial sequence
  SiRNA target sequence
tgatttactaagtttatcaagtca

SEQ ID NO: 164630 - DNA, 24 bp, Artificial sequence
  SiRNA target sequence
gatttactaagtttatcaagtcat

SEQ ID NO: 164631 - DNA, 24 bp, Artificial sequence
  SiRNA target sequence
atttactaagtttatcaagtcata

SEQ ID NO: 164632 - DNA, 24 bp, Artificial sequence
  SiRNA target sequence
tttactaagtttatcaagtcataa

SEQ ID NO: 164633 - DNA, 24 bp, Artificial sequence
  SiRNA target sequence
ttactaagtttatcaagtcataaa

SEQ ID NO: 164634 - DNA, 24 bp, Artificial sequence
  SiRNA target sequence
tactaagtttatcaagtcataaaa

SEQ ID NO: 164635 - DNA, 24 bp, Artificial sequence
  SiRNA target sequence
actaagtttatcaagtcataaaat

SEQ ID NO: 164636 - DNA, 24 bp, Artificial sequence
  SiRNA target sequence
ctaagtttatcaagtcataaaatt

SEQ ID NO: 164637 - DNA, 24 bp, Artificial sequence
  SiRNA target sequence
taagtttatcaagtcataaaattt

SEQ ID NO: 164638 - DNA, 24 bp, Artificial sequence
  SiRNA target sequence
aagtttatcaagtcataaaattta

SEQ ID NO: 164639 - DNA, 24 bp, Artificial sequence
  SiRNA target sequence
agtttatcaagtcataaaatttat

SEQ ID NO: 164640 - DNA, 24 bp, Artificial sequence
  SiRNA target sequence
gtttatcaagtcataaaatttatg

SEQ ID NO: 164641 - DNA, 24 bp, Artificial sequence
  SiRNA target sequence
tttatcaagtcataaaatttatgg

SEQ ID NO: 164642 - DNA, 24 bp, Artificial sequence
  SiRNA target sequence
ttatcaagtcataaaatttatggt

SEQ ID NO: 164643 - DNA, 24 bp, Artificial sequence
  SiRNA target sequence
tatcaagtcataaaatttatggtc

SEQ ID NO: 164644 - DNA, 24 bp, Artificial sequence
  SiRNA target sequence
atcaagtcataaaatttatggtcc

SEQ ID NO: 164645 - DNA, 24 bp, Artificial sequence
  SiRNA target sequence
tcaagtcataaaatttatggtcca

SEQ ID NO: 164646 - DNA, 24 bp, Artificial sequence
  SiRNA target sequence
caagtcataaaatttatggtccaa

SEQ ID NO: 164647 - DNA, 24 bp, Artificial sequence
  SiRNA target sequence
aagtcataaaatttatggtccaaa

SEQ ID NO: 164648 - DNA, 24 bp, Artificial sequence
  SiRNA target sequence
agtcataaaatttatggtccaaaa

SEQ ID NO: 164649 - DNA, 24 bp, Artificial sequence
  SiRNA target sequence
gtcataaaatttatggtccaaaag

SEQ ID NO: 164650 - DNA, 24 bp, Artificial sequence
  SiRNA target sequence
tcataaaatttatggtccaaaagg

SEQ ID NO: 164651 - DNA, 24 bp, Artificial sequence
  SiRNA target sequence
cataaaatttatggtccaaaaggt

SEQ ID NO: 164652 - DNA, 24 bp, Artificial sequence
  SiRNA target sequence
ataaaatttatggtccaaaaggtg

SEQ ID NO: 164653 - DNA, 24 bp, Artificial sequence
  SiRNA target sequence
taaaatttatggtccaaaaggtgt

SEQ ID NO: 164654 - DNA, 24 bp, Artificial sequence
  SiRNA target sequence
aaaatttatggtccaaaaggtgtt

SEQ ID NO: 164655 - DNA, 24 bp, Artificial sequence
  SiRNA target sequence
aaatttatggtccaaaaggtgttg

SEQ ID NO: 164656 - DNA, 24 bp, Artificial sequence
  SiRNA target sequence
aatttatggtccaaaaggtgttgg

SEQ ID NO: 164657 - DNA, 24 bp, Artificial sequence
  SiRNA target sequence
atttatggtccaaaaggtgttggt

SEQ ID NO: 164658 - DNA, 24 bp, Artificial sequence
  SiRNA target sequence
tttatggtccaaaaggtgttggtg

SEQ ID NO: 164659 - DNA, 24 bp, Artificial sequence
  SiRNA target sequence
ttatggtccaaaaggtgttggtgc

SEQ ID NO: 164660 - DNA, 24 bp, Artificial sequence
  SiRNA target sequence
tatggtccaaaaggtgttggtgcc

SEQ ID NO: 164661 - DNA, 24 bp, Artificial sequence
  SiRNA target sequence
atggtccaaaaggtgttggtgcct

SEQ ID NO: 164662 - DNA, 24 bp, Artificial sequence
  SiRNA target sequence
tggtccaaaaggtgttggtgcctt

SEQ ID NO: 164663 - DNA, 24 bp, Artificial sequence
  SiRNA target sequence
ggtccaaaaggtgttggtgcctta

SEQ ID NO: 164664 - DNA, 24 bp, Artificial sequence
  SiRNA target sequence
gtccaaaaggtgttggtgccttat

SEQ ID NO: 164665 - DNA, 24 bp, Artificial sequence
  SiRNA target sequence
tccaaaaggtgttggtgccttata

SEQ ID NO: 164666 - DNA, 24 bp, Artificial sequence
  SiRNA target sequence
ccaaaaggtgttggtgccttatac

SEQ ID NO: 164667 - DNA, 24 bp, Artificial sequence
  SiRNA target sequence
caaaaggtgttggtgccttatacg

SEQ ID NO: 164668 - DNA, 24 bp, Artificial sequence
  SiRNA target sequence
aaaaggtgttggtgccttatacgt

SEQ ID NO: 164669 - DNA, 24 bp, Artificial sequence
  SiRNA target sequence
aaaggtgttggtgccttatacgtc

SEQ ID NO: 164670 - DNA, 24 bp, Artificial sequence
  SiRNA target sequence
aaggtgttggtgccttatacgtca

SEQ ID NO: 164671 - DNA, 24 bp, Artificial sequence
  SiRNA target sequence
aggtgttggtgccttatacgtcag

SEQ ID NO: 164672 - DNA, 24 bp, Artificial sequence
  SiRNA target sequence
ggtgttggtgccttatacgtcaga

SEQ ID NO: 164673 - DNA, 24 bp, Artificial sequence
  SiRNA target sequence
gtgttggtgccttatacgtcagaa

SEQ ID NO: 164674 - DNA, 24 bp, Artificial sequence
  SiRNA target sequence
tgttggtgccttatacgtcagaag

SEQ ID NO: 164675 - DNA, 24 bp, Artificial sequence
  SiRNA target sequence
gttggtgccttatacgtcagaaga

SEQ ID NO: 164676 - DNA, 24 bp, Artificial sequence
  SiRNA target sequence
ttggtgccttatacgtcagaagaa

SEQ ID NO: 164677 - DNA, 24 bp, Artificial sequence
  SiRNA target sequence
tggtgccttatacgtcagaagaag

SEQ ID NO: 164678 - DNA, 24 bp, Artificial sequence
  SiRNA target sequence
ggtgccttatacgtcagaagaagg

SEQ ID NO: 164679 - DNA, 24 bp, Artificial sequence
  SiRNA target sequence
gtgccttatacgtcagaagaaggc

SEQ ID NO: 164680 - DNA, 24 bp, Artificial sequence
  SiRNA target sequence
tgccttatacgtcagaagaaggcc

SEQ ID NO: 164681 - DNA, 24 bp, Artificial sequence
  SiRNA target sequence
gccttatacgtcagaagaaggcct

SEQ ID NO: 164682 - DNA, 24 bp, Artificial sequence
  SiRNA target sequence
ccttatacgtcagaagaaggccta

SEQ ID NO: 164683 - DNA, 24 bp, Artificial sequence
  SiRNA target sequence
cttatacgtcagaagaaggcctag

SEQ ID NO: 164684 - DNA, 24 bp, Artificial sequence
  SiRNA target sequence
ttatacgtcagaagaaggcctagg

SEQ ID NO: 164685 - DNA, 24 bp, Artificial sequence
  SiRNA target sequence
tatacgtcagaagaaggcctaggg

SEQ ID NO: 164686 - DNA, 24 bp, Artificial sequence
  SiRNA target sequence
atacgtcagaagaaggcctagggt

SEQ ID NO: 164687 - DNA, 24 bp, Artificial sequence
  SiRNA target sequence
tacgtcagaagaaggcctagggtg

SEQ ID NO: 164688 - DNA, 24 bp, Artificial sequence
  SiRNA target sequence
acgtcagaagaaggcctagggtga

SEQ ID NO: 164689 - DNA, 24 bp, Artificial sequence
  SiRNA target sequence
cgtcagaagaaggcctagggtgag

SEQ ID NO: 164690 - DNA, 24 bp, Artificial sequence
  SiRNA target sequence
gtcagaagaaggcctagggtgaga

SEQ ID NO: 164691 - DNA, 24 bp, Artificial sequence
  SiRNA target sequence
tcagaagaaggcctagggtgagaa

SEQ ID NO: 164692 - DNA, 24 bp, Artificial sequence
  SiRNA target sequence
cagaagaaggcctagggtgagaat

SEQ ID NO: 164693 - DNA, 24 bp, Artificial sequence
  SiRNA target sequence
agaagaaggcctagggtgagaatg

SEQ ID NO: 164694 - DNA, 24 bp, Artificial sequence
  SiRNA target sequence
gaagaaggcctagggtgagaatgt

SEQ ID NO: 164695 - DNA, 24 bp, Artificial sequence
  SiRNA target sequence
aagaaggcctagggtgagaatgtt

SEQ ID NO: 164696 - DNA, 24 bp, Artificial sequence
  SiRNA target sequence
agaaggcctagggtgagaatgtta

SEQ ID NO: 164697 - DNA, 24 bp, Artificial sequence
  SiRNA target sequence
gaaggcctagggtgagaatgttac

SEQ ID NO: 164698 - DNA, 24 bp, Artificial sequence
  SiRNA target sequence
aaggcctagggtgagaatgttacc

SEQ ID NO: 164699 - DNA, 24 bp, Artificial sequence
  SiRNA target sequence
aggcctagggtgagaatgttacca

SEQ ID NO: 164700 - DNA, 24 bp, Artificial sequence
  SiRNA target sequence
ggcctagggtgagaatgttaccac

SEQ ID NO: 164701 - DNA, 24 bp, Artificial sequence
  SiRNA target sequence
gcctagggtgagaatgttaccact

SEQ ID NO: 164702 - DNA, 24 bp, Artificial sequence
  SiRNA target sequence
cctagggtgagaatgttaccactt

SEQ ID NO: 164703 - DNA, 24 bp, Artificial sequence
  SiRNA target sequence
ctagggtgagaatgttaccacttt

SEQ ID NO: 164704 - DNA, 24 bp, Artificial sequence
  SiRNA target sequence
tagggtgagaatgttaccactttt

SEQ ID NO: 164705 - DNA, 24 bp, Artificial sequence
  SiRNA target sequence
agggtgagaatgttaccacttttt

SEQ ID NO: 164706 - DNA, 24 bp, Artificial sequence
  SiRNA target sequence
gggtgagaatgttaccacttttta

SEQ ID NO: 164707 - DNA, 24 bp, Artificial sequence
  SiRNA target sequence
ggtgagaatgttaccactttttaa

SEQ ID NO: 164708 - DNA, 24 bp, Artificial sequence
  SiRNA target sequence
gtgagaatgttaccactttttaat

SEQ ID NO: 164709 - DNA, 24 bp, Artificial sequence
  SiRNA target sequence
tgagaatgttaccactttttaatg

SEQ ID NO: 164710 - DNA, 24 bp, Artificial sequence
  SiRNA target sequence
gagaatgttaccactttttaatgg

SEQ ID NO: 164711 - DNA, 24 bp, Artificial sequence
  SiRNA target sequence
agaatgttaccactttttaatggt

SEQ ID NO: 164712 - DNA, 24 bp, Artificial sequence
  SiRNA target sequence
gaatgttaccactttttaatggtg

SEQ ID NO: 164713 - DNA, 24 bp, Artificial sequence
  SiRNA target sequence
aatgttaccactttttaatggtgg

SEQ ID NO: 164714 - DNA, 24 bp, Artificial sequence
  SiRNA target sequence
atgttaccactttttaatggtggt

SEQ ID NO: 164715 - DNA, 24 bp, Artificial sequence
  SiRNA target sequence
tgttaccactttttaatggtggtg

SEQ ID NO: 164716 - DNA, 24 bp, Artificial sequence
  SiRNA target sequence
gttaccactttttaatggtggtgg

SEQ ID NO: 164717 - DNA, 24 bp, Artificial sequence
  SiRNA target sequence
ttaccactttttaatggtggtgga

SEQ ID NO: 164718 - DNA, 24 bp, Artificial sequence
  SiRNA target sequence
taccactttttaatggtggtggac

SEQ ID NO: 164719 - DNA, 24 bp, Artificial sequence
  SiRNA target sequence
accactttttaatggtggtggaca

SEQ ID NO: 164720 - DNA, 24 bp, Artificial sequence
  SiRNA target sequence
ccactttttaatggtggtggacaa

SEQ ID NO: 164721 - DNA, 24 bp, Artificial sequence
  SiRNA target sequence
cactttttaatggtggtggacaag

SEQ ID NO: 164722 - DNA, 24 bp, Artificial sequence
  SiRNA target sequence
actttttaatggtggtggacaaga

SEQ ID NO: 164723 - DNA, 24 bp, Artificial sequence
  SiRNA target sequence
ctttttaatggtggtggacaagaa

SEQ ID NO: 164724 - DNA, 24 bp, Artificial sequence
  SiRNA target sequence
tttttaatggtggtggacaagaaa

SEQ ID NO: 164725 - DNA, 24 bp, Artificial sequence
  SiRNA target sequence
ttttaatggtggtggacaagaaag

SEQ ID NO: 164726 - DNA, 24 bp, Artificial sequence
  SiRNA target sequence
tttaatggtggtggacaagaaaga

SEQ ID NO: 164727 - DNA, 24 bp, Artificial sequence
  SiRNA target sequence
ttaatggtggtggacaagaaagag

SEQ ID NO: 164728 - DNA, 24 bp, Artificial sequence
  SiRNA target sequence
taatggtggtggacaagaaagagg

SEQ ID NO: 164729 - DNA, 24 bp, Artificial sequence
  SiRNA target sequence
aatggtggtggacaagaaagagga

SEQ ID NO: 164730 - DNA, 24 bp, Artificial sequence
  SiRNA target sequence
atggtggtggacaagaaagaggat

SEQ ID NO: 164731 - DNA, 24 bp, Artificial sequence
  SiRNA target sequence
tggtggtggacaagaaagaggatt

SEQ ID NO: 164732 - DNA, 24 bp, Artificial sequence
  SiRNA target sequence
ggtggtggacaagaaagaggatta

SEQ ID NO: 164733 - DNA, 24 bp, Artificial sequence
  SiRNA target sequence
gtggtggacaagaaagaggattaa

SEQ ID NO: 164734 - DNA, 24 bp, Artificial sequence
  SiRNA target sequence
tggtggacaagaaagaggattaag

SEQ ID NO: 164735 - DNA, 24 bp, Artificial sequence
  SiRNA target sequence
ggtggacaagaaagaggattaaga

SEQ ID NO: 164736 - DNA, 24 bp, Artificial sequence
  SiRNA target sequence
gtggacaagaaagaggattaagaa

SEQ ID NO: 164737 - DNA, 24 bp, Artificial sequence
  SiRNA target sequence
tggacaagaaagaggattaagaag

SEQ ID NO: 164738 - DNA, 24 bp, Artificial sequence
  SiRNA target sequence
ggacaagaaagaggattaagaagt

SEQ ID NO: 164739 - DNA, 24 bp, Artificial sequence
  SiRNA target sequence
gacaagaaagaggattaagaagtg

SEQ ID NO: 164740 - DNA, 24 bp, Artificial sequence
  SiRNA target sequence
acaagaaagaggattaagaagtgg

SEQ ID NO: 164741 - DNA, 24 bp, Artificial sequence
  SiRNA target sequence
caagaaagaggattaagaagtggg

SEQ ID NO: 164742 - DNA, 24 bp, Artificial sequence
  SiRNA target sequence
aagaaagaggattaagaagtggga

SEQ ID NO: 164743 - DNA, 24 bp, Artificial sequence
  SiRNA target sequence
agaaagaggattaagaagtgggac

SEQ ID NO: 164744 - DNA, 24 bp, Artificial sequence
  SiRNA target sequence
gaaagaggattaagaagtgggaca

SEQ ID NO: 164745 - DNA, 24 bp, Artificial sequence
  SiRNA target sequence
aaagaggattaagaagtgggacaa

SEQ ID NO: 164746 - DNA, 24 bp, Artificial sequence
  SiRNA target sequence
aagaggattaagaagtgggacaac

SEQ ID NO: 164747 - DNA, 24 bp, Artificial sequence
  SiRNA target sequence
agaggattaagaagtgggacaact

SEQ ID NO: 164748 - DNA, 24 bp, Artificial sequence
  SiRNA target sequence
gaggattaagaagtgggacaactt

SEQ ID NO: 164749 - DNA, 24 bp, Artificial sequence
  SiRNA target sequence
aggattaagaagtgggacaacttc

SEQ ID NO: 164750 - DNA, 24 bp, Artificial sequence
  SiRNA target sequence
ggattaagaagtgggacaacttct

SEQ ID NO: 164751 - DNA, 24 bp, Artificial sequence
  SiRNA target sequence
gattaagaagtgggacaacttctc

SEQ ID NO: 164752 - DNA, 24 bp, Artificial sequence
  SiRNA target sequence
attaagaagtgggacaacttctcc

SEQ ID NO: 164753 - DNA, 24 bp, Artificial sequence
  SiRNA target sequence
ttaagaagtgggacaacttctcca

SEQ ID NO: 164754 - DNA, 24 bp, Artificial sequence
  SiRNA target sequence
taagaagtgggacaacttctccac

SEQ ID NO: 164755 - DNA, 24 bp, Artificial sequence
  SiRNA target sequence
aagaagtgggacaacttctccacc

SEQ ID NO: 164756 - DNA, 24 bp, Artificial sequence
  SiRNA target sequence
agaagtgggacaacttctccacct

SEQ ID NO: 164757 - DNA, 24 bp, Artificial sequence
  SiRNA target sequence
gaagtgggacaacttctccacctt

SEQ ID NO: 164758 - DNA, 24 bp, Artificial sequence
  SiRNA target sequence
aagtgggacaacttctccaccttt

SEQ ID NO: 164759 - DNA, 24 bp, Artificial sequence
  SiRNA target sequence
agtgggacaacttctccaccttta

SEQ ID NO: 164760 - DNA, 24 bp, Artificial sequence
  SiRNA target sequence
gtgggacaacttctccacctttag

SEQ ID NO: 164761 - DNA, 24 bp, Artificial sequence
  SiRNA target sequence
tgggacaacttctccacctttagt

SEQ ID NO: 164762 - DNA, 24 bp, Artificial sequence
  SiRNA target sequence
gggacaacttctccacctttagtt

SEQ ID NO: 164763 - DNA, 24 bp, Artificial sequence
  SiRNA target sequence
ggacaacttctccacctttagttg

SEQ ID NO: 164764 - DNA, 24 bp, Artificial sequence
  SiRNA target sequence
gacaacttctccacctttagttgt

SEQ ID NO: 164765 - DNA, 24 bp, Artificial sequence
  SiRNA target sequence
acaacttctccacctttagttgtt

SEQ ID NO: 164766 - DNA, 24 bp, Artificial sequence
  SiRNA target sequence
caacttctccacctttagttgttg

SEQ ID NO: 164767 - DNA, 24 bp, Artificial sequence
  SiRNA target sequence
aacttctccacctttagttgttgg

SEQ ID NO: 164768 - DNA, 24 bp, Artificial sequence
  SiRNA target sequence
acttctccacctttagttgttgga

SEQ ID NO: 164769 - DNA, 24 bp, Artificial sequence
  SiRNA target sequence
cttctccacctttagttgttggat

SEQ ID NO: 164770 - DNA, 24 bp, Artificial sequence
  SiRNA target sequence
ttctccacctttagttgttggatt

SEQ ID NO: 164771 - DNA, 24 bp, Artificial sequence
  SiRNA target sequence
tctccacctttagttgttggatta

SEQ ID NO: 164772 - DNA, 24 bp, Artificial sequence
  SiRNA target sequence
ctccacctttagttgttggattag

SEQ ID NO: 164773 - DNA, 24 bp, Artificial sequence
  SiRNA target sequence
tccacctttagttgttggattagg

SEQ ID NO: 164774 - DNA, 24 bp, Artificial sequence
  SiRNA target sequence
ccacctttagttgttggattaggc

SEQ ID NO: 164775 - DNA, 24 bp, Artificial sequence
  SiRNA target sequence
cacctttagttgttggattaggca

SEQ ID NO: 164776 - DNA, 24 bp, Artificial sequence
  SiRNA target sequence
acctttagttgttggattaggcaa

SEQ ID NO: 164777 - DNA, 24 bp, Artificial sequence
  SiRNA target sequence
cctttagttgttggattaggcaaa

SEQ ID NO: 164778 - DNA, 24 bp, Artificial sequence
  SiRNA target sequence
ctttagttgttggattaggcaaag

SEQ ID NO: 164779 - DNA, 24 bp, Artificial sequence
  SiRNA target sequence
tttagttgttggattaggcaaagc

SEQ ID NO: 164780 - DNA, 24 bp, Artificial sequence
  SiRNA target sequence
ttagttgttggattaggcaaagct

SEQ ID NO: 164781 - DNA, 24 bp, Artificial sequence
  SiRNA target sequence
tagttgttggattaggcaaagctg

SEQ ID NO: 164782 - DNA, 24 bp, Artificial sequence
  SiRNA target sequence
agttgttggattaggcaaagctgc

SEQ ID NO: 164783 - DNA, 24 bp, Artificial sequence
  SiRNA target sequence
gttgttggattaggcaaagctgct

SEQ ID NO: 164784 - DNA, 24 bp, Artificial sequence
  SiRNA target sequence
ttgttggattaggcaaagctgctg

SEQ ID NO: 164785 - DNA, 24 bp, Artificial sequence
  SiRNA target sequence
tgttggattaggcaaagctgctga

SEQ ID NO: 164786 - DNA, 24 bp, Artificial sequence
  SiRNA target sequence
gttggattaggcaaagctgctgag

SEQ ID NO: 164787 - DNA, 24 bp, Artificial sequence
  SiRNA target sequence
ttggattaggcaaagctgctgaga

SEQ ID NO: 164788 - DNA, 24 bp, Artificial sequence
  SiRNA target sequence
tggattaggcaaagctgctgagat

SEQ ID NO: 164789 - DNA, 24 bp, Artificial sequence
  SiRNA target sequence
ggattaggcaaagctgctgagata

SEQ ID NO: 164790 - DNA, 24 bp, Artificial sequence
  SiRNA target sequence
gattaggcaaagctgctgagatat

SEQ ID NO: 164791 - DNA, 24 bp, Artificial sequence
  SiRNA target sequence
attaggcaaagctgctgagatatg

SEQ ID NO: 164792 - DNA, 24 bp, Artificial sequence
  SiRNA target sequence
ttaggcaaagctgctgagatatgc

SEQ ID NO: 164793 - DNA, 24 bp, Artificial sequence
  SiRNA target sequence
taggcaaagctgctgagatatgct

SEQ ID NO: 164794 - DNA, 24 bp, Artificial sequence
  SiRNA target sequence
aggcaaagctgctgagatatgctc

SEQ ID NO: 164795 - DNA, 24 bp, Artificial sequence
  SiRNA target sequence
ggcaaagctgctgagatatgctct

SEQ ID NO: 164796 - DNA, 24 bp, Artificial sequence
  SiRNA target sequence
gcaaagctgctgagatatgctctc

SEQ ID NO: 164797 - DNA, 24 bp, Artificial sequence
  SiRNA target sequence
caaagctgctgagatatgctctca

SEQ ID NO: 164798 - DNA, 24 bp, Artificial sequence
  SiRNA target sequence
aaagctgctgagatatgctctcag

SEQ ID NO: 164799 - DNA, 24 bp, Artificial sequence
  SiRNA target sequence
aagctgctgagatatgctctcagg

SEQ ID NO: 164800 - DNA, 24 bp, Artificial sequence
  SiRNA target sequence
agctgctgagatatgctctcagga

SEQ ID NO: 164801 - DNA, 24 bp, Artificial sequence
  SiRNA target sequence
gctgctgagatatgctctcaggag

SEQ ID NO: 164802 - DNA, 24 bp, Artificial sequence
  SiRNA target sequence
ctgctgagatatgctctcaggaga

SEQ ID NO: 164803 - DNA, 24 bp, Artificial sequence
  SiRNA target sequence
tgctgagatatgctctcaggagat

SEQ ID NO: 164804 - DNA, 24 bp, Artificial sequence
  SiRNA target sequence
gctgagatatgctctcaggagatg

SEQ ID NO: 164805 - DNA, 24 bp, Artificial sequence
  SiRNA target sequence
ctgagatatgctctcaggagatgc

SEQ ID NO: 164806 - DNA, 24 bp, Artificial sequence
  SiRNA target sequence
tgagatatgctctcaggagatgcg

SEQ ID NO: 164807 - DNA, 24 bp, Artificial sequence
  SiRNA target sequence
gagatatgctctcaggagatgcgt

SEQ ID NO: 164808 - DNA, 24 bp, Artificial sequence
  SiRNA target sequence
agatatgctctcaggagatgcgta

SEQ ID NO: 164809 - DNA, 24 bp, Artificial sequence
  SiRNA target sequence
gatatgctctcaggagatgcgtaa

SEQ ID NO: 164810 - DNA, 24 bp, Artificial sequence
  SiRNA target sequence
atatgctctcaggagatgcgtaag

SEQ ID NO: 164811 - DNA, 24 bp, Artificial sequence
  SiRNA target sequence
tatgctctcaggagatgcgtaagg

SEQ ID NO: 164812 - DNA, 24 bp, Artificial sequence
  SiRNA target sequence
atgctctcaggagatgcgtaagga

SEQ ID NO: 164813 - DNA, 24 bp, Artificial sequence
  SiRNA target sequence
tgctctcaggagatgcgtaaggac

SEQ ID NO: 164814 - DNA, 24 bp, Artificial sequence
  SiRNA target sequence
gctctcaggagatgcgtaaggact

SEQ ID NO: 164815 - DNA, 24 bp, Artificial sequence
  SiRNA target sequence
ctctcaggagatgcgtaaggacta

SEQ ID NO: 164816 - DNA, 24 bp, Artificial sequence
  SiRNA target sequence
tctcaggagatgcgtaaggactat

SEQ ID NO: 164817 - DNA, 24 bp, Artificial sequence
  SiRNA target sequence
ctcaggagatgcgtaaggactatg

SEQ ID NO: 164818 - DNA, 24 bp, Artificial sequence
  SiRNA target sequence
tcaggagatgcgtaaggactatga

SEQ ID NO: 164819 - DNA, 24 bp, Artificial sequence
  SiRNA target sequence
caggagatgcgtaaggactatgaa

SEQ ID NO: 164820 - DNA, 24 bp, Artificial sequence
  SiRNA target sequence
aggagatgcgtaaggactatgaat

SEQ ID NO: 164821 - DNA, 24 bp, Artificial sequence
  SiRNA target sequence
ggagatgcgtaaggactatgaata

SEQ ID NO: 164822 - DNA, 24 bp, Artificial sequence
  SiRNA target sequence
gagatgcgtaaggactatgaatat

SEQ ID NO: 164823 - DNA, 24 bp, Artificial sequence
  SiRNA target sequence
agatgcgtaaggactatgaatata

SEQ ID NO: 164824 - DNA, 24 bp, Artificial sequence
  SiRNA target sequence
gatgcgtaaggactatgaatatat

SEQ ID NO: 164825 - DNA, 24 bp, Artificial sequence
  SiRNA target sequence
atgcgtaaggactatgaatatata

SEQ ID NO: 164826 - DNA, 24 bp, Artificial sequence
  SiRNA target sequence
tgcgtaaggactatgaatatatac

SEQ ID NO: 164827 - DNA, 24 bp, Artificial sequence
  SiRNA target sequence
gcgtaaggactatgaatatataca

SEQ ID NO: 164828 - DNA, 24 bp, Artificial sequence
  SiRNA target sequence
cgtaaggactatgaatatatacaa

SEQ ID NO: 164829 - DNA, 24 bp, Artificial sequence
  SiRNA target sequence
gtaaggactatgaatatatacaaa

SEQ ID NO: 164830 - DNA, 24 bp, Artificial sequence
  SiRNA target sequence
taaggactatgaatatatacaaaa

SEQ ID NO: 164831 - DNA, 24 bp, Artificial sequence
  SiRNA target sequence
aaggactatgaatatatacaaaaa

SEQ ID NO: 164832 - DNA, 24 bp, Artificial sequence
  SiRNA target sequence
aggactatgaatatatacaaaaat

SEQ ID NO: 164833 - DNA, 24 bp, Artificial sequence
  SiRNA target sequence
ggactatgaatatatacaaaaatt

SEQ ID NO: 164834 - DNA, 24 bp, Artificial sequence
  SiRNA target sequence
gactatgaatatatacaaaaatta

SEQ ID NO: 164835 - DNA, 24 bp, Artificial sequence
  SiRNA target sequence
actatgaatatatacaaaaattat

SEQ ID NO: 164836 - DNA, 24 bp, Artificial sequence
  SiRNA target sequence
ctatgaatatatacaaaaattatc

SEQ ID NO: 164837 - DNA, 24 bp, Artificial sequence
  SiRNA target sequence
tatgaatatatacaaaaattatcg

SEQ ID NO: 164838 - DNA, 24 bp, Artificial sequence
  SiRNA target sequence
atgaatatatacaaaaattatcgg

SEQ ID NO: 164839 - DNA, 24 bp, Artificial sequence
  SiRNA target sequence
tgaatatatacaaaaattatcgga

SEQ ID NO: 164840 - DNA, 24 bp, Artificial sequence
  SiRNA target sequence
gaatatatacaaaaattatcggat

SEQ ID NO: 164841 - DNA, 24 bp, Artificial sequence
  SiRNA target sequence
aatatatacaaaaattatcggata

SEQ ID NO: 164842 - DNA, 24 bp, Artificial sequence
  SiRNA target sequence
atatatacaaaaattatcggataa

SEQ ID NO: 164843 - DNA, 24 bp, Artificial sequence
  SiRNA target sequence
tatatacaaaaattatcggataaa

SEQ ID NO: 164844 - DNA, 24 bp, Artificial sequence
  SiRNA target sequence
atatacaaaaattatcggataaac

SEQ ID NO: 164845 - DNA, 24 bp, Artificial sequence
  SiRNA target sequence
tatacaaaaattatcggataaact

SEQ ID NO: 164846 - DNA, 24 bp, Artificial sequence
  SiRNA target sequence
atacaaaaattatcggataaacta

SEQ ID NO: 164847 - DNA, 24 bp, Artificial sequence
  SiRNA target sequence
tacaaaaattatcggataaactaa

SEQ ID NO: 164848 - DNA, 24 bp, Artificial sequence
  SiRNA target sequence
acaaaaattatcggataaactaaa

SEQ ID NO: 164849 - DNA, 24 bp, Artificial sequence
  SiRNA target sequence
caaaaattatcggataaactaaaa

SEQ ID NO: 164850 - DNA, 24 bp, Artificial sequence
  SiRNA target sequence
aaaaattatcggataaactaaaaa

SEQ ID NO: 164851 - DNA, 24 bp, Artificial sequence
  SiRNA target sequence
aaaattatcggataaactaaaaaa

SEQ ID NO: 164852 - DNA, 24 bp, Artificial sequence
  SiRNA target sequence
aaattatcggataaactaaaaaat

SEQ ID NO: 164853 - DNA, 24 bp, Artificial sequence
  SiRNA target sequence
aattatcggataaactaaaaaatc

SEQ ID NO: 164854 - DNA, 24 bp, Artificial sequence
  SiRNA target sequence
attatcggataaactaaaaaatcg

SEQ ID NO: 164855 - DNA, 24 bp, Artificial sequence
  SiRNA target sequence
ttatcggataaactaaaaaatcgc

SEQ ID NO: 164856 - DNA, 24 bp, Artificial sequence
  SiRNA target sequence
tatcggataaactaaaaaatcgca

SEQ ID NO: 164857 - DNA, 24 bp, Artificial sequence
  SiRNA target sequence
atcggataaactaaaaaatcgcat

SEQ ID NO: 164858 - DNA, 24 bp, Artificial sequence
  SiRNA target sequence
tcggataaactaaaaaatcgcatc

SEQ ID NO: 164859 - DNA, 24 bp, Artificial sequence
  SiRNA target sequence
cggataaactaaaaaatcgcatca

SEQ ID NO: 164860 - DNA, 24 bp, Artificial sequence
  SiRNA target sequence
ggataaactaaaaaatcgcatcaa

SEQ ID NO: 164861 - DNA, 24 bp, Artificial sequence
  SiRNA target sequence
gataaactaaaaaatcgcatcaaa

SEQ ID NO: 164862 - DNA, 24 bp, Artificial sequence
  SiRNA target sequence
ataaactaaaaaatcgcatcaaaa

SEQ ID NO: 164863 - DNA, 24 bp, Artificial sequence
  SiRNA target sequence
taaactaaaaaatcgcatcaaaac

SEQ ID NO: 164864 - DNA, 24 bp, Artificial sequence
  SiRNA target sequence
aaactaaaaaatcgcatcaaaacg

SEQ ID NO: 164865 - DNA, 24 bp, Artificial sequence
  SiRNA target sequence
aactaaaaaatcgcatcaaaacga

SEQ ID NO: 164866 - DNA, 24 bp, Artificial sequence
  SiRNA target sequence
actaaaaaatcgcatcaaaacgaa

SEQ ID NO: 164867 - DNA, 24 bp, Artificial sequence
  SiRNA target sequence
ctaaaaaatcgcatcaaaacgaat

SEQ ID NO: 164868 - DNA, 24 bp, Artificial sequence
  SiRNA target sequence
taaaaaatcgcatcaaaacgaatg

SEQ ID NO: 164869 - DNA, 24 bp, Artificial sequence
  SiRNA target sequence
aaaaaatcgcatcaaaacgaatgt

SEQ ID NO: 164870 - DNA, 24 bp, Artificial sequence
  SiRNA target sequence
aaaaatcgcatcaaaacgaatgta

SEQ ID NO: 164871 - DNA, 24 bp, Artificial sequence
  SiRNA target sequence
aaaatcgcatcaaaacgaatgtag

SEQ ID NO: 164872 - DNA, 24 bp, Artificial sequence
  SiRNA target sequence
aaatcgcatcaaaacgaatgtaga

SEQ ID NO: 164873 - DNA, 24 bp, Artificial sequence
  SiRNA target sequence
aatcgcatcaaaacgaatgtagaa

SEQ ID NO: 164874 - DNA, 24 bp, Artificial sequence
  SiRNA target sequence
atcgcatcaaaacgaatgtagaaa

SEQ ID NO: 164875 - DNA, 24 bp, Artificial sequence
  SiRNA target sequence
tcgcatcaaaacgaatgtagaaaa

SEQ ID NO: 164876 - DNA, 24 bp, Artificial sequence
  SiRNA target sequence
cgcatcaaaacgaatgtagaaaat

SEQ ID NO: 164877 - DNA, 24 bp, Artificial sequence
  SiRNA target sequence
gcatcaaaacgaatgtagaaaatg

SEQ ID NO: 164878 - DNA, 24 bp, Artificial sequence
  SiRNA target sequence
catcaaaacgaatgtagaaaatgt

SEQ ID NO: 164879 - DNA, 24 bp, Artificial sequence
  SiRNA target sequence
atcaaaacgaatgtagaaaatgtt

SEQ ID NO: 164880 - DNA, 24 bp, Artificial sequence
  SiRNA target sequence
tcaaaacgaatgtagaaaatgttg

SEQ ID NO: 164881 - DNA, 24 bp, Artificial sequence
  SiRNA target sequence
caaaacgaatgtagaaaatgttgt

SEQ ID NO: 164882 - DNA, 24 bp, Artificial sequence
  SiRNA target sequence
aaaacgaatgtagaaaatgttgtt

SEQ ID NO: 164883 - DNA, 24 bp, Artificial sequence
  SiRNA target sequence
aaacgaatgtagaaaatgttgtta

SEQ ID NO: 164884 - DNA, 24 bp, Artificial sequence
  SiRNA target sequence
aacgaatgtagaaaatgttgttat

SEQ ID NO: 164885 - DNA, 24 bp, Artificial sequence
  SiRNA target sequence
acgaatgtagaaaatgttgttatt

SEQ ID NO: 164886 - DNA, 24 bp, Artificial sequence
  SiRNA target sequence
cgaatgtagaaaatgttgttatta

SEQ ID NO: 164887 - DNA, 24 bp, Artificial sequence
  SiRNA target sequence
gaatgtagaaaatgttgttattaa

SEQ ID NO: 164888 - DNA, 24 bp, Artificial sequence
  SiRNA target sequence
aatgtagaaaatgttgttattaac

SEQ ID NO: 164889 - DNA, 24 bp, Artificial sequence
  SiRNA target sequence
atgtagaaaatgttgttattaacg

SEQ ID NO: 164890 - DNA, 24 bp, Artificial sequence
  SiRNA target sequence
tgtagaaaatgttgttattaacgg

SEQ ID NO: 164891 - DNA, 24 bp, Artificial sequence
  SiRNA target sequence
gtagaaaatgttgttattaacggc

SEQ ID NO: 164892 - DNA, 24 bp, Artificial sequence
  SiRNA target sequence
tagaaaatgttgttattaacggcg

SEQ ID NO: 164893 - DNA, 24 bp, Artificial sequence
  SiRNA target sequence
agaaaatgttgttattaacggcga

SEQ ID NO: 164894 - DNA, 24 bp, Artificial sequence
  SiRNA target sequence
gaaaatgttgttattaacggcgat

SEQ ID NO: 164895 - DNA, 24 bp, Artificial sequence
  SiRNA target sequence
aaaatgttgttattaacggcgatg

SEQ ID NO: 164896 - DNA, 24 bp, Artificial sequence
  SiRNA target sequence
aaatgttgttattaacggcgatga

SEQ ID NO: 164897 - DNA, 24 bp, Artificial sequence
  SiRNA target sequence
aatgttgttattaacggcgatgat

SEQ ID NO: 164898 - DNA, 24 bp, Artificial sequence
  SiRNA target sequence
atgttgttattaacggcgatgatt

SEQ ID NO: 164899 - DNA, 24 bp, Artificial sequence
  SiRNA target sequence
tgttgttattaacggcgatgattc

SEQ ID NO: 164900 - DNA, 24 bp, Artificial sequence
  SiRNA target sequence
gttgttattaacggcgatgattct

SEQ ID NO: 164901 - DNA, 24 bp, Artificial sequence
  SiRNA target sequence
ttgttattaacggcgatgattcta

SEQ ID NO: 164902 - DNA, 24 bp, Artificial sequence
  SiRNA target sequence
tgttattaacggcgatgattctaa

SEQ ID NO: 164903 - DNA, 24 bp, Artificial sequence
  SiRNA target sequence
gttattaacggcgatgattctaag

SEQ ID NO: 164904 - DNA, 24 bp, Artificial sequence
  SiRNA target sequence
ttattaacggcgatgattctaaga

SEQ ID NO: 164905 - DNA, 24 bp, Artificial sequence
  SiRNA target sequence
tattaacggcgatgattctaagac

SEQ ID NO: 164906 - DNA, 24 bp, Artificial sequence
  SiRNA target sequence
attaacggcgatgattctaagact

SEQ ID NO: 164907 - DNA, 24 bp, Artificial sequence
  SiRNA target sequence
ttaacggcgatgattctaagactt

SEQ ID NO: 164908 - DNA, 24 bp, Artificial sequence
  SiRNA target sequence
taacggcgatgattctaagacttt

SEQ ID NO: 164909 - DNA, 24 bp, Artificial sequence
  SiRNA target sequence
aacggcgatgattctaagactttt

SEQ ID NO: 164910 - DNA, 24 bp, Artificial sequence
  SiRNA target sequence
acggcgatgattctaagacttttc

SEQ ID NO: 164911 - DNA, 24 bp, Artificial sequence
  SiRNA target sequence
cggcgatgattctaagacttttcc

SEQ ID NO: 164912 - DNA, 24 bp, Artificial sequence
  SiRNA target sequence
ggcgatgattctaagacttttcct

SEQ ID NO: 164913 - DNA, 24 bp, Artificial sequence
  SiRNA target sequence
gcgatgattctaagacttttcctg

SEQ ID NO: 164914 - DNA, 24 bp, Artificial sequence
  SiRNA target sequence
cgatgattctaagacttttcctgg

SEQ ID NO: 164915 - DNA, 24 bp, Artificial sequence
  SiRNA target sequence
gatgattctaagacttttcctggc

SEQ ID NO: 164916 - DNA, 24 bp, Artificial sequence
  SiRNA target sequence
atgattctaagacttttcctggct

SEQ ID NO: 164917 - DNA, 24 bp, Artificial sequence
  SiRNA target sequence
tgattctaagacttttcctggctg

SEQ ID NO: 164918 - DNA, 24 bp, Artificial sequence
  SiRNA target sequence
gattctaagacttttcctggctgt

SEQ ID NO: 164919 - DNA, 24 bp, Artificial sequence
  SiRNA target sequence
attctaagacttttcctggctgtc

SEQ ID NO: 164920 - DNA, 24 bp, Artificial sequence
  SiRNA target sequence
ttctaagacttttcctggctgtct

SEQ ID NO: 164921 - DNA, 24 bp, Artificial sequence
  SiRNA target sequence
tctaagacttttcctggctgtctc

SEQ ID NO: 164922 - DNA, 24 bp, Artificial sequence
  SiRNA target sequence
ctaagacttttcctggctgtctca

SEQ ID NO: 164923 - DNA, 24 bp, Artificial sequence
  SiRNA target sequence
taagacttttcctggctgtctcaa

SEQ ID NO: 164924 - DNA, 24 bp, Artificial sequence
  SiRNA target sequence
aagacttttcctggctgtctcaat

SEQ ID NO: 164925 - DNA, 24 bp, Artificial sequence
  SiRNA target sequence
agacttttcctggctgtctcaata

SEQ ID NO: 164926 - DNA, 24 bp, Artificial sequence
  SiRNA target sequence
gacttttcctggctgtctcaatat

SEQ ID NO: 164927 - DNA, 24 bp, Artificial sequence
  SiRNA target sequence
acttttcctggctgtctcaatatt

SEQ ID NO: 164928 - DNA, 24 bp, Artificial sequence
  SiRNA target sequence
cttttcctggctgtctcaatattt

SEQ ID NO: 164929 - DNA, 24 bp, Artificial sequence
  SiRNA target sequence
ttttcctggctgtctcaatatttc

SEQ ID NO: 164930 - DNA, 24 bp, Artificial sequence
  SiRNA target sequence
tttcctggctgtctcaatatttct

SEQ ID NO: 164931 - DNA, 24 bp, Artificial sequence
  SiRNA target sequence
ttcctggctgtctcaatatttctt

SEQ ID NO: 164932 - DNA, 24 bp, Artificial sequence
  SiRNA target sequence
tcctggctgtctcaatatttcttt

SEQ ID NO: 164933 - DNA, 24 bp, Artificial sequence
  SiRNA target sequence
cctggctgtctcaatatttctttt

SEQ ID NO: 164934 - DNA, 24 bp, Artificial sequence
  SiRNA target sequence
ctggctgtctcaatatttcttttc

SEQ ID NO: 164935 - DNA, 24 bp, Artificial sequence
  SiRNA target sequence
tggctgtctcaatatttcttttcc

SEQ ID NO: 164936 - DNA, 24 bp, Artificial sequence
  SiRNA target sequence
ggctgtctcaatatttcttttcca

SEQ ID NO: 164937 - DNA, 24 bp, Artificial sequence
  SiRNA target sequence
gctgtctcaatatttcttttccat

SEQ ID NO: 164938 - DNA, 24 bp, Artificial sequence
  SiRNA target sequence
ctgtctcaatatttcttttccata

SEQ ID NO: 164939 - DNA, 24 bp, Artificial sequence
  SiRNA target sequence
tgtctcaatatttcttttccatat

SEQ ID NO: 164940 - DNA, 24 bp, Artificial sequence
  SiRNA target sequence
gtctcaatatttcttttccatatg

SEQ ID NO: 164941 - DNA, 24 bp, Artificial sequence
  SiRNA target sequence
tctcaatatttcttttccatatgt

SEQ ID NO: 164942 - DNA, 24 bp, Artificial sequence
  SiRNA target sequence
ctcaatatttcttttccatatgta

SEQ ID NO: 164943 - DNA, 24 bp, Artificial sequence
  SiRNA target sequence
tcaatatttcttttccatatgtag

SEQ ID NO: 164944 - DNA, 24 bp, Artificial sequence
  SiRNA target sequence
caatatttcttttccatatgtaga

SEQ ID NO: 164945 - DNA, 24 bp, Artificial sequence
  SiRNA target sequence
aatatttcttttccatatgtagaa

SEQ ID NO: 164946 - DNA, 24 bp, Artificial sequence
  SiRNA target sequence
atatttcttttccatatgtagaag

SEQ ID NO: 164947 - DNA, 24 bp, Artificial sequence
  SiRNA target sequence
tatttcttttccatatgtagaagg

SEQ ID NO: 164948 - DNA, 24 bp, Artificial sequence
  SiRNA target sequence
atttcttttccatatgtagaaggt

SEQ ID NO: 164949 - DNA, 24 bp, Artificial sequence
  SiRNA target sequence
tttcttttccatatgtagaaggtg

SEQ ID NO: 164950 - DNA, 24 bp, Artificial sequence
  SiRNA target sequence
ttcttttccatatgtagaaggtga

SEQ ID NO: 164951 - DNA, 24 bp, Artificial sequence
  SiRNA target sequence
tcttttccatatgtagaaggtgaa

SEQ ID NO: 164952 - DNA, 24 bp, Artificial sequence
  SiRNA target sequence
cttttccatatgtagaaggtgaag

SEQ ID NO: 164953 - DNA, 24 bp, Artificial sequence
  SiRNA target sequence
ttttccatatgtagaaggtgaagg

SEQ ID NO: 164954 - DNA, 24 bp, Artificial sequence
  SiRNA target sequence
tttccatatgtagaaggtgaaggg

SEQ ID NO: 164955 - DNA, 24 bp, Artificial sequence
  SiRNA target sequence
ttccatatgtagaaggtgaagggc

SEQ ID NO: 164956 - DNA, 24 bp, Artificial sequence
  SiRNA target sequence
tccatatgtagaaggtgaagggct

SEQ ID NO: 164957 - DNA, 24 bp, Artificial sequence
  SiRNA target sequence
ccatatgtagaaggtgaagggctt

SEQ ID NO: 164958 - DNA, 24 bp, Artificial sequence
  SiRNA target sequence
catatgtagaaggtgaagggctta

SEQ ID NO: 164959 - DNA, 24 bp, Artificial sequence
  SiRNA target sequence
atatgtagaaggtgaagggcttat

SEQ ID NO: 164960 - DNA, 24 bp, Artificial sequence
  SiRNA target sequence
tatgtagaaggtgaagggcttatg

SEQ ID NO: 164961 - DNA, 24 bp, Artificial sequence
  SiRNA target sequence
atgtagaaggtgaagggcttatga

SEQ ID NO: 164962 - DNA, 24 bp, Artificial sequence
  SiRNA target sequence
tgtagaaggtgaagggcttatgat

SEQ ID NO: 164963 - DNA, 24 bp, Artificial sequence
  SiRNA target sequence
gtagaaggtgaagggcttatgatg

SEQ ID NO: 164964 - DNA, 24 bp, Artificial sequence
  SiRNA target sequence
tagaaggtgaagggcttatgatga

SEQ ID NO: 164965 - DNA, 24 bp, Artificial sequence
  SiRNA target sequence
agaaggtgaagggcttatgatgaa

SEQ ID NO: 164966 - DNA, 24 bp, Artificial sequence
  SiRNA target sequence
gaaggtgaagggcttatgatgaat

SEQ ID NO: 164967 - DNA, 24 bp, Artificial sequence
  SiRNA target sequence
aaggtgaagggcttatgatgaata

SEQ ID NO: 164968 - DNA, 24 bp, Artificial sequence
  SiRNA target sequence
aggtgaagggcttatgatgaatat

SEQ ID NO: 164969 - DNA, 24 bp, Artificial sequence
  SiRNA target sequence
ggtgaagggcttatgatgaatatt

SEQ ID NO: 164970 - DNA, 24 bp, Artificial sequence
  SiRNA target sequence
gtgaagggcttatgatgaatatta

SEQ ID NO: 164971 - DNA, 24 bp, Artificial sequence
  SiRNA target sequence
tgaagggcttatgatgaatattaa

SEQ ID NO: 164972 - DNA, 24 bp, Artificial sequence
  SiRNA target sequence
gaagggcttatgatgaatattaag

SEQ ID NO: 164973 - DNA, 24 bp, Artificial sequence
  SiRNA target sequence
aagggcttatgatgaatattaagg

SEQ ID NO: 164974 - DNA, 24 bp, Artificial sequence
  SiRNA target sequence
agggcttatgatgaatattaagga

SEQ ID NO: 164975 - DNA, 24 bp, Artificial sequence
  SiRNA target sequence
gggcttatgatgaatattaaggat

SEQ ID NO: 164976 - DNA, 24 bp, Artificial sequence
  SiRNA target sequence
ggcttatgatgaatattaaggata

SEQ ID NO: 164977 - DNA, 24 bp, Artificial sequence
  SiRNA target sequence
gcttatgatgaatattaaggatat

SEQ ID NO: 164978 - DNA, 24 bp, Artificial sequence
  SiRNA target sequence
cttatgatgaatattaaggatatt

SEQ ID NO: 164979 - DNA, 24 bp, Artificial sequence
  SiRNA target sequence
ttatgatgaatattaaggatattg

SEQ ID NO: 164980 - DNA, 24 bp, Artificial sequence
  SiRNA target sequence
tatgatgaatattaaggatattgc

SEQ ID NO: 164981 - DNA, 24 bp, Artificial sequence
  SiRNA target sequence
atgatgaatattaaggatattgct

SEQ ID NO: 164982 - DNA, 24 bp, Artificial sequence
  SiRNA target sequence
tgatgaatattaaggatattgctg

SEQ ID NO: 164983 - DNA, 24 bp, Artificial sequence
  SiRNA target sequence
gatgaatattaaggatattgctgt

SEQ ID NO: 164984 - DNA, 24 bp, Artificial sequence
  SiRNA target sequence
atgaatattaaggatattgctgtt

SEQ ID NO: 164985 - DNA, 24 bp, Artificial sequence
  SiRNA target sequence
tgaatattaaggatattgctgtta

SEQ ID NO: 164986 - DNA, 24 bp, Artificial sequence
  SiRNA target sequence
gaatattaaggatattgctgttag

SEQ ID NO: 164987 - DNA, 24 bp, Artificial sequence
  SiRNA target sequence
aatattaaggatattgctgttagt

SEQ ID NO: 164988 - DNA, 24 bp, Artificial sequence
  SiRNA target sequence
atattaaggatattgctgttagta

SEQ ID NO: 164989 - DNA, 24 bp, Artificial sequence
  SiRNA target sequence
tattaaggatattgctgttagtag

SEQ ID NO: 164990 - DNA, 24 bp, Artificial sequence
  SiRNA target sequence
attaaggatattgctgttagtagt

SEQ ID NO: 164991 - DNA, 24 bp, Artificial sequence
  SiRNA target sequence
ttaaggatattgctgttagtagtg

SEQ ID NO: 164992 - DNA, 24 bp, Artificial sequence
  SiRNA target sequence
taaggatattgctgttagtagtgg

SEQ ID NO: 164993 - DNA, 24 bp, Artificial sequence
  SiRNA target sequence
aaggatattgctgttagtagtgga

SEQ ID NO: 164994 - DNA, 24 bp, Artificial sequence
  SiRNA target sequence
aggatattgctgttagtagtggaa

SEQ ID NO: 164995 - DNA, 24 bp, Artificial sequence
  SiRNA target sequence
ggatattgctgttagtagtggaag

SEQ ID NO: 164996 - DNA, 24 bp, Artificial sequence
  SiRNA target sequence
gatattgctgttagtagtggaagt

SEQ ID NO: 164997 - DNA, 24 bp, Artificial sequence
  SiRNA target sequence
atattgctgttagtagtggaagtg

SEQ ID NO: 164998 - DNA, 24 bp, Artificial sequence
  SiRNA target sequence
tattgctgttagtagtggaagtgc

SEQ ID NO: 164999 - DNA, 24 bp, Artificial sequence
  SiRNA target sequence
attgctgttagtagtggaagtgct

SEQ ID NO: 165000 - DNA, 24 bp, Artificial sequence
  SiRNA target sequence
ttgctgttagtagtggaagtgctt

SEQ ID NO: 165001 - DNA, 24 bp, Artificial sequence
  SiRNA target sequence
tgctgttagtagtggaagtgcttg

SEQ ID NO: 165002 - DNA, 24 bp, Artificial sequence
  SiRNA target sequence
gctgttagtagtggaagtgcttgc

SEQ ID NO: 165003 - DNA, 24 bp, Artificial sequence
  SiRNA target sequence
ctgttagtagtggaagtgcttgca

SEQ ID NO: 165004 - DNA, 24 bp, Artificial sequence
  SiRNA target sequence
tgttagtagtggaagtgcttgcac

SEQ ID NO: 165005 - DNA, 24 bp, Artificial sequence
  SiRNA target sequence
gttagtagtggaagtgcttgcact

SEQ ID NO: 165006 - DNA, 24 bp, Artificial sequence
  SiRNA target sequence
ttagtagtggaagtgcttgcactt

SEQ ID NO: 165007 - DNA, 24 bp, Artificial sequence
  SiRNA target sequence
tagtagtggaagtgcttgcacttc

SEQ ID NO: 165008 - DNA, 24 bp, Artificial sequence
  SiRNA target sequence
agtagtggaagtgcttgcacttca

SEQ ID NO: 165009 - DNA, 24 bp, Artificial sequence
  SiRNA target sequence
gtagtggaagtgcttgcacttcat

SEQ ID NO: 165010 - DNA, 24 bp, Artificial sequence
  SiRNA target sequence
tagtggaagtgcttgcacttcatc

SEQ ID NO: 165011 - DNA, 24 bp, Artificial sequence
  SiRNA target sequence
agtggaagtgcttgcacttcatca

SEQ ID NO: 165012 - DNA, 24 bp, Artificial sequence
  SiRNA target sequence
gtggaagtgcttgcacttcatcat

SEQ ID NO: 165013 - DNA, 24 bp, Artificial sequence
  SiRNA target sequence
tggaagtgcttgcacttcatcatc

SEQ ID NO: 165014 - DNA, 24 bp, Artificial sequence
  SiRNA target sequence
ggaagtgcttgcacttcatcatct

SEQ ID NO: 165015 - DNA, 24 bp, Artificial sequence
  SiRNA target sequence
gaagtgcttgcacttcatcatctt

SEQ ID NO: 165016 - DNA, 24 bp, Artificial sequence
  SiRNA target sequence
aagtgcttgcacttcatcatcttt

SEQ ID NO: 165017 - DNA, 24 bp, Artificial sequence
  SiRNA target sequence
agtgcttgcacttcatcatcttta

SEQ ID NO: 165018 - DNA, 24 bp, Artificial sequence
  SiRNA target sequence
gtgcttgcacttcatcatctttag

SEQ ID NO: 165019 - DNA, 24 bp, Artificial sequence
  SiRNA target sequence
tgcttgcacttcatcatctttaga

SEQ ID NO: 165020 - DNA, 24 bp, Artificial sequence
  SiRNA target sequence
gcttgcacttcatcatctttagaa

SEQ ID NO: 165021 - DNA, 24 bp, Artificial sequence
  SiRNA target sequence
cttgcacttcatcatctttagaac

SEQ ID NO: 165022 - DNA, 24 bp, Artificial sequence
  SiRNA target sequence
ttgcacttcatcatctttagaacc

SEQ ID NO: 165023 - DNA, 24 bp, Artificial sequence
  SiRNA target sequence
tgcacttcatcatctttagaaccc

SEQ ID NO: 165024 - DNA, 24 bp, Artificial sequence
  SiRNA target sequence
gcacttcatcatctttagaaccct

SEQ ID NO: 165025 - DNA, 24 bp, Artificial sequence
  SiRNA target sequence
cacttcatcatctttagaaccctc

SEQ ID NO: 165026 - DNA, 24 bp, Artificial sequence
  SiRNA target sequence
acttcatcatctttagaaccctct

SEQ ID NO: 165027 - DNA, 24 bp, Artificial sequence
  SiRNA target sequence
cttcatcatctttagaaccctctt

SEQ ID NO: 165028 - DNA, 24 bp, Artificial sequence
  SiRNA target sequence
ttcatcatctttagaaccctctta

SEQ ID NO: 165029 - DNA, 24 bp, Artificial sequence
  SiRNA target sequence
tcatcatctttagaaccctcttat

SEQ ID NO: 165030 - DNA, 24 bp, Artificial sequence
  SiRNA target sequence
catcatctttagaaccctcttatg

SEQ ID NO: 165031 - DNA, 24 bp, Artificial sequence
  SiRNA target sequence
atcatctttagaaccctcttatgt

SEQ ID NO: 165032 - DNA, 24 bp, Artificial sequence
  SiRNA target sequence
tcatctttagaaccctcttatgtt

SEQ ID NO: 165033 - DNA, 24 bp, Artificial sequence
  SiRNA target sequence
catctttagaaccctcttatgttt

SEQ ID NO: 165034 - DNA, 24 bp, Artificial sequence
  SiRNA target sequence
atctttagaaccctcttatgtttt

SEQ ID NO: 165035 - DNA, 24 bp, Artificial sequence
  SiRNA target sequence
tctttagaaccctcttatgttttg

SEQ ID NO: 165036 - DNA, 24 bp, Artificial sequence
  SiRNA target sequence
ctttagaaccctcttatgttttgc

SEQ ID NO: 165037 - DNA, 24 bp, Artificial sequence
  SiRNA target sequence
tttagaaccctcttatgttttgcg

SEQ ID NO: 165038 - DNA, 24 bp, Artificial sequence
  SiRNA target sequence
ttagaaccctcttatgttttgcga

SEQ ID NO: 165039 - DNA, 24 bp, Artificial sequence
  SiRNA target sequence
tagaaccctcttatgttttgcgag

SEQ ID NO: 165040 - DNA, 24 bp, Artificial sequence
  SiRNA target sequence
agaaccctcttatgttttgcgagc

SEQ ID NO: 165041 - DNA, 24 bp, Artificial sequence
  SiRNA target sequence
gaaccctcttatgttttgcgagct

SEQ ID NO: 165042 - DNA, 24 bp, Artificial sequence
  SiRNA target sequence
aaccctcttatgttttgcgagctt

SEQ ID NO: 165043 - DNA, 24 bp, Artificial sequence
  SiRNA target sequence
accctcttatgttttgcgagcttt

SEQ ID NO: 165044 - DNA, 24 bp, Artificial sequence
  SiRNA target sequence
ccctcttatgttttgcgagcttta

SEQ ID NO: 165045 - DNA, 24 bp, Artificial sequence
  SiRNA target sequence
cctcttatgttttgcgagctttag

SEQ ID NO: 165046 - DNA, 24 bp, Artificial sequence
  SiRNA target sequence
ctcttatgttttgcgagctttagg

SEQ ID NO: 165047 - DNA, 24 bp, Artificial sequence
  SiRNA target sequence
tcttatgttttgcgagctttaggc

SEQ ID NO: 165048 - DNA, 24 bp, Artificial sequence
  SiRNA target sequence
cttatgttttgcgagctttaggca

SEQ ID NO: 165049 - DNA, 24 bp, Artificial sequence
  SiRNA target sequence
ttatgttttgcgagctttaggcaa

SEQ ID NO: 165050 - DNA, 24 bp, Artificial sequence
  SiRNA target sequence
tatgttttgcgagctttaggcaaa

SEQ ID NO: 165051 - DNA, 24 bp, Artificial sequence
  SiRNA target sequence
atgttttgcgagctttaggcaaaa

SEQ ID NO: 165052 - DNA, 24 bp, Artificial sequence
  SiRNA target sequence
tgttttgcgagctttaggcaaaaa

SEQ ID NO: 165053 - DNA, 24 bp, Artificial sequence
  SiRNA target sequence
gttttgcgagctttaggcaaaaat

SEQ ID NO: 165054 - DNA, 24 bp, Artificial sequence
  SiRNA target sequence
ttttgcgagctttaggcaaaaatg

SEQ ID NO: 165055 - DNA, 24 bp, Artificial sequence
  SiRNA target sequence
tttgcgagctttaggcaaaaatga

SEQ ID NO: 165056 - DNA, 24 bp, Artificial sequence
  SiRNA target sequence
ttgcgagctttaggcaaaaatgat

SEQ ID NO: 165057 - DNA, 24 bp, Artificial sequence
  SiRNA target sequence
tgcgagctttaggcaaaaatgatg

SEQ ID NO: 165058 - DNA, 24 bp, Artificial sequence
  SiRNA target sequence
gcgagctttaggcaaaaatgatga

SEQ ID NO: 165059 - DNA, 24 bp, Artificial sequence
  SiRNA target sequence
cgagctttaggcaaaaatgatgat

SEQ ID NO: 165060 - DNA, 24 bp, Artificial sequence
  SiRNA target sequence
gagctttaggcaaaaatgatgatc

SEQ ID NO: 165061 - DNA, 24 bp, Artificial sequence
  SiRNA target sequence
agctttaggcaaaaatgatgatct

SEQ ID NO: 165062 - DNA, 24 bp, Artificial sequence
  SiRNA target sequence
gctttaggcaaaaatgatgatctt

SEQ ID NO: 165063 - DNA, 24 bp, Artificial sequence
  SiRNA target sequence
ctttaggcaaaaatgatgatcttg

SEQ ID NO: 165064 - DNA, 24 bp, Artificial sequence
  SiRNA target sequence
tttaggcaaaaatgatgatcttgc

SEQ ID NO: 165065 - DNA, 24 bp, Artificial sequence
  SiRNA target sequence
ttaggcaaaaatgatgatcttgcg

SEQ ID NO: 165066 - DNA, 24 bp, Artificial sequence
  SiRNA target sequence
taggcaaaaatgatgatcttgcgc

SEQ ID NO: 165067 - DNA, 24 bp, Artificial sequence
  SiRNA target sequence
aggcaaaaatgatgatcttgcgca

SEQ ID NO: 165068 - DNA, 24 bp, Artificial sequence
  SiRNA target sequence
ggcaaaaatgatgatcttgcgcat

SEQ ID NO: 165069 - DNA, 24 bp, Artificial sequence
  SiRNA target sequence
gcaaaaatgatgatcttgcgcatt

SEQ ID NO: 165070 - DNA, 24 bp, Artificial sequence
  SiRNA target sequence
caaaaatgatgatcttgcgcattc

SEQ ID NO: 165071 - DNA, 24 bp, Artificial sequence
  SiRNA target sequence
aaaaatgatgatcttgcgcattct

SEQ ID NO: 165072 - DNA, 24 bp, Artificial sequence
  SiRNA target sequence
aaaatgatgatcttgcgcattctt

SEQ ID NO: 165073 - DNA, 24 bp, Artificial sequence
  SiRNA target sequence
aaatgatgatcttgcgcattcttc

SEQ ID NO: 165074 - DNA, 24 bp, Artificial sequence
  SiRNA target sequence
aatgatgatcttgcgcattcttct

SEQ ID NO: 165075 - DNA, 24 bp, Artificial sequence
  SiRNA target sequence
atgatgatcttgcgcattcttcta

SEQ ID NO: 165076 - DNA, 24 bp, Artificial sequence
  SiRNA target sequence
tgatgatcttgcgcattcttctat

SEQ ID NO: 165077 - DNA, 24 bp, Artificial sequence
  SiRNA target sequence
gatgatcttgcgcattcttctata

SEQ ID NO: 165078 - DNA, 24 bp, Artificial sequence
  SiRNA target sequence
atgatcttgcgcattcttctataa

SEQ ID NO: 165079 - DNA, 24 bp, Artificial sequence
  SiRNA target sequence
tgatcttgcgcattcttctataag

SEQ ID NO: 165080 - DNA, 24 bp, Artificial sequence
  SiRNA target sequence
gatcttgcgcattcttctataaga

SEQ ID NO: 165081 - DNA, 24 bp, Artificial sequence
  SiRNA target sequence
atcttgcgcattcttctataagat

SEQ ID NO: 165082 - DNA, 24 bp, Artificial sequence
  SiRNA target sequence
tcttgcgcattcttctataagatt

SEQ ID NO: 165083 - DNA, 24 bp, Artificial sequence
  SiRNA target sequence
cttgcgcattcttctataagattt

SEQ ID NO: 165084 - DNA, 24 bp, Artificial sequence
  SiRNA target sequence
ttgcgcattcttctataagatttg

SEQ ID NO: 165085 - DNA, 24 bp, Artificial sequence
  SiRNA target sequence
tgcgcattcttctataagatttgg

SEQ ID NO: 165086 - DNA, 24 bp, Artificial sequence
  SiRNA target sequence
gcgcattcttctataagatttgga

SEQ ID NO: 165087 - DNA, 24 bp, Artificial sequence
  SiRNA target sequence
cgcattcttctataagatttggaa

SEQ ID NO: 165088 - DNA, 24 bp, Artificial sequence
  SiRNA target sequence
gcattcttctataagatttggaat

SEQ ID NO: 165089 - DNA, 24 bp, Artificial sequence
  SiRNA target sequence
cattcttctataagatttggaata

SEQ ID NO: 165090 - DNA, 24 bp, Artificial sequence
  SiRNA target sequence
attcttctataagatttggaataa

SEQ ID NO: 165091 - DNA, 24 bp, Artificial sequence
  SiRNA target sequence
ttcttctataagatttggaataaa

SEQ ID NO: 165092 - DNA, 24 bp, Artificial sequence
  SiRNA target sequence
tcttctataagatttggaataaat

SEQ ID NO: 165093 - DNA, 24 bp, Artificial sequence
  SiRNA target sequence
cttctataagatttggaataaata

SEQ ID NO: 165094 - DNA, 24 bp, Artificial sequence
  SiRNA target sequence
ttctataagatttggaataaataa

SEQ ID NO: 165095 - DNA, 24 bp, Artificial sequence
  SiRNA target sequence
tctataagatttggaataaataag

SEQ ID NO: 165096 - DNA, 24 bp, Artificial sequence
  SiRNA target sequence
ctataagatttggaataaataagt

SEQ ID NO: 165097 - DNA, 24 bp, Artificial sequence
  SiRNA target sequence
tataagatttggaataaataagtt

SEQ ID NO: 165098 - DNA, 24 bp, Artificial sequence
  SiRNA target sequence
ataagatttggaataaataagttt

SEQ ID NO: 165099 - DNA, 24 bp, Artificial sequence
  SiRNA target sequence
taagatttggaataaataagttta

SEQ ID NO: 165100 - DNA, 24 bp, Artificial sequence
  SiRNA target sequence
aagatttggaataaataagtttac

SEQ ID NO: 165101 - DNA, 24 bp, Artificial sequence
  SiRNA target sequence
agatttggaataaataagtttaca

SEQ ID NO: 165102 - DNA, 24 bp, Artificial sequence
  SiRNA target sequence
gatttggaataaataagtttacaa

SEQ ID NO: 165103 - DNA, 24 bp, Artificial sequence
  SiRNA target sequence
atttggaataaataagtttacaac

SEQ ID NO: 165104 - DNA, 24 bp, Artificial sequence
  SiRNA target sequence
tttggaataaataagtttacaact

SEQ ID NO: 165105 - DNA, 24 bp, Artificial sequence
  SiRNA target sequence
ttggaataaataagtttacaactg

SEQ ID NO: 165106 - DNA, 24 bp, Artificial sequence
  SiRNA target sequence
tggaataaataagtttacaactga

SEQ ID NO: 165107 - DNA, 24 bp, Artificial sequence
  SiRNA target sequence
ggaataaataagtttacaactgaa

SEQ ID NO: 165108 - DNA, 24 bp, Artificial sequence
  SiRNA target sequence
gaataaataagtttacaactgaag

SEQ ID NO: 165109 - DNA, 24 bp, Artificial sequence
  SiRNA target sequence
aataaataagtttacaactgaaga

SEQ ID NO: 165110 - DNA, 24 bp, Artificial sequence
  SiRNA target sequence
ataaataagtttacaactgaagaa

SEQ ID NO: 165111 - DNA, 24 bp, Artificial sequence
  SiRNA target sequence
taaataagtttacaactgaagaag

SEQ ID NO: 165112 - DNA, 24 bp, Artificial sequence
  SiRNA target sequence
aaataagtttacaactgaagaaga

SEQ ID NO: 165113 - DNA, 24 bp, Artificial sequence
  SiRNA target sequence
aataagtttacaactgaagaagaa

SEQ ID NO: 165114 - DNA, 24 bp, Artificial sequence
  SiRNA target sequence
ataagtttacaactgaagaagaaa

SEQ ID NO: 165115 - DNA, 24 bp, Artificial sequence
  SiRNA target sequence
taagtttacaactgaagaagaaat

SEQ ID NO: 165116 - DNA, 24 bp, Artificial sequence
  SiRNA target sequence
aagtttacaactgaagaagaaatc

SEQ ID NO: 165117 - DNA, 24 bp, Artificial sequence
  SiRNA target sequence
agtttacaactgaagaagaaatca

SEQ ID NO: 165118 - DNA, 24 bp, Artificial sequence
  SiRNA target sequence
gtttacaactgaagaagaaatcaa

SEQ ID NO: 165119 - DNA, 24 bp, Artificial sequence
  SiRNA target sequence
tttacaactgaagaagaaatcaat

SEQ ID NO: 165120 - DNA, 24 bp, Artificial sequence
  SiRNA target sequence
ttacaactgaagaagaaatcaata

SEQ ID NO: 165121 - DNA, 24 bp, Artificial sequence
  SiRNA target sequence
tacaactgaagaagaaatcaataa

SEQ ID NO: 165122 - DNA, 24 bp, Artificial sequence
  SiRNA target sequence
acaactgaagaagaaatcaataaa

SEQ ID NO: 165123 - DNA, 24 bp, Artificial sequence
  SiRNA target sequence
caactgaagaagaaatcaataaag

SEQ ID NO: 165124 - DNA, 24 bp, Artificial sequence
  SiRNA target sequence
aactgaagaagaaatcaataaagt

SEQ ID NO: 165125 - DNA, 24 bp, Artificial sequence
  SiRNA target sequence
actgaagaagaaatcaataaagta

SEQ ID NO: 165126 - DNA, 24 bp, Artificial sequence
  SiRNA target sequence
ctgaagaagaaatcaataaagtat

SEQ ID NO: 165127 - DNA, 24 bp, Artificial sequence
  SiRNA target sequence
tgaagaagaaatcaataaagtatc

SEQ ID NO: 165128 - DNA, 24 bp, Artificial sequence
  SiRNA target sequence
gaagaagaaatcaataaagtatct

SEQ ID NO: 165129 - DNA, 24 bp, Artificial sequence
  SiRNA target sequence
aagaagaaatcaataaagtatcta

SEQ ID NO: 165130 - DNA, 24 bp, Artificial sequence
  SiRNA target sequence
agaagaaatcaataaagtatctag

SEQ ID NO: 165131 - DNA, 24 bp, Artificial sequence
  SiRNA target sequence
gaagaaatcaataaagtatctagt

SEQ ID NO: 165132 - DNA, 24 bp, Artificial sequence
  SiRNA target sequence
aagaaatcaataaagtatctagtg

SEQ ID NO: 165133 - DNA, 24 bp, Artificial sequence
  SiRNA target sequence
agaaatcaataaagtatctagtga

SEQ ID NO: 165134 - DNA, 24 bp, Artificial sequence
  SiRNA target sequence
gaaatcaataaagtatctagtgat

SEQ ID NO: 165135 - DNA, 24 bp, Artificial sequence
  SiRNA target sequence
aaatcaataaagtatctagtgata

SEQ ID NO: 165136 - DNA, 24 bp, Artificial sequence
  SiRNA target sequence
aatcaataaagtatctagtgatac

SEQ ID NO: 165137 - DNA, 24 bp, Artificial sequence
  SiRNA target sequence
atcaataaagtatctagtgataca

SEQ ID NO: 165138 - DNA, 24 bp, Artificial sequence
  SiRNA target sequence
tcaataaagtatctagtgatacaa

SEQ ID NO: 165139 - DNA, 24 bp, Artificial sequence
  SiRNA target sequence
caataaagtatctagtgatacaat

SEQ ID NO: 165140 - DNA, 24 bp, Artificial sequence
  SiRNA target sequence
aataaagtatctagtgatacaatt

SEQ ID NO: 165141 - DNA, 24 bp, Artificial sequence
  SiRNA target sequence
ataaagtatctagtgatacaatta

SEQ ID NO: 165142 - DNA, 24 bp, Artificial sequence
  SiRNA target sequence
taaagtatctagtgatacaattaa

SEQ ID NO: 165143 - DNA, 24 bp, Artificial sequence
  SiRNA target sequence
aaagtatctagtgatacaattaaa

SEQ ID NO: 165144 - DNA, 24 bp, Artificial sequence
  SiRNA target sequence
aagtatctagtgatacaattaaag

SEQ ID NO: 165145 - DNA, 24 bp, Artificial sequence
  SiRNA target sequence
agtatctagtgatacaattaaagc

SEQ ID NO: 165146 - DNA, 24 bp, Artificial sequence
  SiRNA target sequence
gtatctagtgatacaattaaagct

SEQ ID NO: 165147 - DNA, 24 bp, Artificial sequence
  SiRNA target sequence
tatctagtgatacaattaaagctg

SEQ ID NO: 165148 - DNA, 24 bp, Artificial sequence
  SiRNA target sequence
atctagtgatacaattaaagctgt

SEQ ID NO: 165149 - DNA, 24 bp, Artificial sequence
  SiRNA target sequence
tctagtgatacaattaaagctgtt

SEQ ID NO: 165150 - DNA, 24 bp, Artificial sequence
  SiRNA target sequence
ctagtgatacaattaaagctgtta

SEQ ID NO: 165151 - DNA, 24 bp, Artificial sequence
  SiRNA target sequence
tagtgatacaattaaagctgttaa

SEQ ID NO: 165152 - DNA, 24 bp, Artificial sequence
  SiRNA target sequence
agtgatacaattaaagctgttaat

SEQ ID NO: 165153 - DNA, 24 bp, Artificial sequence
  SiRNA target sequence
gtgatacaattaaagctgttaata

SEQ ID NO: 165154 - DNA, 24 bp, Artificial sequence
  SiRNA target sequence
tgatacaattaaagctgttaataa

SEQ ID NO: 165155 - DNA, 24 bp, Artificial sequence
  SiRNA target sequence
gatacaattaaagctgttaataag

SEQ ID NO: 165156 - DNA, 24 bp, Artificial sequence
  SiRNA target sequence
atacaattaaagctgttaataagt

SEQ ID NO: 165157 - DNA, 24 bp, Artificial sequence
  SiRNA target sequence
tacaattaaagctgttaataagtt

SEQ ID NO: 165158 - DNA, 24 bp, Artificial sequence
  SiRNA target sequence
acaattaaagctgttaataagtta

SEQ ID NO: 165159 - DNA, 24 bp, Artificial sequence
  SiRNA target sequence
caattaaagctgttaataagttaa

SEQ ID NO: 165160 - DNA, 24 bp, Artificial sequence
  SiRNA target sequence
aattaaagctgttaataagttaag

SEQ ID NO: 165161 - DNA, 24 bp, Artificial sequence
  SiRNA target sequence
attaaagctgttaataagttaaga

SEQ ID NO: 165162 - DNA, 24 bp, Artificial sequence
  SiRNA target sequence
ttaaagctgttaataagttaagag

SEQ ID NO: 165163 - DNA, 24 bp, Artificial sequence
  SiRNA target sequence
taaagctgttaataagttaagaga

SEQ ID NO: 165164 - DNA, 24 bp, Artificial sequence
  SiRNA target sequence
aaagctgttaataagttaagagat

SEQ ID NO: 165165 - DNA, 24 bp, Artificial sequence
  SiRNA target sequence
aagctgttaataagttaagagata

SEQ ID NO: 165166 - DNA, 24 bp, Artificial sequence
  SiRNA target sequence
agctgttaataagttaagagatat

SEQ ID NO: 165167 - DNA, 24 bp, Artificial sequence
  SiRNA target sequence
gctgttaataagttaagagatatg

SEQ ID NO: 165168 - DNA, 24 bp, Artificial sequence
  SiRNA target sequence
ctgttaataagttaagagatatgt

SEQ ID NO: 165169 - DNA, 24 bp, Artificial sequence
  SiRNA target sequence
tgttaataagttaagagatatgtc

SEQ ID NO: 165170 - DNA, 24 bp, Artificial sequence
  SiRNA target sequence
gttaataagttaagagatatgtct

SEQ ID NO: 165171 - DNA, 24 bp, Artificial sequence
  SiRNA target sequence
ttaataagttaagagatatgtctc

SEQ ID NO: 165172 - DNA, 24 bp, Artificial sequence
  SiRNA target sequence
taataagttaagagatatgtctcc

SEQ ID NO: 165173 - DNA, 24 bp, Artificial sequence
  SiRNA target sequence
aataagttaagagatatgtctcct

SEQ ID NO: 165174 - DNA, 24 bp, Artificial sequence
  SiRNA target sequence
ataagttaagagatatgtctcctt

SEQ ID NO: 165175 - DNA, 24 bp, Artificial sequence
  SiRNA target sequence
taagttaagagatatgtctccttt

SEQ ID NO: 165176 - DNA, 24 bp, Artificial sequence
  SiRNA target sequence
aagttaagagatatgtctccttta

SEQ ID NO: 165177 - DNA, 24 bp, Artificial sequence
  SiRNA target sequence
agttaagagatatgtctcctttat

SEQ ID NO: 165178 - DNA, 24 bp, Artificial sequence
  SiRNA target sequence
gttaagagatatgtctcctttata

SEQ ID NO: 165179 - DNA, 24 bp, Artificial sequence
  SiRNA target sequence
ttaagagatatgtctcctttatat

SEQ ID NO: 165180 - DNA, 24 bp, Artificial sequence
  SiRNA target sequence
taagagatatgtctcctttatatg

SEQ ID NO: 165181 - DNA, 24 bp, Artificial sequence
  SiRNA target sequence
aagagatatgtctcctttatatga

SEQ ID NO: 165182 - DNA, 24 bp, Artificial sequence
  SiRNA target sequence
agagatatgtctcctttatatgaa

SEQ ID NO: 165183 - DNA, 24 bp, Artificial sequence
  SiRNA target sequence
gagatatgtctcctttatatgaaa

SEQ ID NO: 165184 - DNA, 24 bp, Artificial sequence
  SiRNA target sequence
agatatgtctcctttatatgaaat

SEQ ID NO: 165185 - DNA, 24 bp, Artificial sequence
  SiRNA target sequence
gatatgtctcctttatatgaaatg

SEQ ID NO: 165186 - DNA, 24 bp, Artificial sequence
  SiRNA target sequence
atatgtctcctttatatgaaatgg

SEQ ID NO: 165187 - DNA, 24 bp, Artificial sequence
  SiRNA target sequence
tatgtctcctttatatgaaatggt

SEQ ID NO: 165188 - DNA, 24 bp, Artificial sequence
  SiRNA target sequence
atgtctcctttatatgaaatggtc

SEQ ID NO: 165189 - DNA, 24 bp, Artificial sequence
  SiRNA target sequence
tgtctcctttatatgaaatggtca

SEQ ID NO: 165190 - DNA, 24 bp, Artificial sequence
  SiRNA target sequence
gtctcctttatatgaaatggtcaa

SEQ ID NO: 165191 - DNA, 24 bp, Artificial sequence
  SiRNA target sequence
tctcctttatatgaaatggtcaaa

SEQ ID NO: 165192 - DNA, 24 bp, Artificial sequence
  SiRNA target sequence
ctcctttatatgaaatggtcaaag

SEQ ID NO: 165193 - DNA, 24 bp, Artificial sequence
  SiRNA target sequence
tcctttatatgaaatggtcaaaga

SEQ ID NO: 165194 - DNA, 24 bp, Artificial sequence
  SiRNA target sequence
cctttatatgaaatggtcaaagaa

SEQ ID NO: 165195 - DNA, 24 bp, Artificial sequence
  SiRNA target sequence
ctttatatgaaatggtcaaagaag

SEQ ID NO: 165196 - DNA, 24 bp, Artificial sequence
  SiRNA target sequence
tttatatgaaatggtcaaagaagg

SEQ ID NO: 165197 - DNA, 24 bp, Artificial sequence
  SiRNA target sequence
ttatatgaaatggtcaaagaaggg

SEQ ID NO: 165198 - DNA, 24 bp, Artificial sequence
  SiRNA target sequence
tatatgaaatggtcaaagaaggga

SEQ ID NO: 165199 - DNA, 24 bp, Artificial sequence
  SiRNA target sequence
atatgaaatggtcaaagaagggat

SEQ ID NO: 165200 - DNA, 24 bp, Artificial sequence
  SiRNA target sequence
tatgaaatggtcaaagaagggata

SEQ ID NO: 165201 - DNA, 24 bp, Artificial sequence
  SiRNA target sequence
atgaaatggtcaaagaagggatag

SEQ ID NO: 165202 - DNA, 24 bp, Artificial sequence
  SiRNA target sequence
tgaaatggtcaaagaagggataga

SEQ ID NO: 165203 - DNA, 24 bp, Artificial sequence
  SiRNA target sequence
gaaatggtcaaagaagggatagat

SEQ ID NO: 165204 - DNA, 24 bp, Artificial sequence
  SiRNA target sequence
aaatggtcaaagaagggatagatt

SEQ ID NO: 165205 - DNA, 24 bp, Artificial sequence
  SiRNA target sequence
aatggtcaaagaagggatagattt

SEQ ID NO: 165206 - DNA, 24 bp, Artificial sequence
  SiRNA target sequence
atggtcaaagaagggatagattta

SEQ ID NO: 165207 - DNA, 24 bp, Artificial sequence
  SiRNA target sequence
tggtcaaagaagggatagatttag

SEQ ID NO: 165208 - DNA, 24 bp, Artificial sequence
  SiRNA target sequence
ggtcaaagaagggatagatttaga

SEQ ID NO: 165209 - DNA, 24 bp, Artificial sequence
  SiRNA target sequence
gtcaaagaagggatagatttagat

SEQ ID NO: 165210 - DNA, 24 bp, Artificial sequence
  SiRNA target sequence
tcaaagaagggatagatttagata

SEQ ID NO: 165211 - DNA, 24 bp, Artificial sequence
  SiRNA target sequence
caaagaagggatagatttagataa

SEQ ID NO: 165212 - DNA, 24 bp, Artificial sequence
  SiRNA target sequence
aaagaagggatagatttagataaa

SEQ ID NO: 165213 - DNA, 24 bp, Artificial sequence
  SiRNA target sequence
aagaagggatagatttagataaaa

SEQ ID NO: 165214 - DNA, 24 bp, Artificial sequence
  SiRNA target sequence
agaagggatagatttagataaaat

SEQ ID NO: 165215 - DNA, 24 bp, Artificial sequence
  SiRNA target sequence
gaagggatagatttagataaaatt

SEQ ID NO: 165216 - DNA, 24 bp, Artificial sequence
  SiRNA target sequence
aagggatagatttagataaaatta

SEQ ID NO: 165217 - DNA, 24 bp, Artificial sequence
  SiRNA target sequence
agggatagatttagataaaattaa

SEQ ID NO: 165218 - DNA, 24 bp, Artificial sequence
  SiRNA target sequence
gggatagatttagataaaattaat

SEQ ID NO: 165219 - DNA, 24 bp, Artificial sequence
  SiRNA target sequence
ggatagatttagataaaattaatt

SEQ ID NO: 165220 - DNA, 24 bp, Artificial sequence
  SiRNA target sequence
gatagatttagataaaattaattg

SEQ ID NO: 165221 - DNA, 24 bp, Artificial sequence
  SiRNA target sequence
atagatttagataaaattaattgg

SEQ ID NO: 165222 - DNA, 24 bp, Artificial sequence
  SiRNA target sequence
tagatttagataaaattaattggt

SEQ ID NO: 165223 - DNA, 24 bp, Artificial sequence
  SiRNA target sequence
agatttagataaaattaattggtc

SEQ ID NO: 165224 - DNA, 24 bp, Artificial sequence
  SiRNA target sequence
gatttagataaaattaattggtct

SEQ ID NO: 165225 - DNA, 24 bp, Artificial sequence
  SiRNA target sequence
atttagataaaattaattggtctg

SEQ ID NO: 165226 - DNA, 24 bp, Artificial sequence
  SiRNA target sequence
tttagataaaattaattggtctgc

SEQ ID NO: 165227 - DNA, 24 bp, Artificial sequence
  SiRNA target sequence
ttagataaaattaattggtctgct

SEQ ID NO: 165228 - DNA, 24 bp, Artificial sequence
  SiRNA target sequence
tagataaaattaattggtctgctt

SEQ ID NO: 165229 - DNA, 24 bp, Artificial sequence
  SiRNA target sequence
agataaaattaattggtctgctta

SEQ ID NO: 165230 - DNA, 24 bp, Artificial sequence
  SiRNA target sequence
gataaaattaattggtctgcttaa

SEQ ID NO: 165231 - DNA, 25 bp, Artificial sequence
  SiRNA target sequence
atgttatttttttatagccccattt

SEQ ID NO: 165232 - DNA, 25 bp, Artificial sequence
  SiRNA target sequence
tgttatttttttatagccccatttt

SEQ ID NO: 165233 - DNA, 25 bp, Artificial sequence
  SiRNA target sequence
gttatttttttatagccccattttt

SEQ ID NO: 165234 - DNA, 25 bp, Artificial sequence
  SiRNA target sequence
ttatttttttatagccccattttta

SEQ ID NO: 165235 - DNA, 25 bp, Artificial sequence
  SiRNA target sequence
tatttttttatagccccatttttat

SEQ ID NO: 165236 - DNA, 25 bp, Artificial sequence
  SiRNA target sequence
atttttttatagccccatttttatg

SEQ ID NO: 165237 - DNA, 25 bp, Artificial sequence
  SiRNA target sequence
tttttttatagccccatttttatga

SEQ ID NO: 165238 - DNA, 25 bp, Artificial sequence
  SiRNA target sequence
ttttttatagccccatttttatgac

SEQ ID NO: 165239 - DNA, 25 bp, Artificial sequence
  SiRNA target sequence
tttttatagccccatttttatgact

SEQ ID NO: 165240 - DNA, 25 bp, Artificial sequence
  SiRNA target sequence
ttttatagccccatttttatgacta

SEQ ID NO: 165241 - DNA, 25 bp, Artificial sequence
  SiRNA target sequence
tttatagccccatttttatgactaa

SEQ ID NO: 165242 - DNA, 25 bp, Artificial sequence
  SiRNA target sequence
ttatagccccatttttatgactaaa

SEQ ID NO: 165243 - DNA, 25 bp, Artificial sequence
  SiRNA target sequence
tatagccccatttttatgactaaaa

SEQ ID NO: 165244 - DNA, 25 bp, Artificial sequence
  SiRNA target sequence
atagccccatttttatgactaaaag

SEQ ID NO: 165245 - DNA, 25 bp, Artificial sequence
  SiRNA target sequence
tagccccatttttatgactaaaagt

SEQ ID NO: 165246 - DNA, 25 bp, Artificial sequence
  SiRNA target sequence
agccccatttttatgactaaaagtt

SEQ ID NO: 165247 - DNA, 25 bp, Artificial sequence
  SiRNA target sequence
gccccatttttatgactaaaagttt

SEQ ID NO: 165248 - DNA, 25 bp, Artificial sequence
  SiRNA target sequence
ccccatttttatgactaaaagttta

SEQ ID NO: 165249 - DNA, 25 bp, Artificial sequence
  SiRNA target sequence
cccatttttatgactaaaagtttaa

SEQ ID NO: 165250 - DNA, 25 bp, Artificial sequence
  SiRNA target sequence
ccatttttatgactaaaagtttaac

SEQ ID NO: 165251 - DNA, 25 bp, Artificial sequence
  SiRNA target sequence
catttttatgactaaaagtttaacg

SEQ ID NO: 165252 - DNA, 25 bp, Artificial sequence
  SiRNA target sequence
atttttatgactaaaagtttaacga

SEQ ID NO: 165253 - DNA, 25 bp, Artificial sequence
  SiRNA target sequence
tttttatgactaaaagtttaacgaa

SEQ ID NO: 165254 - DNA, 25 bp, Artificial sequence
  SiRNA target sequence
ttttatgactaaaagtttaacgaat

SEQ ID NO: 165255 - DNA, 25 bp, Artificial sequence
  SiRNA target sequence
tttatgactaaaagtttaacgaatt

SEQ ID NO: 165256 - DNA, 25 bp, Artificial sequence
  SiRNA target sequence
ttatgactaaaagtttaacgaattc

SEQ ID NO: 165257 - DNA, 25 bp, Artificial sequence
  SiRNA target sequence
tatgactaaaagtttaacgaattct

SEQ ID NO: 165258 - DNA, 25 bp, Artificial sequence
  SiRNA target sequence
atgactaaaagtttaacgaattcta

SEQ ID NO: 165259 - DNA, 25 bp, Artificial sequence
  SiRNA target sequence
tgactaaaagtttaacgaattctaa

SEQ ID NO: 165260 - DNA, 25 bp, Artificial sequence
  SiRNA target sequence
gactaaaagtttaacgaattctaaa

SEQ ID NO: 165261 - DNA, 25 bp, Artificial sequence
  SiRNA target sequence
actaaaagtttaacgaattctaaaa

SEQ ID NO: 165262 - DNA, 25 bp, Artificial sequence
  SiRNA target sequence
ctaaaagtttaacgaattctaaaac

SEQ ID NO: 165263 - DNA, 25 bp, Artificial sequence
  SiRNA target sequence
taaaagtttaacgaattctaaaact

SEQ ID NO: 165264 - DNA, 25 bp, Artificial sequence
  SiRNA target sequence
aaaagtttaacgaattctaaaactt

SEQ ID NO: 165265 - DNA, 25 bp, Artificial sequence
  SiRNA target sequence
aaagtttaacgaattctaaaacttt

SEQ ID NO: 165266 - DNA, 25 bp, Artificial sequence
  SiRNA target sequence
aagtttaacgaattctaaaacttta

SEQ ID NO: 165267 - DNA, 25 bp, Artificial sequence
  SiRNA target sequence
agtttaacgaattctaaaactttaa

SEQ ID NO: 165268 - DNA, 25 bp, Artificial sequence
  SiRNA target sequence
gtttaacgaattctaaaactttaaa

SEQ ID NO: 165269 - DNA, 25 bp, Artificial sequence
  SiRNA target sequence
tttaacgaattctaaaactttaaat

SEQ ID NO: 165270 - DNA, 25 bp, Artificial sequence
  SiRNA target sequence
ttaacgaattctaaaactttaaatt

SEQ ID NO: 165271 - DNA, 25 bp, Artificial sequence
  SiRNA target sequence
taacgaattctaaaactttaaattt

SEQ ID NO: 165272 - DNA, 25 bp, Artificial sequence
  SiRNA target sequence
aacgaattctaaaactttaaattta

SEQ ID NO: 165273 - DNA, 25 bp, Artificial sequence
  SiRNA target sequence
acgaattctaaaactttaaatttaa

SEQ ID NO: 165274 - DNA, 25 bp, Artificial sequence
  SiRNA target sequence
cgaattctaaaactttaaatttaat

SEQ ID NO: 165275 - DNA, 25 bp, Artificial sequence
  SiRNA target sequence
gaattctaaaactttaaatttaatg

SEQ ID NO: 165276 - DNA, 25 bp, Artificial sequence
  SiRNA target sequence
aattctaaaactttaaatttaatgt

SEQ ID NO: 165277 - DNA, 25 bp, Artificial sequence
  SiRNA target sequence
attctaaaactttaaatttaatgtc

SEQ ID NO: 165278 - DNA, 25 bp, Artificial sequence
  SiRNA target sequence
ttctaaaactttaaatttaatgtca

SEQ ID NO: 165279 - DNA, 25 bp, Artificial sequence
  SiRNA target sequence
tctaaaactttaaatttaatgtcaa

SEQ ID NO: 165280 - DNA, 25 bp, Artificial sequence
  SiRNA target sequence
ctaaaactttaaatttaatgtcaag

SEQ ID NO: 165281 - DNA, 25 bp, Artificial sequence
  SiRNA target sequence
taaaactttaaatttaatgtcaagt

SEQ ID NO: 165282 - DNA, 25 bp, Artificial sequence
  SiRNA target sequence
aaaactttaaatttaatgtcaagtg

SEQ ID NO: 165283 - DNA, 25 bp, Artificial sequence
  SiRNA target sequence
aaactttaaatttaatgtcaagtgt

SEQ ID NO: 165284 - DNA, 25 bp, Artificial sequence
  SiRNA target sequence
aactttaaatttaatgtcaagtgta

SEQ ID NO: 165285 - DNA, 25 bp, Artificial sequence
  SiRNA target sequence
actttaaatttaatgtcaagtgtac

SEQ ID NO: 165286 - DNA, 25 bp, Artificial sequence
  SiRNA target sequence
ctttaaatttaatgtcaagtgtaca

SEQ ID NO: 165287 - DNA, 25 bp, Artificial sequence
  SiRNA target sequence
tttaaatttaatgtcaagtgtacaa

SEQ ID NO: 165288 - DNA, 25 bp, Artificial sequence
  SiRNA target sequence
ttaaatttaatgtcaagtgtacaat

SEQ ID NO: 165289 - DNA, 25 bp, Artificial sequence
  SiRNA target sequence
taaatttaatgtcaagtgtacaatc

SEQ ID NO: 165290 - DNA, 25 bp, Artificial sequence
  SiRNA target sequence
aaatttaatgtcaagtgtacaatca

SEQ ID NO: 165291 - DNA, 25 bp, Artificial sequence
  SiRNA target sequence
aatttaatgtcaagtgtacaatcac

SEQ ID NO: 165292 - DNA, 25 bp, Artificial sequence
  SiRNA target sequence
atttaatgtcaagtgtacaatcacc

SEQ ID NO: 165293 - DNA, 25 bp, Artificial sequence
  SiRNA target sequence
tttaatgtcaagtgtacaatcacca

SEQ ID NO: 165294 - DNA, 25 bp, Artificial sequence
  SiRNA target sequence
ttaatgtcaagtgtacaatcaccag

SEQ ID NO: 165295 - DNA, 25 bp, Artificial sequence
  SiRNA target sequence
taatgtcaagtgtacaatcaccagt

SEQ ID NO: 165296 - DNA, 25 bp, Artificial sequence
  SiRNA target sequence
aatgtcaagtgtacaatcaccagtt

SEQ ID NO: 165297 - DNA, 25 bp, Artificial sequence
  SiRNA target sequence
atgtcaagtgtacaatcaccagtta

SEQ ID NO: 165298 - DNA, 25 bp, Artificial sequence
  SiRNA target sequence
tgtcaagtgtacaatcaccagttat

SEQ ID NO: 165299 - DNA, 25 bp, Artificial sequence
  SiRNA target sequence
gtcaagtgtacaatcaccagttata

SEQ ID NO: 165300 - DNA, 25 bp, Artificial sequence
  SiRNA target sequence
tcaagtgtacaatcaccagttataa

SEQ ID NO: 165301 - DNA, 25 bp, Artificial sequence
  SiRNA target sequence
caagtgtacaatcaccagttataaa

SEQ ID NO: 165302 - DNA, 25 bp, Artificial sequence
  SiRNA target sequence
aagtgtacaatcaccagttataaat

SEQ ID NO: 165303 - DNA, 25 bp, Artificial sequence
  SiRNA target sequence
agtgtacaatcaccagttataaata

SEQ ID NO: 165304 - DNA, 25 bp, Artificial sequence
  SiRNA target sequence
gtgtacaatcaccagttataaatac

SEQ ID NO: 165305 - DNA, 25 bp, Artificial sequence
  SiRNA target sequence
tgtacaatcaccagttataaataca

SEQ ID NO: 165306 - DNA, 25 bp, Artificial sequence
  SiRNA target sequence
gtacaatcaccagttataaatacaa

SEQ ID NO: 165307 - DNA, 25 bp, Artificial sequence
  SiRNA target sequence
tacaatcaccagttataaatacaaa

SEQ ID NO: 165308 - DNA, 25 bp, Artificial sequence
  SiRNA target sequence
acaatcaccagttataaatacaaaa

SEQ ID NO: 165309 - DNA, 25 bp, Artificial sequence
  SiRNA target sequence
caatcaccagttataaatacaaaaa

SEQ ID NO: 165310 - DNA, 25 bp, Artificial sequence
  SiRNA target sequence
aatcaccagttataaatacaaaaaa

SEQ ID NO: 165311 - DNA, 25 bp, Artificial sequence
  SiRNA target sequence
atcaccagttataaatacaaaaaaa

SEQ ID NO: 165312 - DNA, 25 bp, Artificial sequence
  SiRNA target sequence
tcaccagttataaatacaaaaaaaa

SEQ ID NO: 165313 - DNA, 25 bp, Artificial sequence
  SiRNA target sequence
caccagttataaatacaaaaaaaat

SEQ ID NO: 165314 - DNA, 25 bp, Artificial sequence
  SiRNA target sequence
accagttataaatacaaaaaaaata

SEQ ID NO: 165315 - DNA, 25 bp, Artificial sequence
  SiRNA target sequence
ccagttataaatacaaaaaaaatat

SEQ ID NO: 165316 - DNA, 25 bp, Artificial sequence
  SiRNA target sequence
cagttataaatacaaaaaaaatata

SEQ ID NO: 165317 - DNA, 25 bp, Artificial sequence
  SiRNA target sequence
agttataaatacaaaaaaaatatat

SEQ ID NO: 165318 - DNA, 25 bp, Artificial sequence
  SiRNA target sequence
gttataaatacaaaaaaaatatatc

SEQ ID NO: 165319 - DNA, 25 bp, Artificial sequence
  SiRNA target sequence
ttataaatacaaaaaaaatatatct

SEQ ID NO: 165320 - DNA, 25 bp, Artificial sequence
  SiRNA target sequence
tataaatacaaaaaaaatatatctt

SEQ ID NO: 165321 - DNA, 25 bp, Artificial sequence
  SiRNA target sequence
ataaatacaaaaaaaatatatcttg

SEQ ID NO: 165322 - DNA, 25 bp, Artificial sequence
  SiRNA target sequence
taaatacaaaaaaaatatatcttga

SEQ ID NO: 165323 - DNA, 25 bp, Artificial sequence
  SiRNA target sequence
aaatacaaaaaaaatatatcttgat

SEQ ID NO: 165324 - DNA, 25 bp, Artificial sequence
  SiRNA target sequence
aatacaaaaaaaatatatcttgatg

SEQ ID NO: 165325 - DNA, 25 bp, Artificial sequence
  SiRNA target sequence
atacaaaaaaaatatatcttgatgc

SEQ ID NO: 165326 - DNA, 25 bp, Artificial sequence
  SiRNA target sequence
tacaaaaaaaatatatcttgatgca

SEQ ID NO: 165327 - DNA, 25 bp, Artificial sequence
  SiRNA target sequence
acaaaaaaaatatatcttgatgcac

SEQ ID NO: 165328 - DNA, 25 bp, Artificial sequence
  SiRNA target sequence
caaaaaaaatatatcttgatgcaca

SEQ ID NO: 165329 - DNA, 25 bp, Artificial sequence
  SiRNA target sequence
aaaaaaaatatatcttgatgcacaa

SEQ ID NO: 165330 - DNA, 25 bp, Artificial sequence
  SiRNA target sequence
aaaaaaatatatcttgatgcacaag

SEQ ID NO: 165331 - DNA, 25 bp, Artificial sequence
  SiRNA target sequence
aaaaaatatatcttgatgcacaagc

SEQ ID NO: 165332 - DNA, 25 bp, Artificial sequence
  SiRNA target sequence
aaaaatatatcttgatgcacaagcg

SEQ ID NO: 165333 - DNA, 25 bp, Artificial sequence
  SiRNA target sequence
aaaatatatcttgatgcacaagcga

SEQ ID NO: 165334 - DNA, 25 bp, Artificial sequence
  SiRNA target sequence
aaatatatcttgatgcacaagcgac

SEQ ID NO: 165335 - DNA, 25 bp, Artificial sequence
  SiRNA target sequence
aatatatcttgatgcacaagcgacc

SEQ ID NO: 165336 - DNA, 25 bp, Artificial sequence
  SiRNA target sequence
atatatcttgatgcacaagcgacca

SEQ ID NO: 165337 - DNA, 25 bp, Artificial sequence
  SiRNA target sequence
tatatcttgatgcacaagcgaccaa

SEQ ID NO: 165338 - DNA, 25 bp, Artificial sequence
  SiRNA target sequence
atatcttgatgcacaagcgaccaag

SEQ ID NO: 165339 - DNA, 25 bp, Artificial sequence
  SiRNA target sequence
tatcttgatgcacaagcgaccaagc

SEQ ID NO: 165340 - DNA, 25 bp, Artificial sequence
  SiRNA target sequence
atcttgatgcacaagcgaccaagcc

SEQ ID NO: 165341 - DNA, 25 bp, Artificial sequence
  SiRNA target sequence
tcttgatgcacaagcgaccaagcct

SEQ ID NO: 165342 - DNA, 25 bp, Artificial sequence
  SiRNA target sequence
cttgatgcacaagcgaccaagcctt

SEQ ID NO: 165343 - DNA, 25 bp, Artificial sequence
  SiRNA target sequence
ttgatgcacaagcgaccaagccttt

SEQ ID NO: 165344 - DNA, 25 bp, Artificial sequence
  SiRNA target sequence
tgatgcacaagcgaccaagccttta

SEQ ID NO: 165345 - DNA, 25 bp, Artificial sequence
  SiRNA target sequence
gatgcacaagcgaccaagcctttag

SEQ ID NO: 165346 - DNA, 25 bp, Artificial sequence
  SiRNA target sequence
atgcacaagcgaccaagcctttaga

SEQ ID NO: 165347 - DNA, 25 bp, Artificial sequence
  SiRNA target sequence
tgcacaagcgaccaagcctttagac

SEQ ID NO: 165348 - DNA, 25 bp, Artificial sequence
  SiRNA target sequence
gcacaagcgaccaagcctttagacc

SEQ ID NO: 165349 - DNA, 25 bp, Artificial sequence
  SiRNA target sequence
cacaagcgaccaagcctttagaccc

SEQ ID NO: 165350 - DNA, 25 bp, Artificial sequence
  SiRNA target sequence
acaagcgaccaagcctttagacccg

SEQ ID NO: 165351 - DNA, 25 bp, Artificial sequence
  SiRNA target sequence
caagcgaccaagcctttagacccgc

SEQ ID NO: 165352 - DNA, 25 bp, Artificial sequence
  SiRNA target sequence
aagcgaccaagcctttagacccgcg

SEQ ID NO: 165353 - DNA, 25 bp, Artificial sequence
  SiRNA target sequence
agcgaccaagcctttagacccgcgt

SEQ ID NO: 165354 - DNA, 25 bp, Artificial sequence
  SiRNA target sequence
gcgaccaagcctttagacccgcgtg

SEQ ID NO: 165355 - DNA, 25 bp, Artificial sequence
  SiRNA target sequence
cgaccaagcctttagacccgcgtgt

SEQ ID NO: 165356 - DNA, 25 bp, Artificial sequence
  SiRNA target sequence
gaccaagcctttagacccgcgtgtg

SEQ ID NO: 165357 - DNA, 25 bp, Artificial sequence
  SiRNA target sequence
accaagcctttagacccgcgtgtgc

SEQ ID NO: 165358 - DNA, 25 bp, Artificial sequence
  SiRNA target sequence
ccaagcctttagacccgcgtgtgct

SEQ ID NO: 165359 - DNA, 25 bp, Artificial sequence
  SiRNA target sequence
caagcctttagacccgcgtgtgctt

SEQ ID NO: 165360 - DNA, 25 bp, Artificial sequence
  SiRNA target sequence
aagcctttagacccgcgtgtgcttg

SEQ ID NO: 165361 - DNA, 25 bp, Artificial sequence
  SiRNA target sequence
agcctttagacccgcgtgtgcttga

SEQ ID NO: 165362 - DNA, 25 bp, Artificial sequence
  SiRNA target sequence
gcctttagacccgcgtgtgcttgat

SEQ ID NO: 165363 - DNA, 25 bp, Artificial sequence
  SiRNA target sequence
cctttagacccgcgtgtgcttgatg

SEQ ID NO: 165364 - DNA, 25 bp, Artificial sequence
  SiRNA target sequence
ctttagacccgcgtgtgcttgatgc

SEQ ID NO: 165365 - DNA, 25 bp, Artificial sequence
  SiRNA target sequence
tttagacccgcgtgtgcttgatgca

SEQ ID NO: 165366 - DNA, 25 bp, Artificial sequence
  SiRNA target sequence
ttagacccgcgtgtgcttgatgcaa

SEQ ID NO: 165367 - DNA, 25 bp, Artificial sequence
  SiRNA target sequence
tagacccgcgtgtgcttgatgcaat

SEQ ID NO: 165368 - DNA, 25 bp, Artificial sequence
  SiRNA target sequence
agacccgcgtgtgcttgatgcaatg

SEQ ID NO: 165369 - DNA, 25 bp, Artificial sequence
  SiRNA target sequence
gacccgcgtgtgcttgatgcaatgc

SEQ ID NO: 165370 - DNA, 25 bp, Artificial sequence
  SiRNA target sequence
acccgcgtgtgcttgatgcaatgct

SEQ ID NO: 165371 - DNA, 25 bp, Artificial sequence
  SiRNA target sequence
cccgcgtgtgcttgatgcaatgctt

SEQ ID NO: 165372 - DNA, 25 bp, Artificial sequence
  SiRNA target sequence
ccgcgtgtgcttgatgcaatgcttc

SEQ ID NO: 165373 - DNA, 25 bp, Artificial sequence
  SiRNA target sequence
cgcgtgtgcttgatgcaatgcttcc

SEQ ID NO: 165374 - DNA, 25 bp, Artificial sequence
  SiRNA target sequence
gcgtgtgcttgatgcaatgcttcca

SEQ ID NO: 165375 - DNA, 25 bp, Artificial sequence
  SiRNA target sequence
cgtgtgcttgatgcaatgcttccat

SEQ ID NO: 165376 - DNA, 25 bp, Artificial sequence
  SiRNA target sequence
gtgtgcttgatgcaatgcttccata

SEQ ID NO: 165377 - DNA, 25 bp, Artificial sequence
  SiRNA target sequence
tgtgcttgatgcaatgcttccatac

SEQ ID NO: 165378 - DNA, 25 bp, Artificial sequence
  SiRNA target sequence
gtgcttgatgcaatgcttccatact

SEQ ID NO: 165379 - DNA, 25 bp, Artificial sequence
  SiRNA target sequence
tgcttgatgcaatgcttccatacta

SEQ ID NO: 165380 - DNA, 25 bp, Artificial sequence
  SiRNA target sequence
gcttgatgcaatgcttccatactat

SEQ ID NO: 165381 - DNA, 25 bp, Artificial sequence
  SiRNA target sequence
cttgatgcaatgcttccatactata

SEQ ID NO: 165382 - DNA, 25 bp, Artificial sequence
  SiRNA target sequence
ttgatgcaatgcttccatactatac

SEQ ID NO: 165383 - DNA, 25 bp, Artificial sequence
  SiRNA target sequence
tgatgcaatgcttccatactataca

SEQ ID NO: 165384 - DNA, 25 bp, Artificial sequence
  SiRNA target sequence
gatgcaatgcttccatactatacat

SEQ ID NO: 165385 - DNA, 25 bp, Artificial sequence
  SiRNA target sequence
atgcaatgcttccatactatacatc

SEQ ID NO: 165386 - DNA, 25 bp, Artificial sequence
  SiRNA target sequence
tgcaatgcttccatactatacatcc

SEQ ID NO: 165387 - DNA, 25 bp, Artificial sequence
  SiRNA target sequence
gcaatgcttccatactatacatcca

SEQ ID NO: 165388 - DNA, 25 bp, Artificial sequence
  SiRNA target sequence
caatgcttccatactatacatccat

SEQ ID NO: 165389 - DNA, 25 bp, Artificial sequence
  SiRNA target sequence
aatgcttccatactatacatccatt

SEQ ID NO: 165390 - DNA, 25 bp, Artificial sequence
  SiRNA target sequence
atgcttccatactatacatccattt

SEQ ID NO: 165391 - DNA, 25 bp, Artificial sequence
  SiRNA target sequence
tgcttccatactatacatccatttt

SEQ ID NO: 165392 - DNA, 25 bp, Artificial sequence
  SiRNA target sequence
gcttccatactatacatccattttt

SEQ ID NO: 165393 - DNA, 25 bp, Artificial sequence
  SiRNA target sequence
cttccatactatacatccatttttg

SEQ ID NO: 165394 - DNA, 25 bp, Artificial sequence
  SiRNA target sequence
ttccatactatacatccatttttgg

SEQ ID NO: 165395 - DNA, 25 bp, Artificial sequence
  SiRNA target sequence
tccatactatacatccatttttgga

SEQ ID NO: 165396 - DNA, 25 bp, Artificial sequence
  SiRNA target sequence
ccatactatacatccatttttggaa

SEQ ID NO: 165397 - DNA, 25 bp, Artificial sequence
  SiRNA target sequence
catactatacatccatttttggaaa

SEQ ID NO: 165398 - DNA, 25 bp, Artificial sequence
  SiRNA target sequence
atactatacatccatttttggaaat

SEQ ID NO: 165399 - DNA, 25 bp, Artificial sequence
  SiRNA target sequence
tactatacatccatttttggaaatc

SEQ ID NO: 165400 - DNA, 25 bp, Artificial sequence
  SiRNA target sequence
actatacatccatttttggaaatcc

SEQ ID NO: 165401 - DNA, 25 bp, Artificial sequence
  SiRNA target sequence
ctatacatccatttttggaaatcca

SEQ ID NO: 165402 - DNA, 25 bp, Artificial sequence
  SiRNA target sequence
tatacatccatttttggaaatccac

SEQ ID NO: 165403 - DNA, 25 bp, Artificial sequence
  SiRNA target sequence
atacatccatttttggaaatccaca

SEQ ID NO: 165404 - DNA, 25 bp, Artificial sequence
  SiRNA target sequence
tacatccatttttggaaatccacat

SEQ ID NO: 165405 - DNA, 25 bp, Artificial sequence
  SiRNA target sequence
acatccatttttggaaatccacatt

SEQ ID NO: 165406 - DNA, 25 bp, Artificial sequence
  SiRNA target sequence
catccatttttggaaatccacattc

SEQ ID NO: 165407 - DNA, 25 bp, Artificial sequence
  SiRNA target sequence
atccatttttggaaatccacattct

SEQ ID NO: 165408 - DNA, 25 bp, Artificial sequence
  SiRNA target sequence
tccatttttggaaatccacattctc

SEQ ID NO: 165409 - DNA, 25 bp, Artificial sequence
  SiRNA target sequence
ccatttttggaaatccacattctcg

SEQ ID NO: 165410 - DNA, 25 bp, Artificial sequence
  SiRNA target sequence
catttttggaaatccacattctcgc

SEQ ID NO: 165411 - DNA, 25 bp, Artificial sequence
  SiRNA target sequence
atttttggaaatccacattctcgca

SEQ ID NO: 165412 - DNA, 25 bp, Artificial sequence
  SiRNA target sequence
tttttggaaatccacattctcgcac

SEQ ID NO: 165413 - DNA, 25 bp, Artificial sequence
  SiRNA target sequence
ttttggaaatccacattctcgcacg

SEQ ID NO: 165414 - DNA, 25 bp, Artificial sequence
  SiRNA target sequence
tttggaaatccacattctcgcacgc

SEQ ID NO: 165415 - DNA, 25 bp, Artificial sequence
  SiRNA target sequence
ttggaaatccacattctcgcacgca

SEQ ID NO: 165416 - DNA, 25 bp, Artificial sequence
  SiRNA target sequence
tggaaatccacattctcgcacgcat

SEQ ID NO: 165417 - DNA, 25 bp, Artificial sequence
  SiRNA target sequence
ggaaatccacattctcgcacgcata

SEQ ID NO: 165418 - DNA, 25 bp, Artificial sequence
  SiRNA target sequence
gaaatccacattctcgcacgcatac

SEQ ID NO: 165419 - DNA, 25 bp, Artificial sequence
  SiRNA target sequence
aaatccacattctcgcacgcatacg

SEQ ID NO: 165420 - DNA, 25 bp, Artificial sequence
  SiRNA target sequence
aatccacattctcgcacgcatacgt

SEQ ID NO: 165421 - DNA, 25 bp, Artificial sequence
  SiRNA target sequence
atccacattctcgcacgcatacgtt

SEQ ID NO: 165422 - DNA, 25 bp, Artificial sequence
  SiRNA target sequence
tccacattctcgcacgcatacgttt

SEQ ID NO: 165423 - DNA, 25 bp, Artificial sequence
  SiRNA target sequence
ccacattctcgcacgcatacgtttg

SEQ ID NO: 165424 - DNA, 25 bp, Artificial sequence
  SiRNA target sequence
cacattctcgcacgcatacgtttgg

SEQ ID NO: 165425 - DNA, 25 bp, Artificial sequence
  SiRNA target sequence
acattctcgcacgcatacgtttgga

SEQ ID NO: 165426 - DNA, 25 bp, Artificial sequence
  SiRNA target sequence
cattctcgcacgcatacgtttggat

SEQ ID NO: 165427 - DNA, 25 bp, Artificial sequence
  SiRNA target sequence
attctcgcacgcatacgtttggatg

SEQ ID NO: 165428 - DNA, 25 bp, Artificial sequence
  SiRNA target sequence
ttctcgcacgcatacgtttggatgg

SEQ ID NO: 165429 - DNA, 25 bp, Artificial sequence
  SiRNA target sequence
tctcgcacgcatacgtttggatgga

SEQ ID NO: 165430 - DNA, 25 bp, Artificial sequence
  SiRNA target sequence
ctcgcacgcatacgtttggatggaa

SEQ ID NO: 165431 - DNA, 25 bp, Artificial sequence
  SiRNA target sequence
tcgcacgcatacgtttggatggaat

SEQ ID NO: 165432 - DNA, 25 bp, Artificial sequence
  SiRNA target sequence
cgcacgcatacgtttggatggaatg

SEQ ID NO: 165433 - DNA, 25 bp, Artificial sequence
  SiRNA target sequence
gcacgcatacgtttggatggaatgc

SEQ ID NO: 165434 - DNA, 25 bp, Artificial sequence
  SiRNA target sequence
cacgcatacgtttggatggaatgca

SEQ ID NO: 165435 - DNA, 25 bp, Artificial sequence
  SiRNA target sequence
acgcatacgtttggatggaatgcag

SEQ ID NO: 165436 - DNA, 25 bp, Artificial sequence
  SiRNA target sequence
cgcatacgtttggatggaatgcaga

SEQ ID NO: 165437 - DNA, 25 bp, Artificial sequence
  SiRNA target sequence
gcatacgtttggatggaatgcagaa

SEQ ID NO: 165438 - DNA, 25 bp, Artificial sequence
  SiRNA target sequence
catacgtttggatggaatgcagaaa

SEQ ID NO: 165439 - DNA, 25 bp, Artificial sequence
  SiRNA target sequence
atacgtttggatggaatgcagaaaa

SEQ ID NO: 165440 - DNA, 25 bp, Artificial sequence
  SiRNA target sequence
tacgtttggatggaatgcagaaaaa

SEQ ID NO: 165441 - DNA, 25 bp, Artificial sequence
  SiRNA target sequence
acgtttggatggaatgcagaaaaag

SEQ ID NO: 165442 - DNA, 25 bp, Artificial sequence
  SiRNA target sequence
cgtttggatggaatgcagaaaaagg

SEQ ID NO: 165443 - DNA, 25 bp, Artificial sequence
  SiRNA target sequence
gtttggatggaatgcagaaaaaggc

SEQ ID NO: 165444 - DNA, 25 bp, Artificial sequence
  SiRNA target sequence
tttggatggaatgcagaaaaaggcg

SEQ ID NO: 165445 - DNA, 25 bp, Artificial sequence
  SiRNA target sequence
ttggatggaatgcagaaaaaggcgt

SEQ ID NO: 165446 - DNA, 25 bp, Artificial sequence
  SiRNA target sequence
tggatggaatgcagaaaaaggcgta

SEQ ID NO: 165447 - DNA, 25 bp, Artificial sequence
  SiRNA target sequence
ggatggaatgcagaaaaaggcgtag

SEQ ID NO: 165448 - DNA, 25 bp, Artificial sequence
  SiRNA target sequence
gatggaatgcagaaaaaggcgtaga

SEQ ID NO: 165449 - DNA, 25 bp, Artificial sequence
  SiRNA target sequence
atggaatgcagaaaaaggcgtagaa

SEQ ID NO: 165450 - DNA, 25 bp, Artificial sequence
  SiRNA target sequence
tggaatgcagaaaaaggcgtagaaa

SEQ ID NO: 165451 - DNA, 25 bp, Artificial sequence
  SiRNA target sequence
ggaatgcagaaaaaggcgtagaaat

SEQ ID NO: 165452 - DNA, 25 bp, Artificial sequence
  SiRNA target sequence
gaatgcagaaaaaggcgtagaaatg

SEQ ID NO: 165453 - DNA, 25 bp, Artificial sequence
  SiRNA target sequence
aatgcagaaaaaggcgtagaaatgg

SEQ ID NO: 165454 - DNA, 25 bp, Artificial sequence
  SiRNA target sequence
atgcagaaaaaggcgtagaaatggc

SEQ ID NO: 165455 - DNA, 25 bp, Artificial sequence
  SiRNA target sequence
tgcagaaaaaggcgtagaaatggct

SEQ ID NO: 165456 - DNA, 25 bp, Artificial sequence
  SiRNA target sequence
gcagaaaaaggcgtagaaatggctc

SEQ ID NO: 165457 - DNA, 25 bp, Artificial sequence
  SiRNA target sequence
cagaaaaaggcgtagaaatggctcg

SEQ ID NO: 165458 - DNA, 25 bp, Artificial sequence
  SiRNA target sequence
agaaaaaggcgtagaaatggctcga

SEQ ID NO: 165459 - DNA, 25 bp, Artificial sequence
  SiRNA target sequence
gaaaaaggcgtagaaatggctcgaa

SEQ ID NO: 165460 - DNA, 25 bp, Artificial sequence
  SiRNA target sequence
aaaaaggcgtagaaatggctcgaaa

SEQ ID NO: 165461 - DNA, 25 bp, Artificial sequence
  SiRNA target sequence
aaaaggcgtagaaatggctcgaaag

SEQ ID NO: 165462 - DNA, 25 bp, Artificial sequence
  SiRNA target sequence
aaaggcgtagaaatggctcgaaagc

SEQ ID NO: 165463 - DNA, 25 bp, Artificial sequence
  SiRNA target sequence
aaggcgtagaaatggctcgaaagca

SEQ ID NO: 165464 - DNA, 25 bp, Artificial sequence
  SiRNA target sequence
aggcgtagaaatggctcgaaagcaa

SEQ ID NO: 165465 - DNA, 25 bp, Artificial sequence
  SiRNA target sequence
ggcgtagaaatggctcgaaagcaag

SEQ ID NO: 165466 - DNA, 25 bp, Artificial sequence
  SiRNA target sequence
gcgtagaaatggctcgaaagcaagt

SEQ ID NO: 165467 - DNA, 25 bp, Artificial sequence
  SiRNA target sequence
cgtagaaatggctcgaaagcaagta

SEQ ID NO: 165468 - DNA, 25 bp, Artificial sequence
  SiRNA target sequence
gtagaaatggctcgaaagcaagtag

SEQ ID NO: 165469 - DNA, 25 bp, Artificial sequence
  SiRNA target sequence
tagaaatggctcgaaagcaagtagc

SEQ ID NO: 165470 - DNA, 25 bp, Artificial sequence
  SiRNA target sequence
agaaatggctcgaaagcaagtagca

SEQ ID NO: 165471 - DNA, 25 bp, Artificial sequence
  SiRNA target sequence
gaaatggctcgaaagcaagtagcag

SEQ ID NO: 165472 - DNA, 25 bp, Artificial sequence
  SiRNA target sequence
aaatggctcgaaagcaagtagcaga

SEQ ID NO: 165473 - DNA, 25 bp, Artificial sequence
  SiRNA target sequence
aatggctcgaaagcaagtagcagat

SEQ ID NO: 165474 - DNA, 25 bp, Artificial sequence
  SiRNA target sequence
atggctcgaaagcaagtagcagatt

SEQ ID NO: 165475 - DNA, 25 bp, Artificial sequence
  SiRNA target sequence
tggctcgaaagcaagtagcagattt

SEQ ID NO: 165476 - DNA, 25 bp, Artificial sequence
  SiRNA target sequence
ggctcgaaagcaagtagcagattta

SEQ ID NO: 165477 - DNA, 25 bp, Artificial sequence
  SiRNA target sequence
gctcgaaagcaagtagcagatttac

SEQ ID NO: 165478 - DNA, 25 bp, Artificial sequence
  SiRNA target sequence
ctcgaaagcaagtagcagatttact

SEQ ID NO: 165479 - DNA, 25 bp, Artificial sequence
  SiRNA target sequence
tcgaaagcaagtagcagatttactg

SEQ ID NO: 165480 - DNA, 25 bp, Artificial sequence
  SiRNA target sequence
cgaaagcaagtagcagatttactga

SEQ ID NO: 165481 - DNA, 25 bp, Artificial sequence
  SiRNA target sequence
gaaagcaagtagcagatttactgaa

SEQ ID NO: 165482 - DNA, 25 bp, Artificial sequence
  SiRNA target sequence
aaagcaagtagcagatttactgaat

SEQ ID NO: 165483 - DNA, 25 bp, Artificial sequence
  SiRNA target sequence
aagcaagtagcagatttactgaatg

SEQ ID NO: 165484 - DNA, 25 bp, Artificial sequence
  SiRNA target sequence
agcaagtagcagatttactgaatgc

SEQ ID NO: 165485 - DNA, 25 bp, Artificial sequence
  SiRNA target sequence
gcaagtagcagatttactgaatgcc

SEQ ID NO: 165486 - DNA, 25 bp, Artificial sequence
  SiRNA target sequence
caagtagcagatttactgaatgcca

SEQ ID NO: 165487 - DNA, 25 bp, Artificial sequence
  SiRNA target sequence
aagtagcagatttactgaatgccaa

SEQ ID NO: 165488 - DNA, 25 bp, Artificial sequence
  SiRNA target sequence
agtagcagatttactgaatgccaat

SEQ ID NO: 165489 - DNA, 25 bp, Artificial sequence
  SiRNA target sequence
gtagcagatttactgaatgccaatg

SEQ ID NO: 165490 - DNA, 25 bp, Artificial sequence
  SiRNA target sequence
tagcagatttactgaatgccaatga

SEQ ID NO: 165491 - DNA, 25 bp, Artificial sequence
  SiRNA target sequence
agcagatttactgaatgccaatgaa

SEQ ID NO: 165492 - DNA, 25 bp, Artificial sequence
  SiRNA target sequence
gcagatttactgaatgccaatgaaa

SEQ ID NO: 165493 - DNA, 25 bp, Artificial sequence
  SiRNA target sequence
cagatttactgaatgccaatgaaaa

SEQ ID NO: 165494 - DNA, 25 bp, Artificial sequence
  SiRNA target sequence
agatttactgaatgccaatgaaaaa

SEQ ID NO: 165495 - DNA, 25 bp, Artificial sequence
  SiRNA target sequence
gatttactgaatgccaatgaaaaag

SEQ ID NO: 165496 - DNA, 25 bp, Artificial sequence
  SiRNA target sequence
atttactgaatgccaatgaaaaaga

SEQ ID NO: 165497 - DNA, 25 bp, Artificial sequence
  SiRNA target sequence
tttactgaatgccaatgaaaaagaa

SEQ ID NO: 165498 - DNA, 25 bp, Artificial sequence
  SiRNA target sequence
ttactgaatgccaatgaaaaagaaa

SEQ ID NO: 165499 - DNA, 25 bp, Artificial sequence
  SiRNA target sequence
tactgaatgccaatgaaaaagaaat

SEQ ID NO: 165500 - DNA, 25 bp, Artificial sequence
  SiRNA target sequence
actgaatgccaatgaaaaagaaatt

SEQ ID NO: 165501 - DNA, 25 bp, Artificial sequence
  SiRNA target sequence
ctgaatgccaatgaaaaagaaatta

SEQ ID NO: 165502 - DNA, 25 bp, Artificial sequence
  SiRNA target sequence
tgaatgccaatgaaaaagaaattat

SEQ ID NO: 165503 - DNA, 25 bp, Artificial sequence
  SiRNA target sequence
gaatgccaatgaaaaagaaattatt

SEQ ID NO: 165504 - DNA, 25 bp, Artificial sequence
  SiRNA target sequence
aatgccaatgaaaaagaaattattt

SEQ ID NO: 165505 - DNA, 25 bp, Artificial sequence
  SiRNA target sequence
atgccaatgaaaaagaaattatttt

SEQ ID NO: 165506 - DNA, 25 bp, Artificial sequence
  SiRNA target sequence
tgccaatgaaaaagaaattattttt

SEQ ID NO: 165507 - DNA, 25 bp, Artificial sequence
  SiRNA target sequence
gccaatgaaaaagaaattattttta

SEQ ID NO: 165508 - DNA, 25 bp, Artificial sequence
  SiRNA target sequence
ccaatgaaaaagaaattatttttac

SEQ ID NO: 165509 - DNA, 25 bp, Artificial sequence
  SiRNA target sequence
caatgaaaaagaaattatttttact

SEQ ID NO: 165510 - DNA, 25 bp, Artificial sequence
  SiRNA target sequence
aatgaaaaagaaattatttttacta

SEQ ID NO: 165511 - DNA, 25 bp, Artificial sequence
  SiRNA target sequence
atgaaaaagaaattatttttactag

SEQ ID NO: 165512 - DNA, 25 bp, Artificial sequence
  SiRNA target sequence
tgaaaaagaaattatttttactagc

SEQ ID NO: 165513 - DNA, 25 bp, Artificial sequence
  SiRNA target sequence
gaaaaagaaattatttttactagcg

SEQ ID NO: 165514 - DNA, 25 bp, Artificial sequence
  SiRNA target sequence
aaaaagaaattatttttactagcgg

SEQ ID NO: 165515 - DNA, 25 bp, Artificial sequence
  SiRNA target sequence
aaaagaaattatttttactagcggt

SEQ ID NO: 165516 - DNA, 25 bp, Artificial sequence
  SiRNA target sequence
aaagaaattatttttactagcggtg

SEQ ID NO: 165517 - DNA, 25 bp, Artificial sequence
  SiRNA target sequence
aagaaattatttttactagcggtgc

SEQ ID NO: 165518 - DNA, 25 bp, Artificial sequence
  SiRNA target sequence
agaaattatttttactagcggtgct

SEQ ID NO: 165519 - DNA, 25 bp, Artificial sequence
  SiRNA target sequence
gaaattatttttactagcggtgcta

SEQ ID NO: 165520 - DNA, 25 bp, Artificial sequence
  SiRNA target sequence
aaattatttttactagcggtgctac

SEQ ID NO: 165521 - DNA, 25 bp, Artificial sequence
  SiRNA target sequence
aattatttttactagcggtgctact

SEQ ID NO: 165522 - DNA, 25 bp, Artificial sequence
  SiRNA target sequence
attatttttactagcggtgctactg

SEQ ID NO: 165523 - DNA, 25 bp, Artificial sequence
  SiRNA target sequence
ttatttttactagcggtgctactga

SEQ ID NO: 165524 - DNA, 25 bp, Artificial sequence
  SiRNA target sequence
tatttttactagcggtgctactgag

SEQ ID NO: 165525 - DNA, 25 bp, Artificial sequence
  SiRNA target sequence
atttttactagcggtgctactgaga

SEQ ID NO: 165526 - DNA, 25 bp, Artificial sequence
  SiRNA target sequence
tttttactagcggtgctactgagag

SEQ ID NO: 165527 - DNA, 25 bp, Artificial sequence
  SiRNA target sequence
ttttactagcggtgctactgagagt

SEQ ID NO: 165528 - DNA, 25 bp, Artificial sequence
  SiRNA target sequence
tttactagcggtgctactgagagta

SEQ ID NO: 165529 - DNA, 25 bp, Artificial sequence
  SiRNA target sequence
ttactagcggtgctactgagagtaa

SEQ ID NO: 165530 - DNA, 25 bp, Artificial sequence
  SiRNA target sequence
tactagcggtgctactgagagtaac

SEQ ID NO: 165531 - DNA, 25 bp, Artificial sequence
  SiRNA target sequence
actagcggtgctactgagagtaaca

SEQ ID NO: 165532 - DNA, 25 bp, Artificial sequence
  SiRNA target sequence
ctagcggtgctactgagagtaacaa

SEQ ID NO: 165533 - DNA, 25 bp, Artificial sequence
  SiRNA target sequence
tagcggtgctactgagagtaacaac

SEQ ID NO: 165534 - DNA, 25 bp, Artificial sequence
  SiRNA target sequence
agcggtgctactgagagtaacaacc

SEQ ID NO: 165535 - DNA, 25 bp, Artificial sequence
  SiRNA target sequence
gcggtgctactgagagtaacaacct

SEQ ID NO: 165536 - DNA, 25 bp, Artificial sequence
  SiRNA target sequence
cggtgctactgagagtaacaacctt

SEQ ID NO: 165537 - DNA, 25 bp, Artificial sequence
  SiRNA target sequence
ggtgctactgagagtaacaaccttg

SEQ ID NO: 165538 - DNA, 25 bp, Artificial sequence
  SiRNA target sequence
gtgctactgagagtaacaaccttgc

SEQ ID NO: 165539 - DNA, 25 bp, Artificial sequence
  SiRNA target sequence
tgctactgagagtaacaaccttgca

SEQ ID NO: 165540 - DNA, 25 bp, Artificial sequence
  SiRNA target sequence
gctactgagagtaacaaccttgcac

SEQ ID NO: 165541 - DNA, 25 bp, Artificial sequence
  SiRNA target sequence
ctactgagagtaacaaccttgcact

SEQ ID NO: 165542 - DNA, 25 bp, Artificial sequence
  SiRNA target sequence
tactgagagtaacaaccttgcacta

SEQ ID NO: 165543 - DNA, 25 bp, Artificial sequence
  SiRNA target sequence
actgagagtaacaaccttgcactaa

SEQ ID NO: 165544 - DNA, 25 bp, Artificial sequence
  SiRNA target sequence
ctgagagtaacaaccttgcactaaa

SEQ ID NO: 165545 - DNA, 25 bp, Artificial sequence
  SiRNA target sequence
tgagagtaacaaccttgcactaaag

SEQ ID NO: 165546 - DNA, 25 bp, Artificial sequence
  SiRNA target sequence
gagagtaacaaccttgcactaaagg

SEQ ID NO: 165547 - DNA, 25 bp, Artificial sequence
  SiRNA target sequence
agagtaacaaccttgcactaaaggg

SEQ ID NO: 165548 - DNA, 25 bp, Artificial sequence
  SiRNA target sequence
gagtaacaaccttgcactaaagggt

SEQ ID NO: 165549 - DNA, 25 bp, Artificial sequence
  SiRNA target sequence
agtaacaaccttgcactaaagggtg

SEQ ID NO: 165550 - DNA, 25 bp, Artificial sequence
  SiRNA target sequence
gtaacaaccttgcactaaagggtgt

SEQ ID NO: 165551 - DNA, 25 bp, Artificial sequence
  SiRNA target sequence
taacaaccttgcactaaagggtgtc

SEQ ID NO: 165552 - DNA, 25 bp, Artificial sequence
  SiRNA target sequence
aacaaccttgcactaaagggtgtct

SEQ ID NO: 165553 - DNA, 25 bp, Artificial sequence
  SiRNA target sequence
acaaccttgcactaaagggtgtctt

SEQ ID NO: 165554 - DNA, 25 bp, Artificial sequence
  SiRNA target sequence
caaccttgcactaaagggtgtcttt

SEQ ID NO: 165555 - DNA, 25 bp, Artificial sequence
  SiRNA target sequence
aaccttgcactaaagggtgtctttg

SEQ ID NO: 165556 - DNA, 25 bp, Artificial sequence
  SiRNA target sequence
accttgcactaaagggtgtctttgc

SEQ ID NO: 165557 - DNA, 25 bp, Artificial sequence
  SiRNA target sequence
ccttgcactaaagggtgtctttgca

SEQ ID NO: 165558 - DNA, 25 bp, Artificial sequence
  SiRNA target sequence
cttgcactaaagggtgtctttgcat

SEQ ID NO: 165559 - DNA, 25 bp, Artificial sequence
  SiRNA target sequence
ttgcactaaagggtgtctttgcatt

SEQ ID NO: 165560 - DNA, 25 bp, Artificial sequence
  SiRNA target sequence
tgcactaaagggtgtctttgcattt

SEQ ID NO: 165561 - DNA, 25 bp, Artificial sequence
  SiRNA target sequence
gcactaaagggtgtctttgcatttt

SEQ ID NO: 165562 - DNA, 25 bp, Artificial sequence
  SiRNA target sequence
cactaaagggtgtctttgcattttt

SEQ ID NO: 165563 - DNA, 25 bp, Artificial sequence
  SiRNA target sequence
actaaagggtgtctttgcattttta

SEQ ID NO: 165564 - DNA, 25 bp, Artificial sequence
  SiRNA target sequence
ctaaagggtgtctttgcatttttaa

SEQ ID NO: 165565 - DNA, 25 bp, Artificial sequence
  SiRNA target sequence
taaagggtgtctttgcatttttaaa

SEQ ID NO: 165566 - DNA, 25 bp, Artificial sequence
  SiRNA target sequence
aaagggtgtctttgcatttttaaaa

SEQ ID NO: 165567 - DNA, 25 bp, Artificial sequence
  SiRNA target sequence
aagggtgtctttgcatttttaaaaa

SEQ ID NO: 165568 - DNA, 25 bp, Artificial sequence
  SiRNA target sequence
agggtgtctttgcatttttaaaaaa

SEQ ID NO: 165569 - DNA, 25 bp, Artificial sequence
  SiRNA target sequence
gggtgtctttgcatttttaaaaaaa

SEQ ID NO: 165570 - DNA, 25 bp, Artificial sequence
  SiRNA target sequence
ggtgtctttgcatttttaaaaaaag

SEQ ID NO: 165571 - DNA, 25 bp, Artificial sequence
  SiRNA target sequence
gtgtctttgcatttttaaaaaaaga

SEQ ID NO: 165572 - DNA, 25 bp, Artificial sequence
  SiRNA target sequence
tgtctttgcatttttaaaaaaagac

SEQ ID NO: 165573 - DNA, 25 bp, Artificial sequence
  SiRNA target sequence
gtctttgcatttttaaaaaaagaca

SEQ ID NO: 165574 - DNA, 25 bp, Artificial sequence
  SiRNA target sequence
tctttgcatttttaaaaaaagacaa

SEQ ID NO: 165575 - DNA, 25 bp, Artificial sequence
  SiRNA target sequence
ctttgcatttttaaaaaaagacaat

SEQ ID NO: 165576 - DNA, 25 bp, Artificial sequence
  SiRNA target sequence
tttgcatttttaaaaaaagacaata

SEQ ID NO: 165577 - DNA, 25 bp, Artificial sequence
  SiRNA target sequence
ttgcatttttaaaaaaagacaatag

SEQ ID NO: 165578 - DNA, 25 bp, Artificial sequence
  SiRNA target sequence
tgcatttttaaaaaaagacaatagg

SEQ ID NO: 165579 - DNA, 25 bp, Artificial sequence
  SiRNA target sequence
gcatttttaaaaaaagacaataggc

SEQ ID NO: 165580 - DNA, 25 bp, Artificial sequence
  SiRNA target sequence
catttttaaaaaaagacaataggcc

SEQ ID NO: 165581 - DNA, 25 bp, Artificial sequence
  SiRNA target sequence
atttttaaaaaaagacaataggcct

SEQ ID NO: 165582 - DNA, 25 bp, Artificial sequence
  SiRNA target sequence
tttttaaaaaaagacaataggcctg

SEQ ID NO: 165583 - DNA, 25 bp, Artificial sequence
  SiRNA target sequence
ttttaaaaaaagacaataggcctgt

SEQ ID NO: 165584 - DNA, 25 bp, Artificial sequence
  SiRNA target sequence
tttaaaaaaagacaataggcctgtt

SEQ ID NO: 165585 - DNA, 25 bp, Artificial sequence
  SiRNA target sequence
ttaaaaaaagacaataggcctgttc

SEQ ID NO: 165586 - DNA, 25 bp, Artificial sequence
  SiRNA target sequence
taaaaaaagacaataggcctgttca

SEQ ID NO: 165587 - DNA, 25 bp, Artificial sequence
  SiRNA target sequence
aaaaaaagacaataggcctgttcat

SEQ ID NO: 165588 - DNA, 25 bp, Artificial sequence
  SiRNA target sequence
aaaaaagacaataggcctgttcata

SEQ ID NO: 165589 - DNA, 25 bp, Artificial sequence
  SiRNA target sequence
aaaaagacaataggcctgttcatat

SEQ ID NO: 165590 - DNA, 25 bp, Artificial sequence
  SiRNA target sequence
aaaagacaataggcctgttcatatc

SEQ ID NO: 165591 - DNA, 25 bp, Artificial sequence
  SiRNA target sequence
aaagacaataggcctgttcatatca

SEQ ID NO: 165592 - DNA, 25 bp, Artificial sequence
  SiRNA target sequence
aagacaataggcctgttcatatcat

SEQ ID NO: 165593 - DNA, 25 bp, Artificial sequence
  SiRNA target sequence
agacaataggcctgttcatatcatt

SEQ ID NO: 165594 - DNA, 25 bp, Artificial sequence
  SiRNA target sequence
gacaataggcctgttcatatcatta

SEQ ID NO: 165595 - DNA, 25 bp, Artificial sequence
  SiRNA target sequence
acaataggcctgttcatatcattac

SEQ ID NO: 165596 - DNA, 25 bp, Artificial sequence
  SiRNA target sequence
caataggcctgttcatatcattacc

SEQ ID NO: 165597 - DNA, 25 bp, Artificial sequence
  SiRNA target sequence
aataggcctgttcatatcattacca

SEQ ID NO: 165598 - DNA, 25 bp, Artificial sequence
  SiRNA target sequence
ataggcctgttcatatcattaccac

SEQ ID NO: 165599 - DNA, 25 bp, Artificial sequence
  SiRNA target sequence
taggcctgttcatatcattaccaca

SEQ ID NO: 165600 - DNA, 25 bp, Artificial sequence
  SiRNA target sequence
aggcctgttcatatcattaccacac

SEQ ID NO: 165601 - DNA, 25 bp, Artificial sequence
  SiRNA target sequence
ggcctgttcatatcattaccacaca

SEQ ID NO: 165602 - DNA, 25 bp, Artificial sequence
  SiRNA target sequence
gcctgttcatatcattaccacacaa

SEQ ID NO: 165603 - DNA, 25 bp, Artificial sequence
  SiRNA target sequence
cctgttcatatcattaccacacaaa

SEQ ID NO: 165604 - DNA, 25 bp, Artificial sequence
  SiRNA target sequence
ctgttcatatcattaccacacaaat

SEQ ID NO: 165605 - DNA, 25 bp, Artificial sequence
  SiRNA target sequence
tgttcatatcattaccacacaaatt

SEQ ID NO: 165606 - DNA, 25 bp, Artificial sequence
  SiRNA target sequence
gttcatatcattaccacacaaattg

SEQ ID NO: 165607 - DNA, 25 bp, Artificial sequence
  SiRNA target sequence
ttcatatcattaccacacaaattga

SEQ ID NO: 165608 - DNA, 25 bp, Artificial sequence
  SiRNA target sequence
tcatatcattaccacacaaattgaa

SEQ ID NO: 165609 - DNA, 25 bp, Artificial sequence
  SiRNA target sequence
catatcattaccacacaaattgaac

SEQ ID NO: 165610 - DNA, 25 bp, Artificial sequence
  SiRNA target sequence
atatcattaccacacaaattgaaca

SEQ ID NO: 165611 - DNA, 25 bp, Artificial sequence
  SiRNA target sequence
tatcattaccacacaaattgaacat

SEQ ID NO: 165612 - DNA, 25 bp, Artificial sequence
  SiRNA target sequence
atcattaccacacaaattgaacata

SEQ ID NO: 165613 - DNA, 25 bp, Artificial sequence
  SiRNA target sequence
tcattaccacacaaattgaacataa

SEQ ID NO: 165614 - DNA, 25 bp, Artificial sequence
  SiRNA target sequence
cattaccacacaaattgaacataaa

SEQ ID NO: 165615 - DNA, 25 bp, Artificial sequence
  SiRNA target sequence
attaccacacaaattgaacataaat

SEQ ID NO: 165616 - DNA, 25 bp, Artificial sequence
  SiRNA target sequence
ttaccacacaaattgaacataaatg

SEQ ID NO: 165617 - DNA, 25 bp, Artificial sequence
  SiRNA target sequence
taccacacaaattgaacataaatgt

SEQ ID NO: 165618 - DNA, 25 bp, Artificial sequence
  SiRNA target sequence
accacacaaattgaacataaatgtg

SEQ ID NO: 165619 - DNA, 25 bp, Artificial sequence
  SiRNA target sequence
ccacacaaattgaacataaatgtgt

SEQ ID NO: 165620 - DNA, 25 bp, Artificial sequence
  SiRNA target sequence
cacacaaattgaacataaatgtgta

SEQ ID NO: 165621 - DNA, 25 bp, Artificial sequence
  SiRNA target sequence
acacaaattgaacataaatgtgtat

SEQ ID NO: 165622 - DNA, 25 bp, Artificial sequence
  SiRNA target sequence
cacaaattgaacataaatgtgtatt

SEQ ID NO: 165623 - DNA, 25 bp, Artificial sequence
  SiRNA target sequence
acaaattgaacataaatgtgtattg

SEQ ID NO: 165624 - DNA, 25 bp, Artificial sequence
  SiRNA target sequence
caaattgaacataaatgtgtattgg

SEQ ID NO: 165625 - DNA, 25 bp, Artificial sequence
  SiRNA target sequence
aaattgaacataaatgtgtattgga

SEQ ID NO: 165626 - DNA, 25 bp, Artificial sequence
  SiRNA target sequence
aattgaacataaatgtgtattggac

SEQ ID NO: 165627 - DNA, 25 bp, Artificial sequence
  SiRNA target sequence
attgaacataaatgtgtattggaca

SEQ ID NO: 165628 - DNA, 25 bp, Artificial sequence
  SiRNA target sequence
ttgaacataaatgtgtattggacac

SEQ ID NO: 165629 - DNA, 25 bp, Artificial sequence
  SiRNA target sequence
tgaacataaatgtgtattggacaca

SEQ ID NO: 165630 - DNA, 25 bp, Artificial sequence
  SiRNA target sequence
gaacataaatgtgtattggacacat

SEQ ID NO: 165631 - DNA, 25 bp, Artificial sequence
  SiRNA target sequence
aacataaatgtgtattggacacatg

SEQ ID NO: 165632 - DNA, 25 bp, Artificial sequence
  SiRNA target sequence
acataaatgtgtattggacacatgt

SEQ ID NO: 165633 - DNA, 25 bp, Artificial sequence
  SiRNA target sequence
cataaatgtgtattggacacatgta

SEQ ID NO: 165634 - DNA, 25 bp, Artificial sequence
  SiRNA target sequence
ataaatgtgtattggacacatgtag

SEQ ID NO: 165635 - DNA, 25 bp, Artificial sequence
  SiRNA target sequence
taaatgtgtattggacacatgtaga

SEQ ID NO: 165636 - DNA, 25 bp, Artificial sequence
  SiRNA target sequence
aaatgtgtattggacacatgtagaa

SEQ ID NO: 165637 - DNA, 25 bp, Artificial sequence
  SiRNA target sequence
aatgtgtattggacacatgtagaag

SEQ ID NO: 165638 - DNA, 25 bp, Artificial sequence
  SiRNA target sequence
atgtgtattggacacatgtagaaga

SEQ ID NO: 165639 - DNA, 25 bp, Artificial sequence
  SiRNA target sequence
tgtgtattggacacatgtagaagat

SEQ ID NO: 165640 - DNA, 25 bp, Artificial sequence
  SiRNA target sequence
gtgtattggacacatgtagaagatt

SEQ ID NO: 165641 - DNA, 25 bp, Artificial sequence
  SiRNA target sequence
tgtattggacacatgtagaagatta

SEQ ID NO: 165642 - DNA, 25 bp, Artificial sequence
  SiRNA target sequence
gtattggacacatgtagaagattag

SEQ ID NO: 165643 - DNA, 25 bp, Artificial sequence
  SiRNA target sequence
tattggacacatgtagaagattaga

SEQ ID NO: 165644 - DNA, 25 bp, Artificial sequence
  SiRNA target sequence
attggacacatgtagaagattagaa

SEQ ID NO: 165645 - DNA, 25 bp, Artificial sequence
  SiRNA target sequence
ttggacacatgtagaagattagaag

SEQ ID NO: 165646 - DNA, 25 bp, Artificial sequence
  SiRNA target sequence
tggacacatgtagaagattagaaga

SEQ ID NO: 165647 - DNA, 25 bp, Artificial sequence
  SiRNA target sequence
ggacacatgtagaagattagaagaa

SEQ ID NO: 165648 - DNA, 25 bp, Artificial sequence
  SiRNA target sequence
gacacatgtagaagattagaagaag

SEQ ID NO: 165649 - DNA, 25 bp, Artificial sequence
  SiRNA target sequence
acacatgtagaagattagaagaaga

SEQ ID NO: 165650 - DNA, 25 bp, Artificial sequence
  SiRNA target sequence
cacatgtagaagattagaagaagaa

SEQ ID NO: 165651 - DNA, 25 bp, Artificial sequence
  SiRNA target sequence
acatgtagaagattagaagaagaag

SEQ ID NO: 165652 - DNA, 25 bp, Artificial sequence
  SiRNA target sequence
catgtagaagattagaagaagaagg

SEQ ID NO: 165653 - DNA, 25 bp, Artificial sequence
  SiRNA target sequence
atgtagaagattagaagaagaagga

SEQ ID NO: 165654 - DNA, 25 bp, Artificial sequence
  SiRNA target sequence
tgtagaagattagaagaagaaggag

SEQ ID NO: 165655 - DNA, 25 bp, Artificial sequence
  SiRNA target sequence
gtagaagattagaagaagaaggagc

SEQ ID NO: 165656 - DNA, 25 bp, Artificial sequence
  SiRNA target sequence
tagaagattagaagaagaaggagct

SEQ ID NO: 165657 - DNA, 25 bp, Artificial sequence
  SiRNA target sequence
agaagattagaagaagaaggagcta

SEQ ID NO: 165658 - DNA, 25 bp, Artificial sequence
  SiRNA target sequence
gaagattagaagaagaaggagctac

SEQ ID NO: 165659 - DNA, 25 bp, Artificial sequence
  SiRNA target sequence
aagattagaagaagaaggagctaca

SEQ ID NO: 165660 - DNA, 25 bp, Artificial sequence
  SiRNA target sequence
agattagaagaagaaggagctacag

SEQ ID NO: 165661 - DNA, 25 bp, Artificial sequence
  SiRNA target sequence
gattagaagaagaaggagctacagt

SEQ ID NO: 165662 - DNA, 25 bp, Artificial sequence
  SiRNA target sequence
attagaagaagaaggagctacagtg

SEQ ID NO: 165663 - DNA, 25 bp, Artificial sequence
  SiRNA target sequence
ttagaagaagaaggagctacagtga

SEQ ID NO: 165664 - DNA, 25 bp, Artificial sequence
  SiRNA target sequence
tagaagaagaaggagctacagtgac

SEQ ID NO: 165665 - DNA, 25 bp, Artificial sequence
  SiRNA target sequence
agaagaagaaggagctacagtgact

SEQ ID NO: 165666 - DNA, 25 bp, Artificial sequence
  SiRNA target sequence
gaagaagaaggagctacagtgactt

SEQ ID NO: 165667 - DNA, 25 bp, Artificial sequence
  SiRNA target sequence
aagaagaaggagctacagtgactta

SEQ ID NO: 165668 - DNA, 25 bp, Artificial sequence
  SiRNA target sequence
agaagaaggagctacagtgacttat

SEQ ID NO: 165669 - DNA, 25 bp, Artificial sequence
  SiRNA target sequence
gaagaaggagctacagtgacttatt

SEQ ID NO: 165670 - DNA, 25 bp, Artificial sequence
  SiRNA target sequence
aagaaggagctacagtgacttattt

SEQ ID NO: 165671 - DNA, 25 bp, Artificial sequence
  SiRNA target sequence
agaaggagctacagtgacttatttg

SEQ ID NO: 165672 - DNA, 25 bp, Artificial sequence
  SiRNA target sequence
gaaggagctacagtgacttatttgc

SEQ ID NO: 165673 - DNA, 25 bp, Artificial sequence
  SiRNA target sequence
aaggagctacagtgacttatttgcc

SEQ ID NO: 165674 - DNA, 25 bp, Artificial sequence
  SiRNA target sequence
aggagctacagtgacttatttgcct

SEQ ID NO: 165675 - DNA, 25 bp, Artificial sequence
  SiRNA target sequence
ggagctacagtgacttatttgcctg

SEQ ID NO: 165676 - DNA, 25 bp, Artificial sequence
  SiRNA target sequence
gagctacagtgacttatttgcctgt

SEQ ID NO: 165677 - DNA, 25 bp, Artificial sequence
  SiRNA target sequence
agctacagtgacttatttgcctgta

SEQ ID NO: 165678 - DNA, 25 bp, Artificial sequence
  SiRNA target sequence
gctacagtgacttatttgcctgtag

SEQ ID NO: 165679 - DNA, 25 bp, Artificial sequence
  SiRNA target sequence
ctacagtgacttatttgcctgtaga

SEQ ID NO: 165680 - DNA, 25 bp, Artificial sequence
  SiRNA target sequence
tacagtgacttatttgcctgtagat

SEQ ID NO: 165681 - DNA, 25 bp, Artificial sequence
  SiRNA target sequence
acagtgacttatttgcctgtagata

SEQ ID NO: 165682 - DNA, 25 bp, Artificial sequence
  SiRNA target sequence
cagtgacttatttgcctgtagataa

SEQ ID NO: 165683 - DNA, 25 bp, Artificial sequence
  SiRNA target sequence
agtgacttatttgcctgtagataaa

SEQ ID NO: 165684 - DNA, 25 bp, Artificial sequence
  SiRNA target sequence
gtgacttatttgcctgtagataaaa

SEQ ID NO: 165685 - DNA, 25 bp, Artificial sequence
  SiRNA target sequence
tgacttatttgcctgtagataaaaa

SEQ ID NO: 165686 - DNA, 25 bp, Artificial sequence
  SiRNA target sequence
gacttatttgcctgtagataaaaat

SEQ ID NO: 165687 - DNA, 25 bp, Artificial sequence
  SiRNA target sequence
acttatttgcctgtagataaaaatg

SEQ ID NO: 165688 - DNA, 25 bp, Artificial sequence
  SiRNA target sequence
cttatttgcctgtagataaaaatgg

SEQ ID NO: 165689 - DNA, 25 bp, Artificial sequence
  SiRNA target sequence
ttatttgcctgtagataaaaatgga

SEQ ID NO: 165690 - DNA, 25 bp, Artificial sequence
  SiRNA target sequence
tatttgcctgtagataaaaatggaa

SEQ ID NO: 165691 - DNA, 25 bp, Artificial sequence
  SiRNA target sequence
atttgcctgtagataaaaatggaat

SEQ ID NO: 165692 - DNA, 25 bp, Artificial sequence
  SiRNA target sequence
tttgcctgtagataaaaatggaata

SEQ ID NO: 165693 - DNA, 25 bp, Artificial sequence
  SiRNA target sequence
ttgcctgtagataaaaatggaatag

SEQ ID NO: 165694 - DNA, 25 bp, Artificial sequence
  SiRNA target sequence
tgcctgtagataaaaatggaatagt

SEQ ID NO: 165695 - DNA, 25 bp, Artificial sequence
  SiRNA target sequence
gcctgtagataaaaatggaatagta

SEQ ID NO: 165696 - DNA, 25 bp, Artificial sequence
  SiRNA target sequence
cctgtagataaaaatggaatagtag

SEQ ID NO: 165697 - DNA, 25 bp, Artificial sequence
  SiRNA target sequence
ctgtagataaaaatggaatagtaga

SEQ ID NO: 165698 - DNA, 25 bp, Artificial sequence
  SiRNA target sequence
tgtagataaaaatggaatagtagat

SEQ ID NO: 165699 - DNA, 25 bp, Artificial sequence
  SiRNA target sequence
gtagataaaaatggaatagtagatc

SEQ ID NO: 165700 - DNA, 25 bp, Artificial sequence
  SiRNA target sequence
tagataaaaatggaatagtagatcc

SEQ ID NO: 165701 - DNA, 25 bp, Artificial sequence
  SiRNA target sequence
agataaaaatggaatagtagatccg

SEQ ID NO: 165702 - DNA, 25 bp, Artificial sequence
  SiRNA target sequence
gataaaaatggaatagtagatccgc

SEQ ID NO: 165703 - DNA, 25 bp, Artificial sequence
  SiRNA target sequence
ataaaaatggaatagtagatccgca

SEQ ID NO: 165704 - DNA, 25 bp, Artificial sequence
  SiRNA target sequence
taaaaatggaatagtagatccgcaa

SEQ ID NO: 165705 - DNA, 25 bp, Artificial sequence
  SiRNA target sequence
aaaaatggaatagtagatccgcaat

SEQ ID NO: 165706 - DNA, 25 bp, Artificial sequence
  SiRNA target sequence
aaaatggaatagtagatccgcaatt

SEQ ID NO: 165707 - DNA, 25 bp, Artificial sequence
  SiRNA target sequence
aaatggaatagtagatccgcaatta

SEQ ID NO: 165708 - DNA, 25 bp, Artificial sequence
  SiRNA target sequence
aatggaatagtagatccgcaattaa

SEQ ID NO: 165709 - DNA, 25 bp, Artificial sequence
  SiRNA target sequence
atggaatagtagatccgcaattaat

SEQ ID NO: 165710 - DNA, 25 bp, Artificial sequence
  SiRNA target sequence
tggaatagtagatccgcaattaata

SEQ ID NO: 165711 - DNA, 25 bp, Artificial sequence
  SiRNA target sequence
ggaatagtagatccgcaattaataa

SEQ ID NO: 165712 - DNA, 25 bp, Artificial sequence
  SiRNA target sequence
gaatagtagatccgcaattaataaa

SEQ ID NO: 165713 - DNA, 25 bp, Artificial sequence
  SiRNA target sequence
aatagtagatccgcaattaataaaa

SEQ ID NO: 165714 - DNA, 25 bp, Artificial sequence
  SiRNA target sequence
atagtagatccgcaattaataaaaa

SEQ ID NO: 165715 - DNA, 25 bp, Artificial sequence
  SiRNA target sequence
tagtagatccgcaattaataaaaaa

SEQ ID NO: 165716 - DNA, 25 bp, Artificial sequence
  SiRNA target sequence
agtagatccgcaattaataaaaaac

SEQ ID NO: 165717 - DNA, 25 bp, Artificial sequence
  SiRNA target sequence
gtagatccgcaattaataaaaaaca

SEQ ID NO: 165718 - DNA, 25 bp, Artificial sequence
  SiRNA target sequence
tagatccgcaattaataaaaaacag

SEQ ID NO: 165719 - DNA, 25 bp, Artificial sequence
  SiRNA target sequence
agatccgcaattaataaaaaacagt

SEQ ID NO: 165720 - DNA, 25 bp, Artificial sequence
  SiRNA target sequence
gatccgcaattaataaaaaacagta

SEQ ID NO: 165721 - DNA, 25 bp, Artificial sequence
  SiRNA target sequence
atccgcaattaataaaaaacagtat

SEQ ID NO: 165722 - DNA, 25 bp, Artificial sequence
  SiRNA target sequence
tccgcaattaataaaaaacagtatt

SEQ ID NO: 165723 - DNA, 25 bp, Artificial sequence
  SiRNA target sequence
ccgcaattaataaaaaacagtatta

SEQ ID NO: 165724 - DNA, 25 bp, Artificial sequence
  SiRNA target sequence
cgcaattaataaaaaacagtattac

SEQ ID NO: 165725 - DNA, 25 bp, Artificial sequence
  SiRNA target sequence
gcaattaataaaaaacagtattact

SEQ ID NO: 165726 - DNA, 25 bp, Artificial sequence
  SiRNA target sequence
caattaataaaaaacagtattacta

SEQ ID NO: 165727 - DNA, 25 bp, Artificial sequence
  SiRNA target sequence
aattaataaaaaacagtattactaa

SEQ ID NO: 165728 - DNA, 25 bp, Artificial sequence
  SiRNA target sequence
attaataaaaaacagtattactaaa

SEQ ID NO: 165729 - DNA, 25 bp, Artificial sequence
  SiRNA target sequence
ttaataaaaaacagtattactaaag

SEQ ID NO: 165730 - DNA, 25 bp, Artificial sequence
  SiRNA target sequence
taataaaaaacagtattactaaaga

SEQ ID NO: 165731 - DNA, 25 bp, Artificial sequence
  SiRNA target sequence
aataaaaaacagtattactaaagat

SEQ ID NO: 165732 - DNA, 25 bp, Artificial sequence
  SiRNA target sequence
ataaaaaacagtattactaaagata

SEQ ID NO: 165733 - DNA, 25 bp, Artificial sequence
  SiRNA target sequence
taaaaaacagtattactaaagatac

SEQ ID NO: 165734 - DNA, 25 bp, Artificial sequence
  SiRNA target sequence
aaaaaacagtattactaaagatacc

SEQ ID NO: 165735 - DNA, 25 bp, Artificial sequence
  SiRNA target sequence
aaaaacagtattactaaagataccg

SEQ ID NO: 165736 - DNA, 25 bp, Artificial sequence
  SiRNA target sequence
aaaacagtattactaaagataccgc

SEQ ID NO: 165737 - DNA, 25 bp, Artificial sequence
  SiRNA target sequence
aaacagtattactaaagataccgct

SEQ ID NO: 165738 - DNA, 25 bp, Artificial sequence
  SiRNA target sequence
aacagtattactaaagataccgctt

SEQ ID NO: 165739 - DNA, 25 bp, Artificial sequence
  SiRNA target sequence
acagtattactaaagataccgcttt

SEQ ID NO: 165740 - DNA, 25 bp, Artificial sequence
  SiRNA target sequence
cagtattactaaagataccgctttg

SEQ ID NO: 165741 - DNA, 25 bp, Artificial sequence
  SiRNA target sequence
agtattactaaagataccgctttgg

SEQ ID NO: 165742 - DNA, 25 bp, Artificial sequence
  SiRNA target sequence
gtattactaaagataccgctttggt

SEQ ID NO: 165743 - DNA, 25 bp, Artificial sequence
  SiRNA target sequence
tattactaaagataccgctttggtg

SEQ ID NO: 165744 - DNA, 25 bp, Artificial sequence
  SiRNA target sequence
attactaaagataccgctttggtgt

SEQ ID NO: 165745 - DNA, 25 bp, Artificial sequence
  SiRNA target sequence
ttactaaagataccgctttggtgtc

SEQ ID NO: 165746 - DNA, 25 bp, Artificial sequence
  SiRNA target sequence
tactaaagataccgctttggtgtct

SEQ ID NO: 165747 - DNA, 25 bp, Artificial sequence
  SiRNA target sequence
actaaagataccgctttggtgtctg

SEQ ID NO: 165748 - DNA, 25 bp, Artificial sequence
  SiRNA target sequence
ctaaagataccgctttggtgtctgt

SEQ ID NO: 165749 - DNA, 25 bp, Artificial sequence
  SiRNA target sequence
taaagataccgctttggtgtctgtt

SEQ ID NO: 165750 - DNA, 25 bp, Artificial sequence
  SiRNA target sequence
aaagataccgctttggtgtctgtta

SEQ ID NO: 165751 - DNA, 25 bp, Artificial sequence
  SiRNA target sequence
aagataccgctttggtgtctgttat

SEQ ID NO: 165752 - DNA, 25 bp, Artificial sequence
  SiRNA target sequence
agataccgctttggtgtctgttatg

SEQ ID NO: 165753 - DNA, 25 bp, Artificial sequence
  SiRNA target sequence
gataccgctttggtgtctgttatgg

SEQ ID NO: 165754 - DNA, 25 bp, Artificial sequence
  SiRNA target sequence
ataccgctttggtgtctgttatggc

SEQ ID NO: 165755 - DNA, 25 bp, Artificial sequence
  SiRNA target sequence
taccgctttggtgtctgttatggct

SEQ ID NO: 165756 - DNA, 25 bp, Artificial sequence
  SiRNA target sequence
accgctttggtgtctgttatggctg

SEQ ID NO: 165757 - DNA, 25 bp, Artificial sequence
  SiRNA target sequence
ccgctttggtgtctgttatggctgt

SEQ ID NO: 165758 - DNA, 25 bp, Artificial sequence
  SiRNA target sequence
cgctttggtgtctgttatggctgtt

SEQ ID NO: 165759 - DNA, 25 bp, Artificial sequence
  SiRNA target sequence
gctttggtgtctgttatggctgtta

SEQ ID NO: 165760 - DNA, 25 bp, Artificial sequence
  SiRNA target sequence
ctttggtgtctgttatggctgttaa

SEQ ID NO: 165761 - DNA, 25 bp, Artificial sequence
  SiRNA target sequence
tttggtgtctgttatggctgttaac

SEQ ID NO: 165762 - DNA, 25 bp, Artificial sequence
  SiRNA target sequence
ttggtgtctgttatggctgttaaca

SEQ ID NO: 165763 - DNA, 25 bp, Artificial sequence
  SiRNA target sequence
tggtgtctgttatggctgttaacaa

SEQ ID NO: 165764 - DNA, 25 bp, Artificial sequence
  SiRNA target sequence
ggtgtctgttatggctgttaacaac

SEQ ID NO: 165765 - DNA, 25 bp, Artificial sequence
  SiRNA target sequence
gtgtctgttatggctgttaacaacg

SEQ ID NO: 165766 - DNA, 25 bp, Artificial sequence
  SiRNA target sequence
tgtctgttatggctgttaacaacga

SEQ ID NO: 165767 - DNA, 25 bp, Artificial sequence
  SiRNA target sequence
gtctgttatggctgttaacaacgaa

SEQ ID NO: 165768 - DNA, 25 bp, Artificial sequence
  SiRNA target sequence
tctgttatggctgttaacaacgaaa

SEQ ID NO: 165769 - DNA, 25 bp, Artificial sequence
  SiRNA target sequence
ctgttatggctgttaacaacgaaat

SEQ ID NO: 165770 - DNA, 25 bp, Artificial sequence
  SiRNA target sequence
tgttatggctgttaacaacgaaatg

SEQ ID NO: 165771 - DNA, 25 bp, Artificial sequence
  SiRNA target sequence
gttatggctgttaacaacgaaatgg

SEQ ID NO: 165772 - DNA, 25 bp, Artificial sequence
  SiRNA target sequence
ttatggctgttaacaacgaaatggg

SEQ ID NO: 165773 - DNA, 25 bp, Artificial sequence
  SiRNA target sequence
tatggctgttaacaacgaaatggga

SEQ ID NO: 165774 - DNA, 25 bp, Artificial sequence
  SiRNA target sequence
atggctgttaacaacgaaatgggag

SEQ ID NO: 165775 - DNA, 25 bp, Artificial sequence
  SiRNA target sequence
tggctgttaacaacgaaatgggagc

SEQ ID NO: 165776 - DNA, 25 bp, Artificial sequence
  SiRNA target sequence
ggctgttaacaacgaaatgggagca

SEQ ID NO: 165777 - DNA, 25 bp, Artificial sequence
  SiRNA target sequence
gctgttaacaacgaaatgggagcaa

SEQ ID NO: 165778 - DNA, 25 bp, Artificial sequence
  SiRNA target sequence
ctgttaacaacgaaatgggagcaat

SEQ ID NO: 165779 - DNA, 25 bp, Artificial sequence
  SiRNA target sequence
tgttaacaacgaaatgggagcaata

SEQ ID NO: 165780 - DNA, 25 bp, Artificial sequence
  SiRNA target sequence
gttaacaacgaaatgggagcaatac

SEQ ID NO: 165781 - DNA, 25 bp, Artificial sequence
  SiRNA target sequence
ttaacaacgaaatgggagcaataca

SEQ ID NO: 165782 - DNA, 25 bp, Artificial sequence
  SiRNA target sequence
taacaacgaaatgggagcaatacaa

SEQ ID NO: 165783 - DNA, 25 bp, Artificial sequence
  SiRNA target sequence
aacaacgaaatgggagcaatacaac

SEQ ID NO: 165784 - DNA, 25 bp, Artificial sequence
  SiRNA target sequence
acaacgaaatgggagcaatacaacc

SEQ ID NO: 165785 - DNA, 25 bp, Artificial sequence
  SiRNA target sequence
caacgaaatgggagcaatacaaccg

SEQ ID NO: 165786 - DNA, 25 bp, Artificial sequence
  SiRNA target sequence
aacgaaatgggagcaatacaaccgc

SEQ ID NO: 165787 - DNA, 25 bp, Artificial sequence
  SiRNA target sequence
acgaaatgggagcaatacaaccgct

SEQ ID NO: 165788 - DNA, 25 bp, Artificial sequence
  SiRNA target sequence
cgaaatgggagcaatacaaccgctt

SEQ ID NO: 165789 - DNA, 25 bp, Artificial sequence
  SiRNA target sequence
gaaatgggagcaatacaaccgctta

SEQ ID NO: 165790 - DNA, 25 bp, Artificial sequence
  SiRNA target sequence
aaatgggagcaatacaaccgcttaa

SEQ ID NO: 165791 - DNA, 25 bp, Artificial sequence
  SiRNA target sequence
aatgggagcaatacaaccgcttaaa

SEQ ID NO: 165792 - DNA, 25 bp, Artificial sequence
  SiRNA target sequence
atgggagcaatacaaccgcttaaag

SEQ ID NO: 165793 - DNA, 25 bp, Artificial sequence
  SiRNA target sequence
tgggagcaatacaaccgcttaaaga

SEQ ID NO: 165794 - DNA, 25 bp, Artificial sequence
  SiRNA target sequence
gggagcaatacaaccgcttaaagaa

SEQ ID NO: 165795 - DNA, 25 bp, Artificial sequence
  SiRNA target sequence
ggagcaatacaaccgcttaaagaaa

SEQ ID NO: 165796 - DNA, 25 bp, Artificial sequence
  SiRNA target sequence
gagcaatacaaccgcttaaagaaat

SEQ ID NO: 165797 - DNA, 25 bp, Artificial sequence
  SiRNA target sequence
agcaatacaaccgcttaaagaaata

SEQ ID NO: 165798 - DNA, 25 bp, Artificial sequence
  SiRNA target sequence
gcaatacaaccgcttaaagaaatag

SEQ ID NO: 165799 - DNA, 25 bp, Artificial sequence
  SiRNA target sequence
caatacaaccgcttaaagaaatagg

SEQ ID NO: 165800 - DNA, 25 bp, Artificial sequence
  SiRNA target sequence
aatacaaccgcttaaagaaatagga

SEQ ID NO: 165801 - DNA, 25 bp, Artificial sequence
  SiRNA target sequence
atacaaccgcttaaagaaataggaa

SEQ ID NO: 165802 - DNA, 25 bp, Artificial sequence
  SiRNA target sequence
tacaaccgcttaaagaaataggaag

SEQ ID NO: 165803 - DNA, 25 bp, Artificial sequence
  SiRNA target sequence
acaaccgcttaaagaaataggaaga

SEQ ID NO: 165804 - DNA, 25 bp, Artificial sequence
  SiRNA target sequence
caaccgcttaaagaaataggaagaa

SEQ ID NO: 165805 - DNA, 25 bp, Artificial sequence
  SiRNA target sequence
aaccgcttaaagaaataggaagaat

SEQ ID NO: 165806 - DNA, 25 bp, Artificial sequence
  SiRNA target sequence
accgcttaaagaaataggaagaata

SEQ ID NO: 165807 - DNA, 25 bp, Artificial sequence
  SiRNA target sequence
ccgcttaaagaaataggaagaatat

SEQ ID NO: 165808 - DNA, 25 bp, Artificial sequence
  SiRNA target sequence
cgcttaaagaaataggaagaatatg

SEQ ID NO: 165809 - DNA, 25 bp, Artificial sequence
  SiRNA target sequence
gcttaaagaaataggaagaatatgt

SEQ ID NO: 165810 - DNA, 25 bp, Artificial sequence
  SiRNA target sequence
cttaaagaaataggaagaatatgta

SEQ ID NO: 165811 - DNA, 25 bp, Artificial sequence
  SiRNA target sequence
ttaaagaaataggaagaatatgtaa

SEQ ID NO: 165812 - DNA, 25 bp, Artificial sequence
  SiRNA target sequence
taaagaaataggaagaatatgtaaa

SEQ ID NO: 165813 - DNA, 25 bp, Artificial sequence
  SiRNA target sequence
aaagaaataggaagaatatgtaaag

SEQ ID NO: 165814 - DNA, 25 bp, Artificial sequence
  SiRNA target sequence
aagaaataggaagaatatgtaaaga

SEQ ID NO: 165815 - DNA, 25 bp, Artificial sequence
  SiRNA target sequence
agaaataggaagaatatgtaaagaa

SEQ ID NO: 165816 - DNA, 25 bp, Artificial sequence
  SiRNA target sequence
gaaataggaagaatatgtaaagaaa

SEQ ID NO: 165817 - DNA, 25 bp, Artificial sequence
  SiRNA target sequence
aaataggaagaatatgtaaagaaaa

SEQ ID NO: 165818 - DNA, 25 bp, Artificial sequence
  SiRNA target sequence
aataggaagaatatgtaaagaaaat

SEQ ID NO: 165819 - DNA, 25 bp, Artificial sequence
  SiRNA target sequence
ataggaagaatatgtaaagaaaata

SEQ ID NO: 165820 - DNA, 25 bp, Artificial sequence
  SiRNA target sequence
taggaagaatatgtaaagaaaataa

SEQ ID NO: 165821 - DNA, 25 bp, Artificial sequence
  SiRNA target sequence
aggaagaatatgtaaagaaaataat

SEQ ID NO: 165822 - DNA, 25 bp, Artificial sequence
  SiRNA target sequence
ggaagaatatgtaaagaaaataata

SEQ ID NO: 165823 - DNA, 25 bp, Artificial sequence
  SiRNA target sequence
gaagaatatgtaaagaaaataatat

SEQ ID NO: 165824 - DNA, 25 bp, Artificial sequence
  SiRNA target sequence
aagaatatgtaaagaaaataatatt

SEQ ID NO: 165825 - DNA, 25 bp, Artificial sequence
  SiRNA target sequence
agaatatgtaaagaaaataatattt

SEQ ID NO: 165826 - DNA, 25 bp, Artificial sequence
  SiRNA target sequence
gaatatgtaaagaaaataatatttt

SEQ ID NO: 165827 - DNA, 25 bp, Artificial sequence
  SiRNA target sequence
aatatgtaaagaaaataatatttta

SEQ ID NO: 165828 - DNA, 25 bp, Artificial sequence
  SiRNA target sequence
atatgtaaagaaaataatattttat

SEQ ID NO: 165829 - DNA, 25 bp, Artificial sequence
  SiRNA target sequence
tatgtaaagaaaataatattttatt

SEQ ID NO: 165830 - DNA, 25 bp, Artificial sequence
  SiRNA target sequence
atgtaaagaaaataatattttattt

SEQ ID NO: 165831 - DNA, 25 bp, Artificial sequence
  SiRNA target sequence
tgtaaagaaaataatattttatttc

SEQ ID NO: 165832 - DNA, 25 bp, Artificial sequence
  SiRNA target sequence
gtaaagaaaataatattttatttca

SEQ ID NO: 165833 - DNA, 25 bp, Artificial sequence
  SiRNA target sequence
taaagaaaataatattttatttcac

SEQ ID NO: 165834 - DNA, 25 bp, Artificial sequence
  SiRNA target sequence
aaagaaaataatattttatttcaca

SEQ ID NO: 165835 - DNA, 25 bp, Artificial sequence
  SiRNA target sequence
aagaaaataatattttatttcacac

SEQ ID NO: 165836 - DNA, 25 bp, Artificial sequence
  SiRNA target sequence
agaaaataatattttatttcacact

SEQ ID NO: 165837 - DNA, 25 bp, Artificial sequence
  SiRNA target sequence
gaaaataatattttatttcacactg

SEQ ID NO: 165838 - DNA, 25 bp, Artificial sequence
  SiRNA target sequence
aaaataatattttatttcacactga

SEQ ID NO: 165839 - DNA, 25 bp, Artificial sequence
  SiRNA target sequence
aaataatattttatttcacactgat

SEQ ID NO: 165840 - DNA, 25 bp, Artificial sequence
  SiRNA target sequence
aataatattttatttcacactgatg

SEQ ID NO: 165841 - DNA, 25 bp, Artificial sequence
  SiRNA target sequence
ataatattttatttcacactgatgc

SEQ ID NO: 165842 - DNA, 25 bp, Artificial sequence
  SiRNA target sequence
taatattttatttcacactgatgca

SEQ ID NO: 165843 - DNA, 25 bp, Artificial sequence
  SiRNA target sequence
aatattttatttcacactgatgcag

SEQ ID NO: 165844 - DNA, 25 bp, Artificial sequence
  SiRNA target sequence
atattttatttcacactgatgcagc

SEQ ID NO: 165845 - DNA, 25 bp, Artificial sequence
  SiRNA target sequence
tattttatttcacactgatgcagca

SEQ ID NO: 165846 - DNA, 25 bp, Artificial sequence
  SiRNA target sequence
attttatttcacactgatgcagcac

SEQ ID NO: 165847 - DNA, 25 bp, Artificial sequence
  SiRNA target sequence
ttttatttcacactgatgcagcaca

SEQ ID NO: 165848 - DNA, 25 bp, Artificial sequence
  SiRNA target sequence
tttatttcacactgatgcagcacaa

SEQ ID NO: 165849 - DNA, 25 bp, Artificial sequence
  SiRNA target sequence
ttatttcacactgatgcagcacaag

SEQ ID NO: 165850 - DNA, 25 bp, Artificial sequence
  SiRNA target sequence
tatttcacactgatgcagcacaagc

SEQ ID NO: 165851 - DNA, 25 bp, Artificial sequence
  SiRNA target sequence
atttcacactgatgcagcacaagca

SEQ ID NO: 165852 - DNA, 25 bp, Artificial sequence
  SiRNA target sequence
tttcacactgatgcagcacaagcag

SEQ ID NO: 165853 - DNA, 25 bp, Artificial sequence
  SiRNA target sequence
ttcacactgatgcagcacaagcagt

SEQ ID NO: 165854 - DNA, 25 bp, Artificial sequence
  SiRNA target sequence
tcacactgatgcagcacaagcagtt

SEQ ID NO: 165855 - DNA, 25 bp, Artificial sequence
  SiRNA target sequence
cacactgatgcagcacaagcagttg

SEQ ID NO: 165856 - DNA, 25 bp, Artificial sequence
  SiRNA target sequence
acactgatgcagcacaagcagttgg

SEQ ID NO: 165857 - DNA, 25 bp, Artificial sequence
  SiRNA target sequence
cactgatgcagcacaagcagttggt

SEQ ID NO: 165858 - DNA, 25 bp, Artificial sequence
  SiRNA target sequence
actgatgcagcacaagcagttggta

SEQ ID NO: 165859 - DNA, 25 bp, Artificial sequence
  SiRNA target sequence
ctgatgcagcacaagcagttggtaa

SEQ ID NO: 165860 - DNA, 25 bp, Artificial sequence
  SiRNA target sequence
tgatgcagcacaagcagttggtaat

SEQ ID NO: 165861 - DNA, 25 bp, Artificial sequence
  SiRNA target sequence
gatgcagcacaagcagttggtaata

SEQ ID NO: 165862 - DNA, 25 bp, Artificial sequence
  SiRNA target sequence
atgcagcacaagcagttggtaatat

SEQ ID NO: 165863 - DNA, 25 bp, Artificial sequence
  SiRNA target sequence
tgcagcacaagcagttggtaatata

SEQ ID NO: 165864 - DNA, 25 bp, Artificial sequence
  SiRNA target sequence
gcagcacaagcagttggtaatatag

SEQ ID NO: 165865 - DNA, 25 bp, Artificial sequence
  SiRNA target sequence
cagcacaagcagttggtaatataga

SEQ ID NO: 165866 - DNA, 25 bp, Artificial sequence
  SiRNA target sequence
agcacaagcagttggtaatatagat

SEQ ID NO: 165867 - DNA, 25 bp, Artificial sequence
  SiRNA target sequence
gcacaagcagttggtaatatagata

SEQ ID NO: 165868 - DNA, 25 bp, Artificial sequence
  SiRNA target sequence
cacaagcagttggtaatatagatat

SEQ ID NO: 165869 - DNA, 25 bp, Artificial sequence
  SiRNA target sequence
acaagcagttggtaatatagatatt

SEQ ID NO: 165870 - DNA, 25 bp, Artificial sequence
  SiRNA target sequence
caagcagttggtaatatagatattg

SEQ ID NO: 165871 - DNA, 25 bp, Artificial sequence
  SiRNA target sequence
aagcagttggtaatatagatattga

SEQ ID NO: 165872 - DNA, 25 bp, Artificial sequence
  SiRNA target sequence
agcagttggtaatatagatattgat

SEQ ID NO: 165873 - DNA, 25 bp, Artificial sequence
  SiRNA target sequence
gcagttggtaatatagatattgatg

SEQ ID NO: 165874 - DNA, 25 bp, Artificial sequence
  SiRNA target sequence
cagttggtaatatagatattgatgt

SEQ ID NO: 165875 - DNA, 25 bp, Artificial sequence
  SiRNA target sequence
agttggtaatatagatattgatgtc

SEQ ID NO: 165876 - DNA, 25 bp, Artificial sequence
  SiRNA target sequence
gttggtaatatagatattgatgtca

SEQ ID NO: 165877 - DNA, 25 bp, Artificial sequence
  SiRNA target sequence
ttggtaatatagatattgatgtcaa

SEQ ID NO: 165878 - DNA, 25 bp, Artificial sequence
  SiRNA target sequence
tggtaatatagatattgatgtcaat

SEQ ID NO: 165879 - DNA, 25 bp, Artificial sequence
  SiRNA target sequence
ggtaatatagatattgatgtcaatg

SEQ ID NO: 165880 - DNA, 25 bp, Artificial sequence
  SiRNA target sequence
gtaatatagatattgatgtcaatga

SEQ ID NO: 165881 - DNA, 25 bp, Artificial sequence
  SiRNA target sequence
taatatagatattgatgtcaatgat

SEQ ID NO: 165882 - DNA, 25 bp, Artificial sequence
  SiRNA target sequence
aatatagatattgatgtcaatgata

SEQ ID NO: 165883 - DNA, 25 bp, Artificial sequence
  SiRNA target sequence
atatagatattgatgtcaatgatat

SEQ ID NO: 165884 - DNA, 25 bp, Artificial sequence
  SiRNA target sequence
tatagatattgatgtcaatgatatg

SEQ ID NO: 165885 - DNA, 25 bp, Artificial sequence
  SiRNA target sequence
atagatattgatgtcaatgatatga

SEQ ID NO: 165886 - DNA, 25 bp, Artificial sequence
  SiRNA target sequence
tagatattgatgtcaatgatatgaa

SEQ ID NO: 165887 - DNA, 25 bp, Artificial sequence
  SiRNA target sequence
agatattgatgtcaatgatatgaat

SEQ ID NO: 165888 - DNA, 25 bp, Artificial sequence
  SiRNA target sequence
gatattgatgtcaatgatatgaata

SEQ ID NO: 165889 - DNA, 25 bp, Artificial sequence
  SiRNA target sequence
atattgatgtcaatgatatgaatat

SEQ ID NO: 165890 - DNA, 25 bp, Artificial sequence
  SiRNA target sequence
tattgatgtcaatgatatgaatatt

SEQ ID NO: 165891 - DNA, 25 bp, Artificial sequence
  SiRNA target sequence
attgatgtcaatgatatgaatattg

SEQ ID NO: 165892 - DNA, 25 bp, Artificial sequence
  SiRNA target sequence
ttgatgtcaatgatatgaatattga

SEQ ID NO: 165893 - DNA, 25 bp, Artificial sequence
  SiRNA target sequence
tgatgtcaatgatatgaatattgat

SEQ ID NO: 165894 - DNA, 25 bp, Artificial sequence
  SiRNA target sequence
gatgtcaatgatatgaatattgatt

SEQ ID NO: 165895 - DNA, 25 bp, Artificial sequence
  SiRNA target sequence
atgtcaatgatatgaatattgattt

SEQ ID NO: 165896 - DNA, 25 bp, Artificial sequence
  SiRNA target sequence
tgtcaatgatatgaatattgattta

SEQ ID NO: 165897 - DNA, 25 bp, Artificial sequence
  SiRNA target sequence
gtcaatgatatgaatattgatttac

SEQ ID NO: 165898 - DNA, 25 bp, Artificial sequence
  SiRNA target sequence
tcaatgatatgaatattgatttact

SEQ ID NO: 165899 - DNA, 25 bp, Artificial sequence
  SiRNA target sequence
caatgatatgaatattgatttacta

SEQ ID NO: 165900 - DNA, 25 bp, Artificial sequence
  SiRNA target sequence
aatgatatgaatattgatttactaa

SEQ ID NO: 165901 - DNA, 25 bp, Artificial sequence
  SiRNA target sequence
atgatatgaatattgatttactaag

SEQ ID NO: 165902 - DNA, 25 bp, Artificial sequence
  SiRNA target sequence
tgatatgaatattgatttactaagt

SEQ ID NO: 165903 - DNA, 25 bp, Artificial sequence
  SiRNA target sequence
gatatgaatattgatttactaagtt

SEQ ID NO: 165904 - DNA, 25 bp, Artificial sequence
  SiRNA target sequence
atatgaatattgatttactaagttt

SEQ ID NO: 165905 - DNA, 25 bp, Artificial sequence
  SiRNA target sequence
tatgaatattgatttactaagttta

SEQ ID NO: 165906 - DNA, 25 bp, Artificial sequence
  SiRNA target sequence
atgaatattgatttactaagtttat

SEQ ID NO: 165907 - DNA, 25 bp, Artificial sequence
  SiRNA target sequence
tgaatattgatttactaagtttatc

SEQ ID NO: 165908 - DNA, 25 bp, Artificial sequence
  SiRNA target sequence
gaatattgatttactaagtttatca

SEQ ID NO: 165909 - DNA, 25 bp, Artificial sequence
  SiRNA target sequence
aatattgatttactaagtttatcaa

SEQ ID NO: 165910 - DNA, 25 bp, Artificial sequence
  SiRNA target sequence
atattgatttactaagtttatcaag

SEQ ID NO: 165911 - DNA, 25 bp, Artificial sequence
  SiRNA target sequence
tattgatttactaagtttatcaagt

SEQ ID NO: 165912 - DNA, 25 bp, Artificial sequence
  SiRNA target sequence
attgatttactaagtttatcaagtc

SEQ ID NO: 165913 - DNA, 25 bp, Artificial sequence
  SiRNA target sequence
ttgatttactaagtttatcaagtca

SEQ ID NO: 165914 - DNA, 25 bp, Artificial sequence
  SiRNA target sequence
tgatttactaagtttatcaagtcat

SEQ ID NO: 165915 - DNA, 25 bp, Artificial sequence
  SiRNA target sequence
gatttactaagtttatcaagtcata

SEQ ID NO: 165916 - DNA, 25 bp, Artificial sequence
  SiRNA target sequence
atttactaagtttatcaagtcataa

SEQ ID NO: 165917 - DNA, 25 bp, Artificial sequence
  SiRNA target sequence
tttactaagtttatcaagtcataaa

SEQ ID NO: 165918 - DNA, 25 bp, Artificial sequence
  SiRNA target sequence
ttactaagtttatcaagtcataaaa

SEQ ID NO: 165919 - DNA, 25 bp, Artificial sequence
  SiRNA target sequence
tactaagtttatcaagtcataaaat

SEQ ID NO: 165920 - DNA, 25 bp, Artificial sequence
  SiRNA target sequence
actaagtttatcaagtcataaaatt

SEQ ID NO: 165921 - DNA, 25 bp, Artificial sequence
  SiRNA target sequence
ctaagtttatcaagtcataaaattt

SEQ ID NO: 165922 - DNA, 25 bp, Artificial sequence
  SiRNA target sequence
taagtttatcaagtcataaaattta

SEQ ID NO: 165923 - DNA, 25 bp, Artificial sequence
  SiRNA target sequence
aagtttatcaagtcataaaatttat

SEQ ID NO: 165924 - DNA, 25 bp, Artificial sequence
  SiRNA target sequence
agtttatcaagtcataaaatttatg

SEQ ID NO: 165925 - DNA, 25 bp, Artificial sequence
  SiRNA target sequence
gtttatcaagtcataaaatttatgg

SEQ ID NO: 165926 - DNA, 25 bp, Artificial sequence
  SiRNA target sequence
tttatcaagtcataaaatttatggt

SEQ ID NO: 165927 - DNA, 25 bp, Artificial sequence
  SiRNA target sequence
ttatcaagtcataaaatttatggtc

SEQ ID NO: 165928 - DNA, 25 bp, Artificial sequence
  SiRNA target sequence
tatcaagtcataaaatttatggtcc

SEQ ID NO: 165929 - DNA, 25 bp, Artificial sequence
  SiRNA target sequence
atcaagtcataaaatttatggtcca

SEQ ID NO: 165930 - DNA, 25 bp, Artificial sequence
  SiRNA target sequence
tcaagtcataaaatttatggtccaa

SEQ ID NO: 165931 - DNA, 25 bp, Artificial sequence
  SiRNA target sequence
caagtcataaaatttatggtccaaa

SEQ ID NO: 165932 - DNA, 25 bp, Artificial sequence
  SiRNA target sequence
aagtcataaaatttatggtccaaaa

SEQ ID NO: 165933 - DNA, 25 bp, Artificial sequence
  SiRNA target sequence
agtcataaaatttatggtccaaaag

SEQ ID NO: 165934 - DNA, 25 bp, Artificial sequence
  SiRNA target sequence
gtcataaaatttatggtccaaaagg

SEQ ID NO: 165935 - DNA, 25 bp, Artificial sequence
  SiRNA target sequence
tcataaaatttatggtccaaaaggt

SEQ ID NO: 165936 - DNA, 25 bp, Artificial sequence
  SiRNA target sequence
cataaaatttatggtccaaaaggtg

SEQ ID NO: 165937 - DNA, 25 bp, Artificial sequence
  SiRNA target sequence
ataaaatttatggtccaaaaggtgt

SEQ ID NO: 165938 - DNA, 25 bp, Artificial sequence
  SiRNA target sequence
taaaatttatggtccaaaaggtgtt

SEQ ID NO: 165939 - DNA, 25 bp, Artificial sequence
  SiRNA target sequence
aaaatttatggtccaaaaggtgttg

SEQ ID NO: 165940 - DNA, 25 bp, Artificial sequence
  SiRNA target sequence
aaatttatggtccaaaaggtgttgg

SEQ ID NO: 165941 - DNA, 25 bp, Artificial sequence
  SiRNA target sequence
aatttatggtccaaaaggtgttggt

SEQ ID NO: 165942 - DNA, 25 bp, Artificial sequence
  SiRNA target sequence
atttatggtccaaaaggtgttggtg

SEQ ID NO: 165943 - DNA, 25 bp, Artificial sequence
  SiRNA target sequence
tttatggtccaaaaggtgttggtgc

SEQ ID NO: 165944 - DNA, 25 bp, Artificial sequence
  SiRNA target sequence
ttatggtccaaaaggtgttggtgcc

SEQ ID NO: 165945 - DNA, 25 bp, Artificial sequence
  SiRNA target sequence
tatggtccaaaaggtgttggtgcct

SEQ ID NO: 165946 - DNA, 25 bp, Artificial sequence
  SiRNA target sequence
atggtccaaaaggtgttggtgcctt

SEQ ID NO: 165947 - DNA, 25 bp, Artificial sequence
  SiRNA target sequence
tggtccaaaaggtgttggtgcctta

SEQ ID NO: 165948 - DNA, 25 bp, Artificial sequence
  SiRNA target sequence
ggtccaaaaggtgttggtgccttat

SEQ ID NO: 165949 - DNA, 25 bp, Artificial sequence
  SiRNA target sequence
gtccaaaaggtgttggtgccttata

SEQ ID NO: 165950 - DNA, 25 bp, Artificial sequence
  SiRNA target sequence
tccaaaaggtgttggtgccttatac

SEQ ID NO: 165951 - DNA, 25 bp, Artificial sequence
  SiRNA target sequence
ccaaaaggtgttggtgccttatacg

SEQ ID NO: 165952 - DNA, 25 bp, Artificial sequence
  SiRNA target sequence
caaaaggtgttggtgccttatacgt

SEQ ID NO: 165953 - DNA, 25 bp, Artificial sequence
  SiRNA target sequence
aaaaggtgttggtgccttatacgtc

SEQ ID NO: 165954 - DNA, 25 bp, Artificial sequence
  SiRNA target sequence
aaaggtgttggtgccttatacgtca

SEQ ID NO: 165955 - DNA, 25 bp, Artificial sequence
  SiRNA target sequence
aaggtgttggtgccttatacgtcag

SEQ ID NO: 165956 - DNA, 25 bp, Artificial sequence
  SiRNA target sequence
aggtgttggtgccttatacgtcaga

SEQ ID NO: 165957 - DNA, 25 bp, Artificial sequence
  SiRNA target sequence
ggtgttggtgccttatacgtcagaa

SEQ ID NO: 165958 - DNA, 25 bp, Artificial sequence
  SiRNA target sequence
gtgttggtgccttatacgtcagaag

SEQ ID NO: 165959 - DNA, 25 bp, Artificial sequence
  SiRNA target sequence
tgttggtgccttatacgtcagaaga

SEQ ID NO: 165960 - DNA, 25 bp, Artificial sequence
  SiRNA target sequence
gttggtgccttatacgtcagaagaa

SEQ ID NO: 165961 - DNA, 25 bp, Artificial sequence
  SiRNA target sequence
ttggtgccttatacgtcagaagaag

SEQ ID NO: 165962 - DNA, 25 bp, Artificial sequence
  SiRNA target sequence
tggtgccttatacgtcagaagaagg

SEQ ID NO: 165963 - DNA, 25 bp, Artificial sequence
  SiRNA target sequence
ggtgccttatacgtcagaagaaggc

SEQ ID NO: 165964 - DNA, 25 bp, Artificial sequence
  SiRNA target sequence
gtgccttatacgtcagaagaaggcc

SEQ ID NO: 165965 - DNA, 25 bp, Artificial sequence
  SiRNA target sequence
tgccttatacgtcagaagaaggcct

SEQ ID NO: 165966 - DNA, 25 bp, Artificial sequence
  SiRNA target sequence
gccttatacgtcagaagaaggccta

SEQ ID NO: 165967 - DNA, 25 bp, Artificial sequence
  SiRNA target sequence
ccttatacgtcagaagaaggcctag

SEQ ID NO: 165968 - DNA, 25 bp, Artificial sequence
  SiRNA target sequence
cttatacgtcagaagaaggcctagg

SEQ ID NO: 165969 - DNA, 25 bp, Artificial sequence
  SiRNA target sequence
ttatacgtcagaagaaggcctaggg

SEQ ID NO: 165970 - DNA, 25 bp, Artificial sequence
  SiRNA target sequence
tatacgtcagaagaaggcctagggt

SEQ ID NO: 165971 - DNA, 25 bp, Artificial sequence
  SiRNA target sequence
atacgtcagaagaaggcctagggtg

SEQ ID NO: 165972 - DNA, 25 bp, Artificial sequence
  SiRNA target sequence
tacgtcagaagaaggcctagggtga

SEQ ID NO: 165973 - DNA, 25 bp, Artificial sequence
  SiRNA target sequence
acgtcagaagaaggcctagggtgag

SEQ ID NO: 165974 - DNA, 25 bp, Artificial sequence
  SiRNA target sequence
cgtcagaagaaggcctagggtgaga

SEQ ID NO: 165975 - DNA, 25 bp, Artificial sequence
  SiRNA target sequence
gtcagaagaaggcctagggtgagaa

SEQ ID NO: 165976 - DNA, 25 bp, Artificial sequence
  SiRNA target sequence
tcagaagaaggcctagggtgagaat

SEQ ID NO: 165977 - DNA, 25 bp, Artificial sequence
  SiRNA target sequence
cagaagaaggcctagggtgagaatg

SEQ ID NO: 165978 - DNA, 25 bp, Artificial sequence
  SiRNA target sequence
agaagaaggcctagggtgagaatgt

SEQ ID NO: 165979 - DNA, 25 bp, Artificial sequence
  SiRNA target sequence
gaagaaggcctagggtgagaatgtt

SEQ ID NO: 165980 - DNA, 25 bp, Artificial sequence
  SiRNA target sequence
aagaaggcctagggtgagaatgtta

SEQ ID NO: 165981 - DNA, 25 bp, Artificial sequence
  SiRNA target sequence
agaaggcctagggtgagaatgttac

SEQ ID NO: 165982 - DNA, 25 bp, Artificial sequence
  SiRNA target sequence
gaaggcctagggtgagaatgttacc

SEQ ID NO: 165983 - DNA, 25 bp, Artificial sequence
  SiRNA target sequence
aaggcctagggtgagaatgttacca

SEQ ID NO: 165984 - DNA, 25 bp, Artificial sequence
  SiRNA target sequence
aggcctagggtgagaatgttaccac

SEQ ID NO: 165985 - DNA, 25 bp, Artificial sequence
  SiRNA target sequence
ggcctagggtgagaatgttaccact

SEQ ID NO: 165986 - DNA, 25 bp, Artificial sequence
  SiRNA target sequence
gcctagggtgagaatgttaccactt

SEQ ID NO: 165987 - DNA, 25 bp, Artificial sequence
  SiRNA target sequence
cctagggtgagaatgttaccacttt

SEQ ID NO: 165988 - DNA, 25 bp, Artificial sequence
  SiRNA target sequence
ctagggtgagaatgttaccactttt

SEQ ID NO: 165989 - DNA, 25 bp, Artificial sequence
  SiRNA target sequence
tagggtgagaatgttaccacttttt

SEQ ID NO: 165990 - DNA, 25 bp, Artificial sequence
  SiRNA target sequence
agggtgagaatgttaccacttttta

SEQ ID NO: 165991 - DNA, 25 bp, Artificial sequence
  SiRNA target sequence
gggtgagaatgttaccactttttaa

SEQ ID NO: 165992 - DNA, 25 bp, Artificial sequence
  SiRNA target sequence
ggtgagaatgttaccactttttaat

SEQ ID NO: 165993 - DNA, 25 bp, Artificial sequence
  SiRNA target sequence
gtgagaatgttaccactttttaatg

SEQ ID NO: 165994 - DNA, 25 bp, Artificial sequence
  SiRNA target sequence
tgagaatgttaccactttttaatgg

SEQ ID NO: 165995 - DNA, 25 bp, Artificial sequence
  SiRNA target sequence
gagaatgttaccactttttaatggt

SEQ ID NO: 165996 - DNA, 25 bp, Artificial sequence
  SiRNA target sequence
agaatgttaccactttttaatggtg

SEQ ID NO: 165997 - DNA, 25 bp, Artificial sequence
  SiRNA target sequence
gaatgttaccactttttaatggtgg

SEQ ID NO: 165998 - DNA, 25 bp, Artificial sequence
  SiRNA target sequence
aatgttaccactttttaatggtggt

SEQ ID NO: 165999 - DNA, 25 bp, Artificial sequence
  SiRNA target sequence
atgttaccactttttaatggtggtg

SEQ ID NO: 166000 - DNA, 25 bp, Artificial sequence
  SiRNA target sequence
tgttaccactttttaatggtggtgg

SEQ ID NO: 166001 - DNA, 25 bp, Artificial sequence
  SiRNA target sequence
gttaccactttttaatggtggtgga

SEQ ID NO: 166002 - DNA, 25 bp, Artificial sequence
  SiRNA target sequence
ttaccactttttaatggtggtggac

SEQ ID NO: 166003 - DNA, 25 bp, Artificial sequence
  SiRNA target sequence
taccactttttaatggtggtggaca

SEQ ID NO: 166004 - DNA, 25 bp, Artificial sequence
  SiRNA target sequence
accactttttaatggtggtggacaa

SEQ ID NO: 166005 - DNA, 25 bp, Artificial sequence
  SiRNA target sequence
ccactttttaatggtggtggacaag

SEQ ID NO: 166006 - DNA, 25 bp, Artificial sequence
  SiRNA target sequence
cactttttaatggtggtggacaaga

SEQ ID NO: 166007 - DNA, 25 bp, Artificial sequence
  SiRNA target sequence
actttttaatggtggtggacaagaa

SEQ ID NO: 166008 - DNA, 25 bp, Artificial sequence
  SiRNA target sequence
ctttttaatggtggtggacaagaaa

SEQ ID NO: 166009 - DNA, 25 bp, Artificial sequence
  SiRNA target sequence
tttttaatggtggtggacaagaaag

SEQ ID NO: 166010 - DNA, 25 bp, Artificial sequence
  SiRNA target sequence
ttttaatggtggtggacaagaaaga

SEQ ID NO: 166011 - DNA, 25 bp, Artificial sequence
  SiRNA target sequence
tttaatggtggtggacaagaaagag

SEQ ID NO: 166012 - DNA, 25 bp, Artificial sequence
  SiRNA target sequence
ttaatggtggtggacaagaaagagg

SEQ ID NO: 166013 - DNA, 25 bp, Artificial sequence
  SiRNA target sequence
taatggtggtggacaagaaagagga

SEQ ID NO: 166014 - DNA, 25 bp, Artificial sequence
  SiRNA target sequence
aatggtggtggacaagaaagaggat

SEQ ID NO: 166015 - DNA, 25 bp, Artificial sequence
  SiRNA target sequence
atggtggtggacaagaaagaggatt

SEQ ID NO: 166016 - DNA, 25 bp, Artificial sequence
  SiRNA target sequence
tggtggtggacaagaaagaggatta

SEQ ID NO: 166017 - DNA, 25 bp, Artificial sequence
  SiRNA target sequence
ggtggtggacaagaaagaggattaa

SEQ ID NO: 166018 - DNA, 25 bp, Artificial sequence
  SiRNA target sequence
gtggtggacaagaaagaggattaag

SEQ ID NO: 166019 - DNA, 25 bp, Artificial sequence
  SiRNA target sequence
tggtggacaagaaagaggattaaga

SEQ ID NO: 166020 - DNA, 25 bp, Artificial sequence
  SiRNA target sequence
ggtggacaagaaagaggattaagaa

SEQ ID NO: 166021 - DNA, 25 bp, Artificial sequence
  SiRNA target sequence
gtggacaagaaagaggattaagaag

SEQ ID NO: 166022 - DNA, 25 bp, Artificial sequence
  SiRNA target sequence
tggacaagaaagaggattaagaagt

SEQ ID NO: 166023 - DNA, 25 bp, Artificial sequence
  SiRNA target sequence
ggacaagaaagaggattaagaagtg

SEQ ID NO: 166024 - DNA, 25 bp, Artificial sequence
  SiRNA target sequence
gacaagaaagaggattaagaagtgg

SEQ ID NO: 166025 - DNA, 25 bp, Artificial sequence
  SiRNA target sequence
acaagaaagaggattaagaagtggg

SEQ ID NO: 166026 - DNA, 25 bp, Artificial sequence
  SiRNA target sequence
caagaaagaggattaagaagtggga

SEQ ID NO: 166027 - DNA, 25 bp, Artificial sequence
  SiRNA target sequence
aagaaagaggattaagaagtgggac

SEQ ID NO: 166028 - DNA, 25 bp, Artificial sequence
  SiRNA target sequence
agaaagaggattaagaagtgggaca

SEQ ID NO: 166029 - DNA, 25 bp, Artificial sequence
  SiRNA target sequence
gaaagaggattaagaagtgggacaa

SEQ ID NO: 166030 - DNA, 25 bp, Artificial sequence
  SiRNA target sequence
aaagaggattaagaagtgggacaac

SEQ ID NO: 166031 - DNA, 25 bp, Artificial sequence
  SiRNA target sequence
aagaggattaagaagtgggacaact

SEQ ID NO: 166032 - DNA, 25 bp, Artificial sequence
  SiRNA target sequence
agaggattaagaagtgggacaactt

SEQ ID NO: 166033 - DNA, 25 bp, Artificial sequence
  SiRNA target sequence
gaggattaagaagtgggacaacttc

SEQ ID NO: 166034 - DNA, 25 bp, Artificial sequence
  SiRNA target sequence
aggattaagaagtgggacaacttct

SEQ ID NO: 166035 - DNA, 25 bp, Artificial sequence
  SiRNA target sequence
ggattaagaagtgggacaacttctc

SEQ ID NO: 166036 - DNA, 25 bp, Artificial sequence
  SiRNA target sequence
gattaagaagtgggacaacttctcc

SEQ ID NO: 166037 - DNA, 25 bp, Artificial sequence
  SiRNA target sequence
attaagaagtgggacaacttctcca

SEQ ID NO: 166038 - DNA, 25 bp, Artificial sequence
  SiRNA target sequence
ttaagaagtgggacaacttctccac

SEQ ID NO: 166039 - DNA, 25 bp, Artificial sequence
  SiRNA target sequence
taagaagtgggacaacttctccacc

SEQ ID NO: 166040 - DNA, 25 bp, Artificial sequence
  SiRNA target sequence
aagaagtgggacaacttctccacct

SEQ ID NO: 166041 - DNA, 25 bp, Artificial sequence
  SiRNA target sequence
agaagtgggacaacttctccacctt

SEQ ID NO: 166042 - DNA, 25 bp, Artificial sequence
  SiRNA target sequence
gaagtgggacaacttctccaccttt

SEQ ID NO: 166043 - DNA, 25 bp, Artificial sequence
  SiRNA target sequence
aagtgggacaacttctccaccttta

SEQ ID NO: 166044 - DNA, 25 bp, Artificial sequence
  SiRNA target sequence
agtgggacaacttctccacctttag

SEQ ID NO: 166045 - DNA, 25 bp, Artificial sequence
  SiRNA target sequence
gtgggacaacttctccacctttagt

SEQ ID NO: 166046 - DNA, 25 bp, Artificial sequence
  SiRNA target sequence
tgggacaacttctccacctttagtt

SEQ ID NO: 166047 - DNA, 25 bp, Artificial sequence
  SiRNA target sequence
gggacaacttctccacctttagttg

SEQ ID NO: 166048 - DNA, 25 bp, Artificial sequence
  SiRNA target sequence
ggacaacttctccacctttagttgt

SEQ ID NO: 166049 - DNA, 25 bp, Artificial sequence
  SiRNA target sequence
gacaacttctccacctttagttgtt

SEQ ID NO: 166050 - DNA, 25 bp, Artificial sequence
  SiRNA target sequence
acaacttctccacctttagttgttg

SEQ ID NO: 166051 - DNA, 25 bp, Artificial sequence
  SiRNA target sequence
caacttctccacctttagttgttgg

SEQ ID NO: 166052 - DNA, 25 bp, Artificial sequence
  SiRNA target sequence
aacttctccacctttagttgttgga

SEQ ID NO: 166053 - DNA, 25 bp, Artificial sequence
  SiRNA target sequence
acttctccacctttagttgttggat

SEQ ID NO: 166054 - DNA, 25 bp, Artificial sequence
  SiRNA target sequence
cttctccacctttagttgttggatt

SEQ ID NO: 166055 - DNA, 25 bp, Artificial sequence
  SiRNA target sequence
ttctccacctttagttgttggatta

SEQ ID NO: 166056 - DNA, 25 bp, Artificial sequence
  SiRNA target sequence
tctccacctttagttgttggattag

SEQ ID NO: 166057 - DNA, 25 bp, Artificial sequence
  SiRNA target sequence
ctccacctttagttgttggattagg

SEQ ID NO: 166058 - DNA, 25 bp, Artificial sequence
  SiRNA target sequence
tccacctttagttgttggattaggc

SEQ ID NO: 166059 - DNA, 25 bp, Artificial sequence
  SiRNA target sequence
ccacctttagttgttggattaggca

SEQ ID NO: 166060 - DNA, 25 bp, Artificial sequence
  SiRNA target sequence
cacctttagttgttggattaggcaa

SEQ ID NO: 166061 - DNA, 25 bp, Artificial sequence
  SiRNA target sequence
acctttagttgttggattaggcaaa

SEQ ID NO: 166062 - DNA, 25 bp, Artificial sequence
  SiRNA target sequence
cctttagttgttggattaggcaaag

SEQ ID NO: 166063 - DNA, 25 bp, Artificial sequence
  SiRNA target sequence
ctttagttgttggattaggcaaagc

SEQ ID NO: 166064 - DNA, 25 bp, Artificial sequence
  SiRNA target sequence
tttagttgttggattaggcaaagct

SEQ ID NO: 166065 - DNA, 25 bp, Artificial sequence
  SiRNA target sequence
ttagttgttggattaggcaaagctg

SEQ ID NO: 166066 - DNA, 25 bp, Artificial sequence
  SiRNA target sequence
tagttgttggattaggcaaagctgc

SEQ ID NO: 166067 - DNA, 25 bp, Artificial sequence
  SiRNA target sequence
agttgttggattaggcaaagctgct

SEQ ID NO: 166068 - DNA, 25 bp, Artificial sequence
  SiRNA target sequence
gttgttggattaggcaaagctgctg

SEQ ID NO: 166069 - DNA, 25 bp, Artificial sequence
  SiRNA target sequence
ttgttggattaggcaaagctgctga

SEQ ID NO: 166070 - DNA, 25 bp, Artificial sequence
  SiRNA target sequence
tgttggattaggcaaagctgctgag

SEQ ID NO: 166071 - DNA, 25 bp, Artificial sequence
  SiRNA target sequence
gttggattaggcaaagctgctgaga

SEQ ID NO: 166072 - DNA, 25 bp, Artificial sequence
  SiRNA target sequence
ttggattaggcaaagctgctgagat

SEQ ID NO: 166073 - DNA, 25 bp, Artificial sequence
  SiRNA target sequence
tggattaggcaaagctgctgagata

SEQ ID NO: 166074 - DNA, 25 bp, Artificial sequence
  SiRNA target sequence
ggattaggcaaagctgctgagatat

SEQ ID NO: 166075 - DNA, 25 bp, Artificial sequence
  SiRNA target sequence
gattaggcaaagctgctgagatatg

SEQ ID NO: 166076 - DNA, 25 bp, Artificial sequence
  SiRNA target sequence
attaggcaaagctgctgagatatgc

SEQ ID NO: 166077 - DNA, 25 bp, Artificial sequence
  SiRNA target sequence
ttaggcaaagctgctgagatatgct

SEQ ID NO: 166078 - DNA, 25 bp, Artificial sequence
  SiRNA target sequence
taggcaaagctgctgagatatgctc

SEQ ID NO: 166079 - DNA, 25 bp, Artificial sequence
  SiRNA target sequence
aggcaaagctgctgagatatgctct

SEQ ID NO: 166080 - DNA, 25 bp, Artificial sequence
  SiRNA target sequence
ggcaaagctgctgagatatgctctc

SEQ ID NO: 166081 - DNA, 25 bp, Artificial sequence
  SiRNA target sequence
gcaaagctgctgagatatgctctca

SEQ ID NO: 166082 - DNA, 25 bp, Artificial sequence
  SiRNA target sequence
caaagctgctgagatatgctctcag

SEQ ID NO: 166083 - DNA, 25 bp, Artificial sequence
  SiRNA target sequence
aaagctgctgagatatgctctcagg

SEQ ID NO: 166084 - DNA, 25 bp, Artificial sequence
  SiRNA target sequence
aagctgctgagatatgctctcagga

SEQ ID NO: 166085 - DNA, 25 bp, Artificial sequence
  SiRNA target sequence
agctgctgagatatgctctcaggag

SEQ ID NO: 166086 - DNA, 25 bp, Artificial sequence
  SiRNA target sequence
gctgctgagatatgctctcaggaga

SEQ ID NO: 166087 - DNA, 25 bp, Artificial sequence
  SiRNA target sequence
ctgctgagatatgctctcaggagat

SEQ ID NO: 166088 - DNA, 25 bp, Artificial sequence
  SiRNA target sequence
tgctgagatatgctctcaggagatg

SEQ ID NO: 166089 - DNA, 25 bp, Artificial sequence
  SiRNA target sequence
gctgagatatgctctcaggagatgc

SEQ ID NO: 166090 - DNA, 25 bp, Artificial sequence
  SiRNA target sequence
ctgagatatgctctcaggagatgcg

SEQ ID NO: 166091 - DNA, 25 bp, Artificial sequence
  SiRNA target sequence
tgagatatgctctcaggagatgcgt

SEQ ID NO: 166092 - DNA, 25 bp, Artificial sequence
  SiRNA target sequence
gagatatgctctcaggagatgcgta

SEQ ID NO: 166093 - DNA, 25 bp, Artificial sequence
  SiRNA target sequence
agatatgctctcaggagatgcgtaa

SEQ ID NO: 166094 - DNA, 25 bp, Artificial sequence
  SiRNA target sequence
gatatgctctcaggagatgcgtaag

SEQ ID NO: 166095 - DNA, 25 bp, Artificial sequence
  SiRNA target sequence
atatgctctcaggagatgcgtaagg

SEQ ID NO: 166096 - DNA, 25 bp, Artificial sequence
  SiRNA target sequence
tatgctctcaggagatgcgtaagga

SEQ ID NO: 166097 - DNA, 25 bp, Artificial sequence
  SiRNA target sequence
atgctctcaggagatgcgtaaggac

SEQ ID NO: 166098 - DNA, 25 bp, Artificial sequence
  SiRNA target sequence
tgctctcaggagatgcgtaaggact

SEQ ID NO: 166099 - DNA, 25 bp, Artificial sequence
  SiRNA target sequence
gctctcaggagatgcgtaaggacta

SEQ ID NO: 166100 - DNA, 25 bp, Artificial sequence
  SiRNA target sequence
ctctcaggagatgcgtaaggactat

SEQ ID NO: 166101 - DNA, 25 bp, Artificial sequence
  SiRNA target sequence
tctcaggagatgcgtaaggactatg

SEQ ID NO: 166102 - DNA, 25 bp, Artificial sequence
  SiRNA target sequence
ctcaggagatgcgtaaggactatga

SEQ ID NO: 166103 - DNA, 25 bp, Artificial sequence
  SiRNA target sequence
tcaggagatgcgtaaggactatgaa

SEQ ID NO: 166104 - DNA, 25 bp, Artificial sequence
  SiRNA target sequence
caggagatgcgtaaggactatgaat

SEQ ID NO: 166105 - DNA, 25 bp, Artificial sequence
  SiRNA target sequence
aggagatgcgtaaggactatgaata

SEQ ID NO: 166106 - DNA, 25 bp, Artificial sequence
  SiRNA target sequence
ggagatgcgtaaggactatgaatat

SEQ ID NO: 166107 - DNA, 25 bp, Artificial sequence
  SiRNA target sequence
gagatgcgtaaggactatgaatata

SEQ ID NO: 166108 - DNA, 25 bp, Artificial sequence
  SiRNA target sequence
agatgcgtaaggactatgaatatat

SEQ ID NO: 166109 - DNA, 25 bp, Artificial sequence
  SiRNA target sequence
gatgcgtaaggactatgaatatata

SEQ ID NO: 166110 - DNA, 25 bp, Artificial sequence
  SiRNA target sequence
atgcgtaaggactatgaatatatac

SEQ ID NO: 166111 - DNA, 25 bp, Artificial sequence
  SiRNA target sequence
tgcgtaaggactatgaatatataca

SEQ ID NO: 166112 - DNA, 25 bp, Artificial sequence
  SiRNA target sequence
gcgtaaggactatgaatatatacaa

SEQ ID NO: 166113 - DNA, 25 bp, Artificial sequence
  SiRNA target sequence
cgtaaggactatgaatatatacaaa

SEQ ID NO: 166114 - DNA, 25 bp, Artificial sequence
  SiRNA target sequence
gtaaggactatgaatatatacaaaa

SEQ ID NO: 166115 - DNA, 25 bp, Artificial sequence
  SiRNA target sequence
taaggactatgaatatatacaaaaa

SEQ ID NO: 166116 - DNA, 25 bp, Artificial sequence
  SiRNA target sequence
aaggactatgaatatatacaaaaat

SEQ ID NO: 166117 - DNA, 25 bp, Artificial sequence
  SiRNA target sequence
aggactatgaatatatacaaaaatt

SEQ ID NO: 166118 - DNA, 25 bp, Artificial sequence
  SiRNA target sequence
ggactatgaatatatacaaaaatta

SEQ ID NO: 166119 - DNA, 25 bp, Artificial sequence
  SiRNA target sequence
gactatgaatatatacaaaaattat

SEQ ID NO: 166120 - DNA, 25 bp, Artificial sequence
  SiRNA target sequence
actatgaatatatacaaaaattatc

SEQ ID NO: 166121 - DNA, 25 bp, Artificial sequence
  SiRNA target sequence
ctatgaatatatacaaaaattatcg

SEQ ID NO: 166122 - DNA, 25 bp, Artificial sequence
  SiRNA target sequence
tatgaatatatacaaaaattatcgg

SEQ ID NO: 166123 - DNA, 25 bp, Artificial sequence
  SiRNA target sequence
atgaatatatacaaaaattatcgga

SEQ ID NO: 166124 - DNA, 25 bp, Artificial sequence
  SiRNA target sequence
tgaatatatacaaaaattatcggat

SEQ ID NO: 166125 - DNA, 25 bp, Artificial sequence
  SiRNA target sequence
gaatatatacaaaaattatcggata

SEQ ID NO: 166126 - DNA, 25 bp, Artificial sequence
  SiRNA target sequence
aatatatacaaaaattatcggataa

SEQ ID NO: 166127 - DNA, 25 bp, Artificial sequence
  SiRNA target sequence
atatatacaaaaattatcggataaa

SEQ ID NO: 166128 - DNA, 25 bp, Artificial sequence
  SiRNA target sequence
tatatacaaaaattatcggataaac

SEQ ID NO: 166129 - DNA, 25 bp, Artificial sequence
  SiRNA target sequence
atatacaaaaattatcggataaact

SEQ ID NO: 166130 - DNA, 25 bp, Artificial sequence
  SiRNA target sequence
tatacaaaaattatcggataaacta

SEQ ID NO: 166131 - DNA, 25 bp, Artificial sequence
  SiRNA target sequence
atacaaaaattatcggataaactaa

SEQ ID NO: 166132 - DNA, 25 bp, Artificial sequence
  SiRNA target sequence
tacaaaaattatcggataaactaaa

SEQ ID NO: 166133 - DNA, 25 bp, Artificial sequence
  SiRNA target sequence
acaaaaattatcggataaactaaaa

SEQ ID NO: 166134 - DNA, 25 bp, Artificial sequence
  SiRNA target sequence
caaaaattatcggataaactaaaaa

SEQ ID NO: 166135 - DNA, 25 bp, Artificial sequence
  SiRNA target sequence
aaaaattatcggataaactaaaaaa

SEQ ID NO: 166136 - DNA, 25 bp, Artificial sequence
  SiRNA target sequence
aaaattatcggataaactaaaaaat

SEQ ID NO: 166137 - DNA, 25 bp, Artificial sequence
  SiRNA target sequence
aaattatcggataaactaaaaaatc

SEQ ID NO: 166138 - DNA, 25 bp, Artificial sequence
  SiRNA target sequence
aattatcggataaactaaaaaatcg

SEQ ID NO: 166139 - DNA, 25 bp, Artificial sequence
  SiRNA target sequence
attatcggataaactaaaaaatcgc

SEQ ID NO: 166140 - DNA, 25 bp, Artificial sequence
  SiRNA target sequence
ttatcggataaactaaaaaatcgca

SEQ ID NO: 166141 - DNA, 25 bp, Artificial sequence
  SiRNA target sequence
tatcggataaactaaaaaatcgcat

SEQ ID NO: 166142 - DNA, 25 bp, Artificial sequence
  SiRNA target sequence
atcggataaactaaaaaatcgcatc

SEQ ID NO: 166143 - DNA, 25 bp, Artificial sequence
  SiRNA target sequence
tcggataaactaaaaaatcgcatca

SEQ ID NO: 166144 - DNA, 25 bp, Artificial sequence
  SiRNA target sequence
cggataaactaaaaaatcgcatcaa

SEQ ID NO: 166145 - DNA, 25 bp, Artificial sequence
  SiRNA target sequence
ggataaactaaaaaatcgcatcaaa

SEQ ID NO: 166146 - DNA, 25 bp, Artificial sequence
  SiRNA target sequence
gataaactaaaaaatcgcatcaaaa

SEQ ID NO: 166147 - DNA, 25 bp, Artificial sequence
  SiRNA target sequence
ataaactaaaaaatcgcatcaaaac

SEQ ID NO: 166148 - DNA, 25 bp, Artificial sequence
  SiRNA target sequence
taaactaaaaaatcgcatcaaaacg

SEQ ID NO: 166149 - DNA, 25 bp, Artificial sequence
  SiRNA target sequence
aaactaaaaaatcgcatcaaaacga

SEQ ID NO: 166150 - DNA, 25 bp, Artificial sequence
  SiRNA target sequence
aactaaaaaatcgcatcaaaacgaa

SEQ ID NO: 166151 - DNA, 25 bp, Artificial sequence
  SiRNA target sequence
actaaaaaatcgcatcaaaacgaat

SEQ ID NO: 166152 - DNA, 25 bp, Artificial sequence
  SiRNA target sequence
ctaaaaaatcgcatcaaaacgaatg

SEQ ID NO: 166153 - DNA, 25 bp, Artificial sequence
  SiRNA target sequence
taaaaaatcgcatcaaaacgaatgt

SEQ ID NO: 166154 - DNA, 25 bp, Artificial sequence
  SiRNA target sequence
aaaaaatcgcatcaaaacgaatgta

SEQ ID NO: 166155 - DNA, 25 bp, Artificial sequence
  SiRNA target sequence
aaaaatcgcatcaaaacgaatgtag

SEQ ID NO: 166156 - DNA, 25 bp, Artificial sequence
  SiRNA target sequence
aaaatcgcatcaaaacgaatgtaga

SEQ ID NO: 166157 - DNA, 25 bp, Artificial sequence
  SiRNA target sequence
aaatcgcatcaaaacgaatgtagaa

SEQ ID NO: 166158 - DNA, 25 bp, Artificial sequence
  SiRNA target sequence
aatcgcatcaaaacgaatgtagaaa

SEQ ID NO: 166159 - DNA, 25 bp, Artificial sequence
  SiRNA target sequence
atcgcatcaaaacgaatgtagaaaa

SEQ ID NO: 166160 - DNA, 25 bp, Artificial sequence
  SiRNA target sequence
tcgcatcaaaacgaatgtagaaaat

SEQ ID NO: 166161 - DNA, 25 bp, Artificial sequence
  SiRNA target sequence
cgcatcaaaacgaatgtagaaaatg

SEQ ID NO: 166162 - DNA, 25 bp, Artificial sequence
  SiRNA target sequence
gcatcaaaacgaatgtagaaaatgt

SEQ ID NO: 166163 - DNA, 25 bp, Artificial sequence
  SiRNA target sequence
catcaaaacgaatgtagaaaatgtt

SEQ ID NO: 166164 - DNA, 25 bp, Artificial sequence
  SiRNA target sequence
atcaaaacgaatgtagaaaatgttg

SEQ ID NO: 166165 - DNA, 25 bp, Artificial sequence
  SiRNA target sequence
tcaaaacgaatgtagaaaatgttgt

SEQ ID NO: 166166 - DNA, 25 bp, Artificial sequence
  SiRNA target sequence
caaaacgaatgtagaaaatgttgtt

SEQ ID NO: 166167 - DNA, 25 bp, Artificial sequence
  SiRNA target sequence
aaaacgaatgtagaaaatgttgtta

SEQ ID NO: 166168 - DNA, 25 bp, Artificial sequence
  SiRNA target sequence
aaacgaatgtagaaaatgttgttat

SEQ ID NO: 166169 - DNA, 25 bp, Artificial sequence
  SiRNA target sequence
aacgaatgtagaaaatgttgttatt

SEQ ID NO: 166170 - DNA, 25 bp, Artificial sequence
  SiRNA target sequence
acgaatgtagaaaatgttgttatta

SEQ ID NO: 166171 - DNA, 25 bp, Artificial sequence
  SiRNA target sequence
cgaatgtagaaaatgttgttattaa

SEQ ID NO: 166172 - DNA, 25 bp, Artificial sequence
  SiRNA target sequence
gaatgtagaaaatgttgttattaac

SEQ ID NO: 166173 - DNA, 25 bp, Artificial sequence
  SiRNA target sequence
aatgtagaaaatgttgttattaacg

SEQ ID NO: 166174 - DNA, 25 bp, Artificial sequence
  SiRNA target sequence
atgtagaaaatgttgttattaacgg

SEQ ID NO: 166175 - DNA, 25 bp, Artificial sequence
  SiRNA target sequence
tgtagaaaatgttgttattaacggc

SEQ ID NO: 166176 - DNA, 25 bp, Artificial sequence
  SiRNA target sequence
gtagaaaatgttgttattaacggcg

SEQ ID NO: 166177 - DNA, 25 bp, Artificial sequence
  SiRNA target sequence
tagaaaatgttgttattaacggcga

SEQ ID NO: 166178 - DNA, 25 bp, Artificial sequence
  SiRNA target sequence
agaaaatgttgttattaacggcgat

SEQ ID NO: 166179 - DNA, 25 bp, Artificial sequence
  SiRNA target sequence
gaaaatgttgttattaacggcgatg

SEQ ID NO: 166180 - DNA, 25 bp, Artificial sequence
  SiRNA target sequence
aaaatgttgttattaacggcgatga

SEQ ID NO: 166181 - DNA, 25 bp, Artificial sequence
  SiRNA target sequence
aaatgttgttattaacggcgatgat

SEQ ID NO: 166182 - DNA, 25 bp, Artificial sequence
  SiRNA target sequence
aatgttgttattaacggcgatgatt

SEQ ID NO: 166183 - DNA, 25 bp, Artificial sequence
  SiRNA target sequence
atgttgttattaacggcgatgattc

SEQ ID NO: 166184 - DNA, 25 bp, Artificial sequence
  SiRNA target sequence
tgttgttattaacggcgatgattct

SEQ ID NO: 166185 - DNA, 25 bp, Artificial sequence
  SiRNA target sequence
gttgttattaacggcgatgattcta

SEQ ID NO: 166186 - DNA, 25 bp, Artificial sequence
  SiRNA target sequence
ttgttattaacggcgatgattctaa

SEQ ID NO: 166187 - DNA, 25 bp, Artificial sequence
  SiRNA target sequence
tgttattaacggcgatgattctaag

SEQ ID NO: 166188 - DNA, 25 bp, Artificial sequence
  SiRNA target sequence
gttattaacggcgatgattctaaga

SEQ ID NO: 166189 - DNA, 25 bp, Artificial sequence
  SiRNA target sequence
ttattaacggcgatgattctaagac

SEQ ID NO: 166190 - DNA, 25 bp, Artificial sequence
  SiRNA target sequence
tattaacggcgatgattctaagact

SEQ ID NO: 166191 - DNA, 25 bp, Artificial sequence
  SiRNA target sequence
attaacggcgatgattctaagactt

SEQ ID NO: 166192 - DNA, 25 bp, Artificial sequence
  SiRNA target sequence
ttaacggcgatgattctaagacttt

SEQ ID NO: 166193 - DNA, 25 bp, Artificial sequence
  SiRNA target sequence
taacggcgatgattctaagactttt

SEQ ID NO: 166194 - DNA, 25 bp, Artificial sequence
  SiRNA target sequence
aacggcgatgattctaagacttttc

SEQ ID NO: 166195 - DNA, 25 bp, Artificial sequence
  SiRNA target sequence
acggcgatgattctaagacttttcc

SEQ ID NO: 166196 - DNA, 25 bp, Artificial sequence
  SiRNA target sequence
cggcgatgattctaagacttttcct

SEQ ID NO: 166197 - DNA, 25 bp, Artificial sequence
  SiRNA target sequence
ggcgatgattctaagacttttcctg

SEQ ID NO: 166198 - DNA, 25 bp, Artificial sequence
  SiRNA target sequence
gcgatgattctaagacttttcctgg

SEQ ID NO: 166199 - DNA, 25 bp, Artificial sequence
  SiRNA target sequence
cgatgattctaagacttttcctggc

SEQ ID NO: 166200 - DNA, 25 bp, Artificial sequence
  SiRNA target sequence
gatgattctaagacttttcctggct

SEQ ID NO: 166201 - DNA, 25 bp, Artificial sequence
  SiRNA target sequence
atgattctaagacttttcctggctg

SEQ ID NO: 166202 - DNA, 25 bp, Artificial sequence
  SiRNA target sequence
tgattctaagacttttcctggctgt

SEQ ID NO: 166203 - DNA, 25 bp, Artificial sequence
  SiRNA target sequence
gattctaagacttttcctggctgtc

SEQ ID NO: 166204 - DNA, 25 bp, Artificial sequence
  SiRNA target sequence
attctaagacttttcctggctgtct

SEQ ID NO: 166205 - DNA, 25 bp, Artificial sequence
  SiRNA target sequence
ttctaagacttttcctggctgtctc

SEQ ID NO: 166206 - DNA, 25 bp, Artificial sequence
  SiRNA target sequence
tctaagacttttcctggctgtctca

SEQ ID NO: 166207 - DNA, 25 bp, Artificial sequence
  SiRNA target sequence
ctaagacttttcctggctgtctcaa

SEQ ID NO: 166208 - DNA, 25 bp, Artificial sequence
  SiRNA target sequence
taagacttttcctggctgtctcaat

SEQ ID NO: 166209 - DNA, 25 bp, Artificial sequence
  SiRNA target sequence
aagacttttcctggctgtctcaata

SEQ ID NO: 166210 - DNA, 25 bp, Artificial sequence
  SiRNA target sequence
agacttttcctggctgtctcaatat

SEQ ID NO: 166211 - DNA, 25 bp, Artificial sequence
  SiRNA target sequence
gacttttcctggctgtctcaatatt

SEQ ID NO: 166212 - DNA, 25 bp, Artificial sequence
  SiRNA target sequence
acttttcctggctgtctcaatattt

SEQ ID NO: 166213 - DNA, 25 bp, Artificial sequence
  SiRNA target sequence
cttttcctggctgtctcaatatttc

SEQ ID NO: 166214 - DNA, 25 bp, Artificial sequence
  SiRNA target sequence
ttttcctggctgtctcaatatttct

SEQ ID NO: 166215 - DNA, 25 bp, Artificial sequence
  SiRNA target sequence
tttcctggctgtctcaatatttctt

SEQ ID NO: 166216 - DNA, 25 bp, Artificial sequence
  SiRNA target sequence
ttcctggctgtctcaatatttcttt

SEQ ID NO: 166217 - DNA, 25 bp, Artificial sequence
  SiRNA target sequence
tcctggctgtctcaatatttctttt

SEQ ID NO: 166218 - DNA, 25 bp, Artificial sequence
  SiRNA target sequence
cctggctgtctcaatatttcttttc

SEQ ID NO: 166219 - DNA, 25 bp, Artificial sequence
  SiRNA target sequence
ctggctgtctcaatatttcttttcc

SEQ ID NO: 166220 - DNA, 25 bp, Artificial sequence
  SiRNA target sequence
tggctgtctcaatatttcttttcca

SEQ ID NO: 166221 - DNA, 25 bp, Artificial sequence
  SiRNA target sequence
ggctgtctcaatatttcttttccat

SEQ ID NO: 166222 - DNA, 25 bp, Artificial sequence
  SiRNA target sequence
gctgtctcaatatttcttttccata

SEQ ID NO: 166223 - DNA, 25 bp, Artificial sequence
  SiRNA target sequence
ctgtctcaatatttcttttccatat

SEQ ID NO: 166224 - DNA, 25 bp, Artificial sequence
  SiRNA target sequence
tgtctcaatatttcttttccatatg

SEQ ID NO: 166225 - DNA, 25 bp, Artificial sequence
  SiRNA target sequence
gtctcaatatttcttttccatatgt

SEQ ID NO: 166226 - DNA, 25 bp, Artificial sequence
  SiRNA target sequence
tctcaatatttcttttccatatgta

SEQ ID NO: 166227 - DNA, 25 bp, Artificial sequence
  SiRNA target sequence
ctcaatatttcttttccatatgtag

SEQ ID NO: 166228 - DNA, 25 bp, Artificial sequence
  SiRNA target sequence
tcaatatttcttttccatatgtaga

SEQ ID NO: 166229 - DNA, 25 bp, Artificial sequence
  SiRNA target sequence
caatatttcttttccatatgtagaa

SEQ ID NO: 166230 - DNA, 25 bp, Artificial sequence
  SiRNA target sequence
aatatttcttttccatatgtagaag

SEQ ID NO: 166231 - DNA, 25 bp, Artificial sequence
  SiRNA target sequence
atatttcttttccatatgtagaagg

SEQ ID NO: 166232 - DNA, 25 bp, Artificial sequence
  SiRNA target sequence
tatttcttttccatatgtagaaggt

SEQ ID NO: 166233 - DNA, 25 bp, Artificial sequence
  SiRNA target sequence
atttcttttccatatgtagaaggtg

SEQ ID NO: 166234 - DNA, 25 bp, Artificial sequence
  SiRNA target sequence
tttcttttccatatgtagaaggtga

SEQ ID NO: 166235 - DNA, 25 bp, Artificial sequence
  SiRNA target sequence
ttcttttccatatgtagaaggtgaa

SEQ ID NO: 166236 - DNA, 25 bp, Artificial sequence
  SiRNA target sequence
tcttttccatatgtagaaggtgaag

SEQ ID NO: 166237 - DNA, 25 bp, Artificial sequence
  SiRNA target sequence
cttttccatatgtagaaggtgaagg

SEQ ID NO: 166238 - DNA, 25 bp, Artificial sequence
  SiRNA target sequence
ttttccatatgtagaaggtgaaggg

SEQ ID NO: 166239 - DNA, 25 bp, Artificial sequence
  SiRNA target sequence
tttccatatgtagaaggtgaagggc

SEQ ID NO: 166240 - DNA, 25 bp, Artificial sequence
  SiRNA target sequence
ttccatatgtagaaggtgaagggct

SEQ ID NO: 166241 - DNA, 25 bp, Artificial sequence
  SiRNA target sequence
tccatatgtagaaggtgaagggctt

SEQ ID NO: 166242 - DNA, 25 bp, Artificial sequence
  SiRNA target sequence
ccatatgtagaaggtgaagggctta

SEQ ID NO: 166243 - DNA, 25 bp, Artificial sequence
  SiRNA target sequence
catatgtagaaggtgaagggcttat

SEQ ID NO: 166244 - DNA, 25 bp, Artificial sequence
  SiRNA target sequence
atatgtagaaggtgaagggcttatg

SEQ ID NO: 166245 - DNA, 25 bp, Artificial sequence
  SiRNA target sequence
tatgtagaaggtgaagggcttatga

SEQ ID NO: 166246 - DNA, 25 bp, Artificial sequence
  SiRNA target sequence
atgtagaaggtgaagggcttatgat

SEQ ID NO: 166247 - DNA, 25 bp, Artificial sequence
  SiRNA target sequence
tgtagaaggtgaagggcttatgatg

SEQ ID NO: 166248 - DNA, 25 bp, Artificial sequence
  SiRNA target sequence
gtagaaggtgaagggcttatgatga

SEQ ID NO: 166249 - DNA, 25 bp, Artificial sequence
  SiRNA target sequence
tagaaggtgaagggcttatgatgaa

SEQ ID NO: 166250 - DNA, 25 bp, Artificial sequence
  SiRNA target sequence
agaaggtgaagggcttatgatgaat

SEQ ID NO: 166251 - DNA, 25 bp, Artificial sequence
  SiRNA target sequence
gaaggtgaagggcttatgatgaata

SEQ ID NO: 166252 - DNA, 25 bp, Artificial sequence
  SiRNA target sequence
aaggtgaagggcttatgatgaatat

SEQ ID NO: 166253 - DNA, 25 bp, Artificial sequence
  SiRNA target sequence
aggtgaagggcttatgatgaatatt

SEQ ID NO: 166254 - DNA, 25 bp, Artificial sequence
  SiRNA target sequence
ggtgaagggcttatgatgaatatta

SEQ ID NO: 166255 - DNA, 25 bp, Artificial sequence
  SiRNA target sequence
gtgaagggcttatgatgaatattaa

SEQ ID NO: 166256 - DNA, 25 bp, Artificial sequence
  SiRNA target sequence
tgaagggcttatgatgaatattaag

SEQ ID NO: 166257 - DNA, 25 bp, Artificial sequence
  SiRNA target sequence
gaagggcttatgatgaatattaagg

SEQ ID NO: 166258 - DNA, 25 bp, Artificial sequence
  SiRNA target sequence
aagggcttatgatgaatattaagga

SEQ ID NO: 166259 - DNA, 25 bp, Artificial sequence
  SiRNA target sequence
agggcttatgatgaatattaaggat

SEQ ID NO: 166260 - DNA, 25 bp, Artificial sequence
  SiRNA target sequence
gggcttatgatgaatattaaggata

SEQ ID NO: 166261 - DNA, 25 bp, Artificial sequence
  SiRNA target sequence
ggcttatgatgaatattaaggatat

SEQ ID NO: 166262 - DNA, 25 bp, Artificial sequence
  SiRNA target sequence
gcttatgatgaatattaaggatatt

SEQ ID NO: 166263 - DNA, 25 bp, Artificial sequence
  SiRNA target sequence
cttatgatgaatattaaggatattg

SEQ ID NO: 166264 - DNA, 25 bp, Artificial sequence
  SiRNA target sequence
ttatgatgaatattaaggatattgc

SEQ ID NO: 166265 - DNA, 25 bp, Artificial sequence
  SiRNA target sequence
tatgatgaatattaaggatattgct

SEQ ID NO: 166266 - DNA, 25 bp, Artificial sequence
  SiRNA target sequence
atgatgaatattaaggatattgctg

SEQ ID NO: 166267 - DNA, 25 bp, Artificial sequence
  SiRNA target sequence
tgatgaatattaaggatattgctgt

SEQ ID NO: 166268 - DNA, 25 bp, Artificial sequence
  SiRNA target sequence
gatgaatattaaggatattgctgtt

SEQ ID NO: 166269 - DNA, 25 bp, Artificial sequence
  SiRNA target sequence
atgaatattaaggatattgctgtta

SEQ ID NO: 166270 - DNA, 25 bp, Artificial sequence
  SiRNA target sequence
tgaatattaaggatattgctgttag

SEQ ID NO: 166271 - DNA, 25 bp, Artificial sequence
  SiRNA target sequence
gaatattaaggatattgctgttagt

SEQ ID NO: 166272 - DNA, 25 bp, Artificial sequence
  SiRNA target sequence
aatattaaggatattgctgttagta

SEQ ID NO: 166273 - DNA, 25 bp, Artificial sequence
  SiRNA target sequence
atattaaggatattgctgttagtag

SEQ ID NO: 166274 - DNA, 25 bp, Artificial sequence
  SiRNA target sequence
tattaaggatattgctgttagtagt

SEQ ID NO: 166275 - DNA, 25 bp, Artificial sequence
  SiRNA target sequence
attaaggatattgctgttagtagtg

SEQ ID NO: 166276 - DNA, 25 bp, Artificial sequence
  SiRNA target sequence
ttaaggatattgctgttagtagtgg

SEQ ID NO: 166277 - DNA, 25 bp, Artificial sequence
  SiRNA target sequence
taaggatattgctgttagtagtgga

SEQ ID NO: 166278 - DNA, 25 bp, Artificial sequence
  SiRNA target sequence
aaggatattgctgttagtagtggaa

SEQ ID NO: 166279 - DNA, 25 bp, Artificial sequence
  SiRNA target sequence
aggatattgctgttagtagtggaag

SEQ ID NO: 166280 - DNA, 25 bp, Artificial sequence
  SiRNA target sequence
ggatattgctgttagtagtggaagt

SEQ ID NO: 166281 - DNA, 25 bp, Artificial sequence
  SiRNA target sequence
gatattgctgttagtagtggaagtg

SEQ ID NO: 166282 - DNA, 25 bp, Artificial sequence
  SiRNA target sequence
atattgctgttagtagtggaagtgc

SEQ ID NO: 166283 - DNA, 25 bp, Artificial sequence
  SiRNA target sequence
tattgctgttagtagtggaagtgct

SEQ ID NO: 166284 - DNA, 25 bp, Artificial sequence
  SiRNA target sequence
attgctgttagtagtggaagtgctt

SEQ ID NO: 166285 - DNA, 25 bp, Artificial sequence
  SiRNA target sequence
ttgctgttagtagtggaagtgcttg

SEQ ID NO: 166286 - DNA, 25 bp, Artificial sequence
  SiRNA target sequence
tgctgttagtagtggaagtgcttgc

SEQ ID NO: 166287 - DNA, 25 bp, Artificial sequence
  SiRNA target sequence
gctgttagtagtggaagtgcttgca

SEQ ID NO: 166288 - DNA, 25 bp, Artificial sequence
  SiRNA target sequence
ctgttagtagtggaagtgcttgcac

SEQ ID NO: 166289 - DNA, 25 bp, Artificial sequence
  SiRNA target sequence
tgttagtagtggaagtgcttgcact

SEQ ID NO: 166290 - DNA, 25 bp, Artificial sequence
  SiRNA target sequence
gttagtagtggaagtgcttgcactt

SEQ ID NO: 166291 - DNA, 25 bp, Artificial sequence
  SiRNA target sequence
ttagtagtggaagtgcttgcacttc

SEQ ID NO: 166292 - DNA, 25 bp, Artificial sequence
  SiRNA target sequence
tagtagtggaagtgcttgcacttca

SEQ ID NO: 166293 - DNA, 25 bp, Artificial sequence
  SiRNA target sequence
agtagtggaagtgcttgcacttcat

SEQ ID NO: 166294 - DNA, 25 bp, Artificial sequence
  SiRNA target sequence
gtagtggaagtgcttgcacttcatc

SEQ ID NO: 166295 - DNA, 25 bp, Artificial sequence
  SiRNA target sequence
tagtggaagtgcttgcacttcatca

SEQ ID NO: 166296 - DNA, 25 bp, Artificial sequence
  SiRNA target sequence
agtggaagtgcttgcacttcatcat

SEQ ID NO: 166297 - DNA, 25 bp, Artificial sequence
  SiRNA target sequence
gtggaagtgcttgcacttcatcatc

SEQ ID NO: 166298 - DNA, 25 bp, Artificial sequence
  SiRNA target sequence
tggaagtgcttgcacttcatcatct

SEQ ID NO: 166299 - DNA, 25 bp, Artificial sequence
  SiRNA target sequence
ggaagtgcttgcacttcatcatctt

SEQ ID NO: 166300 - DNA, 25 bp, Artificial sequence
  SiRNA target sequence
gaagtgcttgcacttcatcatcttt

SEQ ID NO: 166301 - DNA, 25 bp, Artificial sequence
  SiRNA target sequence
aagtgcttgcacttcatcatcttta

SEQ ID NO: 166302 - DNA, 25 bp, Artificial sequence
  SiRNA target sequence
agtgcttgcacttcatcatctttag

SEQ ID NO: 166303 - DNA, 25 bp, Artificial sequence
  SiRNA target sequence
gtgcttgcacttcatcatctttaga

SEQ ID NO: 166304 - DNA, 25 bp, Artificial sequence
  SiRNA target sequence
tgcttgcacttcatcatctttagaa

SEQ ID NO: 166305 - DNA, 25 bp, Artificial sequence
  SiRNA target sequence
gcttgcacttcatcatctttagaac

SEQ ID NO: 166306 - DNA, 25 bp, Artificial sequence
  SiRNA target sequence
cttgcacttcatcatctttagaacc

SEQ ID NO: 166307 - DNA, 25 bp, Artificial sequence
  SiRNA target sequence
ttgcacttcatcatctttagaaccc

SEQ ID NO: 166308 - DNA, 25 bp, Artificial sequence
  SiRNA target sequence
tgcacttcatcatctttagaaccct

SEQ ID NO: 166309 - DNA, 25 bp, Artificial sequence
  SiRNA target sequence
gcacttcatcatctttagaaccctc

SEQ ID NO: 166310 - DNA, 25 bp, Artificial sequence
  SiRNA target sequence
cacttcatcatctttagaaccctct

SEQ ID NO: 166311 - DNA, 25 bp, Artificial sequence
  SiRNA target sequence
acttcatcatctttagaaccctctt

SEQ ID NO: 166312 - DNA, 25 bp, Artificial sequence
  SiRNA target sequence
cttcatcatctttagaaccctctta

SEQ ID NO: 166313 - DNA, 25 bp, Artificial sequence
  SiRNA target sequence
ttcatcatctttagaaccctcttat

SEQ ID NO: 166314 - DNA, 25 bp, Artificial sequence
  SiRNA target sequence
tcatcatctttagaaccctcttatg

SEQ ID NO: 166315 - DNA, 25 bp, Artificial sequence
  SiRNA target sequence
catcatctttagaaccctcttatgt

SEQ ID NO: 166316 - DNA, 25 bp, Artificial sequence
  SiRNA target sequence
atcatctttagaaccctcttatgtt

SEQ ID NO: 166317 - DNA, 25 bp, Artificial sequence
  SiRNA target sequence
tcatctttagaaccctcttatgttt

SEQ ID NO: 166318 - DNA, 25 bp, Artificial sequence
  SiRNA target sequence
catctttagaaccctcttatgtttt

SEQ ID NO: 166319 - DNA, 25 bp, Artificial sequence
  SiRNA target sequence
atctttagaaccctcttatgttttg

SEQ ID NO: 166320 - DNA, 25 bp, Artificial sequence
  SiRNA target sequence
tctttagaaccctcttatgttttgc

SEQ ID NO: 166321 - DNA, 25 bp, Artificial sequence
  SiRNA target sequence
ctttagaaccctcttatgttttgcg

SEQ ID NO: 166322 - DNA, 25 bp, Artificial sequence
  SiRNA target sequence
tttagaaccctcttatgttttgcga

SEQ ID NO: 166323 - DNA, 25 bp, Artificial sequence
  SiRNA target sequence
ttagaaccctcttatgttttgcgag

SEQ ID NO: 166324 - DNA, 25 bp, Artificial sequence
  SiRNA target sequence
tagaaccctcttatgttttgcgagc

SEQ ID NO: 166325 - DNA, 25 bp, Artificial sequence
  SiRNA target sequence
agaaccctcttatgttttgcgagct

SEQ ID NO: 166326 - DNA, 25 bp, Artificial sequence
  SiRNA target sequence
gaaccctcttatgttttgcgagctt

SEQ ID NO: 166327 - DNA, 25 bp, Artificial sequence
  SiRNA target sequence
aaccctcttatgttttgcgagcttt

SEQ ID NO: 166328 - DNA, 25 bp, Artificial sequence
  SiRNA target sequence
accctcttatgttttgcgagcttta

SEQ ID NO: 166329 - DNA, 25 bp, Artificial sequence
  SiRNA target sequence
ccctcttatgttttgcgagctttag

SEQ ID NO: 166330 - DNA, 25 bp, Artificial sequence
  SiRNA target sequence
cctcttatgttttgcgagctttagg

SEQ ID NO: 166331 - DNA, 25 bp, Artificial sequence
  SiRNA target sequence
ctcttatgttttgcgagctttaggc

SEQ ID NO: 166332 - DNA, 25 bp, Artificial sequence
  SiRNA target sequence
tcttatgttttgcgagctttaggca

SEQ ID NO: 166333 - DNA, 25 bp, Artificial sequence
  SiRNA target sequence
cttatgttttgcgagctttaggcaa

SEQ ID NO: 166334 - DNA, 25 bp, Artificial sequence
  SiRNA target sequence
ttatgttttgcgagctttaggcaaa

SEQ ID NO: 166335 - DNA, 25 bp, Artificial sequence
  SiRNA target sequence
tatgttttgcgagctttaggcaaaa

SEQ ID NO: 166336 - DNA, 25 bp, Artificial sequence
  SiRNA target sequence
atgttttgcgagctttaggcaaaaa

SEQ ID NO: 166337 - DNA, 25 bp, Artificial sequence
  SiRNA target sequence
tgttttgcgagctttaggcaaaaat

SEQ ID NO: 166338 - DNA, 25 bp, Artificial sequence
  SiRNA target sequence
gttttgcgagctttaggcaaaaatg

SEQ ID NO: 166339 - DNA, 25 bp, Artificial sequence
  SiRNA target sequence
ttttgcgagctttaggcaaaaatga

SEQ ID NO: 166340 - DNA, 25 bp, Artificial sequence
  SiRNA target sequence
tttgcgagctttaggcaaaaatgat

SEQ ID NO: 166341 - DNA, 25 bp, Artificial sequence
  SiRNA target sequence
ttgcgagctttaggcaaaaatgatg

SEQ ID NO: 166342 - DNA, 25 bp, Artificial sequence
  SiRNA target sequence
tgcgagctttaggcaaaaatgatga

SEQ ID NO: 166343 - DNA, 25 bp, Artificial sequence
  SiRNA target sequence
gcgagctttaggcaaaaatgatgat

SEQ ID NO: 166344 - DNA, 25 bp, Artificial sequence
  SiRNA target sequence
cgagctttaggcaaaaatgatgatc

SEQ ID NO: 166345 - DNA, 25 bp, Artificial sequence
  SiRNA target sequence
gagctttaggcaaaaatgatgatct

SEQ ID NO: 166346 - DNA, 25 bp, Artificial sequence
  SiRNA target sequence
agctttaggcaaaaatgatgatctt

SEQ ID NO: 166347 - DNA, 25 bp, Artificial sequence
  SiRNA target sequence
gctttaggcaaaaatgatgatcttg

SEQ ID NO: 166348 - DNA, 25 bp, Artificial sequence
  SiRNA target sequence
ctttaggcaaaaatgatgatcttgc

SEQ ID NO: 166349 - DNA, 25 bp, Artificial sequence
  SiRNA target sequence
tttaggcaaaaatgatgatcttgcg

SEQ ID NO: 166350 - DNA, 25 bp, Artificial sequence
  SiRNA target sequence
ttaggcaaaaatgatgatcttgcgc

SEQ ID NO: 166351 - DNA, 25 bp, Artificial sequence
  SiRNA target sequence
taggcaaaaatgatgatcttgcgca

SEQ ID NO: 166352 - DNA, 25 bp, Artificial sequence
  SiRNA target sequence
aggcaaaaatgatgatcttgcgcat

SEQ ID NO: 166353 - DNA, 25 bp, Artificial sequence
  SiRNA target sequence
ggcaaaaatgatgatcttgcgcatt

SEQ ID NO: 166354 - DNA, 25 bp, Artificial sequence
  SiRNA target sequence
gcaaaaatgatgatcttgcgcattc

SEQ ID NO: 166355 - DNA, 25 bp, Artificial sequence
  SiRNA target sequence
caaaaatgatgatcttgcgcattct

SEQ ID NO: 166356 - DNA, 25 bp, Artificial sequence
  SiRNA target sequence
aaaaatgatgatcttgcgcattctt

SEQ ID NO: 166357 - DNA, 25 bp, Artificial sequence
  SiRNA target sequence
aaaatgatgatcttgcgcattcttc

SEQ ID NO: 166358 - DNA, 25 bp, Artificial sequence
  SiRNA target sequence
aaatgatgatcttgcgcattcttct

SEQ ID NO: 166359 - DNA, 25 bp, Artificial sequence
  SiRNA target sequence
aatgatgatcttgcgcattcttcta

SEQ ID NO: 166360 - DNA, 25 bp, Artificial sequence
  SiRNA target sequence
atgatgatcttgcgcattcttctat

SEQ ID NO: 166361 - DNA, 25 bp, Artificial sequence
  SiRNA target sequence
tgatgatcttgcgcattcttctata

SEQ ID NO: 166362 - DNA, 25 bp, Artificial sequence
  SiRNA target sequence
gatgatcttgcgcattcttctataa

SEQ ID NO: 166363 - DNA, 25 bp, Artificial sequence
  SiRNA target sequence
atgatcttgcgcattcttctataag

SEQ ID NO: 166364 - DNA, 25 bp, Artificial sequence
  SiRNA target sequence
tgatcttgcgcattcttctataaga

SEQ ID NO: 166365 - DNA, 25 bp, Artificial sequence
  SiRNA target sequence
gatcttgcgcattcttctataagat

SEQ ID NO: 166366 - DNA, 25 bp, Artificial sequence
  SiRNA target sequence
atcttgcgcattcttctataagatt

SEQ ID NO: 166367 - DNA, 25 bp, Artificial sequence
  SiRNA target sequence
tcttgcgcattcttctataagattt

SEQ ID NO: 166368 - DNA, 25 bp, Artificial sequence
  SiRNA target sequence
cttgcgcattcttctataagatttg

SEQ ID NO: 166369 - DNA, 25 bp, Artificial sequence
  SiRNA target sequence
ttgcgcattcttctataagatttgg

SEQ ID NO: 166370 - DNA, 25 bp, Artificial sequence
  SiRNA target sequence
tgcgcattcttctataagatttgga

SEQ ID NO: 166371 - DNA, 25 bp, Artificial sequence
  SiRNA target sequence
gcgcattcttctataagatttggaa

SEQ ID NO: 166372 - DNA, 25 bp, Artificial sequence
  SiRNA target sequence
cgcattcttctataagatttggaat

SEQ ID NO: 166373 - DNA, 25 bp, Artificial sequence
  SiRNA target sequence
gcattcttctataagatttggaata

SEQ ID NO: 166374 - DNA, 25 bp, Artificial sequence
  SiRNA target sequence
cattcttctataagatttggaataa

SEQ ID NO: 166375 - DNA, 25 bp, Artificial sequence
  SiRNA target sequence
attcttctataagatttggaataaa

SEQ ID NO: 166376 - DNA, 25 bp, Artificial sequence
  SiRNA target sequence
ttcttctataagatttggaataaat

SEQ ID NO: 166377 - DNA, 25 bp, Artificial sequence
  SiRNA target sequence
tcttctataagatttggaataaata

SEQ ID NO: 166378 - DNA, 25 bp, Artificial sequence
  SiRNA target sequence
cttctataagatttggaataaataa

SEQ ID NO: 166379 - DNA, 25 bp, Artificial sequence
  SiRNA target sequence
ttctataagatttggaataaataag

SEQ ID NO: 166380 - DNA, 25 bp, Artificial sequence
  SiRNA target sequence
tctataagatttggaataaataagt

SEQ ID NO: 166381 - DNA, 25 bp, Artificial sequence
  SiRNA target sequence
ctataagatttggaataaataagtt

SEQ ID NO: 166382 - DNA, 25 bp, Artificial sequence
  SiRNA target sequence
tataagatttggaataaataagttt

SEQ ID NO: 166383 - DNA, 25 bp, Artificial sequence
  SiRNA target sequence
ataagatttggaataaataagttta

SEQ ID NO: 166384 - DNA, 25 bp, Artificial sequence
  SiRNA target sequence
taagatttggaataaataagtttac

SEQ ID NO: 166385 - DNA, 25 bp, Artificial sequence
  SiRNA target sequence
aagatttggaataaataagtttaca

SEQ ID NO: 166386 - DNA, 25 bp, Artificial sequence
  SiRNA target sequence
agatttggaataaataagtttacaa

SEQ ID NO: 166387 - DNA, 25 bp, Artificial sequence
  SiRNA target sequence
gatttggaataaataagtttacaac

SEQ ID NO: 166388 - DNA, 25 bp, Artificial sequence
  SiRNA target sequence
atttggaataaataagtttacaact

SEQ ID NO: 166389 - DNA, 25 bp, Artificial sequence
  SiRNA target sequence
tttggaataaataagtttacaactg

SEQ ID NO: 166390 - DNA, 25 bp, Artificial sequence
  SiRNA target sequence
ttggaataaataagtttacaactga

SEQ ID NO: 166391 - DNA, 25 bp, Artificial sequence
  SiRNA target sequence
tggaataaataagtttacaactgaa

SEQ ID NO: 166392 - DNA, 25 bp, Artificial sequence
  SiRNA target sequence
ggaataaataagtttacaactgaag

SEQ ID NO: 166393 - DNA, 25 bp, Artificial sequence
  SiRNA target sequence
gaataaataagtttacaactgaaga

SEQ ID NO: 166394 - DNA, 25 bp, Artificial sequence
  SiRNA target sequence
aataaataagtttacaactgaagaa

SEQ ID NO: 166395 - DNA, 25 bp, Artificial sequence
  SiRNA target sequence
ataaataagtttacaactgaagaag

SEQ ID NO: 166396 - DNA, 25 bp, Artificial sequence
  SiRNA target sequence
taaataagtttacaactgaagaaga

SEQ ID NO: 166397 - DNA, 25 bp, Artificial sequence
  SiRNA target sequence
aaataagtttacaactgaagaagaa

SEQ ID NO: 166398 - DNA, 25 bp, Artificial sequence
  SiRNA target sequence
aataagtttacaactgaagaagaaa

SEQ ID NO: 166399 - DNA, 25 bp, Artificial sequence
  SiRNA target sequence
ataagtttacaactgaagaagaaat

SEQ ID NO: 166400 - DNA, 25 bp, Artificial sequence
  SiRNA target sequence
taagtttacaactgaagaagaaatc

SEQ ID NO: 166401 - DNA, 25 bp, Artificial sequence
  SiRNA target sequence
aagtttacaactgaagaagaaatca

SEQ ID NO: 166402 - DNA, 25 bp, Artificial sequence
  SiRNA target sequence
agtttacaactgaagaagaaatcaa

SEQ ID NO: 166403 - DNA, 25 bp, Artificial sequence
  SiRNA target sequence
gtttacaactgaagaagaaatcaat

SEQ ID NO: 166404 - DNA, 25 bp, Artificial sequence
  SiRNA target sequence
tttacaactgaagaagaaatcaata

SEQ ID NO: 166405 - DNA, 25 bp, Artificial sequence
  SiRNA target sequence
ttacaactgaagaagaaatcaataa

SEQ ID NO: 166406 - DNA, 25 bp, Artificial sequence
  SiRNA target sequence
tacaactgaagaagaaatcaataaa

SEQ ID NO: 166407 - DNA, 25 bp, Artificial sequence
  SiRNA target sequence
acaactgaagaagaaatcaataaag

SEQ ID NO: 166408 - DNA, 25 bp, Artificial sequence
  SiRNA target sequence
caactgaagaagaaatcaataaagt

SEQ ID NO: 166409 - DNA, 25 bp, Artificial sequence
  SiRNA target sequence
aactgaagaagaaatcaataaagta

SEQ ID NO: 166410 - DNA, 25 bp, Artificial sequence
  SiRNA target sequence
actgaagaagaaatcaataaagtat

SEQ ID NO: 166411 - DNA, 25 bp, Artificial sequence
  SiRNA target sequence
ctgaagaagaaatcaataaagtatc

SEQ ID NO: 166412 - DNA, 25 bp, Artificial sequence
  SiRNA target sequence
tgaagaagaaatcaataaagtatct

SEQ ID NO: 166413 - DNA, 25 bp, Artificial sequence
  SiRNA target sequence
gaagaagaaatcaataaagtatcta

SEQ ID NO: 166414 - DNA, 25 bp, Artificial sequence
  SiRNA target sequence
aagaagaaatcaataaagtatctag

SEQ ID NO: 166415 - DNA, 25 bp, Artificial sequence
  SiRNA target sequence
agaagaaatcaataaagtatctagt

SEQ ID NO: 166416 - DNA, 25 bp, Artificial sequence
  SiRNA target sequence
gaagaaatcaataaagtatctagtg

SEQ ID NO: 166417 - DNA, 25 bp, Artificial sequence
  SiRNA target sequence
aagaaatcaataaagtatctagtga

SEQ ID NO: 166418 - DNA, 25 bp, Artificial sequence
  SiRNA target sequence
agaaatcaataaagtatctagtgat

SEQ ID NO: 166419 - DNA, 25 bp, Artificial sequence
  SiRNA target sequence
gaaatcaataaagtatctagtgata

SEQ ID NO: 166420 - DNA, 25 bp, Artificial sequence
  SiRNA target sequence
aaatcaataaagtatctagtgatac

SEQ ID NO: 166421 - DNA, 25 bp, Artificial sequence
  SiRNA target sequence
aatcaataaagtatctagtgataca

SEQ ID NO: 166422 - DNA, 25 bp, Artificial sequence
  SiRNA target sequence
atcaataaagtatctagtgatacaa

SEQ ID NO: 166423 - DNA, 25 bp, Artificial sequence
  SiRNA target sequence
tcaataaagtatctagtgatacaat

SEQ ID NO: 166424 - DNA, 25 bp, Artificial sequence
  SiRNA target sequence
caataaagtatctagtgatacaatt

SEQ ID NO: 166425 - DNA, 25 bp, Artificial sequence
  SiRNA target sequence
aataaagtatctagtgatacaatta

SEQ ID NO: 166426 - DNA, 25 bp, Artificial sequence
  SiRNA target sequence
ataaagtatctagtgatacaattaa

SEQ ID NO: 166427 - DNA, 25 bp, Artificial sequence
  SiRNA target sequence
taaagtatctagtgatacaattaaa

SEQ ID NO: 166428 - DNA, 25 bp, Artificial sequence
  SiRNA target sequence
aaagtatctagtgatacaattaaag

SEQ ID NO: 166429 - DNA, 25 bp, Artificial sequence
  SiRNA target sequence
aagtatctagtgatacaattaaagc

SEQ ID NO: 166430 - DNA, 25 bp, Artificial sequence
  SiRNA target sequence
agtatctagtgatacaattaaagct

SEQ ID NO: 166431 - DNA, 25 bp, Artificial sequence
  SiRNA target sequence
gtatctagtgatacaattaaagctg

SEQ ID NO: 166432 - DNA, 25 bp, Artificial sequence
  SiRNA target sequence
tatctagtgatacaattaaagctgt

SEQ ID NO: 166433 - DNA, 25 bp, Artificial sequence
  SiRNA target sequence
atctagtgatacaattaaagctgtt

SEQ ID NO: 166434 - DNA, 25 bp, Artificial sequence
  SiRNA target sequence
tctagtgatacaattaaagctgtta

SEQ ID NO: 166435 - DNA, 25 bp, Artificial sequence
  SiRNA target sequence
ctagtgatacaattaaagctgttaa

SEQ ID NO: 166436 - DNA, 25 bp, Artificial sequence
  SiRNA target sequence
tagtgatacaattaaagctgttaat

SEQ ID NO: 166437 - DNA, 25 bp, Artificial sequence
  SiRNA target sequence
agtgatacaattaaagctgttaata

SEQ ID NO: 166438 - DNA, 25 bp, Artificial sequence
  SiRNA target sequence
gtgatacaattaaagctgttaataa

SEQ ID NO: 166439 - DNA, 25 bp, Artificial sequence
  SiRNA target sequence
tgatacaattaaagctgttaataag

SEQ ID NO: 166440 - DNA, 25 bp, Artificial sequence
  SiRNA target sequence
gatacaattaaagctgttaataagt

SEQ ID NO: 166441 - DNA, 25 bp, Artificial sequence
  SiRNA target sequence
atacaattaaagctgttaataagtt

SEQ ID NO: 166442 - DNA, 25 bp, Artificial sequence
  SiRNA target sequence
tacaattaaagctgttaataagtta

SEQ ID NO: 166443 - DNA, 25 bp, Artificial sequence
  SiRNA target sequence
acaattaaagctgttaataagttaa

SEQ ID NO: 166444 - DNA, 25 bp, Artificial sequence
  SiRNA target sequence
caattaaagctgttaataagttaag

SEQ ID NO: 166445 - DNA, 25 bp, Artificial sequence
  SiRNA target sequence
aattaaagctgttaataagttaaga

SEQ ID NO: 166446 - DNA, 25 bp, Artificial sequence
  SiRNA target sequence
attaaagctgttaataagttaagag

SEQ ID NO: 166447 - DNA, 25 bp, Artificial sequence
  SiRNA target sequence
ttaaagctgttaataagttaagaga

SEQ ID NO: 166448 - DNA, 25 bp, Artificial sequence
  SiRNA target sequence
taaagctgttaataagttaagagat

SEQ ID NO: 166449 - DNA, 25 bp, Artificial sequence
  SiRNA target sequence
aaagctgttaataagttaagagata

SEQ ID NO: 166450 - DNA, 25 bp, Artificial sequence
  SiRNA target sequence
aagctgttaataagttaagagatat

SEQ ID NO: 166451 - DNA, 25 bp, Artificial sequence
  SiRNA target sequence
agctgttaataagttaagagatatg

SEQ ID NO: 166452 - DNA, 25 bp, Artificial sequence
  SiRNA target sequence
gctgttaataagttaagagatatgt

SEQ ID NO: 166453 - DNA, 25 bp, Artificial sequence
  SiRNA target sequence
ctgttaataagttaagagatatgtc

SEQ ID NO: 166454 - DNA, 25 bp, Artificial sequence
  SiRNA target sequence
tgttaataagttaagagatatgtct

SEQ ID NO: 166455 - DNA, 25 bp, Artificial sequence
  SiRNA target sequence
gttaataagttaagagatatgtctc

SEQ ID NO: 166456 - DNA, 25 bp, Artificial sequence
  SiRNA target sequence
ttaataagttaagagatatgtctcc

SEQ ID NO: 166457 - DNA, 25 bp, Artificial sequence
  SiRNA target sequence
taataagttaagagatatgtctcct

SEQ ID NO: 166458 - DNA, 25 bp, Artificial sequence
  SiRNA target sequence
aataagttaagagatatgtctcctt

SEQ ID NO: 166459 - DNA, 25 bp, Artificial sequence
  SiRNA target sequence
ataagttaagagatatgtctccttt

SEQ ID NO: 166460 - DNA, 25 bp, Artificial sequence
  SiRNA target sequence
taagttaagagatatgtctccttta

SEQ ID NO: 166461 - DNA, 25 bp, Artificial sequence
  SiRNA target sequence
aagttaagagatatgtctcctttat

SEQ ID NO: 166462 - DNA, 25 bp, Artificial sequence
  SiRNA target sequence
agttaagagatatgtctcctttata

SEQ ID NO: 166463 - DNA, 25 bp, Artificial sequence
  SiRNA target sequence
gttaagagatatgtctcctttatat

SEQ ID NO: 166464 - DNA, 25 bp, Artificial sequence
  SiRNA target sequence
ttaagagatatgtctcctttatatg

SEQ ID NO: 166465 - DNA, 25 bp, Artificial sequence
  SiRNA target sequence
taagagatatgtctcctttatatga

SEQ ID NO: 166466 - DNA, 25 bp, Artificial sequence
  SiRNA target sequence
aagagatatgtctcctttatatgaa

SEQ ID NO: 166467 - DNA, 25 bp, Artificial sequence
  SiRNA target sequence
agagatatgtctcctttatatgaaa

SEQ ID NO: 166468 - DNA, 25 bp, Artificial sequence
  SiRNA target sequence
gagatatgtctcctttatatgaaat

SEQ ID NO: 166469 - DNA, 25 bp, Artificial sequence
  SiRNA target sequence
agatatgtctcctttatatgaaatg

SEQ ID NO: 166470 - DNA, 25 bp, Artificial sequence
  SiRNA target sequence
gatatgtctcctttatatgaaatgg

SEQ ID NO: 166471 - DNA, 25 bp, Artificial sequence
  SiRNA target sequence
atatgtctcctttatatgaaatggt

SEQ ID NO: 166472 - DNA, 25 bp, Artificial sequence
  SiRNA target sequence
tatgtctcctttatatgaaatggtc

SEQ ID NO: 166473 - DNA, 25 bp, Artificial sequence
  SiRNA target sequence
atgtctcctttatatgaaatggtca

SEQ ID NO: 166474 - DNA, 25 bp, Artificial sequence
  SiRNA target sequence
tgtctcctttatatgaaatggtcaa

SEQ ID NO: 166475 - DNA, 25 bp, Artificial sequence
  SiRNA target sequence
gtctcctttatatgaaatggtcaaa

SEQ ID NO: 166476 - DNA, 25 bp, Artificial sequence
  SiRNA target sequence
tctcctttatatgaaatggtcaaag

SEQ ID NO: 166477 - DNA, 25 bp, Artificial sequence
  SiRNA target sequence
ctcctttatatgaaatggtcaaaga

SEQ ID NO: 166478 - DNA, 25 bp, Artificial sequence
  SiRNA target sequence
tcctttatatgaaatggtcaaagaa

SEQ ID NO: 166479 - DNA, 25 bp, Artificial sequence
  SiRNA target sequence
cctttatatgaaatggtcaaagaag

SEQ ID NO: 166480 - DNA, 25 bp, Artificial sequence
  SiRNA target sequence
ctttatatgaaatggtcaaagaagg

SEQ ID NO: 166481 - DNA, 25 bp, Artificial sequence
  SiRNA target sequence
tttatatgaaatggtcaaagaaggg

SEQ ID NO: 166482 - DNA, 25 bp, Artificial sequence
  SiRNA target sequence
ttatatgaaatggtcaaagaaggga

SEQ ID NO: 166483 - DNA, 25 bp, Artificial sequence
  SiRNA target sequence
tatatgaaatggtcaaagaagggat

SEQ ID NO: 166484 - DNA, 25 bp, Artificial sequence
  SiRNA target sequence
atatgaaatggtcaaagaagggata

SEQ ID NO: 166485 - DNA, 25 bp, Artificial sequence
  SiRNA target sequence
tatgaaatggtcaaagaagggatag

SEQ ID NO: 166486 - DNA, 25 bp, Artificial sequence
  SiRNA target sequence
atgaaatggtcaaagaagggataga

SEQ ID NO: 166487 - DNA, 25 bp, Artificial sequence
  SiRNA target sequence
tgaaatggtcaaagaagggatagat

SEQ ID NO: 166488 - DNA, 25 bp, Artificial sequence
  SiRNA target sequence
gaaatggtcaaagaagggatagatt

SEQ ID NO: 166489 - DNA, 25 bp, Artificial sequence
  SiRNA target sequence
aaatggtcaaagaagggatagattt

SEQ ID NO: 166490 - DNA, 25 bp, Artificial sequence
  SiRNA target sequence
aatggtcaaagaagggatagattta

SEQ ID NO: 166491 - DNA, 25 bp, Artificial sequence
  SiRNA target sequence
atggtcaaagaagggatagatttag

SEQ ID NO: 166492 - DNA, 25 bp, Artificial sequence
  SiRNA target sequence
tggtcaaagaagggatagatttaga

SEQ ID NO: 166493 - DNA, 25 bp, Artificial sequence
  SiRNA target sequence
ggtcaaagaagggatagatttagat

SEQ ID NO: 166494 - DNA, 25 bp, Artificial sequence
  SiRNA target sequence
gtcaaagaagggatagatttagata

SEQ ID NO: 166495 - DNA, 25 bp, Artificial sequence
  SiRNA target sequence
tcaaagaagggatagatttagataa

SEQ ID NO: 166496 - DNA, 25 bp, Artificial sequence
  SiRNA target sequence
caaagaagggatagatttagataaa

SEQ ID NO: 166497 - DNA, 25 bp, Artificial sequence
  SiRNA target sequence
aaagaagggatagatttagataaaa

SEQ ID NO: 166498 - DNA, 25 bp, Artificial sequence
  SiRNA target sequence
aagaagggatagatttagataaaat

SEQ ID NO: 166499 - DNA, 25 bp, Artificial sequence
  SiRNA target sequence
agaagggatagatttagataaaatt

SEQ ID NO: 166500 - DNA, 25 bp, Artificial sequence
  SiRNA target sequence
gaagggatagatttagataaaatta

SEQ ID NO: 166501 - DNA, 25 bp, Artificial sequence
  SiRNA target sequence
aagggatagatttagataaaattaa

SEQ ID NO: 166502 - DNA, 25 bp, Artificial sequence
  SiRNA target sequence
agggatagatttagataaaattaat

SEQ ID NO: 166503 - DNA, 25 bp, Artificial sequence
  SiRNA target sequence
gggatagatttagataaaattaatt

SEQ ID NO: 166504 - DNA, 25 bp, Artificial sequence
  SiRNA target sequence
ggatagatttagataaaattaattg

SEQ ID NO: 166505 - DNA, 25 bp, Artificial sequence
  SiRNA target sequence
gatagatttagataaaattaattgg

SEQ ID NO: 166506 - DNA, 25 bp, Artificial sequence
  SiRNA target sequence
atagatttagataaaattaattggt

SEQ ID NO: 166507 - DNA, 25 bp, Artificial sequence
  SiRNA target sequence
tagatttagataaaattaattggtc

SEQ ID NO: 166508 - DNA, 25 bp, Artificial sequence
  SiRNA target sequence
agatttagataaaattaattggtct

SEQ ID NO: 166509 - DNA, 25 bp, Artificial sequence
  SiRNA target sequence
gatttagataaaattaattggtctg

SEQ ID NO: 166510 - DNA, 25 bp, Artificial sequence
  SiRNA target sequence
atttagataaaattaattggtctgc

SEQ ID NO: 166511 - DNA, 25 bp, Artificial sequence
  SiRNA target sequence
tttagataaaattaattggtctgct

SEQ ID NO: 166512 - DNA, 25 bp, Artificial sequence
  SiRNA target sequence
ttagataaaattaattggtctgctt

SEQ ID NO: 166513 - DNA, 25 bp, Artificial sequence
  SiRNA target sequence
tagataaaattaattggtctgctta

SEQ ID NO: 166514 - DNA, 25 bp, Artificial sequence
  SiRNA target sequence
agataaaattaattggtctgcttaa

SEQ ID NO: 166515 - DNA, 26 bp, Artificial sequence
  SiRNA target sequence
atgttatttttttatagccccatttt

SEQ ID NO: 166516 - DNA, 26 bp, Artificial sequence
  SiRNA target sequence
tgttatttttttatagccccattttt

SEQ ID NO: 166517 - DNA, 26 bp, Artificial sequence
  SiRNA target sequence
gttatttttttatagccccattttta

SEQ ID NO: 166518 - DNA, 26 bp, Artificial sequence
  SiRNA target sequence
ttatttttttatagccccatttttat

SEQ ID NO: 166519 - DNA, 26 bp, Artificial sequence
  SiRNA target sequence
tatttttttatagccccatttttatg

SEQ ID NO: 166520 - DNA, 26 bp, Artificial sequence
  SiRNA target sequence
atttttttatagccccatttttatga

SEQ ID NO: 166521 - DNA, 26 bp, Artificial sequence
  SiRNA target sequence
tttttttatagccccatttttatgac

SEQ ID NO: 166522 - DNA, 26 bp, Artificial sequence
  SiRNA target sequence
ttttttatagccccatttttatgact

SEQ ID NO: 166523 - DNA, 26 bp, Artificial sequence
  SiRNA target sequence
tttttatagccccatttttatgacta

SEQ ID NO: 166524 - DNA, 26 bp, Artificial sequence
  SiRNA target sequence
ttttatagccccatttttatgactaa

SEQ ID NO: 166525 - DNA, 26 bp, Artificial sequence
  SiRNA target sequence
tttatagccccatttttatgactaaa

SEQ ID NO: 166526 - DNA, 26 bp, Artificial sequence
  SiRNA target sequence
ttatagccccatttttatgactaaaa

SEQ ID NO: 166527 - DNA, 26 bp, Artificial sequence
  SiRNA target sequence
tatagccccatttttatgactaaaag

SEQ ID NO: 166528 - DNA, 26 bp, Artificial sequence
  SiRNA target sequence
atagccccatttttatgactaaaagt

SEQ ID NO: 166529 - DNA, 26 bp, Artificial sequence
  SiRNA target sequence
tagccccatttttatgactaaaagtt

SEQ ID NO: 166530 - DNA, 26 bp, Artificial sequence
  SiRNA target sequence
agccccatttttatgactaaaagttt

SEQ ID NO: 166531 - DNA, 26 bp, Artificial sequence
  SiRNA target sequence
gccccatttttatgactaaaagttta

SEQ ID NO: 166532 - DNA, 26 bp, Artificial sequence
  SiRNA target sequence
ccccatttttatgactaaaagtttaa

SEQ ID NO: 166533 - DNA, 26 bp, Artificial sequence
  SiRNA target sequence
cccatttttatgactaaaagtttaac

SEQ ID NO: 166534 - DNA, 26 bp, Artificial sequence
  SiRNA target sequence
ccatttttatgactaaaagtttaacg

SEQ ID NO: 166535 - DNA, 26 bp, Artificial sequence
  SiRNA target sequence
catttttatgactaaaagtttaacga

SEQ ID NO: 166536 - DNA, 26 bp, Artificial sequence
  SiRNA target sequence
atttttatgactaaaagtttaacgaa

SEQ ID NO: 166537 - DNA, 26 bp, Artificial sequence
  SiRNA target sequence
tttttatgactaaaagtttaacgaat

SEQ ID NO: 166538 - DNA, 26 bp, Artificial sequence
  SiRNA target sequence
ttttatgactaaaagtttaacgaatt

SEQ ID NO: 166539 - DNA, 26 bp, Artificial sequence
  SiRNA target sequence
tttatgactaaaagtttaacgaattc

SEQ ID NO: 166540 - DNA, 26 bp, Artificial sequence
  SiRNA target sequence
ttatgactaaaagtttaacgaattct

SEQ ID NO: 166541 - DNA, 26 bp, Artificial sequence
  SiRNA target sequence
tatgactaaaagtttaacgaattcta

SEQ ID NO: 166542 - DNA, 26 bp, Artificial sequence
  SiRNA target sequence
atgactaaaagtttaacgaattctaa

SEQ ID NO: 166543 - DNA, 26 bp, Artificial sequence
  SiRNA target sequence
tgactaaaagtttaacgaattctaaa

SEQ ID NO: 166544 - DNA, 26 bp, Artificial sequence
  SiRNA target sequence
gactaaaagtttaacgaattctaaaa

SEQ ID NO: 166545 - DNA, 26 bp, Artificial sequence
  SiRNA target sequence
actaaaagtttaacgaattctaaaac

SEQ ID NO: 166546 - DNA, 26 bp, Artificial sequence
  SiRNA target sequence
ctaaaagtttaacgaattctaaaact

SEQ ID NO: 166547 - DNA, 26 bp, Artificial sequence
  SiRNA target sequence
taaaagtttaacgaattctaaaactt

SEQ ID NO: 166548 - DNA, 26 bp, Artificial sequence
  SiRNA target sequence
aaaagtttaacgaattctaaaacttt

SEQ ID NO: 166549 - DNA, 26 bp, Artificial sequence
  SiRNA target sequence
aaagtttaacgaattctaaaacttta

SEQ ID NO: 166550 - DNA, 26 bp, Artificial sequence
  SiRNA target sequence
aagtttaacgaattctaaaactttaa

SEQ ID NO: 166551 - DNA, 26 bp, Artificial sequence
  SiRNA target sequence
agtttaacgaattctaaaactttaaa

SEQ ID NO: 166552 - DNA, 26 bp, Artificial sequence
  SiRNA target sequence
gtttaacgaattctaaaactttaaat

SEQ ID NO: 166553 - DNA, 26 bp, Artificial sequence
  SiRNA target sequence
tttaacgaattctaaaactttaaatt

SEQ ID NO: 166554 - DNA, 26 bp, Artificial sequence
  SiRNA target sequence
ttaacgaattctaaaactttaaattt

SEQ ID NO: 166555 - DNA, 26 bp, Artificial sequence
  SiRNA target sequence
taacgaattctaaaactttaaattta

SEQ ID NO: 166556 - DNA, 26 bp, Artificial sequence
  SiRNA target sequence
aacgaattctaaaactttaaatttaa

SEQ ID NO: 166557 - DNA, 26 bp, Artificial sequence
  SiRNA target sequence
acgaattctaaaactttaaatttaat

SEQ ID NO: 166558 - DNA, 26 bp, Artificial sequence
  SiRNA target sequence
cgaattctaaaactttaaatttaatg

SEQ ID NO: 166559 - DNA, 26 bp, Artificial sequence
  SiRNA target sequence
gaattctaaaactttaaatttaatgt

SEQ ID NO: 166560 - DNA, 26 bp, Artificial sequence
  SiRNA target sequence
aattctaaaactttaaatttaatgtc

SEQ ID NO: 166561 - DNA, 26 bp, Artificial sequence
  SiRNA target sequence
attctaaaactttaaatttaatgtca

SEQ ID NO: 166562 - DNA, 26 bp, Artificial sequence
  SiRNA target sequence
ttctaaaactttaaatttaatgtcaa

SEQ ID NO: 166563 - DNA, 26 bp, Artificial sequence
  SiRNA target sequence
tctaaaactttaaatttaatgtcaag

SEQ ID NO: 166564 - DNA, 26 bp, Artificial sequence
  SiRNA target sequence
ctaaaactttaaatttaatgtcaagt

SEQ ID NO: 166565 - DNA, 26 bp, Artificial sequence
  SiRNA target sequence
taaaactttaaatttaatgtcaagtg

SEQ ID NO: 166566 - DNA, 26 bp, Artificial sequence
  SiRNA target sequence
aaaactttaaatttaatgtcaagtgt

SEQ ID NO: 166567 - DNA, 26 bp, Artificial sequence
  SiRNA target sequence
aaactttaaatttaatgtcaagtgta

SEQ ID NO: 166568 - DNA, 26 bp, Artificial sequence
  SiRNA target sequence
aactttaaatttaatgtcaagtgtac

SEQ ID NO: 166569 - DNA, 26 bp, Artificial sequence
  SiRNA target sequence
actttaaatttaatgtcaagtgtaca

SEQ ID NO: 166570 - DNA, 26 bp, Artificial sequence
  SiRNA target sequence
ctttaaatttaatgtcaagtgtacaa

SEQ ID NO: 166571 - DNA, 26 bp, Artificial sequence
  SiRNA target sequence
tttaaatttaatgtcaagtgtacaat

SEQ ID NO: 166572 - DNA, 26 bp, Artificial sequence
  SiRNA target sequence
ttaaatttaatgtcaagtgtacaatc

SEQ ID NO: 166573 - DNA, 26 bp, Artificial sequence
  SiRNA target sequence
taaatttaatgtcaagtgtacaatca

SEQ ID NO: 166574 - DNA, 26 bp, Artificial sequence
  SiRNA target sequence
aaatttaatgtcaagtgtacaatcac

SEQ ID NO: 166575 - DNA, 26 bp, Artificial sequence
  SiRNA target sequence
aatttaatgtcaagtgtacaatcacc

SEQ ID NO: 166576 - DNA, 26 bp, Artificial sequence
  SiRNA target sequence
atttaatgtcaagtgtacaatcacca

SEQ ID NO: 166577 - DNA, 26 bp, Artificial sequence
  SiRNA target sequence
tttaatgtcaagtgtacaatcaccag

SEQ ID NO: 166578 - DNA, 26 bp, Artificial sequence
  SiRNA target sequence
ttaatgtcaagtgtacaatcaccagt

SEQ ID NO: 166579 - DNA, 26 bp, Artificial sequence
  SiRNA target sequence
taatgtcaagtgtacaatcaccagtt

SEQ ID NO: 166580 - DNA, 26 bp, Artificial sequence
  SiRNA target sequence
aatgtcaagtgtacaatcaccagtta

SEQ ID NO: 166581 - DNA, 26 bp, Artificial sequence
  SiRNA target sequence
atgtcaagtgtacaatcaccagttat

SEQ ID NO: 166582 - DNA, 26 bp, Artificial sequence
  SiRNA target sequence
tgtcaagtgtacaatcaccagttata

SEQ ID NO: 166583 - DNA, 26 bp, Artificial sequence
  SiRNA target sequence
gtcaagtgtacaatcaccagttataa

SEQ ID NO: 166584 - DNA, 26 bp, Artificial sequence
  SiRNA target sequence
tcaagtgtacaatcaccagttataaa

SEQ ID NO: 166585 - DNA, 26 bp, Artificial sequence
  SiRNA target sequence
caagtgtacaatcaccagttataaat

SEQ ID NO: 166586 - DNA, 26 bp, Artificial sequence
  SiRNA target sequence
aagtgtacaatcaccagttataaata

SEQ ID NO: 166587 - DNA, 26 bp, Artificial sequence
  SiRNA target sequence
agtgtacaatcaccagttataaatac

SEQ ID NO: 166588 - DNA, 26 bp, Artificial sequence
  SiRNA target sequence
gtgtacaatcaccagttataaataca

SEQ ID NO: 166589 - DNA, 26 bp, Artificial sequence
  SiRNA target sequence
tgtacaatcaccagttataaatacaa

SEQ ID NO: 166590 - DNA, 26 bp, Artificial sequence
  SiRNA target sequence
gtacaatcaccagttataaatacaaa

SEQ ID NO: 166591 - DNA, 26 bp, Artificial sequence
  SiRNA target sequence
tacaatcaccagttataaatacaaaa

SEQ ID NO: 166592 - DNA, 26 bp, Artificial sequence
  SiRNA target sequence
acaatcaccagttataaatacaaaaa

SEQ ID NO: 166593 - DNA, 26 bp, Artificial sequence
  SiRNA target sequence
caatcaccagttataaatacaaaaaa

SEQ ID NO: 166594 - DNA, 26 bp, Artificial sequence
  SiRNA target sequence
aatcaccagttataaatacaaaaaaa

SEQ ID NO: 166595 - DNA, 26 bp, Artificial sequence
  SiRNA target sequence
atcaccagttataaatacaaaaaaaa

SEQ ID NO: 166596 - DNA, 26 bp, Artificial sequence
  SiRNA target sequence
tcaccagttataaatacaaaaaaaat

SEQ ID NO: 166597 - DNA, 26 bp, Artificial sequence
  SiRNA target sequence
caccagttataaatacaaaaaaaata

SEQ ID NO: 166598 - DNA, 26 bp, Artificial sequence
  SiRNA target sequence
accagttataaatacaaaaaaaatat

SEQ ID NO: 166599 - DNA, 26 bp, Artificial sequence
  SiRNA target sequence
ccagttataaatacaaaaaaaatata

SEQ ID NO: 166600 - DNA, 26 bp, Artificial sequence
  SiRNA target sequence
cagttataaatacaaaaaaaatatat

SEQ ID NO: 166601 - DNA, 26 bp, Artificial sequence
  SiRNA target sequence
agttataaatacaaaaaaaatatatc

SEQ ID NO: 166602 - DNA, 26 bp, Artificial sequence
  SiRNA target sequence
gttataaatacaaaaaaaatatatct

SEQ ID NO: 166603 - DNA, 26 bp, Artificial sequence
  SiRNA target sequence
ttataaatacaaaaaaaatatatctt

SEQ ID NO: 166604 - DNA, 26 bp, Artificial sequence
  SiRNA target sequence
tataaatacaaaaaaaatatatcttg

SEQ ID NO: 166605 - DNA, 26 bp, Artificial sequence
  SiRNA target sequence
ataaatacaaaaaaaatatatcttga

SEQ ID NO: 166606 - DNA, 26 bp, Artificial sequence
  SiRNA target sequence
taaatacaaaaaaaatatatcttgat

SEQ ID NO: 166607 - DNA, 26 bp, Artificial sequence
  SiRNA target sequence
aaatacaaaaaaaatatatcttgatg

SEQ ID NO: 166608 - DNA, 26 bp, Artificial sequence
  SiRNA target sequence
aatacaaaaaaaatatatcttgatgc

SEQ ID NO: 166609 - DNA, 26 bp, Artificial sequence
  SiRNA target sequence
atacaaaaaaaatatatcttgatgca

SEQ ID NO: 166610 - DNA, 26 bp, Artificial sequence
  SiRNA target sequence
tacaaaaaaaatatatcttgatgcac

SEQ ID NO: 166611 - DNA, 26 bp, Artificial sequence
  SiRNA target sequence
acaaaaaaaatatatcttgatgcaca

SEQ ID NO: 166612 - DNA, 26 bp, Artificial sequence
  SiRNA target sequence
caaaaaaaatatatcttgatgcacaa

SEQ ID NO: 166613 - DNA, 26 bp, Artificial sequence
  SiRNA target sequence
aaaaaaaatatatcttgatgcacaag

SEQ ID NO: 166614 - DNA, 26 bp, Artificial sequence
  SiRNA target sequence
aaaaaaatatatcttgatgcacaagc

SEQ ID NO: 166615 - DNA, 26 bp, Artificial sequence
  SiRNA target sequence
aaaaaatatatcttgatgcacaagcg

SEQ ID NO: 166616 - DNA, 26 bp, Artificial sequence
  SiRNA target sequence
aaaaatatatcttgatgcacaagcga

SEQ ID NO: 166617 - DNA, 26 bp, Artificial sequence
  SiRNA target sequence
aaaatatatcttgatgcacaagcgac

SEQ ID NO: 166618 - DNA, 26 bp, Artificial sequence
  SiRNA target sequence
aaatatatcttgatgcacaagcgacc

SEQ ID NO: 166619 - DNA, 26 bp, Artificial sequence
  SiRNA target sequence
aatatatcttgatgcacaagcgacca

SEQ ID NO: 166620 - DNA, 26 bp, Artificial sequence
  SiRNA target sequence
atatatcttgatgcacaagcgaccaa

SEQ ID NO: 166621 - DNA, 26 bp, Artificial sequence
  SiRNA target sequence
tatatcttgatgcacaagcgaccaag

SEQ ID NO: 166622 - DNA, 26 bp, Artificial sequence
  SiRNA target sequence
atatcttgatgcacaagcgaccaagc

SEQ ID NO: 166623 - DNA, 26 bp, Artificial sequence
  SiRNA target sequence
tatcttgatgcacaagcgaccaagcc

SEQ ID NO: 166624 - DNA, 26 bp, Artificial sequence
  SiRNA target sequence
atcttgatgcacaagcgaccaagcct

SEQ ID NO: 166625 - DNA, 26 bp, Artificial sequence
  SiRNA target sequence
tcttgatgcacaagcgaccaagcctt

SEQ ID NO: 166626 - DNA, 26 bp, Artificial sequence
  SiRNA target sequence
cttgatgcacaagcgaccaagccttt

SEQ ID NO: 166627 - DNA, 26 bp, Artificial sequence
  SiRNA target sequence
ttgatgcacaagcgaccaagccttta

SEQ ID NO: 166628 - DNA, 26 bp, Artificial sequence
  SiRNA target sequence
tgatgcacaagcgaccaagcctttag

SEQ ID NO: 166629 - DNA, 26 bp, Artificial sequence
  SiRNA target sequence
gatgcacaagcgaccaagcctttaga

SEQ ID NO: 166630 - DNA, 26 bp, Artificial sequence
  SiRNA target sequence
atgcacaagcgaccaagcctttagac

SEQ ID NO: 166631 - DNA, 26 bp, Artificial sequence
  SiRNA target sequence
tgcacaagcgaccaagcctttagacc

SEQ ID NO: 166632 - DNA, 26 bp, Artificial sequence
  SiRNA target sequence
gcacaagcgaccaagcctttagaccc

SEQ ID NO: 166633 - DNA, 26 bp, Artificial sequence
  SiRNA target sequence
cacaagcgaccaagcctttagacccg

SEQ ID NO: 166634 - DNA, 26 bp, Artificial sequence
  SiRNA target sequence
acaagcgaccaagcctttagacccgc

SEQ ID NO: 166635 - DNA, 26 bp, Artificial sequence
  SiRNA target sequence
caagcgaccaagcctttagacccgcg

SEQ ID NO: 166636 - DNA, 26 bp, Artificial sequence
  SiRNA target sequence
aagcgaccaagcctttagacccgcgt

SEQ ID NO: 166637 - DNA, 26 bp, Artificial sequence
  SiRNA target sequence
agcgaccaagcctttagacccgcgtg

SEQ ID NO: 166638 - DNA, 26 bp, Artificial sequence
  SiRNA target sequence
gcgaccaagcctttagacccgcgtgt

SEQ ID NO: 166639 - DNA, 26 bp, Artificial sequence
  SiRNA target sequence
cgaccaagcctttagacccgcgtgtg

SEQ ID NO: 166640 - DNA, 26 bp, Artificial sequence
  SiRNA target sequence
gaccaagcctttagacccgcgtgtgc

SEQ ID NO: 166641 - DNA, 26 bp, Artificial sequence
  SiRNA target sequence
accaagcctttagacccgcgtgtgct

SEQ ID NO: 166642 - DNA, 26 bp, Artificial sequence
  SiRNA target sequence
ccaagcctttagacccgcgtgtgctt

SEQ ID NO: 166643 - DNA, 26 bp, Artificial sequence
  SiRNA target sequence
caagcctttagacccgcgtgtgcttg

SEQ ID NO: 166644 - DNA, 26 bp, Artificial sequence
  SiRNA target sequence
aagcctttagacccgcgtgtgcttga

SEQ ID NO: 166645 - DNA, 26 bp, Artificial sequence
  SiRNA target sequence
agcctttagacccgcgtgtgcttgat

SEQ ID NO: 166646 - DNA, 26 bp, Artificial sequence
  SiRNA target sequence
gcctttagacccgcgtgtgcttgatg

SEQ ID NO: 166647 - DNA, 26 bp, Artificial sequence
  SiRNA target sequence
cctttagacccgcgtgtgcttgatgc

SEQ ID NO: 166648 - DNA, 26 bp, Artificial sequence
  SiRNA target sequence
ctttagacccgcgtgtgcttgatgca

SEQ ID NO: 166649 - DNA, 26 bp, Artificial sequence
  SiRNA target sequence
tttagacccgcgtgtgcttgatgcaa

SEQ ID NO: 166650 - DNA, 26 bp, Artificial sequence
  SiRNA target sequence
ttagacccgcgtgtgcttgatgcaat

SEQ ID NO: 166651 - DNA, 26 bp, Artificial sequence
  SiRNA target sequence
tagacccgcgtgtgcttgatgcaatg

SEQ ID NO: 166652 - DNA, 26 bp, Artificial sequence
  SiRNA target sequence
agacccgcgtgtgcttgatgcaatgc

SEQ ID NO: 166653 - DNA, 26 bp, Artificial sequence
  SiRNA target sequence
gacccgcgtgtgcttgatgcaatgct

SEQ ID NO: 166654 - DNA, 26 bp, Artificial sequence
  SiRNA target sequence
acccgcgtgtgcttgatgcaatgctt

SEQ ID NO: 166655 - DNA, 26 bp, Artificial sequence
  SiRNA target sequence
cccgcgtgtgcttgatgcaatgcttc

SEQ ID NO: 166656 - DNA, 26 bp, Artificial sequence
  SiRNA target sequence
ccgcgtgtgcttgatgcaatgcttcc

SEQ ID NO: 166657 - DNA, 26 bp, Artificial sequence
  SiRNA target sequence
cgcgtgtgcttgatgcaatgcttcca

SEQ ID NO: 166658 - DNA, 26 bp, Artificial sequence
  SiRNA target sequence
gcgtgtgcttgatgcaatgcttccat

SEQ ID NO: 166659 - DNA, 26 bp, Artificial sequence
  SiRNA target sequence
cgtgtgcttgatgcaatgcttccata

SEQ ID NO: 166660 - DNA, 26 bp, Artificial sequence
  SiRNA target sequence
gtgtgcttgatgcaatgcttccatac

SEQ ID NO: 166661 - DNA, 26 bp, Artificial sequence
  SiRNA target sequence
tgtgcttgatgcaatgcttccatact

SEQ ID NO: 166662 - DNA, 26 bp, Artificial sequence
  SiRNA target sequence
gtgcttgatgcaatgcttccatacta

SEQ ID NO: 166663 - DNA, 26 bp, Artificial sequence
  SiRNA target sequence
tgcttgatgcaatgcttccatactat

SEQ ID NO: 166664 - DNA, 26 bp, Artificial sequence
  SiRNA target sequence
gcttgatgcaatgcttccatactata

SEQ ID NO: 166665 - DNA, 26 bp, Artificial sequence
  SiRNA target sequence
cttgatgcaatgcttccatactatac

SEQ ID NO: 166666 - DNA, 26 bp, Artificial sequence
  SiRNA target sequence
ttgatgcaatgcttccatactataca

SEQ ID NO: 166667 - DNA, 26 bp, Artificial sequence
  SiRNA target sequence
tgatgcaatgcttccatactatacat

SEQ ID NO: 166668 - DNA, 26 bp, Artificial sequence
  SiRNA target sequence
gatgcaatgcttccatactatacatc

SEQ ID NO: 166669 - DNA, 26 bp, Artificial sequence
  SiRNA target sequence
atgcaatgcttccatactatacatcc

SEQ ID NO: 166670 - DNA, 26 bp, Artificial sequence
  SiRNA target sequence
tgcaatgcttccatactatacatcca

SEQ ID NO: 166671 - DNA, 26 bp, Artificial sequence
  SiRNA target sequence
gcaatgcttccatactatacatccat

SEQ ID NO: 166672 - DNA, 26 bp, Artificial sequence
  SiRNA target sequence
caatgcttccatactatacatccatt

SEQ ID NO: 166673 - DNA, 26 bp, Artificial sequence
  SiRNA target sequence
aatgcttccatactatacatccattt

SEQ ID NO: 166674 - DNA, 26 bp, Artificial sequence
  SiRNA target sequence
atgcttccatactatacatccatttt

SEQ ID NO: 166675 - DNA, 26 bp, Artificial sequence
  SiRNA target sequence
tgcttccatactatacatccattttt

SEQ ID NO: 166676 - DNA, 26 bp, Artificial sequence
  SiRNA target sequence
gcttccatactatacatccatttttg

SEQ ID NO: 166677 - DNA, 26 bp, Artificial sequence
  SiRNA target sequence
cttccatactatacatccatttttgg

SEQ ID NO: 166678 - DNA, 26 bp, Artificial sequence
  SiRNA target sequence
ttccatactatacatccatttttgga

SEQ ID NO: 166679 - DNA, 26 bp, Artificial sequence
  SiRNA target sequence
tccatactatacatccatttttggaa

SEQ ID NO: 166680 - DNA, 26 bp, Artificial sequence
  SiRNA target sequence
ccatactatacatccatttttggaaa

SEQ ID NO: 166681 - DNA, 26 bp, Artificial sequence
  SiRNA target sequence
catactatacatccatttttggaaat

SEQ ID NO: 166682 - DNA, 26 bp, Artificial sequence
  SiRNA target sequence
atactatacatccatttttggaaatc

SEQ ID NO: 166683 - DNA, 26 bp, Artificial sequence
  SiRNA target sequence
tactatacatccatttttggaaatcc

SEQ ID NO: 166684 - DNA, 26 bp, Artificial sequence
  SiRNA target sequence
actatacatccatttttggaaatcca

SEQ ID NO: 166685 - DNA, 26 bp, Artificial sequence
  SiRNA target sequence
ctatacatccatttttggaaatccac

SEQ ID NO: 166686 - DNA, 26 bp, Artificial sequence
  SiRNA target sequence
tatacatccatttttggaaatccaca

SEQ ID NO: 166687 - DNA, 26 bp, Artificial sequence
  SiRNA target sequence
atacatccatttttggaaatccacat

SEQ ID NO: 166688 - DNA, 26 bp, Artificial sequence
  SiRNA target sequence
tacatccatttttggaaatccacatt

SEQ ID NO: 166689 - DNA, 26 bp, Artificial sequence
  SiRNA target sequence
acatccatttttggaaatccacattc

SEQ ID NO: 166690 - DNA, 26 bp, Artificial sequence
  SiRNA target sequence
catccatttttggaaatccacattct

SEQ ID NO: 166691 - DNA, 26 bp, Artificial sequence
  SiRNA target sequence
atccatttttggaaatccacattctc

SEQ ID NO: 166692 - DNA, 26 bp, Artificial sequence
  SiRNA target sequence
tccatttttggaaatccacattctcg

SEQ ID NO: 166693 - DNA, 26 bp, Artificial sequence
  SiRNA target sequence
ccatttttggaaatccacattctcgc

SEQ ID NO: 166694 - DNA, 26 bp, Artificial sequence
  SiRNA target sequence
catttttggaaatccacattctcgca

SEQ ID NO: 166695 - DNA, 26 bp, Artificial sequence
  SiRNA target sequence
atttttggaaatccacattctcgcac

SEQ ID NO: 166696 - DNA, 26 bp, Artificial sequence
  SiRNA target sequence
tttttggaaatccacattctcgcacg

SEQ ID NO: 166697 - DNA, 26 bp, Artificial sequence
  SiRNA target sequence
ttttggaaatccacattctcgcacgc

SEQ ID NO: 166698 - DNA, 26 bp, Artificial sequence
  SiRNA target sequence
tttggaaatccacattctcgcacgca

SEQ ID NO: 166699 - DNA, 26 bp, Artificial sequence
  SiRNA target sequence
ttggaaatccacattctcgcacgcat

SEQ ID NO: 166700 - DNA, 26 bp, Artificial sequence
  SiRNA target sequence
tggaaatccacattctcgcacgcata

SEQ ID NO: 166701 - DNA, 26 bp, Artificial sequence
  SiRNA target sequence
ggaaatccacattctcgcacgcatac

SEQ ID NO: 166702 - DNA, 26 bp, Artificial sequence
  SiRNA target sequence
gaaatccacattctcgcacgcatacg

SEQ ID NO: 166703 - DNA, 26 bp, Artificial sequence
  SiRNA target sequence
aaatccacattctcgcacgcatacgt

SEQ ID NO: 166704 - DNA, 26 bp, Artificial sequence
  SiRNA target sequence
aatccacattctcgcacgcatacgtt

SEQ ID NO: 166705 - DNA, 26 bp, Artificial sequence
  SiRNA target sequence
atccacattctcgcacgcatacgttt

SEQ ID NO: 166706 - DNA, 26 bp, Artificial sequence
  SiRNA target sequence
tccacattctcgcacgcatacgtttg

SEQ ID NO: 166707 - DNA, 26 bp, Artificial sequence
  SiRNA target sequence
ccacattctcgcacgcatacgtttgg

SEQ ID NO: 166708 - DNA, 26 bp, Artificial sequence
  SiRNA target sequence
cacattctcgcacgcatacgtttgga

SEQ ID NO: 166709 - DNA, 26 bp, Artificial sequence
  SiRNA target sequence
acattctcgcacgcatacgtttggat

SEQ ID NO: 166710 - DNA, 26 bp, Artificial sequence
  SiRNA target sequence
cattctcgcacgcatacgtttggatg

SEQ ID NO: 166711 - DNA, 26 bp, Artificial sequence
  SiRNA target sequence
attctcgcacgcatacgtttggatgg

SEQ ID NO: 166712 - DNA, 26 bp, Artificial sequence
  SiRNA target sequence
ttctcgcacgcatacgtttggatgga

SEQ ID NO: 166713 - DNA, 26 bp, Artificial sequence
  SiRNA target sequence
tctcgcacgcatacgtttggatggaa

SEQ ID NO: 166714 - DNA, 26 bp, Artificial sequence
  SiRNA target sequence
ctcgcacgcatacgtttggatggaat

SEQ ID NO: 166715 - DNA, 26 bp, Artificial sequence
  SiRNA target sequence
tcgcacgcatacgtttggatggaatg

SEQ ID NO: 166716 - DNA, 26 bp, Artificial sequence
  SiRNA target sequence
cgcacgcatacgtttggatggaatgc

SEQ ID NO: 166717 - DNA, 26 bp, Artificial sequence
  SiRNA target sequence
gcacgcatacgtttggatggaatgca

SEQ ID NO: 166718 - DNA, 26 bp, Artificial sequence
  SiRNA target sequence
cacgcatacgtttggatggaatgcag

SEQ ID NO: 166719 - DNA, 26 bp, Artificial sequence
  SiRNA target sequence
acgcatacgtttggatggaatgcaga

SEQ ID NO: 166720 - DNA, 26 bp, Artificial sequence
  SiRNA target sequence
cgcatacgtttggatggaatgcagaa

SEQ ID NO: 166721 - DNA, 26 bp, Artificial sequence
  SiRNA target sequence
gcatacgtttggatggaatgcagaaa

SEQ ID NO: 166722 - DNA, 26 bp, Artificial sequence
  SiRNA target sequence
catacgtttggatggaatgcagaaaa

SEQ ID NO: 166723 - DNA, 26 bp, Artificial sequence
  SiRNA target sequence
atacgtttggatggaatgcagaaaaa

SEQ ID NO: 166724 - DNA, 26 bp, Artificial sequence
  SiRNA target sequence
tacgtttggatggaatgcagaaaaag

SEQ ID NO: 166725 - DNA, 26 bp, Artificial sequence
  SiRNA target sequence
acgtttggatggaatgcagaaaaagg

SEQ ID NO: 166726 - DNA, 26 bp, Artificial sequence
  SiRNA target sequence
cgtttggatggaatgcagaaaaaggc

SEQ ID NO: 166727 - DNA, 26 bp, Artificial sequence
  SiRNA target sequence
gtttggatggaatgcagaaaaaggcg

SEQ ID NO: 166728 - DNA, 26 bp, Artificial sequence
  SiRNA target sequence
tttggatggaatgcagaaaaaggcgt

SEQ ID NO: 166729 - DNA, 26 bp, Artificial sequence
  SiRNA target sequence
ttggatggaatgcagaaaaaggcgta

SEQ ID NO: 166730 - DNA, 26 bp, Artificial sequence
  SiRNA target sequence
tggatggaatgcagaaaaaggcgtag

SEQ ID NO: 166731 - DNA, 26 bp, Artificial sequence
  SiRNA target sequence
ggatggaatgcagaaaaaggcgtaga

SEQ ID NO: 166732 - DNA, 26 bp, Artificial sequence
  SiRNA target sequence
gatggaatgcagaaaaaggcgtagaa

SEQ ID NO: 166733 - DNA, 26 bp, Artificial sequence
  SiRNA target sequence
atggaatgcagaaaaaggcgtagaaa

SEQ ID NO: 166734 - DNA, 26 bp, Artificial sequence
  SiRNA target sequence
tggaatgcagaaaaaggcgtagaaat

SEQ ID NO: 166735 - DNA, 26 bp, Artificial sequence
  SiRNA target sequence
ggaatgcagaaaaaggcgtagaaatg

SEQ ID NO: 166736 - DNA, 26 bp, Artificial sequence
  SiRNA target sequence
gaatgcagaaaaaggcgtagaaatgg

SEQ ID NO: 166737 - DNA, 26 bp, Artificial sequence
  SiRNA target sequence
aatgcagaaaaaggcgtagaaatggc

SEQ ID NO: 166738 - DNA, 26 bp, Artificial sequence
  SiRNA target sequence
atgcagaaaaaggcgtagaaatggct

SEQ ID NO: 166739 - DNA, 26 bp, Artificial sequence
  SiRNA target sequence
tgcagaaaaaggcgtagaaatggctc

SEQ ID NO: 166740 - DNA, 26 bp, Artificial sequence
  SiRNA target sequence
gcagaaaaaggcgtagaaatggctcg

SEQ ID NO: 166741 - DNA, 26 bp, Artificial sequence
  SiRNA target sequence
cagaaaaaggcgtagaaatggctcga

SEQ ID NO: 166742 - DNA, 26 bp, Artificial sequence
  SiRNA target sequence
agaaaaaggcgtagaaatggctcgaa

SEQ ID NO: 166743 - DNA, 26 bp, Artificial sequence
  SiRNA target sequence
gaaaaaggcgtagaaatggctcgaaa

SEQ ID NO: 166744 - DNA, 26 bp, Artificial sequence
  SiRNA target sequence
aaaaaggcgtagaaatggctcgaaag

SEQ ID NO: 166745 - DNA, 26 bp, Artificial sequence
  SiRNA target sequence
aaaaggcgtagaaatggctcgaaagc

SEQ ID NO: 166746 - DNA, 26 bp, Artificial sequence
  SiRNA target sequence
aaaggcgtagaaatggctcgaaagca

SEQ ID NO: 166747 - DNA, 26 bp, Artificial sequence
  SiRNA target sequence
aaggcgtagaaatggctcgaaagcaa

SEQ ID NO: 166748 - DNA, 26 bp, Artificial sequence
  SiRNA target sequence
aggcgtagaaatggctcgaaagcaag

SEQ ID NO: 166749 - DNA, 26 bp, Artificial sequence
  SiRNA target sequence
ggcgtagaaatggctcgaaagcaagt

SEQ ID NO: 166750 - DNA, 26 bp, Artificial sequence
  SiRNA target sequence
gcgtagaaatggctcgaaagcaagta

SEQ ID NO: 166751 - DNA, 26 bp, Artificial sequence
  SiRNA target sequence
cgtagaaatggctcgaaagcaagtag

SEQ ID NO: 166752 - DNA, 26 bp, Artificial sequence
  SiRNA target sequence
gtagaaatggctcgaaagcaagtagc

SEQ ID NO: 166753 - DNA, 26 bp, Artificial sequence
  SiRNA target sequence
tagaaatggctcgaaagcaagtagca

SEQ ID NO: 166754 - DNA, 26 bp, Artificial sequence
  SiRNA target sequence
agaaatggctcgaaagcaagtagcag

SEQ ID NO: 166755 - DNA, 26 bp, Artificial sequence
  SiRNA target sequence
gaaatggctcgaaagcaagtagcaga

SEQ ID NO: 166756 - DNA, 26 bp, Artificial sequence
  SiRNA target sequence
aaatggctcgaaagcaagtagcagat

SEQ ID NO: 166757 - DNA, 26 bp, Artificial sequence
  SiRNA target sequence
aatggctcgaaagcaagtagcagatt

SEQ ID NO: 166758 - DNA, 26 bp, Artificial sequence
  SiRNA target sequence
atggctcgaaagcaagtagcagattt

SEQ ID NO: 166759 - DNA, 26 bp, Artificial sequence
  SiRNA target sequence
tggctcgaaagcaagtagcagattta

SEQ ID NO: 166760 - DNA, 26 bp, Artificial sequence
  SiRNA target sequence
ggctcgaaagcaagtagcagatttac

SEQ ID NO: 166761 - DNA, 26 bp, Artificial sequence
  SiRNA target sequence
gctcgaaagcaagtagcagatttact

SEQ ID NO: 166762 - DNA, 26 bp, Artificial sequence
  SiRNA target sequence
ctcgaaagcaagtagcagatttactg

SEQ ID NO: 166763 - DNA, 26 bp, Artificial sequence
  SiRNA target sequence
tcgaaagcaagtagcagatttactga

SEQ ID NO: 166764 - DNA, 26 bp, Artificial sequence
  SiRNA target sequence
cgaaagcaagtagcagatttactgaa

SEQ ID NO: 166765 - DNA, 26 bp, Artificial sequence
  SiRNA target sequence
gaaagcaagtagcagatttactgaat

SEQ ID NO: 166766 - DNA, 26 bp, Artificial sequence
  SiRNA target sequence
aaagcaagtagcagatttactgaatg

SEQ ID NO: 166767 - DNA, 26 bp, Artificial sequence
  SiRNA target sequence
aagcaagtagcagatttactgaatgc

SEQ ID NO: 166768 - DNA, 26 bp, Artificial sequence
  SiRNA target sequence
agcaagtagcagatttactgaatgcc

SEQ ID NO: 166769 - DNA, 26 bp, Artificial sequence
  SiRNA target sequence
gcaagtagcagatttactgaatgcca

SEQ ID NO: 166770 - DNA, 26 bp, Artificial sequence
  SiRNA target sequence
caagtagcagatttactgaatgccaa

SEQ ID NO: 166771 - DNA, 26 bp, Artificial sequence
  SiRNA target sequence
aagtagcagatttactgaatgccaat

SEQ ID NO: 166772 - DNA, 26 bp, Artificial sequence
  SiRNA target sequence
agtagcagatttactgaatgccaatg

SEQ ID NO: 166773 - DNA, 26 bp, Artificial sequence
  SiRNA target sequence
gtagcagatttactgaatgccaatga

SEQ ID NO: 166774 - DNA, 26 bp, Artificial sequence
  SiRNA target sequence
tagcagatttactgaatgccaatgaa

SEQ ID NO: 166775 - DNA, 26 bp, Artificial sequence
  SiRNA target sequence
agcagatttactgaatgccaatgaaa

SEQ ID NO: 166776 - DNA, 26 bp, Artificial sequence
  SiRNA target sequence
gcagatttactgaatgccaatgaaaa

SEQ ID NO: 166777 - DNA, 26 bp, Artificial sequence
  SiRNA target sequence
cagatttactgaatgccaatgaaaaa

SEQ ID NO: 166778 - DNA, 26 bp, Artificial sequence
  SiRNA target sequence
agatttactgaatgccaatgaaaaag

SEQ ID NO: 166779 - DNA, 26 bp, Artificial sequence
  SiRNA target sequence
gatttactgaatgccaatgaaaaaga

SEQ ID NO: 166780 - DNA, 26 bp, Artificial sequence
  SiRNA target sequence
atttactgaatgccaatgaaaaagaa

SEQ ID NO: 166781 - DNA, 26 bp, Artificial sequence
  SiRNA target sequence
tttactgaatgccaatgaaaaagaaa

SEQ ID NO: 166782 - DNA, 26 bp, Artificial sequence
  SiRNA target sequence
ttactgaatgccaatgaaaaagaaat

SEQ ID NO: 166783 - DNA, 26 bp, Artificial sequence
  SiRNA target sequence
tactgaatgccaatgaaaaagaaatt

SEQ ID NO: 166784 - DNA, 26 bp, Artificial sequence
  SiRNA target sequence
actgaatgccaatgaaaaagaaatta

SEQ ID NO: 166785 - DNA, 26 bp, Artificial sequence
  SiRNA target sequence
ctgaatgccaatgaaaaagaaattat

SEQ ID NO: 166786 - DNA, 26 bp, Artificial sequence
  SiRNA target sequence
tgaatgccaatgaaaaagaaattatt

SEQ ID NO: 166787 - DNA, 26 bp, Artificial sequence
  SiRNA target sequence
gaatgccaatgaaaaagaaattattt

SEQ ID NO: 166788 - DNA, 26 bp, Artificial sequence
  SiRNA target sequence
aatgccaatgaaaaagaaattatttt

SEQ ID NO: 166789 - DNA, 26 bp, Artificial sequence
  SiRNA target sequence
atgccaatgaaaaagaaattattttt

SEQ ID NO: 166790 - DNA, 26 bp, Artificial sequence
  SiRNA target sequence
tgccaatgaaaaagaaattattttta

SEQ ID NO: 166791 - DNA, 26 bp, Artificial sequence
  SiRNA target sequence
gccaatgaaaaagaaattatttttac

SEQ ID NO: 166792 - DNA, 26 bp, Artificial sequence
  SiRNA target sequence
ccaatgaaaaagaaattatttttact

SEQ ID NO: 166793 - DNA, 26 bp, Artificial sequence
  SiRNA target sequence
caatgaaaaagaaattatttttacta

SEQ ID NO: 166794 - DNA, 26 bp, Artificial sequence
  SiRNA target sequence
aatgaaaaagaaattatttttactag

SEQ ID NO: 166795 - DNA, 26 bp, Artificial sequence
  SiRNA target sequence
atgaaaaagaaattatttttactagc

SEQ ID NO: 166796 - DNA, 26 bp, Artificial sequence
  SiRNA target sequence
tgaaaaagaaattatttttactagcg

SEQ ID NO: 166797 - DNA, 26 bp, Artificial sequence
  SiRNA target sequence
gaaaaagaaattatttttactagcgg

SEQ ID NO: 166798 - DNA, 26 bp, Artificial sequence
  SiRNA target sequence
aaaaagaaattatttttactagcggt

SEQ ID NO: 166799 - DNA, 26 bp, Artificial sequence
  SiRNA target sequence
aaaagaaattatttttactagcggtg

SEQ ID NO: 166800 - DNA, 26 bp, Artificial sequence
  SiRNA target sequence
aaagaaattatttttactagcggtgc

SEQ ID NO: 166801 - DNA, 26 bp, Artificial sequence
  SiRNA target sequence
aagaaattatttttactagcggtgct

SEQ ID NO: 166802 - DNA, 26 bp, Artificial sequence
  SiRNA target sequence
agaaattatttttactagcggtgcta

SEQ ID NO: 166803 - DNA, 26 bp, Artificial sequence
  SiRNA target sequence
gaaattatttttactagcggtgctac

SEQ ID NO: 166804 - DNA, 26 bp, Artificial sequence
  SiRNA target sequence
aaattatttttactagcggtgctact

SEQ ID NO: 166805 - DNA, 26 bp, Artificial sequence
  SiRNA target sequence
aattatttttactagcggtgctactg

SEQ ID NO: 166806 - DNA, 26 bp, Artificial sequence
  SiRNA target sequence
attatttttactagcggtgctactga

SEQ ID NO: 166807 - DNA, 26 bp, Artificial sequence
  SiRNA target sequence
ttatttttactagcggtgctactgag

SEQ ID NO: 166808 - DNA, 26 bp, Artificial sequence
  SiRNA target sequence
tatttttactagcggtgctactgaga

SEQ ID NO: 166809 - DNA, 26 bp, Artificial sequence
  SiRNA target sequence
atttttactagcggtgctactgagag

SEQ ID NO: 166810 - DNA, 26 bp, Artificial sequence
  SiRNA target sequence
tttttactagcggtgctactgagagt

SEQ ID NO: 166811 - DNA, 26 bp, Artificial sequence
  SiRNA target sequence
ttttactagcggtgctactgagagta

SEQ ID NO: 166812 - DNA, 26 bp, Artificial sequence
  SiRNA target sequence
tttactagcggtgctactgagagtaa

SEQ ID NO: 166813 - DNA, 26 bp, Artificial sequence
  SiRNA target sequence
ttactagcggtgctactgagagtaac

SEQ ID NO: 166814 - DNA, 26 bp, Artificial sequence
  SiRNA target sequence
tactagcggtgctactgagagtaaca

SEQ ID NO: 166815 - DNA, 26 bp, Artificial sequence
  SiRNA target sequence
actagcggtgctactgagagtaacaa

SEQ ID NO: 166816 - DNA, 26 bp, Artificial sequence
  SiRNA target sequence
ctagcggtgctactgagagtaacaac

SEQ ID NO: 166817 - DNA, 26 bp, Artificial sequence
  SiRNA target sequence
tagcggtgctactgagagtaacaacc

SEQ ID NO: 166818 - DNA, 26 bp, Artificial sequence
  SiRNA target sequence
agcggtgctactgagagtaacaacct

SEQ ID NO: 166819 - DNA, 26 bp, Artificial sequence
  SiRNA target sequence
gcggtgctactgagagtaacaacctt

SEQ ID NO: 166820 - DNA, 26 bp, Artificial sequence
  SiRNA target sequence
cggtgctactgagagtaacaaccttg

SEQ ID NO: 166821 - DNA, 26 bp, Artificial sequence
  SiRNA target sequence
ggtgctactgagagtaacaaccttgc

SEQ ID NO: 166822 - DNA, 26 bp, Artificial sequence
  SiRNA target sequence
gtgctactgagagtaacaaccttgca

SEQ ID NO: 166823 - DNA, 26 bp, Artificial sequence
  SiRNA target sequence
tgctactgagagtaacaaccttgcac

SEQ ID NO: 166824 - DNA, 26 bp, Artificial sequence
  SiRNA target sequence
gctactgagagtaacaaccttgcact

SEQ ID NO: 166825 - DNA, 26 bp, Artificial sequence
  SiRNA target sequence
ctactgagagtaacaaccttgcacta

SEQ ID NO: 166826 - DNA, 26 bp, Artificial sequence
  SiRNA target sequence
tactgagagtaacaaccttgcactaa

SEQ ID NO: 166827 - DNA, 26 bp, Artificial sequence
  SiRNA target sequence
actgagagtaacaaccttgcactaaa

SEQ ID NO: 166828 - DNA, 26 bp, Artificial sequence
  SiRNA target sequence
ctgagagtaacaaccttgcactaaag

SEQ ID NO: 166829 - DNA, 26 bp, Artificial sequence
  SiRNA target sequence
tgagagtaacaaccttgcactaaagg

SEQ ID NO: 166830 - DNA, 26 bp, Artificial sequence
  SiRNA target sequence
gagagtaacaaccttgcactaaaggg

SEQ ID NO: 166831 - DNA, 26 bp, Artificial sequence
  SiRNA target sequence
agagtaacaaccttgcactaaagggt

SEQ ID NO: 166832 - DNA, 26 bp, Artificial sequence
  SiRNA target sequence
gagtaacaaccttgcactaaagggtg

SEQ ID NO: 166833 - DNA, 26 bp, Artificial sequence
  SiRNA target sequence
agtaacaaccttgcactaaagggtgt

SEQ ID NO: 166834 - DNA, 26 bp, Artificial sequence
  SiRNA target sequence
gtaacaaccttgcactaaagggtgtc

SEQ ID NO: 166835 - DNA, 26 bp, Artificial sequence
  SiRNA target sequence
taacaaccttgcactaaagggtgtct

SEQ ID NO: 166836 - DNA, 26 bp, Artificial sequence
  SiRNA target sequence
aacaaccttgcactaaagggtgtctt

SEQ ID NO: 166837 - DNA, 26 bp, Artificial sequence
  SiRNA target sequence
acaaccttgcactaaagggtgtcttt

SEQ ID NO: 166838 - DNA, 26 bp, Artificial sequence
  SiRNA target sequence
caaccttgcactaaagggtgtctttg

SEQ ID NO: 166839 - DNA, 26 bp, Artificial sequence
  SiRNA target sequence
aaccttgcactaaagggtgtctttgc

SEQ ID NO: 166840 - DNA, 26 bp, Artificial sequence
  SiRNA target sequence
accttgcactaaagggtgtctttgca

SEQ ID NO: 166841 - DNA, 26 bp, Artificial sequence
  SiRNA target sequence
ccttgcactaaagggtgtctttgcat

SEQ ID NO: 166842 - DNA, 26 bp, Artificial sequence
  SiRNA target sequence
cttgcactaaagggtgtctttgcatt

SEQ ID NO: 166843 - DNA, 26 bp, Artificial sequence
  SiRNA target sequence
ttgcactaaagggtgtctttgcattt

SEQ ID NO: 166844 - DNA, 26 bp, Artificial sequence
  SiRNA target sequence
tgcactaaagggtgtctttgcatttt

SEQ ID NO: 166845 - DNA, 26 bp, Artificial sequence
  SiRNA target sequence
gcactaaagggtgtctttgcattttt

SEQ ID NO: 166846 - DNA, 26 bp, Artificial sequence
  SiRNA target sequence
cactaaagggtgtctttgcattttta

SEQ ID NO: 166847 - DNA, 26 bp, Artificial sequence
  SiRNA target sequence
actaaagggtgtctttgcatttttaa

SEQ ID NO: 166848 - DNA, 26 bp, Artificial sequence
  SiRNA target sequence
ctaaagggtgtctttgcatttttaaa

SEQ ID NO: 166849 - DNA, 26 bp, Artificial sequence
  SiRNA target sequence
taaagggtgtctttgcatttttaaaa

SEQ ID NO: 166850 - DNA, 26 bp, Artificial sequence
  SiRNA target sequence
aaagggtgtctttgcatttttaaaaa

SEQ ID NO: 166851 - DNA, 26 bp, Artificial sequence
  SiRNA target sequence
aagggtgtctttgcatttttaaaaaa

SEQ ID NO: 166852 - DNA, 26 bp, Artificial sequence
  SiRNA target sequence
agggtgtctttgcatttttaaaaaaa

SEQ ID NO: 166853 - DNA, 26 bp, Artificial sequence
  SiRNA target sequence
gggtgtctttgcatttttaaaaaaag

SEQ ID NO: 166854 - DNA, 26 bp, Artificial sequence
  SiRNA target sequence
ggtgtctttgcatttttaaaaaaaga

SEQ ID NO: 166855 - DNA, 26 bp, Artificial sequence
  SiRNA target sequence
gtgtctttgcatttttaaaaaaagac

SEQ ID NO: 166856 - DNA, 26 bp, Artificial sequence
  SiRNA target sequence
tgtctttgcatttttaaaaaaagaca

SEQ ID NO: 166857 - DNA, 26 bp, Artificial sequence
  SiRNA target sequence
gtctttgcatttttaaaaaaagacaa

SEQ ID NO: 166858 - DNA, 26 bp, Artificial sequence
  SiRNA target sequence
tctttgcatttttaaaaaaagacaat

SEQ ID NO: 166859 - DNA, 26 bp, Artificial sequence
  SiRNA target sequence
ctttgcatttttaaaaaaagacaata

SEQ ID NO: 166860 - DNA, 26 bp, Artificial sequence
  SiRNA target sequence
tttgcatttttaaaaaaagacaatag

SEQ ID NO: 166861 - DNA, 26 bp, Artificial sequence
  SiRNA target sequence
ttgcatttttaaaaaaagacaatagg

SEQ ID NO: 166862 - DNA, 26 bp, Artificial sequence
  SiRNA target sequence
tgcatttttaaaaaaagacaataggc

SEQ ID NO: 166863 - DNA, 26 bp, Artificial sequence
  SiRNA target sequence
gcatttttaaaaaaagacaataggcc

SEQ ID NO: 166864 - DNA, 26 bp, Artificial sequence
  SiRNA target sequence
catttttaaaaaaagacaataggcct

SEQ ID NO: 166865 - DNA, 26 bp, Artificial sequence
  SiRNA target sequence
atttttaaaaaaagacaataggcctg

SEQ ID NO: 166866 - DNA, 26 bp, Artificial sequence
  SiRNA target sequence
tttttaaaaaaagacaataggcctgt

SEQ ID NO: 166867 - DNA, 26 bp, Artificial sequence
  SiRNA target sequence
ttttaaaaaaagacaataggcctgtt

SEQ ID NO: 166868 - DNA, 26 bp, Artificial sequence
  SiRNA target sequence
tttaaaaaaagacaataggcctgttc

SEQ ID NO: 166869 - DNA, 26 bp, Artificial sequence
  SiRNA target sequence
ttaaaaaaagacaataggcctgttca

SEQ ID NO: 166870 - DNA, 26 bp, Artificial sequence
  SiRNA target sequence
taaaaaaagacaataggcctgttcat

SEQ ID NO: 166871 - DNA, 26 bp, Artificial sequence
  SiRNA target sequence
aaaaaaagacaataggcctgttcata

SEQ ID NO: 166872 - DNA, 26 bp, Artificial sequence
  SiRNA target sequence
aaaaaagacaataggcctgttcatat

SEQ ID NO: 166873 - DNA, 26 bp, Artificial sequence
  SiRNA target sequence
aaaaagacaataggcctgttcatatc

SEQ ID NO: 166874 - DNA, 26 bp, Artificial sequence
  SiRNA target sequence
aaaagacaataggcctgttcatatca

SEQ ID NO: 166875 - DNA, 26 bp, Artificial sequence
  SiRNA target sequence
aaagacaataggcctgttcatatcat

SEQ ID NO: 166876 - DNA, 26 bp, Artificial sequence
  SiRNA target sequence
aagacaataggcctgttcatatcatt

SEQ ID NO: 166877 - DNA, 26 bp, Artificial sequence
  SiRNA target sequence
agacaataggcctgttcatatcatta

SEQ ID NO: 166878 - DNA, 26 bp, Artificial sequence
  SiRNA target sequence
gacaataggcctgttcatatcattac

SEQ ID NO: 166879 - DNA, 26 bp, Artificial sequence
  SiRNA target sequence
acaataggcctgttcatatcattacc

SEQ ID NO: 166880 - DNA, 26 bp, Artificial sequence
  SiRNA target sequence
caataggcctgttcatatcattacca

SEQ ID NO: 166881 - DNA, 26 bp, Artificial sequence
  SiRNA target sequence
aataggcctgttcatatcattaccac

SEQ ID NO: 166882 - DNA, 26 bp, Artificial sequence
  SiRNA target sequence
ataggcctgttcatatcattaccaca

SEQ ID NO: 166883 - DNA, 26 bp, Artificial sequence
  SiRNA target sequence
taggcctgttcatatcattaccacac

SEQ ID NO: 166884 - DNA, 26 bp, Artificial sequence
  SiRNA target sequence
aggcctgttcatatcattaccacaca

SEQ ID NO: 166885 - DNA, 26 bp, Artificial sequence
  SiRNA target sequence
ggcctgttcatatcattaccacacaa

SEQ ID NO: 166886 - DNA, 26 bp, Artificial sequence
  SiRNA target sequence
gcctgttcatatcattaccacacaaa

SEQ ID NO: 166887 - DNA, 26 bp, Artificial sequence
  SiRNA target sequence
cctgttcatatcattaccacacaaat

SEQ ID NO: 166888 - DNA, 26 bp, Artificial sequence
  SiRNA target sequence
ctgttcatatcattaccacacaaatt

SEQ ID NO: 166889 - DNA, 26 bp, Artificial sequence
  SiRNA target sequence
tgttcatatcattaccacacaaattg

SEQ ID NO: 166890 - DNA, 26 bp, Artificial sequence
  SiRNA target sequence
gttcatatcattaccacacaaattga

SEQ ID NO: 166891 - DNA, 26 bp, Artificial sequence
  SiRNA target sequence
ttcatatcattaccacacaaattgaa

SEQ ID NO: 166892 - DNA, 26 bp, Artificial sequence
  SiRNA target sequence
tcatatcattaccacacaaattgaac

SEQ ID NO: 166893 - DNA, 26 bp, Artificial sequence
  SiRNA target sequence
catatcattaccacacaaattgaaca

SEQ ID NO: 166894 - DNA, 26 bp, Artificial sequence
  SiRNA target sequence
atatcattaccacacaaattgaacat

SEQ ID NO: 166895 - DNA, 26 bp, Artificial sequence
  SiRNA target sequence
tatcattaccacacaaattgaacata

SEQ ID NO: 166896 - DNA, 26 bp, Artificial sequence
  SiRNA target sequence
atcattaccacacaaattgaacataa

SEQ ID NO: 166897 - DNA, 26 bp, Artificial sequence
  SiRNA target sequence
tcattaccacacaaattgaacataaa

SEQ ID NO: 166898 - DNA, 26 bp, Artificial sequence
  SiRNA target sequence
cattaccacacaaattgaacataaat

SEQ ID NO: 166899 - DNA, 26 bp, Artificial sequence
  SiRNA target sequence
attaccacacaaattgaacataaatg

SEQ ID NO: 166900 - DNA, 26 bp, Artificial sequence
  SiRNA target sequence
ttaccacacaaattgaacataaatgt

SEQ ID NO: 166901 - DNA, 26 bp, Artificial sequence
  SiRNA target sequence
taccacacaaattgaacataaatgtg

SEQ ID NO: 166902 - DNA, 26 bp, Artificial sequence
  SiRNA target sequence
accacacaaattgaacataaatgtgt

SEQ ID NO: 166903 - DNA, 26 bp, Artificial sequence
  SiRNA target sequence
ccacacaaattgaacataaatgtgta

SEQ ID NO: 166904 - DNA, 26 bp, Artificial sequence
  SiRNA target sequence
cacacaaattgaacataaatgtgtat

SEQ ID NO: 166905 - DNA, 26 bp, Artificial sequence
  SiRNA target sequence
acacaaattgaacataaatgtgtatt

SEQ ID NO: 166906 - DNA, 26 bp, Artificial sequence
  SiRNA target sequence
cacaaattgaacataaatgtgtattg

SEQ ID NO: 166907 - DNA, 26 bp, Artificial sequence
  SiRNA target sequence
acaaattgaacataaatgtgtattgg

SEQ ID NO: 166908 - DNA, 26 bp, Artificial sequence
  SiRNA target sequence
caaattgaacataaatgtgtattgga

SEQ ID NO: 166909 - DNA, 26 bp, Artificial sequence
  SiRNA target sequence
aaattgaacataaatgtgtattggac

SEQ ID NO: 166910 - DNA, 26 bp, Artificial sequence
  SiRNA target sequence
aattgaacataaatgtgtattggaca

SEQ ID NO: 166911 - DNA, 26 bp, Artificial sequence
  SiRNA target sequence
attgaacataaatgtgtattggacac

SEQ ID NO: 166912 - DNA, 26 bp, Artificial sequence
  SiRNA target sequence
ttgaacataaatgtgtattggacaca

SEQ ID NO: 166913 - DNA, 26 bp, Artificial sequence
  SiRNA target sequence
tgaacataaatgtgtattggacacat

SEQ ID NO: 166914 - DNA, 26 bp, Artificial sequence
  SiRNA target sequence
gaacataaatgtgtattggacacatg

SEQ ID NO: 166915 - DNA, 26 bp, Artificial sequence
  SiRNA target sequence
aacataaatgtgtattggacacatgt

SEQ ID NO: 166916 - DNA, 26 bp, Artificial sequence
  SiRNA target sequence
acataaatgtgtattggacacatgta

SEQ ID NO: 166917 - DNA, 26 bp, Artificial sequence
  SiRNA target sequence
cataaatgtgtattggacacatgtag

SEQ ID NO: 166918 - DNA, 26 bp, Artificial sequence
  SiRNA target sequence
ataaatgtgtattggacacatgtaga

SEQ ID NO: 166919 - DNA, 26 bp, Artificial sequence
  SiRNA target sequence
taaatgtgtattggacacatgtagaa

SEQ ID NO: 166920 - DNA, 26 bp, Artificial sequence
  SiRNA target sequence
aaatgtgtattggacacatgtagaag

SEQ ID NO: 166921 - DNA, 26 bp, Artificial sequence
  SiRNA target sequence
aatgtgtattggacacatgtagaaga

SEQ ID NO: 166922 - DNA, 26 bp, Artificial sequence
  SiRNA target sequence
atgtgtattggacacatgtagaagat

SEQ ID NO: 166923 - DNA, 26 bp, Artificial sequence
  SiRNA target sequence
tgtgtattggacacatgtagaagatt

SEQ ID NO: 166924 - DNA, 26 bp, Artificial sequence
  SiRNA target sequence
gtgtattggacacatgtagaagatta

SEQ ID NO: 166925 - DNA, 26 bp, Artificial sequence
  SiRNA target sequence
tgtattggacacatgtagaagattag

SEQ ID NO: 166926 - DNA, 26 bp, Artificial sequence
  SiRNA target sequence
gtattggacacatgtagaagattaga

SEQ ID NO: 166927 - DNA, 26 bp, Artificial sequence
  SiRNA target sequence
tattggacacatgtagaagattagaa

SEQ ID NO: 166928 - DNA, 26 bp, Artificial sequence
  SiRNA target sequence
attggacacatgtagaagattagaag

SEQ ID NO: 166929 - DNA, 26 bp, Artificial sequence
  SiRNA target sequence
ttggacacatgtagaagattagaaga

SEQ ID NO: 166930 - DNA, 26 bp, Artificial sequence
  SiRNA target sequence
tggacacatgtagaagattagaagaa

SEQ ID NO: 166931 - DNA, 26 bp, Artificial sequence
  SiRNA target sequence
ggacacatgtagaagattagaagaag

SEQ ID NO: 166932 - DNA, 26 bp, Artificial sequence
  SiRNA target sequence
gacacatgtagaagattagaagaaga

SEQ ID NO: 166933 - DNA, 26 bp, Artificial sequence
  SiRNA target sequence
acacatgtagaagattagaagaagaa

SEQ ID NO: 166934 - DNA, 26 bp, Artificial sequence
  SiRNA target sequence
cacatgtagaagattagaagaagaag

SEQ ID NO: 166935 - DNA, 26 bp, Artificial sequence
  SiRNA target sequence
acatgtagaagattagaagaagaagg

SEQ ID NO: 166936 - DNA, 26 bp, Artificial sequence
  SiRNA target sequence
catgtagaagattagaagaagaagga

SEQ ID NO: 166937 - DNA, 26 bp, Artificial sequence
  SiRNA target sequence
atgtagaagattagaagaagaaggag

SEQ ID NO: 166938 - DNA, 26 bp, Artificial sequence
  SiRNA target sequence
tgtagaagattagaagaagaaggagc

SEQ ID NO: 166939 - DNA, 26 bp, Artificial sequence
  SiRNA target sequence
gtagaagattagaagaagaaggagct

SEQ ID NO: 166940 - DNA, 26 bp, Artificial sequence
  SiRNA target sequence
tagaagattagaagaagaaggagcta

SEQ ID NO: 166941 - DNA, 26 bp, Artificial sequence
  SiRNA target sequence
agaagattagaagaagaaggagctac

SEQ ID NO: 166942 - DNA, 26 bp, Artificial sequence
  SiRNA target sequence
gaagattagaagaagaaggagctaca

SEQ ID NO: 166943 - DNA, 26 bp, Artificial sequence
  SiRNA target sequence
aagattagaagaagaaggagctacag

SEQ ID NO: 166944 - DNA, 26 bp, Artificial sequence
  SiRNA target sequence
agattagaagaagaaggagctacagt

SEQ ID NO: 166945 - DNA, 26 bp, Artificial sequence
  SiRNA target sequence
gattagaagaagaaggagctacagtg

SEQ ID NO: 166946 - DNA, 26 bp, Artificial sequence
  SiRNA target sequence
attagaagaagaaggagctacagtga

SEQ ID NO: 166947 - DNA, 26 bp, Artificial sequence
  SiRNA target sequence
ttagaagaagaaggagctacagtgac

SEQ ID NO: 166948 - DNA, 26 bp, Artificial sequence
  SiRNA target sequence
tagaagaagaaggagctacagtgact

SEQ ID NO: 166949 - DNA, 26 bp, Artificial sequence
  SiRNA target sequence
agaagaagaaggagctacagtgactt

SEQ ID NO: 166950 - DNA, 26 bp, Artificial sequence
  SiRNA target sequence
gaagaagaaggagctacagtgactta

SEQ ID NO: 166951 - DNA, 26 bp, Artificial sequence
  SiRNA target sequence
aagaagaaggagctacagtgacttat

SEQ ID NO: 166952 - DNA, 26 bp, Artificial sequence
  SiRNA target sequence
agaagaaggagctacagtgacttatt

SEQ ID NO: 166953 - DNA, 26 bp, Artificial sequence
  SiRNA target sequence
gaagaaggagctacagtgacttattt

SEQ ID NO: 166954 - DNA, 26 bp, Artificial sequence
  SiRNA target sequence
aagaaggagctacagtgacttatttg

SEQ ID NO: 166955 - DNA, 26 bp, Artificial sequence
  SiRNA target sequence
agaaggagctacagtgacttatttgc

SEQ ID NO: 166956 - DNA, 26 bp, Artificial sequence
  SiRNA target sequence
gaaggagctacagtgacttatttgcc

SEQ ID NO: 166957 - DNA, 26 bp, Artificial sequence
  SiRNA target sequence
aaggagctacagtgacttatttgcct

SEQ ID NO: 166958 - DNA, 26 bp, Artificial sequence
  SiRNA target sequence
aggagctacagtgacttatttgcctg

SEQ ID NO: 166959 - DNA, 26 bp, Artificial sequence
  SiRNA target sequence
ggagctacagtgacttatttgcctgt

SEQ ID NO: 166960 - DNA, 26 bp, Artificial sequence
  SiRNA target sequence
gagctacagtgacttatttgcctgta

SEQ ID NO: 166961 - DNA, 26 bp, Artificial sequence
  SiRNA target sequence
agctacagtgacttatttgcctgtag

SEQ ID NO: 166962 - DNA, 26 bp, Artificial sequence
  SiRNA target sequence
gctacagtgacttatttgcctgtaga

SEQ ID NO: 166963 - DNA, 26 bp, Artificial sequence
  SiRNA target sequence
ctacagtgacttatttgcctgtagat

SEQ ID NO: 166964 - DNA, 26 bp, Artificial sequence
  SiRNA target sequence
tacagtgacttatttgcctgtagata

SEQ ID NO: 166965 - DNA, 26 bp, Artificial sequence
  SiRNA target sequence
acagtgacttatttgcctgtagataa

SEQ ID NO: 166966 - DNA, 26 bp, Artificial sequence
  SiRNA target sequence
cagtgacttatttgcctgtagataaa

SEQ ID NO: 166967 - DNA, 26 bp, Artificial sequence
  SiRNA target sequence
agtgacttatttgcctgtagataaaa

SEQ ID NO: 166968 - DNA, 26 bp, Artificial sequence
  SiRNA target sequence
gtgacttatttgcctgtagataaaaa

SEQ ID NO: 166969 - DNA, 26 bp, Artificial sequence
  SiRNA target sequence
tgacttatttgcctgtagataaaaat

SEQ ID NO: 166970 - DNA, 26 bp, Artificial sequence
  SiRNA target sequence
gacttatttgcctgtagataaaaatg

SEQ ID NO: 166971 - DNA, 26 bp, Artificial sequence
  SiRNA target sequence
acttatttgcctgtagataaaaatgg

SEQ ID NO: 166972 - DNA, 26 bp, Artificial sequence
  SiRNA target sequence
cttatttgcctgtagataaaaatgga

SEQ ID NO: 166973 - DNA, 26 bp, Artificial sequence
  SiRNA target sequence
ttatttgcctgtagataaaaatggaa

SEQ ID NO: 166974 - DNA, 26 bp, Artificial sequence
  SiRNA target sequence
tatttgcctgtagataaaaatggaat

SEQ ID NO: 166975 - DNA, 26 bp, Artificial sequence
  SiRNA target sequence
atttgcctgtagataaaaatggaata

SEQ ID NO: 166976 - DNA, 26 bp, Artificial sequence
  SiRNA target sequence
tttgcctgtagataaaaatggaatag

SEQ ID NO: 166977 - DNA, 26 bp, Artificial sequence
  SiRNA target sequence
ttgcctgtagataaaaatggaatagt

SEQ ID NO: 166978 - DNA, 26 bp, Artificial sequence
  SiRNA target sequence
tgcctgtagataaaaatggaatagta

SEQ ID NO: 166979 - DNA, 26 bp, Artificial sequence
  SiRNA target sequence
gcctgtagataaaaatggaatagtag

SEQ ID NO: 166980 - DNA, 26 bp, Artificial sequence
  SiRNA target sequence
cctgtagataaaaatggaatagtaga

SEQ ID NO: 166981 - DNA, 26 bp, Artificial sequence
  SiRNA target sequence
ctgtagataaaaatggaatagtagat

SEQ ID NO: 166982 - DNA, 26 bp, Artificial sequence
  SiRNA target sequence
tgtagataaaaatggaatagtagatc

SEQ ID NO: 166983 - DNA, 26 bp, Artificial sequence
  SiRNA target sequence
gtagataaaaatggaatagtagatcc

SEQ ID NO: 166984 - DNA, 26 bp, Artificial sequence
  SiRNA target sequence
tagataaaaatggaatagtagatccg

SEQ ID NO: 166985 - DNA, 26 bp, Artificial sequence
  SiRNA target sequence
agataaaaatggaatagtagatccgc

SEQ ID NO: 166986 - DNA, 26 bp, Artificial sequence
  SiRNA target sequence
gataaaaatggaatagtagatccgca

SEQ ID NO: 166987 - DNA, 26 bp, Artificial sequence
  SiRNA target sequence
ataaaaatggaatagtagatccgcaa

SEQ ID NO: 166988 - DNA, 26 bp, Artificial sequence
  SiRNA target sequence
taaaaatggaatagtagatccgcaat

SEQ ID NO: 166989 - DNA, 26 bp, Artificial sequence
  SiRNA target sequence
aaaaatggaatagtagatccgcaatt

SEQ ID NO: 166990 - DNA, 26 bp, Artificial sequence
  SiRNA target sequence
aaaatggaatagtagatccgcaatta

SEQ ID NO: 166991 - DNA, 26 bp, Artificial sequence
  SiRNA target sequence
aaatggaatagtagatccgcaattaa

SEQ ID NO: 166992 - DNA, 26 bp, Artificial sequence
  SiRNA target sequence
aatggaatagtagatccgcaattaat

SEQ ID NO: 166993 - DNA, 26 bp, Artificial sequence
  SiRNA target sequence
atggaatagtagatccgcaattaata

SEQ ID NO: 166994 - DNA, 26 bp, Artificial sequence
  SiRNA target sequence
tggaatagtagatccgcaattaataa

SEQ ID NO: 166995 - DNA, 26 bp, Artificial sequence
  SiRNA target sequence
ggaatagtagatccgcaattaataaa

SEQ ID NO: 166996 - DNA, 26 bp, Artificial sequence
  SiRNA target sequence
gaatagtagatccgcaattaataaaa

SEQ ID NO: 166997 - DNA, 26 bp, Artificial sequence
  SiRNA target sequence
aatagtagatccgcaattaataaaaa

SEQ ID NO: 166998 - DNA, 26 bp, Artificial sequence
  SiRNA target sequence
atagtagatccgcaattaataaaaaa

SEQ ID NO: 166999 - DNA, 26 bp, Artificial sequence
  SiRNA target sequence
tagtagatccgcaattaataaaaaac

SEQ ID NO: 167000 - DNA, 26 bp, Artificial sequence
  SiRNA target sequence
agtagatccgcaattaataaaaaaca

SEQ ID NO: 167001 - DNA, 26 bp, Artificial sequence
  SiRNA target sequence
gtagatccgcaattaataaaaaacag

SEQ ID NO: 167002 - DNA, 26 bp, Artificial sequence
  SiRNA target sequence
tagatccgcaattaataaaaaacagt

SEQ ID NO: 167003 - DNA, 26 bp, Artificial sequence
  SiRNA target sequence
agatccgcaattaataaaaaacagta

SEQ ID NO: 167004 - DNA, 26 bp, Artificial sequence
  SiRNA target sequence
gatccgcaattaataaaaaacagtat

SEQ ID NO: 167005 - DNA, 26 bp, Artificial sequence
  SiRNA target sequence
atccgcaattaataaaaaacagtatt

SEQ ID NO: 167006 - DNA, 26 bp, Artificial sequence
  SiRNA target sequence
tccgcaattaataaaaaacagtatta

SEQ ID NO: 167007 - DNA, 26 bp, Artificial sequence
  SiRNA target sequence
ccgcaattaataaaaaacagtattac

SEQ ID NO: 167008 - DNA, 26 bp, Artificial sequence
  SiRNA target sequence
cgcaattaataaaaaacagtattact

SEQ ID NO: 167009 - DNA, 26 bp, Artificial sequence
  SiRNA target sequence
gcaattaataaaaaacagtattacta

SEQ ID NO: 167010 - DNA, 26 bp, Artificial sequence
  SiRNA target sequence
caattaataaaaaacagtattactaa

SEQ ID NO: 167011 - DNA, 26 bp, Artificial sequence
  SiRNA target sequence
aattaataaaaaacagtattactaaa

SEQ ID NO: 167012 - DNA, 26 bp, Artificial sequence
  SiRNA target sequence
attaataaaaaacagtattactaaag

SEQ ID NO: 167013 - DNA, 26 bp, Artificial sequence
  SiRNA target sequence
ttaataaaaaacagtattactaaaga

SEQ ID NO: 167014 - DNA, 26 bp, Artificial sequence
  SiRNA target sequence
taataaaaaacagtattactaaagat

SEQ ID NO: 167015 - DNA, 26 bp, Artificial sequence
  SiRNA target sequence
aataaaaaacagtattactaaagata

SEQ ID NO: 167016 - DNA, 26 bp, Artificial sequence
  SiRNA target sequence
ataaaaaacagtattactaaagatac

SEQ ID NO: 167017 - DNA, 26 bp, Artificial sequence
  SiRNA target sequence
taaaaaacagtattactaaagatacc

SEQ ID NO: 167018 - DNA, 26 bp, Artificial sequence
  SiRNA target sequence
aaaaaacagtattactaaagataccg

SEQ ID NO: 167019 - DNA, 26 bp, Artificial sequence
  SiRNA target sequence
aaaaacagtattactaaagataccgc

SEQ ID NO: 167020 - DNA, 26 bp, Artificial sequence
  SiRNA target sequence
aaaacagtattactaaagataccgct

SEQ ID NO: 167021 - DNA, 26 bp, Artificial sequence
  SiRNA target sequence
aaacagtattactaaagataccgctt

SEQ ID NO: 167022 - DNA, 26 bp, Artificial sequence
  SiRNA target sequence
aacagtattactaaagataccgcttt

SEQ ID NO: 167023 - DNA, 26 bp, Artificial sequence
  SiRNA target sequence
acagtattactaaagataccgctttg

SEQ ID NO: 167024 - DNA, 26 bp, Artificial sequence
  SiRNA target sequence
cagtattactaaagataccgctttgg

SEQ ID NO: 167025 - DNA, 26 bp, Artificial sequence
  SiRNA target sequence
agtattactaaagataccgctttggt

SEQ ID NO: 167026 - DNA, 26 bp, Artificial sequence
  SiRNA target sequence
gtattactaaagataccgctttggtg

SEQ ID NO: 167027 - DNA, 26 bp, Artificial sequence
  SiRNA target sequence
tattactaaagataccgctttggtgt

SEQ ID NO: 167028 - DNA, 26 bp, Artificial sequence
  SiRNA target sequence
attactaaagataccgctttggtgtc

SEQ ID NO: 167029 - DNA, 26 bp, Artificial sequence
  SiRNA target sequence
ttactaaagataccgctttggtgtct

SEQ ID NO: 167030 - DNA, 26 bp, Artificial sequence
  SiRNA target sequence
tactaaagataccgctttggtgtctg

SEQ ID NO: 167031 - DNA, 26 bp, Artificial sequence
  SiRNA target sequence
actaaagataccgctttggtgtctgt

SEQ ID NO: 167032 - DNA, 26 bp, Artificial sequence
  SiRNA target sequence
ctaaagataccgctttggtgtctgtt

SEQ ID NO: 167033 - DNA, 26 bp, Artificial sequence
  SiRNA target sequence
taaagataccgctttggtgtctgtta

SEQ ID NO: 167034 - DNA, 26 bp, Artificial sequence
  SiRNA target sequence
aaagataccgctttggtgtctgttat

SEQ ID NO: 167035 - DNA, 26 bp, Artificial sequence
  SiRNA target sequence
aagataccgctttggtgtctgttatg

SEQ ID NO: 167036 - DNA, 26 bp, Artificial sequence
  SiRNA target sequence
agataccgctttggtgtctgttatgg

SEQ ID NO: 167037 - DNA, 26 bp, Artificial sequence
  SiRNA target sequence
gataccgctttggtgtctgttatggc

SEQ ID NO: 167038 - DNA, 26 bp, Artificial sequence
  SiRNA target sequence
ataccgctttggtgtctgttatggct

SEQ ID NO: 167039 - DNA, 26 bp, Artificial sequence
  SiRNA target sequence
taccgctttggtgtctgttatggctg

SEQ ID NO: 167040 - DNA, 26 bp, Artificial sequence
  SiRNA target sequence
accgctttggtgtctgttatggctgt

SEQ ID NO: 167041 - DNA, 26 bp, Artificial sequence
  SiRNA target sequence
ccgctttggtgtctgttatggctgtt

SEQ ID NO: 167042 - DNA, 26 bp, Artificial sequence
  SiRNA target sequence
cgctttggtgtctgttatggctgtta

SEQ ID NO: 167043 - DNA, 26 bp, Artificial sequence
  SiRNA target sequence
gctttggtgtctgttatggctgttaa

SEQ ID NO: 167044 - DNA, 26 bp, Artificial sequence
  SiRNA target sequence
ctttggtgtctgttatggctgttaac

SEQ ID NO: 167045 - DNA, 26 bp, Artificial sequence
  SiRNA target sequence
tttggtgtctgttatggctgttaaca

SEQ ID NO: 167046 - DNA, 26 bp, Artificial sequence
  SiRNA target sequence
ttggtgtctgttatggctgttaacaa

SEQ ID NO: 167047 - DNA, 26 bp, Artificial sequence
  SiRNA target sequence
tggtgtctgttatggctgttaacaac

SEQ ID NO: 167048 - DNA, 26 bp, Artificial sequence
  SiRNA target sequence
ggtgtctgttatggctgttaacaacg

SEQ ID NO: 167049 - DNA, 26 bp, Artificial sequence
  SiRNA target sequence
gtgtctgttatggctgttaacaacga

SEQ ID NO: 167050 - DNA, 26 bp, Artificial sequence
  SiRNA target sequence
tgtctgttatggctgttaacaacgaa

SEQ ID NO: 167051 - DNA, 26 bp, Artificial sequence
  SiRNA target sequence
gtctgttatggctgttaacaacgaaa

SEQ ID NO: 167052 - DNA, 26 bp, Artificial sequence
  SiRNA target sequence
tctgttatggctgttaacaacgaaat

SEQ ID NO: 167053 - DNA, 26 bp, Artificial sequence
  SiRNA target sequence
ctgttatggctgttaacaacgaaatg

SEQ ID NO: 167054 - DNA, 26 bp, Artificial sequence
  SiRNA target sequence
tgttatggctgttaacaacgaaatgg

SEQ ID NO: 167055 - DNA, 26 bp, Artificial sequence
  SiRNA target sequence
gttatggctgttaacaacgaaatggg

SEQ ID NO: 167056 - DNA, 26 bp, Artificial sequence
  SiRNA target sequence
ttatggctgttaacaacgaaatggga

SEQ ID NO: 167057 - DNA, 26 bp, Artificial sequence
  SiRNA target sequence
tatggctgttaacaacgaaatgggag

SEQ ID NO: 167058 - DNA, 26 bp, Artificial sequence
  SiRNA target sequence
atggctgttaacaacgaaatgggagc

SEQ ID NO: 167059 - DNA, 26 bp, Artificial sequence
  SiRNA target sequence
tggctgttaacaacgaaatgggagca

SEQ ID NO: 167060 - DNA, 26 bp, Artificial sequence
  SiRNA target sequence
ggctgttaacaacgaaatgggagcaa

SEQ ID NO: 167061 - DNA, 26 bp, Artificial sequence
  SiRNA target sequence
gctgttaacaacgaaatgggagcaat

SEQ ID NO: 167062 - DNA, 26 bp, Artificial sequence
  SiRNA target sequence
ctgttaacaacgaaatgggagcaata

SEQ ID NO: 167063 - DNA, 26 bp, Artificial sequence
  SiRNA target sequence
tgttaacaacgaaatgggagcaatac

SEQ ID NO: 167064 - DNA, 26 bp, Artificial sequence
  SiRNA target sequence
gttaacaacgaaatgggagcaataca

SEQ ID NO: 167065 - DNA, 26 bp, Artificial sequence
  SiRNA target sequence
ttaacaacgaaatgggagcaatacaa

SEQ ID NO: 167066 - DNA, 26 bp, Artificial sequence
  SiRNA target sequence
taacaacgaaatgggagcaatacaac

SEQ ID NO: 167067 - DNA, 26 bp, Artificial sequence
  SiRNA target sequence
aacaacgaaatgggagcaatacaacc

SEQ ID NO: 167068 - DNA, 26 bp, Artificial sequence
  SiRNA target sequence
acaacgaaatgggagcaatacaaccg

SEQ ID NO: 167069 - DNA, 26 bp, Artificial sequence
  SiRNA target sequence
caacgaaatgggagcaatacaaccgc

SEQ ID NO: 167070 - DNA, 26 bp, Artificial sequence
  SiRNA target sequence
aacgaaatgggagcaatacaaccgct

SEQ ID NO: 167071 - DNA, 26 bp, Artificial sequence
  SiRNA target sequence
acgaaatgggagcaatacaaccgctt

SEQ ID NO: 167072 - DNA, 26 bp, Artificial sequence
  SiRNA target sequence
cgaaatgggagcaatacaaccgctta

SEQ ID NO: 167073 - DNA, 26 bp, Artificial sequence
  SiRNA target sequence
gaaatgggagcaatacaaccgcttaa

SEQ ID NO: 167074 - DNA, 26 bp, Artificial sequence
  SiRNA target sequence
aaatgggagcaatacaaccgcttaaa

SEQ ID NO: 167075 - DNA, 26 bp, Artificial sequence
  SiRNA target sequence
aatgggagcaatacaaccgcttaaag

SEQ ID NO: 167076 - DNA, 26 bp, Artificial sequence
  SiRNA target sequence
atgggagcaatacaaccgcttaaaga

SEQ ID NO: 167077 - DNA, 26 bp, Artificial sequence
  SiRNA target sequence
tgggagcaatacaaccgcttaaagaa

SEQ ID NO: 167078 - DNA, 26 bp, Artificial sequence
  SiRNA target sequence
gggagcaatacaaccgcttaaagaaa

SEQ ID NO: 167079 - DNA, 26 bp, Artificial sequence
  SiRNA target sequence
ggagcaatacaaccgcttaaagaaat

SEQ ID NO: 167080 - DNA, 26 bp, Artificial sequence
  SiRNA target sequence
gagcaatacaaccgcttaaagaaata

SEQ ID NO: 167081 - DNA, 26 bp, Artificial sequence
  SiRNA target sequence
agcaatacaaccgcttaaagaaatag

SEQ ID NO: 167082 - DNA, 26 bp, Artificial sequence
  SiRNA target sequence
gcaatacaaccgcttaaagaaatagg

SEQ ID NO: 167083 - DNA, 26 bp, Artificial sequence
  SiRNA target sequence
caatacaaccgcttaaagaaatagga

SEQ ID NO: 167084 - DNA, 26 bp, Artificial sequence
  SiRNA target sequence
aatacaaccgcttaaagaaataggaa

SEQ ID NO: 167085 - DNA, 26 bp, Artificial sequence
  SiRNA target sequence
atacaaccgcttaaagaaataggaag

SEQ ID NO: 167086 - DNA, 26 bp, Artificial sequence
  SiRNA target sequence
tacaaccgcttaaagaaataggaaga

SEQ ID NO: 167087 - DNA, 26 bp, Artificial sequence
  SiRNA target sequence
acaaccgcttaaagaaataggaagaa

SEQ ID NO: 167088 - DNA, 26 bp, Artificial sequence
  SiRNA target sequence
caaccgcttaaagaaataggaagaat

SEQ ID NO: 167089 - DNA, 26 bp, Artificial sequence
  SiRNA target sequence
aaccgcttaaagaaataggaagaata

SEQ ID NO: 167090 - DNA, 26 bp, Artificial sequence
  SiRNA target sequence
accgcttaaagaaataggaagaatat

SEQ ID NO: 167091 - DNA, 26 bp, Artificial sequence
  SiRNA target sequence
ccgcttaaagaaataggaagaatatg

SEQ ID NO: 167092 - DNA, 26 bp, Artificial sequence
  SiRNA target sequence
cgcttaaagaaataggaagaatatgt

SEQ ID NO: 167093 - DNA, 26 bp, Artificial sequence
  SiRNA target sequence
gcttaaagaaataggaagaatatgta

SEQ ID NO: 167094 - DNA, 26 bp, Artificial sequence
  SiRNA target sequence
cttaaagaaataggaagaatatgtaa

SEQ ID NO: 167095 - DNA, 26 bp, Artificial sequence
  SiRNA target sequence
ttaaagaaataggaagaatatgtaaa

SEQ ID NO: 167096 - DNA, 26 bp, Artificial sequence
  SiRNA target sequence
taaagaaataggaagaatatgtaaag

SEQ ID NO: 167097 - DNA, 26 bp, Artificial sequence
  SiRNA target sequence
aaagaaataggaagaatatgtaaaga

SEQ ID NO: 167098 - DNA, 26 bp, Artificial sequence
  SiRNA target sequence
aagaaataggaagaatatgtaaagaa

SEQ ID NO: 167099 - DNA, 26 bp, Artificial sequence
  SiRNA target sequence
agaaataggaagaatatgtaaagaaa

SEQ ID NO: 167100 - DNA, 26 bp, Artificial sequence
  SiRNA target sequence
gaaataggaagaatatgtaaagaaaa

SEQ ID NO: 167101 - DNA, 26 bp, Artificial sequence
  SiRNA target sequence
aaataggaagaatatgtaaagaaaat

SEQ ID NO: 167102 - DNA, 26 bp, Artificial sequence
  SiRNA target sequence
aataggaagaatatgtaaagaaaata

SEQ ID NO: 167103 - DNA, 26 bp, Artificial sequence
  SiRNA target sequence
ataggaagaatatgtaaagaaaataa

SEQ ID NO: 167104 - DNA, 26 bp, Artificial sequence
  SiRNA target sequence
taggaagaatatgtaaagaaaataat

SEQ ID NO: 167105 - DNA, 26 bp, Artificial sequence
  SiRNA target sequence
aggaagaatatgtaaagaaaataata

SEQ ID NO: 167106 - DNA, 26 bp, Artificial sequence
  SiRNA target sequence
ggaagaatatgtaaagaaaataatat

SEQ ID NO: 167107 - DNA, 26 bp, Artificial sequence
  SiRNA target sequence
gaagaatatgtaaagaaaataatatt

SEQ ID NO: 167108 - DNA, 26 bp, Artificial sequence
  SiRNA target sequence
aagaatatgtaaagaaaataatattt

SEQ ID NO: 167109 - DNA, 26 bp, Artificial sequence
  SiRNA target sequence
agaatatgtaaagaaaataatatttt

SEQ ID NO: 167110 - DNA, 26 bp, Artificial sequence
  SiRNA target sequence
gaatatgtaaagaaaataatatttta

SEQ ID NO: 167111 - DNA, 26 bp, Artificial sequence
  SiRNA target sequence
aatatgtaaagaaaataatattttat

SEQ ID NO: 167112 - DNA, 26 bp, Artificial sequence
  SiRNA target sequence
atatgtaaagaaaataatattttatt

SEQ ID NO: 167113 - DNA, 26 bp, Artificial sequence
  SiRNA target sequence
tatgtaaagaaaataatattttattt

SEQ ID NO: 167114 - DNA, 26 bp, Artificial sequence
  SiRNA target sequence
atgtaaagaaaataatattttatttc

SEQ ID NO: 167115 - DNA, 26 bp, Artificial sequence
  SiRNA target sequence
tgtaaagaaaataatattttatttca

SEQ ID NO: 167116 - DNA, 26 bp, Artificial sequence
  SiRNA target sequence
gtaaagaaaataatattttatttcac

SEQ ID NO: 167117 - DNA, 26 bp, Artificial sequence
  SiRNA target sequence
taaagaaaataatattttatttcaca

SEQ ID NO: 167118 - DNA, 26 bp, Artificial sequence
  SiRNA target sequence
aaagaaaataatattttatttcacac

SEQ ID NO: 167119 - DNA, 26 bp, Artificial sequence
  SiRNA target sequence
aagaaaataatattttatttcacact

SEQ ID NO: 167120 - DNA, 26 bp, Artificial sequence
  SiRNA target sequence
agaaaataatattttatttcacactg

SEQ ID NO: 167121 - DNA, 26 bp, Artificial sequence
  SiRNA target sequence
gaaaataatattttatttcacactga

SEQ ID NO: 167122 - DNA, 26 bp, Artificial sequence
  SiRNA target sequence
aaaataatattttatttcacactgat

SEQ ID NO: 167123 - DNA, 26 bp, Artificial sequence
  SiRNA target sequence
aaataatattttatttcacactgatg

SEQ ID NO: 167124 - DNA, 26 bp, Artificial sequence
  SiRNA target sequence
aataatattttatttcacactgatgc

SEQ ID NO: 167125 - DNA, 26 bp, Artificial sequence
  SiRNA target sequence
ataatattttatttcacactgatgca

SEQ ID NO: 167126 - DNA, 26 bp, Artificial sequence
  SiRNA target sequence
taatattttatttcacactgatgcag

SEQ ID NO: 167127 - DNA, 26 bp, Artificial sequence
  SiRNA target sequence
aatattttatttcacactgatgcagc

SEQ ID NO: 167128 - DNA, 26 bp, Artificial sequence
  SiRNA target sequence
atattttatttcacactgatgcagca

SEQ ID NO: 167129 - DNA, 26 bp, Artificial sequence
  SiRNA target sequence
tattttatttcacactgatgcagcac

SEQ ID NO: 167130 - DNA, 26 bp, Artificial sequence
  SiRNA target sequence
attttatttcacactgatgcagcaca

SEQ ID NO: 167131 - DNA, 26 bp, Artificial sequence
  SiRNA target sequence
ttttatttcacactgatgcagcacaa

SEQ ID NO: 167132 - DNA, 26 bp, Artificial sequence
  SiRNA target sequence
tttatttcacactgatgcagcacaag

SEQ ID NO: 167133 - DNA, 26 bp, Artificial sequence
  SiRNA target sequence
ttatttcacactgatgcagcacaagc

SEQ ID NO: 167134 - DNA, 26 bp, Artificial sequence
  SiRNA target sequence
tatttcacactgatgcagcacaagca

SEQ ID NO: 167135 - DNA, 26 bp, Artificial sequence
  SiRNA target sequence
atttcacactgatgcagcacaagcag

SEQ ID NO: 167136 - DNA, 26 bp, Artificial sequence
  SiRNA target sequence
tttcacactgatgcagcacaagcagt

SEQ ID NO: 167137 - DNA, 26 bp, Artificial sequence
  SiRNA target sequence
ttcacactgatgcagcacaagcagtt

SEQ ID NO: 167138 - DNA, 26 bp, Artificial sequence
  SiRNA target sequence
tcacactgatgcagcacaagcagttg

SEQ ID NO: 167139 - DNA, 26 bp, Artificial sequence
  SiRNA target sequence
cacactgatgcagcacaagcagttgg

SEQ ID NO: 167140 - DNA, 26 bp, Artificial sequence
  SiRNA target sequence
acactgatgcagcacaagcagttggt

SEQ ID NO: 167141 - DNA, 26 bp, Artificial sequence
  SiRNA target sequence
cactgatgcagcacaagcagttggta

SEQ ID NO: 167142 - DNA, 26 bp, Artificial sequence
  SiRNA target sequence
actgatgcagcacaagcagttggtaa

SEQ ID NO: 167143 - DNA, 26 bp, Artificial sequence
  SiRNA target sequence
ctgatgcagcacaagcagttggtaat

SEQ ID NO: 167144 - DNA, 26 bp, Artificial sequence
  SiRNA target sequence
tgatgcagcacaagcagttggtaata

SEQ ID NO: 167145 - DNA, 26 bp, Artificial sequence
  SiRNA target sequence
gatgcagcacaagcagttggtaatat

SEQ ID NO: 167146 - DNA, 26 bp, Artificial sequence
  SiRNA target sequence
atgcagcacaagcagttggtaatata

SEQ ID NO: 167147 - DNA, 26 bp, Artificial sequence
  SiRNA target sequence
tgcagcacaagcagttggtaatatag

SEQ ID NO: 167148 - DNA, 26 bp, Artificial sequence
  SiRNA target sequence
gcagcacaagcagttggtaatataga

SEQ ID NO: 167149 - DNA, 26 bp, Artificial sequence
  SiRNA target sequence
cagcacaagcagttggtaatatagat

SEQ ID NO: 167150 - DNA, 26 bp, Artificial sequence
  SiRNA target sequence
agcacaagcagttggtaatatagata

SEQ ID NO: 167151 - DNA, 26 bp, Artificial sequence
  SiRNA target sequence
gcacaagcagttggtaatatagatat

SEQ ID NO: 167152 - DNA, 26 bp, Artificial sequence
  SiRNA target sequence
cacaagcagttggtaatatagatatt

SEQ ID NO: 167153 - DNA, 26 bp, Artificial sequence
  SiRNA target sequence
acaagcagttggtaatatagatattg

SEQ ID NO: 167154 - DNA, 26 bp, Artificial sequence
  SiRNA target sequence
caagcagttggtaatatagatattga

SEQ ID NO: 167155 - DNA, 26 bp, Artificial sequence
  SiRNA target sequence
aagcagttggtaatatagatattgat

SEQ ID NO: 167156 - DNA, 26 bp, Artificial sequence
  SiRNA target sequence
agcagttggtaatatagatattgatg

SEQ ID NO: 167157 - DNA, 26 bp, Artificial sequence
  SiRNA target sequence
gcagttggtaatatagatattgatgt

SEQ ID NO: 167158 - DNA, 26 bp, Artificial sequence
  SiRNA target sequence
cagttggtaatatagatattgatgtc

SEQ ID NO: 167159 - DNA, 26 bp, Artificial sequence
  SiRNA target sequence
agttggtaatatagatattgatgtca

SEQ ID NO: 167160 - DNA, 26 bp, Artificial sequence
  SiRNA target sequence
gttggtaatatagatattgatgtcaa

SEQ ID NO: 167161 - DNA, 26 bp, Artificial sequence
  SiRNA target sequence
ttggtaatatagatattgatgtcaat

SEQ ID NO: 167162 - DNA, 26 bp, Artificial sequence
  SiRNA target sequence
tggtaatatagatattgatgtcaatg

SEQ ID NO: 167163 - DNA, 26 bp, Artificial sequence
  SiRNA target sequence
ggtaatatagatattgatgtcaatga

SEQ ID NO: 167164 - DNA, 26 bp, Artificial sequence
  SiRNA target sequence
gtaatatagatattgatgtcaatgat

SEQ ID NO: 167165 - DNA, 26 bp, Artificial sequence
  SiRNA target sequence
taatatagatattgatgtcaatgata

SEQ ID NO: 167166 - DNA, 26 bp, Artificial sequence
  SiRNA target sequence
aatatagatattgatgtcaatgatat

SEQ ID NO: 167167 - DNA, 26 bp, Artificial sequence
  SiRNA target sequence
atatagatattgatgtcaatgatatg

SEQ ID NO: 167168 - DNA, 26 bp, Artificial sequence
  SiRNA target sequence
tatagatattgatgtcaatgatatga

SEQ ID NO: 167169 - DNA, 26 bp, Artificial sequence
  SiRNA target sequence
atagatattgatgtcaatgatatgaa

SEQ ID NO: 167170 - DNA, 26 bp, Artificial sequence
  SiRNA target sequence
tagatattgatgtcaatgatatgaat

SEQ ID NO: 167171 - DNA, 26 bp, Artificial sequence
  SiRNA target sequence
agatattgatgtcaatgatatgaata

SEQ ID NO: 167172 - DNA, 26 bp, Artificial sequence
  SiRNA target sequence
gatattgatgtcaatgatatgaatat

SEQ ID NO: 167173 - DNA, 26 bp, Artificial sequence
  SiRNA target sequence
atattgatgtcaatgatatgaatatt

SEQ ID NO: 167174 - DNA, 26 bp, Artificial sequence
  SiRNA target sequence
tattgatgtcaatgatatgaatattg

SEQ ID NO: 167175 - DNA, 26 bp, Artificial sequence
  SiRNA target sequence
attgatgtcaatgatatgaatattga

SEQ ID NO: 167176 - DNA, 26 bp, Artificial sequence
  SiRNA target sequence
ttgatgtcaatgatatgaatattgat

SEQ ID NO: 167177 - DNA, 26 bp, Artificial sequence
  SiRNA target sequence
tgatgtcaatgatatgaatattgatt

SEQ ID NO: 167178 - DNA, 26 bp, Artificial sequence
  SiRNA target sequence
gatgtcaatgatatgaatattgattt

SEQ ID NO: 167179 - DNA, 26 bp, Artificial sequence
  SiRNA target sequence
atgtcaatgatatgaatattgattta

SEQ ID NO: 167180 - DNA, 26 bp, Artificial sequence
  SiRNA target sequence
tgtcaatgatatgaatattgatttac

SEQ ID NO: 167181 - DNA, 26 bp, Artificial sequence
  SiRNA target sequence
gtcaatgatatgaatattgatttact

SEQ ID NO: 167182 - DNA, 26 bp, Artificial sequence
  SiRNA target sequence
tcaatgatatgaatattgatttacta

SEQ ID NO: 167183 - DNA, 26 bp, Artificial sequence
  SiRNA target sequence
caatgatatgaatattgatttactaa

SEQ ID NO: 167184 - DNA, 26 bp, Artificial sequence
  SiRNA target sequence
aatgatatgaatattgatttactaag

SEQ ID NO: 167185 - DNA, 26 bp, Artificial sequence
  SiRNA target sequence
atgatatgaatattgatttactaagt

SEQ ID NO: 167186 - DNA, 26 bp, Artificial sequence
  SiRNA target sequence
tgatatgaatattgatttactaagtt

SEQ ID NO: 167187 - DNA, 26 bp, Artificial sequence
  SiRNA target sequence
gatatgaatattgatttactaagttt

SEQ ID NO: 167188 - DNA, 26 bp, Artificial sequence
  SiRNA target sequence
atatgaatattgatttactaagttta

SEQ ID NO: 167189 - DNA, 26 bp, Artificial sequence
  SiRNA target sequence
tatgaatattgatttactaagtttat

SEQ ID NO: 167190 - DNA, 26 bp, Artificial sequence
  SiRNA target sequence
atgaatattgatttactaagtttatc

SEQ ID NO: 167191 - DNA, 26 bp, Artificial sequence
  SiRNA target sequence
tgaatattgatttactaagtttatca

SEQ ID NO: 167192 - DNA, 26 bp, Artificial sequence
  SiRNA target sequence
gaatattgatttactaagtttatcaa

SEQ ID NO: 167193 - DNA, 26 bp, Artificial sequence
  SiRNA target sequence
aatattgatttactaagtttatcaag

SEQ ID NO: 167194 - DNA, 26 bp, Artificial sequence
  SiRNA target sequence
atattgatttactaagtttatcaagt

SEQ ID NO: 167195 - DNA, 26 bp, Artificial sequence
  SiRNA target sequence
tattgatttactaagtttatcaagtc

SEQ ID NO: 167196 - DNA, 26 bp, Artificial sequence
  SiRNA target sequence
attgatttactaagtttatcaagtca

SEQ ID NO: 167197 - DNA, 26 bp, Artificial sequence
  SiRNA target sequence
ttgatttactaagtttatcaagtcat

SEQ ID NO: 167198 - DNA, 26 bp, Artificial sequence
  SiRNA target sequence
tgatttactaagtttatcaagtcata

SEQ ID NO: 167199 - DNA, 26 bp, Artificial sequence
  SiRNA target sequence
gatttactaagtttatcaagtcataa

SEQ ID NO: 167200 - DNA, 26 bp, Artificial sequence
  SiRNA target sequence
atttactaagtttatcaagtcataaa

SEQ ID NO: 167201 - DNA, 26 bp, Artificial sequence
  SiRNA target sequence
tttactaagtttatcaagtcataaaa

SEQ ID NO: 167202 - DNA, 26 bp, Artificial sequence
  SiRNA target sequence
ttactaagtttatcaagtcataaaat

SEQ ID NO: 167203 - DNA, 26 bp, Artificial sequence
  SiRNA target sequence
tactaagtttatcaagtcataaaatt

SEQ ID NO: 167204 - DNA, 26 bp, Artificial sequence
  SiRNA target sequence
actaagtttatcaagtcataaaattt

SEQ ID NO: 167205 - DNA, 26 bp, Artificial sequence
  SiRNA target sequence
ctaagtttatcaagtcataaaattta

SEQ ID NO: 167206 - DNA, 26 bp, Artificial sequence
  SiRNA target sequence
taagtttatcaagtcataaaatttat

SEQ ID NO: 167207 - DNA, 26 bp, Artificial sequence
  SiRNA target sequence
aagtttatcaagtcataaaatttatg

SEQ ID NO: 167208 - DNA, 26 bp, Artificial sequence
  SiRNA target sequence
agtttatcaagtcataaaatttatgg

SEQ ID NO: 167209 - DNA, 26 bp, Artificial sequence
  SiRNA target sequence
gtttatcaagtcataaaatttatggt

SEQ ID NO: 167210 - DNA, 26 bp, Artificial sequence
  SiRNA target sequence
tttatcaagtcataaaatttatggtc

SEQ ID NO: 167211 - DNA, 26 bp, Artificial sequence
  SiRNA target sequence
ttatcaagtcataaaatttatggtcc

SEQ ID NO: 167212 - DNA, 26 bp, Artificial sequence
  SiRNA target sequence
tatcaagtcataaaatttatggtcca

SEQ ID NO: 167213 - DNA, 26 bp, Artificial sequence
  SiRNA target sequence
atcaagtcataaaatttatggtccaa

SEQ ID NO: 167214 - DNA, 26 bp, Artificial sequence
  SiRNA target sequence
tcaagtcataaaatttatggtccaaa

SEQ ID NO: 167215 - DNA, 26 bp, Artificial sequence
  SiRNA target sequence
caagtcataaaatttatggtccaaaa

SEQ ID NO: 167216 - DNA, 26 bp, Artificial sequence
  SiRNA target sequence
aagtcataaaatttatggtccaaaag

SEQ ID NO: 167217 - DNA, 26 bp, Artificial sequence
  SiRNA target sequence
agtcataaaatttatggtccaaaagg

SEQ ID NO: 167218 - DNA, 26 bp, Artificial sequence
  SiRNA target sequence
gtcataaaatttatggtccaaaaggt

SEQ ID NO: 167219 - DNA, 26 bp, Artificial sequence
  SiRNA target sequence
tcataaaatttatggtccaaaaggtg

SEQ ID NO: 167220 - DNA, 26 bp, Artificial sequence
  SiRNA target sequence
cataaaatttatggtccaaaaggtgt

SEQ ID NO: 167221 - DNA, 26 bp, Artificial sequence
  SiRNA target sequence
ataaaatttatggtccaaaaggtgtt

SEQ ID NO: 167222 - DNA, 26 bp, Artificial sequence
  SiRNA target sequence
taaaatttatggtccaaaaggtgttg

SEQ ID NO: 167223 - DNA, 26 bp, Artificial sequence
  SiRNA target sequence
aaaatttatggtccaaaaggtgttgg

SEQ ID NO: 167224 - DNA, 26 bp, Artificial sequence
  SiRNA target sequence
aaatttatggtccaaaaggtgttggt

SEQ ID NO: 167225 - DNA, 26 bp, Artificial sequence
  SiRNA target sequence
aatttatggtccaaaaggtgttggtg

SEQ ID NO: 167226 - DNA, 26 bp, Artificial sequence
  SiRNA target sequence
atttatggtccaaaaggtgttggtgc

SEQ ID NO: 167227 - DNA, 26 bp, Artificial sequence
  SiRNA target sequence
tttatggtccaaaaggtgttggtgcc

SEQ ID NO: 167228 - DNA, 26 bp, Artificial sequence
  SiRNA target sequence
ttatggtccaaaaggtgttggtgcct

SEQ ID NO: 167229 - DNA, 26 bp, Artificial sequence
  SiRNA target sequence
tatggtccaaaaggtgttggtgcctt

SEQ ID NO: 167230 - DNA, 26 bp, Artificial sequence
  SiRNA target sequence
atggtccaaaaggtgttggtgcctta

SEQ ID NO: 167231 - DNA, 26 bp, Artificial sequence
  SiRNA target sequence
tggtccaaaaggtgttggtgccttat

SEQ ID NO: 167232 - DNA, 26 bp, Artificial sequence
  SiRNA target sequence
ggtccaaaaggtgttggtgccttata

SEQ ID NO: 167233 - DNA, 26 bp, Artificial sequence
  SiRNA target sequence
gtccaaaaggtgttggtgccttatac

SEQ ID NO: 167234 - DNA, 26 bp, Artificial sequence
  SiRNA target sequence
tccaaaaggtgttggtgccttatacg

SEQ ID NO: 167235 - DNA, 26 bp, Artificial sequence
  SiRNA target sequence
ccaaaaggtgttggtgccttatacgt

SEQ ID NO: 167236 - DNA, 26 bp, Artificial sequence
  SiRNA target sequence
caaaaggtgttggtgccttatacgtc

SEQ ID NO: 167237 - DNA, 26 bp, Artificial sequence
  SiRNA target sequence
aaaaggtgttggtgccttatacgtca

SEQ ID NO: 167238 - DNA, 26 bp, Artificial sequence
  SiRNA target sequence
aaaggtgttggtgccttatacgtcag

SEQ ID NO: 167239 - DNA, 26 bp, Artificial sequence
  SiRNA target sequence
aaggtgttggtgccttatacgtcaga

SEQ ID NO: 167240 - DNA, 26 bp, Artificial sequence
  SiRNA target sequence
aggtgttggtgccttatacgtcagaa

SEQ ID NO: 167241 - DNA, 26 bp, Artificial sequence
  SiRNA target sequence
ggtgttggtgccttatacgtcagaag

SEQ ID NO: 167242 - DNA, 26 bp, Artificial sequence
  SiRNA target sequence
gtgttggtgccttatacgtcagaaga

SEQ ID NO: 167243 - DNA, 26 bp, Artificial sequence
  SiRNA target sequence
tgttggtgccttatacgtcagaagaa

SEQ ID NO: 167244 - DNA, 26 bp, Artificial sequence
  SiRNA target sequence
gttggtgccttatacgtcagaagaag

SEQ ID NO: 167245 - DNA, 26 bp, Artificial sequence
  SiRNA target sequence
ttggtgccttatacgtcagaagaagg

SEQ ID NO: 167246 - DNA, 26 bp, Artificial sequence
  SiRNA target sequence
tggtgccttatacgtcagaagaaggc

SEQ ID NO: 167247 - DNA, 26 bp, Artificial sequence
  SiRNA target sequence
ggtgccttatacgtcagaagaaggcc

SEQ ID NO: 167248 - DNA, 26 bp, Artificial sequence
  SiRNA target sequence
gtgccttatacgtcagaagaaggcct

SEQ ID NO: 167249 - DNA, 26 bp, Artificial sequence
  SiRNA target sequence
tgccttatacgtcagaagaaggccta

SEQ ID NO: 167250 - DNA, 26 bp, Artificial sequence
  SiRNA target sequence
gccttatacgtcagaagaaggcctag

SEQ ID NO: 167251 - DNA, 26 bp, Artificial sequence
  SiRNA target sequence
ccttatacgtcagaagaaggcctagg

SEQ ID NO: 167252 - DNA, 26 bp, Artificial sequence
  SiRNA target sequence
cttatacgtcagaagaaggcctaggg

SEQ ID NO: 167253 - DNA, 26 bp, Artificial sequence
  SiRNA target sequence
ttatacgtcagaagaaggcctagggt

SEQ ID NO: 167254 - DNA, 26 bp, Artificial sequence
  SiRNA target sequence
tatacgtcagaagaaggcctagggtg

SEQ ID NO: 167255 - DNA, 26 bp, Artificial sequence
  SiRNA target sequence
atacgtcagaagaaggcctagggtga

SEQ ID NO: 167256 - DNA, 26 bp, Artificial sequence
  SiRNA target sequence
tacgtcagaagaaggcctagggtgag

SEQ ID NO: 167257 - DNA, 26 bp, Artificial sequence
  SiRNA target sequence
acgtcagaagaaggcctagggtgaga

SEQ ID NO: 167258 - DNA, 26 bp, Artificial sequence
  SiRNA target sequence
cgtcagaagaaggcctagggtgagaa

SEQ ID NO: 167259 - DNA, 26 bp, Artificial sequence
  SiRNA target sequence
gtcagaagaaggcctagggtgagaat

SEQ ID NO: 167260 - DNA, 26 bp, Artificial sequence
  SiRNA target sequence
tcagaagaaggcctagggtgagaatg

SEQ ID NO: 167261 - DNA, 26 bp, Artificial sequence
  SiRNA target sequence
cagaagaaggcctagggtgagaatgt

SEQ ID NO: 167262 - DNA, 26 bp, Artificial sequence
  SiRNA target sequence
agaagaaggcctagggtgagaatgtt

SEQ ID NO: 167263 - DNA, 26 bp, Artificial sequence
  SiRNA target sequence
gaagaaggcctagggtgagaatgtta

SEQ ID NO: 167264 - DNA, 26 bp, Artificial sequence
  SiRNA target sequence
aagaaggcctagggtgagaatgttac

SEQ ID NO: 167265 - DNA, 26 bp, Artificial sequence
  SiRNA target sequence
agaaggcctagggtgagaatgttacc

SEQ ID NO: 167266 - DNA, 26 bp, Artificial sequence
  SiRNA target sequence
gaaggcctagggtgagaatgttacca

SEQ ID NO: 167267 - DNA, 26 bp, Artificial sequence
  SiRNA target sequence
aaggcctagggtgagaatgttaccac

SEQ ID NO: 167268 - DNA, 26 bp, Artificial sequence
  SiRNA target sequence
aggcctagggtgagaatgttaccact

SEQ ID NO: 167269 - DNA, 26 bp, Artificial sequence
  SiRNA target sequence
ggcctagggtgagaatgttaccactt

SEQ ID NO: 167270 - DNA, 26 bp, Artificial sequence
  SiRNA target sequence
gcctagggtgagaatgttaccacttt

SEQ ID NO: 167271 - DNA, 26 bp, Artificial sequence
  SiRNA target sequence
cctagggtgagaatgttaccactttt

SEQ ID NO: 167272 - DNA, 26 bp, Artificial sequence
  SiRNA target sequence
ctagggtgagaatgttaccacttttt

SEQ ID NO: 167273 - DNA, 26 bp, Artificial sequence
  SiRNA target sequence
tagggtgagaatgttaccacttttta

SEQ ID NO: 167274 - DNA, 26 bp, Artificial sequence
  SiRNA target sequence
agggtgagaatgttaccactttttaa

SEQ ID NO: 167275 - DNA, 26 bp, Artificial sequence
  SiRNA target sequence
gggtgagaatgttaccactttttaat

SEQ ID NO: 167276 - DNA, 26 bp, Artificial sequence
  SiRNA target sequence
ggtgagaatgttaccactttttaatg

SEQ ID NO: 167277 - DNA, 26 bp, Artificial sequence
  SiRNA target sequence
gtgagaatgttaccactttttaatgg

SEQ ID NO: 167278 - DNA, 26 bp, Artificial sequence
  SiRNA target sequence
tgagaatgttaccactttttaatggt

SEQ ID NO: 167279 - DNA, 26 bp, Artificial sequence
  SiRNA target sequence
gagaatgttaccactttttaatggtg

SEQ ID NO: 167280 - DNA, 26 bp, Artificial sequence
  SiRNA target sequence
agaatgttaccactttttaatggtgg

SEQ ID NO: 167281 - DNA, 26 bp, Artificial sequence
  SiRNA target sequence
gaatgttaccactttttaatggtggt

SEQ ID NO: 167282 - DNA, 26 bp, Artificial sequence
  SiRNA target sequence
aatgttaccactttttaatggtggtg

SEQ ID NO: 167283 - DNA, 26 bp, Artificial sequence
  SiRNA target sequence
atgttaccactttttaatggtggtgg

SEQ ID NO: 167284 - DNA, 26 bp, Artificial sequence
  SiRNA target sequence
tgttaccactttttaatggtggtgga

SEQ ID NO: 167285 - DNA, 26 bp, Artificial sequence
  SiRNA target sequence
gttaccactttttaatggtggtggac

SEQ ID NO: 167286 - DNA, 26 bp, Artificial sequence
  SiRNA target sequence
ttaccactttttaatggtggtggaca

SEQ ID NO: 167287 - DNA, 26 bp, Artificial sequence
  SiRNA target sequence
taccactttttaatggtggtggacaa

SEQ ID NO: 167288 - DNA, 26 bp, Artificial sequence
  SiRNA target sequence
accactttttaatggtggtggacaag

SEQ ID NO: 167289 - DNA, 26 bp, Artificial sequence
  SiRNA target sequence
ccactttttaatggtggtggacaaga

SEQ ID NO: 167290 - DNA, 26 bp, Artificial sequence
  SiRNA target sequence
cactttttaatggtggtggacaagaa

SEQ ID NO: 167291 - DNA, 26 bp, Artificial sequence
  SiRNA target sequence
actttttaatggtggtggacaagaaa

SEQ ID NO: 167292 - DNA, 26 bp, Artificial sequence
  SiRNA target sequence
ctttttaatggtggtggacaagaaag

SEQ ID NO: 167293 - DNA, 26 bp, Artificial sequence
  SiRNA target sequence
tttttaatggtggtggacaagaaaga

SEQ ID NO: 167294 - DNA, 26 bp, Artificial sequence
  SiRNA target sequence
ttttaatggtggtggacaagaaagag

SEQ ID NO: 167295 - DNA, 26 bp, Artificial sequence
  SiRNA target sequence
tttaatggtggtggacaagaaagagg

SEQ ID NO: 167296 - DNA, 26 bp, Artificial sequence
  SiRNA target sequence
ttaatggtggtggacaagaaagagga

SEQ ID NO: 167297 - DNA, 26 bp, Artificial sequence
  SiRNA target sequence
taatggtggtggacaagaaagaggat

SEQ ID NO: 167298 - DNA, 26 bp, Artificial sequence
  SiRNA target sequence
aatggtggtggacaagaaagaggatt

SEQ ID NO: 167299 - DNA, 26 bp, Artificial sequence
  SiRNA target sequence
atggtggtggacaagaaagaggatta

SEQ ID NO: 167300 - DNA, 26 bp, Artificial sequence
  SiRNA target sequence
tggtggtggacaagaaagaggattaa

SEQ ID NO: 167301 - DNA, 26 bp, Artificial sequence
  SiRNA target sequence
ggtggtggacaagaaagaggattaag

SEQ ID NO: 167302 - DNA, 26 bp, Artificial sequence
  SiRNA target sequence
gtggtggacaagaaagaggattaaga

SEQ ID NO: 167303 - DNA, 26 bp, Artificial sequence
  SiRNA target sequence
tggtggacaagaaagaggattaagaa

SEQ ID NO: 167304 - DNA, 26 bp, Artificial sequence
  SiRNA target sequence
ggtggacaagaaagaggattaagaag

SEQ ID NO: 167305 - DNA, 26 bp, Artificial sequence
  SiRNA target sequence
gtggacaagaaagaggattaagaagt

SEQ ID NO: 167306 - DNA, 26 bp, Artificial sequence
  SiRNA target sequence
tggacaagaaagaggattaagaagtg

SEQ ID NO: 167307 - DNA, 26 bp, Artificial sequence
  SiRNA target sequence
ggacaagaaagaggattaagaagtgg

SEQ ID NO: 167308 - DNA, 26 bp, Artificial sequence
  SiRNA target sequence
gacaagaaagaggattaagaagtggg

SEQ ID NO: 167309 - DNA, 26 bp, Artificial sequence
  SiRNA target sequence
acaagaaagaggattaagaagtggga

SEQ ID NO: 167310 - DNA, 26 bp, Artificial sequence
  SiRNA target sequence
caagaaagaggattaagaagtgggac

SEQ ID NO: 167311 - DNA, 26 bp, Artificial sequence
  SiRNA target sequence
aagaaagaggattaagaagtgggaca

SEQ ID NO: 167312 - DNA, 26 bp, Artificial sequence
  SiRNA target sequence
agaaagaggattaagaagtgggacaa

SEQ ID NO: 167313 - DNA, 26 bp, Artificial sequence
  SiRNA target sequence
gaaagaggattaagaagtgggacaac

SEQ ID NO: 167314 - DNA, 26 bp, Artificial sequence
  SiRNA target sequence
aaagaggattaagaagtgggacaact

SEQ ID NO: 167315 - DNA, 26 bp, Artificial sequence
  SiRNA target sequence
aagaggattaagaagtgggacaactt

SEQ ID NO: 167316 - DNA, 26 bp, Artificial sequence
  SiRNA target sequence
agaggattaagaagtgggacaacttc

SEQ ID NO: 167317 - DNA, 26 bp, Artificial sequence
  SiRNA target sequence
gaggattaagaagtgggacaacttct

SEQ ID NO: 167318 - DNA, 26 bp, Artificial sequence
  SiRNA target sequence
aggattaagaagtgggacaacttctc

SEQ ID NO: 167319 - DNA, 26 bp, Artificial sequence
  SiRNA target sequence
ggattaagaagtgggacaacttctcc

SEQ ID NO: 167320 - DNA, 26 bp, Artificial sequence
  SiRNA target sequence
gattaagaagtgggacaacttctcca

SEQ ID NO: 167321 - DNA, 26 bp, Artificial sequence
  SiRNA target sequence
attaagaagtgggacaacttctccac

SEQ ID NO: 167322 - DNA, 26 bp, Artificial sequence
  SiRNA target sequence
ttaagaagtgggacaacttctccacc

SEQ ID NO: 167323 - DNA, 26 bp, Artificial sequence
  SiRNA target sequence
taagaagtgggacaacttctccacct

SEQ ID NO: 167324 - DNA, 26 bp, Artificial sequence
  SiRNA target sequence
aagaagtgggacaacttctccacctt

SEQ ID NO: 167325 - DNA, 26 bp, Artificial sequence
  SiRNA target sequence
agaagtgggacaacttctccaccttt

SEQ ID NO: 167326 - DNA, 26 bp, Artificial sequence
  SiRNA target sequence
gaagtgggacaacttctccaccttta

SEQ ID NO: 167327 - DNA, 26 bp, Artificial sequence
  SiRNA target sequence
aagtgggacaacttctccacctttag

SEQ ID NO: 167328 - DNA, 26 bp, Artificial sequence
  SiRNA target sequence
agtgggacaacttctccacctttagt

SEQ ID NO: 167329 - DNA, 26 bp, Artificial sequence
  SiRNA target sequence
gtgggacaacttctccacctttagtt

SEQ ID NO: 167330 - DNA, 26 bp, Artificial sequence
  SiRNA target sequence
tgggacaacttctccacctttagttg

SEQ ID NO: 167331 - DNA, 26 bp, Artificial sequence
  SiRNA target sequence
gggacaacttctccacctttagttgt

SEQ ID NO: 167332 - DNA, 26 bp, Artificial sequence
  SiRNA target sequence
ggacaacttctccacctttagttgtt

SEQ ID NO: 167333 - DNA, 26 bp, Artificial sequence
  SiRNA target sequence
gacaacttctccacctttagttgttg

SEQ ID NO: 167334 - DNA, 26 bp, Artificial sequence
  SiRNA target sequence
acaacttctccacctttagttgttgg

SEQ ID NO: 167335 - DNA, 26 bp, Artificial sequence
  SiRNA target sequence
caacttctccacctttagttgttgga

SEQ ID NO: 167336 - DNA, 26 bp, Artificial sequence
  SiRNA target sequence
aacttctccacctttagttgttggat

SEQ ID NO: 167337 - DNA, 26 bp, Artificial sequence
  SiRNA target sequence
acttctccacctttagttgttggatt

SEQ ID NO: 167338 - DNA, 26 bp, Artificial sequence
  SiRNA target sequence
cttctccacctttagttgttggatta

SEQ ID NO: 167339 - DNA, 26 bp, Artificial sequence
  SiRNA target sequence
ttctccacctttagttgttggattag

SEQ ID NO: 167340 - DNA, 26 bp, Artificial sequence
  SiRNA target sequence
tctccacctttagttgttggattagg

SEQ ID NO: 167341 - DNA, 26 bp, Artificial sequence
  SiRNA target sequence
ctccacctttagttgttggattaggc

SEQ ID NO: 167342 - DNA, 26 bp, Artificial sequence
  SiRNA target sequence
tccacctttagttgttggattaggca

SEQ ID NO: 167343 - DNA, 26 bp, Artificial sequence
  SiRNA target sequence
ccacctttagttgttggattaggcaa

SEQ ID NO: 167344 - DNA, 26 bp, Artificial sequence
  SiRNA target sequence
cacctttagttgttggattaggcaaa

SEQ ID NO: 167345 - DNA, 26 bp, Artificial sequence
  SiRNA target sequence
acctttagttgttggattaggcaaag

SEQ ID NO: 167346 - DNA, 26 bp, Artificial sequence
  SiRNA target sequence
cctttagttgttggattaggcaaagc

SEQ ID NO: 167347 - DNA, 26 bp, Artificial sequence
  SiRNA target sequence
ctttagttgttggattaggcaaagct

SEQ ID NO: 167348 - DNA, 26 bp, Artificial sequence
  SiRNA target sequence
tttagttgttggattaggcaaagctg

SEQ ID NO: 167349 - DNA, 26 bp, Artificial sequence
  SiRNA target sequence
ttagttgttggattaggcaaagctgc

SEQ ID NO: 167350 - DNA, 26 bp, Artificial sequence
  SiRNA target sequence
tagttgttggattaggcaaagctgct

SEQ ID NO: 167351 - DNA, 26 bp, Artificial sequence
  SiRNA target sequence
agttgttggattaggcaaagctgctg

SEQ ID NO: 167352 - DNA, 26 bp, Artificial sequence
  SiRNA target sequence
gttgttggattaggcaaagctgctga

SEQ ID NO: 167353 - DNA, 26 bp, Artificial sequence
  SiRNA target sequence
ttgttggattaggcaaagctgctgag

SEQ ID NO: 167354 - DNA, 26 bp, Artificial sequence
  SiRNA target sequence
tgttggattaggcaaagctgctgaga

SEQ ID NO: 167355 - DNA, 26 bp, Artificial sequence
  SiRNA target sequence
gttggattaggcaaagctgctgagat

SEQ ID NO: 167356 - DNA, 26 bp, Artificial sequence
  SiRNA target sequence
ttggattaggcaaagctgctgagata

SEQ ID NO: 167357 - DNA, 26 bp, Artificial sequence
  SiRNA target sequence
tggattaggcaaagctgctgagatat

SEQ ID NO: 167358 - DNA, 26 bp, Artificial sequence
  SiRNA target sequence
ggattaggcaaagctgctgagatatg

SEQ ID NO: 167359 - DNA, 26 bp, Artificial sequence
  SiRNA target sequence
gattaggcaaagctgctgagatatgc

SEQ ID NO: 167360 - DNA, 26 bp, Artificial sequence
  SiRNA target sequence
attaggcaaagctgctgagatatgct

SEQ ID NO: 167361 - DNA, 26 bp, Artificial sequence
  SiRNA target sequence
ttaggcaaagctgctgagatatgctc

SEQ ID NO: 167362 - DNA, 26 bp, Artificial sequence
  SiRNA target sequence
taggcaaagctgctgagatatgctct

SEQ ID NO: 167363 - DNA, 26 bp, Artificial sequence
  SiRNA target sequence
aggcaaagctgctgagatatgctctc

SEQ ID NO: 167364 - DNA, 26 bp, Artificial sequence
  SiRNA target sequence
ggcaaagctgctgagatatgctctca

SEQ ID NO: 167365 - DNA, 26 bp, Artificial sequence
  SiRNA target sequence
gcaaagctgctgagatatgctctcag

SEQ ID NO: 167366 - DNA, 26 bp, Artificial sequence
  SiRNA target sequence
caaagctgctgagatatgctctcagg

SEQ ID NO: 167367 - DNA, 26 bp, Artificial sequence
  SiRNA target sequence
aaagctgctgagatatgctctcagga

SEQ ID NO: 167368 - DNA, 26 bp, Artificial sequence
  SiRNA target sequence
aagctgctgagatatgctctcaggag

SEQ ID NO: 167369 - DNA, 26 bp, Artificial sequence
  SiRNA target sequence
agctgctgagatatgctctcaggaga

SEQ ID NO: 167370 - DNA, 26 bp, Artificial sequence
  SiRNA target sequence
gctgctgagatatgctctcaggagat

SEQ ID NO: 167371 - DNA, 26 bp, Artificial sequence
  SiRNA target sequence
ctgctgagatatgctctcaggagatg

SEQ ID NO: 167372 - DNA, 26 bp, Artificial sequence
  SiRNA target sequence
tgctgagatatgctctcaggagatgc

SEQ ID NO: 167373 - DNA, 26 bp, Artificial sequence
  SiRNA target sequence
gctgagatatgctctcaggagatgcg

SEQ ID NO: 167374 - DNA, 26 bp, Artificial sequence
  SiRNA target sequence
ctgagatatgctctcaggagatgcgt

SEQ ID NO: 167375 - DNA, 26 bp, Artificial sequence
  SiRNA target sequence
tgagatatgctctcaggagatgcgta

SEQ ID NO: 167376 - DNA, 26 bp, Artificial sequence
  SiRNA target sequence
gagatatgctctcaggagatgcgtaa

SEQ ID NO: 167377 - DNA, 26 bp, Artificial sequence
  SiRNA target sequence
agatatgctctcaggagatgcgtaag

SEQ ID NO: 167378 - DNA, 26 bp, Artificial sequence
  SiRNA target sequence
gatatgctctcaggagatgcgtaagg

SEQ ID NO: 167379 - DNA, 26 bp, Artificial sequence
  SiRNA target sequence
atatgctctcaggagatgcgtaagga

SEQ ID NO: 167380 - DNA, 26 bp, Artificial sequence
  SiRNA target sequence
tatgctctcaggagatgcgtaaggac

SEQ ID NO: 167381 - DNA, 26 bp, Artificial sequence
  SiRNA target sequence
atgctctcaggagatgcgtaaggact

SEQ ID NO: 167382 - DNA, 26 bp, Artificial sequence
  SiRNA target sequence
tgctctcaggagatgcgtaaggacta

SEQ ID NO: 167383 - DNA, 26 bp, Artificial sequence
  SiRNA target sequence
gctctcaggagatgcgtaaggactat

SEQ ID NO: 167384 - DNA, 26 bp, Artificial sequence
  SiRNA target sequence
ctctcaggagatgcgtaaggactatg

SEQ ID NO: 167385 - DNA, 26 bp, Artificial sequence
  SiRNA target sequence
tctcaggagatgcgtaaggactatga

SEQ ID NO: 167386 - DNA, 26 bp, Artificial sequence
  SiRNA target sequence
ctcaggagatgcgtaaggactatgaa

SEQ ID NO: 167387 - DNA, 26 bp, Artificial sequence
  SiRNA target sequence
tcaggagatgcgtaaggactatgaat

SEQ ID NO: 167388 - DNA, 26 bp, Artificial sequence
  SiRNA target sequence
caggagatgcgtaaggactatgaata

SEQ ID NO: 167389 - DNA, 26 bp, Artificial sequence
  SiRNA target sequence
aggagatgcgtaaggactatgaatat

SEQ ID NO: 167390 - DNA, 26 bp, Artificial sequence
  SiRNA target sequence
ggagatgcgtaaggactatgaatata

SEQ ID NO: 167391 - DNA, 26 bp, Artificial sequence
  SiRNA target sequence
gagatgcgtaaggactatgaatatat

SEQ ID NO: 167392 - DNA, 26 bp, Artificial sequence
  SiRNA target sequence
agatgcgtaaggactatgaatatata

SEQ ID NO: 167393 - DNA, 26 bp, Artificial sequence
  SiRNA target sequence
gatgcgtaaggactatgaatatatac

SEQ ID NO: 167394 - DNA, 26 bp, Artificial sequence
  SiRNA target sequence
atgcgtaaggactatgaatatataca

SEQ ID NO: 167395 - DNA, 26 bp, Artificial sequence
  SiRNA target sequence
tgcgtaaggactatgaatatatacaa

SEQ ID NO: 167396 - DNA, 26 bp, Artificial sequence
  SiRNA target sequence
gcgtaaggactatgaatatatacaaa

SEQ ID NO: 167397 - DNA, 26 bp, Artificial sequence
  SiRNA target sequence
cgtaaggactatgaatatatacaaaa

SEQ ID NO: 167398 - DNA, 26 bp, Artificial sequence
  SiRNA target sequence
gtaaggactatgaatatatacaaaaa

SEQ ID NO: 167399 - DNA, 26 bp, Artificial sequence
  SiRNA target sequence
taaggactatgaatatatacaaaaat

SEQ ID NO: 167400 - DNA, 26 bp, Artificial sequence
  SiRNA target sequence
aaggactatgaatatatacaaaaatt

SEQ ID NO: 167401 - DNA, 26 bp, Artificial sequence
  SiRNA target sequence
aggactatgaatatatacaaaaatta

SEQ ID NO: 167402 - DNA, 26 bp, Artificial sequence
  SiRNA target sequence
ggactatgaatatatacaaaaattat

SEQ ID NO: 167403 - DNA, 26 bp, Artificial sequence
  SiRNA target sequence
gactatgaatatatacaaaaattatc

SEQ ID NO: 167404 - DNA, 26 bp, Artificial sequence
  SiRNA target sequence
actatgaatatatacaaaaattatcg

SEQ ID NO: 167405 - DNA, 26 bp, Artificial sequence
  SiRNA target sequence
ctatgaatatatacaaaaattatcgg

SEQ ID NO: 167406 - DNA, 26 bp, Artificial sequence
  SiRNA target sequence
tatgaatatatacaaaaattatcgga

SEQ ID NO: 167407 - DNA, 26 bp, Artificial sequence
  SiRNA target sequence
atgaatatatacaaaaattatcggat

SEQ ID NO: 167408 - DNA, 26 bp, Artificial sequence
  SiRNA target sequence
tgaatatatacaaaaattatcggata

SEQ ID NO: 167409 - DNA, 26 bp, Artificial sequence
  SiRNA target sequence
gaatatatacaaaaattatcggataa

SEQ ID NO: 167410 - DNA, 26 bp, Artificial sequence
  SiRNA target sequence
aatatatacaaaaattatcggataaa

SEQ ID NO: 167411 - DNA, 26 bp, Artificial sequence
  SiRNA target sequence
atatatacaaaaattatcggataaac

SEQ ID NO: 167412 - DNA, 26 bp, Artificial sequence
  SiRNA target sequence
tatatacaaaaattatcggataaact

SEQ ID NO: 167413 - DNA, 26 bp, Artificial sequence
  SiRNA target sequence
atatacaaaaattatcggataaacta

SEQ ID NO: 167414 - DNA, 26 bp, Artificial sequence
  SiRNA target sequence
tatacaaaaattatcggataaactaa

SEQ ID NO: 167415 - DNA, 26 bp, Artificial sequence
  SiRNA target sequence
atacaaaaattatcggataaactaaa

SEQ ID NO: 167416 - DNA, 26 bp, Artificial sequence
  SiRNA target sequence
tacaaaaattatcggataaactaaaa

SEQ ID NO: 167417 - DNA, 26 bp, Artificial sequence
  SiRNA target sequence
acaaaaattatcggataaactaaaaa

SEQ ID NO: 167418 - DNA, 26 bp, Artificial sequence
  SiRNA target sequence
caaaaattatcggataaactaaaaaa

SEQ ID NO: 167419 - DNA, 26 bp, Artificial sequence
  SiRNA target sequence
aaaaattatcggataaactaaaaaat

SEQ ID NO: 167420 - DNA, 26 bp, Artificial sequence
  SiRNA target sequence
aaaattatcggataaactaaaaaatc

SEQ ID NO: 167421 - DNA, 26 bp, Artificial sequence
  SiRNA target sequence
aaattatcggataaactaaaaaatcg

SEQ ID NO: 167422 - DNA, 26 bp, Artificial sequence
  SiRNA target sequence
aattatcggataaactaaaaaatcgc

SEQ ID NO: 167423 - DNA, 26 bp, Artificial sequence
  SiRNA target sequence
attatcggataaactaaaaaatcgca

SEQ ID NO: 167424 - DNA, 26 bp, Artificial sequence
  SiRNA target sequence
ttatcggataaactaaaaaatcgcat

SEQ ID NO: 167425 - DNA, 26 bp, Artificial sequence
  SiRNA target sequence
tatcggataaactaaaaaatcgcatc

SEQ ID NO: 167426 - DNA, 26 bp, Artificial sequence
  SiRNA target sequence
atcggataaactaaaaaatcgcatca

SEQ ID NO: 167427 - DNA, 26 bp, Artificial sequence
  SiRNA target sequence
tcggataaactaaaaaatcgcatcaa

SEQ ID NO: 167428 - DNA, 26 bp, Artificial sequence
  SiRNA target sequence
cggataaactaaaaaatcgcatcaaa

SEQ ID NO: 167429 - DNA, 26 bp, Artificial sequence
  SiRNA target sequence
ggataaactaaaaaatcgcatcaaaa

SEQ ID NO: 167430 - DNA, 26 bp, Artificial sequence
  SiRNA target sequence
gataaactaaaaaatcgcatcaaaac

SEQ ID NO: 167431 - DNA, 26 bp, Artificial sequence
  SiRNA target sequence
ataaactaaaaaatcgcatcaaaacg

SEQ ID NO: 167432 - DNA, 26 bp, Artificial sequence
  SiRNA target sequence
taaactaaaaaatcgcatcaaaacga

SEQ ID NO: 167433 - DNA, 26 bp, Artificial sequence
  SiRNA target sequence
aaactaaaaaatcgcatcaaaacgaa

SEQ ID NO: 167434 - DNA, 26 bp, Artificial sequence
  SiRNA target sequence
aactaaaaaatcgcatcaaaacgaat

SEQ ID NO: 167435 - DNA, 26 bp, Artificial sequence
  SiRNA target sequence
actaaaaaatcgcatcaaaacgaatg

SEQ ID NO: 167436 - DNA, 26 bp, Artificial sequence
  SiRNA target sequence
ctaaaaaatcgcatcaaaacgaatgt

SEQ ID NO: 167437 - DNA, 26 bp, Artificial sequence
  SiRNA target sequence
taaaaaatcgcatcaaaacgaatgta

SEQ ID NO: 167438 - DNA, 26 bp, Artificial sequence
  SiRNA target sequence
aaaaaatcgcatcaaaacgaatgtag

SEQ ID NO: 167439 - DNA, 26 bp, Artificial sequence
  SiRNA target sequence
aaaaatcgcatcaaaacgaatgtaga

SEQ ID NO: 167440 - DNA, 26 bp, Artificial sequence
  SiRNA target sequence
aaaatcgcatcaaaacgaatgtagaa

SEQ ID NO: 167441 - DNA, 26 bp, Artificial sequence
  SiRNA target sequence
aaatcgcatcaaaacgaatgtagaaa

SEQ ID NO: 167442 - DNA, 26 bp, Artificial sequence
  SiRNA target sequence
aatcgcatcaaaacgaatgtagaaaa

SEQ ID NO: 167443 - DNA, 26 bp, Artificial sequence
  SiRNA target sequence
atcgcatcaaaacgaatgtagaaaat

SEQ ID NO: 167444 - DNA, 26 bp, Artificial sequence
  SiRNA target sequence
tcgcatcaaaacgaatgtagaaaatg

SEQ ID NO: 167445 - DNA, 26 bp, Artificial sequence
  SiRNA target sequence
cgcatcaaaacgaatgtagaaaatgt

SEQ ID NO: 167446 - DNA, 26 bp, Artificial sequence
  SiRNA target sequence
gcatcaaaacgaatgtagaaaatgtt

SEQ ID NO: 167447 - DNA, 26 bp, Artificial sequence
  SiRNA target sequence
catcaaaacgaatgtagaaaatgttg

SEQ ID NO: 167448 - DNA, 26 bp, Artificial sequence
  SiRNA target sequence
atcaaaacgaatgtagaaaatgttgt

SEQ ID NO: 167449 - DNA, 26 bp, Artificial sequence
  SiRNA target sequence
tcaaaacgaatgtagaaaatgttgtt

SEQ ID NO: 167450 - DNA, 26 bp, Artificial sequence
  SiRNA target sequence
caaaacgaatgtagaaaatgttgtta

SEQ ID NO: 167451 - DNA, 26 bp, Artificial sequence
  SiRNA target sequence
aaaacgaatgtagaaaatgttgttat

SEQ ID NO: 167452 - DNA, 26 bp, Artificial sequence
  SiRNA target sequence
aaacgaatgtagaaaatgttgttatt

SEQ ID NO: 167453 - DNA, 26 bp, Artificial sequence
  SiRNA target sequence
aacgaatgtagaaaatgttgttatta

SEQ ID NO: 167454 - DNA, 26 bp, Artificial sequence
  SiRNA target sequence
acgaatgtagaaaatgttgttattaa

SEQ ID NO: 167455 - DNA, 26 bp, Artificial sequence
  SiRNA target sequence
cgaatgtagaaaatgttgttattaac

SEQ ID NO: 167456 - DNA, 26 bp, Artificial sequence
  SiRNA target sequence
gaatgtagaaaatgttgttattaacg

SEQ ID NO: 167457 - DNA, 26 bp, Artificial sequence
  SiRNA target sequence
aatgtagaaaatgttgttattaacgg

SEQ ID NO: 167458 - DNA, 26 bp, Artificial sequence
  SiRNA target sequence
atgtagaaaatgttgttattaacggc

SEQ ID NO: 167459 - DNA, 26 bp, Artificial sequence
  SiRNA target sequence
tgtagaaaatgttgttattaacggcg

SEQ ID NO: 167460 - DNA, 26 bp, Artificial sequence
  SiRNA target sequence
gtagaaaatgttgttattaacggcga

SEQ ID NO: 167461 - DNA, 26 bp, Artificial sequence
  SiRNA target sequence
tagaaaatgttgttattaacggcgat

SEQ ID NO: 167462 - DNA, 26 bp, Artificial sequence
  SiRNA target sequence
agaaaatgttgttattaacggcgatg

SEQ ID NO: 167463 - DNA, 26 bp, Artificial sequence
  SiRNA target sequence
gaaaatgttgttattaacggcgatga

SEQ ID NO: 167464 - DNA, 26 bp, Artificial sequence
  SiRNA target sequence
aaaatgttgttattaacggcgatgat

SEQ ID NO: 167465 - DNA, 26 bp, Artificial sequence
  SiRNA target sequence
aaatgttgttattaacggcgatgatt

SEQ ID NO: 167466 - DNA, 26 bp, Artificial sequence
  SiRNA target sequence
aatgttgttattaacggcgatgattc

SEQ ID NO: 167467 - DNA, 26 bp, Artificial sequence
  SiRNA target sequence
atgttgttattaacggcgatgattct

SEQ ID NO: 167468 - DNA, 26 bp, Artificial sequence
  SiRNA target sequence
tgttgttattaacggcgatgattcta

SEQ ID NO: 167469 - DNA, 26 bp, Artificial sequence
  SiRNA target sequence
gttgttattaacggcgatgattctaa

SEQ ID NO: 167470 - DNA, 26 bp, Artificial sequence
  SiRNA target sequence
ttgttattaacggcgatgattctaag

SEQ ID NO: 167471 - DNA, 26 bp, Artificial sequence
  SiRNA target sequence
tgttattaacggcgatgattctaaga

SEQ ID NO: 167472 - DNA, 26 bp, Artificial sequence
  SiRNA target sequence
gttattaacggcgatgattctaagac

SEQ ID NO: 167473 - DNA, 26 bp, Artificial sequence
  SiRNA target sequence
ttattaacggcgatgattctaagact

SEQ ID NO: 167474 - DNA, 26 bp, Artificial sequence
  SiRNA target sequence
tattaacggcgatgattctaagactt

SEQ ID NO: 167475 - DNA, 26 bp, Artificial sequence
  SiRNA target sequence
attaacggcgatgattctaagacttt

SEQ ID NO: 167476 - DNA, 26 bp, Artificial sequence
  SiRNA target sequence
ttaacggcgatgattctaagactttt

SEQ ID NO: 167477 - DNA, 26 bp, Artificial sequence
  SiRNA target sequence
taacggcgatgattctaagacttttc

SEQ ID NO: 167478 - DNA, 26 bp, Artificial sequence
  SiRNA target sequence
aacggcgatgattctaagacttttcc

SEQ ID NO: 167479 - DNA, 26 bp, Artificial sequence
  SiRNA target sequence
acggcgatgattctaagacttttcct

SEQ ID NO: 167480 - DNA, 26 bp, Artificial sequence
  SiRNA target sequence
cggcgatgattctaagacttttcctg

SEQ ID NO: 167481 - DNA, 26 bp, Artificial sequence
  SiRNA target sequence
ggcgatgattctaagacttttcctgg

SEQ ID NO: 167482 - DNA, 26 bp, Artificial sequence
  SiRNA target sequence
gcgatgattctaagacttttcctggc

SEQ ID NO: 167483 - DNA, 26 bp, Artificial sequence
  SiRNA target sequence
cgatgattctaagacttttcctggct

SEQ ID NO: 167484 - DNA, 26 bp, Artificial sequence
  SiRNA target sequence
gatgattctaagacttttcctggctg

SEQ ID NO: 167485 - DNA, 26 bp, Artificial sequence
  SiRNA target sequence
atgattctaagacttttcctggctgt

SEQ ID NO: 167486 - DNA, 26 bp, Artificial sequence
  SiRNA target sequence
tgattctaagacttttcctggctgtc

SEQ ID NO: 167487 - DNA, 26 bp, Artificial sequence
  SiRNA target sequence
gattctaagacttttcctggctgtct

SEQ ID NO: 167488 - DNA, 26 bp, Artificial sequence
  SiRNA target sequence
attctaagacttttcctggctgtctc

SEQ ID NO: 167489 - DNA, 26 bp, Artificial sequence
  SiRNA target sequence
ttctaagacttttcctggctgtctca

SEQ ID NO: 167490 - DNA, 26 bp, Artificial sequence
  SiRNA target sequence
tctaagacttttcctggctgtctcaa

SEQ ID NO: 167491 - DNA, 26 bp, Artificial sequence
  SiRNA target sequence
ctaagacttttcctggctgtctcaat

SEQ ID NO: 167492 - DNA, 26 bp, Artificial sequence
  SiRNA target sequence
taagacttttcctggctgtctcaata

SEQ ID NO: 167493 - DNA, 26 bp, Artificial sequence
  SiRNA target sequence
aagacttttcctggctgtctcaatat

SEQ ID NO: 167494 - DNA, 26 bp, Artificial sequence
  SiRNA target sequence
agacttttcctggctgtctcaatatt

SEQ ID NO: 167495 - DNA, 26 bp, Artificial sequence
  SiRNA target sequence
gacttttcctggctgtctcaatattt

SEQ ID NO: 167496 - DNA, 26 bp, Artificial sequence
  SiRNA target sequence
acttttcctggctgtctcaatatttc

SEQ ID NO: 167497 - DNA, 26 bp, Artificial sequence
  SiRNA target sequence
cttttcctggctgtctcaatatttct

SEQ ID NO: 167498 - DNA, 26 bp, Artificial sequence
  SiRNA target sequence
ttttcctggctgtctcaatatttctt

SEQ ID NO: 167499 - DNA, 26 bp, Artificial sequence
  SiRNA target sequence
tttcctggctgtctcaatatttcttt

SEQ ID NO: 167500 - DNA, 26 bp, Artificial sequence
  SiRNA target sequence
ttcctggctgtctcaatatttctttt

SEQ ID NO: 167501 - DNA, 26 bp, Artificial sequence
  SiRNA target sequence
tcctggctgtctcaatatttcttttc

SEQ ID NO: 167502 - DNA, 26 bp, Artificial sequence
  SiRNA target sequence
cctggctgtctcaatatttcttttcc

SEQ ID NO: 167503 - DNA, 26 bp, Artificial sequence
  SiRNA target sequence
ctggctgtctcaatatttcttttcca

SEQ ID NO: 167504 - DNA, 26 bp, Artificial sequence
  SiRNA target sequence
tggctgtctcaatatttcttttccat

SEQ ID NO: 167505 - DNA, 26 bp, Artificial sequence
  SiRNA target sequence
ggctgtctcaatatttcttttccata

SEQ ID NO: 167506 - DNA, 26 bp, Artificial sequence
  SiRNA target sequence
gctgtctcaatatttcttttccatat

SEQ ID NO: 167507 - DNA, 26 bp, Artificial sequence
  SiRNA target sequence
ctgtctcaatatttcttttccatatg

SEQ ID NO: 167508 - DNA, 26 bp, Artificial sequence
  SiRNA target sequence
tgtctcaatatttcttttccatatgt

SEQ ID NO: 167509 - DNA, 26 bp, Artificial sequence
  SiRNA target sequence
gtctcaatatttcttttccatatgta

SEQ ID NO: 167510 - DNA, 26 bp, Artificial sequence
  SiRNA target sequence
tctcaatatttcttttccatatgtag

SEQ ID NO: 167511 - DNA, 26 bp, Artificial sequence
  SiRNA target sequence
ctcaatatttcttttccatatgtaga

SEQ ID NO: 167512 - DNA, 26 bp, Artificial sequence
  SiRNA target sequence
tcaatatttcttttccatatgtagaa

SEQ ID NO: 167513 - DNA, 26 bp, Artificial sequence
  SiRNA target sequence
caatatttcttttccatatgtagaag

SEQ ID NO: 167514 - DNA, 26 bp, Artificial sequence
  SiRNA target sequence
aatatttcttttccatatgtagaagg

SEQ ID NO: 167515 - DNA, 26 bp, Artificial sequence
  SiRNA target sequence
atatttcttttccatatgtagaaggt

SEQ ID NO: 167516 - DNA, 26 bp, Artificial sequence
  SiRNA target sequence
tatttcttttccatatgtagaaggtg

SEQ ID NO: 167517 - DNA, 26 bp, Artificial sequence
  SiRNA target sequence
atttcttttccatatgtagaaggtga

SEQ ID NO: 167518 - DNA, 26 bp, Artificial sequence
  SiRNA target sequence
tttcttttccatatgtagaaggtgaa

SEQ ID NO: 167519 - DNA, 26 bp, Artificial sequence
  SiRNA target sequence
ttcttttccatatgtagaaggtgaag

SEQ ID NO: 167520 - DNA, 26 bp, Artificial sequence
  SiRNA target sequence
tcttttccatatgtagaaggtgaagg

SEQ ID NO: 167521 - DNA, 26 bp, Artificial sequence
  SiRNA target sequence
cttttccatatgtagaaggtgaaggg

SEQ ID NO: 167522 - DNA, 26 bp, Artificial sequence
  SiRNA target sequence
ttttccatatgtagaaggtgaagggc

SEQ ID NO: 167523 - DNA, 26 bp, Artificial sequence
  SiRNA target sequence
tttccatatgtagaaggtgaagggct

SEQ ID NO: 167524 - DNA, 26 bp, Artificial sequence
  SiRNA target sequence
ttccatatgtagaaggtgaagggctt

SEQ ID NO: 167525 - DNA, 26 bp, Artificial sequence
  SiRNA target sequence
tccatatgtagaaggtgaagggctta

SEQ ID NO: 167526 - DNA, 26 bp, Artificial sequence
  SiRNA target sequence
ccatatgtagaaggtgaagggcttat

SEQ ID NO: 167527 - DNA, 26 bp, Artificial sequence
  SiRNA target sequence
catatgtagaaggtgaagggcttatg

SEQ ID NO: 167528 - DNA, 26 bp, Artificial sequence
  SiRNA target sequence
atatgtagaaggtgaagggcttatga

SEQ ID NO: 167529 - DNA, 26 bp, Artificial sequence
  SiRNA target sequence
tatgtagaaggtgaagggcttatgat

SEQ ID NO: 167530 - DNA, 26 bp, Artificial sequence
  SiRNA target sequence
atgtagaaggtgaagggcttatgatg

SEQ ID NO: 167531 - DNA, 26 bp, Artificial sequence
  SiRNA target sequence
tgtagaaggtgaagggcttatgatga

SEQ ID NO: 167532 - DNA, 26 bp, Artificial sequence
  SiRNA target sequence
gtagaaggtgaagggcttatgatgaa

SEQ ID NO: 167533 - DNA, 26 bp, Artificial sequence
  SiRNA target sequence
tagaaggtgaagggcttatgatgaat

SEQ ID NO: 167534 - DNA, 26 bp, Artificial sequence
  SiRNA target sequence
agaaggtgaagggcttatgatgaata

SEQ ID NO: 167535 - DNA, 26 bp, Artificial sequence
  SiRNA target sequence
gaaggtgaagggcttatgatgaatat

SEQ ID NO: 167536 - DNA, 26 bp, Artificial sequence
  SiRNA target sequence
aaggtgaagggcttatgatgaatatt

SEQ ID NO: 167537 - DNA, 26 bp, Artificial sequence
  SiRNA target sequence
aggtgaagggcttatgatgaatatta

SEQ ID NO: 167538 - DNA, 26 bp, Artificial sequence
  SiRNA target sequence
ggtgaagggcttatgatgaatattaa

SEQ ID NO: 167539 - DNA, 26 bp, Artificial sequence
  SiRNA target sequence
gtgaagggcttatgatgaatattaag

SEQ ID NO: 167540 - DNA, 26 bp, Artificial sequence
  SiRNA target sequence
tgaagggcttatgatgaatattaagg

SEQ ID NO: 167541 - DNA, 26 bp, Artificial sequence
  SiRNA target sequence
gaagggcttatgatgaatattaagga

SEQ ID NO: 167542 - DNA, 26 bp, Artificial sequence
  SiRNA target sequence
aagggcttatgatgaatattaaggat

SEQ ID NO: 167543 - DNA, 26 bp, Artificial sequence
  SiRNA target sequence
agggcttatgatgaatattaaggata

SEQ ID NO: 167544 - DNA, 26 bp, Artificial sequence
  SiRNA target sequence
gggcttatgatgaatattaaggatat

SEQ ID NO: 167545 - DNA, 26 bp, Artificial sequence
  SiRNA target sequence
ggcttatgatgaatattaaggatatt

SEQ ID NO: 167546 - DNA, 26 bp, Artificial sequence
  SiRNA target sequence
gcttatgatgaatattaaggatattg

SEQ ID NO: 167547 - DNA, 26 bp, Artificial sequence
  SiRNA target sequence
cttatgatgaatattaaggatattgc

SEQ ID NO: 167548 - DNA, 26 bp, Artificial sequence
  SiRNA target sequence
ttatgatgaatattaaggatattgct

SEQ ID NO: 167549 - DNA, 26 bp, Artificial sequence
  SiRNA target sequence
tatgatgaatattaaggatattgctg

SEQ ID NO: 167550 - DNA, 26 bp, Artificial sequence
  SiRNA target sequence
atgatgaatattaaggatattgctgt

SEQ ID NO: 167551 - DNA, 26 bp, Artificial sequence
  SiRNA target sequence
tgatgaatattaaggatattgctgtt

SEQ ID NO: 167552 - DNA, 26 bp, Artificial sequence
  SiRNA target sequence
gatgaatattaaggatattgctgtta

SEQ ID NO: 167553 - DNA, 26 bp, Artificial sequence
  SiRNA target sequence
atgaatattaaggatattgctgttag

SEQ ID NO: 167554 - DNA, 26 bp, Artificial sequence
  SiRNA target sequence
tgaatattaaggatattgctgttagt

SEQ ID NO: 167555 - DNA, 26 bp, Artificial sequence
  SiRNA target sequence
gaatattaaggatattgctgttagta

SEQ ID NO: 167556 - DNA, 26 bp, Artificial sequence
  SiRNA target sequence
aatattaaggatattgctgttagtag

SEQ ID NO: 167557 - DNA, 26 bp, Artificial sequence
  SiRNA target sequence
atattaaggatattgctgttagtagt

SEQ ID NO: 167558 - DNA, 26 bp, Artificial sequence
  SiRNA target sequence
tattaaggatattgctgttagtagtg

SEQ ID NO: 167559 - DNA, 26 bp, Artificial sequence
  SiRNA target sequence
attaaggatattgctgttagtagtgg

SEQ ID NO: 167560 - DNA, 26 bp, Artificial sequence
  SiRNA target sequence
ttaaggatattgctgttagtagtgga

SEQ ID NO: 167561 - DNA, 26 bp, Artificial sequence
  SiRNA target sequence
taaggatattgctgttagtagtggaa

SEQ ID NO: 167562 - DNA, 26 bp, Artificial sequence
  SiRNA target sequence
aaggatattgctgttagtagtggaag

SEQ ID NO: 167563 - DNA, 26 bp, Artificial sequence
  SiRNA target sequence
aggatattgctgttagtagtggaagt

SEQ ID NO: 167564 - DNA, 26 bp, Artificial sequence
  SiRNA target sequence
ggatattgctgttagtagtggaagtg

SEQ ID NO: 167565 - DNA, 26 bp, Artificial sequence
  SiRNA target sequence
gatattgctgttagtagtggaagtgc

SEQ ID NO: 167566 - DNA, 26 bp, Artificial sequence
  SiRNA target sequence
atattgctgttagtagtggaagtgct

SEQ ID NO: 167567 - DNA, 26 bp, Artificial sequence
  SiRNA target sequence
tattgctgttagtagtggaagtgctt

SEQ ID NO: 167568 - DNA, 26 bp, Artificial sequence
  SiRNA target sequence
attgctgttagtagtggaagtgcttg

SEQ ID NO: 167569 - DNA, 26 bp, Artificial sequence
  SiRNA target sequence
ttgctgttagtagtggaagtgcttgc

SEQ ID NO: 167570 - DNA, 26 bp, Artificial sequence
  SiRNA target sequence
tgctgttagtagtggaagtgcttgca

SEQ ID NO: 167571 - DNA, 26 bp, Artificial sequence
  SiRNA target sequence
gctgttagtagtggaagtgcttgcac

SEQ ID NO: 167572 - DNA, 26 bp, Artificial sequence
  SiRNA target sequence
ctgttagtagtggaagtgcttgcact

SEQ ID NO: 167573 - DNA, 26 bp, Artificial sequence
  SiRNA target sequence
tgttagtagtggaagtgcttgcactt

SEQ ID NO: 167574 - DNA, 26 bp, Artificial sequence
  SiRNA target sequence
gttagtagtggaagtgcttgcacttc

SEQ ID NO: 167575 - DNA, 26 bp, Artificial sequence
  SiRNA target sequence
ttagtagtggaagtgcttgcacttca

SEQ ID NO: 167576 - DNA, 26 bp, Artificial sequence
  SiRNA target sequence
tagtagtggaagtgcttgcacttcat

SEQ ID NO: 167577 - DNA, 26 bp, Artificial sequence
  SiRNA target sequence
agtagtggaagtgcttgcacttcatc

SEQ ID NO: 167578 - DNA, 26 bp, Artificial sequence
  SiRNA target sequence
gtagtggaagtgcttgcacttcatca

SEQ ID NO: 167579 - DNA, 26 bp, Artificial sequence
  SiRNA target sequence
tagtggaagtgcttgcacttcatcat

SEQ ID NO: 167580 - DNA, 26 bp, Artificial sequence
  SiRNA target sequence
agtggaagtgcttgcacttcatcatc

SEQ ID NO: 167581 - DNA, 26 bp, Artificial sequence
  SiRNA target sequence
gtggaagtgcttgcacttcatcatct

SEQ ID NO: 167582 - DNA, 26 bp, Artificial sequence
  SiRNA target sequence
tggaagtgcttgcacttcatcatctt

SEQ ID NO: 167583 - DNA, 26 bp, Artificial sequence
  SiRNA target sequence
ggaagtgcttgcacttcatcatcttt

SEQ ID NO: 167584 - DNA, 26 bp, Artificial sequence
  SiRNA target sequence
gaagtgcttgcacttcatcatcttta

SEQ ID NO: 167585 - DNA, 26 bp, Artificial sequence
  SiRNA target sequence
aagtgcttgcacttcatcatctttag

SEQ ID NO: 167586 - DNA, 26 bp, Artificial sequence
  SiRNA target sequence
agtgcttgcacttcatcatctttaga

SEQ ID NO: 167587 - DNA, 26 bp, Artificial sequence
  SiRNA target sequence
gtgcttgcacttcatcatctttagaa

SEQ ID NO: 167588 - DNA, 26 bp, Artificial sequence
  SiRNA target sequence
tgcttgcacttcatcatctttagaac

SEQ ID NO: 167589 - DNA, 26 bp, Artificial sequence
  SiRNA target sequence
gcttgcacttcatcatctttagaacc

SEQ ID NO: 167590 - DNA, 26 bp, Artificial sequence
  SiRNA target sequence
cttgcacttcatcatctttagaaccc

SEQ ID NO: 167591 - DNA, 26 bp, Artificial sequence
  SiRNA target sequence
ttgcacttcatcatctttagaaccct

SEQ ID NO: 167592 - DNA, 26 bp, Artificial sequence
  SiRNA target sequence
tgcacttcatcatctttagaaccctc

SEQ ID NO: 167593 - DNA, 26 bp, Artificial sequence
  SiRNA target sequence
gcacttcatcatctttagaaccctct

SEQ ID NO: 167594 - DNA, 26 bp, Artificial sequence
  SiRNA target sequence
cacttcatcatctttagaaccctctt

SEQ ID NO: 167595 - DNA, 26 bp, Artificial sequence
  SiRNA target sequence
acttcatcatctttagaaccctctta

SEQ ID NO: 167596 - DNA, 26 bp, Artificial sequence
  SiRNA target sequence
cttcatcatctttagaaccctcttat

SEQ ID NO: 167597 - DNA, 26 bp, Artificial sequence
  SiRNA target sequence
ttcatcatctttagaaccctcttatg

SEQ ID NO: 167598 - DNA, 26 bp, Artificial sequence
  SiRNA target sequence
tcatcatctttagaaccctcttatgt

SEQ ID NO: 167599 - DNA, 26 bp, Artificial sequence
  SiRNA target sequence
catcatctttagaaccctcttatgtt

SEQ ID NO: 167600 - DNA, 26 bp, Artificial sequence
  SiRNA target sequence
atcatctttagaaccctcttatgttt

SEQ ID NO: 167601 - DNA, 26 bp, Artificial sequence
  SiRNA target sequence
tcatctttagaaccctcttatgtttt

SEQ ID NO: 167602 - DNA, 26 bp, Artificial sequence
  SiRNA target sequence
catctttagaaccctcttatgttttg

SEQ ID NO: 167603 - DNA, 26 bp, Artificial sequence
  SiRNA target sequence
atctttagaaccctcttatgttttgc

SEQ ID NO: 167604 - DNA, 26 bp, Artificial sequence
  SiRNA target sequence
tctttagaaccctcttatgttttgcg

SEQ ID NO: 167605 - DNA, 26 bp, Artificial sequence
  SiRNA target sequence
ctttagaaccctcttatgttttgcga

SEQ ID NO: 167606 - DNA, 26 bp, Artificial sequence
  SiRNA target sequence
tttagaaccctcttatgttttgcgag

SEQ ID NO: 167607 - DNA, 26 bp, Artificial sequence
  SiRNA target sequence
ttagaaccctcttatgttttgcgagc

SEQ ID NO: 167608 - DNA, 26 bp, Artificial sequence
  SiRNA target sequence
tagaaccctcttatgttttgcgagct

SEQ ID NO: 167609 - DNA, 26 bp, Artificial sequence
  SiRNA target sequence
agaaccctcttatgttttgcgagctt

SEQ ID NO: 167610 - DNA, 26 bp, Artificial sequence
  SiRNA target sequence
gaaccctcttatgttttgcgagcttt

SEQ ID NO: 167611 - DNA, 26 bp, Artificial sequence
  SiRNA target sequence
aaccctcttatgttttgcgagcttta

SEQ ID NO: 167612 - DNA, 26 bp, Artificial sequence
  SiRNA target sequence
accctcttatgttttgcgagctttag

SEQ ID NO: 167613 - DNA, 26 bp, Artificial sequence
  SiRNA target sequence
ccctcttatgttttgcgagctttagg

SEQ ID NO: 167614 - DNA, 26 bp, Artificial sequence
  SiRNA target sequence
cctcttatgttttgcgagctttaggc

SEQ ID NO: 167615 - DNA, 26 bp, Artificial sequence
  SiRNA target sequence
ctcttatgttttgcgagctttaggca

SEQ ID NO: 167616 - DNA, 26 bp, Artificial sequence
  SiRNA target sequence
tcttatgttttgcgagctttaggcaa

SEQ ID NO: 167617 - DNA, 26 bp, Artificial sequence
  SiRNA target sequence
cttatgttttgcgagctttaggcaaa

SEQ ID NO: 167618 - DNA, 26 bp, Artificial sequence
  SiRNA target sequence
ttatgttttgcgagctttaggcaaaa

SEQ ID NO: 167619 - DNA, 26 bp, Artificial sequence
  SiRNA target sequence
tatgttttgcgagctttaggcaaaaa

SEQ ID NO: 167620 - DNA, 26 bp, Artificial sequence
  SiRNA target sequence
atgttttgcgagctttaggcaaaaat

SEQ ID NO: 167621 - DNA, 26 bp, Artificial sequence
  SiRNA target sequence
tgttttgcgagctttaggcaaaaatg

SEQ ID NO: 167622 - DNA, 26 bp, Artificial sequence
  SiRNA target sequence
gttttgcgagctttaggcaaaaatga

SEQ ID NO: 167623 - DNA, 26 bp, Artificial sequence
  SiRNA target sequence
ttttgcgagctttaggcaaaaatgat

SEQ ID NO: 167624 - DNA, 26 bp, Artificial sequence
  SiRNA target sequence
tttgcgagctttaggcaaaaatgatg

SEQ ID NO: 167625 - DNA, 26 bp, Artificial sequence
  SiRNA target sequence
ttgcgagctttaggcaaaaatgatga

SEQ ID NO: 167626 - DNA, 26 bp, Artificial sequence
  SiRNA target sequence
tgcgagctttaggcaaaaatgatgat

SEQ ID NO: 167627 - DNA, 26 bp, Artificial sequence
  SiRNA target sequence
gcgagctttaggcaaaaatgatgatc

SEQ ID NO: 167628 - DNA, 26 bp, Artificial sequence
  SiRNA target sequence
cgagctttaggcaaaaatgatgatct

SEQ ID NO: 167629 - DNA, 26 bp, Artificial sequence
  SiRNA target sequence
gagctttaggcaaaaatgatgatctt

SEQ ID NO: 167630 - DNA, 26 bp, Artificial sequence
  SiRNA target sequence
agctttaggcaaaaatgatgatcttg

SEQ ID NO: 167631 - DNA, 26 bp, Artificial sequence
  SiRNA target sequence
gctttaggcaaaaatgatgatcttgc

SEQ ID NO: 167632 - DNA, 26 bp, Artificial sequence
  SiRNA target sequence
ctttaggcaaaaatgatgatcttgcg

SEQ ID NO: 167633 - DNA, 26 bp, Artificial sequence
  SiRNA target sequence
tttaggcaaaaatgatgatcttgcgc

SEQ ID NO: 167634 - DNA, 26 bp, Artificial sequence
  SiRNA target sequence
ttaggcaaaaatgatgatcttgcgca

SEQ ID NO: 167635 - DNA, 26 bp, Artificial sequence
  SiRNA target sequence
taggcaaaaatgatgatcttgcgcat

SEQ ID NO: 167636 - DNA, 26 bp, Artificial sequence
  SiRNA target sequence
aggcaaaaatgatgatcttgcgcatt

SEQ ID NO: 167637 - DNA, 26 bp, Artificial sequence
  SiRNA target sequence
ggcaaaaatgatgatcttgcgcattc

SEQ ID NO: 167638 - DNA, 26 bp, Artificial sequence
  SiRNA target sequence
gcaaaaatgatgatcttgcgcattct

SEQ ID NO: 167639 - DNA, 26 bp, Artificial sequence
  SiRNA target sequence
caaaaatgatgatcttgcgcattctt

SEQ ID NO: 167640 - DNA, 26 bp, Artificial sequence
  SiRNA target sequence
aaaaatgatgatcttgcgcattcttc

SEQ ID NO: 167641 - DNA, 26 bp, Artificial sequence
  SiRNA target sequence
aaaatgatgatcttgcgcattcttct

SEQ ID NO: 167642 - DNA, 26 bp, Artificial sequence
  SiRNA target sequence
aaatgatgatcttgcgcattcttcta

SEQ ID NO: 167643 - DNA, 26 bp, Artificial sequence
  SiRNA target sequence
aatgatgatcttgcgcattcttctat

SEQ ID NO: 167644 - DNA, 26 bp, Artificial sequence
  SiRNA target sequence
atgatgatcttgcgcattcttctata

SEQ ID NO: 167645 - DNA, 26 bp, Artificial sequence
  SiRNA target sequence
tgatgatcttgcgcattcttctataa

SEQ ID NO: 167646 - DNA, 26 bp, Artificial sequence
  SiRNA target sequence
gatgatcttgcgcattcttctataag

SEQ ID NO: 167647 - DNA, 26 bp, Artificial sequence
  SiRNA target sequence
atgatcttgcgcattcttctataaga

SEQ ID NO: 167648 - DNA, 26 bp, Artificial sequence
  SiRNA target sequence
tgatcttgcgcattcttctataagat

SEQ ID NO: 167649 - DNA, 26 bp, Artificial sequence
  SiRNA target sequence
gatcttgcgcattcttctataagatt

SEQ ID NO: 167650 - DNA, 26 bp, Artificial sequence
  SiRNA target sequence
atcttgcgcattcttctataagattt

SEQ ID NO: 167651 - DNA, 26 bp, Artificial sequence
  SiRNA target sequence
tcttgcgcattcttctataagatttg

SEQ ID NO: 167652 - DNA, 26 bp, Artificial sequence
  SiRNA target sequence
cttgcgcattcttctataagatttgg

SEQ ID NO: 167653 - DNA, 26 bp, Artificial sequence
  SiRNA target sequence
ttgcgcattcttctataagatttgga

SEQ ID NO: 167654 - DNA, 26 bp, Artificial sequence
  SiRNA target sequence
tgcgcattcttctataagatttggaa

SEQ ID NO: 167655 - DNA, 26 bp, Artificial sequence
  SiRNA target sequence
gcgcattcttctataagatttggaat

SEQ ID NO: 167656 - DNA, 26 bp, Artificial sequence
  SiRNA target sequence
cgcattcttctataagatttggaata

SEQ ID NO: 167657 - DNA, 26 bp, Artificial sequence
  SiRNA target sequence
gcattcttctataagatttggaataa

SEQ ID NO: 167658 - DNA, 26 bp, Artificial sequence
  SiRNA target sequence
cattcttctataagatttggaataaa

SEQ ID NO: 167659 - DNA, 26 bp, Artificial sequence
  SiRNA target sequence
attcttctataagatttggaataaat

SEQ ID NO: 167660 - DNA, 26 bp, Artificial sequence
  SiRNA target sequence
ttcttctataagatttggaataaata

SEQ ID NO: 167661 - DNA, 26 bp, Artificial sequence
  SiRNA target sequence
tcttctataagatttggaataaataa

SEQ ID NO: 167662 - DNA, 26 bp, Artificial sequence
  SiRNA target sequence
cttctataagatttggaataaataag

SEQ ID NO: 167663 - DNA, 26 bp, Artificial sequence
  SiRNA target sequence
ttctataagatttggaataaataagt

SEQ ID NO: 167664 - DNA, 26 bp, Artificial sequence
  SiRNA target sequence
tctataagatttggaataaataagtt

SEQ ID NO: 167665 - DNA, 26 bp, Artificial sequence
  SiRNA target sequence
ctataagatttggaataaataagttt

SEQ ID NO: 167666 - DNA, 26 bp, Artificial sequence
  SiRNA target sequence
tataagatttggaataaataagttta

SEQ ID NO: 167667 - DNA, 26 bp, Artificial sequence
  SiRNA target sequence
ataagatttggaataaataagtttac

SEQ ID NO: 167668 - DNA, 26 bp, Artificial sequence
  SiRNA target sequence
taagatttggaataaataagtttaca

SEQ ID NO: 167669 - DNA, 26 bp, Artificial sequence
  SiRNA target sequence
aagatttggaataaataagtttacaa

SEQ ID NO: 167670 - DNA, 26 bp, Artificial sequence
  SiRNA target sequence
agatttggaataaataagtttacaac

SEQ ID NO: 167671 - DNA, 26 bp, Artificial sequence
  SiRNA target sequence
gatttggaataaataagtttacaact

SEQ ID NO: 167672 - DNA, 26 bp, Artificial sequence
  SiRNA target sequence
atttggaataaataagtttacaactg

SEQ ID NO: 167673 - DNA, 26 bp, Artificial sequence
  SiRNA target sequence
tttggaataaataagtttacaactga

SEQ ID NO: 167674 - DNA, 26 bp, Artificial sequence
  SiRNA target sequence
ttggaataaataagtttacaactgaa

SEQ ID NO: 167675 - DNA, 26 bp, Artificial sequence
  SiRNA target sequence
tggaataaataagtttacaactgaag

SEQ ID NO: 167676 - DNA, 26 bp, Artificial sequence
  SiRNA target sequence
ggaataaataagtttacaactgaaga

SEQ ID NO: 167677 - DNA, 26 bp, Artificial sequence
  SiRNA target sequence
gaataaataagtttacaactgaagaa

SEQ ID NO: 167678 - DNA, 26 bp, Artificial sequence
  SiRNA target sequence
aataaataagtttacaactgaagaag

SEQ ID NO: 167679 - DNA, 26 bp, Artificial sequence
  SiRNA target sequence
ataaataagtttacaactgaagaaga

SEQ ID NO: 167680 - DNA, 26 bp, Artificial sequence
  SiRNA target sequence
taaataagtttacaactgaagaagaa

SEQ ID NO: 167681 - DNA, 26 bp, Artificial sequence
  SiRNA target sequence
aaataagtttacaactgaagaagaaa

SEQ ID NO: 167682 - DNA, 26 bp, Artificial sequence
  SiRNA target sequence
aataagtttacaactgaagaagaaat

SEQ ID NO: 167683 - DNA, 26 bp, Artificial sequence
  SiRNA target sequence
ataagtttacaactgaagaagaaatc

SEQ ID NO: 167684 - DNA, 26 bp, Artificial sequence
  SiRNA target sequence
taagtttacaactgaagaagaaatca

SEQ ID NO: 167685 - DNA, 26 bp, Artificial sequence
  SiRNA target sequence
aagtttacaactgaagaagaaatcaa

SEQ ID NO: 167686 - DNA, 26 bp, Artificial sequence
  SiRNA target sequence
agtttacaactgaagaagaaatcaat

SEQ ID NO: 167687 - DNA, 26 bp, Artificial sequence
  SiRNA target sequence
gtttacaactgaagaagaaatcaata

SEQ ID NO: 167688 - DNA, 26 bp, Artificial sequence
  SiRNA target sequence
tttacaactgaagaagaaatcaataa

SEQ ID NO: 167689 - DNA, 26 bp, Artificial sequence
  SiRNA target sequence
ttacaactgaagaagaaatcaataaa

SEQ ID NO: 167690 - DNA, 26 bp, Artificial sequence
  SiRNA target sequence
tacaactgaagaagaaatcaataaag

SEQ ID NO: 167691 - DNA, 26 bp, Artificial sequence
  SiRNA target sequence
acaactgaagaagaaatcaataaagt

SEQ ID NO: 167692 - DNA, 26 bp, Artificial sequence
  SiRNA target sequence
caactgaagaagaaatcaataaagta

SEQ ID NO: 167693 - DNA, 26 bp, Artificial sequence
  SiRNA target sequence
aactgaagaagaaatcaataaagtat

SEQ ID NO: 167694 - DNA, 26 bp, Artificial sequence
  SiRNA target sequence
actgaagaagaaatcaataaagtatc

SEQ ID NO: 167695 - DNA, 26 bp, Artificial sequence
  SiRNA target sequence
ctgaagaagaaatcaataaagtatct

SEQ ID NO: 167696 - DNA, 26 bp, Artificial sequence
  SiRNA target sequence
tgaagaagaaatcaataaagtatcta

SEQ ID NO: 167697 - DNA, 26 bp, Artificial sequence
  SiRNA target sequence
gaagaagaaatcaataaagtatctag

SEQ ID NO: 167698 - DNA, 26 bp, Artificial sequence
  SiRNA target sequence
aagaagaaatcaataaagtatctagt

SEQ ID NO: 167699 - DNA, 26 bp, Artificial sequence
  SiRNA target sequence
agaagaaatcaataaagtatctagtg

SEQ ID NO: 167700 - DNA, 26 bp, Artificial sequence
  SiRNA target sequence
gaagaaatcaataaagtatctagtga

SEQ ID NO: 167701 - DNA, 26 bp, Artificial sequence
  SiRNA target sequence
aagaaatcaataaagtatctagtgat

SEQ ID NO: 167702 - DNA, 26 bp, Artificial sequence
  SiRNA target sequence
agaaatcaataaagtatctagtgata

SEQ ID NO: 167703 - DNA, 26 bp, Artificial sequence
  SiRNA target sequence
gaaatcaataaagtatctagtgatac

SEQ ID NO: 167704 - DNA, 26 bp, Artificial sequence
  SiRNA target sequence
aaatcaataaagtatctagtgataca

SEQ ID NO: 167705 - DNA, 26 bp, Artificial sequence
  SiRNA target sequence
aatcaataaagtatctagtgatacaa

SEQ ID NO: 167706 - DNA, 26 bp, Artificial sequence
  SiRNA target sequence
atcaataaagtatctagtgatacaat

SEQ ID NO: 167707 - DNA, 26 bp, Artificial sequence
  SiRNA target sequence
tcaataaagtatctagtgatacaatt

SEQ ID NO: 167708 - DNA, 26 bp, Artificial sequence
  SiRNA target sequence
caataaagtatctagtgatacaatta

SEQ ID NO: 167709 - DNA, 26 bp, Artificial sequence
  SiRNA target sequence
aataaagtatctagtgatacaattaa

SEQ ID NO: 167710 - DNA, 26 bp, Artificial sequence
  SiRNA target sequence
ataaagtatctagtgatacaattaaa

SEQ ID NO: 167711 - DNA, 26 bp, Artificial sequence
  SiRNA target sequence
taaagtatctagtgatacaattaaag

SEQ ID NO: 167712 - DNA, 26 bp, Artificial sequence
  SiRNA target sequence
aaagtatctagtgatacaattaaagc

SEQ ID NO: 167713 - DNA, 26 bp, Artificial sequence
  SiRNA target sequence
aagtatctagtgatacaattaaagct

SEQ ID NO: 167714 - DNA, 26 bp, Artificial sequence
  SiRNA target sequence
agtatctagtgatacaattaaagctg

SEQ ID NO: 167715 - DNA, 26 bp, Artificial sequence
  SiRNA target sequence
gtatctagtgatacaattaaagctgt

SEQ ID NO: 167716 - DNA, 26 bp, Artificial sequence
  SiRNA target sequence
tatctagtgatacaattaaagctgtt

SEQ ID NO: 167717 - DNA, 26 bp, Artificial sequence
  SiRNA target sequence
atctagtgatacaattaaagctgtta

SEQ ID NO: 167718 - DNA, 26 bp, Artificial sequence
  SiRNA target sequence
tctagtgatacaattaaagctgttaa

SEQ ID NO: 167719 - DNA, 26 bp, Artificial sequence
  SiRNA target sequence
ctagtgatacaattaaagctgttaat

SEQ ID NO: 167720 - DNA, 26 bp, Artificial sequence
  SiRNA target sequence
tagtgatacaattaaagctgttaata

SEQ ID NO: 167721 - DNA, 26 bp, Artificial sequence
  SiRNA target sequence
agtgatacaattaaagctgttaataa

SEQ ID NO: 167722 - DNA, 26 bp, Artificial sequence
  SiRNA target sequence
gtgatacaattaaagctgttaataag

SEQ ID NO: 167723 - DNA, 26 bp, Artificial sequence
  SiRNA target sequence
tgatacaattaaagctgttaataagt

SEQ ID NO: 167724 - DNA, 26 bp, Artificial sequence
  SiRNA target sequence
gatacaattaaagctgttaataagtt

SEQ ID NO: 167725 - DNA, 26 bp, Artificial sequence
  SiRNA target sequence
atacaattaaagctgttaataagtta

SEQ ID NO: 167726 - DNA, 26 bp, Artificial sequence
  SiRNA target sequence
tacaattaaagctgttaataagttaa

SEQ ID NO: 167727 - DNA, 26 bp, Artificial sequence
  SiRNA target sequence
acaattaaagctgttaataagttaag

SEQ ID NO: 167728 - DNA, 26 bp, Artificial sequence
  SiRNA target sequence
caattaaagctgttaataagttaaga

SEQ ID NO: 167729 - DNA, 26 bp, Artificial sequence
  SiRNA target sequence
aattaaagctgttaataagttaagag

SEQ ID NO: 167730 - DNA, 26 bp, Artificial sequence
  SiRNA target sequence
attaaagctgttaataagttaagaga

SEQ ID NO: 167731 - DNA, 26 bp, Artificial sequence
  SiRNA target sequence
ttaaagctgttaataagttaagagat

SEQ ID NO: 167732 - DNA, 26 bp, Artificial sequence
  SiRNA target sequence
taaagctgttaataagttaagagata

SEQ ID NO: 167733 - DNA, 26 bp, Artificial sequence
  SiRNA target sequence
aaagctgttaataagttaagagatat

SEQ ID NO: 167734 - DNA, 26 bp, Artificial sequence
  SiRNA target sequence
aagctgttaataagttaagagatatg

SEQ ID NO: 167735 - DNA, 26 bp, Artificial sequence
  SiRNA target sequence
agctgttaataagttaagagatatgt

SEQ ID NO: 167736 - DNA, 26 bp, Artificial sequence
  SiRNA target sequence
gctgttaataagttaagagatatgtc

SEQ ID NO: 167737 - DNA, 26 bp, Artificial sequence
  SiRNA target sequence
ctgttaataagttaagagatatgtct

SEQ ID NO: 167738 - DNA, 26 bp, Artificial sequence
  SiRNA target sequence
tgttaataagttaagagatatgtctc

SEQ ID NO: 167739 - DNA, 26 bp, Artificial sequence
  SiRNA target sequence
gttaataagttaagagatatgtctcc

SEQ ID NO: 167740 - DNA, 26 bp, Artificial sequence
  SiRNA target sequence
ttaataagttaagagatatgtctcct

SEQ ID NO: 167741 - DNA, 26 bp, Artificial sequence
  SiRNA target sequence
taataagttaagagatatgtctcctt

SEQ ID NO: 167742 - DNA, 26 bp, Artificial sequence
  SiRNA target sequence
aataagttaagagatatgtctccttt

SEQ ID NO: 167743 - DNA, 26 bp, Artificial sequence
  SiRNA target sequence
ataagttaagagatatgtctccttta

SEQ ID NO: 167744 - DNA, 26 bp, Artificial sequence
  SiRNA target sequence
taagttaagagatatgtctcctttat

SEQ ID NO: 167745 - DNA, 26 bp, Artificial sequence
  SiRNA target sequence
aagttaagagatatgtctcctttata

SEQ ID NO: 167746 - DNA, 26 bp, Artificial sequence
  SiRNA target sequence
agttaagagatatgtctcctttatat

SEQ ID NO: 167747 - DNA, 26 bp, Artificial sequence
  SiRNA target sequence
gttaagagatatgtctcctttatatg

SEQ ID NO: 167748 - DNA, 26 bp, Artificial sequence
  SiRNA target sequence
ttaagagatatgtctcctttatatga

SEQ ID NO: 167749 - DNA, 26 bp, Artificial sequence
  SiRNA target sequence
taagagatatgtctcctttatatgaa

SEQ ID NO: 167750 - DNA, 26 bp, Artificial sequence
  SiRNA target sequence
aagagatatgtctcctttatatgaaa

SEQ ID NO: 167751 - DNA, 26 bp, Artificial sequence
  SiRNA target sequence
agagatatgtctcctttatatgaaat

SEQ ID NO: 167752 - DNA, 26 bp, Artificial sequence
  SiRNA target sequence
gagatatgtctcctttatatgaaatg

SEQ ID NO: 167753 - DNA, 26 bp, Artificial sequence
  SiRNA target sequence
agatatgtctcctttatatgaaatgg

SEQ ID NO: 167754 - DNA, 26 bp, Artificial sequence
  SiRNA target sequence
gatatgtctcctttatatgaaatggt

SEQ ID NO: 167755 - DNA, 26 bp, Artificial sequence
  SiRNA target sequence
atatgtctcctttatatgaaatggtc

SEQ ID NO: 167756 - DNA, 26 bp, Artificial sequence
  SiRNA target sequence
tatgtctcctttatatgaaatggtca

SEQ ID NO: 167757 - DNA, 26 bp, Artificial sequence
  SiRNA target sequence
atgtctcctttatatgaaatggtcaa

SEQ ID NO: 167758 - DNA, 26 bp, Artificial sequence
  SiRNA target sequence
tgtctcctttatatgaaatggtcaaa

SEQ ID NO: 167759 - DNA, 26 bp, Artificial sequence
  SiRNA target sequence
gtctcctttatatgaaatggtcaaag

SEQ ID NO: 167760 - DNA, 26 bp, Artificial sequence
  SiRNA target sequence
tctcctttatatgaaatggtcaaaga

SEQ ID NO: 167761 - DNA, 26 bp, Artificial sequence
  SiRNA target sequence
ctcctttatatgaaatggtcaaagaa

SEQ ID NO: 167762 - DNA, 26 bp, Artificial sequence
  SiRNA target sequence
tcctttatatgaaatggtcaaagaag

SEQ ID NO: 167763 - DNA, 26 bp, Artificial sequence
  SiRNA target sequence
cctttatatgaaatggtcaaagaagg

SEQ ID NO: 167764 - DNA, 26 bp, Artificial sequence
  SiRNA target sequence
ctttatatgaaatggtcaaagaaggg

SEQ ID NO: 167765 - DNA, 26 bp, Artificial sequence
  SiRNA target sequence
tttatatgaaatggtcaaagaaggga

SEQ ID NO: 167766 - DNA, 26 bp, Artificial sequence
  SiRNA target sequence
ttatatgaaatggtcaaagaagggat

SEQ ID NO: 167767 - DNA, 26 bp, Artificial sequence
  SiRNA target sequence
tatatgaaatggtcaaagaagggata

SEQ ID NO: 167768 - DNA, 26 bp, Artificial sequence
  SiRNA target sequence
atatgaaatggtcaaagaagggatag

SEQ ID NO: 167769 - DNA, 26 bp, Artificial sequence
  SiRNA target sequence
tatgaaatggtcaaagaagggataga

SEQ ID NO: 167770 - DNA, 26 bp, Artificial sequence
  SiRNA target sequence
atgaaatggtcaaagaagggatagat

SEQ ID NO: 167771 - DNA, 26 bp, Artificial sequence
  SiRNA target sequence
tgaaatggtcaaagaagggatagatt

SEQ ID NO: 167772 - DNA, 26 bp, Artificial sequence
  SiRNA target sequence
gaaatggtcaaagaagggatagattt

SEQ ID NO: 167773 - DNA, 26 bp, Artificial sequence
  SiRNA target sequence
aaatggtcaaagaagggatagattta

SEQ ID NO: 167774 - DNA, 26 bp, Artificial sequence
  SiRNA target sequence
aatggtcaaagaagggatagatttag

SEQ ID NO: 167775 - DNA, 26 bp, Artificial sequence
  SiRNA target sequence
atggtcaaagaagggatagatttaga

SEQ ID NO: 167776 - DNA, 26 bp, Artificial sequence
  SiRNA target sequence
tggtcaaagaagggatagatttagat

SEQ ID NO: 167777 - DNA, 26 bp, Artificial sequence
  SiRNA target sequence
ggtcaaagaagggatagatttagata

SEQ ID NO: 167778 - DNA, 26 bp, Artificial sequence
  SiRNA target sequence
gtcaaagaagggatagatttagataa

SEQ ID NO: 167779 - DNA, 26 bp, Artificial sequence
  SiRNA target sequence
tcaaagaagggatagatttagataaa

SEQ ID NO: 167780 - DNA, 26 bp, Artificial sequence
  SiRNA target sequence
caaagaagggatagatttagataaaa

SEQ ID NO: 167781 - DNA, 26 bp, Artificial sequence
  SiRNA target sequence
aaagaagggatagatttagataaaat

SEQ ID NO: 167782 - DNA, 26 bp, Artificial sequence
  SiRNA target sequence
aagaagggatagatttagataaaatt

SEQ ID NO: 167783 - DNA, 26 bp, Artificial sequence
  SiRNA target sequence
agaagggatagatttagataaaatta

SEQ ID NO: 167784 - DNA, 26 bp, Artificial sequence
  SiRNA target sequence
gaagggatagatttagataaaattaa

SEQ ID NO: 167785 - DNA, 26 bp, Artificial sequence
  SiRNA target sequence
aagggatagatttagataaaattaat

SEQ ID NO: 167786 - DNA, 26 bp, Artificial sequence
  SiRNA target sequence
agggatagatttagataaaattaatt

SEQ ID NO: 167787 - DNA, 26 bp, Artificial sequence
  SiRNA target sequence
gggatagatttagataaaattaattg

SEQ ID NO: 167788 - DNA, 26 bp, Artificial sequence
  SiRNA target sequence
ggatagatttagataaaattaattgg

SEQ ID NO: 167789 - DNA, 26 bp, Artificial sequence
  SiRNA target sequence
gatagatttagataaaattaattggt

SEQ ID NO: 167790 - DNA, 26 bp, Artificial sequence
  SiRNA target sequence
atagatttagataaaattaattggtc

SEQ ID NO: 167791 - DNA, 26 bp, Artificial sequence
  SiRNA target sequence
tagatttagataaaattaattggtct

SEQ ID NO: 167792 - DNA, 26 bp, Artificial sequence
  SiRNA target sequence
agatttagataaaattaattggtctg

SEQ ID NO: 167793 - DNA, 26 bp, Artificial sequence
  SiRNA target sequence
gatttagataaaattaattggtctgc

SEQ ID NO: 167794 - DNA, 26 bp, Artificial sequence
  SiRNA target sequence
atttagataaaattaattggtctgct

SEQ ID NO: 167795 - DNA, 26 bp, Artificial sequence
  SiRNA target sequence
tttagataaaattaattggtctgctt

SEQ ID NO: 167796 - DNA, 26 bp, Artificial sequence
  SiRNA target sequence
ttagataaaattaattggtctgctta

SEQ ID NO: 167797 - DNA, 26 bp, Artificial sequence
  SiRNA target sequence
tagataaaattaattggtctgcttaa

SEQ ID NO: 167798 - DNA, 27 bp, Artificial sequence
  SiRNA target sequence
atgttatttttttatagccccattttt

SEQ ID NO: 167799 - DNA, 27 bp, Artificial sequence
  SiRNA target sequence
tgttatttttttatagccccattttta

SEQ ID NO: 167800 - DNA, 27 bp, Artificial sequence
  SiRNA target sequence
gttatttttttatagccccatttttat

SEQ ID NO: 167801 - DNA, 27 bp, Artificial sequence
  SiRNA target sequence
ttatttttttatagccccatttttatg

SEQ ID NO: 167802 - DNA, 27 bp, Artificial sequence
  SiRNA target sequence
tatttttttatagccccatttttatga

SEQ ID NO: 167803 - DNA, 27 bp, Artificial sequence
  SiRNA target sequence
atttttttatagccccatttttatgac

SEQ ID NO: 167804 - DNA, 27 bp, Artificial sequence
  SiRNA target sequence
tttttttatagccccatttttatgact

SEQ ID NO: 167805 - DNA, 27 bp, Artificial sequence
  SiRNA target sequence
ttttttatagccccatttttatgacta

SEQ ID NO: 167806 - DNA, 27 bp, Artificial sequence
  SiRNA target sequence
tttttatagccccatttttatgactaa

SEQ ID NO: 167807 - DNA, 27 bp, Artificial sequence
  SiRNA target sequence
ttttatagccccatttttatgactaaa

SEQ ID NO: 167808 - DNA, 27 bp, Artificial sequence
  SiRNA target sequence
tttatagccccatttttatgactaaaa

SEQ ID NO: 167809 - DNA, 27 bp, Artificial sequence
  SiRNA target sequence
ttatagccccatttttatgactaaaag

SEQ ID NO: 167810 - DNA, 27 bp, Artificial sequence
  SiRNA target sequence
tatagccccatttttatgactaaaagt

SEQ ID NO: 167811 - DNA, 27 bp, Artificial sequence
  SiRNA target sequence
atagccccatttttatgactaaaagtt

SEQ ID NO: 167812 - DNA, 27 bp, Artificial sequence
  SiRNA target sequence
tagccccatttttatgactaaaagttt

SEQ ID NO: 167813 - DNA, 27 bp, Artificial sequence
  SiRNA target sequence
agccccatttttatgactaaaagttta

SEQ ID NO: 167814 - DNA, 27 bp, Artificial sequence
  SiRNA target sequence
gccccatttttatgactaaaagtttaa

SEQ ID NO: 167815 - DNA, 27 bp, Artificial sequence
  SiRNA target sequence
ccccatttttatgactaaaagtttaac

SEQ ID NO: 167816 - DNA, 27 bp, Artificial sequence
  SiRNA target sequence
cccatttttatgactaaaagtttaacg

SEQ ID NO: 167817 - DNA, 27 bp, Artificial sequence
  SiRNA target sequence
ccatttttatgactaaaagtttaacga

SEQ ID NO: 167818 - DNA, 27 bp, Artificial sequence
  SiRNA target sequence
catttttatgactaaaagtttaacgaa

SEQ ID NO: 167819 - DNA, 27 bp, Artificial sequence
  SiRNA target sequence
atttttatgactaaaagtttaacgaat

SEQ ID NO: 167820 - DNA, 27 bp, Artificial sequence
  SiRNA target sequence
tttttatgactaaaagtttaacgaatt

SEQ ID NO: 167821 - DNA, 27 bp, Artificial sequence
  SiRNA target sequence
ttttatgactaaaagtttaacgaattc

SEQ ID NO: 167822 - DNA, 27 bp, Artificial sequence
  SiRNA target sequence
tttatgactaaaagtttaacgaattct

SEQ ID NO: 167823 - DNA, 27 bp, Artificial sequence
  SiRNA target sequence
ttatgactaaaagtttaacgaattcta

SEQ ID NO: 167824 - DNA, 27 bp, Artificial sequence
  SiRNA target sequence
tatgactaaaagtttaacgaattctaa

SEQ ID NO: 167825 - DNA, 27 bp, Artificial sequence
  SiRNA target sequence
atgactaaaagtttaacgaattctaaa

SEQ ID NO: 167826 - DNA, 27 bp, Artificial sequence
  SiRNA target sequence
tgactaaaagtttaacgaattctaaaa

SEQ ID NO: 167827 - DNA, 27 bp, Artificial sequence
  SiRNA target sequence
gactaaaagtttaacgaattctaaaac

SEQ ID NO: 167828 - DNA, 27 bp, Artificial sequence
  SiRNA target sequence
actaaaagtttaacgaattctaaaact

SEQ ID NO: 167829 - DNA, 27 bp, Artificial sequence
  SiRNA target sequence
ctaaaagtttaacgaattctaaaactt

SEQ ID NO: 167830 - DNA, 27 bp, Artificial sequence
  SiRNA target sequence
taaaagtttaacgaattctaaaacttt

SEQ ID NO: 167831 - DNA, 27 bp, Artificial sequence
  SiRNA target sequence
aaaagtttaacgaattctaaaacttta

SEQ ID NO: 167832 - DNA, 27 bp, Artificial sequence
  SiRNA target sequence
aaagtttaacgaattctaaaactttaa

SEQ ID NO: 167833 - DNA, 27 bp, Artificial sequence
  SiRNA target sequence
aagtttaacgaattctaaaactttaaa

SEQ ID NO: 167834 - DNA, 27 bp, Artificial sequence
  SiRNA target sequence
agtttaacgaattctaaaactttaaat

SEQ ID NO: 167835 - DNA, 27 bp, Artificial sequence
  SiRNA target sequence
gtttaacgaattctaaaactttaaatt

SEQ ID NO: 167836 - DNA, 27 bp, Artificial sequence
  SiRNA target sequence
tttaacgaattctaaaactttaaattt

SEQ ID NO: 167837 - DNA, 27 bp, Artificial sequence
  SiRNA target sequence
ttaacgaattctaaaactttaaattta

SEQ ID NO: 167838 - DNA, 27 bp, Artificial sequence
  SiRNA target sequence
taacgaattctaaaactttaaatttaa

SEQ ID NO: 167839 - DNA, 27 bp, Artificial sequence
  SiRNA target sequence
aacgaattctaaaactttaaatttaat

SEQ ID NO: 167840 - DNA, 27 bp, Artificial sequence
  SiRNA target sequence
acgaattctaaaactttaaatttaatg

SEQ ID NO: 167841 - DNA, 27 bp, Artificial sequence
  SiRNA target sequence
cgaattctaaaactttaaatttaatgt

SEQ ID NO: 167842 - DNA, 27 bp, Artificial sequence
  SiRNA target sequence
gaattctaaaactttaaatttaatgtc

SEQ ID NO: 167843 - DNA, 27 bp, Artificial sequence
  SiRNA target sequence
aattctaaaactttaaatttaatgtca

SEQ ID NO: 167844 - DNA, 27 bp, Artificial sequence
  SiRNA target sequence
attctaaaactttaaatttaatgtcaa

SEQ ID NO: 167845 - DNA, 27 bp, Artificial sequence
  SiRNA target sequence
ttctaaaactttaaatttaatgtcaag

SEQ ID NO: 167846 - DNA, 27 bp, Artificial sequence
  SiRNA target sequence
tctaaaactttaaatttaatgtcaagt

SEQ ID NO: 167847 - DNA, 27 bp, Artificial sequence
  SiRNA target sequence
ctaaaactttaaatttaatgtcaagtg

SEQ ID NO: 167848 - DNA, 27 bp, Artificial sequence
  SiRNA target sequence
taaaactttaaatttaatgtcaagtgt

SEQ ID NO: 167849 - DNA, 27 bp, Artificial sequence
  SiRNA target sequence
aaaactttaaatttaatgtcaagtgta

SEQ ID NO: 167850 - DNA, 27 bp, Artificial sequence
  SiRNA target sequence
aaactttaaatttaatgtcaagtgtac

SEQ ID NO: 167851 - DNA, 27 bp, Artificial sequence
  SiRNA target sequence
aactttaaatttaatgtcaagtgtaca

SEQ ID NO: 167852 - DNA, 27 bp, Artificial sequence
  SiRNA target sequence
actttaaatttaatgtcaagtgtacaa

SEQ ID NO: 167853 - DNA, 27 bp, Artificial sequence
  SiRNA target sequence
ctttaaatttaatgtcaagtgtacaat

SEQ ID NO: 167854 - DNA, 27 bp, Artificial sequence
  SiRNA target sequence
tttaaatttaatgtcaagtgtacaatc

SEQ ID NO: 167855 - DNA, 27 bp, Artificial sequence
  SiRNA target sequence
ttaaatttaatgtcaagtgtacaatca

SEQ ID NO: 167856 - DNA, 27 bp, Artificial sequence
  SiRNA target sequence
taaatttaatgtcaagtgtacaatcac

SEQ ID NO: 167857 - DNA, 27 bp, Artificial sequence
  SiRNA target sequence
aaatttaatgtcaagtgtacaatcacc

SEQ ID NO: 167858 - DNA, 27 bp, Artificial sequence
  SiRNA target sequence
aatttaatgtcaagtgtacaatcacca

SEQ ID NO: 167859 - DNA, 27 bp, Artificial sequence
  SiRNA target sequence
atttaatgtcaagtgtacaatcaccag

SEQ ID NO: 167860 - DNA, 27 bp, Artificial sequence
  SiRNA target sequence
tttaatgtcaagtgtacaatcaccagt

SEQ ID NO: 167861 - DNA, 27 bp, Artificial sequence
  SiRNA target sequence
ttaatgtcaagtgtacaatcaccagtt

SEQ ID NO: 167862 - DNA, 27 bp, Artificial sequence
  SiRNA target sequence
taatgtcaagtgtacaatcaccagtta

SEQ ID NO: 167863 - DNA, 27 bp, Artificial sequence
  SiRNA target sequence
aatgtcaagtgtacaatcaccagttat

SEQ ID NO: 167864 - DNA, 27 bp, Artificial sequence
  SiRNA target sequence
atgtcaagtgtacaatcaccagttata

SEQ ID NO: 167865 - DNA, 27 bp, Artificial sequence
  SiRNA target sequence
tgtcaagtgtacaatcaccagttataa

SEQ ID NO: 167866 - DNA, 27 bp, Artificial sequence
  SiRNA target sequence
gtcaagtgtacaatcaccagttataaa

SEQ ID NO: 167867 - DNA, 27 bp, Artificial sequence
  SiRNA target sequence
tcaagtgtacaatcaccagttataaat

SEQ ID NO: 167868 - DNA, 27 bp, Artificial sequence
  SiRNA target sequence
caagtgtacaatcaccagttataaata

SEQ ID NO: 167869 - DNA, 27 bp, Artificial sequence
  SiRNA target sequence
aagtgtacaatcaccagttataaatac

SEQ ID NO: 167870 - DNA, 27 bp, Artificial sequence
  SiRNA target sequence
agtgtacaatcaccagttataaataca

SEQ ID NO: 167871 - DNA, 27 bp, Artificial sequence
  SiRNA target sequence
gtgtacaatcaccagttataaatacaa

SEQ ID NO: 167872 - DNA, 27 bp, Artificial sequence
  SiRNA target sequence
tgtacaatcaccagttataaatacaaa

SEQ ID NO: 167873 - DNA, 27 bp, Artificial sequence
  SiRNA target sequence
gtacaatcaccagttataaatacaaaa

SEQ ID NO: 167874 - DNA, 27 bp, Artificial sequence
  SiRNA target sequence
tacaatcaccagttataaatacaaaaa

SEQ ID NO: 167875 - DNA, 27 bp, Artificial sequence
  SiRNA target sequence
acaatcaccagttataaatacaaaaaa

SEQ ID NO: 167876 - DNA, 27 bp, Artificial sequence
  SiRNA target sequence
caatcaccagttataaatacaaaaaaa

SEQ ID NO: 167877 - DNA, 27 bp, Artificial sequence
  SiRNA target sequence
aatcaccagttataaatacaaaaaaaa

SEQ ID NO: 167878 - DNA, 27 bp, Artificial sequence
  SiRNA target sequence
atcaccagttataaatacaaaaaaaat

SEQ ID NO: 167879 - DNA, 27 bp, Artificial sequence
  SiRNA target sequence
tcaccagttataaatacaaaaaaaata

SEQ ID NO: 167880 - DNA, 27 bp, Artificial sequence
  SiRNA target sequence
caccagttataaatacaaaaaaaatat

SEQ ID NO: 167881 - DNA, 27 bp, Artificial sequence
  SiRNA target sequence
accagttataaatacaaaaaaaatata

SEQ ID NO: 167882 - DNA, 27 bp, Artificial sequence
  SiRNA target sequence
ccagttataaatacaaaaaaaatatat

SEQ ID NO: 167883 - DNA, 27 bp, Artificial sequence
  SiRNA target sequence
cagttataaatacaaaaaaaatatatc

SEQ ID NO: 167884 - DNA, 27 bp, Artificial sequence
  SiRNA target sequence
agttataaatacaaaaaaaatatatct

SEQ ID NO: 167885 - DNA, 27 bp, Artificial sequence
  SiRNA target sequence
gttataaatacaaaaaaaatatatctt

SEQ ID NO: 167886 - DNA, 27 bp, Artificial sequence
  SiRNA target sequence
ttataaatacaaaaaaaatatatcttg

SEQ ID NO: 167887 - DNA, 27 bp, Artificial sequence
  SiRNA target sequence
tataaatacaaaaaaaatatatcttga

SEQ ID NO: 167888 - DNA, 27 bp, Artificial sequence
  SiRNA target sequence
ataaatacaaaaaaaatatatcttgat

SEQ ID NO: 167889 - DNA, 27 bp, Artificial sequence
  SiRNA target sequence
taaatacaaaaaaaatatatcttgatg

SEQ ID NO: 167890 - DNA, 27 bp, Artificial sequence
  SiRNA target sequence
aaatacaaaaaaaatatatcttgatgc

SEQ ID NO: 167891 - DNA, 27 bp, Artificial sequence
  SiRNA target sequence
aatacaaaaaaaatatatcttgatgca

SEQ ID NO: 167892 - DNA, 27 bp, Artificial sequence
  SiRNA target sequence
atacaaaaaaaatatatcttgatgcac

SEQ ID NO: 167893 - DNA, 27 bp, Artificial sequence
  SiRNA target sequence
tacaaaaaaaatatatcttgatgcaca

SEQ ID NO: 167894 - DNA, 27 bp, Artificial sequence
  SiRNA target sequence
acaaaaaaaatatatcttgatgcacaa

SEQ ID NO: 167895 - DNA, 27 bp, Artificial sequence
  SiRNA target sequence
caaaaaaaatatatcttgatgcacaag

SEQ ID NO: 167896 - DNA, 27 bp, Artificial sequence
  SiRNA target sequence
aaaaaaaatatatcttgatgcacaagc

SEQ ID NO: 167897 - DNA, 27 bp, Artificial sequence
  SiRNA target sequence
aaaaaaatatatcttgatgcacaagcg

SEQ ID NO: 167898 - DNA, 27 bp, Artificial sequence
  SiRNA target sequence
aaaaaatatatcttgatgcacaagcga

SEQ ID NO: 167899 - DNA, 27 bp, Artificial sequence
  SiRNA target sequence
aaaaatatatcttgatgcacaagcgac

SEQ ID NO: 167900 - DNA, 27 bp, Artificial sequence
  SiRNA target sequence
aaaatatatcttgatgcacaagcgacc

SEQ ID NO: 167901 - DNA, 27 bp, Artificial sequence
  SiRNA target sequence
aaatatatcttgatgcacaagcgacca

SEQ ID NO: 167902 - DNA, 27 bp, Artificial sequence
  SiRNA target sequence
aatatatcttgatgcacaagcgaccaa

SEQ ID NO: 167903 - DNA, 27 bp, Artificial sequence
  SiRNA target sequence
atatatcttgatgcacaagcgaccaag

SEQ ID NO: 167904 - DNA, 27 bp, Artificial sequence
  SiRNA target sequence
tatatcttgatgcacaagcgaccaagc

SEQ ID NO: 167905 - DNA, 27 bp, Artificial sequence
  SiRNA target sequence
atatcttgatgcacaagcgaccaagcc

SEQ ID NO: 167906 - DNA, 27 bp, Artificial sequence
  SiRNA target sequence
tatcttgatgcacaagcgaccaagcct

SEQ ID NO: 167907 - DNA, 27 bp, Artificial sequence
  SiRNA target sequence
atcttgatgcacaagcgaccaagcctt

SEQ ID NO: 167908 - DNA, 27 bp, Artificial sequence
  SiRNA target sequence
tcttgatgcacaagcgaccaagccttt

SEQ ID NO: 167909 - DNA, 27 bp, Artificial sequence
  SiRNA target sequence
cttgatgcacaagcgaccaagccttta

SEQ ID NO: 167910 - DNA, 27 bp, Artificial sequence
  SiRNA target sequence
ttgatgcacaagcgaccaagcctttag

SEQ ID NO: 167911 - DNA, 27 bp, Artificial sequence
  SiRNA target sequence
tgatgcacaagcgaccaagcctttaga

SEQ ID NO: 167912 - DNA, 27 bp, Artificial sequence
  SiRNA target sequence
gatgcacaagcgaccaagcctttagac

SEQ ID NO: 167913 - DNA, 27 bp, Artificial sequence
  SiRNA target sequence
atgcacaagcgaccaagcctttagacc

SEQ ID NO: 167914 - DNA, 27 bp, Artificial sequence
  SiRNA target sequence
tgcacaagcgaccaagcctttagaccc

SEQ ID NO: 167915 - DNA, 27 bp, Artificial sequence
  SiRNA target sequence
gcacaagcgaccaagcctttagacccg

SEQ ID NO: 167916 - DNA, 27 bp, Artificial sequence
  SiRNA target sequence
cacaagcgaccaagcctttagacccgc

SEQ ID NO: 167917 - DNA, 27 bp, Artificial sequence
  SiRNA target sequence
acaagcgaccaagcctttagacccgcg

SEQ ID NO: 167918 - DNA, 27 bp, Artificial sequence
  SiRNA target sequence
caagcgaccaagcctttagacccgcgt

SEQ ID NO: 167919 - DNA, 27 bp, Artificial sequence
  SiRNA target sequence
aagcgaccaagcctttagacccgcgtg

SEQ ID NO: 167920 - DNA, 27 bp, Artificial sequence
  SiRNA target sequence
agcgaccaagcctttagacccgcgtgt

SEQ ID NO: 167921 - DNA, 27 bp, Artificial sequence
  SiRNA target sequence
gcgaccaagcctttagacccgcgtgtg

SEQ ID NO: 167922 - DNA, 27 bp, Artificial sequence
  SiRNA target sequence
cgaccaagcctttagacccgcgtgtgc

SEQ ID NO: 167923 - DNA, 27 bp, Artificial sequence
  SiRNA target sequence
gaccaagcctttagacccgcgtgtgct

SEQ ID NO: 167924 - DNA, 27 bp, Artificial sequence
  SiRNA target sequence
accaagcctttagacccgcgtgtgctt

SEQ ID NO: 167925 - DNA, 27 bp, Artificial sequence
  SiRNA target sequence
ccaagcctttagacccgcgtgtgcttg

SEQ ID NO: 167926 - DNA, 27 bp, Artificial sequence
  SiRNA target sequence
caagcctttagacccgcgtgtgcttga

SEQ ID NO: 167927 - DNA, 27 bp, Artificial sequence
  SiRNA target sequence
aagcctttagacccgcgtgtgcttgat

SEQ ID NO: 167928 - DNA, 27 bp, Artificial sequence
  SiRNA target sequence
agcctttagacccgcgtgtgcttgatg

SEQ ID NO: 167929 - DNA, 27 bp, Artificial sequence
  SiRNA target sequence
gcctttagacccgcgtgtgcttgatgc

SEQ ID NO: 167930 - DNA, 27 bp, Artificial sequence
  SiRNA target sequence
cctttagacccgcgtgtgcttgatgca

SEQ ID NO: 167931 - DNA, 27 bp, Artificial sequence
  SiRNA target sequence
ctttagacccgcgtgtgcttgatgcaa

SEQ ID NO: 167932 - DNA, 27 bp, Artificial sequence
  SiRNA target sequence
tttagacccgcgtgtgcttgatgcaat

SEQ ID NO: 167933 - DNA, 27 bp, Artificial sequence
  SiRNA target sequence
ttagacccgcgtgtgcttgatgcaatg

SEQ ID NO: 167934 - DNA, 27 bp, Artificial sequence
  SiRNA target sequence
tagacccgcgtgtgcttgatgcaatgc

SEQ ID NO: 167935 - DNA, 27 bp, Artificial sequence
  SiRNA target sequence
agacccgcgtgtgcttgatgcaatgct

SEQ ID NO: 167936 - DNA, 27 bp, Artificial sequence
  SiRNA target sequence
gacccgcgtgtgcttgatgcaatgctt

SEQ ID NO: 167937 - DNA, 27 bp, Artificial sequence
  SiRNA target sequence
acccgcgtgtgcttgatgcaatgcttc

SEQ ID NO: 167938 - DNA, 27 bp, Artificial sequence
  SiRNA target sequence
cccgcgtgtgcttgatgcaatgcttcc

SEQ ID NO: 167939 - DNA, 27 bp, Artificial sequence
  SiRNA target sequence
ccgcgtgtgcttgatgcaatgcttcca

SEQ ID NO: 167940 - DNA, 27 bp, Artificial sequence
  SiRNA target sequence
cgcgtgtgcttgatgcaatgcttccat

SEQ ID NO: 167941 - DNA, 27 bp, Artificial sequence
  SiRNA target sequence
gcgtgtgcttgatgcaatgcttccata

SEQ ID NO: 167942 - DNA, 27 bp, Artificial sequence
  SiRNA target sequence
cgtgtgcttgatgcaatgcttccatac

SEQ ID NO: 167943 - DNA, 27 bp, Artificial sequence
  SiRNA target sequence
gtgtgcttgatgcaatgcttccatact

SEQ ID NO: 167944 - DNA, 27 bp, Artificial sequence
  SiRNA target sequence
tgtgcttgatgcaatgcttccatacta

SEQ ID NO: 167945 - DNA, 27 bp, Artificial sequence
  SiRNA target sequence
gtgcttgatgcaatgcttccatactat

SEQ ID NO: 167946 - DNA, 27 bp, Artificial sequence
  SiRNA target sequence
tgcttgatgcaatgcttccatactata

SEQ ID NO: 167947 - DNA, 27 bp, Artificial sequence
  SiRNA target sequence
gcttgatgcaatgcttccatactatac

SEQ ID NO: 167948 - DNA, 27 bp, Artificial sequence
  SiRNA target sequence
cttgatgcaatgcttccatactataca

SEQ ID NO: 167949 - DNA, 27 bp, Artificial sequence
  SiRNA target sequence
ttgatgcaatgcttccatactatacat

SEQ ID NO: 167950 - DNA, 27 bp, Artificial sequence
  SiRNA target sequence
tgatgcaatgcttccatactatacatc

SEQ ID NO: 167951 - DNA, 27 bp, Artificial sequence
  SiRNA target sequence
gatgcaatgcttccatactatacatcc

SEQ ID NO: 167952 - DNA, 27 bp, Artificial sequence
  SiRNA target sequence
atgcaatgcttccatactatacatcca

SEQ ID NO: 167953 - DNA, 27 bp, Artificial sequence
  SiRNA target sequence
tgcaatgcttccatactatacatccat

SEQ ID NO: 167954 - DNA, 27 bp, Artificial sequence
  SiRNA target sequence
gcaatgcttccatactatacatccatt

SEQ ID NO: 167955 - DNA, 27 bp, Artificial sequence
  SiRNA target sequence
caatgcttccatactatacatccattt

SEQ ID NO: 167956 - DNA, 27 bp, Artificial sequence
  SiRNA target sequence
aatgcttccatactatacatccatttt

SEQ ID NO: 167957 - DNA, 27 bp, Artificial sequence
  SiRNA target sequence
atgcttccatactatacatccattttt

SEQ ID NO: 167958 - DNA, 27 bp, Artificial sequence
  SiRNA target sequence
tgcttccatactatacatccatttttg

SEQ ID NO: 167959 - DNA, 27 bp, Artificial sequence
  SiRNA target sequence
gcttccatactatacatccatttttgg

SEQ ID NO: 167960 - DNA, 27 bp, Artificial sequence
  SiRNA target sequence
cttccatactatacatccatttttgga

SEQ ID NO: 167961 - DNA, 27 bp, Artificial sequence
  SiRNA target sequence
ttccatactatacatccatttttggaa

SEQ ID NO: 167962 - DNA, 27 bp, Artificial sequence
  SiRNA target sequence
tccatactatacatccatttttggaaa

SEQ ID NO: 167963 - DNA, 27 bp, Artificial sequence
  SiRNA target sequence
ccatactatacatccatttttggaaat

SEQ ID NO: 167964 - DNA, 27 bp, Artificial sequence
  SiRNA target sequence
catactatacatccatttttggaaatc

SEQ ID NO: 167965 - DNA, 27 bp, Artificial sequence
  SiRNA target sequence
atactatacatccatttttggaaatcc

SEQ ID NO: 167966 - DNA, 27 bp, Artificial sequence
  SiRNA target sequence
tactatacatccatttttggaaatcca

SEQ ID NO: 167967 - DNA, 27 bp, Artificial sequence
  SiRNA target sequence
actatacatccatttttggaaatccac

SEQ ID NO: 167968 - DNA, 27 bp, Artificial sequence
  SiRNA target sequence
ctatacatccatttttggaaatccaca

SEQ ID NO: 167969 - DNA, 27 bp, Artificial sequence
  SiRNA target sequence
tatacatccatttttggaaatccacat

SEQ ID NO: 167970 - DNA, 27 bp, Artificial sequence
  SiRNA target sequence
atacatccatttttggaaatccacatt

SEQ ID NO: 167971 - DNA, 27 bp, Artificial sequence
  SiRNA target sequence
tacatccatttttggaaatccacattc

SEQ ID NO: 167972 - DNA, 27 bp, Artificial sequence
  SiRNA target sequence
acatccatttttggaaatccacattct

SEQ ID NO: 167973 - DNA, 27 bp, Artificial sequence
  SiRNA target sequence
catccatttttggaaatccacattctc

SEQ ID NO: 167974 - DNA, 27 bp, Artificial sequence
  SiRNA target sequence
atccatttttggaaatccacattctcg

SEQ ID NO: 167975 - DNA, 27 bp, Artificial sequence
  SiRNA target sequence
tccatttttggaaatccacattctcgc

SEQ ID NO: 167976 - DNA, 27 bp, Artificial sequence
  SiRNA target sequence
ccatttttggaaatccacattctcgca

SEQ ID NO: 167977 - DNA, 27 bp, Artificial sequence
  SiRNA target sequence
catttttggaaatccacattctcgcac

SEQ ID NO: 167978 - DNA, 27 bp, Artificial sequence
  SiRNA target sequence
atttttggaaatccacattctcgcacg

SEQ ID NO: 167979 - DNA, 27 bp, Artificial sequence
  SiRNA target sequence
tttttggaaatccacattctcgcacgc

SEQ ID NO: 167980 - DNA, 27 bp, Artificial sequence
  SiRNA target sequence
ttttggaaatccacattctcgcacgca

SEQ ID NO: 167981 - DNA, 27 bp, Artificial sequence
  SiRNA target sequence
tttggaaatccacattctcgcacgcat

SEQ ID NO: 167982 - DNA, 27 bp, Artificial sequence
  SiRNA target sequence
ttggaaatccacattctcgcacgcata

SEQ ID NO: 167983 - DNA, 27 bp, Artificial sequence
  SiRNA target sequence
tggaaatccacattctcgcacgcatac

SEQ ID NO: 167984 - DNA, 27 bp, Artificial sequence
  SiRNA target sequence
ggaaatccacattctcgcacgcatacg

SEQ ID NO: 167985 - DNA, 27 bp, Artificial sequence
  SiRNA target sequence
gaaatccacattctcgcacgcatacgt

SEQ ID NO: 167986 - DNA, 27 bp, Artificial sequence
  SiRNA target sequence
aaatccacattctcgcacgcatacgtt

SEQ ID NO: 167987 - DNA, 27 bp, Artificial sequence
  SiRNA target sequence
aatccacattctcgcacgcatacgttt

SEQ ID NO: 167988 - DNA, 27 bp, Artificial sequence
  SiRNA target sequence
atccacattctcgcacgcatacgtttg

SEQ ID NO: 167989 - DNA, 27 bp, Artificial sequence
  SiRNA target sequence
tccacattctcgcacgcatacgtttgg

SEQ ID NO: 167990 - DNA, 27 bp, Artificial sequence
  SiRNA target sequence
ccacattctcgcacgcatacgtttgga

SEQ ID NO: 167991 - DNA, 27 bp, Artificial sequence
  SiRNA target sequence
cacattctcgcacgcatacgtttggat

SEQ ID NO: 167992 - DNA, 27 bp, Artificial sequence
  SiRNA target sequence
acattctcgcacgcatacgtttggatg

SEQ ID NO: 167993 - DNA, 27 bp, Artificial sequence
  SiRNA target sequence
cattctcgcacgcatacgtttggatgg

SEQ ID NO: 167994 - DNA, 27 bp, Artificial sequence
  SiRNA target sequence
attctcgcacgcatacgtttggatgga

SEQ ID NO: 167995 - DNA, 27 bp, Artificial sequence
  SiRNA target sequence
ttctcgcacgcatacgtttggatggaa

SEQ ID NO: 167996 - DNA, 27 bp, Artificial sequence
  SiRNA target sequence
tctcgcacgcatacgtttggatggaat

SEQ ID NO: 167997 - DNA, 27 bp, Artificial sequence
  SiRNA target sequence
ctcgcacgcatacgtttggatggaatg

SEQ ID NO: 167998 - DNA, 27 bp, Artificial sequence
  SiRNA target sequence
tcgcacgcatacgtttggatggaatgc

SEQ ID NO: 167999 - DNA, 27 bp, Artificial sequence
  SiRNA target sequence
cgcacgcatacgtttggatggaatgca

SEQ ID NO: 168000 - DNA, 27 bp, Artificial sequence
  SiRNA target sequence
gcacgcatacgtttggatggaatgcag

SEQ ID NO: 168001 - DNA, 27 bp, Artificial sequence
  SiRNA target sequence
cacgcatacgtttggatggaatgcaga

SEQ ID NO: 168002 - DNA, 27 bp, Artificial sequence
  SiRNA target sequence
acgcatacgtttggatggaatgcagaa

SEQ ID NO: 168003 - DNA, 27 bp, Artificial sequence
  SiRNA target sequence
cgcatacgtttggatggaatgcagaaa

SEQ ID NO: 168004 - DNA, 27 bp, Artificial sequence
  SiRNA target sequence
gcatacgtttggatggaatgcagaaaa

SEQ ID NO: 168005 - DNA, 27 bp, Artificial sequence
  SiRNA target sequence
catacgtttggatggaatgcagaaaaa

SEQ ID NO: 168006 - DNA, 27 bp, Artificial sequence
  SiRNA target sequence
atacgtttggatggaatgcagaaaaag

SEQ ID NO: 168007 - DNA, 27 bp, Artificial sequence
  SiRNA target sequence
tacgtttggatggaatgcagaaaaagg

SEQ ID NO: 168008 - DNA, 27 bp, Artificial sequence
  SiRNA target sequence
acgtttggatggaatgcagaaaaaggc

SEQ ID NO: 168009 - DNA, 27 bp, Artificial sequence
  SiRNA target sequence
cgtttggatggaatgcagaaaaaggcg

SEQ ID NO: 168010 - DNA, 27 bp, Artificial sequence
  SiRNA target sequence
gtttggatggaatgcagaaaaaggcgt

SEQ ID NO: 168011 - DNA, 27 bp, Artificial sequence
  SiRNA target sequence
tttggatggaatgcagaaaaaggcgta

SEQ ID NO: 168012 - DNA, 27 bp, Artificial sequence
  SiRNA target sequence
ttggatggaatgcagaaaaaggcgtag

SEQ ID NO: 168013 - DNA, 27 bp, Artificial sequence
  SiRNA target sequence
tggatggaatgcagaaaaaggcgtaga

SEQ ID NO: 168014 - DNA, 27 bp, Artificial sequence
  SiRNA target sequence
ggatggaatgcagaaaaaggcgtagaa

SEQ ID NO: 168015 - DNA, 27 bp, Artificial sequence
  SiRNA target sequence
gatggaatgcagaaaaaggcgtagaaa

SEQ ID NO: 168016 - DNA, 27 bp, Artificial sequence
  SiRNA target sequence
atggaatgcagaaaaaggcgtagaaat

SEQ ID NO: 168017 - DNA, 27 bp, Artificial sequence
  SiRNA target sequence
tggaatgcagaaaaaggcgtagaaatg

SEQ ID NO: 168018 - DNA, 27 bp, Artificial sequence
  SiRNA target sequence
ggaatgcagaaaaaggcgtagaaatgg

SEQ ID NO: 168019 - DNA, 27 bp, Artificial sequence
  SiRNA target sequence
gaatgcagaaaaaggcgtagaaatggc

SEQ ID NO: 168020 - DNA, 27 bp, Artificial sequence
  SiRNA target sequence
aatgcagaaaaaggcgtagaaatggct

SEQ ID NO: 168021 - DNA, 27 bp, Artificial sequence
  SiRNA target sequence
atgcagaaaaaggcgtagaaatggctc

SEQ ID NO: 168022 - DNA, 27 bp, Artificial sequence
  SiRNA target sequence
tgcagaaaaaggcgtagaaatggctcg

SEQ ID NO: 168023 - DNA, 27 bp, Artificial sequence
  SiRNA target sequence
gcagaaaaaggcgtagaaatggctcga

SEQ ID NO: 168024 - DNA, 27 bp, Artificial sequence
  SiRNA target sequence
cagaaaaaggcgtagaaatggctcgaa

SEQ ID NO: 168025 - DNA, 27 bp, Artificial sequence
  SiRNA target sequence
agaaaaaggcgtagaaatggctcgaaa

SEQ ID NO: 168026 - DNA, 27 bp, Artificial sequence
  SiRNA target sequence
gaaaaaggcgtagaaatggctcgaaag

SEQ ID NO: 168027 - DNA, 27 bp, Artificial sequence
  SiRNA target sequence
aaaaaggcgtagaaatggctcgaaagc

SEQ ID NO: 168028 - DNA, 27 bp, Artificial sequence
  SiRNA target sequence
aaaaggcgtagaaatggctcgaaagca

SEQ ID NO: 168029 - DNA, 27 bp, Artificial sequence
  SiRNA target sequence
aaaggcgtagaaatggctcgaaagcaa

SEQ ID NO: 168030 - DNA, 27 bp, Artificial sequence
  SiRNA target sequence
aaggcgtagaaatggctcgaaagcaag

SEQ ID NO: 168031 - DNA, 27 bp, Artificial sequence
  SiRNA target sequence
aggcgtagaaatggctcgaaagcaagt

SEQ ID NO: 168032 - DNA, 27 bp, Artificial sequence
  SiRNA target sequence
ggcgtagaaatggctcgaaagcaagta

SEQ ID NO: 168033 - DNA, 27 bp, Artificial sequence
  SiRNA target sequence
gcgtagaaatggctcgaaagcaagtag

SEQ ID NO: 168034 - DNA, 27 bp, Artificial sequence
  SiRNA target sequence
cgtagaaatggctcgaaagcaagtagc

SEQ ID NO: 168035 - DNA, 27 bp, Artificial sequence
  SiRNA target sequence
gtagaaatggctcgaaagcaagtagca

SEQ ID NO: 168036 - DNA, 27 bp, Artificial sequence
  SiRNA target sequence
tagaaatggctcgaaagcaagtagcag

SEQ ID NO: 168037 - DNA, 27 bp, Artificial sequence
  SiRNA target sequence
agaaatggctcgaaagcaagtagcaga

SEQ ID NO: 168038 - DNA, 27 bp, Artificial sequence
  SiRNA target sequence
gaaatggctcgaaagcaagtagcagat

SEQ ID NO: 168039 - DNA, 27 bp, Artificial sequence
  SiRNA target sequence
aaatggctcgaaagcaagtagcagatt

SEQ ID NO: 168040 - DNA, 27 bp, Artificial sequence
  SiRNA target sequence
aatggctcgaaagcaagtagcagattt

SEQ ID NO: 168041 - DNA, 27 bp, Artificial sequence
  SiRNA target sequence
atggctcgaaagcaagtagcagattta

SEQ ID NO: 168042 - DNA, 27 bp, Artificial sequence
  SiRNA target sequence
tggctcgaaagcaagtagcagatttac

SEQ ID NO: 168043 - DNA, 27 bp, Artificial sequence
  SiRNA target sequence
ggctcgaaagcaagtagcagatttact

SEQ ID NO: 168044 - DNA, 27 bp, Artificial sequence
  SiRNA target sequence
gctcgaaagcaagtagcagatttactg

SEQ ID NO: 168045 - DNA, 27 bp, Artificial sequence
  SiRNA target sequence
ctcgaaagcaagtagcagatttactga

SEQ ID NO: 168046 - DNA, 27 bp, Artificial sequence
  SiRNA target sequence
tcgaaagcaagtagcagatttactgaa

SEQ ID NO: 168047 - DNA, 27 bp, Artificial sequence
  SiRNA target sequence
cgaaagcaagtagcagatttactgaat

SEQ ID NO: 168048 - DNA, 27 bp, Artificial sequence
  SiRNA target sequence
gaaagcaagtagcagatttactgaatg

SEQ ID NO: 168049 - DNA, 27 bp, Artificial sequence
  SiRNA target sequence
aaagcaagtagcagatttactgaatgc

SEQ ID NO: 168050 - DNA, 27 bp, Artificial sequence
  SiRNA target sequence
aagcaagtagcagatttactgaatgcc

SEQ ID NO: 168051 - DNA, 27 bp, Artificial sequence
  SiRNA target sequence
agcaagtagcagatttactgaatgcca

SEQ ID NO: 168052 - DNA, 27 bp, Artificial sequence
  SiRNA target sequence
gcaagtagcagatttactgaatgccaa

SEQ ID NO: 168053 - DNA, 27 bp, Artificial sequence
  SiRNA target sequence
caagtagcagatttactgaatgccaat

SEQ ID NO: 168054 - DNA, 27 bp, Artificial sequence
  SiRNA target sequence
aagtagcagatttactgaatgccaatg

SEQ ID NO: 168055 - DNA, 27 bp, Artificial sequence
  SiRNA target sequence
agtagcagatttactgaatgccaatga

SEQ ID NO: 168056 - DNA, 27 bp, Artificial sequence
  SiRNA target sequence
gtagcagatttactgaatgccaatgaa

SEQ ID NO: 168057 - DNA, 27 bp, Artificial sequence
  SiRNA target sequence
tagcagatttactgaatgccaatgaaa

SEQ ID NO: 168058 - DNA, 27 bp, Artificial sequence
  SiRNA target sequence
agcagatttactgaatgccaatgaaaa

SEQ ID NO: 168059 - DNA, 27 bp, Artificial sequence
  SiRNA target sequence
gcagatttactgaatgccaatgaaaaa

SEQ ID NO: 168060 - DNA, 27 bp, Artificial sequence
  SiRNA target sequence
cagatttactgaatgccaatgaaaaag

SEQ ID NO: 168061 - DNA, 27 bp, Artificial sequence
  SiRNA target sequence
agatttactgaatgccaatgaaaaaga

SEQ ID NO: 168062 - DNA, 27 bp, Artificial sequence
  SiRNA target sequence
gatttactgaatgccaatgaaaaagaa

SEQ ID NO: 168063 - DNA, 27 bp, Artificial sequence
  SiRNA target sequence
atttactgaatgccaatgaaaaagaaa

SEQ ID NO: 168064 - DNA, 27 bp, Artificial sequence
  SiRNA target sequence
tttactgaatgccaatgaaaaagaaat

SEQ ID NO: 168065 - DNA, 27 bp, Artificial sequence
  SiRNA target sequence
ttactgaatgccaatgaaaaagaaatt

SEQ ID NO: 168066 - DNA, 27 bp, Artificial sequence
  SiRNA target sequence
tactgaatgccaatgaaaaagaaatta

SEQ ID NO: 168067 - DNA, 27 bp, Artificial sequence
  SiRNA target sequence
actgaatgccaatgaaaaagaaattat

SEQ ID NO: 168068 - DNA, 27 bp, Artificial sequence
  SiRNA target sequence
ctgaatgccaatgaaaaagaaattatt

SEQ ID NO: 168069 - DNA, 27 bp, Artificial sequence
  SiRNA target sequence
tgaatgccaatgaaaaagaaattattt

SEQ ID NO: 168070 - DNA, 27 bp, Artificial sequence
  SiRNA target sequence
gaatgccaatgaaaaagaaattatttt

SEQ ID NO: 168071 - DNA, 27 bp, Artificial sequence
  SiRNA target sequence
aatgccaatgaaaaagaaattattttt

SEQ ID NO: 168072 - DNA, 27 bp, Artificial sequence
  SiRNA target sequence
atgccaatgaaaaagaaattattttta

SEQ ID NO: 168073 - DNA, 27 bp, Artificial sequence
  SiRNA target sequence
tgccaatgaaaaagaaattatttttac

SEQ ID NO: 168074 - DNA, 27 bp, Artificial sequence
  SiRNA target sequence
gccaatgaaaaagaaattatttttact

SEQ ID NO: 168075 - DNA, 27 bp, Artificial sequence
  SiRNA target sequence
ccaatgaaaaagaaattatttttacta

SEQ ID NO: 168076 - DNA, 27 bp, Artificial sequence
  SiRNA target sequence
caatgaaaaagaaattatttttactag

SEQ ID NO: 168077 - DNA, 27 bp, Artificial sequence
  SiRNA target sequence
aatgaaaaagaaattatttttactagc

SEQ ID NO: 168078 - DNA, 27 bp, Artificial sequence
  SiRNA target sequence
atgaaaaagaaattatttttactagcg

SEQ ID NO: 168079 - DNA, 27 bp, Artificial sequence
  SiRNA target sequence
tgaaaaagaaattatttttactagcgg

SEQ ID NO: 168080 - DNA, 27 bp, Artificial sequence
  SiRNA target sequence
gaaaaagaaattatttttactagcggt

SEQ ID NO: 168081 - DNA, 27 bp, Artificial sequence
  SiRNA target sequence
aaaaagaaattatttttactagcggtg

SEQ ID NO: 168082 - DNA, 27 bp, Artificial sequence
  SiRNA target sequence
aaaagaaattatttttactagcggtgc

SEQ ID NO: 168083 - DNA, 27 bp, Artificial sequence
  SiRNA target sequence
aaagaaattatttttactagcggtgct

SEQ ID NO: 168084 - DNA, 27 bp, Artificial sequence
  SiRNA target sequence
aagaaattatttttactagcggtgcta

SEQ ID NO: 168085 - DNA, 27 bp, Artificial sequence
  SiRNA target sequence
agaaattatttttactagcggtgctac

SEQ ID NO: 168086 - DNA, 27 bp, Artificial sequence
  SiRNA target sequence
gaaattatttttactagcggtgctact

SEQ ID NO: 168087 - DNA, 27 bp, Artificial sequence
  SiRNA target sequence
aaattatttttactagcggtgctactg

SEQ ID NO: 168088 - DNA, 27 bp, Artificial sequence
  SiRNA target sequence
aattatttttactagcggtgctactga

SEQ ID NO: 168089 - DNA, 27 bp, Artificial sequence
  SiRNA target sequence
attatttttactagcggtgctactgag

SEQ ID NO: 168090 - DNA, 27 bp, Artificial sequence
  SiRNA target sequence
ttatttttactagcggtgctactgaga

SEQ ID NO: 168091 - DNA, 27 bp, Artificial sequence
  SiRNA target sequence
tatttttactagcggtgctactgagag

SEQ ID NO: 168092 - DNA, 27 bp, Artificial sequence
  SiRNA target sequence
atttttactagcggtgctactgagagt

SEQ ID NO: 168093 - DNA, 27 bp, Artificial sequence
  SiRNA target sequence
tttttactagcggtgctactgagagta

SEQ ID NO: 168094 - DNA, 27 bp, Artificial sequence
  SiRNA target sequence
ttttactagcggtgctactgagagtaa

SEQ ID NO: 168095 - DNA, 27 bp, Artificial sequence
  SiRNA target sequence
tttactagcggtgctactgagagtaac

SEQ ID NO: 168096 - DNA, 27 bp, Artificial sequence
  SiRNA target sequence
ttactagcggtgctactgagagtaaca

SEQ ID NO: 168097 - DNA, 27 bp, Artificial sequence
  SiRNA target sequence
tactagcggtgctactgagagtaacaa

SEQ ID NO: 168098 - DNA, 27 bp, Artificial sequence
  SiRNA target sequence
actagcggtgctactgagagtaacaac

SEQ ID NO: 168099 - DNA, 27 bp, Artificial sequence
  SiRNA target sequence
ctagcggtgctactgagagtaacaacc

SEQ ID NO: 168100 - DNA, 27 bp, Artificial sequence
  SiRNA target sequence
tagcggtgctactgagagtaacaacct

SEQ ID NO: 168101 - DNA, 27 bp, Artificial sequence
  SiRNA target sequence
agcggtgctactgagagtaacaacctt

SEQ ID NO: 168102 - DNA, 27 bp, Artificial sequence
  SiRNA target sequence
gcggtgctactgagagtaacaaccttg

SEQ ID NO: 168103 - DNA, 27 bp, Artificial sequence
  SiRNA target sequence
cggtgctactgagagtaacaaccttgc

SEQ ID NO: 168104 - DNA, 27 bp, Artificial sequence
  SiRNA target sequence
ggtgctactgagagtaacaaccttgca

SEQ ID NO: 168105 - DNA, 27 bp, Artificial sequence
  SiRNA target sequence
gtgctactgagagtaacaaccttgcac

SEQ ID NO: 168106 - DNA, 27 bp, Artificial sequence
  SiRNA target sequence
tgctactgagagtaacaaccttgcact

SEQ ID NO: 168107 - DNA, 27 bp, Artificial sequence
  SiRNA target sequence
gctactgagagtaacaaccttgcacta

SEQ ID NO: 168108 - DNA, 27 bp, Artificial sequence
  SiRNA target sequence
ctactgagagtaacaaccttgcactaa

SEQ ID NO: 168109 - DNA, 27 bp, Artificial sequence
  SiRNA target sequence
tactgagagtaacaaccttgcactaaa

SEQ ID NO: 168110 - DNA, 27 bp, Artificial sequence
  SiRNA target sequence
actgagagtaacaaccttgcactaaag

SEQ ID NO: 168111 - DNA, 27 bp, Artificial sequence
  SiRNA target sequence
ctgagagtaacaaccttgcactaaagg

SEQ ID NO: 168112 - DNA, 27 bp, Artificial sequence
  SiRNA target sequence
tgagagtaacaaccttgcactaaaggg

SEQ ID NO: 168113 - DNA, 27 bp, Artificial sequence
  SiRNA target sequence
gagagtaacaaccttgcactaaagggt

SEQ ID NO: 168114 - DNA, 27 bp, Artificial sequence
  SiRNA target sequence
agagtaacaaccttgcactaaagggtg

SEQ ID NO: 168115 - DNA, 27 bp, Artificial sequence
  SiRNA target sequence
gagtaacaaccttgcactaaagggtgt

SEQ ID NO: 168116 - DNA, 27 bp, Artificial sequence
  SiRNA target sequence
agtaacaaccttgcactaaagggtgtc

SEQ ID NO: 168117 - DNA, 27 bp, Artificial sequence
  SiRNA target sequence
gtaacaaccttgcactaaagggtgtct

SEQ ID NO: 168118 - DNA, 27 bp, Artificial sequence
  SiRNA target sequence
taacaaccttgcactaaagggtgtctt

SEQ ID NO: 168119 - DNA, 27 bp, Artificial sequence
  SiRNA target sequence
aacaaccttgcactaaagggtgtcttt

SEQ ID NO: 168120 - DNA, 27 bp, Artificial sequence
  SiRNA target sequence
acaaccttgcactaaagggtgtctttg

SEQ ID NO: 168121 - DNA, 27 bp, Artificial sequence
  SiRNA target sequence
caaccttgcactaaagggtgtctttgc

SEQ ID NO: 168122 - DNA, 27 bp, Artificial sequence
  SiRNA target sequence
aaccttgcactaaagggtgtctttgca

SEQ ID NO: 168123 - DNA, 27 bp, Artificial sequence
  SiRNA target sequence
accttgcactaaagggtgtctttgcat

SEQ ID NO: 168124 - DNA, 27 bp, Artificial sequence
  SiRNA target sequence
ccttgcactaaagggtgtctttgcatt

SEQ ID NO: 168125 - DNA, 27 bp, Artificial sequence
  SiRNA target sequence
cttgcactaaagggtgtctttgcattt

SEQ ID NO: 168126 - DNA, 27 bp, Artificial sequence
  SiRNA target sequence
ttgcactaaagggtgtctttgcatttt

SEQ ID NO: 168127 - DNA, 27 bp, Artificial sequence
  SiRNA target sequence
tgcactaaagggtgtctttgcattttt

SEQ ID NO: 168128 - DNA, 27 bp, Artificial sequence
  SiRNA target sequence
gcactaaagggtgtctttgcattttta

SEQ ID NO: 168129 - DNA, 27 bp, Artificial sequence
  SiRNA target sequence
cactaaagggtgtctttgcatttttaa

SEQ ID NO: 168130 - DNA, 27 bp, Artificial sequence
  SiRNA target sequence
actaaagggtgtctttgcatttttaaa

SEQ ID NO: 168131 - DNA, 27 bp, Artificial sequence
  SiRNA target sequence
ctaaagggtgtctttgcatttttaaaa

SEQ ID NO: 168132 - DNA, 27 bp, Artificial sequence
  SiRNA target sequence
taaagggtgtctttgcatttttaaaaa

SEQ ID NO: 168133 - DNA, 27 bp, Artificial sequence
  SiRNA target sequence
aaagggtgtctttgcatttttaaaaaa

SEQ ID NO: 168134 - DNA, 27 bp, Artificial sequence
  SiRNA target sequence
aagggtgtctttgcatttttaaaaaaa

SEQ ID NO: 168135 - DNA, 27 bp, Artificial sequence
  SiRNA target sequence
agggtgtctttgcatttttaaaaaaag

SEQ ID NO: 168136 - DNA, 27 bp, Artificial sequence
  SiRNA target sequence
gggtgtctttgcatttttaaaaaaaga

SEQ ID NO: 168137 - DNA, 27 bp, Artificial sequence
  SiRNA target sequence
ggtgtctttgcatttttaaaaaaagac

SEQ ID NO: 168138 - DNA, 27 bp, Artificial sequence
  SiRNA target sequence
gtgtctttgcatttttaaaaaaagaca

SEQ ID NO: 168139 - DNA, 27 bp, Artificial sequence
  SiRNA target sequence
tgtctttgcatttttaaaaaaagacaa

SEQ ID NO: 168140 - DNA, 27 bp, Artificial sequence
  SiRNA target sequence
gtctttgcatttttaaaaaaagacaat

SEQ ID NO: 168141 - DNA, 27 bp, Artificial sequence
  SiRNA target sequence
tctttgcatttttaaaaaaagacaata

SEQ ID NO: 168142 - DNA, 27 bp, Artificial sequence
  SiRNA target sequence
ctttgcatttttaaaaaaagacaatag

SEQ ID NO: 168143 - DNA, 27 bp, Artificial sequence
  SiRNA target sequence
tttgcatttttaaaaaaagacaatagg

SEQ ID NO: 168144 - DNA, 27 bp, Artificial sequence
  SiRNA target sequence
ttgcatttttaaaaaaagacaataggc

SEQ ID NO: 168145 - DNA, 27 bp, Artificial sequence
  SiRNA target sequence
tgcatttttaaaaaaagacaataggcc

SEQ ID NO: 168146 - DNA, 27 bp, Artificial sequence
  SiRNA target sequence
gcatttttaaaaaaagacaataggcct

SEQ ID NO: 168147 - DNA, 27 bp, Artificial sequence
  SiRNA target sequence
catttttaaaaaaagacaataggcctg

SEQ ID NO: 168148 - DNA, 27 bp, Artificial sequence
  SiRNA target sequence
atttttaaaaaaagacaataggcctgt

SEQ ID NO: 168149 - DNA, 27 bp, Artificial sequence
  SiRNA target sequence
tttttaaaaaaagacaataggcctgtt

SEQ ID NO: 168150 - DNA, 27 bp, Artificial sequence
  SiRNA target sequence
ttttaaaaaaagacaataggcctgttc

SEQ ID NO: 168151 - DNA, 27 bp, Artificial sequence
  SiRNA target sequence
tttaaaaaaagacaataggcctgttca

SEQ ID NO: 168152 - DNA, 27 bp, Artificial sequence
  SiRNA target sequence
ttaaaaaaagacaataggcctgttcat

SEQ ID NO: 168153 - DNA, 27 bp, Artificial sequence
  SiRNA target sequence
taaaaaaagacaataggcctgttcata

SEQ ID NO: 168154 - DNA, 27 bp, Artificial sequence
  SiRNA target sequence
aaaaaaagacaataggcctgttcatat

SEQ ID NO: 168155 - DNA, 27 bp, Artificial sequence
  SiRNA target sequence
aaaaaagacaataggcctgttcatatc

SEQ ID NO: 168156 - DNA, 27 bp, Artificial sequence
  SiRNA target sequence
aaaaagacaataggcctgttcatatca

SEQ ID NO: 168157 - DNA, 27 bp, Artificial sequence
  SiRNA target sequence
aaaagacaataggcctgttcatatcat

SEQ ID NO: 168158 - DNA, 27 bp, Artificial sequence
  SiRNA target sequence
aaagacaataggcctgttcatatcatt

SEQ ID NO: 168159 - DNA, 27 bp, Artificial sequence
  SiRNA target sequence
aagacaataggcctgttcatatcatta

SEQ ID NO: 168160 - DNA, 27 bp, Artificial sequence
  SiRNA target sequence
agacaataggcctgttcatatcattac

SEQ ID NO: 168161 - DNA, 27 bp, Artificial sequence
  SiRNA target sequence
gacaataggcctgttcatatcattacc

SEQ ID NO: 168162 - DNA, 27 bp, Artificial sequence
  SiRNA target sequence
acaataggcctgttcatatcattacca

SEQ ID NO: 168163 - DNA, 27 bp, Artificial sequence
  SiRNA target sequence
caataggcctgttcatatcattaccac

SEQ ID NO: 168164 - DNA, 27 bp, Artificial sequence
  SiRNA target sequence
aataggcctgttcatatcattaccaca

SEQ ID NO: 168165 - DNA, 27 bp, Artificial sequence
  SiRNA target sequence
ataggcctgttcatatcattaccacac

SEQ ID NO: 168166 - DNA, 27 bp, Artificial sequence
  SiRNA target sequence
taggcctgttcatatcattaccacaca

SEQ ID NO: 168167 - DNA, 27 bp, Artificial sequence
  SiRNA target sequence
aggcctgttcatatcattaccacacaa

SEQ ID NO: 168168 - DNA, 27 bp, Artificial sequence
  SiRNA target sequence
ggcctgttcatatcattaccacacaaa

SEQ ID NO: 168169 - DNA, 27 bp, Artificial sequence
  SiRNA target sequence
gcctgttcatatcattaccacacaaat

SEQ ID NO: 168170 - DNA, 27 bp, Artificial sequence
  SiRNA target sequence
cctgttcatatcattaccacacaaatt

SEQ ID NO: 168171 - DNA, 27 bp, Artificial sequence
  SiRNA target sequence
ctgttcatatcattaccacacaaattg

SEQ ID NO: 168172 - DNA, 27 bp, Artificial sequence
  SiRNA target sequence
tgttcatatcattaccacacaaattga

SEQ ID NO: 168173 - DNA, 27 bp, Artificial sequence
  SiRNA target sequence
gttcatatcattaccacacaaattgaa

SEQ ID NO: 168174 - DNA, 27 bp, Artificial sequence
  SiRNA target sequence
ttcatatcattaccacacaaattgaac

SEQ ID NO: 168175 - DNA, 27 bp, Artificial sequence
  SiRNA target sequence
tcatatcattaccacacaaattgaaca

SEQ ID NO: 168176 - DNA, 27 bp, Artificial sequence
  SiRNA target sequence
catatcattaccacacaaattgaacat

SEQ ID NO: 168177 - DNA, 27 bp, Artificial sequence
  SiRNA target sequence
atatcattaccacacaaattgaacata

SEQ ID NO: 168178 - DNA, 27 bp, Artificial sequence
  SiRNA target sequence
tatcattaccacacaaattgaacataa

SEQ ID NO: 168179 - DNA, 27 bp, Artificial sequence
  SiRNA target sequence
atcattaccacacaaattgaacataaa

SEQ ID NO: 168180 - DNA, 27 bp, Artificial sequence
  SiRNA target sequence
tcattaccacacaaattgaacataaat

SEQ ID NO: 168181 - DNA, 27 bp, Artificial sequence
  SiRNA target sequence
cattaccacacaaattgaacataaatg

SEQ ID NO: 168182 - DNA, 27 bp, Artificial sequence
  SiRNA target sequence
attaccacacaaattgaacataaatgt

SEQ ID NO: 168183 - DNA, 27 bp, Artificial sequence
  SiRNA target sequence
ttaccacacaaattgaacataaatgtg

SEQ ID NO: 168184 - DNA, 27 bp, Artificial sequence
  SiRNA target sequence
taccacacaaattgaacataaatgtgt

SEQ ID NO: 168185 - DNA, 27 bp, Artificial sequence
  SiRNA target sequence
accacacaaattgaacataaatgtgta

SEQ ID NO: 168186 - DNA, 27 bp, Artificial sequence
  SiRNA target sequence
ccacacaaattgaacataaatgtgtat

SEQ ID NO: 168187 - DNA, 27 bp, Artificial sequence
  SiRNA target sequence
cacacaaattgaacataaatgtgtatt

SEQ ID NO: 168188 - DNA, 27 bp, Artificial sequence
  SiRNA target sequence
acacaaattgaacataaatgtgtattg

SEQ ID NO: 168189 - DNA, 27 bp, Artificial sequence
  SiRNA target sequence
cacaaattgaacataaatgtgtattgg

SEQ ID NO: 168190 - DNA, 27 bp, Artificial sequence
  SiRNA target sequence
acaaattgaacataaatgtgtattgga

SEQ ID NO: 168191 - DNA, 27 bp, Artificial sequence
  SiRNA target sequence
caaattgaacataaatgtgtattggac

SEQ ID NO: 168192 - DNA, 27 bp, Artificial sequence
  SiRNA target sequence
aaattgaacataaatgtgtattggaca

SEQ ID NO: 168193 - DNA, 27 bp, Artificial sequence
  SiRNA target sequence
aattgaacataaatgtgtattggacac

SEQ ID NO: 168194 - DNA, 27 bp, Artificial sequence
  SiRNA target sequence
attgaacataaatgtgtattggacaca

SEQ ID NO: 168195 - DNA, 27 bp, Artificial sequence
  SiRNA target sequence
ttgaacataaatgtgtattggacacat

SEQ ID NO: 168196 - DNA, 27 bp, Artificial sequence
  SiRNA target sequence
tgaacataaatgtgtattggacacatg

SEQ ID NO: 168197 - DNA, 27 bp, Artificial sequence
  SiRNA target sequence
gaacataaatgtgtattggacacatgt

SEQ ID NO: 168198 - DNA, 27 bp, Artificial sequence
  SiRNA target sequence
aacataaatgtgtattggacacatgta

SEQ ID NO: 168199 - DNA, 27 bp, Artificial sequence
  SiRNA target sequence
acataaatgtgtattggacacatgtag

SEQ ID NO: 168200 - DNA, 27 bp, Artificial sequence
  SiRNA target sequence
cataaatgtgtattggacacatgtaga

SEQ ID NO: 168201 - DNA, 27 bp, Artificial sequence
  SiRNA target sequence
ataaatgtgtattggacacatgtagaa

SEQ ID NO: 168202 - DNA, 27 bp, Artificial sequence
  SiRNA target sequence
taaatgtgtattggacacatgtagaag

SEQ ID NO: 168203 - DNA, 27 bp, Artificial sequence
  SiRNA target sequence
aaatgtgtattggacacatgtagaaga

SEQ ID NO: 168204 - DNA, 27 bp, Artificial sequence
  SiRNA target sequence
aatgtgtattggacacatgtagaagat

SEQ ID NO: 168205 - DNA, 27 bp, Artificial sequence
  SiRNA target sequence
atgtgtattggacacatgtagaagatt

SEQ ID NO: 168206 - DNA, 27 bp, Artificial sequence
  SiRNA target sequence
tgtgtattggacacatgtagaagatta

SEQ ID NO: 168207 - DNA, 27 bp, Artificial sequence
  SiRNA target sequence
gtgtattggacacatgtagaagattag

SEQ ID NO: 168208 - DNA, 27 bp, Artificial sequence
  SiRNA target sequence
tgtattggacacatgtagaagattaga

SEQ ID NO: 168209 - DNA, 27 bp, Artificial sequence
  SiRNA target sequence
gtattggacacatgtagaagattagaa

SEQ ID NO: 168210 - DNA, 27 bp, Artificial sequence
  SiRNA target sequence
tattggacacatgtagaagattagaag

SEQ ID NO: 168211 - DNA, 27 bp, Artificial sequence
  SiRNA target sequence
attggacacatgtagaagattagaaga

SEQ ID NO: 168212 - DNA, 27 bp, Artificial sequence
  SiRNA target sequence
ttggacacatgtagaagattagaagaa

SEQ ID NO: 168213 - DNA, 27 bp, Artificial sequence
  SiRNA target sequence
tggacacatgtagaagattagaagaag

SEQ ID NO: 168214 - DNA, 27 bp, Artificial sequence
  SiRNA target sequence
ggacacatgtagaagattagaagaaga

SEQ ID NO: 168215 - DNA, 27 bp, Artificial sequence
  SiRNA target sequence
gacacatgtagaagattagaagaagaa

SEQ ID NO: 168216 - DNA, 27 bp, Artificial sequence
  SiRNA target sequence
acacatgtagaagattagaagaagaag

SEQ ID NO: 168217 - DNA, 27 bp, Artificial sequence
  SiRNA target sequence
cacatgtagaagattagaagaagaagg

SEQ ID NO: 168218 - DNA, 27 bp, Artificial sequence
  SiRNA target sequence
acatgtagaagattagaagaagaagga

SEQ ID NO: 168219 - DNA, 27 bp, Artificial sequence
  SiRNA target sequence
catgtagaagattagaagaagaaggag

SEQ ID NO: 168220 - DNA, 27 bp, Artificial sequence
  SiRNA target sequence
atgtagaagattagaagaagaaggagc

SEQ ID NO: 168221 - DNA, 27 bp, Artificial sequence
  SiRNA target sequence
tgtagaagattagaagaagaaggagct

SEQ ID NO: 168222 - DNA, 27 bp, Artificial sequence
  SiRNA target sequence
gtagaagattagaagaagaaggagcta

SEQ ID NO: 168223 - DNA, 27 bp, Artificial sequence
  SiRNA target sequence
tagaagattagaagaagaaggagctac

SEQ ID NO: 168224 - DNA, 27 bp, Artificial sequence
  SiRNA target sequence
agaagattagaagaagaaggagctaca

SEQ ID NO: 168225 - DNA, 27 bp, Artificial sequence
  SiRNA target sequence
gaagattagaagaagaaggagctacag

SEQ ID NO: 168226 - DNA, 27 bp, Artificial sequence
  SiRNA target sequence
aagattagaagaagaaggagctacagt

SEQ ID NO: 168227 - DNA, 27 bp, Artificial sequence
  SiRNA target sequence
agattagaagaagaaggagctacagtg

SEQ ID NO: 168228 - DNA, 27 bp, Artificial sequence
  SiRNA target sequence
gattagaagaagaaggagctacagtga

SEQ ID NO: 168229 - DNA, 27 bp, Artificial sequence
  SiRNA target sequence
attagaagaagaaggagctacagtgac

SEQ ID NO: 168230 - DNA, 27 bp, Artificial sequence
  SiRNA target sequence
ttagaagaagaaggagctacagtgact

SEQ ID NO: 168231 - DNA, 27 bp, Artificial sequence
  SiRNA target sequence
tagaagaagaaggagctacagtgactt

SEQ ID NO: 168232 - DNA, 27 bp, Artificial sequence
  SiRNA target sequence
agaagaagaaggagctacagtgactta

SEQ ID NO: 168233 - DNA, 27 bp, Artificial sequence
  SiRNA target sequence
gaagaagaaggagctacagtgacttat

SEQ ID NO: 168234 - DNA, 27 bp, Artificial sequence
  SiRNA target sequence
aagaagaaggagctacagtgacttatt

SEQ ID NO: 168235 - DNA, 27 bp, Artificial sequence
  SiRNA target sequence
agaagaaggagctacagtgacttattt

SEQ ID NO: 168236 - DNA, 27 bp, Artificial sequence
  SiRNA target sequence
gaagaaggagctacagtgacttatttg

SEQ ID NO: 168237 - DNA, 27 bp, Artificial sequence
  SiRNA target sequence
aagaaggagctacagtgacttatttgc

SEQ ID NO: 168238 - DNA, 27 bp, Artificial sequence
  SiRNA target sequence
agaaggagctacagtgacttatttgcc

SEQ ID NO: 168239 - DNA, 27 bp, Artificial sequence
  SiRNA target sequence
gaaggagctacagtgacttatttgcct

SEQ ID NO: 168240 - DNA, 27 bp, Artificial sequence
  SiRNA target sequence
aaggagctacagtgacttatttgcctg

SEQ ID NO: 168241 - DNA, 27 bp, Artificial sequence
  SiRNA target sequence
aggagctacagtgacttatttgcctgt

SEQ ID NO: 168242 - DNA, 27 bp, Artificial sequence
  SiRNA target sequence
ggagctacagtgacttatttgcctgta

SEQ ID NO: 168243 - DNA, 27 bp, Artificial sequence
  SiRNA target sequence
gagctacagtgacttatttgcctgtag

SEQ ID NO: 168244 - DNA, 27 bp, Artificial sequence
  SiRNA target sequence
agctacagtgacttatttgcctgtaga

SEQ ID NO: 168245 - DNA, 27 bp, Artificial sequence
  SiRNA target sequence
gctacagtgacttatttgcctgtagat

SEQ ID NO: 168246 - DNA, 27 bp, Artificial sequence
  SiRNA target sequence
ctacagtgacttatttgcctgtagata

SEQ ID NO: 168247 - DNA, 27 bp, Artificial sequence
  SiRNA target sequence
tacagtgacttatttgcctgtagataa

SEQ ID NO: 168248 - DNA, 27 bp, Artificial sequence
  SiRNA target sequence
acagtgacttatttgcctgtagataaa

SEQ ID NO: 168249 - DNA, 27 bp, Artificial sequence
  SiRNA target sequence
cagtgacttatttgcctgtagataaaa

SEQ ID NO: 168250 - DNA, 27 bp, Artificial sequence
  SiRNA target sequence
agtgacttatttgcctgtagataaaaa

SEQ ID NO: 168251 - DNA, 27 bp, Artificial sequence
  SiRNA target sequence
gtgacttatttgcctgtagataaaaat

SEQ ID NO: 168252 - DNA, 27 bp, Artificial sequence
  SiRNA target sequence
tgacttatttgcctgtagataaaaatg

SEQ ID NO: 168253 - DNA, 27 bp, Artificial sequence
  SiRNA target sequence
gacttatttgcctgtagataaaaatgg

SEQ ID NO: 168254 - DNA, 27 bp, Artificial sequence
  SiRNA target sequence
acttatttgcctgtagataaaaatgga

SEQ ID NO: 168255 - DNA, 27 bp, Artificial sequence
  SiRNA target sequence
cttatttgcctgtagataaaaatggaa

SEQ ID NO: 168256 - DNA, 27 bp, Artificial sequence
  SiRNA target sequence
ttatttgcctgtagataaaaatggaat

SEQ ID NO: 168257 - DNA, 27 bp, Artificial sequence
  SiRNA target sequence
tatttgcctgtagataaaaatggaata

SEQ ID NO: 168258 - DNA, 27 bp, Artificial sequence
  SiRNA target sequence
atttgcctgtagataaaaatggaatag

SEQ ID NO: 168259 - DNA, 27 bp, Artificial sequence
  SiRNA target sequence
tttgcctgtagataaaaatggaatagt

SEQ ID NO: 168260 - DNA, 27 bp, Artificial sequence
  SiRNA target sequence
ttgcctgtagataaaaatggaatagta

SEQ ID NO: 168261 - DNA, 27 bp, Artificial sequence
  SiRNA target sequence
tgcctgtagataaaaatggaatagtag

SEQ ID NO: 168262 - DNA, 27 bp, Artificial sequence
  SiRNA target sequence
gcctgtagataaaaatggaatagtaga

SEQ ID NO: 168263 - DNA, 27 bp, Artificial sequence
  SiRNA target sequence
cctgtagataaaaatggaatagtagat

SEQ ID NO: 168264 - DNA, 27 bp, Artificial sequence
  SiRNA target sequence
ctgtagataaaaatggaatagtagatc

SEQ ID NO: 168265 - DNA, 27 bp, Artificial sequence
  SiRNA target sequence
tgtagataaaaatggaatagtagatcc

SEQ ID NO: 168266 - DNA, 27 bp, Artificial sequence
  SiRNA target sequence
gtagataaaaatggaatagtagatccg

SEQ ID NO: 168267 - DNA, 27 bp, Artificial sequence
  SiRNA target sequence
tagataaaaatggaatagtagatccgc

SEQ ID NO: 168268 - DNA, 27 bp, Artificial sequence
  SiRNA target sequence
agataaaaatggaatagtagatccgca

SEQ ID NO: 168269 - DNA, 27 bp, Artificial sequence
  SiRNA target sequence
gataaaaatggaatagtagatccgcaa

SEQ ID NO: 168270 - DNA, 27 bp, Artificial sequence
  SiRNA target sequence
ataaaaatggaatagtagatccgcaat

SEQ ID NO: 168271 - DNA, 27 bp, Artificial sequence
  SiRNA target sequence
taaaaatggaatagtagatccgcaatt

SEQ ID NO: 168272 - DNA, 27 bp, Artificial sequence
  SiRNA target sequence
aaaaatggaatagtagatccgcaatta

SEQ ID NO: 168273 - DNA, 27 bp, Artificial sequence
  SiRNA target sequence
aaaatggaatagtagatccgcaattaa

SEQ ID NO: 168274 - DNA, 27 bp, Artificial sequence
  SiRNA target sequence
aaatggaatagtagatccgcaattaat

SEQ ID NO: 168275 - DNA, 27 bp, Artificial sequence
  SiRNA target sequence
aatggaatagtagatccgcaattaata

SEQ ID NO: 168276 - DNA, 27 bp, Artificial sequence
  SiRNA target sequence
atggaatagtagatccgcaattaataa

SEQ ID NO: 168277 - DNA, 27 bp, Artificial sequence
  SiRNA target sequence
tggaatagtagatccgcaattaataaa

SEQ ID NO: 168278 - DNA, 27 bp, Artificial sequence
  SiRNA target sequence
ggaatagtagatccgcaattaataaaa

SEQ ID NO: 168279 - DNA, 27 bp, Artificial sequence
  SiRNA target sequence
gaatagtagatccgcaattaataaaaa

SEQ ID NO: 168280 - DNA, 27 bp, Artificial sequence
  SiRNA target sequence
aatagtagatccgcaattaataaaaaa

SEQ ID NO: 168281 - DNA, 27 bp, Artificial sequence
  SiRNA target sequence
atagtagatccgcaattaataaaaaac

SEQ ID NO: 168282 - DNA, 27 bp, Artificial sequence
  SiRNA target sequence
tagtagatccgcaattaataaaaaaca

SEQ ID NO: 168283 - DNA, 27 bp, Artificial sequence
  SiRNA target sequence
agtagatccgcaattaataaaaaacag

SEQ ID NO: 168284 - DNA, 27 bp, Artificial sequence
  SiRNA target sequence
gtagatccgcaattaataaaaaacagt

SEQ ID NO: 168285 - DNA, 27 bp, Artificial sequence
  SiRNA target sequence
tagatccgcaattaataaaaaacagta

SEQ ID NO: 168286 - DNA, 27 bp, Artificial sequence
  SiRNA target sequence
agatccgcaattaataaaaaacagtat

SEQ ID NO: 168287 - DNA, 27 bp, Artificial sequence
  SiRNA target sequence
gatccgcaattaataaaaaacagtatt

SEQ ID NO: 168288 - DNA, 27 bp, Artificial sequence
  SiRNA target sequence
atccgcaattaataaaaaacagtatta

SEQ ID NO: 168289 - DNA, 27 bp, Artificial sequence
  SiRNA target sequence
tccgcaattaataaaaaacagtattac

SEQ ID NO: 168290 - DNA, 27 bp, Artificial sequence
  SiRNA target sequence
ccgcaattaataaaaaacagtattact

SEQ ID NO: 168291 - DNA, 27 bp, Artificial sequence
  SiRNA target sequence
cgcaattaataaaaaacagtattacta

SEQ ID NO: 168292 - DNA, 27 bp, Artificial sequence
  SiRNA target sequence
gcaattaataaaaaacagtattactaa

SEQ ID NO: 168293 - DNA, 27 bp, Artificial sequence
  SiRNA target sequence
caattaataaaaaacagtattactaaa

SEQ ID NO: 168294 - DNA, 27 bp, Artificial sequence
  SiRNA target sequence
aattaataaaaaacagtattactaaag

SEQ ID NO: 168295 - DNA, 27 bp, Artificial sequence
  SiRNA target sequence
attaataaaaaacagtattactaaaga

SEQ ID NO: 168296 - DNA, 27 bp, Artificial sequence
  SiRNA target sequence
ttaataaaaaacagtattactaaagat

SEQ ID NO: 168297 - DNA, 27 bp, Artificial sequence
  SiRNA target sequence
taataaaaaacagtattactaaagata

SEQ ID NO: 168298 - DNA, 27 bp, Artificial sequence
  SiRNA target sequence
aataaaaaacagtattactaaagatac

SEQ ID NO: 168299 - DNA, 27 bp, Artificial sequence
  SiRNA target sequence
ataaaaaacagtattactaaagatacc

SEQ ID NO: 168300 - DNA, 27 bp, Artificial sequence
  SiRNA target sequence
taaaaaacagtattactaaagataccg

SEQ ID NO: 168301 - DNA, 27 bp, Artificial sequence
  SiRNA target sequence
aaaaaacagtattactaaagataccgc

SEQ ID NO: 168302 - DNA, 27 bp, Artificial sequence
  SiRNA target sequence
aaaaacagtattactaaagataccgct

SEQ ID NO: 168303 - DNA, 27 bp, Artificial sequence
  SiRNA target sequence
aaaacagtattactaaagataccgctt

SEQ ID NO: 168304 - DNA, 27 bp, Artificial sequence
  SiRNA target sequence
aaacagtattactaaagataccgcttt

SEQ ID NO: 168305 - DNA, 27 bp, Artificial sequence
  SiRNA target sequence
aacagtattactaaagataccgctttg

SEQ ID NO: 168306 - DNA, 27 bp, Artificial sequence
  SiRNA target sequence
acagtattactaaagataccgctttgg

SEQ ID NO: 168307 - DNA, 27 bp, Artificial sequence
  SiRNA target sequence
cagtattactaaagataccgctttggt

SEQ ID NO: 168308 - DNA, 27 bp, Artificial sequence
  SiRNA target sequence
agtattactaaagataccgctttggtg

SEQ ID NO: 168309 - DNA, 27 bp, Artificial sequence
  SiRNA target sequence
gtattactaaagataccgctttggtgt

SEQ ID NO: 168310 - DNA, 27 bp, Artificial sequence
  SiRNA target sequence
tattactaaagataccgctttggtgtc

SEQ ID NO: 168311 - DNA, 27 bp, Artificial sequence
  SiRNA target sequence
attactaaagataccgctttggtgtct

SEQ ID NO: 168312 - DNA, 27 bp, Artificial sequence
  SiRNA target sequence
ttactaaagataccgctttggtgtctg

SEQ ID NO: 168313 - DNA, 27 bp, Artificial sequence
  SiRNA target sequence
tactaaagataccgctttggtgtctgt

SEQ ID NO: 168314 - DNA, 27 bp, Artificial sequence
  SiRNA target sequence
actaaagataccgctttggtgtctgtt

SEQ ID NO: 168315 - DNA, 27 bp, Artificial sequence
  SiRNA target sequence
ctaaagataccgctttggtgtctgtta

SEQ ID NO: 168316 - DNA, 27 bp, Artificial sequence
  SiRNA target sequence
taaagataccgctttggtgtctgttat

SEQ ID NO: 168317 - DNA, 27 bp, Artificial sequence
  SiRNA target sequence
aaagataccgctttggtgtctgttatg

SEQ ID NO: 168318 - DNA, 27 bp, Artificial sequence
  SiRNA target sequence
aagataccgctttggtgtctgttatgg

SEQ ID NO: 168319 - DNA, 27 bp, Artificial sequence
  SiRNA target sequence
agataccgctttggtgtctgttatggc

SEQ ID NO: 168320 - DNA, 27 bp, Artificial sequence
  SiRNA target sequence
gataccgctttggtgtctgttatggct

SEQ ID NO: 168321 - DNA, 27 bp, Artificial sequence
  SiRNA target sequence
ataccgctttggtgtctgttatggctg

SEQ ID NO: 168322 - DNA, 27 bp, Artificial sequence
  SiRNA target sequence
taccgctttggtgtctgttatggctgt

SEQ ID NO: 168323 - DNA, 27 bp, Artificial sequence
  SiRNA target sequence
accgctttggtgtctgttatggctgtt

SEQ ID NO: 168324 - DNA, 27 bp, Artificial sequence
  SiRNA target sequence
ccgctttggtgtctgttatggctgtta

SEQ ID NO: 168325 - DNA, 27 bp, Artificial sequence
  SiRNA target sequence
cgctttggtgtctgttatggctgttaa

SEQ ID NO: 168326 - DNA, 27 bp, Artificial sequence
  SiRNA target sequence
gctttggtgtctgttatggctgttaac

SEQ ID NO: 168327 - DNA, 27 bp, Artificial sequence
  SiRNA target sequence
ctttggtgtctgttatggctgttaaca

SEQ ID NO: 168328 - DNA, 27 bp, Artificial sequence
  SiRNA target sequence
tttggtgtctgttatggctgttaacaa

SEQ ID NO: 168329 - DNA, 27 bp, Artificial sequence
  SiRNA target sequence
ttggtgtctgttatggctgttaacaac

SEQ ID NO: 168330 - DNA, 27 bp, Artificial sequence
  SiRNA target sequence
tggtgtctgttatggctgttaacaacg

SEQ ID NO: 168331 - DNA, 27 bp, Artificial sequence
  SiRNA target sequence
ggtgtctgttatggctgttaacaacga

SEQ ID NO: 168332 - DNA, 27 bp, Artificial sequence
  SiRNA target sequence
gtgtctgttatggctgttaacaacgaa

SEQ ID NO: 168333 - DNA, 27 bp, Artificial sequence
  SiRNA target sequence
tgtctgttatggctgttaacaacgaaa

SEQ ID NO: 168334 - DNA, 27 bp, Artificial sequence
  SiRNA target sequence
gtctgttatggctgttaacaacgaaat

SEQ ID NO: 168335 - DNA, 27 bp, Artificial sequence
  SiRNA target sequence
tctgttatggctgttaacaacgaaatg

SEQ ID NO: 168336 - DNA, 27 bp, Artificial sequence
  SiRNA target sequence
ctgttatggctgttaacaacgaaatgg

SEQ ID NO: 168337 - DNA, 27 bp, Artificial sequence
  SiRNA target sequence
tgttatggctgttaacaacgaaatggg

SEQ ID NO: 168338 - DNA, 27 bp, Artificial sequence
  SiRNA target sequence
gttatggctgttaacaacgaaatggga

SEQ ID NO: 168339 - DNA, 27 bp, Artificial sequence
  SiRNA target sequence
ttatggctgttaacaacgaaatgggag

SEQ ID NO: 168340 - DNA, 27 bp, Artificial sequence
  SiRNA target sequence
tatggctgttaacaacgaaatgggagc

SEQ ID NO: 168341 - DNA, 27 bp, Artificial sequence
  SiRNA target sequence
atggctgttaacaacgaaatgggagca

SEQ ID NO: 168342 - DNA, 27 bp, Artificial sequence
  SiRNA target sequence
tggctgttaacaacgaaatgggagcaa

SEQ ID NO: 168343 - DNA, 27 bp, Artificial sequence
  SiRNA target sequence
ggctgttaacaacgaaatgggagcaat

SEQ ID NO: 168344 - DNA, 27 bp, Artificial sequence
  SiRNA target sequence
gctgttaacaacgaaatgggagcaata

SEQ ID NO: 168345 - DNA, 27 bp, Artificial sequence
  SiRNA target sequence
ctgttaacaacgaaatgggagcaatac

SEQ ID NO: 168346 - DNA, 27 bp, Artificial sequence
  SiRNA target sequence
tgttaacaacgaaatgggagcaataca

SEQ ID NO: 168347 - DNA, 27 bp, Artificial sequence
  SiRNA target sequence
gttaacaacgaaatgggagcaatacaa

SEQ ID NO: 168348 - DNA, 27 bp, Artificial sequence
  SiRNA target sequence
ttaacaacgaaatgggagcaatacaac

SEQ ID NO: 168349 - DNA, 27 bp, Artificial sequence
  SiRNA target sequence
taacaacgaaatgggagcaatacaacc

SEQ ID NO: 168350 - DNA, 27 bp, Artificial sequence
  SiRNA target sequence
aacaacgaaatgggagcaatacaaccg

SEQ ID NO: 168351 - DNA, 27 bp, Artificial sequence
  SiRNA target sequence
acaacgaaatgggagcaatacaaccgc

SEQ ID NO: 168352 - DNA, 27 bp, Artificial sequence
  SiRNA target sequence
caacgaaatgggagcaatacaaccgct

SEQ ID NO: 168353 - DNA, 27 bp, Artificial sequence
  SiRNA target sequence
aacgaaatgggagcaatacaaccgctt

SEQ ID NO: 168354 - DNA, 27 bp, Artificial sequence
  SiRNA target sequence
acgaaatgggagcaatacaaccgctta

SEQ ID NO: 168355 - DNA, 27 bp, Artificial sequence
  SiRNA target sequence
cgaaatgggagcaatacaaccgcttaa

SEQ ID NO: 168356 - DNA, 27 bp, Artificial sequence
  SiRNA target sequence
gaaatgggagcaatacaaccgcttaaa

SEQ ID NO: 168357 - DNA, 27 bp, Artificial sequence
  SiRNA target sequence
aaatgggagcaatacaaccgcttaaag

SEQ ID NO: 168358 - DNA, 27 bp, Artificial sequence
  SiRNA target sequence
aatgggagcaatacaaccgcttaaaga

SEQ ID NO: 168359 - DNA, 27 bp, Artificial sequence
  SiRNA target sequence
atgggagcaatacaaccgcttaaagaa

SEQ ID NO: 168360 - DNA, 27 bp, Artificial sequence
  SiRNA target sequence
tgggagcaatacaaccgcttaaagaaa

SEQ ID NO: 168361 - DNA, 27 bp, Artificial sequence
  SiRNA target sequence
gggagcaatacaaccgcttaaagaaat

SEQ ID NO: 168362 - DNA, 27 bp, Artificial sequence
  SiRNA target sequence
ggagcaatacaaccgcttaaagaaata

SEQ ID NO: 168363 - DNA, 27 bp, Artificial sequence
  SiRNA target sequence
gagcaatacaaccgcttaaagaaatag

SEQ ID NO: 168364 - DNA, 27 bp, Artificial sequence
  SiRNA target sequence
agcaatacaaccgcttaaagaaatagg

SEQ ID NO: 168365 - DNA, 27 bp, Artificial sequence
  SiRNA target sequence
gcaatacaaccgcttaaagaaatagga

SEQ ID NO: 168366 - DNA, 27 bp, Artificial sequence
  SiRNA target sequence
caatacaaccgcttaaagaaataggaa

SEQ ID NO: 168367 - DNA, 27 bp, Artificial sequence
  SiRNA target sequence
aatacaaccgcttaaagaaataggaag

SEQ ID NO: 168368 - DNA, 27 bp, Artificial sequence
  SiRNA target sequence
atacaaccgcttaaagaaataggaaga

SEQ ID NO: 168369 - DNA, 27 bp, Artificial sequence
  SiRNA target sequence
tacaaccgcttaaagaaataggaagaa

SEQ ID NO: 168370 - DNA, 27 bp, Artificial sequence
  SiRNA target sequence
acaaccgcttaaagaaataggaagaat

SEQ ID NO: 168371 - DNA, 27 bp, Artificial sequence
  SiRNA target sequence
caaccgcttaaagaaataggaagaata

SEQ ID NO: 168372 - DNA, 27 bp, Artificial sequence
  SiRNA target sequence
aaccgcttaaagaaataggaagaatat

SEQ ID NO: 168373 - DNA, 27 bp, Artificial sequence
  SiRNA target sequence
accgcttaaagaaataggaagaatatg

SEQ ID NO: 168374 - DNA, 27 bp, Artificial sequence
  SiRNA target sequence
ccgcttaaagaaataggaagaatatgt

SEQ ID NO: 168375 - DNA, 27 bp, Artificial sequence
  SiRNA target sequence
cgcttaaagaaataggaagaatatgta

SEQ ID NO: 168376 - DNA, 27 bp, Artificial sequence
  SiRNA target sequence
gcttaaagaaataggaagaatatgtaa

SEQ ID NO: 168377 - DNA, 27 bp, Artificial sequence
  SiRNA target sequence
cttaaagaaataggaagaatatgtaaa

SEQ ID NO: 168378 - DNA, 27 bp, Artificial sequence
  SiRNA target sequence
ttaaagaaataggaagaatatgtaaag

SEQ ID NO: 168379 - DNA, 27 bp, Artificial sequence
  SiRNA target sequence
taaagaaataggaagaatatgtaaaga

SEQ ID NO: 168380 - DNA, 27 bp, Artificial sequence
  SiRNA target sequence
aaagaaataggaagaatatgtaaagaa

SEQ ID NO: 168381 - DNA, 27 bp, Artificial sequence
  SiRNA target sequence
aagaaataggaagaatatgtaaagaaa

SEQ ID NO: 168382 - DNA, 27 bp, Artificial sequence
  SiRNA target sequence
agaaataggaagaatatgtaaagaaaa

SEQ ID NO: 168383 - DNA, 27 bp, Artificial sequence
  SiRNA target sequence
gaaataggaagaatatgtaaagaaaat

SEQ ID NO: 168384 - DNA, 27 bp, Artificial sequence
  SiRNA target sequence
aaataggaagaatatgtaaagaaaata

SEQ ID NO: 168385 - DNA, 27 bp, Artificial sequence
  SiRNA target sequence
aataggaagaatatgtaaagaaaataa

SEQ ID NO: 168386 - DNA, 27 bp, Artificial sequence
  SiRNA target sequence
ataggaagaatatgtaaagaaaataat

SEQ ID NO: 168387 - DNA, 27 bp, Artificial sequence
  SiRNA target sequence
taggaagaatatgtaaagaaaataata

SEQ ID NO: 168388 - DNA, 27 bp, Artificial sequence
  SiRNA target sequence
aggaagaatatgtaaagaaaataatat

SEQ ID NO: 168389 - DNA, 27 bp, Artificial sequence
  SiRNA target sequence
ggaagaatatgtaaagaaaataatatt

SEQ ID NO: 168390 - DNA, 27 bp, Artificial sequence
  SiRNA target sequence
gaagaatatgtaaagaaaataatattt

SEQ ID NO: 168391 - DNA, 27 bp, Artificial sequence
  SiRNA target sequence
aagaatatgtaaagaaaataatatttt

SEQ ID NO: 168392 - DNA, 27 bp, Artificial sequence
  SiRNA target sequence
agaatatgtaaagaaaataatatttta

SEQ ID NO: 168393 - DNA, 27 bp, Artificial sequence
  SiRNA target sequence
gaatatgtaaagaaaataatattttat

SEQ ID NO: 168394 - DNA, 27 bp, Artificial sequence
  SiRNA target sequence
aatatgtaaagaaaataatattttatt

SEQ ID NO: 168395 - DNA, 27 bp, Artificial sequence
  SiRNA target sequence
atatgtaaagaaaataatattttattt

SEQ ID NO: 168396 - DNA, 27 bp, Artificial sequence
  SiRNA target sequence
tatgtaaagaaaataatattttatttc

SEQ ID NO: 168397 - DNA, 27 bp, Artificial sequence
  SiRNA target sequence
atgtaaagaaaataatattttatttca

SEQ ID NO: 168398 - DNA, 27 bp, Artificial sequence
  SiRNA target sequence
tgtaaagaaaataatattttatttcac

SEQ ID NO: 168399 - DNA, 27 bp, Artificial sequence
  SiRNA target sequence
gtaaagaaaataatattttatttcaca

SEQ ID NO: 168400 - DNA, 27 bp, Artificial sequence
  SiRNA target sequence
taaagaaaataatattttatttcacac

SEQ ID NO: 168401 - DNA, 27 bp, Artificial sequence
  SiRNA target sequence
aaagaaaataatattttatttcacact

SEQ ID NO: 168402 - DNA, 27 bp, Artificial sequence
  SiRNA target sequence
aagaaaataatattttatttcacactg

SEQ ID NO: 168403 - DNA, 27 bp, Artificial sequence
  SiRNA target sequence
agaaaataatattttatttcacactga

SEQ ID NO: 168404 - DNA, 27 bp, Artificial sequence
  SiRNA target sequence
gaaaataatattttatttcacactgat

SEQ ID NO: 168405 - DNA, 27 bp, Artificial sequence
  SiRNA target sequence
aaaataatattttatttcacactgatg

SEQ ID NO: 168406 - DNA, 27 bp, Artificial sequence
  SiRNA target sequence
aaataatattttatttcacactgatgc

SEQ ID NO: 168407 - DNA, 27 bp, Artificial sequence
  SiRNA target sequence
aataatattttatttcacactgatgca

SEQ ID NO: 168408 - DNA, 27 bp, Artificial sequence
  SiRNA target sequence
ataatattttatttcacactgatgcag

SEQ ID NO: 168409 - DNA, 27 bp, Artificial sequence
  SiRNA target sequence
taatattttatttcacactgatgcagc

SEQ ID NO: 168410 - DNA, 27 bp, Artificial sequence
  SiRNA target sequence
aatattttatttcacactgatgcagca

SEQ ID NO: 168411 - DNA, 27 bp, Artificial sequence
  SiRNA target sequence
atattttatttcacactgatgcagcac

SEQ ID NO: 168412 - DNA, 27 bp, Artificial sequence
  SiRNA target sequence
tattttatttcacactgatgcagcaca

SEQ ID NO: 168413 - DNA, 27 bp, Artificial sequence
  SiRNA target sequence
attttatttcacactgatgcagcacaa

SEQ ID NO: 168414 - DNA, 27 bp, Artificial sequence
  SiRNA target sequence
ttttatttcacactgatgcagcacaag

SEQ ID NO: 168415 - DNA, 27 bp, Artificial sequence
  SiRNA target sequence
tttatttcacactgatgcagcacaagc

SEQ ID NO: 168416 - DNA, 27 bp, Artificial sequence
  SiRNA target sequence
ttatttcacactgatgcagcacaagca

SEQ ID NO: 168417 - DNA, 27 bp, Artificial sequence
  SiRNA target sequence
tatttcacactgatgcagcacaagcag

SEQ ID NO: 168418 - DNA, 27 bp, Artificial sequence
  SiRNA target sequence
atttcacactgatgcagcacaagcagt

SEQ ID NO: 168419 - DNA, 27 bp, Artificial sequence
  SiRNA target sequence
tttcacactgatgcagcacaagcagtt

SEQ ID NO: 168420 - DNA, 27 bp, Artificial sequence
  SiRNA target sequence
ttcacactgatgcagcacaagcagttg

SEQ ID NO: 168421 - DNA, 27 bp, Artificial sequence
  SiRNA target sequence
tcacactgatgcagcacaagcagttgg

SEQ ID NO: 168422 - DNA, 27 bp, Artificial sequence
  SiRNA target sequence
cacactgatgcagcacaagcagttggt

SEQ ID NO: 168423 - DNA, 27 bp, Artificial sequence
  SiRNA target sequence
acactgatgcagcacaagcagttggta

SEQ ID NO: 168424 - DNA, 27 bp, Artificial sequence
  SiRNA target sequence
cactgatgcagcacaagcagttggtaa

SEQ ID NO: 168425 - DNA, 27 bp, Artificial sequence
  SiRNA target sequence
actgatgcagcacaagcagttggtaat

SEQ ID NO: 168426 - DNA, 27 bp, Artificial sequence
  SiRNA target sequence
ctgatgcagcacaagcagttggtaata

SEQ ID NO: 168427 - DNA, 27 bp, Artificial sequence
  SiRNA target sequence
tgatgcagcacaagcagttggtaatat

SEQ ID NO: 168428 - DNA, 27 bp, Artificial sequence
  SiRNA target sequence
gatgcagcacaagcagttggtaatata

SEQ ID NO: 168429 - DNA, 27 bp, Artificial sequence
  SiRNA target sequence
atgcagcacaagcagttggtaatatag

SEQ ID NO: 168430 - DNA, 27 bp, Artificial sequence
  SiRNA target sequence
tgcagcacaagcagttggtaatataga

SEQ ID NO: 168431 - DNA, 27 bp, Artificial sequence
  SiRNA target sequence
gcagcacaagcagttggtaatatagat

SEQ ID NO: 168432 - DNA, 27 bp, Artificial sequence
  SiRNA target sequence
cagcacaagcagttggtaatatagata

SEQ ID NO: 168433 - DNA, 27 bp, Artificial sequence
  SiRNA target sequence
agcacaagcagttggtaatatagatat

SEQ ID NO: 168434 - DNA, 27 bp, Artificial sequence
  SiRNA target sequence
gcacaagcagttggtaatatagatatt

SEQ ID NO: 168435 - DNA, 27 bp, Artificial sequence
  SiRNA target sequence
cacaagcagttggtaatatagatattg

SEQ ID NO: 168436 - DNA, 27 bp, Artificial sequence
  SiRNA target sequence
acaagcagttggtaatatagatattga

SEQ ID NO: 168437 - DNA, 27 bp, Artificial sequence
  SiRNA target sequence
caagcagttggtaatatagatattgat

SEQ ID NO: 168438 - DNA, 27 bp, Artificial sequence
  SiRNA target sequence
aagcagttggtaatatagatattgatg

SEQ ID NO: 168439 - DNA, 27 bp, Artificial sequence
  SiRNA target sequence
agcagttggtaatatagatattgatgt

SEQ ID NO: 168440 - DNA, 27 bp, Artificial sequence
  SiRNA target sequence
gcagttggtaatatagatattgatgtc

SEQ ID NO: 168441 - DNA, 27 bp, Artificial sequence
  SiRNA target sequence
cagttggtaatatagatattgatgtca

SEQ ID NO: 168442 - DNA, 27 bp, Artificial sequence
  SiRNA target sequence
agttggtaatatagatattgatgtcaa

SEQ ID NO: 168443 - DNA, 27 bp, Artificial sequence
  SiRNA target sequence
gttggtaatatagatattgatgtcaat

SEQ ID NO: 168444 - DNA, 27 bp, Artificial sequence
  SiRNA target sequence
ttggtaatatagatattgatgtcaatg

SEQ ID NO: 168445 - DNA, 27 bp, Artificial sequence
  SiRNA target sequence
tggtaatatagatattgatgtcaatga

SEQ ID NO: 168446 - DNA, 27 bp, Artificial sequence
  SiRNA target sequence
ggtaatatagatattgatgtcaatgat

SEQ ID NO: 168447 - DNA, 27 bp, Artificial sequence
  SiRNA target sequence
gtaatatagatattgatgtcaatgata

SEQ ID NO: 168448 - DNA, 27 bp, Artificial sequence
  SiRNA target sequence
taatatagatattgatgtcaatgatat

SEQ ID NO: 168449 - DNA, 27 bp, Artificial sequence
  SiRNA target sequence
aatatagatattgatgtcaatgatatg

SEQ ID NO: 168450 - DNA, 27 bp, Artificial sequence
  SiRNA target sequence
atatagatattgatgtcaatgatatga

SEQ ID NO: 168451 - DNA, 27 bp, Artificial sequence
  SiRNA target sequence
tatagatattgatgtcaatgatatgaa

SEQ ID NO: 168452 - DNA, 27 bp, Artificial sequence
  SiRNA target sequence
atagatattgatgtcaatgatatgaat

SEQ ID NO: 168453 - DNA, 27 bp, Artificial sequence
  SiRNA target sequence
tagatattgatgtcaatgatatgaata

SEQ ID NO: 168454 - DNA, 27 bp, Artificial sequence
  SiRNA target sequence
agatattgatgtcaatgatatgaatat

SEQ ID NO: 168455 - DNA, 27 bp, Artificial sequence
  SiRNA target sequence
gatattgatgtcaatgatatgaatatt

SEQ ID NO: 168456 - DNA, 27 bp, Artificial sequence
  SiRNA target sequence
atattgatgtcaatgatatgaatattg

SEQ ID NO: 168457 - DNA, 27 bp, Artificial sequence
  SiRNA target sequence
tattgatgtcaatgatatgaatattga

SEQ ID NO: 168458 - DNA, 27 bp, Artificial sequence
  SiRNA target sequence
attgatgtcaatgatatgaatattgat

SEQ ID NO: 168459 - DNA, 27 bp, Artificial sequence
  SiRNA target sequence
ttgatgtcaatgatatgaatattgatt

SEQ ID NO: 168460 - DNA, 27 bp, Artificial sequence
  SiRNA target sequence
tgatgtcaatgatatgaatattgattt

SEQ ID NO: 168461 - DNA, 27 bp, Artificial sequence
  SiRNA target sequence
gatgtcaatgatatgaatattgattta

SEQ ID NO: 168462 - DNA, 27 bp, Artificial sequence
  SiRNA target sequence
atgtcaatgatatgaatattgatttac

SEQ ID NO: 168463 - DNA, 27 bp, Artificial sequence
  SiRNA target sequence
tgtcaatgatatgaatattgatttact

SEQ ID NO: 168464 - DNA, 27 bp, Artificial sequence
  SiRNA target sequence
gtcaatgatatgaatattgatttacta

SEQ ID NO: 168465 - DNA, 27 bp, Artificial sequence
  SiRNA target sequence
tcaatgatatgaatattgatttactaa

SEQ ID NO: 168466 - DNA, 27 bp, Artificial sequence
  SiRNA target sequence
caatgatatgaatattgatttactaag

SEQ ID NO: 168467 - DNA, 27 bp, Artificial sequence
  SiRNA target sequence
aatgatatgaatattgatttactaagt

SEQ ID NO: 168468 - DNA, 27 bp, Artificial sequence
  SiRNA target sequence
atgatatgaatattgatttactaagtt

SEQ ID NO: 168469 - DNA, 27 bp, Artificial sequence
  SiRNA target sequence
tgatatgaatattgatttactaagttt

SEQ ID NO: 168470 - DNA, 27 bp, Artificial sequence
  SiRNA target sequence
gatatgaatattgatttactaagttta

SEQ ID NO: 168471 - DNA, 27 bp, Artificial sequence
  SiRNA target sequence
atatgaatattgatttactaagtttat

SEQ ID NO: 168472 - DNA, 27 bp, Artificial sequence
  SiRNA target sequence
tatgaatattgatttactaagtttatc

SEQ ID NO: 168473 - DNA, 27 bp, Artificial sequence
  SiRNA target sequence
atgaatattgatttactaagtttatca

SEQ ID NO: 168474 - DNA, 27 bp, Artificial sequence
  SiRNA target sequence
tgaatattgatttactaagtttatcaa

SEQ ID NO: 168475 - DNA, 27 bp, Artificial sequence
  SiRNA target sequence
gaatattgatttactaagtttatcaag

SEQ ID NO: 168476 - DNA, 27 bp, Artificial sequence
  SiRNA target sequence
aatattgatttactaagtttatcaagt

SEQ ID NO: 168477 - DNA, 27 bp, Artificial sequence
  SiRNA target sequence
atattgatttactaagtttatcaagtc

SEQ ID NO: 168478 - DNA, 27 bp, Artificial sequence
  SiRNA target sequence
tattgatttactaagtttatcaagtca

SEQ ID NO: 168479 - DNA, 27 bp, Artificial sequence
  SiRNA target sequence
attgatttactaagtttatcaagtcat

SEQ ID NO: 168480 - DNA, 27 bp, Artificial sequence
  SiRNA target sequence
ttgatttactaagtttatcaagtcata

SEQ ID NO: 168481 - DNA, 27 bp, Artificial sequence
  SiRNA target sequence
tgatttactaagtttatcaagtcataa

SEQ ID NO: 168482 - DNA, 27 bp, Artificial sequence
  SiRNA target sequence
gatttactaagtttatcaagtcataaa

SEQ ID NO: 168483 - DNA, 27 bp, Artificial sequence
  SiRNA target sequence
atttactaagtttatcaagtcataaaa

SEQ ID NO: 168484 - DNA, 27 bp, Artificial sequence
  SiRNA target sequence
tttactaagtttatcaagtcataaaat

SEQ ID NO: 168485 - DNA, 27 bp, Artificial sequence
  SiRNA target sequence
ttactaagtttatcaagtcataaaatt

SEQ ID NO: 168486 - DNA, 27 bp, Artificial sequence
  SiRNA target sequence
tactaagtttatcaagtcataaaattt

SEQ ID NO: 168487 - DNA, 27 bp, Artificial sequence
  SiRNA target sequence
actaagtttatcaagtcataaaattta

SEQ ID NO: 168488 - DNA, 27 bp, Artificial sequence
  SiRNA target sequence
ctaagtttatcaagtcataaaatttat

SEQ ID NO: 168489 - DNA, 27 bp, Artificial sequence
  SiRNA target sequence
taagtttatcaagtcataaaatttatg

SEQ ID NO: 168490 - DNA, 27 bp, Artificial sequence
  SiRNA target sequence
aagtttatcaagtcataaaatttatgg

SEQ ID NO: 168491 - DNA, 27 bp, Artificial sequence
  SiRNA target sequence
agtttatcaagtcataaaatttatggt

SEQ ID NO: 168492 - DNA, 27 bp, Artificial sequence
  SiRNA target sequence
gtttatcaagtcataaaatttatggtc

SEQ ID NO: 168493 - DNA, 27 bp, Artificial sequence
  SiRNA target sequence
tttatcaagtcataaaatttatggtcc

SEQ ID NO: 168494 - DNA, 27 bp, Artificial sequence
  SiRNA target sequence
ttatcaagtcataaaatttatggtcca

SEQ ID NO: 168495 - DNA, 27 bp, Artificial sequence
  SiRNA target sequence
tatcaagtcataaaatttatggtccaa

SEQ ID NO: 168496 - DNA, 27 bp, Artificial sequence
  SiRNA target sequence
atcaagtcataaaatttatggtccaaa

SEQ ID NO: 168497 - DNA, 27 bp, Artificial sequence
  SiRNA target sequence
tcaagtcataaaatttatggtccaaaa

SEQ ID NO: 168498 - DNA, 27 bp, Artificial sequence
  SiRNA target sequence
caagtcataaaatttatggtccaaaag

SEQ ID NO: 168499 - DNA, 27 bp, Artificial sequence
  SiRNA target sequence
aagtcataaaatttatggtccaaaagg

SEQ ID NO: 168500 - DNA, 27 bp, Artificial sequence
  SiRNA target sequence
agtcataaaatttatggtccaaaaggt

SEQ ID NO: 168501 - DNA, 27 bp, Artificial sequence
  SiRNA target sequence
gtcataaaatttatggtccaaaaggtg

SEQ ID NO: 168502 - DNA, 27 bp, Artificial sequence
  SiRNA target sequence
tcataaaatttatggtccaaaaggtgt

SEQ ID NO: 168503 - DNA, 27 bp, Artificial sequence
  SiRNA target sequence
cataaaatttatggtccaaaaggtgtt

SEQ ID NO: 168504 - DNA, 27 bp, Artificial sequence
  SiRNA target sequence
ataaaatttatggtccaaaaggtgttg

SEQ ID NO: 168505 - DNA, 27 bp, Artificial sequence
  SiRNA target sequence
taaaatttatggtccaaaaggtgttgg

SEQ ID NO: 168506 - DNA, 27 bp, Artificial sequence
  SiRNA target sequence
aaaatttatggtccaaaaggtgttggt

SEQ ID NO: 168507 - DNA, 27 bp, Artificial sequence
  SiRNA target sequence
aaatttatggtccaaaaggtgttggtg

SEQ ID NO: 168508 - DNA, 27 bp, Artificial sequence
  SiRNA target sequence
aatttatggtccaaaaggtgttggtgc

SEQ ID NO: 168509 - DNA, 27 bp, Artificial sequence
  SiRNA target sequence
atttatggtccaaaaggtgttggtgcc

SEQ ID NO: 168510 - DNA, 27 bp, Artificial sequence
  SiRNA target sequence
tttatggtccaaaaggtgttggtgcct

SEQ ID NO: 168511 - DNA, 27 bp, Artificial sequence
  SiRNA target sequence
ttatggtccaaaaggtgttggtgcctt

SEQ ID NO: 168512 - DNA, 27 bp, Artificial sequence
  SiRNA target sequence
tatggtccaaaaggtgttggtgcctta

SEQ ID NO: 168513 - DNA, 27 bp, Artificial sequence
  SiRNA target sequence
atggtccaaaaggtgttggtgccttat

SEQ ID NO: 168514 - DNA, 27 bp, Artificial sequence
  SiRNA target sequence
tggtccaaaaggtgttggtgccttata

SEQ ID NO: 168515 - DNA, 27 bp, Artificial sequence
  SiRNA target sequence
ggtccaaaaggtgttggtgccttatac

SEQ ID NO: 168516 - DNA, 27 bp, Artificial sequence
  SiRNA target sequence
gtccaaaaggtgttggtgccttatacg

SEQ ID NO: 168517 - DNA, 27 bp, Artificial sequence
  SiRNA target sequence
tccaaaaggtgttggtgccttatacgt

SEQ ID NO: 168518 - DNA, 27 bp, Artificial sequence
  SiRNA target sequence
ccaaaaggtgttggtgccttatacgtc

SEQ ID NO: 168519 - DNA, 27 bp, Artificial sequence
  SiRNA target sequence
caaaaggtgttggtgccttatacgtca

SEQ ID NO: 168520 - DNA, 27 bp, Artificial sequence
  SiRNA target sequence
aaaaggtgttggtgccttatacgtcag

SEQ ID NO: 168521 - DNA, 27 bp, Artificial sequence
  SiRNA target sequence
aaaggtgttggtgccttatacgtcaga

SEQ ID NO: 168522 - DNA, 27 bp, Artificial sequence
  SiRNA target sequence
aaggtgttggtgccttatacgtcagaa

SEQ ID NO: 168523 - DNA, 27 bp, Artificial sequence
  SiRNA target sequence
aggtgttggtgccttatacgtcagaag

SEQ ID NO: 168524 - DNA, 27 bp, Artificial sequence
  SiRNA target sequence
ggtgttggtgccttatacgtcagaaga

SEQ ID NO: 168525 - DNA, 27 bp, Artificial sequence
  SiRNA target sequence
gtgttggtgccttatacgtcagaagaa

SEQ ID NO: 168526 - DNA, 27 bp, Artificial sequence
  SiRNA target sequence
tgttggtgccttatacgtcagaagaag

SEQ ID NO: 168527 - DNA, 27 bp, Artificial sequence
  SiRNA target sequence
gttggtgccttatacgtcagaagaagg

SEQ ID NO: 168528 - DNA, 27 bp, Artificial sequence
  SiRNA target sequence
ttggtgccttatacgtcagaagaaggc

SEQ ID NO: 168529 - DNA, 27 bp, Artificial sequence
  SiRNA target sequence
tggtgccttatacgtcagaagaaggcc

SEQ ID NO: 168530 - DNA, 27 bp, Artificial sequence
  SiRNA target sequence
ggtgccttatacgtcagaagaaggcct

SEQ ID NO: 168531 - DNA, 27 bp, Artificial sequence
  SiRNA target sequence
gtgccttatacgtcagaagaaggccta

SEQ ID NO: 168532 - DNA, 27 bp, Artificial sequence
  SiRNA target sequence
tgccttatacgtcagaagaaggcctag

SEQ ID NO: 168533 - DNA, 27 bp, Artificial sequence
  SiRNA target sequence
gccttatacgtcagaagaaggcctagg

SEQ ID NO: 168534 - DNA, 27 bp, Artificial sequence
  SiRNA target sequence
ccttatacgtcagaagaaggcctaggg

SEQ ID NO: 168535 - DNA, 27 bp, Artificial sequence
  SiRNA target sequence
cttatacgtcagaagaaggcctagggt

SEQ ID NO: 168536 - DNA, 27 bp, Artificial sequence
  SiRNA target sequence
ttatacgtcagaagaaggcctagggtg

SEQ ID NO: 168537 - DNA, 27 bp, Artificial sequence
  SiRNA target sequence
tatacgtcagaagaaggcctagggtga

SEQ ID NO: 168538 - DNA, 27 bp, Artificial sequence
  SiRNA target sequence
atacgtcagaagaaggcctagggtgag

SEQ ID NO: 168539 - DNA, 27 bp, Artificial sequence
  SiRNA target sequence
tacgtcagaagaaggcctagggtgaga

SEQ ID NO: 168540 - DNA, 27 bp, Artificial sequence
  SiRNA target sequence
acgtcagaagaaggcctagggtgagaa

SEQ ID NO: 168541 - DNA, 27 bp, Artificial sequence
  SiRNA target sequence
cgtcagaagaaggcctagggtgagaat

SEQ ID NO: 168542 - DNA, 27 bp, Artificial sequence
  SiRNA target sequence
gtcagaagaaggcctagggtgagaatg

SEQ ID NO: 168543 - DNA, 27 bp, Artificial sequence
  SiRNA target sequence
tcagaagaaggcctagggtgagaatgt

SEQ ID NO: 168544 - DNA, 27 bp, Artificial sequence
  SiRNA target sequence
cagaagaaggcctagggtgagaatgtt

SEQ ID NO: 168545 - DNA, 27 bp, Artificial sequence
  SiRNA target sequence
agaagaaggcctagggtgagaatgtta

SEQ ID NO: 168546 - DNA, 27 bp, Artificial sequence
  SiRNA target sequence
gaagaaggcctagggtgagaatgttac

SEQ ID NO: 168547 - DNA, 27 bp, Artificial sequence
  SiRNA target sequence
aagaaggcctagggtgagaatgttacc

SEQ ID NO: 168548 - DNA, 27 bp, Artificial sequence
  SiRNA target sequence
agaaggcctagggtgagaatgttacca

SEQ ID NO: 168549 - DNA, 27 bp, Artificial sequence
  SiRNA target sequence
gaaggcctagggtgagaatgttaccac

SEQ ID NO: 168550 - DNA, 27 bp, Artificial sequence
  SiRNA target sequence
aaggcctagggtgagaatgttaccact

SEQ ID NO: 168551 - DNA, 27 bp, Artificial sequence
  SiRNA target sequence
aggcctagggtgagaatgttaccactt

SEQ ID NO: 168552 - DNA, 27 bp, Artificial sequence
  SiRNA target sequence
ggcctagggtgagaatgttaccacttt

SEQ ID NO: 168553 - DNA, 27 bp, Artificial sequence
  SiRNA target sequence
gcctagggtgagaatgttaccactttt

SEQ ID NO: 168554 - DNA, 27 bp, Artificial sequence
  SiRNA target sequence
cctagggtgagaatgttaccacttttt

SEQ ID NO: 168555 - DNA, 27 bp, Artificial sequence
  SiRNA target sequence
ctagggtgagaatgttaccacttttta

SEQ ID NO: 168556 - DNA, 27 bp, Artificial sequence
  SiRNA target sequence
tagggtgagaatgttaccactttttaa

SEQ ID NO: 168557 - DNA, 27 bp, Artificial sequence
  SiRNA target sequence
agggtgagaatgttaccactttttaat

SEQ ID NO: 168558 - DNA, 27 bp, Artificial sequence
  SiRNA target sequence
gggtgagaatgttaccactttttaatg

SEQ ID NO: 168559 - DNA, 27 bp, Artificial sequence
  SiRNA target sequence
ggtgagaatgttaccactttttaatgg

SEQ ID NO: 168560 - DNA, 27 bp, Artificial sequence
  SiRNA target sequence
gtgagaatgttaccactttttaatggt

SEQ ID NO: 168561 - DNA, 27 bp, Artificial sequence
  SiRNA target sequence
tgagaatgttaccactttttaatggtg

SEQ ID NO: 168562 - DNA, 27 bp, Artificial sequence
  SiRNA target sequence
gagaatgttaccactttttaatggtgg

SEQ ID NO: 168563 - DNA, 27 bp, Artificial sequence
  SiRNA target sequence
agaatgttaccactttttaatggtggt

SEQ ID NO: 168564 - DNA, 27 bp, Artificial sequence
  SiRNA target sequence
gaatgttaccactttttaatggtggtg

SEQ ID NO: 168565 - DNA, 27 bp, Artificial sequence
  SiRNA target sequence
aatgttaccactttttaatggtggtgg

SEQ ID NO: 168566 - DNA, 27 bp, Artificial sequence
  SiRNA target sequence
atgttaccactttttaatggtggtgga

SEQ ID NO: 168567 - DNA, 27 bp, Artificial sequence
  SiRNA target sequence
tgttaccactttttaatggtggtggac

SEQ ID NO: 168568 - DNA, 27 bp, Artificial sequence
  SiRNA target sequence
gttaccactttttaatggtggtggaca

SEQ ID NO: 168569 - DNA, 27 bp, Artificial sequence
  SiRNA target sequence
ttaccactttttaatggtggtggacaa

SEQ ID NO: 168570 - DNA, 27 bp, Artificial sequence
  SiRNA target sequence
taccactttttaatggtggtggacaag

SEQ ID NO: 168571 - DNA, 27 bp, Artificial sequence
  SiRNA target sequence
accactttttaatggtggtggacaaga

SEQ ID NO: 168572 - DNA, 27 bp, Artificial sequence
  SiRNA target sequence
ccactttttaatggtggtggacaagaa

SEQ ID NO: 168573 - DNA, 27 bp, Artificial sequence
  SiRNA target sequence
cactttttaatggtggtggacaagaaa

SEQ ID NO: 168574 - DNA, 27 bp, Artificial sequence
  SiRNA target sequence
actttttaatggtggtggacaagaaag

SEQ ID NO: 168575 - DNA, 27 bp, Artificial sequence
  SiRNA target sequence
ctttttaatggtggtggacaagaaaga

SEQ ID NO: 168576 - DNA, 27 bp, Artificial sequence
  SiRNA target sequence
tttttaatggtggtggacaagaaagag

SEQ ID NO: 168577 - DNA, 27 bp, Artificial sequence
  SiRNA target sequence
ttttaatggtggtggacaagaaagagg

SEQ ID NO: 168578 - DNA, 27 bp, Artificial sequence
  SiRNA target sequence
tttaatggtggtggacaagaaagagga

SEQ ID NO: 168579 - DNA, 27 bp, Artificial sequence
  SiRNA target sequence
ttaatggtggtggacaagaaagaggat

SEQ ID NO: 168580 - DNA, 27 bp, Artificial sequence
  SiRNA target sequence
taatggtggtggacaagaaagaggatt

SEQ ID NO: 168581 - DNA, 27 bp, Artificial sequence
  SiRNA target sequence
aatggtggtggacaagaaagaggatta

SEQ ID NO: 168582 - DNA, 27 bp, Artificial sequence
  SiRNA target sequence
atggtggtggacaagaaagaggattaa

SEQ ID NO: 168583 - DNA, 27 bp, Artificial sequence
  SiRNA target sequence
tggtggtggacaagaaagaggattaag

SEQ ID NO: 168584 - DNA, 27 bp, Artificial sequence
  SiRNA target sequence
ggtggtggacaagaaagaggattaaga

SEQ ID NO: 168585 - DNA, 27 bp, Artificial sequence
  SiRNA target sequence
gtggtggacaagaaagaggattaagaa

SEQ ID NO: 168586 - DNA, 27 bp, Artificial sequence
  SiRNA target sequence
tggtggacaagaaagaggattaagaag

SEQ ID NO: 168587 - DNA, 27 bp, Artificial sequence
  SiRNA target sequence
ggtggacaagaaagaggattaagaagt

SEQ ID NO: 168588 - DNA, 27 bp, Artificial sequence
  SiRNA target sequence
gtggacaagaaagaggattaagaagtg

SEQ ID NO: 168589 - DNA, 27 bp, Artificial sequence
  SiRNA target sequence
tggacaagaaagaggattaagaagtgg

SEQ ID NO: 168590 - DNA, 27 bp, Artificial sequence
  SiRNA target sequence
ggacaagaaagaggattaagaagtggg

SEQ ID NO: 168591 - DNA, 27 bp, Artificial sequence
  SiRNA target sequence
gacaagaaagaggattaagaagtggga

SEQ ID NO: 168592 - DNA, 27 bp, Artificial sequence
  SiRNA target sequence
acaagaaagaggattaagaagtgggac

SEQ ID NO: 168593 - DNA, 27 bp, Artificial sequence
  SiRNA target sequence
caagaaagaggattaagaagtgggaca

SEQ ID NO: 168594 - DNA, 27 bp, Artificial sequence
  SiRNA target sequence
aagaaagaggattaagaagtgggacaa

SEQ ID NO: 168595 - DNA, 27 bp, Artificial sequence
  SiRNA target sequence
agaaagaggattaagaagtgggacaac

SEQ ID NO: 168596 - DNA, 27 bp, Artificial sequence
  SiRNA target sequence
gaaagaggattaagaagtgggacaact

SEQ ID NO: 168597 - DNA, 27 bp, Artificial sequence
  SiRNA target sequence
aaagaggattaagaagtgggacaactt

SEQ ID NO: 168598 - DNA, 27 bp, Artificial sequence
  SiRNA target sequence
aagaggattaagaagtgggacaacttc

SEQ ID NO: 168599 - DNA, 27 bp, Artificial sequence
  SiRNA target sequence
agaggattaagaagtgggacaacttct

SEQ ID NO: 168600 - DNA, 27 bp, Artificial sequence
  SiRNA target sequence
gaggattaagaagtgggacaacttctc

SEQ ID NO: 168601 - DNA, 27 bp, Artificial sequence
  SiRNA target sequence
aggattaagaagtgggacaacttctcc

SEQ ID NO: 168602 - DNA, 27 bp, Artificial sequence
  SiRNA target sequence
ggattaagaagtgggacaacttctcca

SEQ ID NO: 168603 - DNA, 27 bp, Artificial sequence
  SiRNA target sequence
gattaagaagtgggacaacttctccac

SEQ ID NO: 168604 - DNA, 27 bp, Artificial sequence
  SiRNA target sequence
attaagaagtgggacaacttctccacc

SEQ ID NO: 168605 - DNA, 27 bp, Artificial sequence
  SiRNA target sequence
ttaagaagtgggacaacttctccacct

SEQ ID NO: 168606 - DNA, 27 bp, Artificial sequence
  SiRNA target sequence
taagaagtgggacaacttctccacctt

SEQ ID NO: 168607 - DNA, 27 bp, Artificial sequence
  SiRNA target sequence
aagaagtgggacaacttctccaccttt

SEQ ID NO: 168608 - DNA, 27 bp, Artificial sequence
  SiRNA target sequence
agaagtgggacaacttctccaccttta

SEQ ID NO: 168609 - DNA, 27 bp, Artificial sequence
  SiRNA target sequence
gaagtgggacaacttctccacctttag

SEQ ID NO: 168610 - DNA, 27 bp, Artificial sequence
  SiRNA target sequence
aagtgggacaacttctccacctttagt

SEQ ID NO: 168611 - DNA, 27 bp, Artificial sequence
  SiRNA target sequence
agtgggacaacttctccacctttagtt

SEQ ID NO: 168612 - DNA, 27 bp, Artificial sequence
  SiRNA target sequence
gtgggacaacttctccacctttagttg

SEQ ID NO: 168613 - DNA, 27 bp, Artificial sequence
  SiRNA target sequence
tgggacaacttctccacctttagttgt

SEQ ID NO: 168614 - DNA, 27 bp, Artificial sequence
  SiRNA target sequence
gggacaacttctccacctttagttgtt

SEQ ID NO: 168615 - DNA, 27 bp, Artificial sequence
  SiRNA target sequence
ggacaacttctccacctttagttgttg

SEQ ID NO: 168616 - DNA, 27 bp, Artificial sequence
  SiRNA target sequence
gacaacttctccacctttagttgttgg

SEQ ID NO: 168617 - DNA, 27 bp, Artificial sequence
  SiRNA target sequence
acaacttctccacctttagttgttgga

SEQ ID NO: 168618 - DNA, 27 bp, Artificial sequence
  SiRNA target sequence
caacttctccacctttagttgttggat

SEQ ID NO: 168619 - DNA, 27 bp, Artificial sequence
  SiRNA target sequence
aacttctccacctttagttgttggatt

SEQ ID NO: 168620 - DNA, 27 bp, Artificial sequence
  SiRNA target sequence
acttctccacctttagttgttggatta

SEQ ID NO: 168621 - DNA, 27 bp, Artificial sequence
  SiRNA target sequence
cttctccacctttagttgttggattag

SEQ ID NO: 168622 - DNA, 27 bp, Artificial sequence
  SiRNA target sequence
ttctccacctttagttgttggattagg

SEQ ID NO: 168623 - DNA, 27 bp, Artificial sequence
  SiRNA target sequence
tctccacctttagttgttggattaggc

SEQ ID NO: 168624 - DNA, 27 bp, Artificial sequence
  SiRNA target sequence
ctccacctttagttgttggattaggca

SEQ ID NO: 168625 - DNA, 27 bp, Artificial sequence
  SiRNA target sequence
tccacctttagttgttggattaggcaa

SEQ ID NO: 168626 - DNA, 27 bp, Artificial sequence
  SiRNA target sequence
ccacctttagttgttggattaggcaaa

SEQ ID NO: 168627 - DNA, 27 bp, Artificial sequence
  SiRNA target sequence
cacctttagttgttggattaggcaaag

SEQ ID NO: 168628 - DNA, 27 bp, Artificial sequence
  SiRNA target sequence
acctttagttgttggattaggcaaagc

SEQ ID NO: 168629 - DNA, 27 bp, Artificial sequence
  SiRNA target sequence
cctttagttgttggattaggcaaagct

SEQ ID NO: 168630 - DNA, 27 bp, Artificial sequence
  SiRNA target sequence
ctttagttgttggattaggcaaagctg

SEQ ID NO: 168631 - DNA, 27 bp, Artificial sequence
  SiRNA target sequence
tttagttgttggattaggcaaagctgc

SEQ ID NO: 168632 - DNA, 27 bp, Artificial sequence
  SiRNA target sequence
ttagttgttggattaggcaaagctgct

SEQ ID NO: 168633 - DNA, 27 bp, Artificial sequence
  SiRNA target sequence
tagttgttggattaggcaaagctgctg

SEQ ID NO: 168634 - DNA, 27 bp, Artificial sequence
  SiRNA target sequence
agttgttggattaggcaaagctgctga

SEQ ID NO: 168635 - DNA, 27 bp, Artificial sequence
  SiRNA target sequence
gttgttggattaggcaaagctgctgag

SEQ ID NO: 168636 - DNA, 27 bp, Artificial sequence
  SiRNA target sequence
ttgttggattaggcaaagctgctgaga

SEQ ID NO: 168637 - DNA, 27 bp, Artificial sequence
  SiRNA target sequence
tgttggattaggcaaagctgctgagat

SEQ ID NO: 168638 - DNA, 27 bp, Artificial sequence
  SiRNA target sequence
gttggattaggcaaagctgctgagata

SEQ ID NO: 168639 - DNA, 27 bp, Artificial sequence
  SiRNA target sequence
ttggattaggcaaagctgctgagatat

SEQ ID NO: 168640 - DNA, 27 bp, Artificial sequence
  SiRNA target sequence
tggattaggcaaagctgctgagatatg

SEQ ID NO: 168641 - DNA, 27 bp, Artificial sequence
  SiRNA target sequence
ggattaggcaaagctgctgagatatgc

SEQ ID NO: 168642 - DNA, 27 bp, Artificial sequence
  SiRNA target sequence
gattaggcaaagctgctgagatatgct

SEQ ID NO: 168643 - DNA, 27 bp, Artificial sequence
  SiRNA target sequence
attaggcaaagctgctgagatatgctc

SEQ ID NO: 168644 - DNA, 27 bp, Artificial sequence
  SiRNA target sequence
ttaggcaaagctgctgagatatgctct

SEQ ID NO: 168645 - DNA, 27 bp, Artificial sequence
  SiRNA target sequence
taggcaaagctgctgagatatgctctc

SEQ ID NO: 168646 - DNA, 27 bp, Artificial sequence
  SiRNA target sequence
aggcaaagctgctgagatatgctctca

SEQ ID NO: 168647 - DNA, 27 bp, Artificial sequence
  SiRNA target sequence
ggcaaagctgctgagatatgctctcag

SEQ ID NO: 168648 - DNA, 27 bp, Artificial sequence
  SiRNA target sequence
gcaaagctgctgagatatgctctcagg

SEQ ID NO: 168649 - DNA, 27 bp, Artificial sequence
  SiRNA target sequence
caaagctgctgagatatgctctcagga

SEQ ID NO: 168650 - DNA, 27 bp, Artificial sequence
  SiRNA target sequence
aaagctgctgagatatgctctcaggag

SEQ ID NO: 168651 - DNA, 27 bp, Artificial sequence
  SiRNA target sequence
aagctgctgagatatgctctcaggaga

SEQ ID NO: 168652 - DNA, 27 bp, Artificial sequence
  SiRNA target sequence
agctgctgagatatgctctcaggagat

SEQ ID NO: 168653 - DNA, 27 bp, Artificial sequence
  SiRNA target sequence
gctgctgagatatgctctcaggagatg

SEQ ID NO: 168654 - DNA, 27 bp, Artificial sequence
  SiRNA target sequence
ctgctgagatatgctctcaggagatgc

SEQ ID NO: 168655 - DNA, 27 bp, Artificial sequence
  SiRNA target sequence
tgctgagatatgctctcaggagatgcg

SEQ ID NO: 168656 - DNA, 27 bp, Artificial sequence
  SiRNA target sequence
gctgagatatgctctcaggagatgcgt

SEQ ID NO: 168657 - DNA, 27 bp, Artificial sequence
  SiRNA target sequence
ctgagatatgctctcaggagatgcgta

SEQ ID NO: 168658 - DNA, 27 bp, Artificial sequence
  SiRNA target sequence
tgagatatgctctcaggagatgcgtaa

SEQ ID NO: 168659 - DNA, 27 bp, Artificial sequence
  SiRNA target sequence
gagatatgctctcaggagatgcgtaag

SEQ ID NO: 168660 - DNA, 27 bp, Artificial sequence
  SiRNA target sequence
agatatgctctcaggagatgcgtaagg

SEQ ID NO: 168661 - DNA, 27 bp, Artificial sequence
  SiRNA target sequence
gatatgctctcaggagatgcgtaagga

SEQ ID NO: 168662 - DNA, 27 bp, Artificial sequence
  SiRNA target sequence
atatgctctcaggagatgcgtaaggac

SEQ ID NO: 168663 - DNA, 27 bp, Artificial sequence
  SiRNA target sequence
tatgctctcaggagatgcgtaaggact

SEQ ID NO: 168664 - DNA, 27 bp, Artificial sequence
  SiRNA target sequence
atgctctcaggagatgcgtaaggacta

SEQ ID NO: 168665 - DNA, 27 bp, Artificial sequence
  SiRNA target sequence
tgctctcaggagatgcgtaaggactat

SEQ ID NO: 168666 - DNA, 27 bp, Artificial sequence
  SiRNA target sequence
gctctcaggagatgcgtaaggactatg

SEQ ID NO: 168667 - DNA, 27 bp, Artificial sequence
  SiRNA target sequence
ctctcaggagatgcgtaaggactatga

SEQ ID NO: 168668 - DNA, 27 bp, Artificial sequence
  SiRNA target sequence
tctcaggagatgcgtaaggactatgaa

SEQ ID NO: 168669 - DNA, 27 bp, Artificial sequence
  SiRNA target sequence
ctcaggagatgcgtaaggactatgaat

SEQ ID NO: 168670 - DNA, 27 bp, Artificial sequence
  SiRNA target sequence
tcaggagatgcgtaaggactatgaata

SEQ ID NO: 168671 - DNA, 27 bp, Artificial sequence
  SiRNA target sequence
caggagatgcgtaaggactatgaatat

SEQ ID NO: 168672 - DNA, 27 bp, Artificial sequence
  SiRNA target sequence
aggagatgcgtaaggactatgaatata

SEQ ID NO: 168673 - DNA, 27 bp, Artificial sequence
  SiRNA target sequence
ggagatgcgtaaggactatgaatatat

SEQ ID NO: 168674 - DNA, 27 bp, Artificial sequence
  SiRNA target sequence
gagatgcgtaaggactatgaatatata

SEQ ID NO: 168675 - DNA, 27 bp, Artificial sequence
  SiRNA target sequence
agatgcgtaaggactatgaatatatac

SEQ ID NO: 168676 - DNA, 27 bp, Artificial sequence
  SiRNA target sequence
gatgcgtaaggactatgaatatataca

SEQ ID NO: 168677 - DNA, 27 bp, Artificial sequence
  SiRNA target sequence
atgcgtaaggactatgaatatatacaa

SEQ ID NO: 168678 - DNA, 27 bp, Artificial sequence
  SiRNA target sequence
tgcgtaaggactatgaatatatacaaa

SEQ ID NO: 168679 - DNA, 27 bp, Artificial sequence
  SiRNA target sequence
gcgtaaggactatgaatatatacaaaa

SEQ ID NO: 168680 - DNA, 27 bp, Artificial sequence
  SiRNA target sequence
cgtaaggactatgaatatatacaaaaa

SEQ ID NO: 168681 - DNA, 27 bp, Artificial sequence
  SiRNA target sequence
gtaaggactatgaatatatacaaaaat

SEQ ID NO: 168682 - DNA, 27 bp, Artificial sequence
  SiRNA target sequence
taaggactatgaatatatacaaaaatt

SEQ ID NO: 168683 - DNA, 27 bp, Artificial sequence
  SiRNA target sequence
aaggactatgaatatatacaaaaatta

SEQ ID NO: 168684 - DNA, 27 bp, Artificial sequence
  SiRNA target sequence
aggactatgaatatatacaaaaattat

SEQ ID NO: 168685 - DNA, 27 bp, Artificial sequence
  SiRNA target sequence
ggactatgaatatatacaaaaattatc

SEQ ID NO: 168686 - DNA, 27 bp, Artificial sequence
  SiRNA target sequence
gactatgaatatatacaaaaattatcg

SEQ ID NO: 168687 - DNA, 27 bp, Artificial sequence
  SiRNA target sequence
actatgaatatatacaaaaattatcgg

SEQ ID NO: 168688 - DNA, 27 bp, Artificial sequence
  SiRNA target sequence
ctatgaatatatacaaaaattatcgga

SEQ ID NO: 168689 - DNA, 27 bp, Artificial sequence
  SiRNA target sequence
tatgaatatatacaaaaattatcggat

SEQ ID NO: 168690 - DNA, 27 bp, Artificial sequence
  SiRNA target sequence
atgaatatatacaaaaattatcggata

SEQ ID NO: 168691 - DNA, 27 bp, Artificial sequence
  SiRNA target sequence
tgaatatatacaaaaattatcggataa

SEQ ID NO: 168692 - DNA, 27 bp, Artificial sequence
  SiRNA target sequence
gaatatatacaaaaattatcggataaa

SEQ ID NO: 168693 - DNA, 27 bp, Artificial sequence
  SiRNA target sequence
aatatatacaaaaattatcggataaac

SEQ ID NO: 168694 - DNA, 27 bp, Artificial sequence
  SiRNA target sequence
atatatacaaaaattatcggataaact

SEQ ID NO: 168695 - DNA, 27 bp, Artificial sequence
  SiRNA target sequence
tatatacaaaaattatcggataaacta

SEQ ID NO: 168696 - DNA, 27 bp, Artificial sequence
  SiRNA target sequence
atatacaaaaattatcggataaactaa

SEQ ID NO: 168697 - DNA, 27 bp, Artificial sequence
  SiRNA target sequence
tatacaaaaattatcggataaactaaa

SEQ ID NO: 168698 - DNA, 27 bp, Artificial sequence
  SiRNA target sequence
atacaaaaattatcggataaactaaaa

SEQ ID NO: 168699 - DNA, 27 bp, Artificial sequence
  SiRNA target sequence
tacaaaaattatcggataaactaaaaa

SEQ ID NO: 168700 - DNA, 27 bp, Artificial sequence
  SiRNA target sequence
acaaaaattatcggataaactaaaaaa

SEQ ID NO: 168701 - DNA, 27 bp, Artificial sequence
  SiRNA target sequence
caaaaattatcggataaactaaaaaat

SEQ ID NO: 168702 - DNA, 27 bp, Artificial sequence
  SiRNA target sequence
aaaaattatcggataaactaaaaaatc

SEQ ID NO: 168703 - DNA, 27 bp, Artificial sequence
  SiRNA target sequence
aaaattatcggataaactaaaaaatcg

SEQ ID NO: 168704 - DNA, 27 bp, Artificial sequence
  SiRNA target sequence
aaattatcggataaactaaaaaatcgc

SEQ ID NO: 168705 - DNA, 27 bp, Artificial sequence
  SiRNA target sequence
aattatcggataaactaaaaaatcgca

SEQ ID NO: 168706 - DNA, 27 bp, Artificial sequence
  SiRNA target sequence
attatcggataaactaaaaaatcgcat

SEQ ID NO: 168707 - DNA, 27 bp, Artificial sequence
  SiRNA target sequence
ttatcggataaactaaaaaatcgcatc

SEQ ID NO: 168708 - DNA, 27 bp, Artificial sequence
  SiRNA target sequence
tatcggataaactaaaaaatcgcatca

SEQ ID NO: 168709 - DNA, 27 bp, Artificial sequence
  SiRNA target sequence
atcggataaactaaaaaatcgcatcaa

SEQ ID NO: 168710 - DNA, 27 bp, Artificial sequence
  SiRNA target sequence
tcggataaactaaaaaatcgcatcaaa

SEQ ID NO: 168711 - DNA, 27 bp, Artificial sequence
  SiRNA target sequence
cggataaactaaaaaatcgcatcaaaa

SEQ ID NO: 168712 - DNA, 27 bp, Artificial sequence
  SiRNA target sequence
ggataaactaaaaaatcgcatcaaaac

SEQ ID NO: 168713 - DNA, 27 bp, Artificial sequence
  SiRNA target sequence
gataaactaaaaaatcgcatcaaaacg

SEQ ID NO: 168714 - DNA, 27 bp, Artificial sequence
  SiRNA target sequence
ataaactaaaaaatcgcatcaaaacga

SEQ ID NO: 168715 - DNA, 27 bp, Artificial sequence
  SiRNA target sequence
taaactaaaaaatcgcatcaaaacgaa

SEQ ID NO: 168716 - DNA, 27 bp, Artificial sequence
  SiRNA target sequence
aaactaaaaaatcgcatcaaaacgaat

SEQ ID NO: 168717 - DNA, 27 bp, Artificial sequence
  SiRNA target sequence
aactaaaaaatcgcatcaaaacgaatg

SEQ ID NO: 168718 - DNA, 27 bp, Artificial sequence
  SiRNA target sequence
actaaaaaatcgcatcaaaacgaatgt

SEQ ID NO: 168719 - DNA, 27 bp, Artificial sequence
  SiRNA target sequence
ctaaaaaatcgcatcaaaacgaatgta

SEQ ID NO: 168720 - DNA, 27 bp, Artificial sequence
  SiRNA target sequence
taaaaaatcgcatcaaaacgaatgtag

SEQ ID NO: 168721 - DNA, 27 bp, Artificial sequence
  SiRNA target sequence
aaaaaatcgcatcaaaacgaatgtaga

SEQ ID NO: 168722 - DNA, 27 bp, Artificial sequence
  SiRNA target sequence
aaaaatcgcatcaaaacgaatgtagaa

SEQ ID NO: 168723 - DNA, 27 bp, Artificial sequence
  SiRNA target sequence
aaaatcgcatcaaaacgaatgtagaaa

SEQ ID NO: 168724 - DNA, 27 bp, Artificial sequence
  SiRNA target sequence
aaatcgcatcaaaacgaatgtagaaaa

SEQ ID NO: 168725 - DNA, 27 bp, Artificial sequence
  SiRNA target sequence
aatcgcatcaaaacgaatgtagaaaat

SEQ ID NO: 168726 - DNA, 27 bp, Artificial sequence
  SiRNA target sequence
atcgcatcaaaacgaatgtagaaaatg

SEQ ID NO: 168727 - DNA, 27 bp, Artificial sequence
  SiRNA target sequence
tcgcatcaaaacgaatgtagaaaatgt

SEQ ID NO: 168728 - DNA, 27 bp, Artificial sequence
  SiRNA target sequence
cgcatcaaaacgaatgtagaaaatgtt

SEQ ID NO: 168729 - DNA, 27 bp, Artificial sequence
  SiRNA target sequence
gcatcaaaacgaatgtagaaaatgttg

SEQ ID NO: 168730 - DNA, 27 bp, Artificial sequence
  SiRNA target sequence
catcaaaacgaatgtagaaaatgttgt

SEQ ID NO: 168731 - DNA, 27 bp, Artificial sequence
  SiRNA target sequence
atcaaaacgaatgtagaaaatgttgtt

SEQ ID NO: 168732 - DNA, 27 bp, Artificial sequence
  SiRNA target sequence
tcaaaacgaatgtagaaaatgttgtta

SEQ ID NO: 168733 - DNA, 27 bp, Artificial sequence
  SiRNA target sequence
caaaacgaatgtagaaaatgttgttat

SEQ ID NO: 168734 - DNA, 27 bp, Artificial sequence
  SiRNA target sequence
aaaacgaatgtagaaaatgttgttatt

SEQ ID NO: 168735 - DNA, 27 bp, Artificial sequence
  SiRNA target sequence
aaacgaatgtagaaaatgttgttatta

SEQ ID NO: 168736 - DNA, 27 bp, Artificial sequence
  SiRNA target sequence
aacgaatgtagaaaatgttgttattaa

SEQ ID NO: 168737 - DNA, 27 bp, Artificial sequence
  SiRNA target sequence
acgaatgtagaaaatgttgttattaac

SEQ ID NO: 168738 - DNA, 27 bp, Artificial sequence
  SiRNA target sequence
cgaatgtagaaaatgttgttattaacg

SEQ ID NO: 168739 - DNA, 27 bp, Artificial sequence
  SiRNA target sequence
gaatgtagaaaatgttgttattaacgg

SEQ ID NO: 168740 - DNA, 27 bp, Artificial sequence
  SiRNA target sequence
aatgtagaaaatgttgttattaacggc

SEQ ID NO: 168741 - DNA, 27 bp, Artificial sequence
  SiRNA target sequence
atgtagaaaatgttgttattaacggcg

SEQ ID NO: 168742 - DNA, 27 bp, Artificial sequence
  SiRNA target sequence
tgtagaaaatgttgttattaacggcga

SEQ ID NO: 168743 - DNA, 27 bp, Artificial sequence
  SiRNA target sequence
gtagaaaatgttgttattaacggcgat

SEQ ID NO: 168744 - DNA, 27 bp, Artificial sequence
  SiRNA target sequence
tagaaaatgttgttattaacggcgatg

SEQ ID NO: 168745 - DNA, 27 bp, Artificial sequence
  SiRNA target sequence
agaaaatgttgttattaacggcgatga

SEQ ID NO: 168746 - DNA, 27 bp, Artificial sequence
  SiRNA target sequence
gaaaatgttgttattaacggcgatgat

SEQ ID NO: 168747 - DNA, 27 bp, Artificial sequence
  SiRNA target sequence
aaaatgttgttattaacggcgatgatt

SEQ ID NO: 168748 - DNA, 27 bp, Artificial sequence
  SiRNA target sequence
aaatgttgttattaacggcgatgattc

SEQ ID NO: 168749 - DNA, 27 bp, Artificial sequence
  SiRNA target sequence
aatgttgttattaacggcgatgattct

SEQ ID NO: 168750 - DNA, 27 bp, Artificial sequence
  SiRNA target sequence
atgttgttattaacggcgatgattcta

SEQ ID NO: 168751 - DNA, 27 bp, Artificial sequence
  SiRNA target sequence
tgttgttattaacggcgatgattctaa

SEQ ID NO: 168752 - DNA, 27 bp, Artificial sequence
  SiRNA target sequence
gttgttattaacggcgatgattctaag

SEQ ID NO: 168753 - DNA, 27 bp, Artificial sequence
  SiRNA target sequence
ttgttattaacggcgatgattctaaga

SEQ ID NO: 168754 - DNA, 27 bp, Artificial sequence
  SiRNA target sequence
tgttattaacggcgatgattctaagac

SEQ ID NO: 168755 - DNA, 27 bp, Artificial sequence
  SiRNA target sequence
gttattaacggcgatgattctaagact

SEQ ID NO: 168756 - DNA, 27 bp, Artificial sequence
  SiRNA target sequence
ttattaacggcgatgattctaagactt

SEQ ID NO: 168757 - DNA, 27 bp, Artificial sequence
  SiRNA target sequence
tattaacggcgatgattctaagacttt

SEQ ID NO: 168758 - DNA, 27 bp, Artificial sequence
  SiRNA target sequence
attaacggcgatgattctaagactttt

SEQ ID NO: 168759 - DNA, 27 bp, Artificial sequence
  SiRNA target sequence
ttaacggcgatgattctaagacttttc

SEQ ID NO: 168760 - DNA, 27 bp, Artificial sequence
  SiRNA target sequence
taacggcgatgattctaagacttttcc

SEQ ID NO: 168761 - DNA, 27 bp, Artificial sequence
  SiRNA target sequence
aacggcgatgattctaagacttttcct

SEQ ID NO: 168762 - DNA, 27 bp, Artificial sequence
  SiRNA target sequence
acggcgatgattctaagacttttcctg

SEQ ID NO: 168763 - DNA, 27 bp, Artificial sequence
  SiRNA target sequence
cggcgatgattctaagacttttcctgg

SEQ ID NO: 168764 - DNA, 27 bp, Artificial sequence
  SiRNA target sequence
ggcgatgattctaagacttttcctggc

SEQ ID NO: 168765 - DNA, 27 bp, Artificial sequence
  SiRNA target sequence
gcgatgattctaagacttttcctggct

SEQ ID NO: 168766 - DNA, 27 bp, Artificial sequence
  SiRNA target sequence
cgatgattctaagacttttcctggctg

SEQ ID NO: 168767 - DNA, 27 bp, Artificial sequence
  SiRNA target sequence
gatgattctaagacttttcctggctgt

SEQ ID NO: 168768 - DNA, 27 bp, Artificial sequence
  SiRNA target sequence
atgattctaagacttttcctggctgtc

SEQ ID NO: 168769 - DNA, 27 bp, Artificial sequence
  SiRNA target sequence
tgattctaagacttttcctggctgtct

SEQ ID NO: 168770 - DNA, 27 bp, Artificial sequence
  SiRNA target sequence
gattctaagacttttcctggctgtctc

SEQ ID NO: 168771 - DNA, 27 bp, Artificial sequence
  SiRNA target sequence
attctaagacttttcctggctgtctca

SEQ ID NO: 168772 - DNA, 27 bp, Artificial sequence
  SiRNA target sequence
ttctaagacttttcctggctgtctcaa

SEQ ID NO: 168773 - DNA, 27 bp, Artificial sequence
  SiRNA target sequence
tctaagacttttcctggctgtctcaat

SEQ ID NO: 168774 - DNA, 27 bp, Artificial sequence
  SiRNA target sequence
ctaagacttttcctggctgtctcaata

SEQ ID NO: 168775 - DNA, 27 bp, Artificial sequence
  SiRNA target sequence
taagacttttcctggctgtctcaatat

SEQ ID NO: 168776 - DNA, 27 bp, Artificial sequence
  SiRNA target sequence
aagacttttcctggctgtctcaatatt

SEQ ID NO: 168777 - DNA, 27 bp, Artificial sequence
  SiRNA target sequence
agacttttcctggctgtctcaatattt

SEQ ID NO: 168778 - DNA, 27 bp, Artificial sequence
  SiRNA target sequence
gacttttcctggctgtctcaatatttc

SEQ ID NO: 168779 - DNA, 27 bp, Artificial sequence
  SiRNA target sequence
acttttcctggctgtctcaatatttct

SEQ ID NO: 168780 - DNA, 27 bp, Artificial sequence
  SiRNA target sequence
cttttcctggctgtctcaatatttctt

SEQ ID NO: 168781 - DNA, 27 bp, Artificial sequence
  SiRNA target sequence
ttttcctggctgtctcaatatttcttt

SEQ ID NO: 168782 - DNA, 27 bp, Artificial sequence
  SiRNA target sequence
tttcctggctgtctcaatatttctttt

SEQ ID NO: 168783 - DNA, 27 bp, Artificial sequence
  SiRNA target sequence
ttcctggctgtctcaatatttcttttc

SEQ ID NO: 168784 - DNA, 27 bp, Artificial sequence
  SiRNA target sequence
tcctggctgtctcaatatttcttttcc

SEQ ID NO: 168785 - DNA, 27 bp, Artificial sequence
  SiRNA target sequence
cctggctgtctcaatatttcttttcca

SEQ ID NO: 168786 - DNA, 27 bp, Artificial sequence
  SiRNA target sequence
ctggctgtctcaatatttcttttccat

SEQ ID NO: 168787 - DNA, 27 bp, Artificial sequence
  SiRNA target sequence
tggctgtctcaatatttcttttccata

SEQ ID NO: 168788 - DNA, 27 bp, Artificial sequence
  SiRNA target sequence
ggctgtctcaatatttcttttccatat

SEQ ID NO: 168789 - DNA, 27 bp, Artificial sequence
  SiRNA target sequence
gctgtctcaatatttcttttccatatg

SEQ ID NO: 168790 - DNA, 27 bp, Artificial sequence
  SiRNA target sequence
ctgtctcaatatttcttttccatatgt

SEQ ID NO: 168791 - DNA, 27 bp, Artificial sequence
  SiRNA target sequence
tgtctcaatatttcttttccatatgta

SEQ ID NO: 168792 - DNA, 27 bp, Artificial sequence
  SiRNA target sequence
gtctcaatatttcttttccatatgtag

SEQ ID NO: 168793 - DNA, 27 bp, Artificial sequence
  SiRNA target sequence
tctcaatatttcttttccatatgtaga

SEQ ID NO: 168794 - DNA, 27 bp, Artificial sequence
  SiRNA target sequence
ctcaatatttcttttccatatgtagaa

SEQ ID NO: 168795 - DNA, 27 bp, Artificial sequence
  SiRNA target sequence
tcaatatttcttttccatatgtagaag

SEQ ID NO: 168796 - DNA, 27 bp, Artificial sequence
  SiRNA target sequence
caatatttcttttccatatgtagaagg

SEQ ID NO: 168797 - DNA, 27 bp, Artificial sequence
  SiRNA target sequence
aatatttcttttccatatgtagaaggt

SEQ ID NO: 168798 - DNA, 27 bp, Artificial sequence
  SiRNA target sequence
atatttcttttccatatgtagaaggtg

SEQ ID NO: 168799 - DNA, 27 bp, Artificial sequence
  SiRNA target sequence
tatttcttttccatatgtagaaggtga

SEQ ID NO: 168800 - DNA, 27 bp, Artificial sequence
  SiRNA target sequence
atttcttttccatatgtagaaggtgaa

SEQ ID NO: 168801 - DNA, 27 bp, Artificial sequence
  SiRNA target sequence
tttcttttccatatgtagaaggtgaag

SEQ ID NO: 168802 - DNA, 27 bp, Artificial sequence
  SiRNA target sequence
ttcttttccatatgtagaaggtgaagg

SEQ ID NO: 168803 - DNA, 27 bp, Artificial sequence
  SiRNA target sequence
tcttttccatatgtagaaggtgaaggg

SEQ ID NO: 168804 - DNA, 27 bp, Artificial sequence
  SiRNA target sequence
cttttccatatgtagaaggtgaagggc

SEQ ID NO: 168805 - DNA, 27 bp, Artificial sequence
  SiRNA target sequence
ttttccatatgtagaaggtgaagggct

SEQ ID NO: 168806 - DNA, 27 bp, Artificial sequence
  SiRNA target sequence
tttccatatgtagaaggtgaagggctt

SEQ ID NO: 168807 - DNA, 27 bp, Artificial sequence
  SiRNA target sequence
ttccatatgtagaaggtgaagggctta

SEQ ID NO: 168808 - DNA, 27 bp, Artificial sequence
  SiRNA target sequence
tccatatgtagaaggtgaagggcttat

SEQ ID NO: 168809 - DNA, 27 bp, Artificial sequence
  SiRNA target sequence
ccatatgtagaaggtgaagggcttatg

SEQ ID NO: 168810 - DNA, 27 bp, Artificial sequence
  SiRNA target sequence
catatgtagaaggtgaagggcttatga

SEQ ID NO: 168811 - DNA, 27 bp, Artificial sequence
  SiRNA target sequence
atatgtagaaggtgaagggcttatgat

SEQ ID NO: 168812 - DNA, 27 bp, Artificial sequence
  SiRNA target sequence
tatgtagaaggtgaagggcttatgatg

SEQ ID NO: 168813 - DNA, 27 bp, Artificial sequence
  SiRNA target sequence
atgtagaaggtgaagggcttatgatga

SEQ ID NO: 168814 - DNA, 27 bp, Artificial sequence
  SiRNA target sequence
tgtagaaggtgaagggcttatgatgaa

SEQ ID NO: 168815 - DNA, 27 bp, Artificial sequence
  SiRNA target sequence
gtagaaggtgaagggcttatgatgaat

SEQ ID NO: 168816 - DNA, 27 bp, Artificial sequence
  SiRNA target sequence
tagaaggtgaagggcttatgatgaata

SEQ ID NO: 168817 - DNA, 27 bp, Artificial sequence
  SiRNA target sequence
agaaggtgaagggcttatgatgaatat

SEQ ID NO: 168818 - DNA, 27 bp, Artificial sequence
  SiRNA target sequence
gaaggtgaagggcttatgatgaatatt

SEQ ID NO: 168819 - DNA, 27 bp, Artificial sequence
  SiRNA target sequence
aaggtgaagggcttatgatgaatatta

SEQ ID NO: 168820 - DNA, 27 bp, Artificial sequence
  SiRNA target sequence
aggtgaagggcttatgatgaatattaa

SEQ ID NO: 168821 - DNA, 27 bp, Artificial sequence
  SiRNA target sequence
ggtgaagggcttatgatgaatattaag

SEQ ID NO: 168822 - DNA, 27 bp, Artificial sequence
  SiRNA target sequence
gtgaagggcttatgatgaatattaagg

SEQ ID NO: 168823 - DNA, 27 bp, Artificial sequence
  SiRNA target sequence
tgaagggcttatgatgaatattaagga

SEQ ID NO: 168824 - DNA, 27 bp, Artificial sequence
  SiRNA target sequence
gaagggcttatgatgaatattaaggat

SEQ ID NO: 168825 - DNA, 27 bp, Artificial sequence
  SiRNA target sequence
aagggcttatgatgaatattaaggata

SEQ ID NO: 168826 - DNA, 27 bp, Artificial sequence
  SiRNA target sequence
agggcttatgatgaatattaaggatat

SEQ ID NO: 168827 - DNA, 27 bp, Artificial sequence
  SiRNA target sequence
gggcttatgatgaatattaaggatatt

SEQ ID NO: 168828 - DNA, 27 bp, Artificial sequence
  SiRNA target sequence
ggcttatgatgaatattaaggatattg

SEQ ID NO: 168829 - DNA, 27 bp, Artificial sequence
  SiRNA target sequence
gcttatgatgaatattaaggatattgc

SEQ ID NO: 168830 - DNA, 27 bp, Artificial sequence
  SiRNA target sequence
cttatgatgaatattaaggatattgct

SEQ ID NO: 168831 - DNA, 27 bp, Artificial sequence
  SiRNA target sequence
ttatgatgaatattaaggatattgctg

SEQ ID NO: 168832 - DNA, 27 bp, Artificial sequence
  SiRNA target sequence
tatgatgaatattaaggatattgctgt

SEQ ID NO: 168833 - DNA, 27 bp, Artificial sequence
  SiRNA target sequence
atgatgaatattaaggatattgctgtt

SEQ ID NO: 168834 - DNA, 27 bp, Artificial sequence
  SiRNA target sequence
tgatgaatattaaggatattgctgtta

SEQ ID NO: 168835 - DNA, 27 bp, Artificial sequence
  SiRNA target sequence
gatgaatattaaggatattgctgttag

SEQ ID NO: 168836 - DNA, 27 bp, Artificial sequence
  SiRNA target sequence
atgaatattaaggatattgctgttagt

SEQ ID NO: 168837 - DNA, 27 bp, Artificial sequence
  SiRNA target sequence
tgaatattaaggatattgctgttagta

SEQ ID NO: 168838 - DNA, 27 bp, Artificial sequence
  SiRNA target sequence
gaatattaaggatattgctgttagtag

SEQ ID NO: 168839 - DNA, 27 bp, Artificial sequence
  SiRNA target sequence
aatattaaggatattgctgttagtagt

SEQ ID NO: 168840 - DNA, 27 bp, Artificial sequence
  SiRNA target sequence
atattaaggatattgctgttagtagtg

SEQ ID NO: 168841 - DNA, 27 bp, Artificial sequence
  SiRNA target sequence
tattaaggatattgctgttagtagtgg

SEQ ID NO: 168842 - DNA, 27 bp, Artificial sequence
  SiRNA target sequence
attaaggatattgctgttagtagtgga

SEQ ID NO: 168843 - DNA, 27 bp, Artificial sequence
  SiRNA target sequence
ttaaggatattgctgttagtagtggaa

SEQ ID NO: 168844 - DNA, 27 bp, Artificial sequence
  SiRNA target sequence
taaggatattgctgttagtagtggaag

SEQ ID NO: 168845 - DNA, 27 bp, Artificial sequence
  SiRNA target sequence
aaggatattgctgttagtagtggaagt

SEQ ID NO: 168846 - DNA, 27 bp, Artificial sequence
  SiRNA target sequence
aggatattgctgttagtagtggaagtg

SEQ ID NO: 168847 - DNA, 27 bp, Artificial sequence
  SiRNA target sequence
ggatattgctgttagtagtggaagtgc

SEQ ID NO: 168848 - DNA, 27 bp, Artificial sequence
  SiRNA target sequence
gatattgctgttagtagtggaagtgct

SEQ ID NO: 168849 - DNA, 27 bp, Artificial sequence
  SiRNA target sequence
atattgctgttagtagtggaagtgctt

SEQ ID NO: 168850 - DNA, 27 bp, Artificial sequence
  SiRNA target sequence
tattgctgttagtagtggaagtgcttg

SEQ ID NO: 168851 - DNA, 27 bp, Artificial sequence
  SiRNA target sequence
attgctgttagtagtggaagtgcttgc

SEQ ID NO: 168852 - DNA, 27 bp, Artificial sequence
  SiRNA target sequence
ttgctgttagtagtggaagtgcttgca

SEQ ID NO: 168853 - DNA, 27 bp, Artificial sequence
  SiRNA target sequence
tgctgttagtagtggaagtgcttgcac

SEQ ID NO: 168854 - DNA, 27 bp, Artificial sequence
  SiRNA target sequence
gctgttagtagtggaagtgcttgcact

SEQ ID NO: 168855 - DNA, 27 bp, Artificial sequence
  SiRNA target sequence
ctgttagtagtggaagtgcttgcactt

SEQ ID NO: 168856 - DNA, 27 bp, Artificial sequence
  SiRNA target sequence
tgttagtagtggaagtgcttgcacttc

SEQ ID NO: 168857 - DNA, 27 bp, Artificial sequence
  SiRNA target sequence
gttagtagtggaagtgcttgcacttca

SEQ ID NO: 168858 - DNA, 27 bp, Artificial sequence
  SiRNA target sequence
ttagtagtggaagtgcttgcacttcat

SEQ ID NO: 168859 - DNA, 27 bp, Artificial sequence
  SiRNA target sequence
tagtagtggaagtgcttgcacttcatc

SEQ ID NO: 168860 - DNA, 27 bp, Artificial sequence
  SiRNA target sequence
agtagtggaagtgcttgcacttcatca

SEQ ID NO: 168861 - DNA, 27 bp, Artificial sequence
  SiRNA target sequence
gtagtggaagtgcttgcacttcatcat

SEQ ID NO: 168862 - DNA, 27 bp, Artificial sequence
  SiRNA target sequence
tagtggaagtgcttgcacttcatcatc

SEQ ID NO: 168863 - DNA, 27 bp, Artificial sequence
  SiRNA target sequence
agtggaagtgcttgcacttcatcatct

SEQ ID NO: 168864 - DNA, 27 bp, Artificial sequence
  SiRNA target sequence
gtggaagtgcttgcacttcatcatctt

SEQ ID NO: 168865 - DNA, 27 bp, Artificial sequence
  SiRNA target sequence
tggaagtgcttgcacttcatcatcttt

SEQ ID NO: 168866 - DNA, 27 bp, Artificial sequence
  SiRNA target sequence
ggaagtgcttgcacttcatcatcttta

SEQ ID NO: 168867 - DNA, 27 bp, Artificial sequence
  SiRNA target sequence
gaagtgcttgcacttcatcatctttag

SEQ ID NO: 168868 - DNA, 27 bp, Artificial sequence
  SiRNA target sequence
aagtgcttgcacttcatcatctttaga

SEQ ID NO: 168869 - DNA, 27 bp, Artificial sequence
  SiRNA target sequence
agtgcttgcacttcatcatctttagaa

SEQ ID NO: 168870 - DNA, 27 bp, Artificial sequence
  SiRNA target sequence
gtgcttgcacttcatcatctttagaac

SEQ ID NO: 168871 - DNA, 27 bp, Artificial sequence
  SiRNA target sequence
tgcttgcacttcatcatctttagaacc

SEQ ID NO: 168872 - DNA, 27 bp, Artificial sequence
  SiRNA target sequence
gcttgcacttcatcatctttagaaccc

SEQ ID NO: 168873 - DNA, 27 bp, Artificial sequence
  SiRNA target sequence
cttgcacttcatcatctttagaaccct

SEQ ID NO: 168874 - DNA, 27 bp, Artificial sequence
  SiRNA target sequence
ttgcacttcatcatctttagaaccctc

SEQ ID NO: 168875 - DNA, 27 bp, Artificial sequence
  SiRNA target sequence
tgcacttcatcatctttagaaccctct

SEQ ID NO: 168876 - DNA, 27 bp, Artificial sequence
  SiRNA target sequence
gcacttcatcatctttagaaccctctt

SEQ ID NO: 168877 - DNA, 27 bp, Artificial sequence
  SiRNA target sequence
cacttcatcatctttagaaccctctta

SEQ ID NO: 168878 - DNA, 27 bp, Artificial sequence
  SiRNA target sequence
acttcatcatctttagaaccctcttat

SEQ ID NO: 168879 - DNA, 27 bp, Artificial sequence
  SiRNA target sequence
cttcatcatctttagaaccctcttatg

SEQ ID NO: 168880 - DNA, 27 bp, Artificial sequence
  SiRNA target sequence
ttcatcatctttagaaccctcttatgt

SEQ ID NO: 168881 - DNA, 27 bp, Artificial sequence
  SiRNA target sequence
tcatcatctttagaaccctcttatgtt

SEQ ID NO: 168882 - DNA, 27 bp, Artificial sequence
  SiRNA target sequence
catcatctttagaaccctcttatgttt

SEQ ID NO: 168883 - DNA, 27 bp, Artificial sequence
  SiRNA target sequence
atcatctttagaaccctcttatgtttt

SEQ ID NO: 168884 - DNA, 27 bp, Artificial sequence
  SiRNA target sequence
tcatctttagaaccctcttatgttttg

SEQ ID NO: 168885 - DNA, 27 bp, Artificial sequence
  SiRNA target sequence
catctttagaaccctcttatgttttgc

SEQ ID NO: 168886 - DNA, 27 bp, Artificial sequence
  SiRNA target sequence
atctttagaaccctcttatgttttgcg

SEQ ID NO: 168887 - DNA, 27 bp, Artificial sequence
  SiRNA target sequence
tctttagaaccctcttatgttttgcga

SEQ ID NO: 168888 - DNA, 27 bp, Artificial sequence
  SiRNA target sequence
ctttagaaccctcttatgttttgcgag

SEQ ID NO: 168889 - DNA, 27 bp, Artificial sequence
  SiRNA target sequence
tttagaaccctcttatgttttgcgagc

SEQ ID NO: 168890 - DNA, 27 bp, Artificial sequence
  SiRNA target sequence
ttagaaccctcttatgttttgcgagct

SEQ ID NO: 168891 - DNA, 27 bp, Artificial sequence
  SiRNA target sequence
tagaaccctcttatgttttgcgagctt

SEQ ID NO: 168892 - DNA, 27 bp, Artificial sequence
  SiRNA target sequence
agaaccctcttatgttttgcgagcttt

SEQ ID NO: 168893 - DNA, 27 bp, Artificial sequence
  SiRNA target sequence
gaaccctcttatgttttgcgagcttta

SEQ ID NO: 168894 - DNA, 27 bp, Artificial sequence
  SiRNA target sequence
aaccctcttatgttttgcgagctttag

SEQ ID NO: 168895 - DNA, 27 bp, Artificial sequence
  SiRNA target sequence
accctcttatgttttgcgagctttagg

SEQ ID NO: 168896 - DNA, 27 bp, Artificial sequence
  SiRNA target sequence
ccctcttatgttttgcgagctttaggc

SEQ ID NO: 168897 - DNA, 27 bp, Artificial sequence
  SiRNA target sequence
cctcttatgttttgcgagctttaggca

SEQ ID NO: 168898 - DNA, 27 bp, Artificial sequence
  SiRNA target sequence
ctcttatgttttgcgagctttaggcaa

SEQ ID NO: 168899 - DNA, 27 bp, Artificial sequence
  SiRNA target sequence
tcttatgttttgcgagctttaggcaaa

SEQ ID NO: 168900 - DNA, 27 bp, Artificial sequence
  SiRNA target sequence
cttatgttttgcgagctttaggcaaaa

SEQ ID NO: 168901 - DNA, 27 bp, Artificial sequence
  SiRNA target sequence
ttatgttttgcgagctttaggcaaaaa

SEQ ID NO: 168902 - DNA, 27 bp, Artificial sequence
  SiRNA target sequence
tatgttttgcgagctttaggcaaaaat

SEQ ID NO: 168903 - DNA, 27 bp, Artificial sequence
  SiRNA target sequence
atgttttgcgagctttaggcaaaaatg

SEQ ID NO: 168904 - DNA, 27 bp, Artificial sequence
  SiRNA target sequence
tgttttgcgagctttaggcaaaaatga

SEQ ID NO: 168905 - DNA, 27 bp, Artificial sequence
  SiRNA target sequence
gttttgcgagctttaggcaaaaatgat

SEQ ID NO: 168906 - DNA, 27 bp, Artificial sequence
  SiRNA target sequence
ttttgcgagctttaggcaaaaatgatg

SEQ ID NO: 168907 - DNA, 27 bp, Artificial sequence
  SiRNA target sequence
tttgcgagctttaggcaaaaatgatga

SEQ ID NO: 168908 - DNA, 27 bp, Artificial sequence
  SiRNA target sequence
ttgcgagctttaggcaaaaatgatgat

SEQ ID NO: 168909 - DNA, 27 bp, Artificial sequence
  SiRNA target sequence
tgcgagctttaggcaaaaatgatgatc

SEQ ID NO: 168910 - DNA, 27 bp, Artificial sequence
  SiRNA target sequence
gcgagctttaggcaaaaatgatgatct

SEQ ID NO: 168911 - DNA, 27 bp, Artificial sequence
  SiRNA target sequence
cgagctttaggcaaaaatgatgatctt

SEQ ID NO: 168912 - DNA, 27 bp, Artificial sequence
  SiRNA target sequence
gagctttaggcaaaaatgatgatcttg

SEQ ID NO: 168913 - DNA, 27 bp, Artificial sequence
  SiRNA target sequence
agctttaggcaaaaatgatgatcttgc

SEQ ID NO: 168914 - DNA, 27 bp, Artificial sequence
  SiRNA target sequence
gctttaggcaaaaatgatgatcttgcg

SEQ ID NO: 168915 - DNA, 27 bp, Artificial sequence
  SiRNA target sequence
ctttaggcaaaaatgatgatcttgcgc

SEQ ID NO: 168916 - DNA, 27 bp, Artificial sequence
  SiRNA target sequence
tttaggcaaaaatgatgatcttgcgca

SEQ ID NO: 168917 - DNA, 27 bp, Artificial sequence
  SiRNA target sequence
ttaggcaaaaatgatgatcttgcgcat

SEQ ID NO: 168918 - DNA, 27 bp, Artificial sequence
  SiRNA target sequence
taggcaaaaatgatgatcttgcgcatt

SEQ ID NO: 168919 - DNA, 27 bp, Artificial sequence
  SiRNA target sequence
aggcaaaaatgatgatcttgcgcattc

SEQ ID NO: 168920 - DNA, 27 bp, Artificial sequence
  SiRNA target sequence
ggcaaaaatgatgatcttgcgcattct

SEQ ID NO: 168921 - DNA, 27 bp, Artificial sequence
  SiRNA target sequence
gcaaaaatgatgatcttgcgcattctt

SEQ ID NO: 168922 - DNA, 27 bp, Artificial sequence
  SiRNA target sequence
caaaaatgatgatcttgcgcattcttc

SEQ ID NO: 168923 - DNA, 27 bp, Artificial sequence
  SiRNA target sequence
aaaaatgatgatcttgcgcattcttct

SEQ ID NO: 168924 - DNA, 27 bp, Artificial sequence
  SiRNA target sequence
aaaatgatgatcttgcgcattcttcta

SEQ ID NO: 168925 - DNA, 27 bp, Artificial sequence
  SiRNA target sequence
aaatgatgatcttgcgcattcttctat

SEQ ID NO: 168926 - DNA, 27 bp, Artificial sequence
  SiRNA target sequence
aatgatgatcttgcgcattcttctata

SEQ ID NO: 168927 - DNA, 27 bp, Artificial sequence
  SiRNA target sequence
atgatgatcttgcgcattcttctataa

SEQ ID NO: 168928 - DNA, 27 bp, Artificial sequence
  SiRNA target sequence
tgatgatcttgcgcattcttctataag

SEQ ID NO: 168929 - DNA, 27 bp, Artificial sequence
  SiRNA target sequence
gatgatcttgcgcattcttctataaga

SEQ ID NO: 168930 - DNA, 27 bp, Artificial sequence
  SiRNA target sequence
atgatcttgcgcattcttctataagat

SEQ ID NO: 168931 - DNA, 27 bp, Artificial sequence
  SiRNA target sequence
tgatcttgcgcattcttctataagatt

SEQ ID NO: 168932 - DNA, 27 bp, Artificial sequence
  SiRNA target sequence
gatcttgcgcattcttctataagattt

SEQ ID NO: 168933 - DNA, 27 bp, Artificial sequence
  SiRNA target sequence
atcttgcgcattcttctataagatttg

SEQ ID NO: 168934 - DNA, 27 bp, Artificial sequence
  SiRNA target sequence
tcttgcgcattcttctataagatttgg

SEQ ID NO: 168935 - DNA, 27 bp, Artificial sequence
  SiRNA target sequence
cttgcgcattcttctataagatttgga

SEQ ID NO: 168936 - DNA, 27 bp, Artificial sequence
  SiRNA target sequence
ttgcgcattcttctataagatttggaa

SEQ ID NO: 168937 - DNA, 27 bp, Artificial sequence
  SiRNA target sequence
tgcgcattcttctataagatttggaat

SEQ ID NO: 168938 - DNA, 27 bp, Artificial sequence
  SiRNA target sequence
gcgcattcttctataagatttggaata

SEQ ID NO: 168939 - DNA, 27 bp, Artificial sequence
  SiRNA target sequence
cgcattcttctataagatttggaataa

SEQ ID NO: 168940 - DNA, 27 bp, Artificial sequence
  SiRNA target sequence
gcattcttctataagatttggaataaa

SEQ ID NO: 168941 - DNA, 27 bp, Artificial sequence
  SiRNA target sequence
cattcttctataagatttggaataaat

SEQ ID NO: 168942 - DNA, 27 bp, Artificial sequence
  SiRNA target sequence
attcttctataagatttggaataaata

SEQ ID NO: 168943 - DNA, 27 bp, Artificial sequence
  SiRNA target sequence
ttcttctataagatttggaataaataa

SEQ ID NO: 168944 - DNA, 27 bp, Artificial sequence
  SiRNA target sequence
tcttctataagatttggaataaataag

SEQ ID NO: 168945 - DNA, 27 bp, Artificial sequence
  SiRNA target sequence
cttctataagatttggaataaataagt

SEQ ID NO: 168946 - DNA, 27 bp, Artificial sequence
  SiRNA target sequence
ttctataagatttggaataaataagtt

SEQ ID NO: 168947 - DNA, 27 bp, Artificial sequence
  SiRNA target sequence
tctataagatttggaataaataagttt

SEQ ID NO: 168948 - DNA, 27 bp, Artificial sequence
  SiRNA target sequence
ctataagatttggaataaataagttta

SEQ ID NO: 168949 - DNA, 27 bp, Artificial sequence
  SiRNA target sequence
tataagatttggaataaataagtttac

SEQ ID NO: 168950 - DNA, 27 bp, Artificial sequence
  SiRNA target sequence
ataagatttggaataaataagtttaca

SEQ ID NO: 168951 - DNA, 27 bp, Artificial sequence
  SiRNA target sequence
taagatttggaataaataagtttacaa

SEQ ID NO: 168952 - DNA, 27 bp, Artificial sequence
  SiRNA target sequence
aagatttggaataaataagtttacaac

SEQ ID NO: 168953 - DNA, 27 bp, Artificial sequence
  SiRNA target sequence
agatttggaataaataagtttacaact

SEQ ID NO: 168954 - DNA, 27 bp, Artificial sequence
  SiRNA target sequence
gatttggaataaataagtttacaactg

SEQ ID NO: 168955 - DNA, 27 bp, Artificial sequence
  SiRNA target sequence
atttggaataaataagtttacaactga

SEQ ID NO: 168956 - DNA, 27 bp, Artificial sequence
  SiRNA target sequence
tttggaataaataagtttacaactgaa

SEQ ID NO: 168957 - DNA, 27 bp, Artificial sequence
  SiRNA target sequence
ttggaataaataagtttacaactgaag

SEQ ID NO: 168958 - DNA, 27 bp, Artificial sequence
  SiRNA target sequence
tggaataaataagtttacaactgaaga

SEQ ID NO: 168959 - DNA, 27 bp, Artificial sequence
  SiRNA target sequence
ggaataaataagtttacaactgaagaa

SEQ ID NO: 168960 - DNA, 27 bp, Artificial sequence
  SiRNA target sequence
gaataaataagtttacaactgaagaag

SEQ ID NO: 168961 - DNA, 27 bp, Artificial sequence
  SiRNA target sequence
aataaataagtttacaactgaagaaga

SEQ ID NO: 168962 - DNA, 27 bp, Artificial sequence
  SiRNA target sequence
ataaataagtttacaactgaagaagaa

SEQ ID NO: 168963 - DNA, 27 bp, Artificial sequence
  SiRNA target sequence
taaataagtttacaactgaagaagaaa

SEQ ID NO: 168964 - DNA, 27 bp, Artificial sequence
  SiRNA target sequence
aaataagtttacaactgaagaagaaat

SEQ ID NO: 168965 - DNA, 27 bp, Artificial sequence
  SiRNA target sequence
aataagtttacaactgaagaagaaatc

SEQ ID NO: 168966 - DNA, 27 bp, Artificial sequence
  SiRNA target sequence
ataagtttacaactgaagaagaaatca

SEQ ID NO: 168967 - DNA, 27 bp, Artificial sequence
  SiRNA target sequence
taagtttacaactgaagaagaaatcaa

SEQ ID NO: 168968 - DNA, 27 bp, Artificial sequence
  SiRNA target sequence
aagtttacaactgaagaagaaatcaat

SEQ ID NO: 168969 - DNA, 27 bp, Artificial sequence
  SiRNA target sequence
agtttacaactgaagaagaaatcaata

SEQ ID NO: 168970 - DNA, 27 bp, Artificial sequence
  SiRNA target sequence
gtttacaactgaagaagaaatcaataa

SEQ ID NO: 168971 - DNA, 27 bp, Artificial sequence
  SiRNA target sequence
tttacaactgaagaagaaatcaataaa

SEQ ID NO: 168972 - DNA, 27 bp, Artificial sequence
  SiRNA target sequence
ttacaactgaagaagaaatcaataaag

SEQ ID NO: 168973 - DNA, 27 bp, Artificial sequence
  SiRNA target sequence
tacaactgaagaagaaatcaataaagt

SEQ ID NO: 168974 - DNA, 27 bp, Artificial sequence
  SiRNA target sequence
acaactgaagaagaaatcaataaagta

SEQ ID NO: 168975 - DNA, 27 bp, Artificial sequence
  SiRNA target sequence
caactgaagaagaaatcaataaagtat

SEQ ID NO: 168976 - DNA, 27 bp, Artificial sequence
  SiRNA target sequence
aactgaagaagaaatcaataaagtatc

SEQ ID NO: 168977 - DNA, 27 bp, Artificial sequence
  SiRNA target sequence
actgaagaagaaatcaataaagtatct

SEQ ID NO: 168978 - DNA, 27 bp, Artificial sequence
  SiRNA target sequence
ctgaagaagaaatcaataaagtatcta

SEQ ID NO: 168979 - DNA, 27 bp, Artificial sequence
  SiRNA target sequence
tgaagaagaaatcaataaagtatctag

SEQ ID NO: 168980 - DNA, 27 bp, Artificial sequence
  SiRNA target sequence
gaagaagaaatcaataaagtatctagt

SEQ ID NO: 168981 - DNA, 27 bp, Artificial sequence
  SiRNA target sequence
aagaagaaatcaataaagtatctagtg

SEQ ID NO: 168982 - DNA, 27 bp, Artificial sequence
  SiRNA target sequence
agaagaaatcaataaagtatctagtga

SEQ ID NO: 168983 - DNA, 27 bp, Artificial sequence
  SiRNA target sequence
gaagaaatcaataaagtatctagtgat

SEQ ID NO: 168984 - DNA, 27 bp, Artificial sequence
  SiRNA target sequence
aagaaatcaataaagtatctagtgata

SEQ ID NO: 168985 - DNA, 27 bp, Artificial sequence
  SiRNA target sequence
agaaatcaataaagtatctagtgatac

SEQ ID NO: 168986 - DNA, 27 bp, Artificial sequence
  SiRNA target sequence
gaaatcaataaagtatctagtgataca

SEQ ID NO: 168987 - DNA, 27 bp, Artificial sequence
  SiRNA target sequence
aaatcaataaagtatctagtgatacaa

SEQ ID NO: 168988 - DNA, 27 bp, Artificial sequence
  SiRNA target sequence
aatcaataaagtatctagtgatacaat

SEQ ID NO: 168989 - DNA, 27 bp, Artificial sequence
  SiRNA target sequence
atcaataaagtatctagtgatacaatt

SEQ ID NO: 168990 - DNA, 27 bp, Artificial sequence
  SiRNA target sequence
tcaataaagtatctagtgatacaatta

SEQ ID NO: 168991 - DNA, 27 bp, Artificial sequence
  SiRNA target sequence
caataaagtatctagtgatacaattaa

SEQ ID NO: 168992 - DNA, 27 bp, Artificial sequence
  SiRNA target sequence
aataaagtatctagtgatacaattaaa

SEQ ID NO: 168993 - DNA, 27 bp, Artificial sequence
  SiRNA target sequence
ataaagtatctagtgatacaattaaag

SEQ ID NO: 168994 - DNA, 27 bp, Artificial sequence
  SiRNA target sequence
taaagtatctagtgatacaattaaagc

SEQ ID NO: 168995 - DNA, 27 bp, Artificial sequence
  SiRNA target sequence
aaagtatctagtgatacaattaaagct

SEQ ID NO: 168996 - DNA, 27 bp, Artificial sequence
  SiRNA target sequence
aagtatctagtgatacaattaaagctg

SEQ ID NO: 168997 - DNA, 27 bp, Artificial sequence
  SiRNA target sequence
agtatctagtgatacaattaaagctgt

SEQ ID NO: 168998 - DNA, 27 bp, Artificial sequence
  SiRNA target sequence
gtatctagtgatacaattaaagctgtt

SEQ ID NO: 168999 - DNA, 27 bp, Artificial sequence
  SiRNA target sequence
tatctagtgatacaattaaagctgtta

SEQ ID NO: 169000 - DNA, 27 bp, Artificial sequence
  SiRNA target sequence
atctagtgatacaattaaagctgttaa

SEQ ID NO: 169001 - DNA, 27 bp, Artificial sequence
  SiRNA target sequence
tctagtgatacaattaaagctgttaat

SEQ ID NO: 169002 - DNA, 27 bp, Artificial sequence
  SiRNA target sequence
ctagtgatacaattaaagctgttaata

SEQ ID NO: 169003 - DNA, 27 bp, Artificial sequence
  SiRNA target sequence
tagtgatacaattaaagctgttaataa

SEQ ID NO: 169004 - DNA, 27 bp, Artificial sequence
  SiRNA target sequence
agtgatacaattaaagctgttaataag

SEQ ID NO: 169005 - DNA, 27 bp, Artificial sequence
  SiRNA target sequence
gtgatacaattaaagctgttaataagt

SEQ ID NO: 169006 - DNA, 27 bp, Artificial sequence
  SiRNA target sequence
tgatacaattaaagctgttaataagtt

SEQ ID NO: 169007 - DNA, 27 bp, Artificial sequence
  SiRNA target sequence
gatacaattaaagctgttaataagtta

SEQ ID NO: 169008 - DNA, 27 bp, Artificial sequence
  SiRNA target sequence
atacaattaaagctgttaataagttaa

SEQ ID NO: 169009 - DNA, 27 bp, Artificial sequence
  SiRNA target sequence
tacaattaaagctgttaataagttaag

SEQ ID NO: 169010 - DNA, 27 bp, Artificial sequence
  SiRNA target sequence
acaattaaagctgttaataagttaaga

SEQ ID NO: 169011 - DNA, 27 bp, Artificial sequence
  SiRNA target sequence
caattaaagctgttaataagttaagag

SEQ ID NO: 169012 - DNA, 27 bp, Artificial sequence
  SiRNA target sequence
aattaaagctgttaataagttaagaga

SEQ ID NO: 169013 - DNA, 27 bp, Artificial sequence
  SiRNA target sequence
attaaagctgttaataagttaagagat

SEQ ID NO: 169014 - DNA, 27 bp, Artificial sequence
  SiRNA target sequence
ttaaagctgttaataagttaagagata

SEQ ID NO: 169015 - DNA, 27 bp, Artificial sequence
  SiRNA target sequence
taaagctgttaataagttaagagatat

SEQ ID NO: 169016 - DNA, 27 bp, Artificial sequence
  SiRNA target sequence
aaagctgttaataagttaagagatatg

SEQ ID NO: 169017 - DNA, 27 bp, Artificial sequence
  SiRNA target sequence
aagctgttaataagttaagagatatgt

SEQ ID NO: 169018 - DNA, 27 bp, Artificial sequence
  SiRNA target sequence
agctgttaataagttaagagatatgtc

SEQ ID NO: 169019 - DNA, 27 bp, Artificial sequence
  SiRNA target sequence
gctgttaataagttaagagatatgtct

SEQ ID NO: 169020 - DNA, 27 bp, Artificial sequence
  SiRNA target sequence
ctgttaataagttaagagatatgtctc

SEQ ID NO: 169021 - DNA, 27 bp, Artificial sequence
  SiRNA target sequence
tgttaataagttaagagatatgtctcc

SEQ ID NO: 169022 - DNA, 27 bp, Artificial sequence
  SiRNA target sequence
gttaataagttaagagatatgtctcct

SEQ ID NO: 169023 - DNA, 27 bp, Artificial sequence
  SiRNA target sequence
ttaataagttaagagatatgtctcctt

SEQ ID NO: 169024 - DNA, 27 bp, Artificial sequence
  SiRNA target sequence
taataagttaagagatatgtctccttt

SEQ ID NO: 169025 - DNA, 27 bp, Artificial sequence
  SiRNA target sequence
aataagttaagagatatgtctccttta

SEQ ID NO: 169026 - DNA, 27 bp, Artificial sequence
  SiRNA target sequence
ataagttaagagatatgtctcctttat

SEQ ID NO: 169027 - DNA, 27 bp, Artificial sequence
  SiRNA target sequence
taagttaagagatatgtctcctttata

SEQ ID NO: 169028 - DNA, 27 bp, Artificial sequence
  SiRNA target sequence
aagttaagagatatgtctcctttatat

SEQ ID NO: 169029 - DNA, 27 bp, Artificial sequence
  SiRNA target sequence
agttaagagatatgtctcctttatatg

SEQ ID NO: 169030 - DNA, 27 bp, Artificial sequence
  SiRNA target sequence
gttaagagatatgtctcctttatatga

SEQ ID NO: 169031 - DNA, 27 bp, Artificial sequence
  SiRNA target sequence
ttaagagatatgtctcctttatatgaa

SEQ ID NO: 169032 - DNA, 27 bp, Artificial sequence
  SiRNA target sequence
taagagatatgtctcctttatatgaaa

SEQ ID NO: 169033 - DNA, 27 bp, Artificial sequence
  SiRNA target sequence
aagagatatgtctcctttatatgaaat

SEQ ID NO: 169034 - DNA, 27 bp, Artificial sequence
  SiRNA target sequence
agagatatgtctcctttatatgaaatg

SEQ ID NO: 169035 - DNA, 27 bp, Artificial sequence
  SiRNA target sequence
gagatatgtctcctttatatgaaatgg

SEQ ID NO: 169036 - DNA, 27 bp, Artificial sequence
  SiRNA target sequence
agatatgtctcctttatatgaaatggt

SEQ ID NO: 169037 - DNA, 27 bp, Artificial sequence
  SiRNA target sequence
gatatgtctcctttatatgaaatggtc

SEQ ID NO: 169038 - DNA, 27 bp, Artificial sequence
  SiRNA target sequence
atatgtctcctttatatgaaatggtca

SEQ ID NO: 169039 - DNA, 27 bp, Artificial sequence
  SiRNA target sequence
tatgtctcctttatatgaaatggtcaa

SEQ ID NO: 169040 - DNA, 27 bp, Artificial sequence
  SiRNA target sequence
atgtctcctttatatgaaatggtcaaa

SEQ ID NO: 169041 - DNA, 27 bp, Artificial sequence
  SiRNA target sequence
tgtctcctttatatgaaatggtcaaag

SEQ ID NO: 169042 - DNA, 27 bp, Artificial sequence
  SiRNA target sequence
gtctcctttatatgaaatggtcaaaga

SEQ ID NO: 169043 - DNA, 27 bp, Artificial sequence
  SiRNA target sequence
tctcctttatatgaaatggtcaaagaa

SEQ ID NO: 169044 - DNA, 27 bp, Artificial sequence
  SiRNA target sequence
ctcctttatatgaaatggtcaaagaag

SEQ ID NO: 169045 - DNA, 27 bp, Artificial sequence
  SiRNA target sequence
tcctttatatgaaatggtcaaagaagg

SEQ ID NO: 169046 - DNA, 27 bp, Artificial sequence
  SiRNA target sequence
cctttatatgaaatggtcaaagaaggg

SEQ ID NO: 169047 - DNA, 27 bp, Artificial sequence
  SiRNA target sequence
ctttatatgaaatggtcaaagaaggga

SEQ ID NO: 169048 - DNA, 27 bp, Artificial sequence
  SiRNA target sequence
tttatatgaaatggtcaaagaagggat

SEQ ID NO: 169049 - DNA, 27 bp, Artificial sequence
  SiRNA target sequence
ttatatgaaatggtcaaagaagggata

SEQ ID NO: 169050 - DNA, 27 bp, Artificial sequence
  SiRNA target sequence
tatatgaaatggtcaaagaagggatag

SEQ ID NO: 169051 - DNA, 27 bp, Artificial sequence
  SiRNA target sequence
atatgaaatggtcaaagaagggataga

SEQ ID NO: 169052 - DNA, 27 bp, Artificial sequence
  SiRNA target sequence
tatgaaatggtcaaagaagggatagat

SEQ ID NO: 169053 - DNA, 27 bp, Artificial sequence
  SiRNA target sequence
atgaaatggtcaaagaagggatagatt

SEQ ID NO: 169054 - DNA, 27 bp, Artificial sequence
  SiRNA target sequence
tgaaatggtcaaagaagggatagattt

SEQ ID NO: 169055 - DNA, 27 bp, Artificial sequence
  SiRNA target sequence
gaaatggtcaaagaagggatagattta

SEQ ID NO: 169056 - DNA, 27 bp, Artificial sequence
  SiRNA target sequence
aaatggtcaaagaagggatagatttag

SEQ ID NO: 169057 - DNA, 27 bp, Artificial sequence
  SiRNA target sequence
aatggtcaaagaagggatagatttaga

SEQ ID NO: 169058 - DNA, 27 bp, Artificial sequence
  SiRNA target sequence
atggtcaaagaagggatagatttagat

SEQ ID NO: 169059 - DNA, 27 bp, Artificial sequence
  SiRNA target sequence
tggtcaaagaagggatagatttagata

SEQ ID NO: 169060 - DNA, 27 bp, Artificial sequence
  SiRNA target sequence
ggtcaaagaagggatagatttagataa

SEQ ID NO: 169061 - DNA, 27 bp, Artificial sequence
  SiRNA target sequence
gtcaaagaagggatagatttagataaa

SEQ ID NO: 169062 - DNA, 27 bp, Artificial sequence
  SiRNA target sequence
tcaaagaagggatagatttagataaaa

SEQ ID NO: 169063 - DNA, 27 bp, Artificial sequence
  SiRNA target sequence
caaagaagggatagatttagataaaat

SEQ ID NO: 169064 - DNA, 27 bp, Artificial sequence
  SiRNA target sequence
aaagaagggatagatttagataaaatt

SEQ ID NO: 169065 - DNA, 27 bp, Artificial sequence
  SiRNA target sequence
aagaagggatagatttagataaaatta

SEQ ID NO: 169066 - DNA, 27 bp, Artificial sequence
  SiRNA target sequence
agaagggatagatttagataaaattaa

SEQ ID NO: 169067 - DNA, 27 bp, Artificial sequence
  SiRNA target sequence
gaagggatagatttagataaaattaat

SEQ ID NO: 169068 - DNA, 27 bp, Artificial sequence
  SiRNA target sequence
aagggatagatttagataaaattaatt

SEQ ID NO: 169069 - DNA, 27 bp, Artificial sequence
  SiRNA target sequence
agggatagatttagataaaattaattg

SEQ ID NO: 169070 - DNA, 27 bp, Artificial sequence
  SiRNA target sequence
gggatagatttagataaaattaattgg

SEQ ID NO: 169071 - DNA, 27 bp, Artificial sequence
  SiRNA target sequence
ggatagatttagataaaattaattggt

SEQ ID NO: 169072 - DNA, 27 bp, Artificial sequence
  SiRNA target sequence
gatagatttagataaaattaattggtc

SEQ ID NO: 169073 - DNA, 27 bp, Artificial sequence
  SiRNA target sequence
atagatttagataaaattaattggtct

SEQ ID NO: 169074 - DNA, 27 bp, Artificial sequence
  SiRNA target sequence
tagatttagataaaattaattggtctg

SEQ ID NO: 169075 - DNA, 27 bp, Artificial sequence
  SiRNA target sequence
agatttagataaaattaattggtctgc

SEQ ID NO: 169076 - DNA, 27 bp, Artificial sequence
  SiRNA target sequence
gatttagataaaattaattggtctgct

SEQ ID NO: 169077 - DNA, 27 bp, Artificial sequence
  SiRNA target sequence
atttagataaaattaattggtctgctt

SEQ ID NO: 169078 - DNA, 27 bp, Artificial sequence
  SiRNA target sequence
tttagataaaattaattggtctgctta

SEQ ID NO: 169079 - DNA, 27 bp, Artificial sequence
  SiRNA target sequence
ttagataaaattaattggtctgcttaa

SEQ ID NO: 169080 - DNA, 19 bp, Artificial sequence
  SiRNA target sequence
atgaatactgaaaataaac

SEQ ID NO: 169081 - DNA, 19 bp, Artificial sequence
  SiRNA target sequence
tgaatactgaaaataaacc

SEQ ID NO: 169082 - DNA, 19 bp, Artificial sequence
  SiRNA target sequence
gaatactgaaaataaacca

SEQ ID NO: 169083 - DNA, 19 bp, Artificial sequence
  SiRNA target sequence
aatactgaaaataaaccat

SEQ ID NO: 169084 - DNA, 19 bp, Artificial sequence
  SiRNA target sequence
atactgaaaataaaccatg

SEQ ID NO: 169085 - DNA, 19 bp, Artificial sequence
  SiRNA target sequence
tactgaaaataaaccatgt

SEQ ID NO: 169086 - DNA, 19 bp, Artificial sequence
  SiRNA target sequence
actgaaaataaaccatgta

SEQ ID NO: 169087 - DNA, 19 bp, Artificial sequence
  SiRNA target sequence
ctgaaaataaaccatgtat

SEQ ID NO: 169088 - DNA, 19 bp, Artificial sequence
  SiRNA target sequence
tgaaaataaaccatgtatt

SEQ ID NO: 169089 - DNA, 19 bp, Artificial sequence
  SiRNA target sequence
gaaaataaaccatgtattt

SEQ ID NO: 169090 - DNA, 19 bp, Artificial sequence
  SiRNA target sequence
aaaataaaccatgtatttc

SEQ ID NO: 169091 - DNA, 19 bp, Artificial sequence
  SiRNA target sequence
aaataaaccatgtatttca

SEQ ID NO: 169092 - DNA, 19 bp, Artificial sequence
  SiRNA target sequence
aataaaccatgtatttcac

SEQ ID NO: 169093 - DNA, 19 bp, Artificial sequence
  SiRNA target sequence
ataaaccatgtatttcacc

SEQ ID NO: 169094 - DNA, 19 bp, Artificial sequence
  SiRNA target sequence
taaaccatgtatttcacca

SEQ ID NO: 169095 - DNA, 19 bp, Artificial sequence
  SiRNA target sequence
aaaccatgtatttcaccat

SEQ ID NO: 169096 - DNA, 19 bp, Artificial sequence
  SiRNA target sequence
aaccatgtatttcaccatt

SEQ ID NO: 169097 - DNA, 19 bp, Artificial sequence
  SiRNA target sequence
accatgtatttcaccattt

SEQ ID NO: 169098 - DNA, 19 bp, Artificial sequence
  SiRNA target sequence
ccatgtatttcaccattta

SEQ ID NO: 169099 - DNA, 19 bp, Artificial sequence
  SiRNA target sequence
catgtatttcaccatttac

SEQ ID NO: 169100 - DNA, 19 bp, Artificial sequence
  SiRNA target sequence
atgtatttcaccatttacc

SEQ ID NO: 169101 - DNA, 19 bp, Artificial sequence
  SiRNA target sequence
tgtatttcaccatttacct

SEQ ID NO: 169102 - DNA, 19 bp, Artificial sequence
  SiRNA target sequence
gtatttcaccatttacctt

SEQ ID NO: 169103 - DNA, 19 bp, Artificial sequence
  SiRNA target sequence
tatttcaccatttaccttt

SEQ ID NO: 169104 - DNA, 19 bp, Artificial sequence
  SiRNA target sequence
atttcaccatttaccttta

SEQ ID NO: 169105 - DNA, 19 bp, Artificial sequence
  SiRNA target sequence
tttcaccatttacctttaa

SEQ ID NO: 169106 - DNA, 19 bp, Artificial sequence
  SiRNA target sequence
ttcaccatttacctttaaa

SEQ ID NO: 169107 - DNA, 19 bp, Artificial sequence
  SiRNA target sequence
tcaccatttacctttaaac

SEQ ID NO: 169108 - DNA, 19 bp, Artificial sequence
  SiRNA target sequence
caccatttacctttaaact

SEQ ID NO: 169109 - DNA, 19 bp, Artificial sequence
  SiRNA target sequence
accatttacctttaaacta

SEQ ID NO: 169110 - DNA, 19 bp, Artificial sequence
  SiRNA target sequence
ccatttacctttaaactag

SEQ ID NO: 169111 - DNA, 19 bp, Artificial sequence
  SiRNA target sequence
catttacctttaaactaga

SEQ ID NO: 169112 - DNA, 19 bp, Artificial sequence
  SiRNA target sequence
atttacctttaaactagaa

SEQ ID NO: 169113 - DNA, 19 bp, Artificial sequence
  SiRNA target sequence
tttacctttaaactagaag

SEQ ID NO: 169114 - DNA, 19 bp, Artificial sequence
  SiRNA target sequence
ttacctttaaactagaaga

SEQ ID NO: 169115 - DNA, 19 bp, Artificial sequence
  SiRNA target sequence
tacctttaaactagaagat

SEQ ID NO: 169116 - DNA, 19 bp, Artificial sequence
  SiRNA target sequence
acctttaaactagaagatt

SEQ ID NO: 169117 - DNA, 19 bp, Artificial sequence
  SiRNA target sequence
cctttaaactagaagattg

SEQ ID NO: 169118 - DNA, 19 bp, Artificial sequence
  SiRNA target sequence
ctttaaactagaagattgc

SEQ ID NO: 169119 - DNA, 19 bp, Artificial sequence
  SiRNA target sequence
tttaaactagaagattgcc

SEQ ID NO: 169120 - DNA, 19 bp, Artificial sequence
  SiRNA target sequence
ttaaactagaagattgcct

SEQ ID NO: 169121 - DNA, 19 bp, Artificial sequence
  SiRNA target sequence
taaactagaagattgcctg

SEQ ID NO: 169122 - DNA, 19 bp, Artificial sequence
  SiRNA target sequence
aaactagaagattgcctgg

SEQ ID NO: 169123 - DNA, 19 bp, Artificial sequence
  SiRNA target sequence
aactagaagattgcctggc

SEQ ID NO: 169124 - DNA, 19 bp, Artificial sequence
  SiRNA target sequence
actagaagattgcctggca

SEQ ID NO: 169125 - DNA, 19 bp, Artificial sequence
  SiRNA target sequence
ctagaagattgcctggcat

SEQ ID NO: 169126 - DNA, 19 bp, Artificial sequence
  SiRNA target sequence
tagaagattgcctggcatg

SEQ ID NO: 169127 - DNA, 19 bp, Artificial sequence
  SiRNA target sequence
agaagattgcctggcatgt

SEQ ID NO: 169128 - DNA, 19 bp, Artificial sequence
  SiRNA target sequence
gaagattgcctggcatgtt

SEQ ID NO: 169129 - DNA, 19 bp, Artificial sequence
  SiRNA target sequence
aagattgcctggcatgttc

SEQ ID NO: 169130 - DNA, 19 bp, Artificial sequence
  SiRNA target sequence
agattgcctggcatgttcg

SEQ ID NO: 169131 - DNA, 19 bp, Artificial sequence
  SiRNA target sequence
gattgcctggcatgttcgg

SEQ ID NO: 169132 - DNA, 19 bp, Artificial sequence
  SiRNA target sequence
attgcctggcatgttcggc

SEQ ID NO: 169133 - DNA, 19 bp, Artificial sequence
  SiRNA target sequence
ttgcctggcatgttcggct

SEQ ID NO: 169134 - DNA, 19 bp, Artificial sequence
  SiRNA target sequence
tgcctggcatgttcggctt

SEQ ID NO: 169135 - DNA, 19 bp, Artificial sequence
  SiRNA target sequence
gcctggcatgttcggcttg

SEQ ID NO: 169136 - DNA, 19 bp, Artificial sequence
  SiRNA target sequence
cctggcatgttcggcttgt

SEQ ID NO: 169137 - DNA, 19 bp, Artificial sequence
  SiRNA target sequence
ctggcatgttcggcttgta

SEQ ID NO: 169138 - DNA, 19 bp, Artificial sequence
  SiRNA target sequence
tggcatgttcggcttgtat

SEQ ID NO: 169139 - DNA, 19 bp, Artificial sequence
  SiRNA target sequence
ggcatgttcggcttgtatt

SEQ ID NO: 169140 - DNA, 19 bp, Artificial sequence
  SiRNA target sequence
gcatgttcggcttgtattg

SEQ ID NO: 169141 - DNA, 19 bp, Artificial sequence
  SiRNA target sequence
catgttcggcttgtattgc

SEQ ID NO: 169142 - DNA, 19 bp, Artificial sequence
  SiRNA target sequence
atgttcggcttgtattgct

SEQ ID NO: 169143 - DNA, 19 bp, Artificial sequence
  SiRNA target sequence
tgttcggcttgtattgctg

SEQ ID NO: 169144 - DNA, 19 bp, Artificial sequence
  SiRNA target sequence
gttcggcttgtattgctga

SEQ ID NO: 169145 - DNA, 19 bp, Artificial sequence
  SiRNA target sequence
ttcggcttgtattgctgat

SEQ ID NO: 169146 - DNA, 19 bp, Artificial sequence
  SiRNA target sequence
tcggcttgtattgctgatt

SEQ ID NO: 169147 - DNA, 19 bp, Artificial sequence
  SiRNA target sequence
cggcttgtattgctgattt

SEQ ID NO: 169148 - DNA, 19 bp, Artificial sequence
  SiRNA target sequence
ggcttgtattgctgatttt

SEQ ID NO: 169149 - DNA, 19 bp, Artificial sequence
  SiRNA target sequence
gcttgtattgctgattttt

SEQ ID NO: 169150 - DNA, 19 bp, Artificial sequence
  SiRNA target sequence
cttgtattgctgatttttc

SEQ ID NO: 169151 - DNA, 19 bp, Artificial sequence
  SiRNA target sequence
ttgtattgctgatttttct

SEQ ID NO: 169152 - DNA, 19 bp, Artificial sequence
  SiRNA target sequence
tgtattgctgatttttctg

SEQ ID NO: 169153 - DNA, 19 bp, Artificial sequence
  SiRNA target sequence
gtattgctgatttttctgt

SEQ ID NO: 169154 - DNA, 19 bp, Artificial sequence
  SiRNA target sequence
tattgctgatttttctgtt

SEQ ID NO: 169155 - DNA, 19 bp, Artificial sequence
  SiRNA target sequence
attgctgatttttctgttc

SEQ ID NO: 169156 - DNA, 19 bp, Artificial sequence
  SiRNA target sequence
ttgctgatttttctgttcc

SEQ ID NO: 169157 - DNA, 19 bp, Artificial sequence
  SiRNA target sequence
tgctgatttttctgttcca

SEQ ID NO: 169158 - DNA, 19 bp, Artificial sequence
  SiRNA target sequence
gctgatttttctgttccaa

SEQ ID NO: 169159 - DNA, 19 bp, Artificial sequence
  SiRNA target sequence
ctgatttttctgttccaaa

SEQ ID NO: 169160 - DNA, 19 bp, Artificial sequence
  SiRNA target sequence
tgatttttctgttccaaaa

SEQ ID NO: 169161 - DNA, 19 bp, Artificial sequence
  SiRNA target sequence
gatttttctgttccaaaaa

SEQ ID NO: 169162 - DNA, 19 bp, Artificial sequence
  SiRNA target sequence
atttttctgttccaaaaat

SEQ ID NO: 169163 - DNA, 19 bp, Artificial sequence
  SiRNA target sequence
tttttctgttccaaaaatt

SEQ ID NO: 169164 - DNA, 19 bp, Artificial sequence
  SiRNA target sequence
ttttctgttccaaaaattc

SEQ ID NO: 169165 - DNA, 19 bp, Artificial sequence
  SiRNA target sequence
tttctgttccaaaaattcc

SEQ ID NO: 169166 - DNA, 19 bp, Artificial sequence
  SiRNA target sequence
ttctgttccaaaaattcct

SEQ ID NO: 169167 - DNA, 19 bp, Artificial sequence
  SiRNA target sequence
tctgttccaaaaattccta

SEQ ID NO: 169168 - DNA, 19 bp, Artificial sequence
  SiRNA target sequence
ctgttccaaaaattcctac

SEQ ID NO: 169169 - DNA, 19 bp, Artificial sequence
  SiRNA target sequence
tgttccaaaaattcctact

SEQ ID NO: 169170 - DNA, 19 bp, Artificial sequence
  SiRNA target sequence
gttccaaaaattcctactt

SEQ ID NO: 169171 - DNA, 19 bp, Artificial sequence
  SiRNA target sequence
ttccaaaaattcctactta

SEQ ID NO: 169172 - DNA, 19 bp, Artificial sequence
  SiRNA target sequence
tccaaaaattcctacttac

SEQ ID NO: 169173 - DNA, 19 bp, Artificial sequence
  SiRNA target sequence
ccaaaaattcctacttaca

SEQ ID NO: 169174 - DNA, 19 bp, Artificial sequence
  SiRNA target sequence
caaaaattcctacttacac

SEQ ID NO: 169175 - DNA, 19 bp, Artificial sequence
  SiRNA target sequence
aaaaattcctacttacaca

SEQ ID NO: 169176 - DNA, 19 bp, Artificial sequence
  SiRNA target sequence
aaaattcctacttacacag

SEQ ID NO: 169177 - DNA, 19 bp, Artificial sequence
  SiRNA target sequence
aaattcctacttacacaga

SEQ ID NO: 169178 - DNA, 19 bp, Artificial sequence
  SiRNA target sequence
aattcctacttacacagaa

SEQ ID NO: 169179 - DNA, 19 bp, Artificial sequence
  SiRNA target sequence
attcctacttacacagaac

SEQ ID NO: 169180 - DNA, 19 bp, Artificial sequence
  SiRNA target sequence
ttcctacttacacagaact

SEQ ID NO: 169181 - DNA, 19 bp, Artificial sequence
  SiRNA target sequence
tcctacttacacagaactg

SEQ ID NO: 169182 - DNA, 19 bp, Artificial sequence
  SiRNA target sequence
cctacttacacagaactga

SEQ ID NO: 169183 - DNA, 19 bp, Artificial sequence
  SiRNA target sequence
ctacttacacagaactgaa

SEQ ID NO: 169184 - DNA, 19 bp, Artificial sequence
  SiRNA target sequence
tacttacacagaactgaaa

SEQ ID NO: 169185 - DNA, 19 bp, Artificial sequence
  SiRNA target sequence
acttacacagaactgaaag

SEQ ID NO: 169186 - DNA, 19 bp, Artificial sequence
  SiRNA target sequence
cttacacagaactgaaaga

SEQ ID NO: 169187 - DNA, 19 bp, Artificial sequence
  SiRNA target sequence
ttacacagaactgaaagat

SEQ ID NO: 169188 - DNA, 19 bp, Artificial sequence
  SiRNA target sequence
tacacagaactgaaagatg

SEQ ID NO: 169189 - DNA, 19 bp, Artificial sequence
  SiRNA target sequence
acacagaactgaaagatgt

SEQ ID NO: 169190 - DNA, 19 bp, Artificial sequence
  SiRNA target sequence
cacagaactgaaagatgtc

SEQ ID NO: 169191 - DNA, 19 bp, Artificial sequence
  SiRNA target sequence
acagaactgaaagatgtcc

SEQ ID NO: 169192 - DNA, 19 bp, Artificial sequence
  SiRNA target sequence
cagaactgaaagatgtccc

SEQ ID NO: 169193 - DNA, 19 bp, Artificial sequence
  SiRNA target sequence
agaactgaaagatgtccct

SEQ ID NO: 169194 - DNA, 19 bp, Artificial sequence
  SiRNA target sequence
gaactgaaagatgtccctt

SEQ ID NO: 169195 - DNA, 19 bp, Artificial sequence
  SiRNA target sequence
aactgaaagatgtcccttt

SEQ ID NO: 169196 - DNA, 19 bp, Artificial sequence
  SiRNA target sequence
actgaaagatgtcccttta

SEQ ID NO: 169197 - DNA, 19 bp, Artificial sequence
  SiRNA target sequence
ctgaaagatgtccctttaa

SEQ ID NO: 169198 - DNA, 19 bp, Artificial sequence
  SiRNA target sequence
tgaaagatgtccctttaac

SEQ ID NO: 169199 - DNA, 19 bp, Artificial sequence
  SiRNA target sequence
gaaagatgtccctttaaca

SEQ ID NO: 169200 - DNA, 19 bp, Artificial sequence
  SiRNA target sequence
aaagatgtccctttaacat

SEQ ID NO: 169201 - DNA, 19 bp, Artificial sequence
  SiRNA target sequence
aagatgtccctttaacatt

SEQ ID NO: 169202 - DNA, 19 bp, Artificial sequence
  SiRNA target sequence
agatgtccctttaacattt

SEQ ID NO: 169203 - DNA, 19 bp, Artificial sequence
  SiRNA target sequence
gatgtccctttaacatttt

SEQ ID NO: 169204 - DNA, 19 bp, Artificial sequence
  SiRNA target sequence
atgtccctttaacattttt

SEQ ID NO: 169205 - DNA, 19 bp, Artificial sequence
  SiRNA target sequence
tgtccctttaacattttta

SEQ ID NO: 169206 - DNA, 19 bp, Artificial sequence
  SiRNA target sequence
gtccctttaacatttttat

SEQ ID NO: 169207 - DNA, 19 bp, Artificial sequence
  SiRNA target sequence
tccctttaacatttttatt

SEQ ID NO: 169208 - DNA, 19 bp, Artificial sequence
  SiRNA target sequence
ccctttaacatttttatta

SEQ ID NO: 169209 - DNA, 19 bp, Artificial sequence
  SiRNA target sequence
cctttaacatttttattat

SEQ ID NO: 169210 - DNA, 19 bp, Artificial sequence
  SiRNA target sequence
ctttaacatttttattatc

SEQ ID NO: 169211 - DNA, 19 bp, Artificial sequence
  SiRNA target sequence
tttaacatttttattatca

SEQ ID NO: 169212 - DNA, 19 bp, Artificial sequence
  SiRNA target sequence
ttaacatttttattatcac

SEQ ID NO: 169213 - DNA, 19 bp, Artificial sequence
  SiRNA target sequence
taacatttttattatcacc

SEQ ID NO: 169214 - DNA, 19 bp, Artificial sequence
  SiRNA target sequence
aacatttttattatcacca

SEQ ID NO: 169215 - DNA, 19 bp, Artificial sequence
  SiRNA target sequence
acatttttattatcaccac

SEQ ID NO: 169216 - DNA, 19 bp, Artificial sequence
  SiRNA target sequence
catttttattatcaccaca

SEQ ID NO: 169217 - DNA, 19 bp, Artificial sequence
  SiRNA target sequence
atttttattatcaccacat

SEQ ID NO: 169218 - DNA, 19 bp, Artificial sequence
  SiRNA target sequence
tttttattatcaccacatt

SEQ ID NO: 169219 - DNA, 19 bp, Artificial sequence
  SiRNA target sequence
ttttattatcaccacattc

SEQ ID NO: 169220 - DNA, 19 bp, Artificial sequence
  SiRNA target sequence
tttattatcaccacattcg

SEQ ID NO: 169221 - DNA, 19 bp, Artificial sequence
  SiRNA target sequence
ttattatcaccacattcga

SEQ ID NO: 169222 - DNA, 19 bp, Artificial sequence
  SiRNA target sequence
tattatcaccacattcgaa

SEQ ID NO: 169223 - DNA, 19 bp, Artificial sequence
  SiRNA target sequence
attatcaccacattcgaaa

SEQ ID NO: 169224 - DNA, 19 bp, Artificial sequence
  SiRNA target sequence
ttatcaccacattcgaaaa

SEQ ID NO: 169225 - DNA, 19 bp, Artificial sequence
  SiRNA target sequence
tatcaccacattcgaaaat

SEQ ID NO: 169226 - DNA, 19 bp, Artificial sequence
  SiRNA target sequence
atcaccacattcgaaaatg

SEQ ID NO: 169227 - DNA, 19 bp, Artificial sequence
  SiRNA target sequence
tcaccacattcgaaaatga

SEQ ID NO: 169228 - DNA, 19 bp, Artificial sequence
  SiRNA target sequence
caccacattcgaaaatgaa

SEQ ID NO: 169229 - DNA, 19 bp, Artificial sequence
  SiRNA target sequence
accacattcgaaaatgaat

SEQ ID NO: 169230 - DNA, 19 bp, Artificial sequence
  SiRNA target sequence
ccacattcgaaaatgaata

SEQ ID NO: 169231 - DNA, 19 bp, Artificial sequence
  SiRNA target sequence
cacattcgaaaatgaatat

SEQ ID NO: 169232 - DNA, 19 bp, Artificial sequence
  SiRNA target sequence
acattcgaaaatgaatatg

SEQ ID NO: 169233 - DNA, 19 bp, Artificial sequence
  SiRNA target sequence
cattcgaaaatgaatatgt

SEQ ID NO: 169234 - DNA, 19 bp, Artificial sequence
  SiRNA target sequence
attcgaaaatgaatatgta

SEQ ID NO: 169235 - DNA, 19 bp, Artificial sequence
  SiRNA target sequence
ttcgaaaatgaatatgtat

SEQ ID NO: 169236 - DNA, 19 bp, Artificial sequence
  SiRNA target sequence
tcgaaaatgaatatgtatg

SEQ ID NO: 169237 - DNA, 19 bp, Artificial sequence
  SiRNA target sequence
cgaaaatgaatatgtatgc

SEQ ID NO: 169238 - DNA, 19 bp, Artificial sequence
  SiRNA target sequence
gaaaatgaatatgtatgca

SEQ ID NO: 169239 - DNA, 19 bp, Artificial sequence
  SiRNA target sequence
aaaatgaatatgtatgcac

SEQ ID NO: 169240 - DNA, 19 bp, Artificial sequence
  SiRNA target sequence
aaatgaatatgtatgcaca

SEQ ID NO: 169241 - DNA, 19 bp, Artificial sequence
  SiRNA target sequence
aatgaatatgtatgcacac

SEQ ID NO: 169242 - DNA, 19 bp, Artificial sequence
  SiRNA target sequence
atgaatatgtatgcacact

SEQ ID NO: 169243 - DNA, 19 bp, Artificial sequence
  SiRNA target sequence
tgaatatgtatgcacacta

SEQ ID NO: 169244 - DNA, 19 bp, Artificial sequence
  SiRNA target sequence
gaatatgtatgcacactat

SEQ ID NO: 169245 - DNA, 19 bp, Artificial sequence
  SiRNA target sequence
aatatgtatgcacactata

SEQ ID NO: 169246 - DNA, 19 bp, Artificial sequence
  SiRNA target sequence
atatgtatgcacactataa

SEQ ID NO: 169247 - DNA, 19 bp, Artificial sequence
  SiRNA target sequence
tatgtatgcacactataac

SEQ ID NO: 169248 - DNA, 19 bp, Artificial sequence
  SiRNA target sequence
atgtatgcacactataaca

SEQ ID NO: 169249 - DNA, 19 bp, Artificial sequence
  SiRNA target sequence
tgtatgcacactataacaa

SEQ ID NO: 169250 - DNA, 19 bp, Artificial sequence
  SiRNA target sequence
gtatgcacactataacaat

SEQ ID NO: 169251 - DNA, 19 bp, Artificial sequence
  SiRNA target sequence
tatgcacactataacaatc

SEQ ID NO: 169252 - DNA, 19 bp, Artificial sequence
  SiRNA target sequence
atgcacactataacaatca

SEQ ID NO: 169253 - DNA, 19 bp, Artificial sequence
  SiRNA target sequence
tgcacactataacaatcat

SEQ ID NO: 169254 - DNA, 19 bp, Artificial sequence
  SiRNA target sequence
gcacactataacaatcata

SEQ ID NO: 169255 - DNA, 19 bp, Artificial sequence
  SiRNA target sequence
cacactataacaatcatat

SEQ ID NO: 169256 - DNA, 19 bp, Artificial sequence
  SiRNA target sequence
acactataacaatcatata

SEQ ID NO: 169257 - DNA, 19 bp, Artificial sequence
  SiRNA target sequence
cactataacaatcatataa

SEQ ID NO: 169258 - DNA, 19 bp, Artificial sequence
  SiRNA target sequence
actataacaatcatataat

SEQ ID NO: 169259 - DNA, 19 bp, Artificial sequence
  SiRNA target sequence
ctataacaatcatataatg

SEQ ID NO: 169260 - DNA, 19 bp, Artificial sequence
  SiRNA target sequence
tataacaatcatataatgt

SEQ ID NO: 169261 - DNA, 19 bp, Artificial sequence
  SiRNA target sequence
ataacaatcatataatgtc

SEQ ID NO: 169262 - DNA, 19 bp, Artificial sequence
  SiRNA target sequence
taacaatcatataatgtcc

SEQ ID NO: 169263 - DNA, 19 bp, Artificial sequence
  SiRNA target sequence
aacaatcatataatgtcct

SEQ ID NO: 169264 - DNA, 19 bp, Artificial sequence
  SiRNA target sequence
acaatcatataatgtcctt

SEQ ID NO: 169265 - DNA, 19 bp, Artificial sequence
  SiRNA target sequence
caatcatataatgtccttt

SEQ ID NO: 169266 - DNA, 19 bp, Artificial sequence
  SiRNA target sequence
aatcatataatgtccttta

SEQ ID NO: 169267 - DNA, 19 bp, Artificial sequence
  SiRNA target sequence
atcatataatgtcctttag

SEQ ID NO: 169268 - DNA, 19 bp, Artificial sequence
  SiRNA target sequence
tcatataatgtcctttagt

SEQ ID NO: 169269 - DNA, 19 bp, Artificial sequence
  SiRNA target sequence
catataatgtcctttagtg

SEQ ID NO: 169270 - DNA, 19 bp, Artificial sequence
  SiRNA target sequence
atataatgtcctttagtga

SEQ ID NO: 169271 - DNA, 19 bp, Artificial sequence
  SiRNA target sequence
tataatgtcctttagtgat

SEQ ID NO: 169272 - DNA, 19 bp, Artificial sequence
  SiRNA target sequence
ataatgtcctttagtgatt

SEQ ID NO: 169273 - DNA, 19 bp, Artificial sequence
  SiRNA target sequence
taatgtcctttagtgattt

SEQ ID NO: 169274 - DNA, 19 bp, Artificial sequence
  SiRNA target sequence
aatgtcctttagtgatttt

SEQ ID NO: 169275 - DNA, 19 bp, Artificial sequence
  SiRNA target sequence
atgtcctttagtgattttg

SEQ ID NO: 169276 - DNA, 19 bp, Artificial sequence
  SiRNA target sequence
tgtcctttagtgattttga

SEQ ID NO: 169277 - DNA, 19 bp, Artificial sequence
  SiRNA target sequence
gtcctttagtgattttgaa

SEQ ID NO: 169278 - DNA, 19 bp, Artificial sequence
  SiRNA target sequence
tcctttagtgattttgaat

SEQ ID NO: 169279 - DNA, 19 bp, Artificial sequence
  SiRNA target sequence
cctttagtgattttgaata

SEQ ID NO: 169280 - DNA, 19 bp, Artificial sequence
  SiRNA target sequence
ctttagtgattttgaatat

SEQ ID NO: 169281 - DNA, 19 bp, Artificial sequence
  SiRNA target sequence
tttagtgattttgaatatc

SEQ ID NO: 169282 - DNA, 19 bp, Artificial sequence
  SiRNA target sequence
ttagtgattttgaatatca

SEQ ID NO: 169283 - DNA, 19 bp, Artificial sequence
  SiRNA target sequence
tagtgattttgaatatcac

SEQ ID NO: 169284 - DNA, 19 bp, Artificial sequence
  SiRNA target sequence
agtgattttgaatatcact

SEQ ID NO: 169285 - DNA, 19 bp, Artificial sequence
  SiRNA target sequence
gtgattttgaatatcactt

SEQ ID NO: 169286 - DNA, 19 bp, Artificial sequence
  SiRNA target sequence
tgattttgaatatcactta

SEQ ID NO: 169287 - DNA, 19 bp, Artificial sequence
  SiRNA target sequence
gattttgaatatcacttaa

SEQ ID NO: 169288 - DNA, 19 bp, Artificial sequence
  SiRNA target sequence
attttgaatatcacttaat

SEQ ID NO: 169289 - DNA, 19 bp, Artificial sequence
  SiRNA target sequence
ttttgaatatcacttaatt

SEQ ID NO: 169290 - DNA, 19 bp, Artificial sequence
  SiRNA target sequence
tttgaatatcacttaattt

SEQ ID NO: 169291 - DNA, 19 bp, Artificial sequence
  SiRNA target sequence
ttgaatatcacttaatttc

SEQ ID NO: 169292 - DNA, 19 bp, Artificial sequence
  SiRNA target sequence
tgaatatcacttaatttca

SEQ ID NO: 169293 - DNA, 19 bp, Artificial sequence
  SiRNA target sequence
gaatatcacttaatttcat

SEQ ID NO: 169294 - DNA, 19 bp, Artificial sequence
  SiRNA target sequence
aatatcacttaatttcatt

SEQ ID NO: 169295 - DNA, 19 bp, Artificial sequence
  SiRNA target sequence
atatcacttaatttcattt

SEQ ID NO: 169296 - DNA, 19 bp, Artificial sequence
  SiRNA target sequence
tatcacttaatttcattta

SEQ ID NO: 169297 - DNA, 19 bp, Artificial sequence
  SiRNA target sequence
atcacttaatttcatttat

SEQ ID NO: 169298 - DNA, 19 bp, Artificial sequence
  SiRNA target sequence
tcacttaatttcatttata

SEQ ID NO: 169299 - DNA, 19 bp, Artificial sequence
  SiRNA target sequence
cacttaatttcatttataa

SEQ ID NO: 169300 - DNA, 19 bp, Artificial sequence
  SiRNA target sequence
acttaatttcatttataaa

SEQ ID NO: 169301 - DNA, 19 bp, Artificial sequence
  SiRNA target sequence
cttaatttcatttataaaa

SEQ ID NO: 169302 - DNA, 19 bp, Artificial sequence
  SiRNA target sequence
ttaatttcatttataaaac

SEQ ID NO: 169303 - DNA, 19 bp, Artificial sequence
  SiRNA target sequence
taatttcatttataaaact

SEQ ID NO: 169304 - DNA, 19 bp, Artificial sequence
  SiRNA target sequence
aatttcatttataaaacta

SEQ ID NO: 169305 - DNA, 19 bp, Artificial sequence
  SiRNA target sequence
atttcatttataaaactaa

SEQ ID NO: 169306 - DNA, 19 bp, Artificial sequence
  SiRNA target sequence
tttcatttataaaactaaa

SEQ ID NO: 169307 - DNA, 19 bp, Artificial sequence
  SiRNA target sequence
ttcatttataaaactaaaa

SEQ ID NO: 169308 - DNA, 19 bp, Artificial sequence
  SiRNA target sequence
tcatttataaaactaaaat

SEQ ID NO: 169309 - DNA, 19 bp, Artificial sequence
  SiRNA target sequence
catttataaaactaaaatt

SEQ ID NO: 169310 - DNA, 19 bp, Artificial sequence
  SiRNA target sequence
atttataaaactaaaattt

SEQ ID NO: 169311 - DNA, 19 bp, Artificial sequence
  SiRNA target sequence
tttataaaactaaaattta

SEQ ID NO: 169312 - DNA, 19 bp, Artificial sequence
  SiRNA target sequence
ttataaaactaaaatttaa

SEQ ID NO: 169313 - DNA, 19 bp, Artificial sequence
  SiRNA target sequence
tataaaactaaaatttaat

SEQ ID NO: 169314 - DNA, 19 bp, Artificial sequence
  SiRNA target sequence
ataaaactaaaatttaatg

SEQ ID NO: 169315 - DNA, 19 bp, Artificial sequence
  SiRNA target sequence
taaaactaaaatttaatgt

SEQ ID NO: 169316 - DNA, 19 bp, Artificial sequence
  SiRNA target sequence
aaaactaaaatttaatgta

SEQ ID NO: 169317 - DNA, 19 bp, Artificial sequence
  SiRNA target sequence
aaactaaaatttaatgtaa

SEQ ID NO: 169318 - DNA, 19 bp, Artificial sequence
  SiRNA target sequence
aactaaaatttaatgtaat

SEQ ID NO: 169319 - DNA, 19 bp, Artificial sequence
  SiRNA target sequence
actaaaatttaatgtaata

SEQ ID NO: 169320 - DNA, 19 bp, Artificial sequence
  SiRNA target sequence
ctaaaatttaatgtaataa

SEQ ID NO: 169321 - DNA, 19 bp, Artificial sequence
  SiRNA target sequence
taaaatttaatgtaataaa

SEQ ID NO: 169322 - DNA, 19 bp, Artificial sequence
  SiRNA target sequence
aaaatttaatgtaataaaa

SEQ ID NO: 169323 - DNA, 19 bp, Artificial sequence
  SiRNA target sequence
aaatttaatgtaataaaag

SEQ ID NO: 169324 - DNA, 19 bp, Artificial sequence
  SiRNA target sequence
aatttaatgtaataaaagt

SEQ ID NO: 169325 - DNA, 19 bp, Artificial sequence
  SiRNA target sequence
atttaatgtaataaaagta

SEQ ID NO: 169326 - DNA, 19 bp, Artificial sequence
  SiRNA target sequence
tttaatgtaataaaagtat

SEQ ID NO: 169327 - DNA, 19 bp, Artificial sequence
  SiRNA target sequence
ttaatgtaataaaagtata

SEQ ID NO: 169328 - DNA, 19 bp, Artificial sequence
  SiRNA target sequence
taatgtaataaaagtatat

SEQ ID NO: 169329 - DNA, 19 bp, Artificial sequence
  SiRNA target sequence
aatgtaataaaagtatatg

SEQ ID NO: 169330 - DNA, 19 bp, Artificial sequence
  SiRNA target sequence
atgtaataaaagtatatga

SEQ ID NO: 169331 - DNA, 19 bp, Artificial sequence
  SiRNA target sequence
tgtaataaaagtatatgat

SEQ ID NO: 169332 - DNA, 19 bp, Artificial sequence
  SiRNA target sequence
gtaataaaagtatatgata

SEQ ID NO: 169333 - DNA, 19 bp, Artificial sequence
  SiRNA target sequence
taataaaagtatatgatac

SEQ ID NO: 169334 - DNA, 19 bp, Artificial sequence
  SiRNA target sequence
aataaaagtatatgataca

SEQ ID NO: 169335 - DNA, 19 bp, Artificial sequence
  SiRNA target sequence
ataaaagtatatgatacat

SEQ ID NO: 169336 - DNA, 19 bp, Artificial sequence
  SiRNA target sequence
taaaagtatatgatacatc

SEQ ID NO: 169337 - DNA, 19 bp, Artificial sequence
  SiRNA target sequence
aaaagtatatgatacatct

SEQ ID NO: 169338 - DNA, 19 bp, Artificial sequence
  SiRNA target sequence
aaagtatatgatacatctt

SEQ ID NO: 169339 - DNA, 19 bp, Artificial sequence
  SiRNA target sequence
aagtatatgatacatctta

SEQ ID NO: 169340 - DNA, 19 bp, Artificial sequence
  SiRNA target sequence
agtatatgatacatcttat

SEQ ID NO: 169341 - DNA, 19 bp, Artificial sequence
  SiRNA target sequence
gtatatgatacatcttatg

SEQ ID NO: 169342 - DNA, 19 bp, Artificial sequence
  SiRNA target sequence
tatatgatacatcttatgt

SEQ ID NO: 169343 - DNA, 19 bp, Artificial sequence
  SiRNA target sequence
atatgatacatcttatgtc

SEQ ID NO: 169344 - DNA, 19 bp, Artificial sequence
  SiRNA target sequence
tatgatacatcttatgtca

SEQ ID NO: 169345 - DNA, 19 bp, Artificial sequence
  SiRNA target sequence
atgatacatcttatgtcaa

SEQ ID NO: 169346 - DNA, 19 bp, Artificial sequence
  SiRNA target sequence
tgatacatcttatgtcaaa

SEQ ID NO: 169347 - DNA, 19 bp, Artificial sequence
  SiRNA target sequence
gatacatcttatgtcaaaa

SEQ ID NO: 169348 - DNA, 19 bp, Artificial sequence
  SiRNA target sequence
atacatcttatgtcaaaaa

SEQ ID NO: 169349 - DNA, 19 bp, Artificial sequence
  SiRNA target sequence
tacatcttatgtcaaaaat

SEQ ID NO: 169350 - DNA, 19 bp, Artificial sequence
  SiRNA target sequence
acatcttatgtcaaaaata

SEQ ID NO: 169351 - DNA, 19 bp, Artificial sequence
  SiRNA target sequence
catcttatgtcaaaaatat

SEQ ID NO: 169352 - DNA, 19 bp, Artificial sequence
  SiRNA target sequence
atcttatgtcaaaaatatt

SEQ ID NO: 169353 - DNA, 19 bp, Artificial sequence
  SiRNA target sequence
tcttatgtcaaaaatattc

SEQ ID NO: 169354 - DNA, 19 bp, Artificial sequence
  SiRNA target sequence
cttatgtcaaaaatattct

SEQ ID NO: 169355 - DNA, 19 bp, Artificial sequence
  SiRNA target sequence
ttatgtcaaaaatattctg

SEQ ID NO: 169356 - DNA, 19 bp, Artificial sequence
  SiRNA target sequence
tatgtcaaaaatattctgt

SEQ ID NO: 169357 - DNA, 19 bp, Artificial sequence
  SiRNA target sequence
atgtcaaaaatattctgta

SEQ ID NO: 169358 - DNA, 19 bp, Artificial sequence
  SiRNA target sequence
tgtcaaaaatattctgtat

SEQ ID NO: 169359 - DNA, 19 bp, Artificial sequence
  SiRNA target sequence
gtcaaaaatattctgtatg

SEQ ID NO: 169360 - DNA, 19 bp, Artificial sequence
  SiRNA target sequence
tcaaaaatattctgtatga

SEQ ID NO: 169361 - DNA, 19 bp, Artificial sequence
  SiRNA target sequence
caaaaatattctgtatgat

SEQ ID NO: 169362 - DNA, 19 bp, Artificial sequence
  SiRNA target sequence
aaaaatattctgtatgata

SEQ ID NO: 169363 - DNA, 19 bp, Artificial sequence
  SiRNA target sequence
aaaatattctgtatgatag

SEQ ID NO: 169364 - DNA, 19 bp, Artificial sequence
  SiRNA target sequence
aaatattctgtatgatagt

SEQ ID NO: 169365 - DNA, 19 bp, Artificial sequence
  SiRNA target sequence
aatattctgtatgatagtg

SEQ ID NO: 169366 - DNA, 19 bp, Artificial sequence
  SiRNA target sequence
atattctgtatgatagtgt

SEQ ID NO: 169367 - DNA, 19 bp, Artificial sequence
  SiRNA target sequence
tattctgtatgatagtgtt

SEQ ID NO: 169368 - DNA, 19 bp, Artificial sequence
  SiRNA target sequence
attctgtatgatagtgttt

SEQ ID NO: 169369 - DNA, 19 bp, Artificial sequence
  SiRNA target sequence
ttctgtatgatagtgttta

SEQ ID NO: 169370 - DNA, 19 bp, Artificial sequence
  SiRNA target sequence
tctgtatgatagtgtttat

SEQ ID NO: 169371 - DNA, 19 bp, Artificial sequence
  SiRNA target sequence
ctgtatgatagtgtttatg

SEQ ID NO: 169372 - DNA, 19 bp, Artificial sequence
  SiRNA target sequence
tgtatgatagtgtttatga

SEQ ID NO: 169373 - DNA, 19 bp, Artificial sequence
  SiRNA target sequence
gtatgatagtgtttatgag

SEQ ID NO: 169374 - DNA, 19 bp, Artificial sequence
  SiRNA target sequence
tatgatagtgtttatgagg

SEQ ID NO: 169375 - DNA, 19 bp, Artificial sequence
  SiRNA target sequence
atgatagtgtttatgagga

SEQ ID NO: 169376 - DNA, 19 bp, Artificial sequence
  SiRNA target sequence
tgatagtgtttatgaggaa

SEQ ID NO: 169377 - DNA, 19 bp, Artificial sequence
  SiRNA target sequence
gatagtgtttatgaggaaa

SEQ ID NO: 169378 - DNA, 19 bp, Artificial sequence
  SiRNA target sequence
atagtgtttatgaggaaag

SEQ ID NO: 169379 - DNA, 19 bp, Artificial sequence
  SiRNA target sequence
tagtgtttatgaggaaagc

SEQ ID NO: 169380 - DNA, 19 bp, Artificial sequence
  SiRNA target sequence
agtgtttatgaggaaagca

SEQ ID NO: 169381 - DNA, 19 bp, Artificial sequence
  SiRNA target sequence
gtgtttatgaggaaagcac

SEQ ID NO: 169382 - DNA, 19 bp, Artificial sequence
  SiRNA target sequence
tgtttatgaggaaagcacg

SEQ ID NO: 169383 - DNA, 19 bp, Artificial sequence
  SiRNA target sequence
gtttatgaggaaagcacga

SEQ ID NO: 169384 - DNA, 19 bp, Artificial sequence
  SiRNA target sequence
tttatgaggaaagcacgag

SEQ ID NO: 169385 - DNA, 19 bp, Artificial sequence
  SiRNA target sequence
ttatgaggaaagcacgaga

SEQ ID NO: 169386 - DNA, 19 bp, Artificial sequence
  SiRNA target sequence
tatgaggaaagcacgagag

SEQ ID NO: 169387 - DNA, 19 bp, Artificial sequence
  SiRNA target sequence
atgaggaaagcacgagaga

SEQ ID NO: 169388 - DNA, 19 bp, Artificial sequence
  SiRNA target sequence
tgaggaaagcacgagagac

SEQ ID NO: 169389 - DNA, 19 bp, Artificial sequence
  SiRNA target sequence
gaggaaagcacgagagaca

SEQ ID NO: 169390 - DNA, 19 bp, Artificial sequence
  SiRNA target sequence
aggaaagcacgagagacaa

SEQ ID NO: 169391 - DNA, 19 bp, Artificial sequence
  SiRNA target sequence
ggaaagcacgagagacaaa

SEQ ID NO: 169392 - DNA, 19 bp, Artificial sequence
  SiRNA target sequence
gaaagcacgagagacaaaa

SEQ ID NO: 169393 - DNA, 19 bp, Artificial sequence
  SiRNA target sequence
aaagcacgagagacaaaat

SEQ ID NO: 169394 - DNA, 19 bp, Artificial sequence
  SiRNA target sequence
aagcacgagagacaaaata

SEQ ID NO: 169395 - DNA, 19 bp, Artificial sequence
  SiRNA target sequence
agcacgagagacaaaataa

SEQ ID NO: 169396 - DNA, 19 bp, Artificial sequence
  SiRNA target sequence
gcacgagagacaaaataat

SEQ ID NO: 169397 - DNA, 19 bp, Artificial sequence
  SiRNA target sequence
cacgagagacaaaataata

SEQ ID NO: 169398 - DNA, 19 bp, Artificial sequence
  SiRNA target sequence
acgagagacaaaataataa

SEQ ID NO: 169399 - DNA, 19 bp, Artificial sequence
  SiRNA target sequence
cgagagacaaaataataat

SEQ ID NO: 169400 - DNA, 19 bp, Artificial sequence
  SiRNA target sequence
gagagacaaaataataata

SEQ ID NO: 169401 - DNA, 19 bp, Artificial sequence
  SiRNA target sequence
agagacaaaataataataa

SEQ ID NO: 169402 - DNA, 19 bp, Artificial sequence
  SiRNA target sequence
gagacaaaataataataag

SEQ ID NO: 169403 - DNA, 19 bp, Artificial sequence
  SiRNA target sequence
agacaaaataataataagt

SEQ ID NO: 169404 - DNA, 19 bp, Artificial sequence
  SiRNA target sequence
gacaaaataataataagtg

SEQ ID NO: 169405 - DNA, 19 bp, Artificial sequence
  SiRNA target sequence
acaaaataataataagtga

SEQ ID NO: 169406 - DNA, 19 bp, Artificial sequence
  SiRNA target sequence
caaaataataataagtgac

SEQ ID NO: 169407 - DNA, 19 bp, Artificial sequence
  SiRNA target sequence
aaaataataataagtgact

SEQ ID NO: 169408 - DNA, 19 bp, Artificial sequence
  SiRNA target sequence
aaataataataagtgactg

SEQ ID NO: 169409 - DNA, 19 bp, Artificial sequence
  SiRNA target sequence
aataataataagtgactgt

SEQ ID NO: 169410 - DNA, 19 bp, Artificial sequence
  SiRNA target sequence
ataataataagtgactgtc

SEQ ID NO: 169411 - DNA, 19 bp, Artificial sequence
  SiRNA target sequence
taataataagtgactgtcc

SEQ ID NO: 169412 - DNA, 19 bp, Artificial sequence
  SiRNA target sequence
aataataagtgactgtcct

SEQ ID NO: 169413 - DNA, 19 bp, Artificial sequence
  SiRNA target sequence
ataataagtgactgtcctg

SEQ ID NO: 169414 - DNA, 19 bp, Artificial sequence
  SiRNA target sequence
taataagtgactgtcctgg

SEQ ID NO: 169415 - DNA, 19 bp, Artificial sequence
  SiRNA target sequence
aataagtgactgtcctggg

SEQ ID NO: 169416 - DNA, 19 bp, Artificial sequence
  SiRNA target sequence
ataagtgactgtcctggga

SEQ ID NO: 169417 - DNA, 19 bp, Artificial sequence
  SiRNA target sequence
taagtgactgtcctgggac

SEQ ID NO: 169418 - DNA, 19 bp, Artificial sequence
  SiRNA target sequence
aagtgactgtcctgggact

SEQ ID NO: 169419 - DNA, 19 bp, Artificial sequence
  SiRNA target sequence
agtgactgtcctgggactg

SEQ ID NO: 169420 - DNA, 19 bp, Artificial sequence
  SiRNA target sequence
gtgactgtcctgggactgt

SEQ ID NO: 169421 - DNA, 19 bp, Artificial sequence
  SiRNA target sequence
tgactgtcctgggactgtt

SEQ ID NO: 169422 - DNA, 19 bp, Artificial sequence
  SiRNA target sequence
gactgtcctgggactgttt

SEQ ID NO: 169423 - DNA, 19 bp, Artificial sequence
  SiRNA target sequence
actgtcctgggactgtttc

SEQ ID NO: 169424 - DNA, 19 bp, Artificial sequence
  SiRNA target sequence
ctgtcctgggactgtttca

SEQ ID NO: 169425 - DNA, 19 bp, Artificial sequence
  SiRNA target sequence
tgtcctgggactgtttcat

SEQ ID NO: 169426 - DNA, 19 bp, Artificial sequence
  SiRNA target sequence
gtcctgggactgtttcata

SEQ ID NO: 169427 - DNA, 19 bp, Artificial sequence
  SiRNA target sequence
tcctgggactgtttcatat

SEQ ID NO: 169428 - DNA, 19 bp, Artificial sequence
  SiRNA target sequence
cctgggactgtttcatata

SEQ ID NO: 169429 - DNA, 19 bp, Artificial sequence
  SiRNA target sequence
ctgggactgtttcatatat

SEQ ID NO: 169430 - DNA, 19 bp, Artificial sequence
  SiRNA target sequence
tgggactgtttcatatatt

SEQ ID NO: 169431 - DNA, 19 bp, Artificial sequence
  SiRNA target sequence
gggactgtttcatatattg

SEQ ID NO: 169432 - DNA, 19 bp, Artificial sequence
  SiRNA target sequence
ggactgtttcatatattga

SEQ ID NO: 169433 - DNA, 19 bp, Artificial sequence
  SiRNA target sequence
gactgtttcatatattgaa

SEQ ID NO: 169434 - DNA, 19 bp, Artificial sequence
  SiRNA target sequence
actgtttcatatattgaaa

SEQ ID NO: 169435 - DNA, 19 bp, Artificial sequence
  SiRNA target sequence
ctgtttcatatattgaaag

SEQ ID NO: 169436 - DNA, 19 bp, Artificial sequence
  SiRNA target sequence
tgtttcatatattgaaagg

SEQ ID NO: 169437 - DNA, 19 bp, Artificial sequence
  SiRNA target sequence
gtttcatatattgaaaggc

SEQ ID NO: 169438 - DNA, 19 bp, Artificial sequence
  SiRNA target sequence
tttcatatattgaaaggca

SEQ ID NO: 169439 - DNA, 19 bp, Artificial sequence
  SiRNA target sequence
ttcatatattgaaaggcaa

SEQ ID NO: 169440 - DNA, 19 bp, Artificial sequence
  SiRNA target sequence
tcatatattgaaaggcaag

SEQ ID NO: 169441 - DNA, 19 bp, Artificial sequence
  SiRNA target sequence
catatattgaaaggcaagc

SEQ ID NO: 169442 - DNA, 19 bp, Artificial sequence
  SiRNA target sequence
atatattgaaaggcaagca

SEQ ID NO: 169443 - DNA, 19 bp, Artificial sequence
  SiRNA target sequence
tatattgaaaggcaagcac

SEQ ID NO: 169444 - DNA, 19 bp, Artificial sequence
  SiRNA target sequence
atattgaaaggcaagcaca

SEQ ID NO: 169445 - DNA, 19 bp, Artificial sequence
  SiRNA target sequence
tattgaaaggcaagcacac

SEQ ID NO: 169446 - DNA, 19 bp, Artificial sequence
  SiRNA target sequence
attgaaaggcaagcacacc

SEQ ID NO: 169447 - DNA, 19 bp, Artificial sequence
  SiRNA target sequence
ttgaaaggcaagcacacca

SEQ ID NO: 169448 - DNA, 19 bp, Artificial sequence
  SiRNA target sequence
tgaaaggcaagcacaccat

SEQ ID NO: 169449 - DNA, 19 bp, Artificial sequence
  SiRNA target sequence
gaaaggcaagcacaccatt

SEQ ID NO: 169450 - DNA, 19 bp, Artificial sequence
  SiRNA target sequence
aaaggcaagcacaccattt

SEQ ID NO: 169451 - DNA, 19 bp, Artificial sequence
  SiRNA target sequence
aaggcaagcacaccattta

SEQ ID NO: 169452 - DNA, 19 bp, Artificial sequence
  SiRNA target sequence
aggcaagcacaccatttaa

SEQ ID NO: 169453 - DNA, 19 bp, Artificial sequence
  SiRNA target sequence
ggcaagcacaccatttaat

SEQ ID NO: 169454 - DNA, 19 bp, Artificial sequence
  SiRNA target sequence
gcaagcacaccatttaatt

SEQ ID NO: 169455 - DNA, 19 bp, Artificial sequence
  SiRNA target sequence
caagcacaccatttaattg

SEQ ID NO: 169456 - DNA, 19 bp, Artificial sequence
  SiRNA target sequence
aagcacaccatttaattga

SEQ ID NO: 169457 - DNA, 19 bp, Artificial sequence
  SiRNA target sequence
agcacaccatttaattgaa

SEQ ID NO: 169458 - DNA, 19 bp, Artificial sequence
  SiRNA target sequence
gcacaccatttaattgaat

SEQ ID NO: 169459 - DNA, 19 bp, Artificial sequence
  SiRNA target sequence
cacaccatttaattgaata

SEQ ID NO: 169460 - DNA, 19 bp, Artificial sequence
  SiRNA target sequence
acaccatttaattgaatat

SEQ ID NO: 169461 - DNA, 19 bp, Artificial sequence
  SiRNA target sequence
caccatttaattgaatatt

SEQ ID NO: 169462 - DNA, 19 bp, Artificial sequence
  SiRNA target sequence
accatttaattgaatattt

SEQ ID NO: 169463 - DNA, 19 bp, Artificial sequence
  SiRNA target sequence
ccatttaattgaatattta

SEQ ID NO: 169464 - DNA, 19 bp, Artificial sequence
  SiRNA target sequence
catttaattgaatatttat

SEQ ID NO: 169465 - DNA, 19 bp, Artificial sequence
  SiRNA target sequence
atttaattgaatatttatc

SEQ ID NO: 169466 - DNA, 19 bp, Artificial sequence
  SiRNA target sequence
tttaattgaatatttatct

SEQ ID NO: 169467 - DNA, 19 bp, Artificial sequence
  SiRNA target sequence
ttaattgaatatttatctg

SEQ ID NO: 169468 - DNA, 19 bp, Artificial sequence
  SiRNA target sequence
taattgaatatttatctgt

SEQ ID NO: 169469 - DNA, 19 bp, Artificial sequence
  SiRNA target sequence
aattgaatatttatctgtt

SEQ ID NO: 169470 - DNA, 19 bp, Artificial sequence
  SiRNA target sequence
attgaatatttatctgtta

SEQ ID NO: 169471 - DNA, 19 bp, Artificial sequence
  SiRNA target sequence
ttgaatatttatctgttac

SEQ ID NO: 169472 - DNA, 19 bp, Artificial sequence
  SiRNA target sequence
tgaatatttatctgttact

SEQ ID NO: 169473 - DNA, 19 bp, Artificial sequence
  SiRNA target sequence
gaatatttatctgttactt

SEQ ID NO: 169474 - DNA, 19 bp, Artificial sequence
  SiRNA target sequence
aatatttatctgttacttc

SEQ ID NO: 169475 - DNA, 19 bp, Artificial sequence
  SiRNA target sequence
atatttatctgttacttct

SEQ ID NO: 169476 - DNA, 19 bp, Artificial sequence
  SiRNA target sequence
tatttatctgttacttcta

SEQ ID NO: 169477 - DNA, 19 bp, Artificial sequence
  SiRNA target sequence
atttatctgttacttctac

SEQ ID NO: 169478 - DNA, 19 bp, Artificial sequence
  SiRNA target sequence
tttatctgttacttctaca

SEQ ID NO: 169479 - DNA, 19 bp, Artificial sequence
  SiRNA target sequence
ttatctgttacttctacac

SEQ ID NO: 169480 - DNA, 19 bp, Artificial sequence
  SiRNA target sequence
tatctgttacttctacaca

SEQ ID NO: 169481 - DNA, 19 bp, Artificial sequence
  SiRNA target sequence
atctgttacttctacacaa

SEQ ID NO: 169482 - DNA, 19 bp, Artificial sequence
  SiRNA target sequence
tctgttacttctacacaac

SEQ ID NO: 169483 - DNA, 19 bp, Artificial sequence
  SiRNA target sequence
ctgttacttctacacaaca

SEQ ID NO: 169484 - DNA, 19 bp, Artificial sequence
  SiRNA target sequence
tgttacttctacacaacaa

SEQ ID NO: 169485 - DNA, 19 bp, Artificial sequence
  SiRNA target sequence
gttacttctacacaacaac

SEQ ID NO: 169486 - DNA, 19 bp, Artificial sequence
  SiRNA target sequence
ttacttctacacaacaaca

SEQ ID NO: 169487 - DNA, 19 bp, Artificial sequence
  SiRNA target sequence
tacttctacacaacaacaa

SEQ ID NO: 169488 - DNA, 19 bp, Artificial sequence
  SiRNA target sequence
acttctacacaacaacaag

SEQ ID NO: 169489 - DNA, 19 bp, Artificial sequence
  SiRNA target sequence
cttctacacaacaacaagc

SEQ ID NO: 169490 - DNA, 19 bp, Artificial sequence
  SiRNA target sequence
ttctacacaacaacaagcc

SEQ ID NO: 169491 - DNA, 19 bp, Artificial sequence
  SiRNA target sequence
tctacacaacaacaagcca

SEQ ID NO: 169492 - DNA, 19 bp, Artificial sequence
  SiRNA target sequence
ctacacaacaacaagccat

SEQ ID NO: 169493 - DNA, 19 bp, Artificial sequence
  SiRNA target sequence
tacacaacaacaagccata

SEQ ID NO: 169494 - DNA, 19 bp, Artificial sequence
  SiRNA target sequence
acacaacaacaagccataa

SEQ ID NO: 169495 - DNA, 19 bp, Artificial sequence
  SiRNA target sequence
cacaacaacaagccataaa

SEQ ID NO: 169496 - DNA, 19 bp, Artificial sequence
  SiRNA target sequence
acaacaacaagccataaag

SEQ ID NO: 169497 - DNA, 19 bp, Artificial sequence
  SiRNA target sequence
caacaacaagccataaagc

SEQ ID NO: 169498 - DNA, 19 bp, Artificial sequence
  SiRNA target sequence
aacaacaagccataaagct

SEQ ID NO: 169499 - DNA, 19 bp, Artificial sequence
  SiRNA target sequence
acaacaagccataaagcta

SEQ ID NO: 169500 - DNA, 19 bp, Artificial sequence
  SiRNA target sequence
caacaagccataaagctac

SEQ ID NO: 169501 - DNA, 19 bp, Artificial sequence
  SiRNA target sequence
aacaagccataaagctact

SEQ ID NO: 169502 - DNA, 19 bp, Artificial sequence
  SiRNA target sequence
acaagccataaagctactt

SEQ ID NO: 169503 - DNA, 19 bp, Artificial sequence
  SiRNA target sequence
caagccataaagctacttg

SEQ ID NO: 169504 - DNA, 19 bp, Artificial sequence
  SiRNA target sequence
aagccataaagctacttgc

SEQ ID NO: 169505 - DNA, 19 bp, Artificial sequence
  SiRNA target sequence
agccataaagctacttgct

SEQ ID NO: 169506 - DNA, 19 bp, Artificial sequence
  SiRNA target sequence
gccataaagctacttgctc

SEQ ID NO: 169507 - DNA, 19 bp, Artificial sequence
  SiRNA target sequence
ccataaagctacttgctca

SEQ ID NO: 169508 - DNA, 19 bp, Artificial sequence
  SiRNA target sequence
cataaagctacttgctcag

SEQ ID NO: 169509 - DNA, 19 bp, Artificial sequence
  SiRNA target sequence
ataaagctacttgctcagg

SEQ ID NO: 169510 - DNA, 19 bp, Artificial sequence
  SiRNA target sequence
taaagctacttgctcaggg

SEQ ID NO: 169511 - DNA, 19 bp, Artificial sequence
  SiRNA target sequence
aaagctacttgctcagggg

SEQ ID NO: 169512 - DNA, 19 bp, Artificial sequence
  SiRNA target sequence
aagctacttgctcaggggc

SEQ ID NO: 169513 - DNA, 19 bp, Artificial sequence
  SiRNA target sequence
agctacttgctcaggggcg

SEQ ID NO: 169514 - DNA, 19 bp, Artificial sequence
  SiRNA target sequence
gctacttgctcaggggcga

SEQ ID NO: 169515 - DNA, 19 bp, Artificial sequence
  SiRNA target sequence
ctacttgctcaggggcgaa

SEQ ID NO: 169516 - DNA, 19 bp, Artificial sequence
  SiRNA target sequence
tacttgctcaggggcgaag

SEQ ID NO: 169517 - DNA, 19 bp, Artificial sequence
  SiRNA target sequence
acttgctcaggggcgaagt

SEQ ID NO: 169518 - DNA, 19 bp, Artificial sequence
  SiRNA target sequence
cttgctcaggggcgaagta

SEQ ID NO: 169519 - DNA, 19 bp, Artificial sequence
  SiRNA target sequence
ttgctcaggggcgaagtat

SEQ ID NO: 169520 - DNA, 19 bp, Artificial sequence
  SiRNA target sequence
tgctcaggggcgaagtata

SEQ ID NO: 169521 - DNA, 19 bp, Artificial sequence
  SiRNA target sequence
gctcaggggcgaagtataa

SEQ ID NO: 169522 - DNA, 19 bp, Artificial sequence
  SiRNA target sequence
ctcaggggcgaagtataag

SEQ ID NO: 169523 - DNA, 19 bp, Artificial sequence
  SiRNA target sequence
tcaggggcgaagtataagt

SEQ ID NO: 169524 - DNA, 19 bp, Artificial sequence
  SiRNA target sequence
caggggcgaagtataagtg

SEQ ID NO: 169525 - DNA, 19 bp, Artificial sequence
  SiRNA target sequence
aggggcgaagtataagtgt

SEQ ID NO: 169526 - DNA, 19 bp, Artificial sequence
  SiRNA target sequence
ggggcgaagtataagtgtc

SEQ ID NO: 169527 - DNA, 19 bp, Artificial sequence
  SiRNA target sequence
gggcgaagtataagtgtca

SEQ ID NO: 169528 - DNA, 19 bp, Artificial sequence
  SiRNA target sequence
ggcgaagtataagtgtcat

SEQ ID NO: 169529 - DNA, 19 bp, Artificial sequence
  SiRNA target sequence
gcgaagtataagtgtcata

SEQ ID NO: 169530 - DNA, 19 bp, Artificial sequence
  SiRNA target sequence
cgaagtataagtgtcatac

SEQ ID NO: 169531 - DNA, 19 bp, Artificial sequence
  SiRNA target sequence
gaagtataagtgtcataca

SEQ ID NO: 169532 - DNA, 19 bp, Artificial sequence
  SiRNA target sequence
aagtataagtgtcatacag

SEQ ID NO: 169533 - DNA, 19 bp, Artificial sequence
  SiRNA target sequence
agtataagtgtcatacagt

SEQ ID NO: 169534 - DNA, 19 bp, Artificial sequence
  SiRNA target sequence
gtataagtgtcatacagtg

SEQ ID NO: 169535 - DNA, 19 bp, Artificial sequence
  SiRNA target sequence
tataagtgtcatacagtgc

SEQ ID NO: 169536 - DNA, 19 bp, Artificial sequence
  SiRNA target sequence
ataagtgtcatacagtgct

SEQ ID NO: 169537 - DNA, 19 bp, Artificial sequence
  SiRNA target sequence
taagtgtcatacagtgcta

SEQ ID NO: 169538 - DNA, 19 bp, Artificial sequence
  SiRNA target sequence
aagtgtcatacagtgctat

SEQ ID NO: 169539 - DNA, 19 bp, Artificial sequence
  SiRNA target sequence
agtgtcatacagtgctatg

SEQ ID NO: 169540 - DNA, 19 bp, Artificial sequence
  SiRNA target sequence
gtgtcatacagtgctatga

SEQ ID NO: 169541 - DNA, 19 bp, Artificial sequence
  SiRNA target sequence
tgtcatacagtgctatgat

SEQ ID NO: 169542 - DNA, 19 bp, Artificial sequence
  SiRNA target sequence
gtcatacagtgctatgata

SEQ ID NO: 169543 - DNA, 19 bp, Artificial sequence
  SiRNA target sequence
tcatacagtgctatgataa

SEQ ID NO: 169544 - DNA, 19 bp, Artificial sequence
  SiRNA target sequence
catacagtgctatgataaa

SEQ ID NO: 169545 - DNA, 19 bp, Artificial sequence
  SiRNA target sequence
atacagtgctatgataaat

SEQ ID NO: 169546 - DNA, 19 bp, Artificial sequence
  SiRNA target sequence
tacagtgctatgataaatt

SEQ ID NO: 169547 - DNA, 19 bp, Artificial sequence
  SiRNA target sequence
acagtgctatgataaattt

SEQ ID NO: 169548 - DNA, 19 bp, Artificial sequence
  SiRNA target sequence
cagtgctatgataaatttt

SEQ ID NO: 169549 - DNA, 19 bp, Artificial sequence
  SiRNA target sequence
agtgctatgataaattttt

SEQ ID NO: 169550 - DNA, 19 bp, Artificial sequence
  SiRNA target sequence
gtgctatgataaattttta

SEQ ID NO: 169551 - DNA, 19 bp, Artificial sequence
  SiRNA target sequence
tgctatgataaatttttag

SEQ ID NO: 169552 - DNA, 19 bp, Artificial sequence
  SiRNA target sequence
gctatgataaatttttaga

SEQ ID NO: 169553 - DNA, 19 bp, Artificial sequence
  SiRNA target sequence
ctatgataaatttttagag

SEQ ID NO: 169554 - DNA, 19 bp, Artificial sequence
  SiRNA target sequence
tatgataaatttttagaga

SEQ ID NO: 169555 - DNA, 19 bp, Artificial sequence
  SiRNA target sequence
atgataaatttttagagaa

SEQ ID NO: 169556 - DNA, 19 bp, Artificial sequence
  SiRNA target sequence
tgataaatttttagagaat

SEQ ID NO: 169557 - DNA, 19 bp, Artificial sequence
  SiRNA target sequence
gataaatttttagagaata

SEQ ID NO: 169558 - DNA, 19 bp, Artificial sequence
  SiRNA target sequence
ataaatttttagagaatag

SEQ ID NO: 169559 - DNA, 19 bp, Artificial sequence
  SiRNA target sequence
taaatttttagagaatagc

SEQ ID NO: 169560 - DNA, 19 bp, Artificial sequence
  SiRNA target sequence
aaatttttagagaatagcg

SEQ ID NO: 169561 - DNA, 19 bp, Artificial sequence
  SiRNA target sequence
aatttttagagaatagcga

SEQ ID NO: 169562 - DNA, 19 bp, Artificial sequence
  SiRNA target sequence
atttttagagaatagcgat

SEQ ID NO: 169563 - DNA, 19 bp, Artificial sequence
  SiRNA target sequence
tttttagagaatagcgatg

SEQ ID NO: 169564 - DNA, 19 bp, Artificial sequence
  SiRNA target sequence
ttttagagaatagcgatga

SEQ ID NO: 169565 - DNA, 19 bp, Artificial sequence
  SiRNA target sequence
tttagagaatagcgatgat

SEQ ID NO: 169566 - DNA, 19 bp, Artificial sequence
  SiRNA target sequence
ttagagaatagcgatgatg

SEQ ID NO: 169567 - DNA, 19 bp, Artificial sequence
  SiRNA target sequence
tagagaatagcgatgatgt

SEQ ID NO: 169568 - DNA, 19 bp, Artificial sequence
  SiRNA target sequence
agagaatagcgatgatgtt

SEQ ID NO: 169569 - DNA, 19 bp, Artificial sequence
  SiRNA target sequence
gagaatagcgatgatgttt

SEQ ID NO: 169570 - DNA, 19 bp, Artificial sequence
  SiRNA target sequence
agaatagcgatgatgtttt

SEQ ID NO: 169571 - DNA, 19 bp, Artificial sequence
  SiRNA target sequence
gaatagcgatgatgtttta

SEQ ID NO: 169572 - DNA, 19 bp, Artificial sequence
  SiRNA target sequence
aatagcgatgatgttttaa

SEQ ID NO: 169573 - DNA, 19 bp, Artificial sequence
  SiRNA target sequence
atagcgatgatgttttaac

SEQ ID NO: 169574 - DNA, 19 bp, Artificial sequence
  SiRNA target sequence
tagcgatgatgttttaact

SEQ ID NO: 169575 - DNA, 19 bp, Artificial sequence
  SiRNA target sequence
agcgatgatgttttaacta

SEQ ID NO: 169576 - DNA, 19 bp, Artificial sequence
  SiRNA target sequence
gcgatgatgttttaactac

SEQ ID NO: 169577 - DNA, 19 bp, Artificial sequence
  SiRNA target sequence
cgatgatgttttaactacc

SEQ ID NO: 169578 - DNA, 19 bp, Artificial sequence
  SiRNA target sequence
gatgatgttttaactacct

SEQ ID NO: 169579 - DNA, 19 bp, Artificial sequence
  SiRNA target sequence
atgatgttttaactaccta

SEQ ID NO: 169580 - DNA, 19 bp, Artificial sequence
  SiRNA target sequence
tgatgttttaactacctat

SEQ ID NO: 169581 - DNA, 19 bp, Artificial sequence
  SiRNA target sequence
gatgttttaactacctatg

SEQ ID NO: 169582 - DNA, 19 bp, Artificial sequence
  SiRNA target sequence
atgttttaactacctatga

SEQ ID NO: 169583 - DNA, 19 bp, Artificial sequence
  SiRNA target sequence
tgttttaactacctatgat

SEQ ID NO: 169584 - DNA, 19 bp, Artificial sequence
  SiRNA target sequence
gttttaactacctatgatt

SEQ ID NO: 169585 - DNA, 19 bp, Artificial sequence
  SiRNA target sequence
ttttaactacctatgattt

SEQ ID NO: 169586 - DNA, 19 bp, Artificial sequence
  SiRNA target sequence
tttaactacctatgatttt

SEQ ID NO: 169587 - DNA, 19 bp, Artificial sequence
  SiRNA target sequence
ttaactacctatgattttt

SEQ ID NO: 169588 - DNA, 19 bp, Artificial sequence
  SiRNA target sequence
taactacctatgattttta

SEQ ID NO: 169589 - DNA, 19 bp, Artificial sequence
  SiRNA target sequence
aactacctatgatttttat

SEQ ID NO: 169590 - DNA, 19 bp, Artificial sequence
  SiRNA target sequence
actacctatgatttttata

SEQ ID NO: 169591 - DNA, 19 bp, Artificial sequence
  SiRNA target sequence
ctacctatgatttttataa

SEQ ID NO: 169592 - DNA, 19 bp, Artificial sequence
  SiRNA target sequence
tacctatgatttttataaa

SEQ ID NO: 169593 - DNA, 19 bp, Artificial sequence
  SiRNA target sequence
acctatgatttttataaaa

SEQ ID NO: 169594 - DNA, 19 bp, Artificial sequence
  SiRNA target sequence
cctatgatttttataaaat

SEQ ID NO: 169595 - DNA, 19 bp, Artificial sequence
  SiRNA target sequence
ctatgatttttataaaatg

SEQ ID NO: 169596 - DNA, 19 bp, Artificial sequence
  SiRNA target sequence
tatgatttttataaaatga

SEQ ID NO: 169597 - DNA, 19 bp, Artificial sequence
  SiRNA target sequence
atgatttttataaaatgat

SEQ ID NO: 169598 - DNA, 19 bp, Artificial sequence
  SiRNA target sequence
tgatttttataaaatgatt

SEQ ID NO: 169599 - DNA, 19 bp, Artificial sequence
  SiRNA target sequence
gatttttataaaatgattt

SEQ ID NO: 169600 - DNA, 19 bp, Artificial sequence
  SiRNA target sequence
atttttataaaatgatttt

SEQ ID NO: 169601 - DNA, 19 bp, Artificial sequence
  SiRNA target sequence
tttttataaaatgattttg

SEQ ID NO: 169602 - DNA, 19 bp, Artificial sequence
  SiRNA target sequence
ttttataaaatgattttgg

SEQ ID NO: 169603 - DNA, 19 bp, Artificial sequence
  SiRNA target sequence
tttataaaatgattttgga

SEQ ID NO: 169604 - DNA, 19 bp, Artificial sequence
  SiRNA target sequence
ttataaaatgattttggat

SEQ ID NO: 169605 - DNA, 19 bp, Artificial sequence
  SiRNA target sequence
tataaaatgattttggatc

SEQ ID NO: 169606 - DNA, 19 bp, Artificial sequence
  SiRNA target sequence
ataaaatgattttggatct

SEQ ID NO: 169607 - DNA, 19 bp, Artificial sequence
  SiRNA target sequence
taaaatgattttggatcta

SEQ ID NO: 169608 - DNA, 19 bp, Artificial sequence
  SiRNA target sequence
aaaatgattttggatctag

SEQ ID NO: 169609 - DNA, 19 bp, Artificial sequence
  SiRNA target sequence
aaatgattttggatctagg

SEQ ID NO: 169610 - DNA, 19 bp, Artificial sequence
  SiRNA target sequence
aatgattttggatctagga

SEQ ID NO: 169611 - DNA, 19 bp, Artificial sequence
  SiRNA target sequence
atgattttggatctaggat

SEQ ID NO: 169612 - DNA, 19 bp, Artificial sequence
  SiRNA target sequence
tgattttggatctaggatt

SEQ ID NO: 169613 - DNA, 19 bp, Artificial sequence
  SiRNA target sequence
gattttggatctaggattt

SEQ ID NO: 169614 - DNA, 19 bp, Artificial sequence
  SiRNA target sequence
attttggatctaggatttt

SEQ ID NO: 169615 - DNA, 19 bp, Artificial sequence
  SiRNA target sequence
ttttggatctaggattttt

SEQ ID NO: 169616 - DNA, 19 bp, Artificial sequence
  SiRNA target sequence
tttggatctaggattttta

SEQ ID NO: 169617 - DNA, 19 bp, Artificial sequence
  SiRNA target sequence
ttggatctaggatttttac

SEQ ID NO: 169618 - DNA, 19 bp, Artificial sequence
  SiRNA target sequence
tggatctaggatttttaca

SEQ ID NO: 169619 - DNA, 19 bp, Artificial sequence
  SiRNA target sequence
ggatctaggatttttacag

SEQ ID NO: 169620 - DNA, 19 bp, Artificial sequence
  SiRNA target sequence
gatctaggatttttacagc

SEQ ID NO: 169621 - DNA, 19 bp, Artificial sequence
  SiRNA target sequence
atctaggatttttacagca

SEQ ID NO: 169622 - DNA, 19 bp, Artificial sequence
  SiRNA target sequence
tctaggatttttacagcat

SEQ ID NO: 169623 - DNA, 19 bp, Artificial sequence
  SiRNA target sequence
ctaggatttttacagcata

SEQ ID NO: 169624 - DNA, 19 bp, Artificial sequence
  SiRNA target sequence
taggatttttacagcataa

SEQ ID NO: 169625 - DNA, 19 bp, Artificial sequence
  SiRNA target sequence
aggatttttacagcataat

SEQ ID NO: 169626 - DNA, 19 bp, Artificial sequence
  SiRNA target sequence
ggatttttacagcataatt

SEQ ID NO: 169627 - DNA, 19 bp, Artificial sequence
  SiRNA target sequence
gatttttacagcataattt

SEQ ID NO: 169628 - DNA, 19 bp, Artificial sequence
  SiRNA target sequence
atttttacagcataatttt

SEQ ID NO: 169629 - DNA, 19 bp, Artificial sequence
  SiRNA target sequence
tttttacagcataatttta

SEQ ID NO: 169630 - DNA, 19 bp, Artificial sequence
  SiRNA target sequence
ttttacagcataattttat

SEQ ID NO: 169631 - DNA, 19 bp, Artificial sequence
  SiRNA target sequence
tttacagcataattttatt

SEQ ID NO: 169632 - DNA, 19 bp, Artificial sequence
  SiRNA target sequence
ttacagcataattttatta

SEQ ID NO: 169633 - DNA, 19 bp, Artificial sequence
  SiRNA target sequence
tacagcataattttattaa

SEQ ID NO: 169634 - DNA, 19 bp, Artificial sequence
  SiRNA target sequence
acagcataattttattaaa

SEQ ID NO: 169635 - DNA, 19 bp, Artificial sequence
  SiRNA target sequence
cagcataattttattaaag

SEQ ID NO: 169636 - DNA, 19 bp, Artificial sequence
  SiRNA target sequence
agcataattttattaaagg

SEQ ID NO: 169637 - DNA, 19 bp, Artificial sequence
  SiRNA target sequence
gcataattttattaaagga

SEQ ID NO: 169638 - DNA, 19 bp, Artificial sequence
  SiRNA target sequence
cataattttattaaaggaa

SEQ ID NO: 169639 - DNA, 19 bp, Artificial sequence
  SiRNA target sequence
ataattttattaaaggaac

SEQ ID NO: 169640 - DNA, 19 bp, Artificial sequence
  SiRNA target sequence
taattttattaaaggaacc

SEQ ID NO: 169641 - DNA, 19 bp, Artificial sequence
  SiRNA target sequence
aattttattaaaggaacct

SEQ ID NO: 169642 - DNA, 19 bp, Artificial sequence
  SiRNA target sequence
attttattaaaggaacctg

SEQ ID NO: 169643 - DNA, 19 bp, Artificial sequence
  SiRNA target sequence
ttttattaaaggaacctgt

SEQ ID NO: 169644 - DNA, 19 bp, Artificial sequence
  SiRNA target sequence
tttattaaaggaacctgtg

SEQ ID NO: 169645 - DNA, 19 bp, Artificial sequence
  SiRNA target sequence
ttattaaaggaacctgtga

SEQ ID NO: 169646 - DNA, 19 bp, Artificial sequence
  SiRNA target sequence
tattaaaggaacctgtgag

SEQ ID NO: 169647 - DNA, 19 bp, Artificial sequence
  SiRNA target sequence
attaaaggaacctgtgaga

SEQ ID NO: 169648 - DNA, 19 bp, Artificial sequence
  SiRNA target sequence
ttaaaggaacctgtgagaa

SEQ ID NO: 169649 - DNA, 19 bp, Artificial sequence
  SiRNA target sequence
taaaggaacctgtgagaaa

SEQ ID NO: 169650 - DNA, 19 bp, Artificial sequence
  SiRNA target sequence
aaaggaacctgtgagaaat

SEQ ID NO: 169651 - DNA, 19 bp, Artificial sequence
  SiRNA target sequence
aaggaacctgtgagaaatg

SEQ ID NO: 169652 - DNA, 19 bp, Artificial sequence
  SiRNA target sequence
aggaacctgtgagaaatgg

SEQ ID NO: 169653 - DNA, 19 bp, Artificial sequence
  SiRNA target sequence
ggaacctgtgagaaatggg

SEQ ID NO: 169654 - DNA, 19 bp, Artificial sequence
  SiRNA target sequence
gaacctgtgagaaatggga

SEQ ID NO: 169655 - DNA, 19 bp, Artificial sequence
  SiRNA target sequence
aacctgtgagaaatgggag

SEQ ID NO: 169656 - DNA, 19 bp, Artificial sequence
  SiRNA target sequence
acctgtgagaaatgggaga

SEQ ID NO: 169657 - DNA, 19 bp, Artificial sequence
  SiRNA target sequence
cctgtgagaaatgggagaa

SEQ ID NO: 169658 - DNA, 19 bp, Artificial sequence
  SiRNA target sequence
ctgtgagaaatgggagaag

SEQ ID NO: 169659 - DNA, 19 bp, Artificial sequence
  SiRNA target sequence
tgtgagaaatgggagaagt

SEQ ID NO: 169660 - DNA, 19 bp, Artificial sequence
  SiRNA target sequence
gtgagaaatgggagaagtg

SEQ ID NO: 169661 - DNA, 19 bp, Artificial sequence
  SiRNA target sequence
tgagaaatgggagaagtgt

SEQ ID NO: 169662 - DNA, 19 bp, Artificial sequence
  SiRNA target sequence
gagaaatgggagaagtgta

SEQ ID NO: 169663 - DNA, 19 bp, Artificial sequence
  SiRNA target sequence
agaaatgggagaagtgtac

SEQ ID NO: 169664 - DNA, 19 bp, Artificial sequence
  SiRNA target sequence
gaaatgggagaagtgtact

SEQ ID NO: 169665 - DNA, 19 bp, Artificial sequence
  SiRNA target sequence
aaatgggagaagtgtacta

SEQ ID NO: 169666 - DNA, 19 bp, Artificial sequence
  SiRNA target sequence
aatgggagaagtgtactat

SEQ ID NO: 169667 - DNA, 19 bp, Artificial sequence
  SiRNA target sequence
atgggagaagtgtactatt

SEQ ID NO: 169668 - DNA, 19 bp, Artificial sequence
  SiRNA target sequence
tgggagaagtgtactattg

SEQ ID NO: 169669 - DNA, 19 bp, Artificial sequence
  SiRNA target sequence
gggagaagtgtactattgg

SEQ ID NO: 169670 - DNA, 19 bp, Artificial sequence
  SiRNA target sequence
ggagaagtgtactattgga

SEQ ID NO: 169671 - DNA, 19 bp, Artificial sequence
  SiRNA target sequence
gagaagtgtactattggat

SEQ ID NO: 169672 - DNA, 19 bp, Artificial sequence
  SiRNA target sequence
agaagtgtactattggata

SEQ ID NO: 169673 - DNA, 19 bp, Artificial sequence
  SiRNA target sequence
gaagtgtactattggatat

SEQ ID NO: 169674 - DNA, 19 bp, Artificial sequence
  SiRNA target sequence
aagtgtactattggatatc

SEQ ID NO: 169675 - DNA, 19 bp, Artificial sequence
  SiRNA target sequence
agtgtactattggatatca

SEQ ID NO: 169676 - DNA, 19 bp, Artificial sequence
  SiRNA target sequence
gtgtactattggatatcat

SEQ ID NO: 169677 - DNA, 19 bp, Artificial sequence
  SiRNA target sequence
tgtactattggatatcatt

SEQ ID NO: 169678 - DNA, 19 bp, Artificial sequence
  SiRNA target sequence
gtactattggatatcatta

SEQ ID NO: 169679 - DNA, 19 bp, Artificial sequence
  SiRNA target sequence
tactattggatatcattat

SEQ ID NO: 169680 - DNA, 19 bp, Artificial sequence
  SiRNA target sequence
actattggatatcattatg

SEQ ID NO: 169681 - DNA, 19 bp, Artificial sequence
  SiRNA target sequence
ctattggatatcattatgg

SEQ ID NO: 169682 - DNA, 19 bp, Artificial sequence
  SiRNA target sequence
tattggatatcattatgga

SEQ ID NO: 169683 - DNA, 19 bp, Artificial sequence
  SiRNA target sequence
attggatatcattatggat

SEQ ID NO: 169684 - DNA, 19 bp, Artificial sequence
  SiRNA target sequence
ttggatatcattatggata

SEQ ID NO: 169685 - DNA, 19 bp, Artificial sequence
  SiRNA target sequence
tggatatcattatggatat

SEQ ID NO: 169686 - DNA, 19 bp, Artificial sequence
  SiRNA target sequence
ggatatcattatggatatt

SEQ ID NO: 169687 - DNA, 19 bp, Artificial sequence
  SiRNA target sequence
gatatcattatggatattt

SEQ ID NO: 169688 - DNA, 19 bp, Artificial sequence
  SiRNA target sequence
atatcattatggatattta

SEQ ID NO: 169689 - DNA, 19 bp, Artificial sequence
  SiRNA target sequence
tatcattatggatatttag

SEQ ID NO: 169690 - DNA, 19 bp, Artificial sequence
  SiRNA target sequence
atcattatggatatttaga

SEQ ID NO: 169691 - DNA, 19 bp, Artificial sequence
  SiRNA target sequence
tcattatggatatttagaa

SEQ ID NO: 169692 - DNA, 19 bp, Artificial sequence
  SiRNA target sequence
cattatggatatttagaac

SEQ ID NO: 169693 - DNA, 19 bp, Artificial sequence
  SiRNA target sequence
attatggatatttagaaca

SEQ ID NO: 169694 - DNA, 19 bp, Artificial sequence
  SiRNA target sequence
ttatggatatttagaacac

SEQ ID NO: 169695 - DNA, 19 bp, Artificial sequence
  SiRNA target sequence
tatggatatttagaacaca

SEQ ID NO: 169696 - DNA, 19 bp, Artificial sequence
  SiRNA target sequence
atggatatttagaacacat

SEQ ID NO: 169697 - DNA, 19 bp, Artificial sequence
  SiRNA target sequence
tggatatttagaacacata

SEQ ID NO: 169698 - DNA, 19 bp, Artificial sequence
  SiRNA target sequence
ggatatttagaacacatat

SEQ ID NO: 169699 - DNA, 19 bp, Artificial sequence
  SiRNA target sequence
gatatttagaacacatatt

SEQ ID NO: 169700 - DNA, 19 bp, Artificial sequence
  SiRNA target sequence
atatttagaacacatatta

SEQ ID NO: 169701 - DNA, 19 bp, Artificial sequence
  SiRNA target sequence
tatttagaacacatattaa

SEQ ID NO: 169702 - DNA, 19 bp, Artificial sequence
  SiRNA target sequence
atttagaacacatattaaa

SEQ ID NO: 169703 - DNA, 19 bp, Artificial sequence
  SiRNA target sequence
tttagaacacatattaaat

SEQ ID NO: 169704 - DNA, 19 bp, Artificial sequence
  SiRNA target sequence
ttagaacacatattaaata

SEQ ID NO: 169705 - DNA, 19 bp, Artificial sequence
  SiRNA target sequence
tagaacacatattaaataa

SEQ ID NO: 169706 - DNA, 19 bp, Artificial sequence
  SiRNA target sequence
agaacacatattaaataag

SEQ ID NO: 169707 - DNA, 19 bp, Artificial sequence
  SiRNA target sequence
gaacacatattaaataaga

SEQ ID NO: 169708 - DNA, 19 bp, Artificial sequence
  SiRNA target sequence
aacacatattaaataagaa

SEQ ID NO: 169709 - DNA, 19 bp, Artificial sequence
  SiRNA target sequence
acacatattaaataagaag

SEQ ID NO: 169710 - DNA, 19 bp, Artificial sequence
  SiRNA target sequence
cacatattaaataagaaga

SEQ ID NO: 169711 - DNA, 19 bp, Artificial sequence
  SiRNA target sequence
acatattaaataagaagaa

SEQ ID NO: 169712 - DNA, 19 bp, Artificial sequence
  SiRNA target sequence
catattaaataagaagaac

SEQ ID NO: 169713 - DNA, 19 bp, Artificial sequence
  SiRNA target sequence
atattaaataagaagaaca

SEQ ID NO: 169714 - DNA, 19 bp, Artificial sequence
  SiRNA target sequence
tattaaataagaagaacaa

SEQ ID NO: 169715 - DNA, 19 bp, Artificial sequence
  SiRNA target sequence
attaaataagaagaacaat

SEQ ID NO: 169716 - DNA, 19 bp, Artificial sequence
  SiRNA target sequence
ttaaataagaagaacaatt

SEQ ID NO: 169717 - DNA, 19 bp, Artificial sequence
  SiRNA target sequence
taaataagaagaacaatta

SEQ ID NO: 169718 - DNA, 19 bp, Artificial sequence
  SiRNA target sequence
aaataagaagaacaattat

SEQ ID NO: 169719 - DNA, 19 bp, Artificial sequence
  SiRNA target sequence
aataagaagaacaattatt

SEQ ID NO: 169720 - DNA, 19 bp, Artificial sequence
  SiRNA target sequence
ataagaagaacaattattt

SEQ ID NO: 169721 - DNA, 19 bp, Artificial sequence
  SiRNA target sequence
taagaagaacaattattta

SEQ ID NO: 169722 - DNA, 19 bp, Artificial sequence
  SiRNA target sequence
aagaagaacaattatttaa

SEQ ID NO: 169723 - DNA, 19 bp, Artificial sequence
  SiRNA target sequence
agaagaacaattatttaac

SEQ ID NO: 169724 - DNA, 19 bp, Artificial sequence
  SiRNA target sequence
gaagaacaattatttaaca

SEQ ID NO: 169725 - DNA, 19 bp, Artificial sequence
  SiRNA target sequence
aagaacaattatttaacaa

SEQ ID NO: 169726 - DNA, 19 bp, Artificial sequence
  SiRNA target sequence
agaacaattatttaacaaa

SEQ ID NO: 169727 - DNA, 19 bp, Artificial sequence
  SiRNA target sequence
gaacaattatttaacaaaa

SEQ ID NO: 169728 - DNA, 19 bp, Artificial sequence
  SiRNA target sequence
aacaattatttaacaaaaa

SEQ ID NO: 169729 - DNA, 19 bp, Artificial sequence
  SiRNA target sequence
acaattatttaacaaaaaa

SEQ ID NO: 169730 - DNA, 19 bp, Artificial sequence
  SiRNA target sequence
caattatttaacaaaaaat

SEQ ID NO: 169731 - DNA, 19 bp, Artificial sequence
  SiRNA target sequence
aattatttaacaaaaaatg

SEQ ID NO: 169732 - DNA, 19 bp, Artificial sequence
  SiRNA target sequence
attatttaacaaaaaatga

SEQ ID NO: 169733 - DNA, 19 bp, Artificial sequence
  SiRNA target sequence
ttatttaacaaaaaatgat

SEQ ID NO: 169734 - DNA, 19 bp, Artificial sequence
  SiRNA target sequence
tatttaacaaaaaatgata

SEQ ID NO: 169735 - DNA, 19 bp, Artificial sequence
  SiRNA target sequence
atttaacaaaaaatgatag

SEQ ID NO: 169736 - DNA, 19 bp, Artificial sequence
  SiRNA target sequence
tttaacaaaaaatgatagt

SEQ ID NO: 169737 - DNA, 19 bp, Artificial sequence
  SiRNA target sequence
ttaacaaaaaatgatagta

SEQ ID NO: 169738 - DNA, 19 bp, Artificial sequence
  SiRNA target sequence
taacaaaaaatgatagtat

SEQ ID NO: 169739 - DNA, 19 bp, Artificial sequence
  SiRNA target sequence
aacaaaaaatgatagtata

SEQ ID NO: 169740 - DNA, 19 bp, Artificial sequence
  SiRNA target sequence
acaaaaaatgatagtataa

SEQ ID NO: 169741 - DNA, 19 bp, Artificial sequence
  SiRNA target sequence
caaaaaatgatagtataaa

SEQ ID NO: 169742 - DNA, 19 bp, Artificial sequence
  SiRNA target sequence
aaaaaatgatagtataaaa

SEQ ID NO: 169743 - DNA, 19 bp, Artificial sequence
  SiRNA target sequence
aaaaatgatagtataaaaa

SEQ ID NO: 169744 - DNA, 19 bp, Artificial sequence
  SiRNA target sequence
aaaatgatagtataaaaat

SEQ ID NO: 169745 - DNA, 19 bp, Artificial sequence
  SiRNA target sequence
aaatgatagtataaaaata

SEQ ID NO: 169746 - DNA, 19 bp, Artificial sequence
  SiRNA target sequence
aatgatagtataaaaatat

SEQ ID NO: 169747 - DNA, 19 bp, Artificial sequence
  SiRNA target sequence
atgatagtataaaaatatt

SEQ ID NO: 169748 - DNA, 19 bp, Artificial sequence
  SiRNA target sequence
tgatagtataaaaatattt

SEQ ID NO: 169749 - DNA, 19 bp, Artificial sequence
  SiRNA target sequence
gatagtataaaaatattta

SEQ ID NO: 169750 - DNA, 19 bp, Artificial sequence
  SiRNA target sequence
atagtataaaaatatttaa

SEQ ID NO: 169751 - DNA, 19 bp, Artificial sequence
  SiRNA target sequence
tagtataaaaatatttaac

SEQ ID NO: 169752 - DNA, 19 bp, Artificial sequence
  SiRNA target sequence
agtataaaaatatttaaca

SEQ ID NO: 169753 - DNA, 19 bp, Artificial sequence
  SiRNA target sequence
gtataaaaatatttaacag

SEQ ID NO: 169754 - DNA, 19 bp, Artificial sequence
  SiRNA target sequence
tataaaaatatttaacagt

SEQ ID NO: 169755 - DNA, 19 bp, Artificial sequence
  SiRNA target sequence
ataaaaatatttaacagta

SEQ ID NO: 169756 - DNA, 19 bp, Artificial sequence
  SiRNA target sequence
taaaaatatttaacagtaa

SEQ ID NO: 169757 - DNA, 19 bp, Artificial sequence
  SiRNA target sequence
aaaaatatttaacagtaaa

SEQ ID NO: 169758 - DNA, 19 bp, Artificial sequence
  SiRNA target sequence
aaaatatttaacagtaaaa

SEQ ID NO: 169759 - DNA, 19 bp, Artificial sequence
  SiRNA target sequence
aaatatttaacagtaaaaa

SEQ ID NO: 169760 - DNA, 19 bp, Artificial sequence
  SiRNA target sequence
aatatttaacagtaaaaat

SEQ ID NO: 169761 - DNA, 19 bp, Artificial sequence
  SiRNA target sequence
atatttaacagtaaaaatg

SEQ ID NO: 169762 - DNA, 19 bp, Artificial sequence
  SiRNA target sequence
tatttaacagtaaaaatga

SEQ ID NO: 169763 - DNA, 19 bp, Artificial sequence
  SiRNA target sequence
atttaacagtaaaaatgag

SEQ ID NO: 169764 - DNA, 19 bp, Artificial sequence
  SiRNA target sequence
tttaacagtaaaaatgagg

SEQ ID NO: 169765 - DNA, 19 bp, Artificial sequence
  SiRNA target sequence
ttaacagtaaaaatgagga

SEQ ID NO: 169766 - DNA, 19 bp, Artificial sequence
  SiRNA target sequence
taacagtaaaaatgaggag

SEQ ID NO: 169767 - DNA, 19 bp, Artificial sequence
  SiRNA target sequence
aacagtaaaaatgaggagg

SEQ ID NO: 169768 - DNA, 19 bp, Artificial sequence
  SiRNA target sequence
acagtaaaaatgaggaggt

SEQ ID NO: 169769 - DNA, 19 bp, Artificial sequence
  SiRNA target sequence
cagtaaaaatgaggaggta

SEQ ID NO: 169770 - DNA, 19 bp, Artificial sequence
  SiRNA target sequence
agtaaaaatgaggaggtaa

SEQ ID NO: 169771 - DNA, 19 bp, Artificial sequence
  SiRNA target sequence
gtaaaaatgaggaggtaag

SEQ ID NO: 169772 - DNA, 19 bp, Artificial sequence
  SiRNA target sequence
taaaaatgaggaggtaagg

SEQ ID NO: 169773 - DNA, 19 bp, Artificial sequence
  SiRNA target sequence
aaaaatgaggaggtaaggt

SEQ ID NO: 169774 - DNA, 19 bp, Artificial sequence
  SiRNA target sequence
aaaatgaggaggtaaggtt

SEQ ID NO: 169775 - DNA, 19 bp, Artificial sequence
  SiRNA target sequence
aaatgaggaggtaaggtta

SEQ ID NO: 169776 - DNA, 19 bp, Artificial sequence
  SiRNA target sequence
aatgaggaggtaaggttaa

SEQ ID NO: 169777 - DNA, 19 bp, Artificial sequence
  SiRNA target sequence
atgaggaggtaaggttaaa

SEQ ID NO: 169778 - DNA, 19 bp, Artificial sequence
  SiRNA target sequence
tgaggaggtaaggttaaat

SEQ ID NO: 169779 - DNA, 19 bp, Artificial sequence
  SiRNA target sequence
gaggaggtaaggttaaatg

SEQ ID NO: 169780 - DNA, 19 bp, Artificial sequence
  SiRNA target sequence
aggaggtaaggttaaatgg

SEQ ID NO: 169781 - DNA, 19 bp, Artificial sequence
  SiRNA target sequence
ggaggtaaggttaaatgga

SEQ ID NO: 169782 - DNA, 19 bp, Artificial sequence
  SiRNA target sequence
gaggtaaggttaaatggaa

SEQ ID NO: 169783 - DNA, 19 bp, Artificial sequence
  SiRNA target sequence
aggtaaggttaaatggaaa

SEQ ID NO: 169784 - DNA, 19 bp, Artificial sequence
  SiRNA target sequence
ggtaaggttaaatggaaaa

SEQ ID NO: 169785 - DNA, 19 bp, Artificial sequence
  SiRNA target sequence
gtaaggttaaatggaaaaa

SEQ ID NO: 169786 - DNA, 19 bp, Artificial sequence
  SiRNA target sequence
taaggttaaatggaaaaag

SEQ ID NO: 169787 - DNA, 19 bp, Artificial sequence
  SiRNA target sequence
aaggttaaatggaaaaaga

SEQ ID NO: 169788 - DNA, 19 bp, Artificial sequence
  SiRNA target sequence
aggttaaatggaaaaagaa

SEQ ID NO: 169789 - DNA, 19 bp, Artificial sequence
  SiRNA target sequence
ggttaaatggaaaaagaaa

SEQ ID NO: 169790 - DNA, 19 bp, Artificial sequence
  SiRNA target sequence
gttaaatggaaaaagaaaa

SEQ ID NO: 169791 - DNA, 19 bp, Artificial sequence
  SiRNA target sequence
ttaaatggaaaaagaaaat

SEQ ID NO: 169792 - DNA, 19 bp, Artificial sequence
  SiRNA target sequence
taaatggaaaaagaaaatt

SEQ ID NO: 169793 - DNA, 19 bp, Artificial sequence
  SiRNA target sequence
aaatggaaaaagaaaatta

SEQ ID NO: 169794 - DNA, 19 bp, Artificial sequence
  SiRNA target sequence
aatggaaaaagaaaattaa

SEQ ID NO: 169795 - DNA, 19 bp, Artificial sequence
  SiRNA target sequence
atggaaaaagaaaattaaa

SEQ ID NO: 169796 - DNA, 19 bp, Artificial sequence
  SiRNA target sequence
tggaaaaagaaaattaaat

SEQ ID NO: 169797 - DNA, 19 bp, Artificial sequence
  SiRNA target sequence
ggaaaaagaaaattaaata

SEQ ID NO: 169798 - DNA, 19 bp, Artificial sequence
  SiRNA target sequence
gaaaaagaaaattaaatat

SEQ ID NO: 169799 - DNA, 19 bp, Artificial sequence
  SiRNA target sequence
aaaaagaaaattaaatatt

SEQ ID NO: 169800 - DNA, 19 bp, Artificial sequence
  SiRNA target sequence
aaaagaaaattaaatatta

SEQ ID NO: 169801 - DNA, 19 bp, Artificial sequence
  SiRNA target sequence
aaagaaaattaaatattaa

SEQ ID NO: 169802 - DNA, 19 bp, Artificial sequence
  SiRNA target sequence
aagaaaattaaatattaac

SEQ ID NO: 169803 - DNA, 19 bp, Artificial sequence
  SiRNA target sequence
agaaaattaaatattaaca

SEQ ID NO: 169804 - DNA, 19 bp, Artificial sequence
  SiRNA target sequence
gaaaattaaatattaacac

SEQ ID NO: 169805 - DNA, 19 bp, Artificial sequence
  SiRNA target sequence
aaaattaaatattaacaca

SEQ ID NO: 169806 - DNA, 19 bp, Artificial sequence
  SiRNA target sequence
aaattaaatattaacacag

SEQ ID NO: 169807 - DNA, 19 bp, Artificial sequence
  SiRNA target sequence
aattaaatattaacacagt

SEQ ID NO: 169808 - DNA, 19 bp, Artificial sequence
  SiRNA target sequence
attaaatattaacacagtt

SEQ ID NO: 169809 - DNA, 19 bp, Artificial sequence
  SiRNA target sequence
ttaaatattaacacagtta

SEQ ID NO: 169810 - DNA, 19 bp, Artificial sequence
  SiRNA target sequence
taaatattaacacagttac

SEQ ID NO: 169811 - DNA, 19 bp, Artificial sequence
  SiRNA target sequence
aaatattaacacagttaca

SEQ ID NO: 169812 - DNA, 19 bp, Artificial sequence
  SiRNA target sequence
aatattaacacagttacat

SEQ ID NO: 169813 - DNA, 19 bp, Artificial sequence
  SiRNA target sequence
atattaacacagttacatt

SEQ ID NO: 169814 - DNA, 19 bp, Artificial sequence
  SiRNA target sequence
tattaacacagttacatta

SEQ ID NO: 169815 - DNA, 19 bp, Artificial sequence
  SiRNA target sequence
attaacacagttacattaa

SEQ ID NO: 169816 - DNA, 19 bp, Artificial sequence
  SiRNA target sequence
ttaacacagttacattaaa

SEQ ID NO: 169817 - DNA, 19 bp, Artificial sequence
  SiRNA target sequence
taacacagttacattaaat

SEQ ID NO: 169818 - DNA, 19 bp, Artificial sequence
  SiRNA target sequence
aacacagttacattaaata

SEQ ID NO: 169819 - DNA, 19 bp, Artificial sequence
  SiRNA target sequence
acacagttacattaaataa

SEQ ID NO: 169820 - DNA, 19 bp, Artificial sequence
  SiRNA target sequence
cacagttacattaaataaa

SEQ ID NO: 169821 - DNA, 19 bp, Artificial sequence
  SiRNA target sequence
acagttacattaaataaaa

SEQ ID NO: 169822 - DNA, 19 bp, Artificial sequence
  SiRNA target sequence
cagttacattaaataaaat

SEQ ID NO: 169823 - DNA, 19 bp, Artificial sequence
  SiRNA target sequence
agttacattaaataaaatt

SEQ ID NO: 169824 - DNA, 19 bp, Artificial sequence
  SiRNA target sequence
gttacattaaataaaatta

SEQ ID NO: 169825 - DNA, 19 bp, Artificial sequence
  SiRNA target sequence
ttacattaaataaaattaa

SEQ ID NO: 169826 - DNA, 19 bp, Artificial sequence
  SiRNA target sequence
tacattaaataaaattaat

SEQ ID NO: 169827 - DNA, 19 bp, Artificial sequence
  SiRNA target sequence
acattaaataaaattaata

SEQ ID NO: 169828 - DNA, 19 bp, Artificial sequence
  SiRNA target sequence
cattaaataaaattaatat

SEQ ID NO: 169829 - DNA, 19 bp, Artificial sequence
  SiRNA target sequence
attaaataaaattaatata

SEQ ID NO: 169830 - DNA, 19 bp, Artificial sequence
  SiRNA target sequence
ttaaataaaattaatatac

SEQ ID NO: 169831 - DNA, 19 bp, Artificial sequence
  SiRNA target sequence
taaataaaattaatatacc

SEQ ID NO: 169832 - DNA, 19 bp, Artificial sequence
  SiRNA target sequence
aaataaaattaatatacct

SEQ ID NO: 169833 - DNA, 19 bp, Artificial sequence
  SiRNA target sequence
aataaaattaatatacctg

SEQ ID NO: 169834 - DNA, 19 bp, Artificial sequence
  SiRNA target sequence
ataaaattaatatacctga

SEQ ID NO: 169835 - DNA, 19 bp, Artificial sequence
  SiRNA target sequence
taaaattaatatacctgag

SEQ ID NO: 169836 - DNA, 19 bp, Artificial sequence
  SiRNA target sequence
aaaattaatatacctgaga

SEQ ID NO: 169837 - DNA, 19 bp, Artificial sequence
  SiRNA target sequence
aaattaatatacctgagat

SEQ ID NO: 169838 - DNA, 19 bp, Artificial sequence
  SiRNA target sequence
aattaatatacctgagata

SEQ ID NO: 169839 - DNA, 19 bp, Artificial sequence
  SiRNA target sequence
attaatatacctgagatag

SEQ ID NO: 169840 - DNA, 19 bp, Artificial sequence
  SiRNA target sequence
ttaatatacctgagataga

SEQ ID NO: 169841 - DNA, 19 bp, Artificial sequence
  SiRNA target sequence
taatatacctgagatagat

SEQ ID NO: 169842 - DNA, 19 bp, Artificial sequence
  SiRNA target sequence
aatatacctgagatagatt

SEQ ID NO: 169843 - DNA, 19 bp, Artificial sequence
  SiRNA target sequence
atatacctgagatagatta

SEQ ID NO: 169844 - DNA, 19 bp, Artificial sequence
  SiRNA target sequence
tatacctgagatagattat

SEQ ID NO: 169845 - DNA, 19 bp, Artificial sequence
  SiRNA target sequence
atacctgagatagattata

SEQ ID NO: 169846 - DNA, 19 bp, Artificial sequence
  SiRNA target sequence
tacctgagatagattataa

SEQ ID NO: 169847 - DNA, 19 bp, Artificial sequence
  SiRNA target sequence
acctgagatagattataaa

SEQ ID NO: 169848 - DNA, 19 bp, Artificial sequence
  SiRNA target sequence
cctgagatagattataaat

SEQ ID NO: 169849 - DNA, 19 bp, Artificial sequence
  SiRNA target sequence
ctgagatagattataaata

SEQ ID NO: 169850 - DNA, 19 bp, Artificial sequence
  SiRNA target sequence
tgagatagattataaatat

SEQ ID NO: 169851 - DNA, 19 bp, Artificial sequence
  SiRNA target sequence
gagatagattataaatata

SEQ ID NO: 169852 - DNA, 19 bp, Artificial sequence
  SiRNA target sequence
agatagattataaatataa

SEQ ID NO: 169853 - DNA, 19 bp, Artificial sequence
  SiRNA target sequence
gatagattataaatataaa

SEQ ID NO: 169854 - DNA, 19 bp, Artificial sequence
  SiRNA target sequence
atagattataaatataaaa

SEQ ID NO: 169855 - DNA, 19 bp, Artificial sequence
  SiRNA target sequence
tagattataaatataaaaa

SEQ ID NO: 169856 - DNA, 19 bp, Artificial sequence
  SiRNA target sequence
agattataaatataaaaat

SEQ ID NO: 169857 - DNA, 19 bp, Artificial sequence
  SiRNA target sequence
gattataaatataaaaatg

SEQ ID NO: 169858 - DNA, 19 bp, Artificial sequence
  SiRNA target sequence
attataaatataaaaatgg

SEQ ID NO: 169859 - DNA, 19 bp, Artificial sequence
  SiRNA target sequence
ttataaatataaaaatgga

SEQ ID NO: 169860 - DNA, 19 bp, Artificial sequence
  SiRNA target sequence
tataaatataaaaatggag

SEQ ID NO: 169861 - DNA, 19 bp, Artificial sequence
  SiRNA target sequence
ataaatataaaaatggagt

SEQ ID NO: 169862 - DNA, 19 bp, Artificial sequence
  SiRNA target sequence
taaatataaaaatggagtg

SEQ ID NO: 169863 - DNA, 19 bp, Artificial sequence
  SiRNA target sequence
aaatataaaaatggagtgt

SEQ ID NO: 169864 - DNA, 19 bp, Artificial sequence
  SiRNA target sequence
aatataaaaatggagtgtt

SEQ ID NO: 169865 - DNA, 19 bp, Artificial sequence
  SiRNA target sequence
atataaaaatggagtgttt

SEQ ID NO: 169866 - DNA, 19 bp, Artificial sequence
  SiRNA target sequence
tataaaaatggagtgttta

SEQ ID NO: 169867 - DNA, 19 bp, Artificial sequence
  SiRNA target sequence
ataaaaatggagtgtttac

SEQ ID NO: 169868 - DNA, 19 bp, Artificial sequence
  SiRNA target sequence
taaaaatggagtgtttaca

SEQ ID NO: 169869 - DNA, 19 bp, Artificial sequence
  SiRNA target sequence
aaaaatggagtgtttacat

SEQ ID NO: 169870 - DNA, 19 bp, Artificial sequence
  SiRNA target sequence
aaaatggagtgtttacata

SEQ ID NO: 169871 - DNA, 19 bp, Artificial sequence
  SiRNA target sequence
aaatggagtgtttacatat

SEQ ID NO: 169872 - DNA, 19 bp, Artificial sequence
  SiRNA target sequence
aatggagtgtttacatata

SEQ ID NO: 169873 - DNA, 19 bp, Artificial sequence
  SiRNA target sequence
atggagtgtttacatatac

SEQ ID NO: 169874 - DNA, 19 bp, Artificial sequence
  SiRNA target sequence
tggagtgtttacatataca

SEQ ID NO: 169875 - DNA, 19 bp, Artificial sequence
  SiRNA target sequence
ggagtgtttacatatacac

SEQ ID NO: 169876 - DNA, 19 bp, Artificial sequence
  SiRNA target sequence
gagtgtttacatatacaca

SEQ ID NO: 169877 - DNA, 19 bp, Artificial sequence
  SiRNA target sequence
agtgtttacatatacacag

SEQ ID NO: 169878 - DNA, 19 bp, Artificial sequence
  SiRNA target sequence
gtgtttacatatacacaga

SEQ ID NO: 169879 - DNA, 19 bp, Artificial sequence
  SiRNA target sequence
tgtttacatatacacagat

SEQ ID NO: 169880 - DNA, 19 bp, Artificial sequence
  SiRNA target sequence
gtttacatatacacagatc

SEQ ID NO: 169881 - DNA, 19 bp, Artificial sequence
  SiRNA target sequence
tttacatatacacagatca

SEQ ID NO: 169882 - DNA, 19 bp, Artificial sequence
  SiRNA target sequence
ttacatatacacagatcaa

SEQ ID NO: 169883 - DNA, 19 bp, Artificial sequence
  SiRNA target sequence
tacatatacacagatcaaa

SEQ ID NO: 169884 - DNA, 19 bp, Artificial sequence
  SiRNA target sequence
acatatacacagatcaaaa

SEQ ID NO: 169885 - DNA, 19 bp, Artificial sequence
  SiRNA target sequence
catatacacagatcaaaaa

SEQ ID NO: 169886 - DNA, 19 bp, Artificial sequence
  SiRNA target sequence
atatacacagatcaaaaat

SEQ ID NO: 169887 - DNA, 19 bp, Artificial sequence
  SiRNA target sequence
tatacacagatcaaaaata

SEQ ID NO: 169888 - DNA, 19 bp, Artificial sequence
  SiRNA target sequence
atacacagatcaaaaataa

SEQ ID NO: 169889 - DNA, 19 bp, Artificial sequence
  SiRNA target sequence
tacacagatcaaaaataat

SEQ ID NO: 169890 - DNA, 19 bp, Artificial sequence
  SiRNA target sequence
acacagatcaaaaataata

SEQ ID NO: 169891 - DNA, 19 bp, Artificial sequence
  SiRNA target sequence
cacagatcaaaaataataa

SEQ ID NO: 169892 - DNA, 19 bp, Artificial sequence
  SiRNA target sequence
acagatcaaaaataataag

SEQ ID NO: 169893 - DNA, 19 bp, Artificial sequence
  SiRNA target sequence
cagatcaaaaataataaga

SEQ ID NO: 169894 - DNA, 19 bp, Artificial sequence
  SiRNA target sequence
agatcaaaaataataagaa

SEQ ID NO: 169895 - DNA, 19 bp, Artificial sequence
  SiRNA target sequence
gatcaaaaataataagaaa

SEQ ID NO: 169896 - DNA, 19 bp, Artificial sequence
  SiRNA target sequence
atcaaaaataataagaaaa

SEQ ID NO: 169897 - DNA, 19 bp, Artificial sequence
  SiRNA target sequence
tcaaaaataataagaaaaa

SEQ ID NO: 169898 - DNA, 19 bp, Artificial sequence
  SiRNA target sequence
caaaaataataagaaaaaa

SEQ ID NO: 169899 - DNA, 19 bp, Artificial sequence
  SiRNA target sequence
aaaaataataagaaaaaaa

SEQ ID NO: 169900 - DNA, 19 bp, Artificial sequence
  SiRNA target sequence
aaaataataagaaaaaaaa

SEQ ID NO: 169901 - DNA, 19 bp, Artificial sequence
  SiRNA target sequence
aaataataagaaaaaaaaa

SEQ ID NO: 169902 - DNA, 19 bp, Artificial sequence
  SiRNA target sequence
aataataagaaaaaaaaat

SEQ ID NO: 169903 - DNA, 19 bp, Artificial sequence
  SiRNA target sequence
ataataagaaaaaaaaata

SEQ ID NO: 169904 - DNA, 19 bp, Artificial sequence
  SiRNA target sequence
taataagaaaaaaaaatat

SEQ ID NO: 169905 - DNA, 19 bp, Artificial sequence
  SiRNA target sequence
aataagaaaaaaaaatatt

SEQ ID NO: 169906 - DNA, 19 bp, Artificial sequence
  SiRNA target sequence
ataagaaaaaaaaatattt

SEQ ID NO: 169907 - DNA, 19 bp, Artificial sequence
  SiRNA target sequence
taagaaaaaaaaatattta

SEQ ID NO: 169908 - DNA, 19 bp, Artificial sequence
  SiRNA target sequence
aagaaaaaaaaatatttaa

SEQ ID NO: 169909 - DNA, 19 bp, Artificial sequence
  SiRNA target sequence
agaaaaaaaaatatttaag

SEQ ID NO: 169910 - DNA, 19 bp, Artificial sequence
  SiRNA target sequence
gaaaaaaaaatatttaaga

SEQ ID NO: 169911 - DNA, 19 bp, Artificial sequence
  SiRNA target sequence
aaaaaaaaatatttaagaa

SEQ ID NO: 169912 - DNA, 19 bp, Artificial sequence
  SiRNA target sequence
aaaaaaaatatttaagaat

SEQ ID NO: 169913 - DNA, 19 bp, Artificial sequence
  SiRNA target sequence
aaaaaaatatttaagaata

SEQ ID NO: 169914 - DNA, 19 bp, Artificial sequence
  SiRNA target sequence
aaaaaatatttaagaatat

SEQ ID NO: 169915 - DNA, 19 bp, Artificial sequence
  SiRNA target sequence
aaaaatatttaagaatatt

SEQ ID NO: 169916 - DNA, 19 bp, Artificial sequence
  SiRNA target sequence
aaaatatttaagaatattg

SEQ ID NO: 169917 - DNA, 19 bp, Artificial sequence
  SiRNA target sequence
aaatatttaagaatattgg

SEQ ID NO: 169918 - DNA, 19 bp, Artificial sequence
  SiRNA target sequence
aatatttaagaatattggg

SEQ ID NO: 169919 - DNA, 19 bp, Artificial sequence
  SiRNA target sequence
atatttaagaatattgggt

SEQ ID NO: 169920 - DNA, 19 bp, Artificial sequence
  SiRNA target sequence
tatttaagaatattgggtc

SEQ ID NO: 169921 - DNA, 19 bp, Artificial sequence
  SiRNA target sequence
atttaagaatattgggtct

SEQ ID NO: 169922 - DNA, 19 bp, Artificial sequence
  SiRNA target sequence
tttaagaatattgggtcta

SEQ ID NO: 169923 - DNA, 19 bp, Artificial sequence
  SiRNA target sequence
ttaagaatattgggtctag

SEQ ID NO: 169924 - DNA, 19 bp, Artificial sequence
  SiRNA target sequence
taagaatattgggtctaga

SEQ ID NO: 169925 - DNA, 19 bp, Artificial sequence
  SiRNA target sequence
aagaatattgggtctagaa

SEQ ID NO: 169926 - DNA, 19 bp, Artificial sequence
  SiRNA target sequence
agaatattgggtctagaac

SEQ ID NO: 169927 - DNA, 19 bp, Artificial sequence
  SiRNA target sequence
gaatattgggtctagaacc

SEQ ID NO: 169928 - DNA, 19 bp, Artificial sequence
  SiRNA target sequence
aatattgggtctagaacct

SEQ ID NO: 169929 - DNA, 19 bp, Artificial sequence
  SiRNA target sequence
atattgggtctagaacctt

SEQ ID NO: 169930 - DNA, 19 bp, Artificial sequence
  SiRNA target sequence
tattgggtctagaaccttt

SEQ ID NO: 169931 - DNA, 19 bp, Artificial sequence
  SiRNA target sequence
attgggtctagaacctttt

SEQ ID NO: 169932 - DNA, 19 bp, Artificial sequence
  SiRNA target sequence
ttgggtctagaaccttttc

SEQ ID NO: 169933 - DNA, 19 bp, Artificial sequence
  SiRNA target sequence
tgggtctagaaccttttct

SEQ ID NO: 169934 - DNA, 19 bp, Artificial sequence
  SiRNA target sequence
gggtctagaaccttttctt

SEQ ID NO: 169935 - DNA, 19 bp, Artificial sequence
  SiRNA target sequence
ggtctagaaccttttctta

SEQ ID NO: 169936 - DNA, 19 bp, Artificial sequence
  SiRNA target sequence
gtctagaaccttttcttaa

SEQ ID NO: 169937 - DNA, 19 bp, Artificial sequence
  SiRNA target sequence
tctagaaccttttcttaat

SEQ ID NO: 169938 - DNA, 19 bp, Artificial sequence
  SiRNA target sequence
ctagaaccttttcttaatt

SEQ ID NO: 169939 - DNA, 19 bp, Artificial sequence
  SiRNA target sequence
tagaaccttttcttaattt

SEQ ID NO: 169940 - DNA, 19 bp, Artificial sequence
  SiRNA target sequence
agaaccttttcttaatttt

SEQ ID NO: 169941 - DNA, 19 bp, Artificial sequence
  SiRNA target sequence
gaaccttttcttaatttta

SEQ ID NO: 169942 - DNA, 19 bp, Artificial sequence
  SiRNA target sequence
aaccttttcttaattttat

SEQ ID NO: 169943 - DNA, 19 bp, Artificial sequence
  SiRNA target sequence
accttttcttaattttatt

SEQ ID NO: 169944 - DNA, 19 bp, Artificial sequence
  SiRNA target sequence
ccttttcttaattttatta

SEQ ID NO: 169945 - DNA, 19 bp, Artificial sequence
  SiRNA target sequence
cttttcttaattttattaa

SEQ ID NO: 169946 - DNA, 19 bp, Artificial sequence
  SiRNA target sequence
ttttcttaattttattaag

SEQ ID NO: 169947 - DNA, 19 bp, Artificial sequence
  SiRNA target sequence
tttcttaattttattaagg

SEQ ID NO: 169948 - DNA, 19 bp, Artificial sequence
  SiRNA target sequence
ttcttaattttattaagga

SEQ ID NO: 169949 - DNA, 19 bp, Artificial sequence
  SiRNA target sequence
tcttaattttattaaggaa

SEQ ID NO: 169950 - DNA, 19 bp, Artificial sequence
  SiRNA target sequence
cttaattttattaaggaaa

SEQ ID NO: 169951 - DNA, 19 bp, Artificial sequence
  SiRNA target sequence
ttaattttattaaggaaag

SEQ ID NO: 169952 - DNA, 19 bp, Artificial sequence
  SiRNA target sequence
taattttattaaggaaagt

SEQ ID NO: 169953 - DNA, 19 bp, Artificial sequence
  SiRNA target sequence
aattttattaaggaaagta

SEQ ID NO: 169954 - DNA, 19 bp, Artificial sequence
  SiRNA target sequence
attttattaaggaaagtaa

SEQ ID NO: 169955 - DNA, 19 bp, Artificial sequence
  SiRNA target sequence
ttttattaaggaaagtaaa

SEQ ID NO: 169956 - DNA, 19 bp, Artificial sequence
  SiRNA target sequence
tttattaaggaaagtaaac

SEQ ID NO: 169957 - DNA, 19 bp, Artificial sequence
  SiRNA target sequence
ttattaaggaaagtaaaca

SEQ ID NO: 169958 - DNA, 19 bp, Artificial sequence
  SiRNA target sequence
tattaaggaaagtaaacat

SEQ ID NO: 169959 - DNA, 19 bp, Artificial sequence
  SiRNA target sequence
attaaggaaagtaaacata

SEQ ID NO: 169960 - DNA, 19 bp, Artificial sequence
  SiRNA target sequence
ttaaggaaagtaaacataa

SEQ ID NO: 169961 - DNA, 19 bp, Artificial sequence
  SiRNA target sequence
taaggaaagtaaacataaa

SEQ ID NO: 169962 - DNA, 19 bp, Artificial sequence
  SiRNA target sequence
aaggaaagtaaacataaag

SEQ ID NO: 169963 - DNA, 19 bp, Artificial sequence
  SiRNA target sequence
aggaaagtaaacataaaga

SEQ ID NO: 169964 - DNA, 19 bp, Artificial sequence
  SiRNA target sequence
ggaaagtaaacataaagaa

SEQ ID NO: 169965 - DNA, 19 bp, Artificial sequence
  SiRNA target sequence
gaaagtaaacataaagaat

SEQ ID NO: 169966 - DNA, 19 bp, Artificial sequence
  SiRNA target sequence
aaagtaaacataaagaatt

SEQ ID NO: 169967 - DNA, 19 bp, Artificial sequence
  SiRNA target sequence
aagtaaacataaagaatta

SEQ ID NO: 169968 - DNA, 19 bp, Artificial sequence
  SiRNA target sequence
agtaaacataaagaattag

SEQ ID NO: 169969 - DNA, 19 bp, Artificial sequence
  SiRNA target sequence
gtaaacataaagaattaga

SEQ ID NO: 169970 - DNA, 19 bp, Artificial sequence
  SiRNA target sequence
taaacataaagaattagaa

SEQ ID NO: 169971 - DNA, 19 bp, Artificial sequence
  SiRNA target sequence
aaacataaagaattagaat

SEQ ID NO: 169972 - DNA, 19 bp, Artificial sequence
  SiRNA target sequence
aacataaagaattagaata

SEQ ID NO: 169973 - DNA, 19 bp, Artificial sequence
  SiRNA target sequence
acataaagaattagaatat

SEQ ID NO: 169974 - DNA, 19 bp, Artificial sequence
  SiRNA target sequence
cataaagaattagaatatg

SEQ ID NO: 169975 - DNA, 19 bp, Artificial sequence
  SiRNA target sequence
ataaagaattagaatatga

SEQ ID NO: 169976 - DNA, 19 bp, Artificial sequence
  SiRNA target sequence
taaagaattagaatatgat

SEQ ID NO: 169977 - DNA, 19 bp, Artificial sequence
  SiRNA target sequence
aaagaattagaatatgatg

SEQ ID NO: 169978 - DNA, 19 bp, Artificial sequence
  SiRNA target sequence
aagaattagaatatgatgt

SEQ ID NO: 169979 - DNA, 19 bp, Artificial sequence
  SiRNA target sequence
agaattagaatatgatgta

SEQ ID NO: 169980 - DNA, 19 bp, Artificial sequence
  SiRNA target sequence
gaattagaatatgatgtat

SEQ ID NO: 169981 - DNA, 19 bp, Artificial sequence
  SiRNA target sequence
aattagaatatgatgtatg

SEQ ID NO: 169982 - DNA, 19 bp, Artificial sequence
  SiRNA target sequence
attagaatatgatgtatgc

SEQ ID NO: 169983 - DNA, 19 bp, Artificial sequence
  SiRNA target sequence
ttagaatatgatgtatgcg

SEQ ID NO: 169984 - DNA, 19 bp, Artificial sequence
  SiRNA target sequence
tagaatatgatgtatgcga

SEQ ID NO: 169985 - DNA, 19 bp, Artificial sequence
  SiRNA target sequence
agaatatgatgtatgcgaa

SEQ ID NO: 169986 - DNA, 19 bp, Artificial sequence
  SiRNA target sequence
gaatatgatgtatgcgaaa

SEQ ID NO: 169987 - DNA, 19 bp, Artificial sequence
  SiRNA target sequence
aatatgatgtatgcgaaat

SEQ ID NO: 169988 - DNA, 19 bp, Artificial sequence
  SiRNA target sequence
atatgatgtatgcgaaata

SEQ ID NO: 169989 - DNA, 19 bp, Artificial sequence
  SiRNA target sequence
tatgatgtatgcgaaatat

SEQ ID NO: 169990 - DNA, 19 bp, Artificial sequence
  SiRNA target sequence
atgatgtatgcgaaatata

SEQ ID NO: 169991 - DNA, 19 bp, Artificial sequence
  SiRNA target sequence
tgatgtatgcgaaatatac

SEQ ID NO: 169992 - DNA, 19 bp, Artificial sequence
  SiRNA target sequence
gatgtatgcgaaatataca

SEQ ID NO: 169993 - DNA, 19 bp, Artificial sequence
  SiRNA target sequence
atgtatgcgaaatatacat

SEQ ID NO: 169994 - DNA, 19 bp, Artificial sequence
  SiRNA target sequence
tgtatgcgaaatatacatt

SEQ ID NO: 169995 - DNA, 19 bp, Artificial sequence
  SiRNA target sequence
gtatgcgaaatatacattt

SEQ ID NO: 169996 - DNA, 19 bp, Artificial sequence
  SiRNA target sequence
tatgcgaaatatacatttg

SEQ ID NO: 169997 - DNA, 19 bp, Artificial sequence
  SiRNA target sequence
atgcgaaatatacatttgt

SEQ ID NO: 169998 - DNA, 19 bp, Artificial sequence
  SiRNA target sequence
tgcgaaatatacatttgta

SEQ ID NO: 169999 - DNA, 19 bp, Artificial sequence
  SiRNA target sequence
gcgaaatatacatttgtaa

SEQ ID NO: 170000 - DNA, 19 bp, Artificial sequence
  SiRNA target sequence
cgaaatatacatttgtaat

SEQ ID NO: 170001 - DNA, 19 bp, Artificial sequence
  SiRNA target sequence
gaaatatacatttgtaatc

SEQ ID NO: 170002 - DNA, 19 bp, Artificial sequence
  SiRNA target sequence
aaatatacatttgtaatca

SEQ ID NO: 170003 - DNA, 19 bp, Artificial sequence
  SiRNA target sequence
aatatacatttgtaatcag

SEQ ID NO: 170004 - DNA, 19 bp, Artificial sequence
  SiRNA target sequence
atatacatttgtaatcagg

SEQ ID NO: 170005 - DNA, 19 bp, Artificial sequence
  SiRNA target sequence
tatacatttgtaatcaggg

SEQ ID NO: 170006 - DNA, 19 bp, Artificial sequence
  SiRNA target sequence
atacatttgtaatcaggga

SEQ ID NO: 170007 - DNA, 19 bp, Artificial sequence
  SiRNA target sequence
tacatttgtaatcagggat

SEQ ID NO: 170008 - DNA, 19 bp, Artificial sequence
  SiRNA target sequence
acatttgtaatcagggatg

SEQ ID NO: 170009 - DNA, 19 bp, Artificial sequence
  SiRNA target sequence
catttgtaatcagggatgc

SEQ ID NO: 170010 - DNA, 19 bp, Artificial sequence
  SiRNA target sequence
atttgtaatcagggatgca

SEQ ID NO: 170011 - DNA, 19 bp, Artificial sequence
  SiRNA target sequence
tttgtaatcagggatgcat

SEQ ID NO: 170012 - DNA, 19 bp, Artificial sequence
  SiRNA target sequence
ttgtaatcagggatgcatt

SEQ ID NO: 170013 - DNA, 19 bp, Artificial sequence
  SiRNA target sequence
tgtaatcagggatgcatta

SEQ ID NO: 170014 - DNA, 19 bp, Artificial sequence
  SiRNA target sequence
gtaatcagggatgcattaa

SEQ ID NO: 170015 - DNA, 19 bp, Artificial sequence
  SiRNA target sequence
taatcagggatgcattaat

SEQ ID NO: 170016 - DNA, 19 bp, Artificial sequence
  SiRNA target sequence
aatcagggatgcattaatg

SEQ ID NO: 170017 - DNA, 19 bp, Artificial sequence
  SiRNA target sequence
atcagggatgcattaatgg

SEQ ID NO: 170018 - DNA, 19 bp, Artificial sequence
  SiRNA target sequence
tcagggatgcattaatgga

SEQ ID NO: 170019 - DNA, 19 bp, Artificial sequence
  SiRNA target sequence
cagggatgcattaatggac

SEQ ID NO: 170020 - DNA, 19 bp, Artificial sequence
  SiRNA target sequence
agggatgcattaatggacc

SEQ ID NO: 170021 - DNA, 19 bp, Artificial sequence
  SiRNA target sequence
gggatgcattaatggacca

SEQ ID NO: 170022 - DNA, 19 bp, Artificial sequence
  SiRNA target sequence
ggatgcattaatggaccag

SEQ ID NO: 170023 - DNA, 19 bp, Artificial sequence
  SiRNA target sequence
gatgcattaatggaccagg

SEQ ID NO: 170024 - DNA, 19 bp, Artificial sequence
  SiRNA target sequence
atgcattaatggaccagga

SEQ ID NO: 170025 - DNA, 19 bp, Artificial sequence
  SiRNA target sequence
tgcattaatggaccaggac

SEQ ID NO: 170026 - DNA, 19 bp, Artificial sequence
  SiRNA target sequence
gcattaatggaccaggaca

SEQ ID NO: 170027 - DNA, 19 bp, Artificial sequence
  SiRNA target sequence
cattaatggaccaggacaa

SEQ ID NO: 170028 - DNA, 19 bp, Artificial sequence
  SiRNA target sequence
attaatggaccaggacaat

SEQ ID NO: 170029 - DNA, 19 bp, Artificial sequence
  SiRNA target sequence
ttaatggaccaggacaatt

SEQ ID NO: 170030 - DNA, 19 bp, Artificial sequence
  SiRNA target sequence
taatggaccaggacaattg

SEQ ID NO: 170031 - DNA, 19 bp, Artificial sequence
  SiRNA target sequence
aatggaccaggacaattgt

SEQ ID NO: 170032 - DNA, 19 bp, Artificial sequence
  SiRNA target sequence
atggaccaggacaattgta

SEQ ID NO: 170033 - DNA, 19 bp, Artificial sequence
  SiRNA target sequence
tggaccaggacaattgtat

SEQ ID NO: 170034 - DNA, 19 bp, Artificial sequence
  SiRNA target sequence
ggaccaggacaattgtata

SEQ ID NO: 170035 - DNA, 19 bp, Artificial sequence
  SiRNA target sequence
gaccaggacaattgtatac

SEQ ID NO: 170036 - DNA, 19 bp, Artificial sequence
  SiRNA target sequence
accaggacaattgtataca

SEQ ID NO: 170037 - DNA, 19 bp, Artificial sequence
  SiRNA target sequence
ccaggacaattgtatacag

SEQ ID NO: 170038 - DNA, 19 bp, Artificial sequence
  SiRNA target sequence
caggacaattgtatacaga

SEQ ID NO: 170039 - DNA, 19 bp, Artificial sequence
  SiRNA target sequence
aggacaattgtatacagat

SEQ ID NO: 170040 - DNA, 19 bp, Artificial sequence
  SiRNA target sequence
ggacaattgtatacagata

SEQ ID NO: 170041 - DNA, 19 bp, Artificial sequence
  SiRNA target sequence
gacaattgtatacagataa

SEQ ID NO: 170042 - DNA, 19 bp, Artificial sequence
  SiRNA target sequence
acaattgtatacagataat

SEQ ID NO: 170043 - DNA, 19 bp, Artificial sequence
  SiRNA target sequence
caattgtatacagataatt

SEQ ID NO: 170044 - DNA, 19 bp, Artificial sequence
  SiRNA target sequence
aattgtatacagataattt

SEQ ID NO: 170045 - DNA, 19 bp, Artificial sequence
  SiRNA target sequence
attgtatacagataattta

SEQ ID NO: 170046 - DNA, 19 bp, Artificial sequence
  SiRNA target sequence
ttgtatacagataatttat

SEQ ID NO: 170047 - DNA, 19 bp, Artificial sequence
  SiRNA target sequence
tgtatacagataatttata

SEQ ID NO: 170048 - DNA, 19 bp, Artificial sequence
  SiRNA target sequence
gtatacagataatttatat

SEQ ID NO: 170049 - DNA, 19 bp, Artificial sequence
  SiRNA target sequence
tatacagataatttatatg

SEQ ID NO: 170050 - DNA, 19 bp, Artificial sequence
  SiRNA target sequence
atacagataatttatatgt

SEQ ID NO: 170051 - DNA, 19 bp, Artificial sequence
  SiRNA target sequence
tacagataatttatatgta

SEQ ID NO: 170052 - DNA, 19 bp, Artificial sequence
  SiRNA target sequence
acagataatttatatgtaa

SEQ ID NO: 170053 - DNA, 19 bp, Artificial sequence
  SiRNA target sequence
cagataatttatatgtaaa

SEQ ID NO: 170054 - DNA, 19 bp, Artificial sequence
  SiRNA target sequence
agataatttatatgtaaat

SEQ ID NO: 170055 - DNA, 19 bp, Artificial sequence
  SiRNA target sequence
gataatttatatgtaaata

SEQ ID NO: 170056 - DNA, 19 bp, Artificial sequence
  SiRNA target sequence
ataatttatatgtaaataa

SEQ ID NO: 170057 - DNA, 19 bp, Artificial sequence
  SiRNA target sequence
taatttatatgtaaataat

SEQ ID NO: 170058 - DNA, 19 bp, Artificial sequence
  SiRNA target sequence
aatttatatgtaaataatt

SEQ ID NO: 170059 - DNA, 19 bp, Artificial sequence
  SiRNA target sequence
atttatatgtaaataattc

SEQ ID NO: 170060 - DNA, 19 bp, Artificial sequence
  SiRNA target sequence
tttatatgtaaataattca

SEQ ID NO: 170061 - DNA, 19 bp, Artificial sequence
  SiRNA target sequence
ttatatgtaaataattcag

SEQ ID NO: 170062 - DNA, 19 bp, Artificial sequence
  SiRNA target sequence
tatatgtaaataattcaga

SEQ ID NO: 170063 - DNA, 19 bp, Artificial sequence
  SiRNA target sequence
atatgtaaataattcagaa

SEQ ID NO: 170064 - DNA, 19 bp, Artificial sequence
  SiRNA target sequence
tatgtaaataattcagaat

SEQ ID NO: 170065 - DNA, 19 bp, Artificial sequence
  SiRNA target sequence
atgtaaataattcagaata

SEQ ID NO: 170066 - DNA, 19 bp, Artificial sequence
  SiRNA target sequence
tgtaaataattcagaatac

SEQ ID NO: 170067 - DNA, 19 bp, Artificial sequence
  SiRNA target sequence
gtaaataattcagaataca

SEQ ID NO: 170068 - DNA, 19 bp, Artificial sequence
  SiRNA target sequence
taaataattcagaatacat

SEQ ID NO: 170069 - DNA, 19 bp, Artificial sequence
  SiRNA target sequence
aaataattcagaatacata

SEQ ID NO: 170070 - DNA, 19 bp, Artificial sequence
  SiRNA target sequence
aataattcagaatacatag

SEQ ID NO: 170071 - DNA, 19 bp, Artificial sequence
  SiRNA target sequence
ataattcagaatacataga

SEQ ID NO: 170072 - DNA, 19 bp, Artificial sequence
  SiRNA target sequence
taattcagaatacatagat

SEQ ID NO: 170073 - DNA, 19 bp, Artificial sequence
  SiRNA target sequence
aattcagaatacatagata

SEQ ID NO: 170074 - DNA, 19 bp, Artificial sequence
  SiRNA target sequence
attcagaatacatagatat

SEQ ID NO: 170075 - DNA, 19 bp, Artificial sequence
  SiRNA target sequence
ttcagaatacatagatatt

SEQ ID NO: 170076 - DNA, 19 bp, Artificial sequence
  SiRNA target sequence
tcagaatacatagatattg

SEQ ID NO: 170077 - DNA, 19 bp, Artificial sequence
  SiRNA target sequence
cagaatacatagatattga

SEQ ID NO: 170078 - DNA, 19 bp, Artificial sequence
  SiRNA target sequence
agaatacatagatattgat

SEQ ID NO: 170079 - DNA, 19 bp, Artificial sequence
  SiRNA target sequence
gaatacatagatattgatc

SEQ ID NO: 170080 - DNA, 19 bp, Artificial sequence
  SiRNA target sequence
aatacatagatattgatct

SEQ ID NO: 170081 - DNA, 19 bp, Artificial sequence
  SiRNA target sequence
atacatagatattgatctt

SEQ ID NO: 170082 - DNA, 19 bp, Artificial sequence
  SiRNA target sequence
tacatagatattgatcttg

SEQ ID NO: 170083 - DNA, 19 bp, Artificial sequence
  SiRNA target sequence
acatagatattgatcttgg

SEQ ID NO: 170084 - DNA, 19 bp, Artificial sequence
  SiRNA target sequence
catagatattgatcttggt

SEQ ID NO: 170085 - DNA, 19 bp, Artificial sequence
  SiRNA target sequence
atagatattgatcttggta

SEQ ID NO: 170086 - DNA, 19 bp, Artificial sequence
  SiRNA target sequence
tagatattgatcttggtat

SEQ ID NO: 170087 - DNA, 19 bp, Artificial sequence
  SiRNA target sequence
agatattgatcttggtatt

SEQ ID NO: 170088 - DNA, 19 bp, Artificial sequence
  SiRNA target sequence
gatattgatcttggtattg

SEQ ID NO: 170089 - DNA, 19 bp, Artificial sequence
  SiRNA target sequence
atattgatcttggtattga

SEQ ID NO: 170090 - DNA, 19 bp, Artificial sequence
  SiRNA target sequence
tattgatcttggtattgat

SEQ ID NO: 170091 - DNA, 19 bp, Artificial sequence
  SiRNA target sequence
attgatcttggtattgatt

SEQ ID NO: 170092 - DNA, 19 bp, Artificial sequence
  SiRNA target sequence
ttgatcttggtattgattg

SEQ ID NO: 170093 - DNA, 19 bp, Artificial sequence
  SiRNA target sequence
tgatcttggtattgattgt

SEQ ID NO: 170094 - DNA, 19 bp, Artificial sequence
  SiRNA target sequence
gatcttggtattgattgta

SEQ ID NO: 170095 - DNA, 19 bp, Artificial sequence
  SiRNA target sequence
atcttggtattgattgtaa

SEQ ID NO: 170096 - DNA, 19 bp, Artificial sequence
  SiRNA target sequence
tcttggtattgattgtaaa

SEQ ID NO: 170097 - DNA, 19 bp, Artificial sequence
  SiRNA target sequence
cttggtattgattgtaaac

SEQ ID NO: 170098 - DNA, 19 bp, Artificial sequence
  SiRNA target sequence
ttggtattgattgtaaaca

SEQ ID NO: 170099 - DNA, 19 bp, Artificial sequence
  SiRNA target sequence
tggtattgattgtaaacag

SEQ ID NO: 170100 - DNA, 19 bp, Artificial sequence
  SiRNA target sequence
ggtattgattgtaaacagt

SEQ ID NO: 170101 - DNA, 19 bp, Artificial sequence
  SiRNA target sequence
gtattgattgtaaacagtt

SEQ ID NO: 170102 - DNA, 19 bp, Artificial sequence
  SiRNA target sequence
tattgattgtaaacagtta

SEQ ID NO: 170103 - DNA, 19 bp, Artificial sequence
  SiRNA target sequence
attgattgtaaacagttac

SEQ ID NO: 170104 - DNA, 19 bp, Artificial sequence
  SiRNA target sequence
ttgattgtaaacagttaca

SEQ ID NO: 170105 - DNA, 19 bp, Artificial sequence
  SiRNA target sequence
tgattgtaaacagttacaa

SEQ ID NO: 170106 - DNA, 19 bp, Artificial sequence
  SiRNA target sequence
gattgtaaacagttacaaa

SEQ ID NO: 170107 - DNA, 19 bp, Artificial sequence
  SiRNA target sequence
attgtaaacagttacaaaa

SEQ ID NO: 170108 - DNA, 19 bp, Artificial sequence
  SiRNA target sequence
ttgtaaacagttacaaaaa

SEQ ID NO: 170109 - DNA, 19 bp, Artificial sequence
  SiRNA target sequence
tgtaaacagttacaaaaaa

SEQ ID NO: 170110 - DNA, 19 bp, Artificial sequence
  SiRNA target sequence
gtaaacagttacaaaaaag

SEQ ID NO: 170111 - DNA, 19 bp, Artificial sequence
  SiRNA target sequence
taaacagttacaaaaaagg

SEQ ID NO: 170112 - DNA, 19 bp, Artificial sequence
  SiRNA target sequence
aaacagttacaaaaaagga

SEQ ID NO: 170113 - DNA, 19 bp, Artificial sequence
  SiRNA target sequence
aacagttacaaaaaaggac

SEQ ID NO: 170114 - DNA, 19 bp, Artificial sequence
  SiRNA target sequence
acagttacaaaaaaggaca

SEQ ID NO: 170115 - DNA, 19 bp, Artificial sequence
  SiRNA target sequence
cagttacaaaaaaggacat

SEQ ID NO: 170116 - DNA, 19 bp, Artificial sequence
  SiRNA target sequence
agttacaaaaaaggacata

SEQ ID NO: 170117 - DNA, 19 bp, Artificial sequence
  SiRNA target sequence
gttacaaaaaaggacatat

SEQ ID NO: 170118 - DNA, 19 bp, Artificial sequence
  SiRNA target sequence
ttacaaaaaaggacatata

SEQ ID NO: 170119 - DNA, 19 bp, Artificial sequence
  SiRNA target sequence
tacaaaaaaggacatatag

SEQ ID NO: 170120 - DNA, 19 bp, Artificial sequence
  SiRNA target sequence
acaaaaaaggacatataga

SEQ ID NO: 170121 - DNA, 19 bp, Artificial sequence
  SiRNA target sequence
caaaaaaggacatatagaa

SEQ ID NO: 170122 - DNA, 19 bp, Artificial sequence
  SiRNA target sequence
aaaaaaggacatatagaaa

SEQ ID NO: 170123 - DNA, 19 bp, Artificial sequence
  SiRNA target sequence
aaaaaggacatatagaaaa

SEQ ID NO: 170124 - DNA, 19 bp, Artificial sequence
  SiRNA target sequence
aaaaggacatatagaaaaa

SEQ ID NO: 170125 - DNA, 19 bp, Artificial sequence
  SiRNA target sequence
aaaggacatatagaaaaat

SEQ ID NO: 170126 - DNA, 19 bp, Artificial sequence
  SiRNA target sequence
aaggacatatagaaaaata

SEQ ID NO: 170127 - DNA, 19 bp, Artificial sequence
  SiRNA target sequence
aggacatatagaaaaatag

SEQ ID NO: 170128 - DNA, 19 bp, Artificial sequence
  SiRNA target sequence
ggacatatagaaaaataga

SEQ ID NO: 170129 - DNA, 19 bp, Artificial sequence
  SiRNA target sequence
gacatatagaaaaatagaa

SEQ ID NO: 170130 - DNA, 19 bp, Artificial sequence
  SiRNA target sequence
acatatagaaaaatagaaa

SEQ ID NO: 170131 - DNA, 19 bp, Artificial sequence
  SiRNA target sequence
catatagaaaaatagaaac

SEQ ID NO: 170132 - DNA, 19 bp, Artificial sequence
  SiRNA target sequence
atatagaaaaatagaaaca

SEQ ID NO: 170133 - DNA, 19 bp, Artificial sequence
  SiRNA target sequence
tatagaaaaatagaaacaa

SEQ ID NO: 170134 - DNA, 19 bp, Artificial sequence
  SiRNA target sequence
atagaaaaatagaaacaaa

SEQ ID NO: 170135 - DNA, 19 bp, Artificial sequence
  SiRNA target sequence
tagaaaaatagaaacaaag

SEQ ID NO: 170136 - DNA, 19 bp, Artificial sequence
  SiRNA target sequence
agaaaaatagaaacaaaga

SEQ ID NO: 170137 - DNA, 19 bp, Artificial sequence
  SiRNA target sequence
gaaaaatagaaacaaagaa

SEQ ID NO: 170138 - DNA, 19 bp, Artificial sequence
  SiRNA target sequence
aaaaatagaaacaaagaaa

SEQ ID NO: 170139 - DNA, 19 bp, Artificial sequence
  SiRNA target sequence
aaaatagaaacaaagaaag

SEQ ID NO: 170140 - DNA, 19 bp, Artificial sequence
  SiRNA target sequence
aaatagaaacaaagaaagt

SEQ ID NO: 170141 - DNA, 19 bp, Artificial sequence
  SiRNA target sequence
aatagaaacaaagaaagtt

SEQ ID NO: 170142 - DNA, 19 bp, Artificial sequence
  SiRNA target sequence
atagaaacaaagaaagtta

SEQ ID NO: 170143 - DNA, 19 bp, Artificial sequence
  SiRNA target sequence
tagaaacaaagaaagttaa

SEQ ID NO: 170144 - DNA, 19 bp, Artificial sequence
  SiRNA target sequence
agaaacaaagaaagttaat

SEQ ID NO: 170145 - DNA, 19 bp, Artificial sequence
  SiRNA target sequence
gaaacaaagaaagttaatt

SEQ ID NO: 170146 - DNA, 19 bp, Artificial sequence
  SiRNA target sequence
aaacaaagaaagttaattt

SEQ ID NO: 170147 - DNA, 19 bp, Artificial sequence
  SiRNA target sequence
aacaaagaaagttaatttt

SEQ ID NO: 170148 - DNA, 19 bp, Artificial sequence
  SiRNA target sequence
acaaagaaagttaatttta

SEQ ID NO: 170149 - DNA, 19 bp, Artificial sequence
  SiRNA target sequence
caaagaaagttaattttaa

SEQ ID NO: 170150 - DNA, 19 bp, Artificial sequence
  SiRNA target sequence
aaagaaagttaattttaaa

SEQ ID NO: 170151 - DNA, 19 bp, Artificial sequence
  SiRNA target sequence
aagaaagttaattttaaaa

SEQ ID NO: 170152 - DNA, 19 bp, Artificial sequence
  SiRNA target sequence
agaaagttaattttaaaat

SEQ ID NO: 170153 - DNA, 19 bp, Artificial sequence
  SiRNA target sequence
gaaagttaattttaaaata

SEQ ID NO: 170154 - DNA, 19 bp, Artificial sequence
  SiRNA target sequence
aaagttaattttaaaatag

SEQ ID NO: 170155 - DNA, 19 bp, Artificial sequence
  SiRNA target sequence
aagttaattttaaaataga

SEQ ID NO: 170156 - DNA, 19 bp, Artificial sequence
  SiRNA target sequence
agttaattttaaaatagaa

SEQ ID NO: 170157 - DNA, 19 bp, Artificial sequence
  SiRNA target sequence
gttaattttaaaatagaat

SEQ ID NO: 170158 - DNA, 19 bp, Artificial sequence
  SiRNA target sequence
ttaattttaaaatagaatg

SEQ ID NO: 170159 - DNA, 19 bp, Artificial sequence
  SiRNA target sequence
taattttaaaatagaatgg

SEQ ID NO: 170160 - DNA, 19 bp, Artificial sequence
  SiRNA target sequence
aattttaaaatagaatggt

SEQ ID NO: 170161 - DNA, 19 bp, Artificial sequence
  SiRNA target sequence
attttaaaatagaatggta

SEQ ID NO: 170162 - DNA, 19 bp, Artificial sequence
  SiRNA target sequence
ttttaaaatagaatggtaa

SEQ ID NO: 170163 - DNA, 20 bp, Artificial sequence
  SiRNA target sequence
atgaatactgaaaataaacc

SEQ ID NO: 170164 - DNA, 20 bp, Artificial sequence
  SiRNA target sequence
tgaatactgaaaataaacca

SEQ ID NO: 170165 - DNA, 20 bp, Artificial sequence
  SiRNA target sequence
gaatactgaaaataaaccat

SEQ ID NO: 170166 - DNA, 20 bp, Artificial sequence
  SiRNA target sequence
aatactgaaaataaaccatg

SEQ ID NO: 170167 - DNA, 20 bp, Artificial sequence
  SiRNA target sequence
atactgaaaataaaccatgt

SEQ ID NO: 170168 - DNA, 20 bp, Artificial sequence
  SiRNA target sequence
tactgaaaataaaccatgta

SEQ ID NO: 170169 - DNA, 20 bp, Artificial sequence
  SiRNA target sequence
actgaaaataaaccatgtat

SEQ ID NO: 170170 - DNA, 20 bp, Artificial sequence
  SiRNA target sequence
ctgaaaataaaccatgtatt

SEQ ID NO: 170171 - DNA, 20 bp, Artificial sequence
  SiRNA target sequence
tgaaaataaaccatgtattt

SEQ ID NO: 170172 - DNA, 20 bp, Artificial sequence
  SiRNA target sequence
gaaaataaaccatgtatttc

SEQ ID NO: 170173 - DNA, 20 bp, Artificial sequence
  SiRNA target sequence
aaaataaaccatgtatttca

SEQ ID NO: 170174 - DNA, 20 bp, Artificial sequence
  SiRNA target sequence
aaataaaccatgtatttcac

SEQ ID NO: 170175 - DNA, 20 bp, Artificial sequence
  SiRNA target sequence
aataaaccatgtatttcacc

SEQ ID NO: 170176 - DNA, 20 bp, Artificial sequence
  SiRNA target sequence
ataaaccatgtatttcacca

SEQ ID NO: 170177 - DNA, 20 bp, Artificial sequence
  SiRNA target sequence
taaaccatgtatttcaccat

SEQ ID NO: 170178 - DNA, 20 bp, Artificial sequence
  SiRNA target sequence
aaaccatgtatttcaccatt

SEQ ID NO: 170179 - DNA, 20 bp, Artificial sequence
  SiRNA target sequence
aaccatgtatttcaccattt

SEQ ID NO: 170180 - DNA, 20 bp, Artificial sequence
  SiRNA target sequence
accatgtatttcaccattta

SEQ ID NO: 170181 - DNA, 20 bp, Artificial sequence
  SiRNA target sequence
ccatgtatttcaccatttac

SEQ ID NO: 170182 - DNA, 20 bp, Artificial sequence
  SiRNA target sequence
catgtatttcaccatttacc

SEQ ID NO: 170183 - DNA, 20 bp, Artificial sequence
  SiRNA target sequence
atgtatttcaccatttacct

SEQ ID NO: 170184 - DNA, 20 bp, Artificial sequence
  SiRNA target sequence
tgtatttcaccatttacctt

SEQ ID NO: 170185 - DNA, 20 bp, Artificial sequence
  SiRNA target sequence
gtatttcaccatttaccttt

SEQ ID NO: 170186 - DNA, 20 bp, Artificial sequence
  SiRNA target sequence
tatttcaccatttaccttta

SEQ ID NO: 170187 - DNA, 20 bp, Artificial sequence
  SiRNA target sequence
atttcaccatttacctttaa

SEQ ID NO: 170188 - DNA, 20 bp, Artificial sequence
  SiRNA target sequence
tttcaccatttacctttaaa

SEQ ID NO: 170189 - DNA, 20 bp, Artificial sequence
  SiRNA target sequence
ttcaccatttacctttaaac

SEQ ID NO: 170190 - DNA, 20 bp, Artificial sequence
  SiRNA target sequence
tcaccatttacctttaaact

SEQ ID NO: 170191 - DNA, 20 bp, Artificial sequence
  SiRNA target sequence
caccatttacctttaaacta

SEQ ID NO: 170192 - DNA, 20 bp, Artificial sequence
  SiRNA target sequence
accatttacctttaaactag

SEQ ID NO: 170193 - DNA, 20 bp, Artificial sequence
  SiRNA target sequence
ccatttacctttaaactaga

SEQ ID NO: 170194 - DNA, 20 bp, Artificial sequence
  SiRNA target sequence
catttacctttaaactagaa

SEQ ID NO: 170195 - DNA, 20 bp, Artificial sequence
  SiRNA target sequence
atttacctttaaactagaag

SEQ ID NO: 170196 - DNA, 20 bp, Artificial sequence
  SiRNA target sequence
tttacctttaaactagaaga

SEQ ID NO: 170197 - DNA, 20 bp, Artificial sequence
  SiRNA target sequence
ttacctttaaactagaagat

SEQ ID NO: 170198 - DNA, 20 bp, Artificial sequence
  SiRNA target sequence
tacctttaaactagaagatt

SEQ ID NO: 170199 - DNA, 20 bp, Artificial sequence
  SiRNA target sequence
acctttaaactagaagattg

SEQ ID NO: 170200 - DNA, 20 bp, Artificial sequence
  SiRNA target sequence
cctttaaactagaagattgc

SEQ ID NO: 170201 - DNA, 20 bp, Artificial sequence
  SiRNA target sequence
ctttaaactagaagattgcc

SEQ ID NO: 170202 - DNA, 20 bp, Artificial sequence
  SiRNA target sequence
tttaaactagaagattgcct

SEQ ID NO: 170203 - DNA, 20 bp, Artificial sequence
  SiRNA target sequence
ttaaactagaagattgcctg

SEQ ID NO: 170204 - DNA, 20 bp, Artificial sequence
  SiRNA target sequence
taaactagaagattgcctgg

SEQ ID NO: 170205 - DNA, 20 bp, Artificial sequence
  SiRNA target sequence
aaactagaagattgcctggc

SEQ ID NO: 170206 - DNA, 20 bp, Artificial sequence
  SiRNA target sequence
aactagaagattgcctggca

SEQ ID NO: 170207 - DNA, 20 bp, Artificial sequence
  SiRNA target sequence
actagaagattgcctggcat

SEQ ID NO: 170208 - DNA, 20 bp, Artificial sequence
  SiRNA target sequence
ctagaagattgcctggcatg

SEQ ID NO: 170209 - DNA, 20 bp, Artificial sequence
  SiRNA target sequence
tagaagattgcctggcatgt

SEQ ID NO: 170210 - DNA, 20 bp, Artificial sequence
  SiRNA target sequence
agaagattgcctggcatgtt

SEQ ID NO: 170211 - DNA, 20 bp, Artificial sequence
  SiRNA target sequence
gaagattgcctggcatgttc

SEQ ID NO: 170212 - DNA, 20 bp, Artificial sequence
  SiRNA target sequence
aagattgcctggcatgttcg

SEQ ID NO: 170213 - DNA, 20 bp, Artificial sequence
  SiRNA target sequence
agattgcctggcatgttcgg

SEQ ID NO: 170214 - DNA, 20 bp, Artificial sequence
  SiRNA target sequence
gattgcctggcatgttcggc

SEQ ID NO: 170215 - DNA, 20 bp, Artificial sequence
  SiRNA target sequence
attgcctggcatgttcggct

SEQ ID NO: 170216 - DNA, 20 bp, Artificial sequence
  SiRNA target sequence
ttgcctggcatgttcggctt

SEQ ID NO: 170217 - DNA, 20 bp, Artificial sequence
  SiRNA target sequence
tgcctggcatgttcggcttg

SEQ ID NO: 170218 - DNA, 20 bp, Artificial sequence
  SiRNA target sequence
gcctggcatgttcggcttgt

SEQ ID NO: 170219 - DNA, 20 bp, Artificial sequence
  SiRNA target sequence
cctggcatgttcggcttgta

SEQ ID NO: 170220 - DNA, 20 bp, Artificial sequence
  SiRNA target sequence
ctggcatgttcggcttgtat

SEQ ID NO: 170221 - DNA, 20 bp, Artificial sequence
  SiRNA target sequence
tggcatgttcggcttgtatt

SEQ ID NO: 170222 - DNA, 20 bp, Artificial sequence
  SiRNA target sequence
ggcatgttcggcttgtattg

SEQ ID NO: 170223 - DNA, 20 bp, Artificial sequence
  SiRNA target sequence
gcatgttcggcttgtattgc

SEQ ID NO: 170224 - DNA, 20 bp, Artificial sequence
  SiRNA target sequence
catgttcggcttgtattgct

SEQ ID NO: 170225 - DNA, 20 bp, Artificial sequence
  SiRNA target sequence
atgttcggcttgtattgctg

SEQ ID NO: 170226 - DNA, 20 bp, Artificial sequence
  SiRNA target sequence
tgttcggcttgtattgctga

SEQ ID NO: 170227 - DNA, 20 bp, Artificial sequence
  SiRNA target sequence
gttcggcttgtattgctgat

SEQ ID NO: 170228 - DNA, 20 bp, Artificial sequence
  SiRNA target sequence
ttcggcttgtattgctgatt

SEQ ID NO: 170229 - DNA, 20 bp, Artificial sequence
  SiRNA target sequence
tcggcttgtattgctgattt

SEQ ID NO: 170230 - DNA, 20 bp, Artificial sequence
  SiRNA target sequence
cggcttgtattgctgatttt

SEQ ID NO: 170231 - DNA, 20 bp, Artificial sequence
  SiRNA target sequence
ggcttgtattgctgattttt

SEQ ID NO: 170232 - DNA, 20 bp, Artificial sequence
  SiRNA target sequence
gcttgtattgctgatttttc

SEQ ID NO: 170233 - DNA, 20 bp, Artificial sequence
  SiRNA target sequence
cttgtattgctgatttttct

SEQ ID NO: 170234 - DNA, 20 bp, Artificial sequence
  SiRNA target sequence
ttgtattgctgatttttctg

SEQ ID NO: 170235 - DNA, 20 bp, Artificial sequence
  SiRNA target sequence
tgtattgctgatttttctgt

SEQ ID NO: 170236 - DNA, 20 bp, Artificial sequence
  SiRNA target sequence
gtattgctgatttttctgtt

SEQ ID NO: 170237 - DNA, 20 bp, Artificial sequence
  SiRNA target sequence
tattgctgatttttctgttc

SEQ ID NO: 170238 - DNA, 20 bp, Artificial sequence
  SiRNA target sequence
attgctgatttttctgttcc

SEQ ID NO: 170239 - DNA, 20 bp, Artificial sequence
  SiRNA target sequence
ttgctgatttttctgttcca

SEQ ID NO: 170240 - DNA, 20 bp, Artificial sequence
  SiRNA target sequence
tgctgatttttctgttccaa

SEQ ID NO: 170241 - DNA, 20 bp, Artificial sequence
  SiRNA target sequence
gctgatttttctgttccaaa

SEQ ID NO: 170242 - DNA, 20 bp, Artificial sequence
  SiRNA target sequence
ctgatttttctgttccaaaa

SEQ ID NO: 170243 - DNA, 20 bp, Artificial sequence
  SiRNA target sequence
tgatttttctgttccaaaaa

SEQ ID NO: 170244 - DNA, 20 bp, Artificial sequence
  SiRNA target sequence
gatttttctgttccaaaaat

SEQ ID NO: 170245 - DNA, 20 bp, Artificial sequence
  SiRNA target sequence
atttttctgttccaaaaatt

SEQ ID NO: 170246 - DNA, 20 bp, Artificial sequence
  SiRNA target sequence
tttttctgttccaaaaattc

SEQ ID NO: 170247 - DNA, 20 bp, Artificial sequence
  SiRNA target sequence
ttttctgttccaaaaattcc

SEQ ID NO: 170248 - DNA, 20 bp, Artificial sequence
  SiRNA target sequence
tttctgttccaaaaattcct

SEQ ID NO: 170249 - DNA, 20 bp, Artificial sequence
  SiRNA target sequence
ttctgttccaaaaattccta

SEQ ID NO: 170250 - DNA, 20 bp, Artificial sequence
  SiRNA target sequence
tctgttccaaaaattcctac

SEQ ID NO: 170251 - DNA, 20 bp, Artificial sequence
  SiRNA target sequence
ctgttccaaaaattcctact

SEQ ID NO: 170252 - DNA, 20 bp, Artificial sequence
  SiRNA target sequence
tgttccaaaaattcctactt

SEQ ID NO: 170253 - DNA, 20 bp, Artificial sequence
  SiRNA target sequence
gttccaaaaattcctactta

SEQ ID NO: 170254 - DNA, 20 bp, Artificial sequence
  SiRNA target sequence
ttccaaaaattcctacttac

SEQ ID NO: 170255 - DNA, 20 bp, Artificial sequence
  SiRNA target sequence
tccaaaaattcctacttaca

SEQ ID NO: 170256 - DNA, 20 bp, Artificial sequence
  SiRNA target sequence
ccaaaaattcctacttacac

SEQ ID NO: 170257 - DNA, 20 bp, Artificial sequence
  SiRNA target sequence
caaaaattcctacttacaca

SEQ ID NO: 170258 - DNA, 20 bp, Artificial sequence
  SiRNA target sequence
aaaaattcctacttacacag

SEQ ID NO: 170259 - DNA, 20 bp, Artificial sequence
  SiRNA target sequence
aaaattcctacttacacaga

SEQ ID NO: 170260 - DNA, 20 bp, Artificial sequence
  SiRNA target sequence
aaattcctacttacacagaa

SEQ ID NO: 170261 - DNA, 20 bp, Artificial sequence
  SiRNA target sequence
aattcctacttacacagaac

SEQ ID NO: 170262 - DNA, 20 bp, Artificial sequence
  SiRNA target sequence
attcctacttacacagaact

SEQ ID NO: 170263 - DNA, 20 bp, Artificial sequence
  SiRNA target sequence
ttcctacttacacagaactg

SEQ ID NO: 170264 - DNA, 20 bp, Artificial sequence
  SiRNA target sequence
tcctacttacacagaactga

SEQ ID NO: 170265 - DNA, 20 bp, Artificial sequence
  SiRNA target sequence
cctacttacacagaactgaa

SEQ ID NO: 170266 - DNA, 20 bp, Artificial sequence
  SiRNA target sequence
ctacttacacagaactgaaa

SEQ ID NO: 170267 - DNA, 20 bp, Artificial sequence
  SiRNA target sequence
tacttacacagaactgaaag

SEQ ID NO: 170268 - DNA, 20 bp, Artificial sequence
  SiRNA target sequence
acttacacagaactgaaaga

SEQ ID NO: 170269 - DNA, 20 bp, Artificial sequence
  SiRNA target sequence
cttacacagaactgaaagat

SEQ ID NO: 170270 - DNA, 20 bp, Artificial sequence
  SiRNA target sequence
ttacacagaactgaaagatg

SEQ ID NO: 170271 - DNA, 20 bp, Artificial sequence
  SiRNA target sequence
tacacagaactgaaagatgt

SEQ ID NO: 170272 - DNA, 20 bp, Artificial sequence
  SiRNA target sequence
acacagaactgaaagatgtc

SEQ ID NO: 170273 - DNA, 20 bp, Artificial sequence
  SiRNA target sequence
cacagaactgaaagatgtcc

SEQ ID NO: 170274 - DNA, 20 bp, Artificial sequence
  SiRNA target sequence
acagaactgaaagatgtccc

SEQ ID NO: 170275 - DNA, 20 bp, Artificial sequence
  SiRNA target sequence
cagaactgaaagatgtccct

SEQ ID NO: 170276 - DNA, 20 bp, Artificial sequence
  SiRNA target sequence
agaactgaaagatgtccctt

SEQ ID NO: 170277 - DNA, 20 bp, Artificial sequence
  SiRNA target sequence
gaactgaaagatgtcccttt

SEQ ID NO: 170278 - DNA, 20 bp, Artificial sequence
  SiRNA target sequence
aactgaaagatgtcccttta

SEQ ID NO: 170279 - DNA, 20 bp, Artificial sequence
  SiRNA target sequence
actgaaagatgtccctttaa

SEQ ID NO: 170280 - DNA, 20 bp, Artificial sequence
  SiRNA target sequence
ctgaaagatgtccctttaac

SEQ ID NO: 170281 - DNA, 20 bp, Artificial sequence
  SiRNA target sequence
tgaaagatgtccctttaaca

SEQ ID NO: 170282 - DNA, 20 bp, Artificial sequence
  SiRNA target sequence
gaaagatgtccctttaacat

SEQ ID NO: 170283 - DNA, 20 bp, Artificial sequence
  SiRNA target sequence
aaagatgtccctttaacatt

SEQ ID NO: 170284 - DNA, 20 bp, Artificial sequence
  SiRNA target sequence
aagatgtccctttaacattt

SEQ ID NO: 170285 - DNA, 20 bp, Artificial sequence
  SiRNA target sequence
agatgtccctttaacatttt

SEQ ID NO: 170286 - DNA, 20 bp, Artificial sequence
  SiRNA target sequence
gatgtccctttaacattttt

SEQ ID NO: 170287 - DNA, 20 bp, Artificial sequence
  SiRNA target sequence
atgtccctttaacattttta

SEQ ID NO: 170288 - DNA, 20 bp, Artificial sequence
  SiRNA target sequence
tgtccctttaacatttttat

SEQ ID NO: 170289 - DNA, 20 bp, Artificial sequence
  SiRNA target sequence
gtccctttaacatttttatt

SEQ ID NO: 170290 - DNA, 20 bp, Artificial sequence
  SiRNA target sequence
tccctttaacatttttatta

SEQ ID NO: 170291 - DNA, 20 bp, Artificial sequence
  SiRNA target sequence
ccctttaacatttttattat

SEQ ID NO: 170292 - DNA, 20 bp, Artificial sequence
  SiRNA target sequence
cctttaacatttttattatc

SEQ ID NO: 170293 - DNA, 20 bp, Artificial sequence
  SiRNA target sequence
ctttaacatttttattatca

SEQ ID NO: 170294 - DNA, 20 bp, Artificial sequence
  SiRNA target sequence
tttaacatttttattatcac

SEQ ID NO: 170295 - DNA, 20 bp, Artificial sequence
  SiRNA target sequence
ttaacatttttattatcacc

SEQ ID NO: 170296 - DNA, 20 bp, Artificial sequence
  SiRNA target sequence
taacatttttattatcacca

SEQ ID NO: 170297 - DNA, 20 bp, Artificial sequence
  SiRNA target sequence
aacatttttattatcaccac

SEQ ID NO: 170298 - DNA, 20 bp, Artificial sequence
  SiRNA target sequence
acatttttattatcaccaca

SEQ ID NO: 170299 - DNA, 20 bp, Artificial sequence
  SiRNA target sequence
catttttattatcaccacat

SEQ ID NO: 170300 - DNA, 20 bp, Artificial sequence
  SiRNA target sequence
atttttattatcaccacatt

SEQ ID NO: 170301 - DNA, 20 bp, Artificial sequence
  SiRNA target sequence
tttttattatcaccacattc

SEQ ID NO: 170302 - DNA, 20 bp, Artificial sequence
  SiRNA target sequence
ttttattatcaccacattcg

SEQ ID NO: 170303 - DNA, 20 bp, Artificial sequence
  SiRNA target sequence
tttattatcaccacattcga

SEQ ID NO: 170304 - DNA, 20 bp, Artificial sequence
  SiRNA target sequence
ttattatcaccacattcgaa

SEQ ID NO: 170305 - DNA, 20 bp, Artificial sequence
  SiRNA target sequence
tattatcaccacattcgaaa

SEQ ID NO: 170306 - DNA, 20 bp, Artificial sequence
  SiRNA target sequence
attatcaccacattcgaaaa

SEQ ID NO: 170307 - DNA, 20 bp, Artificial sequence
  SiRNA target sequence
ttatcaccacattcgaaaat

SEQ ID NO: 170308 - DNA, 20 bp, Artificial sequence
  SiRNA target sequence
tatcaccacattcgaaaatg

SEQ ID NO: 170309 - DNA, 20 bp, Artificial sequence
  SiRNA target sequence
atcaccacattcgaaaatga

SEQ ID NO: 170310 - DNA, 20 bp, Artificial sequence
  SiRNA target sequence
tcaccacattcgaaaatgaa

SEQ ID NO: 170311 - DNA, 20 bp, Artificial sequence
  SiRNA target sequence
caccacattcgaaaatgaat

SEQ ID NO: 170312 - DNA, 20 bp, Artificial sequence
  SiRNA target sequence
accacattcgaaaatgaata

SEQ ID NO: 170313 - DNA, 20 bp, Artificial sequence
  SiRNA target sequence
ccacattcgaaaatgaatat

SEQ ID NO: 170314 - DNA, 20 bp, Artificial sequence
  SiRNA target sequence
cacattcgaaaatgaatatg

SEQ ID NO: 170315 - DNA, 20 bp, Artificial sequence
  SiRNA target sequence
acattcgaaaatgaatatgt

SEQ ID NO: 170316 - DNA, 20 bp, Artificial sequence
  SiRNA target sequence
cattcgaaaatgaatatgta

SEQ ID NO: 170317 - DNA, 20 bp, Artificial sequence
  SiRNA target sequence
attcgaaaatgaatatgtat

SEQ ID NO: 170318 - DNA, 20 bp, Artificial sequence
  SiRNA target sequence
ttcgaaaatgaatatgtatg

SEQ ID NO: 170319 - DNA, 20 bp, Artificial sequence
  SiRNA target sequence
tcgaaaatgaatatgtatgc

SEQ ID NO: 170320 - DNA, 20 bp, Artificial sequence
  SiRNA target sequence
cgaaaatgaatatgtatgca

SEQ ID NO: 170321 - DNA, 20 bp, Artificial sequence
  SiRNA target sequence
gaaaatgaatatgtatgcac

SEQ ID NO: 170322 - DNA, 20 bp, Artificial sequence
  SiRNA target sequence
aaaatgaatatgtatgcaca

SEQ ID NO: 170323 - DNA, 20 bp, Artificial sequence
  SiRNA target sequence
aaatgaatatgtatgcacac

SEQ ID NO: 170324 - DNA, 20 bp, Artificial sequence
  SiRNA target sequence
aatgaatatgtatgcacact

SEQ ID NO: 170325 - DNA, 20 bp, Artificial sequence
  SiRNA target sequence
atgaatatgtatgcacacta

SEQ ID NO: 170326 - DNA, 20 bp, Artificial sequence
  SiRNA target sequence
tgaatatgtatgcacactat

SEQ ID NO: 170327 - DNA, 20 bp, Artificial sequence
  SiRNA target sequence
gaatatgtatgcacactata

SEQ ID NO: 170328 - DNA, 20 bp, Artificial sequence
  SiRNA target sequence
aatatgtatgcacactataa

SEQ ID NO: 170329 - DNA, 20 bp, Artificial sequence
  SiRNA target sequence
atatgtatgcacactataac

SEQ ID NO: 170330 - DNA, 20 bp, Artificial sequence
  SiRNA target sequence
tatgtatgcacactataaca

SEQ ID NO: 170331 - DNA, 20 bp, Artificial sequence
  SiRNA target sequence
atgtatgcacactataacaa

SEQ ID NO: 170332 - DNA, 20 bp, Artificial sequence
  SiRNA target sequence
tgtatgcacactataacaat

SEQ ID NO: 170333 - DNA, 20 bp, Artificial sequence
  SiRNA target sequence
gtatgcacactataacaatc

SEQ ID NO: 170334 - DNA, 20 bp, Artificial sequence
  SiRNA target sequence
tatgcacactataacaatca

SEQ ID NO: 170335 - DNA, 20 bp, Artificial sequence
  SiRNA target sequence
atgcacactataacaatcat

SEQ ID NO: 170336 - DNA, 20 bp, Artificial sequence
  SiRNA target sequence
tgcacactataacaatcata

SEQ ID NO: 170337 - DNA, 20 bp, Artificial sequence
  SiRNA target sequence
gcacactataacaatcatat

SEQ ID NO: 170338 - DNA, 20 bp, Artificial sequence
  SiRNA target sequence
cacactataacaatcatata

SEQ ID NO: 170339 - DNA, 20 bp, Artificial sequence
  SiRNA target sequence
acactataacaatcatataa

SEQ ID NO: 170340 - DNA, 20 bp, Artificial sequence
  SiRNA target sequence
cactataacaatcatataat

SEQ ID NO: 170341 - DNA, 20 bp, Artificial sequence
  SiRNA target sequence
actataacaatcatataatg

SEQ ID NO: 170342 - DNA, 20 bp, Artificial sequence
  SiRNA target sequence
ctataacaatcatataatgt

SEQ ID NO: 170343 - DNA, 20 bp, Artificial sequence
  SiRNA target sequence
tataacaatcatataatgtc

SEQ ID NO: 170344 - DNA, 20 bp, Artificial sequence
  SiRNA target sequence
ataacaatcatataatgtcc

SEQ ID NO: 170345 - DNA, 20 bp, Artificial sequence
  SiRNA target sequence
taacaatcatataatgtcct

SEQ ID NO: 170346 - DNA, 20 bp, Artificial sequence
  SiRNA target sequence
aacaatcatataatgtcctt

SEQ ID NO: 170347 - DNA, 20 bp, Artificial sequence
  SiRNA target sequence
acaatcatataatgtccttt

SEQ ID NO: 170348 - DNA, 20 bp, Artificial sequence
  SiRNA target sequence
caatcatataatgtccttta

SEQ ID NO: 170349 - DNA, 20 bp, Artificial sequence
  SiRNA target sequence
aatcatataatgtcctttag

SEQ ID NO: 170350 - DNA, 20 bp, Artificial sequence
  SiRNA target sequence
atcatataatgtcctttagt

SEQ ID NO: 170351 - DNA, 20 bp, Artificial sequence
  SiRNA target sequence
tcatataatgtcctttagtg

SEQ ID NO: 170352 - DNA, 20 bp, Artificial sequence
  SiRNA target sequence
catataatgtcctttagtga

SEQ ID NO: 170353 - DNA, 20 bp, Artificial sequence
  SiRNA target sequence
atataatgtcctttagtgat

SEQ ID NO: 170354 - DNA, 20 bp, Artificial sequence
  SiRNA target sequence
tataatgtcctttagtgatt

SEQ ID NO: 170355 - DNA, 20 bp, Artificial sequence
  SiRNA target sequence
ataatgtcctttagtgattt

SEQ ID NO: 170356 - DNA, 20 bp, Artificial sequence
  SiRNA target sequence
taatgtcctttagtgatttt

SEQ ID NO: 170357 - DNA, 20 bp, Artificial sequence
  SiRNA target sequence
aatgtcctttagtgattttg

SEQ ID NO: 170358 - DNA, 20 bp, Artificial sequence
  SiRNA target sequence
atgtcctttagtgattttga

SEQ ID NO: 170359 - DNA, 20 bp, Artificial sequence
  SiRNA target sequence
tgtcctttagtgattttgaa

SEQ ID NO: 170360 - DNA, 20 bp, Artificial sequence
  SiRNA target sequence
gtcctttagtgattttgaat

SEQ ID NO: 170361 - DNA, 20 bp, Artificial sequence
  SiRNA target sequence
tcctttagtgattttgaata

SEQ ID NO: 170362 - DNA, 20 bp, Artificial sequence
  SiRNA target sequence
cctttagtgattttgaatat

SEQ ID NO: 170363 - DNA, 20 bp, Artificial sequence
  SiRNA target sequence
ctttagtgattttgaatatc

SEQ ID NO: 170364 - DNA, 20 bp, Artificial sequence
  SiRNA target sequence
tttagtgattttgaatatca

SEQ ID NO: 170365 - DNA, 20 bp, Artificial sequence
  SiRNA target sequence
ttagtgattttgaatatcac

SEQ ID NO: 170366 - DNA, 20 bp, Artificial sequence
  SiRNA target sequence
tagtgattttgaatatcact

SEQ ID NO: 170367 - DNA, 20 bp, Artificial sequence
  SiRNA target sequence
agtgattttgaatatcactt

SEQ ID NO: 170368 - DNA, 20 bp, Artificial sequence
  SiRNA target sequence
gtgattttgaatatcactta

SEQ ID NO: 170369 - DNA, 20 bp, Artificial sequence
  SiRNA target sequence
tgattttgaatatcacttaa

SEQ ID NO: 170370 - DNA, 20 bp, Artificial sequence
  SiRNA target sequence
gattttgaatatcacttaat

SEQ ID NO: 170371 - DNA, 20 bp, Artificial sequence
  SiRNA target sequence
attttgaatatcacttaatt

SEQ ID NO: 170372 - DNA, 20 bp, Artificial sequence
  SiRNA target sequence
ttttgaatatcacttaattt

SEQ ID NO: 170373 - DNA, 20 bp, Artificial sequence
  SiRNA target sequence
tttgaatatcacttaatttc

SEQ ID NO: 170374 - DNA, 20 bp, Artificial sequence
  SiRNA target sequence
ttgaatatcacttaatttca

SEQ ID NO: 170375 - DNA, 20 bp, Artificial sequence
  SiRNA target sequence
tgaatatcacttaatttcat

SEQ ID NO: 170376 - DNA, 20 bp, Artificial sequence
  SiRNA target sequence
gaatatcacttaatttcatt

SEQ ID NO: 170377 - DNA, 20 bp, Artificial sequence
  SiRNA target sequence
aatatcacttaatttcattt

SEQ ID NO: 170378 - DNA, 20 bp, Artificial sequence
  SiRNA target sequence
atatcacttaatttcattta

SEQ ID NO: 170379 - DNA, 20 bp, Artificial sequence
  SiRNA target sequence
tatcacttaatttcatttat

SEQ ID NO: 170380 - DNA, 20 bp, Artificial sequence
  SiRNA target sequence
atcacttaatttcatttata

SEQ ID NO: 170381 - DNA, 20 bp, Artificial sequence
  SiRNA target sequence
tcacttaatttcatttataa

SEQ ID NO: 170382 - DNA, 20 bp, Artificial sequence
  SiRNA target sequence
cacttaatttcatttataaa

SEQ ID NO: 170383 - DNA, 20 bp, Artificial sequence
  SiRNA target sequence
acttaatttcatttataaaa

SEQ ID NO: 170384 - DNA, 20 bp, Artificial sequence
  SiRNA target sequence
cttaatttcatttataaaac

SEQ ID NO: 170385 - DNA, 20 bp, Artificial sequence
  SiRNA target sequence
ttaatttcatttataaaact

SEQ ID NO: 170386 - DNA, 20 bp, Artificial sequence
  SiRNA target sequence
taatttcatttataaaacta

SEQ ID NO: 170387 - DNA, 20 bp, Artificial sequence
  SiRNA target sequence
aatttcatttataaaactaa

SEQ ID NO: 170388 - DNA, 20 bp, Artificial sequence
  SiRNA target sequence
atttcatttataaaactaaa

SEQ ID NO: 170389 - DNA, 20 bp, Artificial sequence
  SiRNA target sequence
tttcatttataaaactaaaa

SEQ ID NO: 170390 - DNA, 20 bp, Artificial sequence
  SiRNA target sequence
ttcatttataaaactaaaat

SEQ ID NO: 170391 - DNA, 20 bp, Artificial sequence
  SiRNA target sequence
tcatttataaaactaaaatt

SEQ ID NO: 170392 - DNA, 20 bp, Artificial sequence
  SiRNA target sequence
catttataaaactaaaattt

SEQ ID NO: 170393 - DNA, 20 bp, Artificial sequence
  SiRNA target sequence
atttataaaactaaaattta

SEQ ID NO: 170394 - DNA, 20 bp, Artificial sequence
  SiRNA target sequence
tttataaaactaaaatttaa

SEQ ID NO: 170395 - DNA, 20 bp, Artificial sequence
  SiRNA target sequence
ttataaaactaaaatttaat

SEQ ID NO: 170396 - DNA, 20 bp, Artificial sequence
  SiRNA target sequence
tataaaactaaaatttaatg

SEQ ID NO: 170397 - DNA, 20 bp, Artificial sequence
  SiRNA target sequence
ataaaactaaaatttaatgt

SEQ ID NO: 170398 - DNA, 20 bp, Artificial sequence
  SiRNA target sequence
taaaactaaaatttaatgta

SEQ ID NO: 170399 - DNA, 20 bp, Artificial sequence
  SiRNA target sequence
aaaactaaaatttaatgtaa

SEQ ID NO: 170400 - DNA, 20 bp, Artificial sequence
  SiRNA target sequence
aaactaaaatttaatgtaat

SEQ ID NO: 170401 - DNA, 20 bp, Artificial sequence
  SiRNA target sequence
aactaaaatttaatgtaata

SEQ ID NO: 170402 - DNA, 20 bp, Artificial sequence
  SiRNA target sequence
actaaaatttaatgtaataa

SEQ ID NO: 170403 - DNA, 20 bp, Artificial sequence
  SiRNA target sequence
ctaaaatttaatgtaataaa

SEQ ID NO: 170404 - DNA, 20 bp, Artificial sequence
  SiRNA target sequence
taaaatttaatgtaataaaa

SEQ ID NO: 170405 - DNA, 20 bp, Artificial sequence
  SiRNA target sequence
aaaatttaatgtaataaaag

SEQ ID NO: 170406 - DNA, 20 bp, Artificial sequence
  SiRNA target sequence
aaatttaatgtaataaaagt

SEQ ID NO: 170407 - DNA, 20 bp, Artificial sequence
  SiRNA target sequence
aatttaatgtaataaaagta

SEQ ID NO: 170408 - DNA, 20 bp, Artificial sequence
  SiRNA target sequence
atttaatgtaataaaagtat

SEQ ID NO: 170409 - DNA, 20 bp, Artificial sequence
  SiRNA target sequence
tttaatgtaataaaagtata

SEQ ID NO: 170410 - DNA, 20 bp, Artificial sequence
  SiRNA target sequence
ttaatgtaataaaagtatat

SEQ ID NO: 170411 - DNA, 20 bp, Artificial sequence
  SiRNA target sequence
taatgtaataaaagtatatg

SEQ ID NO: 170412 - DNA, 20 bp, Artificial sequence
  SiRNA target sequence
aatgtaataaaagtatatga

SEQ ID NO: 170413 - DNA, 20 bp, Artificial sequence
  SiRNA target sequence
atgtaataaaagtatatgat

SEQ ID NO: 170414 - DNA, 20 bp, Artificial sequence
  SiRNA target sequence
tgtaataaaagtatatgata

SEQ ID NO: 170415 - DNA, 20 bp, Artificial sequence
  SiRNA target sequence
gtaataaaagtatatgatac

SEQ ID NO: 170416 - DNA, 20 bp, Artificial sequence
  SiRNA target sequence
taataaaagtatatgataca

SEQ ID NO: 170417 - DNA, 20 bp, Artificial sequence
  SiRNA target sequence
aataaaagtatatgatacat

SEQ ID NO: 170418 - DNA, 20 bp, Artificial sequence
  SiRNA target sequence
ataaaagtatatgatacatc

SEQ ID NO: 170419 - DNA, 20 bp, Artificial sequence
  SiRNA target sequence
taaaagtatatgatacatct

SEQ ID NO: 170420 - DNA, 20 bp, Artificial sequence
  SiRNA target sequence
aaaagtatatgatacatctt

SEQ ID NO: 170421 - DNA, 20 bp, Artificial sequence
  SiRNA target sequence
aaagtatatgatacatctta

SEQ ID NO: 170422 - DNA, 20 bp, Artificial sequence
  SiRNA target sequence
aagtatatgatacatcttat

SEQ ID NO: 170423 - DNA, 20 bp, Artificial sequence
  SiRNA target sequence
agtatatgatacatcttatg

SEQ ID NO: 170424 - DNA, 20 bp, Artificial sequence
  SiRNA target sequence
gtatatgatacatcttatgt

SEQ ID NO: 170425 - DNA, 20 bp, Artificial sequence
  SiRNA target sequence
tatatgatacatcttatgtc

SEQ ID NO: 170426 - DNA, 20 bp, Artificial sequence
  SiRNA target sequence
atatgatacatcttatgtca

SEQ ID NO: 170427 - DNA, 20 bp, Artificial sequence
  SiRNA target sequence
tatgatacatcttatgtcaa

SEQ ID NO: 170428 - DNA, 20 bp, Artificial sequence
  SiRNA target sequence
atgatacatcttatgtcaaa

SEQ ID NO: 170429 - DNA, 20 bp, Artificial sequence
  SiRNA target sequence
tgatacatcttatgtcaaaa

SEQ ID NO: 170430 - DNA, 20 bp, Artificial sequence
  SiRNA target sequence
gatacatcttatgtcaaaaa

SEQ ID NO: 170431 - DNA, 20 bp, Artificial sequence
  SiRNA target sequence
atacatcttatgtcaaaaat

SEQ ID NO: 170432 - DNA, 20 bp, Artificial sequence
  SiRNA target sequence
tacatcttatgtcaaaaata

SEQ ID NO: 170433 - DNA, 20 bp, Artificial sequence
  SiRNA target sequence
acatcttatgtcaaaaatat

SEQ ID NO: 170434 - DNA, 20 bp, Artificial sequence
  SiRNA target sequence
catcttatgtcaaaaatatt

SEQ ID NO: 170435 - DNA, 20 bp, Artificial sequence
  SiRNA target sequence
atcttatgtcaaaaatattc

SEQ ID NO: 170436 - DNA, 20 bp, Artificial sequence
  SiRNA target sequence
tcttatgtcaaaaatattct

SEQ ID NO: 170437 - DNA, 20 bp, Artificial sequence
  SiRNA target sequence
cttatgtcaaaaatattctg

SEQ ID NO: 170438 - DNA, 20 bp, Artificial sequence
  SiRNA target sequence
ttatgtcaaaaatattctgt

SEQ ID NO: 170439 - DNA, 20 bp, Artificial sequence
  SiRNA target sequence
tatgtcaaaaatattctgta

SEQ ID NO: 170440 - DNA, 20 bp, Artificial sequence
  SiRNA target sequence
atgtcaaaaatattctgtat

SEQ ID NO: 170441 - DNA, 20 bp, Artificial sequence
  SiRNA target sequence
tgtcaaaaatattctgtatg

SEQ ID NO: 170442 - DNA, 20 bp, Artificial sequence
  SiRNA target sequence
gtcaaaaatattctgtatga

SEQ ID NO: 170443 - DNA, 20 bp, Artificial sequence
  SiRNA target sequence
tcaaaaatattctgtatgat

SEQ ID NO: 170444 - DNA, 20 bp, Artificial sequence
  SiRNA target sequence
caaaaatattctgtatgata

SEQ ID NO: 170445 - DNA, 20 bp, Artificial sequence
  SiRNA target sequence
aaaaatattctgtatgatag

SEQ ID NO: 170446 - DNA, 20 bp, Artificial sequence
  SiRNA target sequence
aaaatattctgtatgatagt

SEQ ID NO: 170447 - DNA, 20 bp, Artificial sequence
  SiRNA target sequence
aaatattctgtatgatagtg

SEQ ID NO: 170448 - DNA, 20 bp, Artificial sequence
  SiRNA target sequence
aatattctgtatgatagtgt

SEQ ID NO: 170449 - DNA, 20 bp, Artificial sequence
  SiRNA target sequence
atattctgtatgatagtgtt

SEQ ID NO: 170450 - DNA, 20 bp, Artificial sequence
  SiRNA target sequence
tattctgtatgatagtgttt

SEQ ID NO: 170451 - DNA, 20 bp, Artificial sequence
  SiRNA target sequence
attctgtatgatagtgttta

SEQ ID NO: 170452 - DNA, 20 bp, Artificial sequence
  SiRNA target sequence
ttctgtatgatagtgtttat

SEQ ID NO: 170453 - DNA, 20 bp, Artificial sequence
  SiRNA target sequence
tctgtatgatagtgtttatg

SEQ ID NO: 170454 - DNA, 20 bp, Artificial sequence
  SiRNA target sequence
ctgtatgatagtgtttatga

SEQ ID NO: 170455 - DNA, 20 bp, Artificial sequence
  SiRNA target sequence
tgtatgatagtgtttatgag

SEQ ID NO: 170456 - DNA, 20 bp, Artificial sequence
  SiRNA target sequence
gtatgatagtgtttatgagg

SEQ ID NO: 170457 - DNA, 20 bp, Artificial sequence
  SiRNA target sequence
tatgatagtgtttatgagga

SEQ ID NO: 170458 - DNA, 20 bp, Artificial sequence
  SiRNA target sequence
atgatagtgtttatgaggaa

SEQ ID NO: 170459 - DNA, 20 bp, Artificial sequence
  SiRNA target sequence
tgatagtgtttatgaggaaa

SEQ ID NO: 170460 - DNA, 20 bp, Artificial sequence
  SiRNA target sequence
gatagtgtttatgaggaaag

SEQ ID NO: 170461 - DNA, 20 bp, Artificial sequence
  SiRNA target sequence
atagtgtttatgaggaaagc

SEQ ID NO: 170462 - DNA, 20 bp, Artificial sequence
  SiRNA target sequence
tagtgtttatgaggaaagca

SEQ ID NO: 170463 - DNA, 20 bp, Artificial sequence
  SiRNA target sequence
agtgtttatgaggaaagcac

SEQ ID NO: 170464 - DNA, 20 bp, Artificial sequence
  SiRNA target sequence
gtgtttatgaggaaagcacg

SEQ ID NO: 170465 - DNA, 20 bp, Artificial sequence
  SiRNA target sequence
tgtttatgaggaaagcacga

SEQ ID NO: 170466 - DNA, 20 bp, Artificial sequence
  SiRNA target sequence
gtttatgaggaaagcacgag

SEQ ID NO: 170467 - DNA, 20 bp, Artificial sequence
  SiRNA target sequence
tttatgaggaaagcacgaga

SEQ ID NO: 170468 - DNA, 20 bp, Artificial sequence
  SiRNA target sequence
ttatgaggaaagcacgagag

SEQ ID NO: 170469 - DNA, 20 bp, Artificial sequence
  SiRNA target sequence
tatgaggaaagcacgagaga

SEQ ID NO: 170470 - DNA, 20 bp, Artificial sequence
  SiRNA target sequence
atgaggaaagcacgagagac

SEQ ID NO: 170471 - DNA, 20 bp, Artificial sequence
  SiRNA target sequence
tgaggaaagcacgagagaca

SEQ ID NO: 170472 - DNA, 20 bp, Artificial sequence
  SiRNA target sequence
gaggaaagcacgagagacaa

SEQ ID NO: 170473 - DNA, 20 bp, Artificial sequence
  SiRNA target sequence
aggaaagcacgagagacaaa

SEQ ID NO: 170474 - DNA, 20 bp, Artificial sequence
  SiRNA target sequence
ggaaagcacgagagacaaaa

SEQ ID NO: 170475 - DNA, 20 bp, Artificial sequence
  SiRNA target sequence
gaaagcacgagagacaaaat

SEQ ID NO: 170476 - DNA, 20 bp, Artificial sequence
  SiRNA target sequence
aaagcacgagagacaaaata

SEQ ID NO: 170477 - DNA, 20 bp, Artificial sequence
  SiRNA target sequence
aagcacgagagacaaaataa

SEQ ID NO: 170478 - DNA, 20 bp, Artificial sequence
  SiRNA target sequence
agcacgagagacaaaataat

SEQ ID NO: 170479 - DNA, 20 bp, Artificial sequence
  SiRNA target sequence
gcacgagagacaaaataata

SEQ ID NO: 170480 - DNA, 20 bp, Artificial sequence
  SiRNA target sequence
cacgagagacaaaataataa

SEQ ID NO: 170481 - DNA, 20 bp, Artificial sequence
  SiRNA target sequence
acgagagacaaaataataat

SEQ ID NO: 170482 - DNA, 20 bp, Artificial sequence
  SiRNA target sequence
cgagagacaaaataataata

SEQ ID NO: 170483 - DNA, 20 bp, Artificial sequence
  SiRNA target sequence
gagagacaaaataataataa

SEQ ID NO: 170484 - DNA, 20 bp, Artificial sequence
  SiRNA target sequence
agagacaaaataataataag

SEQ ID NO: 170485 - DNA, 20 bp, Artificial sequence
  SiRNA target sequence
gagacaaaataataataagt

SEQ ID NO: 170486 - DNA, 20 bp, Artificial sequence
  SiRNA target sequence
agacaaaataataataagtg

SEQ ID NO: 170487 - DNA, 20 bp, Artificial sequence
  SiRNA target sequence
gacaaaataataataagtga

SEQ ID NO: 170488 - DNA, 20 bp, Artificial sequence
  SiRNA target sequence
acaaaataataataagtgac

SEQ ID NO: 170489 - DNA, 20 bp, Artificial sequence
  SiRNA target sequence
caaaataataataagtgact

SEQ ID NO: 170490 - DNA, 20 bp, Artificial sequence
  SiRNA target sequence
aaaataataataagtgactg

SEQ ID NO: 170491 - DNA, 20 bp, Artificial sequence
  SiRNA target sequence
aaataataataagtgactgt

SEQ ID NO: 170492 - DNA, 20 bp, Artificial sequence
  SiRNA target sequence
aataataataagtgactgtc

SEQ ID NO: 170493 - DNA, 20 bp, Artificial sequence
  SiRNA target sequence
ataataataagtgactgtcc

SEQ ID NO: 170494 - DNA, 20 bp, Artificial sequence
  SiRNA target sequence
taataataagtgactgtcct

SEQ ID NO: 170495 - DNA, 20 bp, Artificial sequence
  SiRNA target sequence
aataataagtgactgtcctg

SEQ ID NO: 170496 - DNA, 20 bp, Artificial sequence
  SiRNA target sequence
ataataagtgactgtcctgg

SEQ ID NO: 170497 - DNA, 20 bp, Artificial sequence
  SiRNA target sequence
taataagtgactgtcctggg

SEQ ID NO: 170498 - DNA, 20 bp, Artificial sequence
  SiRNA target sequence
aataagtgactgtcctggga

SEQ ID NO: 170499 - DNA, 20 bp, Artificial sequence
  SiRNA target sequence
ataagtgactgtcctgggac

SEQ ID NO: 170500 - DNA, 20 bp, Artificial sequence
  SiRNA target sequence
taagtgactgtcctgggact

SEQ ID NO: 170501 - DNA, 20 bp, Artificial sequence
  SiRNA target sequence
aagtgactgtcctgggactg

SEQ ID NO: 170502 - DNA, 20 bp, Artificial sequence
  SiRNA target sequence
agtgactgtcctgggactgt

SEQ ID NO: 170503 - DNA, 20 bp, Artificial sequence
  SiRNA target sequence
gtgactgtcctgggactgtt

SEQ ID NO: 170504 - DNA, 20 bp, Artificial sequence
  SiRNA target sequence
tgactgtcctgggactgttt

SEQ ID NO: 170505 - DNA, 20 bp, Artificial sequence
  SiRNA target sequence
gactgtcctgggactgtttc

SEQ ID NO: 170506 - DNA, 20 bp, Artificial sequence
  SiRNA target sequence
actgtcctgggactgtttca

SEQ ID NO: 170507 - DNA, 20 bp, Artificial sequence
  SiRNA target sequence
ctgtcctgggactgtttcat

SEQ ID NO: 170508 - DNA, 20 bp, Artificial sequence
  SiRNA target sequence
tgtcctgggactgtttcata

SEQ ID NO: 170509 - DNA, 20 bp, Artificial sequence
  SiRNA target sequence
gtcctgggactgtttcatat

SEQ ID NO: 170510 - DNA, 20 bp, Artificial sequence
  SiRNA target sequence
tcctgggactgtttcatata

SEQ ID NO: 170511 - DNA, 20 bp, Artificial sequence
  SiRNA target sequence
cctgggactgtttcatatat

SEQ ID NO: 170512 - DNA, 20 bp, Artificial sequence
  SiRNA target sequence
ctgggactgtttcatatatt

SEQ ID NO: 170513 - DNA, 20 bp, Artificial sequence
  SiRNA target sequence
tgggactgtttcatatattg

SEQ ID NO: 170514 - DNA, 20 bp, Artificial sequence
  SiRNA target sequence
gggactgtttcatatattga

SEQ ID NO: 170515 - DNA, 20 bp, Artificial sequence
  SiRNA target sequence
ggactgtttcatatattgaa

SEQ ID NO: 170516 - DNA, 20 bp, Artificial sequence
  SiRNA target sequence
gactgtttcatatattgaaa

SEQ ID NO: 170517 - DNA, 20 bp, Artificial sequence
  SiRNA target sequence
actgtttcatatattgaaag

SEQ ID NO: 170518 - DNA, 20 bp, Artificial sequence
  SiRNA target sequence
ctgtttcatatattgaaagg

SEQ ID NO: 170519 - DNA, 20 bp, Artificial sequence
  SiRNA target sequence
tgtttcatatattgaaaggc

SEQ ID NO: 170520 - DNA, 20 bp, Artificial sequence
  SiRNA target sequence
gtttcatatattgaaaggca

SEQ ID NO: 170521 - DNA, 20 bp, Artificial sequence
  SiRNA target sequence
tttcatatattgaaaggcaa

SEQ ID NO: 170522 - DNA, 20 bp, Artificial sequence
  SiRNA target sequence
ttcatatattgaaaggcaag

SEQ ID NO: 170523 - DNA, 20 bp, Artificial sequence
  SiRNA target sequence
tcatatattgaaaggcaagc

SEQ ID NO: 170524 - DNA, 20 bp, Artificial sequence
  SiRNA target sequence
catatattgaaaggcaagca

SEQ ID NO: 170525 - DNA, 20 bp, Artificial sequence
  SiRNA target sequence
atatattgaaaggcaagcac

SEQ ID NO: 170526 - DNA, 20 bp, Artificial sequence
  SiRNA target sequence
tatattgaaaggcaagcaca

SEQ ID NO: 170527 - DNA, 20 bp, Artificial sequence
  SiRNA target sequence
atattgaaaggcaagcacac

SEQ ID NO: 170528 - DNA, 20 bp, Artificial sequence
  SiRNA target sequence
tattgaaaggcaagcacacc

SEQ ID NO: 170529 - DNA, 20 bp, Artificial sequence
  SiRNA target sequence
attgaaaggcaagcacacca

SEQ ID NO: 170530 - DNA, 20 bp, Artificial sequence
  SiRNA target sequence
ttgaaaggcaagcacaccat

SEQ ID NO: 170531 - DNA, 20 bp, Artificial sequence
  SiRNA target sequence
tgaaaggcaagcacaccatt

SEQ ID NO: 170532 - DNA, 20 bp, Artificial sequence
  SiRNA target sequence
gaaaggcaagcacaccattt

SEQ ID NO: 170533 - DNA, 20 bp, Artificial sequence
  SiRNA target sequence
aaaggcaagcacaccattta

SEQ ID NO: 170534 - DNA, 20 bp, Artificial sequence
  SiRNA target sequence
aaggcaagcacaccatttaa

SEQ ID NO: 170535 - DNA, 20 bp, Artificial sequence
  SiRNA target sequence
aggcaagcacaccatttaat

SEQ ID NO: 170536 - DNA, 20 bp, Artificial sequence
  SiRNA target sequence
ggcaagcacaccatttaatt

SEQ ID NO: 170537 - DNA, 20 bp, Artificial sequence
  SiRNA target sequence
gcaagcacaccatttaattg

SEQ ID NO: 170538 - DNA, 20 bp, Artificial sequence
  SiRNA target sequence
caagcacaccatttaattga

SEQ ID NO: 170539 - DNA, 20 bp, Artificial sequence
  SiRNA target sequence
aagcacaccatttaattgaa

SEQ ID NO: 170540 - DNA, 20 bp, Artificial sequence
  SiRNA target sequence
agcacaccatttaattgaat

SEQ ID NO: 170541 - DNA, 20 bp, Artificial sequence
  SiRNA target sequence
gcacaccatttaattgaata

SEQ ID NO: 170542 - DNA, 20 bp, Artificial sequence
  SiRNA target sequence
cacaccatttaattgaatat

SEQ ID NO: 170543 - DNA, 20 bp, Artificial sequence
  SiRNA target sequence
acaccatttaattgaatatt

SEQ ID NO: 170544 - DNA, 20 bp, Artificial sequence
  SiRNA target sequence
caccatttaattgaatattt

SEQ ID NO: 170545 - DNA, 20 bp, Artificial sequence
  SiRNA target sequence
accatttaattgaatattta

SEQ ID NO: 170546 - DNA, 20 bp, Artificial sequence
  SiRNA target sequence
ccatttaattgaatatttat

SEQ ID NO: 170547 - DNA, 20 bp, Artificial sequence
  SiRNA target sequence
catttaattgaatatttatc

SEQ ID NO: 170548 - DNA, 20 bp, Artificial sequence
  SiRNA target sequence
atttaattgaatatttatct

SEQ ID NO: 170549 - DNA, 20 bp, Artificial sequence
  SiRNA target sequence
tttaattgaatatttatctg

SEQ ID NO: 170550 - DNA, 20 bp, Artificial sequence
  SiRNA target sequence
ttaattgaatatttatctgt

SEQ ID NO: 170551 - DNA, 20 bp, Artificial sequence
  SiRNA target sequence
taattgaatatttatctgtt

SEQ ID NO: 170552 - DNA, 20 bp, Artificial sequence
  SiRNA target sequence
aattgaatatttatctgtta

SEQ ID NO: 170553 - DNA, 20 bp, Artificial sequence
  SiRNA target sequence
attgaatatttatctgttac

SEQ ID NO: 170554 - DNA, 20 bp, Artificial sequence
  SiRNA target sequence
ttgaatatttatctgttact

SEQ ID NO: 170555 - DNA, 20 bp, Artificial sequence
  SiRNA target sequence
tgaatatttatctgttactt

SEQ ID NO: 170556 - DNA, 20 bp, Artificial sequence
  SiRNA target sequence
gaatatttatctgttacttc

SEQ ID NO: 170557 - DNA, 20 bp, Artificial sequence
  SiRNA target sequence
aatatttatctgttacttct

SEQ ID NO: 170558 - DNA, 20 bp, Artificial sequence
  SiRNA target sequence
atatttatctgttacttcta

SEQ ID NO: 170559 - DNA, 20 bp, Artificial sequence
  SiRNA target sequence
tatttatctgttacttctac

SEQ ID NO: 170560 - DNA, 20 bp, Artificial sequence
  SiRNA target sequence
atttatctgttacttctaca

SEQ ID NO: 170561 - DNA, 20 bp, Artificial sequence
  SiRNA target sequence
tttatctgttacttctacac

SEQ ID NO: 170562 - DNA, 20 bp, Artificial sequence
  SiRNA target sequence
ttatctgttacttctacaca

SEQ ID NO: 170563 - DNA, 20 bp, Artificial sequence
  SiRNA target sequence
tatctgttacttctacacaa

SEQ ID NO: 170564 - DNA, 20 bp, Artificial sequence
  SiRNA target sequence
atctgttacttctacacaac

SEQ ID NO: 170565 - DNA, 20 bp, Artificial sequence
  SiRNA target sequence
tctgttacttctacacaaca

SEQ ID NO: 170566 - DNA, 20 bp, Artificial sequence
  SiRNA target sequence
ctgttacttctacacaacaa

SEQ ID NO: 170567 - DNA, 20 bp, Artificial sequence
  SiRNA target sequence
tgttacttctacacaacaac

SEQ ID NO: 170568 - DNA, 20 bp, Artificial sequence
  SiRNA target sequence
gttacttctacacaacaaca

SEQ ID NO: 170569 - DNA, 20 bp, Artificial sequence
  SiRNA target sequence
ttacttctacacaacaacaa

SEQ ID NO: 170570 - DNA, 20 bp, Artificial sequence
  SiRNA target sequence
tacttctacacaacaacaag

SEQ ID NO: 170571 - DNA, 20 bp, Artificial sequence
  SiRNA target sequence
acttctacacaacaacaagc

SEQ ID NO: 170572 - DNA, 20 bp, Artificial sequence
  SiRNA target sequence
cttctacacaacaacaagcc

SEQ ID NO: 170573 - DNA, 20 bp, Artificial sequence
  SiRNA target sequence
ttctacacaacaacaagcca

SEQ ID NO: 170574 - DNA, 20 bp, Artificial sequence
  SiRNA target sequence
tctacacaacaacaagccat

SEQ ID NO: 170575 - DNA, 20 bp, Artificial sequence
  SiRNA target sequence
ctacacaacaacaagccata

SEQ ID NO: 170576 - DNA, 20 bp, Artificial sequence
  SiRNA target sequence
tacacaacaacaagccataa

SEQ ID NO: 170577 - DNA, 20 bp, Artificial sequence
  SiRNA target sequence
acacaacaacaagccataaa

SEQ ID NO: 170578 - DNA, 20 bp, Artificial sequence
  SiRNA target sequence
cacaacaacaagccataaag

SEQ ID NO: 170579 - DNA, 20 bp, Artificial sequence
  SiRNA target sequence
acaacaacaagccataaagc

SEQ ID NO: 170580 - DNA, 20 bp, Artificial sequence
  SiRNA target sequence
caacaacaagccataaagct

SEQ ID NO: 170581 - DNA, 20 bp, Artificial sequence
  SiRNA target sequence
aacaacaagccataaagcta

SEQ ID NO: 170582 - DNA, 20 bp, Artificial sequence
  SiRNA target sequence
acaacaagccataaagctac

SEQ ID NO: 170583 - DNA, 20 bp, Artificial sequence
  SiRNA target sequence
caacaagccataaagctact

SEQ ID NO: 170584 - DNA, 20 bp, Artificial sequence
  SiRNA target sequence
aacaagccataaagctactt

SEQ ID NO: 170585 - DNA, 20 bp, Artificial sequence
  SiRNA target sequence
acaagccataaagctacttg

SEQ ID NO: 170586 - DNA, 20 bp, Artificial sequence
  SiRNA target sequence
caagccataaagctacttgc

SEQ ID NO: 170587 - DNA, 20 bp, Artificial sequence
  SiRNA target sequence
aagccataaagctacttgct

SEQ ID NO: 170588 - DNA, 20 bp, Artificial sequence
  SiRNA target sequence
agccataaagctacttgctc

SEQ ID NO: 170589 - DNA, 20 bp, Artificial sequence
  SiRNA target sequence
gccataaagctacttgctca

SEQ ID NO: 170590 - DNA, 20 bp, Artificial sequence
  SiRNA target sequence
ccataaagctacttgctcag

SEQ ID NO: 170591 - DNA, 20 bp, Artificial sequence
  SiRNA target sequence
cataaagctacttgctcagg

SEQ ID NO: 170592 - DNA, 20 bp, Artificial sequence
  SiRNA target sequence
ataaagctacttgctcaggg

SEQ ID NO: 170593 - DNA, 20 bp, Artificial sequence
  SiRNA target sequence
taaagctacttgctcagggg

SEQ ID NO: 170594 - DNA, 20 bp, Artificial sequence
  SiRNA target sequence
aaagctacttgctcaggggc

SEQ ID NO: 170595 - DNA, 20 bp, Artificial sequence
  SiRNA target sequence
aagctacttgctcaggggcg

SEQ ID NO: 170596 - DNA, 20 bp, Artificial sequence
  SiRNA target sequence
agctacttgctcaggggcga

SEQ ID NO: 170597 - DNA, 20 bp, Artificial sequence
  SiRNA target sequence
gctacttgctcaggggcgaa

SEQ ID NO: 170598 - DNA, 20 bp, Artificial sequence
  SiRNA target sequence
ctacttgctcaggggcgaag

SEQ ID NO: 170599 - DNA, 20 bp, Artificial sequence
  SiRNA target sequence
tacttgctcaggggcgaagt

SEQ ID NO: 170600 - DNA, 20 bp, Artificial sequence
  SiRNA target sequence
acttgctcaggggcgaagta

SEQ ID NO: 170601 - DNA, 20 bp, Artificial sequence
  SiRNA target sequence
cttgctcaggggcgaagtat

SEQ ID NO: 170602 - DNA, 20 bp, Artificial sequence
  SiRNA target sequence
ttgctcaggggcgaagtata

SEQ ID NO: 170603 - DNA, 20 bp, Artificial sequence
  SiRNA target sequence
tgctcaggggcgaagtataa

SEQ ID NO: 170604 - DNA, 20 bp, Artificial sequence
  SiRNA target sequence
gctcaggggcgaagtataag

SEQ ID NO: 170605 - DNA, 20 bp, Artificial sequence
  SiRNA target sequence
ctcaggggcgaagtataagt

SEQ ID NO: 170606 - DNA, 20 bp, Artificial sequence
  SiRNA target sequence
tcaggggcgaagtataagtg

SEQ ID NO: 170607 - DNA, 20 bp, Artificial sequence
  SiRNA target sequence
caggggcgaagtataagtgt

SEQ ID NO: 170608 - DNA, 20 bp, Artificial sequence
  SiRNA target sequence
aggggcgaagtataagtgtc

SEQ ID NO: 170609 - DNA, 20 bp, Artificial sequence
  SiRNA target sequence
ggggcgaagtataagtgtca

SEQ ID NO: 170610 - DNA, 20 bp, Artificial sequence
  SiRNA target sequence
gggcgaagtataagtgtcat

SEQ ID NO: 170611 - DNA, 20 bp, Artificial sequence
  SiRNA target sequence
ggcgaagtataagtgtcata

SEQ ID NO: 170612 - DNA, 20 bp, Artificial sequence
  SiRNA target sequence
gcgaagtataagtgtcatac

SEQ ID NO: 170613 - DNA, 20 bp, Artificial sequence
  SiRNA target sequence
cgaagtataagtgtcataca

SEQ ID NO: 170614 - DNA, 20 bp, Artificial sequence
  SiRNA target sequence
gaagtataagtgtcatacag

SEQ ID NO: 170615 - DNA, 20 bp, Artificial sequence
  SiRNA target sequence
aagtataagtgtcatacagt

SEQ ID NO: 170616 - DNA, 20 bp, Artificial sequence
  SiRNA target sequence
agtataagtgtcatacagtg

SEQ ID NO: 170617 - DNA, 20 bp, Artificial sequence
  SiRNA target sequence
gtataagtgtcatacagtgc

SEQ ID NO: 170618 - DNA, 20 bp, Artificial sequence
  SiRNA target sequence
tataagtgtcatacagtgct

SEQ ID NO: 170619 - DNA, 20 bp, Artificial sequence
  SiRNA target sequence
ataagtgtcatacagtgcta

SEQ ID NO: 170620 - DNA, 20 bp, Artificial sequence
  SiRNA target sequence
taagtgtcatacagtgctat

SEQ ID NO: 170621 - DNA, 20 bp, Artificial sequence
  SiRNA target sequence
aagtgtcatacagtgctatg

SEQ ID NO: 170622 - DNA, 20 bp, Artificial sequence
  SiRNA target sequence
agtgtcatacagtgctatga

SEQ ID NO: 170623 - DNA, 20 bp, Artificial sequence
  SiRNA target sequence
gtgtcatacagtgctatgat

SEQ ID NO: 170624 - DNA, 20 bp, Artificial sequence
  SiRNA target sequence
tgtcatacagtgctatgata

SEQ ID NO: 170625 - DNA, 20 bp, Artificial sequence
  SiRNA target sequence
gtcatacagtgctatgataa

SEQ ID NO: 170626 - DNA, 20 bp, Artificial sequence
  SiRNA target sequence
tcatacagtgctatgataaa

SEQ ID NO: 170627 - DNA, 20 bp, Artificial sequence
  SiRNA target sequence
catacagtgctatgataaat

SEQ ID NO: 170628 - DNA, 20 bp, Artificial sequence
  SiRNA target sequence
atacagtgctatgataaatt

SEQ ID NO: 170629 - DNA, 20 bp, Artificial sequence
  SiRNA target sequence
tacagtgctatgataaattt

SEQ ID NO: 170630 - DNA, 20 bp, Artificial sequence
  SiRNA target sequence
acagtgctatgataaatttt

SEQ ID NO: 170631 - DNA, 20 bp, Artificial sequence
  SiRNA target sequence
cagtgctatgataaattttt

SEQ ID NO: 170632 - DNA, 20 bp, Artificial sequence
  SiRNA target sequence
agtgctatgataaattttta

SEQ ID NO: 170633 - DNA, 20 bp, Artificial sequence
  SiRNA target sequence
gtgctatgataaatttttag

SEQ ID NO: 170634 - DNA, 20 bp, Artificial sequence
  SiRNA target sequence
tgctatgataaatttttaga

SEQ ID NO: 170635 - DNA, 20 bp, Artificial sequence
  SiRNA target sequence
gctatgataaatttttagag

SEQ ID NO: 170636 - DNA, 20 bp, Artificial sequence
  SiRNA target sequence
ctatgataaatttttagaga

SEQ ID NO: 170637 - DNA, 20 bp, Artificial sequence
  SiRNA target sequence
tatgataaatttttagagaa

SEQ ID NO: 170638 - DNA, 20 bp, Artificial sequence
  SiRNA target sequence
atgataaatttttagagaat

SEQ ID NO: 170639 - DNA, 20 bp, Artificial sequence
  SiRNA target sequence
tgataaatttttagagaata

SEQ ID NO: 170640 - DNA, 20 bp, Artificial sequence
  SiRNA target sequence
gataaatttttagagaatag

SEQ ID NO: 170641 - DNA, 20 bp, Artificial sequence
  SiRNA target sequence
ataaatttttagagaatagc

SEQ ID NO: 170642 - DNA, 20 bp, Artificial sequence
  SiRNA target sequence
taaatttttagagaatagcg

SEQ ID NO: 170643 - DNA, 20 bp, Artificial sequence
  SiRNA target sequence
aaatttttagagaatagcga

SEQ ID NO: 170644 - DNA, 20 bp, Artificial sequence
  SiRNA target sequence
aatttttagagaatagcgat

SEQ ID NO: 170645 - DNA, 20 bp, Artificial sequence
  SiRNA target sequence
atttttagagaatagcgatg

SEQ ID NO: 170646 - DNA, 20 bp, Artificial sequence
  SiRNA target sequence
tttttagagaatagcgatga

SEQ ID NO: 170647 - DNA, 20 bp, Artificial sequence
  SiRNA target sequence
ttttagagaatagcgatgat

SEQ ID NO: 170648 - DNA, 20 bp, Artificial sequence
  SiRNA target sequence
tttagagaatagcgatgatg

SEQ ID NO: 170649 - DNA, 20 bp, Artificial sequence
  SiRNA target sequence
ttagagaatagcgatgatgt

SEQ ID NO: 170650 - DNA, 20 bp, Artificial sequence
  SiRNA target sequence
tagagaatagcgatgatgtt

SEQ ID NO: 170651 - DNA, 20 bp, Artificial sequence
  SiRNA target sequence
agagaatagcgatgatgttt

SEQ ID NO: 170652 - DNA, 20 bp, Artificial sequence
  SiRNA target sequence
gagaatagcgatgatgtttt

SEQ ID NO: 170653 - DNA, 20 bp, Artificial sequence
  SiRNA target sequence
agaatagcgatgatgtttta

SEQ ID NO: 170654 - DNA, 20 bp, Artificial sequence
  SiRNA target sequence
gaatagcgatgatgttttaa

SEQ ID NO: 170655 - DNA, 20 bp, Artificial sequence
  SiRNA target sequence
aatagcgatgatgttttaac

SEQ ID NO: 170656 - DNA, 20 bp, Artificial sequence
  SiRNA target sequence
atagcgatgatgttttaact

SEQ ID NO: 170657 - DNA, 20 bp, Artificial sequence
  SiRNA target sequence
tagcgatgatgttttaacta

SEQ ID NO: 170658 - DNA, 20 bp, Artificial sequence
  SiRNA target sequence
agcgatgatgttttaactac

SEQ ID NO: 170659 - DNA, 20 bp, Artificial sequence
  SiRNA target sequence
gcgatgatgttttaactacc

SEQ ID NO: 170660 - DNA, 20 bp, Artificial sequence
  SiRNA target sequence
cgatgatgttttaactacct

SEQ ID NO: 170661 - DNA, 20 bp, Artificial sequence
  SiRNA target sequence
gatgatgttttaactaccta

SEQ ID NO: 170662 - DNA, 20 bp, Artificial sequence
  SiRNA target sequence
atgatgttttaactacctat

SEQ ID NO: 170663 - DNA, 20 bp, Artificial sequence
  SiRNA target sequence
tgatgttttaactacctatg

SEQ ID NO: 170664 - DNA, 20 bp, Artificial sequence
  SiRNA target sequence
gatgttttaactacctatga

SEQ ID NO: 170665 - DNA, 20 bp, Artificial sequence
  SiRNA target sequence
atgttttaactacctatgat

SEQ ID NO: 170666 - DNA, 20 bp, Artificial sequence
  SiRNA target sequence
tgttttaactacctatgatt

SEQ ID NO: 170667 - DNA, 20 bp, Artificial sequence
  SiRNA target sequence
gttttaactacctatgattt

SEQ ID NO: 170668 - DNA, 20 bp, Artificial sequence
  SiRNA target sequence
ttttaactacctatgatttt

SEQ ID NO: 170669 - DNA, 20 bp, Artificial sequence
  SiRNA target sequence
tttaactacctatgattttt

SEQ ID NO: 170670 - DNA, 20 bp, Artificial sequence
  SiRNA target sequence
ttaactacctatgattttta

SEQ ID NO: 170671 - DNA, 20 bp, Artificial sequence
  SiRNA target sequence
taactacctatgatttttat

SEQ ID NO: 170672 - DNA, 20 bp, Artificial sequence
  SiRNA target sequence
aactacctatgatttttata

SEQ ID NO: 170673 - DNA, 20 bp, Artificial sequence
  SiRNA target sequence
actacctatgatttttataa

SEQ ID NO: 170674 - DNA, 20 bp, Artificial sequence
  SiRNA target sequence
ctacctatgatttttataaa

SEQ ID NO: 170675 - DNA, 20 bp, Artificial sequence
  SiRNA target sequence
tacctatgatttttataaaa

SEQ ID NO: 170676 - DNA, 20 bp, Artificial sequence
  SiRNA target sequence
acctatgatttttataaaat

SEQ ID NO: 170677 - DNA, 20 bp, Artificial sequence
  SiRNA target sequence
cctatgatttttataaaatg

SEQ ID NO: 170678 - DNA, 20 bp, Artificial sequence
  SiRNA target sequence
ctatgatttttataaaatga

SEQ ID NO: 170679 - DNA, 20 bp, Artificial sequence
  SiRNA target sequence
tatgatttttataaaatgat

SEQ ID NO: 170680 - DNA, 20 bp, Artificial sequence
  SiRNA target sequence
atgatttttataaaatgatt

SEQ ID NO: 170681 - DNA, 20 bp, Artificial sequence
  SiRNA target sequence
tgatttttataaaatgattt

SEQ ID NO: 170682 - DNA, 20 bp, Artificial sequence
  SiRNA target sequence
gatttttataaaatgatttt

SEQ ID NO: 170683 - DNA, 20 bp, Artificial sequence
  SiRNA target sequence
atttttataaaatgattttg

SEQ ID NO: 170684 - DNA, 20 bp, Artificial sequence
  SiRNA target sequence
tttttataaaatgattttgg

SEQ ID NO: 170685 - DNA, 20 bp, Artificial sequence
  SiRNA target sequence
ttttataaaatgattttgga

SEQ ID NO: 170686 - DNA, 20 bp, Artificial sequence
  SiRNA target sequence
tttataaaatgattttggat

SEQ ID NO: 170687 - DNA, 20 bp, Artificial sequence
  SiRNA target sequence
ttataaaatgattttggatc

SEQ ID NO: 170688 - DNA, 20 bp, Artificial sequence
  SiRNA target sequence
tataaaatgattttggatct

SEQ ID NO: 170689 - DNA, 20 bp, Artificial sequence
  SiRNA target sequence
ataaaatgattttggatcta

SEQ ID NO: 170690 - DNA, 20 bp, Artificial sequence
  SiRNA target sequence
taaaatgattttggatctag

SEQ ID NO: 170691 - DNA, 20 bp, Artificial sequence
  SiRNA target sequence
aaaatgattttggatctagg

SEQ ID NO: 170692 - DNA, 20 bp, Artificial sequence
  SiRNA target sequence
aaatgattttggatctagga

SEQ ID NO: 170693 - DNA, 20 bp, Artificial sequence
  SiRNA target sequence
aatgattttggatctaggat

SEQ ID NO: 170694 - DNA, 20 bp, Artificial sequence
  SiRNA target sequence
atgattttggatctaggatt

SEQ ID NO: 170695 - DNA, 20 bp, Artificial sequence
  SiRNA target sequence
tgattttggatctaggattt

SEQ ID NO: 170696 - DNA, 20 bp, Artificial sequence
  SiRNA target sequence
gattttggatctaggatttt

SEQ ID NO: 170697 - DNA, 20 bp, Artificial sequence
  SiRNA target sequence
attttggatctaggattttt

SEQ ID NO: 170698 - DNA, 20 bp, Artificial sequence
  SiRNA target sequence
ttttggatctaggattttta

SEQ ID NO: 170699 - DNA, 20 bp, Artificial sequence
  SiRNA target sequence
tttggatctaggatttttac

SEQ ID NO: 170700 - DNA, 20 bp, Artificial sequence
  SiRNA target sequence
ttggatctaggatttttaca

SEQ ID NO: 170701 - DNA, 20 bp, Artificial sequence
  SiRNA target sequence
tggatctaggatttttacag

SEQ ID NO: 170702 - DNA, 20 bp, Artificial sequence
  SiRNA target sequence
ggatctaggatttttacagc

SEQ ID NO: 170703 - DNA, 20 bp, Artificial sequence
  SiRNA target sequence
gatctaggatttttacagca

SEQ ID NO: 170704 - DNA, 20 bp, Artificial sequence
  SiRNA target sequence
atctaggatttttacagcat

SEQ ID NO: 170705 - DNA, 20 bp, Artificial sequence
  SiRNA target sequence
tctaggatttttacagcata

SEQ ID NO: 170706 - DNA, 20 bp, Artificial sequence
  SiRNA target sequence
ctaggatttttacagcataa

SEQ ID NO: 170707 - DNA, 20 bp, Artificial sequence
  SiRNA target sequence
taggatttttacagcataat

SEQ ID NO: 170708 - DNA, 20 bp, Artificial sequence
  SiRNA target sequence
aggatttttacagcataatt

SEQ ID NO: 170709 - DNA, 20 bp, Artificial sequence
  SiRNA target sequence
ggatttttacagcataattt

SEQ ID NO: 170710 - DNA, 20 bp, Artificial sequence
  SiRNA target sequence
gatttttacagcataatttt

SEQ ID NO: 170711 - DNA, 20 bp, Artificial sequence
  SiRNA target sequence
atttttacagcataatttta

SEQ ID NO: 170712 - DNA, 20 bp, Artificial sequence
  SiRNA target sequence
tttttacagcataattttat

SEQ ID NO: 170713 - DNA, 20 bp, Artificial sequence
  SiRNA target sequence
ttttacagcataattttatt

SEQ ID NO: 170714 - DNA, 20 bp, Artificial sequence
  SiRNA target sequence
tttacagcataattttatta

SEQ ID NO: 170715 - DNA, 20 bp, Artificial sequence
  SiRNA target sequence
ttacagcataattttattaa

SEQ ID NO: 170716 - DNA, 20 bp, Artificial sequence
  SiRNA target sequence
tacagcataattttattaaa

SEQ ID NO: 170717 - DNA, 20 bp, Artificial sequence
  SiRNA target sequence
acagcataattttattaaag

SEQ ID NO: 170718 - DNA, 20 bp, Artificial sequence
  SiRNA target sequence
cagcataattttattaaagg

SEQ ID NO: 170719 - DNA, 20 bp, Artificial sequence
  SiRNA target sequence
agcataattttattaaagga

SEQ ID NO: 170720 - DNA, 20 bp, Artificial sequence
  SiRNA target sequence
gcataattttattaaaggaa

SEQ ID NO: 170721 - DNA, 20 bp, Artificial sequence
  SiRNA target sequence
cataattttattaaaggaac

SEQ ID NO: 170722 - DNA, 20 bp, Artificial sequence
  SiRNA target sequence
ataattttattaaaggaacc

SEQ ID NO: 170723 - DNA, 20 bp, Artificial sequence
  SiRNA target sequence
taattttattaaaggaacct

SEQ ID NO: 170724 - DNA, 20 bp, Artificial sequence
  SiRNA target sequence
aattttattaaaggaacctg

SEQ ID NO: 170725 - DNA, 20 bp, Artificial sequence
  SiRNA target sequence
attttattaaaggaacctgt

SEQ ID NO: 170726 - DNA, 20 bp, Artificial sequence
  SiRNA target sequence
ttttattaaaggaacctgtg

SEQ ID NO: 170727 - DNA, 20 bp, Artificial sequence
  SiRNA target sequence
tttattaaaggaacctgtga

SEQ ID NO: 170728 - DNA, 20 bp, Artificial sequence
  SiRNA target sequence
ttattaaaggaacctgtgag

SEQ ID NO: 170729 - DNA, 20 bp, Artificial sequence
  SiRNA target sequence
tattaaaggaacctgtgaga

SEQ ID NO: 170730 - DNA, 20 bp, Artificial sequence
  SiRNA target sequence
attaaaggaacctgtgagaa

SEQ ID NO: 170731 - DNA, 20 bp, Artificial sequence
  SiRNA target sequence
ttaaaggaacctgtgagaaa

SEQ ID NO: 170732 - DNA, 20 bp, Artificial sequence
  SiRNA target sequence
taaaggaacctgtgagaaat

SEQ ID NO: 170733 - DNA, 20 bp, Artificial sequence
  SiRNA target sequence
aaaggaacctgtgagaaatg

SEQ ID NO: 170734 - DNA, 20 bp, Artificial sequence
  SiRNA target sequence
aaggaacctgtgagaaatgg

SEQ ID NO: 170735 - DNA, 20 bp, Artificial sequence
  SiRNA target sequence
aggaacctgtgagaaatggg

SEQ ID NO: 170736 - DNA, 20 bp, Artificial sequence
  SiRNA target sequence
ggaacctgtgagaaatggga

SEQ ID NO: 170737 - DNA, 20 bp, Artificial sequence
  SiRNA target sequence
gaacctgtgagaaatgggag

SEQ ID NO: 170738 - DNA, 20 bp, Artificial sequence
  SiRNA target sequence
aacctgtgagaaatgggaga

SEQ ID NO: 170739 - DNA, 20 bp, Artificial sequence
  SiRNA target sequence
acctgtgagaaatgggagaa

SEQ ID NO: 170740 - DNA, 20 bp, Artificial sequence
  SiRNA target sequence
cctgtgagaaatgggagaag

SEQ ID NO: 170741 - DNA, 20 bp, Artificial sequence
  SiRNA target sequence
ctgtgagaaatgggagaagt

SEQ ID NO: 170742 - DNA, 20 bp, Artificial sequence
  SiRNA target sequence
tgtgagaaatgggagaagtg

SEQ ID NO: 170743 - DNA, 20 bp, Artificial sequence
  SiRNA target sequence
gtgagaaatgggagaagtgt

SEQ ID NO: 170744 - DNA, 20 bp, Artificial sequence
  SiRNA target sequence
tgagaaatgggagaagtgta

SEQ ID NO: 170745 - DNA, 20 bp, Artificial sequence
  SiRNA target sequence
gagaaatgggagaagtgtac

SEQ ID NO: 170746 - DNA, 20 bp, Artificial sequence
  SiRNA target sequence
agaaatgggagaagtgtact

SEQ ID NO: 170747 - DNA, 20 bp, Artificial sequence
  SiRNA target sequence
gaaatgggagaagtgtacta

SEQ ID NO: 170748 - DNA, 20 bp, Artificial sequence
  SiRNA target sequence
aaatgggagaagtgtactat

SEQ ID NO: 170749 - DNA, 20 bp, Artificial sequence
  SiRNA target sequence
aatgggagaagtgtactatt

SEQ ID NO: 170750 - DNA, 20 bp, Artificial sequence
  SiRNA target sequence
atgggagaagtgtactattg

SEQ ID NO: 170751 - DNA, 20 bp, Artificial sequence
  SiRNA target sequence
tgggagaagtgtactattgg

SEQ ID NO: 170752 - DNA, 20 bp, Artificial sequence
  SiRNA target sequence
gggagaagtgtactattgga

SEQ ID NO: 170753 - DNA, 20 bp, Artificial sequence
  SiRNA target sequence
ggagaagtgtactattggat

SEQ ID NO: 170754 - DNA, 20 bp, Artificial sequence
  SiRNA target sequence
gagaagtgtactattggata

SEQ ID NO: 170755 - DNA, 20 bp, Artificial sequence
  SiRNA target sequence
agaagtgtactattggatat

SEQ ID NO: 170756 - DNA, 20 bp, Artificial sequence
  SiRNA target sequence
gaagtgtactattggatatc

SEQ ID NO: 170757 - DNA, 20 bp, Artificial sequence
  SiRNA target sequence
aagtgtactattggatatca

SEQ ID NO: 170758 - DNA, 20 bp, Artificial sequence
  SiRNA target sequence
agtgtactattggatatcat

SEQ ID NO: 170759 - DNA, 20 bp, Artificial sequence
  SiRNA target sequence
gtgtactattggatatcatt

SEQ ID NO: 170760 - DNA, 20 bp, Artificial sequence
  SiRNA target sequence
tgtactattggatatcatta

SEQ ID NO: 170761 - DNA, 20 bp, Artificial sequence
  SiRNA target sequence
gtactattggatatcattat

SEQ ID NO: 170762 - DNA, 20 bp, Artificial sequence
  SiRNA target sequence
tactattggatatcattatg

SEQ ID NO: 170763 - DNA, 20 bp, Artificial sequence
  SiRNA target sequence
actattggatatcattatgg

SEQ ID NO: 170764 - DNA, 20 bp, Artificial sequence
  SiRNA target sequence
ctattggatatcattatgga

SEQ ID NO: 170765 - DNA, 20 bp, Artificial sequence
  SiRNA target sequence
tattggatatcattatggat

SEQ ID NO: 170766 - DNA, 20 bp, Artificial sequence
  SiRNA target sequence
attggatatcattatggata

SEQ ID NO: 170767 - DNA, 20 bp, Artificial sequence
  SiRNA target sequence
ttggatatcattatggatat

SEQ ID NO: 170768 - DNA, 20 bp, Artificial sequence
  SiRNA target sequence
tggatatcattatggatatt

SEQ ID NO: 170769 - DNA, 20 bp, Artificial sequence
  SiRNA target sequence
ggatatcattatggatattt

SEQ ID NO: 170770 - DNA, 20 bp, Artificial sequence
  SiRNA target sequence
gatatcattatggatattta

SEQ ID NO: 170771 - DNA, 20 bp, Artificial sequence
  SiRNA target sequence
atatcattatggatatttag

SEQ ID NO: 170772 - DNA, 20 bp, Artificial sequence
  SiRNA target sequence
tatcattatggatatttaga

SEQ ID NO: 170773 - DNA, 20 bp, Artificial sequence
  SiRNA target sequence
atcattatggatatttagaa

SEQ ID NO: 170774 - DNA, 20 bp, Artificial sequence
  SiRNA target sequence
tcattatggatatttagaac

SEQ ID NO: 170775 - DNA, 20 bp, Artificial sequence
  SiRNA target sequence
cattatggatatttagaaca

SEQ ID NO: 170776 - DNA, 20 bp, Artificial sequence
  SiRNA target sequence
attatggatatttagaacac

SEQ ID NO: 170777 - DNA, 20 bp, Artificial sequence
  SiRNA target sequence
ttatggatatttagaacaca

SEQ ID NO: 170778 - DNA, 20 bp, Artificial sequence
  SiRNA target sequence
tatggatatttagaacacat

SEQ ID NO: 170779 - DNA, 20 bp, Artificial sequence
  SiRNA target sequence
atggatatttagaacacata

SEQ ID NO: 170780 - DNA, 20 bp, Artificial sequence
  SiRNA target sequence
tggatatttagaacacatat

SEQ ID NO: 170781 - DNA, 20 bp, Artificial sequence
  SiRNA target sequence
ggatatttagaacacatatt

SEQ ID NO: 170782 - DNA, 20 bp, Artificial sequence
  SiRNA target sequence
gatatttagaacacatatta

SEQ ID NO: 170783 - DNA, 20 bp, Artificial sequence
  SiRNA target sequence
atatttagaacacatattaa

SEQ ID NO: 170784 - DNA, 20 bp, Artificial sequence
  SiRNA target sequence
tatttagaacacatattaaa

SEQ ID NO: 170785 - DNA, 20 bp, Artificial sequence
  SiRNA target sequence
atttagaacacatattaaat

SEQ ID NO: 170786 - DNA, 20 bp, Artificial sequence
  SiRNA target sequence
tttagaacacatattaaata

SEQ ID NO: 170787 - DNA, 20 bp, Artificial sequence
  SiRNA target sequence
ttagaacacatattaaataa

SEQ ID NO: 170788 - DNA, 20 bp, Artificial sequence
  SiRNA target sequence
tagaacacatattaaataag

SEQ ID NO: 170789 - DNA, 20 bp, Artificial sequence
  SiRNA target sequence
agaacacatattaaataaga

SEQ ID NO: 170790 - DNA, 20 bp, Artificial sequence
  SiRNA target sequence
gaacacatattaaataagaa

SEQ ID NO: 170791 - DNA, 20 bp, Artificial sequence
  SiRNA target sequence
aacacatattaaataagaag

SEQ ID NO: 170792 - DNA, 20 bp, Artificial sequence
  SiRNA target sequence
acacatattaaataagaaga

SEQ ID NO: 170793 - DNA, 20 bp, Artificial sequence
  SiRNA target sequence
cacatattaaataagaagaa

SEQ ID NO: 170794 - DNA, 20 bp, Artificial sequence
  SiRNA target sequence
acatattaaataagaagaac

SEQ ID NO: 170795 - DNA, 20 bp, Artificial sequence
  SiRNA target sequence
catattaaataagaagaaca

SEQ ID NO: 170796 - DNA, 20 bp, Artificial sequence
  SiRNA target sequence
atattaaataagaagaacaa

SEQ ID NO: 170797 - DNA, 20 bp, Artificial sequence
  SiRNA target sequence
tattaaataagaagaacaat

SEQ ID NO: 170798 - DNA, 20 bp, Artificial sequence
  SiRNA target sequence
attaaataagaagaacaatt

SEQ ID NO: 170799 - DNA, 20 bp, Artificial sequence
  SiRNA target sequence
ttaaataagaagaacaatta

SEQ ID NO: 170800 - DNA, 20 bp, Artificial sequence
  SiRNA target sequence
taaataagaagaacaattat

SEQ ID NO: 170801 - DNA, 20 bp, Artificial sequence
  SiRNA target sequence
aaataagaagaacaattatt

SEQ ID NO: 170802 - DNA, 20 bp, Artificial sequence
  SiRNA target sequence
aataagaagaacaattattt

SEQ ID NO: 170803 - DNA, 20 bp, Artificial sequence
  SiRNA target sequence
ataagaagaacaattattta

SEQ ID NO: 170804 - DNA, 20 bp, Artificial sequence
  SiRNA target sequence
taagaagaacaattatttaa

SEQ ID NO: 170805 - DNA, 20 bp, Artificial sequence
  SiRNA target sequence
aagaagaacaattatttaac

SEQ ID NO: 170806 - DNA, 20 bp, Artificial sequence
  SiRNA target sequence
agaagaacaattatttaaca

SEQ ID NO: 170807 - DNA, 20 bp, Artificial sequence
  SiRNA target sequence
gaagaacaattatttaacaa

SEQ ID NO: 170808 - DNA, 20 bp, Artificial sequence
  SiRNA target sequence
aagaacaattatttaacaaa

SEQ ID NO: 170809 - DNA, 20 bp, Artificial sequence
  SiRNA target sequence
agaacaattatttaacaaaa

SEQ ID NO: 170810 - DNA, 20 bp, Artificial sequence
  SiRNA target sequence
gaacaattatttaacaaaaa

SEQ ID NO: 170811 - DNA, 20 bp, Artificial sequence
  SiRNA target sequence
aacaattatttaacaaaaaa

SEQ ID NO: 170812 - DNA, 20 bp, Artificial sequence
  SiRNA target sequence
acaattatttaacaaaaaat

SEQ ID NO: 170813 - DNA, 20 bp, Artificial sequence
  SiRNA target sequence
caattatttaacaaaaaatg

SEQ ID NO: 170814 - DNA, 20 bp, Artificial sequence
  SiRNA target sequence
aattatttaacaaaaaatga

SEQ ID NO: 170815 - DNA, 20 bp, Artificial sequence
  SiRNA target sequence
attatttaacaaaaaatgat

SEQ ID NO: 170816 - DNA, 20 bp, Artificial sequence
  SiRNA target sequence
ttatttaacaaaaaatgata

SEQ ID NO: 170817 - DNA, 20 bp, Artificial sequence
  SiRNA target sequence
tatttaacaaaaaatgatag

SEQ ID NO: 170818 - DNA, 20 bp, Artificial sequence
  SiRNA target sequence
atttaacaaaaaatgatagt

SEQ ID NO: 170819 - DNA, 20 bp, Artificial sequence
  SiRNA target sequence
tttaacaaaaaatgatagta

SEQ ID NO: 170820 - DNA, 20 bp, Artificial sequence
  SiRNA target sequence
ttaacaaaaaatgatagtat

SEQ ID NO: 170821 - DNA, 20 bp, Artificial sequence
  SiRNA target sequence
taacaaaaaatgatagtata

SEQ ID NO: 170822 - DNA, 20 bp, Artificial sequence
  SiRNA target sequence
aacaaaaaatgatagtataa

SEQ ID NO: 170823 - DNA, 20 bp, Artificial sequence
  SiRNA target sequence
acaaaaaatgatagtataaa

SEQ ID NO: 170824 - DNA, 20 bp, Artificial sequence
  SiRNA target sequence
caaaaaatgatagtataaaa

SEQ ID NO: 170825 - DNA, 20 bp, Artificial sequence
  SiRNA target sequence
aaaaaatgatagtataaaaa

SEQ ID NO: 170826 - DNA, 20 bp, Artificial sequence
  SiRNA target sequence
aaaaatgatagtataaaaat

SEQ ID NO: 170827 - DNA, 20 bp, Artificial sequence
  SiRNA target sequence
aaaatgatagtataaaaata

SEQ ID NO: 170828 - DNA, 20 bp, Artificial sequence
  SiRNA target sequence
aaatgatagtataaaaatat

SEQ ID NO: 170829 - DNA, 20 bp, Artificial sequence
  SiRNA target sequence
aatgatagtataaaaatatt

SEQ ID NO: 170830 - DNA, 20 bp, Artificial sequence
  SiRNA target sequence
atgatagtataaaaatattt

SEQ ID NO: 170831 - DNA, 20 bp, Artificial sequence
  SiRNA target sequence
tgatagtataaaaatattta

SEQ ID NO: 170832 - DNA, 20 bp, Artificial sequence
  SiRNA target sequence
gatagtataaaaatatttaa

SEQ ID NO: 170833 - DNA, 20 bp, Artificial sequence
  SiRNA target sequence
atagtataaaaatatttaac

SEQ ID NO: 170834 - DNA, 20 bp, Artificial sequence
  SiRNA target sequence
tagtataaaaatatttaaca

SEQ ID NO: 170835 - DNA, 20 bp, Artificial sequence
  SiRNA target sequence
agtataaaaatatttaacag

SEQ ID NO: 170836 - DNA, 20 bp, Artificial sequence
  SiRNA target sequence
gtataaaaatatttaacagt

SEQ ID NO: 170837 - DNA, 20 bp, Artificial sequence
  SiRNA target sequence
tataaaaatatttaacagta

SEQ ID NO: 170838 - DNA, 20 bp, Artificial sequence
  SiRNA target sequence
ataaaaatatttaacagtaa

SEQ ID NO: 170839 - DNA, 20 bp, Artificial sequence
  SiRNA target sequence
taaaaatatttaacagtaaa

SEQ ID NO: 170840 - DNA, 20 bp, Artificial sequence
  SiRNA target sequence
aaaaatatttaacagtaaaa

SEQ ID NO: 170841 - DNA, 20 bp, Artificial sequence
  SiRNA target sequence
aaaatatttaacagtaaaaa

SEQ ID NO: 170842 - DNA, 20 bp, Artificial sequence
  SiRNA target sequence
aaatatttaacagtaaaaat

SEQ ID NO: 170843 - DNA, 20 bp, Artificial sequence
  SiRNA target sequence
aatatttaacagtaaaaatg

SEQ ID NO: 170844 - DNA, 20 bp, Artificial sequence
  SiRNA target sequence
atatttaacagtaaaaatga

SEQ ID NO: 170845 - DNA, 20 bp, Artificial sequence
  SiRNA target sequence
tatttaacagtaaaaatgag

SEQ ID NO: 170846 - DNA, 20 bp, Artificial sequence
  SiRNA target sequence
atttaacagtaaaaatgagg

SEQ ID NO: 170847 - DNA, 20 bp, Artificial sequence
  SiRNA target sequence
tttaacagtaaaaatgagga

SEQ ID NO: 170848 - DNA, 20 bp, Artificial sequence
  SiRNA target sequence
ttaacagtaaaaatgaggag

SEQ ID NO: 170849 - DNA, 20 bp, Artificial sequence
  SiRNA target sequence
taacagtaaaaatgaggagg

SEQ ID NO: 170850 - DNA, 20 bp, Artificial sequence
  SiRNA target sequence
aacagtaaaaatgaggaggt

SEQ ID NO: 170851 - DNA, 20 bp, Artificial sequence
  SiRNA target sequence
acagtaaaaatgaggaggta

SEQ ID NO: 170852 - DNA, 20 bp, Artificial sequence
  SiRNA target sequence
cagtaaaaatgaggaggtaa

SEQ ID NO: 170853 - DNA, 20 bp, Artificial sequence
  SiRNA target sequence
agtaaaaatgaggaggtaag

SEQ ID NO: 170854 - DNA, 20 bp, Artificial sequence
  SiRNA target sequence
gtaaaaatgaggaggtaagg

SEQ ID NO: 170855 - DNA, 20 bp, Artificial sequence
  SiRNA target sequence
taaaaatgaggaggtaaggt

SEQ ID NO: 170856 - DNA, 20 bp, Artificial sequence
  SiRNA target sequence
aaaaatgaggaggtaaggtt

SEQ ID NO: 170857 - DNA, 20 bp, Artificial sequence
  SiRNA target sequence
aaaatgaggaggtaaggtta

SEQ ID NO: 170858 - DNA, 20 bp, Artificial sequence
  SiRNA target sequence
aaatgaggaggtaaggttaa

SEQ ID NO: 170859 - DNA, 20 bp, Artificial sequence
  SiRNA target sequence
aatgaggaggtaaggttaaa

SEQ ID NO: 170860 - DNA, 20 bp, Artificial sequence
  SiRNA target sequence
atgaggaggtaaggttaaat

SEQ ID NO: 170861 - DNA, 20 bp, Artificial sequence
  SiRNA target sequence
tgaggaggtaaggttaaatg

SEQ ID NO: 170862 - DNA, 20 bp, Artificial sequence
  SiRNA target sequence
gaggaggtaaggttaaatgg

SEQ ID NO: 170863 - DNA, 20 bp, Artificial sequence
  SiRNA target sequence
aggaggtaaggttaaatgga

SEQ ID NO: 170864 - DNA, 20 bp, Artificial sequence
  SiRNA target sequence
ggaggtaaggttaaatggaa

SEQ ID NO: 170865 - DNA, 20 bp, Artificial sequence
  SiRNA target sequence
gaggtaaggttaaatggaaa

SEQ ID NO: 170866 - DNA, 20 bp, Artificial sequence
  SiRNA target sequence
aggtaaggttaaatggaaaa

SEQ ID NO: 170867 - DNA, 20 bp, Artificial sequence
  SiRNA target sequence
ggtaaggttaaatggaaaaa

SEQ ID NO: 170868 - DNA, 20 bp, Artificial sequence
  SiRNA target sequence
gtaaggttaaatggaaaaag

SEQ ID NO: 170869 - DNA, 20 bp, Artificial sequence
  SiRNA target sequence
taaggttaaatggaaaaaga

SEQ ID NO: 170870 - DNA, 20 bp, Artificial sequence
  SiRNA target sequence
aaggttaaatggaaaaagaa

SEQ ID NO: 170871 - DNA, 20 bp, Artificial sequence
  SiRNA target sequence
aggttaaatggaaaaagaaa

SEQ ID NO: 170872 - DNA, 20 bp, Artificial sequence
  SiRNA target sequence
ggttaaatggaaaaagaaaa

SEQ ID NO: 170873 - DNA, 20 bp, Artificial sequence
  SiRNA target sequence
gttaaatggaaaaagaaaat

SEQ ID NO: 170874 - DNA, 20 bp, Artificial sequence
  SiRNA target sequence
ttaaatggaaaaagaaaatt

SEQ ID NO: 170875 - DNA, 20 bp, Artificial sequence
  SiRNA target sequence
taaatggaaaaagaaaatta

SEQ ID NO: 170876 - DNA, 20 bp, Artificial sequence
  SiRNA target sequence
aaatggaaaaagaaaattaa

SEQ ID NO: 170877 - DNA, 20 bp, Artificial sequence
  SiRNA target sequence
aatggaaaaagaaaattaaa

SEQ ID NO: 170878 - DNA, 20 bp, Artificial sequence
  SiRNA target sequence
atggaaaaagaaaattaaat

SEQ ID NO: 170879 - DNA, 20 bp, Artificial sequence
  SiRNA target sequence
tggaaaaagaaaattaaata

SEQ ID NO: 170880 - DNA, 20 bp, Artificial sequence
  SiRNA target sequence
ggaaaaagaaaattaaatat

SEQ ID NO: 170881 - DNA, 20 bp, Artificial sequence
  SiRNA target sequence
gaaaaagaaaattaaatatt

SEQ ID NO: 170882 - DNA, 20 bp, Artificial sequence
  SiRNA target sequence
aaaaagaaaattaaatatta

SEQ ID NO: 170883 - DNA, 20 bp, Artificial sequence
  SiRNA target sequence
aaaagaaaattaaatattaa

SEQ ID NO: 170884 - DNA, 20 bp, Artificial sequence
  SiRNA target sequence
aaagaaaattaaatattaac

SEQ ID NO: 170885 - DNA, 20 bp, Artificial sequence
  SiRNA target sequence
aagaaaattaaatattaaca

SEQ ID NO: 170886 - DNA, 20 bp, Artificial sequence
  SiRNA target sequence
agaaaattaaatattaacac

SEQ ID NO: 170887 - DNA, 20 bp, Artificial sequence
  SiRNA target sequence
gaaaattaaatattaacaca

SEQ ID NO: 170888 - DNA, 20 bp, Artificial sequence
  SiRNA target sequence
aaaattaaatattaacacag

SEQ ID NO: 170889 - DNA, 20 bp, Artificial sequence
  SiRNA target sequence
aaattaaatattaacacagt

SEQ ID NO: 170890 - DNA, 20 bp, Artificial sequence
  SiRNA target sequence
aattaaatattaacacagtt

SEQ ID NO: 170891 - DNA, 20 bp, Artificial sequence
  SiRNA target sequence
attaaatattaacacagtta

SEQ ID NO: 170892 - DNA, 20 bp, Artificial sequence
  SiRNA target sequence
ttaaatattaacacagttac

SEQ ID NO: 170893 - DNA, 20 bp, Artificial sequence
  SiRNA target sequence
taaatattaacacagttaca

SEQ ID NO: 170894 - DNA, 20 bp, Artificial sequence
  SiRNA target sequence
aaatattaacacagttacat

SEQ ID NO: 170895 - DNA, 20 bp, Artificial sequence
  SiRNA target sequence
aatattaacacagttacatt

SEQ ID NO: 170896 - DNA, 20 bp, Artificial sequence
  SiRNA target sequence
atattaacacagttacatta

SEQ ID NO: 170897 - DNA, 20 bp, Artificial sequence
  SiRNA target sequence
tattaacacagttacattaa

SEQ ID NO: 170898 - DNA, 20 bp, Artificial sequence
  SiRNA target sequence
attaacacagttacattaaa

SEQ ID NO: 170899 - DNA, 20 bp, Artificial sequence
  SiRNA target sequence
ttaacacagttacattaaat

SEQ ID NO: 170900 - DNA, 20 bp, Artificial sequence
  SiRNA target sequence
taacacagttacattaaata

SEQ ID NO: 170901 - DNA, 20 bp, Artificial sequence
  SiRNA target sequence
aacacagttacattaaataa

SEQ ID NO: 170902 - DNA, 20 bp, Artificial sequence
  SiRNA target sequence
acacagttacattaaataaa

SEQ ID NO: 170903 - DNA, 20 bp, Artificial sequence
  SiRNA target sequence
cacagttacattaaataaaa

SEQ ID NO: 170904 - DNA, 20 bp, Artificial sequence
  SiRNA target sequence
acagttacattaaataaaat

SEQ ID NO: 170905 - DNA, 20 bp, Artificial sequence
  SiRNA target sequence
cagttacattaaataaaatt

SEQ ID NO: 170906 - DNA, 20 bp, Artificial sequence
  SiRNA target sequence
agttacattaaataaaatta

SEQ ID NO: 170907 - DNA, 20 bp, Artificial sequence
  SiRNA target sequence
gttacattaaataaaattaa

SEQ ID NO: 170908 - DNA, 20 bp, Artificial sequence
  SiRNA target sequence
ttacattaaataaaattaat

SEQ ID NO: 170909 - DNA, 20 bp, Artificial sequence
  SiRNA target sequence
tacattaaataaaattaata

SEQ ID NO: 170910 - DNA, 20 bp, Artificial sequence
  SiRNA target sequence
acattaaataaaattaatat

SEQ ID NO: 170911 - DNA, 20 bp, Artificial sequence
  SiRNA target sequence
cattaaataaaattaatata

SEQ ID NO: 170912 - DNA, 20 bp, Artificial sequence
  SiRNA target sequence
attaaataaaattaatatac

SEQ ID NO: 170913 - DNA, 20 bp, Artificial sequence
  SiRNA target sequence
ttaaataaaattaatatacc

SEQ ID NO: 170914 - DNA, 20 bp, Artificial sequence
  SiRNA target sequence
taaataaaattaatatacct

SEQ ID NO: 170915 - DNA, 20 bp, Artificial sequence
  SiRNA target sequence
aaataaaattaatatacctg

SEQ ID NO: 170916 - DNA, 20 bp, Artificial sequence
  SiRNA target sequence
aataaaattaatatacctga

SEQ ID NO: 170917 - DNA, 20 bp, Artificial sequence
  SiRNA target sequence
ataaaattaatatacctgag

SEQ ID NO: 170918 - DNA, 20 bp, Artificial sequence
  SiRNA target sequence
taaaattaatatacctgaga

SEQ ID NO: 170919 - DNA, 20 bp, Artificial sequence
  SiRNA target sequence
aaaattaatatacctgagat

SEQ ID NO: 170920 - DNA, 20 bp, Artificial sequence
  SiRNA target sequence
aaattaatatacctgagata

SEQ ID NO: 170921 - DNA, 20 bp, Artificial sequence
  SiRNA target sequence
aattaatatacctgagatag

SEQ ID NO: 170922 - DNA, 20 bp, Artificial sequence
  SiRNA target sequence
attaatatacctgagataga

SEQ ID NO: 170923 - DNA, 20 bp, Artificial sequence
  SiRNA target sequence
ttaatatacctgagatagat

SEQ ID NO: 170924 - DNA, 20 bp, Artificial sequence
  SiRNA target sequence
taatatacctgagatagatt

SEQ ID NO: 170925 - DNA, 20 bp, Artificial sequence
  SiRNA target sequence
aatatacctgagatagatta

SEQ ID NO: 170926 - DNA, 20 bp, Artificial sequence
  SiRNA target sequence
atatacctgagatagattat

SEQ ID NO: 170927 - DNA, 20 bp, Artificial sequence
  SiRNA target sequence
tatacctgagatagattata

SEQ ID NO: 170928 - DNA, 20 bp, Artificial sequence
  SiRNA target sequence
atacctgagatagattataa

SEQ ID NO: 170929 - DNA, 20 bp, Artificial sequence
  SiRNA target sequence
tacctgagatagattataaa

SEQ ID NO: 170930 - DNA, 20 bp, Artificial sequence
  SiRNA target sequence
acctgagatagattataaat

SEQ ID NO: 170931 - DNA, 20 bp, Artificial sequence
  SiRNA target sequence
cctgagatagattataaata

SEQ ID NO: 170932 - DNA, 20 bp, Artificial sequence
  SiRNA target sequence
ctgagatagattataaatat

SEQ ID NO: 170933 - DNA, 20 bp, Artificial sequence
  SiRNA target sequence
tgagatagattataaatata

SEQ ID NO: 170934 - DNA, 20 bp, Artificial sequence
  SiRNA target sequence
gagatagattataaatataa

SEQ ID NO: 170935 - DNA, 20 bp, Artificial sequence
  SiRNA target sequence
agatagattataaatataaa

SEQ ID NO: 170936 - DNA, 20 bp, Artificial sequence
  SiRNA target sequence
gatagattataaatataaaa

SEQ ID NO: 170937 - DNA, 20 bp, Artificial sequence
  SiRNA target sequence
atagattataaatataaaaa

SEQ ID NO: 170938 - DNA, 20 bp, Artificial sequence
  SiRNA target sequence
tagattataaatataaaaat

SEQ ID NO: 170939 - DNA, 20 bp, Artificial sequence
  SiRNA target sequence
agattataaatataaaaatg

SEQ ID NO: 170940 - DNA, 20 bp, Artificial sequence
  SiRNA target sequence
gattataaatataaaaatgg

SEQ ID NO: 170941 - DNA, 20 bp, Artificial sequence
  SiRNA target sequence
attataaatataaaaatgga

SEQ ID NO: 170942 - DNA, 20 bp, Artificial sequence
  SiRNA target sequence
ttataaatataaaaatggag

SEQ ID NO: 170943 - DNA, 20 bp, Artificial sequence
  SiRNA target sequence
tataaatataaaaatggagt

SEQ ID NO: 170944 - DNA, 20 bp, Artificial sequence
  SiRNA target sequence
ataaatataaaaatggagtg

SEQ ID NO: 170945 - DNA, 20 bp, Artificial sequence
  SiRNA target sequence
taaatataaaaatggagtgt

SEQ ID NO: 170946 - DNA, 20 bp, Artificial sequence
  SiRNA target sequence
aaatataaaaatggagtgtt

SEQ ID NO: 170947 - DNA, 20 bp, Artificial sequence
  SiRNA target sequence
aatataaaaatggagtgttt

SEQ ID NO: 170948 - DNA, 20 bp, Artificial sequence
  SiRNA target sequence
atataaaaatggagtgttta

SEQ ID NO: 170949 - DNA, 20 bp, Artificial sequence
  SiRNA target sequence
tataaaaatggagtgtttac

SEQ ID NO: 170950 - DNA, 20 bp, Artificial sequence
  SiRNA target sequence
ataaaaatggagtgtttaca

SEQ ID NO: 170951 - DNA, 20 bp, Artificial sequence
  SiRNA target sequence
taaaaatggagtgtttacat

SEQ ID NO: 170952 - DNA, 20 bp, Artificial sequence
  SiRNA target sequence
aaaaatggagtgtttacata

SEQ ID NO: 170953 - DNA, 20 bp, Artificial sequence
  SiRNA target sequence
aaaatggagtgtttacatat

SEQ ID NO: 170954 - DNA, 20 bp, Artificial sequence
  SiRNA target sequence
aaatggagtgtttacatata

SEQ ID NO: 170955 - DNA, 20 bp, Artificial sequence
  SiRNA target sequence
aatggagtgtttacatatac

SEQ ID NO: 170956 - DNA, 20 bp, Artificial sequence
  SiRNA target sequence
atggagtgtttacatataca

SEQ ID NO: 170957 - DNA, 20 bp, Artificial sequence
  SiRNA target sequence
tggagtgtttacatatacac

SEQ ID NO: 170958 - DNA, 20 bp, Artificial sequence
  SiRNA target sequence
ggagtgtttacatatacaca

SEQ ID NO: 170959 - DNA, 20 bp, Artificial sequence
  SiRNA target sequence
gagtgtttacatatacacag

SEQ ID NO: 170960 - DNA, 20 bp, Artificial sequence
  SiRNA target sequence
agtgtttacatatacacaga

SEQ ID NO: 170961 - DNA, 20 bp, Artificial sequence
  SiRNA target sequence
gtgtttacatatacacagat

SEQ ID NO: 170962 - DNA, 20 bp, Artificial sequence
  SiRNA target sequence
tgtttacatatacacagatc

SEQ ID NO: 170963 - DNA, 20 bp, Artificial sequence
  SiRNA target sequence
gtttacatatacacagatca

SEQ ID NO: 170964 - DNA, 20 bp, Artificial sequence
  SiRNA target sequence
tttacatatacacagatcaa

SEQ ID NO: 170965 - DNA, 20 bp, Artificial sequence
  SiRNA target sequence
ttacatatacacagatcaaa

SEQ ID NO: 170966 - DNA, 20 bp, Artificial sequence
  SiRNA target sequence
tacatatacacagatcaaaa

SEQ ID NO: 170967 - DNA, 20 bp, Artificial sequence
  SiRNA target sequence
acatatacacagatcaaaaa

SEQ ID NO: 170968 - DNA, 20 bp, Artificial sequence
  SiRNA target sequence
catatacacagatcaaaaat

SEQ ID NO: 170969 - DNA, 20 bp, Artificial sequence
  SiRNA target sequence
atatacacagatcaaaaata

SEQ ID NO: 170970 - DNA, 20 bp, Artificial sequence
  SiRNA target sequence
tatacacagatcaaaaataa

SEQ ID NO: 170971 - DNA, 20 bp, Artificial sequence
  SiRNA target sequence
atacacagatcaaaaataat

SEQ ID NO: 170972 - DNA, 20 bp, Artificial sequence
  SiRNA target sequence
tacacagatcaaaaataata

SEQ ID NO: 170973 - DNA, 20 bp, Artificial sequence
  SiRNA target sequence
acacagatcaaaaataataa

SEQ ID NO: 170974 - DNA, 20 bp, Artificial sequence
  SiRNA target sequence
cacagatcaaaaataataag

SEQ ID NO: 170975 - DNA, 20 bp, Artificial sequence
  SiRNA target sequence
acagatcaaaaataataaga

SEQ ID NO: 170976 - DNA, 20 bp, Artificial sequence
  SiRNA target sequence
cagatcaaaaataataagaa

SEQ ID NO: 170977 - DNA, 20 bp, Artificial sequence
  SiRNA target sequence
agatcaaaaataataagaaa

SEQ ID NO: 170978 - DNA, 20 bp, Artificial sequence
  SiRNA target sequence
gatcaaaaataataagaaaa

SEQ ID NO: 170979 - DNA, 20 bp, Artificial sequence
  SiRNA target sequence
atcaaaaataataagaaaaa

SEQ ID NO: 170980 - DNA, 20 bp, Artificial sequence
  SiRNA target sequence
tcaaaaataataagaaaaaa

SEQ ID NO: 170981 - DNA, 20 bp, Artificial sequence
  SiRNA target sequence
caaaaataataagaaaaaaa

SEQ ID NO: 170982 - DNA, 20 bp, Artificial sequence
  SiRNA target sequence
aaaaataataagaaaaaaaa

SEQ ID NO: 170983 - DNA, 20 bp, Artificial sequence
  SiRNA target sequence
aaaataataagaaaaaaaaa

SEQ ID NO: 170984 - DNA, 20 bp, Artificial sequence
  SiRNA target sequence
aaataataagaaaaaaaaat

SEQ ID NO: 170985 - DNA, 20 bp, Artificial sequence
  SiRNA target sequence
aataataagaaaaaaaaata

SEQ ID NO: 170986 - DNA, 20 bp, Artificial sequence
  SiRNA target sequence
ataataagaaaaaaaaatat

SEQ ID NO: 170987 - DNA, 20 bp, Artificial sequence
  SiRNA target sequence
taataagaaaaaaaaatatt

SEQ ID NO: 170988 - DNA, 20 bp, Artificial sequence
  SiRNA target sequence
aataagaaaaaaaaatattt

SEQ ID NO: 170989 - DNA, 20 bp, Artificial sequence
  SiRNA target sequence
ataagaaaaaaaaatattta

SEQ ID NO: 170990 - DNA, 20 bp, Artificial sequence
  SiRNA target sequence
taagaaaaaaaaatatttaa

SEQ ID NO: 170991 - DNA, 20 bp, Artificial sequence
  SiRNA target sequence
aagaaaaaaaaatatttaag

SEQ ID NO: 170992 - DNA, 20 bp, Artificial sequence
  SiRNA target sequence
agaaaaaaaaatatttaaga

SEQ ID NO: 170993 - DNA, 20 bp, Artificial sequence
  SiRNA target sequence
gaaaaaaaaatatttaagaa

SEQ ID NO: 170994 - DNA, 20 bp, Artificial sequence
  SiRNA target sequence
aaaaaaaaatatttaagaat

SEQ ID NO: 170995 - DNA, 20 bp, Artificial sequence
  SiRNA target sequence
aaaaaaaatatttaagaata

SEQ ID NO: 170996 - DNA, 20 bp, Artificial sequence
  SiRNA target sequence
aaaaaaatatttaagaatat

SEQ ID NO: 170997 - DNA, 20 bp, Artificial sequence
  SiRNA target sequence
aaaaaatatttaagaatatt

SEQ ID NO: 170998 - DNA, 20 bp, Artificial sequence
  SiRNA target sequence
aaaaatatttaagaatattg

SEQ ID NO: 170999 - DNA, 20 bp, Artificial sequence
  SiRNA target sequence
aaaatatttaagaatattgg

SEQ ID NO: 171000 - DNA, 20 bp, Artificial sequence
  SiRNA target sequence
aaatatttaagaatattggg

SEQ ID NO: 171001 - DNA, 20 bp, Artificial sequence
  SiRNA target sequence
aatatttaagaatattgggt

SEQ ID NO: 171002 - DNA, 20 bp, Artificial sequence
  SiRNA target sequence
atatttaagaatattgggtc

SEQ ID NO: 171003 - DNA, 20 bp, Artificial sequence
  SiRNA target sequence
tatttaagaatattgggtct

SEQ ID NO: 171004 - DNA, 20 bp, Artificial sequence
  SiRNA target sequence
atttaagaatattgggtcta

SEQ ID NO: 171005 - DNA, 20 bp, Artificial sequence
  SiRNA target sequence
tttaagaatattgggtctag

SEQ ID NO: 171006 - DNA, 20 bp, Artificial sequence
  SiRNA target sequence
ttaagaatattgggtctaga

SEQ ID NO: 171007 - DNA, 20 bp, Artificial sequence
  SiRNA target sequence
taagaatattgggtctagaa

SEQ ID NO: 171008 - DNA, 20 bp, Artificial sequence
  SiRNA target sequence
aagaatattgggtctagaac

SEQ ID NO: 171009 - DNA, 20 bp, Artificial sequence
  SiRNA target sequence
agaatattgggtctagaacc

SEQ ID NO: 171010 - DNA, 20 bp, Artificial sequence
  SiRNA target sequence
gaatattgggtctagaacct

SEQ ID NO: 171011 - DNA, 20 bp, Artificial sequence
  SiRNA target sequence
aatattgggtctagaacctt

SEQ ID NO: 171012 - DNA, 20 bp, Artificial sequence
  SiRNA target sequence
atattgggtctagaaccttt

SEQ ID NO: 171013 - DNA, 20 bp, Artificial sequence
  SiRNA target sequence
tattgggtctagaacctttt

SEQ ID NO: 171014 - DNA, 20 bp, Artificial sequence
  SiRNA target sequence
attgggtctagaaccttttc

SEQ ID NO: 171015 - DNA, 20 bp, Artificial sequence
  SiRNA target sequence
ttgggtctagaaccttttct

SEQ ID NO: 171016 - DNA, 20 bp, Artificial sequence
  SiRNA target sequence
tgggtctagaaccttttctt

SEQ ID NO: 171017 - DNA, 20 bp, Artificial sequence
  SiRNA target sequence
gggtctagaaccttttctta

SEQ ID NO: 171018 - DNA, 20 bp, Artificial sequence
  SiRNA target sequence
ggtctagaaccttttcttaa

SEQ ID NO: 171019 - DNA, 20 bp, Artificial sequence
  SiRNA target sequence
gtctagaaccttttcttaat

SEQ ID NO: 171020 - DNA, 20 bp, Artificial sequence
  SiRNA target sequence
tctagaaccttttcttaatt

SEQ ID NO: 171021 - DNA, 20 bp, Artificial sequence
  SiRNA target sequence
ctagaaccttttcttaattt

SEQ ID NO: 171022 - DNA, 20 bp, Artificial sequence
  SiRNA target sequence
tagaaccttttcttaatttt

SEQ ID NO: 171023 - DNA, 20 bp, Artificial sequence
  SiRNA target sequence
agaaccttttcttaatttta

SEQ ID NO: 171024 - DNA, 20 bp, Artificial sequence
  SiRNA target sequence
gaaccttttcttaattttat

SEQ ID NO: 171025 - DNA, 20 bp, Artificial sequence
  SiRNA target sequence
aaccttttcttaattttatt

SEQ ID NO: 171026 - DNA, 20 bp, Artificial sequence
  SiRNA target sequence
accttttcttaattttatta

SEQ ID NO: 171027 - DNA, 20 bp, Artificial sequence
  SiRNA target sequence
ccttttcttaattttattaa

SEQ ID NO: 171028 - DNA, 20 bp, Artificial sequence
  SiRNA target sequence
cttttcttaattttattaag

SEQ ID NO: 171029 - DNA, 20 bp, Artificial sequence
  SiRNA target sequence
ttttcttaattttattaagg

SEQ ID NO: 171030 - DNA, 20 bp, Artificial sequence
  SiRNA target sequence
tttcttaattttattaagga

SEQ ID NO: 171031 - DNA, 20 bp, Artificial sequence
  SiRNA target sequence
ttcttaattttattaaggaa

SEQ ID NO: 171032 - DNA, 20 bp, Artificial sequence
  SiRNA target sequence
tcttaattttattaaggaaa

SEQ ID NO: 171033 - DNA, 20 bp, Artificial sequence
  SiRNA target sequence
cttaattttattaaggaaag

SEQ ID NO: 171034 - DNA, 20 bp, Artificial sequence
  SiRNA target sequence
ttaattttattaaggaaagt

SEQ ID NO: 171035 - DNA, 20 bp, Artificial sequence
  SiRNA target sequence
taattttattaaggaaagta

SEQ ID NO: 171036 - DNA, 20 bp, Artificial sequence
  SiRNA target sequence
aattttattaaggaaagtaa

SEQ ID NO: 171037 - DNA, 20 bp, Artificial sequence
  SiRNA target sequence
attttattaaggaaagtaaa

SEQ ID NO: 171038 - DNA, 20 bp, Artificial sequence
  SiRNA target sequence
ttttattaaggaaagtaaac

SEQ ID NO: 171039 - DNA, 20 bp, Artificial sequence
  SiRNA target sequence
tttattaaggaaagtaaaca

SEQ ID NO: 171040 - DNA, 20 bp, Artificial sequence
  SiRNA target sequence
ttattaaggaaagtaaacat

SEQ ID NO: 171041 - DNA, 20 bp, Artificial sequence
  SiRNA target sequence
tattaaggaaagtaaacata

SEQ ID NO: 171042 - DNA, 20 bp, Artificial sequence
  SiRNA target sequence
attaaggaaagtaaacataa

SEQ ID NO: 171043 - DNA, 20 bp, Artificial sequence
  SiRNA target sequence
ttaaggaaagtaaacataaa

SEQ ID NO: 171044 - DNA, 20 bp, Artificial sequence
  SiRNA target sequence
taaggaaagtaaacataaag

SEQ ID NO: 171045 - DNA, 20 bp, Artificial sequence
  SiRNA target sequence
aaggaaagtaaacataaaga

SEQ ID NO: 171046 - DNA, 20 bp, Artificial sequence
  SiRNA target sequence
aggaaagtaaacataaagaa

SEQ ID NO: 171047 - DNA, 20 bp, Artificial sequence
  SiRNA target sequence
ggaaagtaaacataaagaat

SEQ ID NO: 171048 - DNA, 20 bp, Artificial sequence
  SiRNA target sequence
gaaagtaaacataaagaatt

SEQ ID NO: 171049 - DNA, 20 bp, Artificial sequence
  SiRNA target sequence
aaagtaaacataaagaatta

SEQ ID NO: 171050 - DNA, 20 bp, Artificial sequence
  SiRNA target sequence
aagtaaacataaagaattag

SEQ ID NO: 171051 - DNA, 20 bp, Artificial sequence
  SiRNA target sequence
agtaaacataaagaattaga

SEQ ID NO: 171052 - DNA, 20 bp, Artificial sequence
  SiRNA target sequence
gtaaacataaagaattagaa

SEQ ID NO: 171053 - DNA, 20 bp, Artificial sequence
  SiRNA target sequence
taaacataaagaattagaat

SEQ ID NO: 171054 - DNA, 20 bp, Artificial sequence
  SiRNA target sequence
aaacataaagaattagaata

SEQ ID NO: 171055 - DNA, 20 bp, Artificial sequence
  SiRNA target sequence
aacataaagaattagaatat

SEQ ID NO: 171056 - DNA, 20 bp, Artificial sequence
  SiRNA target sequence
acataaagaattagaatatg

SEQ ID NO: 171057 - DNA, 20 bp, Artificial sequence
  SiRNA target sequence
cataaagaattagaatatga

SEQ ID NO: 171058 - DNA, 20 bp, Artificial sequence
  SiRNA target sequence
ataaagaattagaatatgat

SEQ ID NO: 171059 - DNA, 20 bp, Artificial sequence
  SiRNA target sequence
taaagaattagaatatgatg

SEQ ID NO: 171060 - DNA, 20 bp, Artificial sequence
  SiRNA target sequence
aaagaattagaatatgatgt

SEQ ID NO: 171061 - DNA, 20 bp, Artificial sequence
  SiRNA target sequence
aagaattagaatatgatgta

SEQ ID NO: 171062 - DNA, 20 bp, Artificial sequence
  SiRNA target sequence
agaattagaatatgatgtat

SEQ ID NO: 171063 - DNA, 20 bp, Artificial sequence
  SiRNA target sequence
gaattagaatatgatgtatg

SEQ ID NO: 171064 - DNA, 20 bp, Artificial sequence
  SiRNA target sequence
aattagaatatgatgtatgc

SEQ ID NO: 171065 - DNA, 20 bp, Artificial sequence
  SiRNA target sequence
attagaatatgatgtatgcg

SEQ ID NO: 171066 - DNA, 20 bp, Artificial sequence
  SiRNA target sequence
ttagaatatgatgtatgcga

SEQ ID NO: 171067 - DNA, 20 bp, Artificial sequence
  SiRNA target sequence
tagaatatgatgtatgcgaa

SEQ ID NO: 171068 - DNA, 20 bp, Artificial sequence
  SiRNA target sequence
agaatatgatgtatgcgaaa

SEQ ID NO: 171069 - DNA, 20 bp, Artificial sequence
  SiRNA target sequence
gaatatgatgtatgcgaaat

SEQ ID NO: 171070 - DNA, 20 bp, Artificial sequence
  SiRNA target sequence
aatatgatgtatgcgaaata

SEQ ID NO: 171071 - DNA, 20 bp, Artificial sequence
  SiRNA target sequence
atatgatgtatgcgaaatat

SEQ ID NO: 171072 - DNA, 20 bp, Artificial sequence
  SiRNA target sequence
tatgatgtatgcgaaatata

SEQ ID NO: 171073 - DNA, 20 bp, Artificial sequence
  SiRNA target sequence
atgatgtatgcgaaatatac

SEQ ID NO: 171074 - DNA, 20 bp, Artificial sequence
  SiRNA target sequence
tgatgtatgcgaaatataca

SEQ ID NO: 171075 - DNA, 20 bp, Artificial sequence
  SiRNA target sequence
gatgtatgcgaaatatacat

SEQ ID NO: 171076 - DNA, 20 bp, Artificial sequence
  SiRNA target sequence
atgtatgcgaaatatacatt

SEQ ID NO: 171077 - DNA, 20 bp, Artificial sequence
  SiRNA target sequence
tgtatgcgaaatatacattt

SEQ ID NO: 171078 - DNA, 20 bp, Artificial sequence
  SiRNA target sequence
gtatgcgaaatatacatttg

SEQ ID NO: 171079 - DNA, 20 bp, Artificial sequence
  SiRNA target sequence
tatgcgaaatatacatttgt

SEQ ID NO: 171080 - DNA, 20 bp, Artificial sequence
  SiRNA target sequence
atgcgaaatatacatttgta

SEQ ID NO: 171081 - DNA, 20 bp, Artificial sequence
  SiRNA target sequence
tgcgaaatatacatttgtaa

SEQ ID NO: 171082 - DNA, 20 bp, Artificial sequence
  SiRNA target sequence
gcgaaatatacatttgtaat

SEQ ID NO: 171083 - DNA, 20 bp, Artificial sequence
  SiRNA target sequence
cgaaatatacatttgtaatc

SEQ ID NO: 171084 - DNA, 20 bp, Artificial sequence
  SiRNA target sequence
gaaatatacatttgtaatca

SEQ ID NO: 171085 - DNA, 20 bp, Artificial sequence
  SiRNA target sequence
aaatatacatttgtaatcag

SEQ ID NO: 171086 - DNA, 20 bp, Artificial sequence
  SiRNA target sequence
aatatacatttgtaatcagg

SEQ ID NO: 171087 - DNA, 20 bp, Artificial sequence
  SiRNA target sequence
atatacatttgtaatcaggg

SEQ ID NO: 171088 - DNA, 20 bp, Artificial sequence
  SiRNA target sequence
tatacatttgtaatcaggga

SEQ ID NO: 171089 - DNA, 20 bp, Artificial sequence
  SiRNA target sequence
atacatttgtaatcagggat

SEQ ID NO: 171090 - DNA, 20 bp, Artificial sequence
  SiRNA target sequence
tacatttgtaatcagggatg

SEQ ID NO: 171091 - DNA, 20 bp, Artificial sequence
  SiRNA target sequence
acatttgtaatcagggatgc

SEQ ID NO: 171092 - DNA, 20 bp, Artificial sequence
  SiRNA target sequence
catttgtaatcagggatgca

SEQ ID NO: 171093 - DNA, 20 bp, Artificial sequence
  SiRNA target sequence
atttgtaatcagggatgcat

SEQ ID NO: 171094 - DNA, 20 bp, Artificial sequence
  SiRNA target sequence
tttgtaatcagggatgcatt

SEQ ID NO: 171095 - DNA, 20 bp, Artificial sequence
  SiRNA target sequence
ttgtaatcagggatgcatta

SEQ ID NO: 171096 - DNA, 20 bp, Artificial sequence
  SiRNA target sequence
tgtaatcagggatgcattaa

SEQ ID NO: 171097 - DNA, 20 bp, Artificial sequence
  SiRNA target sequence
gtaatcagggatgcattaat

SEQ ID NO: 171098 - DNA, 20 bp, Artificial sequence
  SiRNA target sequence
taatcagggatgcattaatg

SEQ ID NO: 171099 - DNA, 20 bp, Artificial sequence
  SiRNA target sequence
aatcagggatgcattaatgg

SEQ ID NO: 171100 - DNA, 20 bp, Artificial sequence
  SiRNA target sequence
atcagggatgcattaatgga

SEQ ID NO: 171101 - DNA, 20 bp, Artificial sequence
  SiRNA target sequence
tcagggatgcattaatggac

SEQ ID NO: 171102 - DNA, 20 bp, Artificial sequence
  SiRNA target sequence
cagggatgcattaatggacc

SEQ ID NO: 171103 - DNA, 20 bp, Artificial sequence
  SiRNA target sequence
agggatgcattaatggacca

SEQ ID NO: 171104 - DNA, 20 bp, Artificial sequence
  SiRNA target sequence
gggatgcattaatggaccag

SEQ ID NO: 171105 - DNA, 20 bp, Artificial sequence
  SiRNA target sequence
ggatgcattaatggaccagg

SEQ ID NO: 171106 - DNA, 20 bp, Artificial sequence
  SiRNA target sequence
gatgcattaatggaccagga

SEQ ID NO: 171107 - DNA, 20 bp, Artificial sequence
  SiRNA target sequence
atgcattaatggaccaggac

SEQ ID NO: 171108 - DNA, 20 bp, Artificial sequence
  SiRNA target sequence
tgcattaatggaccaggaca

SEQ ID NO: 171109 - DNA, 20 bp, Artificial sequence
  SiRNA target sequence
gcattaatggaccaggacaa

SEQ ID NO: 171110 - DNA, 20 bp, Artificial sequence
  SiRNA target sequence
cattaatggaccaggacaat

SEQ ID NO: 171111 - DNA, 20 bp, Artificial sequence
  SiRNA target sequence
attaatggaccaggacaatt

SEQ ID NO: 171112 - DNA, 20 bp, Artificial sequence
  SiRNA target sequence
ttaatggaccaggacaattg

SEQ ID NO: 171113 - DNA, 20 bp, Artificial sequence
  SiRNA target sequence
taatggaccaggacaattgt

SEQ ID NO: 171114 - DNA, 20 bp, Artificial sequence
  SiRNA target sequence
aatggaccaggacaattgta

SEQ ID NO: 171115 - DNA, 20 bp, Artificial sequence
  SiRNA target sequence
atggaccaggacaattgtat

SEQ ID NO: 171116 - DNA, 20 bp, Artificial sequence
  SiRNA target sequence
tggaccaggacaattgtata

SEQ ID NO: 171117 - DNA, 20 bp, Artificial sequence
  SiRNA target sequence
ggaccaggacaattgtatac

SEQ ID NO: 171118 - DNA, 20 bp, Artificial sequence
  SiRNA target sequence
gaccaggacaattgtataca

SEQ ID NO: 171119 - DNA, 20 bp, Artificial sequence
  SiRNA target sequence
accaggacaattgtatacag

SEQ ID NO: 171120 - DNA, 20 bp, Artificial sequence
  SiRNA target sequence
ccaggacaattgtatacaga

SEQ ID NO: 171121 - DNA, 20 bp, Artificial sequence
  SiRNA target sequence
caggacaattgtatacagat

SEQ ID NO: 171122 - DNA, 20 bp, Artificial sequence
  SiRNA target sequence
aggacaattgtatacagata

SEQ ID NO: 171123 - DNA, 20 bp, Artificial sequence
  SiRNA target sequence
ggacaattgtatacagataa

SEQ ID NO: 171124 - DNA, 20 bp, Artificial sequence
  SiRNA target sequence
gacaattgtatacagataat

SEQ ID NO: 171125 - DNA, 20 bp, Artificial sequence
  SiRNA target sequence
acaattgtatacagataatt

SEQ ID NO: 171126 - DNA, 20 bp, Artificial sequence
  SiRNA target sequence
caattgtatacagataattt

SEQ ID NO: 171127 - DNA, 20 bp, Artificial sequence
  SiRNA target sequence
aattgtatacagataattta

SEQ ID NO: 171128 - DNA, 20 bp, Artificial sequence
  SiRNA target sequence
attgtatacagataatttat

SEQ ID NO: 171129 - DNA, 20 bp, Artificial sequence
  SiRNA target sequence
ttgtatacagataatttata

SEQ ID NO: 171130 - DNA, 20 bp, Artificial sequence
  SiRNA target sequence
tgtatacagataatttatat

SEQ ID NO: 171131 - DNA, 20 bp, Artificial sequence
  SiRNA target sequence
gtatacagataatttatatg

SEQ ID NO: 171132 - DNA, 20 bp, Artificial sequence
  SiRNA target sequence
tatacagataatttatatgt

SEQ ID NO: 171133 - DNA, 20 bp, Artificial sequence
  SiRNA target sequence
atacagataatttatatgta

SEQ ID NO: 171134 - DNA, 20 bp, Artificial sequence
  SiRNA target sequence
tacagataatttatatgtaa

SEQ ID NO: 171135 - DNA, 20 bp, Artificial sequence
  SiRNA target sequence
acagataatttatatgtaaa

SEQ ID NO: 171136 - DNA, 20 bp, Artificial sequence
  SiRNA target sequence
cagataatttatatgtaaat

SEQ ID NO: 171137 - DNA, 20 bp, Artificial sequence
  SiRNA target sequence
agataatttatatgtaaata

SEQ ID NO: 171138 - DNA, 20 bp, Artificial sequence
  SiRNA target sequence
gataatttatatgtaaataa

SEQ ID NO: 171139 - DNA, 20 bp, Artificial sequence
  SiRNA target sequence
ataatttatatgtaaataat

SEQ ID NO: 171140 - DNA, 20 bp, Artificial sequence
  SiRNA target sequence
taatttatatgtaaataatt

SEQ ID NO: 171141 - DNA, 20 bp, Artificial sequence
  SiRNA target sequence
aatttatatgtaaataattc

SEQ ID NO: 171142 - DNA, 20 bp, Artificial sequence
  SiRNA target sequence
atttatatgtaaataattca

SEQ ID NO: 171143 - DNA, 20 bp, Artificial sequence
  SiRNA target sequence
tttatatgtaaataattcag

SEQ ID NO: 171144 - DNA, 20 bp, Artificial sequence
  SiRNA target sequence
ttatatgtaaataattcaga

SEQ ID NO: 171145 - DNA, 20 bp, Artificial sequence
  SiRNA target sequence
tatatgtaaataattcagaa

SEQ ID NO: 171146 - DNA, 20 bp, Artificial sequence
  SiRNA target sequence
atatgtaaataattcagaat

SEQ ID NO: 171147 - DNA, 20 bp, Artificial sequence
  SiRNA target sequence
tatgtaaataattcagaata

SEQ ID NO: 171148 - DNA, 20 bp, Artificial sequence
  SiRNA target sequence
atgtaaataattcagaatac

SEQ ID NO: 171149 - DNA, 20 bp, Artificial sequence
  SiRNA target sequence
tgtaaataattcagaataca

SEQ ID NO: 171150 - DNA, 20 bp, Artificial sequence
  SiRNA target sequence
gtaaataattcagaatacat

SEQ ID NO: 171151 - DNA, 20 bp, Artificial sequence
  SiRNA target sequence
taaataattcagaatacata

SEQ ID NO: 171152 - DNA, 20 bp, Artificial sequence
  SiRNA target sequence
aaataattcagaatacatag

SEQ ID NO: 171153 - DNA, 20 bp, Artificial sequence
  SiRNA target sequence
aataattcagaatacataga

SEQ ID NO: 171154 - DNA, 20 bp, Artificial sequence
  SiRNA target sequence
ataattcagaatacatagat

SEQ ID NO: 171155 - DNA, 20 bp, Artificial sequence
  SiRNA target sequence
taattcagaatacatagata

SEQ ID NO: 171156 - DNA, 20 bp, Artificial sequence
  SiRNA target sequence
aattcagaatacatagatat

SEQ ID NO: 171157 - DNA, 20 bp, Artificial sequence
  SiRNA target sequence
attcagaatacatagatatt

SEQ ID NO: 171158 - DNA, 20 bp, Artificial sequence
  SiRNA target sequence
ttcagaatacatagatattg

SEQ ID NO: 171159 - DNA, 20 bp, Artificial sequence
  SiRNA target sequence
tcagaatacatagatattga

SEQ ID NO: 171160 - DNA, 20 bp, Artificial sequence
  SiRNA target sequence
cagaatacatagatattgat

SEQ ID NO: 171161 - DNA, 20 bp, Artificial sequence
  SiRNA target sequence
agaatacatagatattgatc

SEQ ID NO: 171162 - DNA, 20 bp, Artificial sequence
  SiRNA target sequence
gaatacatagatattgatct

SEQ ID NO: 171163 - DNA, 20 bp, Artificial sequence
  SiRNA target sequence
aatacatagatattgatctt

SEQ ID NO: 171164 - DNA, 20 bp, Artificial sequence
  SiRNA target sequence
atacatagatattgatcttg

SEQ ID NO: 171165 - DNA, 20 bp, Artificial sequence
  SiRNA target sequence
tacatagatattgatcttgg

SEQ ID NO: 171166 - DNA, 20 bp, Artificial sequence
  SiRNA target sequence
acatagatattgatcttggt

SEQ ID NO: 171167 - DNA, 20 bp, Artificial sequence
  SiRNA target sequence
catagatattgatcttggta

SEQ ID NO: 171168 - DNA, 20 bp, Artificial sequence
  SiRNA target sequence
atagatattgatcttggtat

SEQ ID NO: 171169 - DNA, 20 bp, Artificial sequence
  SiRNA target sequence
tagatattgatcttggtatt

SEQ ID NO: 171170 - DNA, 20 bp, Artificial sequence
  SiRNA target sequence
agatattgatcttggtattg

SEQ ID NO: 171171 - DNA, 20 bp, Artificial sequence
  SiRNA target sequence
gatattgatcttggtattga

SEQ ID NO: 171172 - DNA, 20 bp, Artificial sequence
  SiRNA target sequence
atattgatcttggtattgat

SEQ ID NO: 171173 - DNA, 20 bp, Artificial sequence
  SiRNA target sequence
tattgatcttggtattgatt

SEQ ID NO: 171174 - DNA, 20 bp, Artificial sequence
  SiRNA target sequence
attgatcttggtattgattg

SEQ ID NO: 171175 - DNA, 20 bp, Artificial sequence
  SiRNA target sequence
ttgatcttggtattgattgt

SEQ ID NO: 171176 - DNA, 20 bp, Artificial sequence
  SiRNA target sequence
tgatcttggtattgattgta

SEQ ID NO: 171177 - DNA, 20 bp, Artificial sequence
  SiRNA target sequence
gatcttggtattgattgtaa

SEQ ID NO: 171178 - DNA, 20 bp, Artificial sequence
  SiRNA target sequence
atcttggtattgattgtaaa

SEQ ID NO: 171179 - DNA, 20 bp, Artificial sequence
  SiRNA target sequence
tcttggtattgattgtaaac

SEQ ID NO: 171180 - DNA, 20 bp, Artificial sequence
  SiRNA target sequence
cttggtattgattgtaaaca

SEQ ID NO: 171181 - DNA, 20 bp, Artificial sequence
  SiRNA target sequence
ttggtattgattgtaaacag

SEQ ID NO: 171182 - DNA, 20 bp, Artificial sequence
  SiRNA target sequence
tggtattgattgtaaacagt

SEQ ID NO: 171183 - DNA, 20 bp, Artificial sequence
  SiRNA target sequence
ggtattgattgtaaacagtt

SEQ ID NO: 171184 - DNA, 20 bp, Artificial sequence
  SiRNA target sequence
gtattgattgtaaacagtta

SEQ ID NO: 171185 - DNA, 20 bp, Artificial sequence
  SiRNA target sequence
tattgattgtaaacagttac

SEQ ID NO: 171186 - DNA, 20 bp, Artificial sequence
  SiRNA target sequence
attgattgtaaacagttaca

SEQ ID NO: 171187 - DNA, 20 bp, Artificial sequence
  SiRNA target sequence
ttgattgtaaacagttacaa

SEQ ID NO: 171188 - DNA, 20 bp, Artificial sequence
  SiRNA target sequence
tgattgtaaacagttacaaa

SEQ ID NO: 171189 - DNA, 20 bp, Artificial sequence
  SiRNA target sequence
gattgtaaacagttacaaaa

SEQ ID NO: 171190 - DNA, 20 bp, Artificial sequence
  SiRNA target sequence
attgtaaacagttacaaaaa

SEQ ID NO: 171191 - DNA, 20 bp, Artificial sequence
  SiRNA target sequence
ttgtaaacagttacaaaaaa

SEQ ID NO: 171192 - DNA, 20 bp, Artificial sequence
  SiRNA target sequence
tgtaaacagttacaaaaaag

SEQ ID NO: 171193 - DNA, 20 bp, Artificial sequence
  SiRNA target sequence
gtaaacagttacaaaaaagg

SEQ ID NO: 171194 - DNA, 20 bp, Artificial sequence
  SiRNA target sequence
taaacagttacaaaaaagga

SEQ ID NO: 171195 - DNA, 20 bp, Artificial sequence
  SiRNA target sequence
aaacagttacaaaaaaggac

SEQ ID NO: 171196 - DNA, 20 bp, Artificial sequence
  SiRNA target sequence
aacagttacaaaaaaggaca

SEQ ID NO: 171197 - DNA, 20 bp, Artificial sequence
  SiRNA target sequence
acagttacaaaaaaggacat

SEQ ID NO: 171198 - DNA, 20 bp, Artificial sequence
  SiRNA target sequence
cagttacaaaaaaggacata

SEQ ID NO: 171199 - DNA, 20 bp, Artificial sequence
  SiRNA target sequence
agttacaaaaaaggacatat

SEQ ID NO: 171200 - DNA, 20 bp, Artificial sequence
  SiRNA target sequence
gttacaaaaaaggacatata

SEQ ID NO: 171201 - DNA, 20 bp, Artificial sequence
  SiRNA target sequence
ttacaaaaaaggacatatag

SEQ ID NO: 171202 - DNA, 20 bp, Artificial sequence
  SiRNA target sequence
tacaaaaaaggacatataga

SEQ ID NO: 171203 - DNA, 20 bp, Artificial sequence
  SiRNA target sequence
acaaaaaaggacatatagaa

SEQ ID NO: 171204 - DNA, 20 bp, Artificial sequence
  SiRNA target sequence
caaaaaaggacatatagaaa

SEQ ID NO: 171205 - DNA, 20 bp, Artificial sequence
  SiRNA target sequence
aaaaaaggacatatagaaaa

SEQ ID NO: 171206 - DNA, 20 bp, Artificial sequence
  SiRNA target sequence
aaaaaggacatatagaaaaa

SEQ ID NO: 171207 - DNA, 20 bp, Artificial sequence
  SiRNA target sequence
aaaaggacatatagaaaaat

SEQ ID NO: 171208 - DNA, 20 bp, Artificial sequence
  SiRNA target sequence
aaaggacatatagaaaaata

SEQ ID NO: 171209 - DNA, 20 bp, Artificial sequence
  SiRNA target sequence
aaggacatatagaaaaatag

SEQ ID NO: 171210 - DNA, 20 bp, Artificial sequence
  SiRNA target sequence
aggacatatagaaaaataga

SEQ ID NO: 171211 - DNA, 20 bp, Artificial sequence
  SiRNA target sequence
ggacatatagaaaaatagaa

SEQ ID NO: 171212 - DNA, 20 bp, Artificial sequence
  SiRNA target sequence
gacatatagaaaaatagaaa

SEQ ID NO: 171213 - DNA, 20 bp, Artificial sequence
  SiRNA target sequence
acatatagaaaaatagaaac

SEQ ID NO: 171214 - DNA, 20 bp, Artificial sequence
  SiRNA target sequence
catatagaaaaatagaaaca

SEQ ID NO: 171215 - DNA, 20 bp, Artificial sequence
  SiRNA target sequence
atatagaaaaatagaaacaa

SEQ ID NO: 171216 - DNA, 20 bp, Artificial sequence
  SiRNA target sequence
tatagaaaaatagaaacaaa

SEQ ID NO: 171217 - DNA, 20 bp, Artificial sequence
  SiRNA target sequence
atagaaaaatagaaacaaag

SEQ ID NO: 171218 - DNA, 20 bp, Artificial sequence
  SiRNA target sequence
tagaaaaatagaaacaaaga

SEQ ID NO: 171219 - DNA, 20 bp, Artificial sequence
  SiRNA target sequence
agaaaaatagaaacaaagaa

SEQ ID NO: 171220 - DNA, 20 bp, Artificial sequence
  SiRNA target sequence
gaaaaatagaaacaaagaaa

SEQ ID NO: 171221 - DNA, 20 bp, Artificial sequence
  SiRNA target sequence
aaaaatagaaacaaagaaag

SEQ ID NO: 171222 - DNA, 20 bp, Artificial sequence
  SiRNA target sequence
aaaatagaaacaaagaaagt

SEQ ID NO: 171223 - DNA, 20 bp, Artificial sequence
  SiRNA target sequence
aaatagaaacaaagaaagtt

SEQ ID NO: 171224 - DNA, 20 bp, Artificial sequence
  SiRNA target sequence
aatagaaacaaagaaagtta

SEQ ID NO: 171225 - DNA, 20 bp, Artificial sequence
  SiRNA target sequence
atagaaacaaagaaagttaa

SEQ ID NO: 171226 - DNA, 20 bp, Artificial sequence
  SiRNA target sequence
tagaaacaaagaaagttaat

SEQ ID NO: 171227 - DNA, 20 bp, Artificial sequence
  SiRNA target sequence
agaaacaaagaaagttaatt

SEQ ID NO: 171228 - DNA, 20 bp, Artificial sequence
  SiRNA target sequence
gaaacaaagaaagttaattt

SEQ ID NO: 171229 - DNA, 20 bp, Artificial sequence
  SiRNA target sequence
aaacaaagaaagttaatttt

SEQ ID NO: 171230 - DNA, 20 bp, Artificial sequence
  SiRNA target sequence
aacaaagaaagttaatttta

SEQ ID NO: 171231 - DNA, 20 bp, Artificial sequence
  SiRNA target sequence
acaaagaaagttaattttaa

SEQ ID NO: 171232 - DNA, 20 bp, Artificial sequence
  SiRNA target sequence
caaagaaagttaattttaaa

SEQ ID NO: 171233 - DNA, 20 bp, Artificial sequence
  SiRNA target sequence
aaagaaagttaattttaaaa

SEQ ID NO: 171234 - DNA, 20 bp, Artificial sequence
  SiRNA target sequence
aagaaagttaattttaaaat

SEQ ID NO: 171235 - DNA, 20 bp, Artificial sequence
  SiRNA target sequence
agaaagttaattttaaaata

SEQ ID NO: 171236 - DNA, 20 bp, Artificial sequence
  SiRNA target sequence
gaaagttaattttaaaatag

SEQ ID NO: 171237 - DNA, 20 bp, Artificial sequence
  SiRNA target sequence
aaagttaattttaaaataga

SEQ ID NO: 171238 - DNA, 20 bp, Artificial sequence
  SiRNA target sequence
aagttaattttaaaatagaa

SEQ ID NO: 171239 - DNA, 20 bp, Artificial sequence
  SiRNA target sequence
agttaattttaaaatagaat

SEQ ID NO: 171240 - DNA, 20 bp, Artificial sequence
  SiRNA target sequence
gttaattttaaaatagaatg

SEQ ID NO: 171241 - DNA, 20 bp, Artificial sequence
  SiRNA target sequence
ttaattttaaaatagaatgg

SEQ ID NO: 171242 - DNA, 20 bp, Artificial sequence
  SiRNA target sequence
taattttaaaatagaatggt

SEQ ID NO: 171243 - DNA, 20 bp, Artificial sequence
  SiRNA target sequence
aattttaaaatagaatggta

SEQ ID NO: 171244 - DNA, 20 bp, Artificial sequence
  SiRNA target sequence
attttaaaatagaatggtaa

SEQ ID NO: 171245 - DNA, 21 bp, Artificial sequence
  SiRNA target sequence
atgaatactgaaaataaacca

SEQ ID NO: 171246 - DNA, 21 bp, Artificial sequence
  SiRNA target sequence
tgaatactgaaaataaaccat

SEQ ID NO: 171247 - DNA, 21 bp, Artificial sequence
  SiRNA target sequence
gaatactgaaaataaaccatg

SEQ ID NO: 171248 - DNA, 21 bp, Artificial sequence
  SiRNA target sequence
aatactgaaaataaaccatgt

SEQ ID NO: 171249 - DNA, 21 bp, Artificial sequence
  SiRNA target sequence
atactgaaaataaaccatgta

SEQ ID NO: 171250 - DNA, 21 bp, Artificial sequence
  SiRNA target sequence
tactgaaaataaaccatgtat

SEQ ID NO: 171251 - DNA, 21 bp, Artificial sequence
  SiRNA target sequence
actgaaaataaaccatgtatt

SEQ ID NO: 171252 - DNA, 21 bp, Artificial sequence
  SiRNA target sequence
ctgaaaataaaccatgtattt

SEQ ID NO: 171253 - DNA, 21 bp, Artificial sequence
  SiRNA target sequence
tgaaaataaaccatgtatttc

SEQ ID NO: 171254 - DNA, 21 bp, Artificial sequence
  SiRNA target sequence
gaaaataaaccatgtatttca

SEQ ID NO: 171255 - DNA, 21 bp, Artificial sequence
  SiRNA target sequence
aaaataaaccatgtatttcac

SEQ ID NO: 171256 - DNA, 21 bp, Artificial sequence
  SiRNA target sequence
aaataaaccatgtatttcacc

SEQ ID NO: 171257 - DNA, 21 bp, Artificial sequence
  SiRNA target sequence
aataaaccatgtatttcacca

SEQ ID NO: 171258 - DNA, 21 bp, Artificial sequence
  SiRNA target sequence
ataaaccatgtatttcaccat

SEQ ID NO: 171259 - DNA, 21 bp, Artificial sequence
  SiRNA target sequence
taaaccatgtatttcaccatt

SEQ ID NO: 171260 - DNA, 21 bp, Artificial sequence
  SiRNA target sequence
aaaccatgtatttcaccattt

SEQ ID NO: 171261 - DNA, 21 bp, Artificial sequence
  SiRNA target sequence
aaccatgtatttcaccattta

SEQ ID NO: 171262 - DNA, 21 bp, Artificial sequence
  SiRNA target sequence
accatgtatttcaccatttac

SEQ ID NO: 171263 - DNA, 21 bp, Artificial sequence
  SiRNA target sequence
ccatgtatttcaccatttacc

SEQ ID NO: 171264 - DNA, 21 bp, Artificial sequence
  SiRNA target sequence
catgtatttcaccatttacct

SEQ ID NO: 171265 - DNA, 21 bp, Artificial sequence
  SiRNA target sequence
atgtatttcaccatttacctt

SEQ ID NO: 171266 - DNA, 21 bp, Artificial sequence
  SiRNA target sequence
tgtatttcaccatttaccttt

SEQ ID NO: 171267 - DNA, 21 bp, Artificial sequence
  SiRNA target sequence
gtatttcaccatttaccttta

SEQ ID NO: 171268 - DNA, 21 bp, Artificial sequence
  SiRNA target sequence
tatttcaccatttacctttaa

SEQ ID NO: 171269 - DNA, 21 bp, Artificial sequence
  SiRNA target sequence
atttcaccatttacctttaaa

SEQ ID NO: 171270 - DNA, 21 bp, Artificial sequence
  SiRNA target sequence
tttcaccatttacctttaaac

SEQ ID NO: 171271 - DNA, 21 bp, Artificial sequence
  SiRNA target sequence
ttcaccatttacctttaaact

SEQ ID NO: 171272 - DNA, 21 bp, Artificial sequence
  SiRNA target sequence
tcaccatttacctttaaacta

SEQ ID NO: 171273 - DNA, 21 bp, Artificial sequence
  SiRNA target sequence
caccatttacctttaaactag

SEQ ID NO: 171274 - DNA, 21 bp, Artificial sequence
  SiRNA target sequence
accatttacctttaaactaga

SEQ ID NO: 171275 - DNA, 21 bp, Artificial sequence
  SiRNA target sequence
ccatttacctttaaactagaa

SEQ ID NO: 171276 - DNA, 21 bp, Artificial sequence
  SiRNA target sequence
catttacctttaaactagaag

SEQ ID NO: 171277 - DNA, 21 bp, Artificial sequence
  SiRNA target sequence
atttacctttaaactagaaga

SEQ ID NO: 171278 - DNA, 21 bp, Artificial sequence
  SiRNA target sequence
tttacctttaaactagaagat

SEQ ID NO: 171279 - DNA, 21 bp, Artificial sequence
  SiRNA target sequence
ttacctttaaactagaagatt

SEQ ID NO: 171280 - DNA, 21 bp, Artificial sequence
  SiRNA target sequence
tacctttaaactagaagattg

SEQ ID NO: 171281 - DNA, 21 bp, Artificial sequence
  SiRNA target sequence
acctttaaactagaagattgc

SEQ ID NO: 171282 - DNA, 21 bp, Artificial sequence
  SiRNA target sequence
cctttaaactagaagattgcc

SEQ ID NO: 171283 - DNA, 21 bp, Artificial sequence
  SiRNA target sequence
ctttaaactagaagattgcct

SEQ ID NO: 171284 - DNA, 21 bp, Artificial sequence
  SiRNA target sequence
tttaaactagaagattgcctg

SEQ ID NO: 171285 - DNA, 21 bp, Artificial sequence
  SiRNA target sequence
ttaaactagaagattgcctgg

SEQ ID NO: 171286 - DNA, 21 bp, Artificial sequence
  SiRNA target sequence
taaactagaagattgcctggc

SEQ ID NO: 171287 - DNA, 21 bp, Artificial sequence
  SiRNA target sequence
aaactagaagattgcctggca

SEQ ID NO: 171288 - DNA, 21 bp, Artificial sequence
  SiRNA target sequence
aactagaagattgcctggcat

SEQ ID NO: 171289 - DNA, 21 bp, Artificial sequence
  SiRNA target sequence
actagaagattgcctggcatg

SEQ ID NO: 171290 - DNA, 21 bp, Artificial sequence
  SiRNA target sequence
ctagaagattgcctggcatgt

SEQ ID NO: 171291 - DNA, 21 bp, Artificial sequence
  SiRNA target sequence
tagaagattgcctggcatgtt

SEQ ID NO: 171292 - DNA, 21 bp, Artificial sequence
  SiRNA target sequence
agaagattgcctggcatgttc

SEQ ID NO: 171293 - DNA, 21 bp, Artificial sequence
  SiRNA target sequence
gaagattgcctggcatgttcg

SEQ ID NO: 171294 - DNA, 21 bp, Artificial sequence
  SiRNA target sequence
aagattgcctggcatgttcgg

SEQ ID NO: 171295 - DNA, 21 bp, Artificial sequence
  SiRNA target sequence
agattgcctggcatgttcggc

SEQ ID NO: 171296 - DNA, 21 bp, Artificial sequence
  SiRNA target sequence
gattgcctggcatgttcggct

SEQ ID NO: 171297 - DNA, 21 bp, Artificial sequence
  SiRNA target sequence
attgcctggcatgttcggctt

SEQ ID NO: 171298 - DNA, 21 bp, Artificial sequence
  SiRNA target sequence
ttgcctggcatgttcggcttg

SEQ ID NO: 171299 - DNA, 21 bp, Artificial sequence
  SiRNA target sequence
tgcctggcatgttcggcttgt

SEQ ID NO: 171300 - DNA, 21 bp, Artificial sequence
  SiRNA target sequence
gcctggcatgttcggcttgta

SEQ ID NO: 171301 - DNA, 21 bp, Artificial sequence
  SiRNA target sequence
cctggcatgttcggcttgtat

SEQ ID NO: 171302 - DNA, 21 bp, Artificial sequence
  SiRNA target sequence
ctggcatgttcggcttgtatt

SEQ ID NO: 171303 - DNA, 21 bp, Artificial sequence
  SiRNA target sequence
tggcatgttcggcttgtattg

SEQ ID NO: 171304 - DNA, 21 bp, Artificial sequence
  SiRNA target sequence
ggcatgttcggcttgtattgc

SEQ ID NO: 171305 - DNA, 21 bp, Artificial sequence
  SiRNA target sequence
gcatgttcggcttgtattgct

SEQ ID NO: 171306 - DNA, 21 bp, Artificial sequence
  SiRNA target sequence
catgttcggcttgtattgctg

SEQ ID NO: 171307 - DNA, 21 bp, Artificial sequence
  SiRNA target sequence
atgttcggcttgtattgctga

SEQ ID NO: 171308 - DNA, 21 bp, Artificial sequence
  SiRNA target sequence
tgttcggcttgtattgctgat

SEQ ID NO: 171309 - DNA, 21 bp, Artificial sequence
  SiRNA target sequence
gttcggcttgtattgctgatt

SEQ ID NO: 171310 - DNA, 21 bp, Artificial sequence
  SiRNA target sequence
ttcggcttgtattgctgattt

SEQ ID NO: 171311 - DNA, 21 bp, Artificial sequence
  SiRNA target sequence
tcggcttgtattgctgatttt

SEQ ID NO: 171312 - DNA, 21 bp, Artificial sequence
  SiRNA target sequence
cggcttgtattgctgattttt

SEQ ID NO: 171313 - DNA, 21 bp, Artificial sequence
  SiRNA target sequence
ggcttgtattgctgatttttc

SEQ ID NO: 171314 - DNA, 21 bp, Artificial sequence
  SiRNA target sequence
gcttgtattgctgatttttct

SEQ ID NO: 171315 - DNA, 21 bp, Artificial sequence
  SiRNA target sequence
cttgtattgctgatttttctg

SEQ ID NO: 171316 - DNA, 21 bp, Artificial sequence
  SiRNA target sequence
ttgtattgctgatttttctgt

SEQ ID NO: 171317 - DNA, 21 bp, Artificial sequence
  SiRNA target sequence
tgtattgctgatttttctgtt

SEQ ID NO: 171318 - DNA, 21 bp, Artificial sequence
  SiRNA target sequence
gtattgctgatttttctgttc

SEQ ID NO: 171319 - DNA, 21 bp, Artificial sequence
  SiRNA target sequence
tattgctgatttttctgttcc

SEQ ID NO: 171320 - DNA, 21 bp, Artificial sequence
  SiRNA target sequence
attgctgatttttctgttcca

SEQ ID NO: 171321 - DNA, 21 bp, Artificial sequence
  SiRNA target sequence
ttgctgatttttctgttccaa

SEQ ID NO: 171322 - DNA, 21 bp, Artificial sequence
  SiRNA target sequence
tgctgatttttctgttccaaa

SEQ ID NO: 171323 - DNA, 21 bp, Artificial sequence
  SiRNA target sequence
gctgatttttctgttccaaaa

SEQ ID NO: 171324 - DNA, 21 bp, Artificial sequence
  SiRNA target sequence
ctgatttttctgttccaaaaa

SEQ ID NO: 171325 - DNA, 21 bp, Artificial sequence
  SiRNA target sequence
tgatttttctgttccaaaaat

SEQ ID NO: 171326 - DNA, 21 bp, Artificial sequence
  SiRNA target sequence
gatttttctgttccaaaaatt

SEQ ID NO: 171327 - DNA, 21 bp, Artificial sequence
  SiRNA target sequence
atttttctgttccaaaaattc

SEQ ID NO: 171328 - DNA, 21 bp, Artificial sequence
  SiRNA target sequence
tttttctgttccaaaaattcc

SEQ ID NO: 171329 - DNA, 21 bp, Artificial sequence
  SiRNA target sequence
ttttctgttccaaaaattcct

SEQ ID NO: 171330 - DNA, 21 bp, Artificial sequence
  SiRNA target sequence
tttctgttccaaaaattccta

SEQ ID NO: 171331 - DNA, 21 bp, Artificial sequence
  SiRNA target sequence
ttctgttccaaaaattcctac

SEQ ID NO: 171332 - DNA, 21 bp, Artificial sequence
  SiRNA target sequence
tctgttccaaaaattcctact

SEQ ID NO: 171333 - DNA, 21 bp, Artificial sequence
  SiRNA target sequence
ctgttccaaaaattcctactt

SEQ ID NO: 171334 - DNA, 21 bp, Artificial sequence
  SiRNA target sequence
tgttccaaaaattcctactta

SEQ ID NO: 171335 - DNA, 21 bp, Artificial sequence
  SiRNA target sequence
gttccaaaaattcctacttac

SEQ ID NO: 171336 - DNA, 21 bp, Artificial sequence
  SiRNA target sequence
ttccaaaaattcctacttaca

SEQ ID NO: 171337 - DNA, 21 bp, Artificial sequence
  SiRNA target sequence
tccaaaaattcctacttacac

SEQ ID NO: 171338 - DNA, 21 bp, Artificial sequence
  SiRNA target sequence
ccaaaaattcctacttacaca

SEQ ID NO: 171339 - DNA, 21 bp, Artificial sequence
  SiRNA target sequence
caaaaattcctacttacacag

SEQ ID NO: 171340 - DNA, 21 bp, Artificial sequence
  SiRNA target sequence
aaaaattcctacttacacaga

SEQ ID NO: 171341 - DNA, 21 bp, Artificial sequence
  SiRNA target sequence
aaaattcctacttacacagaa

SEQ ID NO: 171342 - DNA, 21 bp, Artificial sequence
  SiRNA target sequence
aaattcctacttacacagaac

SEQ ID NO: 171343 - DNA, 21 bp, Artificial sequence
  SiRNA target sequence
aattcctacttacacagaact

SEQ ID NO: 171344 - DNA, 21 bp, Artificial sequence
  SiRNA target sequence
attcctacttacacagaactg

SEQ ID NO: 171345 - DNA, 21 bp, Artificial sequence
  SiRNA target sequence
ttcctacttacacagaactga

SEQ ID NO: 171346 - DNA, 21 bp, Artificial sequence
  SiRNA target sequence
tcctacttacacagaactgaa

SEQ ID NO: 171347 - DNA, 21 bp, Artificial sequence
  SiRNA target sequence
cctacttacacagaactgaaa

SEQ ID NO: 171348 - DNA, 21 bp, Artificial sequence
  SiRNA target sequence
ctacttacacagaactgaaag

SEQ ID NO: 171349 - DNA, 21 bp, Artificial sequence
  SiRNA target sequence
tacttacacagaactgaaaga

SEQ ID NO: 171350 - DNA, 21 bp, Artificial sequence
  SiRNA target sequence
acttacacagaactgaaagat

SEQ ID NO: 171351 - DNA, 21 bp, Artificial sequence
  SiRNA target sequence
cttacacagaactgaaagatg

SEQ ID NO: 171352 - DNA, 21 bp, Artificial sequence
  SiRNA target sequence
ttacacagaactgaaagatgt

SEQ ID NO: 171353 - DNA, 21 bp, Artificial sequence
  SiRNA target sequence
tacacagaactgaaagatgtc

SEQ ID NO: 171354 - DNA, 21 bp, Artificial sequence
  SiRNA target sequence
acacagaactgaaagatgtcc

SEQ ID NO: 171355 - DNA, 21 bp, Artificial sequence
  SiRNA target sequence
cacagaactgaaagatgtccc

SEQ ID NO: 171356 - DNA, 21 bp, Artificial sequence
  SiRNA target sequence
acagaactgaaagatgtccct

SEQ ID NO: 171357 - DNA, 21 bp, Artificial sequence
  SiRNA target sequence
cagaactgaaagatgtccctt

SEQ ID NO: 171358 - DNA, 21 bp, Artificial sequence
  SiRNA target sequence
agaactgaaagatgtcccttt

SEQ ID NO: 171359 - DNA, 21 bp, Artificial sequence
  SiRNA target sequence
gaactgaaagatgtcccttta

SEQ ID NO: 171360 - DNA, 21 bp, Artificial sequence
  SiRNA target sequence
aactgaaagatgtccctttaa

SEQ ID NO: 171361 - DNA, 21 bp, Artificial sequence
  SiRNA target sequence
actgaaagatgtccctttaac

SEQ ID NO: 171362 - DNA, 21 bp, Artificial sequence
  SiRNA target sequence
ctgaaagatgtccctttaaca

SEQ ID NO: 171363 - DNA, 21 bp, Artificial sequence
  SiRNA target sequence
tgaaagatgtccctttaacat

SEQ ID NO: 171364 - DNA, 21 bp, Artificial sequence
  SiRNA target sequence
gaaagatgtccctttaacatt

SEQ ID NO: 171365 - DNA, 21 bp, Artificial sequence
  SiRNA target sequence
aaagatgtccctttaacattt

SEQ ID NO: 171366 - DNA, 21 bp, Artificial sequence
  SiRNA target sequence
aagatgtccctttaacatttt

SEQ ID NO: 171367 - DNA, 21 bp, Artificial sequence
  SiRNA target sequence
agatgtccctttaacattttt

SEQ ID NO: 171368 - DNA, 21 bp, Artificial sequence
  SiRNA target sequence
gatgtccctttaacattttta

SEQ ID NO: 171369 - DNA, 21 bp, Artificial sequence
  SiRNA target sequence
atgtccctttaacatttttat

SEQ ID NO: 171370 - DNA, 21 bp, Artificial sequence
  SiRNA target sequence
tgtccctttaacatttttatt

SEQ ID NO: 171371 - DNA, 21 bp, Artificial sequence
  SiRNA target sequence
gtccctttaacatttttatta

SEQ ID NO: 171372 - DNA, 21 bp, Artificial sequence
  SiRNA target sequence
tccctttaacatttttattat

SEQ ID NO: 171373 - DNA, 21 bp, Artificial sequence
  SiRNA target sequence
ccctttaacatttttattatc

SEQ ID NO: 171374 - DNA, 21 bp, Artificial sequence
  SiRNA target sequence
cctttaacatttttattatca

SEQ ID NO: 171375 - DNA, 21 bp, Artificial sequence
  SiRNA target sequence
ctttaacatttttattatcac

SEQ ID NO: 171376 - DNA, 21 bp, Artificial sequence
  SiRNA target sequence
tttaacatttttattatcacc

SEQ ID NO: 171377 - DNA, 21 bp, Artificial sequence
  SiRNA target sequence
ttaacatttttattatcacca

SEQ ID NO: 171378 - DNA, 21 bp, Artificial sequence
  SiRNA target sequence
taacatttttattatcaccac

SEQ ID NO: 171379 - DNA, 21 bp, Artificial sequence
  SiRNA target sequence
aacatttttattatcaccaca

SEQ ID NO: 171380 - DNA, 21 bp, Artificial sequence
  SiRNA target sequence
acatttttattatcaccacat

SEQ ID NO: 171381 - DNA, 21 bp, Artificial sequence
  SiRNA target sequence
catttttattatcaccacatt

SEQ ID NO: 171382 - DNA, 21 bp, Artificial sequence
  SiRNA target sequence
atttttattatcaccacattc

SEQ ID NO: 171383 - DNA, 21 bp, Artificial sequence
  SiRNA target sequence
tttttattatcaccacattcg

SEQ ID NO: 171384 - DNA, 21 bp, Artificial sequence
  SiRNA target sequence
ttttattatcaccacattcga

SEQ ID NO: 171385 - DNA, 21 bp, Artificial sequence
  SiRNA target sequence
tttattatcaccacattcgaa

SEQ ID NO: 171386 - DNA, 21 bp, Artificial sequence
  SiRNA target sequence
ttattatcaccacattcgaaa

SEQ ID NO: 171387 - DNA, 21 bp, Artificial sequence
  SiRNA target sequence
tattatcaccacattcgaaaa

SEQ ID NO: 171388 - DNA, 21 bp, Artificial sequence
  SiRNA target sequence
attatcaccacattcgaaaat

SEQ ID NO: 171389 - DNA, 21 bp, Artificial sequence
  SiRNA target sequence
ttatcaccacattcgaaaatg

SEQ ID NO: 171390 - DNA, 21 bp, Artificial sequence
  SiRNA target sequence
tatcaccacattcgaaaatga

SEQ ID NO: 171391 - DNA, 21 bp, Artificial sequence
  SiRNA target sequence
atcaccacattcgaaaatgaa

SEQ ID NO: 171392 - DNA, 21 bp, Artificial sequence
  SiRNA target sequence
tcaccacattcgaaaatgaat

SEQ ID NO: 171393 - DNA, 21 bp, Artificial sequence
  SiRNA target sequence
caccacattcgaaaatgaata

SEQ ID NO: 171394 - DNA, 21 bp, Artificial sequence
  SiRNA target sequence
accacattcgaaaatgaatat

SEQ ID NO: 171395 - DNA, 21 bp, Artificial sequence
  SiRNA target sequence
ccacattcgaaaatgaatatg

SEQ ID NO: 171396 - DNA, 21 bp, Artificial sequence
  SiRNA target sequence
cacattcgaaaatgaatatgt

SEQ ID NO: 171397 - DNA, 21 bp, Artificial sequence
  SiRNA target sequence
acattcgaaaatgaatatgta

SEQ ID NO: 171398 - DNA, 21 bp, Artificial sequence
  SiRNA target sequence
cattcgaaaatgaatatgtat

SEQ ID NO: 171399 - DNA, 21 bp, Artificial sequence
  SiRNA target sequence
attcgaaaatgaatatgtatg

SEQ ID NO: 171400 - DNA, 21 bp, Artificial sequence
  SiRNA target sequence
ttcgaaaatgaatatgtatgc

SEQ ID NO: 171401 - DNA, 21 bp, Artificial sequence
  SiRNA target sequence
tcgaaaatgaatatgtatgca

SEQ ID NO: 171402 - DNA, 21 bp, Artificial sequence
  SiRNA target sequence
cgaaaatgaatatgtatgcac

SEQ ID NO: 171403 - DNA, 21 bp, Artificial sequence
  SiRNA target sequence
gaaaatgaatatgtatgcaca

SEQ ID NO: 171404 - DNA, 21 bp, Artificial sequence
  SiRNA target sequence
aaaatgaatatgtatgcacac

SEQ ID NO: 171405 - DNA, 21 bp, Artificial sequence
  SiRNA target sequence
aaatgaatatgtatgcacact

SEQ ID NO: 171406 - DNA, 21 bp, Artificial sequence
  SiRNA target sequence
aatgaatatgtatgcacacta

SEQ ID NO: 171407 - DNA, 21 bp, Artificial sequence
  SiRNA target sequence
atgaatatgtatgcacactat

SEQ ID NO: 171408 - DNA, 21 bp, Artificial sequence
  SiRNA target sequence
tgaatatgtatgcacactata

SEQ ID NO: 171409 - DNA, 21 bp, Artificial sequence
  SiRNA target sequence
gaatatgtatgcacactataa

SEQ ID NO: 171410 - DNA, 21 bp, Artificial sequence
  SiRNA target sequence
aatatgtatgcacactataac

SEQ ID NO: 171411 - DNA, 21 bp, Artificial sequence
  SiRNA target sequence
atatgtatgcacactataaca

SEQ ID NO: 171412 - DNA, 21 bp, Artificial sequence
  SiRNA target sequence
tatgtatgcacactataacaa

SEQ ID NO: 171413 - DNA, 21 bp, Artificial sequence
  SiRNA target sequence
atgtatgcacactataacaat

SEQ ID NO: 171414 - DNA, 21 bp, Artificial sequence
  SiRNA target sequence
tgtatgcacactataacaatc

SEQ ID NO: 171415 - DNA, 21 bp, Artificial sequence
  SiRNA target sequence
gtatgcacactataacaatca

SEQ ID NO: 171416 - DNA, 21 bp, Artificial sequence
  SiRNA target sequence
tatgcacactataacaatcat

SEQ ID NO: 171417 - DNA, 21 bp, Artificial sequence
  SiRNA target sequence
atgcacactataacaatcata

SEQ ID NO: 171418 - DNA, 21 bp, Artificial sequence
  SiRNA target sequence
tgcacactataacaatcatat

SEQ ID NO: 171419 - DNA, 21 bp, Artificial sequence
  SiRNA target sequence
gcacactataacaatcatata

SEQ ID NO: 171420 - DNA, 21 bp, Artificial sequence
  SiRNA target sequence
cacactataacaatcatataa

SEQ ID NO: 171421 - DNA, 21 bp, Artificial sequence
  SiRNA target sequence
acactataacaatcatataat

SEQ ID NO: 171422 - DNA, 21 bp, Artificial sequence
  SiRNA target sequence
cactataacaatcatataatg

SEQ ID NO: 171423 - DNA, 21 bp, Artificial sequence
  SiRNA target sequence
actataacaatcatataatgt

SEQ ID NO: 171424 - DNA, 21 bp, Artificial sequence
  SiRNA target sequence
ctataacaatcatataatgtc

SEQ ID NO: 171425 - DNA, 21 bp, Artificial sequence
  SiRNA target sequence
tataacaatcatataatgtcc

SEQ ID NO: 171426 - DNA, 21 bp, Artificial sequence
  SiRNA target sequence
ataacaatcatataatgtcct

SEQ ID NO: 171427 - DNA, 21 bp, Artificial sequence
  SiRNA target sequence
taacaatcatataatgtcctt

SEQ ID NO: 171428 - DNA, 21 bp, Artificial sequence
  SiRNA target sequence
aacaatcatataatgtccttt

SEQ ID NO: 171429 - DNA, 21 bp, Artificial sequence
  SiRNA target sequence
acaatcatataatgtccttta

SEQ ID NO: 171430 - DNA, 21 bp, Artificial sequence
  SiRNA target sequence
caatcatataatgtcctttag

SEQ ID NO: 171431 - DNA, 21 bp, Artificial sequence
  SiRNA target sequence
aatcatataatgtcctttagt

SEQ ID NO: 171432 - DNA, 21 bp, Artificial sequence
  SiRNA target sequence
atcatataatgtcctttagtg

SEQ ID NO: 171433 - DNA, 21 bp, Artificial sequence
  SiRNA target sequence
tcatataatgtcctttagtga

SEQ ID NO: 171434 - DNA, 21 bp, Artificial sequence
  SiRNA target sequence
catataatgtcctttagtgat

SEQ ID NO: 171435 - DNA, 21 bp, Artificial sequence
  SiRNA target sequence
atataatgtcctttagtgatt

SEQ ID NO: 171436 - DNA, 21 bp, Artificial sequence
  SiRNA target sequence
tataatgtcctttagtgattt

SEQ ID NO: 171437 - DNA, 21 bp, Artificial sequence
  SiRNA target sequence
ataatgtcctttagtgatttt

SEQ ID NO: 171438 - DNA, 21 bp, Artificial sequence
  SiRNA target sequence
taatgtcctttagtgattttg

SEQ ID NO: 171439 - DNA, 21 bp, Artificial sequence
  SiRNA target sequence
aatgtcctttagtgattttga

SEQ ID NO: 171440 - DNA, 21 bp, Artificial sequence
  SiRNA target sequence
atgtcctttagtgattttgaa

SEQ ID NO: 171441 - DNA, 21 bp, Artificial sequence
  SiRNA target sequence
tgtcctttagtgattttgaat

SEQ ID NO: 171442 - DNA, 21 bp, Artificial sequence
  SiRNA target sequence
gtcctttagtgattttgaata

SEQ ID NO: 171443 - DNA, 21 bp, Artificial sequence
  SiRNA target sequence
tcctttagtgattttgaatat

SEQ ID NO: 171444 - DNA, 21 bp, Artificial sequence
  SiRNA target sequence
cctttagtgattttgaatatc

SEQ ID NO: 171445 - DNA, 21 bp, Artificial sequence
  SiRNA target sequence
ctttagtgattttgaatatca

SEQ ID NO: 171446 - DNA, 21 bp, Artificial sequence
  SiRNA target sequence
tttagtgattttgaatatcac

SEQ ID NO: 171447 - DNA, 21 bp, Artificial sequence
  SiRNA target sequence
ttagtgattttgaatatcact

SEQ ID NO: 171448 - DNA, 21 bp, Artificial sequence
  SiRNA target sequence
tagtgattttgaatatcactt

SEQ ID NO: 171449 - DNA, 21 bp, Artificial sequence
  SiRNA target sequence
agtgattttgaatatcactta

SEQ ID NO: 171450 - DNA, 21 bp, Artificial sequence
  SiRNA target sequence
gtgattttgaatatcacttaa

SEQ ID NO: 171451 - DNA, 21 bp, Artificial sequence
  SiRNA target sequence
tgattttgaatatcacttaat

SEQ ID NO: 171452 - DNA, 21 bp, Artificial sequence
  SiRNA target sequence
gattttgaatatcacttaatt

SEQ ID NO: 171453 - DNA, 21 bp, Artificial sequence
  SiRNA target sequence
attttgaatatcacttaattt

SEQ ID NO: 171454 - DNA, 21 bp, Artificial sequence
  SiRNA target sequence
ttttgaatatcacttaatttc

SEQ ID NO: 171455 - DNA, 21 bp, Artificial sequence
  SiRNA target sequence
tttgaatatcacttaatttca

SEQ ID NO: 171456 - DNA, 21 bp, Artificial sequence
  SiRNA target sequence
ttgaatatcacttaatttcat

SEQ ID NO: 171457 - DNA, 21 bp, Artificial sequence
  SiRNA target sequence
tgaatatcacttaatttcatt

SEQ ID NO: 171458 - DNA, 21 bp, Artificial sequence
  SiRNA target sequence
gaatatcacttaatttcattt

SEQ ID NO: 171459 - DNA, 21 bp, Artificial sequence
  SiRNA target sequence
aatatcacttaatttcattta

SEQ ID NO: 171460 - DNA, 21 bp, Artificial sequence
  SiRNA target sequence
atatcacttaatttcatttat

SEQ ID NO: 171461 - DNA, 21 bp, Artificial sequence
  SiRNA target sequence
tatcacttaatttcatttata

SEQ ID NO: 171462 - DNA, 21 bp, Artificial sequence
  SiRNA target sequence
atcacttaatttcatttataa

SEQ ID NO: 171463 - DNA, 21 bp, Artificial sequence
  SiRNA target sequence
tcacttaatttcatttataaa

SEQ ID NO: 171464 - DNA, 21 bp, Artificial sequence
  SiRNA target sequence
cacttaatttcatttataaaa

SEQ ID NO: 171465 - DNA, 21 bp, Artificial sequence
  SiRNA target sequence
acttaatttcatttataaaac

SEQ ID NO: 171466 - DNA, 21 bp, Artificial sequence
  SiRNA target sequence
cttaatttcatttataaaact

SEQ ID NO: 171467 - DNA, 21 bp, Artificial sequence
  SiRNA target sequence
ttaatttcatttataaaacta

SEQ ID NO: 171468 - DNA, 21 bp, Artificial sequence
  SiRNA target sequence
taatttcatttataaaactaa

SEQ ID NO: 171469 - DNA, 21 bp, Artificial sequence
  SiRNA target sequence
aatttcatttataaaactaaa

SEQ ID NO: 171470 - DNA, 21 bp, Artificial sequence
  SiRNA target sequence
atttcatttataaaactaaaa

SEQ ID NO: 171471 - DNA, 21 bp, Artificial sequence
  SiRNA target sequence
tttcatttataaaactaaaat

SEQ ID NO: 171472 - DNA, 21 bp, Artificial sequence
  SiRNA target sequence
ttcatttataaaactaaaatt

SEQ ID NO: 171473 - DNA, 21 bp, Artificial sequence
  SiRNA target sequence
tcatttataaaactaaaattt

SEQ ID NO: 171474 - DNA, 21 bp, Artificial sequence
  SiRNA target sequence
catttataaaactaaaattta

SEQ ID NO: 171475 - DNA, 21 bp, Artificial sequence
  SiRNA target sequence
atttataaaactaaaatttaa

SEQ ID NO: 171476 - DNA, 21 bp, Artificial sequence
  SiRNA target sequence
tttataaaactaaaatttaat

SEQ ID NO: 171477 - DNA, 21 bp, Artificial sequence
  SiRNA target sequence
ttataaaactaaaatttaatg

SEQ ID NO: 171478 - DNA, 21 bp, Artificial sequence
  SiRNA target sequence
tataaaactaaaatttaatgt

SEQ ID NO: 171479 - DNA, 21 bp, Artificial sequence
  SiRNA target sequence
ataaaactaaaatttaatgta

SEQ ID NO: 171480 - DNA, 21 bp, Artificial sequence
  SiRNA target sequence
taaaactaaaatttaatgtaa

SEQ ID NO: 171481 - DNA, 21 bp, Artificial sequence
  SiRNA target sequence
aaaactaaaatttaatgtaat

SEQ ID NO: 171482 - DNA, 21 bp, Artificial sequence
  SiRNA target sequence
aaactaaaatttaatgtaata

SEQ ID NO: 171483 - DNA, 21 bp, Artificial sequence
  SiRNA target sequence
aactaaaatttaatgtaataa

SEQ ID NO: 171484 - DNA, 21 bp, Artificial sequence
  SiRNA target sequence
actaaaatttaatgtaataaa

SEQ ID NO: 171485 - DNA, 21 bp, Artificial sequence
  SiRNA target sequence
ctaaaatttaatgtaataaaa

SEQ ID NO: 171486 - DNA, 21 bp, Artificial sequence
  SiRNA target sequence
taaaatttaatgtaataaaag

SEQ ID NO: 171487 - DNA, 21 bp, Artificial sequence
  SiRNA target sequence
aaaatttaatgtaataaaagt

SEQ ID NO: 171488 - DNA, 21 bp, Artificial sequence
  SiRNA target sequence
aaatttaatgtaataaaagta

SEQ ID NO: 171489 - DNA, 21 bp, Artificial sequence
  SiRNA target sequence
aatttaatgtaataaaagtat

SEQ ID NO: 171490 - DNA, 21 bp, Artificial sequence
  SiRNA target sequence
atttaatgtaataaaagtata

SEQ ID NO: 171491 - DNA, 21 bp, Artificial sequence
  SiRNA target sequence
tttaatgtaataaaagtatat

SEQ ID NO: 171492 - DNA, 21 bp, Artificial sequence
  SiRNA target sequence
ttaatgtaataaaagtatatg

SEQ ID NO: 171493 - DNA, 21 bp, Artificial sequence
  SiRNA target sequence
taatgtaataaaagtatatga

SEQ ID NO: 171494 - DNA, 21 bp, Artificial sequence
  SiRNA target sequence
aatgtaataaaagtatatgat

SEQ ID NO: 171495 - DNA, 21 bp, Artificial sequence
  SiRNA target sequence
atgtaataaaagtatatgata

SEQ ID NO: 171496 - DNA, 21 bp, Artificial sequence
  SiRNA target sequence
tgtaataaaagtatatgatac

SEQ ID NO: 171497 - DNA, 21 bp, Artificial sequence
  SiRNA target sequence
gtaataaaagtatatgataca

SEQ ID NO: 171498 - DNA, 21 bp, Artificial sequence
  SiRNA target sequence
taataaaagtatatgatacat

SEQ ID NO: 171499 - DNA, 21 bp, Artificial sequence
  SiRNA target sequence
aataaaagtatatgatacatc

SEQ ID NO: 171500 - DNA, 21 bp, Artificial sequence
  SiRNA target sequence
ataaaagtatatgatacatct

SEQ ID NO: 171501 - DNA, 21 bp, Artificial sequence
  SiRNA target sequence
taaaagtatatgatacatctt

SEQ ID NO: 171502 - DNA, 21 bp, Artificial sequence
  SiRNA target sequence
aaaagtatatgatacatctta

SEQ ID NO: 171503 - DNA, 21 bp, Artificial sequence
  SiRNA target sequence
aaagtatatgatacatcttat

SEQ ID NO: 171504 - DNA, 21 bp, Artificial sequence
  SiRNA target sequence
aagtatatgatacatcttatg

SEQ ID NO: 171505 - DNA, 21 bp, Artificial sequence
  SiRNA target sequence
agtatatgatacatcttatgt

SEQ ID NO: 171506 - DNA, 21 bp, Artificial sequence
  SiRNA target sequence
gtatatgatacatcttatgtc

SEQ ID NO: 171507 - DNA, 21 bp, Artificial sequence
  SiRNA target sequence
tatatgatacatcttatgtca

SEQ ID NO: 171508 - DNA, 21 bp, Artificial sequence
  SiRNA target sequence
atatgatacatcttatgtcaa

SEQ ID NO: 171509 - DNA, 21 bp, Artificial sequence
  SiRNA target sequence
tatgatacatcttatgtcaaa

SEQ ID NO: 171510 - DNA, 21 bp, Artificial sequence
  SiRNA target sequence
atgatacatcttatgtcaaaa

SEQ ID NO: 171511 - DNA, 21 bp, Artificial sequence
  SiRNA target sequence
tgatacatcttatgtcaaaaa

SEQ ID NO: 171512 - DNA, 21 bp, Artificial sequence
  SiRNA target sequence
gatacatcttatgtcaaaaat

SEQ ID NO: 171513 - DNA, 21 bp, Artificial sequence
  SiRNA target sequence
atacatcttatgtcaaaaata

SEQ ID NO: 171514 - DNA, 21 bp, Artificial sequence
  SiRNA target sequence
tacatcttatgtcaaaaatat

SEQ ID NO: 171515 - DNA, 21 bp, Artificial sequence
  SiRNA target sequence
acatcttatgtcaaaaatatt

SEQ ID NO: 171516 - DNA, 21 bp, Artificial sequence
  SiRNA target sequence
catcttatgtcaaaaatattc

SEQ ID NO: 171517 - DNA, 21 bp, Artificial sequence
  SiRNA target sequence
atcttatgtcaaaaatattct

SEQ ID NO: 171518 - DNA, 21 bp, Artificial sequence
  SiRNA target sequence
tcttatgtcaaaaatattctg

SEQ ID NO: 171519 - DNA, 21 bp, Artificial sequence
  SiRNA target sequence
cttatgtcaaaaatattctgt

SEQ ID NO: 171520 - DNA, 21 bp, Artificial sequence
  SiRNA target sequence
ttatgtcaaaaatattctgta

SEQ ID NO: 171521 - DNA, 21 bp, Artificial sequence
  SiRNA target sequence
tatgtcaaaaatattctgtat

SEQ ID NO: 171522 - DNA, 21 bp, Artificial sequence
  SiRNA target sequence
atgtcaaaaatattctgtatg

SEQ ID NO: 171523 - DNA, 21 bp, Artificial sequence
  SiRNA target sequence
tgtcaaaaatattctgtatga

SEQ ID NO: 171524 - DNA, 21 bp, Artificial sequence
  SiRNA target sequence
gtcaaaaatattctgtatgat

SEQ ID NO: 171525 - DNA, 21 bp, Artificial sequence
  SiRNA target sequence
tcaaaaatattctgtatgata

SEQ ID NO: 171526 - DNA, 21 bp, Artificial sequence
  SiRNA target sequence
caaaaatattctgtatgatag

SEQ ID NO: 171527 - DNA, 21 bp, Artificial sequence
  SiRNA target sequence
aaaaatattctgtatgatagt

SEQ ID NO: 171528 - DNA, 21 bp, Artificial sequence
  SiRNA target sequence
aaaatattctgtatgatagtg

SEQ ID NO: 171529 - DNA, 21 bp, Artificial sequence
  SiRNA target sequence
aaatattctgtatgatagtgt

SEQ ID NO: 171530 - DNA, 21 bp, Artificial sequence
  SiRNA target sequence
aatattctgtatgatagtgtt

SEQ ID NO: 171531 - DNA, 21 bp, Artificial sequence
  SiRNA target sequence
atattctgtatgatagtgttt

SEQ ID NO: 171532 - DNA, 21 bp, Artificial sequence
  SiRNA target sequence
tattctgtatgatagtgttta

SEQ ID NO: 171533 - DNA, 21 bp, Artificial sequence
  SiRNA target sequence
attctgtatgatagtgtttat

SEQ ID NO: 171534 - DNA, 21 bp, Artificial sequence
  SiRNA target sequence
ttctgtatgatagtgtttatg

SEQ ID NO: 171535 - DNA, 21 bp, Artificial sequence
  SiRNA target sequence
tctgtatgatagtgtttatga

SEQ ID NO: 171536 - DNA, 21 bp, Artificial sequence
  SiRNA target sequence
ctgtatgatagtgtttatgag

SEQ ID NO: 171537 - DNA, 21 bp, Artificial sequence
  SiRNA target sequence
tgtatgatagtgtttatgagg

SEQ ID NO: 171538 - DNA, 21 bp, Artificial sequence
  SiRNA target sequence
gtatgatagtgtttatgagga

SEQ ID NO: 171539 - DNA, 21 bp, Artificial sequence
  SiRNA target sequence
tatgatagtgtttatgaggaa

SEQ ID NO: 171540 - DNA, 21 bp, Artificial sequence
  SiRNA target sequence
atgatagtgtttatgaggaaa

SEQ ID NO: 171541 - DNA, 21 bp, Artificial sequence
  SiRNA target sequence
tgatagtgtttatgaggaaag

SEQ ID NO: 171542 - DNA, 21 bp, Artificial sequence
  SiRNA target sequence
gatagtgtttatgaggaaagc

SEQ ID NO: 171543 - DNA, 21 bp, Artificial sequence
  SiRNA target sequence
atagtgtttatgaggaaagca

SEQ ID NO: 171544 - DNA, 21 bp, Artificial sequence
  SiRNA target sequence
tagtgtttatgaggaaagcac

SEQ ID NO: 171545 - DNA, 21 bp, Artificial sequence
  SiRNA target sequence
agtgtttatgaggaaagcacg

SEQ ID NO: 171546 - DNA, 21 bp, Artificial sequence
  SiRNA target sequence
gtgtttatgaggaaagcacga

SEQ ID NO: 171547 - DNA, 21 bp, Artificial sequence
  SiRNA target sequence
tgtttatgaggaaagcacgag

SEQ ID NO: 171548 - DNA, 21 bp, Artificial sequence
  SiRNA target sequence
gtttatgaggaaagcacgaga

SEQ ID NO: 171549 - DNA, 21 bp, Artificial sequence
  SiRNA target sequence
tttatgaggaaagcacgagag

SEQ ID NO: 171550 - DNA, 21 bp, Artificial sequence
  SiRNA target sequence
ttatgaggaaagcacgagaga

SEQ ID NO: 171551 - DNA, 21 bp, Artificial sequence
  SiRNA target sequence
tatgaggaaagcacgagagac

SEQ ID NO: 171552 - DNA, 21 bp, Artificial sequence
  SiRNA target sequence
atgaggaaagcacgagagaca

SEQ ID NO: 171553 - DNA, 21 bp, Artificial sequence
  SiRNA target sequence
tgaggaaagcacgagagacaa

SEQ ID NO: 171554 - DNA, 21 bp, Artificial sequence
  SiRNA target sequence
gaggaaagcacgagagacaaa

SEQ ID NO: 171555 - DNA, 21 bp, Artificial sequence
  SiRNA target sequence
aggaaagcacgagagacaaaa

SEQ ID NO: 171556 - DNA, 21 bp, Artificial sequence
  SiRNA target sequence
ggaaagcacgagagacaaaat

SEQ ID NO: 171557 - DNA, 21 bp, Artificial sequence
  SiRNA target sequence
gaaagcacgagagacaaaata

SEQ ID NO: 171558 - DNA, 21 bp, Artificial sequence
  SiRNA target sequence
aaagcacgagagacaaaataa

SEQ ID NO: 171559 - DNA, 21 bp, Artificial sequence
  SiRNA target sequence
aagcacgagagacaaaataat

SEQ ID NO: 171560 - DNA, 21 bp, Artificial sequence
  SiRNA target sequence
agcacgagagacaaaataata

SEQ ID NO: 171561 - DNA, 21 bp, Artificial sequence
  SiRNA target sequence
gcacgagagacaaaataataa

SEQ ID NO: 171562 - DNA, 21 bp, Artificial sequence
  SiRNA target sequence
cacgagagacaaaataataat

SEQ ID NO: 171563 - DNA, 21 bp, Artificial sequence
  SiRNA target sequence
acgagagacaaaataataata

SEQ ID NO: 171564 - DNA, 21 bp, Artificial sequence
  SiRNA target sequence
cgagagacaaaataataataa

SEQ ID NO: 171565 - DNA, 21 bp, Artificial sequence
  SiRNA target sequence
gagagacaaaataataataag

SEQ ID NO: 171566 - DNA, 21 bp, Artificial sequence
  SiRNA target sequence
agagacaaaataataataagt

SEQ ID NO: 171567 - DNA, 21 bp, Artificial sequence
  SiRNA target sequence
gagacaaaataataataagtg

SEQ ID NO: 171568 - DNA, 21 bp, Artificial sequence
  SiRNA target sequence
agacaaaataataataagtga

SEQ ID NO: 171569 - DNA, 21 bp, Artificial sequence
  SiRNA target sequence
gacaaaataataataagtgac

SEQ ID NO: 171570 - DNA, 21 bp, Artificial sequence
  SiRNA target sequence
acaaaataataataagtgact

SEQ ID NO: 171571 - DNA, 21 bp, Artificial sequence
  SiRNA target sequence
caaaataataataagtgactg

SEQ ID NO: 171572 - DNA, 21 bp, Artificial sequence
  SiRNA target sequence
aaaataataataagtgactgt

SEQ ID NO: 171573 - DNA, 21 bp, Artificial sequence
  SiRNA target sequence
aaataataataagtgactgtc

SEQ ID NO: 171574 - DNA, 21 bp, Artificial sequence
  SiRNA target sequence
aataataataagtgactgtcc

SEQ ID NO: 171575 - DNA, 21 bp, Artificial sequence
  SiRNA target sequence
ataataataagtgactgtcct

SEQ ID NO: 171576 - DNA, 21 bp, Artificial sequence
  SiRNA target sequence
taataataagtgactgtcctg

SEQ ID NO: 171577 - DNA, 21 bp, Artificial sequence
  SiRNA target sequence
aataataagtgactgtcctgg

SEQ ID NO: 171578 - DNA, 21 bp, Artificial sequence
  SiRNA target sequence
ataataagtgactgtcctggg

SEQ ID NO: 171579 - DNA, 21 bp, Artificial sequence
  SiRNA target sequence
taataagtgactgtcctggga

SEQ ID NO: 171580 - DNA, 21 bp, Artificial sequence
  SiRNA target sequence
aataagtgactgtcctgggac

SEQ ID NO: 171581 - DNA, 21 bp, Artificial sequence
  SiRNA target sequence
ataagtgactgtcctgggact

SEQ ID NO: 171582 - DNA, 21 bp, Artificial sequence
  SiRNA target sequence
taagtgactgtcctgggactg

SEQ ID NO: 171583 - DNA, 21 bp, Artificial sequence
  SiRNA target sequence
aagtgactgtcctgggactgt

SEQ ID NO: 171584 - DNA, 21 bp, Artificial sequence
  SiRNA target sequence
agtgactgtcctgggactgtt

SEQ ID NO: 171585 - DNA, 21 bp, Artificial sequence
  SiRNA target sequence
gtgactgtcctgggactgttt

SEQ ID NO: 171586 - DNA, 21 bp, Artificial sequence
  SiRNA target sequence
tgactgtcctgggactgtttc

SEQ ID NO: 171587 - DNA, 21 bp, Artificial sequence
  SiRNA target sequence
gactgtcctgggactgtttca

SEQ ID NO: 171588 - DNA, 21 bp, Artificial sequence
  SiRNA target sequence
actgtcctgggactgtttcat

SEQ ID NO: 171589 - DNA, 21 bp, Artificial sequence
  SiRNA target sequence
ctgtcctgggactgtttcata

SEQ ID NO: 171590 - DNA, 21 bp, Artificial sequence
  SiRNA target sequence
tgtcctgggactgtttcatat

SEQ ID NO: 171591 - DNA, 21 bp, Artificial sequence
  SiRNA target sequence
gtcctgggactgtttcatata

SEQ ID NO: 171592 - DNA, 21 bp, Artificial sequence
  SiRNA target sequence
tcctgggactgtttcatatat

SEQ ID NO: 171593 - DNA, 21 bp, Artificial sequence
  SiRNA target sequence
cctgggactgtttcatatatt

SEQ ID NO: 171594 - DNA, 21 bp, Artificial sequence
  SiRNA target sequence
ctgggactgtttcatatattg

SEQ ID NO: 171595 - DNA, 21 bp, Artificial sequence
  SiRNA target sequence
tgggactgtttcatatattga

SEQ ID NO: 171596 - DNA, 21 bp, Artificial sequence
  SiRNA target sequence
gggactgtttcatatattgaa

SEQ ID NO: 171597 - DNA, 21 bp, Artificial sequence
  SiRNA target sequence
ggactgtttcatatattgaaa

SEQ ID NO: 171598 - DNA, 21 bp, Artificial sequence
  SiRNA target sequence
gactgtttcatatattgaaag

SEQ ID NO: 171599 - DNA, 21 bp, Artificial sequence
  SiRNA target sequence
actgtttcatatattgaaagg

SEQ ID NO: 171600 - DNA, 21 bp, Artificial sequence
  SiRNA target sequence
ctgtttcatatattgaaaggc

SEQ ID NO: 171601 - DNA, 21 bp, Artificial sequence
  SiRNA target sequence
tgtttcatatattgaaaggca

SEQ ID NO: 171602 - DNA, 21 bp, Artificial sequence
  SiRNA target sequence
gtttcatatattgaaaggcaa

SEQ ID NO: 171603 - DNA, 21 bp, Artificial sequence
  SiRNA target sequence
tttcatatattgaaaggcaag

SEQ ID NO: 171604 - DNA, 21 bp, Artificial sequence
  SiRNA target sequence
ttcatatattgaaaggcaagc

SEQ ID NO: 171605 - DNA, 21 bp, Artificial sequence
  SiRNA target sequence
tcatatattgaaaggcaagca

SEQ ID NO: 171606 - DNA, 21 bp, Artificial sequence
  SiRNA target sequence
catatattgaaaggcaagcac

SEQ ID NO: 171607 - DNA, 21 bp, Artificial sequence
  SiRNA target sequence
atatattgaaaggcaagcaca

SEQ ID NO: 171608 - DNA, 21 bp, Artificial sequence
  SiRNA target sequence
tatattgaaaggcaagcacac

SEQ ID NO: 171609 - DNA, 21 bp, Artificial sequence
  SiRNA target sequence
atattgaaaggcaagcacacc

SEQ ID NO: 171610 - DNA, 21 bp, Artificial sequence
  SiRNA target sequence
tattgaaaggcaagcacacca

SEQ ID NO: 171611 - DNA, 21 bp, Artificial sequence
  SiRNA target sequence
attgaaaggcaagcacaccat

SEQ ID NO: 171612 - DNA, 21 bp, Artificial sequence
  SiRNA target sequence
ttgaaaggcaagcacaccatt

SEQ ID NO: 171613 - DNA, 21 bp, Artificial sequence
  SiRNA target sequence
tgaaaggcaagcacaccattt

SEQ ID NO: 171614 - DNA, 21 bp, Artificial sequence
  SiRNA target sequence
gaaaggcaagcacaccattta

SEQ ID NO: 171615 - DNA, 21 bp, Artificial sequence
  SiRNA target sequence
aaaggcaagcacaccatttaa

SEQ ID NO: 171616 - DNA, 21 bp, Artificial sequence
  SiRNA target sequence
aaggcaagcacaccatttaat

SEQ ID NO: 171617 - DNA, 21 bp, Artificial sequence
  SiRNA target sequence
aggcaagcacaccatttaatt

SEQ ID NO: 171618 - DNA, 21 bp, Artificial sequence
  SiRNA target sequence
ggcaagcacaccatttaattg

SEQ ID NO: 171619 - DNA, 21 bp, Artificial sequence
  SiRNA target sequence
gcaagcacaccatttaattga

SEQ ID NO: 171620 - DNA, 21 bp, Artificial sequence
  SiRNA target sequence
caagcacaccatttaattgaa

SEQ ID NO: 171621 - DNA, 21 bp, Artificial sequence
  SiRNA target sequence
aagcacaccatttaattgaat

SEQ ID NO: 171622 - DNA, 21 bp, Artificial sequence
  SiRNA target sequence
agcacaccatttaattgaata

SEQ ID NO: 171623 - DNA, 21 bp, Artificial sequence
  SiRNA target sequence
gcacaccatttaattgaatat

SEQ ID NO: 171624 - DNA, 21 bp, Artificial sequence
  SiRNA target sequence
cacaccatttaattgaatatt

SEQ ID NO: 171625 - DNA, 21 bp, Artificial sequence
  SiRNA target sequence
acaccatttaattgaatattt

SEQ ID NO: 171626 - DNA, 21 bp, Artificial sequence
  SiRNA target sequence
caccatttaattgaatattta

SEQ ID NO: 171627 - DNA, 21 bp, Artificial sequence
  SiRNA target sequence
accatttaattgaatatttat

SEQ ID NO: 171628 - DNA, 21 bp, Artificial sequence
  SiRNA target sequence
ccatttaattgaatatttatc

SEQ ID NO: 171629 - DNA, 21 bp, Artificial sequence
  SiRNA target sequence
catttaattgaatatttatct

SEQ ID NO: 171630 - DNA, 21 bp, Artificial sequence
  SiRNA target sequence
atttaattgaatatttatctg

SEQ ID NO: 171631 - DNA, 21 bp, Artificial sequence
  SiRNA target sequence
tttaattgaatatttatctgt

SEQ ID NO: 171632 - DNA, 21 bp, Artificial sequence
  SiRNA target sequence
ttaattgaatatttatctgtt

SEQ ID NO: 171633 - DNA, 21 bp, Artificial sequence
  SiRNA target sequence
taattgaatatttatctgtta

SEQ ID NO: 171634 - DNA, 21 bp, Artificial sequence
  SiRNA target sequence
aattgaatatttatctgttac

SEQ ID NO: 171635 - DNA, 21 bp, Artificial sequence
  SiRNA target sequence
attgaatatttatctgttact

SEQ ID NO: 171636 - DNA, 21 bp, Artificial sequence
  SiRNA target sequence
ttgaatatttatctgttactt

SEQ ID NO: 171637 - DNA, 21 bp, Artificial sequence
  SiRNA target sequence
tgaatatttatctgttacttc

SEQ ID NO: 171638 - DNA, 21 bp, Artificial sequence
  SiRNA target sequence
gaatatttatctgttacttct

SEQ ID NO: 171639 - DNA, 21 bp, Artificial sequence
  SiRNA target sequence
aatatttatctgttacttcta

SEQ ID NO: 171640 - DNA, 21 bp, Artificial sequence
  SiRNA target sequence
atatttatctgttacttctac

SEQ ID NO: 171641 - DNA, 21 bp, Artificial sequence
  SiRNA target sequence
tatttatctgttacttctaca

SEQ ID NO: 171642 - DNA, 21 bp, Artificial sequence
  SiRNA target sequence
atttatctgttacttctacac

SEQ ID NO: 171643 - DNA, 21 bp, Artificial sequence
  SiRNA target sequence
tttatctgttacttctacaca

SEQ ID NO: 171644 - DNA, 21 bp, Artificial sequence
  SiRNA target sequence
ttatctgttacttctacacaa

SEQ ID NO: 171645 - DNA, 21 bp, Artificial sequence
  SiRNA target sequence
tatctgttacttctacacaac

SEQ ID NO: 171646 - DNA, 21 bp, Artificial sequence
  SiRNA target sequence
atctgttacttctacacaaca

SEQ ID NO: 171647 - DNA, 21 bp, Artificial sequence
  SiRNA target sequence
tctgttacttctacacaacaa

SEQ ID NO: 171648 - DNA, 21 bp, Artificial sequence
  SiRNA target sequence
ctgttacttctacacaacaac

SEQ ID NO: 171649 - DNA, 21 bp, Artificial sequence
  SiRNA target sequence
tgttacttctacacaacaaca

SEQ ID NO: 171650 - DNA, 21 bp, Artificial sequence
  SiRNA target sequence
gttacttctacacaacaacaa

SEQ ID NO: 171651 - DNA, 21 bp, Artificial sequence
  SiRNA target sequence
ttacttctacacaacaacaag

SEQ ID NO: 171652 - DNA, 21 bp, Artificial sequence
  SiRNA target sequence
tacttctacacaacaacaagc

SEQ ID NO: 171653 - DNA, 21 bp, Artificial sequence
  SiRNA target sequence
acttctacacaacaacaagcc

SEQ ID NO: 171654 - DNA, 21 bp, Artificial sequence
  SiRNA target sequence
cttctacacaacaacaagcca

SEQ ID NO: 171655 - DNA, 21 bp, Artificial sequence
  SiRNA target sequence
ttctacacaacaacaagccat

SEQ ID NO: 171656 - DNA, 21 bp, Artificial sequence
  SiRNA target sequence
tctacacaacaacaagccata

SEQ ID NO: 171657 - DNA, 21 bp, Artificial sequence
  SiRNA target sequence
ctacacaacaacaagccataa

SEQ ID NO: 171658 - DNA, 21 bp, Artificial sequence
  SiRNA target sequence
tacacaacaacaagccataaa

SEQ ID NO: 171659 - DNA, 21 bp, Artificial sequence
  SiRNA target sequence
acacaacaacaagccataaag

SEQ ID NO: 171660 - DNA, 21 bp, Artificial sequence
  SiRNA target sequence
cacaacaacaagccataaagc

SEQ ID NO: 171661 - DNA, 21 bp, Artificial sequence
  SiRNA target sequence
acaacaacaagccataaagct

SEQ ID NO: 171662 - DNA, 21 bp, Artificial sequence
  SiRNA target sequence
caacaacaagccataaagcta

SEQ ID NO: 171663 - DNA, 21 bp, Artificial sequence
  SiRNA target sequence
aacaacaagccataaagctac

SEQ ID NO: 171664 - DNA, 21 bp, Artificial sequence
  SiRNA target sequence
acaacaagccataaagctact

SEQ ID NO: 171665 - DNA, 21 bp, Artificial sequence
  SiRNA target sequence
caacaagccataaagctactt

SEQ ID NO: 171666 - DNA, 21 bp, Artificial sequence
  SiRNA target sequence
aacaagccataaagctacttg

SEQ ID NO: 171667 - DNA, 21 bp, Artificial sequence
  SiRNA target sequence
acaagccataaagctacttgc

SEQ ID NO: 171668 - DNA, 21 bp, Artificial sequence
  SiRNA target sequence
caagccataaagctacttgct

SEQ ID NO: 171669 - DNA, 21 bp, Artificial sequence
  SiRNA target sequence
aagccataaagctacttgctc

SEQ ID NO: 171670 - DNA, 21 bp, Artificial sequence
  SiRNA target sequence
agccataaagctacttgctca

SEQ ID NO: 171671 - DNA, 21 bp, Artificial sequence
  SiRNA target sequence
gccataaagctacttgctcag

SEQ ID NO: 171672 - DNA, 21 bp, Artificial sequence
  SiRNA target sequence
ccataaagctacttgctcagg

SEQ ID NO: 171673 - DNA, 21 bp, Artificial sequence
  SiRNA target sequence
cataaagctacttgctcaggg

SEQ ID NO: 171674 - DNA, 21 bp, Artificial sequence
  SiRNA target sequence
ataaagctacttgctcagggg

SEQ ID NO: 171675 - DNA, 21 bp, Artificial sequence
  SiRNA target sequence
taaagctacttgctcaggggc

SEQ ID NO: 171676 - DNA, 21 bp, Artificial sequence
  SiRNA target sequence
aaagctacttgctcaggggcg

SEQ ID NO: 171677 - DNA, 21 bp, Artificial sequence
  SiRNA target sequence
aagctacttgctcaggggcga

SEQ ID NO: 171678 - DNA, 21 bp, Artificial sequence
  SiRNA target sequence
agctacttgctcaggggcgaa

SEQ ID NO: 171679 - DNA, 21 bp, Artificial sequence
  SiRNA target sequence
gctacttgctcaggggcgaag

SEQ ID NO: 171680 - DNA, 21 bp, Artificial sequence
  SiRNA target sequence
ctacttgctcaggggcgaagt

SEQ ID NO: 171681 - DNA, 21 bp, Artificial sequence
  SiRNA target sequence
tacttgctcaggggcgaagta

SEQ ID NO: 171682 - DNA, 21 bp, Artificial sequence
  SiRNA target sequence
acttgctcaggggcgaagtat

SEQ ID NO: 171683 - DNA, 21 bp, Artificial sequence
  SiRNA target sequence
cttgctcaggggcgaagtata

SEQ ID NO: 171684 - DNA, 21 bp, Artificial sequence
  SiRNA target sequence
ttgctcaggggcgaagtataa

SEQ ID NO: 171685 - DNA, 21 bp, Artificial sequence
  SiRNA target sequence
tgctcaggggcgaagtataag

SEQ ID NO: 171686 - DNA, 21 bp, Artificial sequence
  SiRNA target sequence
gctcaggggcgaagtataagt

SEQ ID NO: 171687 - DNA, 21 bp, Artificial sequence
  SiRNA target sequence
ctcaggggcgaagtataagtg

SEQ ID NO: 171688 - DNA, 21 bp, Artificial sequence
  SiRNA target sequence
tcaggggcgaagtataagtgt

SEQ ID NO: 171689 - DNA, 21 bp, Artificial sequence
  SiRNA target sequence
caggggcgaagtataagtgtc

SEQ ID NO: 171690 - DNA, 21 bp, Artificial sequence
  SiRNA target sequence
aggggcgaagtataagtgtca

SEQ ID NO: 171691 - DNA, 21 bp, Artificial sequence
  SiRNA target sequence
ggggcgaagtataagtgtcat

SEQ ID NO: 171692 - DNA, 21 bp, Artificial sequence
  SiRNA target sequence
gggcgaagtataagtgtcata

SEQ ID NO: 171693 - DNA, 21 bp, Artificial sequence
  SiRNA target sequence
ggcgaagtataagtgtcatac

SEQ ID NO: 171694 - DNA, 21 bp, Artificial sequence
  SiRNA target sequence
gcgaagtataagtgtcataca

SEQ ID NO: 171695 - DNA, 21 bp, Artificial sequence
  SiRNA target sequence
cgaagtataagtgtcatacag

SEQ ID NO: 171696 - DNA, 21 bp, Artificial sequence
  SiRNA target sequence
gaagtataagtgtcatacagt

SEQ ID NO: 171697 - DNA, 21 bp, Artificial sequence
  SiRNA target sequence
aagtataagtgtcatacagtg

SEQ ID NO: 171698 - DNA, 21 bp, Artificial sequence
  SiRNA target sequence
agtataagtgtcatacagtgc

SEQ ID NO: 171699 - DNA, 21 bp, Artificial sequence
  SiRNA target sequence
gtataagtgtcatacagtgct

SEQ ID NO: 171700 - DNA, 21 bp, Artificial sequence
  SiRNA target sequence
tataagtgtcatacagtgcta

SEQ ID NO: 171701 - DNA, 21 bp, Artificial sequence
  SiRNA target sequence
ataagtgtcatacagtgctat

SEQ ID NO: 171702 - DNA, 21 bp, Artificial sequence
  SiRNA target sequence
taagtgtcatacagtgctatg

SEQ ID NO: 171703 - DNA, 21 bp, Artificial sequence
  SiRNA target sequence
aagtgtcatacagtgctatga

SEQ ID NO: 171704 - DNA, 21 bp, Artificial sequence
  SiRNA target sequence
agtgtcatacagtgctatgat

SEQ ID NO: 171705 - DNA, 21 bp, Artificial sequence
  SiRNA target sequence
gtgtcatacagtgctatgata

SEQ ID NO: 171706 - DNA, 21 bp, Artificial sequence
  SiRNA target sequence
tgtcatacagtgctatgataa

SEQ ID NO: 171707 - DNA, 21 bp, Artificial sequence
  SiRNA target sequence
gtcatacagtgctatgataaa

SEQ ID NO: 171708 - DNA, 21 bp, Artificial sequence
  SiRNA target sequence
tcatacagtgctatgataaat

SEQ ID NO: 171709 - DNA, 21 bp, Artificial sequence
  SiRNA target sequence
catacagtgctatgataaatt

SEQ ID NO: 171710 - DNA, 21 bp, Artificial sequence
  SiRNA target sequence
atacagtgctatgataaattt

SEQ ID NO: 171711 - DNA, 21 bp, Artificial sequence
  SiRNA target sequence
tacagtgctatgataaatttt

SEQ ID NO: 171712 - DNA, 21 bp, Artificial sequence
  SiRNA target sequence
acagtgctatgataaattttt

SEQ ID NO: 171713 - DNA, 21 bp, Artificial sequence
  SiRNA target sequence
cagtgctatgataaattttta

SEQ ID NO: 171714 - DNA, 21 bp, Artificial sequence
  SiRNA target sequence
agtgctatgataaatttttag

SEQ ID NO: 171715 - DNA, 21 bp, Artificial sequence
  SiRNA target sequence
gtgctatgataaatttttaga

SEQ ID NO: 171716 - DNA, 21 bp, Artificial sequence
  SiRNA target sequence
tgctatgataaatttttagag

SEQ ID NO: 171717 - DNA, 21 bp, Artificial sequence
  SiRNA target sequence
gctatgataaatttttagaga

SEQ ID NO: 171718 - DNA, 21 bp, Artificial sequence
  SiRNA target sequence
ctatgataaatttttagagaa

SEQ ID NO: 171719 - DNA, 21 bp, Artificial sequence
  SiRNA target sequence
tatgataaatttttagagaat

SEQ ID NO: 171720 - DNA, 21 bp, Artificial sequence
  SiRNA target sequence
atgataaatttttagagaata

SEQ ID NO: 171721 - DNA, 21 bp, Artificial sequence
  SiRNA target sequence
tgataaatttttagagaatag

SEQ ID NO: 171722 - DNA, 21 bp, Artificial sequence
  SiRNA target sequence
gataaatttttagagaatagc

SEQ ID NO: 171723 - DNA, 21 bp, Artificial sequence
  SiRNA target sequence
ataaatttttagagaatagcg

SEQ ID NO: 171724 - DNA, 21 bp, Artificial sequence
  SiRNA target sequence
taaatttttagagaatagcga

SEQ ID NO: 171725 - DNA, 21 bp, Artificial sequence
  SiRNA target sequence
aaatttttagagaatagcgat

SEQ ID NO: 171726 - DNA, 21 bp, Artificial sequence
  SiRNA target sequence
aatttttagagaatagcgatg

SEQ ID NO: 171727 - DNA, 21 bp, Artificial sequence
  SiRNA target sequence
atttttagagaatagcgatga

SEQ ID NO: 171728 - DNA, 21 bp, Artificial sequence
  SiRNA target sequence
tttttagagaatagcgatgat

SEQ ID NO: 171729 - DNA, 21 bp, Artificial sequence
  SiRNA target sequence
ttttagagaatagcgatgatg

SEQ ID NO: 171730 - DNA, 21 bp, Artificial sequence
  SiRNA target sequence
tttagagaatagcgatgatgt

SEQ ID NO: 171731 - DNA, 21 bp, Artificial sequence
  SiRNA target sequence
ttagagaatagcgatgatgtt

SEQ ID NO: 171732 - DNA, 21 bp, Artificial sequence
  SiRNA target sequence
tagagaatagcgatgatgttt

SEQ ID NO: 171733 - DNA, 21 bp, Artificial sequence
  SiRNA target sequence
agagaatagcgatgatgtttt

SEQ ID NO: 171734 - DNA, 21 bp, Artificial sequence
  SiRNA target sequence
gagaatagcgatgatgtttta

SEQ ID NO: 171735 - DNA, 21 bp, Artificial sequence
  SiRNA target sequence
agaatagcgatgatgttttaa

SEQ ID NO: 171736 - DNA, 21 bp, Artificial sequence
  SiRNA target sequence
gaatagcgatgatgttttaac

SEQ ID NO: 171737 - DNA, 21 bp, Artificial sequence
  SiRNA target sequence
aatagcgatgatgttttaact

SEQ ID NO: 171738 - DNA, 21 bp, Artificial sequence
  SiRNA target sequence
atagcgatgatgttttaacta

SEQ ID NO: 171739 - DNA, 21 bp, Artificial sequence
  SiRNA target sequence
tagcgatgatgttttaactac

SEQ ID NO: 171740 - DNA, 21 bp, Artificial sequence
  SiRNA target sequence
agcgatgatgttttaactacc

SEQ ID NO: 171741 - DNA, 21 bp, Artificial sequence
  SiRNA target sequence
gcgatgatgttttaactacct

SEQ ID NO: 171742 - DNA, 21 bp, Artificial sequence
  SiRNA target sequence
cgatgatgttttaactaccta

SEQ ID NO: 171743 - DNA, 21 bp, Artificial sequence
  SiRNA target sequence
gatgatgttttaactacctat

SEQ ID NO: 171744 - DNA, 21 bp, Artificial sequence
  SiRNA target sequence
atgatgttttaactacctatg

SEQ ID NO: 171745 - DNA, 21 bp, Artificial sequence
  SiRNA target sequence
tgatgttttaactacctatga

SEQ ID NO: 171746 - DNA, 21 bp, Artificial sequence
  SiRNA target sequence
gatgttttaactacctatgat

SEQ ID NO: 171747 - DNA, 21 bp, Artificial sequence
  SiRNA target sequence
atgttttaactacctatgatt

SEQ ID NO: 171748 - DNA, 21 bp, Artificial sequence
  SiRNA target sequence
tgttttaactacctatgattt

SEQ ID NO: 171749 - DNA, 21 bp, Artificial sequence
  SiRNA target sequence
gttttaactacctatgatttt

SEQ ID NO: 171750 - DNA, 21 bp, Artificial sequence
  SiRNA target sequence
ttttaactacctatgattttt

SEQ ID NO: 171751 - DNA, 21 bp, Artificial sequence
  SiRNA target sequence
tttaactacctatgattttta

SEQ ID NO: 171752 - DNA, 21 bp, Artificial sequence
  SiRNA target sequence
ttaactacctatgatttttat

SEQ ID NO: 171753 - DNA, 21 bp, Artificial sequence
  SiRNA target sequence
taactacctatgatttttata

SEQ ID NO: 171754 - DNA, 21 bp, Artificial sequence
  SiRNA target sequence
aactacctatgatttttataa

SEQ ID NO: 171755 - DNA, 21 bp, Artificial sequence
  SiRNA target sequence
actacctatgatttttataaa

SEQ ID NO: 171756 - DNA, 21 bp, Artificial sequence
  SiRNA target sequence
ctacctatgatttttataaaa

SEQ ID NO: 171757 - DNA, 21 bp, Artificial sequence
  SiRNA target sequence
tacctatgatttttataaaat

SEQ ID NO: 171758 - DNA, 21 bp, Artificial sequence
  SiRNA target sequence
acctatgatttttataaaatg

SEQ ID NO: 171759 - DNA, 21 bp, Artificial sequence
  SiRNA target sequence
cctatgatttttataaaatga

SEQ ID NO: 171760 - DNA, 21 bp, Artificial sequence
  SiRNA target sequence
ctatgatttttataaaatgat

SEQ ID NO: 171761 - DNA, 21 bp, Artificial sequence
  SiRNA target sequence
tatgatttttataaaatgatt

SEQ ID NO: 171762 - DNA, 21 bp, Artificial sequence
  SiRNA target sequence
atgatttttataaaatgattt

SEQ ID NO: 171763 - DNA, 21 bp, Artificial sequence
  SiRNA target sequence
tgatttttataaaatgatttt

SEQ ID NO: 171764 - DNA, 21 bp, Artificial sequence
  SiRNA target sequence
gatttttataaaatgattttg

SEQ ID NO: 171765 - DNA, 21 bp, Artificial sequence
  SiRNA target sequence
atttttataaaatgattttgg

SEQ ID NO: 171766 - DNA, 21 bp, Artificial sequence
  SiRNA target sequence
tttttataaaatgattttgga

SEQ ID NO: 171767 - DNA, 21 bp, Artificial sequence
  SiRNA target sequence
ttttataaaatgattttggat

SEQ ID NO: 171768 - DNA, 21 bp, Artificial sequence
  SiRNA target sequence
tttataaaatgattttggatc

SEQ ID NO: 171769 - DNA, 21 bp, Artificial sequence
  SiRNA target sequence
ttataaaatgattttggatct

SEQ ID NO: 171770 - DNA, 21 bp, Artificial sequence
  SiRNA target sequence
tataaaatgattttggatcta

SEQ ID NO: 171771 - DNA, 21 bp, Artificial sequence
  SiRNA target sequence
ataaaatgattttggatctag

SEQ ID NO: 171772 - DNA, 21 bp, Artificial sequence
  SiRNA target sequence
taaaatgattttggatctagg

SEQ ID NO: 171773 - DNA, 21 bp, Artificial sequence
  SiRNA target sequence
aaaatgattttggatctagga

SEQ ID NO: 171774 - DNA, 21 bp, Artificial sequence
  SiRNA target sequence
aaatgattttggatctaggat

SEQ ID NO: 171775 - DNA, 21 bp, Artificial sequence
  SiRNA target sequence
aatgattttggatctaggatt

SEQ ID NO: 171776 - DNA, 21 bp, Artificial sequence
  SiRNA target sequence
atgattttggatctaggattt

SEQ ID NO: 171777 - DNA, 21 bp, Artificial sequence
  SiRNA target sequence
tgattttggatctaggatttt

SEQ ID NO: 171778 - DNA, 21 bp, Artificial sequence
  SiRNA target sequence
gattttggatctaggattttt

SEQ ID NO: 171779 - DNA, 21 bp, Artificial sequence
  SiRNA target sequence
attttggatctaggattttta

SEQ ID NO: 171780 - DNA, 21 bp, Artificial sequence
  SiRNA target sequence
ttttggatctaggatttttac

SEQ ID NO: 171781 - DNA, 21 bp, Artificial sequence
  SiRNA target sequence
tttggatctaggatttttaca

SEQ ID NO: 171782 - DNA, 21 bp, Artificial sequence
  SiRNA target sequence
ttggatctaggatttttacag

SEQ ID NO: 171783 - DNA, 21 bp, Artificial sequence
  SiRNA target sequence
tggatctaggatttttacagc

SEQ ID NO: 171784 - DNA, 21 bp, Artificial sequence
  SiRNA target sequence
ggatctaggatttttacagca

SEQ ID NO: 171785 - DNA, 21 bp, Artificial sequence
  SiRNA target sequence
gatctaggatttttacagcat

SEQ ID NO: 171786 - DNA, 21 bp, Artificial sequence
  SiRNA target sequence
atctaggatttttacagcata

SEQ ID NO: 171787 - DNA, 21 bp, Artificial sequence
  SiRNA target sequence
tctaggatttttacagcataa

SEQ ID NO: 171788 - DNA, 21 bp, Artificial sequence
  SiRNA target sequence
ctaggatttttacagcataat

SEQ ID NO: 171789 - DNA, 21 bp, Artificial sequence
  SiRNA target sequence
taggatttttacagcataatt

SEQ ID NO: 171790 - DNA, 21 bp, Artificial sequence
  SiRNA target sequence
aggatttttacagcataattt

SEQ ID NO: 171791 - DNA, 21 bp, Artificial sequence
  SiRNA target sequence
ggatttttacagcataatttt

SEQ ID NO: 171792 - DNA, 21 bp, Artificial sequence
  SiRNA target sequence
gatttttacagcataatttta

SEQ ID NO: 171793 - DNA, 21 bp, Artificial sequence
  SiRNA target sequence
atttttacagcataattttat

SEQ ID NO: 171794 - DNA, 21 bp, Artificial sequence
  SiRNA target sequence
tttttacagcataattttatt

SEQ ID NO: 171795 - DNA, 21 bp, Artificial sequence
  SiRNA target sequence
ttttacagcataattttatta

SEQ ID NO: 171796 - DNA, 21 bp, Artificial sequence
  SiRNA target sequence
tttacagcataattttattaa

SEQ ID NO: 171797 - DNA, 21 bp, Artificial sequence
  SiRNA target sequence
ttacagcataattttattaaa

SEQ ID NO: 171798 - DNA, 21 bp, Artificial sequence
  SiRNA target sequence
tacagcataattttattaaag

SEQ ID NO: 171799 - DNA, 21 bp, Artificial sequence
  SiRNA target sequence
acagcataattttattaaagg

SEQ ID NO: 171800 - DNA, 21 bp, Artificial sequence
  SiRNA target sequence
cagcataattttattaaagga

SEQ ID NO: 171801 - DNA, 21 bp, Artificial sequence
  SiRNA target sequence
agcataattttattaaaggaa

SEQ ID NO: 171802 - DNA, 21 bp, Artificial sequence
  SiRNA target sequence
gcataattttattaaaggaac

SEQ ID NO: 171803 - DNA, 21 bp, Artificial sequence
  SiRNA target sequence
cataattttattaaaggaacc

SEQ ID NO: 171804 - DNA, 21 bp, Artificial sequence
  SiRNA target sequence
ataattttattaaaggaacct

SEQ ID NO: 171805 - DNA, 21 bp, Artificial sequence
  SiRNA target sequence
taattttattaaaggaacctg

SEQ ID NO: 171806 - DNA, 21 bp, Artificial sequence
  SiRNA target sequence
aattttattaaaggaacctgt

SEQ ID NO: 171807 - DNA, 21 bp, Artificial sequence
  SiRNA target sequence
attttattaaaggaacctgtg

SEQ ID NO: 171808 - DNA, 21 bp, Artificial sequence
  SiRNA target sequence
ttttattaaaggaacctgtga

SEQ ID NO: 171809 - DNA, 21 bp, Artificial sequence
  SiRNA target sequence
tttattaaaggaacctgtgag

SEQ ID NO: 171810 - DNA, 21 bp, Artificial sequence
  SiRNA target sequence
ttattaaaggaacctgtgaga

SEQ ID NO: 171811 - DNA, 21 bp, Artificial sequence
  SiRNA target sequence
tattaaaggaacctgtgagaa

SEQ ID NO: 171812 - DNA, 21 bp, Artificial sequence
  SiRNA target sequence
attaaaggaacctgtgagaaa

SEQ ID NO: 171813 - DNA, 21 bp, Artificial sequence
  SiRNA target sequence
ttaaaggaacctgtgagaaat

SEQ ID NO: 171814 - DNA, 21 bp, Artificial sequence
  SiRNA target sequence
taaaggaacctgtgagaaatg

SEQ ID NO: 171815 - DNA, 21 bp, Artificial sequence
  SiRNA target sequence
aaaggaacctgtgagaaatgg

SEQ ID NO: 171816 - DNA, 21 bp, Artificial sequence
  SiRNA target sequence
aaggaacctgtgagaaatggg

SEQ ID NO: 171817 - DNA, 21 bp, Artificial sequence
  SiRNA target sequence
aggaacctgtgagaaatggga

SEQ ID NO: 171818 - DNA, 21 bp, Artificial sequence
  SiRNA target sequence
ggaacctgtgagaaatgggag

SEQ ID NO: 171819 - DNA, 21 bp, Artificial sequence
  SiRNA target sequence
gaacctgtgagaaatgggaga

SEQ ID NO: 171820 - DNA, 21 bp, Artificial sequence
  SiRNA target sequence
aacctgtgagaaatgggagaa

SEQ ID NO: 171821 - DNA, 21 bp, Artificial sequence
  SiRNA target sequence
acctgtgagaaatgggagaag

SEQ ID NO: 171822 - DNA, 21 bp, Artificial sequence
  SiRNA target sequence
cctgtgagaaatgggagaagt

SEQ ID NO: 171823 - DNA, 21 bp, Artificial sequence
  SiRNA target sequence
ctgtgagaaatgggagaagtg

SEQ ID NO: 171824 - DNA, 21 bp, Artificial sequence
  SiRNA target sequence
tgtgagaaatgggagaagtgt

SEQ ID NO: 171825 - DNA, 21 bp, Artificial sequence
  SiRNA target sequence
gtgagaaatgggagaagtgta

SEQ ID NO: 171826 - DNA, 21 bp, Artificial sequence
  SiRNA target sequence
tgagaaatgggagaagtgtac

SEQ ID NO: 171827 - DNA, 21 bp, Artificial sequence
  SiRNA target sequence
gagaaatgggagaagtgtact

SEQ ID NO: 171828 - DNA, 21 bp, Artificial sequence
  SiRNA target sequence
agaaatgggagaagtgtacta

SEQ ID NO: 171829 - DNA, 21 bp, Artificial sequence
  SiRNA target sequence
gaaatgggagaagtgtactat

SEQ ID NO: 171830 - DNA, 21 bp, Artificial sequence
  SiRNA target sequence
aaatgggagaagtgtactatt

SEQ ID NO: 171831 - DNA, 21 bp, Artificial sequence
  SiRNA target sequence
aatgggagaagtgtactattg

SEQ ID NO: 171832 - DNA, 21 bp, Artificial sequence
  SiRNA target sequence
atgggagaagtgtactattgg

SEQ ID NO: 171833 - DNA, 21 bp, Artificial sequence
  SiRNA target sequence
tgggagaagtgtactattgga

SEQ ID NO: 171834 - DNA, 21 bp, Artificial sequence
  SiRNA target sequence
gggagaagtgtactattggat

SEQ ID NO: 171835 - DNA, 21 bp, Artificial sequence
  SiRNA target sequence
ggagaagtgtactattggata

SEQ ID NO: 171836 - DNA, 21 bp, Artificial sequence
  SiRNA target sequence
gagaagtgtactattggatat

SEQ ID NO: 171837 - DNA, 21 bp, Artificial sequence
  SiRNA target sequence
agaagtgtactattggatatc

SEQ ID NO: 171838 - DNA, 21 bp, Artificial sequence
  SiRNA target sequence
gaagtgtactattggatatca

SEQ ID NO: 171839 - DNA, 21 bp, Artificial sequence
  SiRNA target sequence
aagtgtactattggatatcat

SEQ ID NO: 171840 - DNA, 21 bp, Artificial sequence
  SiRNA target sequence
agtgtactattggatatcatt

SEQ ID NO: 171841 - DNA, 21 bp, Artificial sequence
  SiRNA target sequence
gtgtactattggatatcatta

SEQ ID NO: 171842 - DNA, 21 bp, Artificial sequence
  SiRNA target sequence
tgtactattggatatcattat

SEQ ID NO: 171843 - DNA, 21 bp, Artificial sequence
  SiRNA target sequence
gtactattggatatcattatg

SEQ ID NO: 171844 - DNA, 21 bp, Artificial sequence
  SiRNA target sequence
tactattggatatcattatgg

SEQ ID NO: 171845 - DNA, 21 bp, Artificial sequence
  SiRNA target sequence
actattggatatcattatgga

SEQ ID NO: 171846 - DNA, 21 bp, Artificial sequence
  SiRNA target sequence
ctattggatatcattatggat

SEQ ID NO: 171847 - DNA, 21 bp, Artificial sequence
  SiRNA target sequence
tattggatatcattatggata

SEQ ID NO: 171848 - DNA, 21 bp, Artificial sequence
  SiRNA target sequence
attggatatcattatggatat

SEQ ID NO: 171849 - DNA, 21 bp, Artificial sequence
  SiRNA target sequence
ttggatatcattatggatatt

SEQ ID NO: 171850 - DNA, 21 bp, Artificial sequence
  SiRNA target sequence
tggatatcattatggatattt

SEQ ID NO: 171851 - DNA, 21 bp, Artificial sequence
  SiRNA target sequence
ggatatcattatggatattta

SEQ ID NO: 171852 - DNA, 21 bp, Artificial sequence
  SiRNA target sequence
gatatcattatggatatttag

SEQ ID NO: 171853 - DNA, 21 bp, Artificial sequence
  SiRNA target sequence
atatcattatggatatttaga

SEQ ID NO: 171854 - DNA, 21 bp, Artificial sequence
  SiRNA target sequence
tatcattatggatatttagaa

SEQ ID NO: 171855 - DNA, 21 bp, Artificial sequence
  SiRNA target sequence
atcattatggatatttagaac

SEQ ID NO: 171856 - DNA, 21 bp, Artificial sequence
  SiRNA target sequence
tcattatggatatttagaaca

SEQ ID NO: 171857 - DNA, 21 bp, Artificial sequence
  SiRNA target sequence
cattatggatatttagaacac

SEQ ID NO: 171858 - DNA, 21 bp, Artificial sequence
  SiRNA target sequence
attatggatatttagaacaca

SEQ ID NO: 171859 - DNA, 21 bp, Artificial sequence
  SiRNA target sequence
ttatggatatttagaacacat

SEQ ID NO: 171860 - DNA, 21 bp, Artificial sequence
  SiRNA target sequence
tatggatatttagaacacata

SEQ ID NO: 171861 - DNA, 21 bp, Artificial sequence
  SiRNA target sequence
atggatatttagaacacatat

SEQ ID NO: 171862 - DNA, 21 bp, Artificial sequence
  SiRNA target sequence
tggatatttagaacacatatt

SEQ ID NO: 171863 - DNA, 21 bp, Artificial sequence
  SiRNA target sequence
ggatatttagaacacatatta

SEQ ID NO: 171864 - DNA, 21 bp, Artificial sequence
  SiRNA target sequence
gatatttagaacacatattaa

SEQ ID NO: 171865 - DNA, 21 bp, Artificial sequence
  SiRNA target sequence
atatttagaacacatattaaa

SEQ ID NO: 171866 - DNA, 21 bp, Artificial sequence
  SiRNA target sequence
tatttagaacacatattaaat

SEQ ID NO: 171867 - DNA, 21 bp, Artificial sequence
  SiRNA target sequence
atttagaacacatattaaata

SEQ ID NO: 171868 - DNA, 21 bp, Artificial sequence
  SiRNA target sequence
tttagaacacatattaaataa

SEQ ID NO: 171869 - DNA, 21 bp, Artificial sequence
  SiRNA target sequence
ttagaacacatattaaataag

SEQ ID NO: 171870 - DNA, 21 bp, Artificial sequence
  SiRNA target sequence
tagaacacatattaaataaga

SEQ ID NO: 171871 - DNA, 21 bp, Artificial sequence
  SiRNA target sequence
agaacacatattaaataagaa

SEQ ID NO: 171872 - DNA, 21 bp, Artificial sequence
  SiRNA target sequence
gaacacatattaaataagaag

SEQ ID NO: 171873 - DNA, 21 bp, Artificial sequence
  SiRNA target sequence
aacacatattaaataagaaga

SEQ ID NO: 171874 - DNA, 21 bp, Artificial sequence
  SiRNA target sequence
acacatattaaataagaagaa

SEQ ID NO: 171875 - DNA, 21 bp, Artificial sequence
  SiRNA target sequence
cacatattaaataagaagaac

SEQ ID NO: 171876 - DNA, 21 bp, Artificial sequence
  SiRNA target sequence
acatattaaataagaagaaca

SEQ ID NO: 171877 - DNA, 21 bp, Artificial sequence
  SiRNA target sequence
catattaaataagaagaacaa

SEQ ID NO: 171878 - DNA, 21 bp, Artificial sequence
  SiRNA target sequence
atattaaataagaagaacaat

SEQ ID NO: 171879 - DNA, 21 bp, Artificial sequence
  SiRNA target sequence
tattaaataagaagaacaatt

SEQ ID NO: 171880 - DNA, 21 bp, Artificial sequence
  SiRNA target sequence
attaaataagaagaacaatta

SEQ ID NO: 171881 - DNA, 21 bp, Artificial sequence
  SiRNA target sequence
ttaaataagaagaacaattat

SEQ ID NO: 171882 - DNA, 21 bp, Artificial sequence
  SiRNA target sequence
taaataagaagaacaattatt

SEQ ID NO: 171883 - DNA, 21 bp, Artificial sequence
  SiRNA target sequence
aaataagaagaacaattattt

SEQ ID NO: 171884 - DNA, 21 bp, Artificial sequence
  SiRNA target sequence
aataagaagaacaattattta

SEQ ID NO: 171885 - DNA, 21 bp, Artificial sequence
  SiRNA target sequence
ataagaagaacaattatttaa

SEQ ID NO: 171886 - DNA, 21 bp, Artificial sequence
  SiRNA target sequence
taagaagaacaattatttaac

SEQ ID NO: 171887 - DNA, 21 bp, Artificial sequence
  SiRNA target sequence
aagaagaacaattatttaaca

SEQ ID NO: 171888 - DNA, 21 bp, Artificial sequence
  SiRNA target sequence
agaagaacaattatttaacaa

SEQ ID NO: 171889 - DNA, 21 bp, Artificial sequence
  SiRNA target sequence
gaagaacaattatttaacaaa

SEQ ID NO: 171890 - DNA, 21 bp, Artificial sequence
  SiRNA target sequence
aagaacaattatttaacaaaa

SEQ ID NO: 171891 - DNA, 21 bp, Artificial sequence
  SiRNA target sequence
agaacaattatttaacaaaaa

SEQ ID NO: 171892 - DNA, 21 bp, Artificial sequence
  SiRNA target sequence
gaacaattatttaacaaaaaa

SEQ ID NO: 171893 - DNA, 21 bp, Artificial sequence
  SiRNA target sequence
aacaattatttaacaaaaaat

SEQ ID NO: 171894 - DNA, 21 bp, Artificial sequence
  SiRNA target sequence
acaattatttaacaaaaaatg

SEQ ID NO: 171895 - DNA, 21 bp, Artificial sequence
  SiRNA target sequence
caattatttaacaaaaaatga

SEQ ID NO: 171896 - DNA, 21 bp, Artificial sequence
  SiRNA target sequence
aattatttaacaaaaaatgat

SEQ ID NO: 171897 - DNA, 21 bp, Artificial sequence
  SiRNA target sequence
attatttaacaaaaaatgata

SEQ ID NO: 171898 - DNA, 21 bp, Artificial sequence
  SiRNA target sequence
ttatttaacaaaaaatgatag

SEQ ID NO: 171899 - DNA, 21 bp, Artificial sequence
  SiRNA target sequence
tatttaacaaaaaatgatagt

SEQ ID NO: 171900 - DNA, 21 bp, Artificial sequence
  SiRNA target sequence
atttaacaaaaaatgatagta

SEQ ID NO: 171901 - DNA, 21 bp, Artificial sequence
  SiRNA target sequence
tttaacaaaaaatgatagtat

SEQ ID NO: 171902 - DNA, 21 bp, Artificial sequence
  SiRNA target sequence
ttaacaaaaaatgatagtata

SEQ ID NO: 171903 - DNA, 21 bp, Artificial sequence
  SiRNA target sequence
taacaaaaaatgatagtataa

SEQ ID NO: 171904 - DNA, 21 bp, Artificial sequence
  SiRNA target sequence
aacaaaaaatgatagtataaa

SEQ ID NO: 171905 - DNA, 21 bp, Artificial sequence
  SiRNA target sequence
acaaaaaatgatagtataaaa

SEQ ID NO: 171906 - DNA, 21 bp, Artificial sequence
  SiRNA target sequence
caaaaaatgatagtataaaaa

SEQ ID NO: 171907 - DNA, 21 bp, Artificial sequence
  SiRNA target sequence
aaaaaatgatagtataaaaat

SEQ ID NO: 171908 - DNA, 21 bp, Artificial sequence
  SiRNA target sequence
aaaaatgatagtataaaaata

SEQ ID NO: 171909 - DNA, 21 bp, Artificial sequence
  SiRNA target sequence
aaaatgatagtataaaaatat

SEQ ID NO: 171910 - DNA, 21 bp, Artificial sequence
  SiRNA target sequence
aaatgatagtataaaaatatt

SEQ ID NO: 171911 - DNA, 21 bp, Artificial sequence
  SiRNA target sequence
aatgatagtataaaaatattt

SEQ ID NO: 171912 - DNA, 21 bp, Artificial sequence
  SiRNA target sequence
atgatagtataaaaatattta

SEQ ID NO: 171913 - DNA, 21 bp, Artificial sequence
  SiRNA target sequence
tgatagtataaaaatatttaa

SEQ ID NO: 171914 - DNA, 21 bp, Artificial sequence
  SiRNA target sequence
gatagtataaaaatatttaac

SEQ ID NO: 171915 - DNA, 21 bp, Artificial sequence
  SiRNA target sequence
atagtataaaaatatttaaca

SEQ ID NO: 171916 - DNA, 21 bp, Artificial sequence
  SiRNA target sequence
tagtataaaaatatttaacag

SEQ ID NO: 171917 - DNA, 21 bp, Artificial sequence
  SiRNA target sequence
agtataaaaatatttaacagt

SEQ ID NO: 171918 - DNA, 21 bp, Artificial sequence
  SiRNA target sequence
gtataaaaatatttaacagta

SEQ ID NO: 171919 - DNA, 21 bp, Artificial sequence
  SiRNA target sequence
tataaaaatatttaacagtaa

SEQ ID NO: 171920 - DNA, 21 bp, Artificial sequence
  SiRNA target sequence
ataaaaatatttaacagtaaa

SEQ ID NO: 171921 - DNA, 21 bp, Artificial sequence
  SiRNA target sequence
taaaaatatttaacagtaaaa

SEQ ID NO: 171922 - DNA, 21 bp, Artificial sequence
  SiRNA target sequence
aaaaatatttaacagtaaaaa

SEQ ID NO: 171923 - DNA, 21 bp, Artificial sequence
  SiRNA target sequence
aaaatatttaacagtaaaaat

SEQ ID NO: 171924 - DNA, 21 bp, Artificial sequence
  SiRNA target sequence
aaatatttaacagtaaaaatg

SEQ ID NO: 171925 - DNA, 21 bp, Artificial sequence
  SiRNA target sequence
aatatttaacagtaaaaatga

SEQ ID NO: 171926 - DNA, 21 bp, Artificial sequence
  SiRNA target sequence
atatttaacagtaaaaatgag

SEQ ID NO: 171927 - DNA, 21 bp, Artificial sequence
  SiRNA target sequence
tatttaacagtaaaaatgagg

SEQ ID NO: 171928 - DNA, 21 bp, Artificial sequence
  SiRNA target sequence
atttaacagtaaaaatgagga

SEQ ID NO: 171929 - DNA, 21 bp, Artificial sequence
  SiRNA target sequence
tttaacagtaaaaatgaggag

SEQ ID NO: 171930 - DNA, 21 bp, Artificial sequence
  SiRNA target sequence
ttaacagtaaaaatgaggagg

SEQ ID NO: 171931 - DNA, 21 bp, Artificial sequence
  SiRNA target sequence
taacagtaaaaatgaggaggt

SEQ ID NO: 171932 - DNA, 21 bp, Artificial sequence
  SiRNA target sequence
aacagtaaaaatgaggaggta

SEQ ID NO: 171933 - DNA, 21 bp, Artificial sequence
  SiRNA target sequence
acagtaaaaatgaggaggtaa

SEQ ID NO: 171934 - DNA, 21 bp, Artificial sequence
  SiRNA target sequence
cagtaaaaatgaggaggtaag

SEQ ID NO: 171935 - DNA, 21 bp, Artificial sequence
  SiRNA target sequence
agtaaaaatgaggaggtaagg

SEQ ID NO: 171936 - DNA, 21 bp, Artificial sequence
  SiRNA target sequence
gtaaaaatgaggaggtaaggt

SEQ ID NO: 171937 - DNA, 21 bp, Artificial sequence
  SiRNA target sequence
taaaaatgaggaggtaaggtt

SEQ ID NO: 171938 - DNA, 21 bp, Artificial sequence
  SiRNA target sequence
aaaaatgaggaggtaaggtta

SEQ ID NO: 171939 - DNA, 21 bp, Artificial sequence
  SiRNA target sequence
aaaatgaggaggtaaggttaa

SEQ ID NO: 171940 - DNA, 21 bp, Artificial sequence
  SiRNA target sequence
aaatgaggaggtaaggttaaa

SEQ ID NO: 171941 - DNA, 21 bp, Artificial sequence
  SiRNA target sequence
aatgaggaggtaaggttaaat

SEQ ID NO: 171942 - DNA, 21 bp, Artificial sequence
  SiRNA target sequence
atgaggaggtaaggttaaatg

SEQ ID NO: 171943 - DNA, 21 bp, Artificial sequence
  SiRNA target sequence
tgaggaggtaaggttaaatgg

SEQ ID NO: 171944 - DNA, 21 bp, Artificial sequence
  SiRNA target sequence
gaggaggtaaggttaaatgga

SEQ ID NO: 171945 - DNA, 21 bp, Artificial sequence
  SiRNA target sequence
aggaggtaaggttaaatggaa

SEQ ID NO: 171946 - DNA, 21 bp, Artificial sequence
  SiRNA target sequence
ggaggtaaggttaaatggaaa

SEQ ID NO: 171947 - DNA, 21 bp, Artificial sequence
  SiRNA target sequence
gaggtaaggttaaatggaaaa

SEQ ID NO: 171948 - DNA, 21 bp, Artificial sequence
  SiRNA target sequence
aggtaaggttaaatggaaaaa

SEQ ID NO: 171949 - DNA, 21 bp, Artificial sequence
  SiRNA target sequence
ggtaaggttaaatggaaaaag

SEQ ID NO: 171950 - DNA, 21 bp, Artificial sequence
  SiRNA target sequence
gtaaggttaaatggaaaaaga

SEQ ID NO: 171951 - DNA, 21 bp, Artificial sequence
  SiRNA target sequence
taaggttaaatggaaaaagaa

SEQ ID NO: 171952 - DNA, 21 bp, Artificial sequence
  SiRNA target sequence
aaggttaaatggaaaaagaaa

SEQ ID NO: 171953 - DNA, 21 bp, Artificial sequence
  SiRNA target sequence
aggttaaatggaaaaagaaaa

SEQ ID NO: 171954 - DNA, 21 bp, Artificial sequence
  SiRNA target sequence
ggttaaatggaaaaagaaaat

SEQ ID NO: 171955 - DNA, 21 bp, Artificial sequence
  SiRNA target sequence
gttaaatggaaaaagaaaatt

SEQ ID NO: 171956 - DNA, 21 bp, Artificial sequence
  SiRNA target sequence
ttaaatggaaaaagaaaatta

SEQ ID NO: 171957 - DNA, 21 bp, Artificial sequence
  SiRNA target sequence
taaatggaaaaagaaaattaa

SEQ ID NO: 171958 - DNA, 21 bp, Artificial sequence
  SiRNA target sequence
aaatggaaaaagaaaattaaa

SEQ ID NO: 171959 - DNA, 21 bp, Artificial sequence
  SiRNA target sequence
aatggaaaaagaaaattaaat

SEQ ID NO: 171960 - DNA, 21 bp, Artificial sequence
  SiRNA target sequence
atggaaaaagaaaattaaata

SEQ ID NO: 171961 - DNA, 21 bp, Artificial sequence
  SiRNA target sequence
tggaaaaagaaaattaaatat

SEQ ID NO: 171962 - DNA, 21 bp, Artificial sequence
  SiRNA target sequence
ggaaaaagaaaattaaatatt

SEQ ID NO: 171963 - DNA, 21 bp, Artificial sequence
  SiRNA target sequence
gaaaaagaaaattaaatatta

SEQ ID NO: 171964 - DNA, 21 bp, Artificial sequence
  SiRNA target sequence
aaaaagaaaattaaatattaa

SEQ ID NO: 171965 - DNA, 21 bp, Artificial sequence
  SiRNA target sequence
aaaagaaaattaaatattaac

SEQ ID NO: 171966 - DNA, 21 bp, Artificial sequence
  SiRNA target sequence
aaagaaaattaaatattaaca

SEQ ID NO: 171967 - DNA, 21 bp, Artificial sequence
  SiRNA target sequence
aagaaaattaaatattaacac

SEQ ID NO: 171968 - DNA, 21 bp, Artificial sequence
  SiRNA target sequence
agaaaattaaatattaacaca

SEQ ID NO: 171969 - DNA, 21 bp, Artificial sequence
  SiRNA target sequence
gaaaattaaatattaacacag

SEQ ID NO: 171970 - DNA, 21 bp, Artificial sequence
  SiRNA target sequence
aaaattaaatattaacacagt

SEQ ID NO: 171971 - DNA, 21 bp, Artificial sequence
  SiRNA target sequence
aaattaaatattaacacagtt

SEQ ID NO: 171972 - DNA, 21 bp, Artificial sequence
  SiRNA target sequence
aattaaatattaacacagtta

SEQ ID NO: 171973 - DNA, 21 bp, Artificial sequence
  SiRNA target sequence
attaaatattaacacagttac

SEQ ID NO: 171974 - DNA, 21 bp, Artificial sequence
  SiRNA target sequence
ttaaatattaacacagttaca

SEQ ID NO: 171975 - DNA, 21 bp, Artificial sequence
  SiRNA target sequence
taaatattaacacagttacat

SEQ ID NO: 171976 - DNA, 21 bp, Artificial sequence
  SiRNA target sequence
aaatattaacacagttacatt

SEQ ID NO: 171977 - DNA, 21 bp, Artificial sequence
  SiRNA target sequence
aatattaacacagttacatta

SEQ ID NO: 171978 - DNA, 21 bp, Artificial sequence
  SiRNA target sequence
atattaacacagttacattaa

SEQ ID NO: 171979 - DNA, 21 bp, Artificial sequence
  SiRNA target sequence
tattaacacagttacattaaa

SEQ ID NO: 171980 - DNA, 21 bp, Artificial sequence
  SiRNA target sequence
attaacacagttacattaaat

SEQ ID NO: 171981 - DNA, 21 bp, Artificial sequence
  SiRNA target sequence
ttaacacagttacattaaata

SEQ ID NO: 171982 - DNA, 21 bp, Artificial sequence
  SiRNA target sequence
taacacagttacattaaataa

SEQ ID NO: 171983 - DNA, 21 bp, Artificial sequence
  SiRNA target sequence
aacacagttacattaaataaa

SEQ ID NO: 171984 - DNA, 21 bp, Artificial sequence
  SiRNA target sequence
acacagttacattaaataaaa

SEQ ID NO: 171985 - DNA, 21 bp, Artificial sequence
  SiRNA target sequence
cacagttacattaaataaaat

SEQ ID NO: 171986 - DNA, 21 bp, Artificial sequence
  SiRNA target sequence
acagttacattaaataaaatt

SEQ ID NO: 171987 - DNA, 21 bp, Artificial sequence
  SiRNA target sequence
cagttacattaaataaaatta

SEQ ID NO: 171988 - DNA, 21 bp, Artificial sequence
  SiRNA target sequence
agttacattaaataaaattaa

SEQ ID NO: 171989 - DNA, 21 bp, Artificial sequence
  SiRNA target sequence
gttacattaaataaaattaat

SEQ ID NO: 171990 - DNA, 21 bp, Artificial sequence
  SiRNA target sequence
ttacattaaataaaattaata

SEQ ID NO: 171991 - DNA, 21 bp, Artificial sequence
  SiRNA target sequence
tacattaaataaaattaatat

SEQ ID NO: 171992 - DNA, 21 bp, Artificial sequence
  SiRNA target sequence
acattaaataaaattaatata

SEQ ID NO: 171993 - DNA, 21 bp, Artificial sequence
  SiRNA target sequence
cattaaataaaattaatatac

SEQ ID NO: 171994 - DNA, 21 bp, Artificial sequence
  SiRNA target sequence
attaaataaaattaatatacc

SEQ ID NO: 171995 - DNA, 21 bp, Artificial sequence
  SiRNA target sequence
ttaaataaaattaatatacct

SEQ ID NO: 171996 - DNA, 21 bp, Artificial sequence
  SiRNA target sequence
taaataaaattaatatacctg

SEQ ID NO: 171997 - DNA, 21 bp, Artificial sequence
  SiRNA target sequence
aaataaaattaatatacctga

SEQ ID NO: 171998 - DNA, 21 bp, Artificial sequence
  SiRNA target sequence
aataaaattaatatacctgag

SEQ ID NO: 171999 - DNA, 21 bp, Artificial sequence
  SiRNA target sequence
ataaaattaatatacctgaga

SEQ ID NO: 172000 - DNA, 21 bp, Artificial sequence
  SiRNA target sequence
taaaattaatatacctgagat

SEQ ID NO: 172001 - DNA, 21 bp, Artificial sequence
  SiRNA target sequence
aaaattaatatacctgagata

SEQ ID NO: 172002 - DNA, 21 bp, Artificial sequence
  SiRNA target sequence
aaattaatatacctgagatag

SEQ ID NO: 172003 - DNA, 21 bp, Artificial sequence
  SiRNA target sequence
aattaatatacctgagataga

SEQ ID NO: 172004 - DNA, 21 bp, Artificial sequence
  SiRNA target sequence
attaatatacctgagatagat

SEQ ID NO: 172005 - DNA, 21 bp, Artificial sequence
  SiRNA target sequence
ttaatatacctgagatagatt

SEQ ID NO: 172006 - DNA, 21 bp, Artificial sequence
  SiRNA target sequence
taatatacctgagatagatta

SEQ ID NO: 172007 - DNA, 21 bp, Artificial sequence
  SiRNA target sequence
aatatacctgagatagattat

SEQ ID NO: 172008 - DNA, 21 bp, Artificial sequence
  SiRNA target sequence
atatacctgagatagattata

SEQ ID NO: 172009 - DNA, 21 bp, Artificial sequence
  SiRNA target sequence
tatacctgagatagattataa

SEQ ID NO: 172010 - DNA, 21 bp, Artificial sequence
  SiRNA target sequence
atacctgagatagattataaa

SEQ ID NO: 172011 - DNA, 21 bp, Artificial sequence
  SiRNA target sequence
tacctgagatagattataaat

SEQ ID NO: 172012 - DNA, 21 bp, Artificial sequence
  SiRNA target sequence
acctgagatagattataaata

SEQ ID NO: 172013 - DNA, 21 bp, Artificial sequence
  SiRNA target sequence
cctgagatagattataaatat

SEQ ID NO: 172014 - DNA, 21 bp, Artificial sequence
  SiRNA target sequence
ctgagatagattataaatata

SEQ ID NO: 172015 - DNA, 21 bp, Artificial sequence
  SiRNA target sequence
tgagatagattataaatataa

SEQ ID NO: 172016 - DNA, 21 bp, Artificial sequence
  SiRNA target sequence
gagatagattataaatataaa

SEQ ID NO: 172017 - DNA, 21 bp, Artificial sequence
  SiRNA target sequence
agatagattataaatataaaa

SEQ ID NO: 172018 - DNA, 21 bp, Artificial sequence
  SiRNA target sequence
gatagattataaatataaaaa

SEQ ID NO: 172019 - DNA, 21 bp, Artificial sequence
  SiRNA target sequence
atagattataaatataaaaat

SEQ ID NO: 172020 - DNA, 21 bp, Artificial sequence
  SiRNA target sequence
tagattataaatataaaaatg

SEQ ID NO: 172021 - DNA, 21 bp, Artificial sequence
  SiRNA target sequence
agattataaatataaaaatgg

SEQ ID NO: 172022 - DNA, 21 bp, Artificial sequence
  SiRNA target sequence
gattataaatataaaaatgga

SEQ ID NO: 172023 - DNA, 21 bp, Artificial sequence
  SiRNA target sequence
attataaatataaaaatggag

SEQ ID NO: 172024 - DNA, 21 bp, Artificial sequence
  SiRNA target sequence
ttataaatataaaaatggagt

SEQ ID NO: 172025 - DNA, 21 bp, Artificial sequence
  SiRNA target sequence
tataaatataaaaatggagtg

SEQ ID NO: 172026 - DNA, 21 bp, Artificial sequence
  SiRNA target sequence
ataaatataaaaatggagtgt

SEQ ID NO: 172027 - DNA, 21 bp, Artificial sequence
  SiRNA target sequence
taaatataaaaatggagtgtt

SEQ ID NO: 172028 - DNA, 21 bp, Artificial sequence
  SiRNA target sequence
aaatataaaaatggagtgttt

SEQ ID NO: 172029 - DNA, 21 bp, Artificial sequence
  SiRNA target sequence
aatataaaaatggagtgttta

SEQ ID NO: 172030 - DNA, 21 bp, Artificial sequence
  SiRNA target sequence
atataaaaatggagtgtttac

SEQ ID NO: 172031 - DNA, 21 bp, Artificial sequence
  SiRNA target sequence
tataaaaatggagtgtttaca

SEQ ID NO: 172032 - DNA, 21 bp, Artificial sequence
  SiRNA target sequence
ataaaaatggagtgtttacat

SEQ ID NO: 172033 - DNA, 21 bp, Artificial sequence
  SiRNA target sequence
taaaaatggagtgtttacata

SEQ ID NO: 172034 - DNA, 21 bp, Artificial sequence
  SiRNA target sequence
aaaaatggagtgtttacatat

SEQ ID NO: 172035 - DNA, 21 bp, Artificial sequence
  SiRNA target sequence
aaaatggagtgtttacatata

SEQ ID NO: 172036 - DNA, 21 bp, Artificial sequence
  SiRNA target sequence
aaatggagtgtttacatatac

SEQ ID NO: 172037 - DNA, 21 bp, Artificial sequence
  SiRNA target sequence
aatggagtgtttacatataca

SEQ ID NO: 172038 - DNA, 21 bp, Artificial sequence
  SiRNA target sequence
atggagtgtttacatatacac

SEQ ID NO: 172039 - DNA, 21 bp, Artificial sequence
  SiRNA target sequence
tggagtgtttacatatacaca

SEQ ID NO: 172040 - DNA, 21 bp, Artificial sequence
  SiRNA target sequence
ggagtgtttacatatacacag

SEQ ID NO: 172041 - DNA, 21 bp, Artificial sequence
  SiRNA target sequence
gagtgtttacatatacacaga

SEQ ID NO: 172042 - DNA, 21 bp, Artificial sequence
  SiRNA target sequence
agtgtttacatatacacagat

SEQ ID NO: 172043 - DNA, 21 bp, Artificial sequence
  SiRNA target sequence
gtgtttacatatacacagatc

SEQ ID NO: 172044 - DNA, 21 bp, Artificial sequence
  SiRNA target sequence
tgtttacatatacacagatca

SEQ ID NO: 172045 - DNA, 21 bp, Artificial sequence
  SiRNA target sequence
gtttacatatacacagatcaa

SEQ ID NO: 172046 - DNA, 21 bp, Artificial sequence
  SiRNA target sequence
tttacatatacacagatcaaa

SEQ ID NO: 172047 - DNA, 21 bp, Artificial sequence
  SiRNA target sequence
ttacatatacacagatcaaaa

SEQ ID NO: 172048 - DNA, 21 bp, Artificial sequence
  SiRNA target sequence
tacatatacacagatcaaaaa

SEQ ID NO: 172049 - DNA, 21 bp, Artificial sequence
  SiRNA target sequence
acatatacacagatcaaaaat

SEQ ID NO: 172050 - DNA, 21 bp, Artificial sequence
  SiRNA target sequence
catatacacagatcaaaaata

SEQ ID NO: 172051 - DNA, 21 bp, Artificial sequence
  SiRNA target sequence
atatacacagatcaaaaataa

SEQ ID NO: 172052 - DNA, 21 bp, Artificial sequence
  SiRNA target sequence
tatacacagatcaaaaataat

SEQ ID NO: 172053 - DNA, 21 bp, Artificial sequence
  SiRNA target sequence
atacacagatcaaaaataata

SEQ ID NO: 172054 - DNA, 21 bp, Artificial sequence
  SiRNA target sequence
tacacagatcaaaaataataa

SEQ ID NO: 172055 - DNA, 21 bp, Artificial sequence
  SiRNA target sequence
acacagatcaaaaataataag

SEQ ID NO: 172056 - DNA, 21 bp, Artificial sequence
  SiRNA target sequence
cacagatcaaaaataataaga

SEQ ID NO: 172057 - DNA, 21 bp, Artificial sequence
  SiRNA target sequence
acagatcaaaaataataagaa

SEQ ID NO: 172058 - DNA, 21 bp, Artificial sequence
  SiRNA target sequence
cagatcaaaaataataagaaa

SEQ ID NO: 172059 - DNA, 21 bp, Artificial sequence
  SiRNA target sequence
agatcaaaaataataagaaaa

SEQ ID NO: 172060 - DNA, 21 bp, Artificial sequence
  SiRNA target sequence
gatcaaaaataataagaaaaa

SEQ ID NO: 172061 - DNA, 21 bp, Artificial sequence
  SiRNA target sequence
atcaaaaataataagaaaaaa

SEQ ID NO: 172062 - DNA, 21 bp, Artificial sequence
  SiRNA target sequence
tcaaaaataataagaaaaaaa

SEQ ID NO: 172063 - DNA, 21 bp, Artificial sequence
  SiRNA target sequence
caaaaataataagaaaaaaaa

SEQ ID NO: 172064 - DNA, 21 bp, Artificial sequence
  SiRNA target sequence
aaaaataataagaaaaaaaaa

SEQ ID NO: 172065 - DNA, 21 bp, Artificial sequence
  SiRNA target sequence
aaaataataagaaaaaaaaat

SEQ ID NO: 172066 - DNA, 21 bp, Artificial sequence
  SiRNA target sequence
aaataataagaaaaaaaaata

SEQ ID NO: 172067 - DNA, 21 bp, Artificial sequence
  SiRNA target sequence
aataataagaaaaaaaaatat

SEQ ID NO: 172068 - DNA, 21 bp, Artificial sequence
  SiRNA target sequence
ataataagaaaaaaaaatatt

SEQ ID NO: 172069 - DNA, 21 bp, Artificial sequence
  SiRNA target sequence
taataagaaaaaaaaatattt

SEQ ID NO: 172070 - DNA, 21 bp, Artificial sequence
  SiRNA target sequence
aataagaaaaaaaaatattta

SEQ ID NO: 172071 - DNA, 21 bp, Artificial sequence
  SiRNA target sequence
ataagaaaaaaaaatatttaa

SEQ ID NO: 172072 - DNA, 21 bp, Artificial sequence
  SiRNA target sequence
taagaaaaaaaaatatttaag

SEQ ID NO: 172073 - DNA, 21 bp, Artificial sequence
  SiRNA target sequence
aagaaaaaaaaatatttaaga

SEQ ID NO: 172074 - DNA, 21 bp, Artificial sequence
  SiRNA target sequence
agaaaaaaaaatatttaagaa

SEQ ID NO: 172075 - DNA, 21 bp, Artificial sequence
  SiRNA target sequence
gaaaaaaaaatatttaagaat

SEQ ID NO: 172076 - DNA, 21 bp, Artificial sequence
  SiRNA target sequence
aaaaaaaaatatttaagaata

SEQ ID NO: 172077 - DNA, 21 bp, Artificial sequence
  SiRNA target sequence
aaaaaaaatatttaagaatat

SEQ ID NO: 172078 - DNA, 21 bp, Artificial sequence
  SiRNA target sequence
aaaaaaatatttaagaatatt

SEQ ID NO: 172079 - DNA, 21 bp, Artificial sequence
  SiRNA target sequence
aaaaaatatttaagaatattg

SEQ ID NO: 172080 - DNA, 21 bp, Artificial sequence
  SiRNA target sequence
aaaaatatttaagaatattgg

SEQ ID NO: 172081 - DNA, 21 bp, Artificial sequence
  SiRNA target sequence
aaaatatttaagaatattggg

SEQ ID NO: 172082 - DNA, 21 bp, Artificial sequence
  SiRNA target sequence
aaatatttaagaatattgggt

SEQ ID NO: 172083 - DNA, 21 bp, Artificial sequence
  SiRNA target sequence
aatatttaagaatattgggtc

SEQ ID NO: 172084 - DNA, 21 bp, Artificial sequence
  SiRNA target sequence
atatttaagaatattgggtct

SEQ ID NO: 172085 - DNA, 21 bp, Artificial sequence
  SiRNA target sequence
tatttaagaatattgggtcta

SEQ ID NO: 172086 - DNA, 21 bp, Artificial sequence
  SiRNA target sequence
atttaagaatattgggtctag

SEQ ID NO: 172087 - DNA, 21 bp, Artificial sequence
  SiRNA target sequence
tttaagaatattgggtctaga

SEQ ID NO: 172088 - DNA, 21 bp, Artificial sequence
  SiRNA target sequence
ttaagaatattgggtctagaa

SEQ ID NO: 172089 - DNA, 21 bp, Artificial sequence
  SiRNA target sequence
taagaatattgggtctagaac

SEQ ID NO: 172090 - DNA, 21 bp, Artificial sequence
  SiRNA target sequence
aagaatattgggtctagaacc

SEQ ID NO: 172091 - DNA, 21 bp, Artificial sequence
  SiRNA target sequence
agaatattgggtctagaacct

SEQ ID NO: 172092 - DNA, 21 bp, Artificial sequence
  SiRNA target sequence
gaatattgggtctagaacctt

SEQ ID NO: 172093 - DNA, 21 bp, Artificial sequence
  SiRNA target sequence
aatattgggtctagaaccttt

SEQ ID NO: 172094 - DNA, 21 bp, Artificial sequence
  SiRNA target sequence
atattgggtctagaacctttt

SEQ ID NO: 172095 - DNA, 21 bp, Artificial sequence
  SiRNA target sequence
tattgggtctagaaccttttc

SEQ ID NO: 172096 - DNA, 21 bp, Artificial sequence
  SiRNA target sequence
attgggtctagaaccttttct

SEQ ID NO: 172097 - DNA, 21 bp, Artificial sequence
  SiRNA target sequence
ttgggtctagaaccttttctt

SEQ ID NO: 172098 - DNA, 21 bp, Artificial sequence
  SiRNA target sequence
tgggtctagaaccttttctta

SEQ ID NO: 172099 - DNA, 21 bp, Artificial sequence
  SiRNA target sequence
gggtctagaaccttttcttaa

SEQ ID NO: 172100 - DNA, 21 bp, Artificial sequence
  SiRNA target sequence
ggtctagaaccttttcttaat

SEQ ID NO: 172101 - DNA, 21 bp, Artificial sequence
  SiRNA target sequence
gtctagaaccttttcttaatt

SEQ ID NO: 172102 - DNA, 21 bp, Artificial sequence
  SiRNA target sequence
tctagaaccttttcttaattt

SEQ ID NO: 172103 - DNA, 21 bp, Artificial sequence
  SiRNA target sequence
ctagaaccttttcttaatttt

SEQ ID NO: 172104 - DNA, 21 bp, Artificial sequence
  SiRNA target sequence
tagaaccttttcttaatttta

SEQ ID NO: 172105 - DNA, 21 bp, Artificial sequence
  SiRNA target sequence
agaaccttttcttaattttat

SEQ ID NO: 172106 - DNA, 21 bp, Artificial sequence
  SiRNA target sequence
gaaccttttcttaattttatt

SEQ ID NO: 172107 - DNA, 21 bp, Artificial sequence
  SiRNA target sequence
aaccttttcttaattttatta

SEQ ID NO: 172108 - DNA, 21 bp, Artificial sequence
  SiRNA target sequence
accttttcttaattttattaa

SEQ ID NO: 172109 - DNA, 21 bp, Artificial sequence
  SiRNA target sequence
ccttttcttaattttattaag

SEQ ID NO: 172110 - DNA, 21 bp, Artificial sequence
  SiRNA target sequence
cttttcttaattttattaagg

SEQ ID NO: 172111 - DNA, 21 bp, Artificial sequence
  SiRNA target sequence
ttttcttaattttattaagga

SEQ ID NO: 172112 - DNA, 21 bp, Artificial sequence
  SiRNA target sequence
tttcttaattttattaaggaa

SEQ ID NO: 172113 - DNA, 21 bp, Artificial sequence
  SiRNA target sequence
ttcttaattttattaaggaaa

SEQ ID NO: 172114 - DNA, 21 bp, Artificial sequence
  SiRNA target sequence
tcttaattttattaaggaaag

SEQ ID NO: 172115 - DNA, 21 bp, Artificial sequence
  SiRNA target sequence
cttaattttattaaggaaagt

SEQ ID NO: 172116 - DNA, 21 bp, Artificial sequence
  SiRNA target sequence
ttaattttattaaggaaagta

SEQ ID NO: 172117 - DNA, 21 bp, Artificial sequence
  SiRNA target sequence
taattttattaaggaaagtaa

SEQ ID NO: 172118 - DNA, 21 bp, Artificial sequence
  SiRNA target sequence
aattttattaaggaaagtaaa

SEQ ID NO: 172119 - DNA, 21 bp, Artificial sequence
  SiRNA target sequence
attttattaaggaaagtaaac

SEQ ID NO: 172120 - DNA, 21 bp, Artificial sequence
  SiRNA target sequence
ttttattaaggaaagtaaaca

SEQ ID NO: 172121 - DNA, 21 bp, Artificial sequence
  SiRNA target sequence
tttattaaggaaagtaaacat

SEQ ID NO: 172122 - DNA, 21 bp, Artificial sequence
  SiRNA target sequence
ttattaaggaaagtaaacata

SEQ ID NO: 172123 - DNA, 21 bp, Artificial sequence
  SiRNA target sequence
tattaaggaaagtaaacataa

SEQ ID NO: 172124 - DNA, 21 bp, Artificial sequence
  SiRNA target sequence
attaaggaaagtaaacataaa

SEQ ID NO: 172125 - DNA, 21 bp, Artificial sequence
  SiRNA target sequence
ttaaggaaagtaaacataaag

SEQ ID NO: 172126 - DNA, 21 bp, Artificial sequence
  SiRNA target sequence
taaggaaagtaaacataaaga

SEQ ID NO: 172127 - DNA, 21 bp, Artificial sequence
  SiRNA target sequence
aaggaaagtaaacataaagaa

SEQ ID NO: 172128 - DNA, 21 bp, Artificial sequence
  SiRNA target sequence
aggaaagtaaacataaagaat

SEQ ID NO: 172129 - DNA, 21 bp, Artificial sequence
  SiRNA target sequence
ggaaagtaaacataaagaatt

SEQ ID NO: 172130 - DNA, 21 bp, Artificial sequence
  SiRNA target sequence
gaaagtaaacataaagaatta

SEQ ID NO: 172131 - DNA, 21 bp, Artificial sequence
  SiRNA target sequence
aaagtaaacataaagaattag

SEQ ID NO: 172132 - DNA, 21 bp, Artificial sequence
  SiRNA target sequence
aagtaaacataaagaattaga

SEQ ID NO: 172133 - DNA, 21 bp, Artificial sequence
  SiRNA target sequence
agtaaacataaagaattagaa

SEQ ID NO: 172134 - DNA, 21 bp, Artificial sequence
  SiRNA target sequence
gtaaacataaagaattagaat

SEQ ID NO: 172135 - DNA, 21 bp, Artificial sequence
  SiRNA target sequence
taaacataaagaattagaata

SEQ ID NO: 172136 - DNA, 21 bp, Artificial sequence
  SiRNA target sequence
aaacataaagaattagaatat

SEQ ID NO: 172137 - DNA, 21 bp, Artificial sequence
  SiRNA target sequence
aacataaagaattagaatatg

SEQ ID NO: 172138 - DNA, 21 bp, Artificial sequence
  SiRNA target sequence
acataaagaattagaatatga

SEQ ID NO: 172139 - DNA, 21 bp, Artificial sequence
  SiRNA target sequence
cataaagaattagaatatgat

SEQ ID NO: 172140 - DNA, 21 bp, Artificial sequence
  SiRNA target sequence
ataaagaattagaatatgatg

SEQ ID NO: 172141 - DNA, 21 bp, Artificial sequence
  SiRNA target sequence
taaagaattagaatatgatgt

SEQ ID NO: 172142 - DNA, 21 bp, Artificial sequence
  SiRNA target sequence
aaagaattagaatatgatgta

SEQ ID NO: 172143 - DNA, 21 bp, Artificial sequence
  SiRNA target sequence
aagaattagaatatgatgtat

SEQ ID NO: 172144 - DNA, 21 bp, Artificial sequence
  SiRNA target sequence
agaattagaatatgatgtatg

SEQ ID NO: 172145 - DNA, 21 bp, Artificial sequence
  SiRNA target sequence
gaattagaatatgatgtatgc

SEQ ID NO: 172146 - DNA, 21 bp, Artificial sequence
  SiRNA target sequence
aattagaatatgatgtatgcg

SEQ ID NO: 172147 - DNA, 21 bp, Artificial sequence
  SiRNA target sequence
attagaatatgatgtatgcga

SEQ ID NO: 172148 - DNA, 21 bp, Artificial sequence
  SiRNA target sequence
ttagaatatgatgtatgcgaa

SEQ ID NO: 172149 - DNA, 21 bp, Artificial sequence
  SiRNA target sequence
tagaatatgatgtatgcgaaa

SEQ ID NO: 172150 - DNA, 21 bp, Artificial sequence
  SiRNA target sequence
agaatatgatgtatgcgaaat

SEQ ID NO: 172151 - DNA, 21 bp, Artificial sequence
  SiRNA target sequence
gaatatgatgtatgcgaaata

SEQ ID NO: 172152 - DNA, 21 bp, Artificial sequence
  SiRNA target sequence
aatatgatgtatgcgaaatat

SEQ ID NO: 172153 - DNA, 21 bp, Artificial sequence
  SiRNA target sequence
atatgatgtatgcgaaatata

SEQ ID NO: 172154 - DNA, 21 bp, Artificial sequence
  SiRNA target sequence
tatgatgtatgcgaaatatac

SEQ ID NO: 172155 - DNA, 21 bp, Artificial sequence
  SiRNA target sequence
atgatgtatgcgaaatataca

SEQ ID NO: 172156 - DNA, 21 bp, Artificial sequence
  SiRNA target sequence
tgatgtatgcgaaatatacat

SEQ ID NO: 172157 - DNA, 21 bp, Artificial sequence
  SiRNA target sequence
gatgtatgcgaaatatacatt

SEQ ID NO: 172158 - DNA, 21 bp, Artificial sequence
  SiRNA target sequence
atgtatgcgaaatatacattt

SEQ ID NO: 172159 - DNA, 21 bp, Artificial sequence
  SiRNA target sequence
tgtatgcgaaatatacatttg

SEQ ID NO: 172160 - DNA, 21 bp, Artificial sequence
  SiRNA target sequence
gtatgcgaaatatacatttgt

SEQ ID NO: 172161 - DNA, 21 bp, Artificial sequence
  SiRNA target sequence
tatgcgaaatatacatttgta

SEQ ID NO: 172162 - DNA, 21 bp, Artificial sequence
  SiRNA target sequence
atgcgaaatatacatttgtaa

SEQ ID NO: 172163 - DNA, 21 bp, Artificial sequence
  SiRNA target sequence
tgcgaaatatacatttgtaat

SEQ ID NO: 172164 - DNA, 21 bp, Artificial sequence
  SiRNA target sequence
gcgaaatatacatttgtaatc

SEQ ID NO: 172165 - DNA, 21 bp, Artificial sequence
  SiRNA target sequence
cgaaatatacatttgtaatca

SEQ ID NO: 172166 - DNA, 21 bp, Artificial sequence
  SiRNA target sequence
gaaatatacatttgtaatcag

SEQ ID NO: 172167 - DNA, 21 bp, Artificial sequence
  SiRNA target sequence
aaatatacatttgtaatcagg

SEQ ID NO: 172168 - DNA, 21 bp, Artificial sequence
  SiRNA target sequence
aatatacatttgtaatcaggg

SEQ ID NO: 172169 - DNA, 21 bp, Artificial sequence
  SiRNA target sequence
atatacatttgtaatcaggga

SEQ ID NO: 172170 - DNA, 21 bp, Artificial sequence
  SiRNA target sequence
tatacatttgtaatcagggat

SEQ ID NO: 172171 - DNA, 21 bp, Artificial sequence
  SiRNA target sequence
atacatttgtaatcagggatg

SEQ ID NO: 172172 - DNA, 21 bp, Artificial sequence
  SiRNA target sequence
tacatttgtaatcagggatgc

SEQ ID NO: 172173 - DNA, 21 bp, Artificial sequence
  SiRNA target sequence
acatttgtaatcagggatgca

SEQ ID NO: 172174 - DNA, 21 bp, Artificial sequence
  SiRNA target sequence
catttgtaatcagggatgcat

SEQ ID NO: 172175 - DNA, 21 bp, Artificial sequence
  SiRNA target sequence
atttgtaatcagggatgcatt

SEQ ID NO: 172176 - DNA, 21 bp, Artificial sequence
  SiRNA target sequence
tttgtaatcagggatgcatta

SEQ ID NO: 172177 - DNA, 21 bp, Artificial sequence
  SiRNA target sequence
ttgtaatcagggatgcattaa

SEQ ID NO: 172178 - DNA, 21 bp, Artificial sequence
  SiRNA target sequence
tgtaatcagggatgcattaat

SEQ ID NO: 172179 - DNA, 21 bp, Artificial sequence
  SiRNA target sequence
gtaatcagggatgcattaatg

SEQ ID NO: 172180 - DNA, 21 bp, Artificial sequence
  SiRNA target sequence
taatcagggatgcattaatgg

SEQ ID NO: 172181 - DNA, 21 bp, Artificial sequence
  SiRNA target sequence
aatcagggatgcattaatgga

SEQ ID NO: 172182 - DNA, 21 bp, Artificial sequence
  SiRNA target sequence
atcagggatgcattaatggac

SEQ ID NO: 172183 - DNA, 21 bp, Artificial sequence
  SiRNA target sequence
tcagggatgcattaatggacc

SEQ ID NO: 172184 - DNA, 21 bp, Artificial sequence
  SiRNA target sequence
cagggatgcattaatggacca

SEQ ID NO: 172185 - DNA, 21 bp, Artificial sequence
  SiRNA target sequence
agggatgcattaatggaccag

SEQ ID NO: 172186 - DNA, 21 bp, Artificial sequence
  SiRNA target sequence
gggatgcattaatggaccagg

SEQ ID NO: 172187 - DNA, 21 bp, Artificial sequence
  SiRNA target sequence
ggatgcattaatggaccagga

SEQ ID NO: 172188 - DNA, 21 bp, Artificial sequence
  SiRNA target sequence
gatgcattaatggaccaggac

SEQ ID NO: 172189 - DNA, 21 bp, Artificial sequence
  SiRNA target sequence
atgcattaatggaccaggaca

SEQ ID NO: 172190 - DNA, 21 bp, Artificial sequence
  SiRNA target sequence
tgcattaatggaccaggacaa

SEQ ID NO: 172191 - DNA, 21 bp, Artificial sequence
  SiRNA target sequence
gcattaatggaccaggacaat

SEQ ID NO: 172192 - DNA, 21 bp, Artificial sequence
  SiRNA target sequence
cattaatggaccaggacaatt

SEQ ID NO: 172193 - DNA, 21 bp, Artificial sequence
  SiRNA target sequence
attaatggaccaggacaattg

SEQ ID NO: 172194 - DNA, 21 bp, Artificial sequence
  SiRNA target sequence
ttaatggaccaggacaattgt

SEQ ID NO: 172195 - DNA, 21 bp, Artificial sequence
  SiRNA target sequence
taatggaccaggacaattgta

SEQ ID NO: 172196 - DNA, 21 bp, Artificial sequence
  SiRNA target sequence
aatggaccaggacaattgtat

SEQ ID NO: 172197 - DNA, 21 bp, Artificial sequence
  SiRNA target sequence
atggaccaggacaattgtata

SEQ ID NO: 172198 - DNA, 21 bp, Artificial sequence
  SiRNA target sequence
tggaccaggacaattgtatac

SEQ ID NO: 172199 - DNA, 21 bp, Artificial sequence
  SiRNA target sequence
ggaccaggacaattgtataca

SEQ ID NO: 172200 - DNA, 21 bp, Artificial sequence
  SiRNA target sequence
gaccaggacaattgtatacag

SEQ ID NO: 172201 - DNA, 21 bp, Artificial sequence
  SiRNA target sequence
accaggacaattgtatacaga

SEQ ID NO: 172202 - DNA, 21 bp, Artificial sequence
  SiRNA target sequence
ccaggacaattgtatacagat

SEQ ID NO: 172203 - DNA, 21 bp, Artificial sequence
  SiRNA target sequence
caggacaattgtatacagata

SEQ ID NO: 172204 - DNA, 21 bp, Artificial sequence
  SiRNA target sequence
aggacaattgtatacagataa

SEQ ID NO: 172205 - DNA, 21 bp, Artificial sequence
  SiRNA target sequence
ggacaattgtatacagataat

SEQ ID NO: 172206 - DNA, 21 bp, Artificial sequence
  SiRNA target sequence
gacaattgtatacagataatt

SEQ ID NO: 172207 - DNA, 21 bp, Artificial sequence
  SiRNA target sequence
acaattgtatacagataattt

SEQ ID NO: 172208 - DNA, 21 bp, Artificial sequence
  SiRNA target sequence
caattgtatacagataattta

SEQ ID NO: 172209 - DNA, 21 bp, Artificial sequence
  SiRNA target sequence
aattgtatacagataatttat

SEQ ID NO: 172210 - DNA, 21 bp, Artificial sequence
  SiRNA target sequence
attgtatacagataatttata

SEQ ID NO: 172211 - DNA, 21 bp, Artificial sequence
  SiRNA target sequence
ttgtatacagataatttatat

SEQ ID NO: 172212 - DNA, 21 bp, Artificial sequence
  SiRNA target sequence
tgtatacagataatttatatg

SEQ ID NO: 172213 - DNA, 21 bp, Artificial sequence
  SiRNA target sequence
gtatacagataatttatatgt

SEQ ID NO: 172214 - DNA, 21 bp, Artificial sequence
  SiRNA target sequence
tatacagataatttatatgta

SEQ ID NO: 172215 - DNA, 21 bp, Artificial sequence
  SiRNA target sequence
atacagataatttatatgtaa

SEQ ID NO: 172216 - DNA, 21 bp, Artificial sequence
  SiRNA target sequence
tacagataatttatatgtaaa

SEQ ID NO: 172217 - DNA, 21 bp, Artificial sequence
  SiRNA target sequence
acagataatttatatgtaaat

SEQ ID NO: 172218 - DNA, 21 bp, Artificial sequence
  SiRNA target sequence
cagataatttatatgtaaata

SEQ ID NO: 172219 - DNA, 21 bp, Artificial sequence
  SiRNA target sequence
agataatttatatgtaaataa

SEQ ID NO: 172220 - DNA, 21 bp, Artificial sequence
  SiRNA target sequence
gataatttatatgtaaataat

SEQ ID NO: 172221 - DNA, 21 bp, Artificial sequence
  SiRNA target sequence
ataatttatatgtaaataatt

SEQ ID NO: 172222 - DNA, 21 bp, Artificial sequence
  SiRNA target sequence
taatttatatgtaaataattc

SEQ ID NO: 172223 - DNA, 21 bp, Artificial sequence
  SiRNA target sequence
aatttatatgtaaataattca

SEQ ID NO: 172224 - DNA, 21 bp, Artificial sequence
  SiRNA target sequence
atttatatgtaaataattcag

SEQ ID NO: 172225 - DNA, 21 bp, Artificial sequence
  SiRNA target sequence
tttatatgtaaataattcaga

SEQ ID NO: 172226 - DNA, 21 bp, Artificial sequence
  SiRNA target sequence
ttatatgtaaataattcagaa

SEQ ID NO: 172227 - DNA, 21 bp, Artificial sequence
  SiRNA target sequence
tatatgtaaataattcagaat

SEQ ID NO: 172228 - DNA, 21 bp, Artificial sequence
  SiRNA target sequence
atatgtaaataattcagaata

SEQ ID NO: 172229 - DNA, 21 bp, Artificial sequence
  SiRNA target sequence
tatgtaaataattcagaatac

SEQ ID NO: 172230 - DNA, 21 bp, Artificial sequence
  SiRNA target sequence
atgtaaataattcagaataca

SEQ ID NO: 172231 - DNA, 21 bp, Artificial sequence
  SiRNA target sequence
tgtaaataattcagaatacat

SEQ ID NO: 172232 - DNA, 21 bp, Artificial sequence
  SiRNA target sequence
gtaaataattcagaatacata

SEQ ID NO: 172233 - DNA, 21 bp, Artificial sequence
  SiRNA target sequence
taaataattcagaatacatag

SEQ ID NO: 172234 - DNA, 21 bp, Artificial sequence
  SiRNA target sequence
aaataattcagaatacataga

SEQ ID NO: 172235 - DNA, 21 bp, Artificial sequence
  SiRNA target sequence
aataattcagaatacatagat

SEQ ID NO: 172236 - DNA, 21 bp, Artificial sequence
  SiRNA target sequence
ataattcagaatacatagata

SEQ ID NO: 172237 - DNA, 21 bp, Artificial sequence
  SiRNA target sequence
taattcagaatacatagatat

SEQ ID NO: 172238 - DNA, 21 bp, Artificial sequence
  SiRNA target sequence
aattcagaatacatagatatt

SEQ ID NO: 172239 - DNA, 21 bp, Artificial sequence
  SiRNA target sequence
attcagaatacatagatattg

SEQ ID NO: 172240 - DNA, 21 bp, Artificial sequence
  SiRNA target sequence
ttcagaatacatagatattga

SEQ ID NO: 172241 - DNA, 21 bp, Artificial sequence
  SiRNA target sequence
tcagaatacatagatattgat

SEQ ID NO: 172242 - DNA, 21 bp, Artificial sequence
  SiRNA target sequence
cagaatacatagatattgatc

SEQ ID NO: 172243 - DNA, 21 bp, Artificial sequence
  SiRNA target sequence
agaatacatagatattgatct

SEQ ID NO: 172244 - DNA, 21 bp, Artificial sequence
  SiRNA target sequence
gaatacatagatattgatctt

SEQ ID NO: 172245 - DNA, 21 bp, Artificial sequence
  SiRNA target sequence
aatacatagatattgatcttg

SEQ ID NO: 172246 - DNA, 21 bp, Artificial sequence
  SiRNA target sequence
atacatagatattgatcttgg

SEQ ID NO: 172247 - DNA, 21 bp, Artificial sequence
  SiRNA target sequence
tacatagatattgatcttggt

SEQ ID NO: 172248 - DNA, 21 bp, Artificial sequence
  SiRNA target sequence
acatagatattgatcttggta

SEQ ID NO: 172249 - DNA, 21 bp, Artificial sequence
  SiRNA target sequence
catagatattgatcttggtat

SEQ ID NO: 172250 - DNA, 21 bp, Artificial sequence
  SiRNA target sequence
atagatattgatcttggtatt

SEQ ID NO: 172251 - DNA, 21 bp, Artificial sequence
  SiRNA target sequence
tagatattgatcttggtattg

SEQ ID NO: 172252 - DNA, 21 bp, Artificial sequence
  SiRNA target sequence
agatattgatcttggtattga

SEQ ID NO: 172253 - DNA, 21 bp, Artificial sequence
  SiRNA target sequence
gatattgatcttggtattgat

SEQ ID NO: 172254 - DNA, 21 bp, Artificial sequence
  SiRNA target sequence
atattgatcttggtattgatt

SEQ ID NO: 172255 - DNA, 21 bp, Artificial sequence
  SiRNA target sequence
tattgatcttggtattgattg

SEQ ID NO: 172256 - DNA, 21 bp, Artificial sequence
  SiRNA target sequence
attgatcttggtattgattgt

SEQ ID NO: 172257 - DNA, 21 bp, Artificial sequence
  SiRNA target sequence
ttgatcttggtattgattgta

SEQ ID NO: 172258 - DNA, 21 bp, Artificial sequence
  SiRNA target sequence
tgatcttggtattgattgtaa

SEQ ID NO: 172259 - DNA, 21 bp, Artificial sequence
  SiRNA target sequence
gatcttggtattgattgtaaa

SEQ ID NO: 172260 - DNA, 21 bp, Artificial sequence
  SiRNA target sequence
atcttggtattgattgtaaac

SEQ ID NO: 172261 - DNA, 21 bp, Artificial sequence
  SiRNA target sequence
tcttggtattgattgtaaaca

SEQ ID NO: 172262 - DNA, 21 bp, Artificial sequence
  SiRNA target sequence
cttggtattgattgtaaacag

SEQ ID NO: 172263 - DNA, 21 bp, Artificial sequence
  SiRNA target sequence
ttggtattgattgtaaacagt

SEQ ID NO: 172264 - DNA, 21 bp, Artificial sequence
  SiRNA target sequence
tggtattgattgtaaacagtt

SEQ ID NO: 172265 - DNA, 21 bp, Artificial sequence
  SiRNA target sequence
ggtattgattgtaaacagtta

SEQ ID NO: 172266 - DNA, 21 bp, Artificial sequence
  SiRNA target sequence
gtattgattgtaaacagttac

SEQ ID NO: 172267 - DNA, 21 bp, Artificial sequence
  SiRNA target sequence
tattgattgtaaacagttaca

SEQ ID NO: 172268 - DNA, 21 bp, Artificial sequence
  SiRNA target sequence
attgattgtaaacagttacaa

SEQ ID NO: 172269 - DNA, 21 bp, Artificial sequence
  SiRNA target sequence
ttgattgtaaacagttacaaa

SEQ ID NO: 172270 - DNA, 21 bp, Artificial sequence
  SiRNA target sequence
tgattgtaaacagttacaaaa

SEQ ID NO: 172271 - DNA, 21 bp, Artificial sequence
  SiRNA target sequence
gattgtaaacagttacaaaaa

SEQ ID NO: 172272 - DNA, 21 bp, Artificial sequence
  SiRNA target sequence
attgtaaacagttacaaaaaa

SEQ ID NO: 172273 - DNA, 21 bp, Artificial sequence
  SiRNA target sequence
ttgtaaacagttacaaaaaag

SEQ ID NO: 172274 - DNA, 21 bp, Artificial sequence
  SiRNA target sequence
tgtaaacagttacaaaaaagg

SEQ ID NO: 172275 - DNA, 21 bp, Artificial sequence
  SiRNA target sequence
gtaaacagttacaaaaaagga

SEQ ID NO: 172276 - DNA, 21 bp, Artificial sequence
  SiRNA target sequence
taaacagttacaaaaaaggac

SEQ ID NO: 172277 - DNA, 21 bp, Artificial sequence
  SiRNA target sequence
aaacagttacaaaaaaggaca

SEQ ID NO: 172278 - DNA, 21 bp, Artificial sequence
  SiRNA target sequence
aacagttacaaaaaaggacat

SEQ ID NO: 172279 - DNA, 21 bp, Artificial sequence
  SiRNA target sequence
acagttacaaaaaaggacata

SEQ ID NO: 172280 - DNA, 21 bp, Artificial sequence
  SiRNA target sequence
cagttacaaaaaaggacatat

SEQ ID NO: 172281 - DNA, 21 bp, Artificial sequence
  SiRNA target sequence
agttacaaaaaaggacatata

SEQ ID NO: 172282 - DNA, 21 bp, Artificial sequence
  SiRNA target sequence
gttacaaaaaaggacatatag

SEQ ID NO: 172283 - DNA, 21 bp, Artificial sequence
  SiRNA target sequence
ttacaaaaaaggacatataga

SEQ ID NO: 172284 - DNA, 21 bp, Artificial sequence
  SiRNA target sequence
tacaaaaaaggacatatagaa

SEQ ID NO: 172285 - DNA, 21 bp, Artificial sequence
  SiRNA target sequence
acaaaaaaggacatatagaaa

SEQ ID NO: 172286 - DNA, 21 bp, Artificial sequence
  SiRNA target sequence
caaaaaaggacatatagaaaa

SEQ ID NO: 172287 - DNA, 21 bp, Artificial sequence
  SiRNA target sequence
aaaaaaggacatatagaaaaa

SEQ ID NO: 172288 - DNA, 21 bp, Artificial sequence
  SiRNA target sequence
aaaaaggacatatagaaaaat

SEQ ID NO: 172289 - DNA, 21 bp, Artificial sequence
  SiRNA target sequence
aaaaggacatatagaaaaata

SEQ ID NO: 172290 - DNA, 21 bp, Artificial sequence
  SiRNA target sequence
aaaggacatatagaaaaatag

SEQ ID NO: 172291 - DNA, 21 bp, Artificial sequence
  SiRNA target sequence
aaggacatatagaaaaataga

SEQ ID NO: 172292 - DNA, 21 bp, Artificial sequence
  SiRNA target sequence
aggacatatagaaaaatagaa

SEQ ID NO: 172293 - DNA, 21 bp, Artificial sequence
  SiRNA target sequence
ggacatatagaaaaatagaaa

SEQ ID NO: 172294 - DNA, 21 bp, Artificial sequence
  SiRNA target sequence
gacatatagaaaaatagaaac

SEQ ID NO: 172295 - DNA, 21 bp, Artificial sequence
  SiRNA target sequence
acatatagaaaaatagaaaca

SEQ ID NO: 172296 - DNA, 21 bp, Artificial sequence
  SiRNA target sequence
catatagaaaaatagaaacaa

SEQ ID NO: 172297 - DNA, 21 bp, Artificial sequence
  SiRNA target sequence
atatagaaaaatagaaacaaa

SEQ ID NO: 172298 - DNA, 21 bp, Artificial sequence
  SiRNA target sequence
tatagaaaaatagaaacaaag

SEQ ID NO: 172299 - DNA, 21 bp, Artificial sequence
  SiRNA target sequence
atagaaaaatagaaacaaaga

SEQ ID NO: 172300 - DNA, 21 bp, Artificial sequence
  SiRNA target sequence
tagaaaaatagaaacaaagaa

SEQ ID NO: 172301 - DNA, 21 bp, Artificial sequence
  SiRNA target sequence
agaaaaatagaaacaaagaaa

SEQ ID NO: 172302 - DNA, 21 bp, Artificial sequence
  SiRNA target sequence
gaaaaatagaaacaaagaaag

SEQ ID NO: 172303 - DNA, 21 bp, Artificial sequence
  SiRNA target sequence
aaaaatagaaacaaagaaagt

SEQ ID NO: 172304 - DNA, 21 bp, Artificial sequence
  SiRNA target sequence
aaaatagaaacaaagaaagtt

SEQ ID NO: 172305 - DNA, 21 bp, Artificial sequence
  SiRNA target sequence
aaatagaaacaaagaaagtta

SEQ ID NO: 172306 - DNA, 21 bp, Artificial sequence
  SiRNA target sequence
aatagaaacaaagaaagttaa

SEQ ID NO: 172307 - DNA, 21 bp, Artificial sequence
  SiRNA target sequence
atagaaacaaagaaagttaat

SEQ ID NO: 172308 - DNA, 21 bp, Artificial sequence
  SiRNA target sequence
tagaaacaaagaaagttaatt

SEQ ID NO: 172309 - DNA, 21 bp, Artificial sequence
  SiRNA target sequence
agaaacaaagaaagttaattt

SEQ ID NO: 172310 - DNA, 21 bp, Artificial sequence
  SiRNA target sequence
gaaacaaagaaagttaatttt

SEQ ID NO: 172311 - DNA, 21 bp, Artificial sequence
  SiRNA target sequence
aaacaaagaaagttaatttta

SEQ ID NO: 172312 - DNA, 21 bp, Artificial sequence
  SiRNA target sequence
aacaaagaaagttaattttaa

SEQ ID NO: 172313 - DNA, 21 bp, Artificial sequence
  SiRNA target sequence
acaaagaaagttaattttaaa

SEQ ID NO: 172314 - DNA, 21 bp, Artificial sequence
  SiRNA target sequence
caaagaaagttaattttaaaa

SEQ ID NO: 172315 - DNA, 21 bp, Artificial sequence
  SiRNA target sequence
aaagaaagttaattttaaaat

SEQ ID NO: 172316 - DNA, 21 bp, Artificial sequence
  SiRNA target sequence
aagaaagttaattttaaaata

SEQ ID NO: 172317 - DNA, 21 bp, Artificial sequence
  SiRNA target sequence
agaaagttaattttaaaatag

SEQ ID NO: 172318 - DNA, 21 bp, Artificial sequence
  SiRNA target sequence
gaaagttaattttaaaataga

SEQ ID NO: 172319 - DNA, 21 bp, Artificial sequence
  SiRNA target sequence
aaagttaattttaaaatagaa

SEQ ID NO: 172320 - DNA, 21 bp, Artificial sequence
  SiRNA target sequence
aagttaattttaaaatagaat

SEQ ID NO: 172321 - DNA, 21 bp, Artificial sequence
  SiRNA target sequence
agttaattttaaaatagaatg

SEQ ID NO: 172322 - DNA, 21 bp, Artificial sequence
  SiRNA target sequence
gttaattttaaaatagaatgg

SEQ ID NO: 172323 - DNA, 21 bp, Artificial sequence
  SiRNA target sequence
ttaattttaaaatagaatggt

SEQ ID NO: 172324 - DNA, 21 bp, Artificial sequence
  SiRNA target sequence
taattttaaaatagaatggta

SEQ ID NO: 172325 - DNA, 21 bp, Artificial sequence
  SiRNA target sequence
aattttaaaatagaatggtaa

SEQ ID NO: 172326 - DNA, 22 bp, Artificial sequence
  SiRNA target sequence
atgaatactgaaaataaaccat

SEQ ID NO: 172327 - DNA, 22 bp, Artificial sequence
  SiRNA target sequence
tgaatactgaaaataaaccatg

SEQ ID NO: 172328 - DNA, 22 bp, Artificial sequence
  SiRNA target sequence
gaatactgaaaataaaccatgt

SEQ ID NO: 172329 - DNA, 22 bp, Artificial sequence
  SiRNA target sequence
aatactgaaaataaaccatgta

SEQ ID NO: 172330 - DNA, 22 bp, Artificial sequence
  SiRNA target sequence
atactgaaaataaaccatgtat

SEQ ID NO: 172331 - DNA, 22 bp, Artificial sequence
  SiRNA target sequence
tactgaaaataaaccatgtatt

SEQ ID NO: 172332 - DNA, 22 bp, Artificial sequence
  SiRNA target sequence
actgaaaataaaccatgtattt

SEQ ID NO: 172333 - DNA, 22 bp, Artificial sequence
  SiRNA target sequence
ctgaaaataaaccatgtatttc

SEQ ID NO: 172334 - DNA, 22 bp, Artificial sequence
  SiRNA target sequence
tgaaaataaaccatgtatttca

SEQ ID NO: 172335 - DNA, 22 bp, Artificial sequence
  SiRNA target sequence
gaaaataaaccatgtatttcac

SEQ ID NO: 172336 - DNA, 22 bp, Artificial sequence
  SiRNA target sequence
aaaataaaccatgtatttcacc

SEQ ID NO: 172337 - DNA, 22 bp, Artificial sequence
  SiRNA target sequence
aaataaaccatgtatttcacca

SEQ ID NO: 172338 - DNA, 22 bp, Artificial sequence
  SiRNA target sequence
aataaaccatgtatttcaccat

SEQ ID NO: 172339 - DNA, 22 bp, Artificial sequence
  SiRNA target sequence
ataaaccatgtatttcaccatt

SEQ ID NO: 172340 - DNA, 22 bp, Artificial sequence
  SiRNA target sequence
taaaccatgtatttcaccattt

SEQ ID NO: 172341 - DNA, 22 bp, Artificial sequence
  SiRNA target sequence
aaaccatgtatttcaccattta

SEQ ID NO: 172342 - DNA, 22 bp, Artificial sequence
  SiRNA target sequence
aaccatgtatttcaccatttac

SEQ ID NO: 172343 - DNA, 22 bp, Artificial sequence
  SiRNA target sequence
accatgtatttcaccatttacc

SEQ ID NO: 172344 - DNA, 22 bp, Artificial sequence
  SiRNA target sequence
ccatgtatttcaccatttacct

SEQ ID NO: 172345 - DNA, 22 bp, Artificial sequence
  SiRNA target sequence
catgtatttcaccatttacctt

SEQ ID NO: 172346 - DNA, 22 bp, Artificial sequence
  SiRNA target sequence
atgtatttcaccatttaccttt

SEQ ID NO: 172347 - DNA, 22 bp, Artificial sequence
  SiRNA target sequence
tgtatttcaccatttaccttta

SEQ ID NO: 172348 - DNA, 22 bp, Artificial sequence
  SiRNA target sequence
gtatttcaccatttacctttaa

SEQ ID NO: 172349 - DNA, 22 bp, Artificial sequence
  SiRNA target sequence
tatttcaccatttacctttaaa

SEQ ID NO: 172350 - DNA, 22 bp, Artificial sequence
  SiRNA target sequence
atttcaccatttacctttaaac

SEQ ID NO: 172351 - DNA, 22 bp, Artificial sequence
  SiRNA target sequence
tttcaccatttacctttaaact

SEQ ID NO: 172352 - DNA, 22 bp, Artificial sequence
  SiRNA target sequence
ttcaccatttacctttaaacta

SEQ ID NO: 172353 - DNA, 22 bp, Artificial sequence
  SiRNA target sequence
tcaccatttacctttaaactag

SEQ ID NO: 172354 - DNA, 22 bp, Artificial sequence
  SiRNA target sequence
caccatttacctttaaactaga

SEQ ID NO: 172355 - DNA, 22 bp, Artificial sequence
  SiRNA target sequence
accatttacctttaaactagaa

SEQ ID NO: 172356 - DNA, 22 bp, Artificial sequence
  SiRNA target sequence
ccatttacctttaaactagaag

SEQ ID NO: 172357 - DNA, 22 bp, Artificial sequence
  SiRNA target sequence
catttacctttaaactagaaga

SEQ ID NO: 172358 - DNA, 22 bp, Artificial sequence
  SiRNA target sequence
atttacctttaaactagaagat

SEQ ID NO: 172359 - DNA, 22 bp, Artificial sequence
  SiRNA target sequence
tttacctttaaactagaagatt

SEQ ID NO: 172360 - DNA, 22 bp, Artificial sequence
  SiRNA target sequence
ttacctttaaactagaagattg

SEQ ID NO: 172361 - DNA, 22 bp, Artificial sequence
  SiRNA target sequence
tacctttaaactagaagattgc

SEQ ID NO: 172362 - DNA, 22 bp, Artificial sequence
  SiRNA target sequence
acctttaaactagaagattgcc

SEQ ID NO: 172363 - DNA, 22 bp, Artificial sequence
  SiRNA target sequence
cctttaaactagaagattgcct

SEQ ID NO: 172364 - DNA, 22 bp, Artificial sequence
  SiRNA target sequence
ctttaaactagaagattgcctg

SEQ ID NO: 172365 - DNA, 22 bp, Artificial sequence
  SiRNA target sequence
tttaaactagaagattgcctgg

SEQ ID NO: 172366 - DNA, 22 bp, Artificial sequence
  SiRNA target sequence
ttaaactagaagattgcctggc

SEQ ID NO: 172367 - DNA, 22 bp, Artificial sequence
  SiRNA target sequence
taaactagaagattgcctggca

SEQ ID NO: 172368 - DNA, 22 bp, Artificial sequence
  SiRNA target sequence
aaactagaagattgcctggcat

SEQ ID NO: 172369 - DNA, 22 bp, Artificial sequence
  SiRNA target sequence
aactagaagattgcctggcatg

SEQ ID NO: 172370 - DNA, 22 bp, Artificial sequence
  SiRNA target sequence
actagaagattgcctggcatgt

SEQ ID NO: 172371 - DNA, 22 bp, Artificial sequence
  SiRNA target sequence
ctagaagattgcctggcatgtt

SEQ ID NO: 172372 - DNA, 22 bp, Artificial sequence
  SiRNA target sequence
tagaagattgcctggcatgttc

SEQ ID NO: 172373 - DNA, 22 bp, Artificial sequence
  SiRNA target sequence
agaagattgcctggcatgttcg

SEQ ID NO: 172374 - DNA, 22 bp, Artificial sequence
  SiRNA target sequence
gaagattgcctggcatgttcgg

SEQ ID NO: 172375 - DNA, 22 bp, Artificial sequence
  SiRNA target sequence
aagattgcctggcatgttcggc

SEQ ID NO: 172376 - DNA, 22 bp, Artificial sequence
  SiRNA target sequence
agattgcctggcatgttcggct

SEQ ID NO: 172377 - DNA, 22 bp, Artificial sequence
  SiRNA target sequence
gattgcctggcatgttcggctt

SEQ ID NO: 172378 - DNA, 22 bp, Artificial sequence
  SiRNA target sequence
attgcctggcatgttcggcttg

SEQ ID NO: 172379 - DNA, 22 bp, Artificial sequence
  SiRNA target sequence
ttgcctggcatgttcggcttgt

SEQ ID NO: 172380 - DNA, 22 bp, Artificial sequence
  SiRNA target sequence
tgcctggcatgttcggcttgta

SEQ ID NO: 172381 - DNA, 22 bp, Artificial sequence
  SiRNA target sequence
gcctggcatgttcggcttgtat

SEQ ID NO: 172382 - DNA, 22 bp, Artificial sequence
  SiRNA target sequence
cctggcatgttcggcttgtatt

SEQ ID NO: 172383 - DNA, 22 bp, Artificial sequence
  SiRNA target sequence
ctggcatgttcggcttgtattg

SEQ ID NO: 172384 - DNA, 22 bp, Artificial sequence
  SiRNA target sequence
tggcatgttcggcttgtattgc

SEQ ID NO: 172385 - DNA, 22 bp, Artificial sequence
  SiRNA target sequence
ggcatgttcggcttgtattgct

SEQ ID NO: 172386 - DNA, 22 bp, Artificial sequence
  SiRNA target sequence
gcatgttcggcttgtattgctg

SEQ ID NO: 172387 - DNA, 22 bp, Artificial sequence
  SiRNA target sequence
catgttcggcttgtattgctga

SEQ ID NO: 172388 - DNA, 22 bp, Artificial sequence
  SiRNA target sequence
atgttcggcttgtattgctgat

SEQ ID NO: 172389 - DNA, 22 bp, Artificial sequence
  SiRNA target sequence
tgttcggcttgtattgctgatt

SEQ ID NO: 172390 - DNA, 22 bp, Artificial sequence
  SiRNA target sequence
gttcggcttgtattgctgattt

SEQ ID NO: 172391 - DNA, 22 bp, Artificial sequence
  SiRNA target sequence
ttcggcttgtattgctgatttt

SEQ ID NO: 172392 - DNA, 22 bp, Artificial sequence
  SiRNA target sequence
tcggcttgtattgctgattttt

SEQ ID NO: 172393 - DNA, 22 bp, Artificial sequence
  SiRNA target sequence
cggcttgtattgctgatttttc

SEQ ID NO: 172394 - DNA, 22 bp, Artificial sequence
  SiRNA target sequence
ggcttgtattgctgatttttct

SEQ ID NO: 172395 - DNA, 22 bp, Artificial sequence
  SiRNA target sequence
gcttgtattgctgatttttctg

SEQ ID NO: 172396 - DNA, 22 bp, Artificial sequence
  SiRNA target sequence
cttgtattgctgatttttctgt

SEQ ID NO: 172397 - DNA, 22 bp, Artificial sequence
  SiRNA target sequence
ttgtattgctgatttttctgtt

SEQ ID NO: 172398 - DNA, 22 bp, Artificial sequence
  SiRNA target sequence
tgtattgctgatttttctgttc

SEQ ID NO: 172399 - DNA, 22 bp, Artificial sequence
  SiRNA target sequence
gtattgctgatttttctgttcc

SEQ ID NO: 172400 - DNA, 22 bp, Artificial sequence
  SiRNA target sequence
tattgctgatttttctgttcca

SEQ ID NO: 172401 - DNA, 22 bp, Artificial sequence
  SiRNA target sequence
attgctgatttttctgttccaa

SEQ ID NO: 172402 - DNA, 22 bp, Artificial sequence
  SiRNA target sequence
ttgctgatttttctgttccaaa

SEQ ID NO: 172403 - DNA, 22 bp, Artificial sequence
  SiRNA target sequence
tgctgatttttctgttccaaaa

SEQ ID NO: 172404 - DNA, 22 bp, Artificial sequence
  SiRNA target sequence
gctgatttttctgttccaaaaa

SEQ ID NO: 172405 - DNA, 22 bp, Artificial sequence
  SiRNA target sequence
ctgatttttctgttccaaaaat

SEQ ID NO: 172406 - DNA, 22 bp, Artificial sequence
  SiRNA target sequence
tgatttttctgttccaaaaatt

SEQ ID NO: 172407 - DNA, 22 bp, Artificial sequence
  SiRNA target sequence
gatttttctgttccaaaaattc

SEQ ID NO: 172408 - DNA, 22 bp, Artificial sequence
  SiRNA target sequence
atttttctgttccaaaaattcc

SEQ ID NO: 172409 - DNA, 22 bp, Artificial sequence
  SiRNA target sequence
tttttctgttccaaaaattcct

SEQ ID NO: 172410 - DNA, 22 bp, Artificial sequence
  SiRNA target sequence
ttttctgttccaaaaattccta

SEQ ID NO: 172411 - DNA, 22 bp, Artificial sequence
  SiRNA target sequence
tttctgttccaaaaattcctac

SEQ ID NO: 172412 - DNA, 22 bp, Artificial sequence
  SiRNA target sequence
ttctgttccaaaaattcctact

SEQ ID NO: 172413 - DNA, 22 bp, Artificial sequence
  SiRNA target sequence
tctgttccaaaaattcctactt

SEQ ID NO: 172414 - DNA, 22 bp, Artificial sequence
  SiRNA target sequence
ctgttccaaaaattcctactta

SEQ ID NO: 172415 - DNA, 22 bp, Artificial sequence
  SiRNA target sequence
tgttccaaaaattcctacttac

SEQ ID NO: 172416 - DNA, 22 bp, Artificial sequence
  SiRNA target sequence
gttccaaaaattcctacttaca

SEQ ID NO: 172417 - DNA, 22 bp, Artificial sequence
  SiRNA target sequence
ttccaaaaattcctacttacac

SEQ ID NO: 172418 - DNA, 22 bp, Artificial sequence
  SiRNA target sequence
tccaaaaattcctacttacaca

SEQ ID NO: 172419 - DNA, 22 bp, Artificial sequence
  SiRNA target sequence
ccaaaaattcctacttacacag

SEQ ID NO: 172420 - DNA, 22 bp, Artificial sequence
  SiRNA target sequence
caaaaattcctacttacacaga

SEQ ID NO: 172421 - DNA, 22 bp, Artificial sequence
  SiRNA target sequence
aaaaattcctacttacacagaa

SEQ ID NO: 172422 - DNA, 22 bp, Artificial sequence
  SiRNA target sequence
aaaattcctacttacacagaac

SEQ ID NO: 172423 - DNA, 22 bp, Artificial sequence
  SiRNA target sequence
aaattcctacttacacagaact

SEQ ID NO: 172424 - DNA, 22 bp, Artificial sequence
  SiRNA target sequence
aattcctacttacacagaactg

SEQ ID NO: 172425 - DNA, 22 bp, Artificial sequence
  SiRNA target sequence
attcctacttacacagaactga

SEQ ID NO: 172426 - DNA, 22 bp, Artificial sequence
  SiRNA target sequence
ttcctacttacacagaactgaa

SEQ ID NO: 172427 - DNA, 22 bp, Artificial sequence
  SiRNA target sequence
tcctacttacacagaactgaaa

SEQ ID NO: 172428 - DNA, 22 bp, Artificial sequence
  SiRNA target sequence
cctacttacacagaactgaaag

SEQ ID NO: 172429 - DNA, 22 bp, Artificial sequence
  SiRNA target sequence
ctacttacacagaactgaaaga

SEQ ID NO: 172430 - DNA, 22 bp, Artificial sequence
  SiRNA target sequence
tacttacacagaactgaaagat

SEQ ID NO: 172431 - DNA, 22 bp, Artificial sequence
  SiRNA target sequence
acttacacagaactgaaagatg

SEQ ID NO: 172432 - DNA, 22 bp, Artificial sequence
  SiRNA target sequence
cttacacagaactgaaagatgt

SEQ ID NO: 172433 - DNA, 22 bp, Artificial sequence
  SiRNA target sequence
ttacacagaactgaaagatgtc

SEQ ID NO: 172434 - DNA, 22 bp, Artificial sequence
  SiRNA target sequence
tacacagaactgaaagatgtcc

SEQ ID NO: 172435 - DNA, 22 bp, Artificial sequence
  SiRNA target sequence
acacagaactgaaagatgtccc

SEQ ID NO: 172436 - DNA, 22 bp, Artificial sequence
  SiRNA target sequence
cacagaactgaaagatgtccct

SEQ ID NO: 172437 - DNA, 22 bp, Artificial sequence
  SiRNA target sequence
acagaactgaaagatgtccctt

SEQ ID NO: 172438 - DNA, 22 bp, Artificial sequence
  SiRNA target sequence
cagaactgaaagatgtcccttt

SEQ ID NO: 172439 - DNA, 22 bp, Artificial sequence
  SiRNA target sequence
agaactgaaagatgtcccttta

SEQ ID NO: 172440 - DNA, 22 bp, Artificial sequence
  SiRNA target sequence
gaactgaaagatgtccctttaa

SEQ ID NO: 172441 - DNA, 22 bp, Artificial sequence
  SiRNA target sequence
aactgaaagatgtccctttaac

SEQ ID NO: 172442 - DNA, 22 bp, Artificial sequence
  SiRNA target sequence
actgaaagatgtccctttaaca

SEQ ID NO: 172443 - DNA, 22 bp, Artificial sequence
  SiRNA target sequence
ctgaaagatgtccctttaacat

SEQ ID NO: 172444 - DNA, 22 bp, Artificial sequence
  SiRNA target sequence
tgaaagatgtccctttaacatt

SEQ ID NO: 172445 - DNA, 22 bp, Artificial sequence
  SiRNA target sequence
gaaagatgtccctttaacattt

SEQ ID NO: 172446 - DNA, 22 bp, Artificial sequence
  SiRNA target sequence
aaagatgtccctttaacatttt

SEQ ID NO: 172447 - DNA, 22 bp, Artificial sequence
  SiRNA target sequence
aagatgtccctttaacattttt

SEQ ID NO: 172448 - DNA, 22 bp, Artificial sequence
  SiRNA target sequence
agatgtccctttaacattttta

SEQ ID NO: 172449 - DNA, 22 bp, Artificial sequence
  SiRNA target sequence
gatgtccctttaacatttttat

SEQ ID NO: 172450 - DNA, 22 bp, Artificial sequence
  SiRNA target sequence
atgtccctttaacatttttatt

SEQ ID NO: 172451 - DNA, 22 bp, Artificial sequence
  SiRNA target sequence
tgtccctttaacatttttatta

SEQ ID NO: 172452 - DNA, 22 bp, Artificial sequence
  SiRNA target sequence
gtccctttaacatttttattat

SEQ ID NO: 172453 - DNA, 22 bp, Artificial sequence
  SiRNA target sequence
tccctttaacatttttattatc

SEQ ID NO: 172454 - DNA, 22 bp, Artificial sequence
  SiRNA target sequence
ccctttaacatttttattatca

SEQ ID NO: 172455 - DNA, 22 bp, Artificial sequence
  SiRNA target sequence
cctttaacatttttattatcac

SEQ ID NO: 172456 - DNA, 22 bp, Artificial sequence
  SiRNA target sequence
ctttaacatttttattatcacc

SEQ ID NO: 172457 - DNA, 22 bp, Artificial sequence
  SiRNA target sequence
tttaacatttttattatcacca

SEQ ID NO: 172458 - DNA, 22 bp, Artificial sequence
  SiRNA target sequence
ttaacatttttattatcaccac

SEQ ID NO: 172459 - DNA, 22 bp, Artificial sequence
  SiRNA target sequence
taacatttttattatcaccaca

SEQ ID NO: 172460 - DNA, 22 bp, Artificial sequence
  SiRNA target sequence
aacatttttattatcaccacat

SEQ ID NO: 172461 - DNA, 22 bp, Artificial sequence
  SiRNA target sequence
acatttttattatcaccacatt

SEQ ID NO: 172462 - DNA, 22 bp, Artificial sequence
  SiRNA target sequence
catttttattatcaccacattc

SEQ ID NO: 172463 - DNA, 22 bp, Artificial sequence
  SiRNA target sequence
atttttattatcaccacattcg

SEQ ID NO: 172464 - DNA, 22 bp, Artificial sequence
  SiRNA target sequence
tttttattatcaccacattcga

SEQ ID NO: 172465 - DNA, 22 bp, Artificial sequence
  SiRNA target sequence
ttttattatcaccacattcgaa

SEQ ID NO: 172466 - DNA, 22 bp, Artificial sequence
  SiRNA target sequence
tttattatcaccacattcgaaa

SEQ ID NO: 172467 - DNA, 22 bp, Artificial sequence
  SiRNA target sequence
ttattatcaccacattcgaaaa

SEQ ID NO: 172468 - DNA, 22 bp, Artificial sequence
  SiRNA target sequence
tattatcaccacattcgaaaat

SEQ ID NO: 172469 - DNA, 22 bp, Artificial sequence
  SiRNA target sequence
attatcaccacattcgaaaatg

SEQ ID NO: 172470 - DNA, 22 bp, Artificial sequence
  SiRNA target sequence
ttatcaccacattcgaaaatga

SEQ ID NO: 172471 - DNA, 22 bp, Artificial sequence
  SiRNA target sequence
tatcaccacattcgaaaatgaa

SEQ ID NO: 172472 - DNA, 22 bp, Artificial sequence
  SiRNA target sequence
atcaccacattcgaaaatgaat

SEQ ID NO: 172473 - DNA, 22 bp, Artificial sequence
  SiRNA target sequence
tcaccacattcgaaaatgaata

SEQ ID NO: 172474 - DNA, 22 bp, Artificial sequence
  SiRNA target sequence
caccacattcgaaaatgaatat

SEQ ID NO: 172475 - DNA, 22 bp, Artificial sequence
  SiRNA target sequence
accacattcgaaaatgaatatg

SEQ ID NO: 172476 - DNA, 22 bp, Artificial sequence
  SiRNA target sequence
ccacattcgaaaatgaatatgt

SEQ ID NO: 172477 - DNA, 22 bp, Artificial sequence
  SiRNA target sequence
cacattcgaaaatgaatatgta

SEQ ID NO: 172478 - DNA, 22 bp, Artificial sequence
  SiRNA target sequence
acattcgaaaatgaatatgtat

SEQ ID NO: 172479 - DNA, 22 bp, Artificial sequence
  SiRNA target sequence
cattcgaaaatgaatatgtatg

SEQ ID NO: 172480 - DNA, 22 bp, Artificial sequence
  SiRNA target sequence
attcgaaaatgaatatgtatgc

SEQ ID NO: 172481 - DNA, 22 bp, Artificial sequence
  SiRNA target sequence
ttcgaaaatgaatatgtatgca

SEQ ID NO: 172482 - DNA, 22 bp, Artificial sequence
  SiRNA target sequence
tcgaaaatgaatatgtatgcac

SEQ ID NO: 172483 - DNA, 22 bp, Artificial sequence
  SiRNA target sequence
cgaaaatgaatatgtatgcaca

SEQ ID NO: 172484 - DNA, 22 bp, Artificial sequence
  SiRNA target sequence
gaaaatgaatatgtatgcacac

SEQ ID NO: 172485 - DNA, 22 bp, Artificial sequence
  SiRNA target sequence
aaaatgaatatgtatgcacact

SEQ ID NO: 172486 - DNA, 22 bp, Artificial sequence
  SiRNA target sequence
aaatgaatatgtatgcacacta

SEQ ID NO: 172487 - DNA, 22 bp, Artificial sequence
  SiRNA target sequence
aatgaatatgtatgcacactat

SEQ ID NO: 172488 - DNA, 22 bp, Artificial sequence
  SiRNA target sequence
atgaatatgtatgcacactata

SEQ ID NO: 172489 - DNA, 22 bp, Artificial sequence
  SiRNA target sequence
tgaatatgtatgcacactataa

SEQ ID NO: 172490 - DNA, 22 bp, Artificial sequence
  SiRNA target sequence
gaatatgtatgcacactataac

SEQ ID NO: 172491 - DNA, 22 bp, Artificial sequence
  SiRNA target sequence
aatatgtatgcacactataaca

SEQ ID NO: 172492 - DNA, 22 bp, Artificial sequence
  SiRNA target sequence
atatgtatgcacactataacaa

SEQ ID NO: 172493 - DNA, 22 bp, Artificial sequence
  SiRNA target sequence
tatgtatgcacactataacaat

SEQ ID NO: 172494 - DNA, 22 bp, Artificial sequence
  SiRNA target sequence
atgtatgcacactataacaatc

SEQ ID NO: 172495 - DNA, 22 bp, Artificial sequence
  SiRNA target sequence
tgtatgcacactataacaatca

SEQ ID NO: 172496 - DNA, 22 bp, Artificial sequence
  SiRNA target sequence
gtatgcacactataacaatcat

SEQ ID NO: 172497 - DNA, 22 bp, Artificial sequence
  SiRNA target sequence
tatgcacactataacaatcata

SEQ ID NO: 172498 - DNA, 22 bp, Artificial sequence
  SiRNA target sequence
atgcacactataacaatcatat

SEQ ID NO: 172499 - DNA, 22 bp, Artificial sequence
  SiRNA target sequence
tgcacactataacaatcatata

SEQ ID NO: 172500 - DNA, 22 bp, Artificial sequence
  SiRNA target sequence
gcacactataacaatcatataa

SEQ ID NO: 172501 - DNA, 22 bp, Artificial sequence
  SiRNA target sequence
cacactataacaatcatataat

SEQ ID NO: 172502 - DNA, 22 bp, Artificial sequence
  SiRNA target sequence
acactataacaatcatataatg

SEQ ID NO: 172503 - DNA, 22 bp, Artificial sequence
  SiRNA target sequence
cactataacaatcatataatgt

SEQ ID NO: 172504 - DNA, 22 bp, Artificial sequence
  SiRNA target sequence
actataacaatcatataatgtc

SEQ ID NO: 172505 - DNA, 22 bp, Artificial sequence
  SiRNA target sequence
ctataacaatcatataatgtcc

SEQ ID NO: 172506 - DNA, 22 bp, Artificial sequence
  SiRNA target sequence
tataacaatcatataatgtcct

SEQ ID NO: 172507 - DNA, 22 bp, Artificial sequence
  SiRNA target sequence
ataacaatcatataatgtcctt

SEQ ID NO: 172508 - DNA, 22 bp, Artificial sequence
  SiRNA target sequence
taacaatcatataatgtccttt

SEQ ID NO: 172509 - DNA, 22 bp, Artificial sequence
  SiRNA target sequence
aacaatcatataatgtccttta

SEQ ID NO: 172510 - DNA, 22 bp, Artificial sequence
  SiRNA target sequence
acaatcatataatgtcctttag

SEQ ID NO: 172511 - DNA, 22 bp, Artificial sequence
  SiRNA target sequence
caatcatataatgtcctttagt

SEQ ID NO: 172512 - DNA, 22 bp, Artificial sequence
  SiRNA target sequence
aatcatataatgtcctttagtg

SEQ ID NO: 172513 - DNA, 22 bp, Artificial sequence
  SiRNA target sequence
atcatataatgtcctttagtga

SEQ ID NO: 172514 - DNA, 22 bp, Artificial sequence
  SiRNA target sequence
tcatataatgtcctttagtgat

SEQ ID NO: 172515 - DNA, 22 bp, Artificial sequence
  SiRNA target sequence
catataatgtcctttagtgatt

SEQ ID NO: 172516 - DNA, 22 bp, Artificial sequence
  SiRNA target sequence
atataatgtcctttagtgattt

SEQ ID NO: 172517 - DNA, 22 bp, Artificial sequence
  SiRNA target sequence
tataatgtcctttagtgatttt

SEQ ID NO: 172518 - DNA, 22 bp, Artificial sequence
  SiRNA target sequence
ataatgtcctttagtgattttg

SEQ ID NO: 172519 - DNA, 22 bp, Artificial sequence
  SiRNA target sequence
taatgtcctttagtgattttga

SEQ ID NO: 172520 - DNA, 22 bp, Artificial sequence
  SiRNA target sequence
aatgtcctttagtgattttgaa

SEQ ID NO: 172521 - DNA, 22 bp, Artificial sequence
  SiRNA target sequence
atgtcctttagtgattttgaat

SEQ ID NO: 172522 - DNA, 22 bp, Artificial sequence
  SiRNA target sequence
tgtcctttagtgattttgaata

SEQ ID NO: 172523 - DNA, 22 bp, Artificial sequence
  SiRNA target sequence
gtcctttagtgattttgaatat

SEQ ID NO: 172524 - DNA, 22 bp, Artificial sequence
  SiRNA target sequence
tcctttagtgattttgaatatc

SEQ ID NO: 172525 - DNA, 22 bp, Artificial sequence
  SiRNA target sequence
cctttagtgattttgaatatca

SEQ ID NO: 172526 - DNA, 22 bp, Artificial sequence
  SiRNA target sequence
ctttagtgattttgaatatcac

SEQ ID NO: 172527 - DNA, 22 bp, Artificial sequence
  SiRNA target sequence
tttagtgattttgaatatcact

SEQ ID NO: 172528 - DNA, 22 bp, Artificial sequence
  SiRNA target sequence
ttagtgattttgaatatcactt

SEQ ID NO: 172529 - DNA, 22 bp, Artificial sequence
  SiRNA target sequence
tagtgattttgaatatcactta

SEQ ID NO: 172530 - DNA, 22 bp, Artificial sequence
  SiRNA target sequence
agtgattttgaatatcacttaa

SEQ ID NO: 172531 - DNA, 22 bp, Artificial sequence
  SiRNA target sequence
gtgattttgaatatcacttaat

SEQ ID NO: 172532 - DNA, 22 bp, Artificial sequence
  SiRNA target sequence
tgattttgaatatcacttaatt

SEQ ID NO: 172533 - DNA, 22 bp, Artificial sequence
  SiRNA target sequence
gattttgaatatcacttaattt

SEQ ID NO: 172534 - DNA, 22 bp, Artificial sequence
  SiRNA target sequence
attttgaatatcacttaatttc

SEQ ID NO: 172535 - DNA, 22 bp, Artificial sequence
  SiRNA target sequence
ttttgaatatcacttaatttca

SEQ ID NO: 172536 - DNA, 22 bp, Artificial sequence
  SiRNA target sequence
tttgaatatcacttaatttcat

SEQ ID NO: 172537 - DNA, 22 bp, Artificial sequence
  SiRNA target sequence
ttgaatatcacttaatttcatt

SEQ ID NO: 172538 - DNA, 22 bp, Artificial sequence
  SiRNA target sequence
tgaatatcacttaatttcattt

SEQ ID NO: 172539 - DNA, 22 bp, Artificial sequence
  SiRNA target sequence
gaatatcacttaatttcattta

SEQ ID NO: 172540 - DNA, 22 bp, Artificial sequence
  SiRNA target sequence
aatatcacttaatttcatttat

SEQ ID NO: 172541 - DNA, 22 bp, Artificial sequence
  SiRNA target sequence
atatcacttaatttcatttata

SEQ ID NO: 172542 - DNA, 22 bp, Artificial sequence
  SiRNA target sequence
tatcacttaatttcatttataa

SEQ ID NO: 172543 - DNA, 22 bp, Artificial sequence
  SiRNA target sequence
atcacttaatttcatttataaa

SEQ ID NO: 172544 - DNA, 22 bp, Artificial sequence
  SiRNA target sequence
tcacttaatttcatttataaaa

SEQ ID NO: 172545 - DNA, 22 bp, Artificial sequence
  SiRNA target sequence
cacttaatttcatttataaaac

SEQ ID NO: 172546 - DNA, 22 bp, Artificial sequence
  SiRNA target sequence
acttaatttcatttataaaact

SEQ ID NO: 172547 - DNA, 22 bp, Artificial sequence
  SiRNA target sequence
cttaatttcatttataaaacta

SEQ ID NO: 172548 - DNA, 22 bp, Artificial sequence
  SiRNA target sequence
ttaatttcatttataaaactaa

SEQ ID NO: 172549 - DNA, 22 bp, Artificial sequence
  SiRNA target sequence
taatttcatttataaaactaaa

SEQ ID NO: 172550 - DNA, 22 bp, Artificial sequence
  SiRNA target sequence
aatttcatttataaaactaaaa

SEQ ID NO: 172551 - DNA, 22 bp, Artificial sequence
  SiRNA target sequence
atttcatttataaaactaaaat

SEQ ID NO: 172552 - DNA, 22 bp, Artificial sequence
  SiRNA target sequence
tttcatttataaaactaaaatt

SEQ ID NO: 172553 - DNA, 22 bp, Artificial sequence
  SiRNA target sequence
ttcatttataaaactaaaattt

SEQ ID NO: 172554 - DNA, 22 bp, Artificial sequence
  SiRNA target sequence
tcatttataaaactaaaattta

SEQ ID NO: 172555 - DNA, 22 bp, Artificial sequence
  SiRNA target sequence
catttataaaactaaaatttaa

SEQ ID NO: 172556 - DNA, 22 bp, Artificial sequence
  SiRNA target sequence
atttataaaactaaaatttaat

SEQ ID NO: 172557 - DNA, 22 bp, Artificial sequence
  SiRNA target sequence
tttataaaactaaaatttaatg

SEQ ID NO: 172558 - DNA, 22 bp, Artificial sequence
  SiRNA target sequence
ttataaaactaaaatttaatgt

SEQ ID NO: 172559 - DNA, 22 bp, Artificial sequence
  SiRNA target sequence
tataaaactaaaatttaatgta

SEQ ID NO: 172560 - DNA, 22 bp, Artificial sequence
  SiRNA target sequence
ataaaactaaaatttaatgtaa

SEQ ID NO: 172561 - DNA, 22 bp, Artificial sequence
  SiRNA target sequence
taaaactaaaatttaatgtaat

SEQ ID NO: 172562 - DNA, 22 bp, Artificial sequence
  SiRNA target sequence
aaaactaaaatttaatgtaata

SEQ ID NO: 172563 - DNA, 22 bp, Artificial sequence
  SiRNA target sequence
aaactaaaatttaatgtaataa

SEQ ID NO: 172564 - DNA, 22 bp, Artificial sequence
  SiRNA target sequence
aactaaaatttaatgtaataaa

SEQ ID NO: 172565 - DNA, 22 bp, Artificial sequence
  SiRNA target sequence
actaaaatttaatgtaataaaa

SEQ ID NO: 172566 - DNA, 22 bp, Artificial sequence
  SiRNA target sequence
ctaaaatttaatgtaataaaag

SEQ ID NO: 172567 - DNA, 22 bp, Artificial sequence
  SiRNA target sequence
taaaatttaatgtaataaaagt

SEQ ID NO: 172568 - DNA, 22 bp, Artificial sequence
  SiRNA target sequence
aaaatttaatgtaataaaagta

SEQ ID NO: 172569 - DNA, 22 bp, Artificial sequence
  SiRNA target sequence
aaatttaatgtaataaaagtat

SEQ ID NO: 172570 - DNA, 22 bp, Artificial sequence
  SiRNA target sequence
aatttaatgtaataaaagtata

SEQ ID NO: 172571 - DNA, 22 bp, Artificial sequence
  SiRNA target sequence
atttaatgtaataaaagtatat

SEQ ID NO: 172572 - DNA, 22 bp, Artificial sequence
  SiRNA target sequence
tttaatgtaataaaagtatatg

SEQ ID NO: 172573 - DNA, 22 bp, Artificial sequence
  SiRNA target sequence
ttaatgtaataaaagtatatga

SEQ ID NO: 172574 - DNA, 22 bp, Artificial sequence
  SiRNA target sequence
taatgtaataaaagtatatgat

SEQ ID NO: 172575 - DNA, 22 bp, Artificial sequence
  SiRNA target sequence
aatgtaataaaagtatatgata

SEQ ID NO: 172576 - DNA, 22 bp, Artificial sequence
  SiRNA target sequence
atgtaataaaagtatatgatac

SEQ ID NO: 172577 - DNA, 22 bp, Artificial sequence
  SiRNA target sequence
tgtaataaaagtatatgataca

SEQ ID NO: 172578 - DNA, 22 bp, Artificial sequence
  SiRNA target sequence
gtaataaaagtatatgatacat

SEQ ID NO: 172579 - DNA, 22 bp, Artificial sequence
  SiRNA target sequence
taataaaagtatatgatacatc

SEQ ID NO: 172580 - DNA, 22 bp, Artificial sequence
  SiRNA target sequence
aataaaagtatatgatacatct

SEQ ID NO: 172581 - DNA, 22 bp, Artificial sequence
  SiRNA target sequence
ataaaagtatatgatacatctt

SEQ ID NO: 172582 - DNA, 22 bp, Artificial sequence
  SiRNA target sequence
taaaagtatatgatacatctta

SEQ ID NO: 172583 - DNA, 22 bp, Artificial sequence
  SiRNA target sequence
aaaagtatatgatacatcttat

SEQ ID NO: 172584 - DNA, 22 bp, Artificial sequence
  SiRNA target sequence
aaagtatatgatacatcttatg

SEQ ID NO: 172585 - DNA, 22 bp, Artificial sequence
  SiRNA target sequence
aagtatatgatacatcttatgt

SEQ ID NO: 172586 - DNA, 22 bp, Artificial sequence
  SiRNA target sequence
agtatatgatacatcttatgtc

SEQ ID NO: 172587 - DNA, 22 bp, Artificial sequence
  SiRNA target sequence
gtatatgatacatcttatgtca

SEQ ID NO: 172588 - DNA, 22 bp, Artificial sequence
  SiRNA target sequence
tatatgatacatcttatgtcaa

SEQ ID NO: 172589 - DNA, 22 bp, Artificial sequence
  SiRNA target sequence
atatgatacatcttatgtcaaa

SEQ ID NO: 172590 - DNA, 22 bp, Artificial sequence
  SiRNA target sequence
tatgatacatcttatgtcaaaa

SEQ ID NO: 172591 - DNA, 22 bp, Artificial sequence
  SiRNA target sequence
atgatacatcttatgtcaaaaa

SEQ ID NO: 172592 - DNA, 22 bp, Artificial sequence
  SiRNA target sequence
tgatacatcttatgtcaaaaat

SEQ ID NO: 172593 - DNA, 22 bp, Artificial sequence
  SiRNA target sequence
gatacatcttatgtcaaaaata

SEQ ID NO: 172594 - DNA, 22 bp, Artificial sequence
  SiRNA target sequence
atacatcttatgtcaaaaatat

SEQ ID NO: 172595 - DNA, 22 bp, Artificial sequence
  SiRNA target sequence
tacatcttatgtcaaaaatatt

SEQ ID NO: 172596 - DNA, 22 bp, Artificial sequence
  SiRNA target sequence
acatcttatgtcaaaaatattc

SEQ ID NO: 172597 - DNA, 22 bp, Artificial sequence
  SiRNA target sequence
catcttatgtcaaaaatattct

SEQ ID NO: 172598 - DNA, 22 bp, Artificial sequence
  SiRNA target sequence
atcttatgtcaaaaatattctg

SEQ ID NO: 172599 - DNA, 22 bp, Artificial sequence
  SiRNA target sequence
tcttatgtcaaaaatattctgt

SEQ ID NO: 172600 - DNA, 22 bp, Artificial sequence
  SiRNA target sequence
cttatgtcaaaaatattctgta

SEQ ID NO: 172601 - DNA, 22 bp, Artificial sequence
  SiRNA target sequence
ttatgtcaaaaatattctgtat

SEQ ID NO: 172602 - DNA, 22 bp, Artificial sequence
  SiRNA target sequence
tatgtcaaaaatattctgtatg

SEQ ID NO: 172603 - DNA, 22 bp, Artificial sequence
  SiRNA target sequence
atgtcaaaaatattctgtatga

SEQ ID NO: 172604 - DNA, 22 bp, Artificial sequence
  SiRNA target sequence
tgtcaaaaatattctgtatgat

SEQ ID NO: 172605 - DNA, 22 bp, Artificial sequence
  SiRNA target sequence
gtcaaaaatattctgtatgata

SEQ ID NO: 172606 - DNA, 22 bp, Artificial sequence
  SiRNA target sequence
tcaaaaatattctgtatgatag

SEQ ID NO: 172607 - DNA, 22 bp, Artificial sequence
  SiRNA target sequence
caaaaatattctgtatgatagt

SEQ ID NO: 172608 - DNA, 22 bp, Artificial sequence
  SiRNA target sequence
aaaaatattctgtatgatagtg

SEQ ID NO: 172609 - DNA, 22 bp, Artificial sequence
  SiRNA target sequence
aaaatattctgtatgatagtgt

SEQ ID NO: 172610 - DNA, 22 bp, Artificial sequence
  SiRNA target sequence
aaatattctgtatgatagtgtt

SEQ ID NO: 172611 - DNA, 22 bp, Artificial sequence
  SiRNA target sequence
aatattctgtatgatagtgttt

SEQ ID NO: 172612 - DNA, 22 bp, Artificial sequence
  SiRNA target sequence
atattctgtatgatagtgttta

SEQ ID NO: 172613 - DNA, 22 bp, Artificial sequence
  SiRNA target sequence
tattctgtatgatagtgtttat

SEQ ID NO: 172614 - DNA, 22 bp, Artificial sequence
  SiRNA target sequence
attctgtatgatagtgtttatg

SEQ ID NO: 172615 - DNA, 22 bp, Artificial sequence
  SiRNA target sequence
ttctgtatgatagtgtttatga

SEQ ID NO: 172616 - DNA, 22 bp, Artificial sequence
  SiRNA target sequence
tctgtatgatagtgtttatgag

SEQ ID NO: 172617 - DNA, 22 bp, Artificial sequence
  SiRNA target sequence
ctgtatgatagtgtttatgagg

SEQ ID NO: 172618 - DNA, 22 bp, Artificial sequence
  SiRNA target sequence
tgtatgatagtgtttatgagga

SEQ ID NO: 172619 - DNA, 22 bp, Artificial sequence
  SiRNA target sequence
gtatgatagtgtttatgaggaa

SEQ ID NO: 172620 - DNA, 22 bp, Artificial sequence
  SiRNA target sequence
tatgatagtgtttatgaggaaa

SEQ ID NO: 172621 - DNA, 22 bp, Artificial sequence
  SiRNA target sequence
atgatagtgtttatgaggaaag

SEQ ID NO: 172622 - DNA, 22 bp, Artificial sequence
  SiRNA target sequence
tgatagtgtttatgaggaaagc

SEQ ID NO: 172623 - DNA, 22 bp, Artificial sequence
  SiRNA target sequence
gatagtgtttatgaggaaagca

SEQ ID NO: 172624 - DNA, 22 bp, Artificial sequence
  SiRNA target sequence
atagtgtttatgaggaaagcac

SEQ ID NO: 172625 - DNA, 22 bp, Artificial sequence
  SiRNA target sequence
tagtgtttatgaggaaagcacg

SEQ ID NO: 172626 - DNA, 22 bp, Artificial sequence
  SiRNA target sequence
agtgtttatgaggaaagcacga

SEQ ID NO: 172627 - DNA, 22 bp, Artificial sequence
  SiRNA target sequence
gtgtttatgaggaaagcacgag

SEQ ID NO: 172628 - DNA, 22 bp, Artificial sequence
  SiRNA target sequence
tgtttatgaggaaagcacgaga

SEQ ID NO: 172629 - DNA, 22 bp, Artificial sequence
  SiRNA target sequence
gtttatgaggaaagcacgagag

SEQ ID NO: 172630 - DNA, 22 bp, Artificial sequence
  SiRNA target sequence
tttatgaggaaagcacgagaga

SEQ ID NO: 172631 - DNA, 22 bp, Artificial sequence
  SiRNA target sequence
ttatgaggaaagcacgagagac

SEQ ID NO: 172632 - DNA, 22 bp, Artificial sequence
  SiRNA target sequence
tatgaggaaagcacgagagaca

SEQ ID NO: 172633 - DNA, 22 bp, Artificial sequence
  SiRNA target sequence
atgaggaaagcacgagagacaa

SEQ ID NO: 172634 - DNA, 22 bp, Artificial sequence
  SiRNA target sequence
tgaggaaagcacgagagacaaa

SEQ ID NO: 172635 - DNA, 22 bp, Artificial sequence
  SiRNA target sequence
gaggaaagcacgagagacaaaa

SEQ ID NO: 172636 - DNA, 22 bp, Artificial sequence
  SiRNA target sequence
aggaaagcacgagagacaaaat

SEQ ID NO: 172637 - DNA, 22 bp, Artificial sequence
  SiRNA target sequence
ggaaagcacgagagacaaaata

SEQ ID NO: 172638 - DNA, 22 bp, Artificial sequence
  SiRNA target sequence
gaaagcacgagagacaaaataa

SEQ ID NO: 172639 - DNA, 22 bp, Artificial sequence
  SiRNA target sequence
aaagcacgagagacaaaataat

SEQ ID NO: 172640 - DNA, 22 bp, Artificial sequence
  SiRNA target sequence
aagcacgagagacaaaataata

SEQ ID NO: 172641 - DNA, 22 bp, Artificial sequence
  SiRNA target sequence
agcacgagagacaaaataataa

SEQ ID NO: 172642 - DNA, 22 bp, Artificial sequence
  SiRNA target sequence
gcacgagagacaaaataataat

SEQ ID NO: 172643 - DNA, 22 bp, Artificial sequence
  SiRNA target sequence
cacgagagacaaaataataata

SEQ ID NO: 172644 - DNA, 22 bp, Artificial sequence
  SiRNA target sequence
acgagagacaaaataataataa

SEQ ID NO: 172645 - DNA, 22 bp, Artificial sequence
  SiRNA target sequence
cgagagacaaaataataataag

SEQ ID NO: 172646 - DNA, 22 bp, Artificial sequence
  SiRNA target sequence
gagagacaaaataataataagt

SEQ ID NO: 172647 - DNA, 22 bp, Artificial sequence
  SiRNA target sequence
agagacaaaataataataagtg

SEQ ID NO: 172648 - DNA, 22 bp, Artificial sequence
  SiRNA target sequence
gagacaaaataataataagtga

SEQ ID NO: 172649 - DNA, 22 bp, Artificial sequence
  SiRNA target sequence
agacaaaataataataagtgac

SEQ ID NO: 172650 - DNA, 22 bp, Artificial sequence
  SiRNA target sequence
gacaaaataataataagtgact

SEQ ID NO: 172651 - DNA, 22 bp, Artificial sequence
  SiRNA target sequence
acaaaataataataagtgactg

SEQ ID NO: 172652 - DNA, 22 bp, Artificial sequence
  SiRNA target sequence
caaaataataataagtgactgt

SEQ ID NO: 172653 - DNA, 22 bp, Artificial sequence
  SiRNA target sequence
aaaataataataagtgactgtc

SEQ ID NO: 172654 - DNA, 22 bp, Artificial sequence
  SiRNA target sequence
aaataataataagtgactgtcc

SEQ ID NO: 172655 - DNA, 22 bp, Artificial sequence
  SiRNA target sequence
aataataataagtgactgtcct

SEQ ID NO: 172656 - DNA, 22 bp, Artificial sequence
  SiRNA target sequence
ataataataagtgactgtcctg

SEQ ID NO: 172657 - DNA, 22 bp, Artificial sequence
  SiRNA target sequence
taataataagtgactgtcctgg

SEQ ID NO: 172658 - DNA, 22 bp, Artificial sequence
  SiRNA target sequence
aataataagtgactgtcctggg

SEQ ID NO: 172659 - DNA, 22 bp, Artificial sequence
  SiRNA target sequence
ataataagtgactgtcctggga

SEQ ID NO: 172660 - DNA, 22 bp, Artificial sequence
  SiRNA target sequence
taataagtgactgtcctgggac

SEQ ID NO: 172661 - DNA, 22 bp, Artificial sequence
  SiRNA target sequence
aataagtgactgtcctgggact

SEQ ID NO: 172662 - DNA, 22 bp, Artificial sequence
  SiRNA target sequence
ataagtgactgtcctgggactg

SEQ ID NO: 172663 - DNA, 22 bp, Artificial sequence
  SiRNA target sequence
taagtgactgtcctgggactgt

SEQ ID NO: 172664 - DNA, 22 bp, Artificial sequence
  SiRNA target sequence
aagtgactgtcctgggactgtt

SEQ ID NO: 172665 - DNA, 22 bp, Artificial sequence
  SiRNA target sequence
agtgactgtcctgggactgttt

SEQ ID NO: 172666 - DNA, 22 bp, Artificial sequence
  SiRNA target sequence
gtgactgtcctgggactgtttc

SEQ ID NO: 172667 - DNA, 22 bp, Artificial sequence
  SiRNA target sequence
tgactgtcctgggactgtttca

SEQ ID NO: 172668 - DNA, 22 bp, Artificial sequence
  SiRNA target sequence
gactgtcctgggactgtttcat

SEQ ID NO: 172669 - DNA, 22 bp, Artificial sequence
  SiRNA target sequence
actgtcctgggactgtttcata

SEQ ID NO: 172670 - DNA, 22 bp, Artificial sequence
  SiRNA target sequence
ctgtcctgggactgtttcatat

SEQ ID NO: 172671 - DNA, 22 bp, Artificial sequence
  SiRNA target sequence
tgtcctgggactgtttcatata

SEQ ID NO: 172672 - DNA, 22 bp, Artificial sequence
  SiRNA target sequence
gtcctgggactgtttcatatat

SEQ ID NO: 172673 - DNA, 22 bp, Artificial sequence
  SiRNA target sequence
tcctgggactgtttcatatatt

SEQ ID NO: 172674 - DNA, 22 bp, Artificial sequence
  SiRNA target sequence
cctgggactgtttcatatattg

SEQ ID NO: 172675 - DNA, 22 bp, Artificial sequence
  SiRNA target sequence
ctgggactgtttcatatattga

SEQ ID NO: 172676 - DNA, 22 bp, Artificial sequence
  SiRNA target sequence
tgggactgtttcatatattgaa

SEQ ID NO: 172677 - DNA, 22 bp, Artificial sequence
  SiRNA target sequence
gggactgtttcatatattgaaa

SEQ ID NO: 172678 - DNA, 22 bp, Artificial sequence
  SiRNA target sequence
ggactgtttcatatattgaaag

SEQ ID NO: 172679 - DNA, 22 bp, Artificial sequence
  SiRNA target sequence
gactgtttcatatattgaaagg

SEQ ID NO: 172680 - DNA, 22 bp, Artificial sequence
  SiRNA target sequence
actgtttcatatattgaaaggc

SEQ ID NO: 172681 - DNA, 22 bp, Artificial sequence
  SiRNA target sequence
ctgtttcatatattgaaaggca

SEQ ID NO: 172682 - DNA, 22 bp, Artificial sequence
  SiRNA target sequence
tgtttcatatattgaaaggcaa

SEQ ID NO: 172683 - DNA, 22 bp, Artificial sequence
  SiRNA target sequence
gtttcatatattgaaaggcaag

SEQ ID NO: 172684 - DNA, 22 bp, Artificial sequence
  SiRNA target sequence
tttcatatattgaaaggcaagc

SEQ ID NO: 172685 - DNA, 22 bp, Artificial sequence
  SiRNA target sequence
ttcatatattgaaaggcaagca

SEQ ID NO: 172686 - DNA, 22 bp, Artificial sequence
  SiRNA target sequence
tcatatattgaaaggcaagcac

SEQ ID NO: 172687 - DNA, 22 bp, Artificial sequence
  SiRNA target sequence
catatattgaaaggcaagcaca

SEQ ID NO: 172688 - DNA, 22 bp, Artificial sequence
  SiRNA target sequence
atatattgaaaggcaagcacac

SEQ ID NO: 172689 - DNA, 22 bp, Artificial sequence
  SiRNA target sequence
tatattgaaaggcaagcacacc

SEQ ID NO: 172690 - DNA, 22 bp, Artificial sequence
  SiRNA target sequence
atattgaaaggcaagcacacca

SEQ ID NO: 172691 - DNA, 22 bp, Artificial sequence
  SiRNA target sequence
tattgaaaggcaagcacaccat

SEQ ID NO: 172692 - DNA, 22 bp, Artificial sequence
  SiRNA target sequence
attgaaaggcaagcacaccatt

SEQ ID NO: 172693 - DNA, 22 bp, Artificial sequence
  SiRNA target sequence
ttgaaaggcaagcacaccattt

SEQ ID NO: 172694 - DNA, 22 bp, Artificial sequence
  SiRNA target sequence
tgaaaggcaagcacaccattta

SEQ ID NO: 172695 - DNA, 22 bp, Artificial sequence
  SiRNA target sequence
gaaaggcaagcacaccatttaa

SEQ ID NO: 172696 - DNA, 22 bp, Artificial sequence
  SiRNA target sequence
aaaggcaagcacaccatttaat

SEQ ID NO: 172697 - DNA, 22 bp, Artificial sequence
  SiRNA target sequence
aaggcaagcacaccatttaatt

SEQ ID NO: 172698 - DNA, 22 bp, Artificial sequence
  SiRNA target sequence
aggcaagcacaccatttaattg

SEQ ID NO: 172699 - DNA, 22 bp, Artificial sequence
  SiRNA target sequence
ggcaagcacaccatttaattga

SEQ ID NO: 172700 - DNA, 22 bp, Artificial sequence
  SiRNA target sequence
gcaagcacaccatttaattgaa

SEQ ID NO: 172701 - DNA, 22 bp, Artificial sequence
  SiRNA target sequence
caagcacaccatttaattgaat

SEQ ID NO: 172702 - DNA, 22 bp, Artificial sequence
  SiRNA target sequence
aagcacaccatttaattgaata

SEQ ID NO: 172703 - DNA, 22 bp, Artificial sequence
  SiRNA target sequence
agcacaccatttaattgaatat

SEQ ID NO: 172704 - DNA, 22 bp, Artificial sequence
  SiRNA target sequence
gcacaccatttaattgaatatt

SEQ ID NO: 172705 - DNA, 22 bp, Artificial sequence
  SiRNA target sequence
cacaccatttaattgaatattt

SEQ ID NO: 172706 - DNA, 22 bp, Artificial sequence
  SiRNA target sequence
acaccatttaattgaatattta

SEQ ID NO: 172707 - DNA, 22 bp, Artificial sequence
  SiRNA target sequence
caccatttaattgaatatttat

SEQ ID NO: 172708 - DNA, 22 bp, Artificial sequence
  SiRNA target sequence
accatttaattgaatatttatc

SEQ ID NO: 172709 - DNA, 22 bp, Artificial sequence
  SiRNA target sequence
ccatttaattgaatatttatct

SEQ ID NO: 172710 - DNA, 22 bp, Artificial sequence
  SiRNA target sequence
catttaattgaatatttatctg

SEQ ID NO: 172711 - DNA, 22 bp, Artificial sequence
  SiRNA target sequence
atttaattgaatatttatctgt

SEQ ID NO: 172712 - DNA, 22 bp, Artificial sequence
  SiRNA target sequence
tttaattgaatatttatctgtt

SEQ ID NO: 172713 - DNA, 22 bp, Artificial sequence
  SiRNA target sequence
ttaattgaatatttatctgtta

SEQ ID NO: 172714 - DNA, 22 bp, Artificial sequence
  SiRNA target sequence
taattgaatatttatctgttac

SEQ ID NO: 172715 - DNA, 22 bp, Artificial sequence
  SiRNA target sequence
aattgaatatttatctgttact

SEQ ID NO: 172716 - DNA, 22 bp, Artificial sequence
  SiRNA target sequence
attgaatatttatctgttactt

SEQ ID NO: 172717 - DNA, 22 bp, Artificial sequence
  SiRNA target sequence
ttgaatatttatctgttacttc

SEQ ID NO: 172718 - DNA, 22 bp, Artificial sequence
  SiRNA target sequence
tgaatatttatctgttacttct

SEQ ID NO: 172719 - DNA, 22 bp, Artificial sequence
  SiRNA target sequence
gaatatttatctgttacttcta

SEQ ID NO: 172720 - DNA, 22 bp, Artificial sequence
  SiRNA target sequence
aatatttatctgttacttctac

SEQ ID NO: 172721 - DNA, 22 bp, Artificial sequence
  SiRNA target sequence
atatttatctgttacttctaca

SEQ ID NO: 172722 - DNA, 22 bp, Artificial sequence
  SiRNA target sequence
tatttatctgttacttctacac

SEQ ID NO: 172723 - DNA, 22 bp, Artificial sequence
  SiRNA target sequence
atttatctgttacttctacaca

SEQ ID NO: 172724 - DNA, 22 bp, Artificial sequence
  SiRNA target sequence
tttatctgttacttctacacaa

SEQ ID NO: 172725 - DNA, 22 bp, Artificial sequence
  SiRNA target sequence
ttatctgttacttctacacaac

SEQ ID NO: 172726 - DNA, 22 bp, Artificial sequence
  SiRNA target sequence
tatctgttacttctacacaaca

SEQ ID NO: 172727 - DNA, 22 bp, Artificial sequence
  SiRNA target sequence
atctgttacttctacacaacaa

SEQ ID NO: 172728 - DNA, 22 bp, Artificial sequence
  SiRNA target sequence
tctgttacttctacacaacaac

SEQ ID NO: 172729 - DNA, 22 bp, Artificial sequence
  SiRNA target sequence
ctgttacttctacacaacaaca

SEQ ID NO: 172730 - DNA, 22 bp, Artificial sequence
  SiRNA target sequence
tgttacttctacacaacaacaa

SEQ ID NO: 172731 - DNA, 22 bp, Artificial sequence
  SiRNA target sequence
gttacttctacacaacaacaag

SEQ ID NO: 172732 - DNA, 22 bp, Artificial sequence
  SiRNA target sequence
ttacttctacacaacaacaagc

SEQ ID NO: 172733 - DNA, 22 bp, Artificial sequence
  SiRNA target sequence
tacttctacacaacaacaagcc

SEQ ID NO: 172734 - DNA, 22 bp, Artificial sequence
  SiRNA target sequence
acttctacacaacaacaagcca

SEQ ID NO: 172735 - DNA, 22 bp, Artificial sequence
  SiRNA target sequence
cttctacacaacaacaagccat

SEQ ID NO: 172736 - DNA, 22 bp, Artificial sequence
  SiRNA target sequence
ttctacacaacaacaagccata

SEQ ID NO: 172737 - DNA, 22 bp, Artificial sequence
  SiRNA target sequence
tctacacaacaacaagccataa

SEQ ID NO: 172738 - DNA, 22 bp, Artificial sequence
  SiRNA target sequence
ctacacaacaacaagccataaa

SEQ ID NO: 172739 - DNA, 22 bp, Artificial sequence
  SiRNA target sequence
tacacaacaacaagccataaag

SEQ ID NO: 172740 - DNA, 22 bp, Artificial sequence
  SiRNA target sequence
acacaacaacaagccataaagc

SEQ ID NO: 172741 - DNA, 22 bp, Artificial sequence
  SiRNA target sequence
cacaacaacaagccataaagct

SEQ ID NO: 172742 - DNA, 22 bp, Artificial sequence
  SiRNA target sequence
acaacaacaagccataaagcta

SEQ ID NO: 172743 - DNA, 22 bp, Artificial sequence
  SiRNA target sequence
caacaacaagccataaagctac

SEQ ID NO: 172744 - DNA, 22 bp, Artificial sequence
  SiRNA target sequence
aacaacaagccataaagctact

SEQ ID NO: 172745 - DNA, 22 bp, Artificial sequence
  SiRNA target sequence
acaacaagccataaagctactt

SEQ ID NO: 172746 - DNA, 22 bp, Artificial sequence
  SiRNA target sequence
caacaagccataaagctacttg

SEQ ID NO: 172747 - DNA, 22 bp, Artificial sequence
  SiRNA target sequence
aacaagccataaagctacttgc

SEQ ID NO: 172748 - DNA, 22 bp, Artificial sequence
  SiRNA target sequence
acaagccataaagctacttgct

SEQ ID NO: 172749 - DNA, 22 bp, Artificial sequence
  SiRNA target sequence
caagccataaagctacttgctc

SEQ ID NO: 172750 - DNA, 22 bp, Artificial sequence
  SiRNA target sequence
aagccataaagctacttgctca

SEQ ID NO: 172751 - DNA, 22 bp, Artificial sequence
  SiRNA target sequence
agccataaagctacttgctcag

SEQ ID NO: 172752 - DNA, 22 bp, Artificial sequence
  SiRNA target sequence
gccataaagctacttgctcagg

SEQ ID NO: 172753 - DNA, 22 bp, Artificial sequence
  SiRNA target sequence
ccataaagctacttgctcaggg

SEQ ID NO: 172754 - DNA, 22 bp, Artificial sequence
  SiRNA target sequence
cataaagctacttgctcagggg

SEQ ID NO: 172755 - DNA, 22 bp, Artificial sequence
  SiRNA target sequence
ataaagctacttgctcaggggc

SEQ ID NO: 172756 - DNA, 22 bp, Artificial sequence
  SiRNA target sequence
taaagctacttgctcaggggcg

SEQ ID NO: 172757 - DNA, 22 bp, Artificial sequence
  SiRNA target sequence
aaagctacttgctcaggggcga

SEQ ID NO: 172758 - DNA, 22 bp, Artificial sequence
  SiRNA target sequence
aagctacttgctcaggggcgaa

SEQ ID NO: 172759 - DNA, 22 bp, Artificial sequence
  SiRNA target sequence
agctacttgctcaggggcgaag

SEQ ID NO: 172760 - DNA, 22 bp, Artificial sequence
  SiRNA target sequence
gctacttgctcaggggcgaagt

SEQ ID NO: 172761 - DNA, 22 bp, Artificial sequence
  SiRNA target sequence
ctacttgctcaggggcgaagta

SEQ ID NO: 172762 - DNA, 22 bp, Artificial sequence
  SiRNA target sequence
tacttgctcaggggcgaagtat

SEQ ID NO: 172763 - DNA, 22 bp, Artificial sequence
  SiRNA target sequence
acttgctcaggggcgaagtata

SEQ ID NO: 172764 - DNA, 22 bp, Artificial sequence
  SiRNA target sequence
cttgctcaggggcgaagtataa

SEQ ID NO: 172765 - DNA, 22 bp, Artificial sequence
  SiRNA target sequence
ttgctcaggggcgaagtataag

SEQ ID NO: 172766 - DNA, 22 bp, Artificial sequence
  SiRNA target sequence
tgctcaggggcgaagtataagt

SEQ ID NO: 172767 - DNA, 22 bp, Artificial sequence
  SiRNA target sequence
gctcaggggcgaagtataagtg

SEQ ID NO: 172768 - DNA, 22 bp, Artificial sequence
  SiRNA target sequence
ctcaggggcgaagtataagtgt

SEQ ID NO: 172769 - DNA, 22 bp, Artificial sequence
  SiRNA target sequence
tcaggggcgaagtataagtgtc

SEQ ID NO: 172770 - DNA, 22 bp, Artificial sequence
  SiRNA target sequence
caggggcgaagtataagtgtca

SEQ ID NO: 172771 - DNA, 22 bp, Artificial sequence
  SiRNA target sequence
aggggcgaagtataagtgtcat

SEQ ID NO: 172772 - DNA, 22 bp, Artificial sequence
  SiRNA target sequence
ggggcgaagtataagtgtcata

SEQ ID NO: 172773 - DNA, 22 bp, Artificial sequence
  SiRNA target sequence
gggcgaagtataagtgtcatac

SEQ ID NO: 172774 - DNA, 22 bp, Artificial sequence
  SiRNA target sequence
ggcgaagtataagtgtcataca

SEQ ID NO: 172775 - DNA, 22 bp, Artificial sequence
  SiRNA target sequence
gcgaagtataagtgtcatacag

SEQ ID NO: 172776 - DNA, 22 bp, Artificial sequence
  SiRNA target sequence
cgaagtataagtgtcatacagt

SEQ ID NO: 172777 - DNA, 22 bp, Artificial sequence
  SiRNA target sequence
gaagtataagtgtcatacagtg

SEQ ID NO: 172778 - DNA, 22 bp, Artificial sequence
  SiRNA target sequence
aagtataagtgtcatacagtgc

SEQ ID NO: 172779 - DNA, 22 bp, Artificial sequence
  SiRNA target sequence
agtataagtgtcatacagtgct

SEQ ID NO: 172780 - DNA, 22 bp, Artificial sequence
  SiRNA target sequence
gtataagtgtcatacagtgcta

SEQ ID NO: 172781 - DNA, 22 bp, Artificial sequence
  SiRNA target sequence
tataagtgtcatacagtgctat

SEQ ID NO: 172782 - DNA, 22 bp, Artificial sequence
  SiRNA target sequence
ataagtgtcatacagtgctatg

SEQ ID NO: 172783 - DNA, 22 bp, Artificial sequence
  SiRNA target sequence
taagtgtcatacagtgctatga

SEQ ID NO: 172784 - DNA, 22 bp, Artificial sequence
  SiRNA target sequence
aagtgtcatacagtgctatgat

SEQ ID NO: 172785 - DNA, 22 bp, Artificial sequence
  SiRNA target sequence
agtgtcatacagtgctatgata

SEQ ID NO: 172786 - DNA, 22 bp, Artificial sequence
  SiRNA target sequence
gtgtcatacagtgctatgataa

SEQ ID NO: 172787 - DNA, 22 bp, Artificial sequence
  SiRNA target sequence
tgtcatacagtgctatgataaa

SEQ ID NO: 172788 - DNA, 22 bp, Artificial sequence
  SiRNA target sequence
gtcatacagtgctatgataaat

SEQ ID NO: 172789 - DNA, 22 bp, Artificial sequence
  SiRNA target sequence
tcatacagtgctatgataaatt

SEQ ID NO: 172790 - DNA, 22 bp, Artificial sequence
  SiRNA target sequence
catacagtgctatgataaattt

SEQ ID NO: 172791 - DNA, 22 bp, Artificial sequence
  SiRNA target sequence
atacagtgctatgataaatttt

SEQ ID NO: 172792 - DNA, 22 bp, Artificial sequence
  SiRNA target sequence
tacagtgctatgataaattttt

SEQ ID NO: 172793 - DNA, 22 bp, Artificial sequence
  SiRNA target sequence
acagtgctatgataaattttta

SEQ ID NO: 172794 - DNA, 22 bp, Artificial sequence
  SiRNA target sequence
cagtgctatgataaatttttag

SEQ ID NO: 172795 - DNA, 22 bp, Artificial sequence
  SiRNA target sequence
agtgctatgataaatttttaga

SEQ ID NO: 172796 - DNA, 22 bp, Artificial sequence
  SiRNA target sequence
gtgctatgataaatttttagag

SEQ ID NO: 172797 - DNA, 22 bp, Artificial sequence
  SiRNA target sequence
tgctatgataaatttttagaga

SEQ ID NO: 172798 - DNA, 22 bp, Artificial sequence
  SiRNA target sequence
gctatgataaatttttagagaa

SEQ ID NO: 172799 - DNA, 22 bp, Artificial sequence
  SiRNA target sequence
ctatgataaatttttagagaat

SEQ ID NO: 172800 - DNA, 22 bp, Artificial sequence
  SiRNA target sequence
tatgataaatttttagagaata

SEQ ID NO: 172801 - DNA, 22 bp, Artificial sequence
  SiRNA target sequence
atgataaatttttagagaatag

SEQ ID NO: 172802 - DNA, 22 bp, Artificial sequence
  SiRNA target sequence
tgataaatttttagagaatagc

SEQ ID NO: 172803 - DNA, 22 bp, Artificial sequence
  SiRNA target sequence
gataaatttttagagaatagcg

SEQ ID NO: 172804 - DNA, 22 bp, Artificial sequence
  SiRNA target sequence
ataaatttttagagaatagcga

SEQ ID NO: 172805 - DNA, 22 bp, Artificial sequence
  SiRNA target sequence
taaatttttagagaatagcgat

SEQ ID NO: 172806 - DNA, 22 bp, Artificial sequence
  SiRNA target sequence
aaatttttagagaatagcgatg

SEQ ID NO: 172807 - DNA, 22 bp, Artificial sequence
  SiRNA target sequence
aatttttagagaatagcgatga

SEQ ID NO: 172808 - DNA, 22 bp, Artificial sequence
  SiRNA target sequence
atttttagagaatagcgatgat

SEQ ID NO: 172809 - DNA, 22 bp, Artificial sequence
  SiRNA target sequence
tttttagagaatagcgatgatg

SEQ ID NO: 172810 - DNA, 22 bp, Artificial sequence
  SiRNA target sequence
ttttagagaatagcgatgatgt

SEQ ID NO: 172811 - DNA, 22 bp, Artificial sequence
  SiRNA target sequence
tttagagaatagcgatgatgtt

SEQ ID NO: 172812 - DNA, 22 bp, Artificial sequence
  SiRNA target sequence
ttagagaatagcgatgatgttt

SEQ ID NO: 172813 - DNA, 22 bp, Artificial sequence
  SiRNA target sequence
tagagaatagcgatgatgtttt

SEQ ID NO: 172814 - DNA, 22 bp, Artificial sequence
  SiRNA target sequence
agagaatagcgatgatgtttta

SEQ ID NO: 172815 - DNA, 22 bp, Artificial sequence
  SiRNA target sequence
gagaatagcgatgatgttttaa

SEQ ID NO: 172816 - DNA, 22 bp, Artificial sequence
  SiRNA target sequence
agaatagcgatgatgttttaac

SEQ ID NO: 172817 - DNA, 22 bp, Artificial sequence
  SiRNA target sequence
gaatagcgatgatgttttaact

SEQ ID NO: 172818 - DNA, 22 bp, Artificial sequence
  SiRNA target sequence
aatagcgatgatgttttaacta

SEQ ID NO: 172819 - DNA, 22 bp, Artificial sequence
  SiRNA target sequence
atagcgatgatgttttaactac

SEQ ID NO: 172820 - DNA, 22 bp, Artificial sequence
  SiRNA target sequence
tagcgatgatgttttaactacc

SEQ ID NO: 172821 - DNA, 22 bp, Artificial sequence
  SiRNA target sequence
agcgatgatgttttaactacct

SEQ ID NO: 172822 - DNA, 22 bp, Artificial sequence
  SiRNA target sequence
gcgatgatgttttaactaccta

SEQ ID NO: 172823 - DNA, 22 bp, Artificial sequence
  SiRNA target sequence
cgatgatgttttaactacctat

SEQ ID NO: 172824 - DNA, 22 bp, Artificial sequence
  SiRNA target sequence
gatgatgttttaactacctatg

SEQ ID NO: 172825 - DNA, 22 bp, Artificial sequence
  SiRNA target sequence
atgatgttttaactacctatga

SEQ ID NO: 172826 - DNA, 22 bp, Artificial sequence
  SiRNA target sequence
tgatgttttaactacctatgat

SEQ ID NO: 172827 - DNA, 22 bp, Artificial sequence
  SiRNA target sequence
gatgttttaactacctatgatt

SEQ ID NO: 172828 - DNA, 22 bp, Artificial sequence
  SiRNA target sequence
atgttttaactacctatgattt

SEQ ID NO: 172829 - DNA, 22 bp, Artificial sequence
  SiRNA target sequence
tgttttaactacctatgatttt

SEQ ID NO: 172830 - DNA, 22 bp, Artificial sequence
  SiRNA target sequence
gttttaactacctatgattttt

SEQ ID NO: 172831 - DNA, 22 bp, Artificial sequence
  SiRNA target sequence
ttttaactacctatgattttta

SEQ ID NO: 172832 - DNA, 22 bp, Artificial sequence
  SiRNA target sequence
tttaactacctatgatttttat

SEQ ID NO: 172833 - DNA, 22 bp, Artificial sequence
  SiRNA target sequence
ttaactacctatgatttttata

SEQ ID NO: 172834 - DNA, 22 bp, Artificial sequence
  SiRNA target sequence
taactacctatgatttttataa

SEQ ID NO: 172835 - DNA, 22 bp, Artificial sequence
  SiRNA target sequence
aactacctatgatttttataaa

SEQ ID NO: 172836 - DNA, 22 bp, Artificial sequence
  SiRNA target sequence
actacctatgatttttataaaa

SEQ ID NO: 172837 - DNA, 22 bp, Artificial sequence
  SiRNA target sequence
ctacctatgatttttataaaat

SEQ ID NO: 172838 - DNA, 22 bp, Artificial sequence
  SiRNA target sequence
tacctatgatttttataaaatg

SEQ ID NO: 172839 - DNA, 22 bp, Artificial sequence
  SiRNA target sequence
acctatgatttttataaaatga

SEQ ID NO: 172840 - DNA, 22 bp, Artificial sequence
  SiRNA target sequence
cctatgatttttataaaatgat

SEQ ID NO: 172841 - DNA, 22 bp, Artificial sequence
  SiRNA target sequence
ctatgatttttataaaatgatt

SEQ ID NO: 172842 - DNA, 22 bp, Artificial sequence
  SiRNA target sequence
tatgatttttataaaatgattt

SEQ ID NO: 172843 - DNA, 22 bp, Artificial sequence
  SiRNA target sequence
atgatttttataaaatgatttt

SEQ ID NO: 172844 - DNA, 22 bp, Artificial sequence
  SiRNA target sequence
tgatttttataaaatgattttg

SEQ ID NO: 172845 - DNA, 22 bp, Artificial sequence
  SiRNA target sequence
gatttttataaaatgattttgg

SEQ ID NO: 172846 - DNA, 22 bp, Artificial sequence
  SiRNA target sequence
atttttataaaatgattttgga

SEQ ID NO: 172847 - DNA, 22 bp, Artificial sequence
  SiRNA target sequence
tttttataaaatgattttggat

SEQ ID NO: 172848 - DNA, 22 bp, Artificial sequence
  SiRNA target sequence
ttttataaaatgattttggatc

SEQ ID NO: 172849 - DNA, 22 bp, Artificial sequence
  SiRNA target sequence
tttataaaatgattttggatct

SEQ ID NO: 172850 - DNA, 22 bp, Artificial sequence
  SiRNA target sequence
ttataaaatgattttggatcta

SEQ ID NO: 172851 - DNA, 22 bp, Artificial sequence
  SiRNA target sequence
tataaaatgattttggatctag

SEQ ID NO: 172852 - DNA, 22 bp, Artificial sequence
  SiRNA target sequence
ataaaatgattttggatctagg

SEQ ID NO: 172853 - DNA, 22 bp, Artificial sequence
  SiRNA target sequence
taaaatgattttggatctagga

SEQ ID NO: 172854 - DNA, 22 bp, Artificial sequence
  SiRNA target sequence
aaaatgattttggatctaggat

SEQ ID NO: 172855 - DNA, 22 bp, Artificial sequence
  SiRNA target sequence
aaatgattttggatctaggatt

SEQ ID NO: 172856 - DNA, 22 bp, Artificial sequence
  SiRNA target sequence
aatgattttggatctaggattt

SEQ ID NO: 172857 - DNA, 22 bp, Artificial sequence
  SiRNA target sequence
atgattttggatctaggatttt

SEQ ID NO: 172858 - DNA, 22 bp, Artificial sequence
  SiRNA target sequence
tgattttggatctaggattttt

SEQ ID NO: 172859 - DNA, 22 bp, Artificial sequence
  SiRNA target sequence
gattttggatctaggattttta

SEQ ID NO: 172860 - DNA, 22 bp, Artificial sequence
  SiRNA target sequence
attttggatctaggatttttac

SEQ ID NO: 172861 - DNA, 22 bp, Artificial sequence
  SiRNA target sequence
ttttggatctaggatttttaca

SEQ ID NO: 172862 - DNA, 22 bp, Artificial sequence
  SiRNA target sequence
tttggatctaggatttttacag

SEQ ID NO: 172863 - DNA, 22 bp, Artificial sequence
  SiRNA target sequence
ttggatctaggatttttacagc

SEQ ID NO: 172864 - DNA, 22 bp, Artificial sequence
  SiRNA target sequence
tggatctaggatttttacagca

SEQ ID NO: 172865 - DNA, 22 bp, Artificial sequence
  SiRNA target sequence
ggatctaggatttttacagcat

SEQ ID NO: 172866 - DNA, 22 bp, Artificial sequence
  SiRNA target sequence
gatctaggatttttacagcata

SEQ ID NO: 172867 - DNA, 22 bp, Artificial sequence
  SiRNA target sequence
atctaggatttttacagcataa

SEQ ID NO: 172868 - DNA, 22 bp, Artificial sequence
  SiRNA target sequence
tctaggatttttacagcataat

SEQ ID NO: 172869 - DNA, 22 bp, Artificial sequence
  SiRNA target sequence
ctaggatttttacagcataatt

SEQ ID NO: 172870 - DNA, 22 bp, Artificial sequence
  SiRNA target sequence
taggatttttacagcataattt

SEQ ID NO: 172871 - DNA, 22 bp, Artificial sequence
  SiRNA target sequence
aggatttttacagcataatttt

SEQ ID NO: 172872 - DNA, 22 bp, Artificial sequence
  SiRNA target sequence
ggatttttacagcataatttta

SEQ ID NO: 172873 - DNA, 22 bp, Artificial sequence
  SiRNA target sequence
gatttttacagcataattttat

SEQ ID NO: 172874 - DNA, 22 bp, Artificial sequence
  SiRNA target sequence
atttttacagcataattttatt

SEQ ID NO: 172875 - DNA, 22 bp, Artificial sequence
  SiRNA target sequence
tttttacagcataattttatta

SEQ ID NO: 172876 - DNA, 22 bp, Artificial sequence
  SiRNA target sequence
ttttacagcataattttattaa

SEQ ID NO: 172877 - DNA, 22 bp, Artificial sequence
  SiRNA target sequence
tttacagcataattttattaaa

SEQ ID NO: 172878 - DNA, 22 bp, Artificial sequence
  SiRNA target sequence
ttacagcataattttattaaag

SEQ ID NO: 172879 - DNA, 22 bp, Artificial sequence
  SiRNA target sequence
tacagcataattttattaaagg

SEQ ID NO: 172880 - DNA, 22 bp, Artificial sequence
  SiRNA target sequence
acagcataattttattaaagga

SEQ ID NO: 172881 - DNA, 22 bp, Artificial sequence
  SiRNA target sequence
cagcataattttattaaaggaa

SEQ ID NO: 172882 - DNA, 22 bp, Artificial sequence
  SiRNA target sequence
agcataattttattaaaggaac

SEQ ID NO: 172883 - DNA, 22 bp, Artificial sequence
  SiRNA target sequence
gcataattttattaaaggaacc

SEQ ID NO: 172884 - DNA, 22 bp, Artificial sequence
  SiRNA target sequence
cataattttattaaaggaacct

SEQ ID NO: 172885 - DNA, 22 bp, Artificial sequence
  SiRNA target sequence
ataattttattaaaggaacctg

SEQ ID NO: 172886 - DNA, 22 bp, Artificial sequence
  SiRNA target sequence
taattttattaaaggaacctgt

SEQ ID NO: 172887 - DNA, 22 bp, Artificial sequence
  SiRNA target sequence
aattttattaaaggaacctgtg

SEQ ID NO: 172888 - DNA, 22 bp, Artificial sequence
  SiRNA target sequence
attttattaaaggaacctgtga

SEQ ID NO: 172889 - DNA, 22 bp, Artificial sequence
  SiRNA target sequence
ttttattaaaggaacctgtgag

SEQ ID NO: 172890 - DNA, 22 bp, Artificial sequence
  SiRNA target sequence
tttattaaaggaacctgtgaga

SEQ ID NO: 172891 - DNA, 22 bp, Artificial sequence
  SiRNA target sequence
ttattaaaggaacctgtgagaa

SEQ ID NO: 172892 - DNA, 22 bp, Artificial sequence
  SiRNA target sequence
tattaaaggaacctgtgagaaa

SEQ ID NO: 172893 - DNA, 22 bp, Artificial sequence
  SiRNA target sequence
attaaaggaacctgtgagaaat

SEQ ID NO: 172894 - DNA, 22 bp, Artificial sequence
  SiRNA target sequence
ttaaaggaacctgtgagaaatg

SEQ ID NO: 172895 - DNA, 22 bp, Artificial sequence
  SiRNA target sequence
taaaggaacctgtgagaaatgg

SEQ ID NO: 172896 - DNA, 22 bp, Artificial sequence
  SiRNA target sequence
aaaggaacctgtgagaaatggg

SEQ ID NO: 172897 - DNA, 22 bp, Artificial sequence
  SiRNA target sequence
aaggaacctgtgagaaatggga

SEQ ID NO: 172898 - DNA, 22 bp, Artificial sequence
  SiRNA target sequence
aggaacctgtgagaaatgggag

SEQ ID NO: 172899 - DNA, 22 bp, Artificial sequence
  SiRNA target sequence
ggaacctgtgagaaatgggaga

SEQ ID NO: 172900 - DNA, 22 bp, Artificial sequence
  SiRNA target sequence
gaacctgtgagaaatgggagaa

SEQ ID NO: 172901 - DNA, 22 bp, Artificial sequence
  SiRNA target sequence
aacctgtgagaaatgggagaag

SEQ ID NO: 172902 - DNA, 22 bp, Artificial sequence
  SiRNA target sequence
acctgtgagaaatgggagaagt

SEQ ID NO: 172903 - DNA, 22 bp, Artificial sequence
  SiRNA target sequence
cctgtgagaaatgggagaagtg

SEQ ID NO: 172904 - DNA, 22 bp, Artificial sequence
  SiRNA target sequence
ctgtgagaaatgggagaagtgt

SEQ ID NO: 172905 - DNA, 22 bp, Artificial sequence
  SiRNA target sequence
tgtgagaaatgggagaagtgta

SEQ ID NO: 172906 - DNA, 22 bp, Artificial sequence
  SiRNA target sequence
gtgagaaatgggagaagtgtac

SEQ ID NO: 172907 - DNA, 22 bp, Artificial sequence
  SiRNA target sequence
tgagaaatgggagaagtgtact

SEQ ID NO: 172908 - DNA, 22 bp, Artificial sequence
  SiRNA target sequence
gagaaatgggagaagtgtacta

SEQ ID NO: 172909 - DNA, 22 bp, Artificial sequence
  SiRNA target sequence
agaaatgggagaagtgtactat

SEQ ID NO: 172910 - DNA, 22 bp, Artificial sequence
  SiRNA target sequence
gaaatgggagaagtgtactatt

SEQ ID NO: 172911 - DNA, 22 bp, Artificial sequence
  SiRNA target sequence
aaatgggagaagtgtactattg

SEQ ID NO: 172912 - DNA, 22 bp, Artificial sequence
  SiRNA target sequence
aatgggagaagtgtactattgg

SEQ ID NO: 172913 - DNA, 22 bp, Artificial sequence
  SiRNA target sequence
atgggagaagtgtactattgga

SEQ ID NO: 172914 - DNA, 22 bp, Artificial sequence
  SiRNA target sequence
tgggagaagtgtactattggat

SEQ ID NO: 172915 - DNA, 22 bp, Artificial sequence
  SiRNA target sequence
gggagaagtgtactattggata

SEQ ID NO: 172916 - DNA, 22 bp, Artificial sequence
  SiRNA target sequence
ggagaagtgtactattggatat

SEQ ID NO: 172917 - DNA, 22 bp, Artificial sequence
  SiRNA target sequence
gagaagtgtactattggatatc

SEQ ID NO: 172918 - DNA, 22 bp, Artificial sequence
  SiRNA target sequence
agaagtgtactattggatatca

SEQ ID NO: 172919 - DNA, 22 bp, Artificial sequence
  SiRNA target sequence
gaagtgtactattggatatcat

SEQ ID NO: 172920 - DNA, 22 bp, Artificial sequence
  SiRNA target sequence
aagtgtactattggatatcatt

SEQ ID NO: 172921 - DNA, 22 bp, Artificial sequence
  SiRNA target sequence
agtgtactattggatatcatta

SEQ ID NO: 172922 - DNA, 22 bp, Artificial sequence
  SiRNA target sequence
gtgtactattggatatcattat

SEQ ID NO: 172923 - DNA, 22 bp, Artificial sequence
  SiRNA target sequence
tgtactattggatatcattatg

SEQ ID NO: 172924 - DNA, 22 bp, Artificial sequence
  SiRNA target sequence
gtactattggatatcattatgg

SEQ ID NO: 172925 - DNA, 22 bp, Artificial sequence
  SiRNA target sequence
tactattggatatcattatgga

SEQ ID NO: 172926 - DNA, 22 bp, Artificial sequence
  SiRNA target sequence
actattggatatcattatggat

SEQ ID NO: 172927 - DNA, 22 bp, Artificial sequence
  SiRNA target sequence
ctattggatatcattatggata

SEQ ID NO: 172928 - DNA, 22 bp, Artificial sequence
  SiRNA target sequence
tattggatatcattatggatat

SEQ ID NO: 172929 - DNA, 22 bp, Artificial sequence
  SiRNA target sequence
attggatatcattatggatatt

SEQ ID NO: 172930 - DNA, 22 bp, Artificial sequence
  SiRNA target sequence
ttggatatcattatggatattt

SEQ ID NO: 172931 - DNA, 22 bp, Artificial sequence
  SiRNA target sequence
tggatatcattatggatattta

SEQ ID NO: 172932 - DNA, 22 bp, Artificial sequence
  SiRNA target sequence
ggatatcattatggatatttag

SEQ ID NO: 172933 - DNA, 22 bp, Artificial sequence
  SiRNA target sequence
gatatcattatggatatttaga

SEQ ID NO: 172934 - DNA, 22 bp, Artificial sequence
  SiRNA target sequence
atatcattatggatatttagaa

SEQ ID NO: 172935 - DNA, 22 bp, Artificial sequence
  SiRNA target sequence
tatcattatggatatttagaac

SEQ ID NO: 172936 - DNA, 22 bp, Artificial sequence
  SiRNA target sequence
atcattatggatatttagaaca

SEQ ID NO: 172937 - DNA, 22 bp, Artificial sequence
  SiRNA target sequence
tcattatggatatttagaacac

SEQ ID NO: 172938 - DNA, 22 bp, Artificial sequence
  SiRNA target sequence
cattatggatatttagaacaca

SEQ ID NO: 172939 - DNA, 22 bp, Artificial sequence
  SiRNA target sequence
attatggatatttagaacacat

SEQ ID NO: 172940 - DNA, 22 bp, Artificial sequence
  SiRNA target sequence
ttatggatatttagaacacata

SEQ ID NO: 172941 - DNA, 22 bp, Artificial sequence
  SiRNA target sequence
tatggatatttagaacacatat

SEQ ID NO: 172942 - DNA, 22 bp, Artificial sequence
  SiRNA target sequence
atggatatttagaacacatatt

SEQ ID NO: 172943 - DNA, 22 bp, Artificial sequence
  SiRNA target sequence
tggatatttagaacacatatta

SEQ ID NO: 172944 - DNA, 22 bp, Artificial sequence
  SiRNA target sequence
ggatatttagaacacatattaa

SEQ ID NO: 172945 - DNA, 22 bp, Artificial sequence
  SiRNA target sequence
gatatttagaacacatattaaa

SEQ ID NO: 172946 - DNA, 22 bp, Artificial sequence
  SiRNA target sequence
atatttagaacacatattaaat

SEQ ID NO: 172947 - DNA, 22 bp, Artificial sequence
  SiRNA target sequence
tatttagaacacatattaaata

SEQ ID NO: 172948 - DNA, 22 bp, Artificial sequence
  SiRNA target sequence
atttagaacacatattaaataa

SEQ ID NO: 172949 - DNA, 22 bp, Artificial sequence
  SiRNA target sequence
tttagaacacatattaaataag

SEQ ID NO: 172950 - DNA, 22 bp, Artificial sequence
  SiRNA target sequence
ttagaacacatattaaataaga

SEQ ID NO: 172951 - DNA, 22 bp, Artificial sequence
  SiRNA target sequence
tagaacacatattaaataagaa

SEQ ID NO: 172952 - DNA, 22 bp, Artificial sequence
  SiRNA target sequence
agaacacatattaaataagaag

SEQ ID NO: 172953 - DNA, 22 bp, Artificial sequence
  SiRNA target sequence
gaacacatattaaataagaaga

SEQ ID NO: 172954 - DNA, 22 bp, Artificial sequence
  SiRNA target sequence
aacacatattaaataagaagaa

SEQ ID NO: 172955 - DNA, 22 bp, Artificial sequence
  SiRNA target sequence
acacatattaaataagaagaac

SEQ ID NO: 172956 - DNA, 22 bp, Artificial sequence
  SiRNA target sequence
cacatattaaataagaagaaca

SEQ ID NO: 172957 - DNA, 22 bp, Artificial sequence
  SiRNA target sequence
acatattaaataagaagaacaa

SEQ ID NO: 172958 - DNA, 22 bp, Artificial sequence
  SiRNA target sequence
catattaaataagaagaacaat

SEQ ID NO: 172959 - DNA, 22 bp, Artificial sequence
  SiRNA target sequence
atattaaataagaagaacaatt

SEQ ID NO: 172960 - DNA, 22 bp, Artificial sequence
  SiRNA target sequence
tattaaataagaagaacaatta

SEQ ID NO: 172961 - DNA, 22 bp, Artificial sequence
  SiRNA target sequence
attaaataagaagaacaattat

SEQ ID NO: 172962 - DNA, 22 bp, Artificial sequence
  SiRNA target sequence
ttaaataagaagaacaattatt

SEQ ID NO: 172963 - DNA, 22 bp, Artificial sequence
  SiRNA target sequence
taaataagaagaacaattattt

SEQ ID NO: 172964 - DNA, 22 bp, Artificial sequence
  SiRNA target sequence
aaataagaagaacaattattta

SEQ ID NO: 172965 - DNA, 22 bp, Artificial sequence
  SiRNA target sequence
aataagaagaacaattatttaa

SEQ ID NO: 172966 - DNA, 22 bp, Artificial sequence
  SiRNA target sequence
ataagaagaacaattatttaac

SEQ ID NO: 172967 - DNA, 22 bp, Artificial sequence
  SiRNA target sequence
taagaagaacaattatttaaca

SEQ ID NO: 172968 - DNA, 22 bp, Artificial sequence
  SiRNA target sequence
aagaagaacaattatttaacaa

SEQ ID NO: 172969 - DNA, 22 bp, Artificial sequence
  SiRNA target sequence
agaagaacaattatttaacaaa

SEQ ID NO: 172970 - DNA, 22 bp, Artificial sequence
  SiRNA target sequence
gaagaacaattatttaacaaaa

SEQ ID NO: 172971 - DNA, 22 bp, Artificial sequence
  SiRNA target sequence
aagaacaattatttaacaaaaa

SEQ ID NO: 172972 - DNA, 22 bp, Artificial sequence
  SiRNA target sequence
agaacaattatttaacaaaaaa

SEQ ID NO: 172973 - DNA, 22 bp, Artificial sequence
  SiRNA target sequence
gaacaattatttaacaaaaaat

SEQ ID NO: 172974 - DNA, 22 bp, Artificial sequence
  SiRNA target sequence
aacaattatttaacaaaaaatg

SEQ ID NO: 172975 - DNA, 22 bp, Artificial sequence
  SiRNA target sequence
acaattatttaacaaaaaatga

SEQ ID NO: 172976 - DNA, 22 bp, Artificial sequence
  SiRNA target sequence
caattatttaacaaaaaatgat

SEQ ID NO: 172977 - DNA, 22 bp, Artificial sequence
  SiRNA target sequence
aattatttaacaaaaaatgata

SEQ ID NO: 172978 - DNA, 22 bp, Artificial sequence
  SiRNA target sequence
attatttaacaaaaaatgatag

SEQ ID NO: 172979 - DNA, 22 bp, Artificial sequence
  SiRNA target sequence
ttatttaacaaaaaatgatagt

SEQ ID NO: 172980 - DNA, 22 bp, Artificial sequence
  SiRNA target sequence
tatttaacaaaaaatgatagta

SEQ ID NO: 172981 - DNA, 22 bp, Artificial sequence
  SiRNA target sequence
atttaacaaaaaatgatagtat

SEQ ID NO: 172982 - DNA, 22 bp, Artificial sequence
  SiRNA target sequence
tttaacaaaaaatgatagtata

SEQ ID NO: 172983 - DNA, 22 bp, Artificial sequence
  SiRNA target sequence
ttaacaaaaaatgatagtataa

SEQ ID NO: 172984 - DNA, 22 bp, Artificial sequence
  SiRNA target sequence
taacaaaaaatgatagtataaa

SEQ ID NO: 172985 - DNA, 22 bp, Artificial sequence
  SiRNA target sequence
aacaaaaaatgatagtataaaa

SEQ ID NO: 172986 - DNA, 22 bp, Artificial sequence
  SiRNA target sequence
acaaaaaatgatagtataaaaa

SEQ ID NO: 172987 - DNA, 22 bp, Artificial sequence
  SiRNA target sequence
caaaaaatgatagtataaaaat

SEQ ID NO: 172988 - DNA, 22 bp, Artificial sequence
  SiRNA target sequence
aaaaaatgatagtataaaaata

SEQ ID NO: 172989 - DNA, 22 bp, Artificial sequence
  SiRNA target sequence
aaaaatgatagtataaaaatat

SEQ ID NO: 172990 - DNA, 22 bp, Artificial sequence
  SiRNA target sequence
aaaatgatagtataaaaatatt

SEQ ID NO: 172991 - DNA, 22 bp, Artificial sequence
  SiRNA target sequence
aaatgatagtataaaaatattt

SEQ ID NO: 172992 - DNA, 22 bp, Artificial sequence
  SiRNA target sequence
aatgatagtataaaaatattta

SEQ ID NO: 172993 - DNA, 22 bp, Artificial sequence
  SiRNA target sequence
atgatagtataaaaatatttaa

SEQ ID NO: 172994 - DNA, 22 bp, Artificial sequence
  SiRNA target sequence
tgatagtataaaaatatttaac

SEQ ID NO: 172995 - DNA, 22 bp, Artificial sequence
  SiRNA target sequence
gatagtataaaaatatttaaca

SEQ ID NO: 172996 - DNA, 22 bp, Artificial sequence
  SiRNA target sequence
atagtataaaaatatttaacag

SEQ ID NO: 172997 - DNA, 22 bp, Artificial sequence
  SiRNA target sequence
tagtataaaaatatttaacagt

SEQ ID NO: 172998 - DNA, 22 bp, Artificial sequence
  SiRNA target sequence
agtataaaaatatttaacagta

SEQ ID NO: 172999 - DNA, 22 bp, Artificial sequence
  SiRNA target sequence
gtataaaaatatttaacagtaa

SEQ ID NO: 173000 - DNA, 22 bp, Artificial sequence
  SiRNA target sequence
tataaaaatatttaacagtaaa

SEQ ID NO: 173001 - DNA, 22 bp, Artificial sequence
  SiRNA target sequence
ataaaaatatttaacagtaaaa

SEQ ID NO: 173002 - DNA, 22 bp, Artificial sequence
  SiRNA target sequence
taaaaatatttaacagtaaaaa

SEQ ID NO: 173003 - DNA, 22 bp, Artificial sequence
  SiRNA target sequence
aaaaatatttaacagtaaaaat

SEQ ID NO: 173004 - DNA, 22 bp, Artificial sequence
  SiRNA target sequence
aaaatatttaacagtaaaaatg

SEQ ID NO: 173005 - DNA, 22 bp, Artificial sequence
  SiRNA target sequence
aaatatttaacagtaaaaatga

SEQ ID NO: 173006 - DNA, 22 bp, Artificial sequence
  SiRNA target sequence
aatatttaacagtaaaaatgag

SEQ ID NO: 173007 - DNA, 22 bp, Artificial sequence
  SiRNA target sequence
atatttaacagtaaaaatgagg

SEQ ID NO: 173008 - DNA, 22 bp, Artificial sequence
  SiRNA target sequence
tatttaacagtaaaaatgagga

SEQ ID NO: 173009 - DNA, 22 bp, Artificial sequence
  SiRNA target sequence
atttaacagtaaaaatgaggag

SEQ ID NO: 173010 - DNA, 22 bp, Artificial sequence
  SiRNA target sequence
tttaacagtaaaaatgaggagg

SEQ ID NO: 173011 - DNA, 22 bp, Artificial sequence
  SiRNA target sequence
ttaacagtaaaaatgaggaggt

SEQ ID NO: 173012 - DNA, 22 bp, Artificial sequence
  SiRNA target sequence
taacagtaaaaatgaggaggta

SEQ ID NO: 173013 - DNA, 22 bp, Artificial sequence
  SiRNA target sequence
aacagtaaaaatgaggaggtaa

SEQ ID NO: 173014 - DNA, 22 bp, Artificial sequence
  SiRNA target sequence
acagtaaaaatgaggaggtaag

SEQ ID NO: 173015 - DNA, 22 bp, Artificial sequence
  SiRNA target sequence
cagtaaaaatgaggaggtaagg

SEQ ID NO: 173016 - DNA, 22 bp, Artificial sequence
  SiRNA target sequence
agtaaaaatgaggaggtaaggt

SEQ ID NO: 173017 - DNA, 22 bp, Artificial sequence
  SiRNA target sequence
gtaaaaatgaggaggtaaggtt

SEQ ID NO: 173018 - DNA, 22 bp, Artificial sequence
  SiRNA target sequence
taaaaatgaggaggtaaggtta

SEQ ID NO: 173019 - DNA, 22 bp, Artificial sequence
  SiRNA target sequence
aaaaatgaggaggtaaggttaa

SEQ ID NO: 173020 - DNA, 22 bp, Artificial sequence
  SiRNA target sequence
aaaatgaggaggtaaggttaaa

SEQ ID NO: 173021 - DNA, 22 bp, Artificial sequence
  SiRNA target sequence
aaatgaggaggtaaggttaaat

SEQ ID NO: 173022 - DNA, 22 bp, Artificial sequence
  SiRNA target sequence
aatgaggaggtaaggttaaatg

SEQ ID NO: 173023 - DNA, 22 bp, Artificial sequence
  SiRNA target sequence
atgaggaggtaaggttaaatgg

SEQ ID NO: 173024 - DNA, 22 bp, Artificial sequence
  SiRNA target sequence
tgaggaggtaaggttaaatgga

SEQ ID NO: 173025 - DNA, 22 bp, Artificial sequence
  SiRNA target sequence
gaggaggtaaggttaaatggaa

SEQ ID NO: 173026 - DNA, 22 bp, Artificial sequence
  SiRNA target sequence
aggaggtaaggttaaatggaaa

SEQ ID NO: 173027 - DNA, 22 bp, Artificial sequence
  SiRNA target sequence
ggaggtaaggttaaatggaaaa

SEQ ID NO: 173028 - DNA, 22 bp, Artificial sequence
  SiRNA target sequence
gaggtaaggttaaatggaaaaa

SEQ ID NO: 173029 - DNA, 22 bp, Artificial sequence
  SiRNA target sequence
aggtaaggttaaatggaaaaag

SEQ ID NO: 173030 - DNA, 22 bp, Artificial sequence
  SiRNA target sequence
ggtaaggttaaatggaaaaaga

SEQ ID NO: 173031 - DNA, 22 bp, Artificial sequence
  SiRNA target sequence
gtaaggttaaatggaaaaagaa

SEQ ID NO: 173032 - DNA, 22 bp, Artificial sequence
  SiRNA target sequence
taaggttaaatggaaaaagaaa

SEQ ID NO: 173033 - DNA, 22 bp, Artificial sequence
  SiRNA target sequence
aaggttaaatggaaaaagaaaa

SEQ ID NO: 173034 - DNA, 22 bp, Artificial sequence
  SiRNA target sequence
aggttaaatggaaaaagaaaat

SEQ ID NO: 173035 - DNA, 22 bp, Artificial sequence
  SiRNA target sequence
ggttaaatggaaaaagaaaatt

SEQ ID NO: 173036 - DNA, 22 bp, Artificial sequence
  SiRNA target sequence
gttaaatggaaaaagaaaatta

SEQ ID NO: 173037 - DNA, 22 bp, Artificial sequence
  SiRNA target sequence
ttaaatggaaaaagaaaattaa

SEQ ID NO: 173038 - DNA, 22 bp, Artificial sequence
  SiRNA target sequence
taaatggaaaaagaaaattaaa

SEQ ID NO: 173039 - DNA, 22 bp, Artificial sequence
  SiRNA target sequence
aaatggaaaaagaaaattaaat

SEQ ID NO: 173040 - DNA, 22 bp, Artificial sequence
  SiRNA target sequence
aatggaaaaagaaaattaaata

SEQ ID NO: 173041 - DNA, 22 bp, Artificial sequence
  SiRNA target sequence
atggaaaaagaaaattaaatat

SEQ ID NO: 173042 - DNA, 22 bp, Artificial sequence
  SiRNA target sequence
tggaaaaagaaaattaaatatt

SEQ ID NO: 173043 - DNA, 22 bp, Artificial sequence
  SiRNA target sequence
ggaaaaagaaaattaaatatta

SEQ ID NO: 173044 - DNA, 22 bp, Artificial sequence
  SiRNA target sequence
gaaaaagaaaattaaatattaa

SEQ ID NO: 173045 - DNA, 22 bp, Artificial sequence
  SiRNA target sequence
aaaaagaaaattaaatattaac

SEQ ID NO: 173046 - DNA, 22 bp, Artificial sequence
  SiRNA target sequence
aaaagaaaattaaatattaaca

SEQ ID NO: 173047 - DNA, 22 bp, Artificial sequence
  SiRNA target sequence
aaagaaaattaaatattaacac

SEQ ID NO: 173048 - DNA, 22 bp, Artificial sequence
  SiRNA target sequence
aagaaaattaaatattaacaca

SEQ ID NO: 173049 - DNA, 22 bp, Artificial sequence
  SiRNA target sequence
agaaaattaaatattaacacag

SEQ ID NO: 173050 - DNA, 22 bp, Artificial sequence
  SiRNA target sequence
gaaaattaaatattaacacagt

SEQ ID NO: 173051 - DNA, 22 bp, Artificial sequence
  SiRNA target sequence
aaaattaaatattaacacagtt

SEQ ID NO: 173052 - DNA, 22 bp, Artificial sequence
  SiRNA target sequence
aaattaaatattaacacagtta

SEQ ID NO: 173053 - DNA, 22 bp, Artificial sequence
  SiRNA target sequence
aattaaatattaacacagttac

SEQ ID NO: 173054 - DNA, 22 bp, Artificial sequence
  SiRNA target sequence
attaaatattaacacagttaca

SEQ ID NO: 173055 - DNA, 22 bp, Artificial sequence
  SiRNA target sequence
ttaaatattaacacagttacat

SEQ ID NO: 173056 - DNA, 22 bp, Artificial sequence
  SiRNA target sequence
taaatattaacacagttacatt

SEQ ID NO: 173057 - DNA, 22 bp, Artificial sequence
  SiRNA target sequence
aaatattaacacagttacatta

SEQ ID NO: 173058 - DNA, 22 bp, Artificial sequence
  SiRNA target sequence
aatattaacacagttacattaa

SEQ ID NO: 173059 - DNA, 22 bp, Artificial sequence
  SiRNA target sequence
atattaacacagttacattaaa

SEQ ID NO: 173060 - DNA, 22 bp, Artificial sequence
  SiRNA target sequence
tattaacacagttacattaaat

SEQ ID NO: 173061 - DNA, 22 bp, Artificial sequence
  SiRNA target sequence
attaacacagttacattaaata

SEQ ID NO: 173062 - DNA, 22 bp, Artificial sequence
  SiRNA target sequence
ttaacacagttacattaaataa

SEQ ID NO: 173063 - DNA, 22 bp, Artificial sequence
  SiRNA target sequence
taacacagttacattaaataaa

SEQ ID NO: 173064 - DNA, 22 bp, Artificial sequence
  SiRNA target sequence
aacacagttacattaaataaaa

SEQ ID NO: 173065 - DNA, 22 bp, Artificial sequence
  SiRNA target sequence
acacagttacattaaataaaat

SEQ ID NO: 173066 - DNA, 22 bp, Artificial sequence
  SiRNA target sequence
cacagttacattaaataaaatt

SEQ ID NO: 173067 - DNA, 22 bp, Artificial sequence
  SiRNA target sequence
acagttacattaaataaaatta

SEQ ID NO: 173068 - DNA, 22 bp, Artificial sequence
  SiRNA target sequence
cagttacattaaataaaattaa

SEQ ID NO: 173069 - DNA, 22 bp, Artificial sequence
  SiRNA target sequence
agttacattaaataaaattaat

SEQ ID NO: 173070 - DNA, 22 bp, Artificial sequence
  SiRNA target sequence
gttacattaaataaaattaata

SEQ ID NO: 173071 - DNA, 22 bp, Artificial sequence
  SiRNA target sequence
ttacattaaataaaattaatat

SEQ ID NO: 173072 - DNA, 22 bp, Artificial sequence
  SiRNA target sequence
tacattaaataaaattaatata

SEQ ID NO: 173073 - DNA, 22 bp, Artificial sequence
  SiRNA target sequence
acattaaataaaattaatatac

SEQ ID NO: 173074 - DNA, 22 bp, Artificial sequence
  SiRNA target sequence
cattaaataaaattaatatacc

SEQ ID NO: 173075 - DNA, 22 bp, Artificial sequence
  SiRNA target sequence
attaaataaaattaatatacct

SEQ ID NO: 173076 - DNA, 22 bp, Artificial sequence
  SiRNA target sequence
ttaaataaaattaatatacctg

SEQ ID NO: 173077 - DNA, 22 bp, Artificial sequence
  SiRNA target sequence
taaataaaattaatatacctga

SEQ ID NO: 173078 - DNA, 22 bp, Artificial sequence
  SiRNA target sequence
aaataaaattaatatacctgag

SEQ ID NO: 173079 - DNA, 22 bp, Artificial sequence
  SiRNA target sequence
aataaaattaatatacctgaga

SEQ ID NO: 173080 - DNA, 22 bp, Artificial sequence
  SiRNA target sequence
ataaaattaatatacctgagat

SEQ ID NO: 173081 - DNA, 22 bp, Artificial sequence
  SiRNA target sequence
taaaattaatatacctgagata

SEQ ID NO: 173082 - DNA, 22 bp, Artificial sequence
  SiRNA target sequence
aaaattaatatacctgagatag

SEQ ID NO: 173083 - DNA, 22 bp, Artificial sequence
  SiRNA target sequence
aaattaatatacctgagataga

SEQ ID NO: 173084 - DNA, 22 bp, Artificial sequence
  SiRNA target sequence
aattaatatacctgagatagat

SEQ ID NO: 173085 - DNA, 22 bp, Artificial sequence
  SiRNA target sequence
attaatatacctgagatagatt

SEQ ID NO: 173086 - DNA, 22 bp, Artificial sequence
  SiRNA target sequence
ttaatatacctgagatagatta

SEQ ID NO: 173087 - DNA, 22 bp, Artificial sequence
  SiRNA target sequence
taatatacctgagatagattat

SEQ ID NO: 173088 - DNA, 22 bp, Artificial sequence
  SiRNA target sequence
aatatacctgagatagattata

SEQ ID NO: 173089 - DNA, 22 bp, Artificial sequence
  SiRNA target sequence
atatacctgagatagattataa

SEQ ID NO: 173090 - DNA, 22 bp, Artificial sequence
  SiRNA target sequence
tatacctgagatagattataaa

SEQ ID NO: 173091 - DNA, 22 bp, Artificial sequence
  SiRNA target sequence
atacctgagatagattataaat

SEQ ID NO: 173092 - DNA, 22 bp, Artificial sequence
  SiRNA target sequence
tacctgagatagattataaata

SEQ ID NO: 173093 - DNA, 22 bp, Artificial sequence
  SiRNA target sequence
acctgagatagattataaatat

SEQ ID NO: 173094 - DNA, 22 bp, Artificial sequence
  SiRNA target sequence
cctgagatagattataaatata

SEQ ID NO: 173095 - DNA, 22 bp, Artificial sequence
  SiRNA target sequence
ctgagatagattataaatataa

SEQ ID NO: 173096 - DNA, 22 bp, Artificial sequence
  SiRNA target sequence
tgagatagattataaatataaa

SEQ ID NO: 173097 - DNA, 22 bp, Artificial sequence
  SiRNA target sequence
gagatagattataaatataaaa

SEQ ID NO: 173098 - DNA, 22 bp, Artificial sequence
  SiRNA target sequence
agatagattataaatataaaaa

SEQ ID NO: 173099 - DNA, 22 bp, Artificial sequence
  SiRNA target sequence
gatagattataaatataaaaat

SEQ ID NO: 173100 - DNA, 22 bp, Artificial sequence
  SiRNA target sequence
atagattataaatataaaaatg

SEQ ID NO: 173101 - DNA, 22 bp, Artificial sequence
  SiRNA target sequence
tagattataaatataaaaatgg

SEQ ID NO: 173102 - DNA, 22 bp, Artificial sequence
  SiRNA target sequence
agattataaatataaaaatgga

SEQ ID NO: 173103 - DNA, 22 bp, Artificial sequence
  SiRNA target sequence
gattataaatataaaaatggag

SEQ ID NO: 173104 - DNA, 22 bp, Artificial sequence
  SiRNA target sequence
attataaatataaaaatggagt

SEQ ID NO: 173105 - DNA, 22 bp, Artificial sequence
  SiRNA target sequence
ttataaatataaaaatggagtg

SEQ ID NO: 173106 - DNA, 22 bp, Artificial sequence
  SiRNA target sequence
tataaatataaaaatggagtgt

SEQ ID NO: 173107 - DNA, 22 bp, Artificial sequence
  SiRNA target sequence
ataaatataaaaatggagtgtt

SEQ ID NO: 173108 - DNA, 22 bp, Artificial sequence
  SiRNA target sequence
taaatataaaaatggagtgttt

SEQ ID NO: 173109 - DNA, 22 bp, Artificial sequence
  SiRNA target sequence
aaatataaaaatggagtgttta

SEQ ID NO: 173110 - DNA, 22 bp, Artificial sequence
  SiRNA target sequence
aatataaaaatggagtgtttac

SEQ ID NO: 173111 - DNA, 22 bp, Artificial sequence
  SiRNA target sequence
atataaaaatggagtgtttaca

SEQ ID NO: 173112 - DNA, 22 bp, Artificial sequence
  SiRNA target sequence
tataaaaatggagtgtttacat

SEQ ID NO: 173113 - DNA, 22 bp, Artificial sequence
  SiRNA target sequence
ataaaaatggagtgtttacata

SEQ ID NO: 173114 - DNA, 22 bp, Artificial sequence
  SiRNA target sequence
taaaaatggagtgtttacatat

SEQ ID NO: 173115 - DNA, 22 bp, Artificial sequence
  SiRNA target sequence
aaaaatggagtgtttacatata

SEQ ID NO: 173116 - DNA, 22 bp, Artificial sequence
  SiRNA target sequence
aaaatggagtgtttacatatac

SEQ ID NO: 173117 - DNA, 22 bp, Artificial sequence
  SiRNA target sequence
aaatggagtgtttacatataca

SEQ ID NO: 173118 - DNA, 22 bp, Artificial sequence
  SiRNA target sequence
aatggagtgtttacatatacac

SEQ ID NO: 173119 - DNA, 22 bp, Artificial sequence
  SiRNA target sequence
atggagtgtttacatatacaca

SEQ ID NO: 173120 - DNA, 22 bp, Artificial sequence
  SiRNA target sequence
tggagtgtttacatatacacag

SEQ ID NO: 173121 - DNA, 22 bp, Artificial sequence
  SiRNA target sequence
ggagtgtttacatatacacaga

SEQ ID NO: 173122 - DNA, 22 bp, Artificial sequence
  SiRNA target sequence
gagtgtttacatatacacagat

SEQ ID NO: 173123 - DNA, 22 bp, Artificial sequence
  SiRNA target sequence
agtgtttacatatacacagatc

SEQ ID NO: 173124 - DNA, 22 bp, Artificial sequence
  SiRNA target sequence
gtgtttacatatacacagatca

SEQ ID NO: 173125 - DNA, 22 bp, Artificial sequence
  SiRNA target sequence
tgtttacatatacacagatcaa

SEQ ID NO: 173126 - DNA, 22 bp, Artificial sequence
  SiRNA target sequence
gtttacatatacacagatcaaa

SEQ ID NO: 173127 - DNA, 22 bp, Artificial sequence
  SiRNA target sequence
tttacatatacacagatcaaaa

SEQ ID NO: 173128 - DNA, 22 bp, Artificial sequence
  SiRNA target sequence
ttacatatacacagatcaaaaa

SEQ ID NO: 173129 - DNA, 22 bp, Artificial sequence
  SiRNA target sequence
tacatatacacagatcaaaaat

SEQ ID NO: 173130 - DNA, 22 bp, Artificial sequence
  SiRNA target sequence
acatatacacagatcaaaaata

SEQ ID NO: 173131 - DNA, 22 bp, Artificial sequence
  SiRNA target sequence
catatacacagatcaaaaataa

SEQ ID NO: 173132 - DNA, 22 bp, Artificial sequence
  SiRNA target sequence
atatacacagatcaaaaataat

SEQ ID NO: 173133 - DNA, 22 bp, Artificial sequence
  SiRNA target sequence
tatacacagatcaaaaataata

SEQ ID NO: 173134 - DNA, 22 bp, Artificial sequence
  SiRNA target sequence
atacacagatcaaaaataataa

SEQ ID NO: 173135 - DNA, 22 bp, Artificial sequence
  SiRNA target sequence
tacacagatcaaaaataataag

SEQ ID NO: 173136 - DNA, 22 bp, Artificial sequence
  SiRNA target sequence
acacagatcaaaaataataaga

SEQ ID NO: 173137 - DNA, 22 bp, Artificial sequence
  SiRNA target sequence
cacagatcaaaaataataagaa

SEQ ID NO: 173138 - DNA, 22 bp, Artificial sequence
  SiRNA target sequence
acagatcaaaaataataagaaa

SEQ ID NO: 173139 - DNA, 22 bp, Artificial sequence
  SiRNA target sequence
cagatcaaaaataataagaaaa

SEQ ID NO: 173140 - DNA, 22 bp, Artificial sequence
  SiRNA target sequence
agatcaaaaataataagaaaaa

SEQ ID NO: 173141 - DNA, 22 bp, Artificial sequence
  SiRNA target sequence
gatcaaaaataataagaaaaaa

SEQ ID NO: 173142 - DNA, 22 bp, Artificial sequence
  SiRNA target sequence
atcaaaaataataagaaaaaaa

SEQ ID NO: 173143 - DNA, 22 bp, Artificial sequence
  SiRNA target sequence
tcaaaaataataagaaaaaaaa

SEQ ID NO: 173144 - DNA, 22 bp, Artificial sequence
  SiRNA target sequence
caaaaataataagaaaaaaaaa

SEQ ID NO: 173145 - DNA, 22 bp, Artificial sequence
  SiRNA target sequence
aaaaataataagaaaaaaaaat

SEQ ID NO: 173146 - DNA, 22 bp, Artificial sequence
  SiRNA target sequence
aaaataataagaaaaaaaaata

SEQ ID NO: 173147 - DNA, 22 bp, Artificial sequence
  SiRNA target sequence
aaataataagaaaaaaaaatat

SEQ ID NO: 173148 - DNA, 22 bp, Artificial sequence
  SiRNA target sequence
aataataagaaaaaaaaatatt

SEQ ID NO: 173149 - DNA, 22 bp, Artificial sequence
  SiRNA target sequence
ataataagaaaaaaaaatattt

SEQ ID NO: 173150 - DNA, 22 bp, Artificial sequence
  SiRNA target sequence
taataagaaaaaaaaatattta

SEQ ID NO: 173151 - DNA, 22 bp, Artificial sequence
  SiRNA target sequence
aataagaaaaaaaaatatttaa

SEQ ID NO: 173152 - DNA, 22 bp, Artificial sequence
  SiRNA target sequence
ataagaaaaaaaaatatttaag

SEQ ID NO: 173153 - DNA, 22 bp, Artificial sequence
  SiRNA target sequence
taagaaaaaaaaatatttaaga

SEQ ID NO: 173154 - DNA, 22 bp, Artificial sequence
  SiRNA target sequence
aagaaaaaaaaatatttaagaa

SEQ ID NO: 173155 - DNA, 22 bp, Artificial sequence
  SiRNA target sequence
agaaaaaaaaatatttaagaat

SEQ ID NO: 173156 - DNA, 22 bp, Artificial sequence
  SiRNA target sequence
gaaaaaaaaatatttaagaata

SEQ ID NO: 173157 - DNA, 22 bp, Artificial sequence
  SiRNA target sequence
aaaaaaaaatatttaagaatat

SEQ ID NO: 173158 - DNA, 22 bp, Artificial sequence
  SiRNA target sequence
aaaaaaaatatttaagaatatt

SEQ ID NO: 173159 - DNA, 22 bp, Artificial sequence
  SiRNA target sequence
aaaaaaatatttaagaatattg

SEQ ID NO: 173160 - DNA, 22 bp, Artificial sequence
  SiRNA target sequence
aaaaaatatttaagaatattgg

SEQ ID NO: 173161 - DNA, 22 bp, Artificial sequence
  SiRNA target sequence
aaaaatatttaagaatattggg

SEQ ID NO: 173162 - DNA, 22 bp, Artificial sequence
  SiRNA target sequence
aaaatatttaagaatattgggt

SEQ ID NO: 173163 - DNA, 22 bp, Artificial sequence
  SiRNA target sequence
aaatatttaagaatattgggtc

SEQ ID NO: 173164 - DNA, 22 bp, Artificial sequence
  SiRNA target sequence
aatatttaagaatattgggtct

SEQ ID NO: 173165 - DNA, 22 bp, Artificial sequence
  SiRNA target sequence
atatttaagaatattgggtcta

SEQ ID NO: 173166 - DNA, 22 bp, Artificial sequence
  SiRNA target sequence
tatttaagaatattgggtctag

SEQ ID NO: 173167 - DNA, 22 bp, Artificial sequence
  SiRNA target sequence
atttaagaatattgggtctaga

SEQ ID NO: 173168 - DNA, 22 bp, Artificial sequence
  SiRNA target sequence
tttaagaatattgggtctagaa

SEQ ID NO: 173169 - DNA, 22 bp, Artificial sequence
  SiRNA target sequence
ttaagaatattgggtctagaac

SEQ ID NO: 173170 - DNA, 22 bp, Artificial sequence
  SiRNA target sequence
taagaatattgggtctagaacc

SEQ ID NO: 173171 - DNA, 22 bp, Artificial sequence
  SiRNA target sequence
aagaatattgggtctagaacct

SEQ ID NO: 173172 - DNA, 22 bp, Artificial sequence
  SiRNA target sequence
agaatattgggtctagaacctt

SEQ ID NO: 173173 - DNA, 22 bp, Artificial sequence
  SiRNA target sequence
gaatattgggtctagaaccttt

SEQ ID NO: 173174 - DNA, 22 bp, Artificial sequence
  SiRNA target sequence
aatattgggtctagaacctttt

SEQ ID NO: 173175 - DNA, 22 bp, Artificial sequence
  SiRNA target sequence
atattgggtctagaaccttttc

SEQ ID NO: 173176 - DNA, 22 bp, Artificial sequence
  SiRNA target sequence
tattgggtctagaaccttttct

SEQ ID NO: 173177 - DNA, 22 bp, Artificial sequence
  SiRNA target sequence
attgggtctagaaccttttctt

SEQ ID NO: 173178 - DNA, 22 bp, Artificial sequence
  SiRNA target sequence
ttgggtctagaaccttttctta

SEQ ID NO: 173179 - DNA, 22 bp, Artificial sequence
  SiRNA target sequence
tgggtctagaaccttttcttaa

SEQ ID NO: 173180 - DNA, 22 bp, Artificial sequence
  SiRNA target sequence
gggtctagaaccttttcttaat

SEQ ID NO: 173181 - DNA, 22 bp, Artificial sequence
  SiRNA target sequence
ggtctagaaccttttcttaatt

SEQ ID NO: 173182 - DNA, 22 bp, Artificial sequence
  SiRNA target sequence
gtctagaaccttttcttaattt

SEQ ID NO: 173183 - DNA, 22 bp, Artificial sequence
  SiRNA target sequence
tctagaaccttttcttaatttt

SEQ ID NO: 173184 - DNA, 22 bp, Artificial sequence
  SiRNA target sequence
ctagaaccttttcttaatttta

SEQ ID NO: 173185 - DNA, 22 bp, Artificial sequence
  SiRNA target sequence
tagaaccttttcttaattttat

SEQ ID NO: 173186 - DNA, 22 bp, Artificial sequence
  SiRNA target sequence
agaaccttttcttaattttatt

SEQ ID NO: 173187 - DNA, 22 bp, Artificial sequence
  SiRNA target sequence
gaaccttttcttaattttatta

SEQ ID NO: 173188 - DNA, 22 bp, Artificial sequence
  SiRNA target sequence
aaccttttcttaattttattaa

SEQ ID NO: 173189 - DNA, 22 bp, Artificial sequence
  SiRNA target sequence
accttttcttaattttattaag

SEQ ID NO: 173190 - DNA, 22 bp, Artificial sequence
  SiRNA target sequence
ccttttcttaattttattaagg

SEQ ID NO: 173191 - DNA, 22 bp, Artificial sequence
  SiRNA target sequence
cttttcttaattttattaagga

SEQ ID NO: 173192 - DNA, 22 bp, Artificial sequence
  SiRNA target sequence
ttttcttaattttattaaggaa

SEQ ID NO: 173193 - DNA, 22 bp, Artificial sequence
  SiRNA target sequence
tttcttaattttattaaggaaa

SEQ ID NO: 173194 - DNA, 22 bp, Artificial sequence
  SiRNA target sequence
ttcttaattttattaaggaaag

SEQ ID NO: 173195 - DNA, 22 bp, Artificial sequence
  SiRNA target sequence
tcttaattttattaaggaaagt

SEQ ID NO: 173196 - DNA, 22 bp, Artificial sequence
  SiRNA target sequence
cttaattttattaaggaaagta

SEQ ID NO: 173197 - DNA, 22 bp, Artificial sequence
  SiRNA target sequence
ttaattttattaaggaaagtaa

SEQ ID NO: 173198 - DNA, 22 bp, Artificial sequence
  SiRNA target sequence
taattttattaaggaaagtaaa

SEQ ID NO: 173199 - DNA, 22 bp, Artificial sequence
  SiRNA target sequence
aattttattaaggaaagtaaac

SEQ ID NO: 173200 - DNA, 22 bp, Artificial sequence
  SiRNA target sequence
attttattaaggaaagtaaaca

SEQ ID NO: 173201 - DNA, 22 bp, Artificial sequence
  SiRNA target sequence
ttttattaaggaaagtaaacat

SEQ ID NO: 173202 - DNA, 22 bp, Artificial sequence
  SiRNA target sequence
tttattaaggaaagtaaacata

SEQ ID NO: 173203 - DNA, 22 bp, Artificial sequence
  SiRNA target sequence
ttattaaggaaagtaaacataa

SEQ ID NO: 173204 - DNA, 22 bp, Artificial sequence
  SiRNA target sequence
tattaaggaaagtaaacataaa

SEQ ID NO: 173205 - DNA, 22 bp, Artificial sequence
  SiRNA target sequence
attaaggaaagtaaacataaag

SEQ ID NO: 173206 - DNA, 22 bp, Artificial sequence
  SiRNA target sequence
ttaaggaaagtaaacataaaga

SEQ ID NO: 173207 - DNA, 22 bp, Artificial sequence
  SiRNA target sequence
taaggaaagtaaacataaagaa

SEQ ID NO: 173208 - DNA, 22 bp, Artificial sequence
  SiRNA target sequence
aaggaaagtaaacataaagaat

SEQ ID NO: 173209 - DNA, 22 bp, Artificial sequence
  SiRNA target sequence
aggaaagtaaacataaagaatt

SEQ ID NO: 173210 - DNA, 22 bp, Artificial sequence
  SiRNA target sequence
ggaaagtaaacataaagaatta

SEQ ID NO: 173211 - DNA, 22 bp, Artificial sequence
  SiRNA target sequence
gaaagtaaacataaagaattag

SEQ ID NO: 173212 - DNA, 22 bp, Artificial sequence
  SiRNA target sequence
aaagtaaacataaagaattaga

SEQ ID NO: 173213 - DNA, 22 bp, Artificial sequence
  SiRNA target sequence
aagtaaacataaagaattagaa

SEQ ID NO: 173214 - DNA, 22 bp, Artificial sequence
  SiRNA target sequence
agtaaacataaagaattagaat

SEQ ID NO: 173215 - DNA, 22 bp, Artificial sequence
  SiRNA target sequence
gtaaacataaagaattagaata

SEQ ID NO: 173216 - DNA, 22 bp, Artificial sequence
  SiRNA target sequence
taaacataaagaattagaatat

SEQ ID NO: 173217 - DNA, 22 bp, Artificial sequence
  SiRNA target sequence
aaacataaagaattagaatatg

SEQ ID NO: 173218 - DNA, 22 bp, Artificial sequence
  SiRNA target sequence
aacataaagaattagaatatga

SEQ ID NO: 173219 - DNA, 22 bp, Artificial sequence
  SiRNA target sequence
acataaagaattagaatatgat

SEQ ID NO: 173220 - DNA, 22 bp, Artificial sequence
  SiRNA target sequence
cataaagaattagaatatgatg

SEQ ID NO: 173221 - DNA, 22 bp, Artificial sequence
  SiRNA target sequence
ataaagaattagaatatgatgt

SEQ ID NO: 173222 - DNA, 22 bp, Artificial sequence
  SiRNA target sequence
taaagaattagaatatgatgta

SEQ ID NO: 173223 - DNA, 22 bp, Artificial sequence
  SiRNA target sequence
aaagaattagaatatgatgtat

SEQ ID NO: 173224 - DNA, 22 bp, Artificial sequence
  SiRNA target sequence
aagaattagaatatgatgtatg

SEQ ID NO: 173225 - DNA, 22 bp, Artificial sequence
  SiRNA target sequence
agaattagaatatgatgtatgc

SEQ ID NO: 173226 - DNA, 22 bp, Artificial sequence
  SiRNA target sequence
gaattagaatatgatgtatgcg

SEQ ID NO: 173227 - DNA, 22 bp, Artificial sequence
  SiRNA target sequence
aattagaatatgatgtatgcga

SEQ ID NO: 173228 - DNA, 22 bp, Artificial sequence
  SiRNA target sequence
attagaatatgatgtatgcgaa

SEQ ID NO: 173229 - DNA, 22 bp, Artificial sequence
  SiRNA target sequence
ttagaatatgatgtatgcgaaa

SEQ ID NO: 173230 - DNA, 22 bp, Artificial sequence
  SiRNA target sequence
tagaatatgatgtatgcgaaat

SEQ ID NO: 173231 - DNA, 22 bp, Artificial sequence
  SiRNA target sequence
agaatatgatgtatgcgaaata

SEQ ID NO: 173232 - DNA, 22 bp, Artificial sequence
  SiRNA target sequence
gaatatgatgtatgcgaaatat

SEQ ID NO: 173233 - DNA, 22 bp, Artificial sequence
  SiRNA target sequence
aatatgatgtatgcgaaatata

SEQ ID NO: 173234 - DNA, 22 bp, Artificial sequence
  SiRNA target sequence
atatgatgtatgcgaaatatac

SEQ ID NO: 173235 - DNA, 22 bp, Artificial sequence
  SiRNA target sequence
tatgatgtatgcgaaatataca

SEQ ID NO: 173236 - DNA, 22 bp, Artificial sequence
  SiRNA target sequence
atgatgtatgcgaaatatacat

SEQ ID NO: 173237 - DNA, 22 bp, Artificial sequence
  SiRNA target sequence
tgatgtatgcgaaatatacatt

SEQ ID NO: 173238 - DNA, 22 bp, Artificial sequence
  SiRNA target sequence
gatgtatgcgaaatatacattt

SEQ ID NO: 173239 - DNA, 22 bp, Artificial sequence
  SiRNA target sequence
atgtatgcgaaatatacatttg

SEQ ID NO: 173240 - DNA, 22 bp, Artificial sequence
  SiRNA target sequence
tgtatgcgaaatatacatttgt

SEQ ID NO: 173241 - DNA, 22 bp, Artificial sequence
  SiRNA target sequence
gtatgcgaaatatacatttgta

SEQ ID NO: 173242 - DNA, 22 bp, Artificial sequence
  SiRNA target sequence
tatgcgaaatatacatttgtaa

SEQ ID NO: 173243 - DNA, 22 bp, Artificial sequence
  SiRNA target sequence
atgcgaaatatacatttgtaat

SEQ ID NO: 173244 - DNA, 22 bp, Artificial sequence
  SiRNA target sequence
tgcgaaatatacatttgtaatc

SEQ ID NO: 173245 - DNA, 22 bp, Artificial sequence
  SiRNA target sequence
gcgaaatatacatttgtaatca

SEQ ID NO: 173246 - DNA, 22 bp, Artificial sequence
  SiRNA target sequence
cgaaatatacatttgtaatcag

SEQ ID NO: 173247 - DNA, 22 bp, Artificial sequence
  SiRNA target sequence
gaaatatacatttgtaatcagg

SEQ ID NO: 173248 - DNA, 22 bp, Artificial sequence
  SiRNA target sequence
aaatatacatttgtaatcaggg

SEQ ID NO: 173249 - DNA, 22 bp, Artificial sequence
  SiRNA target sequence
aatatacatttgtaatcaggga

SEQ ID NO: 173250 - DNA, 22 bp, Artificial sequence
  SiRNA target sequence
atatacatttgtaatcagggat

SEQ ID NO: 173251 - DNA, 22 bp, Artificial sequence
  SiRNA target sequence
tatacatttgtaatcagggatg

SEQ ID NO: 173252 - DNA, 22 bp, Artificial sequence
  SiRNA target sequence
atacatttgtaatcagggatgc

SEQ ID NO: 173253 - DNA, 22 bp, Artificial sequence
  SiRNA target sequence
tacatttgtaatcagggatgca

SEQ ID NO: 173254 - DNA, 22 bp, Artificial sequence
  SiRNA target sequence
acatttgtaatcagggatgcat

SEQ ID NO: 173255 - DNA, 22 bp, Artificial sequence
  SiRNA target sequence
catttgtaatcagggatgcatt

SEQ ID NO: 173256 - DNA, 22 bp, Artificial sequence
  SiRNA target sequence
atttgtaatcagggatgcatta

SEQ ID NO: 173257 - DNA, 22 bp, Artificial sequence
  SiRNA target sequence
tttgtaatcagggatgcattaa

SEQ ID NO: 173258 - DNA, 22 bp, Artificial sequence
  SiRNA target sequence
ttgtaatcagggatgcattaat

SEQ ID NO: 173259 - DNA, 22 bp, Artificial sequence
  SiRNA target sequence
tgtaatcagggatgcattaatg

SEQ ID NO: 173260 - DNA, 22 bp, Artificial sequence
  SiRNA target sequence
gtaatcagggatgcattaatgg

SEQ ID NO: 173261 - DNA, 22 bp, Artificial sequence
  SiRNA target sequence
taatcagggatgcattaatgga

SEQ ID NO: 173262 - DNA, 22 bp, Artificial sequence
  SiRNA target sequence
aatcagggatgcattaatggac

SEQ ID NO: 173263 - DNA, 22 bp, Artificial sequence
  SiRNA target sequence
atcagggatgcattaatggacc

SEQ ID NO: 173264 - DNA, 22 bp, Artificial sequence
  SiRNA target sequence
tcagggatgcattaatggacca

SEQ ID NO: 173265 - DNA, 22 bp, Artificial sequence
  SiRNA target sequence
cagggatgcattaatggaccag

SEQ ID NO: 173266 - DNA, 22 bp, Artificial sequence
  SiRNA target sequence
agggatgcattaatggaccagg

SEQ ID NO: 173267 - DNA, 22 bp, Artificial sequence
  SiRNA target sequence
gggatgcattaatggaccagga

SEQ ID NO: 173268 - DNA, 22 bp, Artificial sequence
  SiRNA target sequence
ggatgcattaatggaccaggac

SEQ ID NO: 173269 - DNA, 22 bp, Artificial sequence
  SiRNA target sequence
gatgcattaatggaccaggaca

SEQ ID NO: 173270 - DNA, 22 bp, Artificial sequence
  SiRNA target sequence
atgcattaatggaccaggacaa

SEQ ID NO: 173271 - DNA, 22 bp, Artificial sequence
  SiRNA target sequence
tgcattaatggaccaggacaat

SEQ ID NO: 173272 - DNA, 22 bp, Artificial sequence
  SiRNA target sequence
gcattaatggaccaggacaatt

SEQ ID NO: 173273 - DNA, 22 bp, Artificial sequence
  SiRNA target sequence
cattaatggaccaggacaattg

SEQ ID NO: 173274 - DNA, 22 bp, Artificial sequence
  SiRNA target sequence
attaatggaccaggacaattgt

SEQ ID NO: 173275 - DNA, 22 bp, Artificial sequence
  SiRNA target sequence
ttaatggaccaggacaattgta

SEQ ID NO: 173276 - DNA, 22 bp, Artificial sequence
  SiRNA target sequence
taatggaccaggacaattgtat

SEQ ID NO: 173277 - DNA, 22 bp, Artificial sequence
  SiRNA target sequence
aatggaccaggacaattgtata

SEQ ID NO: 173278 - DNA, 22 bp, Artificial sequence
  SiRNA target sequence
atggaccaggacaattgtatac

SEQ ID NO: 173279 - DNA, 22 bp, Artificial sequence
  SiRNA target sequence
tggaccaggacaattgtataca

SEQ ID NO: 173280 - DNA, 22 bp, Artificial sequence
  SiRNA target sequence
ggaccaggacaattgtatacag

SEQ ID NO: 173281 - DNA, 22 bp, Artificial sequence
  SiRNA target sequence
gaccaggacaattgtatacaga

SEQ ID NO: 173282 - DNA, 22 bp, Artificial sequence
  SiRNA target sequence
accaggacaattgtatacagat

SEQ ID NO: 173283 - DNA, 22 bp, Artificial sequence
  SiRNA target sequence
ccaggacaattgtatacagata

SEQ ID NO: 173284 - DNA, 22 bp, Artificial sequence
  SiRNA target sequence
caggacaattgtatacagataa

SEQ ID NO: 173285 - DNA, 22 bp, Artificial sequence
  SiRNA target sequence
aggacaattgtatacagataat

SEQ ID NO: 173286 - DNA, 22 bp, Artificial sequence
  SiRNA target sequence
ggacaattgtatacagataatt

SEQ ID NO: 173287 - DNA, 22 bp, Artificial sequence
  SiRNA target sequence
gacaattgtatacagataattt

SEQ ID NO: 173288 - DNA, 22 bp, Artificial sequence
  SiRNA target sequence
acaattgtatacagataattta

SEQ ID NO: 173289 - DNA, 22 bp, Artificial sequence
  SiRNA target sequence
caattgtatacagataatttat

SEQ ID NO: 173290 - DNA, 22 bp, Artificial sequence
  SiRNA target sequence
aattgtatacagataatttata

SEQ ID NO: 173291 - DNA, 22 bp, Artificial sequence
  SiRNA target sequence
attgtatacagataatttatat

SEQ ID NO: 173292 - DNA, 22 bp, Artificial sequence
  SiRNA target sequence
ttgtatacagataatttatatg

SEQ ID NO: 173293 - DNA, 22 bp, Artificial sequence
  SiRNA target sequence
tgtatacagataatttatatgt

SEQ ID NO: 173294 - DNA, 22 bp, Artificial sequence
  SiRNA target sequence
gtatacagataatttatatgta

SEQ ID NO: 173295 - DNA, 22 bp, Artificial sequence
  SiRNA target sequence
tatacagataatttatatgtaa

SEQ ID NO: 173296 - DNA, 22 bp, Artificial sequence
  SiRNA target sequence
atacagataatttatatgtaaa

SEQ ID NO: 173297 - DNA, 22 bp, Artificial sequence
  SiRNA target sequence
tacagataatttatatgtaaat

SEQ ID NO: 173298 - DNA, 22 bp, Artificial sequence
  SiRNA target sequence
acagataatttatatgtaaata

SEQ ID NO: 173299 - DNA, 22 bp, Artificial sequence
  SiRNA target sequence
cagataatttatatgtaaataa

SEQ ID NO: 173300 - DNA, 22 bp, Artificial sequence
  SiRNA target sequence
agataatttatatgtaaataat

SEQ ID NO: 173301 - DNA, 22 bp, Artificial sequence
  SiRNA target sequence
gataatttatatgtaaataatt

SEQ ID NO: 173302 - DNA, 22 bp, Artificial sequence
  SiRNA target sequence
ataatttatatgtaaataattc

SEQ ID NO: 173303 - DNA, 22 bp, Artificial sequence
  SiRNA target sequence
taatttatatgtaaataattca

SEQ ID NO: 173304 - DNA, 22 bp, Artificial sequence
  SiRNA target sequence
aatttatatgtaaataattcag

SEQ ID NO: 173305 - DNA, 22 bp, Artificial sequence
  SiRNA target sequence
atttatatgtaaataattcaga

SEQ ID NO: 173306 - DNA, 22 bp, Artificial sequence
  SiRNA target sequence
tttatatgtaaataattcagaa

SEQ ID NO: 173307 - DNA, 22 bp, Artificial sequence
  SiRNA target sequence
ttatatgtaaataattcagaat

SEQ ID NO: 173308 - DNA, 22 bp, Artificial sequence
  SiRNA target sequence
tatatgtaaataattcagaata

SEQ ID NO: 173309 - DNA, 22 bp, Artificial sequence
  SiRNA target sequence
atatgtaaataattcagaatac

SEQ ID NO: 173310 - DNA, 22 bp, Artificial sequence
  SiRNA target sequence
tatgtaaataattcagaataca

SEQ ID NO: 173311 - DNA, 22 bp, Artificial sequence
  SiRNA target sequence
atgtaaataattcagaatacat

SEQ ID NO: 173312 - DNA, 22 bp, Artificial sequence
  SiRNA target sequence
tgtaaataattcagaatacata

SEQ ID NO: 173313 - DNA, 22 bp, Artificial sequence
  SiRNA target sequence
gtaaataattcagaatacatag

SEQ ID NO: 173314 - DNA, 22 bp, Artificial sequence
  SiRNA target sequence
taaataattcagaatacataga

SEQ ID NO: 173315 - DNA, 22 bp, Artificial sequence
  SiRNA target sequence
aaataattcagaatacatagat

SEQ ID NO: 173316 - DNA, 22 bp, Artificial sequence
  SiRNA target sequence
aataattcagaatacatagata

SEQ ID NO: 173317 - DNA, 22 bp, Artificial sequence
  SiRNA target sequence
ataattcagaatacatagatat

SEQ ID NO: 173318 - DNA, 22 bp, Artificial sequence
  SiRNA target sequence
taattcagaatacatagatatt

SEQ ID NO: 173319 - DNA, 22 bp, Artificial sequence
  SiRNA target sequence
aattcagaatacatagatattg

SEQ ID NO: 173320 - DNA, 22 bp, Artificial sequence
  SiRNA target sequence
attcagaatacatagatattga

SEQ ID NO: 173321 - DNA, 22 bp, Artificial sequence
  SiRNA target sequence
ttcagaatacatagatattgat

SEQ ID NO: 173322 - DNA, 22 bp, Artificial sequence
  SiRNA target sequence
tcagaatacatagatattgatc

SEQ ID NO: 173323 - DNA, 22 bp, Artificial sequence
  SiRNA target sequence
cagaatacatagatattgatct

SEQ ID NO: 173324 - DNA, 22 bp, Artificial sequence
  SiRNA target sequence
agaatacatagatattgatctt

SEQ ID NO: 173325 - DNA, 22 bp, Artificial sequence
  SiRNA target sequence
gaatacatagatattgatcttg

SEQ ID NO: 173326 - DNA, 22 bp, Artificial sequence
  SiRNA target sequence
aatacatagatattgatcttgg

SEQ ID NO: 173327 - DNA, 22 bp, Artificial sequence
  SiRNA target sequence
atacatagatattgatcttggt

SEQ ID NO: 173328 - DNA, 22 bp, Artificial sequence
  SiRNA target sequence
tacatagatattgatcttggta

SEQ ID NO: 173329 - DNA, 22 bp, Artificial sequence
  SiRNA target sequence
acatagatattgatcttggtat

SEQ ID NO: 173330 - DNA, 22 bp, Artificial sequence
  SiRNA target sequence
catagatattgatcttggtatt

SEQ ID NO: 173331 - DNA, 22 bp, Artificial sequence
  SiRNA target sequence
atagatattgatcttggtattg

SEQ ID NO: 173332 - DNA, 22 bp, Artificial sequence
  SiRNA target sequence
tagatattgatcttggtattga

SEQ ID NO: 173333 - DNA, 22 bp, Artificial sequence
  SiRNA target sequence
agatattgatcttggtattgat

SEQ ID NO: 173334 - DNA, 22 bp, Artificial sequence
  SiRNA target sequence
gatattgatcttggtattgatt

SEQ ID NO: 173335 - DNA, 22 bp, Artificial sequence
  SiRNA target sequence
atattgatcttggtattgattg

SEQ ID NO: 173336 - DNA, 22 bp, Artificial sequence
  SiRNA target sequence
tattgatcttggtattgattgt

SEQ ID NO: 173337 - DNA, 22 bp, Artificial sequence
  SiRNA target sequence
attgatcttggtattgattgta

SEQ ID NO: 173338 - DNA, 22 bp, Artificial sequence
  SiRNA target sequence
ttgatcttggtattgattgtaa

SEQ ID NO: 173339 - DNA, 22 bp, Artificial sequence
  SiRNA target sequence
tgatcttggtattgattgtaaa

SEQ ID NO: 173340 - DNA, 22 bp, Artificial sequence
  SiRNA target sequence
gatcttggtattgattgtaaac

SEQ ID NO: 173341 - DNA, 22 bp, Artificial sequence
  SiRNA target sequence
atcttggtattgattgtaaaca

SEQ ID NO: 173342 - DNA, 22 bp, Artificial sequence
  SiRNA target sequence
tcttggtattgattgtaaacag

SEQ ID NO: 173343 - DNA, 22 bp, Artificial sequence
  SiRNA target sequence
cttggtattgattgtaaacagt

SEQ ID NO: 173344 - DNA, 22 bp, Artificial sequence
  SiRNA target sequence
ttggtattgattgtaaacagtt

SEQ ID NO: 173345 - DNA, 22 bp, Artificial sequence
  SiRNA target sequence
tggtattgattgtaaacagtta

SEQ ID NO: 173346 - DNA, 22 bp, Artificial sequence
  SiRNA target sequence
ggtattgattgtaaacagttac

SEQ ID NO: 173347 - DNA, 22 bp, Artificial sequence
  SiRNA target sequence
gtattgattgtaaacagttaca

SEQ ID NO: 173348 - DNA, 22 bp, Artificial sequence
  SiRNA target sequence
tattgattgtaaacagttacaa

SEQ ID NO: 173349 - DNA, 22 bp, Artificial sequence
  SiRNA target sequence
attgattgtaaacagttacaaa

SEQ ID NO: 173350 - DNA, 22 bp, Artificial sequence
  SiRNA target sequence
ttgattgtaaacagttacaaaa

SEQ ID NO: 173351 - DNA, 22 bp, Artificial sequence
  SiRNA target sequence
tgattgtaaacagttacaaaaa

SEQ ID NO: 173352 - DNA, 22 bp, Artificial sequence
  SiRNA target sequence
gattgtaaacagttacaaaaaa

SEQ ID NO: 173353 - DNA, 22 bp, Artificial sequence
  SiRNA target sequence
attgtaaacagttacaaaaaag

SEQ ID NO: 173354 - DNA, 22 bp, Artificial sequence
  SiRNA target sequence
ttgtaaacagttacaaaaaagg

SEQ ID NO: 173355 - DNA, 22 bp, Artificial sequence
  SiRNA target sequence
tgtaaacagttacaaaaaagga

SEQ ID NO: 173356 - DNA, 22 bp, Artificial sequence
  SiRNA target sequence
gtaaacagttacaaaaaaggac

SEQ ID NO: 173357 - DNA, 22 bp, Artificial sequence
  SiRNA target sequence
taaacagttacaaaaaaggaca

SEQ ID NO: 173358 - DNA, 22 bp, Artificial sequence
  SiRNA target sequence
aaacagttacaaaaaaggacat

SEQ ID NO: 173359 - DNA, 22 bp, Artificial sequence
  SiRNA target sequence
aacagttacaaaaaaggacata

SEQ ID NO: 173360 - DNA, 22 bp, Artificial sequence
  SiRNA target sequence
acagttacaaaaaaggacatat

SEQ ID NO: 173361 - DNA, 22 bp, Artificial sequence
  SiRNA target sequence
cagttacaaaaaaggacatata

SEQ ID NO: 173362 - DNA, 22 bp, Artificial sequence
  SiRNA target sequence
agttacaaaaaaggacatatag

SEQ ID NO: 173363 - DNA, 22 bp, Artificial sequence
  SiRNA target sequence
gttacaaaaaaggacatataga

SEQ ID NO: 173364 - DNA, 22 bp, Artificial sequence
  SiRNA target sequence
ttacaaaaaaggacatatagaa

SEQ ID NO: 173365 - DNA, 22 bp, Artificial sequence
  SiRNA target sequence
tacaaaaaaggacatatagaaa

SEQ ID NO: 173366 - DNA, 22 bp, Artificial sequence
  SiRNA target sequence
acaaaaaaggacatatagaaaa

SEQ ID NO: 173367 - DNA, 22 bp, Artificial sequence
  SiRNA target sequence
caaaaaaggacatatagaaaaa

SEQ ID NO: 173368 - DNA, 22 bp, Artificial sequence
  SiRNA target sequence
aaaaaaggacatatagaaaaat

SEQ ID NO: 173369 - DNA, 22 bp, Artificial sequence
  SiRNA target sequence
aaaaaggacatatagaaaaata

SEQ ID NO: 173370 - DNA, 22 bp, Artificial sequence
  SiRNA target sequence
aaaaggacatatagaaaaatag

SEQ ID NO: 173371 - DNA, 22 bp, Artificial sequence
  SiRNA target sequence
aaaggacatatagaaaaataga

SEQ ID NO: 173372 - DNA, 22 bp, Artificial sequence
  SiRNA target sequence
aaggacatatagaaaaatagaa

SEQ ID NO: 173373 - DNA, 22 bp, Artificial sequence
  SiRNA target sequence
aggacatatagaaaaatagaaa

SEQ ID NO: 173374 - DNA, 22 bp, Artificial sequence
  SiRNA target sequence
ggacatatagaaaaatagaaac

SEQ ID NO: 173375 - DNA, 22 bp, Artificial sequence
  SiRNA target sequence
gacatatagaaaaatagaaaca

SEQ ID NO: 173376 - DNA, 22 bp, Artificial sequence
  SiRNA target sequence
acatatagaaaaatagaaacaa

SEQ ID NO: 173377 - DNA, 22 bp, Artificial sequence
  SiRNA target sequence
catatagaaaaatagaaacaaa

SEQ ID NO: 173378 - DNA, 22 bp, Artificial sequence
  SiRNA target sequence
atatagaaaaatagaaacaaag

SEQ ID NO: 173379 - DNA, 22 bp, Artificial sequence
  SiRNA target sequence
tatagaaaaatagaaacaaaga

SEQ ID NO: 173380 - DNA, 22 bp, Artificial sequence
  SiRNA target sequence
atagaaaaatagaaacaaagaa

SEQ ID NO: 173381 - DNA, 22 bp, Artificial sequence
  SiRNA target sequence
tagaaaaatagaaacaaagaaa

SEQ ID NO: 173382 - DNA, 22 bp, Artificial sequence
  SiRNA target sequence
agaaaaatagaaacaaagaaag

SEQ ID NO: 173383 - DNA, 22 bp, Artificial sequence
  SiRNA target sequence
gaaaaatagaaacaaagaaagt

SEQ ID NO: 173384 - DNA, 22 bp, Artificial sequence
  SiRNA target sequence
aaaaatagaaacaaagaaagtt

SEQ ID NO: 173385 - DNA, 22 bp, Artificial sequence
  SiRNA target sequence
aaaatagaaacaaagaaagtta

SEQ ID NO: 173386 - DNA, 22 bp, Artificial sequence
  SiRNA target sequence
aaatagaaacaaagaaagttaa

SEQ ID NO: 173387 - DNA, 22 bp, Artificial sequence
  SiRNA target sequence
aatagaaacaaagaaagttaat

SEQ ID NO: 173388 - DNA, 22 bp, Artificial sequence
  SiRNA target sequence
atagaaacaaagaaagttaatt

SEQ ID NO: 173389 - DNA, 22 bp, Artificial sequence
  SiRNA target sequence
tagaaacaaagaaagttaattt

SEQ ID NO: 173390 - DNA, 22 bp, Artificial sequence
  SiRNA target sequence
agaaacaaagaaagttaatttt

SEQ ID NO: 173391 - DNA, 22 bp, Artificial sequence
  SiRNA target sequence
gaaacaaagaaagttaatttta

SEQ ID NO: 173392 - DNA, 22 bp, Artificial sequence
  SiRNA target sequence
aaacaaagaaagttaattttaa

SEQ ID NO: 173393 - DNA, 22 bp, Artificial sequence
  SiRNA target sequence
aacaaagaaagttaattttaaa

SEQ ID NO: 173394 - DNA, 22 bp, Artificial sequence
  SiRNA target sequence
acaaagaaagttaattttaaaa

SEQ ID NO: 173395 - DNA, 22 bp, Artificial sequence
  SiRNA target sequence
caaagaaagttaattttaaaat

SEQ ID NO: 173396 - DNA, 22 bp, Artificial sequence
  SiRNA target sequence
aaagaaagttaattttaaaata

SEQ ID NO: 173397 - DNA, 22 bp, Artificial sequence
  SiRNA target sequence
aagaaagttaattttaaaatag

SEQ ID NO: 173398 - DNA, 22 bp, Artificial sequence
  SiRNA target sequence
agaaagttaattttaaaataga

SEQ ID NO: 173399 - DNA, 22 bp, Artificial sequence
  SiRNA target sequence
gaaagttaattttaaaatagaa

SEQ ID NO: 173400 - DNA, 22 bp, Artificial sequence
  SiRNA target sequence
aaagttaattttaaaatagaat

SEQ ID NO: 173401 - DNA, 22 bp, Artificial sequence
  SiRNA target sequence
aagttaattttaaaatagaatg

SEQ ID NO: 173402 - DNA, 22 bp, Artificial sequence
  SiRNA target sequence
agttaattttaaaatagaatgg

SEQ ID NO: 173403 - DNA, 22 bp, Artificial sequence
  SiRNA target sequence
gttaattttaaaatagaatggt

SEQ ID NO: 173404 - DNA, 22 bp, Artificial sequence
  SiRNA target sequence
ttaattttaaaatagaatggta

SEQ ID NO: 173405 - DNA, 22 bp, Artificial sequence
  SiRNA target sequence
taattttaaaatagaatggtaa

SEQ ID NO: 173406 - DNA, 23 bp, Artificial sequence
  SiRNA target sequence
atgaatactgaaaataaaccatg

SEQ ID NO: 173407 - DNA, 23 bp, Artificial sequence
  SiRNA target sequence
tgaatactgaaaataaaccatgt

SEQ ID NO: 173408 - DNA, 23 bp, Artificial sequence
  SiRNA target sequence
gaatactgaaaataaaccatgta

SEQ ID NO: 173409 - DNA, 23 bp, Artificial sequence
  SiRNA target sequence
aatactgaaaataaaccatgtat

SEQ ID NO: 173410 - DNA, 23 bp, Artificial sequence
  SiRNA target sequence
atactgaaaataaaccatgtatt

SEQ ID NO: 173411 - DNA, 23 bp, Artificial sequence
  SiRNA target sequence
tactgaaaataaaccatgtattt

SEQ ID NO: 173412 - DNA, 23 bp, Artificial sequence
  SiRNA target sequence
actgaaaataaaccatgtatttc

SEQ ID NO: 173413 - DNA, 23 bp, Artificial sequence
  SiRNA target sequence
ctgaaaataaaccatgtatttca

SEQ ID NO: 173414 - DNA, 23 bp, Artificial sequence
  SiRNA target sequence
tgaaaataaaccatgtatttcac

SEQ ID NO: 173415 - DNA, 23 bp, Artificial sequence
  SiRNA target sequence
gaaaataaaccatgtatttcacc

SEQ ID NO: 173416 - DNA, 23 bp, Artificial sequence
  SiRNA target sequence
aaaataaaccatgtatttcacca

SEQ ID NO: 173417 - DNA, 23 bp, Artificial sequence
  SiRNA target sequence
aaataaaccatgtatttcaccat

SEQ ID NO: 173418 - DNA, 23 bp, Artificial sequence
  SiRNA target sequence
aataaaccatgtatttcaccatt

SEQ ID NO: 173419 - DNA, 23 bp, Artificial sequence
  SiRNA target sequence
ataaaccatgtatttcaccattt

SEQ ID NO: 173420 - DNA, 23 bp, Artificial sequence
  SiRNA target sequence
taaaccatgtatttcaccattta

SEQ ID NO: 173421 - DNA, 23 bp, Artificial sequence
  SiRNA target sequence
aaaccatgtatttcaccatttac

SEQ ID NO: 173422 - DNA, 23 bp, Artificial sequence
  SiRNA target sequence
aaccatgtatttcaccatttacc

SEQ ID NO: 173423 - DNA, 23 bp, Artificial sequence
  SiRNA target sequence
accatgtatttcaccatttacct

SEQ ID NO: 173424 - DNA, 23 bp, Artificial sequence
  SiRNA target sequence
ccatgtatttcaccatttacctt

SEQ ID NO: 173425 - DNA, 23 bp, Artificial sequence
  SiRNA target sequence
catgtatttcaccatttaccttt

SEQ ID NO: 173426 - DNA, 23 bp, Artificial sequence
  SiRNA target sequence
atgtatttcaccatttaccttta

SEQ ID NO: 173427 - DNA, 23 bp, Artificial sequence
  SiRNA target sequence
tgtatttcaccatttacctttaa

SEQ ID NO: 173428 - DNA, 23 bp, Artificial sequence
  SiRNA target sequence
gtatttcaccatttacctttaaa

SEQ ID NO: 173429 - DNA, 23 bp, Artificial sequence
  SiRNA target sequence
tatttcaccatttacctttaaac

SEQ ID NO: 173430 - DNA, 23 bp, Artificial sequence
  SiRNA target sequence
atttcaccatttacctttaaact

SEQ ID NO: 173431 - DNA, 23 bp, Artificial sequence
  SiRNA target sequence
tttcaccatttacctttaaacta

SEQ ID NO: 173432 - DNA, 23 bp, Artificial sequence
  SiRNA target sequence
ttcaccatttacctttaaactag

SEQ ID NO: 173433 - DNA, 23 bp, Artificial sequence
  SiRNA target sequence
tcaccatttacctttaaactaga

SEQ ID NO: 173434 - DNA, 23 bp, Artificial sequence
  SiRNA target sequence
caccatttacctttaaactagaa

SEQ ID NO: 173435 - DNA, 23 bp, Artificial sequence
  SiRNA target sequence
accatttacctttaaactagaag

SEQ ID NO: 173436 - DNA, 23 bp, Artificial sequence
  SiRNA target sequence
ccatttacctttaaactagaaga

SEQ ID NO: 173437 - DNA, 23 bp, Artificial sequence
  SiRNA target sequence
catttacctttaaactagaagat

SEQ ID NO: 173438 - DNA, 23 bp, Artificial sequence
  SiRNA target sequence
atttacctttaaactagaagatt

SEQ ID NO: 173439 - DNA, 23 bp, Artificial sequence
  SiRNA target sequence
tttacctttaaactagaagattg

SEQ ID NO: 173440 - DNA, 23 bp, Artificial sequence
  SiRNA target sequence
ttacctttaaactagaagattgc

SEQ ID NO: 173441 - DNA, 23 bp, Artificial sequence
  SiRNA target sequence
tacctttaaactagaagattgcc

SEQ ID NO: 173442 - DNA, 23 bp, Artificial sequence
  SiRNA target sequence
acctttaaactagaagattgcct

SEQ ID NO: 173443 - DNA, 23 bp, Artificial sequence
  SiRNA target sequence
cctttaaactagaagattgcctg

SEQ ID NO: 173444 - DNA, 23 bp, Artificial sequence
  SiRNA target sequence
ctttaaactagaagattgcctgg

SEQ ID NO: 173445 - DNA, 23 bp, Artificial sequence
  SiRNA target sequence
tttaaactagaagattgcctggc

SEQ ID NO: 173446 - DNA, 23 bp, Artificial sequence
  SiRNA target sequence
ttaaactagaagattgcctggca

SEQ ID NO: 173447 - DNA, 23 bp, Artificial sequence
  SiRNA target sequence
taaactagaagattgcctggcat

SEQ ID NO: 173448 - DNA, 23 bp, Artificial sequence
  SiRNA target sequence
aaactagaagattgcctggcatg

SEQ ID NO: 173449 - DNA, 23 bp, Artificial sequence
  SiRNA target sequence
aactagaagattgcctggcatgt

SEQ ID NO: 173450 - DNA, 23 bp, Artificial sequence
  SiRNA target sequence
actagaagattgcctggcatgtt

SEQ ID NO: 173451 - DNA, 23 bp, Artificial sequence
  SiRNA target sequence
ctagaagattgcctggcatgttc

SEQ ID NO: 173452 - DNA, 23 bp, Artificial sequence
  SiRNA target sequence
tagaagattgcctggcatgttcg

SEQ ID NO: 173453 - DNA, 23 bp, Artificial sequence
  SiRNA target sequence
agaagattgcctggcatgttcgg

SEQ ID NO: 173454 - DNA, 23 bp, Artificial sequence
  SiRNA target sequence
gaagattgcctggcatgttcggc

SEQ ID NO: 173455 - DNA, 23 bp, Artificial sequence
  SiRNA target sequence
aagattgcctggcatgttcggct

SEQ ID NO: 173456 - DNA, 23 bp, Artificial sequence
  SiRNA target sequence
agattgcctggcatgttcggctt

SEQ ID NO: 173457 - DNA, 23 bp, Artificial sequence
  SiRNA target sequence
gattgcctggcatgttcggcttg

SEQ ID NO: 173458 - DNA, 23 bp, Artificial sequence
  SiRNA target sequence
attgcctggcatgttcggcttgt

SEQ ID NO: 173459 - DNA, 23 bp, Artificial sequence
  SiRNA target sequence
ttgcctggcatgttcggcttgta

SEQ ID NO: 173460 - DNA, 23 bp, Artificial sequence
  SiRNA target sequence
tgcctggcatgttcggcttgtat

SEQ ID NO: 173461 - DNA, 23 bp, Artificial sequence
  SiRNA target sequence
gcctggcatgttcggcttgtatt

SEQ ID NO: 173462 - DNA, 23 bp, Artificial sequence
  SiRNA target sequence
cctggcatgttcggcttgtattg

SEQ ID NO: 173463 - DNA, 23 bp, Artificial sequence
  SiRNA target sequence
ctggcatgttcggcttgtattgc

SEQ ID NO: 173464 - DNA, 23 bp, Artificial sequence
  SiRNA target sequence
tggcatgttcggcttgtattgct

SEQ ID NO: 173465 - DNA, 23 bp, Artificial sequence
  SiRNA target sequence
ggcatgttcggcttgtattgctg

SEQ ID NO: 173466 - DNA, 23 bp, Artificial sequence
  SiRNA target sequence
gcatgttcggcttgtattgctga

SEQ ID NO: 173467 - DNA, 23 bp, Artificial sequence
  SiRNA target sequence
catgttcggcttgtattgctgat

SEQ ID NO: 173468 - DNA, 23 bp, Artificial sequence
  SiRNA target sequence
atgttcggcttgtattgctgatt

SEQ ID NO: 173469 - DNA, 23 bp, Artificial sequence
  SiRNA target sequence
tgttcggcttgtattgctgattt

SEQ ID NO: 173470 - DNA, 23 bp, Artificial sequence
  SiRNA target sequence
gttcggcttgtattgctgatttt

SEQ ID NO: 173471 - DNA, 23 bp, Artificial sequence
  SiRNA target sequence
ttcggcttgtattgctgattttt

SEQ ID NO: 173472 - DNA, 23 bp, Artificial sequence
  SiRNA target sequence
tcggcttgtattgctgatttttc

SEQ ID NO: 173473 - DNA, 23 bp, Artificial sequence
  SiRNA target sequence
cggcttgtattgctgatttttct

SEQ ID NO: 173474 - DNA, 23 bp, Artificial sequence
  SiRNA target sequence
ggcttgtattgctgatttttctg

SEQ ID NO: 173475 - DNA, 23 bp, Artificial sequence
  SiRNA target sequence
gcttgtattgctgatttttctgt

SEQ ID NO: 173476 - DNA, 23 bp, Artificial sequence
  SiRNA target sequence
cttgtattgctgatttttctgtt

SEQ ID NO: 173477 - DNA, 23 bp, Artificial sequence
  SiRNA target sequence
ttgtattgctgatttttctgttc

SEQ ID NO: 173478 - DNA, 23 bp, Artificial sequence
  SiRNA target sequence
tgtattgctgatttttctgttcc

SEQ ID NO: 173479 - DNA, 23 bp, Artificial sequence
  SiRNA target sequence
gtattgctgatttttctgttcca

SEQ ID NO: 173480 - DNA, 23 bp, Artificial sequence
  SiRNA target sequence
tattgctgatttttctgttccaa

SEQ ID NO: 173481 - DNA, 23 bp, Artificial sequence
  SiRNA target sequence
attgctgatttttctgttccaaa

SEQ ID NO: 173482 - DNA, 23 bp, Artificial sequence
  SiRNA target sequence
ttgctgatttttctgttccaaaa

SEQ ID NO: 173483 - DNA, 23 bp, Artificial sequence
  SiRNA target sequence
tgctgatttttctgttccaaaaa

SEQ ID NO: 173484 - DNA, 23 bp, Artificial sequence
  SiRNA target sequence
gctgatttttctgttccaaaaat

SEQ ID NO: 173485 - DNA, 23 bp, Artificial sequence
  SiRNA target sequence
ctgatttttctgttccaaaaatt

SEQ ID NO: 173486 - DNA, 23 bp, Artificial sequence
  SiRNA target sequence
tgatttttctgttccaaaaattc

SEQ ID NO: 173487 - DNA, 23 bp, Artificial sequence
  SiRNA target sequence
gatttttctgttccaaaaattcc

SEQ ID NO: 173488 - DNA, 23 bp, Artificial sequence
  SiRNA target sequence
atttttctgttccaaaaattcct

SEQ ID NO: 173489 - DNA, 23 bp, Artificial sequence
  SiRNA target sequence
tttttctgttccaaaaattccta

SEQ ID NO: 173490 - DNA, 23 bp, Artificial sequence
  SiRNA target sequence
ttttctgttccaaaaattcctac

SEQ ID NO: 173491 - DNA, 23 bp, Artificial sequence
  SiRNA target sequence
tttctgttccaaaaattcctact

SEQ ID NO: 173492 - DNA, 23 bp, Artificial sequence
  SiRNA target sequence
ttctgttccaaaaattcctactt

SEQ ID NO: 173493 - DNA, 23 bp, Artificial sequence
  SiRNA target sequence
tctgttccaaaaattcctactta

SEQ ID NO: 173494 - DNA, 23 bp, Artificial sequence
  SiRNA target sequence
ctgttccaaaaattcctacttac

SEQ ID NO: 173495 - DNA, 23 bp, Artificial sequence
  SiRNA target sequence
tgttccaaaaattcctacttaca

SEQ ID NO: 173496 - DNA, 23 bp, Artificial sequence
  SiRNA target sequence
gttccaaaaattcctacttacac

SEQ ID NO: 173497 - DNA, 23 bp, Artificial sequence
  SiRNA target sequence
ttccaaaaattcctacttacaca

SEQ ID NO: 173498 - DNA, 23 bp, Artificial sequence
  SiRNA target sequence
tccaaaaattcctacttacacag

SEQ ID NO: 173499 - DNA, 23 bp, Artificial sequence
  SiRNA target sequence
ccaaaaattcctacttacacaga

SEQ ID NO: 173500 - DNA, 23 bp, Artificial sequence
  SiRNA target sequence
caaaaattcctacttacacagaa

SEQ ID NO: 173501 - DNA, 23 bp, Artificial sequence
  SiRNA target sequence
aaaaattcctacttacacagaac

SEQ ID NO: 173502 - DNA, 23 bp, Artificial sequence
  SiRNA target sequence
aaaattcctacttacacagaact

SEQ ID NO: 173503 - DNA, 23 bp, Artificial sequence
  SiRNA target sequence
aaattcctacttacacagaactg

SEQ ID NO: 173504 - DNA, 23 bp, Artificial sequence
  SiRNA target sequence
aattcctacttacacagaactga

SEQ ID NO: 173505 - DNA, 23 bp, Artificial sequence
  SiRNA target sequence
attcctacttacacagaactgaa

SEQ ID NO: 173506 - DNA, 23 bp, Artificial sequence
  SiRNA target sequence
ttcctacttacacagaactgaaa

SEQ ID NO: 173507 - DNA, 23 bp, Artificial sequence
  SiRNA target sequence
tcctacttacacagaactgaaag

SEQ ID NO: 173508 - DNA, 23 bp, Artificial sequence
  SiRNA target sequence
cctacttacacagaactgaaaga

SEQ ID NO: 173509 - DNA, 23 bp, Artificial sequence
  SiRNA target sequence
ctacttacacagaactgaaagat

SEQ ID NO: 173510 - DNA, 23 bp, Artificial sequence
  SiRNA target sequence
tacttacacagaactgaaagatg

SEQ ID NO: 173511 - DNA, 23 bp, Artificial sequence
  SiRNA target sequence
acttacacagaactgaaagatgt

SEQ ID NO: 173512 - DNA, 23 bp, Artificial sequence
  SiRNA target sequence
cttacacagaactgaaagatgtc

SEQ ID NO: 173513 - DNA, 23 bp, Artificial sequence
  SiRNA target sequence
ttacacagaactgaaagatgtcc

SEQ ID NO: 173514 - DNA, 23 bp, Artificial sequence
  SiRNA target sequence
tacacagaactgaaagatgtccc

SEQ ID NO: 173515 - DNA, 23 bp, Artificial sequence
  SiRNA target sequence
acacagaactgaaagatgtccct

SEQ ID NO: 173516 - DNA, 23 bp, Artificial sequence
  SiRNA target sequence
cacagaactgaaagatgtccctt

SEQ ID NO: 173517 - DNA, 23 bp, Artificial sequence
  SiRNA target sequence
acagaactgaaagatgtcccttt

SEQ ID NO: 173518 - DNA, 23 bp, Artificial sequence
  SiRNA target sequence
cagaactgaaagatgtcccttta

SEQ ID NO: 173519 - DNA, 23 bp, Artificial sequence
  SiRNA target sequence
agaactgaaagatgtccctttaa

SEQ ID NO: 173520 - DNA, 23 bp, Artificial sequence
  SiRNA target sequence
gaactgaaagatgtccctttaac

SEQ ID NO: 173521 - DNA, 23 bp, Artificial sequence
  SiRNA target sequence
aactgaaagatgtccctttaaca

SEQ ID NO: 173522 - DNA, 23 bp, Artificial sequence
  SiRNA target sequence
actgaaagatgtccctttaacat

SEQ ID NO: 173523 - DNA, 23 bp, Artificial sequence
  SiRNA target sequence
ctgaaagatgtccctttaacatt

SEQ ID NO: 173524 - DNA, 23 bp, Artificial sequence
  SiRNA target sequence
tgaaagatgtccctttaacattt

SEQ ID NO: 173525 - DNA, 23 bp, Artificial sequence
  SiRNA target sequence
gaaagatgtccctttaacatttt

SEQ ID NO: 173526 - DNA, 23 bp, Artificial sequence
  SiRNA target sequence
aaagatgtccctttaacattttt

SEQ ID NO: 173527 - DNA, 23 bp, Artificial sequence
  SiRNA target sequence
aagatgtccctttaacattttta

SEQ ID NO: 173528 - DNA, 23 bp, Artificial sequence
  SiRNA target sequence
agatgtccctttaacatttttat

SEQ ID NO: 173529 - DNA, 23 bp, Artificial sequence
  SiRNA target sequence
gatgtccctttaacatttttatt

SEQ ID NO: 173530 - DNA, 23 bp, Artificial sequence
  SiRNA target sequence
atgtccctttaacatttttatta

SEQ ID NO: 173531 - DNA, 23 bp, Artificial sequence
  SiRNA target sequence
tgtccctttaacatttttattat

SEQ ID NO: 173532 - DNA, 23 bp, Artificial sequence
  SiRNA target sequence
gtccctttaacatttttattatc

SEQ ID NO: 173533 - DNA, 23 bp, Artificial sequence
  SiRNA target sequence
tccctttaacatttttattatca

SEQ ID NO: 173534 - DNA, 23 bp, Artificial sequence
  SiRNA target sequence
ccctttaacatttttattatcac

SEQ ID NO: 173535 - DNA, 23 bp, Artificial sequence
  SiRNA target sequence
cctttaacatttttattatcacc

SEQ ID NO: 173536 - DNA, 23 bp, Artificial sequence
  SiRNA target sequence
ctttaacatttttattatcacca

SEQ ID NO: 173537 - DNA, 23 bp, Artificial sequence
  SiRNA target sequence
tttaacatttttattatcaccac

SEQ ID NO: 173538 - DNA, 23 bp, Artificial sequence
  SiRNA target sequence
ttaacatttttattatcaccaca

SEQ ID NO: 173539 - DNA, 23 bp, Artificial sequence
  SiRNA target sequence
taacatttttattatcaccacat

SEQ ID NO: 173540 - DNA, 23 bp, Artificial sequence
  SiRNA target sequence
aacatttttattatcaccacatt

SEQ ID NO: 173541 - DNA, 23 bp, Artificial sequence
  SiRNA target sequence
acatttttattatcaccacattc

SEQ ID NO: 173542 - DNA, 23 bp, Artificial sequence
  SiRNA target sequence
catttttattatcaccacattcg

SEQ ID NO: 173543 - DNA, 23 bp, Artificial sequence
  SiRNA target sequence
atttttattatcaccacattcga

SEQ ID NO: 173544 - DNA, 23 bp, Artificial sequence
  SiRNA target sequence
tttttattatcaccacattcgaa

SEQ ID NO: 173545 - DNA, 23 bp, Artificial sequence
  SiRNA target sequence
ttttattatcaccacattcgaaa

SEQ ID NO: 173546 - DNA, 23 bp, Artificial sequence
  SiRNA target sequence
tttattatcaccacattcgaaaa

SEQ ID NO: 173547 - DNA, 23 bp, Artificial sequence
  SiRNA target sequence
ttattatcaccacattcgaaaat

SEQ ID NO: 173548 - DNA, 23 bp, Artificial sequence
  SiRNA target sequence
tattatcaccacattcgaaaatg

SEQ ID NO: 173549 - DNA, 23 bp, Artificial sequence
  SiRNA target sequence
attatcaccacattcgaaaatga

SEQ ID NO: 173550 - DNA, 23 bp, Artificial sequence
  SiRNA target sequence
ttatcaccacattcgaaaatgaa

SEQ ID NO: 173551 - DNA, 23 bp, Artificial sequence
  SiRNA target sequence
tatcaccacattcgaaaatgaat

SEQ ID NO: 173552 - DNA, 23 bp, Artificial sequence
  SiRNA target sequence
atcaccacattcgaaaatgaata

SEQ ID NO: 173553 - DNA, 23 bp, Artificial sequence
  SiRNA target sequence
tcaccacattcgaaaatgaatat

SEQ ID NO: 173554 - DNA, 23 bp, Artificial sequence
  SiRNA target sequence
caccacattcgaaaatgaatatg

SEQ ID NO: 173555 - DNA, 23 bp, Artificial sequence
  SiRNA target sequence
accacattcgaaaatgaatatgt

SEQ ID NO: 173556 - DNA, 23 bp, Artificial sequence
  SiRNA target sequence
ccacattcgaaaatgaatatgta

SEQ ID NO: 173557 - DNA, 23 bp, Artificial sequence
  SiRNA target sequence
cacattcgaaaatgaatatgtat

SEQ ID NO: 173558 - DNA, 23 bp, Artificial sequence
  SiRNA target sequence
acattcgaaaatgaatatgtatg

SEQ ID NO: 173559 - DNA, 23 bp, Artificial sequence
  SiRNA target sequence
cattcgaaaatgaatatgtatgc

SEQ ID NO: 173560 - DNA, 23 bp, Artificial sequence
  SiRNA target sequence
attcgaaaatgaatatgtatgca

SEQ ID NO: 173561 - DNA, 23 bp, Artificial sequence
  SiRNA target sequence
ttcgaaaatgaatatgtatgcac

SEQ ID NO: 173562 - DNA, 23 bp, Artificial sequence
  SiRNA target sequence
tcgaaaatgaatatgtatgcaca

SEQ ID NO: 173563 - DNA, 23 bp, Artificial sequence
  SiRNA target sequence
cgaaaatgaatatgtatgcacac

SEQ ID NO: 173564 - DNA, 23 bp, Artificial sequence
  SiRNA target sequence
gaaaatgaatatgtatgcacact

SEQ ID NO: 173565 - DNA, 23 bp, Artificial sequence
  SiRNA target sequence
aaaatgaatatgtatgcacacta

SEQ ID NO: 173566 - DNA, 23 bp, Artificial sequence
  SiRNA target sequence
aaatgaatatgtatgcacactat

SEQ ID NO: 173567 - DNA, 23 bp, Artificial sequence
  SiRNA target sequence
aatgaatatgtatgcacactata

SEQ ID NO: 173568 - DNA, 23 bp, Artificial sequence
  SiRNA target sequence
atgaatatgtatgcacactataa

SEQ ID NO: 173569 - DNA, 23 bp, Artificial sequence
  SiRNA target sequence
tgaatatgtatgcacactataac

SEQ ID NO: 173570 - DNA, 23 bp, Artificial sequence
  SiRNA target sequence
gaatatgtatgcacactataaca

SEQ ID NO: 173571 - DNA, 23 bp, Artificial sequence
  SiRNA target sequence
aatatgtatgcacactataacaa

SEQ ID NO: 173572 - DNA, 23 bp, Artificial sequence
  SiRNA target sequence
atatgtatgcacactataacaat

SEQ ID NO: 173573 - DNA, 23 bp, Artificial sequence
  SiRNA target sequence
tatgtatgcacactataacaatc

SEQ ID NO: 173574 - DNA, 23 bp, Artificial sequence
  SiRNA target sequence
atgtatgcacactataacaatca

SEQ ID NO: 173575 - DNA, 23 bp, Artificial sequence
  SiRNA target sequence
tgtatgcacactataacaatcat

SEQ ID NO: 173576 - DNA, 23 bp, Artificial sequence
  SiRNA target sequence
gtatgcacactataacaatcata

SEQ ID NO: 173577 - DNA, 23 bp, Artificial sequence
  SiRNA target sequence
tatgcacactataacaatcatat

SEQ ID NO: 173578 - DNA, 23 bp, Artificial sequence
  SiRNA target sequence
atgcacactataacaatcatata

SEQ ID NO: 173579 - DNA, 23 bp, Artificial sequence
  SiRNA target sequence
tgcacactataacaatcatataa

SEQ ID NO: 173580 - DNA, 23 bp, Artificial sequence
  SiRNA target sequence
gcacactataacaatcatataat

SEQ ID NO: 173581 - DNA, 23 bp, Artificial sequence
  SiRNA target sequence
cacactataacaatcatataatg

SEQ ID NO: 173582 - DNA, 23 bp, Artificial sequence
  SiRNA target sequence
acactataacaatcatataatgt

SEQ ID NO: 173583 - DNA, 23 bp, Artificial sequence
  SiRNA target sequence
cactataacaatcatataatgtc

SEQ ID NO: 173584 - DNA, 23 bp, Artificial sequence
  SiRNA target sequence
actataacaatcatataatgtcc

SEQ ID NO: 173585 - DNA, 23 bp, Artificial sequence
  SiRNA target sequence
ctataacaatcatataatgtcct

SEQ ID NO: 173586 - DNA, 23 bp, Artificial sequence
  SiRNA target sequence
tataacaatcatataatgtcctt

SEQ ID NO: 173587 - DNA, 23 bp, Artificial sequence
  SiRNA target sequence
ataacaatcatataatgtccttt

SEQ ID NO: 173588 - DNA, 23 bp, Artificial sequence
  SiRNA target sequence
taacaatcatataatgtccttta

SEQ ID NO: 173589 - DNA, 23 bp, Artificial sequence
  SiRNA target sequence
aacaatcatataatgtcctttag

SEQ ID NO: 173590 - DNA, 23 bp, Artificial sequence
  SiRNA target sequence
acaatcatataatgtcctttagt

SEQ ID NO: 173591 - DNA, 23 bp, Artificial sequence
  SiRNA target sequence
caatcatataatgtcctttagtg

SEQ ID NO: 173592 - DNA, 23 bp, Artificial sequence
  SiRNA target sequence
aatcatataatgtcctttagtga

SEQ ID NO: 173593 - DNA, 23 bp, Artificial sequence
  SiRNA target sequence
atcatataatgtcctttagtgat

SEQ ID NO: 173594 - DNA, 23 bp, Artificial sequence
  SiRNA target sequence
tcatataatgtcctttagtgatt

SEQ ID NO: 173595 - DNA, 23 bp, Artificial sequence
  SiRNA target sequence
catataatgtcctttagtgattt

SEQ ID NO: 173596 - DNA, 23 bp, Artificial sequence
  SiRNA target sequence
atataatgtcctttagtgatttt

SEQ ID NO: 173597 - DNA, 23 bp, Artificial sequence
  SiRNA target sequence
tataatgtcctttagtgattttg

SEQ ID NO: 173598 - DNA, 23 bp, Artificial sequence
  SiRNA target sequence
ataatgtcctttagtgattttga

SEQ ID NO: 173599 - DNA, 23 bp, Artificial sequence
  SiRNA target sequence
taatgtcctttagtgattttgaa

SEQ ID NO: 173600 - DNA, 23 bp, Artificial sequence
  SiRNA target sequence
aatgtcctttagtgattttgaat

SEQ ID NO: 173601 - DNA, 23 bp, Artificial sequence
  SiRNA target sequence
atgtcctttagtgattttgaata

SEQ ID NO: 173602 - DNA, 23 bp, Artificial sequence
  SiRNA target sequence
tgtcctttagtgattttgaatat

SEQ ID NO: 173603 - DNA, 23 bp, Artificial sequence
  SiRNA target sequence
gtcctttagtgattttgaatatc

SEQ ID NO: 173604 - DNA, 23 bp, Artificial sequence
  SiRNA target sequence
tcctttagtgattttgaatatca

SEQ ID NO: 173605 - DNA, 23 bp, Artificial sequence
  SiRNA target sequence
cctttagtgattttgaatatcac

SEQ ID NO: 173606 - DNA, 23 bp, Artificial sequence
  SiRNA target sequence
ctttagtgattttgaatatcact

SEQ ID NO: 173607 - DNA, 23 bp, Artificial sequence
  SiRNA target sequence
tttagtgattttgaatatcactt

SEQ ID NO: 173608 - DNA, 23 bp, Artificial sequence
  SiRNA target sequence
ttagtgattttgaatatcactta

SEQ ID NO: 173609 - DNA, 23 bp, Artificial sequence
  SiRNA target sequence
tagtgattttgaatatcacttaa

SEQ ID NO: 173610 - DNA, 23 bp, Artificial sequence
  SiRNA target sequence
agtgattttgaatatcacttaat

SEQ ID NO: 173611 - DNA, 23 bp, Artificial sequence
  SiRNA target sequence
gtgattttgaatatcacttaatt

SEQ ID NO: 173612 - DNA, 23 bp, Artificial sequence
  SiRNA target sequence
tgattttgaatatcacttaattt

SEQ ID NO: 173613 - DNA, 23 bp, Artificial sequence
  SiRNA target sequence
gattttgaatatcacttaatttc

SEQ ID NO: 173614 - DNA, 23 bp, Artificial sequence
  SiRNA target sequence
attttgaatatcacttaatttca

SEQ ID NO: 173615 - DNA, 23 bp, Artificial sequence
  SiRNA target sequence
ttttgaatatcacttaatttcat

SEQ ID NO: 173616 - DNA, 23 bp, Artificial sequence
  SiRNA target sequence
tttgaatatcacttaatttcatt

SEQ ID NO: 173617 - DNA, 23 bp, Artificial sequence
  SiRNA target sequence
ttgaatatcacttaatttcattt

SEQ ID NO: 173618 - DNA, 23 bp, Artificial sequence
  SiRNA target sequence
tgaatatcacttaatttcattta

SEQ ID NO: 173619 - DNA, 23 bp, Artificial sequence
  SiRNA target sequence
gaatatcacttaatttcatttat

SEQ ID NO: 173620 - DNA, 23 bp, Artificial sequence
  SiRNA target sequence
aatatcacttaatttcatttata

SEQ ID NO: 173621 - DNA, 23 bp, Artificial sequence
  SiRNA target sequence
atatcacttaatttcatttataa

SEQ ID NO: 173622 - DNA, 23 bp, Artificial sequence
  SiRNA target sequence
tatcacttaatttcatttataaa

SEQ ID NO: 173623 - DNA, 23 bp, Artificial sequence
  SiRNA target sequence
atcacttaatttcatttataaaa

SEQ ID NO: 173624 - DNA, 23 bp, Artificial sequence
  SiRNA target sequence
tcacttaatttcatttataaaac

SEQ ID NO: 173625 - DNA, 23 bp, Artificial sequence
  SiRNA target sequence
cacttaatttcatttataaaact

SEQ ID NO: 173626 - DNA, 23 bp, Artificial sequence
  SiRNA target sequence
acttaatttcatttataaaacta

SEQ ID NO: 173627 - DNA, 23 bp, Artificial sequence
  SiRNA target sequence
cttaatttcatttataaaactaa

SEQ ID NO: 173628 - DNA, 23 bp, Artificial sequence
  SiRNA target sequence
ttaatttcatttataaaactaaa

SEQ ID NO: 173629 - DNA, 23 bp, Artificial sequence
  SiRNA target sequence
taatttcatttataaaactaaaa

SEQ ID NO: 173630 - DNA, 23 bp, Artificial sequence
  SiRNA target sequence
aatttcatttataaaactaaaat

SEQ ID NO: 173631 - DNA, 23 bp, Artificial sequence
  SiRNA target sequence
atttcatttataaaactaaaatt

SEQ ID NO: 173632 - DNA, 23 bp, Artificial sequence
  SiRNA target sequence
tttcatttataaaactaaaattt

SEQ ID NO: 173633 - DNA, 23 bp, Artificial sequence
  SiRNA target sequence
ttcatttataaaactaaaattta

SEQ ID NO: 173634 - DNA, 23 bp, Artificial sequence
  SiRNA target sequence
tcatttataaaactaaaatttaa

SEQ ID NO: 173635 - DNA, 23 bp, Artificial sequence
  SiRNA target sequence
catttataaaactaaaatttaat

SEQ ID NO: 173636 - DNA, 23 bp, Artificial sequence
  SiRNA target sequence
atttataaaactaaaatttaatg

SEQ ID NO: 173637 - DNA, 23 bp, Artificial sequence
  SiRNA target sequence
tttataaaactaaaatttaatgt

SEQ ID NO: 173638 - DNA, 23 bp, Artificial sequence
  SiRNA target sequence
ttataaaactaaaatttaatgta

SEQ ID NO: 173639 - DNA, 23 bp, Artificial sequence
  SiRNA target sequence
tataaaactaaaatttaatgtaa

SEQ ID NO: 173640 - DNA, 23 bp, Artificial sequence
  SiRNA target sequence
ataaaactaaaatttaatgtaat

SEQ ID NO: 173641 - DNA, 23 bp, Artificial sequence
  SiRNA target sequence
taaaactaaaatttaatgtaata

SEQ ID NO: 173642 - DNA, 23 bp, Artificial sequence
  SiRNA target sequence
aaaactaaaatttaatgtaataa

SEQ ID NO: 173643 - DNA, 23 bp, Artificial sequence
  SiRNA target sequence
aaactaaaatttaatgtaataaa

SEQ ID NO: 173644 - DNA, 23 bp, Artificial sequence
  SiRNA target sequence
aactaaaatttaatgtaataaaa

SEQ ID NO: 173645 - DNA, 23 bp, Artificial sequence
  SiRNA target sequence
actaaaatttaatgtaataaaag

SEQ ID NO: 173646 - DNA, 23 bp, Artificial sequence
  SiRNA target sequence
ctaaaatttaatgtaataaaagt

SEQ ID NO: 173647 - DNA, 23 bp, Artificial sequence
  SiRNA target sequence
taaaatttaatgtaataaaagta

SEQ ID NO: 173648 - DNA, 23 bp, Artificial sequence
  SiRNA target sequence
aaaatttaatgtaataaaagtat

SEQ ID NO: 173649 - DNA, 23 bp, Artificial sequence
  SiRNA target sequence
aaatttaatgtaataaaagtata

SEQ ID NO: 173650 - DNA, 23 bp, Artificial sequence
  SiRNA target sequence
aatttaatgtaataaaagtatat

SEQ ID NO: 173651 - DNA, 23 bp, Artificial sequence
  SiRNA target sequence
atttaatgtaataaaagtatatg

SEQ ID NO: 173652 - DNA, 23 bp, Artificial sequence
  SiRNA target sequence
tttaatgtaataaaagtatatga

SEQ ID NO: 173653 - DNA, 23 bp, Artificial sequence
  SiRNA target sequence
ttaatgtaataaaagtatatgat

SEQ ID NO: 173654 - DNA, 23 bp, Artificial sequence
  SiRNA target sequence
taatgtaataaaagtatatgata

SEQ ID NO: 173655 - DNA, 23 bp, Artificial sequence
  SiRNA target sequence
aatgtaataaaagtatatgatac

SEQ ID NO: 173656 - DNA, 23 bp, Artificial sequence
  SiRNA target sequence
atgtaataaaagtatatgataca

SEQ ID NO: 173657 - DNA, 23 bp, Artificial sequence
  SiRNA target sequence
tgtaataaaagtatatgatacat

SEQ ID NO: 173658 - DNA, 23 bp, Artificial sequence
  SiRNA target sequence
gtaataaaagtatatgatacatc

SEQ ID NO: 173659 - DNA, 23 bp, Artificial sequence
  SiRNA target sequence
taataaaagtatatgatacatct

SEQ ID NO: 173660 - DNA, 23 bp, Artificial sequence
  SiRNA target sequence
aataaaagtatatgatacatctt

SEQ ID NO: 173661 - DNA, 23 bp, Artificial sequence
  SiRNA target sequence
ataaaagtatatgatacatctta

SEQ ID NO: 173662 - DNA, 23 bp, Artificial sequence
  SiRNA target sequence
taaaagtatatgatacatcttat

SEQ ID NO: 173663 - DNA, 23 bp, Artificial sequence
  SiRNA target sequence
aaaagtatatgatacatcttatg

SEQ ID NO: 173664 - DNA, 23 bp, Artificial sequence
  SiRNA target sequence
aaagtatatgatacatcttatgt

SEQ ID NO: 173665 - DNA, 23 bp, Artificial sequence
  SiRNA target sequence
aagtatatgatacatcttatgtc

SEQ ID NO: 173666 - DNA, 23 bp, Artificial sequence
  SiRNA target sequence
agtatatgatacatcttatgtca

SEQ ID NO: 173667 - DNA, 23 bp, Artificial sequence
  SiRNA target sequence
gtatatgatacatcttatgtcaa

SEQ ID NO: 173668 - DNA, 23 bp, Artificial sequence
  SiRNA target sequence
tatatgatacatcttatgtcaaa

SEQ ID NO: 173669 - DNA, 23 bp, Artificial sequence
  SiRNA target sequence
atatgatacatcttatgtcaaaa

SEQ ID NO: 173670 - DNA, 23 bp, Artificial sequence
  SiRNA target sequence
tatgatacatcttatgtcaaaaa

SEQ ID NO: 173671 - DNA, 23 bp, Artificial sequence
  SiRNA target sequence
atgatacatcttatgtcaaaaat

SEQ ID NO: 173672 - DNA, 23 bp, Artificial sequence
  SiRNA target sequence
tgatacatcttatgtcaaaaata

SEQ ID NO: 173673 - DNA, 23 bp, Artificial sequence
  SiRNA target sequence
gatacatcttatgtcaaaaatat

SEQ ID NO: 173674 - DNA, 23 bp, Artificial sequence
  SiRNA target sequence
atacatcttatgtcaaaaatatt

SEQ ID NO: 173675 - DNA, 23 bp, Artificial sequence
  SiRNA target sequence
tacatcttatgtcaaaaatattc

SEQ ID NO: 173676 - DNA, 23 bp, Artificial sequence
  SiRNA target sequence
acatcttatgtcaaaaatattct

SEQ ID NO: 173677 - DNA, 23 bp, Artificial sequence
  SiRNA target sequence
catcttatgtcaaaaatattctg

SEQ ID NO: 173678 - DNA, 23 bp, Artificial sequence
  SiRNA target sequence
atcttatgtcaaaaatattctgt

SEQ ID NO: 173679 - DNA, 23 bp, Artificial sequence
  SiRNA target sequence
tcttatgtcaaaaatattctgta

SEQ ID NO: 173680 - DNA, 23 bp, Artificial sequence
  SiRNA target sequence
cttatgtcaaaaatattctgtat

SEQ ID NO: 173681 - DNA, 23 bp, Artificial sequence
  SiRNA target sequence
ttatgtcaaaaatattctgtatg

SEQ ID NO: 173682 - DNA, 23 bp, Artificial sequence
  SiRNA target sequence
tatgtcaaaaatattctgtatga

SEQ ID NO: 173683 - DNA, 23 bp, Artificial sequence
  SiRNA target sequence
atgtcaaaaatattctgtatgat

SEQ ID NO: 173684 - DNA, 23 bp, Artificial sequence
  SiRNA target sequence
tgtcaaaaatattctgtatgata

SEQ ID NO: 173685 - DNA, 23 bp, Artificial sequence
  SiRNA target sequence
gtcaaaaatattctgtatgatag

SEQ ID NO: 173686 - DNA, 23 bp, Artificial sequence
  SiRNA target sequence
tcaaaaatattctgtatgatagt

SEQ ID NO: 173687 - DNA, 23 bp, Artificial sequence
  SiRNA target sequence
caaaaatattctgtatgatagtg

SEQ ID NO: 173688 - DNA, 23 bp, Artificial sequence
  SiRNA target sequence
aaaaatattctgtatgatagtgt

SEQ ID NO: 173689 - DNA, 23 bp, Artificial sequence
  SiRNA target sequence
aaaatattctgtatgatagtgtt

SEQ ID NO: 173690 - DNA, 23 bp, Artificial sequence
  SiRNA target sequence
aaatattctgtatgatagtgttt

SEQ ID NO: 173691 - DNA, 23 bp, Artificial sequence
  SiRNA target sequence
aatattctgtatgatagtgttta

SEQ ID NO: 173692 - DNA, 23 bp, Artificial sequence
  SiRNA target sequence
atattctgtatgatagtgtttat

SEQ ID NO: 173693 - DNA, 23 bp, Artificial sequence
  SiRNA target sequence
tattctgtatgatagtgtttatg

SEQ ID NO: 173694 - DNA, 23 bp, Artificial sequence
  SiRNA target sequence
attctgtatgatagtgtttatga

SEQ ID NO: 173695 - DNA, 23 bp, Artificial sequence
  SiRNA target sequence
ttctgtatgatagtgtttatgag

SEQ ID NO: 173696 - DNA, 23 bp, Artificial sequence
  SiRNA target sequence
tctgtatgatagtgtttatgagg

SEQ ID NO: 173697 - DNA, 23 bp, Artificial sequence
  SiRNA target sequence
ctgtatgatagtgtttatgagga

SEQ ID NO: 173698 - DNA, 23 bp, Artificial sequence
  SiRNA target sequence
tgtatgatagtgtttatgaggaa

SEQ ID NO: 173699 - DNA, 23 bp, Artificial sequence
  SiRNA target sequence
gtatgatagtgtttatgaggaaa

SEQ ID NO: 173700 - DNA, 23 bp, Artificial sequence
  SiRNA target sequence
tatgatagtgtttatgaggaaag

SEQ ID NO: 173701 - DNA, 23 bp, Artificial sequence
  SiRNA target sequence
atgatagtgtttatgaggaaagc

SEQ ID NO: 173702 - DNA, 23 bp, Artificial sequence
  SiRNA target sequence
tgatagtgtttatgaggaaagca

SEQ ID NO: 173703 - DNA, 23 bp, Artificial sequence
  SiRNA target sequence
gatagtgtttatgaggaaagcac

SEQ ID NO: 173704 - DNA, 23 bp, Artificial sequence
  SiRNA target sequence
atagtgtttatgaggaaagcacg

SEQ ID NO: 173705 - DNA, 23 bp, Artificial sequence
  SiRNA target sequence
tagtgtttatgaggaaagcacga

SEQ ID NO: 173706 - DNA, 23 bp, Artificial sequence
  SiRNA target sequence
agtgtttatgaggaaagcacgag

SEQ ID NO: 173707 - DNA, 23 bp, Artificial sequence
  SiRNA target sequence
gtgtttatgaggaaagcacgaga

SEQ ID NO: 173708 - DNA, 23 bp, Artificial sequence
  SiRNA target sequence
tgtttatgaggaaagcacgagag

SEQ ID NO: 173709 - DNA, 23 bp, Artificial sequence
  SiRNA target sequence
gtttatgaggaaagcacgagaga

SEQ ID NO: 173710 - DNA, 23 bp, Artificial sequence
  SiRNA target sequence
tttatgaggaaagcacgagagac

SEQ ID NO: 173711 - DNA, 23 bp, Artificial sequence
  SiRNA target sequence
ttatgaggaaagcacgagagaca

SEQ ID NO: 173712 - DNA, 23 bp, Artificial sequence
  SiRNA target sequence
tatgaggaaagcacgagagacaa

SEQ ID NO: 173713 - DNA, 23 bp, Artificial sequence
  SiRNA target sequence
atgaggaaagcacgagagacaaa

SEQ ID NO: 173714 - DNA, 23 bp, Artificial sequence
  SiRNA target sequence
tgaggaaagcacgagagacaaaa

SEQ ID NO: 173715 - DNA, 23 bp, Artificial sequence
  SiRNA target sequence
gaggaaagcacgagagacaaaat

SEQ ID NO: 173716 - DNA, 23 bp, Artificial sequence
  SiRNA target sequence
aggaaagcacgagagacaaaata

SEQ ID NO: 173717 - DNA, 23 bp, Artificial sequence
  SiRNA target sequence
ggaaagcacgagagacaaaataa

SEQ ID NO: 173718 - DNA, 23 bp, Artificial sequence
  SiRNA target sequence
gaaagcacgagagacaaaataat

SEQ ID NO: 173719 - DNA, 23 bp, Artificial sequence
  SiRNA target sequence
aaagcacgagagacaaaataata

SEQ ID NO: 173720 - DNA, 23 bp, Artificial sequence
  SiRNA target sequence
aagcacgagagacaaaataataa

SEQ ID NO: 173721 - DNA, 23 bp, Artificial sequence
  SiRNA target sequence
agcacgagagacaaaataataat

SEQ ID NO: 173722 - DNA, 23 bp, Artificial sequence
  SiRNA target sequence
gcacgagagacaaaataataata

SEQ ID NO: 173723 - DNA, 23 bp, Artificial sequence
  SiRNA target sequence
cacgagagacaaaataataataa

SEQ ID NO: 173724 - DNA, 23 bp, Artificial sequence
  SiRNA target sequence
acgagagacaaaataataataag

SEQ ID NO: 173725 - DNA, 23 bp, Artificial sequence
  SiRNA target sequence
cgagagacaaaataataataagt

SEQ ID NO: 173726 - DNA, 23 bp, Artificial sequence
  SiRNA target sequence
gagagacaaaataataataagtg

SEQ ID NO: 173727 - DNA, 23 bp, Artificial sequence
  SiRNA target sequence
agagacaaaataataataagtga

SEQ ID NO: 173728 - DNA, 23 bp, Artificial sequence
  SiRNA target sequence
gagacaaaataataataagtgac

SEQ ID NO: 173729 - DNA, 23 bp, Artificial sequence
  SiRNA target sequence
agacaaaataataataagtgact

SEQ ID NO: 173730 - DNA, 23 bp, Artificial sequence
  SiRNA target sequence
gacaaaataataataagtgactg

SEQ ID NO: 173731 - DNA, 23 bp, Artificial sequence
  SiRNA target sequence
acaaaataataataagtgactgt

SEQ ID NO: 173732 - DNA, 23 bp, Artificial sequence
  SiRNA target sequence
caaaataataataagtgactgtc

SEQ ID NO: 173733 - DNA, 23 bp, Artificial sequence
  SiRNA target sequence
aaaataataataagtgactgtcc

SEQ ID NO: 173734 - DNA, 23 bp, Artificial sequence
  SiRNA target sequence
aaataataataagtgactgtcct

SEQ ID NO: 173735 - DNA, 23 bp, Artificial sequence
  SiRNA target sequence
aataataataagtgactgtcctg

SEQ ID NO: 173736 - DNA, 23 bp, Artificial sequence
  SiRNA target sequence
ataataataagtgactgtcctgg

SEQ ID NO: 173737 - DNA, 23 bp, Artificial sequence
  SiRNA target sequence
taataataagtgactgtcctggg

SEQ ID NO: 173738 - DNA, 23 bp, Artificial sequence
  SiRNA target sequence
aataataagtgactgtcctggga

SEQ ID NO: 173739 - DNA, 23 bp, Artificial sequence
  SiRNA target sequence
ataataagtgactgtcctgggac

SEQ ID NO: 173740 - DNA, 23 bp, Artificial sequence
  SiRNA target sequence
taataagtgactgtcctgggact

SEQ ID NO: 173741 - DNA, 23 bp, Artificial sequence
  SiRNA target sequence
aataagtgactgtcctgggactg

SEQ ID NO: 173742 - DNA, 23 bp, Artificial sequence
  SiRNA target sequence
ataagtgactgtcctgggactgt

SEQ ID NO: 173743 - DNA, 23 bp, Artificial sequence
  SiRNA target sequence
taagtgactgtcctgggactgtt

SEQ ID NO: 173744 - DNA, 23 bp, Artificial sequence
  SiRNA target sequence
aagtgactgtcctgggactgttt

SEQ ID NO: 173745 - DNA, 23 bp, Artificial sequence
  SiRNA target sequence
agtgactgtcctgggactgtttc

SEQ ID NO: 173746 - DNA, 23 bp, Artificial sequence
  SiRNA target sequence
gtgactgtcctgggactgtttca

SEQ ID NO: 173747 - DNA, 23 bp, Artificial sequence
  SiRNA target sequence
tgactgtcctgggactgtttcat

SEQ ID NO: 173748 - DNA, 23 bp, Artificial sequence
  SiRNA target sequence
gactgtcctgggactgtttcata

SEQ ID NO: 173749 - DNA, 23 bp, Artificial sequence
  SiRNA target sequence
actgtcctgggactgtttcatat

SEQ ID NO: 173750 - DNA, 23 bp, Artificial sequence
  SiRNA target sequence
ctgtcctgggactgtttcatata

SEQ ID NO: 173751 - DNA, 23 bp, Artificial sequence
  SiRNA target sequence
tgtcctgggactgtttcatatat

SEQ ID NO: 173752 - DNA, 23 bp, Artificial sequence
  SiRNA target sequence
gtcctgggactgtttcatatatt

SEQ ID NO: 173753 - DNA, 23 bp, Artificial sequence
  SiRNA target sequence
tcctgggactgtttcatatattg

SEQ ID NO: 173754 - DNA, 23 bp, Artificial sequence
  SiRNA target sequence
cctgggactgtttcatatattga

SEQ ID NO: 173755 - DNA, 23 bp, Artificial sequence
  SiRNA target sequence
ctgggactgtttcatatattgaa

SEQ ID NO: 173756 - DNA, 23 bp, Artificial sequence
  SiRNA target sequence
tgggactgtttcatatattgaaa

SEQ ID NO: 173757 - DNA, 23 bp, Artificial sequence
  SiRNA target sequence
gggactgtttcatatattgaaag

SEQ ID NO: 173758 - DNA, 23 bp, Artificial sequence
  SiRNA target sequence
ggactgtttcatatattgaaagg

SEQ ID NO: 173759 - DNA, 23 bp, Artificial sequence
  SiRNA target sequence
gactgtttcatatattgaaaggc

SEQ ID NO: 173760 - DNA, 23 bp, Artificial sequence
  SiRNA target sequence
actgtttcatatattgaaaggca

SEQ ID NO: 173761 - DNA, 23 bp, Artificial sequence
  SiRNA target sequence
ctgtttcatatattgaaaggcaa

SEQ ID NO: 173762 - DNA, 23 bp, Artificial sequence
  SiRNA target sequence
tgtttcatatattgaaaggcaag

SEQ ID NO: 173763 - DNA, 23 bp, Artificial sequence
  SiRNA target sequence
gtttcatatattgaaaggcaagc

SEQ ID NO: 173764 - DNA, 23 bp, Artificial sequence
  SiRNA target sequence
tttcatatattgaaaggcaagca

SEQ ID NO: 173765 - DNA, 23 bp, Artificial sequence
  SiRNA target sequence
ttcatatattgaaaggcaagcac

SEQ ID NO: 173766 - DNA, 23 bp, Artificial sequence
  SiRNA target sequence
tcatatattgaaaggcaagcaca

SEQ ID NO: 173767 - DNA, 23 bp, Artificial sequence
  SiRNA target sequence
catatattgaaaggcaagcacac

SEQ ID NO: 173768 - DNA, 23 bp, Artificial sequence
  SiRNA target sequence
atatattgaaaggcaagcacacc

SEQ ID NO: 173769 - DNA, 23 bp, Artificial sequence
  SiRNA target sequence
tatattgaaaggcaagcacacca

SEQ ID NO: 173770 - DNA, 23 bp, Artificial sequence
  SiRNA target sequence
atattgaaaggcaagcacaccat

SEQ ID NO: 173771 - DNA, 23 bp, Artificial sequence
  SiRNA target sequence
tattgaaaggcaagcacaccatt

SEQ ID NO: 173772 - DNA, 23 bp, Artificial sequence
  SiRNA target sequence
attgaaaggcaagcacaccattt

SEQ ID NO: 173773 - DNA, 23 bp, Artificial sequence
  SiRNA target sequence
ttgaaaggcaagcacaccattta

SEQ ID NO: 173774 - DNA, 23 bp, Artificial sequence
  SiRNA target sequence
tgaaaggcaagcacaccatttaa

SEQ ID NO: 173775 - DNA, 23 bp, Artificial sequence
  SiRNA target sequence
gaaaggcaagcacaccatttaat

SEQ ID NO: 173776 - DNA, 23 bp, Artificial sequence
  SiRNA target sequence
aaaggcaagcacaccatttaatt

SEQ ID NO: 173777 - DNA, 23 bp, Artificial sequence
  SiRNA target sequence
aaggcaagcacaccatttaattg

SEQ ID NO: 173778 - DNA, 23 bp, Artificial sequence
  SiRNA target sequence
aggcaagcacaccatttaattga

SEQ ID NO: 173779 - DNA, 23 bp, Artificial sequence
  SiRNA target sequence
ggcaagcacaccatttaattgaa

SEQ ID NO: 173780 - DNA, 23 bp, Artificial sequence
  SiRNA target sequence
gcaagcacaccatttaattgaat

SEQ ID NO: 173781 - DNA, 23 bp, Artificial sequence
  SiRNA target sequence
caagcacaccatttaattgaata

SEQ ID NO: 173782 - DNA, 23 bp, Artificial sequence
  SiRNA target sequence
aagcacaccatttaattgaatat

SEQ ID NO: 173783 - DNA, 23 bp, Artificial sequence
  SiRNA target sequence
agcacaccatttaattgaatatt

SEQ ID NO: 173784 - DNA, 23 bp, Artificial sequence
  SiRNA target sequence
gcacaccatttaattgaatattt

SEQ ID NO: 173785 - DNA, 23 bp, Artificial sequence
  SiRNA target sequence
cacaccatttaattgaatattta

SEQ ID NO: 173786 - DNA, 23 bp, Artificial sequence
  SiRNA target sequence
acaccatttaattgaatatttat

SEQ ID NO: 173787 - DNA, 23 bp, Artificial sequence
  SiRNA target sequence
caccatttaattgaatatttatc

SEQ ID NO: 173788 - DNA, 23 bp, Artificial sequence
  SiRNA target sequence
accatttaattgaatatttatct

SEQ ID NO: 173789 - DNA, 23 bp, Artificial sequence
  SiRNA target sequence
ccatttaattgaatatttatctg

SEQ ID NO: 173790 - DNA, 23 bp, Artificial sequence
  SiRNA target sequence
catttaattgaatatttatctgt

SEQ ID NO: 173791 - DNA, 23 bp, Artificial sequence
  SiRNA target sequence
atttaattgaatatttatctgtt

SEQ ID NO: 173792 - DNA, 23 bp, Artificial sequence
  SiRNA target sequence
tttaattgaatatttatctgtta

SEQ ID NO: 173793 - DNA, 23 bp, Artificial sequence
  SiRNA target sequence
ttaattgaatatttatctgttac

SEQ ID NO: 173794 - DNA, 23 bp, Artificial sequence
  SiRNA target sequence
taattgaatatttatctgttact

SEQ ID NO: 173795 - DNA, 23 bp, Artificial sequence
  SiRNA target sequence
aattgaatatttatctgttactt

SEQ ID NO: 173796 - DNA, 23 bp, Artificial sequence
  SiRNA target sequence
attgaatatttatctgttacttc

SEQ ID NO: 173797 - DNA, 23 bp, Artificial sequence
  SiRNA target sequence
ttgaatatttatctgttacttct

SEQ ID NO: 173798 - DNA, 23 bp, Artificial sequence
  SiRNA target sequence
tgaatatttatctgttacttcta

SEQ ID NO: 173799 - DNA, 23 bp, Artificial sequence
  SiRNA target sequence
gaatatttatctgttacttctac

SEQ ID NO: 173800 - DNA, 23 bp, Artificial sequence
  SiRNA target sequence
aatatttatctgttacttctaca

SEQ ID NO: 173801 - DNA, 23 bp, Artificial sequence
  SiRNA target sequence
atatttatctgttacttctacac

SEQ ID NO: 173802 - DNA, 23 bp, Artificial sequence
  SiRNA target sequence
tatttatctgttacttctacaca

SEQ ID NO: 173803 - DNA, 23 bp, Artificial sequence
  SiRNA target sequence
atttatctgttacttctacacaa

SEQ ID NO: 173804 - DNA, 23 bp, Artificial sequence
  SiRNA target sequence
tttatctgttacttctacacaac

SEQ ID NO: 173805 - DNA, 23 bp, Artificial sequence
  SiRNA target sequence
ttatctgttacttctacacaaca

SEQ ID NO: 173806 - DNA, 23 bp, Artificial sequence
  SiRNA target sequence
tatctgttacttctacacaacaa

SEQ ID NO: 173807 - DNA, 23 bp, Artificial sequence
  SiRNA target sequence
atctgttacttctacacaacaac

SEQ ID NO: 173808 - DNA, 23 bp, Artificial sequence
  SiRNA target sequence
tctgttacttctacacaacaaca

SEQ ID NO: 173809 - DNA, 23 bp, Artificial sequence
  SiRNA target sequence
ctgttacttctacacaacaacaa

SEQ ID NO: 173810 - DNA, 23 bp, Artificial sequence
  SiRNA target sequence
tgttacttctacacaacaacaag

SEQ ID NO: 173811 - DNA, 23 bp, Artificial sequence
  SiRNA target sequence
gttacttctacacaacaacaagc

SEQ ID NO: 173812 - DNA, 23 bp, Artificial sequence
  SiRNA target sequence
ttacttctacacaacaacaagcc

SEQ ID NO: 173813 - DNA, 23 bp, Artificial sequence
  SiRNA target sequence
tacttctacacaacaacaagcca

SEQ ID NO: 173814 - DNA, 23 bp, Artificial sequence
  SiRNA target sequence
acttctacacaacaacaagccat

SEQ ID NO: 173815 - DNA, 23 bp, Artificial sequence
  SiRNA target sequence
cttctacacaacaacaagccata

SEQ ID NO: 173816 - DNA, 23 bp, Artificial sequence
  SiRNA target sequence
ttctacacaacaacaagccataa

SEQ ID NO: 173817 - DNA, 23 bp, Artificial sequence
  SiRNA target sequence
tctacacaacaacaagccataaa

SEQ ID NO: 173818 - DNA, 23 bp, Artificial sequence
  SiRNA target sequence
ctacacaacaacaagccataaag

SEQ ID NO: 173819 - DNA, 23 bp, Artificial sequence
  SiRNA target sequence
tacacaacaacaagccataaagc

SEQ ID NO: 173820 - DNA, 23 bp, Artificial sequence
  SiRNA target sequence
acacaacaacaagccataaagct

SEQ ID NO: 173821 - DNA, 23 bp, Artificial sequence
  SiRNA target sequence
cacaacaacaagccataaagcta

SEQ ID NO: 173822 - DNA, 23 bp, Artificial sequence
  SiRNA target sequence
acaacaacaagccataaagctac

SEQ ID NO: 173823 - DNA, 23 bp, Artificial sequence
  SiRNA target sequence
caacaacaagccataaagctact

SEQ ID NO: 173824 - DNA, 23 bp, Artificial sequence
  SiRNA target sequence
aacaacaagccataaagctactt

SEQ ID NO: 173825 - DNA, 23 bp, Artificial sequence
  SiRNA target sequence
acaacaagccataaagctacttg

SEQ ID NO: 173826 - DNA, 23 bp, Artificial sequence
  SiRNA target sequence
caacaagccataaagctacttgc

SEQ ID NO: 173827 - DNA, 23 bp, Artificial sequence
  SiRNA target sequence
aacaagccataaagctacttgct

SEQ ID NO: 173828 - DNA, 23 bp, Artificial sequence
  SiRNA target sequence
acaagccataaagctacttgctc

SEQ ID NO: 173829 - DNA, 23 bp, Artificial sequence
  SiRNA target sequence
caagccataaagctacttgctca

SEQ ID NO: 173830 - DNA, 23 bp, Artificial sequence
  SiRNA target sequence
aagccataaagctacttgctcag

SEQ ID NO: 173831 - DNA, 23 bp, Artificial sequence
  SiRNA target sequence
agccataaagctacttgctcagg

SEQ ID NO: 173832 - DNA, 23 bp, Artificial sequence
  SiRNA target sequence
gccataaagctacttgctcaggg

SEQ ID NO: 173833 - DNA, 23 bp, Artificial sequence
  SiRNA target sequence
ccataaagctacttgctcagggg

SEQ ID NO: 173834 - DNA, 23 bp, Artificial sequence
  SiRNA target sequence
cataaagctacttgctcaggggc

SEQ ID NO: 173835 - DNA, 23 bp, Artificial sequence
  SiRNA target sequence
ataaagctacttgctcaggggcg

SEQ ID NO: 173836 - DNA, 23 bp, Artificial sequence
  SiRNA target sequence
taaagctacttgctcaggggcga

SEQ ID NO: 173837 - DNA, 23 bp, Artificial sequence
  SiRNA target sequence
aaagctacttgctcaggggcgaa

SEQ ID NO: 173838 - DNA, 23 bp, Artificial sequence
  SiRNA target sequence
aagctacttgctcaggggcgaag

SEQ ID NO: 173839 - DNA, 23 bp, Artificial sequence
  SiRNA target sequence
agctacttgctcaggggcgaagt

SEQ ID NO: 173840 - DNA, 23 bp, Artificial sequence
  SiRNA target sequence
gctacttgctcaggggcgaagta

SEQ ID NO: 173841 - DNA, 23 bp, Artificial sequence
  SiRNA target sequence
ctacttgctcaggggcgaagtat

SEQ ID NO: 173842 - DNA, 23 bp, Artificial sequence
  SiRNA target sequence
tacttgctcaggggcgaagtata

SEQ ID NO: 173843 - DNA, 23 bp, Artificial sequence
  SiRNA target sequence
acttgctcaggggcgaagtataa

SEQ ID NO: 173844 - DNA, 23 bp, Artificial sequence
  SiRNA target sequence
cttgctcaggggcgaagtataag

SEQ ID NO: 173845 - DNA, 23 bp, Artificial sequence
  SiRNA target sequence
ttgctcaggggcgaagtataagt

SEQ ID NO: 173846 - DNA, 23 bp, Artificial sequence
  SiRNA target sequence
tgctcaggggcgaagtataagtg

SEQ ID NO: 173847 - DNA, 23 bp, Artificial sequence
  SiRNA target sequence
gctcaggggcgaagtataagtgt

SEQ ID NO: 173848 - DNA, 23 bp, Artificial sequence
  SiRNA target sequence
ctcaggggcgaagtataagtgtc

SEQ ID NO: 173849 - DNA, 23 bp, Artificial sequence
  SiRNA target sequence
tcaggggcgaagtataagtgtca

SEQ ID NO: 173850 - DNA, 23 bp, Artificial sequence
  SiRNA target sequence
caggggcgaagtataagtgtcat

SEQ ID NO: 173851 - DNA, 23 bp, Artificial sequence
  SiRNA target sequence
aggggcgaagtataagtgtcata

SEQ ID NO: 173852 - DNA, 23 bp, Artificial sequence
  SiRNA target sequence
ggggcgaagtataagtgtcatac

SEQ ID NO: 173853 - DNA, 23 bp, Artificial sequence
  SiRNA target sequence
gggcgaagtataagtgtcataca

SEQ ID NO: 173854 - DNA, 23 bp, Artificial sequence
  SiRNA target sequence
ggcgaagtataagtgtcatacag

SEQ ID NO: 173855 - DNA, 23 bp, Artificial sequence
  SiRNA target sequence
gcgaagtataagtgtcatacagt

SEQ ID NO: 173856 - DNA, 23 bp, Artificial sequence
  SiRNA target sequence
cgaagtataagtgtcatacagtg

SEQ ID NO: 173857 - DNA, 23 bp, Artificial sequence
  SiRNA target sequence
gaagtataagtgtcatacagtgc

SEQ ID NO: 173858 - DNA, 23 bp, Artificial sequence
  SiRNA target sequence
aagtataagtgtcatacagtgct

SEQ ID NO: 173859 - DNA, 23 bp, Artificial sequence
  SiRNA target sequence
agtataagtgtcatacagtgcta

SEQ ID NO: 173860 - DNA, 23 bp, Artificial sequence
  SiRNA target sequence
gtataagtgtcatacagtgctat

SEQ ID NO: 173861 - DNA, 23 bp, Artificial sequence
  SiRNA target sequence
tataagtgtcatacagtgctatg

SEQ ID NO: 173862 - DNA, 23 bp, Artificial sequence
  SiRNA target sequence
ataagtgtcatacagtgctatga

SEQ ID NO: 173863 - DNA, 23 bp, Artificial sequence
  SiRNA target sequence
taagtgtcatacagtgctatgat

SEQ ID NO: 173864 - DNA, 23 bp, Artificial sequence
  SiRNA target sequence
aagtgtcatacagtgctatgata

SEQ ID NO: 173865 - DNA, 23 bp, Artificial sequence
  SiRNA target sequence
agtgtcatacagtgctatgataa

SEQ ID NO: 173866 - DNA, 23 bp, Artificial sequence
  SiRNA target sequence
gtgtcatacagtgctatgataaa

SEQ ID NO: 173867 - DNA, 23 bp, Artificial sequence
  SiRNA target sequence
tgtcatacagtgctatgataaat

SEQ ID NO: 173868 - DNA, 23 bp, Artificial sequence
  SiRNA target sequence
gtcatacagtgctatgataaatt

SEQ ID NO: 173869 - DNA, 23 bp, Artificial sequence
  SiRNA target sequence
tcatacagtgctatgataaattt

SEQ ID NO: 173870 - DNA, 23 bp, Artificial sequence
  SiRNA target sequence
catacagtgctatgataaatttt

SEQ ID NO: 173871 - DNA, 23 bp, Artificial sequence
  SiRNA target sequence
atacagtgctatgataaattttt

SEQ ID NO: 173872 - DNA, 23 bp, Artificial sequence
  SiRNA target sequence
tacagtgctatgataaattttta

SEQ ID NO: 173873 - DNA, 23 bp, Artificial sequence
  SiRNA target sequence
acagtgctatgataaatttttag

SEQ ID NO: 173874 - DNA, 23 bp, Artificial sequence
  SiRNA target sequence
cagtgctatgataaatttttaga

SEQ ID NO: 173875 - DNA, 23 bp, Artificial sequence
  SiRNA target sequence
agtgctatgataaatttttagag

SEQ ID NO: 173876 - DNA, 23 bp, Artificial sequence
  SiRNA target sequence
gtgctatgataaatttttagaga

SEQ ID NO: 173877 - DNA, 23 bp, Artificial sequence
  SiRNA target sequence
tgctatgataaatttttagagaa

SEQ ID NO: 173878 - DNA, 23 bp, Artificial sequence
  SiRNA target sequence
gctatgataaatttttagagaat

SEQ ID NO: 173879 - DNA, 23 bp, Artificial sequence
  SiRNA target sequence
ctatgataaatttttagagaata

SEQ ID NO: 173880 - DNA, 23 bp, Artificial sequence
  SiRNA target sequence
tatgataaatttttagagaatag

SEQ ID NO: 173881 - DNA, 23 bp, Artificial sequence
  SiRNA target sequence
atgataaatttttagagaatagc

SEQ ID NO: 173882 - DNA, 23 bp, Artificial sequence
  SiRNA target sequence
tgataaatttttagagaatagcg

SEQ ID NO: 173883 - DNA, 23 bp, Artificial sequence
  SiRNA target sequence
gataaatttttagagaatagcga

SEQ ID NO: 173884 - DNA, 23 bp, Artificial sequence
  SiRNA target sequence
ataaatttttagagaatagcgat

SEQ ID NO: 173885 - DNA, 23 bp, Artificial sequence
  SiRNA target sequence
taaatttttagagaatagcgatg

SEQ ID NO: 173886 - DNA, 23 bp, Artificial sequence
  SiRNA target sequence
aaatttttagagaatagcgatga

SEQ ID NO: 173887 - DNA, 23 bp, Artificial sequence
  SiRNA target sequence
aatttttagagaatagcgatgat

SEQ ID NO: 173888 - DNA, 23 bp, Artificial sequence
  SiRNA target sequence
atttttagagaatagcgatgatg

SEQ ID NO: 173889 - DNA, 23 bp, Artificial sequence
  SiRNA target sequence
tttttagagaatagcgatgatgt

SEQ ID NO: 173890 - DNA, 23 bp, Artificial sequence
  SiRNA target sequence
ttttagagaatagcgatgatgtt

SEQ ID NO: 173891 - DNA, 23 bp, Artificial sequence
  SiRNA target sequence
tttagagaatagcgatgatgttt

SEQ ID NO: 173892 - DNA, 23 bp, Artificial sequence
  SiRNA target sequence
ttagagaatagcgatgatgtttt

SEQ ID NO: 173893 - DNA, 23 bp, Artificial sequence
  SiRNA target sequence
tagagaatagcgatgatgtttta

SEQ ID NO: 173894 - DNA, 23 bp, Artificial sequence
  SiRNA target sequence
agagaatagcgatgatgttttaa

SEQ ID NO: 173895 - DNA, 23 bp, Artificial sequence
  SiRNA target sequence
gagaatagcgatgatgttttaac

SEQ ID NO: 173896 - DNA, 23 bp, Artificial sequence
  SiRNA target sequence
agaatagcgatgatgttttaact

SEQ ID NO: 173897 - DNA, 23 bp, Artificial sequence
  SiRNA target sequence
gaatagcgatgatgttttaacta

SEQ ID NO: 173898 - DNA, 23 bp, Artificial sequence
  SiRNA target sequence
aatagcgatgatgttttaactac

SEQ ID NO: 173899 - DNA, 23 bp, Artificial sequence
  SiRNA target sequence
atagcgatgatgttttaactacc

SEQ ID NO: 173900 - DNA, 23 bp, Artificial sequence
  SiRNA target sequence
tagcgatgatgttttaactacct

SEQ ID NO: 173901 - DNA, 23 bp, Artificial sequence
  SiRNA target sequence
agcgatgatgttttaactaccta

SEQ ID NO: 173902 - DNA, 23 bp, Artificial sequence
  SiRNA target sequence
gcgatgatgttttaactacctat

SEQ ID NO: 173903 - DNA, 23 bp, Artificial sequence
  SiRNA target sequence
cgatgatgttttaactacctatg

SEQ ID NO: 173904 - DNA, 23 bp, Artificial sequence
  SiRNA target sequence
gatgatgttttaactacctatga

SEQ ID NO: 173905 - DNA, 23 bp, Artificial sequence
  SiRNA target sequence
atgatgttttaactacctatgat

SEQ ID NO: 173906 - DNA, 23 bp, Artificial sequence
  SiRNA target sequence
tgatgttttaactacctatgatt

SEQ ID NO: 173907 - DNA, 23 bp, Artificial sequence
  SiRNA target sequence
gatgttttaactacctatgattt

SEQ ID NO: 173908 - DNA, 23 bp, Artificial sequence
  SiRNA target sequence
atgttttaactacctatgatttt

SEQ ID NO: 173909 - DNA, 23 bp, Artificial sequence
  SiRNA target sequence
tgttttaactacctatgattttt

SEQ ID NO: 173910 - DNA, 23 bp, Artificial sequence
  SiRNA target sequence
gttttaactacctatgattttta

SEQ ID NO: 173911 - DNA, 23 bp, Artificial sequence
  SiRNA target sequence
ttttaactacctatgatttttat

SEQ ID NO: 173912 - DNA, 23 bp, Artificial sequence
  SiRNA target sequence
tttaactacctatgatttttata

SEQ ID NO: 173913 - DNA, 23 bp, Artificial sequence
  SiRNA target sequence
ttaactacctatgatttttataa

SEQ ID NO: 173914 - DNA, 23 bp, Artificial sequence
  SiRNA target sequence
taactacctatgatttttataaa

SEQ ID NO: 173915 - DNA, 23 bp, Artificial sequence
  SiRNA target sequence
aactacctatgatttttataaaa

SEQ ID NO: 173916 - DNA, 23 bp, Artificial sequence
  SiRNA target sequence
actacctatgatttttataaaat

SEQ ID NO: 173917 - DNA, 23 bp, Artificial sequence
  SiRNA target sequence
ctacctatgatttttataaaatg

SEQ ID NO: 173918 - DNA, 23 bp, Artificial sequence
  SiRNA target sequence
tacctatgatttttataaaatga

SEQ ID NO: 173919 - DNA, 23 bp, Artificial sequence
  SiRNA target sequence
acctatgatttttataaaatgat

SEQ ID NO: 173920 - DNA, 23 bp, Artificial sequence
  SiRNA target sequence
cctatgatttttataaaatgatt

SEQ ID NO: 173921 - DNA, 23 bp, Artificial sequence
  SiRNA target sequence
ctatgatttttataaaatgattt

SEQ ID NO: 173922 - DNA, 23 bp, Artificial sequence
  SiRNA target sequence
tatgatttttataaaatgatttt

SEQ ID NO: 173923 - DNA, 23 bp, Artificial sequence
  SiRNA target sequence
atgatttttataaaatgattttg

SEQ ID NO: 173924 - DNA, 23 bp, Artificial sequence
  SiRNA target sequence
tgatttttataaaatgattttgg

SEQ ID NO: 173925 - DNA, 23 bp, Artificial sequence
  SiRNA target sequence
gatttttataaaatgattttgga

SEQ ID NO: 173926 - DNA, 23 bp, Artificial sequence
  SiRNA target sequence
atttttataaaatgattttggat

SEQ ID NO: 173927 - DNA, 23 bp, Artificial sequence
  SiRNA target sequence
tttttataaaatgattttggatc

SEQ ID NO: 173928 - DNA, 23 bp, Artificial sequence
  SiRNA target sequence
ttttataaaatgattttggatct

SEQ ID NO: 173929 - DNA, 23 bp, Artificial sequence
  SiRNA target sequence
tttataaaatgattttggatcta

SEQ ID NO: 173930 - DNA, 23 bp, Artificial sequence
  SiRNA target sequence
ttataaaatgattttggatctag

SEQ ID NO: 173931 - DNA, 23 bp, Artificial sequence
  SiRNA target sequence
tataaaatgattttggatctagg

SEQ ID NO: 173932 - DNA, 23 bp, Artificial sequence
  SiRNA target sequence
ataaaatgattttggatctagga

SEQ ID NO: 173933 - DNA, 23 bp, Artificial sequence
  SiRNA target sequence
taaaatgattttggatctaggat

SEQ ID NO: 173934 - DNA, 23 bp, Artificial sequence
  SiRNA target sequence
aaaatgattttggatctaggatt

SEQ ID NO: 173935 - DNA, 23 bp, Artificial sequence
  SiRNA target sequence
aaatgattttggatctaggattt

SEQ ID NO: 173936 - DNA, 23 bp, Artificial sequence
  SiRNA target sequence
aatgattttggatctaggatttt

SEQ ID NO: 173937 - DNA, 23 bp, Artificial sequence
  SiRNA target sequence
atgattttggatctaggattttt

SEQ ID NO: 173938 - DNA, 23 bp, Artificial sequence
  SiRNA target sequence
tgattttggatctaggattttta

SEQ ID NO: 173939 - DNA, 23 bp, Artificial sequence
  SiRNA target sequence
gattttggatctaggatttttac

SEQ ID NO: 173940 - DNA, 23 bp, Artificial sequence
  SiRNA target sequence
attttggatctaggatttttaca

SEQ ID NO: 173941 - DNA, 23 bp, Artificial sequence
  SiRNA target sequence
ttttggatctaggatttttacag

SEQ ID NO: 173942 - DNA, 23 bp, Artificial sequence
  SiRNA target sequence
tttggatctaggatttttacagc

SEQ ID NO: 173943 - DNA, 23 bp, Artificial sequence
  SiRNA target sequence
ttggatctaggatttttacagca

SEQ ID NO: 173944 - DNA, 23 bp, Artificial sequence
  SiRNA target sequence
tggatctaggatttttacagcat

SEQ ID NO: 173945 - DNA, 23 bp, Artificial sequence
  SiRNA target sequence
ggatctaggatttttacagcata

SEQ ID NO: 173946 - DNA, 23 bp, Artificial sequence
  SiRNA target sequence
gatctaggatttttacagcataa

SEQ ID NO: 173947 - DNA, 23 bp, Artificial sequence
  SiRNA target sequence
atctaggatttttacagcataat

SEQ ID NO: 173948 - DNA, 23 bp, Artificial sequence
  SiRNA target sequence
tctaggatttttacagcataatt

SEQ ID NO: 173949 - DNA, 23 bp, Artificial sequence
  SiRNA target sequence
ctaggatttttacagcataattt

SEQ ID NO: 173950 - DNA, 23 bp, Artificial sequence
  SiRNA target sequence
taggatttttacagcataatttt

SEQ ID NO: 173951 - DNA, 23 bp, Artificial sequence
  SiRNA target sequence
aggatttttacagcataatttta

SEQ ID NO: 173952 - DNA, 23 bp, Artificial sequence
  SiRNA target sequence
ggatttttacagcataattttat

SEQ ID NO: 173953 - DNA, 23 bp, Artificial sequence
  SiRNA target sequence
gatttttacagcataattttatt

SEQ ID NO: 173954 - DNA, 23 bp, Artificial sequence
  SiRNA target sequence
atttttacagcataattttatta

SEQ ID NO: 173955 - DNA, 23 bp, Artificial sequence
  SiRNA target sequence
tttttacagcataattttattaa

SEQ ID NO: 173956 - DNA, 23 bp, Artificial sequence
  SiRNA target sequence
ttttacagcataattttattaaa

SEQ ID NO: 173957 - DNA, 23 bp, Artificial sequence
  SiRNA target sequence
tttacagcataattttattaaag

SEQ ID NO: 173958 - DNA, 23 bp, Artificial sequence
  SiRNA target sequence
ttacagcataattttattaaagg

SEQ ID NO: 173959 - DNA, 23 bp, Artificial sequence
  SiRNA target sequence
tacagcataattttattaaagga

SEQ ID NO: 173960 - DNA, 23 bp, Artificial sequence
  SiRNA target sequence
acagcataattttattaaaggaa

SEQ ID NO: 173961 - DNA, 23 bp, Artificial sequence
  SiRNA target sequence
cagcataattttattaaaggaac

SEQ ID NO: 173962 - DNA, 23 bp, Artificial sequence
  SiRNA target sequence
agcataattttattaaaggaacc

SEQ ID NO: 173963 - DNA, 23 bp, Artificial sequence
  SiRNA target sequence
gcataattttattaaaggaacct

SEQ ID NO: 173964 - DNA, 23 bp, Artificial sequence
  SiRNA target sequence
cataattttattaaaggaacctg

SEQ ID NO: 173965 - DNA, 23 bp, Artificial sequence
  SiRNA target sequence
ataattttattaaaggaacctgt

SEQ ID NO: 173966 - DNA, 23 bp, Artificial sequence
  SiRNA target sequence
taattttattaaaggaacctgtg

SEQ ID NO: 173967 - DNA, 23 bp, Artificial sequence
  SiRNA target sequence
aattttattaaaggaacctgtga

SEQ ID NO: 173968 - DNA, 23 bp, Artificial sequence
  SiRNA target sequence
attttattaaaggaacctgtgag

SEQ ID NO: 173969 - DNA, 23 bp, Artificial sequence
  SiRNA target sequence
ttttattaaaggaacctgtgaga

SEQ ID NO: 173970 - DNA, 23 bp, Artificial sequence
  SiRNA target sequence
tttattaaaggaacctgtgagaa

SEQ ID NO: 173971 - DNA, 23 bp, Artificial sequence
  SiRNA target sequence
ttattaaaggaacctgtgagaaa

SEQ ID NO: 173972 - DNA, 23 bp, Artificial sequence
  SiRNA target sequence
tattaaaggaacctgtgagaaat

SEQ ID NO: 173973 - DNA, 23 bp, Artificial sequence
  SiRNA target sequence
attaaaggaacctgtgagaaatg

SEQ ID NO: 173974 - DNA, 23 bp, Artificial sequence
  SiRNA target sequence
ttaaaggaacctgtgagaaatgg

SEQ ID NO: 173975 - DNA, 23 bp, Artificial sequence
  SiRNA target sequence
taaaggaacctgtgagaaatggg

SEQ ID NO: 173976 - DNA, 23 bp, Artificial sequence
  SiRNA target sequence
aaaggaacctgtgagaaatggga

SEQ ID NO: 173977 - DNA, 23 bp, Artificial sequence
  SiRNA target sequence
aaggaacctgtgagaaatgggag

SEQ ID NO: 173978 - DNA, 23 bp, Artificial sequence
  SiRNA target sequence
aggaacctgtgagaaatgggaga

SEQ ID NO: 173979 - DNA, 23 bp, Artificial sequence
  SiRNA target sequence
ggaacctgtgagaaatgggagaa

SEQ ID NO: 173980 - DNA, 23 bp, Artificial sequence
  SiRNA target sequence
gaacctgtgagaaatgggagaag

SEQ ID NO: 173981 - DNA, 23 bp, Artificial sequence
  SiRNA target sequence
aacctgtgagaaatgggagaagt

SEQ ID NO: 173982 - DNA, 23 bp, Artificial sequence
  SiRNA target sequence
acctgtgagaaatgggagaagtg

SEQ ID NO: 173983 - DNA, 23 bp, Artificial sequence
  SiRNA target sequence
cctgtgagaaatgggagaagtgt

SEQ ID NO: 173984 - DNA, 23 bp, Artificial sequence
  SiRNA target sequence
ctgtgagaaatgggagaagtgta

SEQ ID NO: 173985 - DNA, 23 bp, Artificial sequence
  SiRNA target sequence
tgtgagaaatgggagaagtgtac

SEQ ID NO: 173986 - DNA, 23 bp, Artificial sequence
  SiRNA target sequence
gtgagaaatgggagaagtgtact

SEQ ID NO: 173987 - DNA, 23 bp, Artificial sequence
  SiRNA target sequence
tgagaaatgggagaagtgtacta

SEQ ID NO: 173988 - DNA, 23 bp, Artificial sequence
  SiRNA target sequence
gagaaatgggagaagtgtactat

SEQ ID NO: 173989 - DNA, 23 bp, Artificial sequence
  SiRNA target sequence
agaaatgggagaagtgtactatt

SEQ ID NO: 173990 - DNA, 23 bp, Artificial sequence
  SiRNA target sequence
gaaatgggagaagtgtactattg

SEQ ID NO: 173991 - DNA, 23 bp, Artificial sequence
  SiRNA target sequence
aaatgggagaagtgtactattgg

SEQ ID NO: 173992 - DNA, 23 bp, Artificial sequence
  SiRNA target sequence
aatgggagaagtgtactattgga

SEQ ID NO: 173993 - DNA, 23 bp, Artificial sequence
  SiRNA target sequence
atgggagaagtgtactattggat

SEQ ID NO: 173994 - DNA, 23 bp, Artificial sequence
  SiRNA target sequence
tgggagaagtgtactattggata

SEQ ID NO: 173995 - DNA, 23 bp, Artificial sequence
  SiRNA target sequence
gggagaagtgtactattggatat

SEQ ID NO: 173996 - DNA, 23 bp, Artificial sequence
  SiRNA target sequence
ggagaagtgtactattggatatc

SEQ ID NO: 173997 - DNA, 23 bp, Artificial sequence
  SiRNA target sequence
gagaagtgtactattggatatca

SEQ ID NO: 173998 - DNA, 23 bp, Artificial sequence
  SiRNA target sequence
agaagtgtactattggatatcat

SEQ ID NO: 173999 - DNA, 23 bp, Artificial sequence
  SiRNA target sequence
gaagtgtactattggatatcatt

SEQ ID NO: 174000 - DNA, 23 bp, Artificial sequence
  SiRNA target sequence
aagtgtactattggatatcatta

SEQ ID NO: 174001 - DNA, 23 bp, Artificial sequence
  SiRNA target sequence
agtgtactattggatatcattat

SEQ ID NO: 174002 - DNA, 23 bp, Artificial sequence
  SiRNA target sequence
gtgtactattggatatcattatg

SEQ ID NO: 174003 - DNA, 23 bp, Artificial sequence
  SiRNA target sequence
tgtactattggatatcattatgg

SEQ ID NO: 174004 - DNA, 23 bp, Artificial sequence
  SiRNA target sequence
gtactattggatatcattatgga

SEQ ID NO: 174005 - DNA, 23 bp, Artificial sequence
  SiRNA target sequence
tactattggatatcattatggat

SEQ ID NO: 174006 - DNA, 23 bp, Artificial sequence
  SiRNA target sequence
actattggatatcattatggata

SEQ ID NO: 174007 - DNA, 23 bp, Artificial sequence
  SiRNA target sequence
ctattggatatcattatggatat

SEQ ID NO: 174008 - DNA, 23 bp, Artificial sequence
  SiRNA target sequence
tattggatatcattatggatatt

SEQ ID NO: 174009 - DNA, 23 bp, Artificial sequence
  SiRNA target sequence
attggatatcattatggatattt

SEQ ID NO: 174010 - DNA, 23 bp, Artificial sequence
  SiRNA target sequence
ttggatatcattatggatattta

SEQ ID NO: 174011 - DNA, 23 bp, Artificial sequence
  SiRNA target sequence
tggatatcattatggatatttag

SEQ ID NO: 174012 - DNA, 23 bp, Artificial sequence
  SiRNA target sequence
ggatatcattatggatatttaga

SEQ ID NO: 174013 - DNA, 23 bp, Artificial sequence
  SiRNA target sequence
gatatcattatggatatttagaa

SEQ ID NO: 174014 - DNA, 23 bp, Artificial sequence
  SiRNA target sequence
atatcattatggatatttagaac

SEQ ID NO: 174015 - DNA, 23 bp, Artificial sequence
  SiRNA target sequence
tatcattatggatatttagaaca

SEQ ID NO: 174016 - DNA, 23 bp, Artificial sequence
  SiRNA target sequence
atcattatggatatttagaacac

SEQ ID NO: 174017 - DNA, 23 bp, Artificial sequence
  SiRNA target sequence
tcattatggatatttagaacaca

SEQ ID NO: 174018 - DNA, 23 bp, Artificial sequence
  SiRNA target sequence
cattatggatatttagaacacat

SEQ ID NO: 174019 - DNA, 23 bp, Artificial sequence
  SiRNA target sequence
attatggatatttagaacacata

SEQ ID NO: 174020 - DNA, 23 bp, Artificial sequence
  SiRNA target sequence
ttatggatatttagaacacatat

SEQ ID NO: 174021 - DNA, 23 bp, Artificial sequence
  SiRNA target sequence
tatggatatttagaacacatatt

SEQ ID NO: 174022 - DNA, 23 bp, Artificial sequence
  SiRNA target sequence
atggatatttagaacacatatta

SEQ ID NO: 174023 - DNA, 23 bp, Artificial sequence
  SiRNA target sequence
tggatatttagaacacatattaa

SEQ ID NO: 174024 - DNA, 23 bp, Artificial sequence
  SiRNA target sequence
ggatatttagaacacatattaaa

SEQ ID NO: 174025 - DNA, 23 bp, Artificial sequence
  SiRNA target sequence
gatatttagaacacatattaaat

SEQ ID NO: 174026 - DNA, 23 bp, Artificial sequence
  SiRNA target sequence
atatttagaacacatattaaata

SEQ ID NO: 174027 - DNA, 23 bp, Artificial sequence
  SiRNA target sequence
tatttagaacacatattaaataa

SEQ ID NO: 174028 - DNA, 23 bp, Artificial sequence
  SiRNA target sequence
atttagaacacatattaaataag

SEQ ID NO: 174029 - DNA, 23 bp, Artificial sequence
  SiRNA target sequence
tttagaacacatattaaataaga

SEQ ID NO: 174030 - DNA, 23 bp, Artificial sequence
  SiRNA target sequence
ttagaacacatattaaataagaa

SEQ ID NO: 174031 - DNA, 23 bp, Artificial sequence
  SiRNA target sequence
tagaacacatattaaataagaag

SEQ ID NO: 174032 - DNA, 23 bp, Artificial sequence
  SiRNA target sequence
agaacacatattaaataagaaga

SEQ ID NO: 174033 - DNA, 23 bp, Artificial sequence
  SiRNA target sequence
gaacacatattaaataagaagaa

SEQ ID NO: 174034 - DNA, 23 bp, Artificial sequence
  SiRNA target sequence
aacacatattaaataagaagaac

SEQ ID NO: 174035 - DNA, 23 bp, Artificial sequence
  SiRNA target sequence
acacatattaaataagaagaaca

SEQ ID NO: 174036 - DNA, 23 bp, Artificial sequence
  SiRNA target sequence
cacatattaaataagaagaacaa

SEQ ID NO: 174037 - DNA, 23 bp, Artificial sequence
  SiRNA target sequence
acatattaaataagaagaacaat

SEQ ID NO: 174038 - DNA, 23 bp, Artificial sequence
  SiRNA target sequence
catattaaataagaagaacaatt

SEQ ID NO: 174039 - DNA, 23 bp, Artificial sequence
  SiRNA target sequence
atattaaataagaagaacaatta

SEQ ID NO: 174040 - DNA, 23 bp, Artificial sequence
  SiRNA target sequence
tattaaataagaagaacaattat

SEQ ID NO: 174041 - DNA, 23 bp, Artificial sequence
  SiRNA target sequence
attaaataagaagaacaattatt

SEQ ID NO: 174042 - DNA, 23 bp, Artificial sequence
  SiRNA target sequence
ttaaataagaagaacaattattt

SEQ ID NO: 174043 - DNA, 23 bp, Artificial sequence
  SiRNA target sequence
taaataagaagaacaattattta

SEQ ID NO: 174044 - DNA, 23 bp, Artificial sequence
  SiRNA target sequence
aaataagaagaacaattatttaa

SEQ ID NO: 174045 - DNA, 23 bp, Artificial sequence
  SiRNA target sequence
aataagaagaacaattatttaac

SEQ ID NO: 174046 - DNA, 23 bp, Artificial sequence
  SiRNA target sequence
ataagaagaacaattatttaaca

SEQ ID NO: 174047 - DNA, 23 bp, Artificial sequence
  SiRNA target sequence
taagaagaacaattatttaacaa

SEQ ID NO: 174048 - DNA, 23 bp, Artificial sequence
  SiRNA target sequence
aagaagaacaattatttaacaaa

SEQ ID NO: 174049 - DNA, 23 bp, Artificial sequence
  SiRNA target sequence
agaagaacaattatttaacaaaa

SEQ ID NO: 174050 - DNA, 23 bp, Artificial sequence
  SiRNA target sequence
gaagaacaattatttaacaaaaa

SEQ ID NO: 174051 - DNA, 23 bp, Artificial sequence
  SiRNA target sequence
aagaacaattatttaacaaaaaa

SEQ ID NO: 174052 - DNA, 23 bp, Artificial sequence
  SiRNA target sequence
agaacaattatttaacaaaaaat

SEQ ID NO: 174053 - DNA, 23 bp, Artificial sequence
  SiRNA target sequence
gaacaattatttaacaaaaaatg

SEQ ID NO: 174054 - DNA, 23 bp, Artificial sequence
  SiRNA target sequence
aacaattatttaacaaaaaatga

SEQ ID NO: 174055 - DNA, 23 bp, Artificial sequence
  SiRNA target sequence
acaattatttaacaaaaaatgat

SEQ ID NO: 174056 - DNA, 23 bp, Artificial sequence
  SiRNA target sequence
caattatttaacaaaaaatgata

SEQ ID NO: 174057 - DNA, 23 bp, Artificial sequence
  SiRNA target sequence
aattatttaacaaaaaatgatag

SEQ ID NO: 174058 - DNA, 23 bp, Artificial sequence
  SiRNA target sequence
attatttaacaaaaaatgatagt

SEQ ID NO: 174059 - DNA, 23 bp, Artificial sequence
  SiRNA target sequence
ttatttaacaaaaaatgatagta

SEQ ID NO: 174060 - DNA, 23 bp, Artificial sequence
  SiRNA target sequence
tatttaacaaaaaatgatagtat

SEQ ID NO: 174061 - DNA, 23 bp, Artificial sequence
  SiRNA target sequence
atttaacaaaaaatgatagtata

SEQ ID NO: 174062 - DNA, 23 bp, Artificial sequence
  SiRNA target sequence
tttaacaaaaaatgatagtataa

SEQ ID NO: 174063 - DNA, 23 bp, Artificial sequence
  SiRNA target sequence
ttaacaaaaaatgatagtataaa

SEQ ID NO: 174064 - DNA, 23 bp, Artificial sequence
  SiRNA target sequence
taacaaaaaatgatagtataaaa

SEQ ID NO: 174065 - DNA, 23 bp, Artificial sequence
  SiRNA target sequence
aacaaaaaatgatagtataaaaa

SEQ ID NO: 174066 - DNA, 23 bp, Artificial sequence
  SiRNA target sequence
acaaaaaatgatagtataaaaat

SEQ ID NO: 174067 - DNA, 23 bp, Artificial sequence
  SiRNA target sequence
caaaaaatgatagtataaaaata

SEQ ID NO: 174068 - DNA, 23 bp, Artificial sequence
  SiRNA target sequence
aaaaaatgatagtataaaaatat

SEQ ID NO: 174069 - DNA, 23 bp, Artificial sequence
  SiRNA target sequence
aaaaatgatagtataaaaatatt

SEQ ID NO: 174070 - DNA, 23 bp, Artificial sequence
  SiRNA target sequence
aaaatgatagtataaaaatattt

SEQ ID NO: 174071 - DNA, 23 bp, Artificial sequence
  SiRNA target sequence
aaatgatagtataaaaatattta

SEQ ID NO: 174072 - DNA, 23 bp, Artificial sequence
  SiRNA target sequence
aatgatagtataaaaatatttaa

SEQ ID NO: 174073 - DNA, 23 bp, Artificial sequence
  SiRNA target sequence
atgatagtataaaaatatttaac

SEQ ID NO: 174074 - DNA, 23 bp, Artificial sequence
  SiRNA target sequence
tgatagtataaaaatatttaaca

SEQ ID NO: 174075 - DNA, 23 bp, Artificial sequence
  SiRNA target sequence
gatagtataaaaatatttaacag

SEQ ID NO: 174076 - DNA, 23 bp, Artificial sequence
  SiRNA target sequence
atagtataaaaatatttaacagt

SEQ ID NO: 174077 - DNA, 23 bp, Artificial sequence
  SiRNA target sequence
tagtataaaaatatttaacagta

SEQ ID NO: 174078 - DNA, 23 bp, Artificial sequence
  SiRNA target sequence
agtataaaaatatttaacagtaa

SEQ ID NO: 174079 - DNA, 23 bp, Artificial sequence
  SiRNA target sequence
gtataaaaatatttaacagtaaa

SEQ ID NO: 174080 - DNA, 23 bp, Artificial sequence
  SiRNA target sequence
tataaaaatatttaacagtaaaa

SEQ ID NO: 174081 - DNA, 23 bp, Artificial sequence
  SiRNA target sequence
ataaaaatatttaacagtaaaaa

SEQ ID NO: 174082 - DNA, 23 bp, Artificial sequence
  SiRNA target sequence
taaaaatatttaacagtaaaaat

SEQ ID NO: 174083 - DNA, 23 bp, Artificial sequence
  SiRNA target sequence
aaaaatatttaacagtaaaaatg

SEQ ID NO: 174084 - DNA, 23 bp, Artificial sequence
  SiRNA target sequence
aaaatatttaacagtaaaaatga

SEQ ID NO: 174085 - DNA, 23 bp, Artificial sequence
  SiRNA target sequence
aaatatttaacagtaaaaatgag

SEQ ID NO: 174086 - DNA, 23 bp, Artificial sequence
  SiRNA target sequence
aatatttaacagtaaaaatgagg

SEQ ID NO: 174087 - DNA, 23 bp, Artificial sequence
  SiRNA target sequence
atatttaacagtaaaaatgagga

SEQ ID NO: 174088 - DNA, 23 bp, Artificial sequence
  SiRNA target sequence
tatttaacagtaaaaatgaggag

SEQ ID NO: 174089 - DNA, 23 bp, Artificial sequence
  SiRNA target sequence
atttaacagtaaaaatgaggagg

SEQ ID NO: 174090 - DNA, 23 bp, Artificial sequence
  SiRNA target sequence
tttaacagtaaaaatgaggaggt

SEQ ID NO: 174091 - DNA, 23 bp, Artificial sequence
  SiRNA target sequence
ttaacagtaaaaatgaggaggta

SEQ ID NO: 174092 - DNA, 23 bp, Artificial sequence
  SiRNA target sequence
taacagtaaaaatgaggaggtaa

SEQ ID NO: 174093 - DNA, 23 bp, Artificial sequence
  SiRNA target sequence
aacagtaaaaatgaggaggtaag

SEQ ID NO: 174094 - DNA, 23 bp, Artificial sequence
  SiRNA target sequence
acagtaaaaatgaggaggtaagg

SEQ ID NO: 174095 - DNA, 23 bp, Artificial sequence
  SiRNA target sequence
cagtaaaaatgaggaggtaaggt

SEQ ID NO: 174096 - DNA, 23 bp, Artificial sequence
  SiRNA target sequence
agtaaaaatgaggaggtaaggtt

SEQ ID NO: 174097 - DNA, 23 bp, Artificial sequence
  SiRNA target sequence
gtaaaaatgaggaggtaaggtta

SEQ ID NO: 174098 - DNA, 23 bp, Artificial sequence
  SiRNA target sequence
taaaaatgaggaggtaaggttaa

SEQ ID NO: 174099 - DNA, 23 bp, Artificial sequence
  SiRNA target sequence
aaaaatgaggaggtaaggttaaa

SEQ ID NO: 174100 - DNA, 23 bp, Artificial sequence
  SiRNA target sequence
aaaatgaggaggtaaggttaaat

SEQ ID NO: 174101 - DNA, 23 bp, Artificial sequence
  SiRNA target sequence
aaatgaggaggtaaggttaaatg

SEQ ID NO: 174102 - DNA, 23 bp, Artificial sequence
  SiRNA target sequence
aatgaggaggtaaggttaaatgg

SEQ ID NO: 174103 - DNA, 23 bp, Artificial sequence
  SiRNA target sequence
atgaggaggtaaggttaaatgga

SEQ ID NO: 174104 - DNA, 23 bp, Artificial sequence
  SiRNA target sequence
tgaggaggtaaggttaaatggaa

SEQ ID NO: 174105 - DNA, 23 bp, Artificial sequence
  SiRNA target sequence
gaggaggtaaggttaaatggaaa

SEQ ID NO: 174106 - DNA, 23 bp, Artificial sequence
  SiRNA target sequence
aggaggtaaggttaaatggaaaa

SEQ ID NO: 174107 - DNA, 23 bp, Artificial sequence
  SiRNA target sequence
ggaggtaaggttaaatggaaaaa

SEQ ID NO: 174108 - DNA, 23 bp, Artificial sequence
  SiRNA target sequence
gaggtaaggttaaatggaaaaag

SEQ ID NO: 174109 - DNA, 23 bp, Artificial sequence
  SiRNA target sequence
aggtaaggttaaatggaaaaaga

SEQ ID NO: 174110 - DNA, 23 bp, Artificial sequence
  SiRNA target sequence
ggtaaggttaaatggaaaaagaa

SEQ ID NO: 174111 - DNA, 23 bp, Artificial sequence
  SiRNA target sequence
gtaaggttaaatggaaaaagaaa

SEQ ID NO: 174112 - DNA, 23 bp, Artificial sequence
  SiRNA target sequence
taaggttaaatggaaaaagaaaa

SEQ ID NO: 174113 - DNA, 23 bp, Artificial sequence
  SiRNA target sequence
aaggttaaatggaaaaagaaaat

SEQ ID NO: 174114 - DNA, 23 bp, Artificial sequence
  SiRNA target sequence
aggttaaatggaaaaagaaaatt

SEQ ID NO: 174115 - DNA, 23 bp, Artificial sequence
  SiRNA target sequence
ggttaaatggaaaaagaaaatta

SEQ ID NO: 174116 - DNA, 23 bp, Artificial sequence
  SiRNA target sequence
gttaaatggaaaaagaaaattaa

SEQ ID NO: 174117 - DNA, 23 bp, Artificial sequence
  SiRNA target sequence
ttaaatggaaaaagaaaattaaa

SEQ ID NO: 174118 - DNA, 23 bp, Artificial sequence
  SiRNA target sequence
taaatggaaaaagaaaattaaat

SEQ ID NO: 174119 - DNA, 23 bp, Artificial sequence
  SiRNA target sequence
aaatggaaaaagaaaattaaata

SEQ ID NO: 174120 - DNA, 23 bp, Artificial sequence
  SiRNA target sequence
aatggaaaaagaaaattaaatat

SEQ ID NO: 174121 - DNA, 23 bp, Artificial sequence
  SiRNA target sequence
atggaaaaagaaaattaaatatt

SEQ ID NO: 174122 - DNA, 23 bp, Artificial sequence
  SiRNA target sequence
tggaaaaagaaaattaaatatta

SEQ ID NO: 174123 - DNA, 23 bp, Artificial sequence
  SiRNA target sequence
ggaaaaagaaaattaaatattaa

SEQ ID NO: 174124 - DNA, 23 bp, Artificial sequence
  SiRNA target sequence
gaaaaagaaaattaaatattaac

SEQ ID NO: 174125 - DNA, 23 bp, Artificial sequence
  SiRNA target sequence
aaaaagaaaattaaatattaaca

SEQ ID NO: 174126 - DNA, 23 bp, Artificial sequence
  SiRNA target sequence
aaaagaaaattaaatattaacac

SEQ ID NO: 174127 - DNA, 23 bp, Artificial sequence
  SiRNA target sequence
aaagaaaattaaatattaacaca

SEQ ID NO: 174128 - DNA, 23 bp, Artificial sequence
  SiRNA target sequence
aagaaaattaaatattaacacag

SEQ ID NO: 174129 - DNA, 23 bp, Artificial sequence
  SiRNA target sequence
agaaaattaaatattaacacagt

SEQ ID NO: 174130 - DNA, 23 bp, Artificial sequence
  SiRNA target sequence
gaaaattaaatattaacacagtt

SEQ ID NO: 174131 - DNA, 23 bp, Artificial sequence
  SiRNA target sequence
aaaattaaatattaacacagtta

SEQ ID NO: 174132 - DNA, 23 bp, Artificial sequence
  SiRNA target sequence
aaattaaatattaacacagttac

SEQ ID NO: 174133 - DNA, 23 bp, Artificial sequence
  SiRNA target sequence
aattaaatattaacacagttaca

SEQ ID NO: 174134 - DNA, 23 bp, Artificial sequence
  SiRNA target sequence
attaaatattaacacagttacat

SEQ ID NO: 174135 - DNA, 23 bp, Artificial sequence
  SiRNA target sequence
ttaaatattaacacagttacatt

SEQ ID NO: 174136 - DNA, 23 bp, Artificial sequence
  SiRNA target sequence
taaatattaacacagttacatta

SEQ ID NO: 174137 - DNA, 23 bp, Artificial sequence
  SiRNA target sequence
aaatattaacacagttacattaa

SEQ ID NO: 174138 - DNA, 23 bp, Artificial sequence
  SiRNA target sequence
aatattaacacagttacattaaa

SEQ ID NO: 174139 - DNA, 23 bp, Artificial sequence
  SiRNA target sequence
atattaacacagttacattaaat

SEQ ID NO: 174140 - DNA, 23 bp, Artificial sequence
  SiRNA target sequence
tattaacacagttacattaaata

SEQ ID NO: 174141 - DNA, 23 bp, Artificial sequence
  SiRNA target sequence
attaacacagttacattaaataa

SEQ ID NO: 174142 - DNA, 23 bp, Artificial sequence
  SiRNA target sequence
ttaacacagttacattaaataaa

SEQ ID NO: 174143 - DNA, 23 bp, Artificial sequence
  SiRNA target sequence
taacacagttacattaaataaaa

SEQ ID NO: 174144 - DNA, 23 bp, Artificial sequence
  SiRNA target sequence
aacacagttacattaaataaaat

SEQ ID NO: 174145 - DNA, 23 bp, Artificial sequence
  SiRNA target sequence
acacagttacattaaataaaatt

SEQ ID NO: 174146 - DNA, 23 bp, Artificial sequence
  SiRNA target sequence
cacagttacattaaataaaatta

SEQ ID NO: 174147 - DNA, 23 bp, Artificial sequence
  SiRNA target sequence
acagttacattaaataaaattaa

SEQ ID NO: 174148 - DNA, 23 bp, Artificial sequence
  SiRNA target sequence
cagttacattaaataaaattaat

SEQ ID NO: 174149 - DNA, 23 bp, Artificial sequence
  SiRNA target sequence
agttacattaaataaaattaata

SEQ ID NO: 174150 - DNA, 23 bp, Artificial sequence
  SiRNA target sequence
gttacattaaataaaattaatat

SEQ ID NO: 174151 - DNA, 23 bp, Artificial sequence
  SiRNA target sequence
ttacattaaataaaattaatata

SEQ ID NO: 174152 - DNA, 23 bp, Artificial sequence
  SiRNA target sequence
tacattaaataaaattaatatac

SEQ ID NO: 174153 - DNA, 23 bp, Artificial sequence
  SiRNA target sequence
acattaaataaaattaatatacc

SEQ ID NO: 174154 - DNA, 23 bp, Artificial sequence
  SiRNA target sequence
cattaaataaaattaatatacct

SEQ ID NO: 174155 - DNA, 23 bp, Artificial sequence
  SiRNA target sequence
attaaataaaattaatatacctg

SEQ ID NO: 174156 - DNA, 23 bp, Artificial sequence
  SiRNA target sequence
ttaaataaaattaatatacctga

SEQ ID NO: 174157 - DNA, 23 bp, Artificial sequence
  SiRNA target sequence
taaataaaattaatatacctgag

SEQ ID NO: 174158 - DNA, 23 bp, Artificial sequence
  SiRNA target sequence
aaataaaattaatatacctgaga

SEQ ID NO: 174159 - DNA, 23 bp, Artificial sequence
  SiRNA target sequence
aataaaattaatatacctgagat

SEQ ID NO: 174160 - DNA, 23 bp, Artificial sequence
  SiRNA target sequence
ataaaattaatatacctgagata

SEQ ID NO: 174161 - DNA, 23 bp, Artificial sequence
  SiRNA target sequence
taaaattaatatacctgagatag

SEQ ID NO: 174162 - DNA, 23 bp, Artificial sequence
  SiRNA target sequence
aaaattaatatacctgagataga

SEQ ID NO: 174163 - DNA, 23 bp, Artificial sequence
  SiRNA target sequence
aaattaatatacctgagatagat

SEQ ID NO: 174164 - DNA, 23 bp, Artificial sequence
  SiRNA target sequence
aattaatatacctgagatagatt

SEQ ID NO: 174165 - DNA, 23 bp, Artificial sequence
  SiRNA target sequence
attaatatacctgagatagatta

SEQ ID NO: 174166 - DNA, 23 bp, Artificial sequence
  SiRNA target sequence
ttaatatacctgagatagattat

SEQ ID NO: 174167 - DNA, 23 bp, Artificial sequence
  SiRNA target sequence
taatatacctgagatagattata

SEQ ID NO: 174168 - DNA, 23 bp, Artificial sequence
  SiRNA target sequence
aatatacctgagatagattataa

SEQ ID NO: 174169 - DNA, 23 bp, Artificial sequence
  SiRNA target sequence
atatacctgagatagattataaa

SEQ ID NO: 174170 - DNA, 23 bp, Artificial sequence
  SiRNA target sequence
tatacctgagatagattataaat

SEQ ID NO: 174171 - DNA, 23 bp, Artificial sequence
  SiRNA target sequence
atacctgagatagattataaata

SEQ ID NO: 174172 - DNA, 23 bp, Artificial sequence
  SiRNA target sequence
tacctgagatagattataaatat

SEQ ID NO: 174173 - DNA, 23 bp, Artificial sequence
  SiRNA target sequence
acctgagatagattataaatata

SEQ ID NO: 174174 - DNA, 23 bp, Artificial sequence
  SiRNA target sequence
cctgagatagattataaatataa

SEQ ID NO: 174175 - DNA, 23 bp, Artificial sequence
  SiRNA target sequence
ctgagatagattataaatataaa

SEQ ID NO: 174176 - DNA, 23 bp, Artificial sequence
  SiRNA target sequence
tgagatagattataaatataaaa

SEQ ID NO: 174177 - DNA, 23 bp, Artificial sequence
  SiRNA target sequence
gagatagattataaatataaaaa

SEQ ID NO: 174178 - DNA, 23 bp, Artificial sequence
  SiRNA target sequence
agatagattataaatataaaaat

SEQ ID NO: 174179 - DNA, 23 bp, Artificial sequence
  SiRNA target sequence
gatagattataaatataaaaatg

SEQ ID NO: 174180 - DNA, 23 bp, Artificial sequence
  SiRNA target sequence
atagattataaatataaaaatgg

SEQ ID NO: 174181 - DNA, 23 bp, Artificial sequence
  SiRNA target sequence
tagattataaatataaaaatgga

SEQ ID NO: 174182 - DNA, 23 bp, Artificial sequence
  SiRNA target sequence
agattataaatataaaaatggag

SEQ ID NO: 174183 - DNA, 23 bp, Artificial sequence
  SiRNA target sequence
gattataaatataaaaatggagt

SEQ ID NO: 174184 - DNA, 23 bp, Artificial sequence
  SiRNA target sequence
attataaatataaaaatggagtg

SEQ ID NO: 174185 - DNA, 23 bp, Artificial sequence
  SiRNA target sequence
ttataaatataaaaatggagtgt

SEQ ID NO: 174186 - DNA, 23 bp, Artificial sequence
  SiRNA target sequence
tataaatataaaaatggagtgtt

SEQ ID NO: 174187 - DNA, 23 bp, Artificial sequence
  SiRNA target sequence
ataaatataaaaatggagtgttt

SEQ ID NO: 174188 - DNA, 23 bp, Artificial sequence
  SiRNA target sequence
taaatataaaaatggagtgttta

SEQ ID NO: 174189 - DNA, 23 bp, Artificial sequence
  SiRNA target sequence
aaatataaaaatggagtgtttac

SEQ ID NO: 174190 - DNA, 23 bp, Artificial sequence
  SiRNA target sequence
aatataaaaatggagtgtttaca

SEQ ID NO: 174191 - DNA, 23 bp, Artificial sequence
  SiRNA target sequence
atataaaaatggagtgtttacat

SEQ ID NO: 174192 - DNA, 23 bp, Artificial sequence
  SiRNA target sequence
tataaaaatggagtgtttacata

SEQ ID NO: 174193 - DNA, 23 bp, Artificial sequence
  SiRNA target sequence
ataaaaatggagtgtttacatat

SEQ ID NO: 174194 - DNA, 23 bp, Artificial sequence
  SiRNA target sequence
taaaaatggagtgtttacatata

SEQ ID NO: 174195 - DNA, 23 bp, Artificial sequence
  SiRNA target sequence
aaaaatggagtgtttacatatac

SEQ ID NO: 174196 - DNA, 23 bp, Artificial sequence
  SiRNA target sequence
aaaatggagtgtttacatataca

SEQ ID NO: 174197 - DNA, 23 bp, Artificial sequence
  SiRNA target sequence
aaatggagtgtttacatatacac

SEQ ID NO: 174198 - DNA, 23 bp, Artificial sequence
  SiRNA target sequence
aatggagtgtttacatatacaca

SEQ ID NO: 174199 - DNA, 23 bp, Artificial sequence
  SiRNA target sequence
atggagtgtttacatatacacag

SEQ ID NO: 174200 - DNA, 23 bp, Artificial sequence
  SiRNA target sequence
tggagtgtttacatatacacaga

SEQ ID NO: 174201 - DNA, 23 bp, Artificial sequence
  SiRNA target sequence
ggagtgtttacatatacacagat

SEQ ID NO: 174202 - DNA, 23 bp, Artificial sequence
  SiRNA target sequence
gagtgtttacatatacacagatc

SEQ ID NO: 174203 - DNA, 23 bp, Artificial sequence
  SiRNA target sequence
agtgtttacatatacacagatca

SEQ ID NO: 174204 - DNA, 23 bp, Artificial sequence
  SiRNA target sequence
gtgtttacatatacacagatcaa

SEQ ID NO: 174205 - DNA, 23 bp, Artificial sequence
  SiRNA target sequence
tgtttacatatacacagatcaaa

SEQ ID NO: 174206 - DNA, 23 bp, Artificial sequence
  SiRNA target sequence
gtttacatatacacagatcaaaa

SEQ ID NO: 174207 - DNA, 23 bp, Artificial sequence
  SiRNA target sequence
tttacatatacacagatcaaaaa

SEQ ID NO: 174208 - DNA, 23 bp, Artificial sequence
  SiRNA target sequence
ttacatatacacagatcaaaaat

SEQ ID NO: 174209 - DNA, 23 bp, Artificial sequence
  SiRNA target sequence
tacatatacacagatcaaaaata

SEQ ID NO: 174210 - DNA, 23 bp, Artificial sequence
  SiRNA target sequence
acatatacacagatcaaaaataa

SEQ ID NO: 174211 - DNA, 23 bp, Artificial sequence
  SiRNA target sequence
catatacacagatcaaaaataat

SEQ ID NO: 174212 - DNA, 23 bp, Artificial sequence
  SiRNA target sequence
atatacacagatcaaaaataata

SEQ ID NO: 174213 - DNA, 23 bp, Artificial sequence
  SiRNA target sequence
tatacacagatcaaaaataataa

SEQ ID NO: 174214 - DNA, 23 bp, Artificial sequence
  SiRNA target sequence
atacacagatcaaaaataataag

SEQ ID NO: 174215 - DNA, 23 bp, Artificial sequence
  SiRNA target sequence
tacacagatcaaaaataataaga

SEQ ID NO: 174216 - DNA, 23 bp, Artificial sequence
  SiRNA target sequence
acacagatcaaaaataataagaa

SEQ ID NO: 174217 - DNA, 23 bp, Artificial sequence
  SiRNA target sequence
cacagatcaaaaataataagaaa

SEQ ID NO: 174218 - DNA, 23 bp, Artificial sequence
  SiRNA target sequence
acagatcaaaaataataagaaaa

SEQ ID NO: 174219 - DNA, 23 bp, Artificial sequence
  SiRNA target sequence
cagatcaaaaataataagaaaaa

SEQ ID NO: 174220 - DNA, 23 bp, Artificial sequence
  SiRNA target sequence
agatcaaaaataataagaaaaaa

SEQ ID NO: 174221 - DNA, 23 bp, Artificial sequence
  SiRNA target sequence
gatcaaaaataataagaaaaaaa

SEQ ID NO: 174222 - DNA, 23 bp, Artificial sequence
  SiRNA target sequence
atcaaaaataataagaaaaaaaa

SEQ ID NO: 174223 - DNA, 23 bp, Artificial sequence
  SiRNA target sequence
tcaaaaataataagaaaaaaaaa

SEQ ID NO: 174224 - DNA, 23 bp, Artificial sequence
  SiRNA target sequence
caaaaataataagaaaaaaaaat

SEQ ID NO: 174225 - DNA, 23 bp, Artificial sequence
  SiRNA target sequence
aaaaataataagaaaaaaaaata

SEQ ID NO: 174226 - DNA, 23 bp, Artificial sequence
  SiRNA target sequence
aaaataataagaaaaaaaaatat

SEQ ID NO: 174227 - DNA, 23 bp, Artificial sequence
  SiRNA target sequence
aaataataagaaaaaaaaatatt

SEQ ID NO: 174228 - DNA, 23 bp, Artificial sequence
  SiRNA target sequence
aataataagaaaaaaaaatattt

SEQ ID NO: 174229 - DNA, 23 bp, Artificial sequence
  SiRNA target sequence
ataataagaaaaaaaaatattta

SEQ ID NO: 174230 - DNA, 23 bp, Artificial sequence
  SiRNA target sequence
taataagaaaaaaaaatatttaa

SEQ ID NO: 174231 - DNA, 23 bp, Artificial sequence
  SiRNA target sequence
aataagaaaaaaaaatatttaag

SEQ ID NO: 174232 - DNA, 23 bp, Artificial sequence
  SiRNA target sequence
ataagaaaaaaaaatatttaaga

SEQ ID NO: 174233 - DNA, 23 bp, Artificial sequence
  SiRNA target sequence
taagaaaaaaaaatatttaagaa

SEQ ID NO: 174234 - DNA, 23 bp, Artificial sequence
  SiRNA target sequence
aagaaaaaaaaatatttaagaat

SEQ ID NO: 174235 - DNA, 23 bp, Artificial sequence
  SiRNA target sequence
agaaaaaaaaatatttaagaata

SEQ ID NO: 174236 - DNA, 23 bp, Artificial sequence
  SiRNA target sequence
gaaaaaaaaatatttaagaatat

SEQ ID NO: 174237 - DNA, 23 bp, Artificial sequence
  SiRNA target sequence
aaaaaaaaatatttaagaatatt

SEQ ID NO: 174238 - DNA, 23 bp, Artificial sequence
  SiRNA target sequence
aaaaaaaatatttaagaatattg

SEQ ID NO: 174239 - DNA, 23 bp, Artificial sequence
  SiRNA target sequence
aaaaaaatatttaagaatattgg

SEQ ID NO: 174240 - DNA, 23 bp, Artificial sequence
  SiRNA target sequence
aaaaaatatttaagaatattggg

SEQ ID NO: 174241 - DNA, 23 bp, Artificial sequence
  SiRNA target sequence
aaaaatatttaagaatattgggt

SEQ ID NO: 174242 - DNA, 23 bp, Artificial sequence
  SiRNA target sequence
aaaatatttaagaatattgggtc

SEQ ID NO: 174243 - DNA, 23 bp, Artificial sequence
  SiRNA target sequence
aaatatttaagaatattgggtct

SEQ ID NO: 174244 - DNA, 23 bp, Artificial sequence
  SiRNA target sequence
aatatttaagaatattgggtcta

SEQ ID NO: 174245 - DNA, 23 bp, Artificial sequence
  SiRNA target sequence
atatttaagaatattgggtctag

SEQ ID NO: 174246 - DNA, 23 bp, Artificial sequence
  SiRNA target sequence
tatttaagaatattgggtctaga

SEQ ID NO: 174247 - DNA, 23 bp, Artificial sequence
  SiRNA target sequence
atttaagaatattgggtctagaa

SEQ ID NO: 174248 - DNA, 23 bp, Artificial sequence
  SiRNA target sequence
tttaagaatattgggtctagaac

SEQ ID NO: 174249 - DNA, 23 bp, Artificial sequence
  SiRNA target sequence
ttaagaatattgggtctagaacc

SEQ ID NO: 174250 - DNA, 23 bp, Artificial sequence
  SiRNA target sequence
taagaatattgggtctagaacct

SEQ ID NO: 174251 - DNA, 23 bp, Artificial sequence
  SiRNA target sequence
aagaatattgggtctagaacctt

SEQ ID NO: 174252 - DNA, 23 bp, Artificial sequence
  SiRNA target sequence
agaatattgggtctagaaccttt

SEQ ID NO: 174253 - DNA, 23 bp, Artificial sequence
  SiRNA target sequence
gaatattgggtctagaacctttt

SEQ ID NO: 174254 - DNA, 23 bp, Artificial sequence
  SiRNA target sequence
aatattgggtctagaaccttttc

SEQ ID NO: 174255 - DNA, 23 bp, Artificial sequence
  SiRNA target sequence
atattgggtctagaaccttttct

SEQ ID NO: 174256 - DNA, 23 bp, Artificial sequence
  SiRNA target sequence
tattgggtctagaaccttttctt

SEQ ID NO: 174257 - DNA, 23 bp, Artificial sequence
  SiRNA target sequence
attgggtctagaaccttttctta

SEQ ID NO: 174258 - DNA, 23 bp, Artificial sequence
  SiRNA target sequence
ttgggtctagaaccttttcttaa

SEQ ID NO: 174259 - DNA, 23 bp, Artificial sequence
  SiRNA target sequence
tgggtctagaaccttttcttaat

SEQ ID NO: 174260 - DNA, 23 bp, Artificial sequence
  SiRNA target sequence
gggtctagaaccttttcttaatt

SEQ ID NO: 174261 - DNA, 23 bp, Artificial sequence
  SiRNA target sequence
ggtctagaaccttttcttaattt

SEQ ID NO: 174262 - DNA, 23 bp, Artificial sequence
  SiRNA target sequence
gtctagaaccttttcttaatttt

SEQ ID NO: 174263 - DNA, 23 bp, Artificial sequence
  SiRNA target sequence
tctagaaccttttcttaatttta

SEQ ID NO: 174264 - DNA, 23 bp, Artificial sequence
  SiRNA target sequence
ctagaaccttttcttaattttat

SEQ ID NO: 174265 - DNA, 23 bp, Artificial sequence
  SiRNA target sequence
tagaaccttttcttaattttatt

SEQ ID NO: 174266 - DNA, 23 bp, Artificial sequence
  SiRNA target sequence
agaaccttttcttaattttatta

SEQ ID NO: 174267 - DNA, 23 bp, Artificial sequence
  SiRNA target sequence
gaaccttttcttaattttattaa

SEQ ID NO: 174268 - DNA, 23 bp, Artificial sequence
  SiRNA target sequence
aaccttttcttaattttattaag

SEQ ID NO: 174269 - DNA, 23 bp, Artificial sequence
  SiRNA target sequence
accttttcttaattttattaagg

SEQ ID NO: 174270 - DNA, 23 bp, Artificial sequence
  SiRNA target sequence
ccttttcttaattttattaagga

SEQ ID NO: 174271 - DNA, 23 bp, Artificial sequence
  SiRNA target sequence
cttttcttaattttattaaggaa

SEQ ID NO: 174272 - DNA, 23 bp, Artificial sequence
  SiRNA target sequence
ttttcttaattttattaaggaaa

SEQ ID NO: 174273 - DNA, 23 bp, Artificial sequence
  SiRNA target sequence
tttcttaattttattaaggaaag

SEQ ID NO: 174274 - DNA, 23 bp, Artificial sequence
  SiRNA target sequence
ttcttaattttattaaggaaagt

SEQ ID NO: 174275 - DNA, 23 bp, Artificial sequence
  SiRNA target sequence
tcttaattttattaaggaaagta

SEQ ID NO: 174276 - DNA, 23 bp, Artificial sequence
  SiRNA target sequence
cttaattttattaaggaaagtaa

SEQ ID NO: 174277 - DNA, 23 bp, Artificial sequence
  SiRNA target sequence
ttaattttattaaggaaagtaaa

SEQ ID NO: 174278 - DNA, 23 bp, Artificial sequence
  SiRNA target sequence
taattttattaaggaaagtaaac

SEQ ID NO: 174279 - DNA, 23 bp, Artificial sequence
  SiRNA target sequence
aattttattaaggaaagtaaaca

SEQ ID NO: 174280 - DNA, 23 bp, Artificial sequence
  SiRNA target sequence
attttattaaggaaagtaaacat

SEQ ID NO: 174281 - DNA, 23 bp, Artificial sequence
  SiRNA target sequence
ttttattaaggaaagtaaacata

SEQ ID NO: 174282 - DNA, 23 bp, Artificial sequence
  SiRNA target sequence
tttattaaggaaagtaaacataa

SEQ ID NO: 174283 - DNA, 23 bp, Artificial sequence
  SiRNA target sequence
ttattaaggaaagtaaacataaa

SEQ ID NO: 174284 - DNA, 23 bp, Artificial sequence
  SiRNA target sequence
tattaaggaaagtaaacataaag

SEQ ID NO: 174285 - DNA, 23 bp, Artificial sequence
  SiRNA target sequence
attaaggaaagtaaacataaaga

SEQ ID NO: 174286 - DNA, 23 bp, Artificial sequence
  SiRNA target sequence
ttaaggaaagtaaacataaagaa

SEQ ID NO: 174287 - DNA, 23 bp, Artificial sequence
  SiRNA target sequence
taaggaaagtaaacataaagaat

SEQ ID NO: 174288 - DNA, 23 bp, Artificial sequence
  SiRNA target sequence
aaggaaagtaaacataaagaatt

SEQ ID NO: 174289 - DNA, 23 bp, Artificial sequence
  SiRNA target sequence
aggaaagtaaacataaagaatta

SEQ ID NO: 174290 - DNA, 23 bp, Artificial sequence
  SiRNA target sequence
ggaaagtaaacataaagaattag

SEQ ID NO: 174291 - DNA, 23 bp, Artificial sequence
  SiRNA target sequence
gaaagtaaacataaagaattaga

SEQ ID NO: 174292 - DNA, 23 bp, Artificial sequence
  SiRNA target sequence
aaagtaaacataaagaattagaa

SEQ ID NO: 174293 - DNA, 23 bp, Artificial sequence
  SiRNA target sequence
aagtaaacataaagaattagaat

SEQ ID NO: 174294 - DNA, 23 bp, Artificial sequence
  SiRNA target sequence
agtaaacataaagaattagaata

SEQ ID NO: 174295 - DNA, 23 bp, Artificial sequence
  SiRNA target sequence
gtaaacataaagaattagaatat

SEQ ID NO: 174296 - DNA, 23 bp, Artificial sequence
  SiRNA target sequence
taaacataaagaattagaatatg

SEQ ID NO: 174297 - DNA, 23 bp, Artificial sequence
  SiRNA target sequence
aaacataaagaattagaatatga

SEQ ID NO: 174298 - DNA, 23 bp, Artificial sequence
  SiRNA target sequence
aacataaagaattagaatatgat

SEQ ID NO: 174299 - DNA, 23 bp, Artificial sequence
  SiRNA target sequence
acataaagaattagaatatgatg

SEQ ID NO: 174300 - DNA, 23 bp, Artificial sequence
  SiRNA target sequence
cataaagaattagaatatgatgt

SEQ ID NO: 174301 - DNA, 23 bp, Artificial sequence
  SiRNA target sequence
ataaagaattagaatatgatgta

SEQ ID NO: 174302 - DNA, 23 bp, Artificial sequence
  SiRNA target sequence
taaagaattagaatatgatgtat

SEQ ID NO: 174303 - DNA, 23 bp, Artificial sequence
  SiRNA target sequence
aaagaattagaatatgatgtatg

SEQ ID NO: 174304 - DNA, 23 bp, Artificial sequence
  SiRNA target sequence
aagaattagaatatgatgtatgc

SEQ ID NO: 174305 - DNA, 23 bp, Artificial sequence
  SiRNA target sequence
agaattagaatatgatgtatgcg

SEQ ID NO: 174306 - DNA, 23 bp, Artificial sequence
  SiRNA target sequence
gaattagaatatgatgtatgcga

SEQ ID NO: 174307 - DNA, 23 bp, Artificial sequence
  SiRNA target sequence
aattagaatatgatgtatgcgaa

SEQ ID NO: 174308 - DNA, 23 bp, Artificial sequence
  SiRNA target sequence
attagaatatgatgtatgcgaaa

SEQ ID NO: 174309 - DNA, 23 bp, Artificial sequence
  SiRNA target sequence
ttagaatatgatgtatgcgaaat

SEQ ID NO: 174310 - DNA, 23 bp, Artificial sequence
  SiRNA target sequence
tagaatatgatgtatgcgaaata

SEQ ID NO: 174311 - DNA, 23 bp, Artificial sequence
  SiRNA target sequence
agaatatgatgtatgcgaaatat

SEQ ID NO: 174312 - DNA, 23 bp, Artificial sequence
  SiRNA target sequence
gaatatgatgtatgcgaaatata

SEQ ID NO: 174313 - DNA, 23 bp, Artificial sequence
  SiRNA target sequence
aatatgatgtatgcgaaatatac

SEQ ID NO: 174314 - DNA, 23 bp, Artificial sequence
  SiRNA target sequence
atatgatgtatgcgaaatataca

SEQ ID NO: 174315 - DNA, 23 bp, Artificial sequence
  SiRNA target sequence
tatgatgtatgcgaaatatacat

SEQ ID NO: 174316 - DNA, 23 bp, Artificial sequence
  SiRNA target sequence
atgatgtatgcgaaatatacatt

SEQ ID NO: 174317 - DNA, 23 bp, Artificial sequence
  SiRNA target sequence
tgatgtatgcgaaatatacattt

SEQ ID NO: 174318 - DNA, 23 bp, Artificial sequence
  SiRNA target sequence
gatgtatgcgaaatatacatttg

SEQ ID NO: 174319 - DNA, 23 bp, Artificial sequence
  SiRNA target sequence
atgtatgcgaaatatacatttgt

SEQ ID NO: 174320 - DNA, 23 bp, Artificial sequence
  SiRNA target sequence
tgtatgcgaaatatacatttgta

SEQ ID NO: 174321 - DNA, 23 bp, Artificial sequence
  SiRNA target sequence
gtatgcgaaatatacatttgtaa

SEQ ID NO: 174322 - DNA, 23 bp, Artificial sequence
  SiRNA target sequence
tatgcgaaatatacatttgtaat

SEQ ID NO: 174323 - DNA, 23 bp, Artificial sequence
  SiRNA target sequence
atgcgaaatatacatttgtaatc

SEQ ID NO: 174324 - DNA, 23 bp, Artificial sequence
  SiRNA target sequence
tgcgaaatatacatttgtaatca

SEQ ID NO: 174325 - DNA, 23 bp, Artificial sequence
  SiRNA target sequence
gcgaaatatacatttgtaatcag

SEQ ID NO: 174326 - DNA, 23 bp, Artificial sequence
  SiRNA target sequence
cgaaatatacatttgtaatcagg

SEQ ID NO: 174327 - DNA, 23 bp, Artificial sequence
  SiRNA target sequence
gaaatatacatttgtaatcaggg

SEQ ID NO: 174328 - DNA, 23 bp, Artificial sequence
  SiRNA target sequence
aaatatacatttgtaatcaggga

SEQ ID NO: 174329 - DNA, 23 bp, Artificial sequence
  SiRNA target sequence
aatatacatttgtaatcagggat

SEQ ID NO: 174330 - DNA, 23 bp, Artificial sequence
  SiRNA target sequence
atatacatttgtaatcagggatg

SEQ ID NO: 174331 - DNA, 23 bp, Artificial sequence
  SiRNA target sequence
tatacatttgtaatcagggatgc

SEQ ID NO: 174332 - DNA, 23 bp, Artificial sequence
  SiRNA target sequence
atacatttgtaatcagggatgca

SEQ ID NO: 174333 - DNA, 23 bp, Artificial sequence
  SiRNA target sequence
tacatttgtaatcagggatgcat

SEQ ID NO: 174334 - DNA, 23 bp, Artificial sequence
  SiRNA target sequence
acatttgtaatcagggatgcatt

SEQ ID NO: 174335 - DNA, 23 bp, Artificial sequence
  SiRNA target sequence
catttgtaatcagggatgcatta

SEQ ID NO: 174336 - DNA, 23 bp, Artificial sequence
  SiRNA target sequence
atttgtaatcagggatgcattaa

SEQ ID NO: 174337 - DNA, 23 bp, Artificial sequence
  SiRNA target sequence
tttgtaatcagggatgcattaat

SEQ ID NO: 174338 - DNA, 23 bp, Artificial sequence
  SiRNA target sequence
ttgtaatcagggatgcattaatg

SEQ ID NO: 174339 - DNA, 23 bp, Artificial sequence
  SiRNA target sequence
tgtaatcagggatgcattaatgg

SEQ ID NO: 174340 - DNA, 23 bp, Artificial sequence
  SiRNA target sequence
gtaatcagggatgcattaatgga

SEQ ID NO: 174341 - DNA, 23 bp, Artificial sequence
  SiRNA target sequence
taatcagggatgcattaatggac

SEQ ID NO: 174342 - DNA, 23 bp, Artificial sequence
  SiRNA target sequence
aatcagggatgcattaatggacc

SEQ ID NO: 174343 - DNA, 23 bp, Artificial sequence
  SiRNA target sequence
atcagggatgcattaatggacca

SEQ ID NO: 174344 - DNA, 23 bp, Artificial sequence
  SiRNA target sequence
tcagggatgcattaatggaccag

SEQ ID NO: 174345 - DNA, 23 bp, Artificial sequence
  SiRNA target sequence
cagggatgcattaatggaccagg

SEQ ID NO: 174346 - DNA, 23 bp, Artificial sequence
  SiRNA target sequence
agggatgcattaatggaccagga

SEQ ID NO: 174347 - DNA, 23 bp, Artificial sequence
  SiRNA target sequence
gggatgcattaatggaccaggac

SEQ ID NO: 174348 - DNA, 23 bp, Artificial sequence
  SiRNA target sequence
ggatgcattaatggaccaggaca

SEQ ID NO: 174349 - DNA, 23 bp, Artificial sequence
  SiRNA target sequence
gatgcattaatggaccaggacaa

SEQ ID NO: 174350 - DNA, 23 bp, Artificial sequence
  SiRNA target sequence
atgcattaatggaccaggacaat

SEQ ID NO: 174351 - DNA, 23 bp, Artificial sequence
  SiRNA target sequence
tgcattaatggaccaggacaatt

SEQ ID NO: 174352 - DNA, 23 bp, Artificial sequence
  SiRNA target sequence
gcattaatggaccaggacaattg

SEQ ID NO: 174353 - DNA, 23 bp, Artificial sequence
  SiRNA target sequence
cattaatggaccaggacaattgt

SEQ ID NO: 174354 - DNA, 23 bp, Artificial sequence
  SiRNA target sequence
attaatggaccaggacaattgta

SEQ ID NO: 174355 - DNA, 23 bp, Artificial sequence
  SiRNA target sequence
ttaatggaccaggacaattgtat

SEQ ID NO: 174356 - DNA, 23 bp, Artificial sequence
  SiRNA target sequence
taatggaccaggacaattgtata

SEQ ID NO: 174357 - DNA, 23 bp, Artificial sequence
  SiRNA target sequence
aatggaccaggacaattgtatac

SEQ ID NO: 174358 - DNA, 23 bp, Artificial sequence
  SiRNA target sequence
atggaccaggacaattgtataca

SEQ ID NO: 174359 - DNA, 23 bp, Artificial sequence
  SiRNA target sequence
tggaccaggacaattgtatacag

SEQ ID NO: 174360 - DNA, 23 bp, Artificial sequence
  SiRNA target sequence
ggaccaggacaattgtatacaga

SEQ ID NO: 174361 - DNA, 23 bp, Artificial sequence
  SiRNA target sequence
gaccaggacaattgtatacagat

SEQ ID NO: 174362 - DNA, 23 bp, Artificial sequence
  SiRNA target sequence
accaggacaattgtatacagata

SEQ ID NO: 174363 - DNA, 23 bp, Artificial sequence
  SiRNA target sequence
ccaggacaattgtatacagataa

SEQ ID NO: 174364 - DNA, 23 bp, Artificial sequence
  SiRNA target sequence
caggacaattgtatacagataat

SEQ ID NO: 174365 - DNA, 23 bp, Artificial sequence
  SiRNA target sequence
aggacaattgtatacagataatt

SEQ ID NO: 174366 - DNA, 23 bp, Artificial sequence
  SiRNA target sequence
ggacaattgtatacagataattt

SEQ ID NO: 174367 - DNA, 23 bp, Artificial sequence
  SiRNA target sequence
gacaattgtatacagataattta

SEQ ID NO: 174368 - DNA, 23 bp, Artificial sequence
  SiRNA target sequence
acaattgtatacagataatttat

SEQ ID NO: 174369 - DNA, 23 bp, Artificial sequence
  SiRNA target sequence
caattgtatacagataatttata

SEQ ID NO: 174370 - DNA, 23 bp, Artificial sequence
  SiRNA target sequence
aattgtatacagataatttatat

SEQ ID NO: 174371 - DNA, 23 bp, Artificial sequence
  SiRNA target sequence
attgtatacagataatttatatg

SEQ ID NO: 174372 - DNA, 23 bp, Artificial sequence
  SiRNA target sequence
ttgtatacagataatttatatgt

SEQ ID NO: 174373 - DNA, 23 bp, Artificial sequence
  SiRNA target sequence
tgtatacagataatttatatgta

SEQ ID NO: 174374 - DNA, 23 bp, Artificial sequence
  SiRNA target sequence
gtatacagataatttatatgtaa

SEQ ID NO: 174375 - DNA, 23 bp, Artificial sequence
  SiRNA target sequence
tatacagataatttatatgtaaa

SEQ ID NO: 174376 - DNA, 23 bp, Artificial sequence
  SiRNA target sequence
atacagataatttatatgtaaat

SEQ ID NO: 174377 - DNA, 23 bp, Artificial sequence
  SiRNA target sequence
tacagataatttatatgtaaata

SEQ ID NO: 174378 - DNA, 23 bp, Artificial sequence
  SiRNA target sequence
acagataatttatatgtaaataa

SEQ ID NO: 174379 - DNA, 23 bp, Artificial sequence
  SiRNA target sequence
cagataatttatatgtaaataat

SEQ ID NO: 174380 - DNA, 23 bp, Artificial sequence
  SiRNA target sequence
agataatttatatgtaaataatt

SEQ ID NO: 174381 - DNA, 23 bp, Artificial sequence
  SiRNA target sequence
gataatttatatgtaaataattc

SEQ ID NO: 174382 - DNA, 23 bp, Artificial sequence
  SiRNA target sequence
ataatttatatgtaaataattca

SEQ ID NO: 174383 - DNA, 23 bp, Artificial sequence
  SiRNA target sequence
taatttatatgtaaataattcag

SEQ ID NO: 174384 - DNA, 23 bp, Artificial sequence
  SiRNA target sequence
aatttatatgtaaataattcaga

SEQ ID NO: 174385 - DNA, 23 bp, Artificial sequence
  SiRNA target sequence
atttatatgtaaataattcagaa

SEQ ID NO: 174386 - DNA, 23 bp, Artificial sequence
  SiRNA target sequence
tttatatgtaaataattcagaat

SEQ ID NO: 174387 - DNA, 23 bp, Artificial sequence
  SiRNA target sequence
ttatatgtaaataattcagaata

SEQ ID NO: 174388 - DNA, 23 bp, Artificial sequence
  SiRNA target sequence
tatatgtaaataattcagaatac

SEQ ID NO: 174389 - DNA, 23 bp, Artificial sequence
  SiRNA target sequence
atatgtaaataattcagaataca

SEQ ID NO: 174390 - DNA, 23 bp, Artificial sequence
  SiRNA target sequence
tatgtaaataattcagaatacat

SEQ ID NO: 174391 - DNA, 23 bp, Artificial sequence
  SiRNA target sequence
atgtaaataattcagaatacata

SEQ ID NO: 174392 - DNA, 23 bp, Artificial sequence
  SiRNA target sequence
tgtaaataattcagaatacatag

SEQ ID NO: 174393 - DNA, 23 bp, Artificial sequence
  SiRNA target sequence
gtaaataattcagaatacataga

SEQ ID NO: 174394 - DNA, 23 bp, Artificial sequence
  SiRNA target sequence
taaataattcagaatacatagat

SEQ ID NO: 174395 - DNA, 23 bp, Artificial sequence
  SiRNA target sequence
aaataattcagaatacatagata

SEQ ID NO: 174396 - DNA, 23 bp, Artificial sequence
  SiRNA target sequence
aataattcagaatacatagatat

SEQ ID NO: 174397 - DNA, 23 bp, Artificial sequence
  SiRNA target sequence
ataattcagaatacatagatatt

SEQ ID NO: 174398 - DNA, 23 bp, Artificial sequence
  SiRNA target sequence
taattcagaatacatagatattg

SEQ ID NO: 174399 - DNA, 23 bp, Artificial sequence
  SiRNA target sequence
aattcagaatacatagatattga

SEQ ID NO: 174400 - DNA, 23 bp, Artificial sequence
  SiRNA target sequence
attcagaatacatagatattgat

SEQ ID NO: 174401 - DNA, 23 bp, Artificial sequence
  SiRNA target sequence
ttcagaatacatagatattgatc

SEQ ID NO: 174402 - DNA, 23 bp, Artificial sequence
  SiRNA target sequence
tcagaatacatagatattgatct

SEQ ID NO: 174403 - DNA, 23 bp, Artificial sequence
  SiRNA target sequence
cagaatacatagatattgatctt

SEQ ID NO: 174404 - DNA, 23 bp, Artificial sequence
  SiRNA target sequence
agaatacatagatattgatcttg

SEQ ID NO: 174405 - DNA, 23 bp, Artificial sequence
  SiRNA target sequence
gaatacatagatattgatcttgg

SEQ ID NO: 174406 - DNA, 23 bp, Artificial sequence
  SiRNA target sequence
aatacatagatattgatcttggt

SEQ ID NO: 174407 - DNA, 23 bp, Artificial sequence
  SiRNA target sequence
atacatagatattgatcttggta

SEQ ID NO: 174408 - DNA, 23 bp, Artificial sequence
  SiRNA target sequence
tacatagatattgatcttggtat

SEQ ID NO: 174409 - DNA, 23 bp, Artificial sequence
  SiRNA target sequence
acatagatattgatcttggtatt

SEQ ID NO: 174410 - DNA, 23 bp, Artificial sequence
  SiRNA target sequence
catagatattgatcttggtattg

SEQ ID NO: 174411 - DNA, 23 bp, Artificial sequence
  SiRNA target sequence
atagatattgatcttggtattga

SEQ ID NO: 174412 - DNA, 23 bp, Artificial sequence
  SiRNA target sequence
tagatattgatcttggtattgat

SEQ ID NO: 174413 - DNA, 23 bp, Artificial sequence
  SiRNA target sequence
agatattgatcttggtattgatt

SEQ ID NO: 174414 - DNA, 23 bp, Artificial sequence
  SiRNA target sequence
gatattgatcttggtattgattg

SEQ ID NO: 174415 - DNA, 23 bp, Artificial sequence
  SiRNA target sequence
atattgatcttggtattgattgt

SEQ ID NO: 174416 - DNA, 23 bp, Artificial sequence
  SiRNA target sequence
tattgatcttggtattgattgta

SEQ ID NO: 174417 - DNA, 23 bp, Artificial sequence
  SiRNA target sequence
attgatcttggtattgattgtaa

SEQ ID NO: 174418 - DNA, 23 bp, Artificial sequence
  SiRNA target sequence
ttgatcttggtattgattgtaaa

SEQ ID NO: 174419 - DNA, 23 bp, Artificial sequence
  SiRNA target sequence
tgatcttggtattgattgtaaac

SEQ ID NO: 174420 - DNA, 23 bp, Artificial sequence
  SiRNA target sequence
gatcttggtattgattgtaaaca

SEQ ID NO: 174421 - DNA, 23 bp, Artificial sequence
  SiRNA target sequence
atcttggtattgattgtaaacag

SEQ ID NO: 174422 - DNA, 23 bp, Artificial sequence
  SiRNA target sequence
tcttggtattgattgtaaacagt

SEQ ID NO: 174423 - DNA, 23 bp, Artificial sequence
  SiRNA target sequence
cttggtattgattgtaaacagtt

SEQ ID NO: 174424 - DNA, 23 bp, Artificial sequence
  SiRNA target sequence
ttggtattgattgtaaacagtta

SEQ ID NO: 174425 - DNA, 23 bp, Artificial sequence
  SiRNA target sequence
tggtattgattgtaaacagttac

SEQ ID NO: 174426 - DNA, 23 bp, Artificial sequence
  SiRNA target sequence
ggtattgattgtaaacagttaca

SEQ ID NO: 174427 - DNA, 23 bp, Artificial sequence
  SiRNA target sequence
gtattgattgtaaacagttacaa

SEQ ID NO: 174428 - DNA, 23 bp, Artificial sequence
  SiRNA target sequence
tattgattgtaaacagttacaaa

SEQ ID NO: 174429 - DNA, 23 bp, Artificial sequence
  SiRNA target sequence
attgattgtaaacagttacaaaa

SEQ ID NO: 174430 - DNA, 23 bp, Artificial sequence
  SiRNA target sequence
ttgattgtaaacagttacaaaaa

SEQ ID NO: 174431 - DNA, 23 bp, Artificial sequence
  SiRNA target sequence
tgattgtaaacagttacaaaaaa

SEQ ID NO: 174432 - DNA, 23 bp, Artificial sequence
  SiRNA target sequence
gattgtaaacagttacaaaaaag

SEQ ID NO: 174433 - DNA, 23 bp, Artificial sequence
  SiRNA target sequence
attgtaaacagttacaaaaaagg

SEQ ID NO: 174434 - DNA, 23 bp, Artificial sequence
  SiRNA target sequence
ttgtaaacagttacaaaaaagga

SEQ ID NO: 174435 - DNA, 23 bp, Artificial sequence
  SiRNA target sequence
tgtaaacagttacaaaaaaggac

SEQ ID NO: 174436 - DNA, 23 bp, Artificial sequence
  SiRNA target sequence
gtaaacagttacaaaaaaggaca

SEQ ID NO: 174437 - DNA, 23 bp, Artificial sequence
  SiRNA target sequence
taaacagttacaaaaaaggacat

SEQ ID NO: 174438 - DNA, 23 bp, Artificial sequence
  SiRNA target sequence
aaacagttacaaaaaaggacata

SEQ ID NO: 174439 - DNA, 23 bp, Artificial sequence
  SiRNA target sequence
aacagttacaaaaaaggacatat

SEQ ID NO: 174440 - DNA, 23 bp, Artificial sequence
  SiRNA target sequence
acagttacaaaaaaggacatata

SEQ ID NO: 174441 - DNA, 23 bp, Artificial sequence
  SiRNA target sequence
cagttacaaaaaaggacatatag

SEQ ID NO: 174442 - DNA, 23 bp, Artificial sequence
  SiRNA target sequence
agttacaaaaaaggacatataga

SEQ ID NO: 174443 - DNA, 23 bp, Artificial sequence
  SiRNA target sequence
gttacaaaaaaggacatatagaa

SEQ ID NO: 174444 - DNA, 23 bp, Artificial sequence
  SiRNA target sequence
ttacaaaaaaggacatatagaaa

SEQ ID NO: 174445 - DNA, 23 bp, Artificial sequence
  SiRNA target sequence
tacaaaaaaggacatatagaaaa

SEQ ID NO: 174446 - DNA, 23 bp, Artificial sequence
  SiRNA target sequence
acaaaaaaggacatatagaaaaa

SEQ ID NO: 174447 - DNA, 23 bp, Artificial sequence
  SiRNA target sequence
caaaaaaggacatatagaaaaat

SEQ ID NO: 174448 - DNA, 23 bp, Artificial sequence
  SiRNA target sequence
aaaaaaggacatatagaaaaata

SEQ ID NO: 174449 - DNA, 23 bp, Artificial sequence
  SiRNA target sequence
aaaaaggacatatagaaaaatag

SEQ ID NO: 174450 - DNA, 23 bp, Artificial sequence
  SiRNA target sequence
aaaaggacatatagaaaaataga

SEQ ID NO: 174451 - DNA, 23 bp, Artificial sequence
  SiRNA target sequence
aaaggacatatagaaaaatagaa

SEQ ID NO: 174452 - DNA, 23 bp, Artificial sequence
  SiRNA target sequence
aaggacatatagaaaaatagaaa

SEQ ID NO: 174453 - DNA, 23 bp, Artificial sequence
  SiRNA target sequence
aggacatatagaaaaatagaaac

SEQ ID NO: 174454 - DNA, 23 bp, Artificial sequence
  SiRNA target sequence
ggacatatagaaaaatagaaaca

SEQ ID NO: 174455 - DNA, 23 bp, Artificial sequence
  SiRNA target sequence
gacatatagaaaaatagaaacaa

SEQ ID NO: 174456 - DNA, 23 bp, Artificial sequence
  SiRNA target sequence
acatatagaaaaatagaaacaaa

SEQ ID NO: 174457 - DNA, 23 bp, Artificial sequence
  SiRNA target sequence
catatagaaaaatagaaacaaag

SEQ ID NO: 174458 - DNA, 23 bp, Artificial sequence
  SiRNA target sequence
atatagaaaaatagaaacaaaga

SEQ ID NO: 174459 - DNA, 23 bp, Artificial sequence
  SiRNA target sequence
tatagaaaaatagaaacaaagaa

SEQ ID NO: 174460 - DNA, 23 bp, Artificial sequence
  SiRNA target sequence
atagaaaaatagaaacaaagaaa

SEQ ID NO: 174461 - DNA, 23 bp, Artificial sequence
  SiRNA target sequence
tagaaaaatagaaacaaagaaag

SEQ ID NO: 174462 - DNA, 23 bp, Artificial sequence
  SiRNA target sequence
agaaaaatagaaacaaagaaagt

SEQ ID NO: 174463 - DNA, 23 bp, Artificial sequence
  SiRNA target sequence
gaaaaatagaaacaaagaaagtt

SEQ ID NO: 174464 - DNA, 23 bp, Artificial sequence
  SiRNA target sequence
aaaaatagaaacaaagaaagtta

SEQ ID NO: 174465 - DNA, 23 bp, Artificial sequence
  SiRNA target sequence
aaaatagaaacaaagaaagttaa

SEQ ID NO: 174466 - DNA, 23 bp, Artificial sequence
  SiRNA target sequence
aaatagaaacaaagaaagttaat

SEQ ID NO: 174467 - DNA, 23 bp, Artificial sequence
  SiRNA target sequence
aatagaaacaaagaaagttaatt

SEQ ID NO: 174468 - DNA, 23 bp, Artificial sequence
  SiRNA target sequence
atagaaacaaagaaagttaattt

SEQ ID NO: 174469 - DNA, 23 bp, Artificial sequence
  SiRNA target sequence
tagaaacaaagaaagttaatttt

SEQ ID NO: 174470 - DNA, 23 bp, Artificial sequence
  SiRNA target sequence
agaaacaaagaaagttaatttta

SEQ ID NO: 174471 - DNA, 23 bp, Artificial sequence
  SiRNA target sequence
gaaacaaagaaagttaattttaa

SEQ ID NO: 174472 - DNA, 23 bp, Artificial sequence
  SiRNA target sequence
aaacaaagaaagttaattttaaa

SEQ ID NO: 174473 - DNA, 23 bp, Artificial sequence
  SiRNA target sequence
aacaaagaaagttaattttaaaa

SEQ ID NO: 174474 - DNA, 23 bp, Artificial sequence
  SiRNA target sequence
acaaagaaagttaattttaaaat

SEQ ID NO: 174475 - DNA, 23 bp, Artificial sequence
  SiRNA target sequence
caaagaaagttaattttaaaata

SEQ ID NO: 174476 - DNA, 23 bp, Artificial sequence
  SiRNA target sequence
aaagaaagttaattttaaaatag

SEQ ID NO: 174477 - DNA, 23 bp, Artificial sequence
  SiRNA target sequence
aagaaagttaattttaaaataga

SEQ ID NO: 174478 - DNA, 23 bp, Artificial sequence
  SiRNA target sequence
agaaagttaattttaaaatagaa

SEQ ID NO: 174479 - DNA, 23 bp, Artificial sequence
  SiRNA target sequence
gaaagttaattttaaaatagaat

SEQ ID NO: 174480 - DNA, 23 bp, Artificial sequence
  SiRNA target sequence
aaagttaattttaaaatagaatg

SEQ ID NO: 174481 - DNA, 23 bp, Artificial sequence
  SiRNA target sequence
aagttaattttaaaatagaatgg

SEQ ID NO: 174482 - DNA, 23 bp, Artificial sequence
  SiRNA target sequence
agttaattttaaaatagaatggt

SEQ ID NO: 174483 - DNA, 23 bp, Artificial sequence
  SiRNA target sequence
gttaattttaaaatagaatggta

SEQ ID NO: 174484 - DNA, 23 bp, Artificial sequence
  SiRNA target sequence
ttaattttaaaatagaatggtaa

SEQ ID NO: 174485 - DNA, 24 bp, Artificial sequence
  SiRNA target sequence
atgaatactgaaaataaaccatgt

SEQ ID NO: 174486 - DNA, 24 bp, Artificial sequence
  SiRNA target sequence
tgaatactgaaaataaaccatgta

SEQ ID NO: 174487 - DNA, 24 bp, Artificial sequence
  SiRNA target sequence
gaatactgaaaataaaccatgtat

SEQ ID NO: 174488 - DNA, 24 bp, Artificial sequence
  SiRNA target sequence
aatactgaaaataaaccatgtatt

SEQ ID NO: 174489 - DNA, 24 bp, Artificial sequence
  SiRNA target sequence
atactgaaaataaaccatgtattt

SEQ ID NO: 174490 - DNA, 24 bp, Artificial sequence
  SiRNA target sequence
tactgaaaataaaccatgtatttc

SEQ ID NO: 174491 - DNA, 24 bp, Artificial sequence
  SiRNA target sequence
actgaaaataaaccatgtatttca

SEQ ID NO: 174492 - DNA, 24 bp, Artificial sequence
  SiRNA target sequence
ctgaaaataaaccatgtatttcac

SEQ ID NO: 174493 - DNA, 24 bp, Artificial sequence
  SiRNA target sequence
tgaaaataaaccatgtatttcacc

SEQ ID NO: 174494 - DNA, 24 bp, Artificial sequence
  SiRNA target sequence
gaaaataaaccatgtatttcacca

SEQ ID NO: 174495 - DNA, 24 bp, Artificial sequence
  SiRNA target sequence
aaaataaaccatgtatttcaccat

SEQ ID NO: 174496 - DNA, 24 bp, Artificial sequence
  SiRNA target sequence
aaataaaccatgtatttcaccatt

SEQ ID NO: 174497 - DNA, 24 bp, Artificial sequence
  SiRNA target sequence
aataaaccatgtatttcaccattt

SEQ ID NO: 174498 - DNA, 24 bp, Artificial sequence
  SiRNA target sequence
ataaaccatgtatttcaccattta

SEQ ID NO: 174499 - DNA, 24 bp, Artificial sequence
  SiRNA target sequence
taaaccatgtatttcaccatttac

SEQ ID NO: 174500 - DNA, 24 bp, Artificial sequence
  SiRNA target sequence
aaaccatgtatttcaccatttacc

SEQ ID NO: 174501 - DNA, 24 bp, Artificial sequence
  SiRNA target sequence
aaccatgtatttcaccatttacct

SEQ ID NO: 174502 - DNA, 24 bp, Artificial sequence
  SiRNA target sequence
accatgtatttcaccatttacctt

SEQ ID NO: 174503 - DNA, 24 bp, Artificial sequence
  SiRNA target sequence
ccatgtatttcaccatttaccttt

SEQ ID NO: 174504 - DNA, 24 bp, Artificial sequence
  SiRNA target sequence
catgtatttcaccatttaccttta

SEQ ID NO: 174505 - DNA, 24 bp, Artificial sequence
  SiRNA target sequence
atgtatttcaccatttacctttaa

SEQ ID NO: 174506 - DNA, 24 bp, Artificial sequence
  SiRNA target sequence
tgtatttcaccatttacctttaaa

SEQ ID NO: 174507 - DNA, 24 bp, Artificial sequence
  SiRNA target sequence
gtatttcaccatttacctttaaac

SEQ ID NO: 174508 - DNA, 24 bp, Artificial sequence
  SiRNA target sequence
tatttcaccatttacctttaaact

SEQ ID NO: 174509 - DNA, 24 bp, Artificial sequence
  SiRNA target sequence
atttcaccatttacctttaaacta

SEQ ID NO: 174510 - DNA, 24 bp, Artificial sequence
  SiRNA target sequence
tttcaccatttacctttaaactag

SEQ ID NO: 174511 - DNA, 24 bp, Artificial sequence
  SiRNA target sequence
ttcaccatttacctttaaactaga

SEQ ID NO: 174512 - DNA, 24 bp, Artificial sequence
  SiRNA target sequence
tcaccatttacctttaaactagaa

SEQ ID NO: 174513 - DNA, 24 bp, Artificial sequence
  SiRNA target sequence
caccatttacctttaaactagaag

SEQ ID NO: 174514 - DNA, 24 bp, Artificial sequence
  SiRNA target sequence
accatttacctttaaactagaaga

SEQ ID NO: 174515 - DNA, 24 bp, Artificial sequence
  SiRNA target sequence
ccatttacctttaaactagaagat

SEQ ID NO: 174516 - DNA, 24 bp, Artificial sequence
  SiRNA target sequence
catttacctttaaactagaagatt

SEQ ID NO: 174517 - DNA, 24 bp, Artificial sequence
  SiRNA target sequence
atttacctttaaactagaagattg

SEQ ID NO: 174518 - DNA, 24 bp, Artificial sequence
  SiRNA target sequence
tttacctttaaactagaagattgc

SEQ ID NO: 174519 - DNA, 24 bp, Artificial sequence
  SiRNA target sequence
ttacctttaaactagaagattgcc

SEQ ID NO: 174520 - DNA, 24 bp, Artificial sequence
  SiRNA target sequence
tacctttaaactagaagattgcct

SEQ ID NO: 174521 - DNA, 24 bp, Artificial sequence
  SiRNA target sequence
acctttaaactagaagattgcctg

SEQ ID NO: 174522 - DNA, 24 bp, Artificial sequence
  SiRNA target sequence
cctttaaactagaagattgcctgg

SEQ ID NO: 174523 - DNA, 24 bp, Artificial sequence
  SiRNA target sequence
ctttaaactagaagattgcctggc

SEQ ID NO: 174524 - DNA, 24 bp, Artificial sequence
  SiRNA target sequence
tttaaactagaagattgcctggca

SEQ ID NO: 174525 - DNA, 24 bp, Artificial sequence
  SiRNA target sequence
ttaaactagaagattgcctggcat

SEQ ID NO: 174526 - DNA, 24 bp, Artificial sequence
  SiRNA target sequence
taaactagaagattgcctggcatg

SEQ ID NO: 174527 - DNA, 24 bp, Artificial sequence
  SiRNA target sequence
aaactagaagattgcctggcatgt

SEQ ID NO: 174528 - DNA, 24 bp, Artificial sequence
  SiRNA target sequence
aactagaagattgcctggcatgtt

SEQ ID NO: 174529 - DNA, 24 bp, Artificial sequence
  SiRNA target sequence
actagaagattgcctggcatgttc

SEQ ID NO: 174530 - DNA, 24 bp, Artificial sequence
  SiRNA target sequence
ctagaagattgcctggcatgttcg

SEQ ID NO: 174531 - DNA, 24 bp, Artificial sequence
  SiRNA target sequence
tagaagattgcctggcatgttcgg

SEQ ID NO: 174532 - DNA, 24 bp, Artificial sequence
  SiRNA target sequence
agaagattgcctggcatgttcggc

SEQ ID NO: 174533 - DNA, 24 bp, Artificial sequence
  SiRNA target sequence
gaagattgcctggcatgttcggct

SEQ ID NO: 174534 - DNA, 24 bp, Artificial sequence
  SiRNA target sequence
aagattgcctggcatgttcggctt

SEQ ID NO: 174535 - DNA, 24 bp, Artificial sequence
  SiRNA target sequence
agattgcctggcatgttcggcttg

SEQ ID NO: 174536 - DNA, 24 bp, Artificial sequence
  SiRNA target sequence
gattgcctggcatgttcggcttgt

SEQ ID NO: 174537 - DNA, 24 bp, Artificial sequence
  SiRNA target sequence
attgcctggcatgttcggcttgta

SEQ ID NO: 174538 - DNA, 24 bp, Artificial sequence
  SiRNA target sequence
ttgcctggcatgttcggcttgtat

SEQ ID NO: 174539 - DNA, 24 bp, Artificial sequence
  SiRNA target sequence
tgcctggcatgttcggcttgtatt

SEQ ID NO: 174540 - DNA, 24 bp, Artificial sequence
  SiRNA target sequence
gcctggcatgttcggcttgtattg

SEQ ID NO: 174541 - DNA, 24 bp, Artificial sequence
  SiRNA target sequence
cctggcatgttcggcttgtattgc

SEQ ID NO: 174542 - DNA, 24 bp, Artificial sequence
  SiRNA target sequence
ctggcatgttcggcttgtattgct

SEQ ID NO: 174543 - DNA, 24 bp, Artificial sequence
  SiRNA target sequence
tggcatgttcggcttgtattgctg

SEQ ID NO: 174544 - DNA, 24 bp, Artificial sequence
  SiRNA target sequence
ggcatgttcggcttgtattgctga

SEQ ID NO: 174545 - DNA, 24 bp, Artificial sequence
  SiRNA target sequence
gcatgttcggcttgtattgctgat

SEQ ID NO: 174546 - DNA, 24 bp, Artificial sequence
  SiRNA target sequence
catgttcggcttgtattgctgatt

SEQ ID NO: 174547 - DNA, 24 bp, Artificial sequence
  SiRNA target sequence
atgttcggcttgtattgctgattt

SEQ ID NO: 174548 - DNA, 24 bp, Artificial sequence
  SiRNA target sequence
tgttcggcttgtattgctgatttt

SEQ ID NO: 174549 - DNA, 24 bp, Artificial sequence
  SiRNA target sequence
gttcggcttgtattgctgattttt

SEQ ID NO: 174550 - DNA, 24 bp, Artificial sequence
  SiRNA target sequence
ttcggcttgtattgctgatttttc

SEQ ID NO: 174551 - DNA, 24 bp, Artificial sequence
  SiRNA target sequence
tcggcttgtattgctgatttttct

SEQ ID NO: 174552 - DNA, 24 bp, Artificial sequence
  SiRNA target sequence
cggcttgtattgctgatttttctg

SEQ ID NO: 174553 - DNA, 24 bp, Artificial sequence
  SiRNA target sequence
ggcttgtattgctgatttttctgt

SEQ ID NO: 174554 - DNA, 24 bp, Artificial sequence
  SiRNA target sequence
gcttgtattgctgatttttctgtt

SEQ ID NO: 174555 - DNA, 24 bp, Artificial sequence
  SiRNA target sequence
cttgtattgctgatttttctgttc

SEQ ID NO: 174556 - DNA, 24 bp, Artificial sequence
  SiRNA target sequence
ttgtattgctgatttttctgttcc

SEQ ID NO: 174557 - DNA, 24 bp, Artificial sequence
  SiRNA target sequence
tgtattgctgatttttctgttcca

SEQ ID NO: 174558 - DNA, 24 bp, Artificial sequence
  SiRNA target sequence
gtattgctgatttttctgttccaa

SEQ ID NO: 174559 - DNA, 24 bp, Artificial sequence
  SiRNA target sequence
tattgctgatttttctgttccaaa

SEQ ID NO: 174560 - DNA, 24 bp, Artificial sequence
  SiRNA target sequence
attgctgatttttctgttccaaaa

SEQ ID NO: 174561 - DNA, 24 bp, Artificial sequence
  SiRNA target sequence
ttgctgatttttctgttccaaaaa

SEQ ID NO: 174562 - DNA, 24 bp, Artificial sequence
  SiRNA target sequence
tgctgatttttctgttccaaaaat

SEQ ID NO: 174563 - DNA, 24 bp, Artificial sequence
  SiRNA target sequence
gctgatttttctgttccaaaaatt

SEQ ID NO: 174564 - DNA, 24 bp, Artificial sequence
  SiRNA target sequence
ctgatttttctgttccaaaaattc

SEQ ID NO: 174565 - DNA, 24 bp, Artificial sequence
  SiRNA target sequence
tgatttttctgttccaaaaattcc

SEQ ID NO: 174566 - DNA, 24 bp, Artificial sequence
  SiRNA target sequence
gatttttctgttccaaaaattcct

SEQ ID NO: 174567 - DNA, 24 bp, Artificial sequence
  SiRNA target sequence
atttttctgttccaaaaattccta

SEQ ID NO: 174568 - DNA, 24 bp, Artificial sequence
  SiRNA target sequence
tttttctgttccaaaaattcctac

SEQ ID NO: 174569 - DNA, 24 bp, Artificial sequence
  SiRNA target sequence
ttttctgttccaaaaattcctact

SEQ ID NO: 174570 - DNA, 24 bp, Artificial sequence
  SiRNA target sequence
tttctgttccaaaaattcctactt

SEQ ID NO: 174571 - DNA, 24 bp, Artificial sequence
  SiRNA target sequence
ttctgttccaaaaattcctactta

SEQ ID NO: 174572 - DNA, 24 bp, Artificial sequence
  SiRNA target sequence
tctgttccaaaaattcctacttac

SEQ ID NO: 174573 - DNA, 24 bp, Artificial sequence
  SiRNA target sequence
ctgttccaaaaattcctacttaca

SEQ ID NO: 174574 - DNA, 24 bp, Artificial sequence
  SiRNA target sequence
tgttccaaaaattcctacttacac

SEQ ID NO: 174575 - DNA, 24 bp, Artificial sequence
  SiRNA target sequence
gttccaaaaattcctacttacaca

SEQ ID NO: 174576 - DNA, 24 bp, Artificial sequence
  SiRNA target sequence
ttccaaaaattcctacttacacag

SEQ ID NO: 174577 - DNA, 24 bp, Artificial sequence
  SiRNA target sequence
tccaaaaattcctacttacacaga

SEQ ID NO: 174578 - DNA, 24 bp, Artificial sequence
  SiRNA target sequence
ccaaaaattcctacttacacagaa

SEQ ID NO: 174579 - DNA, 24 bp, Artificial sequence
  SiRNA target sequence
caaaaattcctacttacacagaac

SEQ ID NO: 174580 - DNA, 24 bp, Artificial sequence
  SiRNA target sequence
aaaaattcctacttacacagaact

SEQ ID NO: 174581 - DNA, 24 bp, Artificial sequence
  SiRNA target sequence
aaaattcctacttacacagaactg

SEQ ID NO: 174582 - DNA, 24 bp, Artificial sequence
  SiRNA target sequence
aaattcctacttacacagaactga

SEQ ID NO: 174583 - DNA, 24 bp, Artificial sequence
  SiRNA target sequence
aattcctacttacacagaactgaa

SEQ ID NO: 174584 - DNA, 24 bp, Artificial sequence
  SiRNA target sequence
attcctacttacacagaactgaaa

SEQ ID NO: 174585 - DNA, 24 bp, Artificial sequence
  SiRNA target sequence
ttcctacttacacagaactgaaag

SEQ ID NO: 174586 - DNA, 24 bp, Artificial sequence
  SiRNA target sequence
tcctacttacacagaactgaaaga

SEQ ID NO: 174587 - DNA, 24 bp, Artificial sequence
  SiRNA target sequence
cctacttacacagaactgaaagat

SEQ ID NO: 174588 - DNA, 24 bp, Artificial sequence
  SiRNA target sequence
ctacttacacagaactgaaagatg

SEQ ID NO: 174589 - DNA, 24 bp, Artificial sequence
  SiRNA target sequence
tacttacacagaactgaaagatgt

SEQ ID NO: 174590 - DNA, 24 bp, Artificial sequence
  SiRNA target sequence
acttacacagaactgaaagatgtc

SEQ ID NO: 174591 - DNA, 24 bp, Artificial sequence
  SiRNA target sequence
cttacacagaactgaaagatgtcc

SEQ ID NO: 174592 - DNA, 24 bp, Artificial sequence
  SiRNA target sequence
ttacacagaactgaaagatgtccc

SEQ ID NO: 174593 - DNA, 24 bp, Artificial sequence
  SiRNA target sequence
tacacagaactgaaagatgtccct

SEQ ID NO: 174594 - DNA, 24 bp, Artificial sequence
  SiRNA target sequence
acacagaactgaaagatgtccctt

SEQ ID NO: 174595 - DNA, 24 bp, Artificial sequence
  SiRNA target sequence
cacagaactgaaagatgtcccttt

SEQ ID NO: 174596 - DNA, 24 bp, Artificial sequence
  SiRNA target sequence
acagaactgaaagatgtcccttta

SEQ ID NO: 174597 - DNA, 24 bp, Artificial sequence
  SiRNA target sequence
cagaactgaaagatgtccctttaa

SEQ ID NO: 174598 - DNA, 24 bp, Artificial sequence
  SiRNA target sequence
agaactgaaagatgtccctttaac

SEQ ID NO: 174599 - DNA, 24 bp, Artificial sequence
  SiRNA target sequence
gaactgaaagatgtccctttaaca

SEQ ID NO: 174600 - DNA, 24 bp, Artificial sequence
  SiRNA target sequence
aactgaaagatgtccctttaacat

SEQ ID NO: 174601 - DNA, 24 bp, Artificial sequence
  SiRNA target sequence
actgaaagatgtccctttaacatt

SEQ ID NO: 174602 - DNA, 24 bp, Artificial sequence
  SiRNA target sequence
ctgaaagatgtccctttaacattt

SEQ ID NO: 174603 - DNA, 24 bp, Artificial sequence
  SiRNA target sequence
tgaaagatgtccctttaacatttt

SEQ ID NO: 174604 - DNA, 24 bp, Artificial sequence
  SiRNA target sequence
gaaagatgtccctttaacattttt

SEQ ID NO: 174605 - DNA, 24 bp, Artificial sequence
  SiRNA target sequence
aaagatgtccctttaacattttta

SEQ ID NO: 174606 - DNA, 24 bp, Artificial sequence
  SiRNA target sequence
aagatgtccctttaacatttttat

SEQ ID NO: 174607 - DNA, 24 bp, Artificial sequence
  SiRNA target sequence
agatgtccctttaacatttttatt

SEQ ID NO: 174608 - DNA, 24 bp, Artificial sequence
  SiRNA target sequence
gatgtccctttaacatttttatta

SEQ ID NO: 174609 - DNA, 24 bp, Artificial sequence
  SiRNA target sequence
atgtccctttaacatttttattat

SEQ ID NO: 174610 - DNA, 24 bp, Artificial sequence
  SiRNA target sequence
tgtccctttaacatttttattatc

SEQ ID NO: 174611 - DNA, 24 bp, Artificial sequence
  SiRNA target sequence
gtccctttaacatttttattatca

SEQ ID NO: 174612 - DNA, 24 bp, Artificial sequence
  SiRNA target sequence
tccctttaacatttttattatcac

SEQ ID NO: 174613 - DNA, 24 bp, Artificial sequence
  SiRNA target sequence
ccctttaacatttttattatcacc

SEQ ID NO: 174614 - DNA, 24 bp, Artificial sequence
  SiRNA target sequence
cctttaacatttttattatcacca

SEQ ID NO: 174615 - DNA, 24 bp, Artificial sequence
  SiRNA target sequence
ctttaacatttttattatcaccac

SEQ ID NO: 174616 - DNA, 24 bp, Artificial sequence
  SiRNA target sequence
tttaacatttttattatcaccaca

SEQ ID NO: 174617 - DNA, 24 bp, Artificial sequence
  SiRNA target sequence
ttaacatttttattatcaccacat

SEQ ID NO: 174618 - DNA, 24 bp, Artificial sequence
  SiRNA target sequence
taacatttttattatcaccacatt

SEQ ID NO: 174619 - DNA, 24 bp, Artificial sequence
  SiRNA target sequence
aacatttttattatcaccacattc

SEQ ID NO: 174620 - DNA, 24 bp, Artificial sequence
  SiRNA target sequence
acatttttattatcaccacattcg

SEQ ID NO: 174621 - DNA, 24 bp, Artificial sequence
  SiRNA target sequence
catttttattatcaccacattcga

SEQ ID NO: 174622 - DNA, 24 bp, Artificial sequence
  SiRNA target sequence
atttttattatcaccacattcgaa

SEQ ID NO: 174623 - DNA, 24 bp, Artificial sequence
  SiRNA target sequence
tttttattatcaccacattcgaaa

SEQ ID NO: 174624 - DNA, 24 bp, Artificial sequence
  SiRNA target sequence
ttttattatcaccacattcgaaaa

SEQ ID NO: 174625 - DNA, 24 bp, Artificial sequence
  SiRNA target sequence
tttattatcaccacattcgaaaat

SEQ ID NO: 174626 - DNA, 24 bp, Artificial sequence
  SiRNA target sequence
ttattatcaccacattcgaaaatg

SEQ ID NO: 174627 - DNA, 24 bp, Artificial sequence
  SiRNA target sequence
tattatcaccacattcgaaaatga

SEQ ID NO: 174628 - DNA, 24 bp, Artificial sequence
  SiRNA target sequence
attatcaccacattcgaaaatgaa

SEQ ID NO: 174629 - DNA, 24 bp, Artificial sequence
  SiRNA target sequence
ttatcaccacattcgaaaatgaat

SEQ ID NO: 174630 - DNA, 24 bp, Artificial sequence
  SiRNA target sequence
tatcaccacattcgaaaatgaata

SEQ ID NO: 174631 - DNA, 24 bp, Artificial sequence
  SiRNA target sequence
atcaccacattcgaaaatgaatat

SEQ ID NO: 174632 - DNA, 24 bp, Artificial sequence
  SiRNA target sequence
tcaccacattcgaaaatgaatatg

SEQ ID NO: 174633 - DNA, 24 bp, Artificial sequence
  SiRNA target sequence
caccacattcgaaaatgaatatgt

SEQ ID NO: 174634 - DNA, 24 bp, Artificial sequence
  SiRNA target sequence
accacattcgaaaatgaatatgta

SEQ ID NO: 174635 - DNA, 24 bp, Artificial sequence
  SiRNA target sequence
ccacattcgaaaatgaatatgtat

SEQ ID NO: 174636 - DNA, 24 bp, Artificial sequence
  SiRNA target sequence
cacattcgaaaatgaatatgtatg

SEQ ID NO: 174637 - DNA, 24 bp, Artificial sequence
  SiRNA target sequence
acattcgaaaatgaatatgtatgc

SEQ ID NO: 174638 - DNA, 24 bp, Artificial sequence
  SiRNA target sequence
cattcgaaaatgaatatgtatgca

SEQ ID NO: 174639 - DNA, 24 bp, Artificial sequence
  SiRNA target sequence
attcgaaaatgaatatgtatgcac

SEQ ID NO: 174640 - DNA, 24 bp, Artificial sequence
  SiRNA target sequence
ttcgaaaatgaatatgtatgcaca

SEQ ID NO: 174641 - DNA, 24 bp, Artificial sequence
  SiRNA target sequence
tcgaaaatgaatatgtatgcacac

SEQ ID NO: 174642 - DNA, 24 bp, Artificial sequence
  SiRNA target sequence
cgaaaatgaatatgtatgcacact

SEQ ID NO: 174643 - DNA, 24 bp, Artificial sequence
  SiRNA target sequence
gaaaatgaatatgtatgcacacta

SEQ ID NO: 174644 - DNA, 24 bp, Artificial sequence
  SiRNA target sequence
aaaatgaatatgtatgcacactat

SEQ ID NO: 174645 - DNA, 24 bp, Artificial sequence
  SiRNA target sequence
aaatgaatatgtatgcacactata

SEQ ID NO: 174646 - DNA, 24 bp, Artificial sequence
  SiRNA target sequence
aatgaatatgtatgcacactataa

SEQ ID NO: 174647 - DNA, 24 bp, Artificial sequence
  SiRNA target sequence
atgaatatgtatgcacactataac

SEQ ID NO: 174648 - DNA, 24 bp, Artificial sequence
  SiRNA target sequence
tgaatatgtatgcacactataaca

SEQ ID NO: 174649 - DNA, 24 bp, Artificial sequence
  SiRNA target sequence
gaatatgtatgcacactataacaa

SEQ ID NO: 174650 - DNA, 24 bp, Artificial sequence
  SiRNA target sequence
aatatgtatgcacactataacaat

SEQ ID NO: 174651 - DNA, 24 bp, Artificial sequence
  SiRNA target sequence
atatgtatgcacactataacaatc

SEQ ID NO: 174652 - DNA, 24 bp, Artificial sequence
  SiRNA target sequence
tatgtatgcacactataacaatca

SEQ ID NO: 174653 - DNA, 24 bp, Artificial sequence
  SiRNA target sequence
atgtatgcacactataacaatcat

SEQ ID NO: 174654 - DNA, 24 bp, Artificial sequence
  SiRNA target sequence
tgtatgcacactataacaatcata

SEQ ID NO: 174655 - DNA, 24 bp, Artificial sequence
  SiRNA target sequence
gtatgcacactataacaatcatat

SEQ ID NO: 174656 - DNA, 24 bp, Artificial sequence
  SiRNA target sequence
tatgcacactataacaatcatata

SEQ ID NO: 174657 - DNA, 24 bp, Artificial sequence
  SiRNA target sequence
atgcacactataacaatcatataa

SEQ ID NO: 174658 - DNA, 24 bp, Artificial sequence
  SiRNA target sequence
tgcacactataacaatcatataat

SEQ ID NO: 174659 - DNA, 24 bp, Artificial sequence
  SiRNA target sequence
gcacactataacaatcatataatg

SEQ ID NO: 174660 - DNA, 24 bp, Artificial sequence
  SiRNA target sequence
cacactataacaatcatataatgt

SEQ ID NO: 174661 - DNA, 24 bp, Artificial sequence
  SiRNA target sequence
acactataacaatcatataatgtc

SEQ ID NO: 174662 - DNA, 24 bp, Artificial sequence
  SiRNA target sequence
cactataacaatcatataatgtcc

SEQ ID NO: 174663 - DNA, 24 bp, Artificial sequence
  SiRNA target sequence
actataacaatcatataatgtcct

SEQ ID NO: 174664 - DNA, 24 bp, Artificial sequence
  SiRNA target sequence
ctataacaatcatataatgtcctt

SEQ ID NO: 174665 - DNA, 24 bp, Artificial sequence
  SiRNA target sequence
tataacaatcatataatgtccttt

SEQ ID NO: 174666 - DNA, 24 bp, Artificial sequence
  SiRNA target sequence
ataacaatcatataatgtccttta

SEQ ID NO: 174667 - DNA, 24 bp, Artificial sequence
  SiRNA target sequence
taacaatcatataatgtcctttag

SEQ ID NO: 174668 - DNA, 24 bp, Artificial sequence
  SiRNA target sequence
aacaatcatataatgtcctttagt

SEQ ID NO: 174669 - DNA, 24 bp, Artificial sequence
  SiRNA target sequence
acaatcatataatgtcctttagtg

SEQ ID NO: 174670 - DNA, 24 bp, Artificial sequence
  SiRNA target sequence
caatcatataatgtcctttagtga

SEQ ID NO: 174671 - DNA, 24 bp, Artificial sequence
  SiRNA target sequence
aatcatataatgtcctttagtgat

SEQ ID NO: 174672 - DNA, 24 bp, Artificial sequence
  SiRNA target sequence
atcatataatgtcctttagtgatt

SEQ ID NO: 174673 - DNA, 24 bp, Artificial sequence
  SiRNA target sequence
tcatataatgtcctttagtgattt

SEQ ID NO: 174674 - DNA, 24 bp, Artificial sequence
  SiRNA target sequence
catataatgtcctttagtgatttt

SEQ ID NO: 174675 - DNA, 24 bp, Artificial sequence
  SiRNA target sequence
atataatgtcctttagtgattttg

SEQ ID NO: 174676 - DNA, 24 bp, Artificial sequence
  SiRNA target sequence
tataatgtcctttagtgattttga

SEQ ID NO: 174677 - DNA, 24 bp, Artificial sequence
  SiRNA target sequence
ataatgtcctttagtgattttgaa

SEQ ID NO: 174678 - DNA, 24 bp, Artificial sequence
  SiRNA target sequence
taatgtcctttagtgattttgaat

SEQ ID NO: 174679 - DNA, 24 bp, Artificial sequence
  SiRNA target sequence
aatgtcctttagtgattttgaata

SEQ ID NO: 174680 - DNA, 24 bp, Artificial sequence
  SiRNA target sequence
atgtcctttagtgattttgaatat

SEQ ID NO: 174681 - DNA, 24 bp, Artificial sequence
  SiRNA target sequence
tgtcctttagtgattttgaatatc

SEQ ID NO: 174682 - DNA, 24 bp, Artificial sequence
  SiRNA target sequence
gtcctttagtgattttgaatatca

SEQ ID NO: 174683 - DNA, 24 bp, Artificial sequence
  SiRNA target sequence
tcctttagtgattttgaatatcac

SEQ ID NO: 174684 - DNA, 24 bp, Artificial sequence
  SiRNA target sequence
cctttagtgattttgaatatcact

SEQ ID NO: 174685 - DNA, 24 bp, Artificial sequence
  SiRNA target sequence
ctttagtgattttgaatatcactt

SEQ ID NO: 174686 - DNA, 24 bp, Artificial sequence
  SiRNA target sequence
tttagtgattttgaatatcactta

SEQ ID NO: 174687 - DNA, 24 bp, Artificial sequence
  SiRNA target sequence
ttagtgattttgaatatcacttaa

SEQ ID NO: 174688 - DNA, 24 bp, Artificial sequence
  SiRNA target sequence
tagtgattttgaatatcacttaat

SEQ ID NO: 174689 - DNA, 24 bp, Artificial sequence
  SiRNA target sequence
agtgattttgaatatcacttaatt

SEQ ID NO: 174690 - DNA, 24 bp, Artificial sequence
  SiRNA target sequence
gtgattttgaatatcacttaattt

SEQ ID NO: 174691 - DNA, 24 bp, Artificial sequence
  SiRNA target sequence
tgattttgaatatcacttaatttc

SEQ ID NO: 174692 - DNA, 24 bp, Artificial sequence
  SiRNA target sequence
gattttgaatatcacttaatttca

SEQ ID NO: 174693 - DNA, 24 bp, Artificial sequence
  SiRNA target sequence
attttgaatatcacttaatttcat

SEQ ID NO: 174694 - DNA, 24 bp, Artificial sequence
  SiRNA target sequence
ttttgaatatcacttaatttcatt

SEQ ID NO: 174695 - DNA, 24 bp, Artificial sequence
  SiRNA target sequence
tttgaatatcacttaatttcattt

SEQ ID NO: 174696 - DNA, 24 bp, Artificial sequence
  SiRNA target sequence
ttgaatatcacttaatttcattta

SEQ ID NO: 174697 - DNA, 24 bp, Artificial sequence
  SiRNA target sequence
tgaatatcacttaatttcatttat

SEQ ID NO: 174698 - DNA, 24 bp, Artificial sequence
  SiRNA target sequence
gaatatcacttaatttcatttata

SEQ ID NO: 174699 - DNA, 24 bp, Artificial sequence
  SiRNA target sequence
aatatcacttaatttcatttataa

SEQ ID NO: 174700 - DNA, 24 bp, Artificial sequence
  SiRNA target sequence
atatcacttaatttcatttataaa

SEQ ID NO: 174701 - DNA, 24 bp, Artificial sequence
  SiRNA target sequence
tatcacttaatttcatttataaaa

SEQ ID NO: 174702 - DNA, 24 bp, Artificial sequence
  SiRNA target sequence
atcacttaatttcatttataaaac

SEQ ID NO: 174703 - DNA, 24 bp, Artificial sequence
  SiRNA target sequence
tcacttaatttcatttataaaact

SEQ ID NO: 174704 - DNA, 24 bp, Artificial sequence
  SiRNA target sequence
cacttaatttcatttataaaacta

SEQ ID NO: 174705 - DNA, 24 bp, Artificial sequence
  SiRNA target sequence
acttaatttcatttataaaactaa

SEQ ID NO: 174706 - DNA, 24 bp, Artificial sequence
  SiRNA target sequence
cttaatttcatttataaaactaaa

SEQ ID NO: 174707 - DNA, 24 bp, Artificial sequence
  SiRNA target sequence
ttaatttcatttataaaactaaaa

SEQ ID NO: 174708 - DNA, 24 bp, Artificial sequence
  SiRNA target sequence
taatttcatttataaaactaaaat

SEQ ID NO: 174709 - DNA, 24 bp, Artificial sequence
  SiRNA target sequence
aatttcatttataaaactaaaatt

SEQ ID NO: 174710 - DNA, 24 bp, Artificial sequence
  SiRNA target sequence
atttcatttataaaactaaaattt

SEQ ID NO: 174711 - DNA, 24 bp, Artificial sequence
  SiRNA target sequence
tttcatttataaaactaaaattta

SEQ ID NO: 174712 - DNA, 24 bp, Artificial sequence
  SiRNA target sequence
ttcatttataaaactaaaatttaa

SEQ ID NO: 174713 - DNA, 24 bp, Artificial sequence
  SiRNA target sequence
tcatttataaaactaaaatttaat

SEQ ID NO: 174714 - DNA, 24 bp, Artificial sequence
  SiRNA target sequence
catttataaaactaaaatttaatg

SEQ ID NO: 174715 - DNA, 24 bp, Artificial sequence
  SiRNA target sequence
atttataaaactaaaatttaatgt

SEQ ID NO: 174716 - DNA, 24 bp, Artificial sequence
  SiRNA target sequence
tttataaaactaaaatttaatgta

SEQ ID NO: 174717 - DNA, 24 bp, Artificial sequence
  SiRNA target sequence
ttataaaactaaaatttaatgtaa

SEQ ID NO: 174718 - DNA, 24 bp, Artificial sequence
  SiRNA target sequence
tataaaactaaaatttaatgtaat

SEQ ID NO: 174719 - DNA, 24 bp, Artificial sequence
  SiRNA target sequence
ataaaactaaaatttaatgtaata

SEQ ID NO: 174720 - DNA, 24 bp, Artificial sequence
  SiRNA target sequence
taaaactaaaatttaatgtaataa

SEQ ID NO: 174721 - DNA, 24 bp, Artificial sequence
  SiRNA target sequence
aaaactaaaatttaatgtaataaa

SEQ ID NO: 174722 - DNA, 24 bp, Artificial sequence
  SiRNA target sequence
aaactaaaatttaatgtaataaaa

SEQ ID NO: 174723 - DNA, 24 bp, Artificial sequence
  SiRNA target sequence
aactaaaatttaatgtaataaaag

SEQ ID NO: 174724 - DNA, 24 bp, Artificial sequence
  SiRNA target sequence
actaaaatttaatgtaataaaagt

SEQ ID NO: 174725 - DNA, 24 bp, Artificial sequence
  SiRNA target sequence
ctaaaatttaatgtaataaaagta

SEQ ID NO: 174726 - DNA, 24 bp, Artificial sequence
  SiRNA target sequence
taaaatttaatgtaataaaagtat

SEQ ID NO: 174727 - DNA, 24 bp, Artificial sequence
  SiRNA target sequence
aaaatttaatgtaataaaagtata

SEQ ID NO: 174728 - DNA, 24 bp, Artificial sequence
  SiRNA target sequence
aaatttaatgtaataaaagtatat

SEQ ID NO: 174729 - DNA, 24 bp, Artificial sequence
  SiRNA target sequence
aatttaatgtaataaaagtatatg

SEQ ID NO: 174730 - DNA, 24 bp, Artificial sequence
  SiRNA target sequence
atttaatgtaataaaagtatatga

SEQ ID NO: 174731 - DNA, 24 bp, Artificial sequence
  SiRNA target sequence
tttaatgtaataaaagtatatgat

SEQ ID NO: 174732 - DNA, 24 bp, Artificial sequence
  SiRNA target sequence
ttaatgtaataaaagtatatgata

SEQ ID NO: 174733 - DNA, 24 bp, Artificial sequence
  SiRNA target sequence
taatgtaataaaagtatatgatac

SEQ ID NO: 174734 - DNA, 24 bp, Artificial sequence
  SiRNA target sequence
aatgtaataaaagtatatgataca

SEQ ID NO: 174735 - DNA, 24 bp, Artificial sequence
  SiRNA target sequence
atgtaataaaagtatatgatacat

SEQ ID NO: 174736 - DNA, 24 bp, Artificial sequence
  SiRNA target sequence
tgtaataaaagtatatgatacatc

SEQ ID NO: 174737 - DNA, 24 bp, Artificial sequence
  SiRNA target sequence
gtaataaaagtatatgatacatct

SEQ ID NO: 174738 - DNA, 24 bp, Artificial sequence
  SiRNA target sequence
taataaaagtatatgatacatctt

SEQ ID NO: 174739 - DNA, 24 bp, Artificial sequence
  SiRNA target sequence
aataaaagtatatgatacatctta

SEQ ID NO: 174740 - DNA, 24 bp, Artificial sequence
  SiRNA target sequence
ataaaagtatatgatacatcttat

SEQ ID NO: 174741 - DNA, 24 bp, Artificial sequence
  SiRNA target sequence
taaaagtatatgatacatcttatg

SEQ ID NO: 174742 - DNA, 24 bp, Artificial sequence
  SiRNA target sequence
aaaagtatatgatacatcttatgt

SEQ ID NO: 174743 - DNA, 24 bp, Artificial sequence
  SiRNA target sequence
aaagtatatgatacatcttatgtc

SEQ ID NO: 174744 - DNA, 24 bp, Artificial sequence
  SiRNA target sequence
aagtatatgatacatcttatgtca

SEQ ID NO: 174745 - DNA, 24 bp, Artificial sequence
  SiRNA target sequence
agtatatgatacatcttatgtcaa

SEQ ID NO: 174746 - DNA, 24 bp, Artificial sequence
  SiRNA target sequence
gtatatgatacatcttatgtcaaa

SEQ ID NO: 174747 - DNA, 24 bp, Artificial sequence
  SiRNA target sequence
tatatgatacatcttatgtcaaaa

SEQ ID NO: 174748 - DNA, 24 bp, Artificial sequence
  SiRNA target sequence
atatgatacatcttatgtcaaaaa

SEQ ID NO: 174749 - DNA, 24 bp, Artificial sequence
  SiRNA target sequence
tatgatacatcttatgtcaaaaat

SEQ ID NO: 174750 - DNA, 24 bp, Artificial sequence
  SiRNA target sequence
atgatacatcttatgtcaaaaata

SEQ ID NO: 174751 - DNA, 24 bp, Artificial sequence
  SiRNA target sequence
tgatacatcttatgtcaaaaatat

SEQ ID NO: 174752 - DNA, 24 bp, Artificial sequence
  SiRNA target sequence
gatacatcttatgtcaaaaatatt

SEQ ID NO: 174753 - DNA, 24 bp, Artificial sequence
  SiRNA target sequence
atacatcttatgtcaaaaatattc

SEQ ID NO: 174754 - DNA, 24 bp, Artificial sequence
  SiRNA target sequence
tacatcttatgtcaaaaatattct

SEQ ID NO: 174755 - DNA, 24 bp, Artificial sequence
  SiRNA target sequence
acatcttatgtcaaaaatattctg

SEQ ID NO: 174756 - DNA, 24 bp, Artificial sequence
  SiRNA target sequence
catcttatgtcaaaaatattctgt

SEQ ID NO: 174757 - DNA, 24 bp, Artificial sequence
  SiRNA target sequence
atcttatgtcaaaaatattctgta

SEQ ID NO: 174758 - DNA, 24 bp, Artificial sequence
  SiRNA target sequence
tcttatgtcaaaaatattctgtat

SEQ ID NO: 174759 - DNA, 24 bp, Artificial sequence
  SiRNA target sequence
cttatgtcaaaaatattctgtatg

SEQ ID NO: 174760 - DNA, 24 bp, Artificial sequence
  SiRNA target sequence
ttatgtcaaaaatattctgtatga

SEQ ID NO: 174761 - DNA, 24 bp, Artificial sequence
  SiRNA target sequence
tatgtcaaaaatattctgtatgat

SEQ ID NO: 174762 - DNA, 24 bp, Artificial sequence
  SiRNA target sequence
atgtcaaaaatattctgtatgata

SEQ ID NO: 174763 - DNA, 24 bp, Artificial sequence
  SiRNA target sequence
tgtcaaaaatattctgtatgatag

SEQ ID NO: 174764 - DNA, 24 bp, Artificial sequence
  SiRNA target sequence
gtcaaaaatattctgtatgatagt

SEQ ID NO: 174765 - DNA, 24 bp, Artificial sequence
  SiRNA target sequence
tcaaaaatattctgtatgatagtg

SEQ ID NO: 174766 - DNA, 24 bp, Artificial sequence
  SiRNA target sequence
caaaaatattctgtatgatagtgt

SEQ ID NO: 174767 - DNA, 24 bp, Artificial sequence
  SiRNA target sequence
aaaaatattctgtatgatagtgtt

SEQ ID NO: 174768 - DNA, 24 bp, Artificial sequence
  SiRNA target sequence
aaaatattctgtatgatagtgttt

SEQ ID NO: 174769 - DNA, 24 bp, Artificial sequence
  SiRNA target sequence
aaatattctgtatgatagtgttta

SEQ ID NO: 174770 - DNA, 24 bp, Artificial sequence
  SiRNA target sequence
aatattctgtatgatagtgtttat

SEQ ID NO: 174771 - DNA, 24 bp, Artificial sequence
  SiRNA target sequence
atattctgtatgatagtgtttatg

SEQ ID NO: 174772 - DNA, 24 bp, Artificial sequence
  SiRNA target sequence
tattctgtatgatagtgtttatga

SEQ ID NO: 174773 - DNA, 24 bp, Artificial sequence
  SiRNA target sequence
attctgtatgatagtgtttatgag

SEQ ID NO: 174774 - DNA, 24 bp, Artificial sequence
  SiRNA target sequence
ttctgtatgatagtgtttatgagg

SEQ ID NO: 174775 - DNA, 24 bp, Artificial sequence
  SiRNA target sequence
tctgtatgatagtgtttatgagga

SEQ ID NO: 174776 - DNA, 24 bp, Artificial sequence
  SiRNA target sequence
ctgtatgatagtgtttatgaggaa

SEQ ID NO: 174777 - DNA, 24 bp, Artificial sequence
  SiRNA target sequence
tgtatgatagtgtttatgaggaaa

SEQ ID NO: 174778 - DNA, 24 bp, Artificial sequence
  SiRNA target sequence
gtatgatagtgtttatgaggaaag

SEQ ID NO: 174779 - DNA, 24 bp, Artificial sequence
  SiRNA target sequence
tatgatagtgtttatgaggaaagc

SEQ ID NO: 174780 - DNA, 24 bp, Artificial sequence
  SiRNA target sequence
atgatagtgtttatgaggaaagca

SEQ ID NO: 174781 - DNA, 24 bp, Artificial sequence
  SiRNA target sequence
tgatagtgtttatgaggaaagcac

SEQ ID NO: 174782 - DNA, 24 bp, Artificial sequence
  SiRNA target sequence
gatagtgtttatgaggaaagcacg

SEQ ID NO: 174783 - DNA, 24 bp, Artificial sequence
  SiRNA target sequence
atagtgtttatgaggaaagcacga

SEQ ID NO: 174784 - DNA, 24 bp, Artificial sequence
  SiRNA target sequence
tagtgtttatgaggaaagcacgag

SEQ ID NO: 174785 - DNA, 24 bp, Artificial sequence
  SiRNA target sequence
agtgtttatgaggaaagcacgaga

SEQ ID NO: 174786 - DNA, 24 bp, Artificial sequence
  SiRNA target sequence
gtgtttatgaggaaagcacgagag

SEQ ID NO: 174787 - DNA, 24 bp, Artificial sequence
  SiRNA target sequence
tgtttatgaggaaagcacgagaga

SEQ ID NO: 174788 - DNA, 24 bp, Artificial sequence
  SiRNA target sequence
gtttatgaggaaagcacgagagac

SEQ ID NO: 174789 - DNA, 24 bp, Artificial sequence
  SiRNA target sequence
tttatgaggaaagcacgagagaca

SEQ ID NO: 174790 - DNA, 24 bp, Artificial sequence
  SiRNA target sequence
ttatgaggaaagcacgagagacaa

SEQ ID NO: 174791 - DNA, 24 bp, Artificial sequence
  SiRNA target sequence
tatgaggaaagcacgagagacaaa

SEQ ID NO: 174792 - DNA, 24 bp, Artificial sequence
  SiRNA target sequence
atgaggaaagcacgagagacaaaa

SEQ ID NO: 174793 - DNA, 24 bp, Artificial sequence
  SiRNA target sequence
tgaggaaagcacgagagacaaaat

SEQ ID NO: 174794 - DNA, 24 bp, Artificial sequence
  SiRNA target sequence
gaggaaagcacgagagacaaaata

SEQ ID NO: 174795 - DNA, 24 bp, Artificial sequence
  SiRNA target sequence
aggaaagcacgagagacaaaataa

SEQ ID NO: 174796 - DNA, 24 bp, Artificial sequence
  SiRNA target sequence
ggaaagcacgagagacaaaataat

SEQ ID NO: 174797 - DNA, 24 bp, Artificial sequence
  SiRNA target sequence
gaaagcacgagagacaaaataata

SEQ ID NO: 174798 - DNA, 24 bp, Artificial sequence
  SiRNA target sequence
aaagcacgagagacaaaataataa

SEQ ID NO: 174799 - DNA, 24 bp, Artificial sequence
  SiRNA target sequence
aagcacgagagacaaaataataat

SEQ ID NO: 174800 - DNA, 24 bp, Artificial sequence
  SiRNA target sequence
agcacgagagacaaaataataata

SEQ ID NO: 174801 - DNA, 24 bp, Artificial sequence
  SiRNA target sequence
gcacgagagacaaaataataataa

SEQ ID NO: 174802 - DNA, 24 bp, Artificial sequence
  SiRNA target sequence
cacgagagacaaaataataataag

SEQ ID NO: 174803 - DNA, 24 bp, Artificial sequence
  SiRNA target sequence
acgagagacaaaataataataagt

SEQ ID NO: 174804 - DNA, 24 bp, Artificial sequence
  SiRNA target sequence
cgagagacaaaataataataagtg

SEQ ID NO: 174805 - DNA, 24 bp, Artificial sequence
  SiRNA target sequence
gagagacaaaataataataagtga

SEQ ID NO: 174806 - DNA, 24 bp, Artificial sequence
  SiRNA target sequence
agagacaaaataataataagtgac

SEQ ID NO: 174807 - DNA, 24 bp, Artificial sequence
  SiRNA target sequence
gagacaaaataataataagtgact

SEQ ID NO: 174808 - DNA, 24 bp, Artificial sequence
  SiRNA target sequence
agacaaaataataataagtgactg

SEQ ID NO: 174809 - DNA, 24 bp, Artificial sequence
  SiRNA target sequence
gacaaaataataataagtgactgt

SEQ ID NO: 174810 - DNA, 24 bp, Artificial sequence
  SiRNA target sequence
acaaaataataataagtgactgtc

SEQ ID NO: 174811 - DNA, 24 bp, Artificial sequence
  SiRNA target sequence
caaaataataataagtgactgtcc

SEQ ID NO: 174812 - DNA, 24 bp, Artificial sequence
  SiRNA target sequence
aaaataataataagtgactgtcct

SEQ ID NO: 174813 - DNA, 24 bp, Artificial sequence
  SiRNA target sequence
aaataataataagtgactgtcctg

SEQ ID NO: 174814 - DNA, 24 bp, Artificial sequence
  SiRNA target sequence
aataataataagtgactgtcctgg

SEQ ID NO: 174815 - DNA, 24 bp, Artificial sequence
  SiRNA target sequence
ataataataagtgactgtcctggg

SEQ ID NO: 174816 - DNA, 24 bp, Artificial sequence
  SiRNA target sequence
taataataagtgactgtcctggga

SEQ ID NO: 174817 - DNA, 24 bp, Artificial sequence
  SiRNA target sequence
aataataagtgactgtcctgggac

SEQ ID NO: 174818 - DNA, 24 bp, Artificial sequence
  SiRNA target sequence
ataataagtgactgtcctgggact

SEQ ID NO: 174819 - DNA, 24 bp, Artificial sequence
  SiRNA target sequence
taataagtgactgtcctgggactg

SEQ ID NO: 174820 - DNA, 24 bp, Artificial sequence
  SiRNA target sequence
aataagtgactgtcctgggactgt

SEQ ID NO: 174821 - DNA, 24 bp, Artificial sequence
  SiRNA target sequence
ataagtgactgtcctgggactgtt

SEQ ID NO: 174822 - DNA, 24 bp, Artificial sequence
  SiRNA target sequence
taagtgactgtcctgggactgttt

SEQ ID NO: 174823 - DNA, 24 bp, Artificial sequence
  SiRNA target sequence
aagtgactgtcctgggactgtttc

SEQ ID NO: 174824 - DNA, 24 bp, Artificial sequence
  SiRNA target sequence
agtgactgtcctgggactgtttca

SEQ ID NO: 174825 - DNA, 24 bp, Artificial sequence
  SiRNA target sequence
gtgactgtcctgggactgtttcat

SEQ ID NO: 174826 - DNA, 24 bp, Artificial sequence
  SiRNA target sequence
tgactgtcctgggactgtttcata

SEQ ID NO: 174827 - DNA, 24 bp, Artificial sequence
  SiRNA target sequence
gactgtcctgggactgtttcatat

SEQ ID NO: 174828 - DNA, 24 bp, Artificial sequence
  SiRNA target sequence
actgtcctgggactgtttcatata

SEQ ID NO: 174829 - DNA, 24 bp, Artificial sequence
  SiRNA target sequence
ctgtcctgggactgtttcatatat

SEQ ID NO: 174830 - DNA, 24 bp, Artificial sequence
  SiRNA target sequence
tgtcctgggactgtttcatatatt

SEQ ID NO: 174831 - DNA, 24 bp, Artificial sequence
  SiRNA target sequence
gtcctgggactgtttcatatattg

SEQ ID NO: 174832 - DNA, 24 bp, Artificial sequence
  SiRNA target sequence
tcctgggactgtttcatatattga

SEQ ID NO: 174833 - DNA, 24 bp, Artificial sequence
  SiRNA target sequence
cctgggactgtttcatatattgaa

SEQ ID NO: 174834 - DNA, 24 bp, Artificial sequence
  SiRNA target sequence
ctgggactgtttcatatattgaaa

SEQ ID NO: 174835 - DNA, 24 bp, Artificial sequence
  SiRNA target sequence
tgggactgtttcatatattgaaag

SEQ ID NO: 174836 - DNA, 24 bp, Artificial sequence
  SiRNA target sequence
gggactgtttcatatattgaaagg

SEQ ID NO: 174837 - DNA, 24 bp, Artificial sequence
  SiRNA target sequence
ggactgtttcatatattgaaaggc

SEQ ID NO: 174838 - DNA, 24 bp, Artificial sequence
  SiRNA target sequence
gactgtttcatatattgaaaggca

SEQ ID NO: 174839 - DNA, 24 bp, Artificial sequence
  SiRNA target sequence
actgtttcatatattgaaaggcaa

SEQ ID NO: 174840 - DNA, 24 bp, Artificial sequence
  SiRNA target sequence
ctgtttcatatattgaaaggcaag

SEQ ID NO: 174841 - DNA, 24 bp, Artificial sequence
  SiRNA target sequence
tgtttcatatattgaaaggcaagc

SEQ ID NO: 174842 - DNA, 24 bp, Artificial sequence
  SiRNA target sequence
gtttcatatattgaaaggcaagca

SEQ ID NO: 174843 - DNA, 24 bp, Artificial sequence
  SiRNA target sequence
tttcatatattgaaaggcaagcac

SEQ ID NO: 174844 - DNA, 24 bp, Artificial sequence
  SiRNA target sequence
ttcatatattgaaaggcaagcaca

SEQ ID NO: 174845 - DNA, 24 bp, Artificial sequence
  SiRNA target sequence
tcatatattgaaaggcaagcacac

SEQ ID NO: 174846 - DNA, 24 bp, Artificial sequence
  SiRNA target sequence
catatattgaaaggcaagcacacc

SEQ ID NO: 174847 - DNA, 24 bp, Artificial sequence
  SiRNA target sequence
atatattgaaaggcaagcacacca

SEQ ID NO: 174848 - DNA, 24 bp, Artificial sequence
  SiRNA target sequence
tatattgaaaggcaagcacaccat

SEQ ID NO: 174849 - DNA, 24 bp, Artificial sequence
  SiRNA target sequence
atattgaaaggcaagcacaccatt

SEQ ID NO: 174850 - DNA, 24 bp, Artificial sequence
  SiRNA target sequence
tattgaaaggcaagcacaccattt

SEQ ID NO: 174851 - DNA, 24 bp, Artificial sequence
  SiRNA target sequence
attgaaaggcaagcacaccattta

SEQ ID NO: 174852 - DNA, 24 bp, Artificial sequence
  SiRNA target sequence
ttgaaaggcaagcacaccatttaa

SEQ ID NO: 174853 - DNA, 24 bp, Artificial sequence
  SiRNA target sequence
tgaaaggcaagcacaccatttaat

SEQ ID NO: 174854 - DNA, 24 bp, Artificial sequence
  SiRNA target sequence
gaaaggcaagcacaccatttaatt

SEQ ID NO: 174855 - DNA, 24 bp, Artificial sequence
  SiRNA target sequence
aaaggcaagcacaccatttaattg

SEQ ID NO: 174856 - DNA, 24 bp, Artificial sequence
  SiRNA target sequence
aaggcaagcacaccatttaattga

SEQ ID NO: 174857 - DNA, 24 bp, Artificial sequence
  SiRNA target sequence
aggcaagcacaccatttaattgaa

SEQ ID NO: 174858 - DNA, 24 bp, Artificial sequence
  SiRNA target sequence
ggcaagcacaccatttaattgaat

SEQ ID NO: 174859 - DNA, 24 bp, Artificial sequence
  SiRNA target sequence
gcaagcacaccatttaattgaata

SEQ ID NO: 174860 - DNA, 24 bp, Artificial sequence
  SiRNA target sequence
caagcacaccatttaattgaatat

SEQ ID NO: 174861 - DNA, 24 bp, Artificial sequence
  SiRNA target sequence
aagcacaccatttaattgaatatt

SEQ ID NO: 174862 - DNA, 24 bp, Artificial sequence
  SiRNA target sequence
agcacaccatttaattgaatattt

SEQ ID NO: 174863 - DNA, 24 bp, Artificial sequence
  SiRNA target sequence
gcacaccatttaattgaatattta

SEQ ID NO: 174864 - DNA, 24 bp, Artificial sequence
  SiRNA target sequence
cacaccatttaattgaatatttat

SEQ ID NO: 174865 - DNA, 24 bp, Artificial sequence
  SiRNA target sequence
acaccatttaattgaatatttatc

SEQ ID NO: 174866 - DNA, 24 bp, Artificial sequence
  SiRNA target sequence
caccatttaattgaatatttatct

SEQ ID NO: 174867 - DNA, 24 bp, Artificial sequence
  SiRNA target sequence
accatttaattgaatatttatctg

SEQ ID NO: 174868 - DNA, 24 bp, Artificial sequence
  SiRNA target sequence
ccatttaattgaatatttatctgt

SEQ ID NO: 174869 - DNA, 24 bp, Artificial sequence
  SiRNA target sequence
catttaattgaatatttatctgtt

SEQ ID NO: 174870 - DNA, 24 bp, Artificial sequence
  SiRNA target sequence
atttaattgaatatttatctgtta

SEQ ID NO: 174871 - DNA, 24 bp, Artificial sequence
  SiRNA target sequence
tttaattgaatatttatctgttac

SEQ ID NO: 174872 - DNA, 24 bp, Artificial sequence
  SiRNA target sequence
ttaattgaatatttatctgttact

SEQ ID NO: 174873 - DNA, 24 bp, Artificial sequence
  SiRNA target sequence
taattgaatatttatctgttactt

SEQ ID NO: 174874 - DNA, 24 bp, Artificial sequence
  SiRNA target sequence
aattgaatatttatctgttacttc

SEQ ID NO: 174875 - DNA, 24 bp, Artificial sequence
  SiRNA target sequence
attgaatatttatctgttacttct

SEQ ID NO: 174876 - DNA, 24 bp, Artificial sequence
  SiRNA target sequence
ttgaatatttatctgttacttcta

SEQ ID NO: 174877 - DNA, 24 bp, Artificial sequence
  SiRNA target sequence
tgaatatttatctgttacttctac

SEQ ID NO: 174878 - DNA, 24 bp, Artificial sequence
  SiRNA target sequence
gaatatttatctgttacttctaca

SEQ ID NO: 174879 - DNA, 24 bp, Artificial sequence
  SiRNA target sequence
aatatttatctgttacttctacac

SEQ ID NO: 174880 - DNA, 24 bp, Artificial sequence
  SiRNA target sequence
atatttatctgttacttctacaca

SEQ ID NO: 174881 - DNA, 24 bp, Artificial sequence
  SiRNA target sequence
tatttatctgttacttctacacaa

SEQ ID NO: 174882 - DNA, 24 bp, Artificial sequence
  SiRNA target sequence
atttatctgttacttctacacaac

SEQ ID NO: 174883 - DNA, 24 bp, Artificial sequence
  SiRNA target sequence
tttatctgttacttctacacaaca

SEQ ID NO: 174884 - DNA, 24 bp, Artificial sequence
  SiRNA target sequence
ttatctgttacttctacacaacaa

SEQ ID NO: 174885 - DNA, 24 bp, Artificial sequence
  SiRNA target sequence
tatctgttacttctacacaacaac

SEQ ID NO: 174886 - DNA, 24 bp, Artificial sequence
  SiRNA target sequence
atctgttacttctacacaacaaca

SEQ ID NO: 174887 - DNA, 24 bp, Artificial sequence
  SiRNA target sequence
tctgttacttctacacaacaacaa

SEQ ID NO: 174888 - DNA, 24 bp, Artificial sequence
  SiRNA target sequence
ctgttacttctacacaacaacaag

SEQ ID NO: 174889 - DNA, 24 bp, Artificial sequence
  SiRNA target sequence
tgttacttctacacaacaacaagc

SEQ ID NO: 174890 - DNA, 24 bp, Artificial sequence
  SiRNA target sequence
gttacttctacacaacaacaagcc

SEQ ID NO: 174891 - DNA, 24 bp, Artificial sequence
  SiRNA target sequence
ttacttctacacaacaacaagcca

SEQ ID NO: 174892 - DNA, 24 bp, Artificial sequence
  SiRNA target sequence
tacttctacacaacaacaagccat

SEQ ID NO: 174893 - DNA, 24 bp, Artificial sequence
  SiRNA target sequence
acttctacacaacaacaagccata

SEQ ID NO: 174894 - DNA, 24 bp, Artificial sequence
  SiRNA target sequence
cttctacacaacaacaagccataa

SEQ ID NO: 174895 - DNA, 24 bp, Artificial sequence
  SiRNA target sequence
ttctacacaacaacaagccataaa

SEQ ID NO: 174896 - DNA, 24 bp, Artificial sequence
  SiRNA target sequence
tctacacaacaacaagccataaag

SEQ ID NO: 174897 - DNA, 24 bp, Artificial sequence
  SiRNA target sequence
ctacacaacaacaagccataaagc

SEQ ID NO: 174898 - DNA, 24 bp, Artificial sequence
  SiRNA target sequence
tacacaacaacaagccataaagct

SEQ ID NO: 174899 - DNA, 24 bp, Artificial sequence
  SiRNA target sequence
acacaacaacaagccataaagcta

SEQ ID NO: 174900 - DNA, 24 bp, Artificial sequence
  SiRNA target sequence
cacaacaacaagccataaagctac

SEQ ID NO: 174901 - DNA, 24 bp, Artificial sequence
  SiRNA target sequence
acaacaacaagccataaagctact

SEQ ID NO: 174902 - DNA, 24 bp, Artificial sequence
  SiRNA target sequence
caacaacaagccataaagctactt

SEQ ID NO: 174903 - DNA, 24 bp, Artificial sequence
  SiRNA target sequence
aacaacaagccataaagctacttg

SEQ ID NO: 174904 - DNA, 24 bp, Artificial sequence
  SiRNA target sequence
acaacaagccataaagctacttgc

SEQ ID NO: 174905 - DNA, 24 bp, Artificial sequence
  SiRNA target sequence
caacaagccataaagctacttgct

SEQ ID NO: 174906 - DNA, 24 bp, Artificial sequence
  SiRNA target sequence
aacaagccataaagctacttgctc

SEQ ID NO: 174907 - DNA, 24 bp, Artificial sequence
  SiRNA target sequence
acaagccataaagctacttgctca

SEQ ID NO: 174908 - DNA, 24 bp, Artificial sequence
  SiRNA target sequence
caagccataaagctacttgctcag

SEQ ID NO: 174909 - DNA, 24 bp, Artificial sequence
  SiRNA target sequence
aagccataaagctacttgctcagg

SEQ ID NO: 174910 - DNA, 24 bp, Artificial sequence
  SiRNA target sequence
agccataaagctacttgctcaggg

SEQ ID NO: 174911 - DNA, 24 bp, Artificial sequence
  SiRNA target sequence
gccataaagctacttgctcagggg

SEQ ID NO: 174912 - DNA, 24 bp, Artificial sequence
  SiRNA target sequence
ccataaagctacttgctcaggggc

SEQ ID NO: 174913 - DNA, 24 bp, Artificial sequence
  SiRNA target sequence
cataaagctacttgctcaggggcg

SEQ ID NO: 174914 - DNA, 24 bp, Artificial sequence
  SiRNA target sequence
ataaagctacttgctcaggggcga

SEQ ID NO: 174915 - DNA, 24 bp, Artificial sequence
  SiRNA target sequence
taaagctacttgctcaggggcgaa

SEQ ID NO: 174916 - DNA, 24 bp, Artificial sequence
  SiRNA target sequence
aaagctacttgctcaggggcgaag

SEQ ID NO: 174917 - DNA, 24 bp, Artificial sequence
  SiRNA target sequence
aagctacttgctcaggggcgaagt

SEQ ID NO: 174918 - DNA, 24 bp, Artificial sequence
  SiRNA target sequence
agctacttgctcaggggcgaagta

SEQ ID NO: 174919 - DNA, 24 bp, Artificial sequence
  SiRNA target sequence
gctacttgctcaggggcgaagtat

SEQ ID NO: 174920 - DNA, 24 bp, Artificial sequence
  SiRNA target sequence
ctacttgctcaggggcgaagtata

SEQ ID NO: 174921 - DNA, 24 bp, Artificial sequence
  SiRNA target sequence
tacttgctcaggggcgaagtataa

SEQ ID NO: 174922 - DNA, 24 bp, Artificial sequence
  SiRNA target sequence
acttgctcaggggcgaagtataag

SEQ ID NO: 174923 - DNA, 24 bp, Artificial sequence
  SiRNA target sequence
cttgctcaggggcgaagtataagt

SEQ ID NO: 174924 - DNA, 24 bp, Artificial sequence
  SiRNA target sequence
ttgctcaggggcgaagtataagtg

SEQ ID NO: 174925 - DNA, 24 bp, Artificial sequence
  SiRNA target sequence
tgctcaggggcgaagtataagtgt

SEQ ID NO: 174926 - DNA, 24 bp, Artificial sequence
  SiRNA target sequence
gctcaggggcgaagtataagtgtc

SEQ ID NO: 174927 - DNA, 24 bp, Artificial sequence
  SiRNA target sequence
ctcaggggcgaagtataagtgtca

SEQ ID NO: 174928 - DNA, 24 bp, Artificial sequence
  SiRNA target sequence
tcaggggcgaagtataagtgtcat

SEQ ID NO: 174929 - DNA, 24 bp, Artificial sequence
  SiRNA target sequence
caggggcgaagtataagtgtcata

SEQ ID NO: 174930 - DNA, 24 bp, Artificial sequence
  SiRNA target sequence
aggggcgaagtataagtgtcatac

SEQ ID NO: 174931 - DNA, 24 bp, Artificial sequence
  SiRNA target sequence
ggggcgaagtataagtgtcataca

SEQ ID NO: 174932 - DNA, 24 bp, Artificial sequence
  SiRNA target sequence
gggcgaagtataagtgtcatacag

SEQ ID NO: 174933 - DNA, 24 bp, Artificial sequence
  SiRNA target sequence
ggcgaagtataagtgtcatacagt

SEQ ID NO: 174934 - DNA, 24 bp, Artificial sequence
  SiRNA target sequence
gcgaagtataagtgtcatacagtg

SEQ ID NO: 174935 - DNA, 24 bp, Artificial sequence
  SiRNA target sequence
cgaagtataagtgtcatacagtgc

SEQ ID NO: 174936 - DNA, 24 bp, Artificial sequence
  SiRNA target sequence
gaagtataagtgtcatacagtgct

SEQ ID NO: 174937 - DNA, 24 bp, Artificial sequence
  SiRNA target sequence
aagtataagtgtcatacagtgcta

SEQ ID NO: 174938 - DNA, 24 bp, Artificial sequence
  SiRNA target sequence
agtataagtgtcatacagtgctat

SEQ ID NO: 174939 - DNA, 24 bp, Artificial sequence
  SiRNA target sequence
gtataagtgtcatacagtgctatg

SEQ ID NO: 174940 - DNA, 24 bp, Artificial sequence
  SiRNA target sequence
tataagtgtcatacagtgctatga

SEQ ID NO: 174941 - DNA, 24 bp, Artificial sequence
  SiRNA target sequence
ataagtgtcatacagtgctatgat

SEQ ID NO: 174942 - DNA, 24 bp, Artificial sequence
  SiRNA target sequence
taagtgtcatacagtgctatgata

SEQ ID NO: 174943 - DNA, 24 bp, Artificial sequence
  SiRNA target sequence
aagtgtcatacagtgctatgataa

SEQ ID NO: 174944 - DNA, 24 bp, Artificial sequence
  SiRNA target sequence
agtgtcatacagtgctatgataaa

SEQ ID NO: 174945 - DNA, 24 bp, Artificial sequence
  SiRNA target sequence
gtgtcatacagtgctatgataaat

SEQ ID NO: 174946 - DNA, 24 bp, Artificial sequence
  SiRNA target sequence
tgtcatacagtgctatgataaatt

SEQ ID NO: 174947 - DNA, 24 bp, Artificial sequence
  SiRNA target sequence
gtcatacagtgctatgataaattt

SEQ ID NO: 174948 - DNA, 24 bp, Artificial sequence
  SiRNA target sequence
tcatacagtgctatgataaatttt

SEQ ID NO: 174949 - DNA, 24 bp, Artificial sequence
  SiRNA target sequence
catacagtgctatgataaattttt

SEQ ID NO: 174950 - DNA, 24 bp, Artificial sequence
  SiRNA target sequence
atacagtgctatgataaattttta

SEQ ID NO: 174951 - DNA, 24 bp, Artificial sequence
  SiRNA target sequence
tacagtgctatgataaatttttag

SEQ ID NO: 174952 - DNA, 24 bp, Artificial sequence
  SiRNA target sequence
acagtgctatgataaatttttaga

SEQ ID NO: 174953 - DNA, 24 bp, Artificial sequence
  SiRNA target sequence
cagtgctatgataaatttttagag

SEQ ID NO: 174954 - DNA, 24 bp, Artificial sequence
  SiRNA target sequence
agtgctatgataaatttttagaga

SEQ ID NO: 174955 - DNA, 24 bp, Artificial sequence
  SiRNA target sequence
gtgctatgataaatttttagagaa

SEQ ID NO: 174956 - DNA, 24 bp, Artificial sequence
  SiRNA target sequence
tgctatgataaatttttagagaat

SEQ ID NO: 174957 - DNA, 24 bp, Artificial sequence
  SiRNA target sequence
gctatgataaatttttagagaata

SEQ ID NO: 174958 - DNA, 24 bp, Artificial sequence
  SiRNA target sequence
ctatgataaatttttagagaatag

SEQ ID NO: 174959 - DNA, 24 bp, Artificial sequence
  SiRNA target sequence
tatgataaatttttagagaatagc

SEQ ID NO: 174960 - DNA, 24 bp, Artificial sequence
  SiRNA target sequence
atgataaatttttagagaatagcg

SEQ ID NO: 174961 - DNA, 24 bp, Artificial sequence
  SiRNA target sequence
tgataaatttttagagaatagcga

SEQ ID NO: 174962 - DNA, 24 bp, Artificial sequence
  SiRNA target sequence
gataaatttttagagaatagcgat

SEQ ID NO: 174963 - DNA, 24 bp, Artificial sequence
  SiRNA target sequence
ataaatttttagagaatagcgatg

SEQ ID NO: 174964 - DNA, 24 bp, Artificial sequence
  SiRNA target sequence
taaatttttagagaatagcgatga

SEQ ID NO: 174965 - DNA, 24 bp, Artificial sequence
  SiRNA target sequence
aaatttttagagaatagcgatgat

SEQ ID NO: 174966 - DNA, 24 bp, Artificial sequence
  SiRNA target sequence
aatttttagagaatagcgatgatg

SEQ ID NO: 174967 - DNA, 24 bp, Artificial sequence
  SiRNA target sequence
atttttagagaatagcgatgatgt

SEQ ID NO: 174968 - DNA, 24 bp, Artificial sequence
  SiRNA target sequence
tttttagagaatagcgatgatgtt

SEQ ID NO: 174969 - DNA, 24 bp, Artificial sequence
  SiRNA target sequence
ttttagagaatagcgatgatgttt

SEQ ID NO: 174970 - DNA, 24 bp, Artificial sequence
  SiRNA target sequence
tttagagaatagcgatgatgtttt

SEQ ID NO: 174971 - DNA, 24 bp, Artificial sequence
  SiRNA target sequence
ttagagaatagcgatgatgtttta

SEQ ID NO: 174972 - DNA, 24 bp, Artificial sequence
  SiRNA target sequence
tagagaatagcgatgatgttttaa

SEQ ID NO: 174973 - DNA, 24 bp, Artificial sequence
  SiRNA target sequence
agagaatagcgatgatgttttaac

SEQ ID NO: 174974 - DNA, 24 bp, Artificial sequence
  SiRNA target sequence
gagaatagcgatgatgttttaact

SEQ ID NO: 174975 - DNA, 24 bp, Artificial sequence
  SiRNA target sequence
agaatagcgatgatgttttaacta

SEQ ID NO: 174976 - DNA, 24 bp, Artificial sequence
  SiRNA target sequence
gaatagcgatgatgttttaactac

SEQ ID NO: 174977 - DNA, 24 bp, Artificial sequence
  SiRNA target sequence
aatagcgatgatgttttaactacc

SEQ ID NO: 174978 - DNA, 24 bp, Artificial sequence
  SiRNA target sequence
atagcgatgatgttttaactacct

SEQ ID NO: 174979 - DNA, 24 bp, Artificial sequence
  SiRNA target sequence
tagcgatgatgttttaactaccta

SEQ ID NO: 174980 - DNA, 24 bp, Artificial sequence
  SiRNA target sequence
agcgatgatgttttaactacctat

SEQ ID NO: 174981 - DNA, 24 bp, Artificial sequence
  SiRNA target sequence
gcgatgatgttttaactacctatg

SEQ ID NO: 174982 - DNA, 24 bp, Artificial sequence
  SiRNA target sequence
cgatgatgttttaactacctatga

SEQ ID NO: 174983 - DNA, 24 bp, Artificial sequence
  SiRNA target sequence
gatgatgttttaactacctatgat

SEQ ID NO: 174984 - DNA, 24 bp, Artificial sequence
  SiRNA target sequence
atgatgttttaactacctatgatt

SEQ ID NO: 174985 - DNA, 24 bp, Artificial sequence
  SiRNA target sequence
tgatgttttaactacctatgattt

SEQ ID NO: 174986 - DNA, 24 bp, Artificial sequence
  SiRNA target sequence
gatgttttaactacctatgatttt

SEQ ID NO: 174987 - DNA, 24 bp, Artificial sequence
  SiRNA target sequence
atgttttaactacctatgattttt

SEQ ID NO: 174988 - DNA, 24 bp, Artificial sequence
  SiRNA target sequence
tgttttaactacctatgattttta

SEQ ID NO: 174989 - DNA, 24 bp, Artificial sequence
  SiRNA target sequence
gttttaactacctatgatttttat

SEQ ID NO: 174990 - DNA, 24 bp, Artificial sequence
  SiRNA target sequence
ttttaactacctatgatttttata

SEQ ID NO: 174991 - DNA, 24 bp, Artificial sequence
  SiRNA target sequence
tttaactacctatgatttttataa

SEQ ID NO: 174992 - DNA, 24 bp, Artificial sequence
  SiRNA target sequence
ttaactacctatgatttttataaa

SEQ ID NO: 174993 - DNA, 24 bp, Artificial sequence
  SiRNA target sequence
taactacctatgatttttataaaa

SEQ ID NO: 174994 - DNA, 24 bp, Artificial sequence
  SiRNA target sequence
aactacctatgatttttataaaat

SEQ ID NO: 174995 - DNA, 24 bp, Artificial sequence
  SiRNA target sequence
actacctatgatttttataaaatg

SEQ ID NO: 174996 - DNA, 24 bp, Artificial sequence
  SiRNA target sequence
ctacctatgatttttataaaatga

SEQ ID NO: 174997 - DNA, 24 bp, Artificial sequence
  SiRNA target sequence
tacctatgatttttataaaatgat

SEQ ID NO: 174998 - DNA, 24 bp, Artificial sequence
  SiRNA target sequence
acctatgatttttataaaatgatt

SEQ ID NO: 174999 - DNA, 24 bp, Artificial sequence
  SiRNA target sequence
cctatgatttttataaaatgattt

SEQ ID NO: 175000 - DNA, 24 bp, Artificial sequence
  SiRNA target sequence
ctatgatttttataaaatgatttt

SEQ ID NO: 175001 - DNA, 24 bp, Artificial sequence
  SiRNA target sequence
tatgatttttataaaatgattttg

SEQ ID NO: 175002 - DNA, 24 bp, Artificial sequence
  SiRNA target sequence
atgatttttataaaatgattttgg

SEQ ID NO: 175003 - DNA, 24 bp, Artificial sequence
  SiRNA target sequence
tgatttttataaaatgattttgga

SEQ ID NO: 175004 - DNA, 24 bp, Artificial sequence
  SiRNA target sequence
gatttttataaaatgattttggat

SEQ ID NO: 175005 - DNA, 24 bp, Artificial sequence
  SiRNA target sequence
atttttataaaatgattttggatc

SEQ ID NO: 175006 - DNA, 24 bp, Artificial sequence
  SiRNA target sequence
tttttataaaatgattttggatct

SEQ ID NO: 175007 - DNA, 24 bp, Artificial sequence
  SiRNA target sequence
ttttataaaatgattttggatcta

SEQ ID NO: 175008 - DNA, 24 bp, Artificial sequence
  SiRNA target sequence
tttataaaatgattttggatctag

SEQ ID NO: 175009 - DNA, 24 bp, Artificial sequence
  SiRNA target sequence
ttataaaatgattttggatctagg

SEQ ID NO: 175010 - DNA, 24 bp, Artificial sequence
  SiRNA target sequence
tataaaatgattttggatctagga

SEQ ID NO: 175011 - DNA, 24 bp, Artificial sequence
  SiRNA target sequence
ataaaatgattttggatctaggat

SEQ ID NO: 175012 - DNA, 24 bp, Artificial sequence
  SiRNA target sequence
taaaatgattttggatctaggatt

SEQ ID NO: 175013 - DNA, 24 bp, Artificial sequence
  SiRNA target sequence
aaaatgattttggatctaggattt

SEQ ID NO: 175014 - DNA, 24 bp, Artificial sequence
  SiRNA target sequence
aaatgattttggatctaggatttt

SEQ ID NO: 175015 - DNA, 24 bp, Artificial sequence
  SiRNA target sequence
aatgattttggatctaggattttt

SEQ ID NO: 175016 - DNA, 24 bp, Artificial sequence
  SiRNA target sequence
atgattttggatctaggattttta

SEQ ID NO: 175017 - DNA, 24 bp, Artificial sequence
  SiRNA target sequence
tgattttggatctaggatttttac

SEQ ID NO: 175018 - DNA, 24 bp, Artificial sequence
  SiRNA target sequence
gattttggatctaggatttttaca

SEQ ID NO: 175019 - DNA, 24 bp, Artificial sequence
  SiRNA target sequence
attttggatctaggatttttacag

SEQ ID NO: 175020 - DNA, 24 bp, Artificial sequence
  SiRNA target sequence
ttttggatctaggatttttacagc

SEQ ID NO: 175021 - DNA, 24 bp, Artificial sequence
  SiRNA target sequence
tttggatctaggatttttacagca

SEQ ID NO: 175022 - DNA, 24 bp, Artificial sequence
  SiRNA target sequence
ttggatctaggatttttacagcat

SEQ ID NO: 175023 - DNA, 24 bp, Artificial sequence
  SiRNA target sequence
tggatctaggatttttacagcata

SEQ ID NO: 175024 - DNA, 24 bp, Artificial sequence
  SiRNA target sequence
ggatctaggatttttacagcataa

SEQ ID NO: 175025 - DNA, 24 bp, Artificial sequence
  SiRNA target sequence
gatctaggatttttacagcataat

SEQ ID NO: 175026 - DNA, 24 bp, Artificial sequence
  SiRNA target sequence
atctaggatttttacagcataatt

SEQ ID NO: 175027 - DNA, 24 bp, Artificial sequence
  SiRNA target sequence
tctaggatttttacagcataattt

SEQ ID NO: 175028 - DNA, 24 bp, Artificial sequence
  SiRNA target sequence
ctaggatttttacagcataatttt

SEQ ID NO: 175029 - DNA, 24 bp, Artificial sequence
  SiRNA target sequence
taggatttttacagcataatttta

SEQ ID NO: 175030 - DNA, 24 bp, Artificial sequence
  SiRNA target sequence
aggatttttacagcataattttat

SEQ ID NO: 175031 - DNA, 24 bp, Artificial sequence
  SiRNA target sequence
ggatttttacagcataattttatt

SEQ ID NO: 175032 - DNA, 24 bp, Artificial sequence
  SiRNA target sequence
gatttttacagcataattttatta

SEQ ID NO: 175033 - DNA, 24 bp, Artificial sequence
  SiRNA target sequence
atttttacagcataattttattaa

SEQ ID NO: 175034 - DNA, 24 bp, Artificial sequence
  SiRNA target sequence
tttttacagcataattttattaaa

SEQ ID NO: 175035 - DNA, 24 bp, Artificial sequence
  SiRNA target sequence
ttttacagcataattttattaaag

SEQ ID NO: 175036 - DNA, 24 bp, Artificial sequence
  SiRNA target sequence
tttacagcataattttattaaagg

SEQ ID NO: 175037 - DNA, 24 bp, Artificial sequence
  SiRNA target sequence
ttacagcataattttattaaagga

SEQ ID NO: 175038 - DNA, 24 bp, Artificial sequence
  SiRNA target sequence
tacagcataattttattaaaggaa

SEQ ID NO: 175039 - DNA, 24 bp, Artificial sequence
  SiRNA target sequence
acagcataattttattaaaggaac

SEQ ID NO: 175040 - DNA, 24 bp, Artificial sequence
  SiRNA target sequence
cagcataattttattaaaggaacc

SEQ ID NO: 175041 - DNA, 24 bp, Artificial sequence
  SiRNA target sequence
agcataattttattaaaggaacct

SEQ ID NO: 175042 - DNA, 24 bp, Artificial sequence
  SiRNA target sequence
gcataattttattaaaggaacctg

SEQ ID NO: 175043 - DNA, 24 bp, Artificial sequence
  SiRNA target sequence
cataattttattaaaggaacctgt

SEQ ID NO: 175044 - DNA, 24 bp, Artificial sequence
  SiRNA target sequence
ataattttattaaaggaacctgtg

SEQ ID NO: 175045 - DNA, 24 bp, Artificial sequence
  SiRNA target sequence
taattttattaaaggaacctgtga

SEQ ID NO: 175046 - DNA, 24 bp, Artificial sequence
  SiRNA target sequence
aattttattaaaggaacctgtgag

SEQ ID NO: 175047 - DNA, 24 bp, Artificial sequence
  SiRNA target sequence
attttattaaaggaacctgtgaga

SEQ ID NO: 175048 - DNA, 24 bp, Artificial sequence
  SiRNA target sequence
ttttattaaaggaacctgtgagaa

SEQ ID NO: 175049 - DNA, 24 bp, Artificial sequence
  SiRNA target sequence
tttattaaaggaacctgtgagaaa

SEQ ID NO: 175050 - DNA, 24 bp, Artificial sequence
  SiRNA target sequence
ttattaaaggaacctgtgagaaat

SEQ ID NO: 175051 - DNA, 24 bp, Artificial sequence
  SiRNA target sequence
tattaaaggaacctgtgagaaatg

SEQ ID NO: 175052 - DNA, 24 bp, Artificial sequence
  SiRNA target sequence
attaaaggaacctgtgagaaatgg

SEQ ID NO: 175053 - DNA, 24 bp, Artificial sequence
  SiRNA target sequence
ttaaaggaacctgtgagaaatggg

SEQ ID NO: 175054 - DNA, 24 bp, Artificial sequence
  SiRNA target sequence
taaaggaacctgtgagaaatggga

SEQ ID NO: 175055 - DNA, 24 bp, Artificial sequence
  SiRNA target sequence
aaaggaacctgtgagaaatgggag

SEQ ID NO: 175056 - DNA, 24 bp, Artificial sequence
  SiRNA target sequence
aaggaacctgtgagaaatgggaga

SEQ ID NO: 175057 - DNA, 24 bp, Artificial sequence
  SiRNA target sequence
aggaacctgtgagaaatgggagaa

SEQ ID NO: 175058 - DNA, 24 bp, Artificial sequence
  SiRNA target sequence
ggaacctgtgagaaatgggagaag

SEQ ID NO: 175059 - DNA, 24 bp, Artificial sequence
  SiRNA target sequence
gaacctgtgagaaatgggagaagt

SEQ ID NO: 175060 - DNA, 24 bp, Artificial sequence
  SiRNA target sequence
aacctgtgagaaatgggagaagtg

SEQ ID NO: 175061 - DNA, 24 bp, Artificial sequence
  SiRNA target sequence
acctgtgagaaatgggagaagtgt

SEQ ID NO: 175062 - DNA, 24 bp, Artificial sequence
  SiRNA target sequence
cctgtgagaaatgggagaagtgta

SEQ ID NO: 175063 - DNA, 24 bp, Artificial sequence
  SiRNA target sequence
ctgtgagaaatgggagaagtgtac

SEQ ID NO: 175064 - DNA, 24 bp, Artificial sequence
  SiRNA target sequence
tgtgagaaatgggagaagtgtact

SEQ ID NO: 175065 - DNA, 24 bp, Artificial sequence
  SiRNA target sequence
gtgagaaatgggagaagtgtacta

SEQ ID NO: 175066 - DNA, 24 bp, Artificial sequence
  SiRNA target sequence
tgagaaatgggagaagtgtactat

SEQ ID NO: 175067 - DNA, 24 bp, Artificial sequence
  SiRNA target sequence
gagaaatgggagaagtgtactatt

SEQ ID NO: 175068 - DNA, 24 bp, Artificial sequence
  SiRNA target sequence
agaaatgggagaagtgtactattg

SEQ ID NO: 175069 - DNA, 24 bp, Artificial sequence
  SiRNA target sequence
gaaatgggagaagtgtactattgg

SEQ ID NO: 175070 - DNA, 24 bp, Artificial sequence
  SiRNA target sequence
aaatgggagaagtgtactattgga

SEQ ID NO: 175071 - DNA, 24 bp, Artificial sequence
  SiRNA target sequence
aatgggagaagtgtactattggat

SEQ ID NO: 175072 - DNA, 24 bp, Artificial sequence
  SiRNA target sequence
atgggagaagtgtactattggata

SEQ ID NO: 175073 - DNA, 24 bp, Artificial sequence
  SiRNA target sequence
tgggagaagtgtactattggatat

SEQ ID NO: 175074 - DNA, 24 bp, Artificial sequence
  SiRNA target sequence
gggagaagtgtactattggatatc

SEQ ID NO: 175075 - DNA, 24 bp, Artificial sequence
  SiRNA target sequence
ggagaagtgtactattggatatca

SEQ ID NO: 175076 - DNA, 24 bp, Artificial sequence
  SiRNA target sequence
gagaagtgtactattggatatcat

SEQ ID NO: 175077 - DNA, 24 bp, Artificial sequence
  SiRNA target sequence
agaagtgtactattggatatcatt

SEQ ID NO: 175078 - DNA, 24 bp, Artificial sequence
  SiRNA target sequence
gaagtgtactattggatatcatta

SEQ ID NO: 175079 - DNA, 24 bp, Artificial sequence
  SiRNA target sequence
aagtgtactattggatatcattat

SEQ ID NO: 175080 - DNA, 24 bp, Artificial sequence
  SiRNA target sequence
agtgtactattggatatcattatg

SEQ ID NO: 175081 - DNA, 24 bp, Artificial sequence
  SiRNA target sequence
gtgtactattggatatcattatgg

SEQ ID NO: 175082 - DNA, 24 bp, Artificial sequence
  SiRNA target sequence
tgtactattggatatcattatgga

SEQ ID NO: 175083 - DNA, 24 bp, Artificial sequence
  SiRNA target sequence
gtactattggatatcattatggat

SEQ ID NO: 175084 - DNA, 24 bp, Artificial sequence
  SiRNA target sequence
tactattggatatcattatggata

SEQ ID NO: 175085 - DNA, 24 bp, Artificial sequence
  SiRNA target sequence
actattggatatcattatggatat

SEQ ID NO: 175086 - DNA, 24 bp, Artificial sequence
  SiRNA target sequence
ctattggatatcattatggatatt

SEQ ID NO: 175087 - DNA, 24 bp, Artificial sequence
  SiRNA target sequence
tattggatatcattatggatattt

SEQ ID NO: 175088 - DNA, 24 bp, Artificial sequence
  SiRNA target sequence
attggatatcattatggatattta

SEQ ID NO: 175089 - DNA, 24 bp, Artificial sequence
  SiRNA target sequence
ttggatatcattatggatatttag

SEQ ID NO: 175090 - DNA, 24 bp, Artificial sequence
  SiRNA target sequence
tggatatcattatggatatttaga

SEQ ID NO: 175091 - DNA, 24 bp, Artificial sequence
  SiRNA target sequence
ggatatcattatggatatttagaa

SEQ ID NO: 175092 - DNA, 24 bp, Artificial sequence
  SiRNA target sequence
gatatcattatggatatttagaac

SEQ ID NO: 175093 - DNA, 24 bp, Artificial sequence
  SiRNA target sequence
atatcattatggatatttagaaca

SEQ ID NO: 175094 - DNA, 24 bp, Artificial sequence
  SiRNA target sequence
tatcattatggatatttagaacac

SEQ ID NO: 175095 - DNA, 24 bp, Artificial sequence
  SiRNA target sequence
atcattatggatatttagaacaca

SEQ ID NO: 175096 - DNA, 24 bp, Artificial sequence
  SiRNA target sequence
tcattatggatatttagaacacat

SEQ ID NO: 175097 - DNA, 24 bp, Artificial sequence
  SiRNA target sequence
cattatggatatttagaacacata

SEQ ID NO: 175098 - DNA, 24 bp, Artificial sequence
  SiRNA target sequence
attatggatatttagaacacatat

SEQ ID NO: 175099 - DNA, 24 bp, Artificial sequence
  SiRNA target sequence
ttatggatatttagaacacatatt

SEQ ID NO: 175100 - DNA, 24 bp, Artificial sequence
  SiRNA target sequence
tatggatatttagaacacatatta

SEQ ID NO: 175101 - DNA, 24 bp, Artificial sequence
  SiRNA target sequence
atggatatttagaacacatattaa

SEQ ID NO: 175102 - DNA, 24 bp, Artificial sequence
  SiRNA target sequence
tggatatttagaacacatattaaa

SEQ ID NO: 175103 - DNA, 24 bp, Artificial sequence
  SiRNA target sequence
ggatatttagaacacatattaaat

SEQ ID NO: 175104 - DNA, 24 bp, Artificial sequence
  SiRNA target sequence
gatatttagaacacatattaaata

SEQ ID NO: 175105 - DNA, 24 bp, Artificial sequence
  SiRNA target sequence
atatttagaacacatattaaataa

SEQ ID NO: 175106 - DNA, 24 bp, Artificial sequence
  SiRNA target sequence
tatttagaacacatattaaataag

SEQ ID NO: 175107 - DNA, 24 bp, Artificial sequence
  SiRNA target sequence
atttagaacacatattaaataaga

SEQ ID NO: 175108 - DNA, 24 bp, Artificial sequence
  SiRNA target sequence
tttagaacacatattaaataagaa

SEQ ID NO: 175109 - DNA, 24 bp, Artificial sequence
  SiRNA target sequence
ttagaacacatattaaataagaag

SEQ ID NO: 175110 - DNA, 24 bp, Artificial sequence
  SiRNA target sequence
tagaacacatattaaataagaaga

SEQ ID NO: 175111 - DNA, 24 bp, Artificial sequence
  SiRNA target sequence
agaacacatattaaataagaagaa

SEQ ID NO: 175112 - DNA, 24 bp, Artificial sequence
  SiRNA target sequence
gaacacatattaaataagaagaac

SEQ ID NO: 175113 - DNA, 24 bp, Artificial sequence
  SiRNA target sequence
aacacatattaaataagaagaaca

SEQ ID NO: 175114 - DNA, 24 bp, Artificial sequence
  SiRNA target sequence
acacatattaaataagaagaacaa

SEQ ID NO: 175115 - DNA, 24 bp, Artificial sequence
  SiRNA target sequence
cacatattaaataagaagaacaat

SEQ ID NO: 175116 - DNA, 24 bp, Artificial sequence
  SiRNA target sequence
acatattaaataagaagaacaatt

SEQ ID NO: 175117 - DNA, 24 bp, Artificial sequence
  SiRNA target sequence
catattaaataagaagaacaatta

SEQ ID NO: 175118 - DNA, 24 bp, Artificial sequence
  SiRNA target sequence
atattaaataagaagaacaattat

SEQ ID NO: 175119 - DNA, 24 bp, Artificial sequence
  SiRNA target sequence
tattaaataagaagaacaattatt

SEQ ID NO: 175120 - DNA, 24 bp, Artificial sequence
  SiRNA target sequence
attaaataagaagaacaattattt

SEQ ID NO: 175121 - DNA, 24 bp, Artificial sequence
  SiRNA target sequence
ttaaataagaagaacaattattta

SEQ ID NO: 175122 - DNA, 24 bp, Artificial sequence
  SiRNA target sequence
taaataagaagaacaattatttaa

SEQ ID NO: 175123 - DNA, 24 bp, Artificial sequence
  SiRNA target sequence
aaataagaagaacaattatttaac

SEQ ID NO: 175124 - DNA, 24 bp, Artificial sequence
  SiRNA target sequence
aataagaagaacaattatttaaca

SEQ ID NO: 175125 - DNA, 24 bp, Artificial sequence
  SiRNA target sequence
ataagaagaacaattatttaacaa

SEQ ID NO: 175126 - DNA, 24 bp, Artificial sequence
  SiRNA target sequence
taagaagaacaattatttaacaaa

SEQ ID NO: 175127 - DNA, 24 bp, Artificial sequence
  SiRNA target sequence
aagaagaacaattatttaacaaaa

SEQ ID NO: 175128 - DNA, 24 bp, Artificial sequence
  SiRNA target sequence
agaagaacaattatttaacaaaaa

SEQ ID NO: 175129 - DNA, 24 bp, Artificial sequence
  SiRNA target sequence
gaagaacaattatttaacaaaaaa

SEQ ID NO: 175130 - DNA, 24 bp, Artificial sequence
  SiRNA target sequence
aagaacaattatttaacaaaaaat

SEQ ID NO: 175131 - DNA, 24 bp, Artificial sequence
  SiRNA target sequence
agaacaattatttaacaaaaaatg

SEQ ID NO: 175132 - DNA, 24 bp, Artificial sequence
  SiRNA target sequence
gaacaattatttaacaaaaaatga

SEQ ID NO: 175133 - DNA, 24 bp, Artificial sequence
  SiRNA target sequence
aacaattatttaacaaaaaatgat

SEQ ID NO: 175134 - DNA, 24 bp, Artificial sequence
  SiRNA target sequence
acaattatttaacaaaaaatgata

SEQ ID NO: 175135 - DNA, 24 bp, Artificial sequence
  SiRNA target sequence
caattatttaacaaaaaatgatag

SEQ ID NO: 175136 - DNA, 24 bp, Artificial sequence
  SiRNA target sequence
aattatttaacaaaaaatgatagt

SEQ ID NO: 175137 - DNA, 24 bp, Artificial sequence
  SiRNA target sequence
attatttaacaaaaaatgatagta

SEQ ID NO: 175138 - DNA, 24 bp, Artificial sequence
  SiRNA target sequence
ttatttaacaaaaaatgatagtat

SEQ ID NO: 175139 - DNA, 24 bp, Artificial sequence
  SiRNA target sequence
tatttaacaaaaaatgatagtata

SEQ ID NO: 175140 - DNA, 24 bp, Artificial sequence
  SiRNA target sequence
atttaacaaaaaatgatagtataa

SEQ ID NO: 175141 - DNA, 24 bp, Artificial sequence
  SiRNA target sequence
tttaacaaaaaatgatagtataaa

SEQ ID NO: 175142 - DNA, 24 bp, Artificial sequence
  SiRNA target sequence
ttaacaaaaaatgatagtataaaa

SEQ ID NO: 175143 - DNA, 24 bp, Artificial sequence
  SiRNA target sequence
taacaaaaaatgatagtataaaaa

SEQ ID NO: 175144 - DNA, 24 bp, Artificial sequence
  SiRNA target sequence
aacaaaaaatgatagtataaaaat

SEQ ID NO: 175145 - DNA, 24 bp, Artificial sequence
  SiRNA target sequence
acaaaaaatgatagtataaaaata

SEQ ID NO: 175146 - DNA, 24 bp, Artificial sequence
  SiRNA target sequence
caaaaaatgatagtataaaaatat

SEQ ID NO: 175147 - DNA, 24 bp, Artificial sequence
  SiRNA target sequence
aaaaaatgatagtataaaaatatt

SEQ ID NO: 175148 - DNA, 24 bp, Artificial sequence
  SiRNA target sequence
aaaaatgatagtataaaaatattt

SEQ ID NO: 175149 - DNA, 24 bp, Artificial sequence
  SiRNA target sequence
aaaatgatagtataaaaatattta

SEQ ID NO: 175150 - DNA, 24 bp, Artificial sequence
  SiRNA target sequence
aaatgatagtataaaaatatttaa

SEQ ID NO: 175151 - DNA, 24 bp, Artificial sequence
  SiRNA target sequence
aatgatagtataaaaatatttaac

SEQ ID NO: 175152 - DNA, 24 bp, Artificial sequence
  SiRNA target sequence
atgatagtataaaaatatttaaca

SEQ ID NO: 175153 - DNA, 24 bp, Artificial sequence
  SiRNA target sequence
tgatagtataaaaatatttaacag

SEQ ID NO: 175154 - DNA, 24 bp, Artificial sequence
  SiRNA target sequence
gatagtataaaaatatttaacagt

SEQ ID NO: 175155 - DNA, 24 bp, Artificial sequence
  SiRNA target sequence
atagtataaaaatatttaacagta

SEQ ID NO: 175156 - DNA, 24 bp, Artificial sequence
  SiRNA target sequence
tagtataaaaatatttaacagtaa

SEQ ID NO: 175157 - DNA, 24 bp, Artificial sequence
  SiRNA target sequence
agtataaaaatatttaacagtaaa

SEQ ID NO: 175158 - DNA, 24 bp, Artificial sequence
  SiRNA target sequence
gtataaaaatatttaacagtaaaa

SEQ ID NO: 175159 - DNA, 24 bp, Artificial sequence
  SiRNA target sequence
tataaaaatatttaacagtaaaaa

SEQ ID NO: 175160 - DNA, 24 bp, Artificial sequence
  SiRNA target sequence
ataaaaatatttaacagtaaaaat

SEQ ID NO: 175161 - DNA, 24 bp, Artificial sequence
  SiRNA target sequence
taaaaatatttaacagtaaaaatg

SEQ ID NO: 175162 - DNA, 24 bp, Artificial sequence
  SiRNA target sequence
aaaaatatttaacagtaaaaatga

SEQ ID NO: 175163 - DNA, 24 bp, Artificial sequence
  SiRNA target sequence
aaaatatttaacagtaaaaatgag

SEQ ID NO: 175164 - DNA, 24 bp, Artificial sequence
  SiRNA target sequence
aaatatttaacagtaaaaatgagg

SEQ ID NO: 175165 - DNA, 24 bp, Artificial sequence
  SiRNA target sequence
aatatttaacagtaaaaatgagga

SEQ ID NO: 175166 - DNA, 24 bp, Artificial sequence
  SiRNA target sequence
atatttaacagtaaaaatgaggag

SEQ ID NO: 175167 - DNA, 24 bp, Artificial sequence
  SiRNA target sequence
tatttaacagtaaaaatgaggagg

SEQ ID NO: 175168 - DNA, 24 bp, Artificial sequence
  SiRNA target sequence
atttaacagtaaaaatgaggaggt

SEQ ID NO: 175169 - DNA, 24 bp, Artificial sequence
  SiRNA target sequence
tttaacagtaaaaatgaggaggta

SEQ ID NO: 175170 - DNA, 24 bp, Artificial sequence
  SiRNA target sequence
ttaacagtaaaaatgaggaggtaa

SEQ ID NO: 175171 - DNA, 24 bp, Artificial sequence
  SiRNA target sequence
taacagtaaaaatgaggaggtaag

SEQ ID NO: 175172 - DNA, 24 bp, Artificial sequence
  SiRNA target sequence
aacagtaaaaatgaggaggtaagg

SEQ ID NO: 175173 - DNA, 24 bp, Artificial sequence
  SiRNA target sequence
acagtaaaaatgaggaggtaaggt

SEQ ID NO: 175174 - DNA, 24 bp, Artificial sequence
  SiRNA target sequence
cagtaaaaatgaggaggtaaggtt

SEQ ID NO: 175175 - DNA, 24 bp, Artificial sequence
  SiRNA target sequence
agtaaaaatgaggaggtaaggtta

SEQ ID NO: 175176 - DNA, 24 bp, Artificial sequence
  SiRNA target sequence
gtaaaaatgaggaggtaaggttaa

SEQ ID NO: 175177 - DNA, 24 bp, Artificial sequence
  SiRNA target sequence
taaaaatgaggaggtaaggttaaa

SEQ ID NO: 175178 - DNA, 24 bp, Artificial sequence
  SiRNA target sequence
aaaaatgaggaggtaaggttaaat

SEQ ID NO: 175179 - DNA, 24 bp, Artificial sequence
  SiRNA target sequence
aaaatgaggaggtaaggttaaatg

SEQ ID NO: 175180 - DNA, 24 bp, Artificial sequence
  SiRNA target sequence
aaatgaggaggtaaggttaaatgg

SEQ ID NO: 175181 - DNA, 24 bp, Artificial sequence
  SiRNA target sequence
aatgaggaggtaaggttaaatgga

SEQ ID NO: 175182 - DNA, 24 bp, Artificial sequence
  SiRNA target sequence
atgaggaggtaaggttaaatggaa

SEQ ID NO: 175183 - DNA, 24 bp, Artificial sequence
  SiRNA target sequence
tgaggaggtaaggttaaatggaaa

SEQ ID NO: 175184 - DNA, 24 bp, Artificial sequence
  SiRNA target sequence
gaggaggtaaggttaaatggaaaa

SEQ ID NO: 175185 - DNA, 24 bp, Artificial sequence
  SiRNA target sequence
aggaggtaaggttaaatggaaaaa

SEQ ID NO: 175186 - DNA, 24 bp, Artificial sequence
  SiRNA target sequence
ggaggtaaggttaaatggaaaaag

SEQ ID NO: 175187 - DNA, 24 bp, Artificial sequence
  SiRNA target sequence
gaggtaaggttaaatggaaaaaga

SEQ ID NO: 175188 - DNA, 24 bp, Artificial sequence
  SiRNA target sequence
aggtaaggttaaatggaaaaagaa

SEQ ID NO: 175189 - DNA, 24 bp, Artificial sequence
  SiRNA target sequence
ggtaaggttaaatggaaaaagaaa

SEQ ID NO: 175190 - DNA, 24 bp, Artificial sequence
  SiRNA target sequence
gtaaggttaaatggaaaaagaaaa

SEQ ID NO: 175191 - DNA, 24 bp, Artificial sequence
  SiRNA target sequence
taaggttaaatggaaaaagaaaat

SEQ ID NO: 175192 - DNA, 24 bp, Artificial sequence
  SiRNA target sequence
aaggttaaatggaaaaagaaaatt

SEQ ID NO: 175193 - DNA, 24 bp, Artificial sequence
  SiRNA target sequence
aggttaaatggaaaaagaaaatta

SEQ ID NO: 175194 - DNA, 24 bp, Artificial sequence
  SiRNA target sequence
ggttaaatggaaaaagaaaattaa

SEQ ID NO: 175195 - DNA, 24 bp, Artificial sequence
  SiRNA target sequence
gttaaatggaaaaagaaaattaaa

SEQ ID NO: 175196 - DNA, 24 bp, Artificial sequence
  SiRNA target sequence
ttaaatggaaaaagaaaattaaat

SEQ ID NO: 175197 - DNA, 24 bp, Artificial sequence
  SiRNA target sequence
taaatggaaaaagaaaattaaata

SEQ ID NO: 175198 - DNA, 24 bp, Artificial sequence
  SiRNA target sequence
aaatggaaaaagaaaattaaatat

SEQ ID NO: 175199 - DNA, 24 bp, Artificial sequence
  SiRNA target sequence
aatggaaaaagaaaattaaatatt

SEQ ID NO: 175200 - DNA, 24 bp, Artificial sequence
  SiRNA target sequence
atggaaaaagaaaattaaatatta

SEQ ID NO: 175201 - DNA, 24 bp, Artificial sequence
  SiRNA target sequence
tggaaaaagaaaattaaatattaa

SEQ ID NO: 175202 - DNA, 24 bp, Artificial sequence
  SiRNA target sequence
ggaaaaagaaaattaaatattaac

SEQ ID NO: 175203 - DNA, 24 bp, Artificial sequence
  SiRNA target sequence
gaaaaagaaaattaaatattaaca

SEQ ID NO: 175204 - DNA, 24 bp, Artificial sequence
  SiRNA target sequence
aaaaagaaaattaaatattaacac

SEQ ID NO: 175205 - DNA, 24 bp, Artificial sequence
  SiRNA target sequence
aaaagaaaattaaatattaacaca

SEQ ID NO: 175206 - DNA, 24 bp, Artificial sequence
  SiRNA target sequence
aaagaaaattaaatattaacacag

SEQ ID NO: 175207 - DNA, 24 bp, Artificial sequence
  SiRNA target sequence
aagaaaattaaatattaacacagt

SEQ ID NO: 175208 - DNA, 24 bp, Artificial sequence
  SiRNA target sequence
agaaaattaaatattaacacagtt

SEQ ID NO: 175209 - DNA, 24 bp, Artificial sequence
  SiRNA target sequence
gaaaattaaatattaacacagtta

SEQ ID NO: 175210 - DNA, 24 bp, Artificial sequence
  SiRNA target sequence
aaaattaaatattaacacagttac

SEQ ID NO: 175211 - DNA, 24 bp, Artificial sequence
  SiRNA target sequence
aaattaaatattaacacagttaca

SEQ ID NO: 175212 - DNA, 24 bp, Artificial sequence
  SiRNA target sequence
aattaaatattaacacagttacat

SEQ ID NO: 175213 - DNA, 24 bp, Artificial sequence
  SiRNA target sequence
attaaatattaacacagttacatt

SEQ ID NO: 175214 - DNA, 24 bp, Artificial sequence
  SiRNA target sequence
ttaaatattaacacagttacatta

SEQ ID NO: 175215 - DNA, 24 bp, Artificial sequence
  SiRNA target sequence
taaatattaacacagttacattaa

SEQ ID NO: 175216 - DNA, 24 bp, Artificial sequence
  SiRNA target sequence
aaatattaacacagttacattaaa

SEQ ID NO: 175217 - DNA, 24 bp, Artificial sequence
  SiRNA target sequence
aatattaacacagttacattaaat

SEQ ID NO: 175218 - DNA, 24 bp, Artificial sequence
  SiRNA target sequence
atattaacacagttacattaaata

SEQ ID NO: 175219 - DNA, 24 bp, Artificial sequence
  SiRNA target sequence
tattaacacagttacattaaataa

SEQ ID NO: 175220 - DNA, 24 bp, Artificial sequence
  SiRNA target sequence
attaacacagttacattaaataaa

SEQ ID NO: 175221 - DNA, 24 bp, Artificial sequence
  SiRNA target sequence
ttaacacagttacattaaataaaa

SEQ ID NO: 175222 - DNA, 24 bp, Artificial sequence
  SiRNA target sequence
taacacagttacattaaataaaat

SEQ ID NO: 175223 - DNA, 24 bp, Artificial sequence
  SiRNA target sequence
aacacagttacattaaataaaatt

SEQ ID NO: 175224 - DNA, 24 bp, Artificial sequence
  SiRNA target sequence
acacagttacattaaataaaatta

SEQ ID NO: 175225 - DNA, 24 bp, Artificial sequence
  SiRNA target sequence
cacagttacattaaataaaattaa

SEQ ID NO: 175226 - DNA, 24 bp, Artificial sequence
  SiRNA target sequence
acagttacattaaataaaattaat

SEQ ID NO: 175227 - DNA, 24 bp, Artificial sequence
  SiRNA target sequence
cagttacattaaataaaattaata

SEQ ID NO: 175228 - DNA, 24 bp, Artificial sequence
  SiRNA target sequence
agttacattaaataaaattaatat

SEQ ID NO: 175229 - DNA, 24 bp, Artificial sequence
  SiRNA target sequence
gttacattaaataaaattaatata

SEQ ID NO: 175230 - DNA, 24 bp, Artificial sequence
  SiRNA target sequence
ttacattaaataaaattaatatac

SEQ ID NO: 175231 - DNA, 24 bp, Artificial sequence
  SiRNA target sequence
tacattaaataaaattaatatacc

SEQ ID NO: 175232 - DNA, 24 bp, Artificial sequence
  SiRNA target sequence
acattaaataaaattaatatacct

SEQ ID NO: 175233 - DNA, 24 bp, Artificial sequence
  SiRNA target sequence
cattaaataaaattaatatacctg

SEQ ID NO: 175234 - DNA, 24 bp, Artificial sequence
  SiRNA target sequence
attaaataaaattaatatacctga

SEQ ID NO: 175235 - DNA, 24 bp, Artificial sequence
  SiRNA target sequence
ttaaataaaattaatatacctgag

SEQ ID NO: 175236 - DNA, 24 bp, Artificial sequence
  SiRNA target sequence
taaataaaattaatatacctgaga

SEQ ID NO: 175237 - DNA, 24 bp, Artificial sequence
  SiRNA target sequence
aaataaaattaatatacctgagat

SEQ ID NO: 175238 - DNA, 24 bp, Artificial sequence
  SiRNA target sequence
aataaaattaatatacctgagata

SEQ ID NO: 175239 - DNA, 24 bp, Artificial sequence
  SiRNA target sequence
ataaaattaatatacctgagatag

SEQ ID NO: 175240 - DNA, 24 bp, Artificial sequence
  SiRNA target sequence
taaaattaatatacctgagataga

SEQ ID NO: 175241 - DNA, 24 bp, Artificial sequence
  SiRNA target sequence
aaaattaatatacctgagatagat

SEQ ID NO: 175242 - DNA, 24 bp, Artificial sequence
  SiRNA target sequence
aaattaatatacctgagatagatt

SEQ ID NO: 175243 - DNA, 24 bp, Artificial sequence
  SiRNA target sequence
aattaatatacctgagatagatta

SEQ ID NO: 175244 - DNA, 24 bp, Artificial sequence
  SiRNA target sequence
attaatatacctgagatagattat

SEQ ID NO: 175245 - DNA, 24 bp, Artificial sequence
  SiRNA target sequence
ttaatatacctgagatagattata

SEQ ID NO: 175246 - DNA, 24 bp, Artificial sequence
  SiRNA target sequence
taatatacctgagatagattataa

SEQ ID NO: 175247 - DNA, 24 bp, Artificial sequence
  SiRNA target sequence
aatatacctgagatagattataaa

SEQ ID NO: 175248 - DNA, 24 bp, Artificial sequence
  SiRNA target sequence
atatacctgagatagattataaat

SEQ ID NO: 175249 - DNA, 24 bp, Artificial sequence
  SiRNA target sequence
tatacctgagatagattataaata

SEQ ID NO: 175250 - DNA, 24 bp, Artificial sequence
  SiRNA target sequence
atacctgagatagattataaatat

SEQ ID NO: 175251 - DNA, 24 bp, Artificial sequence
  SiRNA target sequence
tacctgagatagattataaatata

SEQ ID NO: 175252 - DNA, 24 bp, Artificial sequence
  SiRNA target sequence
acctgagatagattataaatataa

SEQ ID NO: 175253 - DNA, 24 bp, Artificial sequence
  SiRNA target sequence
cctgagatagattataaatataaa

SEQ ID NO: 175254 - DNA, 24 bp, Artificial sequence
  SiRNA target sequence
ctgagatagattataaatataaaa

SEQ ID NO: 175255 - DNA, 24 bp, Artificial sequence
  SiRNA target sequence
tgagatagattataaatataaaaa

SEQ ID NO: 175256 - DNA, 24 bp, Artificial sequence
  SiRNA target sequence
gagatagattataaatataaaaat

SEQ ID NO: 175257 - DNA, 24 bp, Artificial sequence
  SiRNA target sequence
agatagattataaatataaaaatg

SEQ ID NO: 175258 - DNA, 24 bp, Artificial sequence
  SiRNA target sequence
gatagattataaatataaaaatgg

SEQ ID NO: 175259 - DNA, 24 bp, Artificial sequence
  SiRNA target sequence
atagattataaatataaaaatgga

SEQ ID NO: 175260 - DNA, 24 bp, Artificial sequence
  SiRNA target sequence
tagattataaatataaaaatggag

SEQ ID NO: 175261 - DNA, 24 bp, Artificial sequence
  SiRNA target sequence
agattataaatataaaaatggagt

SEQ ID NO: 175262 - DNA, 24 bp, Artificial sequence
  SiRNA target sequence
gattataaatataaaaatggagtg

SEQ ID NO: 175263 - DNA, 24 bp, Artificial sequence
  SiRNA target sequence
attataaatataaaaatggagtgt

SEQ ID NO: 175264 - DNA, 24 bp, Artificial sequence
  SiRNA target sequence
ttataaatataaaaatggagtgtt

SEQ ID NO: 175265 - DNA, 24 bp, Artificial sequence
  SiRNA target sequence
tataaatataaaaatggagtgttt

SEQ ID NO: 175266 - DNA, 24 bp, Artificial sequence
  SiRNA target sequence
ataaatataaaaatggagtgttta

SEQ ID NO: 175267 - DNA, 24 bp, Artificial sequence
  SiRNA target sequence
taaatataaaaatggagtgtttac

SEQ ID NO: 175268 - DNA, 24 bp, Artificial sequence
  SiRNA target sequence
aaatataaaaatggagtgtttaca

SEQ ID NO: 175269 - DNA, 24 bp, Artificial sequence
  SiRNA target sequence
aatataaaaatggagtgtttacat

SEQ ID NO: 175270 - DNA, 24 bp, Artificial sequence
  SiRNA target sequence
atataaaaatggagtgtttacata

SEQ ID NO: 175271 - DNA, 24 bp, Artificial sequence
  SiRNA target sequence
tataaaaatggagtgtttacatat

SEQ ID NO: 175272 - DNA, 24 bp, Artificial sequence
  SiRNA target sequence
ataaaaatggagtgtttacatata

SEQ ID NO: 175273 - DNA, 24 bp, Artificial sequence
  SiRNA target sequence
taaaaatggagtgtttacatatac

SEQ ID NO: 175274 - DNA, 24 bp, Artificial sequence
  SiRNA target sequence
aaaaatggagtgtttacatataca

SEQ ID NO: 175275 - DNA, 24 bp, Artificial sequence
  SiRNA target sequence
aaaatggagtgtttacatatacac

SEQ ID NO: 175276 - DNA, 24 bp, Artificial sequence
  SiRNA target sequence
aaatggagtgtttacatatacaca

SEQ ID NO: 175277 - DNA, 24 bp, Artificial sequence
  SiRNA target sequence
aatggagtgtttacatatacacag

SEQ ID NO: 175278 - DNA, 24 bp, Artificial sequence
  SiRNA target sequence
atggagtgtttacatatacacaga

SEQ ID NO: 175279 - DNA, 24 bp, Artificial sequence
  SiRNA target sequence
tggagtgtttacatatacacagat

SEQ ID NO: 175280 - DNA, 24 bp, Artificial sequence
  SiRNA target sequence
ggagtgtttacatatacacagatc

SEQ ID NO: 175281 - DNA, 24 bp, Artificial sequence
  SiRNA target sequence
gagtgtttacatatacacagatca

SEQ ID NO: 175282 - DNA, 24 bp, Artificial sequence
  SiRNA target sequence
agtgtttacatatacacagatcaa

SEQ ID NO: 175283 - DNA, 24 bp, Artificial sequence
  SiRNA target sequence
gtgtttacatatacacagatcaaa

SEQ ID NO: 175284 - DNA, 24 bp, Artificial sequence
  SiRNA target sequence
tgtttacatatacacagatcaaaa

SEQ ID NO: 175285 - DNA, 24 bp, Artificial sequence
  SiRNA target sequence
gtttacatatacacagatcaaaaa

SEQ ID NO: 175286 - DNA, 24 bp, Artificial sequence
  SiRNA target sequence
tttacatatacacagatcaaaaat

SEQ ID NO: 175287 - DNA, 24 bp, Artificial sequence
  SiRNA target sequence
ttacatatacacagatcaaaaata

SEQ ID NO: 175288 - DNA, 24 bp, Artificial sequence
  SiRNA target sequence
tacatatacacagatcaaaaataa

SEQ ID NO: 175289 - DNA, 24 bp, Artificial sequence
  SiRNA target sequence
acatatacacagatcaaaaataat

SEQ ID NO: 175290 - DNA, 24 bp, Artificial sequence
  SiRNA target sequence
catatacacagatcaaaaataata

SEQ ID NO: 175291 - DNA, 24 bp, Artificial sequence
  SiRNA target sequence
atatacacagatcaaaaataataa

SEQ ID NO: 175292 - DNA, 24 bp, Artificial sequence
  SiRNA target sequence
tatacacagatcaaaaataataag

SEQ ID NO: 175293 - DNA, 24 bp, Artificial sequence
  SiRNA target sequence
atacacagatcaaaaataataaga

SEQ ID NO: 175294 - DNA, 24 bp, Artificial sequence
  SiRNA target sequence
tacacagatcaaaaataataagaa

SEQ ID NO: 175295 - DNA, 24 bp, Artificial sequence
  SiRNA target sequence
acacagatcaaaaataataagaaa

SEQ ID NO: 175296 - DNA, 24 bp, Artificial sequence
  SiRNA target sequence
cacagatcaaaaataataagaaaa

SEQ ID NO: 175297 - DNA, 24 bp, Artificial sequence
  SiRNA target sequence
acagatcaaaaataataagaaaaa

SEQ ID NO: 175298 - DNA, 24 bp, Artificial sequence
  SiRNA target sequence
cagatcaaaaataataagaaaaaa

SEQ ID NO: 175299 - DNA, 24 bp, Artificial sequence
  SiRNA target sequence
agatcaaaaataataagaaaaaaa

SEQ ID NO: 175300 - DNA, 24 bp, Artificial sequence
  SiRNA target sequence
gatcaaaaataataagaaaaaaaa

SEQ ID NO: 175301 - DNA, 24 bp, Artificial sequence
  SiRNA target sequence
atcaaaaataataagaaaaaaaaa

SEQ ID NO: 175302 - DNA, 24 bp, Artificial sequence
  SiRNA target sequence
tcaaaaataataagaaaaaaaaat

SEQ ID NO: 175303 - DNA, 24 bp, Artificial sequence
  SiRNA target sequence
caaaaataataagaaaaaaaaata

SEQ ID NO: 175304 - DNA, 24 bp, Artificial sequence
  SiRNA target sequence
aaaaataataagaaaaaaaaatat

SEQ ID NO: 175305 - DNA, 24 bp, Artificial sequence
  SiRNA target sequence
aaaataataagaaaaaaaaatatt

SEQ ID NO: 175306 - DNA, 24 bp, Artificial sequence
  SiRNA target sequence
aaataataagaaaaaaaaatattt

SEQ ID NO: 175307 - DNA, 24 bp, Artificial sequence
  SiRNA target sequence
aataataagaaaaaaaaatattta

SEQ ID NO: 175308 - DNA, 24 bp, Artificial sequence
  SiRNA target sequence
ataataagaaaaaaaaatatttaa

SEQ ID NO: 175309 - DNA, 24 bp, Artificial sequence
  SiRNA target sequence
taataagaaaaaaaaatatttaag

SEQ ID NO: 175310 - DNA, 24 bp, Artificial sequence
  SiRNA target sequence
aataagaaaaaaaaatatttaaga

SEQ ID NO: 175311 - DNA, 24 bp, Artificial sequence
  SiRNA target sequence
ataagaaaaaaaaatatttaagaa

SEQ ID NO: 175312 - DNA, 24 bp, Artificial sequence
  SiRNA target sequence
taagaaaaaaaaatatttaagaat

SEQ ID NO: 175313 - DNA, 24 bp, Artificial sequence
  SiRNA target sequence
aagaaaaaaaaatatttaagaata

SEQ ID NO: 175314 - DNA, 24 bp, Artificial sequence
  SiRNA target sequence
agaaaaaaaaatatttaagaatat

SEQ ID NO: 175315 - DNA, 24 bp, Artificial sequence
  SiRNA target sequence
gaaaaaaaaatatttaagaatatt

SEQ ID NO: 175316 - DNA, 24 bp, Artificial sequence
  SiRNA target sequence
aaaaaaaaatatttaagaatattg

SEQ ID NO: 175317 - DNA, 24 bp, Artificial sequence
  SiRNA target sequence
aaaaaaaatatttaagaatattgg

SEQ ID NO: 175318 - DNA, 24 bp, Artificial sequence
  SiRNA target sequence
aaaaaaatatttaagaatattggg

SEQ ID NO: 175319 - DNA, 24 bp, Artificial sequence
  SiRNA target sequence
aaaaaatatttaagaatattgggt

SEQ ID NO: 175320 - DNA, 24 bp, Artificial sequence
  SiRNA target sequence
aaaaatatttaagaatattgggtc

SEQ ID NO: 175321 - DNA, 24 bp, Artificial sequence
  SiRNA target sequence
aaaatatttaagaatattgggtct

SEQ ID NO: 175322 - DNA, 24 bp, Artificial sequence
  SiRNA target sequence
aaatatttaagaatattgggtcta

SEQ ID NO: 175323 - DNA, 24 bp, Artificial sequence
  SiRNA target sequence
aatatttaagaatattgggtctag

SEQ ID NO: 175324 - DNA, 24 bp, Artificial sequence
  SiRNA target sequence
atatttaagaatattgggtctaga

SEQ ID NO: 175325 - DNA, 24 bp, Artificial sequence
  SiRNA target sequence
tatttaagaatattgggtctagaa

SEQ ID NO: 175326 - DNA, 24 bp, Artificial sequence
  SiRNA target sequence
atttaagaatattgggtctagaac

SEQ ID NO: 175327 - DNA, 24 bp, Artificial sequence
  SiRNA target sequence
tttaagaatattgggtctagaacc

SEQ ID NO: 175328 - DNA, 24 bp, Artificial sequence
  SiRNA target sequence
ttaagaatattgggtctagaacct

SEQ ID NO: 175329 - DNA, 24 bp, Artificial sequence
  SiRNA target sequence
taagaatattgggtctagaacctt

SEQ ID NO: 175330 - DNA, 24 bp, Artificial sequence
  SiRNA target sequence
aagaatattgggtctagaaccttt

SEQ ID NO: 175331 - DNA, 24 bp, Artificial sequence
  SiRNA target sequence
agaatattgggtctagaacctttt

SEQ ID NO: 175332 - DNA, 24 bp, Artificial sequence
  SiRNA target sequence
gaatattgggtctagaaccttttc

SEQ ID NO: 175333 - DNA, 24 bp, Artificial sequence
  SiRNA target sequence
aatattgggtctagaaccttttct

SEQ ID NO: 175334 - DNA, 24 bp, Artificial sequence
  SiRNA target sequence
atattgggtctagaaccttttctt

SEQ ID NO: 175335 - DNA, 24 bp, Artificial sequence
  SiRNA target sequence
tattgggtctagaaccttttctta

SEQ ID NO: 175336 - DNA, 24 bp, Artificial sequence
  SiRNA target sequence
attgggtctagaaccttttcttaa

SEQ ID NO: 175337 - DNA, 24 bp, Artificial sequence
  SiRNA target sequence
ttgggtctagaaccttttcttaat

SEQ ID NO: 175338 - DNA, 24 bp, Artificial sequence
  SiRNA target sequence
tgggtctagaaccttttcttaatt

SEQ ID NO: 175339 - DNA, 24 bp, Artificial sequence
  SiRNA target sequence
gggtctagaaccttttcttaattt

SEQ ID NO: 175340 - DNA, 24 bp, Artificial sequence
  SiRNA target sequence
ggtctagaaccttttcttaatttt

SEQ ID NO: 175341 - DNA, 24 bp, Artificial sequence
  SiRNA target sequence
gtctagaaccttttcttaatttta

SEQ ID NO: 175342 - DNA, 24 bp, Artificial sequence
  SiRNA target sequence
tctagaaccttttcttaattttat

SEQ ID NO: 175343 - DNA, 24 bp, Artificial sequence
  SiRNA target sequence
ctagaaccttttcttaattttatt

SEQ ID NO: 175344 - DNA, 24 bp, Artificial sequence
  SiRNA target sequence
tagaaccttttcttaattttatta

SEQ ID NO: 175345 - DNA, 24 bp, Artificial sequence
  SiRNA target sequence
agaaccttttcttaattttattaa

SEQ ID NO: 175346 - DNA, 24 bp, Artificial sequence
  SiRNA target sequence
gaaccttttcttaattttattaag

SEQ ID NO: 175347 - DNA, 24 bp, Artificial sequence
  SiRNA target sequence
aaccttttcttaattttattaagg

SEQ ID NO: 175348 - DNA, 24 bp, Artificial sequence
  SiRNA target sequence
accttttcttaattttattaagga

SEQ ID NO: 175349 - DNA, 24 bp, Artificial sequence
  SiRNA target sequence
ccttttcttaattttattaaggaa

SEQ ID NO: 175350 - DNA, 24 bp, Artificial sequence
  SiRNA target sequence
cttttcttaattttattaaggaaa

SEQ ID NO: 175351 - DNA, 24 bp, Artificial sequence
  SiRNA target sequence
ttttcttaattttattaaggaaag

SEQ ID NO: 175352 - DNA, 24 bp, Artificial sequence
  SiRNA target sequence
tttcttaattttattaaggaaagt

SEQ ID NO: 175353 - DNA, 24 bp, Artificial sequence
  SiRNA target sequence
ttcttaattttattaaggaaagta

SEQ ID NO: 175354 - DNA, 24 bp, Artificial sequence
  SiRNA target sequence
tcttaattttattaaggaaagtaa

SEQ ID NO: 175355 - DNA, 24 bp, Artificial sequence
  SiRNA target sequence
cttaattttattaaggaaagtaaa

SEQ ID NO: 175356 - DNA, 24 bp, Artificial sequence
  SiRNA target sequence
ttaattttattaaggaaagtaaac

SEQ ID NO: 175357 - DNA, 24 bp, Artificial sequence
  SiRNA target sequence
taattttattaaggaaagtaaaca

SEQ ID NO: 175358 - DNA, 24 bp, Artificial sequence
  SiRNA target sequence
aattttattaaggaaagtaaacat

SEQ ID NO: 175359 - DNA, 24 bp, Artificial sequence
  SiRNA target sequence
attttattaaggaaagtaaacata

SEQ ID NO: 175360 - DNA, 24 bp, Artificial sequence
  SiRNA target sequence
ttttattaaggaaagtaaacataa

SEQ ID NO: 175361 - DNA, 24 bp, Artificial sequence
  SiRNA target sequence
tttattaaggaaagtaaacataaa

SEQ ID NO: 175362 - DNA, 24 bp, Artificial sequence
  SiRNA target sequence
ttattaaggaaagtaaacataaag

SEQ ID NO: 175363 - DNA, 24 bp, Artificial sequence
  SiRNA target sequence
tattaaggaaagtaaacataaaga

SEQ ID NO: 175364 - DNA, 24 bp, Artificial sequence
  SiRNA target sequence
attaaggaaagtaaacataaagaa

SEQ ID NO: 175365 - DNA, 24 bp, Artificial sequence
  SiRNA target sequence
ttaaggaaagtaaacataaagaat

SEQ ID NO: 175366 - DNA, 24 bp, Artificial sequence
  SiRNA target sequence
taaggaaagtaaacataaagaatt

SEQ ID NO: 175367 - DNA, 24 bp, Artificial sequence
  SiRNA target sequence
aaggaaagtaaacataaagaatta

SEQ ID NO: 175368 - DNA, 24 bp, Artificial sequence
  SiRNA target sequence
aggaaagtaaacataaagaattag

SEQ ID NO: 175369 - DNA, 24 bp, Artificial sequence
  SiRNA target sequence
ggaaagtaaacataaagaattaga

SEQ ID NO: 175370 - DNA, 24 bp, Artificial sequence
  SiRNA target sequence
gaaagtaaacataaagaattagaa

SEQ ID NO: 175371 - DNA, 24 bp, Artificial sequence
  SiRNA target sequence
aaagtaaacataaagaattagaat

SEQ ID NO: 175372 - DNA, 24 bp, Artificial sequence
  SiRNA target sequence
aagtaaacataaagaattagaata

SEQ ID NO: 175373 - DNA, 24 bp, Artificial sequence
  SiRNA target sequence
agtaaacataaagaattagaatat

SEQ ID NO: 175374 - DNA, 24 bp, Artificial sequence
  SiRNA target sequence
gtaaacataaagaattagaatatg

SEQ ID NO: 175375 - DNA, 24 bp, Artificial sequence
  SiRNA target sequence
taaacataaagaattagaatatga

SEQ ID NO: 175376 - DNA, 24 bp, Artificial sequence
  SiRNA target sequence
aaacataaagaattagaatatgat

SEQ ID NO: 175377 - DNA, 24 bp, Artificial sequence
  SiRNA target sequence
aacataaagaattagaatatgatg

SEQ ID NO: 175378 - DNA, 24 bp, Artificial sequence
  SiRNA target sequence
acataaagaattagaatatgatgt

SEQ ID NO: 175379 - DNA, 24 bp, Artificial sequence
  SiRNA target sequence
cataaagaattagaatatgatgta

SEQ ID NO: 175380 - DNA, 24 bp, Artificial sequence
  SiRNA target sequence
ataaagaattagaatatgatgtat

SEQ ID NO: 175381 - DNA, 24 bp, Artificial sequence
  SiRNA target sequence
taaagaattagaatatgatgtatg

SEQ ID NO: 175382 - DNA, 24 bp, Artificial sequence
  SiRNA target sequence
aaagaattagaatatgatgtatgc

SEQ ID NO: 175383 - DNA, 24 bp, Artificial sequence
  SiRNA target sequence
aagaattagaatatgatgtatgcg

SEQ ID NO: 175384 - DNA, 24 bp, Artificial sequence
  SiRNA target sequence
agaattagaatatgatgtatgcga

SEQ ID NO: 175385 - DNA, 24 bp, Artificial sequence
  SiRNA target sequence
gaattagaatatgatgtatgcgaa

SEQ ID NO: 175386 - DNA, 24 bp, Artificial sequence
  SiRNA target sequence
aattagaatatgatgtatgcgaaa

SEQ ID NO: 175387 - DNA, 24 bp, Artificial sequence
  SiRNA target sequence
attagaatatgatgtatgcgaaat

SEQ ID NO: 175388 - DNA, 24 bp, Artificial sequence
  SiRNA target sequence
ttagaatatgatgtatgcgaaata

SEQ ID NO: 175389 - DNA, 24 bp, Artificial sequence
  SiRNA target sequence
tagaatatgatgtatgcgaaatat

SEQ ID NO: 175390 - DNA, 24 bp, Artificial sequence
  SiRNA target sequence
agaatatgatgtatgcgaaatata

SEQ ID NO: 175391 - DNA, 24 bp, Artificial sequence
  SiRNA target sequence
gaatatgatgtatgcgaaatatac

SEQ ID NO: 175392 - DNA, 24 bp, Artificial sequence
  SiRNA target sequence
aatatgatgtatgcgaaatataca

SEQ ID NO: 175393 - DNA, 24 bp, Artificial sequence
  SiRNA target sequence
atatgatgtatgcgaaatatacat

SEQ ID NO: 175394 - DNA, 24 bp, Artificial sequence
  SiRNA target sequence
tatgatgtatgcgaaatatacatt

SEQ ID NO: 175395 - DNA, 24 bp, Artificial sequence
  SiRNA target sequence
atgatgtatgcgaaatatacattt

SEQ ID NO: 175396 - DNA, 24 bp, Artificial sequence
  SiRNA target sequence
tgatgtatgcgaaatatacatttg

SEQ ID NO: 175397 - DNA, 24 bp, Artificial sequence
  SiRNA target sequence
gatgtatgcgaaatatacatttgt

SEQ ID NO: 175398 - DNA, 24 bp, Artificial sequence
  SiRNA target sequence
atgtatgcgaaatatacatttgta

SEQ ID NO: 175399 - DNA, 24 bp, Artificial sequence
  SiRNA target sequence
tgtatgcgaaatatacatttgtaa

SEQ ID NO: 175400 - DNA, 24 bp, Artificial sequence
  SiRNA target sequence
gtatgcgaaatatacatttgtaat

SEQ ID NO: 175401 - DNA, 24 bp, Artificial sequence
  SiRNA target sequence
tatgcgaaatatacatttgtaatc

SEQ ID NO: 175402 - DNA, 24 bp, Artificial sequence
  SiRNA target sequence
atgcgaaatatacatttgtaatca

SEQ ID NO: 175403 - DNA, 24 bp, Artificial sequence
  SiRNA target sequence
tgcgaaatatacatttgtaatcag

SEQ ID NO: 175404 - DNA, 24 bp, Artificial sequence
  SiRNA target sequence
gcgaaatatacatttgtaatcagg

SEQ ID NO: 175405 - DNA, 24 bp, Artificial sequence
  SiRNA target sequence
cgaaatatacatttgtaatcaggg

SEQ ID NO: 175406 - DNA, 24 bp, Artificial sequence
  SiRNA target sequence
gaaatatacatttgtaatcaggga

SEQ ID NO: 175407 - DNA, 24 bp, Artificial sequence
  SiRNA target sequence
aaatatacatttgtaatcagggat

SEQ ID NO: 175408 - DNA, 24 bp, Artificial sequence
  SiRNA target sequence
aatatacatttgtaatcagggatg

SEQ ID NO: 175409 - DNA, 24 bp, Artificial sequence
  SiRNA target sequence
atatacatttgtaatcagggatgc

SEQ ID NO: 175410 - DNA, 24 bp, Artificial sequence
  SiRNA target sequence
tatacatttgtaatcagggatgca

SEQ ID NO: 175411 - DNA, 24 bp, Artificial sequence
  SiRNA target sequence
atacatttgtaatcagggatgcat

SEQ ID NO: 175412 - DNA, 24 bp, Artificial sequence
  SiRNA target sequence
tacatttgtaatcagggatgcatt

SEQ ID NO: 175413 - DNA, 24 bp, Artificial sequence
  SiRNA target sequence
acatttgtaatcagggatgcatta

SEQ ID NO: 175414 - DNA, 24 bp, Artificial sequence
  SiRNA target sequence
catttgtaatcagggatgcattaa

SEQ ID NO: 175415 - DNA, 24 bp, Artificial sequence
  SiRNA target sequence
atttgtaatcagggatgcattaat

SEQ ID NO: 175416 - DNA, 24 bp, Artificial sequence
  SiRNA target sequence
tttgtaatcagggatgcattaatg

SEQ ID NO: 175417 - DNA, 24 bp, Artificial sequence
  SiRNA target sequence
ttgtaatcagggatgcattaatgg

SEQ ID NO: 175418 - DNA, 24 bp, Artificial sequence
  SiRNA target sequence
tgtaatcagggatgcattaatgga

SEQ ID NO: 175419 - DNA, 24 bp, Artificial sequence
  SiRNA target sequence
gtaatcagggatgcattaatggac

SEQ ID NO: 175420 - DNA, 24 bp, Artificial sequence
  SiRNA target sequence
taatcagggatgcattaatggacc

SEQ ID NO: 175421 - DNA, 24 bp, Artificial sequence
  SiRNA target sequence
aatcagggatgcattaatggacca

SEQ ID NO: 175422 - DNA, 24 bp, Artificial sequence
  SiRNA target sequence
atcagggatgcattaatggaccag

SEQ ID NO: 175423 - DNA, 24 bp, Artificial sequence
  SiRNA target sequence
tcagggatgcattaatggaccagg

SEQ ID NO: 175424 - DNA, 24 bp, Artificial sequence
  SiRNA target sequence
cagggatgcattaatggaccagga

SEQ ID NO: 175425 - DNA, 24 bp, Artificial sequence
  SiRNA target sequence
agggatgcattaatggaccaggac

SEQ ID NO: 175426 - DNA, 24 bp, Artificial sequence
  SiRNA target sequence
gggatgcattaatggaccaggaca

SEQ ID NO: 175427 - DNA, 24 bp, Artificial sequence
  SiRNA target sequence
ggatgcattaatggaccaggacaa

SEQ ID NO: 175428 - DNA, 24 bp, Artificial sequence
  SiRNA target sequence
gatgcattaatggaccaggacaat

SEQ ID NO: 175429 - DNA, 24 bp, Artificial sequence
  SiRNA target sequence
atgcattaatggaccaggacaatt

SEQ ID NO: 175430 - DNA, 24 bp, Artificial sequence
  SiRNA target sequence
tgcattaatggaccaggacaattg

SEQ ID NO: 175431 - DNA, 24 bp, Artificial sequence
  SiRNA target sequence
gcattaatggaccaggacaattgt

SEQ ID NO: 175432 - DNA, 24 bp, Artificial sequence
  SiRNA target sequence
cattaatggaccaggacaattgta

SEQ ID NO: 175433 - DNA, 24 bp, Artificial sequence
  SiRNA target sequence
attaatggaccaggacaattgtat

SEQ ID NO: 175434 - DNA, 24 bp, Artificial sequence
  SiRNA target sequence
ttaatggaccaggacaattgtata

SEQ ID NO: 175435 - DNA, 24 bp, Artificial sequence
  SiRNA target sequence
taatggaccaggacaattgtatac

SEQ ID NO: 175436 - DNA, 24 bp, Artificial sequence
  SiRNA target sequence
aatggaccaggacaattgtataca

SEQ ID NO: 175437 - DNA, 24 bp, Artificial sequence
  SiRNA target sequence
atggaccaggacaattgtatacag

SEQ ID NO: 175438 - DNA, 24 bp, Artificial sequence
  SiRNA target sequence
tggaccaggacaattgtatacaga

SEQ ID NO: 175439 - DNA, 24 bp, Artificial sequence
  SiRNA target sequence
ggaccaggacaattgtatacagat

SEQ ID NO: 175440 - DNA, 24 bp, Artificial sequence
  SiRNA target sequence
gaccaggacaattgtatacagata

SEQ ID NO: 175441 - DNA, 24 bp, Artificial sequence
  SiRNA target sequence
accaggacaattgtatacagataa

SEQ ID NO: 175442 - DNA, 24 bp, Artificial sequence
  SiRNA target sequence
ccaggacaattgtatacagataat

SEQ ID NO: 175443 - DNA, 24 bp, Artificial sequence
  SiRNA target sequence
caggacaattgtatacagataatt

SEQ ID NO: 175444 - DNA, 24 bp, Artificial sequence
  SiRNA target sequence
aggacaattgtatacagataattt

SEQ ID NO: 175445 - DNA, 24 bp, Artificial sequence
  SiRNA target sequence
ggacaattgtatacagataattta

SEQ ID NO: 175446 - DNA, 24 bp, Artificial sequence
  SiRNA target sequence
gacaattgtatacagataatttat

SEQ ID NO: 175447 - DNA, 24 bp, Artificial sequence
  SiRNA target sequence
acaattgtatacagataatttata

SEQ ID NO: 175448 - DNA, 24 bp, Artificial sequence
  SiRNA target sequence
caattgtatacagataatttatat

SEQ ID NO: 175449 - DNA, 24 bp, Artificial sequence
  SiRNA target sequence
aattgtatacagataatttatatg

SEQ ID NO: 175450 - DNA, 24 bp, Artificial sequence
  SiRNA target sequence
attgtatacagataatttatatgt

SEQ ID NO: 175451 - DNA, 24 bp, Artificial sequence
  SiRNA target sequence
ttgtatacagataatttatatgta

SEQ ID NO: 175452 - DNA, 24 bp, Artificial sequence
  SiRNA target sequence
tgtatacagataatttatatgtaa

SEQ ID NO: 175453 - DNA, 24 bp, Artificial sequence
  SiRNA target sequence
gtatacagataatttatatgtaaa

SEQ ID NO: 175454 - DNA, 24 bp, Artificial sequence
  SiRNA target sequence
tatacagataatttatatgtaaat

SEQ ID NO: 175455 - DNA, 24 bp, Artificial sequence
  SiRNA target sequence
atacagataatttatatgtaaata

SEQ ID NO: 175456 - DNA, 24 bp, Artificial sequence
  SiRNA target sequence
tacagataatttatatgtaaataa

SEQ ID NO: 175457 - DNA, 24 bp, Artificial sequence
  SiRNA target sequence
acagataatttatatgtaaataat

SEQ ID NO: 175458 - DNA, 24 bp, Artificial sequence
  SiRNA target sequence
cagataatttatatgtaaataatt

SEQ ID NO: 175459 - DNA, 24 bp, Artificial sequence
  SiRNA target sequence
agataatttatatgtaaataattc

SEQ ID NO: 175460 - DNA, 24 bp, Artificial sequence
  SiRNA target sequence
gataatttatatgtaaataattca

SEQ ID NO: 175461 - DNA, 24 bp, Artificial sequence
  SiRNA target sequence
ataatttatatgtaaataattcag

SEQ ID NO: 175462 - DNA, 24 bp, Artificial sequence
  SiRNA target sequence
taatttatatgtaaataattcaga

SEQ ID NO: 175463 - DNA, 24 bp, Artificial sequence
  SiRNA target sequence
aatttatatgtaaataattcagaa

SEQ ID NO: 175464 - DNA, 24 bp, Artificial sequence
  SiRNA target sequence
atttatatgtaaataattcagaat

SEQ ID NO: 175465 - DNA, 24 bp, Artificial sequence
  SiRNA target sequence
tttatatgtaaataattcagaata

SEQ ID NO: 175466 - DNA, 24 bp, Artificial sequence
  SiRNA target sequence
ttatatgtaaataattcagaatac

SEQ ID NO: 175467 - DNA, 24 bp, Artificial sequence
  SiRNA target sequence
tatatgtaaataattcagaataca

SEQ ID NO: 175468 - DNA, 24 bp, Artificial sequence
  SiRNA target sequence
atatgtaaataattcagaatacat

SEQ ID NO: 175469 - DNA, 24 bp, Artificial sequence
  SiRNA target sequence
tatgtaaataattcagaatacata

SEQ ID NO: 175470 - DNA, 24 bp, Artificial sequence
  SiRNA target sequence
atgtaaataattcagaatacatag

SEQ ID NO: 175471 - DNA, 24 bp, Artificial sequence
  SiRNA target sequence
tgtaaataattcagaatacataga

SEQ ID NO: 175472 - DNA, 24 bp, Artificial sequence
  SiRNA target sequence
gtaaataattcagaatacatagat

SEQ ID NO: 175473 - DNA, 24 bp, Artificial sequence
  SiRNA target sequence
taaataattcagaatacatagata

SEQ ID NO: 175474 - DNA, 24 bp, Artificial sequence
  SiRNA target sequence
aaataattcagaatacatagatat

SEQ ID NO: 175475 - DNA, 24 bp, Artificial sequence
  SiRNA target sequence
aataattcagaatacatagatatt

SEQ ID NO: 175476 - DNA, 24 bp, Artificial sequence
  SiRNA target sequence
ataattcagaatacatagatattg

SEQ ID NO: 175477 - DNA, 24 bp, Artificial sequence
  SiRNA target sequence
taattcagaatacatagatattga

SEQ ID NO: 175478 - DNA, 24 bp, Artificial sequence
  SiRNA target sequence
aattcagaatacatagatattgat

SEQ ID NO: 175479 - DNA, 24 bp, Artificial sequence
  SiRNA target sequence
attcagaatacatagatattgatc

SEQ ID NO: 175480 - DNA, 24 bp, Artificial sequence
  SiRNA target sequence
ttcagaatacatagatattgatct

SEQ ID NO: 175481 - DNA, 24 bp, Artificial sequence
  SiRNA target sequence
tcagaatacatagatattgatctt

SEQ ID NO: 175482 - DNA, 24 bp, Artificial sequence
  SiRNA target sequence
cagaatacatagatattgatcttg

SEQ ID NO: 175483 - DNA, 24 bp, Artificial sequence
  SiRNA target sequence
agaatacatagatattgatcttgg

SEQ ID NO: 175484 - DNA, 24 bp, Artificial sequence
  SiRNA target sequence
gaatacatagatattgatcttggt

SEQ ID NO: 175485 - DNA, 24 bp, Artificial sequence
  SiRNA target sequence
aatacatagatattgatcttggta

SEQ ID NO: 175486 - DNA, 24 bp, Artificial sequence
  SiRNA target sequence
atacatagatattgatcttggtat

SEQ ID NO: 175487 - DNA, 24 bp, Artificial sequence
  SiRNA target sequence
tacatagatattgatcttggtatt

SEQ ID NO: 175488 - DNA, 24 bp, Artificial sequence
  SiRNA target sequence
acatagatattgatcttggtattg

SEQ ID NO: 175489 - DNA, 24 bp, Artificial sequence
  SiRNA target sequence
catagatattgatcttggtattga

SEQ ID NO: 175490 - DNA, 24 bp, Artificial sequence
  SiRNA target sequence
atagatattgatcttggtattgat

SEQ ID NO: 175491 - DNA, 24 bp, Artificial sequence
  SiRNA target sequence
tagatattgatcttggtattgatt

SEQ ID NO: 175492 - DNA, 24 bp, Artificial sequence
  SiRNA target sequence
agatattgatcttggtattgattg

SEQ ID NO: 175493 - DNA, 24 bp, Artificial sequence
  SiRNA target sequence
gatattgatcttggtattgattgt

SEQ ID NO: 175494 - DNA, 24 bp, Artificial sequence
  SiRNA target sequence
atattgatcttggtattgattgta

SEQ ID NO: 175495 - DNA, 24 bp, Artificial sequence
  SiRNA target sequence
tattgatcttggtattgattgtaa

SEQ ID NO: 175496 - DNA, 24 bp, Artificial sequence
  SiRNA target sequence
attgatcttggtattgattgtaaa

SEQ ID NO: 175497 - DNA, 24 bp, Artificial sequence
  SiRNA target sequence
ttgatcttggtattgattgtaaac

SEQ ID NO: 175498 - DNA, 24 bp, Artificial sequence
  SiRNA target sequence
tgatcttggtattgattgtaaaca

SEQ ID NO: 175499 - DNA, 24 bp, Artificial sequence
  SiRNA target sequence
gatcttggtattgattgtaaacag

SEQ ID NO: 175500 - DNA, 24 bp, Artificial sequence
  SiRNA target sequence
atcttggtattgattgtaaacagt

SEQ ID NO: 175501 - DNA, 24 bp, Artificial sequence
  SiRNA target sequence
tcttggtattgattgtaaacagtt

SEQ ID NO: 175502 - DNA, 24 bp, Artificial sequence
  SiRNA target sequence
cttggtattgattgtaaacagtta

SEQ ID NO: 175503 - DNA, 24 bp, Artificial sequence
  SiRNA target sequence
ttggtattgattgtaaacagttac

SEQ ID NO: 175504 - DNA, 24 bp, Artificial sequence
  SiRNA target sequence
tggtattgattgtaaacagttaca

SEQ ID NO: 175505 - DNA, 24 bp, Artificial sequence
  SiRNA target sequence
ggtattgattgtaaacagttacaa

SEQ ID NO: 175506 - DNA, 24 bp, Artificial sequence
  SiRNA target sequence
gtattgattgtaaacagttacaaa

SEQ ID NO: 175507 - DNA, 24 bp, Artificial sequence
  SiRNA target sequence
tattgattgtaaacagttacaaaa

SEQ ID NO: 175508 - DNA, 24 bp, Artificial sequence
  SiRNA target sequence
attgattgtaaacagttacaaaaa

SEQ ID NO: 175509 - DNA, 24 bp, Artificial sequence
  SiRNA target sequence
ttgattgtaaacagttacaaaaaa

SEQ ID NO: 175510 - DNA, 24 bp, Artificial sequence
  SiRNA target sequence
tgattgtaaacagttacaaaaaag

SEQ ID NO: 175511 - DNA, 24 bp, Artificial sequence
  SiRNA target sequence
gattgtaaacagttacaaaaaagg

SEQ ID NO: 175512 - DNA, 24 bp, Artificial sequence
  SiRNA target sequence
attgtaaacagttacaaaaaagga

SEQ ID NO: 175513 - DNA, 24 bp, Artificial sequence
  SiRNA target sequence
ttgtaaacagttacaaaaaaggac

SEQ ID NO: 175514 - DNA, 24 bp, Artificial sequence
  SiRNA target sequence
tgtaaacagttacaaaaaaggaca

SEQ ID NO: 175515 - DNA, 24 bp, Artificial sequence
  SiRNA target sequence
gtaaacagttacaaaaaaggacat

SEQ ID NO: 175516 - DNA, 24 bp, Artificial sequence
  SiRNA target sequence
taaacagttacaaaaaaggacata

SEQ ID NO: 175517 - DNA, 24 bp, Artificial sequence
  SiRNA target sequence
aaacagttacaaaaaaggacatat

SEQ ID NO: 175518 - DNA, 24 bp, Artificial sequence
  SiRNA target sequence
aacagttacaaaaaaggacatata

SEQ ID NO: 175519 - DNA, 24 bp, Artificial sequence
  SiRNA target sequence
acagttacaaaaaaggacatatag

SEQ ID NO: 175520 - DNA, 24 bp, Artificial sequence
  SiRNA target sequence
cagttacaaaaaaggacatataga

SEQ ID NO: 175521 - DNA, 24 bp, Artificial sequence
  SiRNA target sequence
agttacaaaaaaggacatatagaa

SEQ ID NO: 175522 - DNA, 24 bp, Artificial sequence
  SiRNA target sequence
gttacaaaaaaggacatatagaaa

SEQ ID NO: 175523 - DNA, 24 bp, Artificial sequence
  SiRNA target sequence
ttacaaaaaaggacatatagaaaa

SEQ ID NO: 175524 - DNA, 24 bp, Artificial sequence
  SiRNA target sequence
tacaaaaaaggacatatagaaaaa

SEQ ID NO: 175525 - DNA, 24 bp, Artificial sequence
  SiRNA target sequence
acaaaaaaggacatatagaaaaat

SEQ ID NO: 175526 - DNA, 24 bp, Artificial sequence
  SiRNA target sequence
caaaaaaggacatatagaaaaata

SEQ ID NO: 175527 - DNA, 24 bp, Artificial sequence
  SiRNA target sequence
aaaaaaggacatatagaaaaatag

SEQ ID NO: 175528 - DNA, 24 bp, Artificial sequence
  SiRNA target sequence
aaaaaggacatatagaaaaataga

SEQ ID NO: 175529 - DNA, 24 bp, Artificial sequence
  SiRNA target sequence
aaaaggacatatagaaaaatagaa

SEQ ID NO: 175530 - DNA, 24 bp, Artificial sequence
  SiRNA target sequence
aaaggacatatagaaaaatagaaa

SEQ ID NO: 175531 - DNA, 24 bp, Artificial sequence
  SiRNA target sequence
aaggacatatagaaaaatagaaac

SEQ ID NO: 175532 - DNA, 24 bp, Artificial sequence
  SiRNA target sequence
aggacatatagaaaaatagaaaca

SEQ ID NO: 175533 - DNA, 24 bp, Artificial sequence
  SiRNA target sequence
ggacatatagaaaaatagaaacaa

SEQ ID NO: 175534 - DNA, 24 bp, Artificial sequence
  SiRNA target sequence
gacatatagaaaaatagaaacaaa

SEQ ID NO: 175535 - DNA, 24 bp, Artificial sequence
  SiRNA target sequence
acatatagaaaaatagaaacaaag

SEQ ID NO: 175536 - DNA, 24 bp, Artificial sequence
  SiRNA target sequence
catatagaaaaatagaaacaaaga

SEQ ID NO: 175537 - DNA, 24 bp, Artificial sequence
  SiRNA target sequence
atatagaaaaatagaaacaaagaa

SEQ ID NO: 175538 - DNA, 24 bp, Artificial sequence
  SiRNA target sequence
tatagaaaaatagaaacaaagaaa

SEQ ID NO: 175539 - DNA, 24 bp, Artificial sequence
  SiRNA target sequence
atagaaaaatagaaacaaagaaag

SEQ ID NO: 175540 - DNA, 24 bp, Artificial sequence
  SiRNA target sequence
tagaaaaatagaaacaaagaaagt

SEQ ID NO: 175541 - DNA, 24 bp, Artificial sequence
  SiRNA target sequence
agaaaaatagaaacaaagaaagtt

SEQ ID NO: 175542 - DNA, 24 bp, Artificial sequence
  SiRNA target sequence
gaaaaatagaaacaaagaaagtta

SEQ ID NO: 175543 - DNA, 24 bp, Artificial sequence
  SiRNA target sequence
aaaaatagaaacaaagaaagttaa

SEQ ID NO: 175544 - DNA, 24 bp, Artificial sequence
  SiRNA target sequence
aaaatagaaacaaagaaagttaat

SEQ ID NO: 175545 - DNA, 24 bp, Artificial sequence
  SiRNA target sequence
aaatagaaacaaagaaagttaatt

SEQ ID NO: 175546 - DNA, 24 bp, Artificial sequence
  SiRNA target sequence
aatagaaacaaagaaagttaattt

SEQ ID NO: 175547 - DNA, 24 bp, Artificial sequence
  SiRNA target sequence
atagaaacaaagaaagttaatttt

SEQ ID NO: 175548 - DNA, 24 bp, Artificial sequence
  SiRNA target sequence
tagaaacaaagaaagttaatttta

SEQ ID NO: 175549 - DNA, 24 bp, Artificial sequence
  SiRNA target sequence
agaaacaaagaaagttaattttaa

SEQ ID NO: 175550 - DNA, 24 bp, Artificial sequence
  SiRNA target sequence
gaaacaaagaaagttaattttaaa

SEQ ID NO: 175551 - DNA, 24 bp, Artificial sequence
  SiRNA target sequence
aaacaaagaaagttaattttaaaa

SEQ ID NO: 175552 - DNA, 24 bp, Artificial sequence
  SiRNA target sequence
aacaaagaaagttaattttaaaat

SEQ ID NO: 175553 - DNA, 24 bp, Artificial sequence
  SiRNA target sequence
acaaagaaagttaattttaaaata

SEQ ID NO: 175554 - DNA, 24 bp, Artificial sequence
  SiRNA target sequence
caaagaaagttaattttaaaatag

SEQ ID NO: 175555 - DNA, 24 bp, Artificial sequence
  SiRNA target sequence
aaagaaagttaattttaaaataga

SEQ ID NO: 175556 - DNA, 24 bp, Artificial sequence
  SiRNA target sequence
aagaaagttaattttaaaatagaa

SEQ ID NO: 175557 - DNA, 24 bp, Artificial sequence
  SiRNA target sequence
agaaagttaattttaaaatagaat

SEQ ID NO: 175558 - DNA, 24 bp, Artificial sequence
  SiRNA target sequence
gaaagttaattttaaaatagaatg

SEQ ID NO: 175559 - DNA, 24 bp, Artificial sequence
  SiRNA target sequence
aaagttaattttaaaatagaatgg

SEQ ID NO: 175560 - DNA, 24 bp, Artificial sequence
  SiRNA target sequence
aagttaattttaaaatagaatggt

SEQ ID NO: 175561 - DNA, 24 bp, Artificial sequence
  SiRNA target sequence
agttaattttaaaatagaatggta

SEQ ID NO: 175562 - DNA, 24 bp, Artificial sequence
  SiRNA target sequence
gttaattttaaaatagaatggtaa

SEQ ID NO: 175563 - DNA, 25 bp, Artificial sequence
  SiRNA target sequence
atgaatactgaaaataaaccatgta

SEQ ID NO: 175564 - DNA, 25 bp, Artificial sequence
  SiRNA target sequence
tgaatactgaaaataaaccatgtat

SEQ ID NO: 175565 - DNA, 25 bp, Artificial sequence
  SiRNA target sequence
gaatactgaaaataaaccatgtatt

SEQ ID NO: 175566 - DNA, 25 bp, Artificial sequence
  SiRNA target sequence
aatactgaaaataaaccatgtattt

SEQ ID NO: 175567 - DNA, 25 bp, Artificial sequence
  SiRNA target sequence
atactgaaaataaaccatgtatttc

SEQ ID NO: 175568 - DNA, 25 bp, Artificial sequence
  SiRNA target sequence
tactgaaaataaaccatgtatttca

SEQ ID NO: 175569 - DNA, 25 bp, Artificial sequence
  SiRNA target sequence
actgaaaataaaccatgtatttcac

SEQ ID NO: 175570 - DNA, 25 bp, Artificial sequence
  SiRNA target sequence
ctgaaaataaaccatgtatttcacc

SEQ ID NO: 175571 - DNA, 25 bp, Artificial sequence
  SiRNA target sequence
tgaaaataaaccatgtatttcacca

SEQ ID NO: 175572 - DNA, 25 bp, Artificial sequence
  SiRNA target sequence
gaaaataaaccatgtatttcaccat

SEQ ID NO: 175573 - DNA, 25 bp, Artificial sequence
  SiRNA target sequence
aaaataaaccatgtatttcaccatt

SEQ ID NO: 175574 - DNA, 25 bp, Artificial sequence
  SiRNA target sequence
aaataaaccatgtatttcaccattt

SEQ ID NO: 175575 - DNA, 25 bp, Artificial sequence
  SiRNA target sequence
aataaaccatgtatttcaccattta

SEQ ID NO: 175576 - DNA, 25 bp, Artificial sequence
  SiRNA target sequence
ataaaccatgtatttcaccatttac

SEQ ID NO: 175577 - DNA, 25 bp, Artificial sequence
  SiRNA target sequence
taaaccatgtatttcaccatttacc

SEQ ID NO: 175578 - DNA, 25 bp, Artificial sequence
  SiRNA target sequence
aaaccatgtatttcaccatttacct

SEQ ID NO: 175579 - DNA, 25 bp, Artificial sequence
  SiRNA target sequence
aaccatgtatttcaccatttacctt

SEQ ID NO: 175580 - DNA, 25 bp, Artificial sequence
  SiRNA target sequence
accatgtatttcaccatttaccttt

SEQ ID NO: 175581 - DNA, 25 bp, Artificial sequence
  SiRNA target sequence
ccatgtatttcaccatttaccttta

SEQ ID NO: 175582 - DNA, 25 bp, Artificial sequence
  SiRNA target sequence
catgtatttcaccatttacctttaa

SEQ ID NO: 175583 - DNA, 25 bp, Artificial sequence
  SiRNA target sequence
atgtatttcaccatttacctttaaa

SEQ ID NO: 175584 - DNA, 25 bp, Artificial sequence
  SiRNA target sequence
tgtatttcaccatttacctttaaac

SEQ ID NO: 175585 - DNA, 25 bp, Artificial sequence
  SiRNA target sequence
gtatttcaccatttacctttaaact

SEQ ID NO: 175586 - DNA, 25 bp, Artificial sequence
  SiRNA target sequence
tatttcaccatttacctttaaacta

SEQ ID NO: 175587 - DNA, 25 bp, Artificial sequence
  SiRNA target sequence
atttcaccatttacctttaaactag

SEQ ID NO: 175588 - DNA, 25 bp, Artificial sequence
  SiRNA target sequence
tttcaccatttacctttaaactaga

SEQ ID NO: 175589 - DNA, 25 bp, Artificial sequence
  SiRNA target sequence
ttcaccatttacctttaaactagaa

SEQ ID NO: 175590 - DNA, 25 bp, Artificial sequence
  SiRNA target sequence
tcaccatttacctttaaactagaag

SEQ ID NO: 175591 - DNA, 25 bp, Artificial sequence
  SiRNA target sequence
caccatttacctttaaactagaaga

SEQ ID NO: 175592 - DNA, 25 bp, Artificial sequence
  SiRNA target sequence
accatttacctttaaactagaagat

SEQ ID NO: 175593 - DNA, 25 bp, Artificial sequence
  SiRNA target sequence
ccatttacctttaaactagaagatt

SEQ ID NO: 175594 - DNA, 25 bp, Artificial sequence
  SiRNA target sequence
catttacctttaaactagaagattg

SEQ ID NO: 175595 - DNA, 25 bp, Artificial sequence
  SiRNA target sequence
atttacctttaaactagaagattgc

SEQ ID NO: 175596 - DNA, 25 bp, Artificial sequence
  SiRNA target sequence
tttacctttaaactagaagattgcc

SEQ ID NO: 175597 - DNA, 25 bp, Artificial sequence
  SiRNA target sequence
ttacctttaaactagaagattgcct

SEQ ID NO: 175598 - DNA, 25 bp, Artificial sequence
  SiRNA target sequence
tacctttaaactagaagattgcctg

SEQ ID NO: 175599 - DNA, 25 bp, Artificial sequence
  SiRNA target sequence
acctttaaactagaagattgcctgg

SEQ ID NO: 175600 - DNA, 25 bp, Artificial sequence
  SiRNA target sequence
cctttaaactagaagattgcctggc

SEQ ID NO: 175601 - DNA, 25 bp, Artificial sequence
  SiRNA target sequence
ctttaaactagaagattgcctggca

SEQ ID NO: 175602 - DNA, 25 bp, Artificial sequence
  SiRNA target sequence
tttaaactagaagattgcctggcat

SEQ ID NO: 175603 - DNA, 25 bp, Artificial sequence
  SiRNA target sequence
ttaaactagaagattgcctggcatg

SEQ ID NO: 175604 - DNA, 25 bp, Artificial sequence
  SiRNA target sequence
taaactagaagattgcctggcatgt

SEQ ID NO: 175605 - DNA, 25 bp, Artificial sequence
  SiRNA target sequence
aaactagaagattgcctggcatgtt

SEQ ID NO: 175606 - DNA, 25 bp, Artificial sequence
  SiRNA target sequence
aactagaagattgcctggcatgttc

SEQ ID NO: 175607 - DNA, 25 bp, Artificial sequence
  SiRNA target sequence
actagaagattgcctggcatgttcg

SEQ ID NO: 175608 - DNA, 25 bp, Artificial sequence
  SiRNA target sequence
ctagaagattgcctggcatgttcgg

SEQ ID NO: 175609 - DNA, 25 bp, Artificial sequence
  SiRNA target sequence
tagaagattgcctggcatgttcggc

SEQ ID NO: 175610 - DNA, 25 bp, Artificial sequence
  SiRNA target sequence
agaagattgcctggcatgttcggct

SEQ ID NO: 175611 - DNA, 25 bp, Artificial sequence
  SiRNA target sequence
gaagattgcctggcatgttcggctt

SEQ ID NO: 175612 - DNA, 25 bp, Artificial sequence
  SiRNA target sequence
aagattgcctggcatgttcggcttg

SEQ ID NO: 175613 - DNA, 25 bp, Artificial sequence
  SiRNA target sequence
agattgcctggcatgttcggcttgt

SEQ ID NO: 175614 - DNA, 25 bp, Artificial sequence
  SiRNA target sequence
gattgcctggcatgttcggcttgta

SEQ ID NO: 175615 - DNA, 25 bp, Artificial sequence
  SiRNA target sequence
attgcctggcatgttcggcttgtat

SEQ ID NO: 175616 - DNA, 25 bp, Artificial sequence
  SiRNA target sequence
ttgcctggcatgttcggcttgtatt

SEQ ID NO: 175617 - DNA, 25 bp, Artificial sequence
  SiRNA target sequence
tgcctggcatgttcggcttgtattg

SEQ ID NO: 175618 - DNA, 25 bp, Artificial sequence
  SiRNA target sequence
gcctggcatgttcggcttgtattgc

SEQ ID NO: 175619 - DNA, 25 bp, Artificial sequence
  SiRNA target sequence
cctggcatgttcggcttgtattgct

SEQ ID NO: 175620 - DNA, 25 bp, Artificial sequence
  SiRNA target sequence
ctggcatgttcggcttgtattgctg

SEQ ID NO: 175621 - DNA, 25 bp, Artificial sequence
  SiRNA target sequence
tggcatgttcggcttgtattgctga

SEQ ID NO: 175622 - DNA, 25 bp, Artificial sequence
  SiRNA target sequence
ggcatgttcggcttgtattgctgat

SEQ ID NO: 175623 - DNA, 25 bp, Artificial sequence
  SiRNA target sequence
gcatgttcggcttgtattgctgatt

SEQ ID NO: 175624 - DNA, 25 bp, Artificial sequence
  SiRNA target sequence
catgttcggcttgtattgctgattt

SEQ ID NO: 175625 - DNA, 25 bp, Artificial sequence
  SiRNA target sequence
atgttcggcttgtattgctgatttt

SEQ ID NO: 175626 - DNA, 25 bp, Artificial sequence
  SiRNA target sequence
tgttcggcttgtattgctgattttt

SEQ ID NO: 175627 - DNA, 25 bp, Artificial sequence
  SiRNA target sequence
gttcggcttgtattgctgatttttc

SEQ ID NO: 175628 - DNA, 25 bp, Artificial sequence
  SiRNA target sequence
ttcggcttgtattgctgatttttct

SEQ ID NO: 175629 - DNA, 25 bp, Artificial sequence
  SiRNA target sequence
tcggcttgtattgctgatttttctg

SEQ ID NO: 175630 - DNA, 25 bp, Artificial sequence
  SiRNA target sequence
cggcttgtattgctgatttttctgt

SEQ ID NO: 175631 - DNA, 25 bp, Artificial sequence
  SiRNA target sequence
ggcttgtattgctgatttttctgtt

SEQ ID NO: 175632 - DNA, 25 bp, Artificial sequence
  SiRNA target sequence
gcttgtattgctgatttttctgttc

SEQ ID NO: 175633 - DNA, 25 bp, Artificial sequence
  SiRNA target sequence
cttgtattgctgatttttctgttcc

SEQ ID NO: 175634 - DNA, 25 bp, Artificial sequence
  SiRNA target sequence
ttgtattgctgatttttctgttcca

SEQ ID NO: 175635 - DNA, 25 bp, Artificial sequence
  SiRNA target sequence
tgtattgctgatttttctgttccaa

SEQ ID NO: 175636 - DNA, 25 bp, Artificial sequence
  SiRNA target sequence
gtattgctgatttttctgttccaaa

SEQ ID NO: 175637 - DNA, 25 bp, Artificial sequence
  SiRNA target sequence
tattgctgatttttctgttccaaaa

SEQ ID NO: 175638 - DNA, 25 bp, Artificial sequence
  SiRNA target sequence
attgctgatttttctgttccaaaaa

SEQ ID NO: 175639 - DNA, 25 bp, Artificial sequence
  SiRNA target sequence
ttgctgatttttctgttccaaaaat

SEQ ID NO: 175640 - DNA, 25 bp, Artificial sequence
  SiRNA target sequence
tgctgatttttctgttccaaaaatt

SEQ ID NO: 175641 - DNA, 25 bp, Artificial sequence
  SiRNA target sequence
gctgatttttctgttccaaaaattc

SEQ ID NO: 175642 - DNA, 25 bp, Artificial sequence
  SiRNA target sequence
ctgatttttctgttccaaaaattcc

SEQ ID NO: 175643 - DNA, 25 bp, Artificial sequence
  SiRNA target sequence
tgatttttctgttccaaaaattcct

SEQ ID NO: 175644 - DNA, 25 bp, Artificial sequence
  SiRNA target sequence
gatttttctgttccaaaaattccta

SEQ ID NO: 175645 - DNA, 25 bp, Artificial sequence
  SiRNA target sequence
atttttctgttccaaaaattcctac

SEQ ID NO: 175646 - DNA, 25 bp, Artificial sequence
  SiRNA target sequence
tttttctgttccaaaaattcctact

SEQ ID NO: 175647 - DNA, 25 bp, Artificial sequence
  SiRNA target sequence
ttttctgttccaaaaattcctactt

SEQ ID NO: 175648 - DNA, 25 bp, Artificial sequence
  SiRNA target sequence
tttctgttccaaaaattcctactta

SEQ ID NO: 175649 - DNA, 25 bp, Artificial sequence
  SiRNA target sequence
ttctgttccaaaaattcctacttac

SEQ ID NO: 175650 - DNA, 25 bp, Artificial sequence
  SiRNA target sequence
tctgttccaaaaattcctacttaca

SEQ ID NO: 175651 - DNA, 25 bp, Artificial sequence
  SiRNA target sequence
ctgttccaaaaattcctacttacac

SEQ ID NO: 175652 - DNA, 25 bp, Artificial sequence
  SiRNA target sequence
tgttccaaaaattcctacttacaca

SEQ ID NO: 175653 - DNA, 25 bp, Artificial sequence
  SiRNA target sequence
gttccaaaaattcctacttacacag

SEQ ID NO: 175654 - DNA, 25 bp, Artificial sequence
  SiRNA target sequence
ttccaaaaattcctacttacacaga

SEQ ID NO: 175655 - DNA, 25 bp, Artificial sequence
  SiRNA target sequence
tccaaaaattcctacttacacagaa

SEQ ID NO: 175656 - DNA, 25 bp, Artificial sequence
  SiRNA target sequence
ccaaaaattcctacttacacagaac

SEQ ID NO: 175657 - DNA, 25 bp, Artificial sequence
  SiRNA target sequence
caaaaattcctacttacacagaact

SEQ ID NO: 175658 - DNA, 25 bp, Artificial sequence
  SiRNA target sequence
aaaaattcctacttacacagaactg

SEQ ID NO: 175659 - DNA, 25 bp, Artificial sequence
  SiRNA target sequence
aaaattcctacttacacagaactga

SEQ ID NO: 175660 - DNA, 25 bp, Artificial sequence
  SiRNA target sequence
aaattcctacttacacagaactgaa

SEQ ID NO: 175661 - DNA, 25 bp, Artificial sequence
  SiRNA target sequence
aattcctacttacacagaactgaaa

SEQ ID NO: 175662 - DNA, 25 bp, Artificial sequence
  SiRNA target sequence
attcctacttacacagaactgaaag

SEQ ID NO: 175663 - DNA, 25 bp, Artificial sequence
  SiRNA target sequence
ttcctacttacacagaactgaaaga

SEQ ID NO: 175664 - DNA, 25 bp, Artificial sequence
  SiRNA target sequence
tcctacttacacagaactgaaagat

SEQ ID NO: 175665 - DNA, 25 bp, Artificial sequence
  SiRNA target sequence
cctacttacacagaactgaaagatg

SEQ ID NO: 175666 - DNA, 25 bp, Artificial sequence
  SiRNA target sequence
ctacttacacagaactgaaagatgt

SEQ ID NO: 175667 - DNA, 25 bp, Artificial sequence
  SiRNA target sequence
tacttacacagaactgaaagatgtc

SEQ ID NO: 175668 - DNA, 25 bp, Artificial sequence
  SiRNA target sequence
acttacacagaactgaaagatgtcc

SEQ ID NO: 175669 - DNA, 25 bp, Artificial sequence
  SiRNA target sequence
cttacacagaactgaaagatgtccc

SEQ ID NO: 175670 - DNA, 25 bp, Artificial sequence
  SiRNA target sequence
ttacacagaactgaaagatgtccct

SEQ ID NO: 175671 - DNA, 25 bp, Artificial sequence
  SiRNA target sequence
tacacagaactgaaagatgtccctt

SEQ ID NO: 175672 - DNA, 25 bp, Artificial sequence
  SiRNA target sequence
acacagaactgaaagatgtcccttt

SEQ ID NO: 175673 - DNA, 25 bp, Artificial sequence
  SiRNA target sequence
cacagaactgaaagatgtcccttta

SEQ ID NO: 175674 - DNA, 25 bp, Artificial sequence
  SiRNA target sequence
acagaactgaaagatgtccctttaa

SEQ ID NO: 175675 - DNA, 25 bp, Artificial sequence
  SiRNA target sequence
cagaactgaaagatgtccctttaac

SEQ ID NO: 175676 - DNA, 25 bp, Artificial sequence
  SiRNA target sequence
agaactgaaagatgtccctttaaca

SEQ ID NO: 175677 - DNA, 25 bp, Artificial sequence
  SiRNA target sequence
gaactgaaagatgtccctttaacat

SEQ ID NO: 175678 - DNA, 25 bp, Artificial sequence
  SiRNA target sequence
aactgaaagatgtccctttaacatt

SEQ ID NO: 175679 - DNA, 25 bp, Artificial sequence
  SiRNA target sequence
actgaaagatgtccctttaacattt

SEQ ID NO: 175680 - DNA, 25 bp, Artificial sequence
  SiRNA target sequence
ctgaaagatgtccctttaacatttt

SEQ ID NO: 175681 - DNA, 25 bp, Artificial sequence
  SiRNA target sequence
tgaaagatgtccctttaacattttt

SEQ ID NO: 175682 - DNA, 25 bp, Artificial sequence
  SiRNA target sequence
gaaagatgtccctttaacattttta

SEQ ID NO: 175683 - DNA, 25 bp, Artificial sequence
  SiRNA target sequence
aaagatgtccctttaacatttttat

SEQ ID NO: 175684 - DNA, 25 bp, Artificial sequence
  SiRNA target sequence
aagatgtccctttaacatttttatt

SEQ ID NO: 175685 - DNA, 25 bp, Artificial sequence
  SiRNA target sequence
agatgtccctttaacatttttatta

SEQ ID NO: 175686 - DNA, 25 bp, Artificial sequence
  SiRNA target sequence
gatgtccctttaacatttttattat

SEQ ID NO: 175687 - DNA, 25 bp, Artificial sequence
  SiRNA target sequence
atgtccctttaacatttttattatc

SEQ ID NO: 175688 - DNA, 25 bp, Artificial sequence
  SiRNA target sequence
tgtccctttaacatttttattatca

SEQ ID NO: 175689 - DNA, 25 bp, Artificial sequence
  SiRNA target sequence
gtccctttaacatttttattatcac

SEQ ID NO: 175690 - DNA, 25 bp, Artificial sequence
  SiRNA target sequence
tccctttaacatttttattatcacc

SEQ ID NO: 175691 - DNA, 25 bp, Artificial sequence
  SiRNA target sequence
ccctttaacatttttattatcacca

SEQ ID NO: 175692 - DNA, 25 bp, Artificial sequence
  SiRNA target sequence
cctttaacatttttattatcaccac

SEQ ID NO: 175693 - DNA, 25 bp, Artificial sequence
  SiRNA target sequence
ctttaacatttttattatcaccaca

SEQ ID NO: 175694 - DNA, 25 bp, Artificial sequence
  SiRNA target sequence
tttaacatttttattatcaccacat

SEQ ID NO: 175695 - DNA, 25 bp, Artificial sequence
  SiRNA target sequence
ttaacatttttattatcaccacatt

SEQ ID NO: 175696 - DNA, 25 bp, Artificial sequence
  SiRNA target sequence
taacatttttattatcaccacattc

SEQ ID NO: 175697 - DNA, 25 bp, Artificial sequence
  SiRNA target sequence
aacatttttattatcaccacattcg

SEQ ID NO: 175698 - DNA, 25 bp, Artificial sequence
  SiRNA target sequence
acatttttattatcaccacattcga

SEQ ID NO: 175699 - DNA, 25 bp, Artificial sequence
  SiRNA target sequence
catttttattatcaccacattcgaa

SEQ ID NO: 175700 - DNA, 25 bp, Artificial sequence
  SiRNA target sequence
atttttattatcaccacattcgaaa

SEQ ID NO: 175701 - DNA, 25 bp, Artificial sequence
  SiRNA target sequence
tttttattatcaccacattcgaaaa

SEQ ID NO: 175702 - DNA, 25 bp, Artificial sequence
  SiRNA target sequence
ttttattatcaccacattcgaaaat

SEQ ID NO: 175703 - DNA, 25 bp, Artificial sequence
  SiRNA target sequence
tttattatcaccacattcgaaaatg

SEQ ID NO: 175704 - DNA, 25 bp, Artificial sequence
  SiRNA target sequence
ttattatcaccacattcgaaaatga

SEQ ID NO: 175705 - DNA, 25 bp, Artificial sequence
  SiRNA target sequence
tattatcaccacattcgaaaatgaa

SEQ ID NO: 175706 - DNA, 25 bp, Artificial sequence
  SiRNA target sequence
attatcaccacattcgaaaatgaat

SEQ ID NO: 175707 - DNA, 25 bp, Artificial sequence
  SiRNA target sequence
ttatcaccacattcgaaaatgaata

SEQ ID NO: 175708 - DNA, 25 bp, Artificial sequence
  SiRNA target sequence
tatcaccacattcgaaaatgaatat

SEQ ID NO: 175709 - DNA, 25 bp, Artificial sequence
  SiRNA target sequence
atcaccacattcgaaaatgaatatg

SEQ ID NO: 175710 - DNA, 25 bp, Artificial sequence
  SiRNA target sequence
tcaccacattcgaaaatgaatatgt

SEQ ID NO: 175711 - DNA, 25 bp, Artificial sequence
  SiRNA target sequence
caccacattcgaaaatgaatatgta

SEQ ID NO: 175712 - DNA, 25 bp, Artificial sequence
  SiRNA target sequence
accacattcgaaaatgaatatgtat

SEQ ID NO: 175713 - DNA, 25 bp, Artificial sequence
  SiRNA target sequence
ccacattcgaaaatgaatatgtatg

SEQ ID NO: 175714 - DNA, 25 bp, Artificial sequence
  SiRNA target sequence
cacattcgaaaatgaatatgtatgc

SEQ ID NO: 175715 - DNA, 25 bp, Artificial sequence
  SiRNA target sequence
acattcgaaaatgaatatgtatgca

SEQ ID NO: 175716 - DNA, 25 bp, Artificial sequence
  SiRNA target sequence
cattcgaaaatgaatatgtatgcac

SEQ ID NO: 175717 - DNA, 25 bp, Artificial sequence
  SiRNA target sequence
attcgaaaatgaatatgtatgcaca

SEQ ID NO: 175718 - DNA, 25 bp, Artificial sequence
  SiRNA target sequence
ttcgaaaatgaatatgtatgcacac

SEQ ID NO: 175719 - DNA, 25 bp, Artificial sequence
  SiRNA target sequence
tcgaaaatgaatatgtatgcacact

SEQ ID NO: 175720 - DNA, 25 bp, Artificial sequence
  SiRNA target sequence
cgaaaatgaatatgtatgcacacta

SEQ ID NO: 175721 - DNA, 25 bp, Artificial sequence
  SiRNA target sequence
gaaaatgaatatgtatgcacactat

SEQ ID NO: 175722 - DNA, 25 bp, Artificial sequence
  SiRNA target sequence
aaaatgaatatgtatgcacactata

SEQ ID NO: 175723 - DNA, 25 bp, Artificial sequence
  SiRNA target sequence
aaatgaatatgtatgcacactataa

SEQ ID NO: 175724 - DNA, 25 bp, Artificial sequence
  SiRNA target sequence
aatgaatatgtatgcacactataac

SEQ ID NO: 175725 - DNA, 25 bp, Artificial sequence
  SiRNA target sequence
atgaatatgtatgcacactataaca

SEQ ID NO: 175726 - DNA, 25 bp, Artificial sequence
  SiRNA target sequence
tgaatatgtatgcacactataacaa

SEQ ID NO: 175727 - DNA, 25 bp, Artificial sequence
  SiRNA target sequence
gaatatgtatgcacactataacaat

SEQ ID NO: 175728 - DNA, 25 bp, Artificial sequence
  SiRNA target sequence
aatatgtatgcacactataacaatc

SEQ ID NO: 175729 - DNA, 25 bp, Artificial sequence
  SiRNA target sequence
atatgtatgcacactataacaatca

SEQ ID NO: 175730 - DNA, 25 bp, Artificial sequence
  SiRNA target sequence
tatgtatgcacactataacaatcat

SEQ ID NO: 175731 - DNA, 25 bp, Artificial sequence
  SiRNA target sequence
atgtatgcacactataacaatcata

SEQ ID NO: 175732 - DNA, 25 bp, Artificial sequence
  SiRNA target sequence
tgtatgcacactataacaatcatat

SEQ ID NO: 175733 - DNA, 25 bp, Artificial sequence
  SiRNA target sequence
gtatgcacactataacaatcatata

SEQ ID NO: 175734 - DNA, 25 bp, Artificial sequence
  SiRNA target sequence
tatgcacactataacaatcatataa

SEQ ID NO: 175735 - DNA, 25 bp, Artificial sequence
  SiRNA target sequence
atgcacactataacaatcatataat

SEQ ID NO: 175736 - DNA, 25 bp, Artificial sequence
  SiRNA target sequence
tgcacactataacaatcatataatg

SEQ ID NO: 175737 - DNA, 25 bp, Artificial sequence
  SiRNA target sequence
gcacactataacaatcatataatgt

SEQ ID NO: 175738 - DNA, 25 bp, Artificial sequence
  SiRNA target sequence
cacactataacaatcatataatgtc

SEQ ID NO: 175739 - DNA, 25 bp, Artificial sequence
  SiRNA target sequence
acactataacaatcatataatgtcc

SEQ ID NO: 175740 - DNA, 25 bp, Artificial sequence
  SiRNA target sequence
cactataacaatcatataatgtcct

SEQ ID NO: 175741 - DNA, 25 bp, Artificial sequence
  SiRNA target sequence
actataacaatcatataatgtcctt

SEQ ID NO: 175742 - DNA, 25 bp, Artificial sequence
  SiRNA target sequence
ctataacaatcatataatgtccttt

SEQ ID NO: 175743 - DNA, 25 bp, Artificial sequence
  SiRNA target sequence
tataacaatcatataatgtccttta

SEQ ID NO: 175744 - DNA, 25 bp, Artificial sequence
  SiRNA target sequence
ataacaatcatataatgtcctttag

SEQ ID NO: 175745 - DNA, 25 bp, Artificial sequence
  SiRNA target sequence
taacaatcatataatgtcctttagt

SEQ ID NO: 175746 - DNA, 25 bp, Artificial sequence
  SiRNA target sequence
aacaatcatataatgtcctttagtg

SEQ ID NO: 175747 - DNA, 25 bp, Artificial sequence
  SiRNA target sequence
acaatcatataatgtcctttagtga

SEQ ID NO: 175748 - DNA, 25 bp, Artificial sequence
  SiRNA target sequence
caatcatataatgtcctttagtgat

SEQ ID NO: 175749 - DNA, 25 bp, Artificial sequence
  SiRNA target sequence
aatcatataatgtcctttagtgatt

SEQ ID NO: 175750 - DNA, 25 bp, Artificial sequence
  SiRNA target sequence
atcatataatgtcctttagtgattt

SEQ ID NO: 175751 - DNA, 25 bp, Artificial sequence
  SiRNA target sequence
tcatataatgtcctttagtgatttt

SEQ ID NO: 175752 - DNA, 25 bp, Artificial sequence
  SiRNA target sequence
catataatgtcctttagtgattttg

SEQ ID NO: 175753 - DNA, 25 bp, Artificial sequence
  SiRNA target sequence
atataatgtcctttagtgattttga

SEQ ID NO: 175754 - DNA, 25 bp, Artificial sequence
  SiRNA target sequence
tataatgtcctttagtgattttgaa

SEQ ID NO: 175755 - DNA, 25 bp, Artificial sequence
  SiRNA target sequence
ataatgtcctttagtgattttgaat

SEQ ID NO: 175756 - DNA, 25 bp, Artificial sequence
  SiRNA target sequence
taatgtcctttagtgattttgaata

SEQ ID NO: 175757 - DNA, 25 bp, Artificial sequence
  SiRNA target sequence
aatgtcctttagtgattttgaatat

SEQ ID NO: 175758 - DNA, 25 bp, Artificial sequence
  SiRNA target sequence
atgtcctttagtgattttgaatatc

SEQ ID NO: 175759 - DNA, 25 bp, Artificial sequence
  SiRNA target sequence
tgtcctttagtgattttgaatatca

SEQ ID NO: 175760 - DNA, 25 bp, Artificial sequence
  SiRNA target sequence
gtcctttagtgattttgaatatcac

SEQ ID NO: 175761 - DNA, 25 bp, Artificial sequence
  SiRNA target sequence
tcctttagtgattttgaatatcact

SEQ ID NO: 175762 - DNA, 25 bp, Artificial sequence
  SiRNA target sequence
cctttagtgattttgaatatcactt

SEQ ID NO: 175763 - DNA, 25 bp, Artificial sequence
  SiRNA target sequence
ctttagtgattttgaatatcactta

SEQ ID NO: 175764 - DNA, 25 bp, Artificial sequence
  SiRNA target sequence
tttagtgattttgaatatcacttaa

SEQ ID NO: 175765 - DNA, 25 bp, Artificial sequence
  SiRNA target sequence
ttagtgattttgaatatcacttaat

SEQ ID NO: 175766 - DNA, 25 bp, Artificial sequence
  SiRNA target sequence
tagtgattttgaatatcacttaatt

SEQ ID NO: 175767 - DNA, 25 bp, Artificial sequence
  SiRNA target sequence
agtgattttgaatatcacttaattt

SEQ ID NO: 175768 - DNA, 25 bp, Artificial sequence
  SiRNA target sequence
gtgattttgaatatcacttaatttc

SEQ ID NO: 175769 - DNA, 25 bp, Artificial sequence
  SiRNA target sequence
tgattttgaatatcacttaatttca

SEQ ID NO: 175770 - DNA, 25 bp, Artificial sequence
  SiRNA target sequence
gattttgaatatcacttaatttcat

SEQ ID NO: 175771 - DNA, 25 bp, Artificial sequence
  SiRNA target sequence
attttgaatatcacttaatttcatt

SEQ ID NO: 175772 - DNA, 25 bp, Artificial sequence
  SiRNA target sequence
ttttgaatatcacttaatttcattt

SEQ ID NO: 175773 - DNA, 25 bp, Artificial sequence
  SiRNA target sequence
tttgaatatcacttaatttcattta

SEQ ID NO: 175774 - DNA, 25 bp, Artificial sequence
  SiRNA target sequence
ttgaatatcacttaatttcatttat

SEQ ID NO: 175775 - DNA, 25 bp, Artificial sequence
  SiRNA target sequence
tgaatatcacttaatttcatttata

SEQ ID NO: 175776 - DNA, 25 bp, Artificial sequence
  SiRNA target sequence
gaatatcacttaatttcatttataa

SEQ ID NO: 175777 - DNA, 25 bp, Artificial sequence
  SiRNA target sequence
aatatcacttaatttcatttataaa

SEQ ID NO: 175778 - DNA, 25 bp, Artificial sequence
  SiRNA target sequence
atatcacttaatttcatttataaaa

SEQ ID NO: 175779 - DNA, 25 bp, Artificial sequence
  SiRNA target sequence
tatcacttaatttcatttataaaac

SEQ ID NO: 175780 - DNA, 25 bp, Artificial sequence
  SiRNA target sequence
atcacttaatttcatttataaaact

SEQ ID NO: 175781 - DNA, 25 bp, Artificial sequence
  SiRNA target sequence
tcacttaatttcatttataaaacta

SEQ ID NO: 175782 - DNA, 25 bp, Artificial sequence
  SiRNA target sequence
cacttaatttcatttataaaactaa

SEQ ID NO: 175783 - DNA, 25 bp, Artificial sequence
  SiRNA target sequence
acttaatttcatttataaaactaaa

SEQ ID NO: 175784 - DNA, 25 bp, Artificial sequence
  SiRNA target sequence
cttaatttcatttataaaactaaaa

SEQ ID NO: 175785 - DNA, 25 bp, Artificial sequence
  SiRNA target sequence
ttaatttcatttataaaactaaaat

SEQ ID NO: 175786 - DNA, 25 bp, Artificial sequence
  SiRNA target sequence
taatttcatttataaaactaaaatt

SEQ ID NO: 175787 - DNA, 25 bp, Artificial sequence
  SiRNA target sequence
aatttcatttataaaactaaaattt

SEQ ID NO: 175788 - DNA, 25 bp, Artificial sequence
  SiRNA target sequence
atttcatttataaaactaaaattta

SEQ ID NO: 175789 - DNA, 25 bp, Artificial sequence
  SiRNA target sequence
tttcatttataaaactaaaatttaa

SEQ ID NO: 175790 - DNA, 25 bp, Artificial sequence
  SiRNA target sequence
ttcatttataaaactaaaatttaat

SEQ ID NO: 175791 - DNA, 25 bp, Artificial sequence
  SiRNA target sequence
tcatttataaaactaaaatttaatg

SEQ ID NO: 175792 - DNA, 25 bp, Artificial sequence
  SiRNA target sequence
catttataaaactaaaatttaatgt

SEQ ID NO: 175793 - DNA, 25 bp, Artificial sequence
  SiRNA target sequence
atttataaaactaaaatttaatgta

SEQ ID NO: 175794 - DNA, 25 bp, Artificial sequence
  SiRNA target sequence
tttataaaactaaaatttaatgtaa

SEQ ID NO: 175795 - DNA, 25 bp, Artificial sequence
  SiRNA target sequence
ttataaaactaaaatttaatgtaat

SEQ ID NO: 175796 - DNA, 25 bp, Artificial sequence
  SiRNA target sequence
tataaaactaaaatttaatgtaata

SEQ ID NO: 175797 - DNA, 25 bp, Artificial sequence
  SiRNA target sequence
ataaaactaaaatttaatgtaataa

SEQ ID NO: 175798 - DNA, 25 bp, Artificial sequence
  SiRNA target sequence
taaaactaaaatttaatgtaataaa

SEQ ID NO: 175799 - DNA, 25 bp, Artificial sequence
  SiRNA target sequence
aaaactaaaatttaatgtaataaaa

SEQ ID NO: 175800 - DNA, 25 bp, Artificial sequence
  SiRNA target sequence
aaactaaaatttaatgtaataaaag

SEQ ID NO: 175801 - DNA, 25 bp, Artificial sequence
  SiRNA target sequence
aactaaaatttaatgtaataaaagt

SEQ ID NO: 175802 - DNA, 25 bp, Artificial sequence
  SiRNA target sequence
actaaaatttaatgtaataaaagta

SEQ ID NO: 175803 - DNA, 25 bp, Artificial sequence
  SiRNA target sequence
ctaaaatttaatgtaataaaagtat

SEQ ID NO: 175804 - DNA, 25 bp, Artificial sequence
  SiRNA target sequence
taaaatttaatgtaataaaagtata

SEQ ID NO: 175805 - DNA, 25 bp, Artificial sequence
  SiRNA target sequence
aaaatttaatgtaataaaagtatat

SEQ ID NO: 175806 - DNA, 25 bp, Artificial sequence
  SiRNA target sequence
aaatttaatgtaataaaagtatatg

SEQ ID NO: 175807 - DNA, 25 bp, Artificial sequence
  SiRNA target sequence
aatttaatgtaataaaagtatatga

SEQ ID NO: 175808 - DNA, 25 bp, Artificial sequence
  SiRNA target sequence
atttaatgtaataaaagtatatgat

SEQ ID NO: 175809 - DNA, 25 bp, Artificial sequence
  SiRNA target sequence
tttaatgtaataaaagtatatgata

SEQ ID NO: 175810 - DNA, 25 bp, Artificial sequence
  SiRNA target sequence
ttaatgtaataaaagtatatgatac

SEQ ID NO: 175811 - DNA, 25 bp, Artificial sequence
  SiRNA target sequence
taatgtaataaaagtatatgataca

SEQ ID NO: 175812 - DNA, 25 bp, Artificial sequence
  SiRNA target sequence
aatgtaataaaagtatatgatacat

SEQ ID NO: 175813 - DNA, 25 bp, Artificial sequence
  SiRNA target sequence
atgtaataaaagtatatgatacatc

SEQ ID NO: 175814 - DNA, 25 bp, Artificial sequence
  SiRNA target sequence
tgtaataaaagtatatgatacatct

SEQ ID NO: 175815 - DNA, 25 bp, Artificial sequence
  SiRNA target sequence
gtaataaaagtatatgatacatctt

SEQ ID NO: 175816 - DNA, 25 bp, Artificial sequence
  SiRNA target sequence
taataaaagtatatgatacatctta

SEQ ID NO: 175817 - DNA, 25 bp, Artificial sequence
  SiRNA target sequence
aataaaagtatatgatacatcttat

SEQ ID NO: 175818 - DNA, 25 bp, Artificial sequence
  SiRNA target sequence
ataaaagtatatgatacatcttatg

SEQ ID NO: 175819 - DNA, 25 bp, Artificial sequence
  SiRNA target sequence
taaaagtatatgatacatcttatgt

SEQ ID NO: 175820 - DNA, 25 bp, Artificial sequence
  SiRNA target sequence
aaaagtatatgatacatcttatgtc

SEQ ID NO: 175821 - DNA, 25 bp, Artificial sequence
  SiRNA target sequence
aaagtatatgatacatcttatgtca

SEQ ID NO: 175822 - DNA, 25 bp, Artificial sequence
  SiRNA target sequence
aagtatatgatacatcttatgtcaa

SEQ ID NO: 175823 - DNA, 25 bp, Artificial sequence
  SiRNA target sequence
agtatatgatacatcttatgtcaaa

SEQ ID NO: 175824 - DNA, 25 bp, Artificial sequence
  SiRNA target sequence
gtatatgatacatcttatgtcaaaa

SEQ ID NO: 175825 - DNA, 25 bp, Artificial sequence
  SiRNA target sequence
tatatgatacatcttatgtcaaaaa

SEQ ID NO: 175826 - DNA, 25 bp, Artificial sequence
  SiRNA target sequence
atatgatacatcttatgtcaaaaat

SEQ ID NO: 175827 - DNA, 25 bp, Artificial sequence
  SiRNA target sequence
tatgatacatcttatgtcaaaaata

SEQ ID NO: 175828 - DNA, 25 bp, Artificial sequence
  SiRNA target sequence
atgatacatcttatgtcaaaaatat

SEQ ID NO: 175829 - DNA, 25 bp, Artificial sequence
  SiRNA target sequence
tgatacatcttatgtcaaaaatatt

SEQ ID NO: 175830 - DNA, 25 bp, Artificial sequence
  SiRNA target sequence
gatacatcttatgtcaaaaatattc

SEQ ID NO: 175831 - DNA, 25 bp, Artificial sequence
  SiRNA target sequence
atacatcttatgtcaaaaatattct

SEQ ID NO: 175832 - DNA, 25 bp, Artificial sequence
  SiRNA target sequence
tacatcttatgtcaaaaatattctg

SEQ ID NO: 175833 - DNA, 25 bp, Artificial sequence
  SiRNA target sequence
acatcttatgtcaaaaatattctgt

SEQ ID NO: 175834 - DNA, 25 bp, Artificial sequence
  SiRNA target sequence
catcttatgtcaaaaatattctgta

SEQ ID NO: 175835 - DNA, 25 bp, Artificial sequence
  SiRNA target sequence
atcttatgtcaaaaatattctgtat

SEQ ID NO: 175836 - DNA, 25 bp, Artificial sequence
  SiRNA target sequence
tcttatgtcaaaaatattctgtatg

SEQ ID NO: 175837 - DNA, 25 bp, Artificial sequence
  SiRNA target sequence
cttatgtcaaaaatattctgtatga

SEQ ID NO: 175838 - DNA, 25 bp, Artificial sequence
  SiRNA target sequence
ttatgtcaaaaatattctgtatgat

SEQ ID NO: 175839 - DNA, 25 bp, Artificial sequence
  SiRNA target sequence
tatgtcaaaaatattctgtatgata

SEQ ID NO: 175840 - DNA, 25 bp, Artificial sequence
  SiRNA target sequence
atgtcaaaaatattctgtatgatag

SEQ ID NO: 175841 - DNA, 25 bp, Artificial sequence
  SiRNA target sequence
tgtcaaaaatattctgtatgatagt

SEQ ID NO: 175842 - DNA, 25 bp, Artificial sequence
  SiRNA target sequence
gtcaaaaatattctgtatgatagtg

SEQ ID NO: 175843 - DNA, 25 bp, Artificial sequence
  SiRNA target sequence
tcaaaaatattctgtatgatagtgt

SEQ ID NO: 175844 - DNA, 25 bp, Artificial sequence
  SiRNA target sequence
caaaaatattctgtatgatagtgtt

SEQ ID NO: 175845 - DNA, 25 bp, Artificial sequence
  SiRNA target sequence
aaaaatattctgtatgatagtgttt

SEQ ID NO: 175846 - DNA, 25 bp, Artificial sequence
  SiRNA target sequence
aaaatattctgtatgatagtgttta

SEQ ID NO: 175847 - DNA, 25 bp, Artificial sequence
  SiRNA target sequence
aaatattctgtatgatagtgtttat

SEQ ID NO: 175848 - DNA, 25 bp, Artificial sequence
  SiRNA target sequence
aatattctgtatgatagtgtttatg

SEQ ID NO: 175849 - DNA, 25 bp, Artificial sequence
  SiRNA target sequence
atattctgtatgatagtgtttatga

SEQ ID NO: 175850 - DNA, 25 bp, Artificial sequence
  SiRNA target sequence
tattctgtatgatagtgtttatgag

SEQ ID NO: 175851 - DNA, 25 bp, Artificial sequence
  SiRNA target sequence
attctgtatgatagtgtttatgagg

SEQ ID NO: 175852 - DNA, 25 bp, Artificial sequence
  SiRNA target sequence
ttctgtatgatagtgtttatgagga

SEQ ID NO: 175853 - DNA, 25 bp, Artificial sequence
  SiRNA target sequence
tctgtatgatagtgtttatgaggaa

SEQ ID NO: 175854 - DNA, 25 bp, Artificial sequence
  SiRNA target sequence
ctgtatgatagtgtttatgaggaaa

SEQ ID NO: 175855 - DNA, 25 bp, Artificial sequence
  SiRNA target sequence
tgtatgatagtgtttatgaggaaag

SEQ ID NO: 175856 - DNA, 25 bp, Artificial sequence
  SiRNA target sequence
gtatgatagtgtttatgaggaaagc

SEQ ID NO: 175857 - DNA, 25 bp, Artificial sequence
  SiRNA target sequence
tatgatagtgtttatgaggaaagca

SEQ ID NO: 175858 - DNA, 25 bp, Artificial sequence
  SiRNA target sequence
atgatagtgtttatgaggaaagcac

SEQ ID NO: 175859 - DNA, 25 bp, Artificial sequence
  SiRNA target sequence
tgatagtgtttatgaggaaagcacg

SEQ ID NO: 175860 - DNA, 25 bp, Artificial sequence
  SiRNA target sequence
gatagtgtttatgaggaaagcacga

SEQ ID NO: 175861 - DNA, 25 bp, Artificial sequence
  SiRNA target sequence
atagtgtttatgaggaaagcacgag

SEQ ID NO: 175862 - DNA, 25 bp, Artificial sequence
  SiRNA target sequence
tagtgtttatgaggaaagcacgaga

SEQ ID NO: 175863 - DNA, 25 bp, Artificial sequence
  SiRNA target sequence
agtgtttatgaggaaagcacgagag

SEQ ID NO: 175864 - DNA, 25 bp, Artificial sequence
  SiRNA target sequence
gtgtttatgaggaaagcacgagaga

SEQ ID NO: 175865 - DNA, 25 bp, Artificial sequence
  SiRNA target sequence
tgtttatgaggaaagcacgagagac

SEQ ID NO: 175866 - DNA, 25 bp, Artificial sequence
  SiRNA target sequence
gtttatgaggaaagcacgagagaca

SEQ ID NO: 175867 - DNA, 25 bp, Artificial sequence
  SiRNA target sequence
tttatgaggaaagcacgagagacaa

SEQ ID NO: 175868 - DNA, 25 bp, Artificial sequence
  SiRNA target sequence
ttatgaggaaagcacgagagacaaa

SEQ ID NO: 175869 - DNA, 25 bp, Artificial sequence
  SiRNA target sequence
tatgaggaaagcacgagagacaaaa

SEQ ID NO: 175870 - DNA, 25 bp, Artificial sequence
  SiRNA target sequence
atgaggaaagcacgagagacaaaat

SEQ ID NO: 175871 - DNA, 25 bp, Artificial sequence
  SiRNA target sequence
tgaggaaagcacgagagacaaaata

SEQ ID NO: 175872 - DNA, 25 bp, Artificial sequence
  SiRNA target sequence
gaggaaagcacgagagacaaaataa

SEQ ID NO: 175873 - DNA, 25 bp, Artificial sequence
  SiRNA target sequence
aggaaagcacgagagacaaaataat

SEQ ID NO: 175874 - DNA, 25 bp, Artificial sequence
  SiRNA target sequence
ggaaagcacgagagacaaaataata

SEQ ID NO: 175875 - DNA, 25 bp, Artificial sequence
  SiRNA target sequence
gaaagcacgagagacaaaataataa

SEQ ID NO: 175876 - DNA, 25 bp, Artificial sequence
  SiRNA target sequence
aaagcacgagagacaaaataataat

SEQ ID NO: 175877 - DNA, 25 bp, Artificial sequence
  SiRNA target sequence
aagcacgagagacaaaataataata

SEQ ID NO: 175878 - DNA, 25 bp, Artificial sequence
  SiRNA target sequence
agcacgagagacaaaataataataa

SEQ ID NO: 175879 - DNA, 25 bp, Artificial sequence
  SiRNA target sequence
gcacgagagacaaaataataataag

SEQ ID NO: 175880 - DNA, 25 bp, Artificial sequence
  SiRNA target sequence
cacgagagacaaaataataataagt

SEQ ID NO: 175881 - DNA, 25 bp, Artificial sequence
  SiRNA target sequence
acgagagacaaaataataataagtg

SEQ ID NO: 175882 - DNA, 25 bp, Artificial sequence
  SiRNA target sequence
cgagagacaaaataataataagtga

SEQ ID NO: 175883 - DNA, 25 bp, Artificial sequence
  SiRNA target sequence
gagagacaaaataataataagtgac

SEQ ID NO: 175884 - DNA, 25 bp, Artificial sequence
  SiRNA target sequence
agagacaaaataataataagtgact

SEQ ID NO: 175885 - DNA, 25 bp, Artificial sequence
  SiRNA target sequence
gagacaaaataataataagtgactg

SEQ ID NO: 175886 - DNA, 25 bp, Artificial sequence
  SiRNA target sequence
agacaaaataataataagtgactgt

SEQ ID NO: 175887 - DNA, 25 bp, Artificial sequence
  SiRNA target sequence
gacaaaataataataagtgactgtc

SEQ ID NO: 175888 - DNA, 25 bp, Artificial sequence
  SiRNA target sequence
acaaaataataataagtgactgtcc

SEQ ID NO: 175889 - DNA, 25 bp, Artificial sequence
  SiRNA target sequence
caaaataataataagtgactgtcct

SEQ ID NO: 175890 - DNA, 25 bp, Artificial sequence
  SiRNA target sequence
aaaataataataagtgactgtcctg

SEQ ID NO: 175891 - DNA, 25 bp, Artificial sequence
  SiRNA target sequence
aaataataataagtgactgtcctgg

SEQ ID NO: 175892 - DNA, 25 bp, Artificial sequence
  SiRNA target sequence
aataataataagtgactgtcctggg

SEQ ID NO: 175893 - DNA, 25 bp, Artificial sequence
  SiRNA target sequence
ataataataagtgactgtcctggga

SEQ ID NO: 175894 - DNA, 25 bp, Artificial sequence
  SiRNA target sequence
taataataagtgactgtcctgggac

SEQ ID NO: 175895 - DNA, 25 bp, Artificial sequence
  SiRNA target sequence
aataataagtgactgtcctgggact

SEQ ID NO: 175896 - DNA, 25 bp, Artificial sequence
  SiRNA target sequence
ataataagtgactgtcctgggactg

SEQ ID NO: 175897 - DNA, 25 bp, Artificial sequence
  SiRNA target sequence
taataagtgactgtcctgggactgt

SEQ ID NO: 175898 - DNA, 25 bp, Artificial sequence
  SiRNA target sequence
aataagtgactgtcctgggactgtt

SEQ ID NO: 175899 - DNA, 25 bp, Artificial sequence
  SiRNA target sequence
ataagtgactgtcctgggactgttt

SEQ ID NO: 175900 - DNA, 25 bp, Artificial sequence
  SiRNA target sequence
taagtgactgtcctgggactgtttc

SEQ ID NO: 175901 - DNA, 25 bp, Artificial sequence
  SiRNA target sequence
aagtgactgtcctgggactgtttca

SEQ ID NO: 175902 - DNA, 25 bp, Artificial sequence
  SiRNA target sequence
agtgactgtcctgggactgtttcat

SEQ ID NO: 175903 - DNA, 25 bp, Artificial sequence
  SiRNA target sequence
gtgactgtcctgggactgtttcata

SEQ ID NO: 175904 - DNA, 25 bp, Artificial sequence
  SiRNA target sequence
tgactgtcctgggactgtttcatat

SEQ ID NO: 175905 - DNA, 25 bp, Artificial sequence
  SiRNA target sequence
gactgtcctgggactgtttcatata

SEQ ID NO: 175906 - DNA, 25 bp, Artificial sequence
  SiRNA target sequence
actgtcctgggactgtttcatatat

SEQ ID NO: 175907 - DNA, 25 bp, Artificial sequence
  SiRNA target sequence
ctgtcctgggactgtttcatatatt

SEQ ID NO: 175908 - DNA, 25 bp, Artificial sequence
  SiRNA target sequence
tgtcctgggactgtttcatatattg

SEQ ID NO: 175909 - DNA, 25 bp, Artificial sequence
  SiRNA target sequence
gtcctgggactgtttcatatattga

SEQ ID NO: 175910 - DNA, 25 bp, Artificial sequence
  SiRNA target sequence
tcctgggactgtttcatatattgaa

SEQ ID NO: 175911 - DNA, 25 bp, Artificial sequence
  SiRNA target sequence
cctgggactgtttcatatattgaaa

SEQ ID NO: 175912 - DNA, 25 bp, Artificial sequence
  SiRNA target sequence
ctgggactgtttcatatattgaaag

SEQ ID NO: 175913 - DNA, 25 bp, Artificial sequence
  SiRNA target sequence
tgggactgtttcatatattgaaagg

SEQ ID NO: 175914 - DNA, 25 bp, Artificial sequence
  SiRNA target sequence
gggactgtttcatatattgaaaggc

SEQ ID NO: 175915 - DNA, 25 bp, Artificial sequence
  SiRNA target sequence
ggactgtttcatatattgaaaggca

SEQ ID NO: 175916 - DNA, 25 bp, Artificial sequence
  SiRNA target sequence
gactgtttcatatattgaaaggcaa

SEQ ID NO: 175917 - DNA, 25 bp, Artificial sequence
  SiRNA target sequence
actgtttcatatattgaaaggcaag

SEQ ID NO: 175918 - DNA, 25 bp, Artificial sequence
  SiRNA target sequence
ctgtttcatatattgaaaggcaagc

SEQ ID NO: 175919 - DNA, 25 bp, Artificial sequence
  SiRNA target sequence
tgtttcatatattgaaaggcaagca

SEQ ID NO: 175920 - DNA, 25 bp, Artificial sequence
  SiRNA target sequence
gtttcatatattgaaaggcaagcac

SEQ ID NO: 175921 - DNA, 25 bp, Artificial sequence
  SiRNA target sequence
tttcatatattgaaaggcaagcaca

SEQ ID NO: 175922 - DNA, 25 bp, Artificial sequence
  SiRNA target sequence
ttcatatattgaaaggcaagcacac

SEQ ID NO: 175923 - DNA, 25 bp, Artificial sequence
  SiRNA target sequence
tcatatattgaaaggcaagcacacc

SEQ ID NO: 175924 - DNA, 25 bp, Artificial sequence
  SiRNA target sequence
catatattgaaaggcaagcacacca

SEQ ID NO: 175925 - DNA, 25 bp, Artificial sequence
  SiRNA target sequence
atatattgaaaggcaagcacaccat

SEQ ID NO: 175926 - DNA, 25 bp, Artificial sequence
  SiRNA target sequence
tatattgaaaggcaagcacaccatt

SEQ ID NO: 175927 - DNA, 25 bp, Artificial sequence
  SiRNA target sequence
atattgaaaggcaagcacaccattt

SEQ ID NO: 175928 - DNA, 25 bp, Artificial sequence
  SiRNA target sequence
tattgaaaggcaagcacaccattta

SEQ ID NO: 175929 - DNA, 25 bp, Artificial sequence
  SiRNA target sequence
attgaaaggcaagcacaccatttaa

SEQ ID NO: 175930 - DNA, 25 bp, Artificial sequence
  SiRNA target sequence
ttgaaaggcaagcacaccatttaat

SEQ ID NO: 175931 - DNA, 25 bp, Artificial sequence
  SiRNA target sequence
tgaaaggcaagcacaccatttaatt

SEQ ID NO: 175932 - DNA, 25 bp, Artificial sequence
  SiRNA target sequence
gaaaggcaagcacaccatttaattg

SEQ ID NO: 175933 - DNA, 25 bp, Artificial sequence
  SiRNA target sequence
aaaggcaagcacaccatttaattga

SEQ ID NO: 175934 - DNA, 25 bp, Artificial sequence
  SiRNA target sequence
aaggcaagcacaccatttaattgaa

SEQ ID NO: 175935 - DNA, 25 bp, Artificial sequence
  SiRNA target sequence
aggcaagcacaccatttaattgaat

SEQ ID NO: 175936 - DNA, 25 bp, Artificial sequence
  SiRNA target sequence
ggcaagcacaccatttaattgaata

SEQ ID NO: 175937 - DNA, 25 bp, Artificial sequence
  SiRNA target sequence
gcaagcacaccatttaattgaatat

SEQ ID NO: 175938 - DNA, 25 bp, Artificial sequence
  SiRNA target sequence
caagcacaccatttaattgaatatt

SEQ ID NO: 175939 - DNA, 25 bp, Artificial sequence
  SiRNA target sequence
aagcacaccatttaattgaatattt

SEQ ID NO: 175940 - DNA, 25 bp, Artificial sequence
  SiRNA target sequence
agcacaccatttaattgaatattta

SEQ ID NO: 175941 - DNA, 25 bp, Artificial sequence
  SiRNA target sequence
gcacaccatttaattgaatatttat

SEQ ID NO: 175942 - DNA, 25 bp, Artificial sequence
  SiRNA target sequence
cacaccatttaattgaatatttatc

SEQ ID NO: 175943 - DNA, 25 bp, Artificial sequence
  SiRNA target sequence
acaccatttaattgaatatttatct

SEQ ID NO: 175944 - DNA, 25 bp, Artificial sequence
  SiRNA target sequence
caccatttaattgaatatttatctg

SEQ ID NO: 175945 - DNA, 25 bp, Artificial sequence
  SiRNA target sequence
accatttaattgaatatttatctgt

SEQ ID NO: 175946 - DNA, 25 bp, Artificial sequence
  SiRNA target sequence
ccatttaattgaatatttatctgtt

SEQ ID NO: 175947 - DNA, 25 bp, Artificial sequence
  SiRNA target sequence
catttaattgaatatttatctgtta

SEQ ID NO: 175948 - DNA, 25 bp, Artificial sequence
  SiRNA target sequence
atttaattgaatatttatctgttac

SEQ ID NO: 175949 - DNA, 25 bp, Artificial sequence
  SiRNA target sequence
tttaattgaatatttatctgttact

SEQ ID NO: 175950 - DNA, 25 bp, Artificial sequence
  SiRNA target sequence
ttaattgaatatttatctgttactt

SEQ ID NO: 175951 - DNA, 25 bp, Artificial sequence
  SiRNA target sequence
taattgaatatttatctgttacttc

SEQ ID NO: 175952 - DNA, 25 bp, Artificial sequence
  SiRNA target sequence
aattgaatatttatctgttacttct

SEQ ID NO: 175953 - DNA, 25 bp, Artificial sequence
  SiRNA target sequence
attgaatatttatctgttacttcta

SEQ ID NO: 175954 - DNA, 25 bp, Artificial sequence
  SiRNA target sequence
ttgaatatttatctgttacttctac

SEQ ID NO: 175955 - DNA, 25 bp, Artificial sequence
  SiRNA target sequence
tgaatatttatctgttacttctaca

SEQ ID NO: 175956 - DNA, 25 bp, Artificial sequence
  SiRNA target sequence
gaatatttatctgttacttctacac

SEQ ID NO: 175957 - DNA, 25 bp, Artificial sequence
  SiRNA target sequence
aatatttatctgttacttctacaca

SEQ ID NO: 175958 - DNA, 25 bp, Artificial sequence
  SiRNA target sequence
atatttatctgttacttctacacaa

SEQ ID NO: 175959 - DNA, 25 bp, Artificial sequence
  SiRNA target sequence
tatttatctgttacttctacacaac

SEQ ID NO: 175960 - DNA, 25 bp, Artificial sequence
  SiRNA target sequence
atttatctgttacttctacacaaca

SEQ ID NO: 175961 - DNA, 25 bp, Artificial sequence
  SiRNA target sequence
tttatctgttacttctacacaacaa

SEQ ID NO: 175962 - DNA, 25 bp, Artificial sequence
  SiRNA target sequence
ttatctgttacttctacacaacaac

SEQ ID NO: 175963 - DNA, 25 bp, Artificial sequence
  SiRNA target sequence
tatctgttacttctacacaacaaca

SEQ ID NO: 175964 - DNA, 25 bp, Artificial sequence
  SiRNA target sequence
atctgttacttctacacaacaacaa

SEQ ID NO: 175965 - DNA, 25 bp, Artificial sequence
  SiRNA target sequence
tctgttacttctacacaacaacaag

SEQ ID NO: 175966 - DNA, 25 bp, Artificial sequence
  SiRNA target sequence
ctgttacttctacacaacaacaagc

SEQ ID NO: 175967 - DNA, 25 bp, Artificial sequence
  SiRNA target sequence
tgttacttctacacaacaacaagcc

SEQ ID NO: 175968 - DNA, 25 bp, Artificial sequence
  SiRNA target sequence
gttacttctacacaacaacaagcca

SEQ ID NO: 175969 - DNA, 25 bp, Artificial sequence
  SiRNA target sequence
ttacttctacacaacaacaagccat

SEQ ID NO: 175970 - DNA, 25 bp, Artificial sequence
  SiRNA target sequence
tacttctacacaacaacaagccata

SEQ ID NO: 175971 - DNA, 25 bp, Artificial sequence
  SiRNA target sequence
acttctacacaacaacaagccataa

SEQ ID NO: 175972 - DNA, 25 bp, Artificial sequence
  SiRNA target sequence
cttctacacaacaacaagccataaa

SEQ ID NO: 175973 - DNA, 25 bp, Artificial sequence
  SiRNA target sequence
ttctacacaacaacaagccataaag

SEQ ID NO: 175974 - DNA, 25 bp, Artificial sequence
  SiRNA target sequence
tctacacaacaacaagccataaagc

SEQ ID NO: 175975 - DNA, 25 bp, Artificial sequence
  SiRNA target sequence
ctacacaacaacaagccataaagct

SEQ ID NO: 175976 - DNA, 25 bp, Artificial sequence
  SiRNA target sequence
tacacaacaacaagccataaagcta

SEQ ID NO: 175977 - DNA, 25 bp, Artificial sequence
  SiRNA target sequence
acacaacaacaagccataaagctac

SEQ ID NO: 175978 - DNA, 25 bp, Artificial sequence
  SiRNA target sequence
cacaacaacaagccataaagctact

SEQ ID NO: 175979 - DNA, 25 bp, Artificial sequence
  SiRNA target sequence
acaacaacaagccataaagctactt

SEQ ID NO: 175980 - DNA, 25 bp, Artificial sequence
  SiRNA target sequence
caacaacaagccataaagctacttg

SEQ ID NO: 175981 - DNA, 25 bp, Artificial sequence
  SiRNA target sequence
aacaacaagccataaagctacttgc

SEQ ID NO: 175982 - DNA, 25 bp, Artificial sequence
  SiRNA target sequence
acaacaagccataaagctacttgct

SEQ ID NO: 175983 - DNA, 25 bp, Artificial sequence
  SiRNA target sequence
caacaagccataaagctacttgctc

SEQ ID NO: 175984 - DNA, 25 bp, Artificial sequence
  SiRNA target sequence
aacaagccataaagctacttgctca

SEQ ID NO: 175985 - DNA, 25 bp, Artificial sequence
  SiRNA target sequence
acaagccataaagctacttgctcag

SEQ ID NO: 175986 - DNA, 25 bp, Artificial sequence
  SiRNA target sequence
caagccataaagctacttgctcagg

SEQ ID NO: 175987 - DNA, 25 bp, Artificial sequence
  SiRNA target sequence
aagccataaagctacttgctcaggg

SEQ ID NO: 175988 - DNA, 25 bp, Artificial sequence
  SiRNA target sequence
agccataaagctacttgctcagggg

SEQ ID NO: 175989 - DNA, 25 bp, Artificial sequence
  SiRNA target sequence
gccataaagctacttgctcaggggc

SEQ ID NO: 175990 - DNA, 25 bp, Artificial sequence
  SiRNA target sequence
ccataaagctacttgctcaggggcg

SEQ ID NO: 175991 - DNA, 25 bp, Artificial sequence
  SiRNA target sequence
cataaagctacttgctcaggggcga

SEQ ID NO: 175992 - DNA, 25 bp, Artificial sequence
  SiRNA target sequence
ataaagctacttgctcaggggcgaa

SEQ ID NO: 175993 - DNA, 25 bp, Artificial sequence
  SiRNA target sequence
taaagctacttgctcaggggcgaag

SEQ ID NO: 175994 - DNA, 25 bp, Artificial sequence
  SiRNA target sequence
aaagctacttgctcaggggcgaagt

SEQ ID NO: 175995 - DNA, 25 bp, Artificial sequence
  SiRNA target sequence
aagctacttgctcaggggcgaagta

SEQ ID NO: 175996 - DNA, 25 bp, Artificial sequence
  SiRNA target sequence
agctacttgctcaggggcgaagtat

SEQ ID NO: 175997 - DNA, 25 bp, Artificial sequence
  SiRNA target sequence
gctacttgctcaggggcgaagtata

SEQ ID NO: 175998 - DNA, 25 bp, Artificial sequence
  SiRNA target sequence
ctacttgctcaggggcgaagtataa

SEQ ID NO: 175999 - DNA, 25 bp, Artificial sequence
  SiRNA target sequence
tacttgctcaggggcgaagtataag

SEQ ID NO: 176000 - DNA, 25 bp, Artificial sequence
  SiRNA target sequence
acttgctcaggggcgaagtataagt

SEQ ID NO: 176001 - DNA, 25 bp, Artificial sequence
  SiRNA target sequence
cttgctcaggggcgaagtataagtg

SEQ ID NO: 176002 - DNA, 25 bp, Artificial sequence
  SiRNA target sequence
ttgctcaggggcgaagtataagtgt

SEQ ID NO: 176003 - DNA, 25 bp, Artificial sequence
  SiRNA target sequence
tgctcaggggcgaagtataagtgtc

SEQ ID NO: 176004 - DNA, 25 bp, Artificial sequence
  SiRNA target sequence
gctcaggggcgaagtataagtgtca

SEQ ID NO: 176005 - DNA, 25 bp, Artificial sequence
  SiRNA target sequence
ctcaggggcgaagtataagtgtcat

SEQ ID NO: 176006 - DNA, 25 bp, Artificial sequence
  SiRNA target sequence
tcaggggcgaagtataagtgtcata

SEQ ID NO: 176007 - DNA, 25 bp, Artificial sequence
  SiRNA target sequence
caggggcgaagtataagtgtcatac

SEQ ID NO: 176008 - DNA, 25 bp, Artificial sequence
  SiRNA target sequence
aggggcgaagtataagtgtcataca

SEQ ID NO: 176009 - DNA, 25 bp, Artificial sequence
  SiRNA target sequence
ggggcgaagtataagtgtcatacag

SEQ ID NO: 176010 - DNA, 25 bp, Artificial sequence
  SiRNA target sequence
gggcgaagtataagtgtcatacagt

SEQ ID NO: 176011 - DNA, 25 bp, Artificial sequence
  SiRNA target sequence
ggcgaagtataagtgtcatacagtg

SEQ ID NO: 176012 - DNA, 25 bp, Artificial sequence
  SiRNA target sequence
gcgaagtataagtgtcatacagtgc

SEQ ID NO: 176013 - DNA, 25 bp, Artificial sequence
  SiRNA target sequence
cgaagtataagtgtcatacagtgct

SEQ ID NO: 176014 - DNA, 25 bp, Artificial sequence
  SiRNA target sequence
gaagtataagtgtcatacagtgcta

SEQ ID NO: 176015 - DNA, 25 bp, Artificial sequence
  SiRNA target sequence
aagtataagtgtcatacagtgctat

SEQ ID NO: 176016 - DNA, 25 bp, Artificial sequence
  SiRNA target sequence
agtataagtgtcatacagtgctatg

SEQ ID NO: 176017 - DNA, 25 bp, Artificial sequence
  SiRNA target sequence
gtataagtgtcatacagtgctatga

SEQ ID NO: 176018 - DNA, 25 bp, Artificial sequence
  SiRNA target sequence
tataagtgtcatacagtgctatgat

SEQ ID NO: 176019 - DNA, 25 bp, Artificial sequence
  SiRNA target sequence
ataagtgtcatacagtgctatgata

SEQ ID NO: 176020 - DNA, 25 bp, Artificial sequence
  SiRNA target sequence
taagtgtcatacagtgctatgataa

SEQ ID NO: 176021 - DNA, 25 bp, Artificial sequence
  SiRNA target sequence
aagtgtcatacagtgctatgataaa

SEQ ID NO: 176022 - DNA, 25 bp, Artificial sequence
  SiRNA target sequence
agtgtcatacagtgctatgataaat

SEQ ID NO: 176023 - DNA, 25 bp, Artificial sequence
  SiRNA target sequence
gtgtcatacagtgctatgataaatt

SEQ ID NO: 176024 - DNA, 25 bp, Artificial sequence
  SiRNA target sequence
tgtcatacagtgctatgataaattt

SEQ ID NO: 176025 - DNA, 25 bp, Artificial sequence
  SiRNA target sequence
gtcatacagtgctatgataaatttt

SEQ ID NO: 176026 - DNA, 25 bp, Artificial sequence
  SiRNA target sequence
tcatacagtgctatgataaattttt

SEQ ID NO: 176027 - DNA, 25 bp, Artificial sequence
  SiRNA target sequence
catacagtgctatgataaattttta

SEQ ID NO: 176028 - DNA, 25 bp, Artificial sequence
  SiRNA target sequence
atacagtgctatgataaatttttag

SEQ ID NO: 176029 - DNA, 25 bp, Artificial sequence
  SiRNA target sequence
tacagtgctatgataaatttttaga

SEQ ID NO: 176030 - DNA, 25 bp, Artificial sequence
  SiRNA target sequence
acagtgctatgataaatttttagag

SEQ ID NO: 176031 - DNA, 25 bp, Artificial sequence
  SiRNA target sequence
cagtgctatgataaatttttagaga

SEQ ID NO: 176032 - DNA, 25 bp, Artificial sequence
  SiRNA target sequence
agtgctatgataaatttttagagaa

SEQ ID NO: 176033 - DNA, 25 bp, Artificial sequence
  SiRNA target sequence
gtgctatgataaatttttagagaat

SEQ ID NO: 176034 - DNA, 25 bp, Artificial sequence
  SiRNA target sequence
tgctatgataaatttttagagaata

SEQ ID NO: 176035 - DNA, 25 bp, Artificial sequence
  SiRNA target sequence
gctatgataaatttttagagaatag

SEQ ID NO: 176036 - DNA, 25 bp, Artificial sequence
  SiRNA target sequence
ctatgataaatttttagagaatagc

SEQ ID NO: 176037 - DNA, 25 bp, Artificial sequence
  SiRNA target sequence
tatgataaatttttagagaatagcg

SEQ ID NO: 176038 - DNA, 25 bp, Artificial sequence
  SiRNA target sequence
atgataaatttttagagaatagcga

SEQ ID NO: 176039 - DNA, 25 bp, Artificial sequence
  SiRNA target sequence
tgataaatttttagagaatagcgat

SEQ ID NO: 176040 - DNA, 25 bp, Artificial sequence
  SiRNA target sequence
gataaatttttagagaatagcgatg

SEQ ID NO: 176041 - DNA, 25 bp, Artificial sequence
  SiRNA target sequence
ataaatttttagagaatagcgatga

SEQ ID NO: 176042 - DNA, 25 bp, Artificial sequence
  SiRNA target sequence
taaatttttagagaatagcgatgat

SEQ ID NO: 176043 - DNA, 25 bp, Artificial sequence
  SiRNA target sequence
aaatttttagagaatagcgatgatg

SEQ ID NO: 176044 - DNA, 25 bp, Artificial sequence
  SiRNA target sequence
aatttttagagaatagcgatgatgt

SEQ ID NO: 176045 - DNA, 25 bp, Artificial sequence
  SiRNA target sequence
atttttagagaatagcgatgatgtt

SEQ ID NO: 176046 - DNA, 25 bp, Artificial sequence
  SiRNA target sequence
tttttagagaatagcgatgatgttt

SEQ ID NO: 176047 - DNA, 25 bp, Artificial sequence
  SiRNA target sequence
ttttagagaatagcgatgatgtttt

SEQ ID NO: 176048 - DNA, 25 bp, Artificial sequence
  SiRNA target sequence
tttagagaatagcgatgatgtttta

SEQ ID NO: 176049 - DNA, 25 bp, Artificial sequence
  SiRNA target sequence
ttagagaatagcgatgatgttttaa

SEQ ID NO: 176050 - DNA, 25 bp, Artificial sequence
  SiRNA target sequence
tagagaatagcgatgatgttttaac

SEQ ID NO: 176051 - DNA, 25 bp, Artificial sequence
  SiRNA target sequence
agagaatagcgatgatgttttaact

SEQ ID NO: 176052 - DNA, 25 bp, Artificial sequence
  SiRNA target sequence
gagaatagcgatgatgttttaacta

SEQ ID NO: 176053 - DNA, 25 bp, Artificial sequence
  SiRNA target sequence
agaatagcgatgatgttttaactac

SEQ ID NO: 176054 - DNA, 25 bp, Artificial sequence
  SiRNA target sequence
gaatagcgatgatgttttaactacc

SEQ ID NO: 176055 - DNA, 25 bp, Artificial sequence
  SiRNA target sequence
aatagcgatgatgttttaactacct

SEQ ID NO: 176056 - DNA, 25 bp, Artificial sequence
  SiRNA target sequence
atagcgatgatgttttaactaccta

SEQ ID NO: 176057 - DNA, 25 bp, Artificial sequence
  SiRNA target sequence
tagcgatgatgttttaactacctat

SEQ ID NO: 176058 - DNA, 25 bp, Artificial sequence
  SiRNA target sequence
agcgatgatgttttaactacctatg

SEQ ID NO: 176059 - DNA, 25 bp, Artificial sequence
  SiRNA target sequence
gcgatgatgttttaactacctatga

SEQ ID NO: 176060 - DNA, 25 bp, Artificial sequence
  SiRNA target sequence
cgatgatgttttaactacctatgat

SEQ ID NO: 176061 - DNA, 25 bp, Artificial sequence
  SiRNA target sequence
gatgatgttttaactacctatgatt

SEQ ID NO: 176062 - DNA, 25 bp, Artificial sequence
  SiRNA target sequence
atgatgttttaactacctatgattt

SEQ ID NO: 176063 - DNA, 25 bp, Artificial sequence
  SiRNA target sequence
tgatgttttaactacctatgatttt

SEQ ID NO: 176064 - DNA, 25 bp, Artificial sequence
  SiRNA target sequence
gatgttttaactacctatgattttt

SEQ ID NO: 176065 - DNA, 25 bp, Artificial sequence
  SiRNA target sequence
atgttttaactacctatgattttta

SEQ ID NO: 176066 - DNA, 25 bp, Artificial sequence
  SiRNA target sequence
tgttttaactacctatgatttttat

SEQ ID NO: 176067 - DNA, 25 bp, Artificial sequence
  SiRNA target sequence
gttttaactacctatgatttttata

SEQ ID NO: 176068 - DNA, 25 bp, Artificial sequence
  SiRNA target sequence
ttttaactacctatgatttttataa

SEQ ID NO: 176069 - DNA, 25 bp, Artificial sequence
  SiRNA target sequence
tttaactacctatgatttttataaa

SEQ ID NO: 176070 - DNA, 25 bp, Artificial sequence
  SiRNA target sequence
ttaactacctatgatttttataaaa

SEQ ID NO: 176071 - DNA, 25 bp, Artificial sequence
  SiRNA target sequence
taactacctatgatttttataaaat

SEQ ID NO: 176072 - DNA, 25 bp, Artificial sequence
  SiRNA target sequence
aactacctatgatttttataaaatg

SEQ ID NO: 176073 - DNA, 25 bp, Artificial sequence
  SiRNA target sequence
actacctatgatttttataaaatga

SEQ ID NO: 176074 - DNA, 25 bp, Artificial sequence
  SiRNA target sequence
ctacctatgatttttataaaatgat

SEQ ID NO: 176075 - DNA, 25 bp, Artificial sequence
  SiRNA target sequence
tacctatgatttttataaaatgatt

SEQ ID NO: 176076 - DNA, 25 bp, Artificial sequence
  SiRNA target sequence
acctatgatttttataaaatgattt

SEQ ID NO: 176077 - DNA, 25 bp, Artificial sequence
  SiRNA target sequence
cctatgatttttataaaatgatttt

SEQ ID NO: 176078 - DNA, 25 bp, Artificial sequence
  SiRNA target sequence
ctatgatttttataaaatgattttg

SEQ ID NO: 176079 - DNA, 25 bp, Artificial sequence
  SiRNA target sequence
tatgatttttataaaatgattttgg

SEQ ID NO: 176080 - DNA, 25 bp, Artificial sequence
  SiRNA target sequence
atgatttttataaaatgattttgga

SEQ ID NO: 176081 - DNA, 25 bp, Artificial sequence
  SiRNA target sequence
tgatttttataaaatgattttggat

SEQ ID NO: 176082 - DNA, 25 bp, Artificial sequence
  SiRNA target sequence
gatttttataaaatgattttggatc

SEQ ID NO: 176083 - DNA, 25 bp, Artificial sequence
  SiRNA target sequence
atttttataaaatgattttggatct

SEQ ID NO: 176084 - DNA, 25 bp, Artificial sequence
  SiRNA target sequence
tttttataaaatgattttggatcta

SEQ ID NO: 176085 - DNA, 25 bp, Artificial sequence
  SiRNA target sequence
ttttataaaatgattttggatctag

SEQ ID NO: 176086 - DNA, 25 bp, Artificial sequence
  SiRNA target sequence
tttataaaatgattttggatctagg

SEQ ID NO: 176087 - DNA, 25 bp, Artificial sequence
  SiRNA target sequence
ttataaaatgattttggatctagga

SEQ ID NO: 176088 - DNA, 25 bp, Artificial sequence
  SiRNA target sequence
tataaaatgattttggatctaggat

SEQ ID NO: 176089 - DNA, 25 bp, Artificial sequence
  SiRNA target sequence
ataaaatgattttggatctaggatt

SEQ ID NO: 176090 - DNA, 25 bp, Artificial sequence
  SiRNA target sequence
taaaatgattttggatctaggattt

SEQ ID NO: 176091 - DNA, 25 bp, Artificial sequence
  SiRNA target sequence
aaaatgattttggatctaggatttt

SEQ ID NO: 176092 - DNA, 25 bp, Artificial sequence
  SiRNA target sequence
aaatgattttggatctaggattttt

SEQ ID NO: 176093 - DNA, 25 bp, Artificial sequence
  SiRNA target sequence
aatgattttggatctaggattttta

SEQ ID NO: 176094 - DNA, 25 bp, Artificial sequence
  SiRNA target sequence
atgattttggatctaggatttttac

SEQ ID NO: 176095 - DNA, 25 bp, Artificial sequence
  SiRNA target sequence
tgattttggatctaggatttttaca

SEQ ID NO: 176096 - DNA, 25 bp, Artificial sequence
  SiRNA target sequence
gattttggatctaggatttttacag

SEQ ID NO: 176097 - DNA, 25 bp, Artificial sequence
  SiRNA target sequence
attttggatctaggatttttacagc

SEQ ID NO: 176098 - DNA, 25 bp, Artificial sequence
  SiRNA target sequence
ttttggatctaggatttttacagca

SEQ ID NO: 176099 - DNA, 25 bp, Artificial sequence
  SiRNA target sequence
tttggatctaggatttttacagcat

SEQ ID NO: 176100 - DNA, 25 bp, Artificial sequence
  SiRNA target sequence
ttggatctaggatttttacagcata

SEQ ID NO: 176101 - DNA, 25 bp, Artificial sequence
  SiRNA target sequence
tggatctaggatttttacagcataa

SEQ ID NO: 176102 - DNA, 25 bp, Artificial sequence
  SiRNA target sequence
ggatctaggatttttacagcataat

SEQ ID NO: 176103 - DNA, 25 bp, Artificial sequence
  SiRNA target sequence
gatctaggatttttacagcataatt

SEQ ID NO: 176104 - DNA, 25 bp, Artificial sequence
  SiRNA target sequence
atctaggatttttacagcataattt

SEQ ID NO: 176105 - DNA, 25 bp, Artificial sequence
  SiRNA target sequence
tctaggatttttacagcataatttt

SEQ ID NO: 176106 - DNA, 25 bp, Artificial sequence
  SiRNA target sequence
ctaggatttttacagcataatttta

SEQ ID NO: 176107 - DNA, 25 bp, Artificial sequence
  SiRNA target sequence
taggatttttacagcataattttat

SEQ ID NO: 176108 - DNA, 25 bp, Artificial sequence
  SiRNA target sequence
aggatttttacagcataattttatt

SEQ ID NO: 176109 - DNA, 25 bp, Artificial sequence
  SiRNA target sequence
ggatttttacagcataattttatta

SEQ ID NO: 176110 - DNA, 25 bp, Artificial sequence
  SiRNA target sequence
gatttttacagcataattttattaa

SEQ ID NO: 176111 - DNA, 25 bp, Artificial sequence
  SiRNA target sequence
atttttacagcataattttattaaa

SEQ ID NO: 176112 - DNA, 25 bp, Artificial sequence
  SiRNA target sequence
tttttacagcataattttattaaag

SEQ ID NO: 176113 - DNA, 25 bp, Artificial sequence
  SiRNA target sequence
ttttacagcataattttattaaagg

SEQ ID NO: 176114 - DNA, 25 bp, Artificial sequence
  SiRNA target sequence
tttacagcataattttattaaagga

SEQ ID NO: 176115 - DNA, 25 bp, Artificial sequence
  SiRNA target sequence
ttacagcataattttattaaaggaa

SEQ ID NO: 176116 - DNA, 25 bp, Artificial sequence
  SiRNA target sequence
tacagcataattttattaaaggaac

SEQ ID NO: 176117 - DNA, 25 bp, Artificial sequence
  SiRNA target sequence
acagcataattttattaaaggaacc

SEQ ID NO: 176118 - DNA, 25 bp, Artificial sequence
  SiRNA target sequence
cagcataattttattaaaggaacct

SEQ ID NO: 176119 - DNA, 25 bp, Artificial sequence
  SiRNA target sequence
agcataattttattaaaggaacctg

SEQ ID NO: 176120 - DNA, 25 bp, Artificial sequence
  SiRNA target sequence
gcataattttattaaaggaacctgt

SEQ ID NO: 176121 - DNA, 25 bp, Artificial sequence
  SiRNA target sequence
cataattttattaaaggaacctgtg

SEQ ID NO: 176122 - DNA, 25 bp, Artificial sequence
  SiRNA target sequence
ataattttattaaaggaacctgtga

SEQ ID NO: 176123 - DNA, 25 bp, Artificial sequence
  SiRNA target sequence
taattttattaaaggaacctgtgag

SEQ ID NO: 176124 - DNA, 25 bp, Artificial sequence
  SiRNA target sequence
aattttattaaaggaacctgtgaga

SEQ ID NO: 176125 - DNA, 25 bp, Artificial sequence
  SiRNA target sequence
attttattaaaggaacctgtgagaa

SEQ ID NO: 176126 - DNA, 25 bp, Artificial sequence
  SiRNA target sequence
ttttattaaaggaacctgtgagaaa

SEQ ID NO: 176127 - DNA, 25 bp, Artificial sequence
  SiRNA target sequence
tttattaaaggaacctgtgagaaat

SEQ ID NO: 176128 - DNA, 25 bp, Artificial sequence
  SiRNA target sequence
ttattaaaggaacctgtgagaaatg

SEQ ID NO: 176129 - DNA, 25 bp, Artificial sequence
  SiRNA target sequence
tattaaaggaacctgtgagaaatgg

SEQ ID NO: 176130 - DNA, 25 bp, Artificial sequence
  SiRNA target sequence
attaaaggaacctgtgagaaatggg

SEQ ID NO: 176131 - DNA, 25 bp, Artificial sequence
  SiRNA target sequence
ttaaaggaacctgtgagaaatggga

SEQ ID NO: 176132 - DNA, 25 bp, Artificial sequence
  SiRNA target sequence
taaaggaacctgtgagaaatgggag

SEQ ID NO: 176133 - DNA, 25 bp, Artificial sequence
  SiRNA target sequence
aaaggaacctgtgagaaatgggaga

SEQ ID NO: 176134 - DNA, 25 bp, Artificial sequence
  SiRNA target sequence
aaggaacctgtgagaaatgggagaa

SEQ ID NO: 176135 - DNA, 25 bp, Artificial sequence
  SiRNA target sequence
aggaacctgtgagaaatgggagaag

SEQ ID NO: 176136 - DNA, 25 bp, Artificial sequence
  SiRNA target sequence
ggaacctgtgagaaatgggagaagt

SEQ ID NO: 176137 - DNA, 25 bp, Artificial sequence
  SiRNA target sequence
gaacctgtgagaaatgggagaagtg

SEQ ID NO: 176138 - DNA, 25 bp, Artificial sequence
  SiRNA target sequence
aacctgtgagaaatgggagaagtgt

SEQ ID NO: 176139 - DNA, 25 bp, Artificial sequence
  SiRNA target sequence
acctgtgagaaatgggagaagtgta

SEQ ID NO: 176140 - DNA, 25 bp, Artificial sequence
  SiRNA target sequence
cctgtgagaaatgggagaagtgtac

SEQ ID NO: 176141 - DNA, 25 bp, Artificial sequence
  SiRNA target sequence
ctgtgagaaatgggagaagtgtact

SEQ ID NO: 176142 - DNA, 25 bp, Artificial sequence
  SiRNA target sequence
tgtgagaaatgggagaagtgtacta

SEQ ID NO: 176143 - DNA, 25 bp, Artificial sequence
  SiRNA target sequence
gtgagaaatgggagaagtgtactat

SEQ ID NO: 176144 - DNA, 25 bp, Artificial sequence
  SiRNA target sequence
tgagaaatgggagaagtgtactatt

SEQ ID NO: 176145 - DNA, 25 bp, Artificial sequence
  SiRNA target sequence
gagaaatgggagaagtgtactattg

SEQ ID NO: 176146 - DNA, 25 bp, Artificial sequence
  SiRNA target sequence
agaaatgggagaagtgtactattgg

SEQ ID NO: 176147 - DNA, 25 bp, Artificial sequence
  SiRNA target sequence
gaaatgggagaagtgtactattgga

SEQ ID NO: 176148 - DNA, 25 bp, Artificial sequence
  SiRNA target sequence
aaatgggagaagtgtactattggat

SEQ ID NO: 176149 - DNA, 25 bp, Artificial sequence
  SiRNA target sequence
aatgggagaagtgtactattggata

SEQ ID NO: 176150 - DNA, 25 bp, Artificial sequence
  SiRNA target sequence
atgggagaagtgtactattggatat

SEQ ID NO: 176151 - DNA, 25 bp, Artificial sequence
  SiRNA target sequence
tgggagaagtgtactattggatatc

SEQ ID NO: 176152 - DNA, 25 bp, Artificial sequence
  SiRNA target sequence
gggagaagtgtactattggatatca

SEQ ID NO: 176153 - DNA, 25 bp, Artificial sequence
  SiRNA target sequence
ggagaagtgtactattggatatcat

SEQ ID NO: 176154 - DNA, 25 bp, Artificial sequence
  SiRNA target sequence
gagaagtgtactattggatatcatt

SEQ ID NO: 176155 - DNA, 25 bp, Artificial sequence
  SiRNA target sequence
agaagtgtactattggatatcatta

SEQ ID NO: 176156 - DNA, 25 bp, Artificial sequence
  SiRNA target sequence
gaagtgtactattggatatcattat

SEQ ID NO: 176157 - DNA, 25 bp, Artificial sequence
  SiRNA target sequence
aagtgtactattggatatcattatg

SEQ ID NO: 176158 - DNA, 25 bp, Artificial sequence
  SiRNA target sequence
agtgtactattggatatcattatgg

SEQ ID NO: 176159 - DNA, 25 bp, Artificial sequence
  SiRNA target sequence
gtgtactattggatatcattatgga

SEQ ID NO: 176160 - DNA, 25 bp, Artificial sequence
  SiRNA target sequence
tgtactattggatatcattatggat

SEQ ID NO: 176161 - DNA, 25 bp, Artificial sequence
  SiRNA target sequence
gtactattggatatcattatggata

SEQ ID NO: 176162 - DNA, 25 bp, Artificial sequence
  SiRNA target sequence
tactattggatatcattatggatat

SEQ ID NO: 176163 - DNA, 25 bp, Artificial sequence
  SiRNA target sequence
actattggatatcattatggatatt

SEQ ID NO: 176164 - DNA, 25 bp, Artificial sequence
  SiRNA target sequence
ctattggatatcattatggatattt

SEQ ID NO: 176165 - DNA, 25 bp, Artificial sequence
  SiRNA target sequence
tattggatatcattatggatattta

SEQ ID NO: 176166 - DNA, 25 bp, Artificial sequence
  SiRNA target sequence
attggatatcattatggatatttag

SEQ ID NO: 176167 - DNA, 25 bp, Artificial sequence
  SiRNA target sequence
ttggatatcattatggatatttaga

SEQ ID NO: 176168 - DNA, 25 bp, Artificial sequence
  SiRNA target sequence
tggatatcattatggatatttagaa

SEQ ID NO: 176169 - DNA, 25 bp, Artificial sequence
  SiRNA target sequence
ggatatcattatggatatttagaac

SEQ ID NO: 176170 - DNA, 25 bp, Artificial sequence
  SiRNA target sequence
gatatcattatggatatttagaaca

SEQ ID NO: 176171 - DNA, 25 bp, Artificial sequence
  SiRNA target sequence
atatcattatggatatttagaacac

SEQ ID NO: 176172 - DNA, 25 bp, Artificial sequence
  SiRNA target sequence
tatcattatggatatttagaacaca

SEQ ID NO: 176173 - DNA, 25 bp, Artificial sequence
  SiRNA target sequence
atcattatggatatttagaacacat

SEQ ID NO: 176174 - DNA, 25 bp, Artificial sequence
  SiRNA target sequence
tcattatggatatttagaacacata

SEQ ID NO: 176175 - DNA, 25 bp, Artificial sequence
  SiRNA target sequence
cattatggatatttagaacacatat

SEQ ID NO: 176176 - DNA, 25 bp, Artificial sequence
  SiRNA target sequence
attatggatatttagaacacatatt

SEQ ID NO: 176177 - DNA, 25 bp, Artificial sequence
  SiRNA target sequence
ttatggatatttagaacacatatta

SEQ ID NO: 176178 - DNA, 25 bp, Artificial sequence
  SiRNA target sequence
tatggatatttagaacacatattaa

SEQ ID NO: 176179 - DNA, 25 bp, Artificial sequence
  SiRNA target sequence
atggatatttagaacacatattaaa

SEQ ID NO: 176180 - DNA, 25 bp, Artificial sequence
  SiRNA target sequence
tggatatttagaacacatattaaat

SEQ ID NO: 176181 - DNA, 25 bp, Artificial sequence
  SiRNA target sequence
ggatatttagaacacatattaaata

SEQ ID NO: 176182 - DNA, 25 bp, Artificial sequence
  SiRNA target sequence
gatatttagaacacatattaaataa

SEQ ID NO: 176183 - DNA, 25 bp, Artificial sequence
  SiRNA target sequence
atatttagaacacatattaaataag

SEQ ID NO: 176184 - DNA, 25 bp, Artificial sequence
  SiRNA target sequence
tatttagaacacatattaaataaga

SEQ ID NO: 176185 - DNA, 25 bp, Artificial sequence
  SiRNA target sequence
atttagaacacatattaaataagaa

SEQ ID NO: 176186 - DNA, 25 bp, Artificial sequence
  SiRNA target sequence
tttagaacacatattaaataagaag

SEQ ID NO: 176187 - DNA, 25 bp, Artificial sequence
  SiRNA target sequence
ttagaacacatattaaataagaaga

SEQ ID NO: 176188 - DNA, 25 bp, Artificial sequence
  SiRNA target sequence
tagaacacatattaaataagaagaa

SEQ ID NO: 176189 - DNA, 25 bp, Artificial sequence
  SiRNA target sequence
agaacacatattaaataagaagaac

SEQ ID NO: 176190 - DNA, 25 bp, Artificial sequence
  SiRNA target sequence
gaacacatattaaataagaagaaca

SEQ ID NO: 176191 - DNA, 25 bp, Artificial sequence
  SiRNA target sequence
aacacatattaaataagaagaacaa

SEQ ID NO: 176192 - DNA, 25 bp, Artificial sequence
  SiRNA target sequence
acacatattaaataagaagaacaat

SEQ ID NO: 176193 - DNA, 25 bp, Artificial sequence
  SiRNA target sequence
cacatattaaataagaagaacaatt

SEQ ID NO: 176194 - DNA, 25 bp, Artificial sequence
  SiRNA target sequence
acatattaaataagaagaacaatta

SEQ ID NO: 176195 - DNA, 25 bp, Artificial sequence
  SiRNA target sequence
catattaaataagaagaacaattat

SEQ ID NO: 176196 - DNA, 25 bp, Artificial sequence
  SiRNA target sequence
atattaaataagaagaacaattatt

SEQ ID NO: 176197 - DNA, 25 bp, Artificial sequence
  SiRNA target sequence
tattaaataagaagaacaattattt

SEQ ID NO: 176198 - DNA, 25 bp, Artificial sequence
  SiRNA target sequence
attaaataagaagaacaattattta

SEQ ID NO: 176199 - DNA, 25 bp, Artificial sequence
  SiRNA target sequence
ttaaataagaagaacaattatttaa

SEQ ID NO: 176200 - DNA, 25 bp, Artificial sequence
  SiRNA target sequence
taaataagaagaacaattatttaac

SEQ ID NO: 176201 - DNA, 25 bp, Artificial sequence
  SiRNA target sequence
aaataagaagaacaattatttaaca

SEQ ID NO: 176202 - DNA, 25 bp, Artificial sequence
  SiRNA target sequence
aataagaagaacaattatttaacaa

SEQ ID NO: 176203 - DNA, 25 bp, Artificial sequence
  SiRNA target sequence
ataagaagaacaattatttaacaaa

SEQ ID NO: 176204 - DNA, 25 bp, Artificial sequence
  SiRNA target sequence
taagaagaacaattatttaacaaaa

SEQ ID NO: 176205 - DNA, 25 bp, Artificial sequence
  SiRNA target sequence
aagaagaacaattatttaacaaaaa

SEQ ID NO: 176206 - DNA, 25 bp, Artificial sequence
  SiRNA target sequence
agaagaacaattatttaacaaaaaa

SEQ ID NO: 176207 - DNA, 25 bp, Artificial sequence
  SiRNA target sequence
gaagaacaattatttaacaaaaaat

SEQ ID NO: 176208 - DNA, 25 bp, Artificial sequence
  SiRNA target sequence
aagaacaattatttaacaaaaaatg

SEQ ID NO: 176209 - DNA, 25 bp, Artificial sequence
  SiRNA target sequence
agaacaattatttaacaaaaaatga

SEQ ID NO: 176210 - DNA, 25 bp, Artificial sequence
  SiRNA target sequence
gaacaattatttaacaaaaaatgat

SEQ ID NO: 176211 - DNA, 25 bp, Artificial sequence
  SiRNA target sequence
aacaattatttaacaaaaaatgata

SEQ ID NO: 176212 - DNA, 25 bp, Artificial sequence
  SiRNA target sequence
acaattatttaacaaaaaatgatag

SEQ ID NO: 176213 - DNA, 25 bp, Artificial sequence
  SiRNA target sequence
caattatttaacaaaaaatgatagt

SEQ ID NO: 176214 - DNA, 25 bp, Artificial sequence
  SiRNA target sequence
aattatttaacaaaaaatgatagta

SEQ ID NO: 176215 - DNA, 25 bp, Artificial sequence
  SiRNA target sequence
attatttaacaaaaaatgatagtat

SEQ ID NO: 176216 - DNA, 25 bp, Artificial sequence
  SiRNA target sequence
ttatttaacaaaaaatgatagtata

SEQ ID NO: 176217 - DNA, 25 bp, Artificial sequence
  SiRNA target sequence
tatttaacaaaaaatgatagtataa

SEQ ID NO: 176218 - DNA, 25 bp, Artificial sequence
  SiRNA target sequence
atttaacaaaaaatgatagtataaa

SEQ ID NO: 176219 - DNA, 25 bp, Artificial sequence
  SiRNA target sequence
tttaacaaaaaatgatagtataaaa

SEQ ID NO: 176220 - DNA, 25 bp, Artificial sequence
  SiRNA target sequence
ttaacaaaaaatgatagtataaaaa

SEQ ID NO: 176221 - DNA, 25 bp, Artificial sequence
  SiRNA target sequence
taacaaaaaatgatagtataaaaat

SEQ ID NO: 176222 - DNA, 25 bp, Artificial sequence
  SiRNA target sequence
aacaaaaaatgatagtataaaaata

SEQ ID NO: 176223 - DNA, 25 bp, Artificial sequence
  SiRNA target sequence
acaaaaaatgatagtataaaaatat

SEQ ID NO: 176224 - DNA, 25 bp, Artificial sequence
  SiRNA target sequence
caaaaaatgatagtataaaaatatt

SEQ ID NO: 176225 - DNA, 25 bp, Artificial sequence
  SiRNA target sequence
aaaaaatgatagtataaaaatattt

SEQ ID NO: 176226 - DNA, 25 bp, Artificial sequence
  SiRNA target sequence
aaaaatgatagtataaaaatattta

SEQ ID NO: 176227 - DNA, 25 bp, Artificial sequence
  SiRNA target sequence
aaaatgatagtataaaaatatttaa

SEQ ID NO: 176228 - DNA, 25 bp, Artificial sequence
  SiRNA target sequence
aaatgatagtataaaaatatttaac

SEQ ID NO: 176229 - DNA, 25 bp, Artificial sequence
  SiRNA target sequence
aatgatagtataaaaatatttaaca

SEQ ID NO: 176230 - DNA, 25 bp, Artificial sequence
  SiRNA target sequence
atgatagtataaaaatatttaacag

SEQ ID NO: 176231 - DNA, 25 bp, Artificial sequence
  SiRNA target sequence
tgatagtataaaaatatttaacagt

SEQ ID NO: 176232 - DNA, 25 bp, Artificial sequence
  SiRNA target sequence
gatagtataaaaatatttaacagta

SEQ ID NO: 176233 - DNA, 25 bp, Artificial sequence
  SiRNA target sequence
atagtataaaaatatttaacagtaa

SEQ ID NO: 176234 - DNA, 25 bp, Artificial sequence
  SiRNA target sequence
tagtataaaaatatttaacagtaaa

SEQ ID NO: 176235 - DNA, 25 bp, Artificial sequence
  SiRNA target sequence
agtataaaaatatttaacagtaaaa

SEQ ID NO: 176236 - DNA, 25 bp, Artificial sequence
  SiRNA target sequence
gtataaaaatatttaacagtaaaaa

SEQ ID NO: 176237 - DNA, 25 bp, Artificial sequence
  SiRNA target sequence
tataaaaatatttaacagtaaaaat

SEQ ID NO: 176238 - DNA, 25 bp, Artificial sequence
  SiRNA target sequence
ataaaaatatttaacagtaaaaatg

SEQ ID NO: 176239 - DNA, 25 bp, Artificial sequence
  SiRNA target sequence
taaaaatatttaacagtaaaaatga

SEQ ID NO: 176240 - DNA, 25 bp, Artificial sequence
  SiRNA target sequence
aaaaatatttaacagtaaaaatgag

SEQ ID NO: 176241 - DNA, 25 bp, Artificial sequence
  SiRNA target sequence
aaaatatttaacagtaaaaatgagg

SEQ ID NO: 176242 - DNA, 25 bp, Artificial sequence
  SiRNA target sequence
aaatatttaacagtaaaaatgagga

SEQ ID NO: 176243 - DNA, 25 bp, Artificial sequence
  SiRNA target sequence
aatatttaacagtaaaaatgaggag

SEQ ID NO: 176244 - DNA, 25 bp, Artificial sequence
  SiRNA target sequence
atatttaacagtaaaaatgaggagg

SEQ ID NO: 176245 - DNA, 25 bp, Artificial sequence
  SiRNA target sequence
tatttaacagtaaaaatgaggaggt

SEQ ID NO: 176246 - DNA, 25 bp, Artificial sequence
  SiRNA target sequence
atttaacagtaaaaatgaggaggta

SEQ ID NO: 176247 - DNA, 25 bp, Artificial sequence
  SiRNA target sequence
tttaacagtaaaaatgaggaggtaa

SEQ ID NO: 176248 - DNA, 25 bp, Artificial sequence
  SiRNA target sequence
ttaacagtaaaaatgaggaggtaag

SEQ ID NO: 176249 - DNA, 25 bp, Artificial sequence
  SiRNA target sequence
taacagtaaaaatgaggaggtaagg

SEQ ID NO: 176250 - DNA, 25 bp, Artificial sequence
  SiRNA target sequence
aacagtaaaaatgaggaggtaaggt

SEQ ID NO: 176251 - DNA, 25 bp, Artificial sequence
  SiRNA target sequence
acagtaaaaatgaggaggtaaggtt

SEQ ID NO: 176252 - DNA, 25 bp, Artificial sequence
  SiRNA target sequence
cagtaaaaatgaggaggtaaggtta

SEQ ID NO: 176253 - DNA, 25 bp, Artificial sequence
  SiRNA target sequence
agtaaaaatgaggaggtaaggttaa

SEQ ID NO: 176254 - DNA, 25 bp, Artificial sequence
  SiRNA target sequence
gtaaaaatgaggaggtaaggttaaa

SEQ ID NO: 176255 - DNA, 25 bp, Artificial sequence
  SiRNA target sequence
taaaaatgaggaggtaaggttaaat

SEQ ID NO: 176256 - DNA, 25 bp, Artificial sequence
  SiRNA target sequence
aaaaatgaggaggtaaggttaaatg

SEQ ID NO: 176257 - DNA, 25 bp, Artificial sequence
  SiRNA target sequence
aaaatgaggaggtaaggttaaatgg

SEQ ID NO: 176258 - DNA, 25 bp, Artificial sequence
  SiRNA target sequence
aaatgaggaggtaaggttaaatgga

SEQ ID NO: 176259 - DNA, 25 bp, Artificial sequence
  SiRNA target sequence
aatgaggaggtaaggttaaatggaa

SEQ ID NO: 176260 - DNA, 25 bp, Artificial sequence
  SiRNA target sequence
atgaggaggtaaggttaaatggaaa

SEQ ID NO: 176261 - DNA, 25 bp, Artificial sequence
  SiRNA target sequence
tgaggaggtaaggttaaatggaaaa

SEQ ID NO: 176262 - DNA, 25 bp, Artificial sequence
  SiRNA target sequence
gaggaggtaaggttaaatggaaaaa

SEQ ID NO: 176263 - DNA, 25 bp, Artificial sequence
  SiRNA target sequence
aggaggtaaggttaaatggaaaaag

SEQ ID NO: 176264 - DNA, 25 bp, Artificial sequence
  SiRNA target sequence
ggaggtaaggttaaatggaaaaaga

SEQ ID NO: 176265 - DNA, 25 bp, Artificial sequence
  SiRNA target sequence
gaggtaaggttaaatggaaaaagaa

SEQ ID NO: 176266 - DNA, 25 bp, Artificial sequence
  SiRNA target sequence
aggtaaggttaaatggaaaaagaaa

SEQ ID NO: 176267 - DNA, 25 bp, Artificial sequence
  SiRNA target sequence
ggtaaggttaaatggaaaaagaaaa

SEQ ID NO: 176268 - DNA, 25 bp, Artificial sequence
  SiRNA target sequence
gtaaggttaaatggaaaaagaaaat

SEQ ID NO: 176269 - DNA, 25 bp, Artificial sequence
  SiRNA target sequence
taaggttaaatggaaaaagaaaatt

SEQ ID NO: 176270 - DNA, 25 bp, Artificial sequence
  SiRNA target sequence
aaggttaaatggaaaaagaaaatta

SEQ ID NO: 176271 - DNA, 25 bp, Artificial sequence
  SiRNA target sequence
aggttaaatggaaaaagaaaattaa

SEQ ID NO: 176272 - DNA, 25 bp, Artificial sequence
  SiRNA target sequence
ggttaaatggaaaaagaaaattaaa

SEQ ID NO: 176273 - DNA, 25 bp, Artificial sequence
  SiRNA target sequence
gttaaatggaaaaagaaaattaaat

SEQ ID NO: 176274 - DNA, 25 bp, Artificial sequence
  SiRNA target sequence
ttaaatggaaaaagaaaattaaata

SEQ ID NO: 176275 - DNA, 25 bp, Artificial sequence
  SiRNA target sequence
taaatggaaaaagaaaattaaatat

SEQ ID NO: 176276 - DNA, 25 bp, Artificial sequence
  SiRNA target sequence
aaatggaaaaagaaaattaaatatt

SEQ ID NO: 176277 - DNA, 25 bp, Artificial sequence
  SiRNA target sequence
aatggaaaaagaaaattaaatatta

SEQ ID NO: 176278 - DNA, 25 bp, Artificial sequence
  SiRNA target sequence
atggaaaaagaaaattaaatattaa

SEQ ID NO: 176279 - DNA, 25 bp, Artificial sequence
  SiRNA target sequence
tggaaaaagaaaattaaatattaac

SEQ ID NO: 176280 - DNA, 25 bp, Artificial sequence
  SiRNA target sequence
ggaaaaagaaaattaaatattaaca

SEQ ID NO: 176281 - DNA, 25 bp, Artificial sequence
  SiRNA target sequence
gaaaaagaaaattaaatattaacac

SEQ ID NO: 176282 - DNA, 25 bp, Artificial sequence
  SiRNA target sequence
aaaaagaaaattaaatattaacaca

SEQ ID NO: 176283 - DNA, 25 bp, Artificial sequence
  SiRNA target sequence
aaaagaaaattaaatattaacacag

SEQ ID NO: 176284 - DNA, 25 bp, Artificial sequence
  SiRNA target sequence
aaagaaaattaaatattaacacagt

SEQ ID NO: 176285 - DNA, 25 bp, Artificial sequence
  SiRNA target sequence
aagaaaattaaatattaacacagtt

SEQ ID NO: 176286 - DNA, 25 bp, Artificial sequence
  SiRNA target sequence
agaaaattaaatattaacacagtta

SEQ ID NO: 176287 - DNA, 25 bp, Artificial sequence
  SiRNA target sequence
gaaaattaaatattaacacagttac

SEQ ID NO: 176288 - DNA, 25 bp, Artificial sequence
  SiRNA target sequence
aaaattaaatattaacacagttaca

SEQ ID NO: 176289 - DNA, 25 bp, Artificial sequence
  SiRNA target sequence
aaattaaatattaacacagttacat

SEQ ID NO: 176290 - DNA, 25 bp, Artificial sequence
  SiRNA target sequence
aattaaatattaacacagttacatt

SEQ ID NO: 176291 - DNA, 25 bp, Artificial sequence
  SiRNA target sequence
attaaatattaacacagttacatta

SEQ ID NO: 176292 - DNA, 25 bp, Artificial sequence
  SiRNA target sequence
ttaaatattaacacagttacattaa

SEQ ID NO: 176293 - DNA, 25 bp, Artificial sequence
  SiRNA target sequence
taaatattaacacagttacattaaa

SEQ ID NO: 176294 - DNA, 25 bp, Artificial sequence
  SiRNA target sequence
aaatattaacacagttacattaaat

SEQ ID NO: 176295 - DNA, 25 bp, Artificial sequence
  SiRNA target sequence
aatattaacacagttacattaaata

SEQ ID NO: 176296 - DNA, 25 bp, Artificial sequence
  SiRNA target sequence
atattaacacagttacattaaataa

SEQ ID NO: 176297 - DNA, 25 bp, Artificial sequence
  SiRNA target sequence
tattaacacagttacattaaataaa

SEQ ID NO: 176298 - DNA, 25 bp, Artificial sequence
  SiRNA target sequence
attaacacagttacattaaataaaa

SEQ ID NO: 176299 - DNA, 25 bp, Artificial sequence
  SiRNA target sequence
ttaacacagttacattaaataaaat

SEQ ID NO: 176300 - DNA, 25 bp, Artificial sequence
  SiRNA target sequence
taacacagttacattaaataaaatt

SEQ ID NO: 176301 - DNA, 25 bp, Artificial sequence
  SiRNA target sequence
aacacagttacattaaataaaatta

SEQ ID NO: 176302 - DNA, 25 bp, Artificial sequence
  SiRNA target sequence
acacagttacattaaataaaattaa

SEQ ID NO: 176303 - DNA, 25 bp, Artificial sequence
  SiRNA target sequence
cacagttacattaaataaaattaat

SEQ ID NO: 176304 - DNA, 25 bp, Artificial sequence
  SiRNA target sequence
acagttacattaaataaaattaata

SEQ ID NO: 176305 - DNA, 25 bp, Artificial sequence
  SiRNA target sequence
cagttacattaaataaaattaatat

SEQ ID NO: 176306 - DNA, 25 bp, Artificial sequence
  SiRNA target sequence
agttacattaaataaaattaatata

SEQ ID NO: 176307 - DNA, 25 bp, Artificial sequence
  SiRNA target sequence
gttacattaaataaaattaatatac

SEQ ID NO: 176308 - DNA, 25 bp, Artificial sequence
  SiRNA target sequence
ttacattaaataaaattaatatacc

SEQ ID NO: 176309 - DNA, 25 bp, Artificial sequence
  SiRNA target sequence
tacattaaataaaattaatatacct

SEQ ID NO: 176310 - DNA, 25 bp, Artificial sequence
  SiRNA target sequence
acattaaataaaattaatatacctg

SEQ ID NO: 176311 - DNA, 25 bp, Artificial sequence
  SiRNA target sequence
cattaaataaaattaatatacctga

SEQ ID NO: 176312 - DNA, 25 bp, Artificial sequence
  SiRNA target sequence
attaaataaaattaatatacctgag

SEQ ID NO: 176313 - DNA, 25 bp, Artificial sequence
  SiRNA target sequence
ttaaataaaattaatatacctgaga

SEQ ID NO: 176314 - DNA, 25 bp, Artificial sequence
  SiRNA target sequence
taaataaaattaatatacctgagat

SEQ ID NO: 176315 - DNA, 25 bp, Artificial sequence
  SiRNA target sequence
aaataaaattaatatacctgagata

SEQ ID NO: 176316 - DNA, 25 bp, Artificial sequence
  SiRNA target sequence
aataaaattaatatacctgagatag

SEQ ID NO: 176317 - DNA, 25 bp, Artificial sequence
  SiRNA target sequence
ataaaattaatatacctgagataga

SEQ ID NO: 176318 - DNA, 25 bp, Artificial sequence
  SiRNA target sequence
taaaattaatatacctgagatagat

SEQ ID NO: 176319 - DNA, 25 bp, Artificial sequence
  SiRNA target sequence
aaaattaatatacctgagatagatt

SEQ ID NO: 176320 - DNA, 25 bp, Artificial sequence
  SiRNA target sequence
aaattaatatacctgagatagatta

SEQ ID NO: 176321 - DNA, 25 bp, Artificial sequence
  SiRNA target sequence
aattaatatacctgagatagattat

SEQ ID NO: 176322 - DNA, 25 bp, Artificial sequence
  SiRNA target sequence
attaatatacctgagatagattata

SEQ ID NO: 176323 - DNA, 25 bp, Artificial sequence
  SiRNA target sequence
ttaatatacctgagatagattataa

SEQ ID NO: 176324 - DNA, 25 bp, Artificial sequence
  SiRNA target sequence
taatatacctgagatagattataaa

SEQ ID NO: 176325 - DNA, 25 bp, Artificial sequence
  SiRNA target sequence
aatatacctgagatagattataaat

SEQ ID NO: 176326 - DNA, 25 bp, Artificial sequence
  SiRNA target sequence
atatacctgagatagattataaata

SEQ ID NO: 176327 - DNA, 25 bp, Artificial sequence
  SiRNA target sequence
tatacctgagatagattataaatat

SEQ ID NO: 176328 - DNA, 25 bp, Artificial sequence
  SiRNA target sequence
atacctgagatagattataaatata

SEQ ID NO: 176329 - DNA, 25 bp, Artificial sequence
  SiRNA target sequence
tacctgagatagattataaatataa

SEQ ID NO: 176330 - DNA, 25 bp, Artificial sequence
  SiRNA target sequence
acctgagatagattataaatataaa

SEQ ID NO: 176331 - DNA, 25 bp, Artificial sequence
  SiRNA target sequence
cctgagatagattataaatataaaa

SEQ ID NO: 176332 - DNA, 25 bp, Artificial sequence
  SiRNA target sequence
ctgagatagattataaatataaaaa

SEQ ID NO: 176333 - DNA, 25 bp, Artificial sequence
  SiRNA target sequence
tgagatagattataaatataaaaat

SEQ ID NO: 176334 - DNA, 25 bp, Artificial sequence
  SiRNA target sequence
gagatagattataaatataaaaatg

SEQ ID NO: 176335 - DNA, 25 bp, Artificial sequence
  SiRNA target sequence
agatagattataaatataaaaatgg

SEQ ID NO: 176336 - DNA, 25 bp, Artificial sequence
  SiRNA target sequence
gatagattataaatataaaaatgga

SEQ ID NO: 176337 - DNA, 25 bp, Artificial sequence
  SiRNA target sequence
atagattataaatataaaaatggag

SEQ ID NO: 176338 - DNA, 25 bp, Artificial sequence
  SiRNA target sequence
tagattataaatataaaaatggagt

SEQ ID NO: 176339 - DNA, 25 bp, Artificial sequence
  SiRNA target sequence
agattataaatataaaaatggagtg

SEQ ID NO: 176340 - DNA, 25 bp, Artificial sequence
  SiRNA target sequence
gattataaatataaaaatggagtgt

SEQ ID NO: 176341 - DNA, 25 bp, Artificial sequence
  SiRNA target sequence
attataaatataaaaatggagtgtt

SEQ ID NO: 176342 - DNA, 25 bp, Artificial sequence
  SiRNA target sequence
ttataaatataaaaatggagtgttt

SEQ ID NO: 176343 - DNA, 25 bp, Artificial sequence
  SiRNA target sequence
tataaatataaaaatggagtgttta

SEQ ID NO: 176344 - DNA, 25 bp, Artificial sequence
  SiRNA target sequence
ataaatataaaaatggagtgtttac

SEQ ID NO: 176345 - DNA, 25 bp, Artificial sequence
  SiRNA target sequence
taaatataaaaatggagtgtttaca

SEQ ID NO: 176346 - DNA, 25 bp, Artificial sequence
  SiRNA target sequence
aaatataaaaatggagtgtttacat

SEQ ID NO: 176347 - DNA, 25 bp, Artificial sequence
  SiRNA target sequence
aatataaaaatggagtgtttacata

SEQ ID NO: 176348 - DNA, 25 bp, Artificial sequence
  SiRNA target sequence
atataaaaatggagtgtttacatat

SEQ ID NO: 176349 - DNA, 25 bp, Artificial sequence
  SiRNA target sequence
tataaaaatggagtgtttacatata

SEQ ID NO: 176350 - DNA, 25 bp, Artificial sequence
  SiRNA target sequence
ataaaaatggagtgtttacatatac

SEQ ID NO: 176351 - DNA, 25 bp, Artificial sequence
  SiRNA target sequence
taaaaatggagtgtttacatataca

SEQ ID NO: 176352 - DNA, 25 bp, Artificial sequence
  SiRNA target sequence
aaaaatggagtgtttacatatacac

SEQ ID NO: 176353 - DNA, 25 bp, Artificial sequence
  SiRNA target sequence
aaaatggagtgtttacatatacaca

SEQ ID NO: 176354 - DNA, 25 bp, Artificial sequence
  SiRNA target sequence
aaatggagtgtttacatatacacag

SEQ ID NO: 176355 - DNA, 25 bp, Artificial sequence
  SiRNA target sequence
aatggagtgtttacatatacacaga

SEQ ID NO: 176356 - DNA, 25 bp, Artificial sequence
  SiRNA target sequence
atggagtgtttacatatacacagat

SEQ ID NO: 176357 - DNA, 25 bp, Artificial sequence
  SiRNA target sequence
tggagtgtttacatatacacagatc

SEQ ID NO: 176358 - DNA, 25 bp, Artificial sequence
  SiRNA target sequence
ggagtgtttacatatacacagatca

SEQ ID NO: 176359 - DNA, 25 bp, Artificial sequence
  SiRNA target sequence
gagtgtttacatatacacagatcaa

SEQ ID NO: 176360 - DNA, 25 bp, Artificial sequence
  SiRNA target sequence
agtgtttacatatacacagatcaaa

SEQ ID NO: 176361 - DNA, 25 bp, Artificial sequence
  SiRNA target sequence
gtgtttacatatacacagatcaaaa

SEQ ID NO: 176362 - DNA, 25 bp, Artificial sequence
  SiRNA target sequence
tgtttacatatacacagatcaaaaa

SEQ ID NO: 176363 - DNA, 25 bp, Artificial sequence
  SiRNA target sequence
gtttacatatacacagatcaaaaat

SEQ ID NO: 176364 - DNA, 25 bp, Artificial sequence
  SiRNA target sequence
tttacatatacacagatcaaaaata

SEQ ID NO: 176365 - DNA, 25 bp, Artificial sequence
  SiRNA target sequence
ttacatatacacagatcaaaaataa

SEQ ID NO: 176366 - DNA, 25 bp, Artificial sequence
  SiRNA target sequence
tacatatacacagatcaaaaataat

SEQ ID NO: 176367 - DNA, 25 bp, Artificial sequence
  SiRNA target sequence
acatatacacagatcaaaaataata

SEQ ID NO: 176368 - DNA, 25 bp, Artificial sequence
  SiRNA target sequence
catatacacagatcaaaaataataa

SEQ ID NO: 176369 - DNA, 25 bp, Artificial sequence
  SiRNA target sequence
atatacacagatcaaaaataataag

SEQ ID NO: 176370 - DNA, 25 bp, Artificial sequence
  SiRNA target sequence
tatacacagatcaaaaataataaga

SEQ ID NO: 176371 - DNA, 25 bp, Artificial sequence
  SiRNA target sequence
atacacagatcaaaaataataagaa

SEQ ID NO: 176372 - DNA, 25 bp, Artificial sequence
  SiRNA target sequence
tacacagatcaaaaataataagaaa

SEQ ID NO: 176373 - DNA, 25 bp, Artificial sequence
  SiRNA target sequence
acacagatcaaaaataataagaaaa

SEQ ID NO: 176374 - DNA, 25 bp, Artificial sequence
  SiRNA target sequence
cacagatcaaaaataataagaaaaa

SEQ ID NO: 176375 - DNA, 25 bp, Artificial sequence
  SiRNA target sequence
acagatcaaaaataataagaaaaaa

SEQ ID NO: 176376 - DNA, 25 bp, Artificial sequence
  SiRNA target sequence
cagatcaaaaataataagaaaaaaa

SEQ ID NO: 176377 - DNA, 25 bp, Artificial sequence
  SiRNA target sequence
agatcaaaaataataagaaaaaaaa

SEQ ID NO: 176378 - DNA, 25 bp, Artificial sequence
  SiRNA target sequence
gatcaaaaataataagaaaaaaaaa

SEQ ID NO: 176379 - DNA, 25 bp, Artificial sequence
  SiRNA target sequence
atcaaaaataataagaaaaaaaaat

SEQ ID NO: 176380 - DNA, 25 bp, Artificial sequence
  SiRNA target sequence
tcaaaaataataagaaaaaaaaata

SEQ ID NO: 176381 - DNA, 25 bp, Artificial sequence
  SiRNA target sequence
caaaaataataagaaaaaaaaatat

SEQ ID NO: 176382 - DNA, 25 bp, Artificial sequence
  SiRNA target sequence
aaaaataataagaaaaaaaaatatt

SEQ ID NO: 176383 - DNA, 25 bp, Artificial sequence
  SiRNA target sequence
aaaataataagaaaaaaaaatattt

SEQ ID NO: 176384 - DNA, 25 bp, Artificial sequence
  SiRNA target sequence
aaataataagaaaaaaaaatattta

SEQ ID NO: 176385 - DNA, 25 bp, Artificial sequence
  SiRNA target sequence
aataataagaaaaaaaaatatttaa

SEQ ID NO: 176386 - DNA, 25 bp, Artificial sequence
  SiRNA target sequence
ataataagaaaaaaaaatatttaag

SEQ ID NO: 176387 - DNA, 25 bp, Artificial sequence
  SiRNA target sequence
taataagaaaaaaaaatatttaaga

SEQ ID NO: 176388 - DNA, 25 bp, Artificial sequence
  SiRNA target sequence
aataagaaaaaaaaatatttaagaa

SEQ ID NO: 176389 - DNA, 25 bp, Artificial sequence
  SiRNA target sequence
ataagaaaaaaaaatatttaagaat

SEQ ID NO: 176390 - DNA, 25 bp, Artificial sequence
  SiRNA target sequence
taagaaaaaaaaatatttaagaata

SEQ ID NO: 176391 - DNA, 25 bp, Artificial sequence
  SiRNA target sequence
aagaaaaaaaaatatttaagaatat

SEQ ID NO: 176392 - DNA, 25 bp, Artificial sequence
  SiRNA target sequence
agaaaaaaaaatatttaagaatatt

SEQ ID NO: 176393 - DNA, 25 bp, Artificial sequence
  SiRNA target sequence
gaaaaaaaaatatttaagaatattg

SEQ ID NO: 176394 - DNA, 25 bp, Artificial sequence
  SiRNA target sequence
aaaaaaaaatatttaagaatattgg

SEQ ID NO: 176395 - DNA, 25 bp, Artificial sequence
  SiRNA target sequence
aaaaaaaatatttaagaatattggg

SEQ ID NO: 176396 - DNA, 25 bp, Artificial sequence
  SiRNA target sequence
aaaaaaatatttaagaatattgggt

SEQ ID NO: 176397 - DNA, 25 bp, Artificial sequence
  SiRNA target sequence
aaaaaatatttaagaatattgggtc

SEQ ID NO: 176398 - DNA, 25 bp, Artificial sequence
  SiRNA target sequence
aaaaatatttaagaatattgggtct

SEQ ID NO: 176399 - DNA, 25 bp, Artificial sequence
  SiRNA target sequence
aaaatatttaagaatattgggtcta

SEQ ID NO: 176400 - DNA, 25 bp, Artificial sequence
  SiRNA target sequence
aaatatttaagaatattgggtctag

SEQ ID NO: 176401 - DNA, 25 bp, Artificial sequence
  SiRNA target sequence
aatatttaagaatattgggtctaga

SEQ ID NO: 176402 - DNA, 25 bp, Artificial sequence
  SiRNA target sequence
atatttaagaatattgggtctagaa

SEQ ID NO: 176403 - DNA, 25 bp, Artificial sequence
  SiRNA target sequence
tatttaagaatattgggtctagaac

SEQ ID NO: 176404 - DNA, 25 bp, Artificial sequence
  SiRNA target sequence
atttaagaatattgggtctagaacc

SEQ ID NO: 176405 - DNA, 25 bp, Artificial sequence
  SiRNA target sequence
tttaagaatattgggtctagaacct

SEQ ID NO: 176406 - DNA, 25 bp, Artificial sequence
  SiRNA target sequence
ttaagaatattgggtctagaacctt

SEQ ID NO: 176407 - DNA, 25 bp, Artificial sequence
  SiRNA target sequence
taagaatattgggtctagaaccttt

SEQ ID NO: 176408 - DNA, 25 bp, Artificial sequence
  SiRNA target sequence
aagaatattgggtctagaacctttt

SEQ ID NO: 176409 - DNA, 25 bp, Artificial sequence
  SiRNA target sequence
agaatattgggtctagaaccttttc

SEQ ID NO: 176410 - DNA, 25 bp, Artificial sequence
  SiRNA target sequence
gaatattgggtctagaaccttttct

SEQ ID NO: 176411 - DNA, 25 bp, Artificial sequence
  SiRNA target sequence
aatattgggtctagaaccttttctt

SEQ ID NO: 176412 - DNA, 25 bp, Artificial sequence
  SiRNA target sequence
atattgggtctagaaccttttctta

SEQ ID NO: 176413 - DNA, 25 bp, Artificial sequence
  SiRNA target sequence
tattgggtctagaaccttttcttaa

SEQ ID NO: 176414 - DNA, 25 bp, Artificial sequence
  SiRNA target sequence
attgggtctagaaccttttcttaat

SEQ ID NO: 176415 - DNA, 25 bp, Artificial sequence
  SiRNA target sequence
ttgggtctagaaccttttcttaatt

SEQ ID NO: 176416 - DNA, 25 bp, Artificial sequence
  SiRNA target sequence
tgggtctagaaccttttcttaattt

SEQ ID NO: 176417 - DNA, 25 bp, Artificial sequence
  SiRNA target sequence
gggtctagaaccttttcttaatttt

SEQ ID NO: 176418 - DNA, 25 bp, Artificial sequence
  SiRNA target sequence
ggtctagaaccttttcttaatttta

SEQ ID NO: 176419 - DNA, 25 bp, Artificial sequence
  SiRNA target sequence
gtctagaaccttttcttaattttat

SEQ ID NO: 176420 - DNA, 25 bp, Artificial sequence
  SiRNA target sequence
tctagaaccttttcttaattttatt

SEQ ID NO: 176421 - DNA, 25 bp, Artificial sequence
  SiRNA target sequence
ctagaaccttttcttaattttatta

SEQ ID NO: 176422 - DNA, 25 bp, Artificial sequence
  SiRNA target sequence
tagaaccttttcttaattttattaa

SEQ ID NO: 176423 - DNA, 25 bp, Artificial sequence
  SiRNA target sequence
agaaccttttcttaattttattaag

SEQ ID NO: 176424 - DNA, 25 bp, Artificial sequence
  SiRNA target sequence
gaaccttttcttaattttattaagg

SEQ ID NO: 176425 - DNA, 25 bp, Artificial sequence
  SiRNA target sequence
aaccttttcttaattttattaagga

SEQ ID NO: 176426 - DNA, 25 bp, Artificial sequence
  SiRNA target sequence
accttttcttaattttattaaggaa

SEQ ID NO: 176427 - DNA, 25 bp, Artificial sequence
  SiRNA target sequence
ccttttcttaattttattaaggaaa

SEQ ID NO: 176428 - DNA, 25 bp, Artificial sequence
  SiRNA target sequence
cttttcttaattttattaaggaaag

SEQ ID NO: 176429 - DNA, 25 bp, Artificial sequence
  SiRNA target sequence
ttttcttaattttattaaggaaagt

SEQ ID NO: 176430 - DNA, 25 bp, Artificial sequence
  SiRNA target sequence
tttcttaattttattaaggaaagta

SEQ ID NO: 176431 - DNA, 25 bp, Artificial sequence
  SiRNA target sequence
ttcttaattttattaaggaaagtaa

SEQ ID NO: 176432 - DNA, 25 bp, Artificial sequence
  SiRNA target sequence
tcttaattttattaaggaaagtaaa

SEQ ID NO: 176433 - DNA, 25 bp, Artificial sequence
  SiRNA target sequence
cttaattttattaaggaaagtaaac

SEQ ID NO: 176434 - DNA, 25 bp, Artificial sequence
  SiRNA target sequence
ttaattttattaaggaaagtaaaca

SEQ ID NO: 176435 - DNA, 25 bp, Artificial sequence
  SiRNA target sequence
taattttattaaggaaagtaaacat

SEQ ID NO: 176436 - DNA, 25 bp, Artificial sequence
  SiRNA target sequence
aattttattaaggaaagtaaacata

SEQ ID NO: 176437 - DNA, 25 bp, Artificial sequence
  SiRNA target sequence
attttattaaggaaagtaaacataa

SEQ ID NO: 176438 - DNA, 25 bp, Artificial sequence
  SiRNA target sequence
ttttattaaggaaagtaaacataaa

SEQ ID NO: 176439 - DNA, 25 bp, Artificial sequence
  SiRNA target sequence
tttattaaggaaagtaaacataaag

SEQ ID NO: 176440 - DNA, 25 bp, Artificial sequence
  SiRNA target sequence
ttattaaggaaagtaaacataaaga

SEQ ID NO: 176441 - DNA, 25 bp, Artificial sequence
  SiRNA target sequence
tattaaggaaagtaaacataaagaa

SEQ ID NO: 176442 - DNA, 25 bp, Artificial sequence
  SiRNA target sequence
attaaggaaagtaaacataaagaat

SEQ ID NO: 176443 - DNA, 25 bp, Artificial sequence
  SiRNA target sequence
ttaaggaaagtaaacataaagaatt

SEQ ID NO: 176444 - DNA, 25 bp, Artificial sequence
  SiRNA target sequence
taaggaaagtaaacataaagaatta

SEQ ID NO: 176445 - DNA, 25 bp, Artificial sequence
  SiRNA target sequence
aaggaaagtaaacataaagaattag

SEQ ID NO: 176446 - DNA, 25 bp, Artificial sequence
  SiRNA target sequence
aggaaagtaaacataaagaattaga

SEQ ID NO: 176447 - DNA, 25 bp, Artificial sequence
  SiRNA target sequence
ggaaagtaaacataaagaattagaa

SEQ ID NO: 176448 - DNA, 25 bp, Artificial sequence
  SiRNA target sequence
gaaagtaaacataaagaattagaat

SEQ ID NO: 176449 - DNA, 25 bp, Artificial sequence
  SiRNA target sequence
aaagtaaacataaagaattagaata

SEQ ID NO: 176450 - DNA, 25 bp, Artificial sequence
  SiRNA target sequence
aagtaaacataaagaattagaatat

SEQ ID NO: 176451 - DNA, 25 bp, Artificial sequence
  SiRNA target sequence
agtaaacataaagaattagaatatg

SEQ ID NO: 176452 - DNA, 25 bp, Artificial sequence
  SiRNA target sequence
gtaaacataaagaattagaatatga

SEQ ID NO: 176453 - DNA, 25 bp, Artificial sequence
  SiRNA target sequence
taaacataaagaattagaatatgat

SEQ ID NO: 176454 - DNA, 25 bp, Artificial sequence
  SiRNA target sequence
aaacataaagaattagaatatgatg

SEQ ID NO: 176455 - DNA, 25 bp, Artificial sequence
  SiRNA target sequence
aacataaagaattagaatatgatgt

SEQ ID NO: 176456 - DNA, 25 bp, Artificial sequence
  SiRNA target sequence
acataaagaattagaatatgatgta

SEQ ID NO: 176457 - DNA, 25 bp, Artificial sequence
  SiRNA target sequence
cataaagaattagaatatgatgtat

SEQ ID NO: 176458 - DNA, 25 bp, Artificial sequence
  SiRNA target sequence
ataaagaattagaatatgatgtatg

SEQ ID NO: 176459 - DNA, 25 bp, Artificial sequence
  SiRNA target sequence
taaagaattagaatatgatgtatgc

SEQ ID NO: 176460 - DNA, 25 bp, Artificial sequence
  SiRNA target sequence
aaagaattagaatatgatgtatgcg

SEQ ID NO: 176461 - DNA, 25 bp, Artificial sequence
  SiRNA target sequence
aagaattagaatatgatgtatgcga

SEQ ID NO: 176462 - DNA, 25 bp, Artificial sequence
  SiRNA target sequence
agaattagaatatgatgtatgcgaa

SEQ ID NO: 176463 - DNA, 25 bp, Artificial sequence
  SiRNA target sequence
gaattagaatatgatgtatgcgaaa

SEQ ID NO: 176464 - DNA, 25 bp, Artificial sequence
  SiRNA target sequence
aattagaatatgatgtatgcgaaat

SEQ ID NO: 176465 - DNA, 25 bp, Artificial sequence
  SiRNA target sequence
attagaatatgatgtatgcgaaata

SEQ ID NO: 176466 - DNA, 25 bp, Artificial sequence
  SiRNA target sequence
ttagaatatgatgtatgcgaaatat

SEQ ID NO: 176467 - DNA, 25 bp, Artificial sequence
  SiRNA target sequence
tagaatatgatgtatgcgaaatata

SEQ ID NO: 176468 - DNA, 25 bp, Artificial sequence
  SiRNA target sequence
agaatatgatgtatgcgaaatatac

SEQ ID NO: 176469 - DNA, 25 bp, Artificial sequence
  SiRNA target sequence
gaatatgatgtatgcgaaatataca

SEQ ID NO: 176470 - DNA, 25 bp, Artificial sequence
  SiRNA target sequence
aatatgatgtatgcgaaatatacat

SEQ ID NO: 176471 - DNA, 25 bp, Artificial sequence
  SiRNA target sequence
atatgatgtatgcgaaatatacatt

SEQ ID NO: 176472 - DNA, 25 bp, Artificial sequence
  SiRNA target sequence
tatgatgtatgcgaaatatacattt

SEQ ID NO: 176473 - DNA, 25 bp, Artificial sequence
  SiRNA target sequence
atgatgtatgcgaaatatacatttg

SEQ ID NO: 176474 - DNA, 25 bp, Artificial sequence
  SiRNA target sequence
tgatgtatgcgaaatatacatttgt

SEQ ID NO: 176475 - DNA, 25 bp, Artificial sequence
  SiRNA target sequence
gatgtatgcgaaatatacatttgta

SEQ ID NO: 176476 - DNA, 25 bp, Artificial sequence
  SiRNA target sequence
atgtatgcgaaatatacatttgtaa

SEQ ID NO: 176477 - DNA, 25 bp, Artificial sequence
  SiRNA target sequence
tgtatgcgaaatatacatttgtaat

SEQ ID NO: 176478 - DNA, 25 bp, Artificial sequence
  SiRNA target sequence
gtatgcgaaatatacatttgtaatc

SEQ ID NO: 176479 - DNA, 25 bp, Artificial sequence
  SiRNA target sequence
tatgcgaaatatacatttgtaatca

SEQ ID NO: 176480 - DNA, 25 bp, Artificial sequence
  SiRNA target sequence
atgcgaaatatacatttgtaatcag

SEQ ID NO: 176481 - DNA, 25 bp, Artificial sequence
  SiRNA target sequence
tgcgaaatatacatttgtaatcagg

SEQ ID NO: 176482 - DNA, 25 bp, Artificial sequence
  SiRNA target sequence
gcgaaatatacatttgtaatcaggg

SEQ ID NO: 176483 - DNA, 25 bp, Artificial sequence
  SiRNA target sequence
cgaaatatacatttgtaatcaggga

SEQ ID NO: 176484 - DNA, 25 bp, Artificial sequence
  SiRNA target sequence
gaaatatacatttgtaatcagggat

SEQ ID NO: 176485 - DNA, 25 bp, Artificial sequence
  SiRNA target sequence
aaatatacatttgtaatcagggatg

SEQ ID NO: 176486 - DNA, 25 bp, Artificial sequence
  SiRNA target sequence
aatatacatttgtaatcagggatgc

SEQ ID NO: 176487 - DNA, 25 bp, Artificial sequence
  SiRNA target sequence
atatacatttgtaatcagggatgca

SEQ ID NO: 176488 - DNA, 25 bp, Artificial sequence
  SiRNA target sequence
tatacatttgtaatcagggatgcat

SEQ ID NO: 176489 - DNA, 25 bp, Artificial sequence
  SiRNA target sequence
atacatttgtaatcagggatgcatt

SEQ ID NO: 176490 - DNA, 25 bp, Artificial sequence
  SiRNA target sequence
tacatttgtaatcagggatgcatta

SEQ ID NO: 176491 - DNA, 25 bp, Artificial sequence
  SiRNA target sequence
acatttgtaatcagggatgcattaa

SEQ ID NO: 176492 - DNA, 25 bp, Artificial sequence
  SiRNA target sequence
catttgtaatcagggatgcattaat

SEQ ID NO: 176493 - DNA, 25 bp, Artificial sequence
  SiRNA target sequence
atttgtaatcagggatgcattaatg

SEQ ID NO: 176494 - DNA, 25 bp, Artificial sequence
  SiRNA target sequence
tttgtaatcagggatgcattaatgg

SEQ ID NO: 176495 - DNA, 25 bp, Artificial sequence
  SiRNA target sequence
ttgtaatcagggatgcattaatgga

SEQ ID NO: 176496 - DNA, 25 bp, Artificial sequence
  SiRNA target sequence
tgtaatcagggatgcattaatggac

SEQ ID NO: 176497 - DNA, 25 bp, Artificial sequence
  SiRNA target sequence
gtaatcagggatgcattaatggacc

SEQ ID NO: 176498 - DNA, 25 bp, Artificial sequence
  SiRNA target sequence
taatcagggatgcattaatggacca

SEQ ID NO: 176499 - DNA, 25 bp, Artificial sequence
  SiRNA target sequence
aatcagggatgcattaatggaccag

SEQ ID NO: 176500 - DNA, 25 bp, Artificial sequence
  SiRNA target sequence
atcagggatgcattaatggaccagg

SEQ ID NO: 176501 - DNA, 25 bp, Artificial sequence
  SiRNA target sequence
tcagggatgcattaatggaccagga

SEQ ID NO: 176502 - DNA, 25 bp, Artificial sequence
  SiRNA target sequence
cagggatgcattaatggaccaggac

SEQ ID NO: 176503 - DNA, 25 bp, Artificial sequence
  SiRNA target sequence
agggatgcattaatggaccaggaca

SEQ ID NO: 176504 - DNA, 25 bp, Artificial sequence
  SiRNA target sequence
gggatgcattaatggaccaggacaa

SEQ ID NO: 176505 - DNA, 25 bp, Artificial sequence
  SiRNA target sequence
ggatgcattaatggaccaggacaat

SEQ ID NO: 176506 - DNA, 25 bp, Artificial sequence
  SiRNA target sequence
gatgcattaatggaccaggacaatt

SEQ ID NO: 176507 - DNA, 25 bp, Artificial sequence
  SiRNA target sequence
atgcattaatggaccaggacaattg

SEQ ID NO: 176508 - DNA, 25 bp, Artificial sequence
  SiRNA target sequence
tgcattaatggaccaggacaattgt

SEQ ID NO: 176509 - DNA, 25 bp, Artificial sequence
  SiRNA target sequence
gcattaatggaccaggacaattgta

SEQ ID NO: 176510 - DNA, 25 bp, Artificial sequence
  SiRNA target sequence
cattaatggaccaggacaattgtat

SEQ ID NO: 176511 - DNA, 25 bp, Artificial sequence
  SiRNA target sequence
attaatggaccaggacaattgtata

SEQ ID NO: 176512 - DNA, 25 bp, Artificial sequence
  SiRNA target sequence
ttaatggaccaggacaattgtatac

SEQ ID NO: 176513 - DNA, 25 bp, Artificial sequence
  SiRNA target sequence
taatggaccaggacaattgtataca

SEQ ID NO: 176514 - DNA, 25 bp, Artificial sequence
  SiRNA target sequence
aatggaccaggacaattgtatacag

SEQ ID NO: 176515 - DNA, 25 bp, Artificial sequence
  SiRNA target sequence
atggaccaggacaattgtatacaga

SEQ ID NO: 176516 - DNA, 25 bp, Artificial sequence
  SiRNA target sequence
tggaccaggacaattgtatacagat

SEQ ID NO: 176517 - DNA, 25 bp, Artificial sequence
  SiRNA target sequence
ggaccaggacaattgtatacagata

SEQ ID NO: 176518 - DNA, 25 bp, Artificial sequence
  SiRNA target sequence
gaccaggacaattgtatacagataa

SEQ ID NO: 176519 - DNA, 25 bp, Artificial sequence
  SiRNA target sequence
accaggacaattgtatacagataat

SEQ ID NO: 176520 - DNA, 25 bp, Artificial sequence
  SiRNA target sequence
ccaggacaattgtatacagataatt

SEQ ID NO: 176521 - DNA, 25 bp, Artificial sequence
  SiRNA target sequence
caggacaattgtatacagataattt

SEQ ID NO: 176522 - DNA, 25 bp, Artificial sequence
  SiRNA target sequence
aggacaattgtatacagataattta

SEQ ID NO: 176523 - DNA, 25 bp, Artificial sequence
  SiRNA target sequence
ggacaattgtatacagataatttat

SEQ ID NO: 176524 - DNA, 25 bp, Artificial sequence
  SiRNA target sequence
gacaattgtatacagataatttata

SEQ ID NO: 176525 - DNA, 25 bp, Artificial sequence
  SiRNA target sequence
acaattgtatacagataatttatat

SEQ ID NO: 176526 - DNA, 25 bp, Artificial sequence
  SiRNA target sequence
caattgtatacagataatttatatg

SEQ ID NO: 176527 - DNA, 25 bp, Artificial sequence
  SiRNA target sequence
aattgtatacagataatttatatgt

SEQ ID NO: 176528 - DNA, 25 bp, Artificial sequence
  SiRNA target sequence
attgtatacagataatttatatgta

SEQ ID NO: 176529 - DNA, 25 bp, Artificial sequence
  SiRNA target sequence
ttgtatacagataatttatatgtaa

SEQ ID NO: 176530 - DNA, 25 bp, Artificial sequence
  SiRNA target sequence
tgtatacagataatttatatgtaaa

SEQ ID NO: 176531 - DNA, 25 bp, Artificial sequence
  SiRNA target sequence
gtatacagataatttatatgtaaat

SEQ ID NO: 176532 - DNA, 25 bp, Artificial sequence
  SiRNA target sequence
tatacagataatttatatgtaaata

SEQ ID NO: 176533 - DNA, 25 bp, Artificial sequence
  SiRNA target sequence
atacagataatttatatgtaaataa

SEQ ID NO: 176534 - DNA, 25 bp, Artificial sequence
  SiRNA target sequence
tacagataatttatatgtaaataat

SEQ ID NO: 176535 - DNA, 25 bp, Artificial sequence
  SiRNA target sequence
acagataatttatatgtaaataatt

SEQ ID NO: 176536 - DNA, 25 bp, Artificial sequence
  SiRNA target sequence
cagataatttatatgtaaataattc

SEQ ID NO: 176537 - DNA, 25 bp, Artificial sequence
  SiRNA target sequence
agataatttatatgtaaataattca

SEQ ID NO: 176538 - DNA, 25 bp, Artificial sequence
  SiRNA target sequence
gataatttatatgtaaataattcag

SEQ ID NO: 176539 - DNA, 25 bp, Artificial sequence
  SiRNA target sequence
ataatttatatgtaaataattcaga

SEQ ID NO: 176540 - DNA, 25 bp, Artificial sequence
  SiRNA target sequence
taatttatatgtaaataattcagaa

SEQ ID NO: 176541 - DNA, 25 bp, Artificial sequence
  SiRNA target sequence
aatttatatgtaaataattcagaat

SEQ ID NO: 176542 - DNA, 25 bp, Artificial sequence
  SiRNA target sequence
atttatatgtaaataattcagaata

SEQ ID NO: 176543 - DNA, 25 bp, Artificial sequence
  SiRNA target sequence
tttatatgtaaataattcagaatac

SEQ ID NO: 176544 - DNA, 25 bp, Artificial sequence
  SiRNA target sequence
ttatatgtaaataattcagaataca

SEQ ID NO: 176545 - DNA, 25 bp, Artificial sequence
  SiRNA target sequence
tatatgtaaataattcagaatacat

SEQ ID NO: 176546 - DNA, 25 bp, Artificial sequence
  SiRNA target sequence
atatgtaaataattcagaatacata

SEQ ID NO: 176547 - DNA, 25 bp, Artificial sequence
  SiRNA target sequence
tatgtaaataattcagaatacatag

SEQ ID NO: 176548 - DNA, 25 bp, Artificial sequence
  SiRNA target sequence
atgtaaataattcagaatacataga

SEQ ID NO: 176549 - DNA, 25 bp, Artificial sequence
  SiRNA target sequence
tgtaaataattcagaatacatagat

SEQ ID NO: 176550 - DNA, 25 bp, Artificial sequence
  SiRNA target sequence
gtaaataattcagaatacatagata

SEQ ID NO: 176551 - DNA, 25 bp, Artificial sequence
  SiRNA target sequence
taaataattcagaatacatagatat

SEQ ID NO: 176552 - DNA, 25 bp, Artificial sequence
  SiRNA target sequence
aaataattcagaatacatagatatt

SEQ ID NO: 176553 - DNA, 25 bp, Artificial sequence
  SiRNA target sequence
aataattcagaatacatagatattg

SEQ ID NO: 176554 - DNA, 25 bp, Artificial sequence
  SiRNA target sequence
ataattcagaatacatagatattga

SEQ ID NO: 176555 - DNA, 25 bp, Artificial sequence
  SiRNA target sequence
taattcagaatacatagatattgat

SEQ ID NO: 176556 - DNA, 25 bp, Artificial sequence
  SiRNA target sequence
aattcagaatacatagatattgatc

SEQ ID NO: 176557 - DNA, 25 bp, Artificial sequence
  SiRNA target sequence
attcagaatacatagatattgatct

SEQ ID NO: 176558 - DNA, 25 bp, Artificial sequence
  SiRNA target sequence
ttcagaatacatagatattgatctt

SEQ ID NO: 176559 - DNA, 25 bp, Artificial sequence
  SiRNA target sequence
tcagaatacatagatattgatcttg

SEQ ID NO: 176560 - DNA, 25 bp, Artificial sequence
  SiRNA target sequence
cagaatacatagatattgatcttgg

SEQ ID NO: 176561 - DNA, 25 bp, Artificial sequence
  SiRNA target sequence
agaatacatagatattgatcttggt

SEQ ID NO: 176562 - DNA, 25 bp, Artificial sequence
  SiRNA target sequence
gaatacatagatattgatcttggta

SEQ ID NO: 176563 - DNA, 25 bp, Artificial sequence
  SiRNA target sequence
aatacatagatattgatcttggtat

SEQ ID NO: 176564 - DNA, 25 bp, Artificial sequence
  SiRNA target sequence
atacatagatattgatcttggtatt

SEQ ID NO: 176565 - DNA, 25 bp, Artificial sequence
  SiRNA target sequence
tacatagatattgatcttggtattg

SEQ ID NO: 176566 - DNA, 25 bp, Artificial sequence
  SiRNA target sequence
acatagatattgatcttggtattga

SEQ ID NO: 176567 - DNA, 25 bp, Artificial sequence
  SiRNA target sequence
catagatattgatcttggtattgat

SEQ ID NO: 176568 - DNA, 25 bp, Artificial sequence
  SiRNA target sequence
atagatattgatcttggtattgatt

SEQ ID NO: 176569 - DNA, 25 bp, Artificial sequence
  SiRNA target sequence
tagatattgatcttggtattgattg

SEQ ID NO: 176570 - DNA, 25 bp, Artificial sequence
  SiRNA target sequence
agatattgatcttggtattgattgt

SEQ ID NO: 176571 - DNA, 25 bp, Artificial sequence
  SiRNA target sequence
gatattgatcttggtattgattgta

SEQ ID NO: 176572 - DNA, 25 bp, Artificial sequence
  SiRNA target sequence
atattgatcttggtattgattgtaa

SEQ ID NO: 176573 - DNA, 25 bp, Artificial sequence
  SiRNA target sequence
tattgatcttggtattgattgtaaa

SEQ ID NO: 176574 - DNA, 25 bp, Artificial sequence
  SiRNA target sequence
attgatcttggtattgattgtaaac

SEQ ID NO: 176575 - DNA, 25 bp, Artificial sequence
  SiRNA target sequence
ttgatcttggtattgattgtaaaca

SEQ ID NO: 176576 - DNA, 25 bp, Artificial sequence
  SiRNA target sequence
tgatcttggtattgattgtaaacag

SEQ ID NO: 176577 - DNA, 25 bp, Artificial sequence
  SiRNA target sequence
gatcttggtattgattgtaaacagt

SEQ ID NO: 176578 - DNA, 25 bp, Artificial sequence
  SiRNA target sequence
atcttggtattgattgtaaacagtt

SEQ ID NO: 176579 - DNA, 25 bp, Artificial sequence
  SiRNA target sequence
tcttggtattgattgtaaacagtta

SEQ ID NO: 176580 - DNA, 25 bp, Artificial sequence
  SiRNA target sequence
cttggtattgattgtaaacagttac

SEQ ID NO: 176581 - DNA, 25 bp, Artificial sequence
  SiRNA target sequence
ttggtattgattgtaaacagttaca

SEQ ID NO: 176582 - DNA, 25 bp, Artificial sequence
  SiRNA target sequence
tggtattgattgtaaacagttacaa

SEQ ID NO: 176583 - DNA, 25 bp, Artificial sequence
  SiRNA target sequence
ggtattgattgtaaacagttacaaa

SEQ ID NO: 176584 - DNA, 25 bp, Artificial sequence
  SiRNA target sequence
gtattgattgtaaacagttacaaaa

SEQ ID NO: 176585 - DNA, 25 bp, Artificial sequence
  SiRNA target sequence
tattgattgtaaacagttacaaaaa

SEQ ID NO: 176586 - DNA, 25 bp, Artificial sequence
  SiRNA target sequence
attgattgtaaacagttacaaaaaa

SEQ ID NO: 176587 - DNA, 25 bp, Artificial sequence
  SiRNA target sequence
ttgattgtaaacagttacaaaaaag

SEQ ID NO: 176588 - DNA, 25 bp, Artificial sequence
  SiRNA target sequence
tgattgtaaacagttacaaaaaagg

SEQ ID NO: 176589 - DNA, 25 bp, Artificial sequence
  SiRNA target sequence
gattgtaaacagttacaaaaaagga

SEQ ID NO: 176590 - DNA, 25 bp, Artificial sequence
  SiRNA target sequence
attgtaaacagttacaaaaaaggac

SEQ ID NO: 176591 - DNA, 25 bp, Artificial sequence
  SiRNA target sequence
ttgtaaacagttacaaaaaaggaca

SEQ ID NO: 176592 - DNA, 25 bp, Artificial sequence
  SiRNA target sequence
tgtaaacagttacaaaaaaggacat

SEQ ID NO: 176593 - DNA, 25 bp, Artificial sequence
  SiRNA target sequence
gtaaacagttacaaaaaaggacata

SEQ ID NO: 176594 - DNA, 25 bp, Artificial sequence
  SiRNA target sequence
taaacagttacaaaaaaggacatat

SEQ ID NO: 176595 - DNA, 25 bp, Artificial sequence
  SiRNA target sequence
aaacagttacaaaaaaggacatata

SEQ ID NO: 176596 - DNA, 25 bp, Artificial sequence
  SiRNA target sequence
aacagttacaaaaaaggacatatag

SEQ ID NO: 176597 - DNA, 25 bp, Artificial sequence
  SiRNA target sequence
acagttacaaaaaaggacatataga

SEQ ID NO: 176598 - DNA, 25 bp, Artificial sequence
  SiRNA target sequence
cagttacaaaaaaggacatatagaa

SEQ ID NO: 176599 - DNA, 25 bp, Artificial sequence
  SiRNA target sequence
agttacaaaaaaggacatatagaaa

SEQ ID NO: 176600 - DNA, 25 bp, Artificial sequence
  SiRNA target sequence
gttacaaaaaaggacatatagaaaa

SEQ ID NO: 176601 - DNA, 25 bp, Artificial sequence
  SiRNA target sequence
ttacaaaaaaggacatatagaaaaa

SEQ ID NO: 176602 - DNA, 25 bp, Artificial sequence
  SiRNA target sequence
tacaaaaaaggacatatagaaaaat

SEQ ID NO: 176603 - DNA, 25 bp, Artificial sequence
  SiRNA target sequence
acaaaaaaggacatatagaaaaata

SEQ ID NO: 176604 - DNA, 25 bp, Artificial sequence
  SiRNA target sequence
caaaaaaggacatatagaaaaatag

SEQ ID NO: 176605 - DNA, 25 bp, Artificial sequence
  SiRNA target sequence
aaaaaaggacatatagaaaaataga

SEQ ID NO: 176606 - DNA, 25 bp, Artificial sequence
  SiRNA target sequence
aaaaaggacatatagaaaaatagaa

SEQ ID NO: 176607 - DNA, 25 bp, Artificial sequence
  SiRNA target sequence
aaaaggacatatagaaaaatagaaa

SEQ ID NO: 176608 - DNA, 25 bp, Artificial sequence
  SiRNA target sequence
aaaggacatatagaaaaatagaaac

SEQ ID NO: 176609 - DNA, 25 bp, Artificial sequence
  SiRNA target sequence
aaggacatatagaaaaatagaaaca

SEQ ID NO: 176610 - DNA, 25 bp, Artificial sequence
  SiRNA target sequence
aggacatatagaaaaatagaaacaa

SEQ ID NO: 176611 - DNA, 25 bp, Artificial sequence
  SiRNA target sequence
ggacatatagaaaaatagaaacaaa

SEQ ID NO: 176612 - DNA, 25 bp, Artificial sequence
  SiRNA target sequence
gacatatagaaaaatagaaacaaag

SEQ ID NO: 176613 - DNA, 25 bp, Artificial sequence
  SiRNA target sequence
acatatagaaaaatagaaacaaaga

SEQ ID NO: 176614 - DNA, 25 bp, Artificial sequence
  SiRNA target sequence
catatagaaaaatagaaacaaagaa

SEQ ID NO: 176615 - DNA, 25 bp, Artificial sequence
  SiRNA target sequence
atatagaaaaatagaaacaaagaaa

SEQ ID NO: 176616 - DNA, 25 bp, Artificial sequence
  SiRNA target sequence
tatagaaaaatagaaacaaagaaag

SEQ ID NO: 176617 - DNA, 25 bp, Artificial sequence
  SiRNA target sequence
atagaaaaatagaaacaaagaaagt

SEQ ID NO: 176618 - DNA, 25 bp, Artificial sequence
  SiRNA target sequence
tagaaaaatagaaacaaagaaagtt

SEQ ID NO: 176619 - DNA, 25 bp, Artificial sequence
  SiRNA target sequence
agaaaaatagaaacaaagaaagtta

SEQ ID NO: 176620 - DNA, 25 bp, Artificial sequence
  SiRNA target sequence
gaaaaatagaaacaaagaaagttaa

SEQ ID NO: 176621 - DNA, 25 bp, Artificial sequence
  SiRNA target sequence
aaaaatagaaacaaagaaagttaat

SEQ ID NO: 176622 - DNA, 25 bp, Artificial sequence
  SiRNA target sequence
aaaatagaaacaaagaaagttaatt

SEQ ID NO: 176623 - DNA, 25 bp, Artificial sequence
  SiRNA target sequence
aaatagaaacaaagaaagttaattt

SEQ ID NO: 176624 - DNA, 25 bp, Artificial sequence
  SiRNA target sequence
aatagaaacaaagaaagttaatttt

SEQ ID NO: 176625 - DNA, 25 bp, Artificial sequence
  SiRNA target sequence
atagaaacaaagaaagttaatttta

SEQ ID NO: 176626 - DNA, 25 bp, Artificial sequence
  SiRNA target sequence
tagaaacaaagaaagttaattttaa

SEQ ID NO: 176627 - DNA, 25 bp, Artificial sequence
  SiRNA target sequence
agaaacaaagaaagttaattttaaa

SEQ ID NO: 176628 - DNA, 25 bp, Artificial sequence
  SiRNA target sequence
gaaacaaagaaagttaattttaaaa

SEQ ID NO: 176629 - DNA, 25 bp, Artificial sequence
  SiRNA target sequence
aaacaaagaaagttaattttaaaat

SEQ ID NO: 176630 - DNA, 25 bp, Artificial sequence
  SiRNA target sequence
aacaaagaaagttaattttaaaata

SEQ ID NO: 176631 - DNA, 25 bp, Artificial sequence
  SiRNA target sequence
acaaagaaagttaattttaaaatag

SEQ ID NO: 176632 - DNA, 25 bp, Artificial sequence
  SiRNA target sequence
caaagaaagttaattttaaaataga

SEQ ID NO: 176633 - DNA, 25 bp, Artificial sequence
  SiRNA target sequence
aaagaaagttaattttaaaatagaa

SEQ ID NO: 176634 - DNA, 25 bp, Artificial sequence
  SiRNA target sequence
aagaaagttaattttaaaatagaat

SEQ ID NO: 176635 - DNA, 25 bp, Artificial sequence
  SiRNA target sequence
agaaagttaattttaaaatagaatg

SEQ ID NO: 176636 - DNA, 25 bp, Artificial sequence
  SiRNA target sequence
gaaagttaattttaaaatagaatgg

SEQ ID NO: 176637 - DNA, 25 bp, Artificial sequence
  SiRNA target sequence
aaagttaattttaaaatagaatggt

SEQ ID NO: 176638 - DNA, 25 bp, Artificial sequence
  SiRNA target sequence
aagttaattttaaaatagaatggta

SEQ ID NO: 176639 - DNA, 25 bp, Artificial sequence
  SiRNA target sequence
agttaattttaaaatagaatggtaa

SEQ ID NO: 176640 - DNA, 26 bp, Artificial sequence
  SiRNA target sequence
atgaatactgaaaataaaccatgtat

SEQ ID NO: 176641 - DNA, 26 bp, Artificial sequence
  SiRNA target sequence
tgaatactgaaaataaaccatgtatt

SEQ ID NO: 176642 - DNA, 26 bp, Artificial sequence
  SiRNA target sequence
gaatactgaaaataaaccatgtattt

SEQ ID NO: 176643 - DNA, 26 bp, Artificial sequence
  SiRNA target sequence
aatactgaaaataaaccatgtatttc

SEQ ID NO: 176644 - DNA, 26 bp, Artificial sequence
  SiRNA target sequence
atactgaaaataaaccatgtatttca

SEQ ID NO: 176645 - DNA, 26 bp, Artificial sequence
  SiRNA target sequence
tactgaaaataaaccatgtatttcac

SEQ ID NO: 176646 - DNA, 26 bp, Artificial sequence
  SiRNA target sequence
actgaaaataaaccatgtatttcacc

SEQ ID NO: 176647 - DNA, 26 bp, Artificial sequence
  SiRNA target sequence
ctgaaaataaaccatgtatttcacca

SEQ ID NO: 176648 - DNA, 26 bp, Artificial sequence
  SiRNA target sequence
tgaaaataaaccatgtatttcaccat

SEQ ID NO: 176649 - DNA, 26 bp, Artificial sequence
  SiRNA target sequence
gaaaataaaccatgtatttcaccatt

SEQ ID NO: 176650 - DNA, 26 bp, Artificial sequence
  SiRNA target sequence
aaaataaaccatgtatttcaccattt

SEQ ID NO: 176651 - DNA, 26 bp, Artificial sequence
  SiRNA target sequence
aaataaaccatgtatttcaccattta

SEQ ID NO: 176652 - DNA, 26 bp, Artificial sequence
  SiRNA target sequence
aataaaccatgtatttcaccatttac

SEQ ID NO: 176653 - DNA, 26 bp, Artificial sequence
  SiRNA target sequence
ataaaccatgtatttcaccatttacc

SEQ ID NO: 176654 - DNA, 26 bp, Artificial sequence
  SiRNA target sequence
taaaccatgtatttcaccatttacct

SEQ ID NO: 176655 - DNA, 26 bp, Artificial sequence
  SiRNA target sequence
aaaccatgtatttcaccatttacctt

SEQ ID NO: 176656 - DNA, 26 bp, Artificial sequence
  SiRNA target sequence
aaccatgtatttcaccatttaccttt

SEQ ID NO: 176657 - DNA, 26 bp, Artificial sequence
  SiRNA target sequence
accatgtatttcaccatttaccttta

SEQ ID NO: 176658 - DNA, 26 bp, Artificial sequence
  SiRNA target sequence
ccatgtatttcaccatttacctttaa

SEQ ID NO: 176659 - DNA, 26 bp, Artificial sequence
  SiRNA target sequence
catgtatttcaccatttacctttaaa

SEQ ID NO: 176660 - DNA, 26 bp, Artificial sequence
  SiRNA target sequence
atgtatttcaccatttacctttaaac

SEQ ID NO: 176661 - DNA, 26 bp, Artificial sequence
  SiRNA target sequence
tgtatttcaccatttacctttaaact

SEQ ID NO: 176662 - DNA, 26 bp, Artificial sequence
  SiRNA target sequence
gtatttcaccatttacctttaaacta

SEQ ID NO: 176663 - DNA, 26 bp, Artificial sequence
  SiRNA target sequence
tatttcaccatttacctttaaactag

SEQ ID NO: 176664 - DNA, 26 bp, Artificial sequence
  SiRNA target sequence
atttcaccatttacctttaaactaga

SEQ ID NO: 176665 - DNA, 26 bp, Artificial sequence
  SiRNA target sequence
tttcaccatttacctttaaactagaa

SEQ ID NO: 176666 - DNA, 26 bp, Artificial sequence
  SiRNA target sequence
ttcaccatttacctttaaactagaag

SEQ ID NO: 176667 - DNA, 26 bp, Artificial sequence
  SiRNA target sequence
tcaccatttacctttaaactagaaga

SEQ ID NO: 176668 - DNA, 26 bp, Artificial sequence
  SiRNA target sequence
caccatttacctttaaactagaagat

SEQ ID NO: 176669 - DNA, 26 bp, Artificial sequence
  SiRNA target sequence
accatttacctttaaactagaagatt

SEQ ID NO: 176670 - DNA, 26 bp, Artificial sequence
  SiRNA target sequence
ccatttacctttaaactagaagattg

SEQ ID NO: 176671 - DNA, 26 bp, Artificial sequence
  SiRNA target sequence
catttacctttaaactagaagattgc

SEQ ID NO: 176672 - DNA, 26 bp, Artificial sequence
  SiRNA target sequence
atttacctttaaactagaagattgcc

SEQ ID NO: 176673 - DNA, 26 bp, Artificial sequence
  SiRNA target sequence
tttacctttaaactagaagattgcct

SEQ ID NO: 176674 - DNA, 26 bp, Artificial sequence
  SiRNA target sequence
ttacctttaaactagaagattgcctg

SEQ ID NO: 176675 - DNA, 26 bp, Artificial sequence
  SiRNA target sequence
tacctttaaactagaagattgcctgg

SEQ ID NO: 176676 - DNA, 26 bp, Artificial sequence
  SiRNA target sequence
acctttaaactagaagattgcctggc

SEQ ID NO: 176677 - DNA, 26 bp, Artificial sequence
  SiRNA target sequence
cctttaaactagaagattgcctggca

SEQ ID NO: 176678 - DNA, 26 bp, Artificial sequence
  SiRNA target sequence
ctttaaactagaagattgcctggcat

SEQ ID NO: 176679 - DNA, 26 bp, Artificial sequence
  SiRNA target sequence
tttaaactagaagattgcctggcatg

SEQ ID NO: 176680 - DNA, 26 bp, Artificial sequence
  SiRNA target sequence
ttaaactagaagattgcctggcatgt

SEQ ID NO: 176681 - DNA, 26 bp, Artificial sequence
  SiRNA target sequence
taaactagaagattgcctggcatgtt

SEQ ID NO: 176682 - DNA, 26 bp, Artificial sequence
  SiRNA target sequence
aaactagaagattgcctggcatgttc

SEQ ID NO: 176683 - DNA, 26 bp, Artificial sequence
  SiRNA target sequence
aactagaagattgcctggcatgttcg

SEQ ID NO: 176684 - DNA, 26 bp, Artificial sequence
  SiRNA target sequence
actagaagattgcctggcatgttcgg

SEQ ID NO: 176685 - DNA, 26 bp, Artificial sequence
  SiRNA target sequence
ctagaagattgcctggcatgttcggc

SEQ ID NO: 176686 - DNA, 26 bp, Artificial sequence
  SiRNA target sequence
tagaagattgcctggcatgttcggct

SEQ ID NO: 176687 - DNA, 26 bp, Artificial sequence
  SiRNA target sequence
agaagattgcctggcatgttcggctt

SEQ ID NO: 176688 - DNA, 26 bp, Artificial sequence
  SiRNA target sequence
gaagattgcctggcatgttcggcttg

SEQ ID NO: 176689 - DNA, 26 bp, Artificial sequence
  SiRNA target sequence
aagattgcctggcatgttcggcttgt

SEQ ID NO: 176690 - DNA, 26 bp, Artificial sequence
  SiRNA target sequence
agattgcctggcatgttcggcttgta

SEQ ID NO: 176691 - DNA, 26 bp, Artificial sequence
  SiRNA target sequence
gattgcctggcatgttcggcttgtat

SEQ ID NO: 176692 - DNA, 26 bp, Artificial sequence
  SiRNA target sequence
attgcctggcatgttcggcttgtatt

SEQ ID NO: 176693 - DNA, 26 bp, Artificial sequence
  SiRNA target sequence
ttgcctggcatgttcggcttgtattg

SEQ ID NO: 176694 - DNA, 26 bp, Artificial sequence
  SiRNA target sequence
tgcctggcatgttcggcttgtattgc

SEQ ID NO: 176695 - DNA, 26 bp, Artificial sequence
  SiRNA target sequence
gcctggcatgttcggcttgtattgct

SEQ ID NO: 176696 - DNA, 26 bp, Artificial sequence
  SiRNA target sequence
cctggcatgttcggcttgtattgctg

SEQ ID NO: 176697 - DNA, 26 bp, Artificial sequence
  SiRNA target sequence
ctggcatgttcggcttgtattgctga

SEQ ID NO: 176698 - DNA, 26 bp, Artificial sequence
  SiRNA target sequence
tggcatgttcggcttgtattgctgat

SEQ ID NO: 176699 - DNA, 26 bp, Artificial sequence
  SiRNA target sequence
ggcatgttcggcttgtattgctgatt

SEQ ID NO: 176700 - DNA, 26 bp, Artificial sequence
  SiRNA target sequence
gcatgttcggcttgtattgctgattt

SEQ ID NO: 176701 - DNA, 26 bp, Artificial sequence
  SiRNA target sequence
catgttcggcttgtattgctgatttt

SEQ ID NO: 176702 - DNA, 26 bp, Artificial sequence
  SiRNA target sequence
atgttcggcttgtattgctgattttt

SEQ ID NO: 176703 - DNA, 26 bp, Artificial sequence
  SiRNA target sequence
tgttcggcttgtattgctgatttttc

SEQ ID NO: 176704 - DNA, 26 bp, Artificial sequence
  SiRNA target sequence
gttcggcttgtattgctgatttttct

SEQ ID NO: 176705 - DNA, 26 bp, Artificial sequence
  SiRNA target sequence
ttcggcttgtattgctgatttttctg

SEQ ID NO: 176706 - DNA, 26 bp, Artificial sequence
  SiRNA target sequence
tcggcttgtattgctgatttttctgt

SEQ ID NO: 176707 - DNA, 26 bp, Artificial sequence
  SiRNA target sequence
cggcttgtattgctgatttttctgtt

SEQ ID NO: 176708 - DNA, 26 bp, Artificial sequence
  SiRNA target sequence
ggcttgtattgctgatttttctgttc

SEQ ID NO: 176709 - DNA, 26 bp, Artificial sequence
  SiRNA target sequence
gcttgtattgctgatttttctgttcc

SEQ ID NO: 176710 - DNA, 26 bp, Artificial sequence
  SiRNA target sequence
cttgtattgctgatttttctgttcca

SEQ ID NO: 176711 - DNA, 26 bp, Artificial sequence
  SiRNA target sequence
ttgtattgctgatttttctgttccaa

SEQ ID NO: 176712 - DNA, 26 bp, Artificial sequence
  SiRNA target sequence
tgtattgctgatttttctgttccaaa

SEQ ID NO: 176713 - DNA, 26 bp, Artificial sequence
  SiRNA target sequence
gtattgctgatttttctgttccaaaa

SEQ ID NO: 176714 - DNA, 26 bp, Artificial sequence
  SiRNA target sequence
tattgctgatttttctgttccaaaaa

SEQ ID NO: 176715 - DNA, 26 bp, Artificial sequence
  SiRNA target sequence
attgctgatttttctgttccaaaaat

SEQ ID NO: 176716 - DNA, 26 bp, Artificial sequence
  SiRNA target sequence
ttgctgatttttctgttccaaaaatt

SEQ ID NO: 176717 - DNA, 26 bp, Artificial sequence
  SiRNA target sequence
tgctgatttttctgttccaaaaattc

SEQ ID NO: 176718 - DNA, 26 bp, Artificial sequence
  SiRNA target sequence
gctgatttttctgttccaaaaattcc

SEQ ID NO: 176719 - DNA, 26 bp, Artificial sequence
  SiRNA target sequence
ctgatttttctgttccaaaaattcct

SEQ ID NO: 176720 - DNA, 26 bp, Artificial sequence
  SiRNA target sequence
tgatttttctgttccaaaaattccta

SEQ ID NO: 176721 - DNA, 26 bp, Artificial sequence
  SiRNA target sequence
gatttttctgttccaaaaattcctac

SEQ ID NO: 176722 - DNA, 26 bp, Artificial sequence
  SiRNA target sequence
atttttctgttccaaaaattcctact

SEQ ID NO: 176723 - DNA, 26 bp, Artificial sequence
  SiRNA target sequence
tttttctgttccaaaaattcctactt

SEQ ID NO: 176724 - DNA, 26 bp, Artificial sequence
  SiRNA target sequence
ttttctgttccaaaaattcctactta

SEQ ID NO: 176725 - DNA, 26 bp, Artificial sequence
  SiRNA target sequence
tttctgttccaaaaattcctacttac

SEQ ID NO: 176726 - DNA, 26 bp, Artificial sequence
  SiRNA target sequence
ttctgttccaaaaattcctacttaca

SEQ ID NO: 176727 - DNA, 26 bp, Artificial sequence
  SiRNA target sequence
tctgttccaaaaattcctacttacac

SEQ ID NO: 176728 - DNA, 26 bp, Artificial sequence
  SiRNA target sequence
ctgttccaaaaattcctacttacaca

SEQ ID NO: 176729 - DNA, 26 bp, Artificial sequence
  SiRNA target sequence
tgttccaaaaattcctacttacacag

SEQ ID NO: 176730 - DNA, 26 bp, Artificial sequence
  SiRNA target sequence
gttccaaaaattcctacttacacaga

SEQ ID NO: 176731 - DNA, 26 bp, Artificial sequence
  SiRNA target sequence
ttccaaaaattcctacttacacagaa

SEQ ID NO: 176732 - DNA, 26 bp, Artificial sequence
  SiRNA target sequence
tccaaaaattcctacttacacagaac

SEQ ID NO: 176733 - DNA, 26 bp, Artificial sequence
  SiRNA target sequence
ccaaaaattcctacttacacagaact

SEQ ID NO: 176734 - DNA, 26 bp, Artificial sequence
  SiRNA target sequence
caaaaattcctacttacacagaactg

SEQ ID NO: 176735 - DNA, 26 bp, Artificial sequence
  SiRNA target sequence
aaaaattcctacttacacagaactga

SEQ ID NO: 176736 - DNA, 26 bp, Artificial sequence
  SiRNA target sequence
aaaattcctacttacacagaactgaa

SEQ ID NO: 176737 - DNA, 26 bp, Artificial sequence
  SiRNA target sequence
aaattcctacttacacagaactgaaa

SEQ ID NO: 176738 - DNA, 26 bp, Artificial sequence
  SiRNA target sequence
aattcctacttacacagaactgaaag

SEQ ID NO: 176739 - DNA, 26 bp, Artificial sequence
  SiRNA target sequence
attcctacttacacagaactgaaaga

SEQ ID NO: 176740 - DNA, 26 bp, Artificial sequence
  SiRNA target sequence
ttcctacttacacagaactgaaagat

SEQ ID NO: 176741 - DNA, 26 bp, Artificial sequence
  SiRNA target sequence
tcctacttacacagaactgaaagatg

SEQ ID NO: 176742 - DNA, 26 bp, Artificial sequence
  SiRNA target sequence
cctacttacacagaactgaaagatgt

SEQ ID NO: 176743 - DNA, 26 bp, Artificial sequence
  SiRNA target sequence
ctacttacacagaactgaaagatgtc

SEQ ID NO: 176744 - DNA, 26 bp, Artificial sequence
  SiRNA target sequence
tacttacacagaactgaaagatgtcc

SEQ ID NO: 176745 - DNA, 26 bp, Artificial sequence
  SiRNA target sequence
acttacacagaactgaaagatgtccc

SEQ ID NO: 176746 - DNA, 26 bp, Artificial sequence
  SiRNA target sequence
cttacacagaactgaaagatgtccct

SEQ ID NO: 176747 - DNA, 26 bp, Artificial sequence
  SiRNA target sequence
ttacacagaactgaaagatgtccctt

SEQ ID NO: 176748 - DNA, 26 bp, Artificial sequence
  SiRNA target sequence
tacacagaactgaaagatgtcccttt

SEQ ID NO: 176749 - DNA, 26 bp, Artificial sequence
  SiRNA target sequence
acacagaactgaaagatgtcccttta

SEQ ID NO: 176750 - DNA, 26 bp, Artificial sequence
  SiRNA target sequence
cacagaactgaaagatgtccctttaa

SEQ ID NO: 176751 - DNA, 26 bp, Artificial sequence
  SiRNA target sequence
acagaactgaaagatgtccctttaac

SEQ ID NO: 176752 - DNA, 26 bp, Artificial sequence
  SiRNA target sequence
cagaactgaaagatgtccctttaaca

SEQ ID NO: 176753 - DNA, 26 bp, Artificial sequence
  SiRNA target sequence
agaactgaaagatgtccctttaacat

SEQ ID NO: 176754 - DNA, 26 bp, Artificial sequence
  SiRNA target sequence
gaactgaaagatgtccctttaacatt

SEQ ID NO: 176755 - DNA, 26 bp, Artificial sequence
  SiRNA target sequence
aactgaaagatgtccctttaacattt

SEQ ID NO: 176756 - DNA, 26 bp, Artificial sequence
  SiRNA target sequence
actgaaagatgtccctttaacatttt

SEQ ID NO: 176757 - DNA, 26 bp, Artificial sequence
  SiRNA target sequence
ctgaaagatgtccctttaacattttt

SEQ ID NO: 176758 - DNA, 26 bp, Artificial sequence
  SiRNA target sequence
tgaaagatgtccctttaacattttta

SEQ ID NO: 176759 - DNA, 26 bp, Artificial sequence
  SiRNA target sequence
gaaagatgtccctttaacatttttat

SEQ ID NO: 176760 - DNA, 26 bp, Artificial sequence
  SiRNA target sequence
aaagatgtccctttaacatttttatt

SEQ ID NO: 176761 - DNA, 26 bp, Artificial sequence
  SiRNA target sequence
aagatgtccctttaacatttttatta

SEQ ID NO: 176762 - DNA, 26 bp, Artificial sequence
  SiRNA target sequence
agatgtccctttaacatttttattat

SEQ ID NO: 176763 - DNA, 26 bp, Artificial sequence
  SiRNA target sequence
gatgtccctttaacatttttattatc

SEQ ID NO: 176764 - DNA, 26 bp, Artificial sequence
  SiRNA target sequence
atgtccctttaacatttttattatca

SEQ ID NO: 176765 - DNA, 26 bp, Artificial sequence
  SiRNA target sequence
tgtccctttaacatttttattatcac

SEQ ID NO: 176766 - DNA, 26 bp, Artificial sequence
  SiRNA target sequence
gtccctttaacatttttattatcacc

SEQ ID NO: 176767 - DNA, 26 bp, Artificial sequence
  SiRNA target sequence
tccctttaacatttttattatcacca

SEQ ID NO: 176768 - DNA, 26 bp, Artificial sequence
  SiRNA target sequence
ccctttaacatttttattatcaccac

SEQ ID NO: 176769 - DNA, 26 bp, Artificial sequence
  SiRNA target sequence
cctttaacatttttattatcaccaca

SEQ ID NO: 176770 - DNA, 26 bp, Artificial sequence
  SiRNA target sequence
ctttaacatttttattatcaccacat

SEQ ID NO: 176771 - DNA, 26 bp, Artificial sequence
  SiRNA target sequence
tttaacatttttattatcaccacatt

SEQ ID NO: 176772 - DNA, 26 bp, Artificial sequence
  SiRNA target sequence
ttaacatttttattatcaccacattc

SEQ ID NO: 176773 - DNA, 26 bp, Artificial sequence
  SiRNA target sequence
taacatttttattatcaccacattcg

SEQ ID NO: 176774 - DNA, 26 bp, Artificial sequence
  SiRNA target sequence
aacatttttattatcaccacattcga

SEQ ID NO: 176775 - DNA, 26 bp, Artificial sequence
  SiRNA target sequence
acatttttattatcaccacattcgaa

SEQ ID NO: 176776 - DNA, 26 bp, Artificial sequence
  SiRNA target sequence
catttttattatcaccacattcgaaa

SEQ ID NO: 176777 - DNA, 26 bp, Artificial sequence
  SiRNA target sequence
atttttattatcaccacattcgaaaa

SEQ ID NO: 176778 - DNA, 26 bp, Artificial sequence
  SiRNA target sequence
tttttattatcaccacattcgaaaat

SEQ ID NO: 176779 - DNA, 26 bp, Artificial sequence
  SiRNA target sequence
ttttattatcaccacattcgaaaatg

SEQ ID NO: 176780 - DNA, 26 bp, Artificial sequence
  SiRNA target sequence
tttattatcaccacattcgaaaatga

SEQ ID NO: 176781 - DNA, 26 bp, Artificial sequence
  SiRNA target sequence
ttattatcaccacattcgaaaatgaa

SEQ ID NO: 176782 - DNA, 26 bp, Artificial sequence
  SiRNA target sequence
tattatcaccacattcgaaaatgaat

SEQ ID NO: 176783 - DNA, 26 bp, Artificial sequence
  SiRNA target sequence
attatcaccacattcgaaaatgaata

SEQ ID NO: 176784 - DNA, 26 bp, Artificial sequence
  SiRNA target sequence
ttatcaccacattcgaaaatgaatat

SEQ ID NO: 176785 - DNA, 26 bp, Artificial sequence
  SiRNA target sequence
tatcaccacattcgaaaatgaatatg

SEQ ID NO: 176786 - DNA, 26 bp, Artificial sequence
  SiRNA target sequence
atcaccacattcgaaaatgaatatgt

SEQ ID NO: 176787 - DNA, 26 bp, Artificial sequence
  SiRNA target sequence
tcaccacattcgaaaatgaatatgta

SEQ ID NO: 176788 - DNA, 26 bp, Artificial sequence
  SiRNA target sequence
caccacattcgaaaatgaatatgtat

SEQ ID NO: 176789 - DNA, 26 bp, Artificial sequence
  SiRNA target sequence
accacattcgaaaatgaatatgtatg

SEQ ID NO: 176790 - DNA, 26 bp, Artificial sequence
  SiRNA target sequence
ccacattcgaaaatgaatatgtatgc

SEQ ID NO: 176791 - DNA, 26 bp, Artificial sequence
  SiRNA target sequence
cacattcgaaaatgaatatgtatgca

SEQ ID NO: 176792 - DNA, 26 bp, Artificial sequence
  SiRNA target sequence
acattcgaaaatgaatatgtatgcac

SEQ ID NO: 176793 - DNA, 26 bp, Artificial sequence
  SiRNA target sequence
cattcgaaaatgaatatgtatgcaca

SEQ ID NO: 176794 - DNA, 26 bp, Artificial sequence
  SiRNA target sequence
attcgaaaatgaatatgtatgcacac

SEQ ID NO: 176795 - DNA, 26 bp, Artificial sequence
  SiRNA target sequence
ttcgaaaatgaatatgtatgcacact

SEQ ID NO: 176796 - DNA, 26 bp, Artificial sequence
  SiRNA target sequence
tcgaaaatgaatatgtatgcacacta

SEQ ID NO: 176797 - DNA, 26 bp, Artificial sequence
  SiRNA target sequence
cgaaaatgaatatgtatgcacactat

SEQ ID NO: 176798 - DNA, 26 bp, Artificial sequence
  SiRNA target sequence
gaaaatgaatatgtatgcacactata

SEQ ID NO: 176799 - DNA, 26 bp, Artificial sequence
  SiRNA target sequence
aaaatgaatatgtatgcacactataa

SEQ ID NO: 176800 - DNA, 26 bp, Artificial sequence
  SiRNA target sequence
aaatgaatatgtatgcacactataac

SEQ ID NO: 176801 - DNA, 26 bp, Artificial sequence
  SiRNA target sequence
aatgaatatgtatgcacactataaca

SEQ ID NO: 176802 - DNA, 26 bp, Artificial sequence
  SiRNA target sequence
atgaatatgtatgcacactataacaa

SEQ ID NO: 176803 - DNA, 26 bp, Artificial sequence
  SiRNA target sequence
tgaatatgtatgcacactataacaat

SEQ ID NO: 176804 - DNA, 26 bp, Artificial sequence
  SiRNA target sequence
gaatatgtatgcacactataacaatc

SEQ ID NO: 176805 - DNA, 26 bp, Artificial sequence
  SiRNA target sequence
aatatgtatgcacactataacaatca

SEQ ID NO: 176806 - DNA, 26 bp, Artificial sequence
  SiRNA target sequence
atatgtatgcacactataacaatcat

SEQ ID NO: 176807 - DNA, 26 bp, Artificial sequence
  SiRNA target sequence
tatgtatgcacactataacaatcata

SEQ ID NO: 176808 - DNA, 26 bp, Artificial sequence
  SiRNA target sequence
atgtatgcacactataacaatcatat

SEQ ID NO: 176809 - DNA, 26 bp, Artificial sequence
  SiRNA target sequence
tgtatgcacactataacaatcatata

SEQ ID NO: 176810 - DNA, 26 bp, Artificial sequence
  SiRNA target sequence
gtatgcacactataacaatcatataa

SEQ ID NO: 176811 - DNA, 26 bp, Artificial sequence
  SiRNA target sequence
tatgcacactataacaatcatataat

SEQ ID NO: 176812 - DNA, 26 bp, Artificial sequence
  SiRNA target sequence
atgcacactataacaatcatataatg

SEQ ID NO: 176813 - DNA, 26 bp, Artificial sequence
  SiRNA target sequence
tgcacactataacaatcatataatgt

SEQ ID NO: 176814 - DNA, 26 bp, Artificial sequence
  SiRNA target sequence
gcacactataacaatcatataatgtc

SEQ ID NO: 176815 - DNA, 26 bp, Artificial sequence
  SiRNA target sequence
cacactataacaatcatataatgtcc

SEQ ID NO: 176816 - DNA, 26 bp, Artificial sequence
  SiRNA target sequence
acactataacaatcatataatgtcct

SEQ ID NO: 176817 - DNA, 26 bp, Artificial sequence
  SiRNA target sequence
cactataacaatcatataatgtcctt

SEQ ID NO: 176818 - DNA, 26 bp, Artificial sequence
  SiRNA target sequence
actataacaatcatataatgtccttt

SEQ ID NO: 176819 - DNA, 26 bp, Artificial sequence
  SiRNA target sequence
ctataacaatcatataatgtccttta

SEQ ID NO: 176820 - DNA, 26 bp, Artificial sequence
  SiRNA target sequence
tataacaatcatataatgtcctttag

SEQ ID NO: 176821 - DNA, 26 bp, Artificial sequence
  SiRNA target sequence
ataacaatcatataatgtcctttagt

SEQ ID NO: 176822 - DNA, 26 bp, Artificial sequence
  SiRNA target sequence
taacaatcatataatgtcctttagtg

SEQ ID NO: 176823 - DNA, 26 bp, Artificial sequence
  SiRNA target sequence
aacaatcatataatgtcctttagtga

SEQ ID NO: 176824 - DNA, 26 bp, Artificial sequence
  SiRNA target sequence
acaatcatataatgtcctttagtgat

SEQ ID NO: 176825 - DNA, 26 bp, Artificial sequence
  SiRNA target sequence
caatcatataatgtcctttagtgatt

SEQ ID NO: 176826 - DNA, 26 bp, Artificial sequence
  SiRNA target sequence
aatcatataatgtcctttagtgattt

SEQ ID NO: 176827 - DNA, 26 bp, Artificial sequence
  SiRNA target sequence
atcatataatgtcctttagtgatttt

SEQ ID NO: 176828 - DNA, 26 bp, Artificial sequence
  SiRNA target sequence
tcatataatgtcctttagtgattttg

SEQ ID NO: 176829 - DNA, 26 bp, Artificial sequence
  SiRNA target sequence
catataatgtcctttagtgattttga

SEQ ID NO: 176830 - DNA, 26 bp, Artificial sequence
  SiRNA target sequence
atataatgtcctttagtgattttgaa

SEQ ID NO: 176831 - DNA, 26 bp, Artificial sequence
  SiRNA target sequence
tataatgtcctttagtgattttgaat

SEQ ID NO: 176832 - DNA, 26 bp, Artificial sequence
  SiRNA target sequence
ataatgtcctttagtgattttgaata

SEQ ID NO: 176833 - DNA, 26 bp, Artificial sequence
  SiRNA target sequence
taatgtcctttagtgattttgaatat

SEQ ID NO: 176834 - DNA, 26 bp, Artificial sequence
  SiRNA target sequence
aatgtcctttagtgattttgaatatc

SEQ ID NO: 176835 - DNA, 26 bp, Artificial sequence
  SiRNA target sequence
atgtcctttagtgattttgaatatca

SEQ ID NO: 176836 - DNA, 26 bp, Artificial sequence
  SiRNA target sequence
tgtcctttagtgattttgaatatcac

SEQ ID NO: 176837 - DNA, 26 bp, Artificial sequence
  SiRNA target sequence
gtcctttagtgattttgaatatcact

SEQ ID NO: 176838 - DNA, 26 bp, Artificial sequence
  SiRNA target sequence
tcctttagtgattttgaatatcactt

SEQ ID NO: 176839 - DNA, 26 bp, Artificial sequence
  SiRNA target sequence
cctttagtgattttgaatatcactta

SEQ ID NO: 176840 - DNA, 26 bp, Artificial sequence
  SiRNA target sequence
ctttagtgattttgaatatcacttaa

SEQ ID NO: 176841 - DNA, 26 bp, Artificial sequence
  SiRNA target sequence
tttagtgattttgaatatcacttaat

SEQ ID NO: 176842 - DNA, 26 bp, Artificial sequence
  SiRNA target sequence
ttagtgattttgaatatcacttaatt

SEQ ID NO: 176843 - DNA, 26 bp, Artificial sequence
  SiRNA target sequence
tagtgattttgaatatcacttaattt

SEQ ID NO: 176844 - DNA, 26 bp, Artificial sequence
  SiRNA target sequence
agtgattttgaatatcacttaatttc

SEQ ID NO: 176845 - DNA, 26 bp, Artificial sequence
  SiRNA target sequence
gtgattttgaatatcacttaatttca

SEQ ID NO: 176846 - DNA, 26 bp, Artificial sequence
  SiRNA target sequence
tgattttgaatatcacttaatttcat

SEQ ID NO: 176847 - DNA, 26 bp, Artificial sequence
  SiRNA target sequence
gattttgaatatcacttaatttcatt

SEQ ID NO: 176848 - DNA, 26 bp, Artificial sequence
  SiRNA target sequence
attttgaatatcacttaatttcattt

SEQ ID NO: 176849 - DNA, 26 bp, Artificial sequence
  SiRNA target sequence
ttttgaatatcacttaatttcattta

SEQ ID NO: 176850 - DNA, 26 bp, Artificial sequence
  SiRNA target sequence
tttgaatatcacttaatttcatttat

SEQ ID NO: 176851 - DNA, 26 bp, Artificial sequence
  SiRNA target sequence
ttgaatatcacttaatttcatttata

SEQ ID NO: 176852 - DNA, 26 bp, Artificial sequence
  SiRNA target sequence
tgaatatcacttaatttcatttataa

SEQ ID NO: 176853 - DNA, 26 bp, Artificial sequence
  SiRNA target sequence
gaatatcacttaatttcatttataaa

SEQ ID NO: 176854 - DNA, 26 bp, Artificial sequence
  SiRNA target sequence
aatatcacttaatttcatttataaaa

SEQ ID NO: 176855 - DNA, 26 bp, Artificial sequence
  SiRNA target sequence
atatcacttaatttcatttataaaac

SEQ ID NO: 176856 - DNA, 26 bp, Artificial sequence
  SiRNA target sequence
tatcacttaatttcatttataaaact

SEQ ID NO: 176857 - DNA, 26 bp, Artificial sequence
  SiRNA target sequence
atcacttaatttcatttataaaacta

SEQ ID NO: 176858 - DNA, 26 bp, Artificial sequence
  SiRNA target sequence
tcacttaatttcatttataaaactaa

SEQ ID NO: 176859 - DNA, 26 bp, Artificial sequence
  SiRNA target sequence
cacttaatttcatttataaaactaaa

SEQ ID NO: 176860 - DNA, 26 bp, Artificial sequence
  SiRNA target sequence
acttaatttcatttataaaactaaaa

SEQ ID NO: 176861 - DNA, 26 bp, Artificial sequence
  SiRNA target sequence
cttaatttcatttataaaactaaaat

SEQ ID NO: 176862 - DNA, 26 bp, Artificial sequence
  SiRNA target sequence
ttaatttcatttataaaactaaaatt

SEQ ID NO: 176863 - DNA, 26 bp, Artificial sequence
  SiRNA target sequence
taatttcatttataaaactaaaattt

SEQ ID NO: 176864 - DNA, 26 bp, Artificial sequence
  SiRNA target sequence
aatttcatttataaaactaaaattta

SEQ ID NO: 176865 - DNA, 26 bp, Artificial sequence
  SiRNA target sequence
atttcatttataaaactaaaatttaa

SEQ ID NO: 176866 - DNA, 26 bp, Artificial sequence
  SiRNA target sequence
tttcatttataaaactaaaatttaat

SEQ ID NO: 176867 - DNA, 26 bp, Artificial sequence
  SiRNA target sequence
ttcatttataaaactaaaatttaatg

SEQ ID NO: 176868 - DNA, 26 bp, Artificial sequence
  SiRNA target sequence
tcatttataaaactaaaatttaatgt

SEQ ID NO: 176869 - DNA, 26 bp, Artificial sequence
  SiRNA target sequence
catttataaaactaaaatttaatgta

SEQ ID NO: 176870 - DNA, 26 bp, Artificial sequence
  SiRNA target sequence
atttataaaactaaaatttaatgtaa

SEQ ID NO: 176871 - DNA, 26 bp, Artificial sequence
  SiRNA target sequence
tttataaaactaaaatttaatgtaat

SEQ ID NO: 176872 - DNA, 26 bp, Artificial sequence
  SiRNA target sequence
ttataaaactaaaatttaatgtaata

SEQ ID NO: 176873 - DNA, 26 bp, Artificial sequence
  SiRNA target sequence
tataaaactaaaatttaatgtaataa

SEQ ID NO: 176874 - DNA, 26 bp, Artificial sequence
  SiRNA target sequence
ataaaactaaaatttaatgtaataaa

SEQ ID NO: 176875 - DNA, 26 bp, Artificial sequence
  SiRNA target sequence
taaaactaaaatttaatgtaataaaa

SEQ ID NO: 176876 - DNA, 26 bp, Artificial sequence
  SiRNA target sequence
aaaactaaaatttaatgtaataaaag

SEQ ID NO: 176877 - DNA, 26 bp, Artificial sequence
  SiRNA target sequence
aaactaaaatttaatgtaataaaagt

SEQ ID NO: 176878 - DNA, 26 bp, Artificial sequence
  SiRNA target sequence
aactaaaatttaatgtaataaaagta

SEQ ID NO: 176879 - DNA, 26 bp, Artificial sequence
  SiRNA target sequence
actaaaatttaatgtaataaaagtat

SEQ ID NO: 176880 - DNA, 26 bp, Artificial sequence
  SiRNA target sequence
ctaaaatttaatgtaataaaagtata

SEQ ID NO: 176881 - DNA, 26 bp, Artificial sequence
  SiRNA target sequence
taaaatttaatgtaataaaagtatat

SEQ ID NO: 176882 - DNA, 26 bp, Artificial sequence
  SiRNA target sequence
aaaatttaatgtaataaaagtatatg

SEQ ID NO: 176883 - DNA, 26 bp, Artificial sequence
  SiRNA target sequence
aaatttaatgtaataaaagtatatga

SEQ ID NO: 176884 - DNA, 26 bp, Artificial sequence
  SiRNA target sequence
aatttaatgtaataaaagtatatgat

SEQ ID NO: 176885 - DNA, 26 bp, Artificial sequence
  SiRNA target sequence
atttaatgtaataaaagtatatgata

SEQ ID NO: 176886 - DNA, 26 bp, Artificial sequence
  SiRNA target sequence
tttaatgtaataaaagtatatgatac

SEQ ID NO: 176887 - DNA, 26 bp, Artificial sequence
  SiRNA target sequence
ttaatgtaataaaagtatatgataca

SEQ ID NO: 176888 - DNA, 26 bp, Artificial sequence
  SiRNA target sequence
taatgtaataaaagtatatgatacat

SEQ ID NO: 176889 - DNA, 26 bp, Artificial sequence
  SiRNA target sequence
aatgtaataaaagtatatgatacatc

SEQ ID NO: 176890 - DNA, 26 bp, Artificial sequence
  SiRNA target sequence
atgtaataaaagtatatgatacatct

SEQ ID NO: 176891 - DNA, 26 bp, Artificial sequence
  SiRNA target sequence
tgtaataaaagtatatgatacatctt

SEQ ID NO: 176892 - DNA, 26 bp, Artificial sequence
  SiRNA target sequence
gtaataaaagtatatgatacatctta

SEQ ID NO: 176893 - DNA, 26 bp, Artificial sequence
  SiRNA target sequence
taataaaagtatatgatacatcttat

SEQ ID NO: 176894 - DNA, 26 bp, Artificial sequence
  SiRNA target sequence
aataaaagtatatgatacatcttatg

SEQ ID NO: 176895 - DNA, 26 bp, Artificial sequence
  SiRNA target sequence
ataaaagtatatgatacatcttatgt

SEQ ID NO: 176896 - DNA, 26 bp, Artificial sequence
  SiRNA target sequence
taaaagtatatgatacatcttatgtc

SEQ ID NO: 176897 - DNA, 26 bp, Artificial sequence
  SiRNA target sequence
aaaagtatatgatacatcttatgtca

SEQ ID NO: 176898 - DNA, 26 bp, Artificial sequence
  SiRNA target sequence
aaagtatatgatacatcttatgtcaa

SEQ ID NO: 176899 - DNA, 26 bp, Artificial sequence
  SiRNA target sequence
aagtatatgatacatcttatgtcaaa

SEQ ID NO: 176900 - DNA, 26 bp, Artificial sequence
  SiRNA target sequence
agtatatgatacatcttatgtcaaaa

SEQ ID NO: 176901 - DNA, 26 bp, Artificial sequence
  SiRNA target sequence
gtatatgatacatcttatgtcaaaaa

SEQ ID NO: 176902 - DNA, 26 bp, Artificial sequence
  SiRNA target sequence
tatatgatacatcttatgtcaaaaat

SEQ ID NO: 176903 - DNA, 26 bp, Artificial sequence
  SiRNA target sequence
atatgatacatcttatgtcaaaaata

SEQ ID NO: 176904 - DNA, 26 bp, Artificial sequence
  SiRNA target sequence
tatgatacatcttatgtcaaaaatat

SEQ ID NO: 176905 - DNA, 26 bp, Artificial sequence
  SiRNA target sequence
atgatacatcttatgtcaaaaatatt

SEQ ID NO: 176906 - DNA, 26 bp, Artificial sequence
  SiRNA target sequence
tgatacatcttatgtcaaaaatattc

SEQ ID NO: 176907 - DNA, 26 bp, Artificial sequence
  SiRNA target sequence
gatacatcttatgtcaaaaatattct

SEQ ID NO: 176908 - DNA, 26 bp, Artificial sequence
  SiRNA target sequence
atacatcttatgtcaaaaatattctg

SEQ ID NO: 176909 - DNA, 26 bp, Artificial sequence
  SiRNA target sequence
tacatcttatgtcaaaaatattctgt

SEQ ID NO: 176910 - DNA, 26 bp, Artificial sequence
  SiRNA target sequence
acatcttatgtcaaaaatattctgta

SEQ ID NO: 176911 - DNA, 26 bp, Artificial sequence
  SiRNA target sequence
catcttatgtcaaaaatattctgtat

SEQ ID NO: 176912 - DNA, 26 bp, Artificial sequence
  SiRNA target sequence
atcttatgtcaaaaatattctgtatg

SEQ ID NO: 176913 - DNA, 26 bp, Artificial sequence
  SiRNA target sequence
tcttatgtcaaaaatattctgtatga

SEQ ID NO: 176914 - DNA, 26 bp, Artificial sequence
  SiRNA target sequence
cttatgtcaaaaatattctgtatgat

SEQ ID NO: 176915 - DNA, 26 bp, Artificial sequence
  SiRNA target sequence
ttatgtcaaaaatattctgtatgata

SEQ ID NO: 176916 - DNA, 26 bp, Artificial sequence
  SiRNA target sequence
tatgtcaaaaatattctgtatgatag

SEQ ID NO: 176917 - DNA, 26 bp, Artificial sequence
  SiRNA target sequence
atgtcaaaaatattctgtatgatagt

SEQ ID NO: 176918 - DNA, 26 bp, Artificial sequence
  SiRNA target sequence
tgtcaaaaatattctgtatgatagtg

SEQ ID NO: 176919 - DNA, 26 bp, Artificial sequence
  SiRNA target sequence
gtcaaaaatattctgtatgatagtgt

SEQ ID NO: 176920 - DNA, 26 bp, Artificial sequence
  SiRNA target sequence
tcaaaaatattctgtatgatagtgtt

SEQ ID NO: 176921 - DNA, 26 bp, Artificial sequence
  SiRNA target sequence
caaaaatattctgtatgatagtgttt

SEQ ID NO: 176922 - DNA, 26 bp, Artificial sequence
  SiRNA target sequence
aaaaatattctgtatgatagtgttta

SEQ ID NO: 176923 - DNA, 26 bp, Artificial sequence
  SiRNA target sequence
aaaatattctgtatgatagtgtttat

SEQ ID NO: 176924 - DNA, 26 bp, Artificial sequence
  SiRNA target sequence
aaatattctgtatgatagtgtttatg

SEQ ID NO: 176925 - DNA, 26 bp, Artificial sequence
  SiRNA target sequence
aatattctgtatgatagtgtttatga

SEQ ID NO: 176926 - DNA, 26 bp, Artificial sequence
  SiRNA target sequence
atattctgtatgatagtgtttatgag

SEQ ID NO: 176927 - DNA, 26 bp, Artificial sequence
  SiRNA target sequence
tattctgtatgatagtgtttatgagg

SEQ ID NO: 176928 - DNA, 26 bp, Artificial sequence
  SiRNA target sequence
attctgtatgatagtgtttatgagga

SEQ ID NO: 176929 - DNA, 26 bp, Artificial sequence
  SiRNA target sequence
ttctgtatgatagtgtttatgaggaa

SEQ ID NO: 176930 - DNA, 26 bp, Artificial sequence
  SiRNA target sequence
tctgtatgatagtgtttatgaggaaa

SEQ ID NO: 176931 - DNA, 26 bp, Artificial sequence
  SiRNA target sequence
ctgtatgatagtgtttatgaggaaag

SEQ ID NO: 176932 - DNA, 26 bp, Artificial sequence
  SiRNA target sequence
tgtatgatagtgtttatgaggaaagc

SEQ ID NO: 176933 - DNA, 26 bp, Artificial sequence
  SiRNA target sequence
gtatgatagtgtttatgaggaaagca

SEQ ID NO: 176934 - DNA, 26 bp, Artificial sequence
  SiRNA target sequence
tatgatagtgtttatgaggaaagcac

SEQ ID NO: 176935 - DNA, 26 bp, Artificial sequence
  SiRNA target sequence
atgatagtgtttatgaggaaagcacg

SEQ ID NO: 176936 - DNA, 26 bp, Artificial sequence
  SiRNA target sequence
tgatagtgtttatgaggaaagcacga

SEQ ID NO: 176937 - DNA, 26 bp, Artificial sequence
  SiRNA target sequence
gatagtgtttatgaggaaagcacgag

SEQ ID NO: 176938 - DNA, 26 bp, Artificial sequence
  SiRNA target sequence
atagtgtttatgaggaaagcacgaga

SEQ ID NO: 176939 - DNA, 26 bp, Artificial sequence
  SiRNA target sequence
tagtgtttatgaggaaagcacgagag

SEQ ID NO: 176940 - DNA, 26 bp, Artificial sequence
  SiRNA target sequence
agtgtttatgaggaaagcacgagaga

SEQ ID NO: 176941 - DNA, 26 bp, Artificial sequence
  SiRNA target sequence
gtgtttatgaggaaagcacgagagac

SEQ ID NO: 176942 - DNA, 26 bp, Artificial sequence
  SiRNA target sequence
tgtttatgaggaaagcacgagagaca

SEQ ID NO: 176943 - DNA, 26 bp, Artificial sequence
  SiRNA target sequence
gtttatgaggaaagcacgagagacaa

SEQ ID NO: 176944 - DNA, 26 bp, Artificial sequence
  SiRNA target sequence
tttatgaggaaagcacgagagacaaa

SEQ ID NO: 176945 - DNA, 26 bp, Artificial sequence
  SiRNA target sequence
ttatgaggaaagcacgagagacaaaa

SEQ ID NO: 176946 - DNA, 26 bp, Artificial sequence
  SiRNA target sequence
tatgaggaaagcacgagagacaaaat

SEQ ID NO: 176947 - DNA, 26 bp, Artificial sequence
  SiRNA target sequence
atgaggaaagcacgagagacaaaata

SEQ ID NO: 176948 - DNA, 26 bp, Artificial sequence
  SiRNA target sequence
tgaggaaagcacgagagacaaaataa

SEQ ID NO: 176949 - DNA, 26 bp, Artificial sequence
  SiRNA target sequence
gaggaaagcacgagagacaaaataat

SEQ ID NO: 176950 - DNA, 26 bp, Artificial sequence
  SiRNA target sequence
aggaaagcacgagagacaaaataata

SEQ ID NO: 176951 - DNA, 26 bp, Artificial sequence
  SiRNA target sequence
ggaaagcacgagagacaaaataataa

SEQ ID NO: 176952 - DNA, 26 bp, Artificial sequence
  SiRNA target sequence
gaaagcacgagagacaaaataataat

SEQ ID NO: 176953 - DNA, 26 bp, Artificial sequence
  SiRNA target sequence
aaagcacgagagacaaaataataata

SEQ ID NO: 176954 - DNA, 26 bp, Artificial sequence
  SiRNA target sequence
aagcacgagagacaaaataataataa

SEQ ID NO: 176955 - DNA, 26 bp, Artificial sequence
  SiRNA target sequence
agcacgagagacaaaataataataag

SEQ ID NO: 176956 - DNA, 26 bp, Artificial sequence
  SiRNA target sequence
gcacgagagacaaaataataataagt

SEQ ID NO: 176957 - DNA, 26 bp, Artificial sequence
  SiRNA target sequence
cacgagagacaaaataataataagtg

SEQ ID NO: 176958 - DNA, 26 bp, Artificial sequence
  SiRNA target sequence
acgagagacaaaataataataagtga

SEQ ID NO: 176959 - DNA, 26 bp, Artificial sequence
  SiRNA target sequence
cgagagacaaaataataataagtgac

SEQ ID NO: 176960 - DNA, 26 bp, Artificial sequence
  SiRNA target sequence
gagagacaaaataataataagtgact

SEQ ID NO: 176961 - DNA, 26 bp, Artificial sequence
  SiRNA target sequence
agagacaaaataataataagtgactg

SEQ ID NO: 176962 - DNA, 26 bp, Artificial sequence
  SiRNA target sequence
gagacaaaataataataagtgactgt

SEQ ID NO: 176963 - DNA, 26 bp, Artificial sequence
  SiRNA target sequence
agacaaaataataataagtgactgtc

SEQ ID NO: 176964 - DNA, 26 bp, Artificial sequence
  SiRNA target sequence
gacaaaataataataagtgactgtcc

SEQ ID NO: 176965 - DNA, 26 bp, Artificial sequence
  SiRNA target sequence
acaaaataataataagtgactgtcct

SEQ ID NO: 176966 - DNA, 26 bp, Artificial sequence
  SiRNA target sequence
caaaataataataagtgactgtcctg

SEQ ID NO: 176967 - DNA, 26 bp, Artificial sequence
  SiRNA target sequence
aaaataataataagtgactgtcctgg

SEQ ID NO: 176968 - DNA, 26 bp, Artificial sequence
  SiRNA target sequence
aaataataataagtgactgtcctggg

SEQ ID NO: 176969 - DNA, 26 bp, Artificial sequence
  SiRNA target sequence
aataataataagtgactgtcctggga

SEQ ID NO: 176970 - DNA, 26 bp, Artificial sequence
  SiRNA target sequence
ataataataagtgactgtcctgggac

SEQ ID NO: 176971 - DNA, 26 bp, Artificial sequence
  SiRNA target sequence
taataataagtgactgtcctgggact

SEQ ID NO: 176972 - DNA, 26 bp, Artificial sequence
  SiRNA target sequence
aataataagtgactgtcctgggactg

SEQ ID NO: 176973 - DNA, 26 bp, Artificial sequence
  SiRNA target sequence
ataataagtgactgtcctgggactgt

SEQ ID NO: 176974 - DNA, 26 bp, Artificial sequence
  SiRNA target sequence
taataagtgactgtcctgggactgtt

SEQ ID NO: 176975 - DNA, 26 bp, Artificial sequence
  SiRNA target sequence
aataagtgactgtcctgggactgttt

SEQ ID NO: 176976 - DNA, 26 bp, Artificial sequence
  SiRNA target sequence
ataagtgactgtcctgggactgtttc

SEQ ID NO: 176977 - DNA, 26 bp, Artificial sequence
  SiRNA target sequence
taagtgactgtcctgggactgtttca

SEQ ID NO: 176978 - DNA, 26 bp, Artificial sequence
  SiRNA target sequence
aagtgactgtcctgggactgtttcat

SEQ ID NO: 176979 - DNA, 26 bp, Artificial sequence
  SiRNA target sequence
agtgactgtcctgggactgtttcata

SEQ ID NO: 176980 - DNA, 26 bp, Artificial sequence
  SiRNA target sequence
gtgactgtcctgggactgtttcatat

SEQ ID NO: 176981 - DNA, 26 bp, Artificial sequence
  SiRNA target sequence
tgactgtcctgggactgtttcatata

SEQ ID NO: 176982 - DNA, 26 bp, Artificial sequence
  SiRNA target sequence
gactgtcctgggactgtttcatatat

SEQ ID NO: 176983 - DNA, 26 bp, Artificial sequence
  SiRNA target sequence
actgtcctgggactgtttcatatatt

SEQ ID NO: 176984 - DNA, 26 bp, Artificial sequence
  SiRNA target sequence
ctgtcctgggactgtttcatatattg

SEQ ID NO: 176985 - DNA, 26 bp, Artificial sequence
  SiRNA target sequence
tgtcctgggactgtttcatatattga

SEQ ID NO: 176986 - DNA, 26 bp, Artificial sequence
  SiRNA target sequence
gtcctgggactgtttcatatattgaa

SEQ ID NO: 176987 - DNA, 26 bp, Artificial sequence
  SiRNA target sequence
tcctgggactgtttcatatattgaaa

SEQ ID NO: 176988 - DNA, 26 bp, Artificial sequence
  SiRNA target sequence
cctgggactgtttcatatattgaaag

SEQ ID NO: 176989 - DNA, 26 bp, Artificial sequence
  SiRNA target sequence
ctgggactgtttcatatattgaaagg

SEQ ID NO: 176990 - DNA, 26 bp, Artificial sequence
  SiRNA target sequence
tgggactgtttcatatattgaaaggc

SEQ ID NO: 176991 - DNA, 26 bp, Artificial sequence
  SiRNA target sequence
gggactgtttcatatattgaaaggca

SEQ ID NO: 176992 - DNA, 26 bp, Artificial sequence
  SiRNA target sequence
ggactgtttcatatattgaaaggcaa

SEQ ID NO: 176993 - DNA, 26 bp, Artificial sequence
  SiRNA target sequence
gactgtttcatatattgaaaggcaag

SEQ ID NO: 176994 - DNA, 26 bp, Artificial sequence
  SiRNA target sequence
actgtttcatatattgaaaggcaagc

SEQ ID NO: 176995 - DNA, 26 bp, Artificial sequence
  SiRNA target sequence
ctgtttcatatattgaaaggcaagca

SEQ ID NO: 176996 - DNA, 26 bp, Artificial sequence
  SiRNA target sequence
tgtttcatatattgaaaggcaagcac

SEQ ID NO: 176997 - DNA, 26 bp, Artificial sequence
  SiRNA target sequence
gtttcatatattgaaaggcaagcaca

SEQ ID NO: 176998 - DNA, 26 bp, Artificial sequence
  SiRNA target sequence
tttcatatattgaaaggcaagcacac

SEQ ID NO: 176999 - DNA, 26 bp, Artificial sequence
  SiRNA target sequence
ttcatatattgaaaggcaagcacacc

SEQ ID NO: 177000 - DNA, 26 bp, Artificial sequence
  SiRNA target sequence
tcatatattgaaaggcaagcacacca

SEQ ID NO: 177001 - DNA, 26 bp, Artificial sequence
  SiRNA target sequence
catatattgaaaggcaagcacaccat

SEQ ID NO: 177002 - DNA, 26 bp, Artificial sequence
  SiRNA target sequence
atatattgaaaggcaagcacaccatt

SEQ ID NO: 177003 - DNA, 26 bp, Artificial sequence
  SiRNA target sequence
tatattgaaaggcaagcacaccattt

SEQ ID NO: 177004 - DNA, 26 bp, Artificial sequence
  SiRNA target sequence
atattgaaaggcaagcacaccattta

SEQ ID NO: 177005 - DNA, 26 bp, Artificial sequence
  SiRNA target sequence
tattgaaaggcaagcacaccatttaa

SEQ ID NO: 177006 - DNA, 26 bp, Artificial sequence
  SiRNA target sequence
attgaaaggcaagcacaccatttaat

SEQ ID NO: 177007 - DNA, 26 bp, Artificial sequence
  SiRNA target sequence
ttgaaaggcaagcacaccatttaatt

SEQ ID NO: 177008 - DNA, 26 bp, Artificial sequence
  SiRNA target sequence
tgaaaggcaagcacaccatttaattg

SEQ ID NO: 177009 - DNA, 26 bp, Artificial sequence
  SiRNA target sequence
gaaaggcaagcacaccatttaattga

SEQ ID NO: 177010 - DNA, 26 bp, Artificial sequence
  SiRNA target sequence
aaaggcaagcacaccatttaattgaa

SEQ ID NO: 177011 - DNA, 26 bp, Artificial sequence
  SiRNA target sequence
aaggcaagcacaccatttaattgaat

SEQ ID NO: 177012 - DNA, 26 bp, Artificial sequence
  SiRNA target sequence
aggcaagcacaccatttaattgaata

SEQ ID NO: 177013 - DNA, 26 bp, Artificial sequence
  SiRNA target sequence
ggcaagcacaccatttaattgaatat

SEQ ID NO: 177014 - DNA, 26 bp, Artificial sequence
  SiRNA target sequence
gcaagcacaccatttaattgaatatt

SEQ ID NO: 177015 - DNA, 26 bp, Artificial sequence
  SiRNA target sequence
caagcacaccatttaattgaatattt

SEQ ID NO: 177016 - DNA, 26 bp, Artificial sequence
  SiRNA target sequence
aagcacaccatttaattgaatattta

SEQ ID NO: 177017 - DNA, 26 bp, Artificial sequence
  SiRNA target sequence
agcacaccatttaattgaatatttat

SEQ ID NO: 177018 - DNA, 26 bp, Artificial sequence
  SiRNA target sequence
gcacaccatttaattgaatatttatc

SEQ ID NO: 177019 - DNA, 26 bp, Artificial sequence
  SiRNA target sequence
cacaccatttaattgaatatttatct

SEQ ID NO: 177020 - DNA, 26 bp, Artificial sequence
  SiRNA target sequence
acaccatttaattgaatatttatctg

SEQ ID NO: 177021 - DNA, 26 bp, Artificial sequence
  SiRNA target sequence
caccatttaattgaatatttatctgt

SEQ ID NO: 177022 - DNA, 26 bp, Artificial sequence
  SiRNA target sequence
accatttaattgaatatttatctgtt

SEQ ID NO: 177023 - DNA, 26 bp, Artificial sequence
  SiRNA target sequence
ccatttaattgaatatttatctgtta

SEQ ID NO: 177024 - DNA, 26 bp, Artificial sequence
  SiRNA target sequence
catttaattgaatatttatctgttac

SEQ ID NO: 177025 - DNA, 26 bp, Artificial sequence
  SiRNA target sequence
atttaattgaatatttatctgttact

SEQ ID NO: 177026 - DNA, 26 bp, Artificial sequence
  SiRNA target sequence
tttaattgaatatttatctgttactt

SEQ ID NO: 177027 - DNA, 26 bp, Artificial sequence
  SiRNA target sequence
ttaattgaatatttatctgttacttc

SEQ ID NO: 177028 - DNA, 26 bp, Artificial sequence
  SiRNA target sequence
taattgaatatttatctgttacttct

SEQ ID NO: 177029 - DNA, 26 bp, Artificial sequence
  SiRNA target sequence
aattgaatatttatctgttacttcta

SEQ ID NO: 177030 - DNA, 26 bp, Artificial sequence
  SiRNA target sequence
attgaatatttatctgttacttctac

SEQ ID NO: 177031 - DNA, 26 bp, Artificial sequence
  SiRNA target sequence
ttgaatatttatctgttacttctaca

SEQ ID NO: 177032 - DNA, 26 bp, Artificial sequence
  SiRNA target sequence
tgaatatttatctgttacttctacac

SEQ ID NO: 177033 - DNA, 26 bp, Artificial sequence
  SiRNA target sequence
gaatatttatctgttacttctacaca

SEQ ID NO: 177034 - DNA, 26 bp, Artificial sequence
  SiRNA target sequence
aatatttatctgttacttctacacaa

SEQ ID NO: 177035 - DNA, 26 bp, Artificial sequence
  SiRNA target sequence
atatttatctgttacttctacacaac

SEQ ID NO: 177036 - DNA, 26 bp, Artificial sequence
  SiRNA target sequence
tatttatctgttacttctacacaaca

SEQ ID NO: 177037 - DNA, 26 bp, Artificial sequence
  SiRNA target sequence
atttatctgttacttctacacaacaa

SEQ ID NO: 177038 - DNA, 26 bp, Artificial sequence
  SiRNA target sequence
tttatctgttacttctacacaacaac

SEQ ID NO: 177039 - DNA, 26 bp, Artificial sequence
  SiRNA target sequence
ttatctgttacttctacacaacaaca

SEQ ID NO: 177040 - DNA, 26 bp, Artificial sequence
  SiRNA target sequence
tatctgttacttctacacaacaacaa

SEQ ID NO: 177041 - DNA, 26 bp, Artificial sequence
  SiRNA target sequence
atctgttacttctacacaacaacaag

SEQ ID NO: 177042 - DNA, 26 bp, Artificial sequence
  SiRNA target sequence
tctgttacttctacacaacaacaagc

SEQ ID NO: 177043 - DNA, 26 bp, Artificial sequence
  SiRNA target sequence
ctgttacttctacacaacaacaagcc

SEQ ID NO: 177044 - DNA, 26 bp, Artificial sequence
  SiRNA target sequence
tgttacttctacacaacaacaagcca

SEQ ID NO: 177045 - DNA, 26 bp, Artificial sequence
  SiRNA target sequence
gttacttctacacaacaacaagccat

SEQ ID NO: 177046 - DNA, 26 bp, Artificial sequence
  SiRNA target sequence
ttacttctacacaacaacaagccata

SEQ ID NO: 177047 - DNA, 26 bp, Artificial sequence
  SiRNA target sequence
tacttctacacaacaacaagccataa

SEQ ID NO: 177048 - DNA, 26 bp, Artificial sequence
  SiRNA target sequence
acttctacacaacaacaagccataaa

SEQ ID NO: 177049 - DNA, 26 bp, Artificial sequence
  SiRNA target sequence
cttctacacaacaacaagccataaag

SEQ ID NO: 177050 - DNA, 26 bp, Artificial sequence
  SiRNA target sequence
ttctacacaacaacaagccataaagc

SEQ ID NO: 177051 - DNA, 26 bp, Artificial sequence
  SiRNA target sequence
tctacacaacaacaagccataaagct

SEQ ID NO: 177052 - DNA, 26 bp, Artificial sequence
  SiRNA target sequence
ctacacaacaacaagccataaagcta

SEQ ID NO: 177053 - DNA, 26 bp, Artificial sequence
  SiRNA target sequence
tacacaacaacaagccataaagctac

SEQ ID NO: 177054 - DNA, 26 bp, Artificial sequence
  SiRNA target sequence
acacaacaacaagccataaagctact

SEQ ID NO: 177055 - DNA, 26 bp, Artificial sequence
  SiRNA target sequence
cacaacaacaagccataaagctactt

SEQ ID NO: 177056 - DNA, 26 bp, Artificial sequence
  SiRNA target sequence
acaacaacaagccataaagctacttg

SEQ ID NO: 177057 - DNA, 26 bp, Artificial sequence
  SiRNA target sequence
caacaacaagccataaagctacttgc

SEQ ID NO: 177058 - DNA, 26 bp, Artificial sequence
  SiRNA target sequence
aacaacaagccataaagctacttgct

SEQ ID NO: 177059 - DNA, 26 bp, Artificial sequence
  SiRNA target sequence
acaacaagccataaagctacttgctc

SEQ ID NO: 177060 - DNA, 26 bp, Artificial sequence
  SiRNA target sequence
caacaagccataaagctacttgctca

SEQ ID NO: 177061 - DNA, 26 bp, Artificial sequence
  SiRNA target sequence
aacaagccataaagctacttgctcag

SEQ ID NO: 177062 - DNA, 26 bp, Artificial sequence
  SiRNA target sequence
acaagccataaagctacttgctcagg

SEQ ID NO: 177063 - DNA, 26 bp, Artificial sequence
  SiRNA target sequence
caagccataaagctacttgctcaggg

SEQ ID NO: 177064 - DNA, 26 bp, Artificial sequence
  SiRNA target sequence
aagccataaagctacttgctcagggg

SEQ ID NO: 177065 - DNA, 26 bp, Artificial sequence
  SiRNA target sequence
agccataaagctacttgctcaggggc

SEQ ID NO: 177066 - DNA, 26 bp, Artificial sequence
  SiRNA target sequence
gccataaagctacttgctcaggggcg

SEQ ID NO: 177067 - DNA, 26 bp, Artificial sequence
  SiRNA target sequence
ccataaagctacttgctcaggggcga

SEQ ID NO: 177068 - DNA, 26 bp, Artificial sequence
  SiRNA target sequence
cataaagctacttgctcaggggcgaa

SEQ ID NO: 177069 - DNA, 26 bp, Artificial sequence
  SiRNA target sequence
ataaagctacttgctcaggggcgaag

SEQ ID NO: 177070 - DNA, 26 bp, Artificial sequence
  SiRNA target sequence
taaagctacttgctcaggggcgaagt

SEQ ID NO: 177071 - DNA, 26 bp, Artificial sequence
  SiRNA target sequence
aaagctacttgctcaggggcgaagta

SEQ ID NO: 177072 - DNA, 26 bp, Artificial sequence
  SiRNA target sequence
aagctacttgctcaggggcgaagtat

SEQ ID NO: 177073 - DNA, 26 bp, Artificial sequence
  SiRNA target sequence
agctacttgctcaggggcgaagtata

SEQ ID NO: 177074 - DNA, 26 bp, Artificial sequence
  SiRNA target sequence
gctacttgctcaggggcgaagtataa

SEQ ID NO: 177075 - DNA, 26 bp, Artificial sequence
  SiRNA target sequence
ctacttgctcaggggcgaagtataag

SEQ ID NO: 177076 - DNA, 26 bp, Artificial sequence
  SiRNA target sequence
tacttgctcaggggcgaagtataagt

SEQ ID NO: 177077 - DNA, 26 bp, Artificial sequence
  SiRNA target sequence
acttgctcaggggcgaagtataagtg

SEQ ID NO: 177078 - DNA, 26 bp, Artificial sequence
  SiRNA target sequence
cttgctcaggggcgaagtataagtgt

SEQ ID NO: 177079 - DNA, 26 bp, Artificial sequence
  SiRNA target sequence
ttgctcaggggcgaagtataagtgtc

SEQ ID NO: 177080 - DNA, 26 bp, Artificial sequence
  SiRNA target sequence
tgctcaggggcgaagtataagtgtca

SEQ ID NO: 177081 - DNA, 26 bp, Artificial sequence
  SiRNA target sequence
gctcaggggcgaagtataagtgtcat

SEQ ID NO: 177082 - DNA, 26 bp, Artificial sequence
  SiRNA target sequence
ctcaggggcgaagtataagtgtcata

SEQ ID NO: 177083 - DNA, 26 bp, Artificial sequence
  SiRNA target sequence
tcaggggcgaagtataagtgtcatac

SEQ ID NO: 177084 - DNA, 26 bp, Artificial sequence
  SiRNA target sequence
caggggcgaagtataagtgtcataca

SEQ ID NO: 177085 - DNA, 26 bp, Artificial sequence
  SiRNA target sequence
aggggcgaagtataagtgtcatacag

SEQ ID NO: 177086 - DNA, 26 bp, Artificial sequence
  SiRNA target sequence
ggggcgaagtataagtgtcatacagt

SEQ ID NO: 177087 - DNA, 26 bp, Artificial sequence
  SiRNA target sequence
gggcgaagtataagtgtcatacagtg

SEQ ID NO: 177088 - DNA, 26 bp, Artificial sequence
  SiRNA target sequence
ggcgaagtataagtgtcatacagtgc

SEQ ID NO: 177089 - DNA, 26 bp, Artificial sequence
  SiRNA target sequence
gcgaagtataagtgtcatacagtgct

SEQ ID NO: 177090 - DNA, 26 bp, Artificial sequence
  SiRNA target sequence
cgaagtataagtgtcatacagtgcta

SEQ ID NO: 177091 - DNA, 26 bp, Artificial sequence
  SiRNA target sequence
gaagtataagtgtcatacagtgctat

SEQ ID NO: 177092 - DNA, 26 bp, Artificial sequence
  SiRNA target sequence
aagtataagtgtcatacagtgctatg

SEQ ID NO: 177093 - DNA, 26 bp, Artificial sequence
  SiRNA target sequence
agtataagtgtcatacagtgctatga

SEQ ID NO: 177094 - DNA, 26 bp, Artificial sequence
  SiRNA target sequence
gtataagtgtcatacagtgctatgat

SEQ ID NO: 177095 - DNA, 26 bp, Artificial sequence
  SiRNA target sequence
tataagtgtcatacagtgctatgata

SEQ ID NO: 177096 - DNA, 26 bp, Artificial sequence
  SiRNA target sequence
ataagtgtcatacagtgctatgataa

SEQ ID NO: 177097 - DNA, 26 bp, Artificial sequence
  SiRNA target sequence
taagtgtcatacagtgctatgataaa

SEQ ID NO: 177098 - DNA, 26 bp, Artificial sequence
  SiRNA target sequence
aagtgtcatacagtgctatgataaat

SEQ ID NO: 177099 - DNA, 26 bp, Artificial sequence
  SiRNA target sequence
agtgtcatacagtgctatgataaatt

SEQ ID NO: 177100 - DNA, 26 bp, Artificial sequence
  SiRNA target sequence
gtgtcatacagtgctatgataaattt

SEQ ID NO: 177101 - DNA, 26 bp, Artificial sequence
  SiRNA target sequence
tgtcatacagtgctatgataaatttt

SEQ ID NO: 177102 - DNA, 26 bp, Artificial sequence
  SiRNA target sequence
gtcatacagtgctatgataaattttt

SEQ ID NO: 177103 - DNA, 26 bp, Artificial sequence
  SiRNA target sequence
tcatacagtgctatgataaattttta

SEQ ID NO: 177104 - DNA, 26 bp, Artificial sequence
  SiRNA target sequence
catacagtgctatgataaatttttag

SEQ ID NO: 177105 - DNA, 26 bp, Artificial sequence
  SiRNA target sequence
atacagtgctatgataaatttttaga

SEQ ID NO: 177106 - DNA, 26 bp, Artificial sequence
  SiRNA target sequence
tacagtgctatgataaatttttagag

SEQ ID NO: 177107 - DNA, 26 bp, Artificial sequence
  SiRNA target sequence
acagtgctatgataaatttttagaga

SEQ ID NO: 177108 - DNA, 26 bp, Artificial sequence
  SiRNA target sequence
cagtgctatgataaatttttagagaa

SEQ ID NO: 177109 - DNA, 26 bp, Artificial sequence
  SiRNA target sequence
agtgctatgataaatttttagagaat

SEQ ID NO: 177110 - DNA, 26 bp, Artificial sequence
  SiRNA target sequence
gtgctatgataaatttttagagaata

SEQ ID NO: 177111 - DNA, 26 bp, Artificial sequence
  SiRNA target sequence
tgctatgataaatttttagagaatag

SEQ ID NO: 177112 - DNA, 26 bp, Artificial sequence
  SiRNA target sequence
gctatgataaatttttagagaatagc

SEQ ID NO: 177113 - DNA, 26 bp, Artificial sequence
  SiRNA target sequence
ctatgataaatttttagagaatagcg

SEQ ID NO: 177114 - DNA, 26 bp, Artificial sequence
  SiRNA target sequence
tatgataaatttttagagaatagcga

SEQ ID NO: 177115 - DNA, 26 bp, Artificial sequence
  SiRNA target sequence
atgataaatttttagagaatagcgat

SEQ ID NO: 177116 - DNA, 26 bp, Artificial sequence
  SiRNA target sequence
tgataaatttttagagaatagcgatg

SEQ ID NO: 177117 - DNA, 26 bp, Artificial sequence
  SiRNA target sequence
gataaatttttagagaatagcgatga

SEQ ID NO: 177118 - DNA, 26 bp, Artificial sequence
  SiRNA target sequence
ataaatttttagagaatagcgatgat

SEQ ID NO: 177119 - DNA, 26 bp, Artificial sequence
  SiRNA target sequence
taaatttttagagaatagcgatgatg

SEQ ID NO: 177120 - DNA, 26 bp, Artificial sequence
  SiRNA target sequence
aaatttttagagaatagcgatgatgt

SEQ ID NO: 177121 - DNA, 26 bp, Artificial sequence
  SiRNA target sequence
aatttttagagaatagcgatgatgtt

SEQ ID NO: 177122 - DNA, 26 bp, Artificial sequence
  SiRNA target sequence
atttttagagaatagcgatgatgttt

SEQ ID NO: 177123 - DNA, 26 bp, Artificial sequence
  SiRNA target sequence
tttttagagaatagcgatgatgtttt

SEQ ID NO: 177124 - DNA, 26 bp, Artificial sequence
  SiRNA target sequence
ttttagagaatagcgatgatgtttta

SEQ ID NO: 177125 - DNA, 26 bp, Artificial sequence
  SiRNA target sequence
tttagagaatagcgatgatgttttaa

SEQ ID NO: 177126 - DNA, 26 bp, Artificial sequence
  SiRNA target sequence
ttagagaatagcgatgatgttttaac

SEQ ID NO: 177127 - DNA, 26 bp, Artificial sequence
  SiRNA target sequence
tagagaatagcgatgatgttttaact

SEQ ID NO: 177128 - DNA, 26 bp, Artificial sequence
  SiRNA target sequence
agagaatagcgatgatgttttaacta

SEQ ID NO: 177129 - DNA, 26 bp, Artificial sequence
  SiRNA target sequence
gagaatagcgatgatgttttaactac

SEQ ID NO: 177130 - DNA, 26 bp, Artificial sequence
  SiRNA target sequence
agaatagcgatgatgttttaactacc

SEQ ID NO: 177131 - DNA, 26 bp, Artificial sequence
  SiRNA target sequence
gaatagcgatgatgttttaactacct

SEQ ID NO: 177132 - DNA, 26 bp, Artificial sequence
  SiRNA target sequence
aatagcgatgatgttttaactaccta

SEQ ID NO: 177133 - DNA, 26 bp, Artificial sequence
  SiRNA target sequence
atagcgatgatgttttaactacctat

SEQ ID NO: 177134 - DNA, 26 bp, Artificial sequence
  SiRNA target sequence
tagcgatgatgttttaactacctatg

SEQ ID NO: 177135 - DNA, 26 bp, Artificial sequence
  SiRNA target sequence
agcgatgatgttttaactacctatga

SEQ ID NO: 177136 - DNA, 26 bp, Artificial sequence
  SiRNA target sequence
gcgatgatgttttaactacctatgat

SEQ ID NO: 177137 - DNA, 26 bp, Artificial sequence
  SiRNA target sequence
cgatgatgttttaactacctatgatt

SEQ ID NO: 177138 - DNA, 26 bp, Artificial sequence
  SiRNA target sequence
gatgatgttttaactacctatgattt

SEQ ID NO: 177139 - DNA, 26 bp, Artificial sequence
  SiRNA target sequence
atgatgttttaactacctatgatttt

SEQ ID NO: 177140 - DNA, 26 bp, Artificial sequence
  SiRNA target sequence
tgatgttttaactacctatgattttt

SEQ ID NO: 177141 - DNA, 26 bp, Artificial sequence
  SiRNA target sequence
gatgttttaactacctatgattttta

SEQ ID NO: 177142 - DNA, 26 bp, Artificial sequence
  SiRNA target sequence
atgttttaactacctatgatttttat

SEQ ID NO: 177143 - DNA, 26 bp, Artificial sequence
  SiRNA target sequence
tgttttaactacctatgatttttata

SEQ ID NO: 177144 - DNA, 26 bp, Artificial sequence
  SiRNA target sequence
gttttaactacctatgatttttataa

SEQ ID NO: 177145 - DNA, 26 bp, Artificial sequence
  SiRNA target sequence
ttttaactacctatgatttttataaa

SEQ ID NO: 177146 - DNA, 26 bp, Artificial sequence
  SiRNA target sequence
tttaactacctatgatttttataaaa

SEQ ID NO: 177147 - DNA, 26 bp, Artificial sequence
  SiRNA target sequence
ttaactacctatgatttttataaaat

SEQ ID NO: 177148 - DNA, 26 bp, Artificial sequence
  SiRNA target sequence
taactacctatgatttttataaaatg

SEQ ID NO: 177149 - DNA, 26 bp, Artificial sequence
  SiRNA target sequence
aactacctatgatttttataaaatga

SEQ ID NO: 177150 - DNA, 26 bp, Artificial sequence
  SiRNA target sequence
actacctatgatttttataaaatgat

SEQ ID NO: 177151 - DNA, 26 bp, Artificial sequence
  SiRNA target sequence
ctacctatgatttttataaaatgatt

SEQ ID NO: 177152 - DNA, 26 bp, Artificial sequence
  SiRNA target sequence
tacctatgatttttataaaatgattt

SEQ ID NO: 177153 - DNA, 26 bp, Artificial sequence
  SiRNA target sequence
acctatgatttttataaaatgatttt

SEQ ID NO: 177154 - DNA, 26 bp, Artificial sequence
  SiRNA target sequence
cctatgatttttataaaatgattttg

SEQ ID NO: 177155 - DNA, 26 bp, Artificial sequence
  SiRNA target sequence
ctatgatttttataaaatgattttgg

SEQ ID NO: 177156 - DNA, 26 bp, Artificial sequence
  SiRNA target sequence
tatgatttttataaaatgattttgga

SEQ ID NO: 177157 - DNA, 26 bp, Artificial sequence
  SiRNA target sequence
atgatttttataaaatgattttggat

SEQ ID NO: 177158 - DNA, 26 bp, Artificial sequence
  SiRNA target sequence
tgatttttataaaatgattttggatc

SEQ ID NO: 177159 - DNA, 26 bp, Artificial sequence
  SiRNA target sequence
gatttttataaaatgattttggatct

SEQ ID NO: 177160 - DNA, 26 bp, Artificial sequence
  SiRNA target sequence
atttttataaaatgattttggatcta

SEQ ID NO: 177161 - DNA, 26 bp, Artificial sequence
  SiRNA target sequence
tttttataaaatgattttggatctag

SEQ ID NO: 177162 - DNA, 26 bp, Artificial sequence
  SiRNA target sequence
ttttataaaatgattttggatctagg

SEQ ID NO: 177163 - DNA, 26 bp, Artificial sequence
  SiRNA target sequence
tttataaaatgattttggatctagga

SEQ ID NO: 177164 - DNA, 26 bp, Artificial sequence
  SiRNA target sequence
ttataaaatgattttggatctaggat

SEQ ID NO: 177165 - DNA, 26 bp, Artificial sequence
  SiRNA target sequence
tataaaatgattttggatctaggatt

SEQ ID NO: 177166 - DNA, 26 bp, Artificial sequence
  SiRNA target sequence
ataaaatgattttggatctaggattt

SEQ ID NO: 177167 - DNA, 26 bp, Artificial sequence
  SiRNA target sequence
taaaatgattttggatctaggatttt

SEQ ID NO: 177168 - DNA, 26 bp, Artificial sequence
  SiRNA target sequence
aaaatgattttggatctaggattttt

SEQ ID NO: 177169 - DNA, 26 bp, Artificial sequence
  SiRNA target sequence
aaatgattttggatctaggattttta

SEQ ID NO: 177170 - DNA, 26 bp, Artificial sequence
  SiRNA target sequence
aatgattttggatctaggatttttac

SEQ ID NO: 177171 - DNA, 26 bp, Artificial sequence
  SiRNA target sequence
atgattttggatctaggatttttaca

SEQ ID NO: 177172 - DNA, 26 bp, Artificial sequence
  SiRNA target sequence
tgattttggatctaggatttttacag

SEQ ID NO: 177173 - DNA, 26 bp, Artificial sequence
  SiRNA target sequence
gattttggatctaggatttttacagc

SEQ ID NO: 177174 - DNA, 26 bp, Artificial sequence
  SiRNA target sequence
attttggatctaggatttttacagca

SEQ ID NO: 177175 - DNA, 26 bp, Artificial sequence
  SiRNA target sequence
ttttggatctaggatttttacagcat

SEQ ID NO: 177176 - DNA, 26 bp, Artificial sequence
  SiRNA target sequence
tttggatctaggatttttacagcata

SEQ ID NO: 177177 - DNA, 26 bp, Artificial sequence
  SiRNA target sequence
ttggatctaggatttttacagcataa

SEQ ID NO: 177178 - DNA, 26 bp, Artificial sequence
  SiRNA target sequence
tggatctaggatttttacagcataat

SEQ ID NO: 177179 - DNA, 26 bp, Artificial sequence
  SiRNA target sequence
ggatctaggatttttacagcataatt

SEQ ID NO: 177180 - DNA, 26 bp, Artificial sequence
  SiRNA target sequence
gatctaggatttttacagcataattt

SEQ ID NO: 177181 - DNA, 26 bp, Artificial sequence
  SiRNA target sequence
atctaggatttttacagcataatttt

SEQ ID NO: 177182 - DNA, 26 bp, Artificial sequence
  SiRNA target sequence
tctaggatttttacagcataatttta

SEQ ID NO: 177183 - DNA, 26 bp, Artificial sequence
  SiRNA target sequence
ctaggatttttacagcataattttat

SEQ ID NO: 177184 - DNA, 26 bp, Artificial sequence
  SiRNA target sequence
taggatttttacagcataattttatt

SEQ ID NO: 177185 - DNA, 26 bp, Artificial sequence
  SiRNA target sequence
aggatttttacagcataattttatta

SEQ ID NO: 177186 - DNA, 26 bp, Artificial sequence
  SiRNA target sequence
ggatttttacagcataattttattaa

SEQ ID NO: 177187 - DNA, 26 bp, Artificial sequence
  SiRNA target sequence
gatttttacagcataattttattaaa

SEQ ID NO: 177188 - DNA, 26 bp, Artificial sequence
  SiRNA target sequence
atttttacagcataattttattaaag

SEQ ID NO: 177189 - DNA, 26 bp, Artificial sequence
  SiRNA target sequence
tttttacagcataattttattaaagg

SEQ ID NO: 177190 - DNA, 26 bp, Artificial sequence
  SiRNA target sequence
ttttacagcataattttattaaagga

SEQ ID NO: 177191 - DNA, 26 bp, Artificial sequence
  SiRNA target sequence
tttacagcataattttattaaaggaa

SEQ ID NO: 177192 - DNA, 26 bp, Artificial sequence
  SiRNA target sequence
ttacagcataattttattaaaggaac

SEQ ID NO: 177193 - DNA, 26 bp, Artificial sequence
  SiRNA target sequence
tacagcataattttattaaaggaacc

SEQ ID NO: 177194 - DNA, 26 bp, Artificial sequence
  SiRNA target sequence
acagcataattttattaaaggaacct

SEQ ID NO: 177195 - DNA, 26 bp, Artificial sequence
  SiRNA target sequence
cagcataattttattaaaggaacctg

SEQ ID NO: 177196 - DNA, 26 bp, Artificial sequence
  SiRNA target sequence
agcataattttattaaaggaacctgt

SEQ ID NO: 177197 - DNA, 26 bp, Artificial sequence
  SiRNA target sequence
gcataattttattaaaggaacctgtg

SEQ ID NO: 177198 - DNA, 26 bp, Artificial sequence
  SiRNA target sequence
cataattttattaaaggaacctgtga

SEQ ID NO: 177199 - DNA, 26 bp, Artificial sequence
  SiRNA target sequence
ataattttattaaaggaacctgtgag

SEQ ID NO: 177200 - DNA, 26 bp, Artificial sequence
  SiRNA target sequence
taattttattaaaggaacctgtgaga

SEQ ID NO: 177201 - DNA, 26 bp, Artificial sequence
  SiRNA target sequence
aattttattaaaggaacctgtgagaa

SEQ ID NO: 177202 - DNA, 26 bp, Artificial sequence
  SiRNA target sequence
attttattaaaggaacctgtgagaaa

SEQ ID NO: 177203 - DNA, 26 bp, Artificial sequence
  SiRNA target sequence
ttttattaaaggaacctgtgagaaat

SEQ ID NO: 177204 - DNA, 26 bp, Artificial sequence
  SiRNA target sequence
tttattaaaggaacctgtgagaaatg

SEQ ID NO: 177205 - DNA, 26 bp, Artificial sequence
  SiRNA target sequence
ttattaaaggaacctgtgagaaatgg

SEQ ID NO: 177206 - DNA, 26 bp, Artificial sequence
  SiRNA target sequence
tattaaaggaacctgtgagaaatggg

SEQ ID NO: 177207 - DNA, 26 bp, Artificial sequence
  SiRNA target sequence
attaaaggaacctgtgagaaatggga

SEQ ID NO: 177208 - DNA, 26 bp, Artificial sequence
  SiRNA target sequence
ttaaaggaacctgtgagaaatgggag

SEQ ID NO: 177209 - DNA, 26 bp, Artificial sequence
  SiRNA target sequence
taaaggaacctgtgagaaatgggaga

SEQ ID NO: 177210 - DNA, 26 bp, Artificial sequence
  SiRNA target sequence
aaaggaacctgtgagaaatgggagaa

SEQ ID NO: 177211 - DNA, 26 bp, Artificial sequence
  SiRNA target sequence
aaggaacctgtgagaaatgggagaag

SEQ ID NO: 177212 - DNA, 26 bp, Artificial sequence
  SiRNA target sequence
aggaacctgtgagaaatgggagaagt

SEQ ID NO: 177213 - DNA, 26 bp, Artificial sequence
  SiRNA target sequence
ggaacctgtgagaaatgggagaagtg

SEQ ID NO: 177214 - DNA, 26 bp, Artificial sequence
  SiRNA target sequence
gaacctgtgagaaatgggagaagtgt

SEQ ID NO: 177215 - DNA, 26 bp, Artificial sequence
  SiRNA target sequence
aacctgtgagaaatgggagaagtgta

SEQ ID NO: 177216 - DNA, 26 bp, Artificial sequence
  SiRNA target sequence
acctgtgagaaatgggagaagtgtac

SEQ ID NO: 177217 - DNA, 26 bp, Artificial sequence
  SiRNA target sequence
cctgtgagaaatgggagaagtgtact

SEQ ID NO: 177218 - DNA, 26 bp, Artificial sequence
  SiRNA target sequence
ctgtgagaaatgggagaagtgtacta

SEQ ID NO: 177219 - DNA, 26 bp, Artificial sequence
  SiRNA target sequence
tgtgagaaatgggagaagtgtactat

SEQ ID NO: 177220 - DNA, 26 bp, Artificial sequence
  SiRNA target sequence
gtgagaaatgggagaagtgtactatt

SEQ ID NO: 177221 - DNA, 26 bp, Artificial sequence
  SiRNA target sequence
tgagaaatgggagaagtgtactattg

SEQ ID NO: 177222 - DNA, 26 bp, Artificial sequence
  SiRNA target sequence
gagaaatgggagaagtgtactattgg

SEQ ID NO: 177223 - DNA, 26 bp, Artificial sequence
  SiRNA target sequence
agaaatgggagaagtgtactattgga

SEQ ID NO: 177224 - DNA, 26 bp, Artificial sequence
  SiRNA target sequence
gaaatgggagaagtgtactattggat

SEQ ID NO: 177225 - DNA, 26 bp, Artificial sequence
  SiRNA target sequence
aaatgggagaagtgtactattggata

SEQ ID NO: 177226 - DNA, 26 bp, Artificial sequence
  SiRNA target sequence
aatgggagaagtgtactattggatat

SEQ ID NO: 177227 - DNA, 26 bp, Artificial sequence
  SiRNA target sequence
atgggagaagtgtactattggatatc

SEQ ID NO: 177228 - DNA, 26 bp, Artificial sequence
  SiRNA target sequence
tgggagaagtgtactattggatatca

SEQ ID NO: 177229 - DNA, 26 bp, Artificial sequence
  SiRNA target sequence
gggagaagtgtactattggatatcat

SEQ ID NO: 177230 - DNA, 26 bp, Artificial sequence
  SiRNA target sequence
ggagaagtgtactattggatatcatt

SEQ ID NO: 177231 - DNA, 26 bp, Artificial sequence
  SiRNA target sequence
gagaagtgtactattggatatcatta

SEQ ID NO: 177232 - DNA, 26 bp, Artificial sequence
  SiRNA target sequence
agaagtgtactattggatatcattat

SEQ ID NO: 177233 - DNA, 26 bp, Artificial sequence
  SiRNA target sequence
gaagtgtactattggatatcattatg

SEQ ID NO: 177234 - DNA, 26 bp, Artificial sequence
  SiRNA target sequence
aagtgtactattggatatcattatgg

SEQ ID NO: 177235 - DNA, 26 bp, Artificial sequence
  SiRNA target sequence
agtgtactattggatatcattatgga

SEQ ID NO: 177236 - DNA, 26 bp, Artificial sequence
  SiRNA target sequence
gtgtactattggatatcattatggat

SEQ ID NO: 177237 - DNA, 26 bp, Artificial sequence
  SiRNA target sequence
tgtactattggatatcattatggata

SEQ ID NO: 177238 - DNA, 26 bp, Artificial sequence
  SiRNA target sequence
gtactattggatatcattatggatat

SEQ ID NO: 177239 - DNA, 26 bp, Artificial sequence
  SiRNA target sequence
tactattggatatcattatggatatt

SEQ ID NO: 177240 - DNA, 26 bp, Artificial sequence
  SiRNA target sequence
actattggatatcattatggatattt

SEQ ID NO: 177241 - DNA, 26 bp, Artificial sequence
  SiRNA target sequence
ctattggatatcattatggatattta

SEQ ID NO: 177242 - DNA, 26 bp, Artificial sequence
  SiRNA target sequence
tattggatatcattatggatatttag

SEQ ID NO: 177243 - DNA, 26 bp, Artificial sequence
  SiRNA target sequence
attggatatcattatggatatttaga

SEQ ID NO: 177244 - DNA, 26 bp, Artificial sequence
  SiRNA target sequence
ttggatatcattatggatatttagaa

SEQ ID NO: 177245 - DNA, 26 bp, Artificial sequence
  SiRNA target sequence
tggatatcattatggatatttagaac

SEQ ID NO: 177246 - DNA, 26 bp, Artificial sequence
  SiRNA target sequence
ggatatcattatggatatttagaaca

SEQ ID NO: 177247 - DNA, 26 bp, Artificial sequence
  SiRNA target sequence
gatatcattatggatatttagaacac

SEQ ID NO: 177248 - DNA, 26 bp, Artificial sequence
  SiRNA target sequence
atatcattatggatatttagaacaca

SEQ ID NO: 177249 - DNA, 26 bp, Artificial sequence
  SiRNA target sequence
tatcattatggatatttagaacacat

SEQ ID NO: 177250 - DNA, 26 bp, Artificial sequence
  SiRNA target sequence
atcattatggatatttagaacacata

SEQ ID NO: 177251 - DNA, 26 bp, Artificial sequence
  SiRNA target sequence
tcattatggatatttagaacacatat

SEQ ID NO: 177252 - DNA, 26 bp, Artificial sequence
  SiRNA target sequence
cattatggatatttagaacacatatt

SEQ ID NO: 177253 - DNA, 26 bp, Artificial sequence
  SiRNA target sequence
attatggatatttagaacacatatta

SEQ ID NO: 177254 - DNA, 26 bp, Artificial sequence
  SiRNA target sequence
ttatggatatttagaacacatattaa

SEQ ID NO: 177255 - DNA, 26 bp, Artificial sequence
  SiRNA target sequence
tatggatatttagaacacatattaaa

SEQ ID NO: 177256 - DNA, 26 bp, Artificial sequence
  SiRNA target sequence
atggatatttagaacacatattaaat

SEQ ID NO: 177257 - DNA, 26 bp, Artificial sequence
  SiRNA target sequence
tggatatttagaacacatattaaata

SEQ ID NO: 177258 - DNA, 26 bp, Artificial sequence
  SiRNA target sequence
ggatatttagaacacatattaaataa

SEQ ID NO: 177259 - DNA, 26 bp, Artificial sequence
  SiRNA target sequence
gatatttagaacacatattaaataag

SEQ ID NO: 177260 - DNA, 26 bp, Artificial sequence
  SiRNA target sequence
atatttagaacacatattaaataaga

SEQ ID NO: 177261 - DNA, 26 bp, Artificial sequence
  SiRNA target sequence
tatttagaacacatattaaataagaa

SEQ ID NO: 177262 - DNA, 26 bp, Artificial sequence
  SiRNA target sequence
atttagaacacatattaaataagaag

SEQ ID NO: 177263 - DNA, 26 bp, Artificial sequence
  SiRNA target sequence
tttagaacacatattaaataagaaga

SEQ ID NO: 177264 - DNA, 26 bp, Artificial sequence
  SiRNA target sequence
ttagaacacatattaaataagaagaa

SEQ ID NO: 177265 - DNA, 26 bp, Artificial sequence
  SiRNA target sequence
tagaacacatattaaataagaagaac

SEQ ID NO: 177266 - DNA, 26 bp, Artificial sequence
  SiRNA target sequence
agaacacatattaaataagaagaaca

SEQ ID NO: 177267 - DNA, 26 bp, Artificial sequence
  SiRNA target sequence
gaacacatattaaataagaagaacaa

SEQ ID NO: 177268 - DNA, 26 bp, Artificial sequence
  SiRNA target sequence
aacacatattaaataagaagaacaat

SEQ ID NO: 177269 - DNA, 26 bp, Artificial sequence
  SiRNA target sequence
acacatattaaataagaagaacaatt

SEQ ID NO: 177270 - DNA, 26 bp, Artificial sequence
  SiRNA target sequence
cacatattaaataagaagaacaatta

SEQ ID NO: 177271 - DNA, 26 bp, Artificial sequence
  SiRNA target sequence
acatattaaataagaagaacaattat

SEQ ID NO: 177272 - DNA, 26 bp, Artificial sequence
  SiRNA target sequence
catattaaataagaagaacaattatt

SEQ ID NO: 177273 - DNA, 26 bp, Artificial sequence
  SiRNA target sequence
atattaaataagaagaacaattattt

SEQ ID NO: 177274 - DNA, 26 bp, Artificial sequence
  SiRNA target sequence
tattaaataagaagaacaattattta

SEQ ID NO: 177275 - DNA, 26 bp, Artificial sequence
  SiRNA target sequence
attaaataagaagaacaattatttaa

SEQ ID NO: 177276 - DNA, 26 bp, Artificial sequence
  SiRNA target sequence
ttaaataagaagaacaattatttaac

SEQ ID NO: 177277 - DNA, 26 bp, Artificial sequence
  SiRNA target sequence
taaataagaagaacaattatttaaca

SEQ ID NO: 177278 - DNA, 26 bp, Artificial sequence
  SiRNA target sequence
aaataagaagaacaattatttaacaa

SEQ ID NO: 177279 - DNA, 26 bp, Artificial sequence
  SiRNA target sequence
aataagaagaacaattatttaacaaa

SEQ ID NO: 177280 - DNA, 26 bp, Artificial sequence
  SiRNA target sequence
ataagaagaacaattatttaacaaaa

SEQ ID NO: 177281 - DNA, 26 bp, Artificial sequence
  SiRNA target sequence
taagaagaacaattatttaacaaaaa

SEQ ID NO: 177282 - DNA, 26 bp, Artificial sequence
  SiRNA target sequence
aagaagaacaattatttaacaaaaaa

SEQ ID NO: 177283 - DNA, 26 bp, Artificial sequence
  SiRNA target sequence
agaagaacaattatttaacaaaaaat

SEQ ID NO: 177284 - DNA, 26 bp, Artificial sequence
  SiRNA target sequence
gaagaacaattatttaacaaaaaatg

SEQ ID NO: 177285 - DNA, 26 bp, Artificial sequence
  SiRNA target sequence
aagaacaattatttaacaaaaaatga

SEQ ID NO: 177286 - DNA, 26 bp, Artificial sequence
  SiRNA target sequence
agaacaattatttaacaaaaaatgat

SEQ ID NO: 177287 - DNA, 26 bp, Artificial sequence
  SiRNA target sequence
gaacaattatttaacaaaaaatgata

SEQ ID NO: 177288 - DNA, 26 bp, Artificial sequence
  SiRNA target sequence
aacaattatttaacaaaaaatgatag

SEQ ID NO: 177289 - DNA, 26 bp, Artificial sequence
  SiRNA target sequence
acaattatttaacaaaaaatgatagt

SEQ ID NO: 177290 - DNA, 26 bp, Artificial sequence
  SiRNA target sequence
caattatttaacaaaaaatgatagta

SEQ ID NO: 177291 - DNA, 26 bp, Artificial sequence
  SiRNA target sequence
aattatttaacaaaaaatgatagtat

SEQ ID NO: 177292 - DNA, 26 bp, Artificial sequence
  SiRNA target sequence
attatttaacaaaaaatgatagtata

SEQ ID NO: 177293 - DNA, 26 bp, Artificial sequence
  SiRNA target sequence
ttatttaacaaaaaatgatagtataa

SEQ ID NO: 177294 - DNA, 26 bp, Artificial sequence
  SiRNA target sequence
tatttaacaaaaaatgatagtataaa

SEQ ID NO: 177295 - DNA, 26 bp, Artificial sequence
  SiRNA target sequence
atttaacaaaaaatgatagtataaaa

SEQ ID NO: 177296 - DNA, 26 bp, Artificial sequence
  SiRNA target sequence
tttaacaaaaaatgatagtataaaaa

SEQ ID NO: 177297 - DNA, 26 bp, Artificial sequence
  SiRNA target sequence
ttaacaaaaaatgatagtataaaaat

SEQ ID NO: 177298 - DNA, 26 bp, Artificial sequence
  SiRNA target sequence
taacaaaaaatgatagtataaaaata

SEQ ID NO: 177299 - DNA, 26 bp, Artificial sequence
  SiRNA target sequence
aacaaaaaatgatagtataaaaatat

SEQ ID NO: 177300 - DNA, 26 bp, Artificial sequence
  SiRNA target sequence
acaaaaaatgatagtataaaaatatt

SEQ ID NO: 177301 - DNA, 26 bp, Artificial sequence
  SiRNA target sequence
caaaaaatgatagtataaaaatattt

SEQ ID NO: 177302 - DNA, 26 bp, Artificial sequence
  SiRNA target sequence
aaaaaatgatagtataaaaatattta

SEQ ID NO: 177303 - DNA, 26 bp, Artificial sequence
  SiRNA target sequence
aaaaatgatagtataaaaatatttaa

SEQ ID NO: 177304 - DNA, 26 bp, Artificial sequence
  SiRNA target sequence
aaaatgatagtataaaaatatttaac

SEQ ID NO: 177305 - DNA, 26 bp, Artificial sequence
  SiRNA target sequence
aaatgatagtataaaaatatttaaca

SEQ ID NO: 177306 - DNA, 26 bp, Artificial sequence
  SiRNA target sequence
aatgatagtataaaaatatttaacag

SEQ ID NO: 177307 - DNA, 26 bp, Artificial sequence
  SiRNA target sequence
atgatagtataaaaatatttaacagt

SEQ ID NO: 177308 - DNA, 26 bp, Artificial sequence
  SiRNA target sequence
tgatagtataaaaatatttaacagta

SEQ ID NO: 177309 - DNA, 26 bp, Artificial sequence
  SiRNA target sequence
gatagtataaaaatatttaacagtaa

SEQ ID NO: 177310 - DNA, 26 bp, Artificial sequence
  SiRNA target sequence
atagtataaaaatatttaacagtaaa

SEQ ID NO: 177311 - DNA, 26 bp, Artificial sequence
  SiRNA target sequence
tagtataaaaatatttaacagtaaaa

SEQ ID NO: 177312 - DNA, 26 bp, Artificial sequence
  SiRNA target sequence
agtataaaaatatttaacagtaaaaa

SEQ ID NO: 177313 - DNA, 26 bp, Artificial sequence
  SiRNA target sequence
gtataaaaatatttaacagtaaaaat

SEQ ID NO: 177314 - DNA, 26 bp, Artificial sequence
  SiRNA target sequence
tataaaaatatttaacagtaaaaatg

SEQ ID NO: 177315 - DNA, 26 bp, Artificial sequence
  SiRNA target sequence
ataaaaatatttaacagtaaaaatga

SEQ ID NO: 177316 - DNA, 26 bp, Artificial sequence
  SiRNA target sequence
taaaaatatttaacagtaaaaatgag

SEQ ID NO: 177317 - DNA, 26 bp, Artificial sequence
  SiRNA target sequence
aaaaatatttaacagtaaaaatgagg

SEQ ID NO: 177318 - DNA, 26 bp, Artificial sequence
  SiRNA target sequence
aaaatatttaacagtaaaaatgagga

SEQ ID NO: 177319 - DNA, 26 bp, Artificial sequence
  SiRNA target sequence
aaatatttaacagtaaaaatgaggag

SEQ ID NO: 177320 - DNA, 26 bp, Artificial sequence
  SiRNA target sequence
aatatttaacagtaaaaatgaggagg

SEQ ID NO: 177321 - DNA, 26 bp, Artificial sequence
  SiRNA target sequence
atatttaacagtaaaaatgaggaggt

SEQ ID NO: 177322 - DNA, 26 bp, Artificial sequence
  SiRNA target sequence
tatttaacagtaaaaatgaggaggta

SEQ ID NO: 177323 - DNA, 26 bp, Artificial sequence
  SiRNA target sequence
atttaacagtaaaaatgaggaggtaa

SEQ ID NO: 177324 - DNA, 26 bp, Artificial sequence
  SiRNA target sequence
tttaacagtaaaaatgaggaggtaag

SEQ ID NO: 177325 - DNA, 26 bp, Artificial sequence
  SiRNA target sequence
ttaacagtaaaaatgaggaggtaagg

SEQ ID NO: 177326 - DNA, 26 bp, Artificial sequence
  SiRNA target sequence
taacagtaaaaatgaggaggtaaggt

SEQ ID NO: 177327 - DNA, 26 bp, Artificial sequence
  SiRNA target sequence
aacagtaaaaatgaggaggtaaggtt

SEQ ID NO: 177328 - DNA, 26 bp, Artificial sequence
  SiRNA target sequence
acagtaaaaatgaggaggtaaggtta

SEQ ID NO: 177329 - DNA, 26 bp, Artificial sequence
  SiRNA target sequence
cagtaaaaatgaggaggtaaggttaa

SEQ ID NO: 177330 - DNA, 26 bp, Artificial sequence
  SiRNA target sequence
agtaaaaatgaggaggtaaggttaaa

SEQ ID NO: 177331 - DNA, 26 bp, Artificial sequence
  SiRNA target sequence
gtaaaaatgaggaggtaaggttaaat

SEQ ID NO: 177332 - DNA, 26 bp, Artificial sequence
  SiRNA target sequence
taaaaatgaggaggtaaggttaaatg

SEQ ID NO: 177333 - DNA, 26 bp, Artificial sequence
  SiRNA target sequence
aaaaatgaggaggtaaggttaaatgg

SEQ ID NO: 177334 - DNA, 26 bp, Artificial sequence
  SiRNA target sequence
aaaatgaggaggtaaggttaaatgga

SEQ ID NO: 177335 - DNA, 26 bp, Artificial sequence
  SiRNA target sequence
aaatgaggaggtaaggttaaatggaa

SEQ ID NO: 177336 - DNA, 26 bp, Artificial sequence
  SiRNA target sequence
aatgaggaggtaaggttaaatggaaa

SEQ ID NO: 177337 - DNA, 26 bp, Artificial sequence
  SiRNA target sequence
atgaggaggtaaggttaaatggaaaa

SEQ ID NO: 177338 - DNA, 26 bp, Artificial sequence
  SiRNA target sequence
tgaggaggtaaggttaaatggaaaaa

SEQ ID NO: 177339 - DNA, 26 bp, Artificial sequence
  SiRNA target sequence
gaggaggtaaggttaaatggaaaaag

SEQ ID NO: 177340 - DNA, 26 bp, Artificial sequence
  SiRNA target sequence
aggaggtaaggttaaatggaaaaaga

SEQ ID NO: 177341 - DNA, 26 bp, Artificial sequence
  SiRNA target sequence
ggaggtaaggttaaatggaaaaagaa

SEQ ID NO: 177342 - DNA, 26 bp, Artificial sequence
  SiRNA target sequence
gaggtaaggttaaatggaaaaagaaa

SEQ ID NO: 177343 - DNA, 26 bp, Artificial sequence
  SiRNA target sequence
aggtaaggttaaatggaaaaagaaaa

SEQ ID NO: 177344 - DNA, 26 bp, Artificial sequence
  SiRNA target sequence
ggtaaggttaaatggaaaaagaaaat

SEQ ID NO: 177345 - DNA, 26 bp, Artificial sequence
  SiRNA target sequence
gtaaggttaaatggaaaaagaaaatt

SEQ ID NO: 177346 - DNA, 26 bp, Artificial sequence
  SiRNA target sequence
taaggttaaatggaaaaagaaaatta

SEQ ID NO: 177347 - DNA, 26 bp, Artificial sequence
  SiRNA target sequence
aaggttaaatggaaaaagaaaattaa

SEQ ID NO: 177348 - DNA, 26 bp, Artificial sequence
  SiRNA target sequence
aggttaaatggaaaaagaaaattaaa

SEQ ID NO: 177349 - DNA, 26 bp, Artificial sequence
  SiRNA target sequence
ggttaaatggaaaaagaaaattaaat

SEQ ID NO: 177350 - DNA, 26 bp, Artificial sequence
  SiRNA target sequence
gttaaatggaaaaagaaaattaaata

SEQ ID NO: 177351 - DNA, 26 bp, Artificial sequence
  SiRNA target sequence
ttaaatggaaaaagaaaattaaatat

SEQ ID NO: 177352 - DNA, 26 bp, Artificial sequence
  SiRNA target sequence
taaatggaaaaagaaaattaaatatt

SEQ ID NO: 177353 - DNA, 26 bp, Artificial sequence
  SiRNA target sequence
aaatggaaaaagaaaattaaatatta

SEQ ID NO: 177354 - DNA, 26 bp, Artificial sequence
  SiRNA target sequence
aatggaaaaagaaaattaaatattaa

SEQ ID NO: 177355 - DNA, 26 bp, Artificial sequence
  SiRNA target sequence
atggaaaaagaaaattaaatattaac

SEQ ID NO: 177356 - DNA, 26 bp, Artificial sequence
  SiRNA target sequence
tggaaaaagaaaattaaatattaaca

SEQ ID NO: 177357 - DNA, 26 bp, Artificial sequence
  SiRNA target sequence
ggaaaaagaaaattaaatattaacac

SEQ ID NO: 177358 - DNA, 26 bp, Artificial sequence
  SiRNA target sequence
gaaaaagaaaattaaatattaacaca

SEQ ID NO: 177359 - DNA, 26 bp, Artificial sequence
  SiRNA target sequence
aaaaagaaaattaaatattaacacag

SEQ ID NO: 177360 - DNA, 26 bp, Artificial sequence
  SiRNA target sequence
aaaagaaaattaaatattaacacagt

SEQ ID NO: 177361 - DNA, 26 bp, Artificial sequence
  SiRNA target sequence
aaagaaaattaaatattaacacagtt

SEQ ID NO: 177362 - DNA, 26 bp, Artificial sequence
  SiRNA target sequence
aagaaaattaaatattaacacagtta

SEQ ID NO: 177363 - DNA, 26 bp, Artificial sequence
  SiRNA target sequence
agaaaattaaatattaacacagttac

SEQ ID NO: 177364 - DNA, 26 bp, Artificial sequence
  SiRNA target sequence
gaaaattaaatattaacacagttaca

SEQ ID NO: 177365 - DNA, 26 bp, Artificial sequence
  SiRNA target sequence
aaaattaaatattaacacagttacat

SEQ ID NO: 177366 - DNA, 26 bp, Artificial sequence
  SiRNA target sequence
aaattaaatattaacacagttacatt

SEQ ID NO: 177367 - DNA, 26 bp, Artificial sequence
  SiRNA target sequence
aattaaatattaacacagttacatta

SEQ ID NO: 177368 - DNA, 26 bp, Artificial sequence
  SiRNA target sequence
attaaatattaacacagttacattaa

SEQ ID NO: 177369 - DNA, 26 bp, Artificial sequence
  SiRNA target sequence
ttaaatattaacacagttacattaaa

SEQ ID NO: 177370 - DNA, 26 bp, Artificial sequence
  SiRNA target sequence
taaatattaacacagttacattaaat

SEQ ID NO: 177371 - DNA, 26 bp, Artificial sequence
  SiRNA target sequence
aaatattaacacagttacattaaata

SEQ ID NO: 177372 - DNA, 26 bp, Artificial sequence
  SiRNA target sequence
aatattaacacagttacattaaataa

SEQ ID NO: 177373 - DNA, 26 bp, Artificial sequence
  SiRNA target sequence
atattaacacagttacattaaataaa

SEQ ID NO: 177374 - DNA, 26 bp, Artificial sequence
  SiRNA target sequence
tattaacacagttacattaaataaaa

SEQ ID NO: 177375 - DNA, 26 bp, Artificial sequence
  SiRNA target sequence
attaacacagttacattaaataaaat

SEQ ID NO: 177376 - DNA, 26 bp, Artificial sequence
  SiRNA target sequence
ttaacacagttacattaaataaaatt

SEQ ID NO: 177377 - DNA, 26 bp, Artificial sequence
  SiRNA target sequence
taacacagttacattaaataaaatta

SEQ ID NO: 177378 - DNA, 26 bp, Artificial sequence
  SiRNA target sequence
aacacagttacattaaataaaattaa

SEQ ID NO: 177379 - DNA, 26 bp, Artificial sequence
  SiRNA target sequence
acacagttacattaaataaaattaat

SEQ ID NO: 177380 - DNA, 26 bp, Artificial sequence
  SiRNA target sequence
cacagttacattaaataaaattaata

SEQ ID NO: 177381 - DNA, 26 bp, Artificial sequence
  SiRNA target sequence
acagttacattaaataaaattaatat

SEQ ID NO: 177382 - DNA, 26 bp, Artificial sequence
  SiRNA target sequence
cagttacattaaataaaattaatata

SEQ ID NO: 177383 - DNA, 26 bp, Artificial sequence
  SiRNA target sequence
agttacattaaataaaattaatatac

SEQ ID NO: 177384 - DNA, 26 bp, Artificial sequence
  SiRNA target sequence
gttacattaaataaaattaatatacc

SEQ ID NO: 177385 - DNA, 26 bp, Artificial sequence
  SiRNA target sequence
ttacattaaataaaattaatatacct

SEQ ID NO: 177386 - DNA, 26 bp, Artificial sequence
  SiRNA target sequence
tacattaaataaaattaatatacctg

SEQ ID NO: 177387 - DNA, 26 bp, Artificial sequence
  SiRNA target sequence
acattaaataaaattaatatacctga

SEQ ID NO: 177388 - DNA, 26 bp, Artificial sequence
  SiRNA target sequence
cattaaataaaattaatatacctgag

SEQ ID NO: 177389 - DNA, 26 bp, Artificial sequence
  SiRNA target sequence
attaaataaaattaatatacctgaga

SEQ ID NO: 177390 - DNA, 26 bp, Artificial sequence
  SiRNA target sequence
ttaaataaaattaatatacctgagat

SEQ ID NO: 177391 - DNA, 26 bp, Artificial sequence
  SiRNA target sequence
taaataaaattaatatacctgagata

SEQ ID NO: 177392 - DNA, 26 bp, Artificial sequence
  SiRNA target sequence
aaataaaattaatatacctgagatag

SEQ ID NO: 177393 - DNA, 26 bp, Artificial sequence
  SiRNA target sequence
aataaaattaatatacctgagataga

SEQ ID NO: 177394 - DNA, 26 bp, Artificial sequence
  SiRNA target sequence
ataaaattaatatacctgagatagat

SEQ ID NO: 177395 - DNA, 26 bp, Artificial sequence
  SiRNA target sequence
taaaattaatatacctgagatagatt

SEQ ID NO: 177396 - DNA, 26 bp, Artificial sequence
  SiRNA target sequence
aaaattaatatacctgagatagatta

SEQ ID NO: 177397 - DNA, 26 bp, Artificial sequence
  SiRNA target sequence
aaattaatatacctgagatagattat

SEQ ID NO: 177398 - DNA, 26 bp, Artificial sequence
  SiRNA target sequence
aattaatatacctgagatagattata

SEQ ID NO: 177399 - DNA, 26 bp, Artificial sequence
  SiRNA target sequence
attaatatacctgagatagattataa

SEQ ID NO: 177400 - DNA, 26 bp, Artificial sequence
  SiRNA target sequence
ttaatatacctgagatagattataaa

SEQ ID NO: 177401 - DNA, 26 bp, Artificial sequence
  SiRNA target sequence
taatatacctgagatagattataaat

SEQ ID NO: 177402 - DNA, 26 bp, Artificial sequence
  SiRNA target sequence
aatatacctgagatagattataaata

SEQ ID NO: 177403 - DNA, 26 bp, Artificial sequence
  SiRNA target sequence
atatacctgagatagattataaatat

SEQ ID NO: 177404 - DNA, 26 bp, Artificial sequence
  SiRNA target sequence
tatacctgagatagattataaatata

SEQ ID NO: 177405 - DNA, 26 bp, Artificial sequence
  SiRNA target sequence
atacctgagatagattataaatataa

SEQ ID NO: 177406 - DNA, 26 bp, Artificial sequence
  SiRNA target sequence
tacctgagatagattataaatataaa

SEQ ID NO: 177407 - DNA, 26 bp, Artificial sequence
  SiRNA target sequence
acctgagatagattataaatataaaa

SEQ ID NO: 177408 - DNA, 26 bp, Artificial sequence
  SiRNA target sequence
cctgagatagattataaatataaaaa

SEQ ID NO: 177409 - DNA, 26 bp, Artificial sequence
  SiRNA target sequence
ctgagatagattataaatataaaaat

SEQ ID NO: 177410 - DNA, 26 bp, Artificial sequence
  SiRNA target sequence
tgagatagattataaatataaaaatg

SEQ ID NO: 177411 - DNA, 26 bp, Artificial sequence
  SiRNA target sequence
gagatagattataaatataaaaatgg

SEQ ID NO: 177412 - DNA, 26 bp, Artificial sequence
  SiRNA target sequence
agatagattataaatataaaaatgga

SEQ ID NO: 177413 - DNA, 26 bp, Artificial sequence
  SiRNA target sequence
gatagattataaatataaaaatggag

SEQ ID NO: 177414 - DNA, 26 bp, Artificial sequence
  SiRNA target sequence
atagattataaatataaaaatggagt

SEQ ID NO: 177415 - DNA, 26 bp, Artificial sequence
  SiRNA target sequence
tagattataaatataaaaatggagtg

SEQ ID NO: 177416 - DNA, 26 bp, Artificial sequence
  SiRNA target sequence
agattataaatataaaaatggagtgt

SEQ ID NO: 177417 - DNA, 26 bp, Artificial sequence
  SiRNA target sequence
gattataaatataaaaatggagtgtt

SEQ ID NO: 177418 - DNA, 26 bp, Artificial sequence
  SiRNA target sequence
attataaatataaaaatggagtgttt

SEQ ID NO: 177419 - DNA, 26 bp, Artificial sequence
  SiRNA target sequence
ttataaatataaaaatggagtgttta

SEQ ID NO: 177420 - DNA, 26 bp, Artificial sequence
  SiRNA target sequence
tataaatataaaaatggagtgtttac

SEQ ID NO: 177421 - DNA, 26 bp, Artificial sequence
  SiRNA target sequence
ataaatataaaaatggagtgtttaca

SEQ ID NO: 177422 - DNA, 26 bp, Artificial sequence
  SiRNA target sequence
taaatataaaaatggagtgtttacat

SEQ ID NO: 177423 - DNA, 26 bp, Artificial sequence
  SiRNA target sequence
aaatataaaaatggagtgtttacata

SEQ ID NO: 177424 - DNA, 26 bp, Artificial sequence
  SiRNA target sequence
aatataaaaatggagtgtttacatat

SEQ ID NO: 177425 - DNA, 26 bp, Artificial sequence
  SiRNA target sequence
atataaaaatggagtgtttacatata

SEQ ID NO: 177426 - DNA, 26 bp, Artificial sequence
  SiRNA target sequence
tataaaaatggagtgtttacatatac

SEQ ID NO: 177427 - DNA, 26 bp, Artificial sequence
  SiRNA target sequence
ataaaaatggagtgtttacatataca

SEQ ID NO: 177428 - DNA, 26 bp, Artificial sequence
  SiRNA target sequence
taaaaatggagtgtttacatatacac

SEQ ID NO: 177429 - DNA, 26 bp, Artificial sequence
  SiRNA target sequence
aaaaatggagtgtttacatatacaca

SEQ ID NO: 177430 - DNA, 26 bp, Artificial sequence
  SiRNA target sequence
aaaatggagtgtttacatatacacag

SEQ ID NO: 177431 - DNA, 26 bp, Artificial sequence
  SiRNA target sequence
aaatggagtgtttacatatacacaga

SEQ ID NO: 177432 - DNA, 26 bp, Artificial sequence
  SiRNA target sequence
aatggagtgtttacatatacacagat

SEQ ID NO: 177433 - DNA, 26 bp, Artificial sequence
  SiRNA target sequence
atggagtgtttacatatacacagatc

SEQ ID NO: 177434 - DNA, 26 bp, Artificial sequence
  SiRNA target sequence
tggagtgtttacatatacacagatca

SEQ ID NO: 177435 - DNA, 26 bp, Artificial sequence
  SiRNA target sequence
ggagtgtttacatatacacagatcaa

SEQ ID NO: 177436 - DNA, 26 bp, Artificial sequence
  SiRNA target sequence
gagtgtttacatatacacagatcaaa

SEQ ID NO: 177437 - DNA, 26 bp, Artificial sequence
  SiRNA target sequence
agtgtttacatatacacagatcaaaa

SEQ ID NO: 177438 - DNA, 26 bp, Artificial sequence
  SiRNA target sequence
gtgtttacatatacacagatcaaaaa

SEQ ID NO: 177439 - DNA, 26 bp, Artificial sequence
  SiRNA target sequence
tgtttacatatacacagatcaaaaat

SEQ ID NO: 177440 - DNA, 26 bp, Artificial sequence
  SiRNA target sequence
gtttacatatacacagatcaaaaata

SEQ ID NO: 177441 - DNA, 26 bp, Artificial sequence
  SiRNA target sequence
tttacatatacacagatcaaaaataa

SEQ ID NO: 177442 - DNA, 26 bp, Artificial sequence
  SiRNA target sequence
ttacatatacacagatcaaaaataat

SEQ ID NO: 177443 - DNA, 26 bp, Artificial sequence
  SiRNA target sequence
tacatatacacagatcaaaaataata

SEQ ID NO: 177444 - DNA, 26 bp, Artificial sequence
  SiRNA target sequence
acatatacacagatcaaaaataataa

SEQ ID NO: 177445 - DNA, 26 bp, Artificial sequence
  SiRNA target sequence
catatacacagatcaaaaataataag

SEQ ID NO: 177446 - DNA, 26 bp, Artificial sequence
  SiRNA target sequence
atatacacagatcaaaaataataaga

SEQ ID NO: 177447 - DNA, 26 bp, Artificial sequence
  SiRNA target sequence
tatacacagatcaaaaataataagaa

SEQ ID NO: 177448 - DNA, 26 bp, Artificial sequence
  SiRNA target sequence
atacacagatcaaaaataataagaaa

SEQ ID NO: 177449 - DNA, 26 bp, Artificial sequence
  SiRNA target sequence
tacacagatcaaaaataataagaaaa

SEQ ID NO: 177450 - DNA, 26 bp, Artificial sequence
  SiRNA target sequence
acacagatcaaaaataataagaaaaa

SEQ ID NO: 177451 - DNA, 26 bp, Artificial sequence
  SiRNA target sequence
cacagatcaaaaataataagaaaaaa

SEQ ID NO: 177452 - DNA, 26 bp, Artificial sequence
  SiRNA target sequence
acagatcaaaaataataagaaaaaaa

SEQ ID NO: 177453 - DNA, 26 bp, Artificial sequence
  SiRNA target sequence
cagatcaaaaataataagaaaaaaaa

SEQ ID NO: 177454 - DNA, 26 bp, Artificial sequence
  SiRNA target sequence
agatcaaaaataataagaaaaaaaaa

SEQ ID NO: 177455 - DNA, 26 bp, Artificial sequence
  SiRNA target sequence
gatcaaaaataataagaaaaaaaaat

SEQ ID NO: 177456 - DNA, 26 bp, Artificial sequence
  SiRNA target sequence
atcaaaaataataagaaaaaaaaata

SEQ ID NO: 177457 - DNA, 26 bp, Artificial sequence
  SiRNA target sequence
tcaaaaataataagaaaaaaaaatat

SEQ ID NO: 177458 - DNA, 26 bp, Artificial sequence
  SiRNA target sequence
caaaaataataagaaaaaaaaatatt

SEQ ID NO: 177459 - DNA, 26 bp, Artificial sequence
  SiRNA target sequence
aaaaataataagaaaaaaaaatattt

SEQ ID NO: 177460 - DNA, 26 bp, Artificial sequence
  SiRNA target sequence
aaaataataagaaaaaaaaatattta

SEQ ID NO: 177461 - DNA, 26 bp, Artificial sequence
  SiRNA target sequence
aaataataagaaaaaaaaatatttaa

SEQ ID NO: 177462 - DNA, 26 bp, Artificial sequence
  SiRNA target sequence
aataataagaaaaaaaaatatttaag

SEQ ID NO: 177463 - DNA, 26 bp, Artificial sequence
  SiRNA target sequence
ataataagaaaaaaaaatatttaaga

SEQ ID NO: 177464 - DNA, 26 bp, Artificial sequence
  SiRNA target sequence
taataagaaaaaaaaatatttaagaa

SEQ ID NO: 177465 - DNA, 26 bp, Artificial sequence
  SiRNA target sequence
aataagaaaaaaaaatatttaagaat

SEQ ID NO: 177466 - DNA, 26 bp, Artificial sequence
  SiRNA target sequence
ataagaaaaaaaaatatttaagaata

SEQ ID NO: 177467 - DNA, 26 bp, Artificial sequence
  SiRNA target sequence
taagaaaaaaaaatatttaagaatat

SEQ ID NO: 177468 - DNA, 26 bp, Artificial sequence
  SiRNA target sequence
aagaaaaaaaaatatttaagaatatt

SEQ ID NO: 177469 - DNA, 26 bp, Artificial sequence
  SiRNA target sequence
agaaaaaaaaatatttaagaatattg

SEQ ID NO: 177470 - DNA, 26 bp, Artificial sequence
  SiRNA target sequence
gaaaaaaaaatatttaagaatattgg

SEQ ID NO: 177471 - DNA, 26 bp, Artificial sequence
  SiRNA target sequence
aaaaaaaaatatttaagaatattggg

SEQ ID NO: 177472 - DNA, 26 bp, Artificial sequence
  SiRNA target sequence
aaaaaaaatatttaagaatattgggt

SEQ ID NO: 177473 - DNA, 26 bp, Artificial sequence
  SiRNA target sequence
aaaaaaatatttaagaatattgggtc

SEQ ID NO: 177474 - DNA, 26 bp, Artificial sequence
  SiRNA target sequence
aaaaaatatttaagaatattgggtct

SEQ ID NO: 177475 - DNA, 26 bp, Artificial sequence
  SiRNA target sequence
aaaaatatttaagaatattgggtcta

SEQ ID NO: 177476 - DNA, 26 bp, Artificial sequence
  SiRNA target sequence
aaaatatttaagaatattgggtctag

SEQ ID NO: 177477 - DNA, 26 bp, Artificial sequence
  SiRNA target sequence
aaatatttaagaatattgggtctaga

SEQ ID NO: 177478 - DNA, 26 bp, Artificial sequence
  SiRNA target sequence
aatatttaagaatattgggtctagaa

SEQ ID NO: 177479 - DNA, 26 bp, Artificial sequence
  SiRNA target sequence
atatttaagaatattgggtctagaac

SEQ ID NO: 177480 - DNA, 26 bp, Artificial sequence
  SiRNA target sequence
tatttaagaatattgggtctagaacc

SEQ ID NO: 177481 - DNA, 26 bp, Artificial sequence
  SiRNA target sequence
atttaagaatattgggtctagaacct

SEQ ID NO: 177482 - DNA, 26 bp, Artificial sequence
  SiRNA target sequence
tttaagaatattgggtctagaacctt

SEQ ID NO: 177483 - DNA, 26 bp, Artificial sequence
  SiRNA target sequence
ttaagaatattgggtctagaaccttt

SEQ ID NO: 177484 - DNA, 26 bp, Artificial sequence
  SiRNA target sequence
taagaatattgggtctagaacctttt

SEQ ID NO: 177485 - DNA, 26 bp, Artificial sequence
  SiRNA target sequence
aagaatattgggtctagaaccttttc

SEQ ID NO: 177486 - DNA, 26 bp, Artificial sequence
  SiRNA target sequence
agaatattgggtctagaaccttttct

SEQ ID NO: 177487 - DNA, 26 bp, Artificial sequence
  SiRNA target sequence
gaatattgggtctagaaccttttctt

SEQ ID NO: 177488 - DNA, 26 bp, Artificial sequence
  SiRNA target sequence
aatattgggtctagaaccttttctta

SEQ ID NO: 177489 - DNA, 26 bp, Artificial sequence
  SiRNA target sequence
atattgggtctagaaccttttcttaa

SEQ ID NO: 177490 - DNA, 26 bp, Artificial sequence
  SiRNA target sequence
tattgggtctagaaccttttcttaat

SEQ ID NO: 177491 - DNA, 26 bp, Artificial sequence
  SiRNA target sequence
attgggtctagaaccttttcttaatt

SEQ ID NO: 177492 - DNA, 26 bp, Artificial sequence
  SiRNA target sequence
ttgggtctagaaccttttcttaattt

SEQ ID NO: 177493 - DNA, 26 bp, Artificial sequence
  SiRNA target sequence
tgggtctagaaccttttcttaatttt

SEQ ID NO: 177494 - DNA, 26 bp, Artificial sequence
  SiRNA target sequence
gggtctagaaccttttcttaatttta

SEQ ID NO: 177495 - DNA, 26 bp, Artificial sequence
  SiRNA target sequence
ggtctagaaccttttcttaattttat

SEQ ID NO: 177496 - DNA, 26 bp, Artificial sequence
  SiRNA target sequence
gtctagaaccttttcttaattttatt

SEQ ID NO: 177497 - DNA, 26 bp, Artificial sequence
  SiRNA target sequence
tctagaaccttttcttaattttatta

SEQ ID NO: 177498 - DNA, 26 bp, Artificial sequence
  SiRNA target sequence
ctagaaccttttcttaattttattaa

SEQ ID NO: 177499 - DNA, 26 bp, Artificial sequence
  SiRNA target sequence
tagaaccttttcttaattttattaag

SEQ ID NO: 177500 - DNA, 26 bp, Artificial sequence
  SiRNA target sequence
agaaccttttcttaattttattaagg

SEQ ID NO: 177501 - DNA, 26 bp, Artificial sequence
  SiRNA target sequence
gaaccttttcttaattttattaagga

SEQ ID NO: 177502 - DNA, 26 bp, Artificial sequence
  SiRNA target sequence
aaccttttcttaattttattaaggaa

SEQ ID NO: 177503 - DNA, 26 bp, Artificial sequence
  SiRNA target sequence
accttttcttaattttattaaggaaa

SEQ ID NO: 177504 - DNA, 26 bp, Artificial sequence
  SiRNA target sequence
ccttttcttaattttattaaggaaag

SEQ ID NO: 177505 - DNA, 26 bp, Artificial sequence
  SiRNA target sequence
cttttcttaattttattaaggaaagt

SEQ ID NO: 177506 - DNA, 26 bp, Artificial sequence
  SiRNA target sequence
ttttcttaattttattaaggaaagta

SEQ ID NO: 177507 - DNA, 26 bp, Artificial sequence
  SiRNA target sequence
tttcttaattttattaaggaaagtaa

SEQ ID NO: 177508 - DNA, 26 bp, Artificial sequence
  SiRNA target sequence
ttcttaattttattaaggaaagtaaa

SEQ ID NO: 177509 - DNA, 26 bp, Artificial sequence
  SiRNA target sequence
tcttaattttattaaggaaagtaaac

SEQ ID NO: 177510 - DNA, 26 bp, Artificial sequence
  SiRNA target sequence
cttaattttattaaggaaagtaaaca

SEQ ID NO: 177511 - DNA, 26 bp, Artificial sequence
  SiRNA target sequence
ttaattttattaaggaaagtaaacat

SEQ ID NO: 177512 - DNA, 26 bp, Artificial sequence
  SiRNA target sequence
taattttattaaggaaagtaaacata

SEQ ID NO: 177513 - DNA, 26 bp, Artificial sequence
  SiRNA target sequence
aattttattaaggaaagtaaacataa

SEQ ID NO: 177514 - DNA, 26 bp, Artificial sequence
  SiRNA target sequence
attttattaaggaaagtaaacataaa

SEQ ID NO: 177515 - DNA, 26 bp, Artificial sequence
  SiRNA target sequence
ttttattaaggaaagtaaacataaag

SEQ ID NO: 177516 - DNA, 26 bp, Artificial sequence
  SiRNA target sequence
tttattaaggaaagtaaacataaaga

SEQ ID NO: 177517 - DNA, 26 bp, Artificial sequence
  SiRNA target sequence
ttattaaggaaagtaaacataaagaa

SEQ ID NO: 177518 - DNA, 26 bp, Artificial sequence
  SiRNA target sequence
tattaaggaaagtaaacataaagaat

SEQ ID NO: 177519 - DNA, 26 bp, Artificial sequence
  SiRNA target sequence
attaaggaaagtaaacataaagaatt

SEQ ID NO: 177520 - DNA, 26 bp, Artificial sequence
  SiRNA target sequence
ttaaggaaagtaaacataaagaatta

SEQ ID NO: 177521 - DNA, 26 bp, Artificial sequence
  SiRNA target sequence
taaggaaagtaaacataaagaattag

SEQ ID NO: 177522 - DNA, 26 bp, Artificial sequence
  SiRNA target sequence
aaggaaagtaaacataaagaattaga

SEQ ID NO: 177523 - DNA, 26 bp, Artificial sequence
  SiRNA target sequence
aggaaagtaaacataaagaattagaa

SEQ ID NO: 177524 - DNA, 26 bp, Artificial sequence
  SiRNA target sequence
ggaaagtaaacataaagaattagaat

SEQ ID NO: 177525 - DNA, 26 bp, Artificial sequence
  SiRNA target sequence
gaaagtaaacataaagaattagaata

SEQ ID NO: 177526 - DNA, 26 bp, Artificial sequence
  SiRNA target sequence
aaagtaaacataaagaattagaatat

SEQ ID NO: 177527 - DNA, 26 bp, Artificial sequence
  SiRNA target sequence
aagtaaacataaagaattagaatatg

SEQ ID NO: 177528 - DNA, 26 bp, Artificial sequence
  SiRNA target sequence
agtaaacataaagaattagaatatga

SEQ ID NO: 177529 - DNA, 26 bp, Artificial sequence
  SiRNA target sequence
gtaaacataaagaattagaatatgat

SEQ ID NO: 177530 - DNA, 26 bp, Artificial sequence
  SiRNA target sequence
taaacataaagaattagaatatgatg

SEQ ID NO: 177531 - DNA, 26 bp, Artificial sequence
  SiRNA target sequence
aaacataaagaattagaatatgatgt

SEQ ID NO: 177532 - DNA, 26 bp, Artificial sequence
  SiRNA target sequence
aacataaagaattagaatatgatgta

SEQ ID NO: 177533 - DNA, 26 bp, Artificial sequence
  SiRNA target sequence
acataaagaattagaatatgatgtat

SEQ ID NO: 177534 - DNA, 26 bp, Artificial sequence
  SiRNA target sequence
cataaagaattagaatatgatgtatg

SEQ ID NO: 177535 - DNA, 26 bp, Artificial sequence
  SiRNA target sequence
ataaagaattagaatatgatgtatgc

SEQ ID NO: 177536 - DNA, 26 bp, Artificial sequence
  SiRNA target sequence
taaagaattagaatatgatgtatgcg

SEQ ID NO: 177537 - DNA, 26 bp, Artificial sequence
  SiRNA target sequence
aaagaattagaatatgatgtatgcga

SEQ ID NO: 177538 - DNA, 26 bp, Artificial sequence
  SiRNA target sequence
aagaattagaatatgatgtatgcgaa

SEQ ID NO: 177539 - DNA, 26 bp, Artificial sequence
  SiRNA target sequence
agaattagaatatgatgtatgcgaaa

SEQ ID NO: 177540 - DNA, 26 bp, Artificial sequence
  SiRNA target sequence
gaattagaatatgatgtatgcgaaat

SEQ ID NO: 177541 - DNA, 26 bp, Artificial sequence
  SiRNA target sequence
aattagaatatgatgtatgcgaaata

SEQ ID NO: 177542 - DNA, 26 bp, Artificial sequence
  SiRNA target sequence
attagaatatgatgtatgcgaaatat

SEQ ID NO: 177543 - DNA, 26 bp, Artificial sequence
  SiRNA target sequence
ttagaatatgatgtatgcgaaatata

SEQ ID NO: 177544 - DNA, 26 bp, Artificial sequence
  SiRNA target sequence
tagaatatgatgtatgcgaaatatac

SEQ ID NO: 177545 - DNA, 26 bp, Artificial sequence
  SiRNA target sequence
agaatatgatgtatgcgaaatataca

SEQ ID NO: 177546 - DNA, 26 bp, Artificial sequence
  SiRNA target sequence
gaatatgatgtatgcgaaatatacat

SEQ ID NO: 177547 - DNA, 26 bp, Artificial sequence
  SiRNA target sequence
aatatgatgtatgcgaaatatacatt

SEQ ID NO: 177548 - DNA, 26 bp, Artificial sequence
  SiRNA target sequence
atatgatgtatgcgaaatatacattt

SEQ ID NO: 177549 - DNA, 26 bp, Artificial sequence
  SiRNA target sequence
tatgatgtatgcgaaatatacatttg

SEQ ID NO: 177550 - DNA, 26 bp, Artificial sequence
  SiRNA target sequence
atgatgtatgcgaaatatacatttgt

SEQ ID NO: 177551 - DNA, 26 bp, Artificial sequence
  SiRNA target sequence
tgatgtatgcgaaatatacatttgta

SEQ ID NO: 177552 - DNA, 26 bp, Artificial sequence
  SiRNA target sequence
gatgtatgcgaaatatacatttgtaa

SEQ ID NO: 177553 - DNA, 26 bp, Artificial sequence
  SiRNA target sequence
atgtatgcgaaatatacatttgtaat

SEQ ID NO: 177554 - DNA, 26 bp, Artificial sequence
  SiRNA target sequence
tgtatgcgaaatatacatttgtaatc

SEQ ID NO: 177555 - DNA, 26 bp, Artificial sequence
  SiRNA target sequence
gtatgcgaaatatacatttgtaatca

SEQ ID NO: 177556 - DNA, 26 bp, Artificial sequence
  SiRNA target sequence
tatgcgaaatatacatttgtaatcag

SEQ ID NO: 177557 - DNA, 26 bp, Artificial sequence
  SiRNA target sequence
atgcgaaatatacatttgtaatcagg

SEQ ID NO: 177558 - DNA, 26 bp, Artificial sequence
  SiRNA target sequence
tgcgaaatatacatttgtaatcaggg

SEQ ID NO: 177559 - DNA, 26 bp, Artificial sequence
  SiRNA target sequence
gcgaaatatacatttgtaatcaggga

SEQ ID NO: 177560 - DNA, 26 bp, Artificial sequence
  SiRNA target sequence
cgaaatatacatttgtaatcagggat

SEQ ID NO: 177561 - DNA, 26 bp, Artificial sequence
  SiRNA target sequence
gaaatatacatttgtaatcagggatg

SEQ ID NO: 177562 - DNA, 26 bp, Artificial sequence
  SiRNA target sequence
aaatatacatttgtaatcagggatgc

SEQ ID NO: 177563 - DNA, 26 bp, Artificial sequence
  SiRNA target sequence
aatatacatttgtaatcagggatgca

SEQ ID NO: 177564 - DNA, 26 bp, Artificial sequence
  SiRNA target sequence
atatacatttgtaatcagggatgcat

SEQ ID NO: 177565 - DNA, 26 bp, Artificial sequence
  SiRNA target sequence
tatacatttgtaatcagggatgcatt

SEQ ID NO: 177566 - DNA, 26 bp, Artificial sequence
  SiRNA target sequence
atacatttgtaatcagggatgcatta

SEQ ID NO: 177567 - DNA, 26 bp, Artificial sequence
  SiRNA target sequence
tacatttgtaatcagggatgcattaa

SEQ ID NO: 177568 - DNA, 26 bp, Artificial sequence
  SiRNA target sequence
acatttgtaatcagggatgcattaat

SEQ ID NO: 177569 - DNA, 26 bp, Artificial sequence
  SiRNA target sequence
catttgtaatcagggatgcattaatg

SEQ ID NO: 177570 - DNA, 26 bp, Artificial sequence
  SiRNA target sequence
atttgtaatcagggatgcattaatgg

SEQ ID NO: 177571 - DNA, 26 bp, Artificial sequence
  SiRNA target sequence
tttgtaatcagggatgcattaatgga

SEQ ID NO: 177572 - DNA, 26 bp, Artificial sequence
  SiRNA target sequence
ttgtaatcagggatgcattaatggac

SEQ ID NO: 177573 - DNA, 26 bp, Artificial sequence
  SiRNA target sequence
tgtaatcagggatgcattaatggacc

SEQ ID NO: 177574 - DNA, 26 bp, Artificial sequence
  SiRNA target sequence
gtaatcagggatgcattaatggacca

SEQ ID NO: 177575 - DNA, 26 bp, Artificial sequence
  SiRNA target sequence
taatcagggatgcattaatggaccag

SEQ ID NO: 177576 - DNA, 26 bp, Artificial sequence
  SiRNA target sequence
aatcagggatgcattaatggaccagg

SEQ ID NO: 177577 - DNA, 26 bp, Artificial sequence
  SiRNA target sequence
atcagggatgcattaatggaccagga

SEQ ID NO: 177578 - DNA, 26 bp, Artificial sequence
  SiRNA target sequence
tcagggatgcattaatggaccaggac

SEQ ID NO: 177579 - DNA, 26 bp, Artificial sequence
  SiRNA target sequence
cagggatgcattaatggaccaggaca

SEQ ID NO: 177580 - DNA, 26 bp, Artificial sequence
  SiRNA target sequence
agggatgcattaatggaccaggacaa

SEQ ID NO: 177581 - DNA, 26 bp, Artificial sequence
  SiRNA target sequence
gggatgcattaatggaccaggacaat

SEQ ID NO: 177582 - DNA, 26 bp, Artificial sequence
  SiRNA target sequence
ggatgcattaatggaccaggacaatt

SEQ ID NO: 177583 - DNA, 26 bp, Artificial sequence
  SiRNA target sequence
gatgcattaatggaccaggacaattg

SEQ ID NO: 177584 - DNA, 26 bp, Artificial sequence
  SiRNA target sequence
atgcattaatggaccaggacaattgt

SEQ ID NO: 177585 - DNA, 26 bp, Artificial sequence
  SiRNA target sequence
tgcattaatggaccaggacaattgta

SEQ ID NO: 177586 - DNA, 26 bp, Artificial sequence
  SiRNA target sequence
gcattaatggaccaggacaattgtat

SEQ ID NO: 177587 - DNA, 26 bp, Artificial sequence
  SiRNA target sequence
cattaatggaccaggacaattgtata

SEQ ID NO: 177588 - DNA, 26 bp, Artificial sequence
  SiRNA target sequence
attaatggaccaggacaattgtatac

SEQ ID NO: 177589 - DNA, 26 bp, Artificial sequence
  SiRNA target sequence
ttaatggaccaggacaattgtataca

SEQ ID NO: 177590 - DNA, 26 bp, Artificial sequence
  SiRNA target sequence
taatggaccaggacaattgtatacag

SEQ ID NO: 177591 - DNA, 26 bp, Artificial sequence
  SiRNA target sequence
aatggaccaggacaattgtatacaga

SEQ ID NO: 177592 - DNA, 26 bp, Artificial sequence
  SiRNA target sequence
atggaccaggacaattgtatacagat

SEQ ID NO: 177593 - DNA, 26 bp, Artificial sequence
  SiRNA target sequence
tggaccaggacaattgtatacagata

SEQ ID NO: 177594 - DNA, 26 bp, Artificial sequence
  SiRNA target sequence
ggaccaggacaattgtatacagataa

SEQ ID NO: 177595 - DNA, 26 bp, Artificial sequence
  SiRNA target sequence
gaccaggacaattgtatacagataat

SEQ ID NO: 177596 - DNA, 26 bp, Artificial sequence
  SiRNA target sequence
accaggacaattgtatacagataatt

SEQ ID NO: 177597 - DNA, 26 bp, Artificial sequence
  SiRNA target sequence
ccaggacaattgtatacagataattt

SEQ ID NO: 177598 - DNA, 26 bp, Artificial sequence
  SiRNA target sequence
caggacaattgtatacagataattta

SEQ ID NO: 177599 - DNA, 26 bp, Artificial sequence
  SiRNA target sequence
aggacaattgtatacagataatttat

SEQ ID NO: 177600 - DNA, 26 bp, Artificial sequence
  SiRNA target sequence
ggacaattgtatacagataatttata

SEQ ID NO: 177601 - DNA, 26 bp, Artificial sequence
  SiRNA target sequence
gacaattgtatacagataatttatat

SEQ ID NO: 177602 - DNA, 26 bp, Artificial sequence
  SiRNA target sequence
acaattgtatacagataatttatatg

SEQ ID NO: 177603 - DNA, 26 bp, Artificial sequence
  SiRNA target sequence
caattgtatacagataatttatatgt

SEQ ID NO: 177604 - DNA, 26 bp, Artificial sequence
  SiRNA target sequence
aattgtatacagataatttatatgta

SEQ ID NO: 177605 - DNA, 26 bp, Artificial sequence
  SiRNA target sequence
attgtatacagataatttatatgtaa

SEQ ID NO: 177606 - DNA, 26 bp, Artificial sequence
  SiRNA target sequence
ttgtatacagataatttatatgtaaa

SEQ ID NO: 177607 - DNA, 26 bp, Artificial sequence
  SiRNA target sequence
tgtatacagataatttatatgtaaat

SEQ ID NO: 177608 - DNA, 26 bp, Artificial sequence
  SiRNA target sequence
gtatacagataatttatatgtaaata

SEQ ID NO: 177609 - DNA, 26 bp, Artificial sequence
  SiRNA target sequence
tatacagataatttatatgtaaataa

SEQ ID NO: 177610 - DNA, 26 bp, Artificial sequence
  SiRNA target sequence
atacagataatttatatgtaaataat

SEQ ID NO: 177611 - DNA, 26 bp, Artificial sequence
  SiRNA target sequence
tacagataatttatatgtaaataatt

SEQ ID NO: 177612 - DNA, 26 bp, Artificial sequence
  SiRNA target sequence
acagataatttatatgtaaataattc

SEQ ID NO: 177613 - DNA, 26 bp, Artificial sequence
  SiRNA target sequence
cagataatttatatgtaaataattca

SEQ ID NO: 177614 - DNA, 26 bp, Artificial sequence
  SiRNA target sequence
agataatttatatgtaaataattcag

SEQ ID NO: 177615 - DNA, 26 bp, Artificial sequence
  SiRNA target sequence
gataatttatatgtaaataattcaga

SEQ ID NO: 177616 - DNA, 26 bp, Artificial sequence
  SiRNA target sequence
ataatttatatgtaaataattcagaa

SEQ ID NO: 177617 - DNA, 26 bp, Artificial sequence
  SiRNA target sequence
taatttatatgtaaataattcagaat

SEQ ID NO: 177618 - DNA, 26 bp, Artificial sequence
  SiRNA target sequence
aatttatatgtaaataattcagaata

SEQ ID NO: 177619 - DNA, 26 bp, Artificial sequence
  SiRNA target sequence
atttatatgtaaataattcagaatac

SEQ ID NO: 177620 - DNA, 26 bp, Artificial sequence
  SiRNA target sequence
tttatatgtaaataattcagaataca

SEQ ID NO: 177621 - DNA, 26 bp, Artificial sequence
  SiRNA target sequence
ttatatgtaaataattcagaatacat

SEQ ID NO: 177622 - DNA, 26 bp, Artificial sequence
  SiRNA target sequence
tatatgtaaataattcagaatacata

SEQ ID NO: 177623 - DNA, 26 bp, Artificial sequence
  SiRNA target sequence
atatgtaaataattcagaatacatag

SEQ ID NO: 177624 - DNA, 26 bp, Artificial sequence
  SiRNA target sequence
tatgtaaataattcagaatacataga

SEQ ID NO: 177625 - DNA, 26 bp, Artificial sequence
  SiRNA target sequence
atgtaaataattcagaatacatagat

SEQ ID NO: 177626 - DNA, 26 bp, Artificial sequence
  SiRNA target sequence
tgtaaataattcagaatacatagata

SEQ ID NO: 177627 - DNA, 26 bp, Artificial sequence
  SiRNA target sequence
gtaaataattcagaatacatagatat

SEQ ID NO: 177628 - DNA, 26 bp, Artificial sequence
  SiRNA target sequence
taaataattcagaatacatagatatt

SEQ ID NO: 177629 - DNA, 26 bp, Artificial sequence
  SiRNA target sequence
aaataattcagaatacatagatattg

SEQ ID NO: 177630 - DNA, 26 bp, Artificial sequence
  SiRNA target sequence
aataattcagaatacatagatattga

SEQ ID NO: 177631 - DNA, 26 bp, Artificial sequence
  SiRNA target sequence
ataattcagaatacatagatattgat

SEQ ID NO: 177632 - DNA, 26 bp, Artificial sequence
  SiRNA target sequence
taattcagaatacatagatattgatc

SEQ ID NO: 177633 - DNA, 26 bp, Artificial sequence
  SiRNA target sequence
aattcagaatacatagatattgatct

SEQ ID NO: 177634 - DNA, 26 bp, Artificial sequence
  SiRNA target sequence
attcagaatacatagatattgatctt

SEQ ID NO: 177635 - DNA, 26 bp, Artificial sequence
  SiRNA target sequence
ttcagaatacatagatattgatcttg

SEQ ID NO: 177636 - DNA, 26 bp, Artificial sequence
  SiRNA target sequence
tcagaatacatagatattgatcttgg

SEQ ID NO: 177637 - DNA, 26 bp, Artificial sequence
  SiRNA target sequence
cagaatacatagatattgatcttggt

SEQ ID NO: 177638 - DNA, 26 bp, Artificial sequence
  SiRNA target sequence
agaatacatagatattgatcttggta

SEQ ID NO: 177639 - DNA, 26 bp, Artificial sequence
  SiRNA target sequence
gaatacatagatattgatcttggtat

SEQ ID NO: 177640 - DNA, 26 bp, Artificial sequence
  SiRNA target sequence
aatacatagatattgatcttggtatt

SEQ ID NO: 177641 - DNA, 26 bp, Artificial sequence
  SiRNA target sequence
atacatagatattgatcttggtattg

SEQ ID NO: 177642 - DNA, 26 bp, Artificial sequence
  SiRNA target sequence
tacatagatattgatcttggtattga

SEQ ID NO: 177643 - DNA, 26 bp, Artificial sequence
  SiRNA target sequence
acatagatattgatcttggtattgat

SEQ ID NO: 177644 - DNA, 26 bp, Artificial sequence
  SiRNA target sequence
catagatattgatcttggtattgatt

SEQ ID NO: 177645 - DNA, 26 bp, Artificial sequence
  SiRNA target sequence
atagatattgatcttggtattgattg

SEQ ID NO: 177646 - DNA, 26 bp, Artificial sequence
  SiRNA target sequence
tagatattgatcttggtattgattgt

SEQ ID NO: 177647 - DNA, 26 bp, Artificial sequence
  SiRNA target sequence
agatattgatcttggtattgattgta

SEQ ID NO: 177648 - DNA, 26 bp, Artificial sequence
  SiRNA target sequence
gatattgatcttggtattgattgtaa

SEQ ID NO: 177649 - DNA, 26 bp, Artificial sequence
  SiRNA target sequence
atattgatcttggtattgattgtaaa

SEQ ID NO: 177650 - DNA, 26 bp, Artificial sequence
  SiRNA target sequence
tattgatcttggtattgattgtaaac

SEQ ID NO: 177651 - DNA, 26 bp, Artificial sequence
  SiRNA target sequence
attgatcttggtattgattgtaaaca

SEQ ID NO: 177652 - DNA, 26 bp, Artificial sequence
  SiRNA target sequence
ttgatcttggtattgattgtaaacag

SEQ ID NO: 177653 - DNA, 26 bp, Artificial sequence
  SiRNA target sequence
tgatcttggtattgattgtaaacagt

SEQ ID NO: 177654 - DNA, 26 bp, Artificial sequence
  SiRNA target sequence
gatcttggtattgattgtaaacagtt

SEQ ID NO: 177655 - DNA, 26 bp, Artificial sequence
  SiRNA target sequence
atcttggtattgattgtaaacagtta

SEQ ID NO: 177656 - DNA, 26 bp, Artificial sequence
  SiRNA target sequence
tcttggtattgattgtaaacagttac

SEQ ID NO: 177657 - DNA, 26 bp, Artificial sequence
  SiRNA target sequence
cttggtattgattgtaaacagttaca

SEQ ID NO: 177658 - DNA, 26 bp, Artificial sequence
  SiRNA target sequence
ttggtattgattgtaaacagttacaa

SEQ ID NO: 177659 - DNA, 26 bp, Artificial sequence
  SiRNA target sequence
tggtattgattgtaaacagttacaaa

SEQ ID NO: 177660 - DNA, 26 bp, Artificial sequence
  SiRNA target sequence
ggtattgattgtaaacagttacaaaa

SEQ ID NO: 177661 - DNA, 26 bp, Artificial sequence
  SiRNA target sequence
gtattgattgtaaacagttacaaaaa

SEQ ID NO: 177662 - DNA, 26 bp, Artificial sequence
  SiRNA target sequence
tattgattgtaaacagttacaaaaaa

SEQ ID NO: 177663 - DNA, 26 bp, Artificial sequence
  SiRNA target sequence
attgattgtaaacagttacaaaaaag

SEQ ID NO: 177664 - DNA, 26 bp, Artificial sequence
  SiRNA target sequence
ttgattgtaaacagttacaaaaaagg

SEQ ID NO: 177665 - DNA, 26 bp, Artificial sequence
  SiRNA target sequence
tgattgtaaacagttacaaaaaagga

SEQ ID NO: 177666 - DNA, 26 bp, Artificial sequence
  SiRNA target sequence
gattgtaaacagttacaaaaaaggac

SEQ ID NO: 177667 - DNA, 26 bp, Artificial sequence
  SiRNA target sequence
attgtaaacagttacaaaaaaggaca

SEQ ID NO: 177668 - DNA, 26 bp, Artificial sequence
  SiRNA target sequence
ttgtaaacagttacaaaaaaggacat

SEQ ID NO: 177669 - DNA, 26 bp, Artificial sequence
  SiRNA target sequence
tgtaaacagttacaaaaaaggacata

SEQ ID NO: 177670 - DNA, 26 bp, Artificial sequence
  SiRNA target sequence
gtaaacagttacaaaaaaggacatat

SEQ ID NO: 177671 - DNA, 26 bp, Artificial sequence
  SiRNA target sequence
taaacagttacaaaaaaggacatata

SEQ ID NO: 177672 - DNA, 26 bp, Artificial sequence
  SiRNA target sequence
aaacagttacaaaaaaggacatatag

SEQ ID NO: 177673 - DNA, 26 bp, Artificial sequence
  SiRNA target sequence
aacagttacaaaaaaggacatataga

SEQ ID NO: 177674 - DNA, 26 bp, Artificial sequence
  SiRNA target sequence
acagttacaaaaaaggacatatagaa

SEQ ID NO: 177675 - DNA, 26 bp, Artificial sequence
  SiRNA target sequence
cagttacaaaaaaggacatatagaaa

SEQ ID NO: 177676 - DNA, 26 bp, Artificial sequence
  SiRNA target sequence
agttacaaaaaaggacatatagaaaa

SEQ ID NO: 177677 - DNA, 26 bp, Artificial sequence
  SiRNA target sequence
gttacaaaaaaggacatatagaaaaa

SEQ ID NO: 177678 - DNA, 26 bp, Artificial sequence
  SiRNA target sequence
ttacaaaaaaggacatatagaaaaat

SEQ ID NO: 177679 - DNA, 26 bp, Artificial sequence
  SiRNA target sequence
tacaaaaaaggacatatagaaaaata

SEQ ID NO: 177680 - DNA, 26 bp, Artificial sequence
  SiRNA target sequence
acaaaaaaggacatatagaaaaatag

SEQ ID NO: 177681 - DNA, 26 bp, Artificial sequence
  SiRNA target sequence
caaaaaaggacatatagaaaaataga

SEQ ID NO: 177682 - DNA, 26 bp, Artificial sequence
  SiRNA target sequence
aaaaaaggacatatagaaaaatagaa

SEQ ID NO: 177683 - DNA, 26 bp, Artificial sequence
  SiRNA target sequence
aaaaaggacatatagaaaaatagaaa

SEQ ID NO: 177684 - DNA, 26 bp, Artificial sequence
  SiRNA target sequence
aaaaggacatatagaaaaatagaaac

SEQ ID NO: 177685 - DNA, 26 bp, Artificial sequence
  SiRNA target sequence
aaaggacatatagaaaaatagaaaca

SEQ ID NO: 177686 - DNA, 26 bp, Artificial sequence
  SiRNA target sequence
aaggacatatagaaaaatagaaacaa

SEQ ID NO: 177687 - DNA, 26 bp, Artificial sequence
  SiRNA target sequence
aggacatatagaaaaatagaaacaaa

SEQ ID NO: 177688 - DNA, 26 bp, Artificial sequence
  SiRNA target sequence
ggacatatagaaaaatagaaacaaag

SEQ ID NO: 177689 - DNA, 26 bp, Artificial sequence
  SiRNA target sequence
gacatatagaaaaatagaaacaaaga

SEQ ID NO: 177690 - DNA, 26 bp, Artificial sequence
  SiRNA target sequence
acatatagaaaaatagaaacaaagaa

SEQ ID NO: 177691 - DNA, 26 bp, Artificial sequence
  SiRNA target sequence
catatagaaaaatagaaacaaagaaa

SEQ ID NO: 177692 - DNA, 26 bp, Artificial sequence
  SiRNA target sequence
atatagaaaaatagaaacaaagaaag

SEQ ID NO: 177693 - DNA, 26 bp, Artificial sequence
  SiRNA target sequence
tatagaaaaatagaaacaaagaaagt

SEQ ID NO: 177694 - DNA, 26 bp, Artificial sequence
  SiRNA target sequence
atagaaaaatagaaacaaagaaagtt

SEQ ID NO: 177695 - DNA, 26 bp, Artificial sequence
  SiRNA target sequence
tagaaaaatagaaacaaagaaagtta

SEQ ID NO: 177696 - DNA, 26 bp, Artificial sequence
  SiRNA target sequence
agaaaaatagaaacaaagaaagttaa

SEQ ID NO: 177697 - DNA, 26 bp, Artificial sequence
  SiRNA target sequence
gaaaaatagaaacaaagaaagttaat

SEQ ID NO: 177698 - DNA, 26 bp, Artificial sequence
  SiRNA target sequence
aaaaatagaaacaaagaaagttaatt

SEQ ID NO: 177699 - DNA, 26 bp, Artificial sequence
  SiRNA target sequence
aaaatagaaacaaagaaagttaattt

SEQ ID NO: 177700 - DNA, 26 bp, Artificial sequence
  SiRNA target sequence
aaatagaaacaaagaaagttaatttt

SEQ ID NO: 177701 - DNA, 26 bp, Artificial sequence
  SiRNA target sequence
aatagaaacaaagaaagttaatttta

SEQ ID NO: 177702 - DNA, 26 bp, Artificial sequence
  SiRNA target sequence
atagaaacaaagaaagttaattttaa

SEQ ID NO: 177703 - DNA, 26 bp, Artificial sequence
  SiRNA target sequence
tagaaacaaagaaagttaattttaaa

SEQ ID NO: 177704 - DNA, 26 bp, Artificial sequence
  SiRNA target sequence
agaaacaaagaaagttaattttaaaa

SEQ ID NO: 177705 - DNA, 26 bp, Artificial sequence
  SiRNA target sequence
gaaacaaagaaagttaattttaaaat

SEQ ID NO: 177706 - DNA, 26 bp, Artificial sequence
  SiRNA target sequence
aaacaaagaaagttaattttaaaata

SEQ ID NO: 177707 - DNA, 26 bp, Artificial sequence
  SiRNA target sequence
aacaaagaaagttaattttaaaatag

SEQ ID NO: 177708 - DNA, 26 bp, Artificial sequence
  SiRNA target sequence
acaaagaaagttaattttaaaataga

SEQ ID NO: 177709 - DNA, 26 bp, Artificial sequence
  SiRNA target sequence
caaagaaagttaattttaaaatagaa

SEQ ID NO: 177710 - DNA, 26 bp, Artificial sequence
  SiRNA target sequence
aaagaaagttaattttaaaatagaat

SEQ ID NO: 177711 - DNA, 26 bp, Artificial sequence
  SiRNA target sequence
aagaaagttaattttaaaatagaatg

SEQ ID NO: 177712 - DNA, 26 bp, Artificial sequence
  SiRNA target sequence
agaaagttaattttaaaatagaatgg

SEQ ID NO: 177713 - DNA, 26 bp, Artificial sequence
  SiRNA target sequence
gaaagttaattttaaaatagaatggt

SEQ ID NO: 177714 - DNA, 26 bp, Artificial sequence
  SiRNA target sequence
aaagttaattttaaaatagaatggta

SEQ ID NO: 177715 - DNA, 26 bp, Artificial sequence
  SiRNA target sequence
aagttaattttaaaatagaatggtaa

SEQ ID NO: 177716 - DNA, 27 bp, Artificial sequence
  SiRNA target sequence
atgaatactgaaaataaaccatgtatt

SEQ ID NO: 177717 - DNA, 27 bp, Artificial sequence
  SiRNA target sequence
tgaatactgaaaataaaccatgtattt

SEQ ID NO: 177718 - DNA, 27 bp, Artificial sequence
  SiRNA target sequence
gaatactgaaaataaaccatgtatttc

SEQ ID NO: 177719 - DNA, 27 bp, Artificial sequence
  SiRNA target sequence
aatactgaaaataaaccatgtatttca

SEQ ID NO: 177720 - DNA, 27 bp, Artificial sequence
  SiRNA target sequence
atactgaaaataaaccatgtatttcac

SEQ ID NO: 177721 - DNA, 27 bp, Artificial sequence
  SiRNA target sequence
tactgaaaataaaccatgtatttcacc

SEQ ID NO: 177722 - DNA, 27 bp, Artificial sequence
  SiRNA target sequence
actgaaaataaaccatgtatttcacca

SEQ ID NO: 177723 - DNA, 27 bp, Artificial sequence
  SiRNA target sequence
ctgaaaataaaccatgtatttcaccat

SEQ ID NO: 177724 - DNA, 27 bp, Artificial sequence
  SiRNA target sequence
tgaaaataaaccatgtatttcaccatt

SEQ ID NO: 177725 - DNA, 27 bp, Artificial sequence
  SiRNA target sequence
gaaaataaaccatgtatttcaccattt

SEQ ID NO: 177726 - DNA, 27 bp, Artificial sequence
  SiRNA target sequence
aaaataaaccatgtatttcaccattta

SEQ ID NO: 177727 - DNA, 27 bp, Artificial sequence
  SiRNA target sequence
aaataaaccatgtatttcaccatttac

SEQ ID NO: 177728 - DNA, 27 bp, Artificial sequence
  SiRNA target sequence
aataaaccatgtatttcaccatttacc

SEQ ID NO: 177729 - DNA, 27 bp, Artificial sequence
  SiRNA target sequence
ataaaccatgtatttcaccatttacct

SEQ ID NO: 177730 - DNA, 27 bp, Artificial sequence
  SiRNA target sequence
taaaccatgtatttcaccatttacctt

SEQ ID NO: 177731 - DNA, 27 bp, Artificial sequence
  SiRNA target sequence
aaaccatgtatttcaccatttaccttt

SEQ ID NO: 177732 - DNA, 27 bp, Artificial sequence
  SiRNA target sequence
aaccatgtatttcaccatttaccttta

SEQ ID NO: 177733 - DNA, 27 bp, Artificial sequence
  SiRNA target sequence
accatgtatttcaccatttacctttaa

SEQ ID NO: 177734 - DNA, 27 bp, Artificial sequence
  SiRNA target sequence
ccatgtatttcaccatttacctttaaa

SEQ ID NO: 177735 - DNA, 27 bp, Artificial sequence
  SiRNA target sequence
catgtatttcaccatttacctttaaac

SEQ ID NO: 177736 - DNA, 27 bp, Artificial sequence
  SiRNA target sequence
atgtatttcaccatttacctttaaact

SEQ ID NO: 177737 - DNA, 27 bp, Artificial sequence
  SiRNA target sequence
tgtatttcaccatttacctttaaacta

SEQ ID NO: 177738 - DNA, 27 bp, Artificial sequence
  SiRNA target sequence
gtatttcaccatttacctttaaactag

SEQ ID NO: 177739 - DNA, 27 bp, Artificial sequence
  SiRNA target sequence
tatttcaccatttacctttaaactaga

SEQ ID NO: 177740 - DNA, 27 bp, Artificial sequence
  SiRNA target sequence
atttcaccatttacctttaaactagaa

SEQ ID NO: 177741 - DNA, 27 bp, Artificial sequence
  SiRNA target sequence
tttcaccatttacctttaaactagaag

SEQ ID NO: 177742 - DNA, 27 bp, Artificial sequence
  SiRNA target sequence
ttcaccatttacctttaaactagaaga

SEQ ID NO: 177743 - DNA, 27 bp, Artificial sequence
  SiRNA target sequence
tcaccatttacctttaaactagaagat

SEQ ID NO: 177744 - DNA, 27 bp, Artificial sequence
  SiRNA target sequence
caccatttacctttaaactagaagatt

SEQ ID NO: 177745 - DNA, 27 bp, Artificial sequence
  SiRNA target sequence
accatttacctttaaactagaagattg

SEQ ID NO: 177746 - DNA, 27 bp, Artificial sequence
  SiRNA target sequence
ccatttacctttaaactagaagattgc

SEQ ID NO: 177747 - DNA, 27 bp, Artificial sequence
  SiRNA target sequence
catttacctttaaactagaagattgcc

SEQ ID NO: 177748 - DNA, 27 bp, Artificial sequence
  SiRNA target sequence
atttacctttaaactagaagattgcct

SEQ ID NO: 177749 - DNA, 27 bp, Artificial sequence
  SiRNA target sequence
tttacctttaaactagaagattgcctg

SEQ ID NO: 177750 - DNA, 27 bp, Artificial sequence
  SiRNA target sequence
ttacctttaaactagaagattgcctgg

SEQ ID NO: 177751 - DNA, 27 bp, Artificial sequence
  SiRNA target sequence
tacctttaaactagaagattgcctggc

SEQ ID NO: 177752 - DNA, 27 bp, Artificial sequence
  SiRNA target sequence
acctttaaactagaagattgcctggca

SEQ ID NO: 177753 - DNA, 27 bp, Artificial sequence
  SiRNA target sequence
cctttaaactagaagattgcctggcat

SEQ ID NO: 177754 - DNA, 27 bp, Artificial sequence
  SiRNA target sequence
ctttaaactagaagattgcctggcatg

SEQ ID NO: 177755 - DNA, 27 bp, Artificial sequence
  SiRNA target sequence
tttaaactagaagattgcctggcatgt

SEQ ID NO: 177756 - DNA, 27 bp, Artificial sequence
  SiRNA target sequence
ttaaactagaagattgcctggcatgtt

SEQ ID NO: 177757 - DNA, 27 bp, Artificial sequence
  SiRNA target sequence
taaactagaagattgcctggcatgttc

SEQ ID NO: 177758 - DNA, 27 bp, Artificial sequence
  SiRNA target sequence
aaactagaagattgcctggcatgttcg

SEQ ID NO: 177759 - DNA, 27 bp, Artificial sequence
  SiRNA target sequence
aactagaagattgcctggcatgttcgg

SEQ ID NO: 177760 - DNA, 27 bp, Artificial sequence
  SiRNA target sequence
actagaagattgcctggcatgttcggc

SEQ ID NO: 177761 - DNA, 27 bp, Artificial sequence
  SiRNA target sequence
ctagaagattgcctggcatgttcggct

SEQ ID NO: 177762 - DNA, 27 bp, Artificial sequence
  SiRNA target sequence
tagaagattgcctggcatgttcggctt

SEQ ID NO: 177763 - DNA, 27 bp, Artificial sequence
  SiRNA target sequence
agaagattgcctggcatgttcggcttg

SEQ ID NO: 177764 - DNA, 27 bp, Artificial sequence
  SiRNA target sequence
gaagattgcctggcatgttcggcttgt

SEQ ID NO: 177765 - DNA, 27 bp, Artificial sequence
  SiRNA target sequence
aagattgcctggcatgttcggcttgta

SEQ ID NO: 177766 - DNA, 27 bp, Artificial sequence
  SiRNA target sequence
agattgcctggcatgttcggcttgtat

SEQ ID NO: 177767 - DNA, 27 bp, Artificial sequence
  SiRNA target sequence
gattgcctggcatgttcggcttgtatt

SEQ ID NO: 177768 - DNA, 27 bp, Artificial sequence
  SiRNA target sequence
attgcctggcatgttcggcttgtattg

SEQ ID NO: 177769 - DNA, 27 bp, Artificial sequence
  SiRNA target sequence
ttgcctggcatgttcggcttgtattgc

SEQ ID NO: 177770 - DNA, 27 bp, Artificial sequence
  SiRNA target sequence
tgcctggcatgttcggcttgtattgct

SEQ ID NO: 177771 - DNA, 27 bp, Artificial sequence
  SiRNA target sequence
gcctggcatgttcggcttgtattgctg

SEQ ID NO: 177772 - DNA, 27 bp, Artificial sequence
  SiRNA target sequence
cctggcatgttcggcttgtattgctga

SEQ ID NO: 177773 - DNA, 27 bp, Artificial sequence
  SiRNA target sequence
ctggcatgttcggcttgtattgctgat

SEQ ID NO: 177774 - DNA, 27 bp, Artificial sequence
  SiRNA target sequence
tggcatgttcggcttgtattgctgatt

SEQ ID NO: 177775 - DNA, 27 bp, Artificial sequence
  SiRNA target sequence
ggcatgttcggcttgtattgctgattt

SEQ ID NO: 177776 - DNA, 27 bp, Artificial sequence
  SiRNA target sequence
gcatgttcggcttgtattgctgatttt

SEQ ID NO: 177777 - DNA, 27 bp, Artificial sequence
  SiRNA target sequence
catgttcggcttgtattgctgattttt

SEQ ID NO: 177778 - DNA, 27 bp, Artificial sequence
  SiRNA target sequence
atgttcggcttgtattgctgatttttc

SEQ ID NO: 177779 - DNA, 27 bp, Artificial sequence
  SiRNA target sequence
tgttcggcttgtattgctgatttttct

SEQ ID NO: 177780 - DNA, 27 bp, Artificial sequence
  SiRNA target sequence
gttcggcttgtattgctgatttttctg

SEQ ID NO: 177781 - DNA, 27 bp, Artificial sequence
  SiRNA target sequence
ttcggcttgtattgctgatttttctgt

SEQ ID NO: 177782 - DNA, 27 bp, Artificial sequence
  SiRNA target sequence
tcggcttgtattgctgatttttctgtt

SEQ ID NO: 177783 - DNA, 27 bp, Artificial sequence
  SiRNA target sequence
cggcttgtattgctgatttttctgttc

SEQ ID NO: 177784 - DNA, 27 bp, Artificial sequence
  SiRNA target sequence
ggcttgtattgctgatttttctgttcc

SEQ ID NO: 177785 - DNA, 27 bp, Artificial sequence
  SiRNA target sequence
gcttgtattgctgatttttctgttcca

SEQ ID NO: 177786 - DNA, 27 bp, Artificial sequence
  SiRNA target sequence
cttgtattgctgatttttctgttccaa

SEQ ID NO: 177787 - DNA, 27 bp, Artificial sequence
  SiRNA target sequence
ttgtattgctgatttttctgttccaaa

SEQ ID NO: 177788 - DNA, 27 bp, Artificial sequence
  SiRNA target sequence
tgtattgctgatttttctgttccaaaa

SEQ ID NO: 177789 - DNA, 27 bp, Artificial sequence
  SiRNA target sequence
gtattgctgatttttctgttccaaaaa

SEQ ID NO: 177790 - DNA, 27 bp, Artificial sequence
  SiRNA target sequence
tattgctgatttttctgttccaaaaat

SEQ ID NO: 177791 - DNA, 27 bp, Artificial sequence
  SiRNA target sequence
attgctgatttttctgttccaaaaatt

SEQ ID NO: 177792 - DNA, 27 bp, Artificial sequence
  SiRNA target sequence
ttgctgatttttctgttccaaaaattc

SEQ ID NO: 177793 - DNA, 27 bp, Artificial sequence
  SiRNA target sequence
tgctgatttttctgttccaaaaattcc

SEQ ID NO: 177794 - DNA, 27 bp, Artificial sequence
  SiRNA target sequence
gctgatttttctgttccaaaaattcct

SEQ ID NO: 177795 - DNA, 27 bp, Artificial sequence
  SiRNA target sequence
ctgatttttctgttccaaaaattccta

SEQ ID NO: 177796 - DNA, 27 bp, Artificial sequence
  SiRNA target sequence
tgatttttctgttccaaaaattcctac

SEQ ID NO: 177797 - DNA, 27 bp, Artificial sequence
  SiRNA target sequence
gatttttctgttccaaaaattcctact

SEQ ID NO: 177798 - DNA, 27 bp, Artificial sequence
  SiRNA target sequence
atttttctgttccaaaaattcctactt

SEQ ID NO: 177799 - DNA, 27 bp, Artificial sequence
  SiRNA target sequence
tttttctgttccaaaaattcctactta

SEQ ID NO: 177800 - DNA, 27 bp, Artificial sequence
  SiRNA target sequence
ttttctgttccaaaaattcctacttac

SEQ ID NO: 177801 - DNA, 27 bp, Artificial sequence
  SiRNA target sequence
tttctgttccaaaaattcctacttaca

SEQ ID NO: 177802 - DNA, 27 bp, Artificial sequence
  SiRNA target sequence
ttctgttccaaaaattcctacttacac

SEQ ID NO: 177803 - DNA, 27 bp, Artificial sequence
  SiRNA target sequence
tctgttccaaaaattcctacttacaca

SEQ ID NO: 177804 - DNA, 27 bp, Artificial sequence
  SiRNA target sequence
ctgttccaaaaattcctacttacacag

SEQ ID NO: 177805 - DNA, 27 bp, Artificial sequence
  SiRNA target sequence
tgttccaaaaattcctacttacacaga

SEQ ID NO: 177806 - DNA, 27 bp, Artificial sequence
  SiRNA target sequence
gttccaaaaattcctacttacacagaa

SEQ ID NO: 177807 - DNA, 27 bp, Artificial sequence
  SiRNA target sequence
ttccaaaaattcctacttacacagaac

SEQ ID NO: 177808 - DNA, 27 bp, Artificial sequence
  SiRNA target sequence
tccaaaaattcctacttacacagaact

SEQ ID NO: 177809 - DNA, 27 bp, Artificial sequence
  SiRNA target sequence
ccaaaaattcctacttacacagaactg

SEQ ID NO: 177810 - DNA, 27 bp, Artificial sequence
  SiRNA target sequence
caaaaattcctacttacacagaactga

SEQ ID NO: 177811 - DNA, 27 bp, Artificial sequence
  SiRNA target sequence
aaaaattcctacttacacagaactgaa

SEQ ID NO: 177812 - DNA, 27 bp, Artificial sequence
  SiRNA target sequence
aaaattcctacttacacagaactgaaa

SEQ ID NO: 177813 - DNA, 27 bp, Artificial sequence
  SiRNA target sequence
aaattcctacttacacagaactgaaag

SEQ ID NO: 177814 - DNA, 27 bp, Artificial sequence
  SiRNA target sequence
aattcctacttacacagaactgaaaga

SEQ ID NO: 177815 - DNA, 27 bp, Artificial sequence
  SiRNA target sequence
attcctacttacacagaactgaaagat

SEQ ID NO: 177816 - DNA, 27 bp, Artificial sequence
  SiRNA target sequence
ttcctacttacacagaactgaaagatg

SEQ ID NO: 177817 - DNA, 27 bp, Artificial sequence
  SiRNA target sequence
tcctacttacacagaactgaaagatgt

SEQ ID NO: 177818 - DNA, 27 bp, Artificial sequence
  SiRNA target sequence
cctacttacacagaactgaaagatgtc

SEQ ID NO: 177819 - DNA, 27 bp, Artificial sequence
  SiRNA target sequence
ctacttacacagaactgaaagatgtcc

SEQ ID NO: 177820 - DNA, 27 bp, Artificial sequence
  SiRNA target sequence
tacttacacagaactgaaagatgtccc

SEQ ID NO: 177821 - DNA, 27 bp, Artificial sequence
  SiRNA target sequence
acttacacagaactgaaagatgtccct

SEQ ID NO: 177822 - DNA, 27 bp, Artificial sequence
  SiRNA target sequence
cttacacagaactgaaagatgtccctt

SEQ ID NO: 177823 - DNA, 27 bp, Artificial sequence
  SiRNA target sequence
ttacacagaactgaaagatgtcccttt

SEQ ID NO: 177824 - DNA, 27 bp, Artificial sequence
  SiRNA target sequence
tacacagaactgaaagatgtcccttta

SEQ ID NO: 177825 - DNA, 27 bp, Artificial sequence
  SiRNA target sequence
acacagaactgaaagatgtccctttaa

SEQ ID NO: 177826 - DNA, 27 bp, Artificial sequence
  SiRNA target sequence
cacagaactgaaagatgtccctttaac

SEQ ID NO: 177827 - DNA, 27 bp, Artificial sequence
  SiRNA target sequence
acagaactgaaagatgtccctttaaca

SEQ ID NO: 177828 - DNA, 27 bp, Artificial sequence
  SiRNA target sequence
cagaactgaaagatgtccctttaacat

SEQ ID NO: 177829 - DNA, 27 bp, Artificial sequence
  SiRNA target sequence
agaactgaaagatgtccctttaacatt

SEQ ID NO: 177830 - DNA, 27 bp, Artificial sequence
  SiRNA target sequence
gaactgaaagatgtccctttaacattt

SEQ ID NO: 177831 - DNA, 27 bp, Artificial sequence
  SiRNA target sequence
aactgaaagatgtccctttaacatttt

SEQ ID NO: 177832 - DNA, 27 bp, Artificial sequence
  SiRNA target sequence
actgaaagatgtccctttaacattttt

SEQ ID NO: 177833 - DNA, 27 bp, Artificial sequence
  SiRNA target sequence
ctgaaagatgtccctttaacattttta

SEQ ID NO: 177834 - DNA, 27 bp, Artificial sequence
  SiRNA target sequence
tgaaagatgtccctttaacatttttat

SEQ ID NO: 177835 - DNA, 27 bp, Artificial sequence
  SiRNA target sequence
gaaagatgtccctttaacatttttatt

SEQ ID NO: 177836 - DNA, 27 bp, Artificial sequence
  SiRNA target sequence
aaagatgtccctttaacatttttatta

SEQ ID NO: 177837 - DNA, 27 bp, Artificial sequence
  SiRNA target sequence
aagatgtccctttaacatttttattat

SEQ ID NO: 177838 - DNA, 27 bp, Artificial sequence
  SiRNA target sequence
agatgtccctttaacatttttattatc

SEQ ID NO: 177839 - DNA, 27 bp, Artificial sequence
  SiRNA target sequence
gatgtccctttaacatttttattatca

SEQ ID NO: 177840 - DNA, 27 bp, Artificial sequence
  SiRNA target sequence
atgtccctttaacatttttattatcac

SEQ ID NO: 177841 - DNA, 27 bp, Artificial sequence
  SiRNA target sequence
tgtccctttaacatttttattatcacc

SEQ ID NO: 177842 - DNA, 27 bp, Artificial sequence
  SiRNA target sequence
gtccctttaacatttttattatcacca

SEQ ID NO: 177843 - DNA, 27 bp, Artificial sequence
  SiRNA target sequence
tccctttaacatttttattatcaccac

SEQ ID NO: 177844 - DNA, 27 bp, Artificial sequence
  SiRNA target sequence
ccctttaacatttttattatcaccaca

SEQ ID NO: 177845 - DNA, 27 bp, Artificial sequence
  SiRNA target sequence
cctttaacatttttattatcaccacat

SEQ ID NO: 177846 - DNA, 27 bp, Artificial sequence
  SiRNA target sequence
ctttaacatttttattatcaccacatt

SEQ ID NO: 177847 - DNA, 27 bp, Artificial sequence
  SiRNA target sequence
tttaacatttttattatcaccacattc

SEQ ID NO: 177848 - DNA, 27 bp, Artificial sequence
  SiRNA target sequence
ttaacatttttattatcaccacattcg

SEQ ID NO: 177849 - DNA, 27 bp, Artificial sequence
  SiRNA target sequence
taacatttttattatcaccacattcga

SEQ ID NO: 177850 - DNA, 27 bp, Artificial sequence
  SiRNA target sequence
aacatttttattatcaccacattcgaa

SEQ ID NO: 177851 - DNA, 27 bp, Artificial sequence
  SiRNA target sequence
acatttttattatcaccacattcgaaa

SEQ ID NO: 177852 - DNA, 27 bp, Artificial sequence
  SiRNA target sequence
catttttattatcaccacattcgaaaa

SEQ ID NO: 177853 - DNA, 27 bp, Artificial sequence
  SiRNA target sequence
atttttattatcaccacattcgaaaat

SEQ ID NO: 177854 - DNA, 27 bp, Artificial sequence
  SiRNA target sequence
tttttattatcaccacattcgaaaatg

SEQ ID NO: 177855 - DNA, 27 bp, Artificial sequence
  SiRNA target sequence
ttttattatcaccacattcgaaaatga

SEQ ID NO: 177856 - DNA, 27 bp, Artificial sequence
  SiRNA target sequence
tttattatcaccacattcgaaaatgaa

SEQ ID NO: 177857 - DNA, 27 bp, Artificial sequence
  SiRNA target sequence
ttattatcaccacattcgaaaatgaat

SEQ ID NO: 177858 - DNA, 27 bp, Artificial sequence
  SiRNA target sequence
tattatcaccacattcgaaaatgaata

SEQ ID NO: 177859 - DNA, 27 bp, Artificial sequence
  SiRNA target sequence
attatcaccacattcgaaaatgaatat

SEQ ID NO: 177860 - DNA, 27 bp, Artificial sequence
  SiRNA target sequence
ttatcaccacattcgaaaatgaatatg

SEQ ID NO: 177861 - DNA, 27 bp, Artificial sequence
  SiRNA target sequence
tatcaccacattcgaaaatgaatatgt

SEQ ID NO: 177862 - DNA, 27 bp, Artificial sequence
  SiRNA target sequence
atcaccacattcgaaaatgaatatgta

SEQ ID NO: 177863 - DNA, 27 bp, Artificial sequence
  SiRNA target sequence
tcaccacattcgaaaatgaatatgtat

SEQ ID NO: 177864 - DNA, 27 bp, Artificial sequence
  SiRNA target sequence
caccacattcgaaaatgaatatgtatg

SEQ ID NO: 177865 - DNA, 27 bp, Artificial sequence
  SiRNA target sequence
accacattcgaaaatgaatatgtatgc

SEQ ID NO: 177866 - DNA, 27 bp, Artificial sequence
  SiRNA target sequence
ccacattcgaaaatgaatatgtatgca

SEQ ID NO: 177867 - DNA, 27 bp, Artificial sequence
  SiRNA target sequence
cacattcgaaaatgaatatgtatgcac

SEQ ID NO: 177868 - DNA, 27 bp, Artificial sequence
  SiRNA target sequence
acattcgaaaatgaatatgtatgcaca

SEQ ID NO: 177869 - DNA, 27 bp, Artificial sequence
  SiRNA target sequence
cattcgaaaatgaatatgtatgcacac

SEQ ID NO: 177870 - DNA, 27 bp, Artificial sequence
  SiRNA target sequence
attcgaaaatgaatatgtatgcacact

SEQ ID NO: 177871 - DNA, 27 bp, Artificial sequence
  SiRNA target sequence
ttcgaaaatgaatatgtatgcacacta

SEQ ID NO: 177872 - DNA, 27 bp, Artificial sequence
  SiRNA target sequence
tcgaaaatgaatatgtatgcacactat

SEQ ID NO: 177873 - DNA, 27 bp, Artificial sequence
  SiRNA target sequence
cgaaaatgaatatgtatgcacactata

SEQ ID NO: 177874 - DNA, 27 bp, Artificial sequence
  SiRNA target sequence
gaaaatgaatatgtatgcacactataa

SEQ ID NO: 177875 - DNA, 27 bp, Artificial sequence
  SiRNA target sequence
aaaatgaatatgtatgcacactataac

SEQ ID NO: 177876 - DNA, 27 bp, Artificial sequence
  SiRNA target sequence
aaatgaatatgtatgcacactataaca

SEQ ID NO: 177877 - DNA, 27 bp, Artificial sequence
  SiRNA target sequence
aatgaatatgtatgcacactataacaa

SEQ ID NO: 177878 - DNA, 27 bp, Artificial sequence
  SiRNA target sequence
atgaatatgtatgcacactataacaat

SEQ ID NO: 177879 - DNA, 27 bp, Artificial sequence
  SiRNA target sequence
tgaatatgtatgcacactataacaatc

SEQ ID NO: 177880 - DNA, 27 bp, Artificial sequence
  SiRNA target sequence
gaatatgtatgcacactataacaatca

SEQ ID NO: 177881 - DNA, 27 bp, Artificial sequence
  SiRNA target sequence
aatatgtatgcacactataacaatcat

SEQ ID NO: 177882 - DNA, 27 bp, Artificial sequence
  SiRNA target sequence
atatgtatgcacactataacaatcata

SEQ ID NO: 177883 - DNA, 27 bp, Artificial sequence
  SiRNA target sequence
tatgtatgcacactataacaatcatat

SEQ ID NO: 177884 - DNA, 27 bp, Artificial sequence
  SiRNA target sequence
atgtatgcacactataacaatcatata

SEQ ID NO: 177885 - DNA, 27 bp, Artificial sequence
  SiRNA target sequence
tgtatgcacactataacaatcatataa

SEQ ID NO: 177886 - DNA, 27 bp, Artificial sequence
  SiRNA target sequence
gtatgcacactataacaatcatataat

SEQ ID NO: 177887 - DNA, 27 bp, Artificial sequence
  SiRNA target sequence
tatgcacactataacaatcatataatg

SEQ ID NO: 177888 - DNA, 27 bp, Artificial sequence
  SiRNA target sequence
atgcacactataacaatcatataatgt

SEQ ID NO: 177889 - DNA, 27 bp, Artificial sequence
  SiRNA target sequence
tgcacactataacaatcatataatgtc

SEQ ID NO: 177890 - DNA, 27 bp, Artificial sequence
  SiRNA target sequence
gcacactataacaatcatataatgtcc

SEQ ID NO: 177891 - DNA, 27 bp, Artificial sequence
  SiRNA target sequence
cacactataacaatcatataatgtcct

SEQ ID NO: 177892 - DNA, 27 bp, Artificial sequence
  SiRNA target sequence
acactataacaatcatataatgtcctt

SEQ ID NO: 177893 - DNA, 27 bp, Artificial sequence
  SiRNA target sequence
cactataacaatcatataatgtccttt

SEQ ID NO: 177894 - DNA, 27 bp, Artificial sequence
  SiRNA target sequence
actataacaatcatataatgtccttta

SEQ ID NO: 177895 - DNA, 27 bp, Artificial sequence
  SiRNA target sequence
ctataacaatcatataatgtcctttag

SEQ ID NO: 177896 - DNA, 27 bp, Artificial sequence
  SiRNA target sequence
tataacaatcatataatgtcctttagt

SEQ ID NO: 177897 - DNA, 27 bp, Artificial sequence
  SiRNA target sequence
ataacaatcatataatgtcctttagtg

SEQ ID NO: 177898 - DNA, 27 bp, Artificial sequence
  SiRNA target sequence
taacaatcatataatgtcctttagtga

SEQ ID NO: 177899 - DNA, 27 bp, Artificial sequence
  SiRNA target sequence
aacaatcatataatgtcctttagtgat

SEQ ID NO: 177900 - DNA, 27 bp, Artificial sequence
  SiRNA target sequence
acaatcatataatgtcctttagtgatt

SEQ ID NO: 177901 - DNA, 27 bp, Artificial sequence
  SiRNA target sequence
caatcatataatgtcctttagtgattt

SEQ ID NO: 177902 - DNA, 27 bp, Artificial sequence
  SiRNA target sequence
aatcatataatgtcctttagtgatttt

SEQ ID NO: 177903 - DNA, 27 bp, Artificial sequence
  SiRNA target sequence
atcatataatgtcctttagtgattttg

SEQ ID NO: 177904 - DNA, 27 bp, Artificial sequence
  SiRNA target sequence
tcatataatgtcctttagtgattttga

SEQ ID NO: 177905 - DNA, 27 bp, Artificial sequence
  SiRNA target sequence
catataatgtcctttagtgattttgaa

SEQ ID NO: 177906 - DNA, 27 bp, Artificial sequence
  SiRNA target sequence
atataatgtcctttagtgattttgaat

SEQ ID NO: 177907 - DNA, 27 bp, Artificial sequence
  SiRNA target sequence
tataatgtcctttagtgattttgaata

SEQ ID NO: 177908 - DNA, 27 bp, Artificial sequence
  SiRNA target sequence
ataatgtcctttagtgattttgaatat

SEQ ID NO: 177909 - DNA, 27 bp, Artificial sequence
  SiRNA target sequence
taatgtcctttagtgattttgaatatc

SEQ ID NO: 177910 - DNA, 27 bp, Artificial sequence
  SiRNA target sequence
aatgtcctttagtgattttgaatatca

SEQ ID NO: 177911 - DNA, 27 bp, Artificial sequence
  SiRNA target sequence
atgtcctttagtgattttgaatatcac

SEQ ID NO: 177912 - DNA, 27 bp, Artificial sequence
  SiRNA target sequence
tgtcctttagtgattttgaatatcact

SEQ ID NO: 177913 - DNA, 27 bp, Artificial sequence
  SiRNA target sequence
gtcctttagtgattttgaatatcactt

SEQ ID NO: 177914 - DNA, 27 bp, Artificial sequence
  SiRNA target sequence
tcctttagtgattttgaatatcactta

SEQ ID NO: 177915 - DNA, 27 bp, Artificial sequence
  SiRNA target sequence
cctttagtgattttgaatatcacttaa

SEQ ID NO: 177916 - DNA, 27 bp, Artificial sequence
  SiRNA target sequence
ctttagtgattttgaatatcacttaat

SEQ ID NO: 177917 - DNA, 27 bp, Artificial sequence
  SiRNA target sequence
tttagtgattttgaatatcacttaatt

SEQ ID NO: 177918 - DNA, 27 bp, Artificial sequence
  SiRNA target sequence
ttagtgattttgaatatcacttaattt

SEQ ID NO: 177919 - DNA, 27 bp, Artificial sequence
  SiRNA target sequence
tagtgattttgaatatcacttaatttc

SEQ ID NO: 177920 - DNA, 27 bp, Artificial sequence
  SiRNA target sequence
agtgattttgaatatcacttaatttca

SEQ ID NO: 177921 - DNA, 27 bp, Artificial sequence
  SiRNA target sequence
gtgattttgaatatcacttaatttcat

SEQ ID NO: 177922 - DNA, 27 bp, Artificial sequence
  SiRNA target sequence
tgattttgaatatcacttaatttcatt

SEQ ID NO: 177923 - DNA, 27 bp, Artificial sequence
  SiRNA target sequence
gattttgaatatcacttaatttcattt

SEQ ID NO: 177924 - DNA, 27 bp, Artificial sequence
  SiRNA target sequence
attttgaatatcacttaatttcattta

SEQ ID NO: 177925 - DNA, 27 bp, Artificial sequence
  SiRNA target sequence
ttttgaatatcacttaatttcatttat

SEQ ID NO: 177926 - DNA, 27 bp, Artificial sequence
  SiRNA target sequence
tttgaatatcacttaatttcatttata

SEQ ID NO: 177927 - DNA, 27 bp, Artificial sequence
  SiRNA target sequence
ttgaatatcacttaatttcatttataa

SEQ ID NO: 177928 - DNA, 27 bp, Artificial sequence
  SiRNA target sequence
tgaatatcacttaatttcatttataaa

SEQ ID NO: 177929 - DNA, 27 bp, Artificial sequence
  SiRNA target sequence
gaatatcacttaatttcatttataaaa

SEQ ID NO: 177930 - DNA, 27 bp, Artificial sequence
  SiRNA target sequence
aatatcacttaatttcatttataaaac

SEQ ID NO: 177931 - DNA, 27 bp, Artificial sequence
  SiRNA target sequence
atatcacttaatttcatttataaaact

SEQ ID NO: 177932 - DNA, 27 bp, Artificial sequence
  SiRNA target sequence
tatcacttaatttcatttataaaacta

SEQ ID NO: 177933 - DNA, 27 bp, Artificial sequence
  SiRNA target sequence
atcacttaatttcatttataaaactaa

SEQ ID NO: 177934 - DNA, 27 bp, Artificial sequence
  SiRNA target sequence
tcacttaatttcatttataaaactaaa

SEQ ID NO: 177935 - DNA, 27 bp, Artificial sequence
  SiRNA target sequence
cacttaatttcatttataaaactaaaa

SEQ ID NO: 177936 - DNA, 27 bp, Artificial sequence
  SiRNA target sequence
acttaatttcatttataaaactaaaat

SEQ ID NO: 177937 - DNA, 27 bp, Artificial sequence
  SiRNA target sequence
cttaatttcatttataaaactaaaatt

SEQ ID NO: 177938 - DNA, 27 bp, Artificial sequence
  SiRNA target sequence
ttaatttcatttataaaactaaaattt

SEQ ID NO: 177939 - DNA, 27 bp, Artificial sequence
  SiRNA target sequence
taatttcatttataaaactaaaattta

SEQ ID NO: 177940 - DNA, 27 bp, Artificial sequence
  SiRNA target sequence
aatttcatttataaaactaaaatttaa

SEQ ID NO: 177941 - DNA, 27 bp, Artificial sequence
  SiRNA target sequence
atttcatttataaaactaaaatttaat

SEQ ID NO: 177942 - DNA, 27 bp, Artificial sequence
  SiRNA target sequence
tttcatttataaaactaaaatttaatg

SEQ ID NO: 177943 - DNA, 27 bp, Artificial sequence
  SiRNA target sequence
ttcatttataaaactaaaatttaatgt

SEQ ID NO: 177944 - DNA, 27 bp, Artificial sequence
  SiRNA target sequence
tcatttataaaactaaaatttaatgta

SEQ ID NO: 177945 - DNA, 27 bp, Artificial sequence
  SiRNA target sequence
catttataaaactaaaatttaatgtaa

SEQ ID NO: 177946 - DNA, 27 bp, Artificial sequence
  SiRNA target sequence
atttataaaactaaaatttaatgtaat

SEQ ID NO: 177947 - DNA, 27 bp, Artificial sequence
  SiRNA target sequence
tttataaaactaaaatttaatgtaata

SEQ ID NO: 177948 - DNA, 27 bp, Artificial sequence
  SiRNA target sequence
ttataaaactaaaatttaatgtaataa

SEQ ID NO: 177949 - DNA, 27 bp, Artificial sequence
  SiRNA target sequence
tataaaactaaaatttaatgtaataaa

SEQ ID NO: 177950 - DNA, 27 bp, Artificial sequence
  SiRNA target sequence
ataaaactaaaatttaatgtaataaaa

SEQ ID NO: 177951 - DNA, 27 bp, Artificial sequence
  SiRNA target sequence
taaaactaaaatttaatgtaataaaag

SEQ ID NO: 177952 - DNA, 27 bp, Artificial sequence
  SiRNA target sequence
aaaactaaaatttaatgtaataaaagt

SEQ ID NO: 177953 - DNA, 27 bp, Artificial sequence
  SiRNA target sequence
aaactaaaatttaatgtaataaaagta

SEQ ID NO: 177954 - DNA, 27 bp, Artificial sequence
  SiRNA target sequence
aactaaaatttaatgtaataaaagtat

SEQ ID NO: 177955 - DNA, 27 bp, Artificial sequence
  SiRNA target sequence
actaaaatttaatgtaataaaagtata

SEQ ID NO: 177956 - DNA, 27 bp, Artificial sequence
  SiRNA target sequence
ctaaaatttaatgtaataaaagtatat

SEQ ID NO: 177957 - DNA, 27 bp, Artificial sequence
  SiRNA target sequence
taaaatttaatgtaataaaagtatatg

SEQ ID NO: 177958 - DNA, 27 bp, Artificial sequence
  SiRNA target sequence
aaaatttaatgtaataaaagtatatga

SEQ ID NO: 177959 - DNA, 27 bp, Artificial sequence
  SiRNA target sequence
aaatttaatgtaataaaagtatatgat

SEQ ID NO: 177960 - DNA, 27 bp, Artificial sequence
  SiRNA target sequence
aatttaatgtaataaaagtatatgata

SEQ ID NO: 177961 - DNA, 27 bp, Artificial sequence
  SiRNA target sequence
atttaatgtaataaaagtatatgatac

SEQ ID NO: 177962 - DNA, 27 bp, Artificial sequence
  SiRNA target sequence
tttaatgtaataaaagtatatgataca

SEQ ID NO: 177963 - DNA, 27 bp, Artificial sequence
  SiRNA target sequence
ttaatgtaataaaagtatatgatacat

SEQ ID NO: 177964 - DNA, 27 bp, Artificial sequence
  SiRNA target sequence
taatgtaataaaagtatatgatacatc

SEQ ID NO: 177965 - DNA, 27 bp, Artificial sequence
  SiRNA target sequence
aatgtaataaaagtatatgatacatct

SEQ ID NO: 177966 - DNA, 27 bp, Artificial sequence
  SiRNA target sequence
atgtaataaaagtatatgatacatctt

SEQ ID NO: 177967 - DNA, 27 bp, Artificial sequence
  SiRNA target sequence
tgtaataaaagtatatgatacatctta

SEQ ID NO: 177968 - DNA, 27 bp, Artificial sequence
  SiRNA target sequence
gtaataaaagtatatgatacatcttat

SEQ ID NO: 177969 - DNA, 27 bp, Artificial sequence
  SiRNA target sequence
taataaaagtatatgatacatcttatg

SEQ ID NO: 177970 - DNA, 27 bp, Artificial sequence
  SiRNA target sequence
aataaaagtatatgatacatcttatgt

SEQ ID NO: 177971 - DNA, 27 bp, Artificial sequence
  SiRNA target sequence
ataaaagtatatgatacatcttatgtc

SEQ ID NO: 177972 - DNA, 27 bp, Artificial sequence
  SiRNA target sequence
taaaagtatatgatacatcttatgtca

SEQ ID NO: 177973 - DNA, 27 bp, Artificial sequence
  SiRNA target sequence
aaaagtatatgatacatcttatgtcaa

SEQ ID NO: 177974 - DNA, 27 bp, Artificial sequence
  SiRNA target sequence
aaagtatatgatacatcttatgtcaaa

SEQ ID NO: 177975 - DNA, 27 bp, Artificial sequence
  SiRNA target sequence
aagtatatgatacatcttatgtcaaaa

SEQ ID NO: 177976 - DNA, 27 bp, Artificial sequence
  SiRNA target sequence
agtatatgatacatcttatgtcaaaaa

SEQ ID NO: 177977 - DNA, 27 bp, Artificial sequence
  SiRNA target sequence
gtatatgatacatcttatgtcaaaaat

SEQ ID NO: 177978 - DNA, 27 bp, Artificial sequence
  SiRNA target sequence
tatatgatacatcttatgtcaaaaata

SEQ ID NO: 177979 - DNA, 27 bp, Artificial sequence
  SiRNA target sequence
atatgatacatcttatgtcaaaaatat

SEQ ID NO: 177980 - DNA, 27 bp, Artificial sequence
  SiRNA target sequence
tatgatacatcttatgtcaaaaatatt

SEQ ID NO: 177981 - DNA, 27 bp, Artificial sequence
  SiRNA target sequence
atgatacatcttatgtcaaaaatattc

SEQ ID NO: 177982 - DNA, 27 bp, Artificial sequence
  SiRNA target sequence
tgatacatcttatgtcaaaaatattct

SEQ ID NO: 177983 - DNA, 27 bp, Artificial sequence
  SiRNA target sequence
gatacatcttatgtcaaaaatattctg

SEQ ID NO: 177984 - DNA, 27 bp, Artificial sequence
  SiRNA target sequence
atacatcttatgtcaaaaatattctgt

SEQ ID NO: 177985 - DNA, 27 bp, Artificial sequence
  SiRNA target sequence
tacatcttatgtcaaaaatattctgta

SEQ ID NO: 177986 - DNA, 27 bp, Artificial sequence
  SiRNA target sequence
acatcttatgtcaaaaatattctgtat

SEQ ID NO: 177987 - DNA, 27 bp, Artificial sequence
  SiRNA target sequence
catcttatgtcaaaaatattctgtatg

SEQ ID NO: 177988 - DNA, 27 bp, Artificial sequence
  SiRNA target sequence
atcttatgtcaaaaatattctgtatga

SEQ ID NO: 177989 - DNA, 27 bp, Artificial sequence
  SiRNA target sequence
tcttatgtcaaaaatattctgtatgat

SEQ ID NO: 177990 - DNA, 27 bp, Artificial sequence
  SiRNA target sequence
cttatgtcaaaaatattctgtatgata

SEQ ID NO: 177991 - DNA, 27 bp, Artificial sequence
  SiRNA target sequence
ttatgtcaaaaatattctgtatgatag

SEQ ID NO: 177992 - DNA, 27 bp, Artificial sequence
  SiRNA target sequence
tatgtcaaaaatattctgtatgatagt

SEQ ID NO: 177993 - DNA, 27 bp, Artificial sequence
  SiRNA target sequence
atgtcaaaaatattctgtatgatagtg

SEQ ID NO: 177994 - DNA, 27 bp, Artificial sequence
  SiRNA target sequence
tgtcaaaaatattctgtatgatagtgt

SEQ ID NO: 177995 - DNA, 27 bp, Artificial sequence
  SiRNA target sequence
gtcaaaaatattctgtatgatagtgtt

SEQ ID NO: 177996 - DNA, 27 bp, Artificial sequence
  SiRNA target sequence
tcaaaaatattctgtatgatagtgttt

SEQ ID NO: 177997 - DNA, 27 bp, Artificial sequence
  SiRNA target sequence
caaaaatattctgtatgatagtgttta

SEQ ID NO: 177998 - DNA, 27 bp, Artificial sequence
  SiRNA target sequence
aaaaatattctgtatgatagtgtttat

SEQ ID NO: 177999 - DNA, 27 bp, Artificial sequence
  SiRNA target sequence
aaaatattctgtatgatagtgtttatg

SEQ ID NO: 178000 - DNA, 27 bp, Artificial sequence
  SiRNA target sequence
aaatattctgtatgatagtgtttatga

SEQ ID NO: 178001 - DNA, 27 bp, Artificial sequence
  SiRNA target sequence
aatattctgtatgatagtgtttatgag

SEQ ID NO: 178002 - DNA, 27 bp, Artificial sequence
  SiRNA target sequence
atattctgtatgatagtgtttatgagg

SEQ ID NO: 178003 - DNA, 27 bp, Artificial sequence
  SiRNA target sequence
tattctgtatgatagtgtttatgagga

SEQ ID NO: 178004 - DNA, 27 bp, Artificial sequence
  SiRNA target sequence
attctgtatgatagtgtttatgaggaa

SEQ ID NO: 178005 - DNA, 27 bp, Artificial sequence
  SiRNA target sequence
ttctgtatgatagtgtttatgaggaaa

SEQ ID NO: 178006 - DNA, 27 bp, Artificial sequence
  SiRNA target sequence
tctgtatgatagtgtttatgaggaaag

SEQ ID NO: 178007 - DNA, 27 bp, Artificial sequence
  SiRNA target sequence
ctgtatgatagtgtttatgaggaaagc

SEQ ID NO: 178008 - DNA, 27 bp, Artificial sequence
  SiRNA target sequence
tgtatgatagtgtttatgaggaaagca

SEQ ID NO: 178009 - DNA, 27 bp, Artificial sequence
  SiRNA target sequence
gtatgatagtgtttatgaggaaagcac

SEQ ID NO: 178010 - DNA, 27 bp, Artificial sequence
  SiRNA target sequence
tatgatagtgtttatgaggaaagcacg

SEQ ID NO: 178011 - DNA, 27 bp, Artificial sequence
  SiRNA target sequence
atgatagtgtttatgaggaaagcacga

SEQ ID NO: 178012 - DNA, 27 bp, Artificial sequence
  SiRNA target sequence
tgatagtgtttatgaggaaagcacgag

SEQ ID NO: 178013 - DNA, 27 bp, Artificial sequence
  SiRNA target sequence
gatagtgtttatgaggaaagcacgaga

SEQ ID NO: 178014 - DNA, 27 bp, Artificial sequence
  SiRNA target sequence
atagtgtttatgaggaaagcacgagag

SEQ ID NO: 178015 - DNA, 27 bp, Artificial sequence
  SiRNA target sequence
tagtgtttatgaggaaagcacgagaga

SEQ ID NO: 178016 - DNA, 27 bp, Artificial sequence
  SiRNA target sequence
agtgtttatgaggaaagcacgagagac

SEQ ID NO: 178017 - DNA, 27 bp, Artificial sequence
  SiRNA target sequence
gtgtttatgaggaaagcacgagagaca

SEQ ID NO: 178018 - DNA, 27 bp, Artificial sequence
  SiRNA target sequence
tgtttatgaggaaagcacgagagacaa

SEQ ID NO: 178019 - DNA, 27 bp, Artificial sequence
  SiRNA target sequence
gtttatgaggaaagcacgagagacaaa

SEQ ID NO: 178020 - DNA, 27 bp, Artificial sequence
  SiRNA target sequence
tttatgaggaaagcacgagagacaaaa

SEQ ID NO: 178021 - DNA, 27 bp, Artificial sequence
  SiRNA target sequence
ttatgaggaaagcacgagagacaaaat

SEQ ID NO: 178022 - DNA, 27 bp, Artificial sequence
  SiRNA target sequence
tatgaggaaagcacgagagacaaaata

SEQ ID NO: 178023 - DNA, 27 bp, Artificial sequence
  SiRNA target sequence
atgaggaaagcacgagagacaaaataa

SEQ ID NO: 178024 - DNA, 27 bp, Artificial sequence
  SiRNA target sequence
tgaggaaagcacgagagacaaaataat

SEQ ID NO: 178025 - DNA, 27 bp, Artificial sequence
  SiRNA target sequence
gaggaaagcacgagagacaaaataata

SEQ ID NO: 178026 - DNA, 27 bp, Artificial sequence
  SiRNA target sequence
aggaaagcacgagagacaaaataataa

SEQ ID NO: 178027 - DNA, 27 bp, Artificial sequence
  SiRNA target sequence
ggaaagcacgagagacaaaataataat

SEQ ID NO: 178028 - DNA, 27 bp, Artificial sequence
  SiRNA target sequence
gaaagcacgagagacaaaataataata

SEQ ID NO: 178029 - DNA, 27 bp, Artificial sequence
  SiRNA target sequence
aaagcacgagagacaaaataataataa

SEQ ID NO: 178030 - DNA, 27 bp, Artificial sequence
  SiRNA target sequence
aagcacgagagacaaaataataataag

SEQ ID NO: 178031 - DNA, 27 bp, Artificial sequence
  SiRNA target sequence
agcacgagagacaaaataataataagt

SEQ ID NO: 178032 - DNA, 27 bp, Artificial sequence
  SiRNA target sequence
gcacgagagacaaaataataataagtg

SEQ ID NO: 178033 - DNA, 27 bp, Artificial sequence
  SiRNA target sequence
cacgagagacaaaataataataagtga

SEQ ID NO: 178034 - DNA, 27 bp, Artificial sequence
  SiRNA target sequence
acgagagacaaaataataataagtgac

SEQ ID NO: 178035 - DNA, 27 bp, Artificial sequence
  SiRNA target sequence
cgagagacaaaataataataagtgact

SEQ ID NO: 178036 - DNA, 27 bp, Artificial sequence
  SiRNA target sequence
gagagacaaaataataataagtgactg

SEQ ID NO: 178037 - DNA, 27 bp, Artificial sequence
  SiRNA target sequence
agagacaaaataataataagtgactgt

SEQ ID NO: 178038 - DNA, 27 bp, Artificial sequence
  SiRNA target sequence
gagacaaaataataataagtgactgtc

SEQ ID NO: 178039 - DNA, 27 bp, Artificial sequence
  SiRNA target sequence
agacaaaataataataagtgactgtcc

SEQ ID NO: 178040 - DNA, 27 bp, Artificial sequence
  SiRNA target sequence
gacaaaataataataagtgactgtcct

SEQ ID NO: 178041 - DNA, 27 bp, Artificial sequence
  SiRNA target sequence
acaaaataataataagtgactgtcctg

SEQ ID NO: 178042 - DNA, 27 bp, Artificial sequence
  SiRNA target sequence
caaaataataataagtgactgtcctgg

SEQ ID NO: 178043 - DNA, 27 bp, Artificial sequence
  SiRNA target sequence
aaaataataataagtgactgtcctggg

SEQ ID NO: 178044 - DNA, 27 bp, Artificial sequence
  SiRNA target sequence
aaataataataagtgactgtcctggga

SEQ ID NO: 178045 - DNA, 27 bp, Artificial sequence
  SiRNA target sequence
aataataataagtgactgtcctgggac

SEQ ID NO: 178046 - DNA, 27 bp, Artificial sequence
  SiRNA target sequence
ataataataagtgactgtcctgggact

SEQ ID NO: 178047 - DNA, 27 bp, Artificial sequence
  SiRNA target sequence
taataataagtgactgtcctgggactg

SEQ ID NO: 178048 - DNA, 27 bp, Artificial sequence
  SiRNA target sequence
aataataagtgactgtcctgggactgt

SEQ ID NO: 178049 - DNA, 27 bp, Artificial sequence
  SiRNA target sequence
ataataagtgactgtcctgggactgtt

SEQ ID NO: 178050 - DNA, 27 bp, Artificial sequence
  SiRNA target sequence
taataagtgactgtcctgggactgttt

SEQ ID NO: 178051 - DNA, 27 bp, Artificial sequence
  SiRNA target sequence
aataagtgactgtcctgggactgtttc

SEQ ID NO: 178052 - DNA, 27 bp, Artificial sequence
  SiRNA target sequence
ataagtgactgtcctgggactgtttca

SEQ ID NO: 178053 - DNA, 27 bp, Artificial sequence
  SiRNA target sequence
taagtgactgtcctgggactgtttcat

SEQ ID NO: 178054 - DNA, 27 bp, Artificial sequence
  SiRNA target sequence
aagtgactgtcctgggactgtttcata

SEQ ID NO: 178055 - DNA, 27 bp, Artificial sequence
  SiRNA target sequence
agtgactgtcctgggactgtttcatat

SEQ ID NO: 178056 - DNA, 27 bp, Artificial sequence
  SiRNA target sequence
gtgactgtcctgggactgtttcatata

SEQ ID NO: 178057 - DNA, 27 bp, Artificial sequence
  SiRNA target sequence
tgactgtcctgggactgtttcatatat

SEQ ID NO: 178058 - DNA, 27 bp, Artificial sequence
  SiRNA target sequence
gactgtcctgggactgtttcatatatt

SEQ ID NO: 178059 - DNA, 27 bp, Artificial sequence
  SiRNA target sequence
actgtcctgggactgtttcatatattg

SEQ ID NO: 178060 - DNA, 27 bp, Artificial sequence
  SiRNA target sequence
ctgtcctgggactgtttcatatattga

SEQ ID NO: 178061 - DNA, 27 bp, Artificial sequence
  SiRNA target sequence
tgtcctgggactgtttcatatattgaa

SEQ ID NO: 178062 - DNA, 27 bp, Artificial sequence
  SiRNA target sequence
gtcctgggactgtttcatatattgaaa

SEQ ID NO: 178063 - DNA, 27 bp, Artificial sequence
  SiRNA target sequence
tcctgggactgtttcatatattgaaag

SEQ ID NO: 178064 - DNA, 27 bp, Artificial sequence
  SiRNA target sequence
cctgggactgtttcatatattgaaagg

SEQ ID NO: 178065 - DNA, 27 bp, Artificial sequence
  SiRNA target sequence
ctgggactgtttcatatattgaaaggc

SEQ ID NO: 178066 - DNA, 27 bp, Artificial sequence
  SiRNA target sequence
tgggactgtttcatatattgaaaggca

SEQ ID NO: 178067 - DNA, 27 bp, Artificial sequence
  SiRNA target sequence
gggactgtttcatatattgaaaggcaa

SEQ ID NO: 178068 - DNA, 27 bp, Artificial sequence
  SiRNA target sequence
ggactgtttcatatattgaaaggcaag

SEQ ID NO: 178069 - DNA, 27 bp, Artificial sequence
  SiRNA target sequence
gactgtttcatatattgaaaggcaagc

SEQ ID NO: 178070 - DNA, 27 bp, Artificial sequence
  SiRNA target sequence
actgtttcatatattgaaaggcaagca

SEQ ID NO: 178071 - DNA, 27 bp, Artificial sequence
  SiRNA target sequence
ctgtttcatatattgaaaggcaagcac

SEQ ID NO: 178072 - DNA, 27 bp, Artificial sequence
  SiRNA target sequence
tgtttcatatattgaaaggcaagcaca

SEQ ID NO: 178073 - DNA, 27 bp, Artificial sequence
  SiRNA target sequence
gtttcatatattgaaaggcaagcacac

SEQ ID NO: 178074 - DNA, 27 bp, Artificial sequence
  SiRNA target sequence
tttcatatattgaaaggcaagcacacc

SEQ ID NO: 178075 - DNA, 27 bp, Artificial sequence
  SiRNA target sequence
ttcatatattgaaaggcaagcacacca

SEQ ID NO: 178076 - DNA, 27 bp, Artificial sequence
  SiRNA target sequence
tcatatattgaaaggcaagcacaccat

SEQ ID NO: 178077 - DNA, 27 bp, Artificial sequence
  SiRNA target sequence
catatattgaaaggcaagcacaccatt

SEQ ID NO: 178078 - DNA, 27 bp, Artificial sequence
  SiRNA target sequence
atatattgaaaggcaagcacaccattt

SEQ ID NO: 178079 - DNA, 27 bp, Artificial sequence
  SiRNA target sequence
tatattgaaaggcaagcacaccattta

SEQ ID NO: 178080 - DNA, 27 bp, Artificial sequence
  SiRNA target sequence
atattgaaaggcaagcacaccatttaa

SEQ ID NO: 178081 - DNA, 27 bp, Artificial sequence
  SiRNA target sequence
tattgaaaggcaagcacaccatttaat

SEQ ID NO: 178082 - DNA, 27 bp, Artificial sequence
  SiRNA target sequence
attgaaaggcaagcacaccatttaatt

SEQ ID NO: 178083 - DNA, 27 bp, Artificial sequence
  SiRNA target sequence
ttgaaaggcaagcacaccatttaattg

SEQ ID NO: 178084 - DNA, 27 bp, Artificial sequence
  SiRNA target sequence
tgaaaggcaagcacaccatttaattga

SEQ ID NO: 178085 - DNA, 27 bp, Artificial sequence
  SiRNA target sequence
gaaaggcaagcacaccatttaattgaa

SEQ ID NO: 178086 - DNA, 27 bp, Artificial sequence
  SiRNA target sequence
aaaggcaagcacaccatttaattgaat

SEQ ID NO: 178087 - DNA, 27 bp, Artificial sequence
  SiRNA target sequence
aaggcaagcacaccatttaattgaata

SEQ ID NO: 178088 - DNA, 27 bp, Artificial sequence
  SiRNA target sequence
aggcaagcacaccatttaattgaatat

SEQ ID NO: 178089 - DNA, 27 bp, Artificial sequence
  SiRNA target sequence
ggcaagcacaccatttaattgaatatt

SEQ ID NO: 178090 - DNA, 27 bp, Artificial sequence
  SiRNA target sequence
gcaagcacaccatttaattgaatattt

SEQ ID NO: 178091 - DNA, 27 bp, Artificial sequence
  SiRNA target sequence
caagcacaccatttaattgaatattta

SEQ ID NO: 178092 - DNA, 27 bp, Artificial sequence
  SiRNA target sequence
aagcacaccatttaattgaatatttat

SEQ ID NO: 178093 - DNA, 27 bp, Artificial sequence
  SiRNA target sequence
agcacaccatttaattgaatatttatc

SEQ ID NO: 178094 - DNA, 27 bp, Artificial sequence
  SiRNA target sequence
gcacaccatttaattgaatatttatct

SEQ ID NO: 178095 - DNA, 27 bp, Artificial sequence
  SiRNA target sequence
cacaccatttaattgaatatttatctg

SEQ ID NO: 178096 - DNA, 27 bp, Artificial sequence
  SiRNA target sequence
acaccatttaattgaatatttatctgt

SEQ ID NO: 178097 - DNA, 27 bp, Artificial sequence
  SiRNA target sequence
caccatttaattgaatatttatctgtt

SEQ ID NO: 178098 - DNA, 27 bp, Artificial sequence
  SiRNA target sequence
accatttaattgaatatttatctgtta

SEQ ID NO: 178099 - DNA, 27 bp, Artificial sequence
  SiRNA target sequence
ccatttaattgaatatttatctgttac

SEQ ID NO: 178100 - DNA, 27 bp, Artificial sequence
  SiRNA target sequence
catttaattgaatatttatctgttact

SEQ ID NO: 178101 - DNA, 27 bp, Artificial sequence
  SiRNA target sequence
atttaattgaatatttatctgttactt

SEQ ID NO: 178102 - DNA, 27 bp, Artificial sequence
  SiRNA target sequence
tttaattgaatatttatctgttacttc

SEQ ID NO: 178103 - DNA, 27 bp, Artificial sequence
  SiRNA target sequence
ttaattgaatatttatctgttacttct

SEQ ID NO: 178104 - DNA, 27 bp, Artificial sequence
  SiRNA target sequence
taattgaatatttatctgttacttcta

SEQ ID NO: 178105 - DNA, 27 bp, Artificial sequence
  SiRNA target sequence
aattgaatatttatctgttacttctac

SEQ ID NO: 178106 - DNA, 27 bp, Artificial sequence
  SiRNA target sequence
attgaatatttatctgttacttctaca

SEQ ID NO: 178107 - DNA, 27 bp, Artificial sequence
  SiRNA target sequence
ttgaatatttatctgttacttctacac

SEQ ID NO: 178108 - DNA, 27 bp, Artificial sequence
  SiRNA target sequence
tgaatatttatctgttacttctacaca

SEQ ID NO: 178109 - DNA, 27 bp, Artificial sequence
  SiRNA target sequence
gaatatttatctgttacttctacacaa

SEQ ID NO: 178110 - DNA, 27 bp, Artificial sequence
  SiRNA target sequence
aatatttatctgttacttctacacaac

SEQ ID NO: 178111 - DNA, 27 bp, Artificial sequence
  SiRNA target sequence
atatttatctgttacttctacacaaca

SEQ ID NO: 178112 - DNA, 27 bp, Artificial sequence
  SiRNA target sequence
tatttatctgttacttctacacaacaa

SEQ ID NO: 178113 - DNA, 27 bp, Artificial sequence
  SiRNA target sequence
atttatctgttacttctacacaacaac

SEQ ID NO: 178114 - DNA, 27 bp, Artificial sequence
  SiRNA target sequence
tttatctgttacttctacacaacaaca

SEQ ID NO: 178115 - DNA, 27 bp, Artificial sequence
  SiRNA target sequence
ttatctgttacttctacacaacaacaa

SEQ ID NO: 178116 - DNA, 27 bp, Artificial sequence
  SiRNA target sequence
tatctgttacttctacacaacaacaag

SEQ ID NO: 178117 - DNA, 27 bp, Artificial sequence
  SiRNA target sequence
atctgttacttctacacaacaacaagc

SEQ ID NO: 178118 - DNA, 27 bp, Artificial sequence
  SiRNA target sequence
tctgttacttctacacaacaacaagcc

SEQ ID NO: 178119 - DNA, 27 bp, Artificial sequence
  SiRNA target sequence
ctgttacttctacacaacaacaagcca

SEQ ID NO: 178120 - DNA, 27 bp, Artificial sequence
  SiRNA target sequence
tgttacttctacacaacaacaagccat

SEQ ID NO: 178121 - DNA, 27 bp, Artificial sequence
  SiRNA target sequence
gttacttctacacaacaacaagccata

SEQ ID NO: 178122 - DNA, 27 bp, Artificial sequence
  SiRNA target sequence
ttacttctacacaacaacaagccataa

SEQ ID NO: 178123 - DNA, 27 bp, Artificial sequence
  SiRNA target sequence
tacttctacacaacaacaagccataaa

SEQ ID NO: 178124 - DNA, 27 bp, Artificial sequence
  SiRNA target sequence
acttctacacaacaacaagccataaag

SEQ ID NO: 178125 - DNA, 27 bp, Artificial sequence
  SiRNA target sequence
cttctacacaacaacaagccataaagc

SEQ ID NO: 178126 - DNA, 27 bp, Artificial sequence
  SiRNA target sequence
ttctacacaacaacaagccataaagct

SEQ ID NO: 178127 - DNA, 27 bp, Artificial sequence
  SiRNA target sequence
tctacacaacaacaagccataaagcta

SEQ ID NO: 178128 - DNA, 27 bp, Artificial sequence
  SiRNA target sequence
ctacacaacaacaagccataaagctac

SEQ ID NO: 178129 - DNA, 27 bp, Artificial sequence
  SiRNA target sequence
tacacaacaacaagccataaagctact

SEQ ID NO: 178130 - DNA, 27 bp, Artificial sequence
  SiRNA target sequence
acacaacaacaagccataaagctactt

SEQ ID NO: 178131 - DNA, 27 bp, Artificial sequence
  SiRNA target sequence
cacaacaacaagccataaagctacttg

SEQ ID NO: 178132 - DNA, 27 bp, Artificial sequence
  SiRNA target sequence
acaacaacaagccataaagctacttgc

SEQ ID NO: 178133 - DNA, 27 bp, Artificial sequence
  SiRNA target sequence
caacaacaagccataaagctacttgct

SEQ ID NO: 178134 - DNA, 27 bp, Artificial sequence
  SiRNA target sequence
aacaacaagccataaagctacttgctc

SEQ ID NO: 178135 - DNA, 27 bp, Artificial sequence
  SiRNA target sequence
acaacaagccataaagctacttgctca

SEQ ID NO: 178136 - DNA, 27 bp, Artificial sequence
  SiRNA target sequence
caacaagccataaagctacttgctcag

SEQ ID NO: 178137 - DNA, 27 bp, Artificial sequence
  SiRNA target sequence
aacaagccataaagctacttgctcagg

SEQ ID NO: 178138 - DNA, 27 bp, Artificial sequence
  SiRNA target sequence
acaagccataaagctacttgctcaggg

SEQ ID NO: 178139 - DNA, 27 bp, Artificial sequence
  SiRNA target sequence
caagccataaagctacttgctcagggg

SEQ ID NO: 178140 - DNA, 27 bp, Artificial sequence
  SiRNA target sequence
aagccataaagctacttgctcaggggc

SEQ ID NO: 178141 - DNA, 27 bp, Artificial sequence
  SiRNA target sequence
agccataaagctacttgctcaggggcg

SEQ ID NO: 178142 - DNA, 27 bp, Artificial sequence
  SiRNA target sequence
gccataaagctacttgctcaggggcga

SEQ ID NO: 178143 - DNA, 27 bp, Artificial sequence
  SiRNA target sequence
ccataaagctacttgctcaggggcgaa

SEQ ID NO: 178144 - DNA, 27 bp, Artificial sequence
  SiRNA target sequence
cataaagctacttgctcaggggcgaag

SEQ ID NO: 178145 - DNA, 27 bp, Artificial sequence
  SiRNA target sequence
ataaagctacttgctcaggggcgaagt

SEQ ID NO: 178146 - DNA, 27 bp, Artificial sequence
  SiRNA target sequence
taaagctacttgctcaggggcgaagta

SEQ ID NO: 178147 - DNA, 27 bp, Artificial sequence
  SiRNA target sequence
aaagctacttgctcaggggcgaagtat

SEQ ID NO: 178148 - DNA, 27 bp, Artificial sequence
  SiRNA target sequence
aagctacttgctcaggggcgaagtata

SEQ ID NO: 178149 - DNA, 27 bp, Artificial sequence
  SiRNA target sequence
agctacttgctcaggggcgaagtataa

SEQ ID NO: 178150 - DNA, 27 bp, Artificial sequence
  SiRNA target sequence
gctacttgctcaggggcgaagtataag

SEQ ID NO: 178151 - DNA, 27 bp, Artificial sequence
  SiRNA target sequence
ctacttgctcaggggcgaagtataagt

SEQ ID NO: 178152 - DNA, 27 bp, Artificial sequence
  SiRNA target sequence
tacttgctcaggggcgaagtataagtg

SEQ ID NO: 178153 - DNA, 27 bp, Artificial sequence
  SiRNA target sequence
acttgctcaggggcgaagtataagtgt

SEQ ID NO: 178154 - DNA, 27 bp, Artificial sequence
  SiRNA target sequence
cttgctcaggggcgaagtataagtgtc

SEQ ID NO: 178155 - DNA, 27 bp, Artificial sequence
  SiRNA target sequence
ttgctcaggggcgaagtataagtgtca

SEQ ID NO: 178156 - DNA, 27 bp, Artificial sequence
  SiRNA target sequence
tgctcaggggcgaagtataagtgtcat

SEQ ID NO: 178157 - DNA, 27 bp, Artificial sequence
  SiRNA target sequence
gctcaggggcgaagtataagtgtcata

SEQ ID NO: 178158 - DNA, 27 bp, Artificial sequence
  SiRNA target sequence
ctcaggggcgaagtataagtgtcatac

SEQ ID NO: 178159 - DNA, 27 bp, Artificial sequence
  SiRNA target sequence
tcaggggcgaagtataagtgtcataca

SEQ ID NO: 178160 - DNA, 27 bp, Artificial sequence
  SiRNA target sequence
caggggcgaagtataagtgtcatacag

SEQ ID NO: 178161 - DNA, 27 bp, Artificial sequence
  SiRNA target sequence
aggggcgaagtataagtgtcatacagt

SEQ ID NO: 178162 - DNA, 27 bp, Artificial sequence
  SiRNA target sequence
ggggcgaagtataagtgtcatacagtg

SEQ ID NO: 178163 - DNA, 27 bp, Artificial sequence
  SiRNA target sequence
gggcgaagtataagtgtcatacagtgc

SEQ ID NO: 178164 - DNA, 27 bp, Artificial sequence
  SiRNA target sequence
ggcgaagtataagtgtcatacagtgct

SEQ ID NO: 178165 - DNA, 27 bp, Artificial sequence
  SiRNA target sequence
gcgaagtataagtgtcatacagtgcta

SEQ ID NO: 178166 - DNA, 27 bp, Artificial sequence
  SiRNA target sequence
cgaagtataagtgtcatacagtgctat

SEQ ID NO: 178167 - DNA, 27 bp, Artificial sequence
  SiRNA target sequence
gaagtataagtgtcatacagtgctatg

SEQ ID NO: 178168 - DNA, 27 bp, Artificial sequence
  SiRNA target sequence
aagtataagtgtcatacagtgctatga

SEQ ID NO: 178169 - DNA, 27 bp, Artificial sequence
  SiRNA target sequence
agtataagtgtcatacagtgctatgat

SEQ ID NO: 178170 - DNA, 27 bp, Artificial sequence
  SiRNA target sequence
gtataagtgtcatacagtgctatgata

SEQ ID NO: 178171 - DNA, 27 bp, Artificial sequence
  SiRNA target sequence
tataagtgtcatacagtgctatgataa

SEQ ID NO: 178172 - DNA, 27 bp, Artificial sequence
  SiRNA target sequence
ataagtgtcatacagtgctatgataaa

SEQ ID NO: 178173 - DNA, 27 bp, Artificial sequence
  SiRNA target sequence
taagtgtcatacagtgctatgataaat

SEQ ID NO: 178174 - DNA, 27 bp, Artificial sequence
  SiRNA target sequence
aagtgtcatacagtgctatgataaatt

SEQ ID NO: 178175 - DNA, 27 bp, Artificial sequence
  SiRNA target sequence
agtgtcatacagtgctatgataaattt

SEQ ID NO: 178176 - DNA, 27 bp, Artificial sequence
  SiRNA target sequence
gtgtcatacagtgctatgataaatttt

SEQ ID NO: 178177 - DNA, 27 bp, Artificial sequence
  SiRNA target sequence
tgtcatacagtgctatgataaattttt

SEQ ID NO: 178178 - DNA, 27 bp, Artificial sequence
  SiRNA target sequence
gtcatacagtgctatgataaattttta

SEQ ID NO: 178179 - DNA, 27 bp, Artificial sequence
  SiRNA target sequence
tcatacagtgctatgataaatttttag

SEQ ID NO: 178180 - DNA, 27 bp, Artificial sequence
  SiRNA target sequence
catacagtgctatgataaatttttaga

SEQ ID NO: 178181 - DNA, 27 bp, Artificial sequence
  SiRNA target sequence
atacagtgctatgataaatttttagag

SEQ ID NO: 178182 - DNA, 27 bp, Artificial sequence
  SiRNA target sequence
tacagtgctatgataaatttttagaga

SEQ ID NO: 178183 - DNA, 27 bp, Artificial sequence
  SiRNA target sequence
acagtgctatgataaatttttagagaa

SEQ ID NO: 178184 - DNA, 27 bp, Artificial sequence
  SiRNA target sequence
cagtgctatgataaatttttagagaat

SEQ ID NO: 178185 - DNA, 27 bp, Artificial sequence
  SiRNA target sequence
agtgctatgataaatttttagagaata

SEQ ID NO: 178186 - DNA, 27 bp, Artificial sequence
  SiRNA target sequence
gtgctatgataaatttttagagaatag

SEQ ID NO: 178187 - DNA, 27 bp, Artificial sequence
  SiRNA target sequence
tgctatgataaatttttagagaatagc

SEQ ID NO: 178188 - DNA, 27 bp, Artificial sequence
  SiRNA target sequence
gctatgataaatttttagagaatagcg

SEQ ID NO: 178189 - DNA, 27 bp, Artificial sequence
  SiRNA target sequence
ctatgataaatttttagagaatagcga

SEQ ID NO: 178190 - DNA, 27 bp, Artificial sequence
  SiRNA target sequence
tatgataaatttttagagaatagcgat

SEQ ID NO: 178191 - DNA, 27 bp, Artificial sequence
  SiRNA target sequence
atgataaatttttagagaatagcgatg

SEQ ID NO: 178192 - DNA, 27 bp, Artificial sequence
  SiRNA target sequence
tgataaatttttagagaatagcgatga

SEQ ID NO: 178193 - DNA, 27 bp, Artificial sequence
  SiRNA target sequence
gataaatttttagagaatagcgatgat

SEQ ID NO: 178194 - DNA, 27 bp, Artificial sequence
  SiRNA target sequence
ataaatttttagagaatagcgatgatg

SEQ ID NO: 178195 - DNA, 27 bp, Artificial sequence
  SiRNA target sequence
taaatttttagagaatagcgatgatgt

SEQ ID NO: 178196 - DNA, 27 bp, Artificial sequence
  SiRNA target sequence
aaatttttagagaatagcgatgatgtt

SEQ ID NO: 178197 - DNA, 27 bp, Artificial sequence
  SiRNA target sequence
aatttttagagaatagcgatgatgttt

SEQ ID NO: 178198 - DNA, 27 bp, Artificial sequence
  SiRNA target sequence
atttttagagaatagcgatgatgtttt

SEQ ID NO: 178199 - DNA, 27 bp, Artificial sequence
  SiRNA target sequence
tttttagagaatagcgatgatgtttta

SEQ ID NO: 178200 - DNA, 27 bp, Artificial sequence
  SiRNA target sequence
ttttagagaatagcgatgatgttttaa

SEQ ID NO: 178201 - DNA, 27 bp, Artificial sequence
  SiRNA target sequence
tttagagaatagcgatgatgttttaac

SEQ ID NO: 178202 - DNA, 27 bp, Artificial sequence
  SiRNA target sequence
ttagagaatagcgatgatgttttaact

SEQ ID NO: 178203 - DNA, 27 bp, Artificial sequence
  SiRNA target sequence
tagagaatagcgatgatgttttaacta

SEQ ID NO: 178204 - DNA, 27 bp, Artificial sequence
  SiRNA target sequence
agagaatagcgatgatgttttaactac

SEQ ID NO: 178205 - DNA, 27 bp, Artificial sequence
  SiRNA target sequence
gagaatagcgatgatgttttaactacc

SEQ ID NO: 178206 - DNA, 27 bp, Artificial sequence
  SiRNA target sequence
agaatagcgatgatgttttaactacct

SEQ ID NO: 178207 - DNA, 27 bp, Artificial sequence
  SiRNA target sequence
gaatagcgatgatgttttaactaccta

SEQ ID NO: 178208 - DNA, 27 bp, Artificial sequence
  SiRNA target sequence
aatagcgatgatgttttaactacctat

SEQ ID NO: 178209 - DNA, 27 bp, Artificial sequence
  SiRNA target sequence
atagcgatgatgttttaactacctatg

SEQ ID NO: 178210 - DNA, 27 bp, Artificial sequence
  SiRNA target sequence
tagcgatgatgttttaactacctatga

SEQ ID NO: 178211 - DNA, 27 bp, Artificial sequence
  SiRNA target sequence
agcgatgatgttttaactacctatgat

SEQ ID NO: 178212 - DNA, 27 bp, Artificial sequence
  SiRNA target sequence
gcgatgatgttttaactacctatgatt

SEQ ID NO: 178213 - DNA, 27 bp, Artificial sequence
  SiRNA target sequence
cgatgatgttttaactacctatgattt

SEQ ID NO: 178214 - DNA, 27 bp, Artificial sequence
  SiRNA target sequence
gatgatgttttaactacctatgatttt

SEQ ID NO: 178215 - DNA, 27 bp, Artificial sequence
  SiRNA target sequence
atgatgttttaactacctatgattttt

SEQ ID NO: 178216 - DNA, 27 bp, Artificial sequence
  SiRNA target sequence
tgatgttttaactacctatgattttta

SEQ ID NO: 178217 - DNA, 27 bp, Artificial sequence
  SiRNA target sequence
gatgttttaactacctatgatttttat

SEQ ID NO: 178218 - DNA, 27 bp, Artificial sequence
  SiRNA target sequence
atgttttaactacctatgatttttata

SEQ ID NO: 178219 - DNA, 27 bp, Artificial sequence
  SiRNA target sequence
tgttttaactacctatgatttttataa

SEQ ID NO: 178220 - DNA, 27 bp, Artificial sequence
  SiRNA target sequence
gttttaactacctatgatttttataaa

SEQ ID NO: 178221 - DNA, 27 bp, Artificial sequence
  SiRNA target sequence
ttttaactacctatgatttttataaaa

SEQ ID NO: 178222 - DNA, 27 bp, Artificial sequence
  SiRNA target sequence
tttaactacctatgatttttataaaat

SEQ ID NO: 178223 - DNA, 27 bp, Artificial sequence
  SiRNA target sequence
ttaactacctatgatttttataaaatg

SEQ ID NO: 178224 - DNA, 27 bp, Artificial sequence
  SiRNA target sequence
taactacctatgatttttataaaatga

SEQ ID NO: 178225 - DNA, 27 bp, Artificial sequence
  SiRNA target sequence
aactacctatgatttttataaaatgat

SEQ ID NO: 178226 - DNA, 27 bp, Artificial sequence
  SiRNA target sequence
actacctatgatttttataaaatgatt

SEQ ID NO: 178227 - DNA, 27 bp, Artificial sequence
  SiRNA target sequence
ctacctatgatttttataaaatgattt

SEQ ID NO: 178228 - DNA, 27 bp, Artificial sequence
  SiRNA target sequence
tacctatgatttttataaaatgatttt

SEQ ID NO: 178229 - DNA, 27 bp, Artificial sequence
  SiRNA target sequence
acctatgatttttataaaatgattttg

SEQ ID NO: 178230 - DNA, 27 bp, Artificial sequence
  SiRNA target sequence
cctatgatttttataaaatgattttgg

SEQ ID NO: 178231 - DNA, 27 bp, Artificial sequence
  SiRNA target sequence
ctatgatttttataaaatgattttgga

SEQ ID NO: 178232 - DNA, 27 bp, Artificial sequence
  SiRNA target sequence
tatgatttttataaaatgattttggat

SEQ ID NO: 178233 - DNA, 27 bp, Artificial sequence
  SiRNA target sequence
atgatttttataaaatgattttggatc

SEQ ID NO: 178234 - DNA, 27 bp, Artificial sequence
  SiRNA target sequence
tgatttttataaaatgattttggatct

SEQ ID NO: 178235 - DNA, 27 bp, Artificial sequence
  SiRNA target sequence
gatttttataaaatgattttggatcta

SEQ ID NO: 178236 - DNA, 27 bp, Artificial sequence
  SiRNA target sequence
atttttataaaatgattttggatctag

SEQ ID NO: 178237 - DNA, 27 bp, Artificial sequence
  SiRNA target sequence
tttttataaaatgattttggatctagg

SEQ ID NO: 178238 - DNA, 27 bp, Artificial sequence
  SiRNA target sequence
ttttataaaatgattttggatctagga

SEQ ID NO: 178239 - DNA, 27 bp, Artificial sequence
  SiRNA target sequence
tttataaaatgattttggatctaggat

SEQ ID NO: 178240 - DNA, 27 bp, Artificial sequence
  SiRNA target sequence
ttataaaatgattttggatctaggatt

SEQ ID NO: 178241 - DNA, 27 bp, Artificial sequence
  SiRNA target sequence
tataaaatgattttggatctaggattt

SEQ ID NO: 178242 - DNA, 27 bp, Artificial sequence
  SiRNA target sequence
ataaaatgattttggatctaggatttt

SEQ ID NO: 178243 - DNA, 27 bp, Artificial sequence
  SiRNA target sequence
taaaatgattttggatctaggattttt

SEQ ID NO: 178244 - DNA, 27 bp, Artificial sequence
  SiRNA target sequence
aaaatgattttggatctaggattttta

SEQ ID NO: 178245 - DNA, 27 bp, Artificial sequence
  SiRNA target sequence
aaatgattttggatctaggatttttac

SEQ ID NO: 178246 - DNA, 27 bp, Artificial sequence
  SiRNA target sequence
aatgattttggatctaggatttttaca

SEQ ID NO: 178247 - DNA, 27 bp, Artificial sequence
  SiRNA target sequence
atgattttggatctaggatttttacag

SEQ ID NO: 178248 - DNA, 27 bp, Artificial sequence
  SiRNA target sequence
tgattttggatctaggatttttacagc

SEQ ID NO: 178249 - DNA, 27 bp, Artificial sequence
  SiRNA target sequence
gattttggatctaggatttttacagca

SEQ ID NO: 178250 - DNA, 27 bp, Artificial sequence
  SiRNA target sequence
attttggatctaggatttttacagcat

SEQ ID NO: 178251 - DNA, 27 bp, Artificial sequence
  SiRNA target sequence
ttttggatctaggatttttacagcata

SEQ ID NO: 178252 - DNA, 27 bp, Artificial sequence
  SiRNA target sequence
tttggatctaggatttttacagcataa

SEQ ID NO: 178253 - DNA, 27 bp, Artificial sequence
  SiRNA target sequence
ttggatctaggatttttacagcataat

SEQ ID NO: 178254 - DNA, 27 bp, Artificial sequence
  SiRNA target sequence
tggatctaggatttttacagcataatt

SEQ ID NO: 178255 - DNA, 27 bp, Artificial sequence
  SiRNA target sequence
ggatctaggatttttacagcataattt

SEQ ID NO: 178256 - DNA, 27 bp, Artificial sequence
  SiRNA target sequence
gatctaggatttttacagcataatttt

SEQ ID NO: 178257 - DNA, 27 bp, Artificial sequence
  SiRNA target sequence
atctaggatttttacagcataatttta

SEQ ID NO: 178258 - DNA, 27 bp, Artificial sequence
  SiRNA target sequence
tctaggatttttacagcataattttat

SEQ ID NO: 178259 - DNA, 27 bp, Artificial sequence
  SiRNA target sequence
ctaggatttttacagcataattttatt

SEQ ID NO: 178260 - DNA, 27 bp, Artificial sequence
  SiRNA target sequence
taggatttttacagcataattttatta

SEQ ID NO: 178261 - DNA, 27 bp, Artificial sequence
  SiRNA target sequence
aggatttttacagcataattttattaa

SEQ ID NO: 178262 - DNA, 27 bp, Artificial sequence
  SiRNA target sequence
ggatttttacagcataattttattaaa

SEQ ID NO: 178263 - DNA, 27 bp, Artificial sequence
  SiRNA target sequence
gatttttacagcataattttattaaag

SEQ ID NO: 178264 - DNA, 27 bp, Artificial sequence
  SiRNA target sequence
atttttacagcataattttattaaagg

SEQ ID NO: 178265 - DNA, 27 bp, Artificial sequence
  SiRNA target sequence
tttttacagcataattttattaaagga

SEQ ID NO: 178266 - DNA, 27 bp, Artificial sequence
  SiRNA target sequence
ttttacagcataattttattaaaggaa

SEQ ID NO: 178267 - DNA, 27 bp, Artificial sequence
  SiRNA target sequence
tttacagcataattttattaaaggaac

SEQ ID NO: 178268 - DNA, 27 bp, Artificial sequence
  SiRNA target sequence
ttacagcataattttattaaaggaacc

SEQ ID NO: 178269 - DNA, 27 bp, Artificial sequence
  SiRNA target sequence
tacagcataattttattaaaggaacct

SEQ ID NO: 178270 - DNA, 27 bp, Artificial sequence
  SiRNA target sequence
acagcataattttattaaaggaacctg

SEQ ID NO: 178271 - DNA, 27 bp, Artificial sequence
  SiRNA target sequence
cagcataattttattaaaggaacctgt

SEQ ID NO: 178272 - DNA, 27 bp, Artificial sequence
  SiRNA target sequence
agcataattttattaaaggaacctgtg

SEQ ID NO: 178273 - DNA, 27 bp, Artificial sequence
  SiRNA target sequence
gcataattttattaaaggaacctgtga

SEQ ID NO: 178274 - DNA, 27 bp, Artificial sequence
  SiRNA target sequence
cataattttattaaaggaacctgtgag

SEQ ID NO: 178275 - DNA, 27 bp, Artificial sequence
  SiRNA target sequence
ataattttattaaaggaacctgtgaga

SEQ ID NO: 178276 - DNA, 27 bp, Artificial sequence
  SiRNA target sequence
taattttattaaaggaacctgtgagaa

SEQ ID NO: 178277 - DNA, 27 bp, Artificial sequence
  SiRNA target sequence
aattttattaaaggaacctgtgagaaa

SEQ ID NO: 178278 - DNA, 27 bp, Artificial sequence
  SiRNA target sequence
attttattaaaggaacctgtgagaaat

SEQ ID NO: 178279 - DNA, 27 bp, Artificial sequence
  SiRNA target sequence
ttttattaaaggaacctgtgagaaatg

SEQ ID NO: 178280 - DNA, 27 bp, Artificial sequence
  SiRNA target sequence
tttattaaaggaacctgtgagaaatgg

SEQ ID NO: 178281 - DNA, 27 bp, Artificial sequence
  SiRNA target sequence
ttattaaaggaacctgtgagaaatggg

SEQ ID NO: 178282 - DNA, 27 bp, Artificial sequence
  SiRNA target sequence
tattaaaggaacctgtgagaaatggga

SEQ ID NO: 178283 - DNA, 27 bp, Artificial sequence
  SiRNA target sequence
attaaaggaacctgtgagaaatgggag

SEQ ID NO: 178284 - DNA, 27 bp, Artificial sequence
  SiRNA target sequence
ttaaaggaacctgtgagaaatgggaga

SEQ ID NO: 178285 - DNA, 27 bp, Artificial sequence
  SiRNA target sequence
taaaggaacctgtgagaaatgggagaa

SEQ ID NO: 178286 - DNA, 27 bp, Artificial sequence
  SiRNA target sequence
aaaggaacctgtgagaaatgggagaag

SEQ ID NO: 178287 - DNA, 27 bp, Artificial sequence
  SiRNA target sequence
aaggaacctgtgagaaatgggagaagt

SEQ ID NO: 178288 - DNA, 27 bp, Artificial sequence
  SiRNA target sequence
aggaacctgtgagaaatgggagaagtg

SEQ ID NO: 178289 - DNA, 27 bp, Artificial sequence
  SiRNA target sequence
ggaacctgtgagaaatgggagaagtgt

SEQ ID NO: 178290 - DNA, 27 bp, Artificial sequence
  SiRNA target sequence
gaacctgtgagaaatgggagaagtgta

SEQ ID NO: 178291 - DNA, 27 bp, Artificial sequence
  SiRNA target sequence
aacctgtgagaaatgggagaagtgtac

SEQ ID NO: 178292 - DNA, 27 bp, Artificial sequence
  SiRNA target sequence
acctgtgagaaatgggagaagtgtact

SEQ ID NO: 178293 - DNA, 27 bp, Artificial sequence
  SiRNA target sequence
cctgtgagaaatgggagaagtgtacta

SEQ ID NO: 178294 - DNA, 27 bp, Artificial sequence
  SiRNA target sequence
ctgtgagaaatgggagaagtgtactat

SEQ ID NO: 178295 - DNA, 27 bp, Artificial sequence
  SiRNA target sequence
tgtgagaaatgggagaagtgtactatt

SEQ ID NO: 178296 - DNA, 27 bp, Artificial sequence
  SiRNA target sequence
gtgagaaatgggagaagtgtactattg

SEQ ID NO: 178297 - DNA, 27 bp, Artificial sequence
  SiRNA target sequence
tgagaaatgggagaagtgtactattgg

SEQ ID NO: 178298 - DNA, 27 bp, Artificial sequence
  SiRNA target sequence
gagaaatgggagaagtgtactattgga

SEQ ID NO: 178299 - DNA, 27 bp, Artificial sequence
  SiRNA target sequence
agaaatgggagaagtgtactattggat

SEQ ID NO: 178300 - DNA, 27 bp, Artificial sequence
  SiRNA target sequence
gaaatgggagaagtgtactattggata

SEQ ID NO: 178301 - DNA, 27 bp, Artificial sequence
  SiRNA target sequence
aaatgggagaagtgtactattggatat

SEQ ID NO: 178302 - DNA, 27 bp, Artificial sequence
  SiRNA target sequence
aatgggagaagtgtactattggatatc

SEQ ID NO: 178303 - DNA, 27 bp, Artificial sequence
  SiRNA target sequence
atgggagaagtgtactattggatatca

SEQ ID NO: 178304 - DNA, 27 bp, Artificial sequence
  SiRNA target sequence
tgggagaagtgtactattggatatcat

SEQ ID NO: 178305 - DNA, 27 bp, Artificial sequence
  SiRNA target sequence
gggagaagtgtactattggatatcatt

SEQ ID NO: 178306 - DNA, 27 bp, Artificial sequence
  SiRNA target sequence
ggagaagtgtactattggatatcatta

SEQ ID NO: 178307 - DNA, 27 bp, Artificial sequence
  SiRNA target sequence
gagaagtgtactattggatatcattat

SEQ ID NO: 178308 - DNA, 27 bp, Artificial sequence
  SiRNA target sequence
agaagtgtactattggatatcattatg

SEQ ID NO: 178309 - DNA, 27 bp, Artificial sequence
  SiRNA target sequence
gaagtgtactattggatatcattatgg

SEQ ID NO: 178310 - DNA, 27 bp, Artificial sequence
  SiRNA target sequence
aagtgtactattggatatcattatgga

SEQ ID NO: 178311 - DNA, 27 bp, Artificial sequence
  SiRNA target sequence
agtgtactattggatatcattatggat

SEQ ID NO: 178312 - DNA, 27 bp, Artificial sequence
  SiRNA target sequence
gtgtactattggatatcattatggata

SEQ ID NO: 178313 - DNA, 27 bp, Artificial sequence
  SiRNA target sequence
tgtactattggatatcattatggatat

SEQ ID NO: 178314 - DNA, 27 bp, Artificial sequence
  SiRNA target sequence
gtactattggatatcattatggatatt

SEQ ID NO: 178315 - DNA, 27 bp, Artificial sequence
  SiRNA target sequence
tactattggatatcattatggatattt

SEQ ID NO: 178316 - DNA, 27 bp, Artificial sequence
  SiRNA target sequence
actattggatatcattatggatattta

SEQ ID NO: 178317 - DNA, 27 bp, Artificial sequence
  SiRNA target sequence
ctattggatatcattatggatatttag

SEQ ID NO: 178318 - DNA, 27 bp, Artificial sequence
  SiRNA target sequence
tattggatatcattatggatatttaga

SEQ ID NO: 178319 - DNA, 27 bp, Artificial sequence
  SiRNA target sequence
attggatatcattatggatatttagaa

SEQ ID NO: 178320 - DNA, 27 bp, Artificial sequence
  SiRNA target sequence
ttggatatcattatggatatttagaac

SEQ ID NO: 178321 - DNA, 27 bp, Artificial sequence
  SiRNA target sequence
tggatatcattatggatatttagaaca

SEQ ID NO: 178322 - DNA, 27 bp, Artificial sequence
  SiRNA target sequence
ggatatcattatggatatttagaacac

SEQ ID NO: 178323 - DNA, 27 bp, Artificial sequence
  SiRNA target sequence
gatatcattatggatatttagaacaca

SEQ ID NO: 178324 - DNA, 27 bp, Artificial sequence
  SiRNA target sequence
atatcattatggatatttagaacacat

SEQ ID NO: 178325 - DNA, 27 bp, Artificial sequence
  SiRNA target sequence
tatcattatggatatttagaacacata

SEQ ID NO: 178326 - DNA, 27 bp, Artificial sequence
  SiRNA target sequence
atcattatggatatttagaacacatat

SEQ ID NO: 178327 - DNA, 27 bp, Artificial sequence
  SiRNA target sequence
tcattatggatatttagaacacatatt

SEQ ID NO: 178328 - DNA, 27 bp, Artificial sequence
  SiRNA target sequence
cattatggatatttagaacacatatta

SEQ ID NO: 178329 - DNA, 27 bp, Artificial sequence
  SiRNA target sequence
attatggatatttagaacacatattaa

SEQ ID NO: 178330 - DNA, 27 bp, Artificial sequence
  SiRNA target sequence
ttatggatatttagaacacatattaaa

SEQ ID NO: 178331 - DNA, 27 bp, Artificial sequence
  SiRNA target sequence
tatggatatttagaacacatattaaat

SEQ ID NO: 178332 - DNA, 27 bp, Artificial sequence
  SiRNA target sequence
atggatatttagaacacatattaaata

SEQ ID NO: 178333 - DNA, 27 bp, Artificial sequence
  SiRNA target sequence
tggatatttagaacacatattaaataa

SEQ ID NO: 178334 - DNA, 27 bp, Artificial sequence
  SiRNA target sequence
ggatatttagaacacatattaaataag

SEQ ID NO: 178335 - DNA, 27 bp, Artificial sequence
  SiRNA target sequence
gatatttagaacacatattaaataaga

SEQ ID NO: 178336 - DNA, 27 bp, Artificial sequence
  SiRNA target sequence
atatttagaacacatattaaataagaa

SEQ ID NO: 178337 - DNA, 27 bp, Artificial sequence
  SiRNA target sequence
tatttagaacacatattaaataagaag

SEQ ID NO: 178338 - DNA, 27 bp, Artificial sequence
  SiRNA target sequence
atttagaacacatattaaataagaaga

SEQ ID NO: 178339 - DNA, 27 bp, Artificial sequence
  SiRNA target sequence
tttagaacacatattaaataagaagaa

SEQ ID NO: 178340 - DNA, 27 bp, Artificial sequence
  SiRNA target sequence
ttagaacacatattaaataagaagaac

SEQ ID NO: 178341 - DNA, 27 bp, Artificial sequence
  SiRNA target sequence
tagaacacatattaaataagaagaaca

SEQ ID NO: 178342 - DNA, 27 bp, Artificial sequence
  SiRNA target sequence
agaacacatattaaataagaagaacaa

SEQ ID NO: 178343 - DNA, 27 bp, Artificial sequence
  SiRNA target sequence
gaacacatattaaataagaagaacaat

SEQ ID NO: 178344 - DNA, 27 bp, Artificial sequence
  SiRNA target sequence
aacacatattaaataagaagaacaatt

SEQ ID NO: 178345 - DNA, 27 bp, Artificial sequence
  SiRNA target sequence
acacatattaaataagaagaacaatta

SEQ ID NO: 178346 - DNA, 27 bp, Artificial sequence
  SiRNA target sequence
cacatattaaataagaagaacaattat

SEQ ID NO: 178347 - DNA, 27 bp, Artificial sequence
  SiRNA target sequence
acatattaaataagaagaacaattatt

SEQ ID NO: 178348 - DNA, 27 bp, Artificial sequence
  SiRNA target sequence
catattaaataagaagaacaattattt

SEQ ID NO: 178349 - DNA, 27 bp, Artificial sequence
  SiRNA target sequence
atattaaataagaagaacaattattta

SEQ ID NO: 178350 - DNA, 27 bp, Artificial sequence
  SiRNA target sequence
tattaaataagaagaacaattatttaa

SEQ ID NO: 178351 - DNA, 27 bp, Artificial sequence
  SiRNA target sequence
attaaataagaagaacaattatttaac

SEQ ID NO: 178352 - DNA, 27 bp, Artificial sequence
  SiRNA target sequence
ttaaataagaagaacaattatttaaca

SEQ ID NO: 178353 - DNA, 27 bp, Artificial sequence
  SiRNA target sequence
taaataagaagaacaattatttaacaa

SEQ ID NO: 178354 - DNA, 27 bp, Artificial sequence
  SiRNA target sequence
aaataagaagaacaattatttaacaaa

SEQ ID NO: 178355 - DNA, 27 bp, Artificial sequence
  SiRNA target sequence
aataagaagaacaattatttaacaaaa

SEQ ID NO: 178356 - DNA, 27 bp, Artificial sequence
  SiRNA target sequence
ataagaagaacaattatttaacaaaaa

SEQ ID NO: 178357 - DNA, 27 bp, Artificial sequence
  SiRNA target sequence
taagaagaacaattatttaacaaaaaa

SEQ ID NO: 178358 - DNA, 27 bp, Artificial sequence
  SiRNA target sequence
aagaagaacaattatttaacaaaaaat

SEQ ID NO: 178359 - DNA, 27 bp, Artificial sequence
  SiRNA target sequence
agaagaacaattatttaacaaaaaatg

SEQ ID NO: 178360 - DNA, 27 bp, Artificial sequence
  SiRNA target sequence
gaagaacaattatttaacaaaaaatga

SEQ ID NO: 178361 - DNA, 27 bp, Artificial sequence
  SiRNA target sequence
aagaacaattatttaacaaaaaatgat

SEQ ID NO: 178362 - DNA, 27 bp, Artificial sequence
  SiRNA target sequence
agaacaattatttaacaaaaaatgata

SEQ ID NO: 178363 - DNA, 27 bp, Artificial sequence
  SiRNA target sequence
gaacaattatttaacaaaaaatgatag

SEQ ID NO: 178364 - DNA, 27 bp, Artificial sequence
  SiRNA target sequence
aacaattatttaacaaaaaatgatagt

SEQ ID NO: 178365 - DNA, 27 bp, Artificial sequence
  SiRNA target sequence
acaattatttaacaaaaaatgatagta

SEQ ID NO: 178366 - DNA, 27 bp, Artificial sequence
  SiRNA target sequence
caattatttaacaaaaaatgatagtat

SEQ ID NO: 178367 - DNA, 27 bp, Artificial sequence
  SiRNA target sequence
aattatttaacaaaaaatgatagtata

SEQ ID NO: 178368 - DNA, 27 bp, Artificial sequence
  SiRNA target sequence
attatttaacaaaaaatgatagtataa

SEQ ID NO: 178369 - DNA, 27 bp, Artificial sequence
  SiRNA target sequence
ttatttaacaaaaaatgatagtataaa

SEQ ID NO: 178370 - DNA, 27 bp, Artificial sequence
  SiRNA target sequence
tatttaacaaaaaatgatagtataaaa

SEQ ID NO: 178371 - DNA, 27 bp, Artificial sequence
  SiRNA target sequence
atttaacaaaaaatgatagtataaaaa

SEQ ID NO: 178372 - DNA, 27 bp, Artificial sequence
  SiRNA target sequence
tttaacaaaaaatgatagtataaaaat

SEQ ID NO: 178373 - DNA, 27 bp, Artificial sequence
  SiRNA target sequence
ttaacaaaaaatgatagtataaaaata

SEQ ID NO: 178374 - DNA, 27 bp, Artificial sequence
  SiRNA target sequence
taacaaaaaatgatagtataaaaatat

SEQ ID NO: 178375 - DNA, 27 bp, Artificial sequence
  SiRNA target sequence
aacaaaaaatgatagtataaaaatatt

SEQ ID NO: 178376 - DNA, 27 bp, Artificial sequence
  SiRNA target sequence
acaaaaaatgatagtataaaaatattt

SEQ ID NO: 178377 - DNA, 27 bp, Artificial sequence
  SiRNA target sequence
caaaaaatgatagtataaaaatattta

SEQ ID NO: 178378 - DNA, 27 bp, Artificial sequence
  SiRNA target sequence
aaaaaatgatagtataaaaatatttaa

SEQ ID NO: 178379 - DNA, 27 bp, Artificial sequence
  SiRNA target sequence
aaaaatgatagtataaaaatatttaac

SEQ ID NO: 178380 - DNA, 27 bp, Artificial sequence
  SiRNA target sequence
aaaatgatagtataaaaatatttaaca

SEQ ID NO: 178381 - DNA, 27 bp, Artificial sequence
  SiRNA target sequence
aaatgatagtataaaaatatttaacag

SEQ ID NO: 178382 - DNA, 27 bp, Artificial sequence
  SiRNA target sequence
aatgatagtataaaaatatttaacagt

SEQ ID NO: 178383 - DNA, 27 bp, Artificial sequence
  SiRNA target sequence
atgatagtataaaaatatttaacagta

SEQ ID NO: 178384 - DNA, 27 bp, Artificial sequence
  SiRNA target sequence
tgatagtataaaaatatttaacagtaa

SEQ ID NO: 178385 - DNA, 27 bp, Artificial sequence
  SiRNA target sequence
gatagtataaaaatatttaacagtaaa

SEQ ID NO: 178386 - DNA, 27 bp, Artificial sequence
  SiRNA target sequence
atagtataaaaatatttaacagtaaaa

SEQ ID NO: 178387 - DNA, 27 bp, Artificial sequence
  SiRNA target sequence
tagtataaaaatatttaacagtaaaaa

SEQ ID NO: 178388 - DNA, 27 bp, Artificial sequence
  SiRNA target sequence
agtataaaaatatttaacagtaaaaat

SEQ ID NO: 178389 - DNA, 27 bp, Artificial sequence
  SiRNA target sequence
gtataaaaatatttaacagtaaaaatg

SEQ ID NO: 178390 - DNA, 27 bp, Artificial sequence
  SiRNA target sequence
tataaaaatatttaacagtaaaaatga

SEQ ID NO: 178391 - DNA, 27 bp, Artificial sequence
  SiRNA target sequence
ataaaaatatttaacagtaaaaatgag

SEQ ID NO: 178392 - DNA, 27 bp, Artificial sequence
  SiRNA target sequence
taaaaatatttaacagtaaaaatgagg

SEQ ID NO: 178393 - DNA, 27 bp, Artificial sequence
  SiRNA target sequence
aaaaatatttaacagtaaaaatgagga

SEQ ID NO: 178394 - DNA, 27 bp, Artificial sequence
  SiRNA target sequence
aaaatatttaacagtaaaaatgaggag

SEQ ID NO: 178395 - DNA, 27 bp, Artificial sequence
  SiRNA target sequence
aaatatttaacagtaaaaatgaggagg

SEQ ID NO: 178396 - DNA, 27 bp, Artificial sequence
  SiRNA target sequence
aatatttaacagtaaaaatgaggaggt

SEQ ID NO: 178397 - DNA, 27 bp, Artificial sequence
  SiRNA target sequence
atatttaacagtaaaaatgaggaggta

SEQ ID NO: 178398 - DNA, 27 bp, Artificial sequence
  SiRNA target sequence
tatttaacagtaaaaatgaggaggtaa

SEQ ID NO: 178399 - DNA, 27 bp, Artificial sequence
  SiRNA target sequence
atttaacagtaaaaatgaggaggtaag

SEQ ID NO: 178400 - DNA, 27 bp, Artificial sequence
  SiRNA target sequence
tttaacagtaaaaatgaggaggtaagg

SEQ ID NO: 178401 - DNA, 27 bp, Artificial sequence
  SiRNA target sequence
ttaacagtaaaaatgaggaggtaaggt

SEQ ID NO: 178402 - DNA, 27 bp, Artificial sequence
  SiRNA target sequence
taacagtaaaaatgaggaggtaaggtt

SEQ ID NO: 178403 - DNA, 27 bp, Artificial sequence
  SiRNA target sequence
aacagtaaaaatgaggaggtaaggtta

SEQ ID NO: 178404 - DNA, 27 bp, Artificial sequence
  SiRNA target sequence
acagtaaaaatgaggaggtaaggttaa

SEQ ID NO: 178405 - DNA, 27 bp, Artificial sequence
  SiRNA target sequence
cagtaaaaatgaggaggtaaggttaaa

SEQ ID NO: 178406 - DNA, 27 bp, Artificial sequence
  SiRNA target sequence
agtaaaaatgaggaggtaaggttaaat

SEQ ID NO: 178407 - DNA, 27 bp, Artificial sequence
  SiRNA target sequence
gtaaaaatgaggaggtaaggttaaatg

SEQ ID NO: 178408 - DNA, 27 bp, Artificial sequence
  SiRNA target sequence
taaaaatgaggaggtaaggttaaatgg

SEQ ID NO: 178409 - DNA, 27 bp, Artificial sequence
  SiRNA target sequence
aaaaatgaggaggtaaggttaaatgga

SEQ ID NO: 178410 - DNA, 27 bp, Artificial sequence
  SiRNA target sequence
aaaatgaggaggtaaggttaaatggaa

SEQ ID NO: 178411 - DNA, 27 bp, Artificial sequence
  SiRNA target sequence
aaatgaggaggtaaggttaaatggaaa

SEQ ID NO: 178412 - DNA, 27 bp, Artificial sequence
  SiRNA target sequence
aatgaggaggtaaggttaaatggaaaa

SEQ ID NO: 178413 - DNA, 27 bp, Artificial sequence
  SiRNA target sequence
atgaggaggtaaggttaaatggaaaaa

SEQ ID NO: 178414 - DNA, 27 bp, Artificial sequence
  SiRNA target sequence
tgaggaggtaaggttaaatggaaaaag

SEQ ID NO: 178415 - DNA, 27 bp, Artificial sequence
  SiRNA target sequence
gaggaggtaaggttaaatggaaaaaga

SEQ ID NO: 178416 - DNA, 27 bp, Artificial sequence
  SiRNA target sequence
aggaggtaaggttaaatggaaaaagaa

SEQ ID NO: 178417 - DNA, 27 bp, Artificial sequence
  SiRNA target sequence
ggaggtaaggttaaatggaaaaagaaa

SEQ ID NO: 178418 - DNA, 27 bp, Artificial sequence
  SiRNA target sequence
gaggtaaggttaaatggaaaaagaaaa

SEQ ID NO: 178419 - DNA, 27 bp, Artificial sequence
  SiRNA target sequence
aggtaaggttaaatggaaaaagaaaat

SEQ ID NO: 178420 - DNA, 27 bp, Artificial sequence
  SiRNA target sequence
ggtaaggttaaatggaaaaagaaaatt

SEQ ID NO: 178421 - DNA, 27 bp, Artificial sequence
  SiRNA target sequence
gtaaggttaaatggaaaaagaaaatta

SEQ ID NO: 178422 - DNA, 27 bp, Artificial sequence
  SiRNA target sequence
taaggttaaatggaaaaagaaaattaa

SEQ ID NO: 178423 - DNA, 27 bp, Artificial sequence
  SiRNA target sequence
aaggttaaatggaaaaagaaaattaaa

SEQ ID NO: 178424 - DNA, 27 bp, Artificial sequence
  SiRNA target sequence
aggttaaatggaaaaagaaaattaaat

SEQ ID NO: 178425 - DNA, 27 bp, Artificial sequence
  SiRNA target sequence
ggttaaatggaaaaagaaaattaaata

SEQ ID NO: 178426 - DNA, 27 bp, Artificial sequence
  SiRNA target sequence
gttaaatggaaaaagaaaattaaatat

SEQ ID NO: 178427 - DNA, 27 bp, Artificial sequence
  SiRNA target sequence
ttaaatggaaaaagaaaattaaatatt

SEQ ID NO: 178428 - DNA, 27 bp, Artificial sequence
  SiRNA target sequence
taaatggaaaaagaaaattaaatatta

SEQ ID NO: 178429 - DNA, 27 bp, Artificial sequence
  SiRNA target sequence
aaatggaaaaagaaaattaaatattaa

SEQ ID NO: 178430 - DNA, 27 bp, Artificial sequence
  SiRNA target sequence
aatggaaaaagaaaattaaatattaac

SEQ ID NO: 178431 - DNA, 27 bp, Artificial sequence
  SiRNA target sequence
atggaaaaagaaaattaaatattaaca

SEQ ID NO: 178432 - DNA, 27 bp, Artificial sequence
  SiRNA target sequence
tggaaaaagaaaattaaatattaacac

SEQ ID NO: 178433 - DNA, 27 bp, Artificial sequence
  SiRNA target sequence
ggaaaaagaaaattaaatattaacaca

SEQ ID NO: 178434 - DNA, 27 bp, Artificial sequence
  SiRNA target sequence
gaaaaagaaaattaaatattaacacag

SEQ ID NO: 178435 - DNA, 27 bp, Artificial sequence
  SiRNA target sequence
aaaaagaaaattaaatattaacacagt

SEQ ID NO: 178436 - DNA, 27 bp, Artificial sequence
  SiRNA target sequence
aaaagaaaattaaatattaacacagtt

SEQ ID NO: 178437 - DNA, 27 bp, Artificial sequence
  SiRNA target sequence
aaagaaaattaaatattaacacagtta

SEQ ID NO: 178438 - DNA, 27 bp, Artificial sequence
  SiRNA target sequence
aagaaaattaaatattaacacagttac

SEQ ID NO: 178439 - DNA, 27 bp, Artificial sequence
  SiRNA target sequence
agaaaattaaatattaacacagttaca

SEQ ID NO: 178440 - DNA, 27 bp, Artificial sequence
  SiRNA target sequence
gaaaattaaatattaacacagttacat

SEQ ID NO: 178441 - DNA, 27 bp, Artificial sequence
  SiRNA target sequence
aaaattaaatattaacacagttacatt

SEQ ID NO: 178442 - DNA, 27 bp, Artificial sequence
  SiRNA target sequence
aaattaaatattaacacagttacatta

SEQ ID NO: 178443 - DNA, 27 bp, Artificial sequence
  SiRNA target sequence
aattaaatattaacacagttacattaa

SEQ ID NO: 178444 - DNA, 27 bp, Artificial sequence
  SiRNA target sequence
attaaatattaacacagttacattaaa

SEQ ID NO: 178445 - DNA, 27 bp, Artificial sequence
  SiRNA target sequence
ttaaatattaacacagttacattaaat

SEQ ID NO: 178446 - DNA, 27 bp, Artificial sequence
  SiRNA target sequence
taaatattaacacagttacattaaata

SEQ ID NO: 178447 - DNA, 27 bp, Artificial sequence
  SiRNA target sequence
aaatattaacacagttacattaaataa

SEQ ID NO: 178448 - DNA, 27 bp, Artificial sequence
  SiRNA target sequence
aatattaacacagttacattaaataaa

SEQ ID NO: 178449 - DNA, 27 bp, Artificial sequence
  SiRNA target sequence
atattaacacagttacattaaataaaa

SEQ ID NO: 178450 - DNA, 27 bp, Artificial sequence
  SiRNA target sequence
tattaacacagttacattaaataaaat

SEQ ID NO: 178451 - DNA, 27 bp, Artificial sequence
  SiRNA target sequence
attaacacagttacattaaataaaatt

SEQ ID NO: 178452 - DNA, 27 bp, Artificial sequence
  SiRNA target sequence
ttaacacagttacattaaataaaatta

SEQ ID NO: 178453 - DNA, 27 bp, Artificial sequence
  SiRNA target sequence
taacacagttacattaaataaaattaa

SEQ ID NO: 178454 - DNA, 27 bp, Artificial sequence
  SiRNA target sequence
aacacagttacattaaataaaattaat

SEQ ID NO: 178455 - DNA, 27 bp, Artificial sequence
  SiRNA target sequence
acacagttacattaaataaaattaata

SEQ ID NO: 178456 - DNA, 27 bp, Artificial sequence
  SiRNA target sequence
cacagttacattaaataaaattaatat

SEQ ID NO: 178457 - DNA, 27 bp, Artificial sequence
  SiRNA target sequence
acagttacattaaataaaattaatata

SEQ ID NO: 178458 - DNA, 27 bp, Artificial sequence
  SiRNA target sequence
cagttacattaaataaaattaatatac

SEQ ID NO: 178459 - DNA, 27 bp, Artificial sequence
  SiRNA target sequence
agttacattaaataaaattaatatacc

SEQ ID NO: 178460 - DNA, 27 bp, Artificial sequence
  SiRNA target sequence
gttacattaaataaaattaatatacct

SEQ ID NO: 178461 - DNA, 27 bp, Artificial sequence
  SiRNA target sequence
ttacattaaataaaattaatatacctg

SEQ ID NO: 178462 - DNA, 27 bp, Artificial sequence
  SiRNA target sequence
tacattaaataaaattaatatacctga

SEQ ID NO: 178463 - DNA, 27 bp, Artificial sequence
  SiRNA target sequence
acattaaataaaattaatatacctgag

SEQ ID NO: 178464 - DNA, 27 bp, Artificial sequence
  SiRNA target sequence
cattaaataaaattaatatacctgaga

SEQ ID NO: 178465 - DNA, 27 bp, Artificial sequence
  SiRNA target sequence
attaaataaaattaatatacctgagat

SEQ ID NO: 178466 - DNA, 27 bp, Artificial sequence
  SiRNA target sequence
ttaaataaaattaatatacctgagata

SEQ ID NO: 178467 - DNA, 27 bp, Artificial sequence
  SiRNA target sequence
taaataaaattaatatacctgagatag

SEQ ID NO: 178468 - DNA, 27 bp, Artificial sequence
  SiRNA target sequence
aaataaaattaatatacctgagataga

SEQ ID NO: 178469 - DNA, 27 bp, Artificial sequence
  SiRNA target sequence
aataaaattaatatacctgagatagat

SEQ ID NO: 178470 - DNA, 27 bp, Artificial sequence
  SiRNA target sequence
ataaaattaatatacctgagatagatt

SEQ ID NO: 178471 - DNA, 27 bp, Artificial sequence
  SiRNA target sequence
taaaattaatatacctgagatagatta

SEQ ID NO: 178472 - DNA, 27 bp, Artificial sequence
  SiRNA target sequence
aaaattaatatacctgagatagattat

SEQ ID NO: 178473 - DNA, 27 bp, Artificial sequence
  SiRNA target sequence
aaattaatatacctgagatagattata

SEQ ID NO: 178474 - DNA, 27 bp, Artificial sequence
  SiRNA target sequence
aattaatatacctgagatagattataa

SEQ ID NO: 178475 - DNA, 27 bp, Artificial sequence
  SiRNA target sequence
attaatatacctgagatagattataaa

SEQ ID NO: 178476 - DNA, 27 bp, Artificial sequence
  SiRNA target sequence
ttaatatacctgagatagattataaat

SEQ ID NO: 178477 - DNA, 27 bp, Artificial sequence
  SiRNA target sequence
taatatacctgagatagattataaata

SEQ ID NO: 178478 - DNA, 27 bp, Artificial sequence
  SiRNA target sequence
aatatacctgagatagattataaatat

SEQ ID NO: 178479 - DNA, 27 bp, Artificial sequence
  SiRNA target sequence
atatacctgagatagattataaatata

SEQ ID NO: 178480 - DNA, 27 bp, Artificial sequence
  SiRNA target sequence
tatacctgagatagattataaatataa

SEQ ID NO: 178481 - DNA, 27 bp, Artificial sequence
  SiRNA target sequence
atacctgagatagattataaatataaa

SEQ ID NO: 178482 - DNA, 27 bp, Artificial sequence
  SiRNA target sequence
tacctgagatagattataaatataaaa

SEQ ID NO: 178483 - DNA, 27 bp, Artificial sequence
  SiRNA target sequence
acctgagatagattataaatataaaaa

SEQ ID NO: 178484 - DNA, 27 bp, Artificial sequence
  SiRNA target sequence
cctgagatagattataaatataaaaat

SEQ ID NO: 178485 - DNA, 27 bp, Artificial sequence
  SiRNA target sequence
ctgagatagattataaatataaaaatg

SEQ ID NO: 178486 - DNA, 27 bp, Artificial sequence
  SiRNA target sequence
tgagatagattataaatataaaaatgg

SEQ ID NO: 178487 - DNA, 27 bp, Artificial sequence
  SiRNA target sequence
gagatagattataaatataaaaatgga

SEQ ID NO: 178488 - DNA, 27 bp, Artificial sequence
  SiRNA target sequence
agatagattataaatataaaaatggag

SEQ ID NO: 178489 - DNA, 27 bp, Artificial sequence
  SiRNA target sequence
gatagattataaatataaaaatggagt

SEQ ID NO: 178490 - DNA, 27 bp, Artificial sequence
  SiRNA target sequence
atagattataaatataaaaatggagtg

SEQ ID NO: 178491 - DNA, 27 bp, Artificial sequence
  SiRNA target sequence
tagattataaatataaaaatggagtgt

SEQ ID NO: 178492 - DNA, 27 bp, Artificial sequence
  SiRNA target sequence
agattataaatataaaaatggagtgtt

SEQ ID NO: 178493 - DNA, 27 bp, Artificial sequence
  SiRNA target sequence
gattataaatataaaaatggagtgttt

SEQ ID NO: 178494 - DNA, 27 bp, Artificial sequence
  SiRNA target sequence
attataaatataaaaatggagtgttta

SEQ ID NO: 178495 - DNA, 27 bp, Artificial sequence
  SiRNA target sequence
ttataaatataaaaatggagtgtttac

SEQ ID NO: 178496 - DNA, 27 bp, Artificial sequence
  SiRNA target sequence
tataaatataaaaatggagtgtttaca

SEQ ID NO: 178497 - DNA, 27 bp, Artificial sequence
  SiRNA target sequence
ataaatataaaaatggagtgtttacat

SEQ ID NO: 178498 - DNA, 27 bp, Artificial sequence
  SiRNA target sequence
taaatataaaaatggagtgtttacata

SEQ ID NO: 178499 - DNA, 27 bp, Artificial sequence
  SiRNA target sequence
aaatataaaaatggagtgtttacatat

SEQ ID NO: 178500 - DNA, 27 bp, Artificial sequence
  SiRNA target sequence
aatataaaaatggagtgtttacatata

SEQ ID NO: 178501 - DNA, 27 bp, Artificial sequence
  SiRNA target sequence
atataaaaatggagtgtttacatatac

SEQ ID NO: 178502 - DNA, 27 bp, Artificial sequence
  SiRNA target sequence
tataaaaatggagtgtttacatataca

SEQ ID NO: 178503 - DNA, 27 bp, Artificial sequence
  SiRNA target sequence
ataaaaatggagtgtttacatatacac

SEQ ID NO: 178504 - DNA, 27 bp, Artificial sequence
  SiRNA target sequence
taaaaatggagtgtttacatatacaca

SEQ ID NO: 178505 - DNA, 27 bp, Artificial sequence
  SiRNA target sequence
aaaaatggagtgtttacatatacacag

SEQ ID NO: 178506 - DNA, 27 bp, Artificial sequence
  SiRNA target sequence
aaaatggagtgtttacatatacacaga

SEQ ID NO: 178507 - DNA, 27 bp, Artificial sequence
  SiRNA target sequence
aaatggagtgtttacatatacacagat

SEQ ID NO: 178508 - DNA, 27 bp, Artificial sequence
  SiRNA target sequence
aatggagtgtttacatatacacagatc

SEQ ID NO: 178509 - DNA, 27 bp, Artificial sequence
  SiRNA target sequence
atggagtgtttacatatacacagatca

SEQ ID NO: 178510 - DNA, 27 bp, Artificial sequence
  SiRNA target sequence
tggagtgtttacatatacacagatcaa

SEQ ID NO: 178511 - DNA, 27 bp, Artificial sequence
  SiRNA target sequence
ggagtgtttacatatacacagatcaaa

SEQ ID NO: 178512 - DNA, 27 bp, Artificial sequence
  SiRNA target sequence
gagtgtttacatatacacagatcaaaa

SEQ ID NO: 178513 - DNA, 27 bp, Artificial sequence
  SiRNA target sequence
agtgtttacatatacacagatcaaaaa

SEQ ID NO: 178514 - DNA, 27 bp, Artificial sequence
  SiRNA target sequence
gtgtttacatatacacagatcaaaaat

SEQ ID NO: 178515 - DNA, 27 bp, Artificial sequence
  SiRNA target sequence
tgtttacatatacacagatcaaaaata

SEQ ID NO: 178516 - DNA, 27 bp, Artificial sequence
  SiRNA target sequence
gtttacatatacacagatcaaaaataa

SEQ ID NO: 178517 - DNA, 27 bp, Artificial sequence
  SiRNA target sequence
tttacatatacacagatcaaaaataat

SEQ ID NO: 178518 - DNA, 27 bp, Artificial sequence
  SiRNA target sequence
ttacatatacacagatcaaaaataata

SEQ ID NO: 178519 - DNA, 27 bp, Artificial sequence
  SiRNA target sequence
tacatatacacagatcaaaaataataa

SEQ ID NO: 178520 - DNA, 27 bp, Artificial sequence
  SiRNA target sequence
acatatacacagatcaaaaataataag

SEQ ID NO: 178521 - DNA, 27 bp, Artificial sequence
  SiRNA target sequence
catatacacagatcaaaaataataaga

SEQ ID NO: 178522 - DNA, 27 bp, Artificial sequence
  SiRNA target sequence
atatacacagatcaaaaataataagaa

SEQ ID NO: 178523 - DNA, 27 bp, Artificial sequence
  SiRNA target sequence
tatacacagatcaaaaataataagaaa

SEQ ID NO: 178524 - DNA, 27 bp, Artificial sequence
  SiRNA target sequence
atacacagatcaaaaataataagaaaa

SEQ ID NO: 178525 - DNA, 27 bp, Artificial sequence
  SiRNA target sequence
tacacagatcaaaaataataagaaaaa

SEQ ID NO: 178526 - DNA, 27 bp, Artificial sequence
  SiRNA target sequence
acacagatcaaaaataataagaaaaaa

SEQ ID NO: 178527 - DNA, 27 bp, Artificial sequence
  SiRNA target sequence
cacagatcaaaaataataagaaaaaaa

SEQ ID NO: 178528 - DNA, 27 bp, Artificial sequence
  SiRNA target sequence
acagatcaaaaataataagaaaaaaaa

SEQ ID NO: 178529 - DNA, 27 bp, Artificial sequence
  SiRNA target sequence
cagatcaaaaataataagaaaaaaaaa

SEQ ID NO: 178530 - DNA, 27 bp, Artificial sequence
  SiRNA target sequence
agatcaaaaataataagaaaaaaaaat

SEQ ID NO: 178531 - DNA, 27 bp, Artificial sequence
  SiRNA target sequence
gatcaaaaataataagaaaaaaaaata

SEQ ID NO: 178532 - DNA, 27 bp, Artificial sequence
  SiRNA target sequence
atcaaaaataataagaaaaaaaaatat

SEQ ID NO: 178533 - DNA, 27 bp, Artificial sequence
  SiRNA target sequence
tcaaaaataataagaaaaaaaaatatt

SEQ ID NO: 178534 - DNA, 27 bp, Artificial sequence
  SiRNA target sequence
caaaaataataagaaaaaaaaatattt

SEQ ID NO: 178535 - DNA, 27 bp, Artificial sequence
  SiRNA target sequence
aaaaataataagaaaaaaaaatattta

SEQ ID NO: 178536 - DNA, 27 bp, Artificial sequence
  SiRNA target sequence
aaaataataagaaaaaaaaatatttaa

SEQ ID NO: 178537 - DNA, 27 bp, Artificial sequence
  SiRNA target sequence
aaataataagaaaaaaaaatatttaag

SEQ ID NO: 178538 - DNA, 27 bp, Artificial sequence
  SiRNA target sequence
aataataagaaaaaaaaatatttaaga

SEQ ID NO: 178539 - DNA, 27 bp, Artificial sequence
  SiRNA target sequence
ataataagaaaaaaaaatatttaagaa

SEQ ID NO: 178540 - DNA, 27 bp, Artificial sequence
  SiRNA target sequence
taataagaaaaaaaaatatttaagaat

SEQ ID NO: 178541 - DNA, 27 bp, Artificial sequence
  SiRNA target sequence
aataagaaaaaaaaatatttaagaata

SEQ ID NO: 178542 - DNA, 27 bp, Artificial sequence
  SiRNA target sequence
ataagaaaaaaaaatatttaagaatat

SEQ ID NO: 178543 - DNA, 27 bp, Artificial sequence
  SiRNA target sequence
taagaaaaaaaaatatttaagaatatt

SEQ ID NO: 178544 - DNA, 27 bp, Artificial sequence
  SiRNA target sequence
aagaaaaaaaaatatttaagaatattg

SEQ ID NO: 178545 - DNA, 27 bp, Artificial sequence
  SiRNA target sequence
agaaaaaaaaatatttaagaatattgg

SEQ ID NO: 178546 - DNA, 27 bp, Artificial sequence
  SiRNA target sequence
gaaaaaaaaatatttaagaatattggg

SEQ ID NO: 178547 - DNA, 27 bp, Artificial sequence
  SiRNA target sequence
aaaaaaaaatatttaagaatattgggt

SEQ ID NO: 178548 - DNA, 27 bp, Artificial sequence
  SiRNA target sequence
aaaaaaaatatttaagaatattgggtc

SEQ ID NO: 178549 - DNA, 27 bp, Artificial sequence
  SiRNA target sequence
aaaaaaatatttaagaatattgggtct

SEQ ID NO: 178550 - DNA, 27 bp, Artificial sequence
  SiRNA target sequence
aaaaaatatttaagaatattgggtcta

SEQ ID NO: 178551 - DNA, 27 bp, Artificial sequence
  SiRNA target sequence
aaaaatatttaagaatattgggtctag

SEQ ID NO: 178552 - DNA, 27 bp, Artificial sequence
  SiRNA target sequence
aaaatatttaagaatattgggtctaga

SEQ ID NO: 178553 - DNA, 27 bp, Artificial sequence
  SiRNA target sequence
aaatatttaagaatattgggtctagaa

SEQ ID NO: 178554 - DNA, 27 bp, Artificial sequence
  SiRNA target sequence
aatatttaagaatattgggtctagaac

SEQ ID NO: 178555 - DNA, 27 bp, Artificial sequence
  SiRNA target sequence
atatttaagaatattgggtctagaacc

SEQ ID NO: 178556 - DNA, 27 bp, Artificial sequence
  SiRNA target sequence
tatttaagaatattgggtctagaacct

SEQ ID NO: 178557 - DNA, 27 bp, Artificial sequence
  SiRNA target sequence
atttaagaatattgggtctagaacctt

SEQ ID NO: 178558 - DNA, 27 bp, Artificial sequence
  SiRNA target sequence
tttaagaatattgggtctagaaccttt

SEQ ID NO: 178559 - DNA, 27 bp, Artificial sequence
  SiRNA target sequence
ttaagaatattgggtctagaacctttt

SEQ ID NO: 178560 - DNA, 27 bp, Artificial sequence
  SiRNA target sequence
taagaatattgggtctagaaccttttc

SEQ ID NO: 178561 - DNA, 27 bp, Artificial sequence
  SiRNA target sequence
aagaatattgggtctagaaccttttct

SEQ ID NO: 178562 - DNA, 27 bp, Artificial sequence
  SiRNA target sequence
agaatattgggtctagaaccttttctt

SEQ ID NO: 178563 - DNA, 27 bp, Artificial sequence
  SiRNA target sequence
gaatattgggtctagaaccttttctta

SEQ ID NO: 178564 - DNA, 27 bp, Artificial sequence
  SiRNA target sequence
aatattgggtctagaaccttttcttaa

SEQ ID NO: 178565 - DNA, 27 bp, Artificial sequence
  SiRNA target sequence
atattgggtctagaaccttttcttaat

SEQ ID NO: 178566 - DNA, 27 bp, Artificial sequence
  SiRNA target sequence
tattgggtctagaaccttttcttaatt

SEQ ID NO: 178567 - DNA, 27 bp, Artificial sequence
  SiRNA target sequence
attgggtctagaaccttttcttaattt

SEQ ID NO: 178568 - DNA, 27 bp, Artificial sequence
  SiRNA target sequence
ttgggtctagaaccttttcttaatttt

SEQ ID NO: 178569 - DNA, 27 bp, Artificial sequence
  SiRNA target sequence
tgggtctagaaccttttcttaatttta

SEQ ID NO: 178570 - DNA, 27 bp, Artificial sequence
  SiRNA target sequence
gggtctagaaccttttcttaattttat

SEQ ID NO: 178571 - DNA, 27 bp, Artificial sequence
  SiRNA target sequence
ggtctagaaccttttcttaattttatt

SEQ ID NO: 178572 - DNA, 27 bp, Artificial sequence
  SiRNA target sequence
gtctagaaccttttcttaattttatta

SEQ ID NO: 178573 - DNA, 27 bp, Artificial sequence
  SiRNA target sequence
tctagaaccttttcttaattttattaa

SEQ ID NO: 178574 - DNA, 27 bp, Artificial sequence
  SiRNA target sequence
ctagaaccttttcttaattttattaag

SEQ ID NO: 178575 - DNA, 27 bp, Artificial sequence
  SiRNA target sequence
tagaaccttttcttaattttattaagg

SEQ ID NO: 178576 - DNA, 27 bp, Artificial sequence
  SiRNA target sequence
agaaccttttcttaattttattaagga

SEQ ID NO: 178577 - DNA, 27 bp, Artificial sequence
  SiRNA target sequence
gaaccttttcttaattttattaaggaa

SEQ ID NO: 178578 - DNA, 27 bp, Artificial sequence
  SiRNA target sequence
aaccttttcttaattttattaaggaaa

SEQ ID NO: 178579 - DNA, 27 bp, Artificial sequence
  SiRNA target sequence
accttttcttaattttattaaggaaag

SEQ ID NO: 178580 - DNA, 27 bp, Artificial sequence
  SiRNA target sequence
ccttttcttaattttattaaggaaagt

SEQ ID NO: 178581 - DNA, 27 bp, Artificial sequence
  SiRNA target sequence
cttttcttaattttattaaggaaagta

SEQ ID NO: 178582 - DNA, 27 bp, Artificial sequence
  SiRNA target sequence
ttttcttaattttattaaggaaagtaa

SEQ ID NO: 178583 - DNA, 27 bp, Artificial sequence
  SiRNA target sequence
tttcttaattttattaaggaaagtaaa

SEQ ID NO: 178584 - DNA, 27 bp, Artificial sequence
  SiRNA target sequence
ttcttaattttattaaggaaagtaaac

SEQ ID NO: 178585 - DNA, 27 bp, Artificial sequence
  SiRNA target sequence
tcttaattttattaaggaaagtaaaca

SEQ ID NO: 178586 - DNA, 27 bp, Artificial sequence
  SiRNA target sequence
cttaattttattaaggaaagtaaacat

SEQ ID NO: 178587 - DNA, 27 bp, Artificial sequence
  SiRNA target sequence
ttaattttattaaggaaagtaaacata

SEQ ID NO: 178588 - DNA, 27 bp, Artificial sequence
  SiRNA target sequence
taattttattaaggaaagtaaacataa

SEQ ID NO: 178589 - DNA, 27 bp, Artificial sequence
  SiRNA target sequence
aattttattaaggaaagtaaacataaa

SEQ ID NO: 178590 - DNA, 27 bp, Artificial sequence
  SiRNA target sequence
attttattaaggaaagtaaacataaag

SEQ ID NO: 178591 - DNA, 27 bp, Artificial sequence
  SiRNA target sequence
ttttattaaggaaagtaaacataaaga

SEQ ID NO: 178592 - DNA, 27 bp, Artificial sequence
  SiRNA target sequence
tttattaaggaaagtaaacataaagaa

SEQ ID NO: 178593 - DNA, 27 bp, Artificial sequence
  SiRNA target sequence
ttattaaggaaagtaaacataaagaat

SEQ ID NO: 178594 - DNA, 27 bp, Artificial sequence
  SiRNA target sequence
tattaaggaaagtaaacataaagaatt

SEQ ID NO: 178595 - DNA, 27 bp, Artificial sequence
  SiRNA target sequence
attaaggaaagtaaacataaagaatta

SEQ ID NO: 178596 - DNA, 27 bp, Artificial sequence
  SiRNA target sequence
ttaaggaaagtaaacataaagaattag

SEQ ID NO: 178597 - DNA, 27 bp, Artificial sequence
  SiRNA target sequence
taaggaaagtaaacataaagaattaga

SEQ ID NO: 178598 - DNA, 27 bp, Artificial sequence
  SiRNA target sequence
aaggaaagtaaacataaagaattagaa

SEQ ID NO: 178599 - DNA, 27 bp, Artificial sequence
  SiRNA target sequence
aggaaagtaaacataaagaattagaat

SEQ ID NO: 178600 - DNA, 27 bp, Artificial sequence
  SiRNA target sequence
ggaaagtaaacataaagaattagaata

SEQ ID NO: 178601 - DNA, 27 bp, Artificial sequence
  SiRNA target sequence
gaaagtaaacataaagaattagaatat

SEQ ID NO: 178602 - DNA, 27 bp, Artificial sequence
  SiRNA target sequence
aaagtaaacataaagaattagaatatg

SEQ ID NO: 178603 - DNA, 27 bp, Artificial sequence
  SiRNA target sequence
aagtaaacataaagaattagaatatga

SEQ ID NO: 178604 - DNA, 27 bp, Artificial sequence
  SiRNA target sequence
agtaaacataaagaattagaatatgat

SEQ ID NO: 178605 - DNA, 27 bp, Artificial sequence
  SiRNA target sequence
gtaaacataaagaattagaatatgatg

SEQ ID NO: 178606 - DNA, 27 bp, Artificial sequence
  SiRNA target sequence
taaacataaagaattagaatatgatgt

SEQ ID NO: 178607 - DNA, 27 bp, Artificial sequence
  SiRNA target sequence
aaacataaagaattagaatatgatgta

SEQ ID NO: 178608 - DNA, 27 bp, Artificial sequence
  SiRNA target sequence
aacataaagaattagaatatgatgtat

SEQ ID NO: 178609 - DNA, 27 bp, Artificial sequence
  SiRNA target sequence
acataaagaattagaatatgatgtatg

SEQ ID NO: 178610 - DNA, 27 bp, Artificial sequence
  SiRNA target sequence
cataaagaattagaatatgatgtatgc

SEQ ID NO: 178611 - DNA, 27 bp, Artificial sequence
  SiRNA target sequence
ataaagaattagaatatgatgtatgcg

SEQ ID NO: 178612 - DNA, 27 bp, Artificial sequence
  SiRNA target sequence
taaagaattagaatatgatgtatgcga

SEQ ID NO: 178613 - DNA, 27 bp, Artificial sequence
  SiRNA target sequence
aaagaattagaatatgatgtatgcgaa

SEQ ID NO: 178614 - DNA, 27 bp, Artificial sequence
  SiRNA target sequence
aagaattagaatatgatgtatgcgaaa

SEQ ID NO: 178615 - DNA, 27 bp, Artificial sequence
  SiRNA target sequence
agaattagaatatgatgtatgcgaaat

SEQ ID NO: 178616 - DNA, 27 bp, Artificial sequence
  SiRNA target sequence
gaattagaatatgatgtatgcgaaata

SEQ ID NO: 178617 - DNA, 27 bp, Artificial sequence
  SiRNA target sequence
aattagaatatgatgtatgcgaaatat

SEQ ID NO: 178618 - DNA, 27 bp, Artificial sequence
  SiRNA target sequence
attagaatatgatgtatgcgaaatata

SEQ ID NO: 178619 - DNA, 27 bp, Artificial sequence
  SiRNA target sequence
ttagaatatgatgtatgcgaaatatac

SEQ ID NO: 178620 - DNA, 27 bp, Artificial sequence
  SiRNA target sequence
tagaatatgatgtatgcgaaatataca

SEQ ID NO: 178621 - DNA, 27 bp, Artificial sequence
  SiRNA target sequence
agaatatgatgtatgcgaaatatacat

SEQ ID NO: 178622 - DNA, 27 bp, Artificial sequence
  SiRNA target sequence
gaatatgatgtatgcgaaatatacatt

SEQ ID NO: 178623 - DNA, 27 bp, Artificial sequence
  SiRNA target sequence
aatatgatgtatgcgaaatatacattt

SEQ ID NO: 178624 - DNA, 27 bp, Artificial sequence
  SiRNA target sequence
atatgatgtatgcgaaatatacatttg

SEQ ID NO: 178625 - DNA, 27 bp, Artificial sequence
  SiRNA target sequence
tatgatgtatgcgaaatatacatttgt

SEQ ID NO: 178626 - DNA, 27 bp, Artificial sequence
  SiRNA target sequence
atgatgtatgcgaaatatacatttgta

SEQ ID NO: 178627 - DNA, 27 bp, Artificial sequence
  SiRNA target sequence
tgatgtatgcgaaatatacatttgtaa

SEQ ID NO: 178628 - DNA, 27 bp, Artificial sequence
  SiRNA target sequence
gatgtatgcgaaatatacatttgtaat

SEQ ID NO: 178629 - DNA, 27 bp, Artificial sequence
  SiRNA target sequence
atgtatgcgaaatatacatttgtaatc

SEQ ID NO: 178630 - DNA, 27 bp, Artificial sequence
  SiRNA target sequence
tgtatgcgaaatatacatttgtaatca

SEQ ID NO: 178631 - DNA, 27 bp, Artificial sequence
  SiRNA target sequence
gtatgcgaaatatacatttgtaatcag

SEQ ID NO: 178632 - DNA, 27 bp, Artificial sequence
  SiRNA target sequence
tatgcgaaatatacatttgtaatcagg

SEQ ID NO: 178633 - DNA, 27 bp, Artificial sequence
  SiRNA target sequence
atgcgaaatatacatttgtaatcaggg

SEQ ID NO: 178634 - DNA, 27 bp, Artificial sequence
  SiRNA target sequence
tgcgaaatatacatttgtaatcaggga

SEQ ID NO: 178635 - DNA, 27 bp, Artificial sequence
  SiRNA target sequence
gcgaaatatacatttgtaatcagggat

SEQ ID NO: 178636 - DNA, 27 bp, Artificial sequence
  SiRNA target sequence
cgaaatatacatttgtaatcagggatg

SEQ ID NO: 178637 - DNA, 27 bp, Artificial sequence
  SiRNA target sequence
gaaatatacatttgtaatcagggatgc

SEQ ID NO: 178638 - DNA, 27 bp, Artificial sequence
  SiRNA target sequence
aaatatacatttgtaatcagggatgca

SEQ ID NO: 178639 - DNA, 27 bp, Artificial sequence
  SiRNA target sequence
aatatacatttgtaatcagggatgcat

SEQ ID NO: 178640 - DNA, 27 bp, Artificial sequence
  SiRNA target sequence
atatacatttgtaatcagggatgcatt

SEQ ID NO: 178641 - DNA, 27 bp, Artificial sequence
  SiRNA target sequence
tatacatttgtaatcagggatgcatta

SEQ ID NO: 178642 - DNA, 27 bp, Artificial sequence
  SiRNA target sequence
atacatttgtaatcagggatgcattaa

SEQ ID NO: 178643 - DNA, 27 bp, Artificial sequence
  SiRNA target sequence
tacatttgtaatcagggatgcattaat

SEQ ID NO: 178644 - DNA, 27 bp, Artificial sequence
  SiRNA target sequence
acatttgtaatcagggatgcattaatg

SEQ ID NO: 178645 - DNA, 27 bp, Artificial sequence
  SiRNA target sequence
catttgtaatcagggatgcattaatgg

SEQ ID NO: 178646 - DNA, 27 bp, Artificial sequence
  SiRNA target sequence
atttgtaatcagggatgcattaatgga

SEQ ID NO: 178647 - DNA, 27 bp, Artificial sequence
  SiRNA target sequence
tttgtaatcagggatgcattaatggac

SEQ ID NO: 178648 - DNA, 27 bp, Artificial sequence
  SiRNA target sequence
ttgtaatcagggatgcattaatggacc

SEQ ID NO: 178649 - DNA, 27 bp, Artificial sequence
  SiRNA target sequence
tgtaatcagggatgcattaatggacca

SEQ ID NO: 178650 - DNA, 27 bp, Artificial sequence
  SiRNA target sequence
gtaatcagggatgcattaatggaccag

SEQ ID NO: 178651 - DNA, 27 bp, Artificial sequence
  SiRNA target sequence
taatcagggatgcattaatggaccagg

SEQ ID NO: 178652 - DNA, 27 bp, Artificial sequence
  SiRNA target sequence
aatcagggatgcattaatggaccagga

SEQ ID NO: 178653 - DNA, 27 bp, Artificial sequence
  SiRNA target sequence
atcagggatgcattaatggaccaggac

SEQ ID NO: 178654 - DNA, 27 bp, Artificial sequence
  SiRNA target sequence
tcagggatgcattaatggaccaggaca

SEQ ID NO: 178655 - DNA, 27 bp, Artificial sequence
  SiRNA target sequence
cagggatgcattaatggaccaggacaa

SEQ ID NO: 178656 - DNA, 27 bp, Artificial sequence
  SiRNA target sequence
agggatgcattaatggaccaggacaat

SEQ ID NO: 178657 - DNA, 27 bp, Artificial sequence
  SiRNA target sequence
gggatgcattaatggaccaggacaatt

SEQ ID NO: 178658 - DNA, 27 bp, Artificial sequence
  SiRNA target sequence
ggatgcattaatggaccaggacaattg

SEQ ID NO: 178659 - DNA, 27 bp, Artificial sequence
  SiRNA target sequence
gatgcattaatggaccaggacaattgt

SEQ ID NO: 178660 - DNA, 27 bp, Artificial sequence
  SiRNA target sequence
atgcattaatggaccaggacaattgta

SEQ ID NO: 178661 - DNA, 27 bp, Artificial sequence
  SiRNA target sequence
tgcattaatggaccaggacaattgtat

SEQ ID NO: 178662 - DNA, 27 bp, Artificial sequence
  SiRNA target sequence
gcattaatggaccaggacaattgtata

SEQ ID NO: 178663 - DNA, 27 bp, Artificial sequence
  SiRNA target sequence
cattaatggaccaggacaattgtatac

SEQ ID NO: 178664 - DNA, 27 bp, Artificial sequence
  SiRNA target sequence
attaatggaccaggacaattgtataca

SEQ ID NO: 178665 - DNA, 27 bp, Artificial sequence
  SiRNA target sequence
ttaatggaccaggacaattgtatacag

SEQ ID NO: 178666 - DNA, 27 bp, Artificial sequence
  SiRNA target sequence
taatggaccaggacaattgtatacaga

SEQ ID NO: 178667 - DNA, 27 bp, Artificial sequence
  SiRNA target sequence
aatggaccaggacaattgtatacagat

SEQ ID NO: 178668 - DNA, 27 bp, Artificial sequence
  SiRNA target sequence
atggaccaggacaattgtatacagata

SEQ ID NO: 178669 - DNA, 27 bp, Artificial sequence
  SiRNA target sequence
tggaccaggacaattgtatacagataa

SEQ ID NO: 178670 - DNA, 27 bp, Artificial sequence
  SiRNA target sequence
ggaccaggacaattgtatacagataat

SEQ ID NO: 178671 - DNA, 27 bp, Artificial sequence
  SiRNA target sequence
gaccaggacaattgtatacagataatt

SEQ ID NO: 178672 - DNA, 27 bp, Artificial sequence
  SiRNA target sequence
accaggacaattgtatacagataattt

SEQ ID NO: 178673 - DNA, 27 bp, Artificial sequence
  SiRNA target sequence
ccaggacaattgtatacagataattta

SEQ ID NO: 178674 - DNA, 27 bp, Artificial sequence
  SiRNA target sequence
caggacaattgtatacagataatttat

SEQ ID NO: 178675 - DNA, 27 bp, Artificial sequence
  SiRNA target sequence
aggacaattgtatacagataatttata

SEQ ID NO: 178676 - DNA, 27 bp, Artificial sequence
  SiRNA target sequence
ggacaattgtatacagataatttatat

SEQ ID NO: 178677 - DNA, 27 bp, Artificial sequence
  SiRNA target sequence
gacaattgtatacagataatttatatg

SEQ ID NO: 178678 - DNA, 27 bp, Artificial sequence
  SiRNA target sequence
acaattgtatacagataatttatatgt

SEQ ID NO: 178679 - DNA, 27 bp, Artificial sequence
  SiRNA target sequence
caattgtatacagataatttatatgta

SEQ ID NO: 178680 - DNA, 27 bp, Artificial sequence
  SiRNA target sequence
aattgtatacagataatttatatgtaa

SEQ ID NO: 178681 - DNA, 27 bp, Artificial sequence
  SiRNA target sequence
attgtatacagataatttatatgtaaa

SEQ ID NO: 178682 - DNA, 27 bp, Artificial sequence
  SiRNA target sequence
ttgtatacagataatttatatgtaaat

SEQ ID NO: 178683 - DNA, 27 bp, Artificial sequence
  SiRNA target sequence
tgtatacagataatttatatgtaaata

SEQ ID NO: 178684 - DNA, 27 bp, Artificial sequence
  SiRNA target sequence
gtatacagataatttatatgtaaataa

SEQ ID NO: 178685 - DNA, 27 bp, Artificial sequence
  SiRNA target sequence
tatacagataatttatatgtaaataat

SEQ ID NO: 178686 - DNA, 27 bp, Artificial sequence
  SiRNA target sequence
atacagataatttatatgtaaataatt

SEQ ID NO: 178687 - DNA, 27 bp, Artificial sequence
  SiRNA target sequence
tacagataatttatatgtaaataattc

SEQ ID NO: 178688 - DNA, 27 bp, Artificial sequence
  SiRNA target sequence
acagataatttatatgtaaataattca

SEQ ID NO: 178689 - DNA, 27 bp, Artificial sequence
  SiRNA target sequence
cagataatttatatgtaaataattcag

SEQ ID NO: 178690 - DNA, 27 bp, Artificial sequence
  SiRNA target sequence
agataatttatatgtaaataattcaga

SEQ ID NO: 178691 - DNA, 27 bp, Artificial sequence
  SiRNA target sequence
gataatttatatgtaaataattcagaa

SEQ ID NO: 178692 - DNA, 27 bp, Artificial sequence
  SiRNA target sequence
ataatttatatgtaaataattcagaat

SEQ ID NO: 178693 - DNA, 27 bp, Artificial sequence
  SiRNA target sequence
taatttatatgtaaataattcagaata

SEQ ID NO: 178694 - DNA, 27 bp, Artificial sequence
  SiRNA target sequence
aatttatatgtaaataattcagaatac

SEQ ID NO: 178695 - DNA, 27 bp, Artificial sequence
  SiRNA target sequence
atttatatgtaaataattcagaataca

SEQ ID NO: 178696 - DNA, 27 bp, Artificial sequence
  SiRNA target sequence
tttatatgtaaataattcagaatacat

SEQ ID NO: 178697 - DNA, 27 bp, Artificial sequence
  SiRNA target sequence
ttatatgtaaataattcagaatacata

SEQ ID NO: 178698 - DNA, 27 bp, Artificial sequence
  SiRNA target sequence
tatatgtaaataattcagaatacatag

SEQ ID NO: 178699 - DNA, 27 bp, Artificial sequence
  SiRNA target sequence
atatgtaaataattcagaatacataga

SEQ ID NO: 178700 - DNA, 27 bp, Artificial sequence
  SiRNA target sequence
tatgtaaataattcagaatacatagat

SEQ ID NO: 178701 - DNA, 27 bp, Artificial sequence
  SiRNA target sequence
atgtaaataattcagaatacatagata

SEQ ID NO: 178702 - DNA, 27 bp, Artificial sequence
  SiRNA target sequence
tgtaaataattcagaatacatagatat

SEQ ID NO: 178703 - DNA, 27 bp, Artificial sequence
  SiRNA target sequence
gtaaataattcagaatacatagatatt

SEQ ID NO: 178704 - DNA, 27 bp, Artificial sequence
  SiRNA target sequence
taaataattcagaatacatagatattg

SEQ ID NO: 178705 - DNA, 27 bp, Artificial sequence
  SiRNA target sequence
aaataattcagaatacatagatattga

SEQ ID NO: 178706 - DNA, 27 bp, Artificial sequence
  SiRNA target sequence
aataattcagaatacatagatattgat

SEQ ID NO: 178707 - DNA, 27 bp, Artificial sequence
  SiRNA target sequence
ataattcagaatacatagatattgatc

SEQ ID NO: 178708 - DNA, 27 bp, Artificial sequence
  SiRNA target sequence
taattcagaatacatagatattgatct

SEQ ID NO: 178709 - DNA, 27 bp, Artificial sequence
  SiRNA target sequence
aattcagaatacatagatattgatctt

SEQ ID NO: 178710 - DNA, 27 bp, Artificial sequence
  SiRNA target sequence
attcagaatacatagatattgatcttg

SEQ ID NO: 178711 - DNA, 27 bp, Artificial sequence
  SiRNA target sequence
ttcagaatacatagatattgatcttgg

SEQ ID NO: 178712 - DNA, 27 bp, Artificial sequence
  SiRNA target sequence
tcagaatacatagatattgatcttggt

SEQ ID NO: 178713 - DNA, 27 bp, Artificial sequence
  SiRNA target sequence
cagaatacatagatattgatcttggta

SEQ ID NO: 178714 - DNA, 27 bp, Artificial sequence
  SiRNA target sequence
agaatacatagatattgatcttggtat

SEQ ID NO: 178715 - DNA, 27 bp, Artificial sequence
  SiRNA target sequence
gaatacatagatattgatcttggtatt

SEQ ID NO: 178716 - DNA, 27 bp, Artificial sequence
  SiRNA target sequence
aatacatagatattgatcttggtattg

SEQ ID NO: 178717 - DNA, 27 bp, Artificial sequence
  SiRNA target sequence
atacatagatattgatcttggtattga

SEQ ID NO: 178718 - DNA, 27 bp, Artificial sequence
  SiRNA target sequence
tacatagatattgatcttggtattgat

SEQ ID NO: 178719 - DNA, 27 bp, Artificial sequence
  SiRNA target sequence
acatagatattgatcttggtattgatt

SEQ ID NO: 178720 - DNA, 27 bp, Artificial sequence
  SiRNA target sequence
catagatattgatcttggtattgattg

SEQ ID NO: 178721 - DNA, 27 bp, Artificial sequence
  SiRNA target sequence
atagatattgatcttggtattgattgt

SEQ ID NO: 178722 - DNA, 27 bp, Artificial sequence
  SiRNA target sequence
tagatattgatcttggtattgattgta

SEQ ID NO: 178723 - DNA, 27 bp, Artificial sequence
  SiRNA target sequence
agatattgatcttggtattgattgtaa

SEQ ID NO: 178724 - DNA, 27 bp, Artificial sequence
  SiRNA target sequence
gatattgatcttggtattgattgtaaa

SEQ ID NO: 178725 - DNA, 27 bp, Artificial sequence
  SiRNA target sequence
atattgatcttggtattgattgtaaac

SEQ ID NO: 178726 - DNA, 27 bp, Artificial sequence
  SiRNA target sequence
tattgatcttggtattgattgtaaaca

SEQ ID NO: 178727 - DNA, 27 bp, Artificial sequence
  SiRNA target sequence
attgatcttggtattgattgtaaacag

SEQ ID NO: 178728 - DNA, 27 bp, Artificial sequence
  SiRNA target sequence
ttgatcttggtattgattgtaaacagt

SEQ ID NO: 178729 - DNA, 27 bp, Artificial sequence
  SiRNA target sequence
tgatcttggtattgattgtaaacagtt

SEQ ID NO: 178730 - DNA, 27 bp, Artificial sequence
  SiRNA target sequence
gatcttggtattgattgtaaacagtta

SEQ ID NO: 178731 - DNA, 27 bp, Artificial sequence
  SiRNA target sequence
atcttggtattgattgtaaacagttac

SEQ ID NO: 178732 - DNA, 27 bp, Artificial sequence
  SiRNA target sequence
tcttggtattgattgtaaacagttaca

SEQ ID NO: 178733 - DNA, 27 bp, Artificial sequence
  SiRNA target sequence
cttggtattgattgtaaacagttacaa

SEQ ID NO: 178734 - DNA, 27 bp, Artificial sequence
  SiRNA target sequence
ttggtattgattgtaaacagttacaaa

SEQ ID NO: 178735 - DNA, 27 bp, Artificial sequence
  SiRNA target sequence
tggtattgattgtaaacagttacaaaa

SEQ ID NO: 178736 - DNA, 27 bp, Artificial sequence
  SiRNA target sequence
ggtattgattgtaaacagttacaaaaa

SEQ ID NO: 178737 - DNA, 27 bp, Artificial sequence
  SiRNA target sequence
gtattgattgtaaacagttacaaaaaa

SEQ ID NO: 178738 - DNA, 27 bp, Artificial sequence
  SiRNA target sequence
tattgattgtaaacagttacaaaaaag

SEQ ID NO: 178739 - DNA, 27 bp, Artificial sequence
  SiRNA target sequence
attgattgtaaacagttacaaaaaagg

SEQ ID NO: 178740 - DNA, 27 bp, Artificial sequence
  SiRNA target sequence
ttgattgtaaacagttacaaaaaagga

SEQ ID NO: 178741 - DNA, 27 bp, Artificial sequence
  SiRNA target sequence
tgattgtaaacagttacaaaaaaggac

SEQ ID NO: 178742 - DNA, 27 bp, Artificial sequence
  SiRNA target sequence
gattgtaaacagttacaaaaaaggaca

SEQ ID NO: 178743 - DNA, 27 bp, Artificial sequence
  SiRNA target sequence
attgtaaacagttacaaaaaaggacat

SEQ ID NO: 178744 - DNA, 27 bp, Artificial sequence
  SiRNA target sequence
ttgtaaacagttacaaaaaaggacata

SEQ ID NO: 178745 - DNA, 27 bp, Artificial sequence
  SiRNA target sequence
tgtaaacagttacaaaaaaggacatat

SEQ ID NO: 178746 - DNA, 27 bp, Artificial sequence
  SiRNA target sequence
gtaaacagttacaaaaaaggacatata

SEQ ID NO: 178747 - DNA, 27 bp, Artificial sequence
  SiRNA target sequence
taaacagttacaaaaaaggacatatag

SEQ ID NO: 178748 - DNA, 27 bp, Artificial sequence
  SiRNA target sequence
aaacagttacaaaaaaggacatataga

SEQ ID NO: 178749 - DNA, 27 bp, Artificial sequence
  SiRNA target sequence
aacagttacaaaaaaggacatatagaa

SEQ ID NO: 178750 - DNA, 27 bp, Artificial sequence
  SiRNA target sequence
acagttacaaaaaaggacatatagaaa

SEQ ID NO: 178751 - DNA, 27 bp, Artificial sequence
  SiRNA target sequence
cagttacaaaaaaggacatatagaaaa

SEQ ID NO: 178752 - DNA, 27 bp, Artificial sequence
  SiRNA target sequence
agttacaaaaaaggacatatagaaaaa

SEQ ID NO: 178753 - DNA, 27 bp, Artificial sequence
  SiRNA target sequence
gttacaaaaaaggacatatagaaaaat

SEQ ID NO: 178754 - DNA, 27 bp, Artificial sequence
  SiRNA target sequence
ttacaaaaaaggacatatagaaaaata

SEQ ID NO: 178755 - DNA, 27 bp, Artificial sequence
  SiRNA target sequence
tacaaaaaaggacatatagaaaaatag

SEQ ID NO: 178756 - DNA, 27 bp, Artificial sequence
  SiRNA target sequence
acaaaaaaggacatatagaaaaataga

SEQ ID NO: 178757 - DNA, 27 bp, Artificial sequence
  SiRNA target sequence
caaaaaaggacatatagaaaaatagaa

SEQ ID NO: 178758 - DNA, 27 bp, Artificial sequence
  SiRNA target sequence
aaaaaaggacatatagaaaaatagaaa

SEQ ID NO: 178759 - DNA, 27 bp, Artificial sequence
  SiRNA target sequence
aaaaaggacatatagaaaaatagaaac

SEQ ID NO: 178760 - DNA, 27 bp, Artificial sequence
  SiRNA target sequence
aaaaggacatatagaaaaatagaaaca

SEQ ID NO: 178761 - DNA, 27 bp, Artificial sequence
  SiRNA target sequence
aaaggacatatagaaaaatagaaacaa

SEQ ID NO: 178762 - DNA, 27 bp, Artificial sequence
  SiRNA target sequence
aaggacatatagaaaaatagaaacaaa

SEQ ID NO: 178763 - DNA, 27 bp, Artificial sequence
  SiRNA target sequence
aggacatatagaaaaatagaaacaaag

SEQ ID NO: 178764 - DNA, 27 bp, Artificial sequence
  SiRNA target sequence
ggacatatagaaaaatagaaacaaaga

SEQ ID NO: 178765 - DNA, 27 bp, Artificial sequence
  SiRNA target sequence
gacatatagaaaaatagaaacaaagaa

SEQ ID NO: 178766 - DNA, 27 bp, Artificial sequence
  SiRNA target sequence
acatatagaaaaatagaaacaaagaaa

SEQ ID NO: 178767 - DNA, 27 bp, Artificial sequence
  SiRNA target sequence
catatagaaaaatagaaacaaagaaag

SEQ ID NO: 178768 - DNA, 27 bp, Artificial sequence
  SiRNA target sequence
atatagaaaaatagaaacaaagaaagt

SEQ ID NO: 178769 - DNA, 27 bp, Artificial sequence
  SiRNA target sequence
tatagaaaaatagaaacaaagaaagtt

SEQ ID NO: 178770 - DNA, 27 bp, Artificial sequence
  SiRNA target sequence
atagaaaaatagaaacaaagaaagtta

SEQ ID NO: 178771 - DNA, 27 bp, Artificial sequence
  SiRNA target sequence
tagaaaaatagaaacaaagaaagttaa

SEQ ID NO: 178772 - DNA, 27 bp, Artificial sequence
  SiRNA target sequence
agaaaaatagaaacaaagaaagttaat

SEQ ID NO: 178773 - DNA, 27 bp, Artificial sequence
  SiRNA target sequence
gaaaaatagaaacaaagaaagttaatt

SEQ ID NO: 178774 - DNA, 27 bp, Artificial sequence
  SiRNA target sequence
aaaaatagaaacaaagaaagttaattt

SEQ ID NO: 178775 - DNA, 27 bp, Artificial sequence
  SiRNA target sequence
aaaatagaaacaaagaaagttaatttt

SEQ ID NO: 178776 - DNA, 27 bp, Artificial sequence
  SiRNA target sequence
aaatagaaacaaagaaagttaatttta

SEQ ID NO: 178777 - DNA, 27 bp, Artificial sequence
  SiRNA target sequence
aatagaaacaaagaaagttaattttaa

SEQ ID NO: 178778 - DNA, 27 bp, Artificial sequence
  SiRNA target sequence
atagaaacaaagaaagttaattttaaa

SEQ ID NO: 178779 - DNA, 27 bp, Artificial sequence
  SiRNA target sequence
tagaaacaaagaaagttaattttaaaa

SEQ ID NO: 178780 - DNA, 27 bp, Artificial sequence
  SiRNA target sequence
agaaacaaagaaagttaattttaaaat

SEQ ID NO: 178781 - DNA, 27 bp, Artificial sequence
  SiRNA target sequence
gaaacaaagaaagttaattttaaaata

SEQ ID NO: 178782 - DNA, 27 bp, Artificial sequence
  SiRNA target sequence
aaacaaagaaagttaattttaaaatag

SEQ ID NO: 178783 - DNA, 27 bp, Artificial sequence
  SiRNA target sequence
aacaaagaaagttaattttaaaataga

SEQ ID NO: 178784 - DNA, 27 bp, Artificial sequence
  SiRNA target sequence
acaaagaaagttaattttaaaatagaa

SEQ ID NO: 178785 - DNA, 27 bp, Artificial sequence
  SiRNA target sequence
caaagaaagttaattttaaaatagaat

SEQ ID NO: 178786 - DNA, 27 bp, Artificial sequence
  SiRNA target sequence
aaagaaagttaattttaaaatagaatg

SEQ ID NO: 178787 - DNA, 27 bp, Artificial sequence
  SiRNA target sequence
aagaaagttaattttaaaatagaatgg

SEQ ID NO: 178788 - DNA, 27 bp, Artificial sequence
  SiRNA target sequence
agaaagttaattttaaaatagaatggt

SEQ ID NO: 178789 - DNA, 27 bp, Artificial sequence
  SiRNA target sequence
gaaagttaattttaaaatagaatggta

SEQ ID NO: 178790 - DNA, 27 bp, Artificial sequence
  SiRNA target sequence
aaagttaattttaaaatagaatggtaa

SEQ ID NO: 178791 - DNA, 19 bp, Artificial sequence
  SiRNA target sequence
atggccaagaatgaatcta

SEQ ID NO: 178792 - DNA, 19 bp, Artificial sequence
  SiRNA target sequence
tggccaagaatgaatctaa

SEQ ID NO: 178793 - DNA, 19 bp, Artificial sequence
  SiRNA target sequence
ggccaagaatgaatctaat

SEQ ID NO: 178794 - DNA, 19 bp, Artificial sequence
  SiRNA target sequence
gccaagaatgaatctaata

SEQ ID NO: 178795 - DNA, 19 bp, Artificial sequence
  SiRNA target sequence
ccaagaatgaatctaataa

SEQ ID NO: 178796 - DNA, 19 bp, Artificial sequence
  SiRNA target sequence
caagaatgaatctaataaa

SEQ ID NO: 178797 - DNA, 19 bp, Artificial sequence
  SiRNA target sequence
aagaatgaatctaataaaa

SEQ ID NO: 178798 - DNA, 19 bp, Artificial sequence
  SiRNA target sequence
agaatgaatctaataaaat

SEQ ID NO: 178799 - DNA, 19 bp, Artificial sequence
  SiRNA target sequence
gaatgaatctaataaaata

SEQ ID NO: 178800 - DNA, 19 bp, Artificial sequence
  SiRNA target sequence
aatgaatctaataaaataa

SEQ ID NO: 178801 - DNA, 19 bp, Artificial sequence
  SiRNA target sequence
atgaatctaataaaataac

SEQ ID NO: 178802 - DNA, 19 bp, Artificial sequence
  SiRNA target sequence
tgaatctaataaaataacg

SEQ ID NO: 178803 - DNA, 19 bp, Artificial sequence
  SiRNA target sequence
gaatctaataaaataacga

SEQ ID NO: 178804 - DNA, 19 bp, Artificial sequence
  SiRNA target sequence
aatctaataaaataacgag

SEQ ID NO: 178805 - DNA, 19 bp, Artificial sequence
  SiRNA target sequence
atctaataaaataacgaga

SEQ ID NO: 178806 - DNA, 19 bp, Artificial sequence
  SiRNA target sequence
tctaataaaataacgagac

SEQ ID NO: 178807 - DNA, 19 bp, Artificial sequence
  SiRNA target sequence
ctaataaaataacgagact

SEQ ID NO: 178808 - DNA, 19 bp, Artificial sequence
  SiRNA target sequence
taataaaataacgagactg

SEQ ID NO: 178809 - DNA, 19 bp, Artificial sequence
  SiRNA target sequence
aataaaataacgagactgg

SEQ ID NO: 178810 - DNA, 19 bp, Artificial sequence
  SiRNA target sequence
ataaaataacgagactggc

SEQ ID NO: 178811 - DNA, 19 bp, Artificial sequence
  SiRNA target sequence
taaaataacgagactggca

SEQ ID NO: 178812 - DNA, 19 bp, Artificial sequence
  SiRNA target sequence
aaaataacgagactggcaa

SEQ ID NO: 178813 - DNA, 19 bp, Artificial sequence
  SiRNA target sequence
aaataacgagactggcaat

SEQ ID NO: 178814 - DNA, 19 bp, Artificial sequence
  SiRNA target sequence
aataacgagactggcaatt

SEQ ID NO: 178815 - DNA, 19 bp, Artificial sequence
  SiRNA target sequence
ataacgagactggcaattg

SEQ ID NO: 178816 - DNA, 19 bp, Artificial sequence
  SiRNA target sequence
taacgagactggcaattgt

SEQ ID NO: 178817 - DNA, 19 bp, Artificial sequence
  SiRNA target sequence
aacgagactggcaattgtt

SEQ ID NO: 178818 - DNA, 19 bp, Artificial sequence
  SiRNA target sequence
acgagactggcaattgtta

SEQ ID NO: 178819 - DNA, 19 bp, Artificial sequence
  SiRNA target sequence
cgagactggcaattgttaa

SEQ ID NO: 178820 - DNA, 19 bp, Artificial sequence
  SiRNA target sequence
gagactggcaattgttaat

SEQ ID NO: 178821 - DNA, 19 bp, Artificial sequence
  SiRNA target sequence
agactggcaattgttaatt

SEQ ID NO: 178822 - DNA, 19 bp, Artificial sequence
  SiRNA target sequence
gactggcaattgttaatta

SEQ ID NO: 178823 - DNA, 19 bp, Artificial sequence
  SiRNA target sequence
actggcaattgttaattat

SEQ ID NO: 178824 - DNA, 19 bp, Artificial sequence
  SiRNA target sequence
ctggcaattgttaattatg

SEQ ID NO: 178825 - DNA, 19 bp, Artificial sequence
  SiRNA target sequence
tggcaattgttaattatga

SEQ ID NO: 178826 - DNA, 19 bp, Artificial sequence
  SiRNA target sequence
ggcaattgttaattatgaa

SEQ ID NO: 178827 - DNA, 19 bp, Artificial sequence
  SiRNA target sequence
gcaattgttaattatgaac

SEQ ID NO: 178828 - DNA, 19 bp, Artificial sequence
  SiRNA target sequence
caattgttaattatgaact

SEQ ID NO: 178829 - DNA, 19 bp, Artificial sequence
  SiRNA target sequence
aattgttaattatgaacta

SEQ ID NO: 178830 - DNA, 19 bp, Artificial sequence
  SiRNA target sequence
attgttaattatgaactat

SEQ ID NO: 178831 - DNA, 19 bp, Artificial sequence
  SiRNA target sequence
ttgttaattatgaactatg

SEQ ID NO: 178832 - DNA, 19 bp, Artificial sequence
  SiRNA target sequence
tgttaattatgaactatgt

SEQ ID NO: 178833 - DNA, 19 bp, Artificial sequence
  SiRNA target sequence
gttaattatgaactatgta

SEQ ID NO: 178834 - DNA, 19 bp, Artificial sequence
  SiRNA target sequence
ttaattatgaactatgtaa

SEQ ID NO: 178835 - DNA, 19 bp, Artificial sequence
  SiRNA target sequence
taattatgaactatgtaaa

SEQ ID NO: 178836 - DNA, 19 bp, Artificial sequence
  SiRNA target sequence
aattatgaactatgtaaac

SEQ ID NO: 178837 - DNA, 19 bp, Artificial sequence
  SiRNA target sequence
attatgaactatgtaaacc

SEQ ID NO: 178838 - DNA, 19 bp, Artificial sequence
  SiRNA target sequence
ttatgaactatgtaaaccg

SEQ ID NO: 178839 - DNA, 19 bp, Artificial sequence
  SiRNA target sequence
tatgaactatgtaaaccga

SEQ ID NO: 178840 - DNA, 19 bp, Artificial sequence
  SiRNA target sequence
atgaactatgtaaaccgaa

SEQ ID NO: 178841 - DNA, 19 bp, Artificial sequence
  SiRNA target sequence
tgaactatgtaaaccgaag

SEQ ID NO: 178842 - DNA, 19 bp, Artificial sequence
  SiRNA target sequence
gaactatgtaaaccgaagg

SEQ ID NO: 178843 - DNA, 19 bp, Artificial sequence
  SiRNA target sequence
aactatgtaaaccgaagga

SEQ ID NO: 178844 - DNA, 19 bp, Artificial sequence
  SiRNA target sequence
actatgtaaaccgaaggaa

SEQ ID NO: 178845 - DNA, 19 bp, Artificial sequence
  SiRNA target sequence
ctatgtaaaccgaaggaat

SEQ ID NO: 178846 - DNA, 19 bp, Artificial sequence
  SiRNA target sequence
tatgtaaaccgaaggaatg

SEQ ID NO: 178847 - DNA, 19 bp, Artificial sequence
  SiRNA target sequence
atgtaaaccgaaggaatgt

SEQ ID NO: 178848 - DNA, 19 bp, Artificial sequence
  SiRNA target sequence
tgtaaaccgaaggaatgta

SEQ ID NO: 178849 - DNA, 19 bp, Artificial sequence
  SiRNA target sequence
gtaaaccgaaggaatgtat

SEQ ID NO: 178850 - DNA, 19 bp, Artificial sequence
  SiRNA target sequence
taaaccgaaggaatgtatg

SEQ ID NO: 178851 - DNA, 19 bp, Artificial sequence
  SiRNA target sequence
aaaccgaaggaatgtatgt

SEQ ID NO: 178852 - DNA, 19 bp, Artificial sequence
  SiRNA target sequence
aaccgaaggaatgtatgtc

SEQ ID NO: 178853 - DNA, 19 bp, Artificial sequence
  SiRNA target sequence
accgaaggaatgtatgtca

SEQ ID NO: 178854 - DNA, 19 bp, Artificial sequence
  SiRNA target sequence
ccgaaggaatgtatgtcag

SEQ ID NO: 178855 - DNA, 19 bp, Artificial sequence
  SiRNA target sequence
cgaaggaatgtatgtcaga

SEQ ID NO: 178856 - DNA, 19 bp, Artificial sequence
  SiRNA target sequence
gaaggaatgtatgtcagaa

SEQ ID NO: 178857 - DNA, 19 bp, Artificial sequence
  SiRNA target sequence
aaggaatgtatgtcagaat

SEQ ID NO: 178858 - DNA, 19 bp, Artificial sequence
  SiRNA target sequence
aggaatgtatgtcagaatg

SEQ ID NO: 178859 - DNA, 19 bp, Artificial sequence
  SiRNA target sequence
ggaatgtatgtcagaatgt

SEQ ID NO: 178860 - DNA, 19 bp, Artificial sequence
  SiRNA target sequence
gaatgtatgtcagaatgta

SEQ ID NO: 178861 - DNA, 19 bp, Artificial sequence
  SiRNA target sequence
aatgtatgtcagaatgtaa

SEQ ID NO: 178862 - DNA, 19 bp, Artificial sequence
  SiRNA target sequence
atgtatgtcagaatgtaaa

SEQ ID NO: 178863 - DNA, 19 bp, Artificial sequence
  SiRNA target sequence
tgtatgtcagaatgtaaaa

SEQ ID NO: 178864 - DNA, 19 bp, Artificial sequence
  SiRNA target sequence
gtatgtcagaatgtaaaaa

SEQ ID NO: 178865 - DNA, 19 bp, Artificial sequence
  SiRNA target sequence
tatgtcagaatgtaaaaag

SEQ ID NO: 178866 - DNA, 19 bp, Artificial sequence
  SiRNA target sequence
atgtcagaatgtaaaaagg

SEQ ID NO: 178867 - DNA, 19 bp, Artificial sequence
  SiRNA target sequence
tgtcagaatgtaaaaaggc

SEQ ID NO: 178868 - DNA, 19 bp, Artificial sequence
  SiRNA target sequence
gtcagaatgtaaaaaggcg

SEQ ID NO: 178869 - DNA, 19 bp, Artificial sequence
  SiRNA target sequence
tcagaatgtaaaaaggcgt

SEQ ID NO: 178870 - DNA, 19 bp, Artificial sequence
  SiRNA target sequence
cagaatgtaaaaaggcgtg

SEQ ID NO: 178871 - DNA, 19 bp, Artificial sequence
  SiRNA target sequence
agaatgtaaaaaggcgtgt

SEQ ID NO: 178872 - DNA, 19 bp, Artificial sequence
  SiRNA target sequence
gaatgtaaaaaggcgtgtc

SEQ ID NO: 178873 - DNA, 19 bp, Artificial sequence
  SiRNA target sequence
aatgtaaaaaggcgtgtcc

SEQ ID NO: 178874 - DNA, 19 bp, Artificial sequence
  SiRNA target sequence
atgtaaaaaggcgtgtcct

SEQ ID NO: 178875 - DNA, 19 bp, Artificial sequence
  SiRNA target sequence
tgtaaaaaggcgtgtcctg

SEQ ID NO: 178876 - DNA, 19 bp, Artificial sequence
  SiRNA target sequence
gtaaaaaggcgtgtcctgt

SEQ ID NO: 178877 - DNA, 19 bp, Artificial sequence
  SiRNA target sequence
taaaaaggcgtgtcctgtt

SEQ ID NO: 178878 - DNA, 19 bp, Artificial sequence
  SiRNA target sequence
aaaaaggcgtgtcctgtta

SEQ ID NO: 178879 - DNA, 19 bp, Artificial sequence
  SiRNA target sequence
aaaaggcgtgtcctgttaa

SEQ ID NO: 178880 - DNA, 19 bp, Artificial sequence
  SiRNA target sequence
aaaggcgtgtcctgttaat

SEQ ID NO: 178881 - DNA, 19 bp, Artificial sequence
  SiRNA target sequence
aaggcgtgtcctgttaata

SEQ ID NO: 178882 - DNA, 19 bp, Artificial sequence
  SiRNA target sequence
aggcgtgtcctgttaataa

SEQ ID NO: 178883 - DNA, 19 bp, Artificial sequence
  SiRNA target sequence
ggcgtgtcctgttaataaa

SEQ ID NO: 178884 - DNA, 19 bp, Artificial sequence
  SiRNA target sequence
gcgtgtcctgttaataaaa

SEQ ID NO: 178885 - DNA, 19 bp, Artificial sequence
  SiRNA target sequence
cgtgtcctgttaataaaac

SEQ ID NO: 178886 - DNA, 19 bp, Artificial sequence
  SiRNA target sequence
gtgtcctgttaataaaaca

SEQ ID NO: 178887 - DNA, 19 bp, Artificial sequence
  SiRNA target sequence
tgtcctgttaataaaacag

SEQ ID NO: 178888 - DNA, 19 bp, Artificial sequence
  SiRNA target sequence
gtcctgttaataaaacagg

SEQ ID NO: 178889 - DNA, 19 bp, Artificial sequence
  SiRNA target sequence
tcctgttaataaaacagga

SEQ ID NO: 178890 - DNA, 19 bp, Artificial sequence
  SiRNA target sequence
cctgttaataaaacaggaa

SEQ ID NO: 178891 - DNA, 19 bp, Artificial sequence
  SiRNA target sequence
ctgttaataaaacaggaaa

SEQ ID NO: 178892 - DNA, 19 bp, Artificial sequence
  SiRNA target sequence
tgttaataaaacaggaaag

SEQ ID NO: 178893 - DNA, 19 bp, Artificial sequence
  SiRNA target sequence
gttaataaaacaggaaagg

SEQ ID NO: 178894 - DNA, 19 bp, Artificial sequence
  SiRNA target sequence
ttaataaaacaggaaagga

SEQ ID NO: 178895 - DNA, 19 bp, Artificial sequence
  SiRNA target sequence
taataaaacaggaaaggag

SEQ ID NO: 178896 - DNA, 19 bp, Artificial sequence
  SiRNA target sequence
aataaaacaggaaaggagt

SEQ ID NO: 178897 - DNA, 19 bp, Artificial sequence
  SiRNA target sequence
ataaaacaggaaaggagtg

SEQ ID NO: 178898 - DNA, 19 bp, Artificial sequence
  SiRNA target sequence
taaaacaggaaaggagtgt

SEQ ID NO: 178899 - DNA, 19 bp, Artificial sequence
  SiRNA target sequence
aaaacaggaaaggagtgta

SEQ ID NO: 178900 - DNA, 19 bp, Artificial sequence
  SiRNA target sequence
aaacaggaaaggagtgtat

SEQ ID NO: 178901 - DNA, 19 bp, Artificial sequence
  SiRNA target sequence
aacaggaaaggagtgtatt

SEQ ID NO: 178902 - DNA, 19 bp, Artificial sequence
  SiRNA target sequence
acaggaaaggagtgtatta

SEQ ID NO: 178903 - DNA, 19 bp, Artificial sequence
  SiRNA target sequence
caggaaaggagtgtattac

SEQ ID NO: 178904 - DNA, 19 bp, Artificial sequence
  SiRNA target sequence
aggaaaggagtgtattaca

SEQ ID NO: 178905 - DNA, 19 bp, Artificial sequence
  SiRNA target sequence
ggaaaggagtgtattacaa

SEQ ID NO: 178906 - DNA, 19 bp, Artificial sequence
  SiRNA target sequence
gaaaggagtgtattacaat

SEQ ID NO: 178907 - DNA, 19 bp, Artificial sequence
  SiRNA target sequence
aaaggagtgtattacaatt

SEQ ID NO: 178908 - DNA, 19 bp, Artificial sequence
  SiRNA target sequence
aaggagtgtattacaattg

SEQ ID NO: 178909 - DNA, 19 bp, Artificial sequence
  SiRNA target sequence
aggagtgtattacaattga

SEQ ID NO: 178910 - DNA, 19 bp, Artificial sequence
  SiRNA target sequence
ggagtgtattacaattgat

SEQ ID NO: 178911 - DNA, 19 bp, Artificial sequence
  SiRNA target sequence
gagtgtattacaattgata

SEQ ID NO: 178912 - DNA, 19 bp, Artificial sequence
  SiRNA target sequence
agtgtattacaattgatac

SEQ ID NO: 178913 - DNA, 19 bp, Artificial sequence
  SiRNA target sequence
gtgtattacaattgatact

SEQ ID NO: 178914 - DNA, 19 bp, Artificial sequence
  SiRNA target sequence
tgtattacaattgatacta

SEQ ID NO: 178915 - DNA, 19 bp, Artificial sequence
  SiRNA target sequence
gtattacaattgatactaa

SEQ ID NO: 178916 - DNA, 19 bp, Artificial sequence
  SiRNA target sequence
tattacaattgatactaaa

SEQ ID NO: 178917 - DNA, 19 bp, Artificial sequence
  SiRNA target sequence
attacaattgatactaaat

SEQ ID NO: 178918 - DNA, 19 bp, Artificial sequence
  SiRNA target sequence
ttacaattgatactaaatc

SEQ ID NO: 178919 - DNA, 19 bp, Artificial sequence
  SiRNA target sequence
tacaattgatactaaatca

SEQ ID NO: 178920 - DNA, 19 bp, Artificial sequence
  SiRNA target sequence
acaattgatactaaatcac

SEQ ID NO: 178921 - DNA, 19 bp, Artificial sequence
  SiRNA target sequence
caattgatactaaatcaca

SEQ ID NO: 178922 - DNA, 19 bp, Artificial sequence
  SiRNA target sequence
aattgatactaaatcacat

SEQ ID NO: 178923 - DNA, 19 bp, Artificial sequence
  SiRNA target sequence
attgatactaaatcacata

SEQ ID NO: 178924 - DNA, 19 bp, Artificial sequence
  SiRNA target sequence
ttgatactaaatcacatat

SEQ ID NO: 178925 - DNA, 19 bp, Artificial sequence
  SiRNA target sequence
tgatactaaatcacatatc

SEQ ID NO: 178926 - DNA, 19 bp, Artificial sequence
  SiRNA target sequence
gatactaaatcacatatct

SEQ ID NO: 178927 - DNA, 19 bp, Artificial sequence
  SiRNA target sequence
atactaaatcacatatctc

SEQ ID NO: 178928 - DNA, 19 bp, Artificial sequence
  SiRNA target sequence
tactaaatcacatatctca

SEQ ID NO: 178929 - DNA, 19 bp, Artificial sequence
  SiRNA target sequence
actaaatcacatatctcag

SEQ ID NO: 178930 - DNA, 19 bp, Artificial sequence
  SiRNA target sequence
ctaaatcacatatctcaga

SEQ ID NO: 178931 - DNA, 19 bp, Artificial sequence
  SiRNA target sequence
taaatcacatatctcagaa

SEQ ID NO: 178932 - DNA, 19 bp, Artificial sequence
  SiRNA target sequence
aaatcacatatctcagaaa

SEQ ID NO: 178933 - DNA, 19 bp, Artificial sequence
  SiRNA target sequence
aatcacatatctcagaaat

SEQ ID NO: 178934 - DNA, 19 bp, Artificial sequence
  SiRNA target sequence
atcacatatctcagaaatt

SEQ ID NO: 178935 - DNA, 19 bp, Artificial sequence
  SiRNA target sequence
tcacatatctcagaaattc

SEQ ID NO: 178936 - DNA, 19 bp, Artificial sequence
  SiRNA target sequence
cacatatctcagaaattct

SEQ ID NO: 178937 - DNA, 19 bp, Artificial sequence
  SiRNA target sequence
acatatctcagaaattctg

SEQ ID NO: 178938 - DNA, 19 bp, Artificial sequence
  SiRNA target sequence
catatctcagaaattctgt

SEQ ID NO: 178939 - DNA, 19 bp, Artificial sequence
  SiRNA target sequence
atatctcagaaattctgtg

SEQ ID NO: 178940 - DNA, 19 bp, Artificial sequence
  SiRNA target sequence
tatctcagaaattctgtgt

SEQ ID NO: 178941 - DNA, 19 bp, Artificial sequence
  SiRNA target sequence
atctcagaaattctgtgta

SEQ ID NO: 178942 - DNA, 19 bp, Artificial sequence
  SiRNA target sequence
tctcagaaattctgtgtat

SEQ ID NO: 178943 - DNA, 19 bp, Artificial sequence
  SiRNA target sequence
ctcagaaattctgtgtata

SEQ ID NO: 178944 - DNA, 19 bp, Artificial sequence
  SiRNA target sequence
tcagaaattctgtgtatag

SEQ ID NO: 178945 - DNA, 19 bp, Artificial sequence
  SiRNA target sequence
cagaaattctgtgtatagg

SEQ ID NO: 178946 - DNA, 19 bp, Artificial sequence
  SiRNA target sequence
agaaattctgtgtatagga

SEQ ID NO: 178947 - DNA, 19 bp, Artificial sequence
  SiRNA target sequence
gaaattctgtgtataggat

SEQ ID NO: 178948 - DNA, 19 bp, Artificial sequence
  SiRNA target sequence
aaattctgtgtataggatg

SEQ ID NO: 178949 - DNA, 19 bp, Artificial sequence
  SiRNA target sequence
aattctgtgtataggatgt

SEQ ID NO: 178950 - DNA, 19 bp, Artificial sequence
  SiRNA target sequence
attctgtgtataggatgtt

SEQ ID NO: 178951 - DNA, 19 bp, Artificial sequence
  SiRNA target sequence
ttctgtgtataggatgttc

SEQ ID NO: 178952 - DNA, 19 bp, Artificial sequence
  SiRNA target sequence
tctgtgtataggatgttct

SEQ ID NO: 178953 - DNA, 19 bp, Artificial sequence
  SiRNA target sequence
ctgtgtataggatgttctg

SEQ ID NO: 178954 - DNA, 19 bp, Artificial sequence
  SiRNA target sequence
tgtgtataggatgttctgc

SEQ ID NO: 178955 - DNA, 19 bp, Artificial sequence
  SiRNA target sequence
gtgtataggatgttctgcg

SEQ ID NO: 178956 - DNA, 19 bp, Artificial sequence
  SiRNA target sequence
tgtataggatgttctgcgt

SEQ ID NO: 178957 - DNA, 19 bp, Artificial sequence
  SiRNA target sequence
gtataggatgttctgcgtg

SEQ ID NO: 178958 - DNA, 19 bp, Artificial sequence
  SiRNA target sequence
tataggatgttctgcgtgt

SEQ ID NO: 178959 - DNA, 19 bp, Artificial sequence
  SiRNA target sequence
ataggatgttctgcgtgtc

SEQ ID NO: 178960 - DNA, 19 bp, Artificial sequence
  SiRNA target sequence
taggatgttctgcgtgtca

SEQ ID NO: 178961 - DNA, 19 bp, Artificial sequence
  SiRNA target sequence
aggatgttctgcgtgtcaa

SEQ ID NO: 178962 - DNA, 19 bp, Artificial sequence
  SiRNA target sequence
ggatgttctgcgtgtcaaa

SEQ ID NO: 178963 - DNA, 19 bp, Artificial sequence
  SiRNA target sequence
gatgttctgcgtgtcaaaa

SEQ ID NO: 178964 - DNA, 19 bp, Artificial sequence
  SiRNA target sequence
atgttctgcgtgtcaaaag

SEQ ID NO: 178965 - DNA, 19 bp, Artificial sequence
  SiRNA target sequence
tgttctgcgtgtcaaaaga

SEQ ID NO: 178966 - DNA, 19 bp, Artificial sequence
  SiRNA target sequence
gttctgcgtgtcaaaagaa

SEQ ID NO: 178967 - DNA, 19 bp, Artificial sequence
  SiRNA target sequence
ttctgcgtgtcaaaagaaa

SEQ ID NO: 178968 - DNA, 19 bp, Artificial sequence
  SiRNA target sequence
tctgcgtgtcaaaagaaat

SEQ ID NO: 178969 - DNA, 19 bp, Artificial sequence
  SiRNA target sequence
ctgcgtgtcaaaagaaatg

SEQ ID NO: 178970 - DNA, 19 bp, Artificial sequence
  SiRNA target sequence
tgcgtgtcaaaagaaatgt

SEQ ID NO: 178971 - DNA, 19 bp, Artificial sequence
  SiRNA target sequence
gcgtgtcaaaagaaatgtc

SEQ ID NO: 178972 - DNA, 19 bp, Artificial sequence
  SiRNA target sequence
cgtgtcaaaagaaatgtcc

SEQ ID NO: 178973 - DNA, 19 bp, Artificial sequence
  SiRNA target sequence
gtgtcaaaagaaatgtcct

SEQ ID NO: 178974 - DNA, 19 bp, Artificial sequence
  SiRNA target sequence
tgtcaaaagaaatgtcctt

SEQ ID NO: 178975 - DNA, 19 bp, Artificial sequence
  SiRNA target sequence
gtcaaaagaaatgtccttt

SEQ ID NO: 178976 - DNA, 19 bp, Artificial sequence
  SiRNA target sequence
tcaaaagaaatgtcctttt

SEQ ID NO: 178977 - DNA, 19 bp, Artificial sequence
  SiRNA target sequence
caaaagaaatgtcctttta

SEQ ID NO: 178978 - DNA, 19 bp, Artificial sequence
  SiRNA target sequence
aaaagaaatgtccttttaa

SEQ ID NO: 178979 - DNA, 19 bp, Artificial sequence
  SiRNA target sequence
aaagaaatgtccttttaag

SEQ ID NO: 178980 - DNA, 19 bp, Artificial sequence
  SiRNA target sequence
aagaaatgtccttttaagg

SEQ ID NO: 178981 - DNA, 19 bp, Artificial sequence
  SiRNA target sequence
agaaatgtccttttaaggc

SEQ ID NO: 178982 - DNA, 19 bp, Artificial sequence
  SiRNA target sequence
gaaatgtccttttaaggcg

SEQ ID NO: 178983 - DNA, 19 bp, Artificial sequence
  SiRNA target sequence
aaatgtccttttaaggcga

SEQ ID NO: 178984 - DNA, 19 bp, Artificial sequence
  SiRNA target sequence
aatgtccttttaaggcgat

SEQ ID NO: 178985 - DNA, 19 bp, Artificial sequence
  SiRNA target sequence
atgtccttttaaggcgatt

SEQ ID NO: 178986 - DNA, 19 bp, Artificial sequence
  SiRNA target sequence
tgtccttttaaggcgatta

SEQ ID NO: 178987 - DNA, 19 bp, Artificial sequence
  SiRNA target sequence
gtccttttaaggcgattac

SEQ ID NO: 178988 - DNA, 19 bp, Artificial sequence
  SiRNA target sequence
tccttttaaggcgattaca

SEQ ID NO: 178989 - DNA, 19 bp, Artificial sequence
  SiRNA target sequence
ccttttaaggcgattacaa

SEQ ID NO: 178990 - DNA, 19 bp, Artificial sequence
  SiRNA target sequence
cttttaaggcgattacaat

SEQ ID NO: 178991 - DNA, 19 bp, Artificial sequence
  SiRNA target sequence
ttttaaggcgattacaatt

SEQ ID NO: 178992 - DNA, 19 bp, Artificial sequence
  SiRNA target sequence
tttaaggcgattacaattg

SEQ ID NO: 178993 - DNA, 19 bp, Artificial sequence
  SiRNA target sequence
ttaaggcgattacaattgt

SEQ ID NO: 178994 - DNA, 19 bp, Artificial sequence
  SiRNA target sequence
taaggcgattacaattgta

SEQ ID NO: 178995 - DNA, 19 bp, Artificial sequence
  SiRNA target sequence
aaggcgattacaattgtaa

SEQ ID NO: 178996 - DNA, 19 bp, Artificial sequence
  SiRNA target sequence
aggcgattacaattgtaaa

SEQ ID NO: 178997 - DNA, 19 bp, Artificial sequence
  SiRNA target sequence
ggcgattacaattgtaaat

SEQ ID NO: 178998 - DNA, 19 bp, Artificial sequence
  SiRNA target sequence
gcgattacaattgtaaatt

SEQ ID NO: 178999 - DNA, 19 bp, Artificial sequence
  SiRNA target sequence
cgattacaattgtaaattt

SEQ ID NO: 179000 - DNA, 19 bp, Artificial sequence
  SiRNA target sequence
gattacaattgtaaattta

SEQ ID NO: 179001 - DNA, 19 bp, Artificial sequence
  SiRNA target sequence
attacaattgtaaatttac

SEQ ID NO: 179002 - DNA, 19 bp, Artificial sequence
  SiRNA target sequence
ttacaattgtaaatttacc

SEQ ID NO: 179003 - DNA, 19 bp, Artificial sequence
  SiRNA target sequence
tacaattgtaaatttacct

SEQ ID NO: 179004 - DNA, 19 bp, Artificial sequence
  SiRNA target sequence
acaattgtaaatttaccta

SEQ ID NO: 179005 - DNA, 19 bp, Artificial sequence
  SiRNA target sequence
caattgtaaatttacctac

SEQ ID NO: 179006 - DNA, 19 bp, Artificial sequence
  SiRNA target sequence
aattgtaaatttacctaca

SEQ ID NO: 179007 - DNA, 19 bp, Artificial sequence
  SiRNA target sequence
attgtaaatttacctacaa

SEQ ID NO: 179008 - DNA, 19 bp, Artificial sequence
  SiRNA target sequence
ttgtaaatttacctacaaa

SEQ ID NO: 179009 - DNA, 19 bp, Artificial sequence
  SiRNA target sequence
tgtaaatttacctacaaat

SEQ ID NO: 179010 - DNA, 19 bp, Artificial sequence
  SiRNA target sequence
gtaaatttacctacaaatc

SEQ ID NO: 179011 - DNA, 19 bp, Artificial sequence
  SiRNA target sequence
taaatttacctacaaatct

SEQ ID NO: 179012 - DNA, 19 bp, Artificial sequence
  SiRNA target sequence
aaatttacctacaaatcta

SEQ ID NO: 179013 - DNA, 19 bp, Artificial sequence
  SiRNA target sequence
aatttacctacaaatctag

SEQ ID NO: 179014 - DNA, 19 bp, Artificial sequence
  SiRNA target sequence
atttacctacaaatctaga

SEQ ID NO: 179015 - DNA, 19 bp, Artificial sequence
  SiRNA target sequence
tttacctacaaatctagat

SEQ ID NO: 179016 - DNA, 19 bp, Artificial sequence
  SiRNA target sequence
ttacctacaaatctagata

SEQ ID NO: 179017 - DNA, 19 bp, Artificial sequence
  SiRNA target sequence
tacctacaaatctagataa

SEQ ID NO: 179018 - DNA, 19 bp, Artificial sequence
  SiRNA target sequence
acctacaaatctagataaa

SEQ ID NO: 179019 - DNA, 19 bp, Artificial sequence
  SiRNA target sequence
cctacaaatctagataaag

SEQ ID NO: 179020 - DNA, 19 bp, Artificial sequence
  SiRNA target sequence
ctacaaatctagataaaga

SEQ ID NO: 179021 - DNA, 19 bp, Artificial sequence
  SiRNA target sequence
tacaaatctagataaagac

SEQ ID NO: 179022 - DNA, 19 bp, Artificial sequence
  SiRNA target sequence
acaaatctagataaagaca

SEQ ID NO: 179023 - DNA, 19 bp, Artificial sequence
  SiRNA target sequence
caaatctagataaagacat

SEQ ID NO: 179024 - DNA, 19 bp, Artificial sequence
  SiRNA target sequence
aaatctagataaagacatt

SEQ ID NO: 179025 - DNA, 19 bp, Artificial sequence
  SiRNA target sequence
aatctagataaagacattt

SEQ ID NO: 179026 - DNA, 19 bp, Artificial sequence
  SiRNA target sequence
atctagataaagacatttc

SEQ ID NO: 179027 - DNA, 19 bp, Artificial sequence
  SiRNA target sequence
tctagataaagacatttca

SEQ ID NO: 179028 - DNA, 19 bp, Artificial sequence
  SiRNA target sequence
ctagataaagacatttcac

SEQ ID NO: 179029 - DNA, 19 bp, Artificial sequence
  SiRNA target sequence
tagataaagacatttcaca

SEQ ID NO: 179030 - DNA, 19 bp, Artificial sequence
  SiRNA target sequence
agataaagacatttcacat

SEQ ID NO: 179031 - DNA, 19 bp, Artificial sequence
  SiRNA target sequence
gataaagacatttcacata

SEQ ID NO: 179032 - DNA, 19 bp, Artificial sequence
  SiRNA target sequence
ataaagacatttcacatag

SEQ ID NO: 179033 - DNA, 19 bp, Artificial sequence
  SiRNA target sequence
taaagacatttcacataga

SEQ ID NO: 179034 - DNA, 19 bp, Artificial sequence
  SiRNA target sequence
aaagacatttcacatagat

SEQ ID NO: 179035 - DNA, 19 bp, Artificial sequence
  SiRNA target sequence
aagacatttcacatagata

SEQ ID NO: 179036 - DNA, 19 bp, Artificial sequence
  SiRNA target sequence
agacatttcacatagatat

SEQ ID NO: 179037 - DNA, 19 bp, Artificial sequence
  SiRNA target sequence
gacatttcacatagatatt

SEQ ID NO: 179038 - DNA, 19 bp, Artificial sequence
  SiRNA target sequence
acatttcacatagatattc

SEQ ID NO: 179039 - DNA, 19 bp, Artificial sequence
  SiRNA target sequence
catttcacatagatattcg

SEQ ID NO: 179040 - DNA, 19 bp, Artificial sequence
  SiRNA target sequence
atttcacatagatattcgg

SEQ ID NO: 179041 - DNA, 19 bp, Artificial sequence
  SiRNA target sequence
tttcacatagatattcggc

SEQ ID NO: 179042 - DNA, 19 bp, Artificial sequence
  SiRNA target sequence
ttcacatagatattcggca

SEQ ID NO: 179043 - DNA, 19 bp, Artificial sequence
  SiRNA target sequence
tcacatagatattcggcaa

SEQ ID NO: 179044 - DNA, 19 bp, Artificial sequence
  SiRNA target sequence
cacatagatattcggcaaa

SEQ ID NO: 179045 - DNA, 19 bp, Artificial sequence
  SiRNA target sequence
acatagatattcggcaaat

SEQ ID NO: 179046 - DNA, 19 bp, Artificial sequence
  SiRNA target sequence
catagatattcggcaaatg

SEQ ID NO: 179047 - DNA, 19 bp, Artificial sequence
  SiRNA target sequence
atagatattcggcaaatgg

SEQ ID NO: 179048 - DNA, 19 bp, Artificial sequence
  SiRNA target sequence
tagatattcggcaaatggt

SEQ ID NO: 179049 - DNA, 19 bp, Artificial sequence
  SiRNA target sequence
agatattcggcaaatggtt

SEQ ID NO: 179050 - DNA, 19 bp, Artificial sequence
  SiRNA target sequence
gatattcggcaaatggttt

SEQ ID NO: 179051 - DNA, 19 bp, Artificial sequence
  SiRNA target sequence
atattcggcaaatggtttt

SEQ ID NO: 179052 - DNA, 19 bp, Artificial sequence
  SiRNA target sequence
tattcggcaaatggtttta

SEQ ID NO: 179053 - DNA, 19 bp, Artificial sequence
  SiRNA target sequence
attcggcaaatggttttaa

SEQ ID NO: 179054 - DNA, 19 bp, Artificial sequence
  SiRNA target sequence
ttcggcaaatggttttaaa

SEQ ID NO: 179055 - DNA, 19 bp, Artificial sequence
  SiRNA target sequence
tcggcaaatggttttaaac

SEQ ID NO: 179056 - DNA, 19 bp, Artificial sequence
  SiRNA target sequence
cggcaaatggttttaaact

SEQ ID NO: 179057 - DNA, 19 bp, Artificial sequence
  SiRNA target sequence
ggcaaatggttttaaactt

SEQ ID NO: 179058 - DNA, 19 bp, Artificial sequence
  SiRNA target sequence
gcaaatggttttaaacttc

SEQ ID NO: 179059 - DNA, 19 bp, Artificial sequence
  SiRNA target sequence
caaatggttttaaacttca

SEQ ID NO: 179060 - DNA, 19 bp, Artificial sequence
  SiRNA target sequence
aaatggttttaaacttcac

SEQ ID NO: 179061 - DNA, 19 bp, Artificial sequence
  SiRNA target sequence
aatggttttaaacttcaca

SEQ ID NO: 179062 - DNA, 19 bp, Artificial sequence
  SiRNA target sequence
atggttttaaacttcacag

SEQ ID NO: 179063 - DNA, 19 bp, Artificial sequence
  SiRNA target sequence
tggttttaaacttcacaga

SEQ ID NO: 179064 - DNA, 19 bp, Artificial sequence
  SiRNA target sequence
ggttttaaacttcacagat

SEQ ID NO: 179065 - DNA, 19 bp, Artificial sequence
  SiRNA target sequence
gttttaaacttcacagatt

SEQ ID NO: 179066 - DNA, 19 bp, Artificial sequence
  SiRNA target sequence
ttttaaacttcacagatta

SEQ ID NO: 179067 - DNA, 19 bp, Artificial sequence
  SiRNA target sequence
tttaaacttcacagattac

SEQ ID NO: 179068 - DNA, 19 bp, Artificial sequence
  SiRNA target sequence
ttaaacttcacagattacc

SEQ ID NO: 179069 - DNA, 19 bp, Artificial sequence
  SiRNA target sequence
taaacttcacagattacca

SEQ ID NO: 179070 - DNA, 19 bp, Artificial sequence
  SiRNA target sequence
aaacttcacagattaccaa

SEQ ID NO: 179071 - DNA, 19 bp, Artificial sequence
  SiRNA target sequence
aacttcacagattaccaat

SEQ ID NO: 179072 - DNA, 19 bp, Artificial sequence
  SiRNA target sequence
acttcacagattaccaatc

SEQ ID NO: 179073 - DNA, 19 bp, Artificial sequence
  SiRNA target sequence
cttcacagattaccaatcc

SEQ ID NO: 179074 - DNA, 19 bp, Artificial sequence
  SiRNA target sequence
ttcacagattaccaatccc

SEQ ID NO: 179075 - DNA, 19 bp, Artificial sequence
  SiRNA target sequence
tcacagattaccaatccct

SEQ ID NO: 179076 - DNA, 19 bp, Artificial sequence
  SiRNA target sequence
cacagattaccaatcccta

SEQ ID NO: 179077 - DNA, 19 bp, Artificial sequence
  SiRNA target sequence
acagattaccaatccctaa

SEQ ID NO: 179078 - DNA, 19 bp, Artificial sequence
  SiRNA target sequence
cagattaccaatccctaaa

SEQ ID NO: 179079 - DNA, 19 bp, Artificial sequence
  SiRNA target sequence
agattaccaatccctaaat

SEQ ID NO: 179080 - DNA, 19 bp, Artificial sequence
  SiRNA target sequence
gattaccaatccctaaata

SEQ ID NO: 179081 - DNA, 19 bp, Artificial sequence
  SiRNA target sequence
attaccaatccctaaatat

SEQ ID NO: 179082 - DNA, 19 bp, Artificial sequence
  SiRNA target sequence
ttaccaatccctaaatatg

SEQ ID NO: 179083 - DNA, 19 bp, Artificial sequence
  SiRNA target sequence
taccaatccctaaatatgg

SEQ ID NO: 179084 - DNA, 19 bp, Artificial sequence
  SiRNA target sequence
accaatccctaaatatggt

SEQ ID NO: 179085 - DNA, 19 bp, Artificial sequence
  SiRNA target sequence
ccaatccctaaatatggta

SEQ ID NO: 179086 - DNA, 19 bp, Artificial sequence
  SiRNA target sequence
caatccctaaatatggtaa

SEQ ID NO: 179087 - DNA, 19 bp, Artificial sequence
  SiRNA target sequence
aatccctaaatatggtaag

SEQ ID NO: 179088 - DNA, 19 bp, Artificial sequence
  SiRNA target sequence
atccctaaatatggtaagg

SEQ ID NO: 179089 - DNA, 19 bp, Artificial sequence
  SiRNA target sequence
tccctaaatatggtaaggt

SEQ ID NO: 179090 - DNA, 19 bp, Artificial sequence
  SiRNA target sequence
ccctaaatatggtaaggtt

SEQ ID NO: 179091 - DNA, 19 bp, Artificial sequence
  SiRNA target sequence
cctaaatatggtaaggttt

SEQ ID NO: 179092 - DNA, 19 bp, Artificial sequence
  SiRNA target sequence
ctaaatatggtaaggtttt

SEQ ID NO: 179093 - DNA, 19 bp, Artificial sequence
  SiRNA target sequence
taaatatggtaaggtttta

SEQ ID NO: 179094 - DNA, 19 bp, Artificial sequence
  SiRNA target sequence
aaatatggtaaggttttag

SEQ ID NO: 179095 - DNA, 19 bp, Artificial sequence
  SiRNA target sequence
aatatggtaaggttttagg

SEQ ID NO: 179096 - DNA, 19 bp, Artificial sequence
  SiRNA target sequence
atatggtaaggttttaggg

SEQ ID NO: 179097 - DNA, 19 bp, Artificial sequence
  SiRNA target sequence
tatggtaaggttttagggc

SEQ ID NO: 179098 - DNA, 19 bp, Artificial sequence
  SiRNA target sequence
atggtaaggttttagggct

SEQ ID NO: 179099 - DNA, 19 bp, Artificial sequence
  SiRNA target sequence
tggtaaggttttagggcta

SEQ ID NO: 179100 - DNA, 19 bp, Artificial sequence
  SiRNA target sequence
ggtaaggttttagggctag

SEQ ID NO: 179101 - DNA, 19 bp, Artificial sequence
  SiRNA target sequence
gtaaggttttagggctagt

SEQ ID NO: 179102 - DNA, 19 bp, Artificial sequence
  SiRNA target sequence
taaggttttagggctagta

SEQ ID NO: 179103 - DNA, 19 bp, Artificial sequence
  SiRNA target sequence
aaggttttagggctagtag

SEQ ID NO: 179104 - DNA, 19 bp, Artificial sequence
  SiRNA target sequence
aggttttagggctagtagg

SEQ ID NO: 179105 - DNA, 19 bp, Artificial sequence
  SiRNA target sequence
ggttttagggctagtaggc

SEQ ID NO: 179106 - DNA, 19 bp, Artificial sequence
  SiRNA target sequence
gttttagggctagtaggca

SEQ ID NO: 179107 - DNA, 19 bp, Artificial sequence
  SiRNA target sequence
ttttagggctagtaggcac

SEQ ID NO: 179108 - DNA, 19 bp, Artificial sequence
  SiRNA target sequence
tttagggctagtaggcact

SEQ ID NO: 179109 - DNA, 19 bp, Artificial sequence
  SiRNA target sequence
ttagggctagtaggcacta

SEQ ID NO: 179110 - DNA, 19 bp, Artificial sequence
  SiRNA target sequence
tagggctagtaggcactaa

SEQ ID NO: 179111 - DNA, 19 bp, Artificial sequence
  SiRNA target sequence
agggctagtaggcactaat

SEQ ID NO: 179112 - DNA, 19 bp, Artificial sequence
  SiRNA target sequence
gggctagtaggcactaatg

SEQ ID NO: 179113 - DNA, 19 bp, Artificial sequence
  SiRNA target sequence
ggctagtaggcactaatgg

SEQ ID NO: 179114 - DNA, 19 bp, Artificial sequence
  SiRNA target sequence
gctagtaggcactaatggt

SEQ ID NO: 179115 - DNA, 19 bp, Artificial sequence
  SiRNA target sequence
ctagtaggcactaatggta

SEQ ID NO: 179116 - DNA, 19 bp, Artificial sequence
  SiRNA target sequence
tagtaggcactaatggtat

SEQ ID NO: 179117 - DNA, 19 bp, Artificial sequence
  SiRNA target sequence
agtaggcactaatggtata

SEQ ID NO: 179118 - DNA, 19 bp, Artificial sequence
  SiRNA target sequence
gtaggcactaatggtatag

SEQ ID NO: 179119 - DNA, 19 bp, Artificial sequence
  SiRNA target sequence
taggcactaatggtatagg

SEQ ID NO: 179120 - DNA, 19 bp, Artificial sequence
  SiRNA target sequence
aggcactaatggtatagga

SEQ ID NO: 179121 - DNA, 19 bp, Artificial sequence
  SiRNA target sequence
ggcactaatggtataggaa

SEQ ID NO: 179122 - DNA, 19 bp, Artificial sequence
  SiRNA target sequence
gcactaatggtataggaaa

SEQ ID NO: 179123 - DNA, 19 bp, Artificial sequence
  SiRNA target sequence
cactaatggtataggaaaa

SEQ ID NO: 179124 - DNA, 19 bp, Artificial sequence
  SiRNA target sequence
actaatggtataggaaaaa

SEQ ID NO: 179125 - DNA, 19 bp, Artificial sequence
  SiRNA target sequence
ctaatggtataggaaaaag

SEQ ID NO: 179126 - DNA, 19 bp, Artificial sequence
  SiRNA target sequence
taatggtataggaaaaagt

SEQ ID NO: 179127 - DNA, 19 bp, Artificial sequence
  SiRNA target sequence
aatggtataggaaaaagta

SEQ ID NO: 179128 - DNA, 19 bp, Artificial sequence
  SiRNA target sequence
atggtataggaaaaagtac

SEQ ID NO: 179129 - DNA, 19 bp, Artificial sequence
  SiRNA target sequence
tggtataggaaaaagtact

SEQ ID NO: 179130 - DNA, 19 bp, Artificial sequence
  SiRNA target sequence
ggtataggaaaaagtactg

SEQ ID NO: 179131 - DNA, 19 bp, Artificial sequence
  SiRNA target sequence
gtataggaaaaagtactgc

SEQ ID NO: 179132 - DNA, 19 bp, Artificial sequence
  SiRNA target sequence
tataggaaaaagtactgca

SEQ ID NO: 179133 - DNA, 19 bp, Artificial sequence
  SiRNA target sequence
ataggaaaaagtactgcac

SEQ ID NO: 179134 - DNA, 19 bp, Artificial sequence
  SiRNA target sequence
taggaaaaagtactgcact

SEQ ID NO: 179135 - DNA, 19 bp, Artificial sequence
  SiRNA target sequence
aggaaaaagtactgcactt

SEQ ID NO: 179136 - DNA, 19 bp, Artificial sequence
  SiRNA target sequence
ggaaaaagtactgcactta

SEQ ID NO: 179137 - DNA, 19 bp, Artificial sequence
  SiRNA target sequence
gaaaaagtactgcacttaa

SEQ ID NO: 179138 - DNA, 19 bp, Artificial sequence
  SiRNA target sequence
aaaaagtactgcacttaaa

SEQ ID NO: 179139 - DNA, 19 bp, Artificial sequence
  SiRNA target sequence
aaaagtactgcacttaaaa

SEQ ID NO: 179140 - DNA, 19 bp, Artificial sequence
  SiRNA target sequence
aaagtactgcacttaaaat

SEQ ID NO: 179141 - DNA, 19 bp, Artificial sequence
  SiRNA target sequence
aagtactgcacttaaaata

SEQ ID NO: 179142 - DNA, 19 bp, Artificial sequence
  SiRNA target sequence
agtactgcacttaaaatat

SEQ ID NO: 179143 - DNA, 19 bp, Artificial sequence
  SiRNA target sequence
gtactgcacttaaaatatt

SEQ ID NO: 179144 - DNA, 19 bp, Artificial sequence
  SiRNA target sequence
tactgcacttaaaatatta

SEQ ID NO: 179145 - DNA, 19 bp, Artificial sequence
  SiRNA target sequence
actgcacttaaaatattat

SEQ ID NO: 179146 - DNA, 19 bp, Artificial sequence
  SiRNA target sequence
ctgcacttaaaatattatc

SEQ ID NO: 179147 - DNA, 19 bp, Artificial sequence
  SiRNA target sequence
tgcacttaaaatattatcg

SEQ ID NO: 179148 - DNA, 19 bp, Artificial sequence
  SiRNA target sequence
gcacttaaaatattatcgg

SEQ ID NO: 179149 - DNA, 19 bp, Artificial sequence
  SiRNA target sequence
cacttaaaatattatcggg

SEQ ID NO: 179150 - DNA, 19 bp, Artificial sequence
  SiRNA target sequence
acttaaaatattatcgggc

SEQ ID NO: 179151 - DNA, 19 bp, Artificial sequence
  SiRNA target sequence
cttaaaatattatcgggca

SEQ ID NO: 179152 - DNA, 19 bp, Artificial sequence
  SiRNA target sequence
ttaaaatattatcgggcaa

SEQ ID NO: 179153 - DNA, 19 bp, Artificial sequence
  SiRNA target sequence
taaaatattatcgggcaat

SEQ ID NO: 179154 - DNA, 19 bp, Artificial sequence
  SiRNA target sequence
aaaatattatcgggcaatc

SEQ ID NO: 179155 - DNA, 19 bp, Artificial sequence
  SiRNA target sequence
aaatattatcgggcaatct

SEQ ID NO: 179156 - DNA, 19 bp, Artificial sequence
  SiRNA target sequence
aatattatcgggcaatctt

SEQ ID NO: 179157 - DNA, 19 bp, Artificial sequence
  SiRNA target sequence
atattatcgggcaatctta

SEQ ID NO: 179158 - DNA, 19 bp, Artificial sequence
  SiRNA target sequence
tattatcgggcaatcttaa

SEQ ID NO: 179159 - DNA, 19 bp, Artificial sequence
  SiRNA target sequence
attatcgggcaatcttaaa

SEQ ID NO: 179160 - DNA, 19 bp, Artificial sequence
  SiRNA target sequence
ttatcgggcaatcttaaac

SEQ ID NO: 179161 - DNA, 19 bp, Artificial sequence
  SiRNA target sequence
tatcgggcaatcttaaacc

SEQ ID NO: 179162 - DNA, 19 bp, Artificial sequence
  SiRNA target sequence
atcgggcaatcttaaacca

SEQ ID NO: 179163 - DNA, 19 bp, Artificial sequence
  SiRNA target sequence
tcgggcaatcttaaaccaa

SEQ ID NO: 179164 - DNA, 19 bp, Artificial sequence
  SiRNA target sequence
cgggcaatcttaaaccaaa

SEQ ID NO: 179165 - DNA, 19 bp, Artificial sequence
  SiRNA target sequence
gggcaatcttaaaccaaac

SEQ ID NO: 179166 - DNA, 19 bp, Artificial sequence
  SiRNA target sequence
ggcaatcttaaaccaaact

SEQ ID NO: 179167 - DNA, 19 bp, Artificial sequence
  SiRNA target sequence
gcaatcttaaaccaaactt

SEQ ID NO: 179168 - DNA, 19 bp, Artificial sequence
  SiRNA target sequence
caatcttaaaccaaactta

SEQ ID NO: 179169 - DNA, 19 bp, Artificial sequence
  SiRNA target sequence
aatcttaaaccaaacttag

SEQ ID NO: 179170 - DNA, 19 bp, Artificial sequence
  SiRNA target sequence
atcttaaaccaaacttagg

SEQ ID NO: 179171 - DNA, 19 bp, Artificial sequence
  SiRNA target sequence
tcttaaaccaaacttagga

SEQ ID NO: 179172 - DNA, 19 bp, Artificial sequence
  SiRNA target sequence
cttaaaccaaacttaggaa

SEQ ID NO: 179173 - DNA, 19 bp, Artificial sequence
  SiRNA target sequence
ttaaaccaaacttaggaaa

SEQ ID NO: 179174 - DNA, 19 bp, Artificial sequence
  SiRNA target sequence
taaaccaaacttaggaaag

SEQ ID NO: 179175 - DNA, 19 bp, Artificial sequence
  SiRNA target sequence
aaaccaaacttaggaaagt

SEQ ID NO: 179176 - DNA, 19 bp, Artificial sequence
  SiRNA target sequence
aaccaaacttaggaaagtt

SEQ ID NO: 179177 - DNA, 19 bp, Artificial sequence
  SiRNA target sequence
accaaacttaggaaagttc

SEQ ID NO: 179178 - DNA, 19 bp, Artificial sequence
  SiRNA target sequence
ccaaacttaggaaagttcg

SEQ ID NO: 179179 - DNA, 19 bp, Artificial sequence
  SiRNA target sequence
caaacttaggaaagttcga

SEQ ID NO: 179180 - DNA, 19 bp, Artificial sequence
  SiRNA target sequence
aaacttaggaaagttcgac

SEQ ID NO: 179181 - DNA, 19 bp, Artificial sequence
  SiRNA target sequence
aacttaggaaagttcgacg

SEQ ID NO: 179182 - DNA, 19 bp, Artificial sequence
  SiRNA target sequence
acttaggaaagttcgacgt

SEQ ID NO: 179183 - DNA, 19 bp, Artificial sequence
  SiRNA target sequence
cttaggaaagttcgacgtt

SEQ ID NO: 179184 - DNA, 19 bp, Artificial sequence
  SiRNA target sequence
ttaggaaagttcgacgtta

SEQ ID NO: 179185 - DNA, 19 bp, Artificial sequence
  SiRNA target sequence
taggaaagttcgacgttac

SEQ ID NO: 179186 - DNA, 19 bp, Artificial sequence
  SiRNA target sequence
aggaaagttcgacgttacg

SEQ ID NO: 179187 - DNA, 19 bp, Artificial sequence
  SiRNA target sequence
ggaaagttcgacgttacgc

SEQ ID NO: 179188 - DNA, 19 bp, Artificial sequence
  SiRNA target sequence
gaaagttcgacgttacgcc

SEQ ID NO: 179189 - DNA, 19 bp, Artificial sequence
  SiRNA target sequence
aaagttcgacgttacgccc

SEQ ID NO: 179190 - DNA, 19 bp, Artificial sequence
  SiRNA target sequence
aagttcgacgttacgcccg

SEQ ID NO: 179191 - DNA, 19 bp, Artificial sequence
  SiRNA target sequence
agttcgacgttacgcccga

SEQ ID NO: 179192 - DNA, 19 bp, Artificial sequence
  SiRNA target sequence
gttcgacgttacgcccgac

SEQ ID NO: 179193 - DNA, 19 bp, Artificial sequence
  SiRNA target sequence
ttcgacgttacgcccgact

SEQ ID NO: 179194 - DNA, 19 bp, Artificial sequence
  SiRNA target sequence
tcgacgttacgcccgactg

SEQ ID NO: 179195 - DNA, 19 bp, Artificial sequence
  SiRNA target sequence
cgacgttacgcccgactgg

SEQ ID NO: 179196 - DNA, 19 bp, Artificial sequence
  SiRNA target sequence
gacgttacgcccgactggg

SEQ ID NO: 179197 - DNA, 19 bp, Artificial sequence
  SiRNA target sequence
acgttacgcccgactgggc

SEQ ID NO: 179198 - DNA, 19 bp, Artificial sequence
  SiRNA target sequence
cgttacgcccgactgggca

SEQ ID NO: 179199 - DNA, 19 bp, Artificial sequence
  SiRNA target sequence
gttacgcccgactgggcag

SEQ ID NO: 179200 - DNA, 19 bp, Artificial sequence
  SiRNA target sequence
ttacgcccgactgggcagc

SEQ ID NO: 179201 - DNA, 19 bp, Artificial sequence
  SiRNA target sequence
tacgcccgactgggcagca

SEQ ID NO: 179202 - DNA, 19 bp, Artificial sequence
  SiRNA target sequence
acgcccgactgggcagcaa

SEQ ID NO: 179203 - DNA, 19 bp, Artificial sequence
  SiRNA target sequence
cgcccgactgggcagcaat

SEQ ID NO: 179204 - DNA, 19 bp, Artificial sequence
  SiRNA target sequence
gcccgactgggcagcaatt

SEQ ID NO: 179205 - DNA, 19 bp, Artificial sequence
  SiRNA target sequence
cccgactgggcagcaattc

SEQ ID NO: 179206 - DNA, 19 bp, Artificial sequence
  SiRNA target sequence
ccgactgggcagcaattct

SEQ ID NO: 179207 - DNA, 19 bp, Artificial sequence
  SiRNA target sequence
cgactgggcagcaattcta

SEQ ID NO: 179208 - DNA, 19 bp, Artificial sequence
  SiRNA target sequence
gactgggcagcaattctaa

SEQ ID NO: 179209 - DNA, 19 bp, Artificial sequence
  SiRNA target sequence
actgggcagcaattctaaa

SEQ ID NO: 179210 - DNA, 19 bp, Artificial sequence
  SiRNA target sequence
ctgggcagcaattctaaat

SEQ ID NO: 179211 - DNA, 19 bp, Artificial sequence
  SiRNA target sequence
tgggcagcaattctaaata

SEQ ID NO: 179212 - DNA, 19 bp, Artificial sequence
  SiRNA target sequence
gggcagcaattctaaataa

SEQ ID NO: 179213 - DNA, 19 bp, Artificial sequence
  SiRNA target sequence
ggcagcaattctaaataat

SEQ ID NO: 179214 - DNA, 19 bp, Artificial sequence
  SiRNA target sequence
gcagcaattctaaataatt

SEQ ID NO: 179215 - DNA, 19 bp, Artificial sequence
  SiRNA target sequence
cagcaattctaaataatta

SEQ ID NO: 179216 - DNA, 19 bp, Artificial sequence
  SiRNA target sequence
agcaattctaaataattat

SEQ ID NO: 179217 - DNA, 19 bp, Artificial sequence
  SiRNA target sequence
gcaattctaaataattata

SEQ ID NO: 179218 - DNA, 19 bp, Artificial sequence
  SiRNA target sequence
caattctaaataattataa

SEQ ID NO: 179219 - DNA, 19 bp, Artificial sequence
  SiRNA target sequence
aattctaaataattataaa

SEQ ID NO: 179220 - DNA, 19 bp, Artificial sequence
  SiRNA target sequence
attctaaataattataaag

SEQ ID NO: 179221 - DNA, 19 bp, Artificial sequence
  SiRNA target sequence
ttctaaataattataaagg

SEQ ID NO: 179222 - DNA, 19 bp, Artificial sequence
  SiRNA target sequence
tctaaataattataaagga

SEQ ID NO: 179223 - DNA, 19 bp, Artificial sequence
  SiRNA target sequence
ctaaataattataaaggat

SEQ ID NO: 179224 - DNA, 19 bp, Artificial sequence
  SiRNA target sequence
taaataattataaaggatc

SEQ ID NO: 179225 - DNA, 19 bp, Artificial sequence
  SiRNA target sequence
aaataattataaaggatct

SEQ ID NO: 179226 - DNA, 19 bp, Artificial sequence
  SiRNA target sequence
aataattataaaggatctg

SEQ ID NO: 179227 - DNA, 19 bp, Artificial sequence
  SiRNA target sequence
ataattataaaggatctga

SEQ ID NO: 179228 - DNA, 19 bp, Artificial sequence
  SiRNA target sequence
taattataaaggatctgaa

SEQ ID NO: 179229 - DNA, 19 bp, Artificial sequence
  SiRNA target sequence
aattataaaggatctgaac

SEQ ID NO: 179230 - DNA, 19 bp, Artificial sequence
  SiRNA target sequence
attataaaggatctgaact

SEQ ID NO: 179231 - DNA, 19 bp, Artificial sequence
  SiRNA target sequence
ttataaaggatctgaactt

SEQ ID NO: 179232 - DNA, 19 bp, Artificial sequence
  SiRNA target sequence
tataaaggatctgaacttc

SEQ ID NO: 179233 - DNA, 19 bp, Artificial sequence
  SiRNA target sequence
ataaaggatctgaacttca

SEQ ID NO: 179234 - DNA, 19 bp, Artificial sequence
  SiRNA target sequence
taaaggatctgaacttcat

SEQ ID NO: 179235 - DNA, 19 bp, Artificial sequence
  SiRNA target sequence
aaaggatctgaacttcatg

SEQ ID NO: 179236 - DNA, 19 bp, Artificial sequence
  SiRNA target sequence
aaggatctgaacttcatgg

SEQ ID NO: 179237 - DNA, 19 bp, Artificial sequence
  SiRNA target sequence
aggatctgaacttcatgga

SEQ ID NO: 179238 - DNA, 19 bp, Artificial sequence
  SiRNA target sequence
ggatctgaacttcatggat

SEQ ID NO: 179239 - DNA, 19 bp, Artificial sequence
  SiRNA target sequence
gatctgaacttcatggatt

SEQ ID NO: 179240 - DNA, 19 bp, Artificial sequence
  SiRNA target sequence
atctgaacttcatggattt

SEQ ID NO: 179241 - DNA, 19 bp, Artificial sequence
  SiRNA target sequence
tctgaacttcatggatttt

SEQ ID NO: 179242 - DNA, 19 bp, Artificial sequence
  SiRNA target sequence
ctgaacttcatggattttt

SEQ ID NO: 179243 - DNA, 19 bp, Artificial sequence
  SiRNA target sequence
tgaacttcatggatttttt

SEQ ID NO: 179244 - DNA, 19 bp, Artificial sequence
  SiRNA target sequence
gaacttcatggatttttta

SEQ ID NO: 179245 - DNA, 19 bp, Artificial sequence
  SiRNA target sequence
aacttcatggattttttac

SEQ ID NO: 179246 - DNA, 19 bp, Artificial sequence
  SiRNA target sequence
acttcatggattttttact

SEQ ID NO: 179247 - DNA, 19 bp, Artificial sequence
  SiRNA target sequence
cttcatggattttttacta

SEQ ID NO: 179248 - DNA, 19 bp, Artificial sequence
  SiRNA target sequence
ttcatggattttttactaa

SEQ ID NO: 179249 - DNA, 19 bp, Artificial sequence
  SiRNA target sequence
tcatggattttttactaaa

SEQ ID NO: 179250 - DNA, 19 bp, Artificial sequence
  SiRNA target sequence
catggattttttactaaaa

SEQ ID NO: 179251 - DNA, 19 bp, Artificial sequence
  SiRNA target sequence
atggattttttactaaaat

SEQ ID NO: 179252 - DNA, 19 bp, Artificial sequence
  SiRNA target sequence
tggattttttactaaaatt

SEQ ID NO: 179253 - DNA, 19 bp, Artificial sequence
  SiRNA target sequence
ggattttttactaaaattt

SEQ ID NO: 179254 - DNA, 19 bp, Artificial sequence
  SiRNA target sequence
gattttttactaaaatttt

SEQ ID NO: 179255 - DNA, 19 bp, Artificial sequence
  SiRNA target sequence
attttttactaaaatttta

SEQ ID NO: 179256 - DNA, 19 bp, Artificial sequence
  SiRNA target sequence
ttttttactaaaattttag

SEQ ID NO: 179257 - DNA, 19 bp, Artificial sequence
  SiRNA target sequence
tttttactaaaattttaga

SEQ ID NO: 179258 - DNA, 19 bp, Artificial sequence
  SiRNA target sequence
ttttactaaaattttagaa

SEQ ID NO: 179259 - DNA, 19 bp, Artificial sequence
  SiRNA target sequence
tttactaaaattttagaag

SEQ ID NO: 179260 - DNA, 19 bp, Artificial sequence
  SiRNA target sequence
ttactaaaattttagaagg

SEQ ID NO: 179261 - DNA, 19 bp, Artificial sequence
  SiRNA target sequence
tactaaaattttagaaggg

SEQ ID NO: 179262 - DNA, 19 bp, Artificial sequence
  SiRNA target sequence
actaaaattttagaagggt

SEQ ID NO: 179263 - DNA, 19 bp, Artificial sequence
  SiRNA target sequence
ctaaaattttagaagggtc

SEQ ID NO: 179264 - DNA, 19 bp, Artificial sequence
  SiRNA target sequence
taaaattttagaagggtct

SEQ ID NO: 179265 - DNA, 19 bp, Artificial sequence
  SiRNA target sequence
aaaattttagaagggtcta

SEQ ID NO: 179266 - DNA, 19 bp, Artificial sequence
  SiRNA target sequence
aaattttagaagggtctat

SEQ ID NO: 179267 - DNA, 19 bp, Artificial sequence
  SiRNA target sequence
aattttagaagggtctatt

SEQ ID NO: 179268 - DNA, 19 bp, Artificial sequence
  SiRNA target sequence
attttagaagggtctatta

SEQ ID NO: 179269 - DNA, 19 bp, Artificial sequence
  SiRNA target sequence
ttttagaagggtctattaa

SEQ ID NO: 179270 - DNA, 19 bp, Artificial sequence
  SiRNA target sequence
tttagaagggtctattaaa

SEQ ID NO: 179271 - DNA, 19 bp, Artificial sequence
  SiRNA target sequence
ttagaagggtctattaaag

SEQ ID NO: 179272 - DNA, 19 bp, Artificial sequence
  SiRNA target sequence
tagaagggtctattaaagc

SEQ ID NO: 179273 - DNA, 19 bp, Artificial sequence
  SiRNA target sequence
agaagggtctattaaagct

SEQ ID NO: 179274 - DNA, 19 bp, Artificial sequence
  SiRNA target sequence
gaagggtctattaaagcta

SEQ ID NO: 179275 - DNA, 19 bp, Artificial sequence
  SiRNA target sequence
aagggtctattaaagctat

SEQ ID NO: 179276 - DNA, 19 bp, Artificial sequence
  SiRNA target sequence
agggtctattaaagctatt

SEQ ID NO: 179277 - DNA, 19 bp, Artificial sequence
  SiRNA target sequence
gggtctattaaagctattt

SEQ ID NO: 179278 - DNA, 19 bp, Artificial sequence
  SiRNA target sequence
ggtctattaaagctatttc

SEQ ID NO: 179279 - DNA, 19 bp, Artificial sequence
  SiRNA target sequence
gtctattaaagctatttct

SEQ ID NO: 179280 - DNA, 19 bp, Artificial sequence
  SiRNA target sequence
tctattaaagctatttcta

SEQ ID NO: 179281 - DNA, 19 bp, Artificial sequence
  SiRNA target sequence
ctattaaagctatttctaa

SEQ ID NO: 179282 - DNA, 19 bp, Artificial sequence
  SiRNA target sequence
tattaaagctatttctaag

SEQ ID NO: 179283 - DNA, 19 bp, Artificial sequence
  SiRNA target sequence
attaaagctatttctaaga

SEQ ID NO: 179284 - DNA, 19 bp, Artificial sequence
  SiRNA target sequence
ttaaagctatttctaagat

SEQ ID NO: 179285 - DNA, 19 bp, Artificial sequence
  SiRNA target sequence
taaagctatttctaagata

SEQ ID NO: 179286 - DNA, 19 bp, Artificial sequence
  SiRNA target sequence
aaagctatttctaagatac

SEQ ID NO: 179287 - DNA, 19 bp, Artificial sequence
  SiRNA target sequence
aagctatttctaagataca

SEQ ID NO: 179288 - DNA, 19 bp, Artificial sequence
  SiRNA target sequence
agctatttctaagatacag

SEQ ID NO: 179289 - DNA, 19 bp, Artificial sequence
  SiRNA target sequence
gctatttctaagatacagt

SEQ ID NO: 179290 - DNA, 19 bp, Artificial sequence
  SiRNA target sequence
ctatttctaagatacagta

SEQ ID NO: 179291 - DNA, 19 bp, Artificial sequence
  SiRNA target sequence
tatttctaagatacagtat

SEQ ID NO: 179292 - DNA, 19 bp, Artificial sequence
  SiRNA target sequence
atttctaagatacagtata

SEQ ID NO: 179293 - DNA, 19 bp, Artificial sequence
  SiRNA target sequence
tttctaagatacagtatat

SEQ ID NO: 179294 - DNA, 19 bp, Artificial sequence
  SiRNA target sequence
ttctaagatacagtatata

SEQ ID NO: 179295 - DNA, 19 bp, Artificial sequence
  SiRNA target sequence
tctaagatacagtatatag

SEQ ID NO: 179296 - DNA, 19 bp, Artificial sequence
  SiRNA target sequence
ctaagatacagtatataga

SEQ ID NO: 179297 - DNA, 19 bp, Artificial sequence
  SiRNA target sequence
taagatacagtatatagat

SEQ ID NO: 179298 - DNA, 19 bp, Artificial sequence
  SiRNA target sequence
aagatacagtatatagata

SEQ ID NO: 179299 - DNA, 19 bp, Artificial sequence
  SiRNA target sequence
agatacagtatatagataa

SEQ ID NO: 179300 - DNA, 19 bp, Artificial sequence
  SiRNA target sequence
gatacagtatatagataaa

SEQ ID NO: 179301 - DNA, 19 bp, Artificial sequence
  SiRNA target sequence
atacagtatatagataaaa

SEQ ID NO: 179302 - DNA, 19 bp, Artificial sequence
  SiRNA target sequence
tacagtatatagataaaat

SEQ ID NO: 179303 - DNA, 19 bp, Artificial sequence
  SiRNA target sequence
acagtatatagataaaatg

SEQ ID NO: 179304 - DNA, 19 bp, Artificial sequence
  SiRNA target sequence
cagtatatagataaaatgc

SEQ ID NO: 179305 - DNA, 19 bp, Artificial sequence
  SiRNA target sequence
agtatatagataaaatgcc

SEQ ID NO: 179306 - DNA, 19 bp, Artificial sequence
  SiRNA target sequence
gtatatagataaaatgcct

SEQ ID NO: 179307 - DNA, 19 bp, Artificial sequence
  SiRNA target sequence
tatatagataaaatgccta

SEQ ID NO: 179308 - DNA, 19 bp, Artificial sequence
  SiRNA target sequence
atatagataaaatgcctaa

SEQ ID NO: 179309 - DNA, 19 bp, Artificial sequence
  SiRNA target sequence
tatagataaaatgcctaaa

SEQ ID NO: 179310 - DNA, 19 bp, Artificial sequence
  SiRNA target sequence
atagataaaatgcctaaat

SEQ ID NO: 179311 - DNA, 19 bp, Artificial sequence
  SiRNA target sequence
tagataaaatgcctaaatt

SEQ ID NO: 179312 - DNA, 19 bp, Artificial sequence
  SiRNA target sequence
agataaaatgcctaaattt

SEQ ID NO: 179313 - DNA, 19 bp, Artificial sequence
  SiRNA target sequence
gataaaatgcctaaatttt

SEQ ID NO: 179314 - DNA, 19 bp, Artificial sequence
  SiRNA target sequence
ataaaatgcctaaattttt

SEQ ID NO: 179315 - DNA, 19 bp, Artificial sequence
  SiRNA target sequence
taaaatgcctaaattttta

SEQ ID NO: 179316 - DNA, 19 bp, Artificial sequence
  SiRNA target sequence
aaaatgcctaaatttttaa

SEQ ID NO: 179317 - DNA, 19 bp, Artificial sequence
  SiRNA target sequence
aaatgcctaaatttttaaa

SEQ ID NO: 179318 - DNA, 19 bp, Artificial sequence
  SiRNA target sequence
aatgcctaaatttttaaaa

SEQ ID NO: 179319 - DNA, 19 bp, Artificial sequence
  SiRNA target sequence
atgcctaaatttttaaaag

SEQ ID NO: 179320 - DNA, 19 bp, Artificial sequence
  SiRNA target sequence
tgcctaaatttttaaaagg

SEQ ID NO: 179321 - DNA, 19 bp, Artificial sequence
  SiRNA target sequence
gcctaaatttttaaaagga

SEQ ID NO: 179322 - DNA, 19 bp, Artificial sequence
  SiRNA target sequence
cctaaatttttaaaaggac

SEQ ID NO: 179323 - DNA, 19 bp, Artificial sequence
  SiRNA target sequence
ctaaatttttaaaaggacg

SEQ ID NO: 179324 - DNA, 19 bp, Artificial sequence
  SiRNA target sequence
taaatttttaaaaggacgc

SEQ ID NO: 179325 - DNA, 19 bp, Artificial sequence
  SiRNA target sequence
aaatttttaaaaggacgct

SEQ ID NO: 179326 - DNA, 19 bp, Artificial sequence
  SiRNA target sequence
aatttttaaaaggacgcta

SEQ ID NO: 179327 - DNA, 19 bp, Artificial sequence
  SiRNA target sequence
atttttaaaaggacgctat

SEQ ID NO: 179328 - DNA, 19 bp, Artificial sequence
  SiRNA target sequence
tttttaaaaggacgctata

SEQ ID NO: 179329 - DNA, 19 bp, Artificial sequence
  SiRNA target sequence
ttttaaaaggacgctataa

SEQ ID NO: 179330 - DNA, 19 bp, Artificial sequence
  SiRNA target sequence
tttaaaaggacgctataag

SEQ ID NO: 179331 - DNA, 19 bp, Artificial sequence
  SiRNA target sequence
ttaaaaggacgctataagt

SEQ ID NO: 179332 - DNA, 19 bp, Artificial sequence
  SiRNA target sequence
taaaaggacgctataagtc

SEQ ID NO: 179333 - DNA, 19 bp, Artificial sequence
  SiRNA target sequence
aaaaggacgctataagtca

SEQ ID NO: 179334 - DNA, 19 bp, Artificial sequence
  SiRNA target sequence
aaaggacgctataagtcag

SEQ ID NO: 179335 - DNA, 19 bp, Artificial sequence
  SiRNA target sequence
aaggacgctataagtcaga

SEQ ID NO: 179336 - DNA, 19 bp, Artificial sequence
  SiRNA target sequence
aggacgctataagtcagaa

SEQ ID NO: 179337 - DNA, 19 bp, Artificial sequence
  SiRNA target sequence
ggacgctataagtcagaaa

SEQ ID NO: 179338 - DNA, 19 bp, Artificial sequence
  SiRNA target sequence
gacgctataagtcagaaat

SEQ ID NO: 179339 - DNA, 19 bp, Artificial sequence
  SiRNA target sequence
acgctataagtcagaaatc

SEQ ID NO: 179340 - DNA, 19 bp, Artificial sequence
  SiRNA target sequence
cgctataagtcagaaatcg

SEQ ID NO: 179341 - DNA, 19 bp, Artificial sequence
  SiRNA target sequence
gctataagtcagaaatcgc

SEQ ID NO: 179342 - DNA, 19 bp, Artificial sequence
  SiRNA target sequence
ctataagtcagaaatcgcc

SEQ ID NO: 179343 - DNA, 19 bp, Artificial sequence
  SiRNA target sequence
tataagtcagaaatcgcct

SEQ ID NO: 179344 - DNA, 19 bp, Artificial sequence
  SiRNA target sequence
ataagtcagaaatcgcctc

SEQ ID NO: 179345 - DNA, 19 bp, Artificial sequence
  SiRNA target sequence
taagtcagaaatcgcctcc

SEQ ID NO: 179346 - DNA, 19 bp, Artificial sequence
  SiRNA target sequence
aagtcagaaatcgcctccg

SEQ ID NO: 179347 - DNA, 19 bp, Artificial sequence
  SiRNA target sequence
agtcagaaatcgcctccgg

SEQ ID NO: 179348 - DNA, 19 bp, Artificial sequence
  SiRNA target sequence
gtcagaaatcgcctccgga

SEQ ID NO: 179349 - DNA, 19 bp, Artificial sequence
  SiRNA target sequence
tcagaaatcgcctccggaa

SEQ ID NO: 179350 - DNA, 19 bp, Artificial sequence
  SiRNA target sequence
cagaaatcgcctccggaaa

SEQ ID NO: 179351 - DNA, 19 bp, Artificial sequence
  SiRNA target sequence
agaaatcgcctccggaaaa

SEQ ID NO: 179352 - DNA, 19 bp, Artificial sequence
  SiRNA target sequence
gaaatcgcctccggaaaaa

SEQ ID NO: 179353 - DNA, 19 bp, Artificial sequence
  SiRNA target sequence
aaatcgcctccggaaaaat

SEQ ID NO: 179354 - DNA, 19 bp, Artificial sequence
  SiRNA target sequence
aatcgcctccggaaaaatg

SEQ ID NO: 179355 - DNA, 19 bp, Artificial sequence
  SiRNA target sequence
atcgcctccggaaaaatgt

SEQ ID NO: 179356 - DNA, 19 bp, Artificial sequence
  SiRNA target sequence
tcgcctccggaaaaatgtt

SEQ ID NO: 179357 - DNA, 19 bp, Artificial sequence
  SiRNA target sequence
cgcctccggaaaaatgttg

SEQ ID NO: 179358 - DNA, 19 bp, Artificial sequence
  SiRNA target sequence
gcctccggaaaaatgttgt

SEQ ID NO: 179359 - DNA, 19 bp, Artificial sequence
  SiRNA target sequence
cctccggaaaaatgttgtt

SEQ ID NO: 179360 - DNA, 19 bp, Artificial sequence
  SiRNA target sequence
ctccggaaaaatgttgttt

SEQ ID NO: 179361 - DNA, 19 bp, Artificial sequence
  SiRNA target sequence
tccggaaaaatgttgttta

SEQ ID NO: 179362 - DNA, 19 bp, Artificial sequence
  SiRNA target sequence
ccggaaaaatgttgtttac

SEQ ID NO: 179363 - DNA, 19 bp, Artificial sequence
  SiRNA target sequence
cggaaaaatgttgtttact

SEQ ID NO: 179364 - DNA, 19 bp, Artificial sequence
  SiRNA target sequence
ggaaaaatgttgtttactg

SEQ ID NO: 179365 - DNA, 19 bp, Artificial sequence
  SiRNA target sequence
gaaaaatgttgtttactgt

SEQ ID NO: 179366 - DNA, 19 bp, Artificial sequence
  SiRNA target sequence
aaaaatgttgtttactgtt

SEQ ID NO: 179367 - DNA, 19 bp, Artificial sequence
  SiRNA target sequence
aaaatgttgtttactgtta

SEQ ID NO: 179368 - DNA, 19 bp, Artificial sequence
  SiRNA target sequence
aaatgttgtttactgttaa

SEQ ID NO: 179369 - DNA, 19 bp, Artificial sequence
  SiRNA target sequence
aatgttgtttactgttaat

SEQ ID NO: 179370 - DNA, 19 bp, Artificial sequence
  SiRNA target sequence
atgttgtttactgttaatg

SEQ ID NO: 179371 - DNA, 19 bp, Artificial sequence
  SiRNA target sequence
tgttgtttactgttaatga

SEQ ID NO: 179372 - DNA, 19 bp, Artificial sequence
  SiRNA target sequence
gttgtttactgttaatgat

SEQ ID NO: 179373 - DNA, 19 bp, Artificial sequence
  SiRNA target sequence
ttgtttactgttaatgata

SEQ ID NO: 179374 - DNA, 19 bp, Artificial sequence
  SiRNA target sequence
tgtttactgttaatgatat

SEQ ID NO: 179375 - DNA, 19 bp, Artificial sequence
  SiRNA target sequence
gtttactgttaatgatata

SEQ ID NO: 179376 - DNA, 19 bp, Artificial sequence
  SiRNA target sequence
tttactgttaatgatatat

SEQ ID NO: 179377 - DNA, 19 bp, Artificial sequence
  SiRNA target sequence
ttactgttaatgatatatt

SEQ ID NO: 179378 - DNA, 19 bp, Artificial sequence
  SiRNA target sequence
tactgttaatgatatatta

SEQ ID NO: 179379 - DNA, 19 bp, Artificial sequence
  SiRNA target sequence
actgttaatgatatattaa

SEQ ID NO: 179380 - DNA, 19 bp, Artificial sequence
  SiRNA target sequence
ctgttaatgatatattaaa

SEQ ID NO: 179381 - DNA, 19 bp, Artificial sequence
  SiRNA target sequence
tgttaatgatatattaaaa

SEQ ID NO: 179382 - DNA, 19 bp, Artificial sequence
  SiRNA target sequence
gttaatgatatattaaaaa

SEQ ID NO: 179383 - DNA, 19 bp, Artificial sequence
  SiRNA target sequence
ttaatgatatattaaaaaa

SEQ ID NO: 179384 - DNA, 19 bp, Artificial sequence
  SiRNA target sequence
taatgatatattaaaaaaa

SEQ ID NO: 179385 - DNA, 19 bp, Artificial sequence
  SiRNA target sequence
aatgatatattaaaaaaag

SEQ ID NO: 179386 - DNA, 19 bp, Artificial sequence
  SiRNA target sequence
atgatatattaaaaaaagt

SEQ ID NO: 179387 - DNA, 19 bp, Artificial sequence
  SiRNA target sequence
tgatatattaaaaaaagtt

SEQ ID NO: 179388 - DNA, 19 bp, Artificial sequence
  SiRNA target sequence
gatatattaaaaaaagttg

SEQ ID NO: 179389 - DNA, 19 bp, Artificial sequence
  SiRNA target sequence
atatattaaaaaaagttga

SEQ ID NO: 179390 - DNA, 19 bp, Artificial sequence
  SiRNA target sequence
tatattaaaaaaagttgat

SEQ ID NO: 179391 - DNA, 19 bp, Artificial sequence
  SiRNA target sequence
atattaaaaaaagttgatg

SEQ ID NO: 179392 - DNA, 19 bp, Artificial sequence
  SiRNA target sequence
tattaaaaaaagttgatga

SEQ ID NO: 179393 - DNA, 19 bp, Artificial sequence
  SiRNA target sequence
attaaaaaaagttgatgaa

SEQ ID NO: 179394 - DNA, 19 bp, Artificial sequence
  SiRNA target sequence
ttaaaaaaagttgatgaaa

SEQ ID NO: 179395 - DNA, 19 bp, Artificial sequence
  SiRNA target sequence
taaaaaaagttgatgaaaa

SEQ ID NO: 179396 - DNA, 19 bp, Artificial sequence
  SiRNA target sequence
aaaaaaagttgatgaaaaa

SEQ ID NO: 179397 - DNA, 19 bp, Artificial sequence
  SiRNA target sequence
aaaaaagttgatgaaaaaa

SEQ ID NO: 179398 - DNA, 19 bp, Artificial sequence
  SiRNA target sequence
aaaaagttgatgaaaaaaa

SEQ ID NO: 179399 - DNA, 19 bp, Artificial sequence
  SiRNA target sequence
aaaagttgatgaaaaaaat

SEQ ID NO: 179400 - DNA, 19 bp, Artificial sequence
  SiRNA target sequence
aaagttgatgaaaaaaata

SEQ ID NO: 179401 - DNA, 19 bp, Artificial sequence
  SiRNA target sequence
aagttgatgaaaaaaataa

SEQ ID NO: 179402 - DNA, 19 bp, Artificial sequence
  SiRNA target sequence
agttgatgaaaaaaataaa

SEQ ID NO: 179403 - DNA, 19 bp, Artificial sequence
  SiRNA target sequence
gttgatgaaaaaaataaat

SEQ ID NO: 179404 - DNA, 19 bp, Artificial sequence
  SiRNA target sequence
ttgatgaaaaaaataaatt

SEQ ID NO: 179405 - DNA, 19 bp, Artificial sequence
  SiRNA target sequence
tgatgaaaaaaataaattt

SEQ ID NO: 179406 - DNA, 19 bp, Artificial sequence
  SiRNA target sequence
gatgaaaaaaataaatttg

SEQ ID NO: 179407 - DNA, 19 bp, Artificial sequence
  SiRNA target sequence
atgaaaaaaataaatttga

SEQ ID NO: 179408 - DNA, 19 bp, Artificial sequence
  SiRNA target sequence
tgaaaaaaataaatttgac

SEQ ID NO: 179409 - DNA, 19 bp, Artificial sequence
  SiRNA target sequence
gaaaaaaataaatttgact

SEQ ID NO: 179410 - DNA, 19 bp, Artificial sequence
  SiRNA target sequence
aaaaaaataaatttgacta

SEQ ID NO: 179411 - DNA, 19 bp, Artificial sequence
  SiRNA target sequence
aaaaaataaatttgactat

SEQ ID NO: 179412 - DNA, 19 bp, Artificial sequence
  SiRNA target sequence
aaaaataaatttgactatt

SEQ ID NO: 179413 - DNA, 19 bp, Artificial sequence
  SiRNA target sequence
aaaataaatttgactatta

SEQ ID NO: 179414 - DNA, 19 bp, Artificial sequence
  SiRNA target sequence
aaataaatttgactattac

SEQ ID NO: 179415 - DNA, 19 bp, Artificial sequence
  SiRNA target sequence
aataaatttgactattacg

SEQ ID NO: 179416 - DNA, 19 bp, Artificial sequence
  SiRNA target sequence
ataaatttgactattacgt

SEQ ID NO: 179417 - DNA, 19 bp, Artificial sequence
  SiRNA target sequence
taaatttgactattacgta

SEQ ID NO: 179418 - DNA, 19 bp, Artificial sequence
  SiRNA target sequence
aaatttgactattacgtag

SEQ ID NO: 179419 - DNA, 19 bp, Artificial sequence
  SiRNA target sequence
aatttgactattacgtaga

SEQ ID NO: 179420 - DNA, 19 bp, Artificial sequence
  SiRNA target sequence
atttgactattacgtagat

SEQ ID NO: 179421 - DNA, 19 bp, Artificial sequence
  SiRNA target sequence
tttgactattacgtagata

SEQ ID NO: 179422 - DNA, 19 bp, Artificial sequence
  SiRNA target sequence
ttgactattacgtagataa

SEQ ID NO: 179423 - DNA, 19 bp, Artificial sequence
  SiRNA target sequence
tgactattacgtagataaa

SEQ ID NO: 179424 - DNA, 19 bp, Artificial sequence
  SiRNA target sequence
gactattacgtagataaaa

SEQ ID NO: 179425 - DNA, 19 bp, Artificial sequence
  SiRNA target sequence
actattacgtagataaaat

SEQ ID NO: 179426 - DNA, 19 bp, Artificial sequence
  SiRNA target sequence
ctattacgtagataaaatg

SEQ ID NO: 179427 - DNA, 19 bp, Artificial sequence
  SiRNA target sequence
tattacgtagataaaatgg

SEQ ID NO: 179428 - DNA, 19 bp, Artificial sequence
  SiRNA target sequence
attacgtagataaaatggc

SEQ ID NO: 179429 - DNA, 19 bp, Artificial sequence
  SiRNA target sequence
ttacgtagataaaatggca

SEQ ID NO: 179430 - DNA, 19 bp, Artificial sequence
  SiRNA target sequence
tacgtagataaaatggcac

SEQ ID NO: 179431 - DNA, 19 bp, Artificial sequence
  SiRNA target sequence
acgtagataaaatggcact

SEQ ID NO: 179432 - DNA, 19 bp, Artificial sequence
  SiRNA target sequence
cgtagataaaatggcactt

SEQ ID NO: 179433 - DNA, 19 bp, Artificial sequence
  SiRNA target sequence
gtagataaaatggcactta

SEQ ID NO: 179434 - DNA, 19 bp, Artificial sequence
  SiRNA target sequence
tagataaaatggcacttaa

SEQ ID NO: 179435 - DNA, 19 bp, Artificial sequence
  SiRNA target sequence
agataaaatggcacttaaa

SEQ ID NO: 179436 - DNA, 19 bp, Artificial sequence
  SiRNA target sequence
gataaaatggcacttaaaa

SEQ ID NO: 179437 - DNA, 19 bp, Artificial sequence
  SiRNA target sequence
ataaaatggcacttaaaaa

SEQ ID NO: 179438 - DNA, 19 bp, Artificial sequence
  SiRNA target sequence
taaaatggcacttaaaaat

SEQ ID NO: 179439 - DNA, 19 bp, Artificial sequence
  SiRNA target sequence
aaaatggcacttaaaaatg

SEQ ID NO: 179440 - DNA, 19 bp, Artificial sequence
  SiRNA target sequence
aaatggcacttaaaaatgt

SEQ ID NO: 179441 - DNA, 19 bp, Artificial sequence
  SiRNA target sequence
aatggcacttaaaaatgta

SEQ ID NO: 179442 - DNA, 19 bp, Artificial sequence
  SiRNA target sequence
atggcacttaaaaatgtat

SEQ ID NO: 179443 - DNA, 19 bp, Artificial sequence
  SiRNA target sequence
tggcacttaaaaatgtatt

SEQ ID NO: 179444 - DNA, 19 bp, Artificial sequence
  SiRNA target sequence
ggcacttaaaaatgtatta

SEQ ID NO: 179445 - DNA, 19 bp, Artificial sequence
  SiRNA target sequence
gcacttaaaaatgtattaa

SEQ ID NO: 179446 - DNA, 19 bp, Artificial sequence
  SiRNA target sequence
cacttaaaaatgtattaac

SEQ ID NO: 179447 - DNA, 19 bp, Artificial sequence
  SiRNA target sequence
acttaaaaatgtattaaca

SEQ ID NO: 179448 - DNA, 19 bp, Artificial sequence
  SiRNA target sequence
cttaaaaatgtattaacaa

SEQ ID NO: 179449 - DNA, 19 bp, Artificial sequence
  SiRNA target sequence
ttaaaaatgtattaacaag

SEQ ID NO: 179450 - DNA, 19 bp, Artificial sequence
  SiRNA target sequence
taaaaatgtattaacaaga

SEQ ID NO: 179451 - DNA, 19 bp, Artificial sequence
  SiRNA target sequence
aaaaatgtattaacaagag

SEQ ID NO: 179452 - DNA, 19 bp, Artificial sequence
  SiRNA target sequence
aaaatgtattaacaagaga

SEQ ID NO: 179453 - DNA, 19 bp, Artificial sequence
  SiRNA target sequence
aaatgtattaacaagagaa

SEQ ID NO: 179454 - DNA, 19 bp, Artificial sequence
  SiRNA target sequence
aatgtattaacaagagaat

SEQ ID NO: 179455 - DNA, 19 bp, Artificial sequence
  SiRNA target sequence
atgtattaacaagagaatt

SEQ ID NO: 179456 - DNA, 19 bp, Artificial sequence
  SiRNA target sequence
tgtattaacaagagaatta

SEQ ID NO: 179457 - DNA, 19 bp, Artificial sequence
  SiRNA target sequence
gtattaacaagagaattag

SEQ ID NO: 179458 - DNA, 19 bp, Artificial sequence
  SiRNA target sequence
tattaacaagagaattaga

SEQ ID NO: 179459 - DNA, 19 bp, Artificial sequence
  SiRNA target sequence
attaacaagagaattagag

SEQ ID NO: 179460 - DNA, 19 bp, Artificial sequence
  SiRNA target sequence
ttaacaagagaattagagc

SEQ ID NO: 179461 - DNA, 19 bp, Artificial sequence
  SiRNA target sequence
taacaagagaattagagca

SEQ ID NO: 179462 - DNA, 19 bp, Artificial sequence
  SiRNA target sequence
aacaagagaattagagcaa

SEQ ID NO: 179463 - DNA, 19 bp, Artificial sequence
  SiRNA target sequence
acaagagaattagagcaat

SEQ ID NO: 179464 - DNA, 19 bp, Artificial sequence
  SiRNA target sequence
caagagaattagagcaatt

SEQ ID NO: 179465 - DNA, 19 bp, Artificial sequence
  SiRNA target sequence
aagagaattagagcaatta

SEQ ID NO: 179466 - DNA, 19 bp, Artificial sequence
  SiRNA target sequence
agagaattagagcaattaa

SEQ ID NO: 179467 - DNA, 19 bp, Artificial sequence
  SiRNA target sequence
gagaattagagcaattaag

SEQ ID NO: 179468 - DNA, 19 bp, Artificial sequence
  SiRNA target sequence
agaattagagcaattaagt

SEQ ID NO: 179469 - DNA, 19 bp, Artificial sequence
  SiRNA target sequence
gaattagagcaattaagtg

SEQ ID NO: 179470 - DNA, 19 bp, Artificial sequence
  SiRNA target sequence
aattagagcaattaagtgg

SEQ ID NO: 179471 - DNA, 19 bp, Artificial sequence
  SiRNA target sequence
attagagcaattaagtggt

SEQ ID NO: 179472 - DNA, 19 bp, Artificial sequence
  SiRNA target sequence
ttagagcaattaagtggtg

SEQ ID NO: 179473 - DNA, 19 bp, Artificial sequence
  SiRNA target sequence
tagagcaattaagtggtgg

SEQ ID NO: 179474 - DNA, 19 bp, Artificial sequence
  SiRNA target sequence
agagcaattaagtggtggt

SEQ ID NO: 179475 - DNA, 19 bp, Artificial sequence
  SiRNA target sequence
gagcaattaagtggtggtg

SEQ ID NO: 179476 - DNA, 19 bp, Artificial sequence
  SiRNA target sequence
agcaattaagtggtggtga

SEQ ID NO: 179477 - DNA, 19 bp, Artificial sequence
  SiRNA target sequence
gcaattaagtggtggtgaa

SEQ ID NO: 179478 - DNA, 19 bp, Artificial sequence
  SiRNA target sequence
caattaagtggtggtgaac

SEQ ID NO: 179479 - DNA, 19 bp, Artificial sequence
  SiRNA target sequence
aattaagtggtggtgaact

SEQ ID NO: 179480 - DNA, 19 bp, Artificial sequence
  SiRNA target sequence
attaagtggtggtgaactt

SEQ ID NO: 179481 - DNA, 19 bp, Artificial sequence
  SiRNA target sequence
ttaagtggtggtgaacttc

SEQ ID NO: 179482 - DNA, 19 bp, Artificial sequence
  SiRNA target sequence
taagtggtggtgaacttca

SEQ ID NO: 179483 - DNA, 19 bp, Artificial sequence
  SiRNA target sequence
aagtggtggtgaacttcaa

SEQ ID NO: 179484 - DNA, 19 bp, Artificial sequence
  SiRNA target sequence
agtggtggtgaacttcaaa

SEQ ID NO: 179485 - DNA, 19 bp, Artificial sequence
  SiRNA target sequence
gtggtggtgaacttcaaag

SEQ ID NO: 179486 - DNA, 19 bp, Artificial sequence
  SiRNA target sequence
tggtggtgaacttcaaaga

SEQ ID NO: 179487 - DNA, 19 bp, Artificial sequence
  SiRNA target sequence
ggtggtgaacttcaaagat

SEQ ID NO: 179488 - DNA, 19 bp, Artificial sequence
  SiRNA target sequence
gtggtgaacttcaaagatt

SEQ ID NO: 179489 - DNA, 19 bp, Artificial sequence
  SiRNA target sequence
tggtgaacttcaaagattt

SEQ ID NO: 179490 - DNA, 19 bp, Artificial sequence
  SiRNA target sequence
ggtgaacttcaaagatttt

SEQ ID NO: 179491 - DNA, 19 bp, Artificial sequence
  SiRNA target sequence
gtgaacttcaaagattttg

SEQ ID NO: 179492 - DNA, 19 bp, Artificial sequence
  SiRNA target sequence
tgaacttcaaagattttgt

SEQ ID NO: 179493 - DNA, 19 bp, Artificial sequence
  SiRNA target sequence
gaacttcaaagattttgta

SEQ ID NO: 179494 - DNA, 19 bp, Artificial sequence
  SiRNA target sequence
aacttcaaagattttgtat

SEQ ID NO: 179495 - DNA, 19 bp, Artificial sequence
  SiRNA target sequence
acttcaaagattttgtatt

SEQ ID NO: 179496 - DNA, 19 bp, Artificial sequence
  SiRNA target sequence
cttcaaagattttgtattg

SEQ ID NO: 179497 - DNA, 19 bp, Artificial sequence
  SiRNA target sequence
ttcaaagattttgtattgc

SEQ ID NO: 179498 - DNA, 19 bp, Artificial sequence
  SiRNA target sequence
tcaaagattttgtattgca

SEQ ID NO: 179499 - DNA, 19 bp, Artificial sequence
  SiRNA target sequence
caaagattttgtattgcat

SEQ ID NO: 179500 - DNA, 19 bp, Artificial sequence
  SiRNA target sequence
aaagattttgtattgcata

SEQ ID NO: 179501 - DNA, 19 bp, Artificial sequence
  SiRNA target sequence
aagattttgtattgcatac

SEQ ID NO: 179502 - DNA, 19 bp, Artificial sequence
  SiRNA target sequence
agattttgtattgcataca

SEQ ID NO: 179503 - DNA, 19 bp, Artificial sequence
  SiRNA target sequence
gattttgtattgcatacac

SEQ ID NO: 179504 - DNA, 19 bp, Artificial sequence
  SiRNA target sequence
attttgtattgcatacaca

SEQ ID NO: 179505 - DNA, 19 bp, Artificial sequence
  SiRNA target sequence
ttttgtattgcatacacat

SEQ ID NO: 179506 - DNA, 19 bp, Artificial sequence
  SiRNA target sequence
tttgtattgcatacacatg

SEQ ID NO: 179507 - DNA, 19 bp, Artificial sequence
  SiRNA target sequence
ttgtattgcatacacatgt

SEQ ID NO: 179508 - DNA, 19 bp, Artificial sequence
  SiRNA target sequence
tgtattgcatacacatgtt

SEQ ID NO: 179509 - DNA, 19 bp, Artificial sequence
  SiRNA target sequence
gtattgcatacacatgttt

SEQ ID NO: 179510 - DNA, 19 bp, Artificial sequence
  SiRNA target sequence
tattgcatacacatgttta

SEQ ID NO: 179511 - DNA, 19 bp, Artificial sequence
  SiRNA target sequence
attgcatacacatgtttac

SEQ ID NO: 179512 - DNA, 19 bp, Artificial sequence
  SiRNA target sequence
ttgcatacacatgtttaca

SEQ ID NO: 179513 - DNA, 19 bp, Artificial sequence
  SiRNA target sequence
tgcatacacatgtttacaa

SEQ ID NO: 179514 - DNA, 19 bp, Artificial sequence
  SiRNA target sequence
gcatacacatgtttacaag

SEQ ID NO: 179515 - DNA, 19 bp, Artificial sequence
  SiRNA target sequence
catacacatgtttacaaga

SEQ ID NO: 179516 - DNA, 19 bp, Artificial sequence
  SiRNA target sequence
atacacatgtttacaagaa

SEQ ID NO: 179517 - DNA, 19 bp, Artificial sequence
  SiRNA target sequence
tacacatgtttacaagaag

SEQ ID NO: 179518 - DNA, 19 bp, Artificial sequence
  SiRNA target sequence
acacatgtttacaagaagg

SEQ ID NO: 179519 - DNA, 19 bp, Artificial sequence
  SiRNA target sequence
cacatgtttacaagaagga

SEQ ID NO: 179520 - DNA, 19 bp, Artificial sequence
  SiRNA target sequence
acatgtttacaagaaggaa

SEQ ID NO: 179521 - DNA, 19 bp, Artificial sequence
  SiRNA target sequence
catgtttacaagaaggaaa

SEQ ID NO: 179522 - DNA, 19 bp, Artificial sequence
  SiRNA target sequence
atgtttacaagaaggaaat

SEQ ID NO: 179523 - DNA, 19 bp, Artificial sequence
  SiRNA target sequence
tgtttacaagaaggaaatg

SEQ ID NO: 179524 - DNA, 19 bp, Artificial sequence
  SiRNA target sequence
gtttacaagaaggaaatgt

SEQ ID NO: 179525 - DNA, 19 bp, Artificial sequence
  SiRNA target sequence
tttacaagaaggaaatgtt

SEQ ID NO: 179526 - DNA, 19 bp, Artificial sequence
  SiRNA target sequence
ttacaagaaggaaatgttt

SEQ ID NO: 179527 - DNA, 19 bp, Artificial sequence
  SiRNA target sequence
tacaagaaggaaatgttta

SEQ ID NO: 179528 - DNA, 19 bp, Artificial sequence
  SiRNA target sequence
acaagaaggaaatgtttat

SEQ ID NO: 179529 - DNA, 19 bp, Artificial sequence
  SiRNA target sequence
caagaaggaaatgtttata

SEQ ID NO: 179530 - DNA, 19 bp, Artificial sequence
  SiRNA target sequence
aagaaggaaatgtttatat

SEQ ID NO: 179531 - DNA, 19 bp, Artificial sequence
  SiRNA target sequence
agaaggaaatgtttatatt

SEQ ID NO: 179532 - DNA, 19 bp, Artificial sequence
  SiRNA target sequence
gaaggaaatgtttatattt

SEQ ID NO: 179533 - DNA, 19 bp, Artificial sequence
  SiRNA target sequence
aaggaaatgtttatatttt

SEQ ID NO: 179534 - DNA, 19 bp, Artificial sequence
  SiRNA target sequence
aggaaatgtttatattttt

SEQ ID NO: 179535 - DNA, 19 bp, Artificial sequence
  SiRNA target sequence
ggaaatgtttatatttttg

SEQ ID NO: 179536 - DNA, 19 bp, Artificial sequence
  SiRNA target sequence
gaaatgtttatatttttga

SEQ ID NO: 179537 - DNA, 19 bp, Artificial sequence
  SiRNA target sequence
aaatgtttatatttttgat

SEQ ID NO: 179538 - DNA, 19 bp, Artificial sequence
  SiRNA target sequence
aatgtttatatttttgatg

SEQ ID NO: 179539 - DNA, 19 bp, Artificial sequence
  SiRNA target sequence
atgtttatatttttgatga

SEQ ID NO: 179540 - DNA, 19 bp, Artificial sequence
  SiRNA target sequence
tgtttatatttttgatgaa

SEQ ID NO: 179541 - DNA, 19 bp, Artificial sequence
  SiRNA target sequence
gtttatatttttgatgaac

SEQ ID NO: 179542 - DNA, 19 bp, Artificial sequence
  SiRNA target sequence
tttatatttttgatgaacc

SEQ ID NO: 179543 - DNA, 19 bp, Artificial sequence
  SiRNA target sequence
ttatatttttgatgaaccc

SEQ ID NO: 179544 - DNA, 19 bp, Artificial sequence
  SiRNA target sequence
tatatttttgatgaaccca

SEQ ID NO: 179545 - DNA, 19 bp, Artificial sequence
  SiRNA target sequence
atatttttgatgaacccac

SEQ ID NO: 179546 - DNA, 19 bp, Artificial sequence
  SiRNA target sequence
tatttttgatgaacccact

SEQ ID NO: 179547 - DNA, 19 bp, Artificial sequence
  SiRNA target sequence
atttttgatgaacccacta

SEQ ID NO: 179548 - DNA, 19 bp, Artificial sequence
  SiRNA target sequence
tttttgatgaacccactag

SEQ ID NO: 179549 - DNA, 19 bp, Artificial sequence
  SiRNA target sequence
ttttgatgaacccactagt

SEQ ID NO: 179550 - DNA, 19 bp, Artificial sequence
  SiRNA target sequence
tttgatgaacccactagtt

SEQ ID NO: 179551 - DNA, 19 bp, Artificial sequence
  SiRNA target sequence
ttgatgaacccactagttt

SEQ ID NO: 179552 - DNA, 19 bp, Artificial sequence
  SiRNA target sequence
tgatgaacccactagtttt

SEQ ID NO: 179553 - DNA, 19 bp, Artificial sequence
  SiRNA target sequence
gatgaacccactagttttt

SEQ ID NO: 179554 - DNA, 19 bp, Artificial sequence
  SiRNA target sequence
atgaacccactagtttttt

SEQ ID NO: 179555 - DNA, 19 bp, Artificial sequence
  SiRNA target sequence
tgaacccactagttttttg

SEQ ID NO: 179556 - DNA, 19 bp, Artificial sequence
  SiRNA target sequence
gaacccactagttttttgg

SEQ ID NO: 179557 - DNA, 19 bp, Artificial sequence
  SiRNA target sequence
aacccactagttttttgga

SEQ ID NO: 179558 - DNA, 19 bp, Artificial sequence
  SiRNA target sequence
acccactagttttttggat

SEQ ID NO: 179559 - DNA, 19 bp, Artificial sequence
  SiRNA target sequence
cccactagttttttggatg

SEQ ID NO: 179560 - DNA, 19 bp, Artificial sequence
  SiRNA target sequence
ccactagttttttggatgt

SEQ ID NO: 179561 - DNA, 19 bp, Artificial sequence
  SiRNA target sequence
cactagttttttggatgtt

SEQ ID NO: 179562 - DNA, 19 bp, Artificial sequence
  SiRNA target sequence
actagttttttggatgtta

SEQ ID NO: 179563 - DNA, 19 bp, Artificial sequence
  SiRNA target sequence
ctagttttttggatgttaa

SEQ ID NO: 179564 - DNA, 19 bp, Artificial sequence
  SiRNA target sequence
tagttttttggatgttaag

SEQ ID NO: 179565 - DNA, 19 bp, Artificial sequence
  SiRNA target sequence
agttttttggatgttaagc

SEQ ID NO: 179566 - DNA, 19 bp, Artificial sequence
  SiRNA target sequence
gttttttggatgttaagca

SEQ ID NO: 179567 - DNA, 19 bp, Artificial sequence
  SiRNA target sequence
ttttttggatgttaagcag

SEQ ID NO: 179568 - DNA, 19 bp, Artificial sequence
  SiRNA target sequence
tttttggatgttaagcagc

SEQ ID NO: 179569 - DNA, 19 bp, Artificial sequence
  SiRNA target sequence
ttttggatgttaagcagcg

SEQ ID NO: 179570 - DNA, 19 bp, Artificial sequence
  SiRNA target sequence
tttggatgttaagcagcga

SEQ ID NO: 179571 - DNA, 19 bp, Artificial sequence
  SiRNA target sequence
ttggatgttaagcagcgac

SEQ ID NO: 179572 - DNA, 19 bp, Artificial sequence
  SiRNA target sequence
tggatgttaagcagcgact

SEQ ID NO: 179573 - DNA, 19 bp, Artificial sequence
  SiRNA target sequence
ggatgttaagcagcgacta

SEQ ID NO: 179574 - DNA, 19 bp, Artificial sequence
  SiRNA target sequence
gatgttaagcagcgactag

SEQ ID NO: 179575 - DNA, 19 bp, Artificial sequence
  SiRNA target sequence
atgttaagcagcgactagc

SEQ ID NO: 179576 - DNA, 19 bp, Artificial sequence
  SiRNA target sequence
tgttaagcagcgactagca

SEQ ID NO: 179577 - DNA, 19 bp, Artificial sequence
  SiRNA target sequence
gttaagcagcgactagcag

SEQ ID NO: 179578 - DNA, 19 bp, Artificial sequence
  SiRNA target sequence
ttaagcagcgactagcagc

SEQ ID NO: 179579 - DNA, 19 bp, Artificial sequence
  SiRNA target sequence
taagcagcgactagcagct

SEQ ID NO: 179580 - DNA, 19 bp, Artificial sequence
  SiRNA target sequence
aagcagcgactagcagctg

SEQ ID NO: 179581 - DNA, 19 bp, Artificial sequence
  SiRNA target sequence
agcagcgactagcagctgc

SEQ ID NO: 179582 - DNA, 19 bp, Artificial sequence
  SiRNA target sequence
gcagcgactagcagctgct

SEQ ID NO: 179583 - DNA, 19 bp, Artificial sequence
  SiRNA target sequence
cagcgactagcagctgcta

SEQ ID NO: 179584 - DNA, 19 bp, Artificial sequence
  SiRNA target sequence
agcgactagcagctgctaa

SEQ ID NO: 179585 - DNA, 19 bp, Artificial sequence
  SiRNA target sequence
gcgactagcagctgctaag

SEQ ID NO: 179586 - DNA, 19 bp, Artificial sequence
  SiRNA target sequence
cgactagcagctgctaagg

SEQ ID NO: 179587 - DNA, 19 bp, Artificial sequence
  SiRNA target sequence
gactagcagctgctaagga

SEQ ID NO: 179588 - DNA, 19 bp, Artificial sequence
  SiRNA target sequence
actagcagctgctaaggaa

SEQ ID NO: 179589 - DNA, 19 bp, Artificial sequence
  SiRNA target sequence
ctagcagctgctaaggaaa

SEQ ID NO: 179590 - DNA, 19 bp, Artificial sequence
  SiRNA target sequence
tagcagctgctaaggaaat

SEQ ID NO: 179591 - DNA, 19 bp, Artificial sequence
  SiRNA target sequence
agcagctgctaaggaaata

SEQ ID NO: 179592 - DNA, 19 bp, Artificial sequence
  SiRNA target sequence
gcagctgctaaggaaataa

SEQ ID NO: 179593 - DNA, 19 bp, Artificial sequence
  SiRNA target sequence
cagctgctaaggaaataag

SEQ ID NO: 179594 - DNA, 19 bp, Artificial sequence
  SiRNA target sequence
agctgctaaggaaataaga

SEQ ID NO: 179595 - DNA, 19 bp, Artificial sequence
  SiRNA target sequence
gctgctaaggaaataagaa

SEQ ID NO: 179596 - DNA, 19 bp, Artificial sequence
  SiRNA target sequence
ctgctaaggaaataagaaa

SEQ ID NO: 179597 - DNA, 19 bp, Artificial sequence
  SiRNA target sequence
tgctaaggaaataagaaat

SEQ ID NO: 179598 - DNA, 19 bp, Artificial sequence
  SiRNA target sequence
gctaaggaaataagaaatt

SEQ ID NO: 179599 - DNA, 19 bp, Artificial sequence
  SiRNA target sequence
ctaaggaaataagaaattt

SEQ ID NO: 179600 - DNA, 19 bp, Artificial sequence
  SiRNA target sequence
taaggaaataagaaatttg

SEQ ID NO: 179601 - DNA, 19 bp, Artificial sequence
  SiRNA target sequence
aaggaaataagaaatttgt

SEQ ID NO: 179602 - DNA, 19 bp, Artificial sequence
  SiRNA target sequence
aggaaataagaaatttgtg

SEQ ID NO: 179603 - DNA, 19 bp, Artificial sequence
  SiRNA target sequence
ggaaataagaaatttgtgt

SEQ ID NO: 179604 - DNA, 19 bp, Artificial sequence
  SiRNA target sequence
gaaataagaaatttgtgtg

SEQ ID NO: 179605 - DNA, 19 bp, Artificial sequence
  SiRNA target sequence
aaataagaaatttgtgtga

SEQ ID NO: 179606 - DNA, 19 bp, Artificial sequence
  SiRNA target sequence
aataagaaatttgtgtgaa

SEQ ID NO: 179607 - DNA, 19 bp, Artificial sequence
  SiRNA target sequence
ataagaaatttgtgtgaag

SEQ ID NO: 179608 - DNA, 19 bp, Artificial sequence
  SiRNA target sequence
taagaaatttgtgtgaaga

SEQ ID NO: 179609 - DNA, 19 bp, Artificial sequence
  SiRNA target sequence
aagaaatttgtgtgaagaa

SEQ ID NO: 179610 - DNA, 19 bp, Artificial sequence
  SiRNA target sequence
agaaatttgtgtgaagaaa

SEQ ID NO: 179611 - DNA, 19 bp, Artificial sequence
  SiRNA target sequence
gaaatttgtgtgaagaaaa

SEQ ID NO: 179612 - DNA, 19 bp, Artificial sequence
  SiRNA target sequence
aaatttgtgtgaagaaaat

SEQ ID NO: 179613 - DNA, 19 bp, Artificial sequence
  SiRNA target sequence
aatttgtgtgaagaaaata

SEQ ID NO: 179614 - DNA, 19 bp, Artificial sequence
  SiRNA target sequence
atttgtgtgaagaaaataa

SEQ ID NO: 179615 - DNA, 19 bp, Artificial sequence
  SiRNA target sequence
tttgtgtgaagaaaataaa

SEQ ID NO: 179616 - DNA, 19 bp, Artificial sequence
  SiRNA target sequence
ttgtgtgaagaaaataaat

SEQ ID NO: 179617 - DNA, 19 bp, Artificial sequence
  SiRNA target sequence
tgtgtgaagaaaataaata

SEQ ID NO: 179618 - DNA, 19 bp, Artificial sequence
  SiRNA target sequence
gtgtgaagaaaataaatat

SEQ ID NO: 179619 - DNA, 19 bp, Artificial sequence
  SiRNA target sequence
tgtgaagaaaataaatatg

SEQ ID NO: 179620 - DNA, 19 bp, Artificial sequence
  SiRNA target sequence
gtgaagaaaataaatatgt

SEQ ID NO: 179621 - DNA, 19 bp, Artificial sequence
  SiRNA target sequence
tgaagaaaataaatatgtt

SEQ ID NO: 179622 - DNA, 19 bp, Artificial sequence
  SiRNA target sequence
gaagaaaataaatatgttg

SEQ ID NO: 179623 - DNA, 19 bp, Artificial sequence
  SiRNA target sequence
aagaaaataaatatgttgt

SEQ ID NO: 179624 - DNA, 19 bp, Artificial sequence
  SiRNA target sequence
agaaaataaatatgttgta

SEQ ID NO: 179625 - DNA, 19 bp, Artificial sequence
  SiRNA target sequence
gaaaataaatatgttgtag

SEQ ID NO: 179626 - DNA, 19 bp, Artificial sequence
  SiRNA target sequence
aaaataaatatgttgtagt

SEQ ID NO: 179627 - DNA, 19 bp, Artificial sequence
  SiRNA target sequence
aaataaatatgttgtagtt

SEQ ID NO: 179628 - DNA, 19 bp, Artificial sequence
  SiRNA target sequence
aataaatatgttgtagttg

SEQ ID NO: 179629 - DNA, 19 bp, Artificial sequence
  SiRNA target sequence
ataaatatgttgtagttgt

SEQ ID NO: 179630 - DNA, 19 bp, Artificial sequence
  SiRNA target sequence
taaatatgttgtagttgtc

SEQ ID NO: 179631 - DNA, 19 bp, Artificial sequence
  SiRNA target sequence
aaatatgttgtagttgtcg

SEQ ID NO: 179632 - DNA, 19 bp, Artificial sequence
  SiRNA target sequence
aatatgttgtagttgtcga

SEQ ID NO: 179633 - DNA, 19 bp, Artificial sequence
  SiRNA target sequence
atatgttgtagttgtcgaa

SEQ ID NO: 179634 - DNA, 19 bp, Artificial sequence
  SiRNA target sequence
tatgttgtagttgtcgaac

SEQ ID NO: 179635 - DNA, 19 bp, Artificial sequence
  SiRNA target sequence
atgttgtagttgtcgaaca

SEQ ID NO: 179636 - DNA, 19 bp, Artificial sequence
  SiRNA target sequence
tgttgtagttgtcgaacac

SEQ ID NO: 179637 - DNA, 19 bp, Artificial sequence
  SiRNA target sequence
gttgtagttgtcgaacacg

SEQ ID NO: 179638 - DNA, 19 bp, Artificial sequence
  SiRNA target sequence
ttgtagttgtcgaacacga

SEQ ID NO: 179639 - DNA, 19 bp, Artificial sequence
  SiRNA target sequence
tgtagttgtcgaacacgat

SEQ ID NO: 179640 - DNA, 19 bp, Artificial sequence
  SiRNA target sequence
gtagttgtcgaacacgatt

SEQ ID NO: 179641 - DNA, 19 bp, Artificial sequence
  SiRNA target sequence
tagttgtcgaacacgattt

SEQ ID NO: 179642 - DNA, 19 bp, Artificial sequence
  SiRNA target sequence
agttgtcgaacacgattta

SEQ ID NO: 179643 - DNA, 19 bp, Artificial sequence
  SiRNA target sequence
gttgtcgaacacgatttag

SEQ ID NO: 179644 - DNA, 19 bp, Artificial sequence
  SiRNA target sequence
ttgtcgaacacgatttagc

SEQ ID NO: 179645 - DNA, 19 bp, Artificial sequence
  SiRNA target sequence
tgtcgaacacgatttagcc

SEQ ID NO: 179646 - DNA, 19 bp, Artificial sequence
  SiRNA target sequence
gtcgaacacgatttagcca

SEQ ID NO: 179647 - DNA, 19 bp, Artificial sequence
  SiRNA target sequence
tcgaacacgatttagccat

SEQ ID NO: 179648 - DNA, 19 bp, Artificial sequence
  SiRNA target sequence
cgaacacgatttagccatt

SEQ ID NO: 179649 - DNA, 19 bp, Artificial sequence
  SiRNA target sequence
gaacacgatttagccattt

SEQ ID NO: 179650 - DNA, 19 bp, Artificial sequence
  SiRNA target sequence
aacacgatttagccatttt

SEQ ID NO: 179651 - DNA, 19 bp, Artificial sequence
  SiRNA target sequence
acacgatttagccatttta

SEQ ID NO: 179652 - DNA, 19 bp, Artificial sequence
  SiRNA target sequence
cacgatttagccattttag

SEQ ID NO: 179653 - DNA, 19 bp, Artificial sequence
  SiRNA target sequence
acgatttagccattttaga

SEQ ID NO: 179654 - DNA, 19 bp, Artificial sequence
  SiRNA target sequence
cgatttagccattttagat

SEQ ID NO: 179655 - DNA, 19 bp, Artificial sequence
  SiRNA target sequence
gatttagccattttagatt

SEQ ID NO: 179656 - DNA, 19 bp, Artificial sequence
  SiRNA target sequence
atttagccattttagattt

SEQ ID NO: 179657 - DNA, 19 bp, Artificial sequence
  SiRNA target sequence
tttagccattttagatttg

SEQ ID NO: 179658 - DNA, 19 bp, Artificial sequence
  SiRNA target sequence
ttagccattttagatttga

SEQ ID NO: 179659 - DNA, 19 bp, Artificial sequence
  SiRNA target sequence
tagccattttagatttgat

SEQ ID NO: 179660 - DNA, 19 bp, Artificial sequence
  SiRNA target sequence
agccattttagatttgatg

SEQ ID NO: 179661 - DNA, 19 bp, Artificial sequence
  SiRNA target sequence
gccattttagatttgatgt

SEQ ID NO: 179662 - DNA, 19 bp, Artificial sequence
  SiRNA target sequence
ccattttagatttgatgtg

SEQ ID NO: 179663 - DNA, 19 bp, Artificial sequence
  SiRNA target sequence
cattttagatttgatgtgt

SEQ ID NO: 179664 - DNA, 19 bp, Artificial sequence
  SiRNA target sequence
attttagatttgatgtgtg

SEQ ID NO: 179665 - DNA, 19 bp, Artificial sequence
  SiRNA target sequence
ttttagatttgatgtgtga

SEQ ID NO: 179666 - DNA, 19 bp, Artificial sequence
  SiRNA target sequence
tttagatttgatgtgtgat

SEQ ID NO: 179667 - DNA, 19 bp, Artificial sequence
  SiRNA target sequence
ttagatttgatgtgtgatt

SEQ ID NO: 179668 - DNA, 19 bp, Artificial sequence
  SiRNA target sequence
tagatttgatgtgtgattt

SEQ ID NO: 179669 - DNA, 19 bp, Artificial sequence
  SiRNA target sequence
agatttgatgtgtgatttt

SEQ ID NO: 179670 - DNA, 19 bp, Artificial sequence
  SiRNA target sequence
gatttgatgtgtgattttg

SEQ ID NO: 179671 - DNA, 19 bp, Artificial sequence
  SiRNA target sequence
atttgatgtgtgattttgg

SEQ ID NO: 179672 - DNA, 19 bp, Artificial sequence
  SiRNA target sequence
tttgatgtgtgattttgga

SEQ ID NO: 179673 - DNA, 19 bp, Artificial sequence
  SiRNA target sequence
ttgatgtgtgattttggat

SEQ ID NO: 179674 - DNA, 19 bp, Artificial sequence
  SiRNA target sequence
tgatgtgtgattttggatg

SEQ ID NO: 179675 - DNA, 19 bp, Artificial sequence
  SiRNA target sequence
gatgtgtgattttggatgt

SEQ ID NO: 179676 - DNA, 19 bp, Artificial sequence
  SiRNA target sequence
atgtgtgattttggatgtg

SEQ ID NO: 179677 - DNA, 19 bp, Artificial sequence
  SiRNA target sequence
tgtgtgattttggatgtgt

SEQ ID NO: 179678 - DNA, 19 bp, Artificial sequence
  SiRNA target sequence
gtgtgattttggatgtgtt

SEQ ID NO: 179679 - DNA, 19 bp, Artificial sequence
  SiRNA target sequence
tgtgattttggatgtgttc

SEQ ID NO: 179680 - DNA, 19 bp, Artificial sequence
  SiRNA target sequence
gtgattttggatgtgttct

SEQ ID NO: 179681 - DNA, 19 bp, Artificial sequence
  SiRNA target sequence
tgattttggatgtgttcta

SEQ ID NO: 179682 - DNA, 19 bp, Artificial sequence
  SiRNA target sequence
gattttggatgtgttctat

SEQ ID NO: 179683 - DNA, 19 bp, Artificial sequence
  SiRNA target sequence
attttggatgtgttctata

SEQ ID NO: 179684 - DNA, 19 bp, Artificial sequence
  SiRNA target sequence
ttttggatgtgttctatac

SEQ ID NO: 179685 - DNA, 19 bp, Artificial sequence
  SiRNA target sequence
tttggatgtgttctatacg

SEQ ID NO: 179686 - DNA, 19 bp, Artificial sequence
  SiRNA target sequence
ttggatgtgttctatacgg

SEQ ID NO: 179687 - DNA, 19 bp, Artificial sequence
  SiRNA target sequence
tggatgtgttctatacgga

SEQ ID NO: 179688 - DNA, 19 bp, Artificial sequence
  SiRNA target sequence
ggatgtgttctatacggac

SEQ ID NO: 179689 - DNA, 19 bp, Artificial sequence
  SiRNA target sequence
gatgtgttctatacggaca

SEQ ID NO: 179690 - DNA, 19 bp, Artificial sequence
  SiRNA target sequence
atgtgttctatacggacaa

SEQ ID NO: 179691 - DNA, 19 bp, Artificial sequence
  SiRNA target sequence
tgtgttctatacggacaat

SEQ ID NO: 179692 - DNA, 19 bp, Artificial sequence
  SiRNA target sequence
gtgttctatacggacaatc

SEQ ID NO: 179693 - DNA, 19 bp, Artificial sequence
  SiRNA target sequence
tgttctatacggacaatct

SEQ ID NO: 179694 - DNA, 19 bp, Artificial sequence
  SiRNA target sequence
gttctatacggacaatctg

SEQ ID NO: 179695 - DNA, 19 bp, Artificial sequence
  SiRNA target sequence
ttctatacggacaatctgg

SEQ ID NO: 179696 - DNA, 19 bp, Artificial sequence
  SiRNA target sequence
tctatacggacaatctggg

SEQ ID NO: 179697 - DNA, 19 bp, Artificial sequence
  SiRNA target sequence
ctatacggacaatctgggg

SEQ ID NO: 179698 - DNA, 19 bp, Artificial sequence
  SiRNA target sequence
tatacggacaatctggggc

SEQ ID NO: 179699 - DNA, 19 bp, Artificial sequence
  SiRNA target sequence
atacggacaatctggggca

SEQ ID NO: 179700 - DNA, 19 bp, Artificial sequence
  SiRNA target sequence
tacggacaatctggggcat

SEQ ID NO: 179701 - DNA, 19 bp, Artificial sequence
  SiRNA target sequence
acggacaatctggggcata

SEQ ID NO: 179702 - DNA, 19 bp, Artificial sequence
  SiRNA target sequence
cggacaatctggggcatac

SEQ ID NO: 179703 - DNA, 19 bp, Artificial sequence
  SiRNA target sequence
ggacaatctggggcatacg

SEQ ID NO: 179704 - DNA, 19 bp, Artificial sequence
  SiRNA target sequence
gacaatctggggcatacgg

SEQ ID NO: 179705 - DNA, 19 bp, Artificial sequence
  SiRNA target sequence
acaatctggggcatacggt

SEQ ID NO: 179706 - DNA, 19 bp, Artificial sequence
  SiRNA target sequence
caatctggggcatacggtg

SEQ ID NO: 179707 - DNA, 19 bp, Artificial sequence
  SiRNA target sequence
aatctggggcatacggtgt

SEQ ID NO: 179708 - DNA, 19 bp, Artificial sequence
  SiRNA target sequence
atctggggcatacggtgta

SEQ ID NO: 179709 - DNA, 19 bp, Artificial sequence
  SiRNA target sequence
tctggggcatacggtgtaa

SEQ ID NO: 179710 - DNA, 19 bp, Artificial sequence
  SiRNA target sequence
ctggggcatacggtgtaat

SEQ ID NO: 179711 - DNA, 19 bp, Artificial sequence
  SiRNA target sequence
tggggcatacggtgtaata

SEQ ID NO: 179712 - DNA, 19 bp, Artificial sequence
  SiRNA target sequence
ggggcatacggtgtaataa

SEQ ID NO: 179713 - DNA, 19 bp, Artificial sequence
  SiRNA target sequence
gggcatacggtgtaataag

SEQ ID NO: 179714 - DNA, 19 bp, Artificial sequence
  SiRNA target sequence
ggcatacggtgtaataagc

SEQ ID NO: 179715 - DNA, 19 bp, Artificial sequence
  SiRNA target sequence
gcatacggtgtaataagcg

SEQ ID NO: 179716 - DNA, 19 bp, Artificial sequence
  SiRNA target sequence
catacggtgtaataagcgc

SEQ ID NO: 179717 - DNA, 19 bp, Artificial sequence
  SiRNA target sequence
atacggtgtaataagcgca

SEQ ID NO: 179718 - DNA, 19 bp, Artificial sequence
  SiRNA target sequence
tacggtgtaataagcgcac

SEQ ID NO: 179719 - DNA, 19 bp, Artificial sequence
  SiRNA target sequence
acggtgtaataagcgcacc

SEQ ID NO: 179720 - DNA, 19 bp, Artificial sequence
  SiRNA target sequence
cggtgtaataagcgcacca

SEQ ID NO: 179721 - DNA, 19 bp, Artificial sequence
  SiRNA target sequence
ggtgtaataagcgcaccat

SEQ ID NO: 179722 - DNA, 19 bp, Artificial sequence
  SiRNA target sequence
gtgtaataagcgcaccata

SEQ ID NO: 179723 - DNA, 19 bp, Artificial sequence
  SiRNA target sequence
tgtaataagcgcaccatac

SEQ ID NO: 179724 - DNA, 19 bp, Artificial sequence
  SiRNA target sequence
gtaataagcgcaccatacg

SEQ ID NO: 179725 - DNA, 19 bp, Artificial sequence
  SiRNA target sequence
taataagcgcaccatacgt

SEQ ID NO: 179726 - DNA, 19 bp, Artificial sequence
  SiRNA target sequence
aataagcgcaccatacgtt

SEQ ID NO: 179727 - DNA, 19 bp, Artificial sequence
  SiRNA target sequence
ataagcgcaccatacgtta

SEQ ID NO: 179728 - DNA, 19 bp, Artificial sequence
  SiRNA target sequence
taagcgcaccatacgttat

SEQ ID NO: 179729 - DNA, 19 bp, Artificial sequence
  SiRNA target sequence
aagcgcaccatacgttatt

SEQ ID NO: 179730 - DNA, 19 bp, Artificial sequence
  SiRNA target sequence
agcgcaccatacgttatta

SEQ ID NO: 179731 - DNA, 19 bp, Artificial sequence
  SiRNA target sequence
gcgcaccatacgttattaa

SEQ ID NO: 179732 - DNA, 19 bp, Artificial sequence
  SiRNA target sequence
cgcaccatacgttattaaa

SEQ ID NO: 179733 - DNA, 19 bp, Artificial sequence
  SiRNA target sequence
gcaccatacgttattaaat

SEQ ID NO: 179734 - DNA, 19 bp, Artificial sequence
  SiRNA target sequence
caccatacgttattaaatc

SEQ ID NO: 179735 - DNA, 19 bp, Artificial sequence
  SiRNA target sequence
accatacgttattaaatca

SEQ ID NO: 179736 - DNA, 19 bp, Artificial sequence
  SiRNA target sequence
ccatacgttattaaatcag

SEQ ID NO: 179737 - DNA, 19 bp, Artificial sequence
  SiRNA target sequence
catacgttattaaatcagc

SEQ ID NO: 179738 - DNA, 19 bp, Artificial sequence
  SiRNA target sequence
atacgttattaaatcagca

SEQ ID NO: 179739 - DNA, 19 bp, Artificial sequence
  SiRNA target sequence
tacgttattaaatcagcaa

SEQ ID NO: 179740 - DNA, 19 bp, Artificial sequence
  SiRNA target sequence
acgttattaaatcagcaat

SEQ ID NO: 179741 - DNA, 19 bp, Artificial sequence
  SiRNA target sequence
cgttattaaatcagcaata

SEQ ID NO: 179742 - DNA, 19 bp, Artificial sequence
  SiRNA target sequence
gttattaaatcagcaataa

SEQ ID NO: 179743 - DNA, 19 bp, Artificial sequence
  SiRNA target sequence
ttattaaatcagcaataaa

SEQ ID NO: 179744 - DNA, 19 bp, Artificial sequence
  SiRNA target sequence
tattaaatcagcaataaat

SEQ ID NO: 179745 - DNA, 19 bp, Artificial sequence
  SiRNA target sequence
attaaatcagcaataaata

SEQ ID NO: 179746 - DNA, 19 bp, Artificial sequence
  SiRNA target sequence
ttaaatcagcaataaatat

SEQ ID NO: 179747 - DNA, 19 bp, Artificial sequence
  SiRNA target sequence
taaatcagcaataaatata

SEQ ID NO: 179748 - DNA, 19 bp, Artificial sequence
  SiRNA target sequence
aaatcagcaataaatatat

SEQ ID NO: 179749 - DNA, 19 bp, Artificial sequence
  SiRNA target sequence
aatcagcaataaatatatt

SEQ ID NO: 179750 - DNA, 19 bp, Artificial sequence
  SiRNA target sequence
atcagcaataaatatattt

SEQ ID NO: 179751 - DNA, 19 bp, Artificial sequence
  SiRNA target sequence
tcagcaataaatatatttc

SEQ ID NO: 179752 - DNA, 19 bp, Artificial sequence
  SiRNA target sequence
cagcaataaatatatttct

SEQ ID NO: 179753 - DNA, 19 bp, Artificial sequence
  SiRNA target sequence
agcaataaatatatttctt

SEQ ID NO: 179754 - DNA, 19 bp, Artificial sequence
  SiRNA target sequence
gcaataaatatatttcttg

SEQ ID NO: 179755 - DNA, 19 bp, Artificial sequence
  SiRNA target sequence
caataaatatatttcttga

SEQ ID NO: 179756 - DNA, 19 bp, Artificial sequence
  SiRNA target sequence
aataaatatatttcttgat

SEQ ID NO: 179757 - DNA, 19 bp, Artificial sequence
  SiRNA target sequence
ataaatatatttcttgatg

SEQ ID NO: 179758 - DNA, 19 bp, Artificial sequence
  SiRNA target sequence
taaatatatttcttgatgg

SEQ ID NO: 179759 - DNA, 19 bp, Artificial sequence
  SiRNA target sequence
aaatatatttcttgatgga

SEQ ID NO: 179760 - DNA, 19 bp, Artificial sequence
  SiRNA target sequence
aatatatttcttgatggat

SEQ ID NO: 179761 - DNA, 19 bp, Artificial sequence
  SiRNA target sequence
atatatttcttgatggatt

SEQ ID NO: 179762 - DNA, 19 bp, Artificial sequence
  SiRNA target sequence
tatatttcttgatggattt

SEQ ID NO: 179763 - DNA, 19 bp, Artificial sequence
  SiRNA target sequence
atatttcttgatggatttt

SEQ ID NO: 179764 - DNA, 19 bp, Artificial sequence
  SiRNA target sequence
tatttcttgatggattttt

SEQ ID NO: 179765 - DNA, 19 bp, Artificial sequence
  SiRNA target sequence
atttcttgatggatttttg

SEQ ID NO: 179766 - DNA, 19 bp, Artificial sequence
  SiRNA target sequence
tttcttgatggatttttgc

SEQ ID NO: 179767 - DNA, 19 bp, Artificial sequence
  SiRNA target sequence
ttcttgatggatttttgcc

SEQ ID NO: 179768 - DNA, 19 bp, Artificial sequence
  SiRNA target sequence
tcttgatggatttttgcct

SEQ ID NO: 179769 - DNA, 19 bp, Artificial sequence
  SiRNA target sequence
cttgatggatttttgccta

SEQ ID NO: 179770 - DNA, 19 bp, Artificial sequence
  SiRNA target sequence
ttgatggatttttgcctac

SEQ ID NO: 179771 - DNA, 19 bp, Artificial sequence
  SiRNA target sequence
tgatggatttttgcctaca

SEQ ID NO: 179772 - DNA, 19 bp, Artificial sequence
  SiRNA target sequence
gatggatttttgcctacag

SEQ ID NO: 179773 - DNA, 19 bp, Artificial sequence
  SiRNA target sequence
atggatttttgcctacaga

SEQ ID NO: 179774 - DNA, 19 bp, Artificial sequence
  SiRNA target sequence
tggatttttgcctacagaa

SEQ ID NO: 179775 - DNA, 19 bp, Artificial sequence
  SiRNA target sequence
ggatttttgcctacagaaa

SEQ ID NO: 179776 - DNA, 19 bp, Artificial sequence
  SiRNA target sequence
gatttttgcctacagaaaa

SEQ ID NO: 179777 - DNA, 19 bp, Artificial sequence
  SiRNA target sequence
atttttgcctacagaaaac

SEQ ID NO: 179778 - DNA, 19 bp, Artificial sequence
  SiRNA target sequence
tttttgcctacagaaaaca

SEQ ID NO: 179779 - DNA, 19 bp, Artificial sequence
  SiRNA target sequence
ttttgcctacagaaaacat

SEQ ID NO: 179780 - DNA, 19 bp, Artificial sequence
  SiRNA target sequence
tttgcctacagaaaacatg

SEQ ID NO: 179781 - DNA, 19 bp, Artificial sequence
  SiRNA target sequence
ttgcctacagaaaacatga

SEQ ID NO: 179782 - DNA, 19 bp, Artificial sequence
  SiRNA target sequence
tgcctacagaaaacatgaa

SEQ ID NO: 179783 - DNA, 19 bp, Artificial sequence
  SiRNA target sequence
gcctacagaaaacatgaaa

SEQ ID NO: 179784 - DNA, 19 bp, Artificial sequence
  SiRNA target sequence
cctacagaaaacatgaaat

SEQ ID NO: 179785 - DNA, 19 bp, Artificial sequence
  SiRNA target sequence
ctacagaaaacatgaaatt

SEQ ID NO: 179786 - DNA, 19 bp, Artificial sequence
  SiRNA target sequence
tacagaaaacatgaaattt

SEQ ID NO: 179787 - DNA, 19 bp, Artificial sequence
  SiRNA target sequence
acagaaaacatgaaattta

SEQ ID NO: 179788 - DNA, 19 bp, Artificial sequence
  SiRNA target sequence
cagaaaacatgaaatttag

SEQ ID NO: 179789 - DNA, 19 bp, Artificial sequence
  SiRNA target sequence
agaaaacatgaaatttaga

SEQ ID NO: 179790 - DNA, 19 bp, Artificial sequence
  SiRNA target sequence
gaaaacatgaaatttagaa

SEQ ID NO: 179791 - DNA, 19 bp, Artificial sequence
  SiRNA target sequence
aaaacatgaaatttagaaa

SEQ ID NO: 179792 - DNA, 19 bp, Artificial sequence
  SiRNA target sequence
aaacatgaaatttagaaat

SEQ ID NO: 179793 - DNA, 19 bp, Artificial sequence
  SiRNA target sequence
aacatgaaatttagaaatt

SEQ ID NO: 179794 - DNA, 19 bp, Artificial sequence
  SiRNA target sequence
acatgaaatttagaaattc

SEQ ID NO: 179795 - DNA, 19 bp, Artificial sequence
  SiRNA target sequence
catgaaatttagaaattca

SEQ ID NO: 179796 - DNA, 19 bp, Artificial sequence
  SiRNA target sequence
atgaaatttagaaattcag

SEQ ID NO: 179797 - DNA, 19 bp, Artificial sequence
  SiRNA target sequence
tgaaatttagaaattcaga

SEQ ID NO: 179798 - DNA, 19 bp, Artificial sequence
  SiRNA target sequence
gaaatttagaaattcagag

SEQ ID NO: 179799 - DNA, 19 bp, Artificial sequence
  SiRNA target sequence
aaatttagaaattcagagt

SEQ ID NO: 179800 - DNA, 19 bp, Artificial sequence
  SiRNA target sequence
aatttagaaattcagagtt

SEQ ID NO: 179801 - DNA, 19 bp, Artificial sequence
  SiRNA target sequence
atttagaaattcagagtta

SEQ ID NO: 179802 - DNA, 19 bp, Artificial sequence
  SiRNA target sequence
tttagaaattcagagttaa

SEQ ID NO: 179803 - DNA, 19 bp, Artificial sequence
  SiRNA target sequence
ttagaaattcagagttaaa

SEQ ID NO: 179804 - DNA, 19 bp, Artificial sequence
  SiRNA target sequence
tagaaattcagagttaaag

SEQ ID NO: 179805 - DNA, 19 bp, Artificial sequence
  SiRNA target sequence
agaaattcagagttaaagt

SEQ ID NO: 179806 - DNA, 19 bp, Artificial sequence
  SiRNA target sequence
gaaattcagagttaaagtt

SEQ ID NO: 179807 - DNA, 19 bp, Artificial sequence
  SiRNA target sequence
aaattcagagttaaagttt

SEQ ID NO: 179808 - DNA, 19 bp, Artificial sequence
  SiRNA target sequence
aattcagagttaaagttta

SEQ ID NO: 179809 - DNA, 19 bp, Artificial sequence
  SiRNA target sequence
attcagagttaaagtttaa

SEQ ID NO: 179810 - DNA, 19 bp, Artificial sequence
  SiRNA target sequence
ttcagagttaaagtttaat

SEQ ID NO: 179811 - DNA, 19 bp, Artificial sequence
  SiRNA target sequence
tcagagttaaagtttaata

SEQ ID NO: 179812 - DNA, 19 bp, Artificial sequence
  SiRNA target sequence
cagagttaaagtttaatat

SEQ ID NO: 179813 - DNA, 19 bp, Artificial sequence
  SiRNA target sequence
agagttaaagtttaatatt

SEQ ID NO: 179814 - DNA, 19 bp, Artificial sequence
  SiRNA target sequence
gagttaaagtttaatattt

SEQ ID NO: 179815 - DNA, 19 bp, Artificial sequence
  SiRNA target sequence
agttaaagtttaatatttc

SEQ ID NO: 179816 - DNA, 19 bp, Artificial sequence
  SiRNA target sequence
gttaaagtttaatatttcg

SEQ ID NO: 179817 - DNA, 19 bp, Artificial sequence
  SiRNA target sequence
ttaaagtttaatatttcgg

SEQ ID NO: 179818 - DNA, 19 bp, Artificial sequence
  SiRNA target sequence
taaagtttaatatttcgga

SEQ ID NO: 179819 - DNA, 19 bp, Artificial sequence
  SiRNA target sequence
aaagtttaatatttcggaa

SEQ ID NO: 179820 - DNA, 19 bp, Artificial sequence
  SiRNA target sequence
aagtttaatatttcggaaa

SEQ ID NO: 179821 - DNA, 19 bp, Artificial sequence
  SiRNA target sequence
agtttaatatttcggaaac

SEQ ID NO: 179822 - DNA, 19 bp, Artificial sequence
  SiRNA target sequence
gtttaatatttcggaaaca

SEQ ID NO: 179823 - DNA, 19 bp, Artificial sequence
  SiRNA target sequence
tttaatatttcggaaacac

SEQ ID NO: 179824 - DNA, 19 bp, Artificial sequence
  SiRNA target sequence
ttaatatttcggaaacact

SEQ ID NO: 179825 - DNA, 19 bp, Artificial sequence
  SiRNA target sequence
taatatttcggaaacactt

SEQ ID NO: 179826 - DNA, 19 bp, Artificial sequence
  SiRNA target sequence
aatatttcggaaacacttg

SEQ ID NO: 179827 - DNA, 19 bp, Artificial sequence
  SiRNA target sequence
atatttcggaaacacttga

SEQ ID NO: 179828 - DNA, 19 bp, Artificial sequence
  SiRNA target sequence
tatttcggaaacacttgat

SEQ ID NO: 179829 - DNA, 19 bp, Artificial sequence
  SiRNA target sequence
atttcggaaacacttgata

SEQ ID NO: 179830 - DNA, 19 bp, Artificial sequence
  SiRNA target sequence
tttcggaaacacttgatag

SEQ ID NO: 179831 - DNA, 19 bp, Artificial sequence
  SiRNA target sequence
ttcggaaacacttgatagt

SEQ ID NO: 179832 - DNA, 19 bp, Artificial sequence
  SiRNA target sequence
tcggaaacacttgatagta

SEQ ID NO: 179833 - DNA, 19 bp, Artificial sequence
  SiRNA target sequence
cggaaacacttgatagtat

SEQ ID NO: 179834 - DNA, 19 bp, Artificial sequence
  SiRNA target sequence
ggaaacacttgatagtatt

SEQ ID NO: 179835 - DNA, 19 bp, Artificial sequence
  SiRNA target sequence
gaaacacttgatagtatta

SEQ ID NO: 179836 - DNA, 19 bp, Artificial sequence
  SiRNA target sequence
aaacacttgatagtattat

SEQ ID NO: 179837 - DNA, 19 bp, Artificial sequence
  SiRNA target sequence
aacacttgatagtattata

SEQ ID NO: 179838 - DNA, 19 bp, Artificial sequence
  SiRNA target sequence
acacttgatagtattatat

SEQ ID NO: 179839 - DNA, 19 bp, Artificial sequence
  SiRNA target sequence
cacttgatagtattatatc

SEQ ID NO: 179840 - DNA, 19 bp, Artificial sequence
  SiRNA target sequence
acttgatagtattatatct

SEQ ID NO: 179841 - DNA, 19 bp, Artificial sequence
  SiRNA target sequence
cttgatagtattatatcta

SEQ ID NO: 179842 - DNA, 19 bp, Artificial sequence
  SiRNA target sequence
ttgatagtattatatctac

SEQ ID NO: 179843 - DNA, 19 bp, Artificial sequence
  SiRNA target sequence
tgatagtattatatctacc

SEQ ID NO: 179844 - DNA, 19 bp, Artificial sequence
  SiRNA target sequence
gatagtattatatctacca

SEQ ID NO: 179845 - DNA, 19 bp, Artificial sequence
  SiRNA target sequence
atagtattatatctaccag

SEQ ID NO: 179846 - DNA, 19 bp, Artificial sequence
  SiRNA target sequence
tagtattatatctaccaga

SEQ ID NO: 179847 - DNA, 19 bp, Artificial sequence
  SiRNA target sequence
agtattatatctaccagag

SEQ ID NO: 179848 - DNA, 19 bp, Artificial sequence
  SiRNA target sequence
gtattatatctaccagaga

SEQ ID NO: 179849 - DNA, 19 bp, Artificial sequence
  SiRNA target sequence
tattatatctaccagagac

SEQ ID NO: 179850 - DNA, 19 bp, Artificial sequence
  SiRNA target sequence
attatatctaccagagacc

SEQ ID NO: 179851 - DNA, 19 bp, Artificial sequence
  SiRNA target sequence
ttatatctaccagagacca

SEQ ID NO: 179852 - DNA, 19 bp, Artificial sequence
  SiRNA target sequence
tatatctaccagagaccag

SEQ ID NO: 179853 - DNA, 19 bp, Artificial sequence
  SiRNA target sequence
atatctaccagagaccagt

SEQ ID NO: 179854 - DNA, 19 bp, Artificial sequence
  SiRNA target sequence
tatctaccagagaccagta

SEQ ID NO: 179855 - DNA, 19 bp, Artificial sequence
  SiRNA target sequence
atctaccagagaccagtat

SEQ ID NO: 179856 - DNA, 19 bp, Artificial sequence
  SiRNA target sequence
tctaccagagaccagtatc

SEQ ID NO: 179857 - DNA, 19 bp, Artificial sequence
  SiRNA target sequence
ctaccagagaccagtatca

SEQ ID NO: 179858 - DNA, 19 bp, Artificial sequence
  SiRNA target sequence
taccagagaccagtatcat

SEQ ID NO: 179859 - DNA, 19 bp, Artificial sequence
  SiRNA target sequence
accagagaccagtatcatt

SEQ ID NO: 179860 - DNA, 19 bp, Artificial sequence
  SiRNA target sequence
ccagagaccagtatcatta

SEQ ID NO: 179861 - DNA, 19 bp, Artificial sequence
  SiRNA target sequence
cagagaccagtatcattat

SEQ ID NO: 179862 - DNA, 19 bp, Artificial sequence
  SiRNA target sequence
agagaccagtatcattatc

SEQ ID NO: 179863 - DNA, 19 bp, Artificial sequence
  SiRNA target sequence
gagaccagtatcattatcc

SEQ ID NO: 179864 - DNA, 19 bp, Artificial sequence
  SiRNA target sequence
agaccagtatcattatccc

SEQ ID NO: 179865 - DNA, 19 bp, Artificial sequence
  SiRNA target sequence
gaccagtatcattatccca

SEQ ID NO: 179866 - DNA, 19 bp, Artificial sequence
  SiRNA target sequence
accagtatcattatcccaa

SEQ ID NO: 179867 - DNA, 19 bp, Artificial sequence
  SiRNA target sequence
ccagtatcattatcccaat

SEQ ID NO: 179868 - DNA, 19 bp, Artificial sequence
  SiRNA target sequence
cagtatcattatcccaatt

SEQ ID NO: 179869 - DNA, 19 bp, Artificial sequence
  SiRNA target sequence
agtatcattatcccaattt

SEQ ID NO: 179870 - DNA, 19 bp, Artificial sequence
  SiRNA target sequence
gtatcattatcccaatttg

SEQ ID NO: 179871 - DNA, 19 bp, Artificial sequence
  SiRNA target sequence
tatcattatcccaatttga

SEQ ID NO: 179872 - DNA, 19 bp, Artificial sequence
  SiRNA target sequence
atcattatcccaatttgat

SEQ ID NO: 179873 - DNA, 19 bp, Artificial sequence
  SiRNA target sequence
tcattatcccaatttgata

SEQ ID NO: 179874 - DNA, 19 bp, Artificial sequence
  SiRNA target sequence
cattatcccaatttgataa

SEQ ID NO: 179875 - DNA, 19 bp, Artificial sequence
  SiRNA target sequence
attatcccaatttgataaa

SEQ ID NO: 179876 - DNA, 19 bp, Artificial sequence
  SiRNA target sequence
ttatcccaatttgataaaa

SEQ ID NO: 179877 - DNA, 19 bp, Artificial sequence
  SiRNA target sequence
tatcccaatttgataaaaa

SEQ ID NO: 179878 - DNA, 19 bp, Artificial sequence
  SiRNA target sequence
atcccaatttgataaaaac

SEQ ID NO: 179879 - DNA, 19 bp, Artificial sequence
  SiRNA target sequence
tcccaatttgataaaaaca

SEQ ID NO: 179880 - DNA, 19 bp, Artificial sequence
  SiRNA target sequence
cccaatttgataaaaacat

SEQ ID NO: 179881 - DNA, 19 bp, Artificial sequence
  SiRNA target sequence
ccaatttgataaaaacata

SEQ ID NO: 179882 - DNA, 19 bp, Artificial sequence
  SiRNA target sequence
caatttgataaaaacatat

SEQ ID NO: 179883 - DNA, 19 bp, Artificial sequence
  SiRNA target sequence
aatttgataaaaacatatc

SEQ ID NO: 179884 - DNA, 19 bp, Artificial sequence
  SiRNA target sequence
atttgataaaaacatatcc

SEQ ID NO: 179885 - DNA, 19 bp, Artificial sequence
  SiRNA target sequence
tttgataaaaacatatcca

SEQ ID NO: 179886 - DNA, 19 bp, Artificial sequence
  SiRNA target sequence
ttgataaaaacatatccaa

SEQ ID NO: 179887 - DNA, 19 bp, Artificial sequence
  SiRNA target sequence
tgataaaaacatatccaaa

SEQ ID NO: 179888 - DNA, 19 bp, Artificial sequence
  SiRNA target sequence
gataaaaacatatccaaat

SEQ ID NO: 179889 - DNA, 19 bp, Artificial sequence
  SiRNA target sequence
ataaaaacatatccaaatt

SEQ ID NO: 179890 - DNA, 19 bp, Artificial sequence
  SiRNA target sequence
taaaaacatatccaaattt

SEQ ID NO: 179891 - DNA, 19 bp, Artificial sequence
  SiRNA target sequence
aaaaacatatccaaatttt

SEQ ID NO: 179892 - DNA, 19 bp, Artificial sequence
  SiRNA target sequence
aaaacatatccaaatttta

SEQ ID NO: 179893 - DNA, 19 bp, Artificial sequence
  SiRNA target sequence
aaacatatccaaattttac

SEQ ID NO: 179894 - DNA, 19 bp, Artificial sequence
  SiRNA target sequence
aacatatccaaattttacg

SEQ ID NO: 179895 - DNA, 19 bp, Artificial sequence
  SiRNA target sequence
acatatccaaattttacgc

SEQ ID NO: 179896 - DNA, 19 bp, Artificial sequence
  SiRNA target sequence
catatccaaattttacgct

SEQ ID NO: 179897 - DNA, 19 bp, Artificial sequence
  SiRNA target sequence
atatccaaattttacgctt

SEQ ID NO: 179898 - DNA, 19 bp, Artificial sequence
  SiRNA target sequence
tatccaaattttacgctta

SEQ ID NO: 179899 - DNA, 19 bp, Artificial sequence
  SiRNA target sequence
atccaaattttacgcttaa

SEQ ID NO: 179900 - DNA, 19 bp, Artificial sequence
  SiRNA target sequence
tccaaattttacgcttaaa

SEQ ID NO: 179901 - DNA, 19 bp, Artificial sequence
  SiRNA target sequence
ccaaattttacgcttaaag

SEQ ID NO: 179902 - DNA, 19 bp, Artificial sequence
  SiRNA target sequence
caaattttacgcttaaagt

SEQ ID NO: 179903 - DNA, 19 bp, Artificial sequence
  SiRNA target sequence
aaattttacgcttaaagtt

SEQ ID NO: 179904 - DNA, 19 bp, Artificial sequence
  SiRNA target sequence
aattttacgcttaaagttg

SEQ ID NO: 179905 - DNA, 19 bp, Artificial sequence
  SiRNA target sequence
attttacgcttaaagttga

SEQ ID NO: 179906 - DNA, 19 bp, Artificial sequence
  SiRNA target sequence
ttttacgcttaaagttgaa

SEQ ID NO: 179907 - DNA, 19 bp, Artificial sequence
  SiRNA target sequence
tttacgcttaaagttgaag

SEQ ID NO: 179908 - DNA, 19 bp, Artificial sequence
  SiRNA target sequence
ttacgcttaaagttgaagg

SEQ ID NO: 179909 - DNA, 19 bp, Artificial sequence
  SiRNA target sequence
tacgcttaaagttgaaggc

SEQ ID NO: 179910 - DNA, 19 bp, Artificial sequence
  SiRNA target sequence
acgcttaaagttgaaggcg

SEQ ID NO: 179911 - DNA, 19 bp, Artificial sequence
  SiRNA target sequence
cgcttaaagttgaaggcgg

SEQ ID NO: 179912 - DNA, 19 bp, Artificial sequence
  SiRNA target sequence
gcttaaagttgaaggcggt

SEQ ID NO: 179913 - DNA, 19 bp, Artificial sequence
  SiRNA target sequence
cttaaagttgaaggcggta

SEQ ID NO: 179914 - DNA, 19 bp, Artificial sequence
  SiRNA target sequence
ttaaagttgaaggcggtaa

SEQ ID NO: 179915 - DNA, 19 bp, Artificial sequence
  SiRNA target sequence
taaagttgaaggcggtaac

SEQ ID NO: 179916 - DNA, 19 bp, Artificial sequence
  SiRNA target sequence
aaagttgaaggcggtaact

SEQ ID NO: 179917 - DNA, 19 bp, Artificial sequence
  SiRNA target sequence
aagttgaaggcggtaactt

SEQ ID NO: 179918 - DNA, 19 bp, Artificial sequence
  SiRNA target sequence
agttgaaggcggtaacttt

SEQ ID NO: 179919 - DNA, 19 bp, Artificial sequence
  SiRNA target sequence
gttgaaggcggtaactttt

SEQ ID NO: 179920 - DNA, 19 bp, Artificial sequence
  SiRNA target sequence
ttgaaggcggtaacttttc

SEQ ID NO: 179921 - DNA, 19 bp, Artificial sequence
  SiRNA target sequence
tgaaggcggtaacttttca

SEQ ID NO: 179922 - DNA, 19 bp, Artificial sequence
  SiRNA target sequence
gaaggcggtaacttttcag

SEQ ID NO: 179923 - DNA, 19 bp, Artificial sequence
  SiRNA target sequence
aaggcggtaacttttcaga

SEQ ID NO: 179924 - DNA, 19 bp, Artificial sequence
  SiRNA target sequence
aggcggtaacttttcagat

SEQ ID NO: 179925 - DNA, 19 bp, Artificial sequence
  SiRNA target sequence
ggcggtaacttttcagatt

SEQ ID NO: 179926 - DNA, 19 bp, Artificial sequence
  SiRNA target sequence
gcggtaacttttcagattc

SEQ ID NO: 179927 - DNA, 19 bp, Artificial sequence
  SiRNA target sequence
cggtaacttttcagattct

SEQ ID NO: 179928 - DNA, 19 bp, Artificial sequence
  SiRNA target sequence
ggtaacttttcagattctg

SEQ ID NO: 179929 - DNA, 19 bp, Artificial sequence
  SiRNA target sequence
gtaacttttcagattctga

SEQ ID NO: 179930 - DNA, 19 bp, Artificial sequence
  SiRNA target sequence
taacttttcagattctgaa

SEQ ID NO: 179931 - DNA, 19 bp, Artificial sequence
  SiRNA target sequence
aacttttcagattctgaaa

SEQ ID NO: 179932 - DNA, 19 bp, Artificial sequence
  SiRNA target sequence
acttttcagattctgaaat

SEQ ID NO: 179933 - DNA, 19 bp, Artificial sequence
  SiRNA target sequence
cttttcagattctgaaatt

SEQ ID NO: 179934 - DNA, 19 bp, Artificial sequence
  SiRNA target sequence
ttttcagattctgaaattg

SEQ ID NO: 179935 - DNA, 19 bp, Artificial sequence
  SiRNA target sequence
tttcagattctgaaattgt

SEQ ID NO: 179936 - DNA, 19 bp, Artificial sequence
  SiRNA target sequence
ttcagattctgaaattgtt

SEQ ID NO: 179937 - DNA, 19 bp, Artificial sequence
  SiRNA target sequence
tcagattctgaaattgttg

SEQ ID NO: 179938 - DNA, 19 bp, Artificial sequence
  SiRNA target sequence
cagattctgaaattgttgt

SEQ ID NO: 179939 - DNA, 19 bp, Artificial sequence
  SiRNA target sequence
agattctgaaattgttgta

SEQ ID NO: 179940 - DNA, 19 bp, Artificial sequence
  SiRNA target sequence
gattctgaaattgttgtat

SEQ ID NO: 179941 - DNA, 19 bp, Artificial sequence
  SiRNA target sequence
attctgaaattgttgtatt

SEQ ID NO: 179942 - DNA, 19 bp, Artificial sequence
  SiRNA target sequence
ttctgaaattgttgtattt

SEQ ID NO: 179943 - DNA, 19 bp, Artificial sequence
  SiRNA target sequence
tctgaaattgttgtatttc

SEQ ID NO: 179944 - DNA, 19 bp, Artificial sequence
  SiRNA target sequence
ctgaaattgttgtatttct

SEQ ID NO: 179945 - DNA, 19 bp, Artificial sequence
  SiRNA target sequence
tgaaattgttgtatttctt

SEQ ID NO: 179946 - DNA, 19 bp, Artificial sequence
  SiRNA target sequence
gaaattgttgtatttcttg

SEQ ID NO: 179947 - DNA, 19 bp, Artificial sequence
  SiRNA target sequence
aaattgttgtatttcttgg

SEQ ID NO: 179948 - DNA, 19 bp, Artificial sequence
  SiRNA target sequence
aattgttgtatttcttggt

SEQ ID NO: 179949 - DNA, 19 bp, Artificial sequence
  SiRNA target sequence
attgttgtatttcttggtg

SEQ ID NO: 179950 - DNA, 19 bp, Artificial sequence
  SiRNA target sequence
ttgttgtatttcttggtga

SEQ ID NO: 179951 - DNA, 19 bp, Artificial sequence
  SiRNA target sequence
tgttgtatttcttggtgaa

SEQ ID NO: 179952 - DNA, 19 bp, Artificial sequence
  SiRNA target sequence
gttgtatttcttggtgaaa

SEQ ID NO: 179953 - DNA, 19 bp, Artificial sequence
  SiRNA target sequence
ttgtatttcttggtgaaaa

SEQ ID NO: 179954 - DNA, 19 bp, Artificial sequence
  SiRNA target sequence
tgtatttcttggtgaaaat

SEQ ID NO: 179955 - DNA, 19 bp, Artificial sequence
  SiRNA target sequence
gtatttcttggtgaaaatg

SEQ ID NO: 179956 - DNA, 19 bp, Artificial sequence
  SiRNA target sequence
tatttcttggtgaaaatgg

SEQ ID NO: 179957 - DNA, 19 bp, Artificial sequence
  SiRNA target sequence
atttcttggtgaaaatgga

SEQ ID NO: 179958 - DNA, 19 bp, Artificial sequence
  SiRNA target sequence
tttcttggtgaaaatggaa

SEQ ID NO: 179959 - DNA, 19 bp, Artificial sequence
  SiRNA target sequence
ttcttggtgaaaatggaat

SEQ ID NO: 179960 - DNA, 19 bp, Artificial sequence
  SiRNA target sequence
tcttggtgaaaatggaatg

SEQ ID NO: 179961 - DNA, 19 bp, Artificial sequence
  SiRNA target sequence
cttggtgaaaatggaatgg

SEQ ID NO: 179962 - DNA, 19 bp, Artificial sequence
  SiRNA target sequence
ttggtgaaaatggaatggg

SEQ ID NO: 179963 - DNA, 19 bp, Artificial sequence
  SiRNA target sequence
tggtgaaaatggaatgggc

SEQ ID NO: 179964 - DNA, 19 bp, Artificial sequence
  SiRNA target sequence
ggtgaaaatggaatgggca

SEQ ID NO: 179965 - DNA, 19 bp, Artificial sequence
  SiRNA target sequence
gtgaaaatggaatgggcaa

SEQ ID NO: 179966 - DNA, 19 bp, Artificial sequence
  SiRNA target sequence
tgaaaatggaatgggcaaa

SEQ ID NO: 179967 - DNA, 19 bp, Artificial sequence
  SiRNA target sequence
gaaaatggaatgggcaaaa

SEQ ID NO: 179968 - DNA, 19 bp, Artificial sequence
  SiRNA target sequence
aaaatggaatgggcaaaac

SEQ ID NO: 179969 - DNA, 19 bp, Artificial sequence
  SiRNA target sequence
aaatggaatgggcaaaact

SEQ ID NO: 179970 - DNA, 19 bp, Artificial sequence
  SiRNA target sequence
aatggaatgggcaaaacta

SEQ ID NO: 179971 - DNA, 19 bp, Artificial sequence
  SiRNA target sequence
atggaatgggcaaaactac

SEQ ID NO: 179972 - DNA, 19 bp, Artificial sequence
  SiRNA target sequence
tggaatgggcaaaactact

SEQ ID NO: 179973 - DNA, 19 bp, Artificial sequence
  SiRNA target sequence
ggaatgggcaaaactactt

SEQ ID NO: 179974 - DNA, 19 bp, Artificial sequence
  SiRNA target sequence
gaatgggcaaaactacttt

SEQ ID NO: 179975 - DNA, 19 bp, Artificial sequence
  SiRNA target sequence
aatgggcaaaactacttta

SEQ ID NO: 179976 - DNA, 19 bp, Artificial sequence
  SiRNA target sequence
atgggcaaaactactttag

SEQ ID NO: 179977 - DNA, 19 bp, Artificial sequence
  SiRNA target sequence
tgggcaaaactactttagt

SEQ ID NO: 179978 - DNA, 19 bp, Artificial sequence
  SiRNA target sequence
gggcaaaactactttagta

SEQ ID NO: 179979 - DNA, 19 bp, Artificial sequence
  SiRNA target sequence
ggcaaaactactttagtag

SEQ ID NO: 179980 - DNA, 19 bp, Artificial sequence
  SiRNA target sequence
gcaaaactactttagtagg

SEQ ID NO: 179981 - DNA, 19 bp, Artificial sequence
  SiRNA target sequence
caaaactactttagtaggt

SEQ ID NO: 179982 - DNA, 19 bp, Artificial sequence
  SiRNA target sequence
aaaactactttagtaggtt

SEQ ID NO: 179983 - DNA, 19 bp, Artificial sequence
  SiRNA target sequence
aaactactttagtaggttt

SEQ ID NO: 179984 - DNA, 19 bp, Artificial sequence
  SiRNA target sequence
aactactttagtaggtttg

SEQ ID NO: 179985 - DNA, 19 bp, Artificial sequence
  SiRNA target sequence
actactttagtaggtttga

SEQ ID NO: 179986 - DNA, 19 bp, Artificial sequence
  SiRNA target sequence
ctactttagtaggtttgat

SEQ ID NO: 179987 - DNA, 19 bp, Artificial sequence
  SiRNA target sequence
tactttagtaggtttgatt

SEQ ID NO: 179988 - DNA, 19 bp, Artificial sequence
  SiRNA target sequence
actttagtaggtttgattt

SEQ ID NO: 179989 - DNA, 19 bp, Artificial sequence
  SiRNA target sequence
ctttagtaggtttgatttc

SEQ ID NO: 179990 - DNA, 19 bp, Artificial sequence
  SiRNA target sequence
tttagtaggtttgatttcg

SEQ ID NO: 179991 - DNA, 19 bp, Artificial sequence
  SiRNA target sequence
ttagtaggtttgatttcgg

SEQ ID NO: 179992 - DNA, 19 bp, Artificial sequence
  SiRNA target sequence
tagtaggtttgatttcggg

SEQ ID NO: 179993 - DNA, 19 bp, Artificial sequence
  SiRNA target sequence
agtaggtttgatttcgggg

SEQ ID NO: 179994 - DNA, 19 bp, Artificial sequence
  SiRNA target sequence
gtaggtttgatttcggggt

SEQ ID NO: 179995 - DNA, 19 bp, Artificial sequence
  SiRNA target sequence
taggtttgatttcggggtt

SEQ ID NO: 179996 - DNA, 19 bp, Artificial sequence
  SiRNA target sequence
aggtttgatttcggggtta

SEQ ID NO: 179997 - DNA, 19 bp, Artificial sequence
  SiRNA target sequence
ggtttgatttcggggttaa

SEQ ID NO: 179998 - DNA, 19 bp, Artificial sequence
  SiRNA target sequence
gtttgatttcggggttaat

SEQ ID NO: 179999 - DNA, 19 bp, Artificial sequence
  SiRNA target sequence
tttgatttcggggttaatt

SEQ ID NO: 180000 - DNA, 19 bp, Artificial sequence
  SiRNA target sequence
ttgatttcggggttaatta

SEQ ID NO: 180001 - DNA, 19 bp, Artificial sequence
  SiRNA target sequence
tgatttcggggttaattaa

SEQ ID NO: 180002 - DNA, 19 bp, Artificial sequence
  SiRNA target sequence
gatttcggggttaattaaa

SEQ ID NO: 180003 - DNA, 19 bp, Artificial sequence
  SiRNA target sequence
atttcggggttaattaaag

SEQ ID NO: 180004 - DNA, 19 bp, Artificial sequence
  SiRNA target sequence
tttcggggttaattaaaga

SEQ ID NO: 180005 - DNA, 19 bp, Artificial sequence
  SiRNA target sequence
ttcggggttaattaaagat

SEQ ID NO: 180006 - DNA, 19 bp, Artificial sequence
  SiRNA target sequence
tcggggttaattaaagatg

SEQ ID NO: 180007 - DNA, 19 bp, Artificial sequence
  SiRNA target sequence
cggggttaattaaagatga

SEQ ID NO: 180008 - DNA, 19 bp, Artificial sequence
  SiRNA target sequence
ggggttaattaaagatgat

SEQ ID NO: 180009 - DNA, 19 bp, Artificial sequence
  SiRNA target sequence
gggttaattaaagatgata

SEQ ID NO: 180010 - DNA, 19 bp, Artificial sequence
  SiRNA target sequence
ggttaattaaagatgataa

SEQ ID NO: 180011 - DNA, 19 bp, Artificial sequence
  SiRNA target sequence
gttaattaaagatgataac

SEQ ID NO: 180012 - DNA, 19 bp, Artificial sequence
  SiRNA target sequence
ttaattaaagatgataacg

SEQ ID NO: 180013 - DNA, 19 bp, Artificial sequence
  SiRNA target sequence
taattaaagatgataacgg

SEQ ID NO: 180014 - DNA, 19 bp, Artificial sequence
  SiRNA target sequence
aattaaagatgataacggg

SEQ ID NO: 180015 - DNA, 19 bp, Artificial sequence
  SiRNA target sequence
attaaagatgataacgggg

SEQ ID NO: 180016 - DNA, 19 bp, Artificial sequence
  SiRNA target sequence
ttaaagatgataacgggga

SEQ ID NO: 180017 - DNA, 19 bp, Artificial sequence
  SiRNA target sequence
taaagatgataacggggaa

SEQ ID NO: 180018 - DNA, 19 bp, Artificial sequence
  SiRNA target sequence
aaagatgataacggggaag

SEQ ID NO: 180019 - DNA, 19 bp, Artificial sequence
  SiRNA target sequence
aagatgataacggggaaga

SEQ ID NO: 180020 - DNA, 19 bp, Artificial sequence
  SiRNA target sequence
agatgataacggggaagag

SEQ ID NO: 180021 - DNA, 19 bp, Artificial sequence
  SiRNA target sequence
gatgataacggggaagagt

SEQ ID NO: 180022 - DNA, 19 bp, Artificial sequence
  SiRNA target sequence
atgataacggggaagagtt

SEQ ID NO: 180023 - DNA, 19 bp, Artificial sequence
  SiRNA target sequence
tgataacggggaagagttc

SEQ ID NO: 180024 - DNA, 19 bp, Artificial sequence
  SiRNA target sequence
gataacggggaagagttcg

SEQ ID NO: 180025 - DNA, 19 bp, Artificial sequence
  SiRNA target sequence
ataacggggaagagttcgg

SEQ ID NO: 180026 - DNA, 19 bp, Artificial sequence
  SiRNA target sequence
taacggggaagagttcggt

SEQ ID NO: 180027 - DNA, 19 bp, Artificial sequence
  SiRNA target sequence
aacggggaagagttcggtt

SEQ ID NO: 180028 - DNA, 19 bp, Artificial sequence
  SiRNA target sequence
acggggaagagttcggttt

SEQ ID NO: 180029 - DNA, 19 bp, Artificial sequence
  SiRNA target sequence
cggggaagagttcggtttg

SEQ ID NO: 180030 - DNA, 19 bp, Artificial sequence
  SiRNA target sequence
ggggaagagttcggtttgt

SEQ ID NO: 180031 - DNA, 19 bp, Artificial sequence
  SiRNA target sequence
gggaagagttcggtttgtt

SEQ ID NO: 180032 - DNA, 19 bp, Artificial sequence
  SiRNA target sequence
ggaagagttcggtttgttg

SEQ ID NO: 180033 - DNA, 19 bp, Artificial sequence
  SiRNA target sequence
gaagagttcggtttgttgt

SEQ ID NO: 180034 - DNA, 19 bp, Artificial sequence
  SiRNA target sequence
aagagttcggtttgttgtc

SEQ ID NO: 180035 - DNA, 19 bp, Artificial sequence
  SiRNA target sequence
agagttcggtttgttgtca

SEQ ID NO: 180036 - DNA, 19 bp, Artificial sequence
  SiRNA target sequence
gagttcggtttgttgtcat

SEQ ID NO: 180037 - DNA, 19 bp, Artificial sequence
  SiRNA target sequence
agttcggtttgttgtcata

SEQ ID NO: 180038 - DNA, 19 bp, Artificial sequence
  SiRNA target sequence
gttcggtttgttgtcatat

SEQ ID NO: 180039 - DNA, 19 bp, Artificial sequence
  SiRNA target sequence
ttcggtttgttgtcatata

SEQ ID NO: 180040 - DNA, 19 bp, Artificial sequence
  SiRNA target sequence
tcggtttgttgtcatatag

SEQ ID NO: 180041 - DNA, 19 bp, Artificial sequence
  SiRNA target sequence
cggtttgttgtcatatagt

SEQ ID NO: 180042 - DNA, 19 bp, Artificial sequence
  SiRNA target sequence
ggtttgttgtcatatagtc

SEQ ID NO: 180043 - DNA, 19 bp, Artificial sequence
  SiRNA target sequence
gtttgttgtcatatagtct

SEQ ID NO: 180044 - DNA, 19 bp, Artificial sequence
  SiRNA target sequence
tttgttgtcatatagtctt

SEQ ID NO: 180045 - DNA, 19 bp, Artificial sequence
  SiRNA target sequence
ttgttgtcatatagtctta

SEQ ID NO: 180046 - DNA, 19 bp, Artificial sequence
  SiRNA target sequence
tgttgtcatatagtcttaa

SEQ ID NO: 180047 - DNA, 19 bp, Artificial sequence
  SiRNA target sequence
gttgtcatatagtcttaaa

SEQ ID NO: 180048 - DNA, 19 bp, Artificial sequence
  SiRNA target sequence
ttgtcatatagtcttaaac

SEQ ID NO: 180049 - DNA, 19 bp, Artificial sequence
  SiRNA target sequence
tgtcatatagtcttaaacc

SEQ ID NO: 180050 - DNA, 19 bp, Artificial sequence
  SiRNA target sequence
gtcatatagtcttaaaccg

SEQ ID NO: 180051 - DNA, 19 bp, Artificial sequence
  SiRNA target sequence
tcatatagtcttaaaccgc

SEQ ID NO: 180052 - DNA, 19 bp, Artificial sequence
  SiRNA target sequence
catatagtcttaaaccgca

SEQ ID NO: 180053 - DNA, 19 bp, Artificial sequence
  SiRNA target sequence
atatagtcttaaaccgcaa

SEQ ID NO: 180054 - DNA, 19 bp, Artificial sequence
  SiRNA target sequence
tatagtcttaaaccgcaaa

SEQ ID NO: 180055 - DNA, 19 bp, Artificial sequence
  SiRNA target sequence
atagtcttaaaccgcaaaa

SEQ ID NO: 180056 - DNA, 19 bp, Artificial sequence
  SiRNA target sequence
tagtcttaaaccgcaaaaa

SEQ ID NO: 180057 - DNA, 19 bp, Artificial sequence
  SiRNA target sequence
agtcttaaaccgcaaaaaa

SEQ ID NO: 180058 - DNA, 19 bp, Artificial sequence
  SiRNA target sequence
gtcttaaaccgcaaaaaat

SEQ ID NO: 180059 - DNA, 19 bp, Artificial sequence
  SiRNA target sequence
tcttaaaccgcaaaaaatc

SEQ ID NO: 180060 - DNA, 19 bp, Artificial sequence
  SiRNA target sequence
cttaaaccgcaaaaaatca

SEQ ID NO: 180061 - DNA, 19 bp, Artificial sequence
  SiRNA target sequence
ttaaaccgcaaaaaatcat

SEQ ID NO: 180062 - DNA, 19 bp, Artificial sequence
  SiRNA target sequence
taaaccgcaaaaaatcata

SEQ ID NO: 180063 - DNA, 19 bp, Artificial sequence
  SiRNA target sequence
aaaccgcaaaaaatcatac

SEQ ID NO: 180064 - DNA, 19 bp, Artificial sequence
  SiRNA target sequence
aaccgcaaaaaatcatacc

SEQ ID NO: 180065 - DNA, 19 bp, Artificial sequence
  SiRNA target sequence
accgcaaaaaatcataccg

SEQ ID NO: 180066 - DNA, 19 bp, Artificial sequence
  SiRNA target sequence
ccgcaaaaaatcataccga

SEQ ID NO: 180067 - DNA, 19 bp, Artificial sequence
  SiRNA target sequence
cgcaaaaaatcataccgaa

SEQ ID NO: 180068 - DNA, 19 bp, Artificial sequence
  SiRNA target sequence
gcaaaaaatcataccgaaa

SEQ ID NO: 180069 - DNA, 19 bp, Artificial sequence
  SiRNA target sequence
caaaaaatcataccgaaat

SEQ ID NO: 180070 - DNA, 19 bp, Artificial sequence
  SiRNA target sequence
aaaaaatcataccgaaata

SEQ ID NO: 180071 - DNA, 19 bp, Artificial sequence
  SiRNA target sequence
aaaaatcataccgaaatac

SEQ ID NO: 180072 - DNA, 19 bp, Artificial sequence
  SiRNA target sequence
aaaatcataccgaaataca

SEQ ID NO: 180073 - DNA, 19 bp, Artificial sequence
  SiRNA target sequence
aaatcataccgaaatacaa

SEQ ID NO: 180074 - DNA, 19 bp, Artificial sequence
  SiRNA target sequence
aatcataccgaaatacaaa

SEQ ID NO: 180075 - DNA, 19 bp, Artificial sequence
  SiRNA target sequence
atcataccgaaatacaaag

SEQ ID NO: 180076 - DNA, 19 bp, Artificial sequence
  SiRNA target sequence
tcataccgaaatacaaagg

SEQ ID NO: 180077 - DNA, 19 bp, Artificial sequence
  SiRNA target sequence
cataccgaaatacaaagga

SEQ ID NO: 180078 - DNA, 19 bp, Artificial sequence
  SiRNA target sequence
ataccgaaatacaaaggaa

SEQ ID NO: 180079 - DNA, 19 bp, Artificial sequence
  SiRNA target sequence
taccgaaatacaaaggaac

SEQ ID NO: 180080 - DNA, 19 bp, Artificial sequence
  SiRNA target sequence
accgaaatacaaaggaaca

SEQ ID NO: 180081 - DNA, 19 bp, Artificial sequence
  SiRNA target sequence
ccgaaatacaaaggaacag

SEQ ID NO: 180082 - DNA, 19 bp, Artificial sequence
  SiRNA target sequence
cgaaatacaaaggaacagt

SEQ ID NO: 180083 - DNA, 19 bp, Artificial sequence
  SiRNA target sequence
gaaatacaaaggaacagtt

SEQ ID NO: 180084 - DNA, 19 bp, Artificial sequence
  SiRNA target sequence
aaatacaaaggaacagtta

SEQ ID NO: 180085 - DNA, 19 bp, Artificial sequence
  SiRNA target sequence
aatacaaaggaacagttag

SEQ ID NO: 180086 - DNA, 19 bp, Artificial sequence
  SiRNA target sequence
atacaaaggaacagttaga

SEQ ID NO: 180087 - DNA, 19 bp, Artificial sequence
  SiRNA target sequence
tacaaaggaacagttagag

SEQ ID NO: 180088 - DNA, 19 bp, Artificial sequence
  SiRNA target sequence
acaaaggaacagttagaga

SEQ ID NO: 180089 - DNA, 19 bp, Artificial sequence
  SiRNA target sequence
caaaggaacagttagagat

SEQ ID NO: 180090 - DNA, 19 bp, Artificial sequence
  SiRNA target sequence
aaaggaacagttagagatc

SEQ ID NO: 180091 - DNA, 19 bp, Artificial sequence
  SiRNA target sequence
aaggaacagttagagatct

SEQ ID NO: 180092 - DNA, 19 bp, Artificial sequence
  SiRNA target sequence
aggaacagttagagatctt

SEQ ID NO: 180093 - DNA, 19 bp, Artificial sequence
  SiRNA target sequence
ggaacagttagagatcttt

SEQ ID NO: 180094 - DNA, 19 bp, Artificial sequence
  SiRNA target sequence
gaacagttagagatctttt

SEQ ID NO: 180095 - DNA, 19 bp, Artificial sequence
  SiRNA target sequence
aacagttagagatcttttt

SEQ ID NO: 180096 - DNA, 19 bp, Artificial sequence
  SiRNA target sequence
acagttagagatcttttta

SEQ ID NO: 180097 - DNA, 19 bp, Artificial sequence
  SiRNA target sequence
cagttagagatctttttat

SEQ ID NO: 180098 - DNA, 19 bp, Artificial sequence
  SiRNA target sequence
agttagagatctttttatg

SEQ ID NO: 180099 - DNA, 19 bp, Artificial sequence
  SiRNA target sequence
gttagagatctttttatgt

SEQ ID NO: 180100 - DNA, 19 bp, Artificial sequence
  SiRNA target sequence
ttagagatctttttatgtc

SEQ ID NO: 180101 - DNA, 19 bp, Artificial sequence
  SiRNA target sequence
tagagatctttttatgtca

SEQ ID NO: 180102 - DNA, 19 bp, Artificial sequence
  SiRNA target sequence
agagatctttttatgtcaa

SEQ ID NO: 180103 - DNA, 19 bp, Artificial sequence
  SiRNA target sequence
gagatctttttatgtcaaa

SEQ ID NO: 180104 - DNA, 19 bp, Artificial sequence
  SiRNA target sequence
agatctttttatgtcaaaa

SEQ ID NO: 180105 - DNA, 19 bp, Artificial sequence
  SiRNA target sequence
gatctttttatgtcaaaaa

SEQ ID NO: 180106 - DNA, 19 bp, Artificial sequence
  SiRNA target sequence
atctttttatgtcaaaaat

SEQ ID NO: 180107 - DNA, 19 bp, Artificial sequence
  SiRNA target sequence
tctttttatgtcaaaaatt

SEQ ID NO: 180108 - DNA, 19 bp, Artificial sequence
  SiRNA target sequence
ctttttatgtcaaaaattc

SEQ ID NO: 180109 - DNA, 19 bp, Artificial sequence
  SiRNA target sequence
tttttatgtcaaaaattcg

SEQ ID NO: 180110 - DNA, 19 bp, Artificial sequence
  SiRNA target sequence
ttttatgtcaaaaattcgt

SEQ ID NO: 180111 - DNA, 19 bp, Artificial sequence
  SiRNA target sequence
tttatgtcaaaaattcgtt

SEQ ID NO: 180112 - DNA, 19 bp, Artificial sequence
  SiRNA target sequence
ttatgtcaaaaattcgttc

SEQ ID NO: 180113 - DNA, 19 bp, Artificial sequence
  SiRNA target sequence
tatgtcaaaaattcgttct

SEQ ID NO: 180114 - DNA, 19 bp, Artificial sequence
  SiRNA target sequence
atgtcaaaaattcgttctt

SEQ ID NO: 180115 - DNA, 19 bp, Artificial sequence
  SiRNA target sequence
tgtcaaaaattcgttcttc

SEQ ID NO: 180116 - DNA, 19 bp, Artificial sequence
  SiRNA target sequence
gtcaaaaattcgttcttcc

SEQ ID NO: 180117 - DNA, 19 bp, Artificial sequence
  SiRNA target sequence
tcaaaaattcgttcttcct

SEQ ID NO: 180118 - DNA, 19 bp, Artificial sequence
  SiRNA target sequence
caaaaattcgttcttcctt

SEQ ID NO: 180119 - DNA, 19 bp, Artificial sequence
  SiRNA target sequence
aaaaattcgttcttccttt

SEQ ID NO: 180120 - DNA, 19 bp, Artificial sequence
  SiRNA target sequence
aaaattcgttcttcctttt

SEQ ID NO: 180121 - DNA, 19 bp, Artificial sequence
  SiRNA target sequence
aaattcgttcttccttttt

SEQ ID NO: 180122 - DNA, 19 bp, Artificial sequence
  SiRNA target sequence
aattcgttcttccttttta

SEQ ID NO: 180123 - DNA, 19 bp, Artificial sequence
  SiRNA target sequence
attcgttcttcctttttag

SEQ ID NO: 180124 - DNA, 19 bp, Artificial sequence
  SiRNA target sequence
ttcgttcttcctttttaga

SEQ ID NO: 180125 - DNA, 19 bp, Artificial sequence
  SiRNA target sequence
tcgttcttcctttttagac

SEQ ID NO: 180126 - DNA, 19 bp, Artificial sequence
  SiRNA target sequence
cgttcttcctttttagacg

SEQ ID NO: 180127 - DNA, 19 bp, Artificial sequence
  SiRNA target sequence
gttcttcctttttagacgc

SEQ ID NO: 180128 - DNA, 19 bp, Artificial sequence
  SiRNA target sequence
ttcttcctttttagacgct

SEQ ID NO: 180129 - DNA, 19 bp, Artificial sequence
  SiRNA target sequence
tcttcctttttagacgcta

SEQ ID NO: 180130 - DNA, 19 bp, Artificial sequence
  SiRNA target sequence
cttcctttttagacgctaa

SEQ ID NO: 180131 - DNA, 19 bp, Artificial sequence
  SiRNA target sequence
ttcctttttagacgctaat

SEQ ID NO: 180132 - DNA, 19 bp, Artificial sequence
  SiRNA target sequence
tcctttttagacgctaatt

SEQ ID NO: 180133 - DNA, 19 bp, Artificial sequence
  SiRNA target sequence
cctttttagacgctaattt

SEQ ID NO: 180134 - DNA, 19 bp, Artificial sequence
  SiRNA target sequence
ctttttagacgctaatttt

SEQ ID NO: 180135 - DNA, 19 bp, Artificial sequence
  SiRNA target sequence
tttttagacgctaattttg

SEQ ID NO: 180136 - DNA, 19 bp, Artificial sequence
  SiRNA target sequence
ttttagacgctaattttgt

SEQ ID NO: 180137 - DNA, 19 bp, Artificial sequence
  SiRNA target sequence
tttagacgctaattttgtt

SEQ ID NO: 180138 - DNA, 19 bp, Artificial sequence
  SiRNA target sequence
ttagacgctaattttgtta

SEQ ID NO: 180139 - DNA, 19 bp, Artificial sequence
  SiRNA target sequence
tagacgctaattttgttaa

SEQ ID NO: 180140 - DNA, 19 bp, Artificial sequence
  SiRNA target sequence
agacgctaattttgttaat

SEQ ID NO: 180141 - DNA, 19 bp, Artificial sequence
  SiRNA target sequence
gacgctaattttgttaatg

SEQ ID NO: 180142 - DNA, 19 bp, Artificial sequence
  SiRNA target sequence
acgctaattttgttaatga

SEQ ID NO: 180143 - DNA, 19 bp, Artificial sequence
  SiRNA target sequence
cgctaattttgttaatgaa

SEQ ID NO: 180144 - DNA, 19 bp, Artificial sequence
  SiRNA target sequence
gctaattttgttaatgaag

SEQ ID NO: 180145 - DNA, 19 bp, Artificial sequence
  SiRNA target sequence
ctaattttgttaatgaagc

SEQ ID NO: 180146 - DNA, 19 bp, Artificial sequence
  SiRNA target sequence
taattttgttaatgaagct

SEQ ID NO: 180147 - DNA, 19 bp, Artificial sequence
  SiRNA target sequence
aattttgttaatgaagcta

SEQ ID NO: 180148 - DNA, 19 bp, Artificial sequence
  SiRNA target sequence
attttgttaatgaagctat

SEQ ID NO: 180149 - DNA, 19 bp, Artificial sequence
  SiRNA target sequence
ttttgttaatgaagctatt

SEQ ID NO: 180150 - DNA, 19 bp, Artificial sequence
  SiRNA target sequence
tttgttaatgaagctatta

SEQ ID NO: 180151 - DNA, 19 bp, Artificial sequence
  SiRNA target sequence
ttgttaatgaagctattaa

SEQ ID NO: 180152 - DNA, 19 bp, Artificial sequence
  SiRNA target sequence
tgttaatgaagctattaaa

SEQ ID NO: 180153 - DNA, 19 bp, Artificial sequence
  SiRNA target sequence
gttaatgaagctattaaac

SEQ ID NO: 180154 - DNA, 19 bp, Artificial sequence
  SiRNA target sequence
ttaatgaagctattaaacc

SEQ ID NO: 180155 - DNA, 19 bp, Artificial sequence
  SiRNA target sequence
taatgaagctattaaacct

SEQ ID NO: 180156 - DNA, 19 bp, Artificial sequence
  SiRNA target sequence
aatgaagctattaaacctt

SEQ ID NO: 180157 - DNA, 19 bp, Artificial sequence
  SiRNA target sequence
atgaagctattaaaccttt

SEQ ID NO: 180158 - DNA, 19 bp, Artificial sequence
  SiRNA target sequence
tgaagctattaaaccttta

SEQ ID NO: 180159 - DNA, 19 bp, Artificial sequence
  SiRNA target sequence
gaagctattaaacctttag

SEQ ID NO: 180160 - DNA, 19 bp, Artificial sequence
  SiRNA target sequence
aagctattaaacctttaga

SEQ ID NO: 180161 - DNA, 19 bp, Artificial sequence
  SiRNA target sequence
agctattaaacctttagat

SEQ ID NO: 180162 - DNA, 19 bp, Artificial sequence
  SiRNA target sequence
gctattaaacctttagata

SEQ ID NO: 180163 - DNA, 19 bp, Artificial sequence
  SiRNA target sequence
ctattaaacctttagatat

SEQ ID NO: 180164 - DNA, 19 bp, Artificial sequence
  SiRNA target sequence
tattaaacctttagatatt

SEQ ID NO: 180165 - DNA, 19 bp, Artificial sequence
  SiRNA target sequence
attaaacctttagatattc

SEQ ID NO: 180166 - DNA, 19 bp, Artificial sequence
  SiRNA target sequence
ttaaacctttagatattca

SEQ ID NO: 180167 - DNA, 19 bp, Artificial sequence
  SiRNA target sequence
taaacctttagatattcat

SEQ ID NO: 180168 - DNA, 19 bp, Artificial sequence
  SiRNA target sequence
aaacctttagatattcatc

SEQ ID NO: 180169 - DNA, 19 bp, Artificial sequence
  SiRNA target sequence
aacctttagatattcatca

SEQ ID NO: 180170 - DNA, 19 bp, Artificial sequence
  SiRNA target sequence
acctttagatattcatcat

SEQ ID NO: 180171 - DNA, 19 bp, Artificial sequence
  SiRNA target sequence
cctttagatattcatcatt

SEQ ID NO: 180172 - DNA, 19 bp, Artificial sequence
  SiRNA target sequence
ctttagatattcatcattt

SEQ ID NO: 180173 - DNA, 19 bp, Artificial sequence
  SiRNA target sequence
tttagatattcatcattta

SEQ ID NO: 180174 - DNA, 19 bp, Artificial sequence
  SiRNA target sequence
ttagatattcatcatttat

SEQ ID NO: 180175 - DNA, 19 bp, Artificial sequence
  SiRNA target sequence
tagatattcatcatttata

SEQ ID NO: 180176 - DNA, 19 bp, Artificial sequence
  SiRNA target sequence
agatattcatcatttatac

SEQ ID NO: 180177 - DNA, 19 bp, Artificial sequence
  SiRNA target sequence
gatattcatcatttatacg

SEQ ID NO: 180178 - DNA, 19 bp, Artificial sequence
  SiRNA target sequence
atattcatcatttatacga

SEQ ID NO: 180179 - DNA, 19 bp, Artificial sequence
  SiRNA target sequence
tattcatcatttatacgac

SEQ ID NO: 180180 - DNA, 19 bp, Artificial sequence
  SiRNA target sequence
attcatcatttatacgacc

SEQ ID NO: 180181 - DNA, 19 bp, Artificial sequence
  SiRNA target sequence
ttcatcatttatacgacca

SEQ ID NO: 180182 - DNA, 19 bp, Artificial sequence
  SiRNA target sequence
tcatcatttatacgaccaa

SEQ ID NO: 180183 - DNA, 19 bp, Artificial sequence
  SiRNA target sequence
catcatttatacgaccaac

SEQ ID NO: 180184 - DNA, 19 bp, Artificial sequence
  SiRNA target sequence
atcatttatacgaccaact

SEQ ID NO: 180185 - DNA, 19 bp, Artificial sequence
  SiRNA target sequence
tcatttatacgaccaactt

SEQ ID NO: 180186 - DNA, 19 bp, Artificial sequence
  SiRNA target sequence
catttatacgaccaacttg

SEQ ID NO: 180187 - DNA, 19 bp, Artificial sequence
  SiRNA target sequence
atttatacgaccaacttgt

SEQ ID NO: 180188 - DNA, 19 bp, Artificial sequence
  SiRNA target sequence
tttatacgaccaacttgta

SEQ ID NO: 180189 - DNA, 19 bp, Artificial sequence
  SiRNA target sequence
ttatacgaccaacttgtag

SEQ ID NO: 180190 - DNA, 19 bp, Artificial sequence
  SiRNA target sequence
tatacgaccaacttgtaga

SEQ ID NO: 180191 - DNA, 19 bp, Artificial sequence
  SiRNA target sequence
atacgaccaacttgtagaa

SEQ ID NO: 180192 - DNA, 19 bp, Artificial sequence
  SiRNA target sequence
tacgaccaacttgtagaaa

SEQ ID NO: 180193 - DNA, 19 bp, Artificial sequence
  SiRNA target sequence
acgaccaacttgtagaaaa

SEQ ID NO: 180194 - DNA, 19 bp, Artificial sequence
  SiRNA target sequence
cgaccaacttgtagaaaac

SEQ ID NO: 180195 - DNA, 19 bp, Artificial sequence
  SiRNA target sequence
gaccaacttgtagaaaact

SEQ ID NO: 180196 - DNA, 19 bp, Artificial sequence
  SiRNA target sequence
accaacttgtagaaaactt

SEQ ID NO: 180197 - DNA, 19 bp, Artificial sequence
  SiRNA target sequence
ccaacttgtagaaaacttg

SEQ ID NO: 180198 - DNA, 19 bp, Artificial sequence
  SiRNA target sequence
caacttgtagaaaacttga

SEQ ID NO: 180199 - DNA, 19 bp, Artificial sequence
  SiRNA target sequence
aacttgtagaaaacttgag

SEQ ID NO: 180200 - DNA, 19 bp, Artificial sequence
  SiRNA target sequence
acttgtagaaaacttgagt

SEQ ID NO: 180201 - DNA, 19 bp, Artificial sequence
  SiRNA target sequence
cttgtagaaaacttgagtg

SEQ ID NO: 180202 - DNA, 19 bp, Artificial sequence
  SiRNA target sequence
ttgtagaaaacttgagtgg

SEQ ID NO: 180203 - DNA, 19 bp, Artificial sequence
  SiRNA target sequence
tgtagaaaacttgagtggt

SEQ ID NO: 180204 - DNA, 19 bp, Artificial sequence
  SiRNA target sequence
gtagaaaacttgagtggtg

SEQ ID NO: 180205 - DNA, 19 bp, Artificial sequence
  SiRNA target sequence
tagaaaacttgagtggtgg

SEQ ID NO: 180206 - DNA, 19 bp, Artificial sequence
  SiRNA target sequence
agaaaacttgagtggtgga

SEQ ID NO: 180207 - DNA, 19 bp, Artificial sequence
  SiRNA target sequence
gaaaacttgagtggtggag

SEQ ID NO: 180208 - DNA, 19 bp, Artificial sequence
  SiRNA target sequence
aaaacttgagtggtggaga

SEQ ID NO: 180209 - DNA, 19 bp, Artificial sequence
  SiRNA target sequence
aaacttgagtggtggagaa

SEQ ID NO: 180210 - DNA, 19 bp, Artificial sequence
  SiRNA target sequence
aacttgagtggtggagaat

SEQ ID NO: 180211 - DNA, 19 bp, Artificial sequence
  SiRNA target sequence
acttgagtggtggagaatt

SEQ ID NO: 180212 - DNA, 19 bp, Artificial sequence
  SiRNA target sequence
cttgagtggtggagaatta

SEQ ID NO: 180213 - DNA, 19 bp, Artificial sequence
  SiRNA target sequence
ttgagtggtggagaattac

SEQ ID NO: 180214 - DNA, 19 bp, Artificial sequence
  SiRNA target sequence
tgagtggtggagaattaca

SEQ ID NO: 180215 - DNA, 19 bp, Artificial sequence
  SiRNA target sequence
gagtggtggagaattacaa

SEQ ID NO: 180216 - DNA, 19 bp, Artificial sequence
  SiRNA target sequence
agtggtggagaattacaaa

SEQ ID NO: 180217 - DNA, 19 bp, Artificial sequence
  SiRNA target sequence
gtggtggagaattacaaag

SEQ ID NO: 180218 - DNA, 19 bp, Artificial sequence
  SiRNA target sequence
tggtggagaattacaaaga

SEQ ID NO: 180219 - DNA, 19 bp, Artificial sequence
  SiRNA target sequence
ggtggagaattacaaagaa

SEQ ID NO: 180220 - DNA, 19 bp, Artificial sequence
  SiRNA target sequence
gtggagaattacaaagaat

SEQ ID NO: 180221 - DNA, 19 bp, Artificial sequence
  SiRNA target sequence
tggagaattacaaagaatt

SEQ ID NO: 180222 - DNA, 19 bp, Artificial sequence
  SiRNA target sequence
ggagaattacaaagaattg

SEQ ID NO: 180223 - DNA, 19 bp, Artificial sequence
  SiRNA target sequence
gagaattacaaagaattgc

SEQ ID NO: 180224 - DNA, 19 bp, Artificial sequence
  SiRNA target sequence
agaattacaaagaattgca

SEQ ID NO: 180225 - DNA, 19 bp, Artificial sequence
  SiRNA target sequence
gaattacaaagaattgcaa

SEQ ID NO: 180226 - DNA, 19 bp, Artificial sequence
  SiRNA target sequence
aattacaaagaattgcaat

SEQ ID NO: 180227 - DNA, 19 bp, Artificial sequence
  SiRNA target sequence
attacaaagaattgcaata

SEQ ID NO: 180228 - DNA, 19 bp, Artificial sequence
  SiRNA target sequence
ttacaaagaattgcaataa

SEQ ID NO: 180229 - DNA, 19 bp, Artificial sequence
  SiRNA target sequence
tacaaagaattgcaataat

SEQ ID NO: 180230 - DNA, 19 bp, Artificial sequence
  SiRNA target sequence
acaaagaattgcaataata

SEQ ID NO: 180231 - DNA, 19 bp, Artificial sequence
  SiRNA target sequence
caaagaattgcaataataa

SEQ ID NO: 180232 - DNA, 19 bp, Artificial sequence
  SiRNA target sequence
aaagaattgcaataataat

SEQ ID NO: 180233 - DNA, 19 bp, Artificial sequence
  SiRNA target sequence
aagaattgcaataataata

SEQ ID NO: 180234 - DNA, 19 bp, Artificial sequence
  SiRNA target sequence
agaattgcaataataatat

SEQ ID NO: 180235 - DNA, 19 bp, Artificial sequence
  SiRNA target sequence
gaattgcaataataatatg

SEQ ID NO: 180236 - DNA, 19 bp, Artificial sequence
  SiRNA target sequence
aattgcaataataatatgt

SEQ ID NO: 180237 - DNA, 19 bp, Artificial sequence
  SiRNA target sequence
attgcaataataatatgtt

SEQ ID NO: 180238 - DNA, 19 bp, Artificial sequence
  SiRNA target sequence
ttgcaataataatatgttt

SEQ ID NO: 180239 - DNA, 19 bp, Artificial sequence
  SiRNA target sequence
tgcaataataatatgttta

SEQ ID NO: 180240 - DNA, 19 bp, Artificial sequence
  SiRNA target sequence
gcaataataatatgtttag

SEQ ID NO: 180241 - DNA, 19 bp, Artificial sequence
  SiRNA target sequence
caataataatatgtttagg

SEQ ID NO: 180242 - DNA, 19 bp, Artificial sequence
  SiRNA target sequence
aataataatatgtttagga

SEQ ID NO: 180243 - DNA, 19 bp, Artificial sequence
  SiRNA target sequence
ataataatatgtttaggaa

SEQ ID NO: 180244 - DNA, 19 bp, Artificial sequence
  SiRNA target sequence
taataatatgtttaggaaa

SEQ ID NO: 180245 - DNA, 19 bp, Artificial sequence
  SiRNA target sequence
aataatatgtttaggaaaa

SEQ ID NO: 180246 - DNA, 19 bp, Artificial sequence
  SiRNA target sequence
ataatatgtttaggaaaag

SEQ ID NO: 180247 - DNA, 19 bp, Artificial sequence
  SiRNA target sequence
taatatgtttaggaaaaga

SEQ ID NO: 180248 - DNA, 19 bp, Artificial sequence
  SiRNA target sequence
aatatgtttaggaaaagat

SEQ ID NO: 180249 - DNA, 19 bp, Artificial sequence
  SiRNA target sequence
atatgtttaggaaaagatg

SEQ ID NO: 180250 - DNA, 19 bp, Artificial sequence
  SiRNA target sequence
tatgtttaggaaaagatgc

SEQ ID NO: 180251 - DNA, 19 bp, Artificial sequence
  SiRNA target sequence
atgtttaggaaaagatgct

SEQ ID NO: 180252 - DNA, 19 bp, Artificial sequence
  SiRNA target sequence
tgtttaggaaaagatgcta

SEQ ID NO: 180253 - DNA, 19 bp, Artificial sequence
  SiRNA target sequence
gtttaggaaaagatgctaa

SEQ ID NO: 180254 - DNA, 19 bp, Artificial sequence
  SiRNA target sequence
tttaggaaaagatgctaac

SEQ ID NO: 180255 - DNA, 19 bp, Artificial sequence
  SiRNA target sequence
ttaggaaaagatgctaacc

SEQ ID NO: 180256 - DNA, 19 bp, Artificial sequence
  SiRNA target sequence
taggaaaagatgctaacct

SEQ ID NO: 180257 - DNA, 19 bp, Artificial sequence
  SiRNA target sequence
aggaaaagatgctaacctt

SEQ ID NO: 180258 - DNA, 19 bp, Artificial sequence
  SiRNA target sequence
ggaaaagatgctaaccttt

SEQ ID NO: 180259 - DNA, 19 bp, Artificial sequence
  SiRNA target sequence
gaaaagatgctaaccttta

SEQ ID NO: 180260 - DNA, 19 bp, Artificial sequence
  SiRNA target sequence
aaaagatgctaacctttat

SEQ ID NO: 180261 - DNA, 19 bp, Artificial sequence
  SiRNA target sequence
aaagatgctaacctttatt

SEQ ID NO: 180262 - DNA, 19 bp, Artificial sequence
  SiRNA target sequence
aagatgctaacctttattt

SEQ ID NO: 180263 - DNA, 19 bp, Artificial sequence
  SiRNA target sequence
agatgctaacctttattta

SEQ ID NO: 180264 - DNA, 19 bp, Artificial sequence
  SiRNA target sequence
gatgctaacctttatttat

SEQ ID NO: 180265 - DNA, 19 bp, Artificial sequence
  SiRNA target sequence
atgctaacctttatttatt

SEQ ID NO: 180266 - DNA, 19 bp, Artificial sequence
  SiRNA target sequence
tgctaacctttatttatta

SEQ ID NO: 180267 - DNA, 19 bp, Artificial sequence
  SiRNA target sequence
gctaacctttatttattag

SEQ ID NO: 180268 - DNA, 19 bp, Artificial sequence
  SiRNA target sequence
ctaacctttatttattaga

SEQ ID NO: 180269 - DNA, 19 bp, Artificial sequence
  SiRNA target sequence
taacctttatttattagat

SEQ ID NO: 180270 - DNA, 19 bp, Artificial sequence
  SiRNA target sequence
aacctttatttattagatg

SEQ ID NO: 180271 - DNA, 19 bp, Artificial sequence
  SiRNA target sequence
acctttatttattagatga

SEQ ID NO: 180272 - DNA, 19 bp, Artificial sequence
  SiRNA target sequence
cctttatttattagatgaa

SEQ ID NO: 180273 - DNA, 19 bp, Artificial sequence
  SiRNA target sequence
ctttatttattagatgaac

SEQ ID NO: 180274 - DNA, 19 bp, Artificial sequence
  SiRNA target sequence
tttatttattagatgaacc

SEQ ID NO: 180275 - DNA, 19 bp, Artificial sequence
  SiRNA target sequence
ttatttattagatgaacct

SEQ ID NO: 180276 - DNA, 19 bp, Artificial sequence
  SiRNA target sequence
tatttattagatgaacctt

SEQ ID NO: 180277 - DNA, 19 bp, Artificial sequence
  SiRNA target sequence
atttattagatgaaccttc

SEQ ID NO: 180278 - DNA, 19 bp, Artificial sequence
  SiRNA target sequence
tttattagatgaaccttct

SEQ ID NO: 180279 - DNA, 19 bp, Artificial sequence
  SiRNA target sequence
ttattagatgaaccttctg

SEQ ID NO: 180280 - DNA, 19 bp, Artificial sequence
  SiRNA target sequence
tattagatgaaccttctgc

SEQ ID NO: 180281 - DNA, 19 bp, Artificial sequence
  SiRNA target sequence
attagatgaaccttctgcg

SEQ ID NO: 180282 - DNA, 19 bp, Artificial sequence
  SiRNA target sequence
ttagatgaaccttctgcgt

SEQ ID NO: 180283 - DNA, 19 bp, Artificial sequence
  SiRNA target sequence
tagatgaaccttctgcgta

SEQ ID NO: 180284 - DNA, 19 bp, Artificial sequence
  SiRNA target sequence
agatgaaccttctgcgtat

SEQ ID NO: 180285 - DNA, 19 bp, Artificial sequence
  SiRNA target sequence
gatgaaccttctgcgtatc

SEQ ID NO: 180286 - DNA, 19 bp, Artificial sequence
  SiRNA target sequence
atgaaccttctgcgtatct

SEQ ID NO: 180287 - DNA, 19 bp, Artificial sequence
  SiRNA target sequence
tgaaccttctgcgtatcta

SEQ ID NO: 180288 - DNA, 19 bp, Artificial sequence
  SiRNA target sequence
gaaccttctgcgtatctag

SEQ ID NO: 180289 - DNA, 19 bp, Artificial sequence
  SiRNA target sequence
aaccttctgcgtatctaga

SEQ ID NO: 180290 - DNA, 19 bp, Artificial sequence
  SiRNA target sequence
accttctgcgtatctagat

SEQ ID NO: 180291 - DNA, 19 bp, Artificial sequence
  SiRNA target sequence
ccttctgcgtatctagatt

SEQ ID NO: 180292 - DNA, 19 bp, Artificial sequence
  SiRNA target sequence
cttctgcgtatctagattc

SEQ ID NO: 180293 - DNA, 19 bp, Artificial sequence
  SiRNA target sequence
ttctgcgtatctagattca

SEQ ID NO: 180294 - DNA, 19 bp, Artificial sequence
  SiRNA target sequence
tctgcgtatctagattcag

SEQ ID NO: 180295 - DNA, 19 bp, Artificial sequence
  SiRNA target sequence
ctgcgtatctagattcaga

SEQ ID NO: 180296 - DNA, 19 bp, Artificial sequence
  SiRNA target sequence
tgcgtatctagattcagat

SEQ ID NO: 180297 - DNA, 19 bp, Artificial sequence
  SiRNA target sequence
gcgtatctagattcagatc

SEQ ID NO: 180298 - DNA, 19 bp, Artificial sequence
  SiRNA target sequence
cgtatctagattcagatca

SEQ ID NO: 180299 - DNA, 19 bp, Artificial sequence
  SiRNA target sequence
gtatctagattcagatcag

SEQ ID NO: 180300 - DNA, 19 bp, Artificial sequence
  SiRNA target sequence
tatctagattcagatcaga

SEQ ID NO: 180301 - DNA, 19 bp, Artificial sequence
  SiRNA target sequence
atctagattcagatcagag

SEQ ID NO: 180302 - DNA, 19 bp, Artificial sequence
  SiRNA target sequence
tctagattcagatcagaga

SEQ ID NO: 180303 - DNA, 19 bp, Artificial sequence
  SiRNA target sequence
ctagattcagatcagagaa

SEQ ID NO: 180304 - DNA, 19 bp, Artificial sequence
  SiRNA target sequence
tagattcagatcagagaat

SEQ ID NO: 180305 - DNA, 19 bp, Artificial sequence
  SiRNA target sequence
agattcagatcagagaata

SEQ ID NO: 180306 - DNA, 19 bp, Artificial sequence
  SiRNA target sequence
gattcagatcagagaatag

SEQ ID NO: 180307 - DNA, 19 bp, Artificial sequence
  SiRNA target sequence
attcagatcagagaatagc

SEQ ID NO: 180308 - DNA, 19 bp, Artificial sequence
  SiRNA target sequence
ttcagatcagagaatagcg

SEQ ID NO: 180309 - DNA, 19 bp, Artificial sequence
  SiRNA target sequence
tcagatcagagaatagcga

SEQ ID NO: 180310 - DNA, 19 bp, Artificial sequence
  SiRNA target sequence
cagatcagagaatagcgat

SEQ ID NO: 180311 - DNA, 19 bp, Artificial sequence
  SiRNA target sequence
agatcagagaatagcgatt

SEQ ID NO: 180312 - DNA, 19 bp, Artificial sequence
  SiRNA target sequence
gatcagagaatagcgattt

SEQ ID NO: 180313 - DNA, 19 bp, Artificial sequence
  SiRNA target sequence
atcagagaatagcgatttc

SEQ ID NO: 180314 - DNA, 19 bp, Artificial sequence
  SiRNA target sequence
tcagagaatagcgatttca

SEQ ID NO: 180315 - DNA, 19 bp, Artificial sequence
  SiRNA target sequence
cagagaatagcgatttcaa

SEQ ID NO: 180316 - DNA, 19 bp, Artificial sequence
  SiRNA target sequence
agagaatagcgatttcaaa

SEQ ID NO: 180317 - DNA, 19 bp, Artificial sequence
  SiRNA target sequence
gagaatagcgatttcaaaa

SEQ ID NO: 180318 - DNA, 19 bp, Artificial sequence
  SiRNA target sequence
agaatagcgatttcaaaag

SEQ ID NO: 180319 - DNA, 19 bp, Artificial sequence
  SiRNA target sequence
gaatagcgatttcaaaagt

SEQ ID NO: 180320 - DNA, 19 bp, Artificial sequence
  SiRNA target sequence
aatagcgatttcaaaagtt

SEQ ID NO: 180321 - DNA, 19 bp, Artificial sequence
  SiRNA target sequence
atagcgatttcaaaagtta

SEQ ID NO: 180322 - DNA, 19 bp, Artificial sequence
  SiRNA target sequence
tagcgatttcaaaagttat

SEQ ID NO: 180323 - DNA, 19 bp, Artificial sequence
  SiRNA target sequence
agcgatttcaaaagttata

SEQ ID NO: 180324 - DNA, 19 bp, Artificial sequence
  SiRNA target sequence
gcgatttcaaaagttataa

SEQ ID NO: 180325 - DNA, 19 bp, Artificial sequence
  SiRNA target sequence
cgatttcaaaagttataaa

SEQ ID NO: 180326 - DNA, 19 bp, Artificial sequence
  SiRNA target sequence
gatttcaaaagttataaaa

SEQ ID NO: 180327 - DNA, 19 bp, Artificial sequence
  SiRNA target sequence
atttcaaaagttataaaaa

SEQ ID NO: 180328 - DNA, 19 bp, Artificial sequence
  SiRNA target sequence
tttcaaaagttataaaaag

SEQ ID NO: 180329 - DNA, 19 bp, Artificial sequence
  SiRNA target sequence
ttcaaaagttataaaaagg

SEQ ID NO: 180330 - DNA, 19 bp, Artificial sequence
  SiRNA target sequence
tcaaaagttataaaaaggt

SEQ ID NO: 180331 - DNA, 19 bp, Artificial sequence
  SiRNA target sequence
caaaagttataaaaaggtt

SEQ ID NO: 180332 - DNA, 19 bp, Artificial sequence
  SiRNA target sequence
aaaagttataaaaaggttt

SEQ ID NO: 180333 - DNA, 19 bp, Artificial sequence
  SiRNA target sequence
aaagttataaaaaggttta

SEQ ID NO: 180334 - DNA, 19 bp, Artificial sequence
  SiRNA target sequence
aagttataaaaaggtttat

SEQ ID NO: 180335 - DNA, 19 bp, Artificial sequence
  SiRNA target sequence
agttataaaaaggtttatt

SEQ ID NO: 180336 - DNA, 19 bp, Artificial sequence
  SiRNA target sequence
gttataaaaaggtttattt

SEQ ID NO: 180337 - DNA, 19 bp, Artificial sequence
  SiRNA target sequence
ttataaaaaggtttattta

SEQ ID NO: 180338 - DNA, 19 bp, Artificial sequence
  SiRNA target sequence
tataaaaaggtttatttat

SEQ ID NO: 180339 - DNA, 19 bp, Artificial sequence
  SiRNA target sequence
ataaaaaggtttatttatg

SEQ ID NO: 180340 - DNA, 19 bp, Artificial sequence
  SiRNA target sequence
taaaaaggtttatttatgg

SEQ ID NO: 180341 - DNA, 19 bp, Artificial sequence
  SiRNA target sequence
aaaaaggtttatttatggg

SEQ ID NO: 180342 - DNA, 19 bp, Artificial sequence
  SiRNA target sequence
aaaaggtttatttatggga

SEQ ID NO: 180343 - DNA, 19 bp, Artificial sequence
  SiRNA target sequence
aaaggtttatttatgggaa

SEQ ID NO: 180344 - DNA, 19 bp, Artificial sequence
  SiRNA target sequence
aaggtttatttatgggaag

SEQ ID NO: 180345 - DNA, 19 bp, Artificial sequence
  SiRNA target sequence
aggtttatttatgggaaga

SEQ ID NO: 180346 - DNA, 19 bp, Artificial sequence
  SiRNA target sequence
ggtttatttatgggaagaa

SEQ ID NO: 180347 - DNA, 19 bp, Artificial sequence
  SiRNA target sequence
gtttatttatgggaagaag

SEQ ID NO: 180348 - DNA, 19 bp, Artificial sequence
  SiRNA target sequence
tttatttatgggaagaagc

SEQ ID NO: 180349 - DNA, 19 bp, Artificial sequence
  SiRNA target sequence
ttatttatgggaagaagcg

SEQ ID NO: 180350 - DNA, 19 bp, Artificial sequence
  SiRNA target sequence
tatttatgggaagaagcga

SEQ ID NO: 180351 - DNA, 19 bp, Artificial sequence
  SiRNA target sequence
atttatgggaagaagcgaa

SEQ ID NO: 180352 - DNA, 19 bp, Artificial sequence
  SiRNA target sequence
tttatgggaagaagcgaac

SEQ ID NO: 180353 - DNA, 19 bp, Artificial sequence
  SiRNA target sequence
ttatgggaagaagcgaaca

SEQ ID NO: 180354 - DNA, 19 bp, Artificial sequence
  SiRNA target sequence
tatgggaagaagcgaacag

SEQ ID NO: 180355 - DNA, 19 bp, Artificial sequence
  SiRNA target sequence
atgggaagaagcgaacagc

SEQ ID NO: 180356 - DNA, 19 bp, Artificial sequence
  SiRNA target sequence
tgggaagaagcgaacagcc

SEQ ID NO: 180357 - DNA, 19 bp, Artificial sequence
  SiRNA target sequence
gggaagaagcgaacagcct

SEQ ID NO: 180358 - DNA, 19 bp, Artificial sequence
  SiRNA target sequence
ggaagaagcgaacagcctt

SEQ ID NO: 180359 - DNA, 19 bp, Artificial sequence
  SiRNA target sequence
gaagaagcgaacagccttt

SEQ ID NO: 180360 - DNA, 19 bp, Artificial sequence
  SiRNA target sequence
aagaagcgaacagcctttg

SEQ ID NO: 180361 - DNA, 19 bp, Artificial sequence
  SiRNA target sequence
agaagcgaacagcctttgt

SEQ ID NO: 180362 - DNA, 19 bp, Artificial sequence
  SiRNA target sequence
gaagcgaacagcctttgtg

SEQ ID NO: 180363 - DNA, 19 bp, Artificial sequence
  SiRNA target sequence
aagcgaacagcctttgtgg

SEQ ID NO: 180364 - DNA, 19 bp, Artificial sequence
  SiRNA target sequence
agcgaacagcctttgtggt

SEQ ID NO: 180365 - DNA, 19 bp, Artificial sequence
  SiRNA target sequence
gcgaacagcctttgtggtt

SEQ ID NO: 180366 - DNA, 19 bp, Artificial sequence
  SiRNA target sequence
cgaacagcctttgtggttg

SEQ ID NO: 180367 - DNA, 19 bp, Artificial sequence
  SiRNA target sequence
gaacagcctttgtggttga

SEQ ID NO: 180368 - DNA, 19 bp, Artificial sequence
  SiRNA target sequence
aacagcctttgtggttgaa

SEQ ID NO: 180369 - DNA, 19 bp, Artificial sequence
  SiRNA target sequence
acagcctttgtggttgaac

SEQ ID NO: 180370 - DNA, 19 bp, Artificial sequence
  SiRNA target sequence
cagcctttgtggttgaaca

SEQ ID NO: 180371 - DNA, 19 bp, Artificial sequence
  SiRNA target sequence
agcctttgtggttgaacat

SEQ ID NO: 180372 - DNA, 19 bp, Artificial sequence
  SiRNA target sequence
gcctttgtggttgaacatg

SEQ ID NO: 180373 - DNA, 19 bp, Artificial sequence
  SiRNA target sequence
cctttgtggttgaacatga

SEQ ID NO: 180374 - DNA, 19 bp, Artificial sequence
  SiRNA target sequence
ctttgtggttgaacatgat

SEQ ID NO: 180375 - DNA, 19 bp, Artificial sequence
  SiRNA target sequence
tttgtggttgaacatgatt

SEQ ID NO: 180376 - DNA, 19 bp, Artificial sequence
  SiRNA target sequence
ttgtggttgaacatgattt

SEQ ID NO: 180377 - DNA, 19 bp, Artificial sequence
  SiRNA target sequence
tgtggttgaacatgattta

SEQ ID NO: 180378 - DNA, 19 bp, Artificial sequence
  SiRNA target sequence
gtggttgaacatgatttaa

SEQ ID NO: 180379 - DNA, 19 bp, Artificial sequence
  SiRNA target sequence
tggttgaacatgatttaat

SEQ ID NO: 180380 - DNA, 19 bp, Artificial sequence
  SiRNA target sequence
ggttgaacatgatttaatt

SEQ ID NO: 180381 - DNA, 19 bp, Artificial sequence
  SiRNA target sequence
gttgaacatgatttaattg

SEQ ID NO: 180382 - DNA, 19 bp, Artificial sequence
  SiRNA target sequence
ttgaacatgatttaattgt

SEQ ID NO: 180383 - DNA, 19 bp, Artificial sequence
  SiRNA target sequence
tgaacatgatttaattgta

SEQ ID NO: 180384 - DNA, 19 bp, Artificial sequence
  SiRNA target sequence
gaacatgatttaattgtag

SEQ ID NO: 180385 - DNA, 19 bp, Artificial sequence
  SiRNA target sequence
aacatgatttaattgtagg

SEQ ID NO: 180386 - DNA, 19 bp, Artificial sequence
  SiRNA target sequence
acatgatttaattgtaggt

SEQ ID NO: 180387 - DNA, 19 bp, Artificial sequence
  SiRNA target sequence
catgatttaattgtaggta

SEQ ID NO: 180388 - DNA, 19 bp, Artificial sequence
  SiRNA target sequence
atgatttaattgtaggtac

SEQ ID NO: 180389 - DNA, 19 bp, Artificial sequence
  SiRNA target sequence
tgatttaattgtaggtaca

SEQ ID NO: 180390 - DNA, 19 bp, Artificial sequence
  SiRNA target sequence
gatttaattgtaggtacat

SEQ ID NO: 180391 - DNA, 19 bp, Artificial sequence
  SiRNA target sequence
atttaattgtaggtacata

SEQ ID NO: 180392 - DNA, 19 bp, Artificial sequence
  SiRNA target sequence
tttaattgtaggtacatat

SEQ ID NO: 180393 - DNA, 19 bp, Artificial sequence
  SiRNA target sequence
ttaattgtaggtacatatt

SEQ ID NO: 180394 - DNA, 19 bp, Artificial sequence
  SiRNA target sequence
taattgtaggtacatattt

SEQ ID NO: 180395 - DNA, 19 bp, Artificial sequence
  SiRNA target sequence
aattgtaggtacatatttg

SEQ ID NO: 180396 - DNA, 19 bp, Artificial sequence
  SiRNA target sequence
attgtaggtacatatttgg

SEQ ID NO: 180397 - DNA, 19 bp, Artificial sequence
  SiRNA target sequence
ttgtaggtacatatttggc

SEQ ID NO: 180398 - DNA, 19 bp, Artificial sequence
  SiRNA target sequence
tgtaggtacatatttggct

SEQ ID NO: 180399 - DNA, 19 bp, Artificial sequence
  SiRNA target sequence
gtaggtacatatttggctg

SEQ ID NO: 180400 - DNA, 19 bp, Artificial sequence
  SiRNA target sequence
taggtacatatttggctga

SEQ ID NO: 180401 - DNA, 19 bp, Artificial sequence
  SiRNA target sequence
aggtacatatttggctgat

SEQ ID NO: 180402 - DNA, 19 bp, Artificial sequence
  SiRNA target sequence
ggtacatatttggctgata

SEQ ID NO: 180403 - DNA, 19 bp, Artificial sequence
  SiRNA target sequence
gtacatatttggctgataa

SEQ ID NO: 180404 - DNA, 19 bp, Artificial sequence
  SiRNA target sequence
tacatatttggctgataaa

SEQ ID NO: 180405 - DNA, 19 bp, Artificial sequence
  SiRNA target sequence
acatatttggctgataaag

SEQ ID NO: 180406 - DNA, 19 bp, Artificial sequence
  SiRNA target sequence
catatttggctgataaagt

SEQ ID NO: 180407 - DNA, 19 bp, Artificial sequence
  SiRNA target sequence
atatttggctgataaagtt

SEQ ID NO: 180408 - DNA, 19 bp, Artificial sequence
  SiRNA target sequence
tatttggctgataaagttg

SEQ ID NO: 180409 - DNA, 19 bp, Artificial sequence
  SiRNA target sequence
atttggctgataaagttgt

SEQ ID NO: 180410 - DNA, 19 bp, Artificial sequence
  SiRNA target sequence
tttggctgataaagttgtt

SEQ ID NO: 180411 - DNA, 19 bp, Artificial sequence
  SiRNA target sequence
ttggctgataaagttgttg

SEQ ID NO: 180412 - DNA, 19 bp, Artificial sequence
  SiRNA target sequence
tggctgataaagttgttgt

SEQ ID NO: 180413 - DNA, 19 bp, Artificial sequence
  SiRNA target sequence
ggctgataaagttgttgtt

SEQ ID NO: 180414 - DNA, 19 bp, Artificial sequence
  SiRNA target sequence
gctgataaagttgttgttt

SEQ ID NO: 180415 - DNA, 19 bp, Artificial sequence
  SiRNA target sequence
ctgataaagttgttgtttt

SEQ ID NO: 180416 - DNA, 19 bp, Artificial sequence
  SiRNA target sequence
tgataaagttgttgttttt

SEQ ID NO: 180417 - DNA, 19 bp, Artificial sequence
  SiRNA target sequence
gataaagttgttgtttttg

SEQ ID NO: 180418 - DNA, 19 bp, Artificial sequence
  SiRNA target sequence
ataaagttgttgtttttga

SEQ ID NO: 180419 - DNA, 19 bp, Artificial sequence
  SiRNA target sequence
taaagttgttgtttttgag

SEQ ID NO: 180420 - DNA, 19 bp, Artificial sequence
  SiRNA target sequence
aaagttgttgtttttgagg

SEQ ID NO: 180421 - DNA, 19 bp, Artificial sequence
  SiRNA target sequence
aagttgttgtttttgaggg

SEQ ID NO: 180422 - DNA, 19 bp, Artificial sequence
  SiRNA target sequence
agttgttgtttttgaggga

SEQ ID NO: 180423 - DNA, 19 bp, Artificial sequence
  SiRNA target sequence
gttgttgtttttgagggaa

SEQ ID NO: 180424 - DNA, 19 bp, Artificial sequence
  SiRNA target sequence
ttgttgtttttgagggaag

SEQ ID NO: 180425 - DNA, 19 bp, Artificial sequence
  SiRNA target sequence
tgttgtttttgagggaagc

SEQ ID NO: 180426 - DNA, 19 bp, Artificial sequence
  SiRNA target sequence
gttgtttttgagggaagcc

SEQ ID NO: 180427 - DNA, 19 bp, Artificial sequence
  SiRNA target sequence
ttgtttttgagggaagccc

SEQ ID NO: 180428 - DNA, 19 bp, Artificial sequence
  SiRNA target sequence
tgtttttgagggaagccct

SEQ ID NO: 180429 - DNA, 19 bp, Artificial sequence
  SiRNA target sequence
gtttttgagggaagcccta

SEQ ID NO: 180430 - DNA, 19 bp, Artificial sequence
  SiRNA target sequence
tttttgagggaagccctag

SEQ ID NO: 180431 - DNA, 19 bp, Artificial sequence
  SiRNA target sequence
ttttgagggaagccctagt

SEQ ID NO: 180432 - DNA, 19 bp, Artificial sequence
  SiRNA target sequence
tttgagggaagccctagtg

SEQ ID NO: 180433 - DNA, 19 bp, Artificial sequence
  SiRNA target sequence
ttgagggaagccctagtgt

SEQ ID NO: 180434 - DNA, 19 bp, Artificial sequence
  SiRNA target sequence
tgagggaagccctagtgtt

SEQ ID NO: 180435 - DNA, 19 bp, Artificial sequence
  SiRNA target sequence
gagggaagccctagtgttc

SEQ ID NO: 180436 - DNA, 19 bp, Artificial sequence
  SiRNA target sequence
agggaagccctagtgttca

SEQ ID NO: 180437 - DNA, 19 bp, Artificial sequence
  SiRNA target sequence
gggaagccctagtgttcat

SEQ ID NO: 180438 - DNA, 19 bp, Artificial sequence
  SiRNA target sequence
ggaagccctagtgttcata

SEQ ID NO: 180439 - DNA, 19 bp, Artificial sequence
  SiRNA target sequence
gaagccctagtgttcatag

SEQ ID NO: 180440 - DNA, 19 bp, Artificial sequence
  SiRNA target sequence
aagccctagtgttcatagc

SEQ ID NO: 180441 - DNA, 19 bp, Artificial sequence
  SiRNA target sequence
agccctagtgttcatagca

SEQ ID NO: 180442 - DNA, 19 bp, Artificial sequence
  SiRNA target sequence
gccctagtgttcatagcac

SEQ ID NO: 180443 - DNA, 19 bp, Artificial sequence
  SiRNA target sequence
ccctagtgttcatagcact

SEQ ID NO: 180444 - DNA, 19 bp, Artificial sequence
  SiRNA target sequence
cctagtgttcatagcactg

SEQ ID NO: 180445 - DNA, 19 bp, Artificial sequence
  SiRNA target sequence
ctagtgttcatagcactgc

SEQ ID NO: 180446 - DNA, 19 bp, Artificial sequence
  SiRNA target sequence
tagtgttcatagcactgct

SEQ ID NO: 180447 - DNA, 19 bp, Artificial sequence
  SiRNA target sequence
agtgttcatagcactgctc

SEQ ID NO: 180448 - DNA, 19 bp, Artificial sequence
  SiRNA target sequence
gtgttcatagcactgctca

SEQ ID NO: 180449 - DNA, 19 bp, Artificial sequence
  SiRNA target sequence
tgttcatagcactgctcat

SEQ ID NO: 180450 - DNA, 19 bp, Artificial sequence
  SiRNA target sequence
gttcatagcactgctcata

SEQ ID NO: 180451 - DNA, 19 bp, Artificial sequence
  SiRNA target sequence
ttcatagcactgctcataa

SEQ ID NO: 180452 - DNA, 19 bp, Artificial sequence
  SiRNA target sequence
tcatagcactgctcataaa

SEQ ID NO: 180453 - DNA, 19 bp, Artificial sequence
  SiRNA target sequence
catagcactgctcataaac

SEQ ID NO: 180454 - DNA, 19 bp, Artificial sequence
  SiRNA target sequence
atagcactgctcataaacc

SEQ ID NO: 180455 - DNA, 19 bp, Artificial sequence
  SiRNA target sequence
tagcactgctcataaaccg

SEQ ID NO: 180456 - DNA, 19 bp, Artificial sequence
  SiRNA target sequence
agcactgctcataaaccga

SEQ ID NO: 180457 - DNA, 19 bp, Artificial sequence
  SiRNA target sequence
gcactgctcataaaccgat

SEQ ID NO: 180458 - DNA, 19 bp, Artificial sequence
  SiRNA target sequence
cactgctcataaaccgatg

SEQ ID NO: 180459 - DNA, 19 bp, Artificial sequence
  SiRNA target sequence
actgctcataaaccgatgg

SEQ ID NO: 180460 - DNA, 19 bp, Artificial sequence
  SiRNA target sequence
ctgctcataaaccgatgga

SEQ ID NO: 180461 - DNA, 19 bp, Artificial sequence
  SiRNA target sequence
tgctcataaaccgatggat

SEQ ID NO: 180462 - DNA, 19 bp, Artificial sequence
  SiRNA target sequence
gctcataaaccgatggatt

SEQ ID NO: 180463 - DNA, 19 bp, Artificial sequence
  SiRNA target sequence
ctcataaaccgatggattt

SEQ ID NO: 180464 - DNA, 19 bp, Artificial sequence
  SiRNA target sequence
tcataaaccgatggatttg

SEQ ID NO: 180465 - DNA, 19 bp, Artificial sequence
  SiRNA target sequence
cataaaccgatggatttgc

SEQ ID NO: 180466 - DNA, 19 bp, Artificial sequence
  SiRNA target sequence
ataaaccgatggatttgca

SEQ ID NO: 180467 - DNA, 19 bp, Artificial sequence
  SiRNA target sequence
taaaccgatggatttgcat

SEQ ID NO: 180468 - DNA, 19 bp, Artificial sequence
  SiRNA target sequence
aaaccgatggatttgcata

SEQ ID NO: 180469 - DNA, 19 bp, Artificial sequence
  SiRNA target sequence
aaccgatggatttgcatag

SEQ ID NO: 180470 - DNA, 19 bp, Artificial sequence
  SiRNA target sequence
accgatggatttgcatagt

SEQ ID NO: 180471 - DNA, 19 bp, Artificial sequence
  SiRNA target sequence
ccgatggatttgcatagtg

SEQ ID NO: 180472 - DNA, 19 bp, Artificial sequence
  SiRNA target sequence
cgatggatttgcatagtgg

SEQ ID NO: 180473 - DNA, 19 bp, Artificial sequence
  SiRNA target sequence
gatggatttgcatagtgga

SEQ ID NO: 180474 - DNA, 19 bp, Artificial sequence
  SiRNA target sequence
atggatttgcatagtggaa

SEQ ID NO: 180475 - DNA, 19 bp, Artificial sequence
  SiRNA target sequence
tggatttgcatagtggaat

SEQ ID NO: 180476 - DNA, 19 bp, Artificial sequence
  SiRNA target sequence
ggatttgcatagtggaatg

SEQ ID NO: 180477 - DNA, 19 bp, Artificial sequence
  SiRNA target sequence
gatttgcatagtggaatga

SEQ ID NO: 180478 - DNA, 19 bp, Artificial sequence
  SiRNA target sequence
atttgcatagtggaatgaa

SEQ ID NO: 180479 - DNA, 19 bp, Artificial sequence
  SiRNA target sequence
tttgcatagtggaatgaat

SEQ ID NO: 180480 - DNA, 19 bp, Artificial sequence
  SiRNA target sequence
ttgcatagtggaatgaata

SEQ ID NO: 180481 - DNA, 19 bp, Artificial sequence
  SiRNA target sequence
tgcatagtggaatgaatat

SEQ ID NO: 180482 - DNA, 19 bp, Artificial sequence
  SiRNA target sequence
gcatagtggaatgaatatt

SEQ ID NO: 180483 - DNA, 19 bp, Artificial sequence
  SiRNA target sequence
catagtggaatgaatattt

SEQ ID NO: 180484 - DNA, 19 bp, Artificial sequence
  SiRNA target sequence
atagtggaatgaatatttt

SEQ ID NO: 180485 - DNA, 19 bp, Artificial sequence
  SiRNA target sequence
tagtggaatgaatattttt

SEQ ID NO: 180486 - DNA, 19 bp, Artificial sequence
  SiRNA target sequence
agtggaatgaatatttttt

SEQ ID NO: 180487 - DNA, 19 bp, Artificial sequence
  SiRNA target sequence
gtggaatgaatattttttt

SEQ ID NO: 180488 - DNA, 19 bp, Artificial sequence
  SiRNA target sequence
tggaatgaatattttttta

SEQ ID NO: 180489 - DNA, 19 bp, Artificial sequence
  SiRNA target sequence
ggaatgaatatttttttaa

SEQ ID NO: 180490 - DNA, 19 bp, Artificial sequence
  SiRNA target sequence
gaatgaatatttttttaaa

SEQ ID NO: 180491 - DNA, 19 bp, Artificial sequence
  SiRNA target sequence
aatgaatatttttttaaag

SEQ ID NO: 180492 - DNA, 19 bp, Artificial sequence
  SiRNA target sequence
atgaatatttttttaaaga

SEQ ID NO: 180493 - DNA, 19 bp, Artificial sequence
  SiRNA target sequence
tgaatatttttttaaagaa

SEQ ID NO: 180494 - DNA, 19 bp, Artificial sequence
  SiRNA target sequence
gaatatttttttaaagaat

SEQ ID NO: 180495 - DNA, 19 bp, Artificial sequence
  SiRNA target sequence
aatatttttttaaagaatc

SEQ ID NO: 180496 - DNA, 19 bp, Artificial sequence
  SiRNA target sequence
atatttttttaaagaatct

SEQ ID NO: 180497 - DNA, 19 bp, Artificial sequence
  SiRNA target sequence
tatttttttaaagaatctt

SEQ ID NO: 180498 - DNA, 19 bp, Artificial sequence
  SiRNA target sequence
atttttttaaagaatcttg

SEQ ID NO: 180499 - DNA, 19 bp, Artificial sequence
  SiRNA target sequence
tttttttaaagaatcttga

SEQ ID NO: 180500 - DNA, 19 bp, Artificial sequence
  SiRNA target sequence
ttttttaaagaatcttgat

SEQ ID NO: 180501 - DNA, 19 bp, Artificial sequence
  SiRNA target sequence
tttttaaagaatcttgata

SEQ ID NO: 180502 - DNA, 19 bp, Artificial sequence
  SiRNA target sequence
ttttaaagaatcttgatat

SEQ ID NO: 180503 - DNA, 19 bp, Artificial sequence
  SiRNA target sequence
tttaaagaatcttgatatt

SEQ ID NO: 180504 - DNA, 19 bp, Artificial sequence
  SiRNA target sequence
ttaaagaatcttgatatta

SEQ ID NO: 180505 - DNA, 19 bp, Artificial sequence
  SiRNA target sequence
taaagaatcttgatattac

SEQ ID NO: 180506 - DNA, 19 bp, Artificial sequence
  SiRNA target sequence
aaagaatcttgatattact

SEQ ID NO: 180507 - DNA, 19 bp, Artificial sequence
  SiRNA target sequence
aagaatcttgatattactt

SEQ ID NO: 180508 - DNA, 19 bp, Artificial sequence
  SiRNA target sequence
agaatcttgatattacttt

SEQ ID NO: 180509 - DNA, 19 bp, Artificial sequence
  SiRNA target sequence
gaatcttgatattactttt

SEQ ID NO: 180510 - DNA, 19 bp, Artificial sequence
  SiRNA target sequence
aatcttgatattactttta

SEQ ID NO: 180511 - DNA, 19 bp, Artificial sequence
  SiRNA target sequence
atcttgatattacttttag

SEQ ID NO: 180512 - DNA, 19 bp, Artificial sequence
  SiRNA target sequence
tcttgatattacttttaga

SEQ ID NO: 180513 - DNA, 19 bp, Artificial sequence
  SiRNA target sequence
cttgatattacttttagaa

SEQ ID NO: 180514 - DNA, 19 bp, Artificial sequence
  SiRNA target sequence
ttgatattacttttagaag

SEQ ID NO: 180515 - DNA, 19 bp, Artificial sequence
  SiRNA target sequence
tgatattacttttagaaga

SEQ ID NO: 180516 - DNA, 19 bp, Artificial sequence
  SiRNA target sequence
gatattacttttagaagag

SEQ ID NO: 180517 - DNA, 19 bp, Artificial sequence
  SiRNA target sequence
atattacttttagaagaga

SEQ ID NO: 180518 - DNA, 19 bp, Artificial sequence
  SiRNA target sequence
tattacttttagaagagac

SEQ ID NO: 180519 - DNA, 19 bp, Artificial sequence
  SiRNA target sequence
attacttttagaagagact

SEQ ID NO: 180520 - DNA, 19 bp, Artificial sequence
  SiRNA target sequence
ttacttttagaagagactc

SEQ ID NO: 180521 - DNA, 19 bp, Artificial sequence
  SiRNA target sequence
tacttttagaagagactct

SEQ ID NO: 180522 - DNA, 19 bp, Artificial sequence
  SiRNA target sequence
acttttagaagagactctt

SEQ ID NO: 180523 - DNA, 19 bp, Artificial sequence
  SiRNA target sequence
cttttagaagagactcttc

SEQ ID NO: 180524 - DNA, 19 bp, Artificial sequence
  SiRNA target sequence
ttttagaagagactcttcc

SEQ ID NO: 180525 - DNA, 19 bp, Artificial sequence
  SiRNA target sequence
tttagaagagactcttcca

SEQ ID NO: 180526 - DNA, 19 bp, Artificial sequence
  SiRNA target sequence
ttagaagagactcttccaa

SEQ ID NO: 180527 - DNA, 19 bp, Artificial sequence
  SiRNA target sequence
tagaagagactcttccaat

SEQ ID NO: 180528 - DNA, 19 bp, Artificial sequence
  SiRNA target sequence
agaagagactcttccaatt

SEQ ID NO: 180529 - DNA, 19 bp, Artificial sequence
  SiRNA target sequence
gaagagactcttccaattt

SEQ ID NO: 180530 - DNA, 19 bp, Artificial sequence
  SiRNA target sequence
aagagactcttccaatttt

SEQ ID NO: 180531 - DNA, 19 bp, Artificial sequence
  SiRNA target sequence
agagactcttccaatttta

SEQ ID NO: 180532 - DNA, 19 bp, Artificial sequence
  SiRNA target sequence
gagactcttccaattttag

SEQ ID NO: 180533 - DNA, 19 bp, Artificial sequence
  SiRNA target sequence
agactcttccaattttaga

SEQ ID NO: 180534 - DNA, 19 bp, Artificial sequence
  SiRNA target sequence
gactcttccaattttagac

SEQ ID NO: 180535 - DNA, 19 bp, Artificial sequence
  SiRNA target sequence
actcttccaattttagacc

SEQ ID NO: 180536 - DNA, 19 bp, Artificial sequence
  SiRNA target sequence
ctcttccaattttagacca

SEQ ID NO: 180537 - DNA, 19 bp, Artificial sequence
  SiRNA target sequence
tcttccaattttagaccaa

SEQ ID NO: 180538 - DNA, 19 bp, Artificial sequence
  SiRNA target sequence
cttccaattttagaccaag

SEQ ID NO: 180539 - DNA, 19 bp, Artificial sequence
  SiRNA target sequence
ttccaattttagaccaaga

SEQ ID NO: 180540 - DNA, 19 bp, Artificial sequence
  SiRNA target sequence
tccaattttagaccaagag

SEQ ID NO: 180541 - DNA, 19 bp, Artificial sequence
  SiRNA target sequence
ccaattttagaccaagagt

SEQ ID NO: 180542 - DNA, 19 bp, Artificial sequence
  SiRNA target sequence
caattttagaccaagagtt

SEQ ID NO: 180543 - DNA, 19 bp, Artificial sequence
  SiRNA target sequence
aattttagaccaagagtta

SEQ ID NO: 180544 - DNA, 19 bp, Artificial sequence
  SiRNA target sequence
attttagaccaagagttaa

SEQ ID NO: 180545 - DNA, 19 bp, Artificial sequence
  SiRNA target sequence
ttttagaccaagagttaat

SEQ ID NO: 180546 - DNA, 19 bp, Artificial sequence
  SiRNA target sequence
tttagaccaagagttaata

SEQ ID NO: 180547 - DNA, 19 bp, Artificial sequence
  SiRNA target sequence
ttagaccaagagttaataa

SEQ ID NO: 180548 - DNA, 19 bp, Artificial sequence
  SiRNA target sequence
tagaccaagagttaataag

SEQ ID NO: 180549 - DNA, 19 bp, Artificial sequence
  SiRNA target sequence
agaccaagagttaataagc

SEQ ID NO: 180550 - DNA, 19 bp, Artificial sequence
  SiRNA target sequence
gaccaagagttaataagcc

SEQ ID NO: 180551 - DNA, 19 bp, Artificial sequence
  SiRNA target sequence
accaagagttaataagccg

SEQ ID NO: 180552 - DNA, 19 bp, Artificial sequence
  SiRNA target sequence
ccaagagttaataagccga

SEQ ID NO: 180553 - DNA, 19 bp, Artificial sequence
  SiRNA target sequence
caagagttaataagccgaa

SEQ ID NO: 180554 - DNA, 19 bp, Artificial sequence
  SiRNA target sequence
aagagttaataagccgaat

SEQ ID NO: 180555 - DNA, 19 bp, Artificial sequence
  SiRNA target sequence
agagttaataagccgaatt

SEQ ID NO: 180556 - DNA, 19 bp, Artificial sequence
  SiRNA target sequence
gagttaataagccgaattc

SEQ ID NO: 180557 - DNA, 19 bp, Artificial sequence
  SiRNA target sequence
agttaataagccgaattcc

SEQ ID NO: 180558 - DNA, 19 bp, Artificial sequence
  SiRNA target sequence
gttaataagccgaattccg

SEQ ID NO: 180559 - DNA, 19 bp, Artificial sequence
  SiRNA target sequence
ttaataagccgaattccgc

SEQ ID NO: 180560 - DNA, 19 bp, Artificial sequence
  SiRNA target sequence
taataagccgaattccgca

SEQ ID NO: 180561 - DNA, 19 bp, Artificial sequence
  SiRNA target sequence
aataagccgaattccgcaa

SEQ ID NO: 180562 - DNA, 19 bp, Artificial sequence
  SiRNA target sequence
ataagccgaattccgcaaa

SEQ ID NO: 180563 - DNA, 19 bp, Artificial sequence
  SiRNA target sequence
taagccgaattccgcaaaa

SEQ ID NO: 180564 - DNA, 19 bp, Artificial sequence
  SiRNA target sequence
aagccgaattccgcaaaag

SEQ ID NO: 180565 - DNA, 19 bp, Artificial sequence
  SiRNA target sequence
agccgaattccgcaaaaga

SEQ ID NO: 180566 - DNA, 19 bp, Artificial sequence
  SiRNA target sequence
gccgaattccgcaaaagac

SEQ ID NO: 180567 - DNA, 19 bp, Artificial sequence
  SiRNA target sequence
ccgaattccgcaaaagaca

SEQ ID NO: 180568 - DNA, 19 bp, Artificial sequence
  SiRNA target sequence
cgaattccgcaaaagacag

SEQ ID NO: 180569 - DNA, 19 bp, Artificial sequence
  SiRNA target sequence
gaattccgcaaaagacaga

SEQ ID NO: 180570 - DNA, 19 bp, Artificial sequence
  SiRNA target sequence
aattccgcaaaagacagaa

SEQ ID NO: 180571 - DNA, 19 bp, Artificial sequence
  SiRNA target sequence
attccgcaaaagacagaac

SEQ ID NO: 180572 - DNA, 19 bp, Artificial sequence
  SiRNA target sequence
ttccgcaaaagacagaact

SEQ ID NO: 180573 - DNA, 19 bp, Artificial sequence
  SiRNA target sequence
tccgcaaaagacagaactc

SEQ ID NO: 180574 - DNA, 19 bp, Artificial sequence
  SiRNA target sequence
ccgcaaaagacagaactca

SEQ ID NO: 180575 - DNA, 19 bp, Artificial sequence
  SiRNA target sequence
cgcaaaagacagaactcag

SEQ ID NO: 180576 - DNA, 19 bp, Artificial sequence
  SiRNA target sequence
gcaaaagacagaactcaga

SEQ ID NO: 180577 - DNA, 19 bp, Artificial sequence
  SiRNA target sequence
caaaagacagaactcagaa

SEQ ID NO: 180578 - DNA, 19 bp, Artificial sequence
  SiRNA target sequence
aaaagacagaactcagaaa

SEQ ID NO: 180579 - DNA, 19 bp, Artificial sequence
  SiRNA target sequence
aaagacagaactcagaaag

SEQ ID NO: 180580 - DNA, 19 bp, Artificial sequence
  SiRNA target sequence
aagacagaactcagaaaga

SEQ ID NO: 180581 - DNA, 19 bp, Artificial sequence
  SiRNA target sequence
agacagaactcagaaagaa

SEQ ID NO: 180582 - DNA, 19 bp, Artificial sequence
  SiRNA target sequence
gacagaactcagaaagaag

SEQ ID NO: 180583 - DNA, 19 bp, Artificial sequence
  SiRNA target sequence
acagaactcagaaagaaga

SEQ ID NO: 180584 - DNA, 19 bp, Artificial sequence
  SiRNA target sequence
cagaactcagaaagaagag

SEQ ID NO: 180585 - DNA, 19 bp, Artificial sequence
  SiRNA target sequence
agaactcagaaagaagaga

SEQ ID NO: 180586 - DNA, 19 bp, Artificial sequence
  SiRNA target sequence
gaactcagaaagaagagaa

SEQ ID NO: 180587 - DNA, 19 bp, Artificial sequence
  SiRNA target sequence
aactcagaaagaagagaat

SEQ ID NO: 180588 - DNA, 19 bp, Artificial sequence
  SiRNA target sequence
actcagaaagaagagaata

SEQ ID NO: 180589 - DNA, 19 bp, Artificial sequence
  SiRNA target sequence
ctcagaaagaagagaataa

SEQ ID NO: 180590 - DNA, 19 bp, Artificial sequence
  SiRNA target sequence
tcagaaagaagagaataaa

SEQ ID NO: 180591 - DNA, 19 bp, Artificial sequence
  SiRNA target sequence
cagaaagaagagaataaat

SEQ ID NO: 180592 - DNA, 19 bp, Artificial sequence
  SiRNA target sequence
agaaagaagagaataaata

SEQ ID NO: 180593 - DNA, 19 bp, Artificial sequence
  SiRNA target sequence
gaaagaagagaataaatat

SEQ ID NO: 180594 - DNA, 19 bp, Artificial sequence
  SiRNA target sequence
aaagaagagaataaatatt

SEQ ID NO: 180595 - DNA, 19 bp, Artificial sequence
  SiRNA target sequence
aagaagagaataaatattt

SEQ ID NO: 180596 - DNA, 19 bp, Artificial sequence
  SiRNA target sequence
agaagagaataaatatttt

SEQ ID NO: 180597 - DNA, 19 bp, Artificial sequence
  SiRNA target sequence
gaagagaataaatattttt

SEQ ID NO: 180598 - DNA, 19 bp, Artificial sequence
  SiRNA target sequence
aagagaataaatatttttt

SEQ ID NO: 180599 - DNA, 19 bp, Artificial sequence
  SiRNA target sequence
agagaataaatattttttt

SEQ ID NO: 180600 - DNA, 19 bp, Artificial sequence
  SiRNA target sequence
gagaataaatatttttttt

SEQ ID NO: 180601 - DNA, 19 bp, Artificial sequence
  SiRNA target sequence
agaataaatattttttttg

SEQ ID NO: 180602 - DNA, 19 bp, Artificial sequence
  SiRNA target sequence
gaataaatattttttttga

SEQ ID NO: 180603 - DNA, 20 bp, Artificial sequence
  SiRNA target sequence
atggccaagaatgaatctaa

SEQ ID NO: 180604 - DNA, 20 bp, Artificial sequence
  SiRNA target sequence
tggccaagaatgaatctaat

SEQ ID NO: 180605 - DNA, 20 bp, Artificial sequence
  SiRNA target sequence
ggccaagaatgaatctaata

SEQ ID NO: 180606 - DNA, 20 bp, Artificial sequence
  SiRNA target sequence
gccaagaatgaatctaataa

SEQ ID NO: 180607 - DNA, 20 bp, Artificial sequence
  SiRNA target sequence
ccaagaatgaatctaataaa

SEQ ID NO: 180608 - DNA, 20 bp, Artificial sequence
  SiRNA target sequence
caagaatgaatctaataaaa

SEQ ID NO: 180609 - DNA, 20 bp, Artificial sequence
  SiRNA target sequence
aagaatgaatctaataaaat

SEQ ID NO: 180610 - DNA, 20 bp, Artificial sequence
  SiRNA target sequence
agaatgaatctaataaaata

SEQ ID NO: 180611 - DNA, 20 bp, Artificial sequence
  SiRNA target sequence
gaatgaatctaataaaataa

SEQ ID NO: 180612 - DNA, 20 bp, Artificial sequence
  SiRNA target sequence
aatgaatctaataaaataac

SEQ ID NO: 180613 - DNA, 20 bp, Artificial sequence
  SiRNA target sequence
atgaatctaataaaataacg

SEQ ID NO: 180614 - DNA, 20 bp, Artificial sequence
  SiRNA target sequence
tgaatctaataaaataacga

SEQ ID NO: 180615 - DNA, 20 bp, Artificial sequence
  SiRNA target sequence
gaatctaataaaataacgag

SEQ ID NO: 180616 - DNA, 20 bp, Artificial sequence
  SiRNA target sequence
aatctaataaaataacgaga

SEQ ID NO: 180617 - DNA, 20 bp, Artificial sequence
  SiRNA target sequence
atctaataaaataacgagac

SEQ ID NO: 180618 - DNA, 20 bp, Artificial sequence
  SiRNA target sequence
tctaataaaataacgagact

SEQ ID NO: 180619 - DNA, 20 bp, Artificial sequence
  SiRNA target sequence
ctaataaaataacgagactg

SEQ ID NO: 180620 - DNA, 20 bp, Artificial sequence
  SiRNA target sequence
taataaaataacgagactgg

SEQ ID NO: 180621 - DNA, 20 bp, Artificial sequence
  SiRNA target sequence
aataaaataacgagactggc

SEQ ID NO: 180622 - DNA, 20 bp, Artificial sequence
  SiRNA target sequence
ataaaataacgagactggca

SEQ ID NO: 180623 - DNA, 20 bp, Artificial sequence
  SiRNA target sequence
taaaataacgagactggcaa

SEQ ID NO: 180624 - DNA, 20 bp, Artificial sequence
  SiRNA target sequence
aaaataacgagactggcaat

SEQ ID NO: 180625 - DNA, 20 bp, Artificial sequence
  SiRNA target sequence
aaataacgagactggcaatt

SEQ ID NO: 180626 - DNA, 20 bp, Artificial sequence
  SiRNA target sequence
aataacgagactggcaattg

SEQ ID NO: 180627 - DNA, 20 bp, Artificial sequence
  SiRNA target sequence
ataacgagactggcaattgt

SEQ ID NO: 180628 - DNA, 20 bp, Artificial sequence
  SiRNA target sequence
taacgagactggcaattgtt

SEQ ID NO: 180629 - DNA, 20 bp, Artificial sequence
  SiRNA target sequence
aacgagactggcaattgtta

SEQ ID NO: 180630 - DNA, 20 bp, Artificial sequence
  SiRNA target sequence
acgagactggcaattgttaa

SEQ ID NO: 180631 - DNA, 20 bp, Artificial sequence
  SiRNA target sequence
cgagactggcaattgttaat

SEQ ID NO: 180632 - DNA, 20 bp, Artificial sequence
  SiRNA target sequence
gagactggcaattgttaatt

SEQ ID NO: 180633 - DNA, 20 bp, Artificial sequence
  SiRNA target sequence
agactggcaattgttaatta

SEQ ID NO: 180634 - DNA, 20 bp, Artificial sequence
  SiRNA target sequence
gactggcaattgttaattat

SEQ ID NO: 180635 - DNA, 20 bp, Artificial sequence
  SiRNA target sequence
actggcaattgttaattatg

SEQ ID NO: 180636 - DNA, 20 bp, Artificial sequence
  SiRNA target sequence
ctggcaattgttaattatga

SEQ ID NO: 180637 - DNA, 20 bp, Artificial sequence
  SiRNA target sequence
tggcaattgttaattatgaa

SEQ ID NO: 180638 - DNA, 20 bp, Artificial sequence
  SiRNA target sequence
ggcaattgttaattatgaac

SEQ ID NO: 180639 - DNA, 20 bp, Artificial sequence
  SiRNA target sequence
gcaattgttaattatgaact

SEQ ID NO: 180640 - DNA, 20 bp, Artificial sequence
  SiRNA target sequence
caattgttaattatgaacta

SEQ ID NO: 180641 - DNA, 20 bp, Artificial sequence
  SiRNA target sequence
aattgttaattatgaactat

SEQ ID NO: 180642 - DNA, 20 bp, Artificial sequence
  SiRNA target sequence
attgttaattatgaactatg

SEQ ID NO: 180643 - DNA, 20 bp, Artificial sequence
  SiRNA target sequence
ttgttaattatgaactatgt

SEQ ID NO: 180644 - DNA, 20 bp, Artificial sequence
  SiRNA target sequence
tgttaattatgaactatgta

SEQ ID NO: 180645 - DNA, 20 bp, Artificial sequence
  SiRNA target sequence
gttaattatgaactatgtaa

SEQ ID NO: 180646 - DNA, 20 bp, Artificial sequence
  SiRNA target sequence
ttaattatgaactatgtaaa

SEQ ID NO: 180647 - DNA, 20 bp, Artificial sequence
  SiRNA target sequence
taattatgaactatgtaaac

SEQ ID NO: 180648 - DNA, 20 bp, Artificial sequence
  SiRNA target sequence
aattatgaactatgtaaacc

SEQ ID NO: 180649 - DNA, 20 bp, Artificial sequence
  SiRNA target sequence
attatgaactatgtaaaccg

SEQ ID NO: 180650 - DNA, 20 bp, Artificial sequence
  SiRNA target sequence
ttatgaactatgtaaaccga

SEQ ID NO: 180651 - DNA, 20 bp, Artificial sequence
  SiRNA target sequence
tatgaactatgtaaaccgaa

SEQ ID NO: 180652 - DNA, 20 bp, Artificial sequence
  SiRNA target sequence
atgaactatgtaaaccgaag

SEQ ID NO: 180653 - DNA, 20 bp, Artificial sequence
  SiRNA target sequence
tgaactatgtaaaccgaagg

SEQ ID NO: 180654 - DNA, 20 bp, Artificial sequence
  SiRNA target sequence
gaactatgtaaaccgaagga

SEQ ID NO: 180655 - DNA, 20 bp, Artificial sequence
  SiRNA target sequence
aactatgtaaaccgaaggaa

SEQ ID NO: 180656 - DNA, 20 bp, Artificial sequence
  SiRNA target sequence
actatgtaaaccgaaggaat

SEQ ID NO: 180657 - DNA, 20 bp, Artificial sequence
  SiRNA target sequence
ctatgtaaaccgaaggaatg

SEQ ID NO: 180658 - DNA, 20 bp, Artificial sequence
  SiRNA target sequence
tatgtaaaccgaaggaatgt

SEQ ID NO: 180659 - DNA, 20 bp, Artificial sequence
  SiRNA target sequence
atgtaaaccgaaggaatgta

SEQ ID NO: 180660 - DNA, 20 bp, Artificial sequence
  SiRNA target sequence
tgtaaaccgaaggaatgtat

SEQ ID NO: 180661 - DNA, 20 bp, Artificial sequence
  SiRNA target sequence
gtaaaccgaaggaatgtatg

SEQ ID NO: 180662 - DNA, 20 bp, Artificial sequence
  SiRNA target sequence
taaaccgaaggaatgtatgt

SEQ ID NO: 180663 - DNA, 20 bp, Artificial sequence
  SiRNA target sequence
aaaccgaaggaatgtatgtc

SEQ ID NO: 180664 - DNA, 20 bp, Artificial sequence
  SiRNA target sequence
aaccgaaggaatgtatgtca

SEQ ID NO: 180665 - DNA, 20 bp, Artificial sequence
  SiRNA target sequence
accgaaggaatgtatgtcag

SEQ ID NO: 180666 - DNA, 20 bp, Artificial sequence
  SiRNA target sequence
ccgaaggaatgtatgtcaga

SEQ ID NO: 180667 - DNA, 20 bp, Artificial sequence
  SiRNA target sequence
cgaaggaatgtatgtcagaa

SEQ ID NO: 180668 - DNA, 20 bp, Artificial sequence
  SiRNA target sequence
gaaggaatgtatgtcagaat

SEQ ID NO: 180669 - DNA, 20 bp, Artificial sequence
  SiRNA target sequence
aaggaatgtatgtcagaatg

SEQ ID NO: 180670 - DNA, 20 bp, Artificial sequence
  SiRNA target sequence
aggaatgtatgtcagaatgt

SEQ ID NO: 180671 - DNA, 20 bp, Artificial sequence
  SiRNA target sequence
ggaatgtatgtcagaatgta

SEQ ID NO: 180672 - DNA, 20 bp, Artificial sequence
  SiRNA target sequence
gaatgtatgtcagaatgtaa

SEQ ID NO: 180673 - DNA, 20 bp, Artificial sequence
  SiRNA target sequence
aatgtatgtcagaatgtaaa

SEQ ID NO: 180674 - DNA, 20 bp, Artificial sequence
  SiRNA target sequence
atgtatgtcagaatgtaaaa

SEQ ID NO: 180675 - DNA, 20 bp, Artificial sequence
  SiRNA target sequence
tgtatgtcagaatgtaaaaa

SEQ ID NO: 180676 - DNA, 20 bp, Artificial sequence
  SiRNA target sequence
gtatgtcagaatgtaaaaag

SEQ ID NO: 180677 - DNA, 20 bp, Artificial sequence
  SiRNA target sequence
tatgtcagaatgtaaaaagg

SEQ ID NO: 180678 - DNA, 20 bp, Artificial sequence
  SiRNA target sequence
atgtcagaatgtaaaaaggc

SEQ ID NO: 180679 - DNA, 20 bp, Artificial sequence
  SiRNA target sequence
tgtcagaatgtaaaaaggcg

SEQ ID NO: 180680 - DNA, 20 bp, Artificial sequence
  SiRNA target sequence
gtcagaatgtaaaaaggcgt

SEQ ID NO: 180681 - DNA, 20 bp, Artificial sequence
  SiRNA target sequence
tcagaatgtaaaaaggcgtg

SEQ ID NO: 180682 - DNA, 20 bp, Artificial sequence
  SiRNA target sequence
cagaatgtaaaaaggcgtgt

SEQ ID NO: 180683 - DNA, 20 bp, Artificial sequence
  SiRNA target sequence
agaatgtaaaaaggcgtgtc

SEQ ID NO: 180684 - DNA, 20 bp, Artificial sequence
  SiRNA target sequence
gaatgtaaaaaggcgtgtcc

SEQ ID NO: 180685 - DNA, 20 bp, Artificial sequence
  SiRNA target sequence
aatgtaaaaaggcgtgtcct

SEQ ID NO: 180686 - DNA, 20 bp, Artificial sequence
  SiRNA target sequence
atgtaaaaaggcgtgtcctg

SEQ ID NO: 180687 - DNA, 20 bp, Artificial sequence
  SiRNA target sequence
tgtaaaaaggcgtgtcctgt

SEQ ID NO: 180688 - DNA, 20 bp, Artificial sequence
  SiRNA target sequence
gtaaaaaggcgtgtcctgtt

SEQ ID NO: 180689 - DNA, 20 bp, Artificial sequence
  SiRNA target sequence
taaaaaggcgtgtcctgtta

SEQ ID NO: 180690 - DNA, 20 bp, Artificial sequence
  SiRNA target sequence
aaaaaggcgtgtcctgttaa

SEQ ID NO: 180691 - DNA, 20 bp, Artificial sequence
  SiRNA target sequence
aaaaggcgtgtcctgttaat

SEQ ID NO: 180692 - DNA, 20 bp, Artificial sequence
  SiRNA target sequence
aaaggcgtgtcctgttaata

SEQ ID NO: 180693 - DNA, 20 bp, Artificial sequence
  SiRNA target sequence
aaggcgtgtcctgttaataa

SEQ ID NO: 180694 - DNA, 20 bp, Artificial sequence
  SiRNA target sequence
aggcgtgtcctgttaataaa

SEQ ID NO: 180695 - DNA, 20 bp, Artificial sequence
  SiRNA target sequence
ggcgtgtcctgttaataaaa

SEQ ID NO: 180696 - DNA, 20 bp, Artificial sequence
  SiRNA target sequence
gcgtgtcctgttaataaaac

SEQ ID NO: 180697 - DNA, 20 bp, Artificial sequence
  SiRNA target sequence
cgtgtcctgttaataaaaca

SEQ ID NO: 180698 - DNA, 20 bp, Artificial sequence
  SiRNA target sequence
gtgtcctgttaataaaacag

SEQ ID NO: 180699 - DNA, 20 bp, Artificial sequence
  SiRNA target sequence
tgtcctgttaataaaacagg

SEQ ID NO: 180700 - DNA, 20 bp, Artificial sequence
  SiRNA target sequence
gtcctgttaataaaacagga

SEQ ID NO: 180701 - DNA, 20 bp, Artificial sequence
  SiRNA target sequence
tcctgttaataaaacaggaa

SEQ ID NO: 180702 - DNA, 20 bp, Artificial sequence
  SiRNA target sequence
cctgttaataaaacaggaaa

SEQ ID NO: 180703 - DNA, 20 bp, Artificial sequence
  SiRNA target sequence
ctgttaataaaacaggaaag

SEQ ID NO: 180704 - DNA, 20 bp, Artificial sequence
  SiRNA target sequence
tgttaataaaacaggaaagg

SEQ ID NO: 180705 - DNA, 20 bp, Artificial sequence
  SiRNA target sequence
gttaataaaacaggaaagga

SEQ ID NO: 180706 - DNA, 20 bp, Artificial sequence
  SiRNA target sequence
ttaataaaacaggaaaggag

SEQ ID NO: 180707 - DNA, 20 bp, Artificial sequence
  SiRNA target sequence
taataaaacaggaaaggagt

SEQ ID NO: 180708 - DNA, 20 bp, Artificial sequence
  SiRNA target sequence
aataaaacaggaaaggagtg

SEQ ID NO: 180709 - DNA, 20 bp, Artificial sequence
  SiRNA target sequence
ataaaacaggaaaggagtgt

SEQ ID NO: 180710 - DNA, 20 bp, Artificial sequence
  SiRNA target sequence
taaaacaggaaaggagtgta

SEQ ID NO: 180711 - DNA, 20 bp, Artificial sequence
  SiRNA target sequence
aaaacaggaaaggagtgtat

SEQ ID NO: 180712 - DNA, 20 bp, Artificial sequence
  SiRNA target sequence
aaacaggaaaggagtgtatt

SEQ ID NO: 180713 - DNA, 20 bp, Artificial sequence
  SiRNA target sequence
aacaggaaaggagtgtatta

SEQ ID NO: 180714 - DNA, 20 bp, Artificial sequence
  SiRNA target sequence
acaggaaaggagtgtattac

SEQ ID NO: 180715 - DNA, 20 bp, Artificial sequence
  SiRNA target sequence
caggaaaggagtgtattaca

SEQ ID NO: 180716 - DNA, 20 bp, Artificial sequence
  SiRNA target sequence
aggaaaggagtgtattacaa

SEQ ID NO: 180717 - DNA, 20 bp, Artificial sequence
  SiRNA target sequence
ggaaaggagtgtattacaat

SEQ ID NO: 180718 - DNA, 20 bp, Artificial sequence
  SiRNA target sequence
gaaaggagtgtattacaatt

SEQ ID NO: 180719 - DNA, 20 bp, Artificial sequence
  SiRNA target sequence
aaaggagtgtattacaattg

SEQ ID NO: 180720 - DNA, 20 bp, Artificial sequence
  SiRNA target sequence
aaggagtgtattacaattga

SEQ ID NO: 180721 - DNA, 20 bp, Artificial sequence
  SiRNA target sequence
aggagtgtattacaattgat

SEQ ID NO: 180722 - DNA, 20 bp, Artificial sequence
  SiRNA target sequence
ggagtgtattacaattgata

SEQ ID NO: 180723 - DNA, 20 bp, Artificial sequence
  SiRNA target sequence
gagtgtattacaattgatac

SEQ ID NO: 180724 - DNA, 20 bp, Artificial sequence
  SiRNA target sequence
agtgtattacaattgatact

SEQ ID NO: 180725 - DNA, 20 bp, Artificial sequence
  SiRNA target sequence
gtgtattacaattgatacta

SEQ ID NO: 180726 - DNA, 20 bp, Artificial sequence
  SiRNA target sequence
tgtattacaattgatactaa

SEQ ID NO: 180727 - DNA, 20 bp, Artificial sequence
  SiRNA target sequence
gtattacaattgatactaaa

SEQ ID NO: 180728 - DNA, 20 bp, Artificial sequence
  SiRNA target sequence
tattacaattgatactaaat

SEQ ID NO: 180729 - DNA, 20 bp, Artificial sequence
  SiRNA target sequence
attacaattgatactaaatc

SEQ ID NO: 180730 - DNA, 20 bp, Artificial sequence
  SiRNA target sequence
ttacaattgatactaaatca

SEQ ID NO: 180731 - DNA, 20 bp, Artificial sequence
  SiRNA target sequence
tacaattgatactaaatcac

SEQ ID NO: 180732 - DNA, 20 bp, Artificial sequence
  SiRNA target sequence
acaattgatactaaatcaca

SEQ ID NO: 180733 - DNA, 20 bp, Artificial sequence
  SiRNA target sequence
caattgatactaaatcacat

SEQ ID NO: 180734 - DNA, 20 bp, Artificial sequence
  SiRNA target sequence
aattgatactaaatcacata

SEQ ID NO: 180735 - DNA, 20 bp, Artificial sequence
  SiRNA target sequence
attgatactaaatcacatat

SEQ ID NO: 180736 - DNA, 20 bp, Artificial sequence
  SiRNA target sequence
ttgatactaaatcacatatc

SEQ ID NO: 180737 - DNA, 20 bp, Artificial sequence
  SiRNA target sequence
tgatactaaatcacatatct

SEQ ID NO: 180738 - DNA, 20 bp, Artificial sequence
  SiRNA target sequence
gatactaaatcacatatctc

SEQ ID NO: 180739 - DNA, 20 bp, Artificial sequence
  SiRNA target sequence
atactaaatcacatatctca

SEQ ID NO: 180740 - DNA, 20 bp, Artificial sequence
  SiRNA target sequence
tactaaatcacatatctcag

SEQ ID NO: 180741 - DNA, 20 bp, Artificial sequence
  SiRNA target sequence
actaaatcacatatctcaga

SEQ ID NO: 180742 - DNA, 20 bp, Artificial sequence
  SiRNA target sequence
ctaaatcacatatctcagaa

SEQ ID NO: 180743 - DNA, 20 bp, Artificial sequence
  SiRNA target sequence
taaatcacatatctcagaaa

SEQ ID NO: 180744 - DNA, 20 bp, Artificial sequence
  SiRNA target sequence
aaatcacatatctcagaaat

SEQ ID NO: 180745 - DNA, 20 bp, Artificial sequence
  SiRNA target sequence
aatcacatatctcagaaatt

SEQ ID NO: 180746 - DNA, 20 bp, Artificial sequence
  SiRNA target sequence
atcacatatctcagaaattc

SEQ ID NO: 180747 - DNA, 20 bp, Artificial sequence
  SiRNA target sequence
tcacatatctcagaaattct

SEQ ID NO: 180748 - DNA, 20 bp, Artificial sequence
  SiRNA target sequence
cacatatctcagaaattctg

SEQ ID NO: 180749 - DNA, 20 bp, Artificial sequence
  SiRNA target sequence
acatatctcagaaattctgt

SEQ ID NO: 180750 - DNA, 20 bp, Artificial sequence
  SiRNA target sequence
catatctcagaaattctgtg

SEQ ID NO: 180751 - DNA, 20 bp, Artificial sequence
  SiRNA target sequence
atatctcagaaattctgtgt

SEQ ID NO: 180752 - DNA, 20 bp, Artificial sequence
  SiRNA target sequence
tatctcagaaattctgtgta

SEQ ID NO: 180753 - DNA, 20 bp, Artificial sequence
  SiRNA target sequence
atctcagaaattctgtgtat

SEQ ID NO: 180754 - DNA, 20 bp, Artificial sequence
  SiRNA target sequence
tctcagaaattctgtgtata

SEQ ID NO: 180755 - DNA, 20 bp, Artificial sequence
  SiRNA target sequence
ctcagaaattctgtgtatag

SEQ ID NO: 180756 - DNA, 20 bp, Artificial sequence
  SiRNA target sequence
tcagaaattctgtgtatagg

SEQ ID NO: 180757 - DNA, 20 bp, Artificial sequence
  SiRNA target sequence
cagaaattctgtgtatagga

SEQ ID NO: 180758 - DNA, 20 bp, Artificial sequence
  SiRNA target sequence
agaaattctgtgtataggat

SEQ ID NO: 180759 - DNA, 20 bp, Artificial sequence
  SiRNA target sequence
gaaattctgtgtataggatg

SEQ ID NO: 180760 - DNA, 20 bp, Artificial sequence
  SiRNA target sequence
aaattctgtgtataggatgt

SEQ ID NO: 180761 - DNA, 20 bp, Artificial sequence
  SiRNA target sequence
aattctgtgtataggatgtt

SEQ ID NO: 180762 - DNA, 20 bp, Artificial sequence
  SiRNA target sequence
attctgtgtataggatgttc

SEQ ID NO: 180763 - DNA, 20 bp, Artificial sequence
  SiRNA target sequence
ttctgtgtataggatgttct

SEQ ID NO: 180764 - DNA, 20 bp, Artificial sequence
  SiRNA target sequence
tctgtgtataggatgttctg

SEQ ID NO: 180765 - DNA, 20 bp, Artificial sequence
  SiRNA target sequence
ctgtgtataggatgttctgc

SEQ ID NO: 180766 - DNA, 20 bp, Artificial sequence
  SiRNA target sequence
tgtgtataggatgttctgcg

SEQ ID NO: 180767 - DNA, 20 bp, Artificial sequence
  SiRNA target sequence
gtgtataggatgttctgcgt

SEQ ID NO: 180768 - DNA, 20 bp, Artificial sequence
  SiRNA target sequence
tgtataggatgttctgcgtg

SEQ ID NO: 180769 - DNA, 20 bp, Artificial sequence
  SiRNA target sequence
gtataggatgttctgcgtgt

SEQ ID NO: 180770 - DNA, 20 bp, Artificial sequence
  SiRNA target sequence
tataggatgttctgcgtgtc

SEQ ID NO: 180771 - DNA, 20 bp, Artificial sequence
  SiRNA target sequence
ataggatgttctgcgtgtca

SEQ ID NO: 180772 - DNA, 20 bp, Artificial sequence
  SiRNA target sequence
taggatgttctgcgtgtcaa

SEQ ID NO: 180773 - DNA, 20 bp, Artificial sequence
  SiRNA target sequence
aggatgttctgcgtgtcaaa

SEQ ID NO: 180774 - DNA, 20 bp, Artificial sequence
  SiRNA target sequence
ggatgttctgcgtgtcaaaa

SEQ ID NO: 180775 - DNA, 20 bp, Artificial sequence
  SiRNA target sequence
gatgttctgcgtgtcaaaag

SEQ ID NO: 180776 - DNA, 20 bp, Artificial sequence
  SiRNA target sequence
atgttctgcgtgtcaaaaga

SEQ ID NO: 180777 - DNA, 20 bp, Artificial sequence
  SiRNA target sequence
tgttctgcgtgtcaaaagaa

SEQ ID NO: 180778 - DNA, 20 bp, Artificial sequence
  SiRNA target sequence
gttctgcgtgtcaaaagaaa

SEQ ID NO: 180779 - DNA, 20 bp, Artificial sequence
  SiRNA target sequence
ttctgcgtgtcaaaagaaat

SEQ ID NO: 180780 - DNA, 20 bp, Artificial sequence
  SiRNA target sequence
tctgcgtgtcaaaagaaatg

SEQ ID NO: 180781 - DNA, 20 bp, Artificial sequence
  SiRNA target sequence
ctgcgtgtcaaaagaaatgt

SEQ ID NO: 180782 - DNA, 20 bp, Artificial sequence
  SiRNA target sequence
tgcgtgtcaaaagaaatgtc

SEQ ID NO: 180783 - DNA, 20 bp, Artificial sequence
  SiRNA target sequence
gcgtgtcaaaagaaatgtcc

SEQ ID NO: 180784 - DNA, 20 bp, Artificial sequence
  SiRNA target sequence
cgtgtcaaaagaaatgtcct

SEQ ID NO: 180785 - DNA, 20 bp, Artificial sequence
  SiRNA target sequence
gtgtcaaaagaaatgtcctt

SEQ ID NO: 180786 - DNA, 20 bp, Artificial sequence
  SiRNA target sequence
tgtcaaaagaaatgtccttt

SEQ ID NO: 180787 - DNA, 20 bp, Artificial sequence
  SiRNA target sequence
gtcaaaagaaatgtcctttt

SEQ ID NO: 180788 - DNA, 20 bp, Artificial sequence
  SiRNA target sequence
tcaaaagaaatgtcctttta

SEQ ID NO: 180789 - DNA, 20 bp, Artificial sequence
  SiRNA target sequence
caaaagaaatgtccttttaa

SEQ ID NO: 180790 - DNA, 20 bp, Artificial sequence
  SiRNA target sequence
aaaagaaatgtccttttaag

SEQ ID NO: 180791 - DNA, 20 bp, Artificial sequence
  SiRNA target sequence
aaagaaatgtccttttaagg

SEQ ID NO: 180792 - DNA, 20 bp, Artificial sequence
  SiRNA target sequence
aagaaatgtccttttaaggc

SEQ ID NO: 180793 - DNA, 20 bp, Artificial sequence
  SiRNA target sequence
agaaatgtccttttaaggcg

SEQ ID NO: 180794 - DNA, 20 bp, Artificial sequence
  SiRNA target sequence
gaaatgtccttttaaggcga

SEQ ID NO: 180795 - DNA, 20 bp, Artificial sequence
  SiRNA target sequence
aaatgtccttttaaggcgat

SEQ ID NO: 180796 - DNA, 20 bp, Artificial sequence
  SiRNA target sequence
aatgtccttttaaggcgatt

SEQ ID NO: 180797 - DNA, 20 bp, Artificial sequence
  SiRNA target sequence
atgtccttttaaggcgatta

SEQ ID NO: 180798 - DNA, 20 bp, Artificial sequence
  SiRNA target sequence
tgtccttttaaggcgattac

SEQ ID NO: 180799 - DNA, 20 bp, Artificial sequence
  SiRNA target sequence
gtccttttaaggcgattaca

SEQ ID NO: 180800 - DNA, 20 bp, Artificial sequence
  SiRNA target sequence
tccttttaaggcgattacaa

SEQ ID NO: 180801 - DNA, 20 bp, Artificial sequence
  SiRNA target sequence
ccttttaaggcgattacaat

SEQ ID NO: 180802 - DNA, 20 bp, Artificial sequence
  SiRNA target sequence
cttttaaggcgattacaatt

SEQ ID NO: 180803 - DNA, 20 bp, Artificial sequence
  SiRNA target sequence
ttttaaggcgattacaattg

SEQ ID NO: 180804 - DNA, 20 bp, Artificial sequence
  SiRNA target sequence
tttaaggcgattacaattgt

SEQ ID NO: 180805 - DNA, 20 bp, Artificial sequence
  SiRNA target sequence
ttaaggcgattacaattgta

SEQ ID NO: 180806 - DNA, 20 bp, Artificial sequence
  SiRNA target sequence
taaggcgattacaattgtaa

SEQ ID NO: 180807 - DNA, 20 bp, Artificial sequence
  SiRNA target sequence
aaggcgattacaattgtaaa

SEQ ID NO: 180808 - DNA, 20 bp, Artificial sequence
  SiRNA target sequence
aggcgattacaattgtaaat

SEQ ID NO: 180809 - DNA, 20 bp, Artificial sequence
  SiRNA target sequence
ggcgattacaattgtaaatt

SEQ ID NO: 180810 - DNA, 20 bp, Artificial sequence
  SiRNA target sequence
gcgattacaattgtaaattt

SEQ ID NO: 180811 - DNA, 20 bp, Artificial sequence
  SiRNA target sequence
cgattacaattgtaaattta

SEQ ID NO: 180812 - DNA, 20 bp, Artificial sequence
  SiRNA target sequence
gattacaattgtaaatttac

SEQ ID NO: 180813 - DNA, 20 bp, Artificial sequence
  SiRNA target sequence
attacaattgtaaatttacc

SEQ ID NO: 180814 - DNA, 20 bp, Artificial sequence
  SiRNA target sequence
ttacaattgtaaatttacct

SEQ ID NO: 180815 - DNA, 20 bp, Artificial sequence
  SiRNA target sequence
tacaattgtaaatttaccta

SEQ ID NO: 180816 - DNA, 20 bp, Artificial sequence
  SiRNA target sequence
acaattgtaaatttacctac

SEQ ID NO: 180817 - DNA, 20 bp, Artificial sequence
  SiRNA target sequence
caattgtaaatttacctaca

SEQ ID NO: 180818 - DNA, 20 bp, Artificial sequence
  SiRNA target sequence
aattgtaaatttacctacaa

SEQ ID NO: 180819 - DNA, 20 bp, Artificial sequence
  SiRNA target sequence
attgtaaatttacctacaaa

SEQ ID NO: 180820 - DNA, 20 bp, Artificial sequence
  SiRNA target sequence
ttgtaaatttacctacaaat

SEQ ID NO: 180821 - DNA, 20 bp, Artificial sequence
  SiRNA target sequence
tgtaaatttacctacaaatc

SEQ ID NO: 180822 - DNA, 20 bp, Artificial sequence
  SiRNA target sequence
gtaaatttacctacaaatct

SEQ ID NO: 180823 - DNA, 20 bp, Artificial sequence
  SiRNA target sequence
taaatttacctacaaatcta

SEQ ID NO: 180824 - DNA, 20 bp, Artificial sequence
  SiRNA target sequence
aaatttacctacaaatctag

SEQ ID NO: 180825 - DNA, 20 bp, Artificial sequence
  SiRNA target sequence
aatttacctacaaatctaga

SEQ ID NO: 180826 - DNA, 20 bp, Artificial sequence
  SiRNA target sequence
atttacctacaaatctagat

SEQ ID NO: 180827 - DNA, 20 bp, Artificial sequence
  SiRNA target sequence
tttacctacaaatctagata

SEQ ID NO: 180828 - DNA, 20 bp, Artificial sequence
  SiRNA target sequence
ttacctacaaatctagataa

SEQ ID NO: 180829 - DNA, 20 bp, Artificial sequence
  SiRNA target sequence
tacctacaaatctagataaa

SEQ ID NO: 180830 - DNA, 20 bp, Artificial sequence
  SiRNA target sequence
acctacaaatctagataaag

SEQ ID NO: 180831 - DNA, 20 bp, Artificial sequence
  SiRNA target sequence
cctacaaatctagataaaga

SEQ ID NO: 180832 - DNA, 20 bp, Artificial sequence
  SiRNA target sequence
ctacaaatctagataaagac

SEQ ID NO: 180833 - DNA, 20 bp, Artificial sequence
  SiRNA target sequence
tacaaatctagataaagaca

SEQ ID NO: 180834 - DNA, 20 bp, Artificial sequence
  SiRNA target sequence
acaaatctagataaagacat

SEQ ID NO: 180835 - DNA, 20 bp, Artificial sequence
  SiRNA target sequence
caaatctagataaagacatt

SEQ ID NO: 180836 - DNA, 20 bp, Artificial sequence
  SiRNA target sequence
aaatctagataaagacattt

SEQ ID NO: 180837 - DNA, 20 bp, Artificial sequence
  SiRNA target sequence
aatctagataaagacatttc

SEQ ID NO: 180838 - DNA, 20 bp, Artificial sequence
  SiRNA target sequence
atctagataaagacatttca

SEQ ID NO: 180839 - DNA, 20 bp, Artificial sequence
  SiRNA target sequence
tctagataaagacatttcac

SEQ ID NO: 180840 - DNA, 20 bp, Artificial sequence
  SiRNA target sequence
ctagataaagacatttcaca

SEQ ID NO: 180841 - DNA, 20 bp, Artificial sequence
  SiRNA target sequence
tagataaagacatttcacat

SEQ ID NO: 180842 - DNA, 20 bp, Artificial sequence
  SiRNA target sequence
agataaagacatttcacata

SEQ ID NO: 180843 - DNA, 20 bp, Artificial sequence
  SiRNA target sequence
gataaagacatttcacatag

SEQ ID NO: 180844 - DNA, 20 bp, Artificial sequence
  SiRNA target sequence
ataaagacatttcacataga

SEQ ID NO: 180845 - DNA, 20 bp, Artificial sequence
  SiRNA target sequence
taaagacatttcacatagat

SEQ ID NO: 180846 - DNA, 20 bp, Artificial sequence
  SiRNA target sequence
aaagacatttcacatagata

SEQ ID NO: 180847 - DNA, 20 bp, Artificial sequence
  SiRNA target sequence
aagacatttcacatagatat

SEQ ID NO: 180848 - DNA, 20 bp, Artificial sequence
  SiRNA target sequence
agacatttcacatagatatt

SEQ ID NO: 180849 - DNA, 20 bp, Artificial sequence
  SiRNA target sequence
gacatttcacatagatattc

SEQ ID NO: 180850 - DNA, 20 bp, Artificial sequence
  SiRNA target sequence
acatttcacatagatattcg

SEQ ID NO: 180851 - DNA, 20 bp, Artificial sequence
  SiRNA target sequence
catttcacatagatattcgg

SEQ ID NO: 180852 - DNA, 20 bp, Artificial sequence
  SiRNA target sequence
atttcacatagatattcggc

SEQ ID NO: 180853 - DNA, 20 bp, Artificial sequence
  SiRNA target sequence
tttcacatagatattcggca

SEQ ID NO: 180854 - DNA, 20 bp, Artificial sequence
  SiRNA target sequence
ttcacatagatattcggcaa

SEQ ID NO: 180855 - DNA, 20 bp, Artificial sequence
  SiRNA target sequence
tcacatagatattcggcaaa

SEQ ID NO: 180856 - DNA, 20 bp, Artificial sequence
  SiRNA target sequence
cacatagatattcggcaaat

SEQ ID NO: 180857 - DNA, 20 bp, Artificial sequence
  SiRNA target sequence
acatagatattcggcaaatg

SEQ ID NO: 180858 - DNA, 20 bp, Artificial sequence
  SiRNA target sequence
catagatattcggcaaatgg

SEQ ID NO: 180859 - DNA, 20 bp, Artificial sequence
  SiRNA target sequence
atagatattcggcaaatggt

SEQ ID NO: 180860 - DNA, 20 bp, Artificial sequence
  SiRNA target sequence
tagatattcggcaaatggtt

SEQ ID NO: 180861 - DNA, 20 bp, Artificial sequence
  SiRNA target sequence
agatattcggcaaatggttt

SEQ ID NO: 180862 - DNA, 20 bp, Artificial sequence
  SiRNA target sequence
gatattcggcaaatggtttt

SEQ ID NO: 180863 - DNA, 20 bp, Artificial sequence
  SiRNA target sequence
atattcggcaaatggtttta

SEQ ID NO: 180864 - DNA, 20 bp, Artificial sequence
  SiRNA target sequence
tattcggcaaatggttttaa

SEQ ID NO: 180865 - DNA, 20 bp, Artificial sequence
  SiRNA target sequence
attcggcaaatggttttaaa

SEQ ID NO: 180866 - DNA, 20 bp, Artificial sequence
  SiRNA target sequence
ttcggcaaatggttttaaac

SEQ ID NO: 180867 - DNA, 20 bp, Artificial sequence
  SiRNA target sequence
tcggcaaatggttttaaact

SEQ ID NO: 180868 - DNA, 20 bp, Artificial sequence
  SiRNA target sequence
cggcaaatggttttaaactt

SEQ ID NO: 180869 - DNA, 20 bp, Artificial sequence
  SiRNA target sequence
ggcaaatggttttaaacttc

SEQ ID NO: 180870 - DNA, 20 bp, Artificial sequence
  SiRNA target sequence
gcaaatggttttaaacttca

SEQ ID NO: 180871 - DNA, 20 bp, Artificial sequence
  SiRNA target sequence
caaatggttttaaacttcac

SEQ ID NO: 180872 - DNA, 20 bp, Artificial sequence
  SiRNA target sequence
aaatggttttaaacttcaca

SEQ ID NO: 180873 - DNA, 20 bp, Artificial sequence
  SiRNA target sequence
aatggttttaaacttcacag

SEQ ID NO: 180874 - DNA, 20 bp, Artificial sequence
  SiRNA target sequence
atggttttaaacttcacaga

SEQ ID NO: 180875 - DNA, 20 bp, Artificial sequence
  SiRNA target sequence
tggttttaaacttcacagat

SEQ ID NO: 180876 - DNA, 20 bp, Artificial sequence
  SiRNA target sequence
ggttttaaacttcacagatt

SEQ ID NO: 180877 - DNA, 20 bp, Artificial sequence
  SiRNA target sequence
gttttaaacttcacagatta

SEQ ID NO: 180878 - DNA, 20 bp, Artificial sequence
  SiRNA target sequence
ttttaaacttcacagattac

SEQ ID NO: 180879 - DNA, 20 bp, Artificial sequence
  SiRNA target sequence
tttaaacttcacagattacc

SEQ ID NO: 180880 - DNA, 20 bp, Artificial sequence
  SiRNA target sequence
ttaaacttcacagattacca

SEQ ID NO: 180881 - DNA, 20 bp, Artificial sequence
  SiRNA target sequence
taaacttcacagattaccaa

SEQ ID NO: 180882 - DNA, 20 bp, Artificial sequence
  SiRNA target sequence
aaacttcacagattaccaat

SEQ ID NO: 180883 - DNA, 20 bp, Artificial sequence
  SiRNA target sequence
aacttcacagattaccaatc

SEQ ID NO: 180884 - DNA, 20 bp, Artificial sequence
  SiRNA target sequence
acttcacagattaccaatcc

SEQ ID NO: 180885 - DNA, 20 bp, Artificial sequence
  SiRNA target sequence
cttcacagattaccaatccc

SEQ ID NO: 180886 - DNA, 20 bp, Artificial sequence
  SiRNA target sequence
ttcacagattaccaatccct

SEQ ID NO: 180887 - DNA, 20 bp, Artificial sequence
  SiRNA target sequence
tcacagattaccaatcccta

SEQ ID NO: 180888 - DNA, 20 bp, Artificial sequence
  SiRNA target sequence
cacagattaccaatccctaa

SEQ ID NO: 180889 - DNA, 20 bp, Artificial sequence
  SiRNA target sequence
acagattaccaatccctaaa

SEQ ID NO: 180890 - DNA, 20 bp, Artificial sequence
  SiRNA target sequence
cagattaccaatccctaaat

SEQ ID NO: 180891 - DNA, 20 bp, Artificial sequence
  SiRNA target sequence
agattaccaatccctaaata

SEQ ID NO: 180892 - DNA, 20 bp, Artificial sequence
  SiRNA target sequence
gattaccaatccctaaatat

SEQ ID NO: 180893 - DNA, 20 bp, Artificial sequence
  SiRNA target sequence
attaccaatccctaaatatg

SEQ ID NO: 180894 - DNA, 20 bp, Artificial sequence
  SiRNA target sequence
ttaccaatccctaaatatgg

SEQ ID NO: 180895 - DNA, 20 bp, Artificial sequence
  SiRNA target sequence
taccaatccctaaatatggt

SEQ ID NO: 180896 - DNA, 20 bp, Artificial sequence
  SiRNA target sequence
accaatccctaaatatggta

SEQ ID NO: 180897 - DNA, 20 bp, Artificial sequence
  SiRNA target sequence
ccaatccctaaatatggtaa

SEQ ID NO: 180898 - DNA, 20 bp, Artificial sequence
  SiRNA target sequence
caatccctaaatatggtaag

SEQ ID NO: 180899 - DNA, 20 bp, Artificial sequence
  SiRNA target sequence
aatccctaaatatggtaagg

SEQ ID NO: 180900 - DNA, 20 bp, Artificial sequence
  SiRNA target sequence
atccctaaatatggtaaggt

SEQ ID NO: 180901 - DNA, 20 bp, Artificial sequence
  SiRNA target sequence
tccctaaatatggtaaggtt

SEQ ID NO: 180902 - DNA, 20 bp, Artificial sequence
  SiRNA target sequence
ccctaaatatggtaaggttt

SEQ ID NO: 180903 - DNA, 20 bp, Artificial sequence
  SiRNA target sequence
cctaaatatggtaaggtttt

SEQ ID NO: 180904 - DNA, 20 bp, Artificial sequence
  SiRNA target sequence
ctaaatatggtaaggtttta

SEQ ID NO: 180905 - DNA, 20 bp, Artificial sequence
  SiRNA target sequence
taaatatggtaaggttttag

SEQ ID NO: 180906 - DNA, 20 bp, Artificial sequence
  SiRNA target sequence
aaatatggtaaggttttagg

SEQ ID NO: 180907 - DNA, 20 bp, Artificial sequence
  SiRNA target sequence
aatatggtaaggttttaggg

SEQ ID NO: 180908 - DNA, 20 bp, Artificial sequence
  SiRNA target sequence
atatggtaaggttttagggc

SEQ ID NO: 180909 - DNA, 20 bp, Artificial sequence
  SiRNA target sequence
tatggtaaggttttagggct

SEQ ID NO: 180910 - DNA, 20 bp, Artificial sequence
  SiRNA target sequence
atggtaaggttttagggcta

SEQ ID NO: 180911 - DNA, 20 bp, Artificial sequence
  SiRNA target sequence
tggtaaggttttagggctag

SEQ ID NO: 180912 - DNA, 20 bp, Artificial sequence
  SiRNA target sequence
ggtaaggttttagggctagt

SEQ ID NO: 180913 - DNA, 20 bp, Artificial sequence
  SiRNA target sequence
gtaaggttttagggctagta

SEQ ID NO: 180914 - DNA, 20 bp, Artificial sequence
  SiRNA target sequence
taaggttttagggctagtag

SEQ ID NO: 180915 - DNA, 20 bp, Artificial sequence
  SiRNA target sequence
aaggttttagggctagtagg

SEQ ID NO: 180916 - DNA, 20 bp, Artificial sequence
  SiRNA target sequence
aggttttagggctagtaggc

SEQ ID NO: 180917 - DNA, 20 bp, Artificial sequence
  SiRNA target sequence
ggttttagggctagtaggca

SEQ ID NO: 180918 - DNA, 20 bp, Artificial sequence
  SiRNA target sequence
gttttagggctagtaggcac

SEQ ID NO: 180919 - DNA, 20 bp, Artificial sequence
  SiRNA target sequence
ttttagggctagtaggcact

SEQ ID NO: 180920 - DNA, 20 bp, Artificial sequence
  SiRNA target sequence
tttagggctagtaggcacta

SEQ ID NO: 180921 - DNA, 20 bp, Artificial sequence
  SiRNA target sequence
ttagggctagtaggcactaa

SEQ ID NO: 180922 - DNA, 20 bp, Artificial sequence
  SiRNA target sequence
tagggctagtaggcactaat

SEQ ID NO: 180923 - DNA, 20 bp, Artificial sequence
  SiRNA target sequence
agggctagtaggcactaatg

SEQ ID NO: 180924 - DNA, 20 bp, Artificial sequence
  SiRNA target sequence
gggctagtaggcactaatgg

SEQ ID NO: 180925 - DNA, 20 bp, Artificial sequence
  SiRNA target sequence
ggctagtaggcactaatggt

SEQ ID NO: 180926 - DNA, 20 bp, Artificial sequence
  SiRNA target sequence
gctagtaggcactaatggta

SEQ ID NO: 180927 - DNA, 20 bp, Artificial sequence
  SiRNA target sequence
ctagtaggcactaatggtat

SEQ ID NO: 180928 - DNA, 20 bp, Artificial sequence
  SiRNA target sequence
tagtaggcactaatggtata

SEQ ID NO: 180929 - DNA, 20 bp, Artificial sequence
  SiRNA target sequence
agtaggcactaatggtatag

SEQ ID NO: 180930 - DNA, 20 bp, Artificial sequence
  SiRNA target sequence
gtaggcactaatggtatagg

SEQ ID NO: 180931 - DNA, 20 bp, Artificial sequence
  SiRNA target sequence
taggcactaatggtatagga

SEQ ID NO: 180932 - DNA, 20 bp, Artificial sequence
  SiRNA target sequence
aggcactaatggtataggaa

SEQ ID NO: 180933 - DNA, 20 bp, Artificial sequence
  SiRNA target sequence
ggcactaatggtataggaaa

SEQ ID NO: 180934 - DNA, 20 bp, Artificial sequence
  SiRNA target sequence
gcactaatggtataggaaaa

SEQ ID NO: 180935 - DNA, 20 bp, Artificial sequence
  SiRNA target sequence
cactaatggtataggaaaaa

SEQ ID NO: 180936 - DNA, 20 bp, Artificial sequence
  SiRNA target sequence
actaatggtataggaaaaag

SEQ ID NO: 180937 - DNA, 20 bp, Artificial sequence
  SiRNA target sequence
ctaatggtataggaaaaagt

SEQ ID NO: 180938 - DNA, 20 bp, Artificial sequence
  SiRNA target sequence
taatggtataggaaaaagta

SEQ ID NO: 180939 - DNA, 20 bp, Artificial sequence
  SiRNA target sequence
aatggtataggaaaaagtac

SEQ ID NO: 180940 - DNA, 20 bp, Artificial sequence
  SiRNA target sequence
atggtataggaaaaagtact

SEQ ID NO: 180941 - DNA, 20 bp, Artificial sequence
  SiRNA target sequence
tggtataggaaaaagtactg

SEQ ID NO: 180942 - DNA, 20 bp, Artificial sequence
  SiRNA target sequence
ggtataggaaaaagtactgc

SEQ ID NO: 180943 - DNA, 20 bp, Artificial sequence
  SiRNA target sequence
gtataggaaaaagtactgca

SEQ ID NO: 180944 - DNA, 20 bp, Artificial sequence
  SiRNA target sequence
tataggaaaaagtactgcac

SEQ ID NO: 180945 - DNA, 20 bp, Artificial sequence
  SiRNA target sequence
ataggaaaaagtactgcact

SEQ ID NO: 180946 - DNA, 20 bp, Artificial sequence
  SiRNA target sequence
taggaaaaagtactgcactt

SEQ ID NO: 180947 - DNA, 20 bp, Artificial sequence
  SiRNA target sequence
aggaaaaagtactgcactta

SEQ ID NO: 180948 - DNA, 20 bp, Artificial sequence
  SiRNA target sequence
ggaaaaagtactgcacttaa

SEQ ID NO: 180949 - DNA, 20 bp, Artificial sequence
  SiRNA target sequence
gaaaaagtactgcacttaaa

SEQ ID NO: 180950 - DNA, 20 bp, Artificial sequence
  SiRNA target sequence
aaaaagtactgcacttaaaa

SEQ ID NO: 180951 - DNA, 20 bp, Artificial sequence
  SiRNA target sequence
aaaagtactgcacttaaaat

SEQ ID NO: 180952 - DNA, 20 bp, Artificial sequence
  SiRNA target sequence
aaagtactgcacttaaaata

SEQ ID NO: 180953 - DNA, 20 bp, Artificial sequence
  SiRNA target sequence
aagtactgcacttaaaatat

SEQ ID NO: 180954 - DNA, 20 bp, Artificial sequence
  SiRNA target sequence
agtactgcacttaaaatatt

SEQ ID NO: 180955 - DNA, 20 bp, Artificial sequence
  SiRNA target sequence
gtactgcacttaaaatatta

SEQ ID NO: 180956 - DNA, 20 bp, Artificial sequence
  SiRNA target sequence
tactgcacttaaaatattat

SEQ ID NO: 180957 - DNA, 20 bp, Artificial sequence
  SiRNA target sequence
actgcacttaaaatattatc

SEQ ID NO: 180958 - DNA, 20 bp, Artificial sequence
  SiRNA target sequence
ctgcacttaaaatattatcg

SEQ ID NO: 180959 - DNA, 20 bp, Artificial sequence
  SiRNA target sequence
tgcacttaaaatattatcgg

SEQ ID NO: 180960 - DNA, 20 bp, Artificial sequence
  SiRNA target sequence
gcacttaaaatattatcggg

SEQ ID NO: 180961 - DNA, 20 bp, Artificial sequence
  SiRNA target sequence
cacttaaaatattatcgggc

SEQ ID NO: 180962 - DNA, 20 bp, Artificial sequence
  SiRNA target sequence
acttaaaatattatcgggca

SEQ ID NO: 180963 - DNA, 20 bp, Artificial sequence
  SiRNA target sequence
cttaaaatattatcgggcaa

SEQ ID NO: 180964 - DNA, 20 bp, Artificial sequence
  SiRNA target sequence
ttaaaatattatcgggcaat

SEQ ID NO: 180965 - DNA, 20 bp, Artificial sequence
  SiRNA target sequence
taaaatattatcgggcaatc

SEQ ID NO: 180966 - DNA, 20 bp, Artificial sequence
  SiRNA target sequence
aaaatattatcgggcaatct

SEQ ID NO: 180967 - DNA, 20 bp, Artificial sequence
  SiRNA target sequence
aaatattatcgggcaatctt

SEQ ID NO: 180968 - DNA, 20 bp, Artificial sequence
  SiRNA target sequence
aatattatcgggcaatctta

SEQ ID NO: 180969 - DNA, 20 bp, Artificial sequence
  SiRNA target sequence
atattatcgggcaatcttaa

SEQ ID NO: 180970 - DNA, 20 bp, Artificial sequence
  SiRNA target sequence
tattatcgggcaatcttaaa

SEQ ID NO: 180971 - DNA, 20 bp, Artificial sequence
  SiRNA target sequence
attatcgggcaatcttaaac

SEQ ID NO: 180972 - DNA, 20 bp, Artificial sequence
  SiRNA target sequence
ttatcgggcaatcttaaacc

SEQ ID NO: 180973 - DNA, 20 bp, Artificial sequence
  SiRNA target sequence
tatcgggcaatcttaaacca

SEQ ID NO: 180974 - DNA, 20 bp, Artificial sequence
  SiRNA target sequence
atcgggcaatcttaaaccaa

SEQ ID NO: 180975 - DNA, 20 bp, Artificial sequence
  SiRNA target sequence
tcgggcaatcttaaaccaaa

SEQ ID NO: 180976 - DNA, 20 bp, Artificial sequence
  SiRNA target sequence
cgggcaatcttaaaccaaac

SEQ ID NO: 180977 - DNA, 20 bp, Artificial sequence
  SiRNA target sequence
gggcaatcttaaaccaaact

SEQ ID NO: 180978 - DNA, 20 bp, Artificial sequence
  SiRNA target sequence
ggcaatcttaaaccaaactt

SEQ ID NO: 180979 - DNA, 20 bp, Artificial sequence
  SiRNA target sequence
gcaatcttaaaccaaactta

SEQ ID NO: 180980 - DNA, 20 bp, Artificial sequence
  SiRNA target sequence
caatcttaaaccaaacttag

SEQ ID NO: 180981 - DNA, 20 bp, Artificial sequence
  SiRNA target sequence
aatcttaaaccaaacttagg

SEQ ID NO: 180982 - DNA, 20 bp, Artificial sequence
  SiRNA target sequence
atcttaaaccaaacttagga

SEQ ID NO: 180983 - DNA, 20 bp, Artificial sequence
  SiRNA target sequence
tcttaaaccaaacttaggaa

SEQ ID NO: 180984 - DNA, 20 bp, Artificial sequence
  SiRNA target sequence
cttaaaccaaacttaggaaa

SEQ ID NO: 180985 - DNA, 20 bp, Artificial sequence
  SiRNA target sequence
ttaaaccaaacttaggaaag

SEQ ID NO: 180986 - DNA, 20 bp, Artificial sequence
  SiRNA target sequence
taaaccaaacttaggaaagt

SEQ ID NO: 180987 - DNA, 20 bp, Artificial sequence
  SiRNA target sequence
aaaccaaacttaggaaagtt

SEQ ID NO: 180988 - DNA, 20 bp, Artificial sequence
  SiRNA target sequence
aaccaaacttaggaaagttc

SEQ ID NO: 180989 - DNA, 20 bp, Artificial sequence
  SiRNA target sequence
accaaacttaggaaagttcg

SEQ ID NO: 180990 - DNA, 20 bp, Artificial sequence
  SiRNA target sequence
ccaaacttaggaaagttcga

SEQ ID NO: 180991 - DNA, 20 bp, Artificial sequence
  SiRNA target sequence
caaacttaggaaagttcgac

SEQ ID NO: 180992 - DNA, 20 bp, Artificial sequence
  SiRNA target sequence
aaacttaggaaagttcgacg

SEQ ID NO: 180993 - DNA, 20 bp, Artificial sequence
  SiRNA target sequence
aacttaggaaagttcgacgt

SEQ ID NO: 180994 - DNA, 20 bp, Artificial sequence
  SiRNA target sequence
acttaggaaagttcgacgtt

SEQ ID NO: 180995 - DNA, 20 bp, Artificial sequence
  SiRNA target sequence
cttaggaaagttcgacgtta

SEQ ID NO: 180996 - DNA, 20 bp, Artificial sequence
  SiRNA target sequence
ttaggaaagttcgacgttac

SEQ ID NO: 180997 - DNA, 20 bp, Artificial sequence
  SiRNA target sequence
taggaaagttcgacgttacg

SEQ ID NO: 180998 - DNA, 20 bp, Artificial sequence
  SiRNA target sequence
aggaaagttcgacgttacgc

SEQ ID NO: 180999 - DNA, 20 bp, Artificial sequence
  SiRNA target sequence
ggaaagttcgacgttacgcc

SEQ ID NO: 181000 - DNA, 20 bp, Artificial sequence
  SiRNA target sequence
gaaagttcgacgttacgccc

SEQ ID NO: 181001 - DNA, 20 bp, Artificial sequence
  SiRNA target sequence
aaagttcgacgttacgcccg

SEQ ID NO: 181002 - DNA, 20 bp, Artificial sequence
  SiRNA target sequence
aagttcgacgttacgcccga

SEQ ID NO: 181003 - DNA, 20 bp, Artificial sequence
  SiRNA target sequence
agttcgacgttacgcccgac

SEQ ID NO: 181004 - DNA, 20 bp, Artificial sequence
  SiRNA target sequence
gttcgacgttacgcccgact

SEQ ID NO: 181005 - DNA, 20 bp, Artificial sequence
  SiRNA target sequence
ttcgacgttacgcccgactg

SEQ ID NO: 181006 - DNA, 20 bp, Artificial sequence
  SiRNA target sequence
tcgacgttacgcccgactgg

SEQ ID NO: 181007 - DNA, 20 bp, Artificial sequence
  SiRNA target sequence
cgacgttacgcccgactggg

SEQ ID NO: 181008 - DNA, 20 bp, Artificial sequence
  SiRNA target sequence
gacgttacgcccgactgggc

SEQ ID NO: 181009 - DNA, 20 bp, Artificial sequence
  SiRNA target sequence
acgttacgcccgactgggca

SEQ ID NO: 181010 - DNA, 20 bp, Artificial sequence
  SiRNA target sequence
cgttacgcccgactgggcag

SEQ ID NO: 181011 - DNA, 20 bp, Artificial sequence
  SiRNA target sequence
gttacgcccgactgggcagc

SEQ ID NO: 181012 - DNA, 20 bp, Artificial sequence
  SiRNA target sequence
ttacgcccgactgggcagca

SEQ ID NO: 181013 - DNA, 20 bp, Artificial sequence
  SiRNA target sequence
tacgcccgactgggcagcaa

SEQ ID NO: 181014 - DNA, 20 bp, Artificial sequence
  SiRNA target sequence
acgcccgactgggcagcaat

SEQ ID NO: 181015 - DNA, 20 bp, Artificial sequence
  SiRNA target sequence
cgcccgactgggcagcaatt

SEQ ID NO: 181016 - DNA, 20 bp, Artificial sequence
  SiRNA target sequence
gcccgactgggcagcaattc

SEQ ID NO: 181017 - DNA, 20 bp, Artificial sequence
  SiRNA target sequence
cccgactgggcagcaattct

SEQ ID NO: 181018 - DNA, 20 bp, Artificial sequence
  SiRNA target sequence
ccgactgggcagcaattcta

SEQ ID NO: 181019 - DNA, 20 bp, Artificial sequence
  SiRNA target sequence
cgactgggcagcaattctaa

SEQ ID NO: 181020 - DNA, 20 bp, Artificial sequence
  SiRNA target sequence
gactgggcagcaattctaaa

SEQ ID NO: 181021 - DNA, 20 bp, Artificial sequence
  SiRNA target sequence
actgggcagcaattctaaat

SEQ ID NO: 181022 - DNA, 20 bp, Artificial sequence
  SiRNA target sequence
ctgggcagcaattctaaata

SEQ ID NO: 181023 - DNA, 20 bp, Artificial sequence
  SiRNA target sequence
tgggcagcaattctaaataa

SEQ ID NO: 181024 - DNA, 20 bp, Artificial sequence
  SiRNA target sequence
gggcagcaattctaaataat

SEQ ID NO: 181025 - DNA, 20 bp, Artificial sequence
  SiRNA target sequence
ggcagcaattctaaataatt

SEQ ID NO: 181026 - DNA, 20 bp, Artificial sequence
  SiRNA target sequence
gcagcaattctaaataatta

SEQ ID NO: 181027 - DNA, 20 bp, Artificial sequence
  SiRNA target sequence
cagcaattctaaataattat

SEQ ID NO: 181028 - DNA, 20 bp, Artificial sequence
  SiRNA target sequence
agcaattctaaataattata

SEQ ID NO: 181029 - DNA, 20 bp, Artificial sequence
  SiRNA target sequence
gcaattctaaataattataa

SEQ ID NO: 181030 - DNA, 20 bp, Artificial sequence
  SiRNA target sequence
caattctaaataattataaa

SEQ ID NO: 181031 - DNA, 20 bp, Artificial sequence
  SiRNA target sequence
aattctaaataattataaag

SEQ ID NO: 181032 - DNA, 20 bp, Artificial sequence
  SiRNA target sequence
attctaaataattataaagg

SEQ ID NO: 181033 - DNA, 20 bp, Artificial sequence
  SiRNA target sequence
ttctaaataattataaagga

SEQ ID NO: 181034 - DNA, 20 bp, Artificial sequence
  SiRNA target sequence
tctaaataattataaaggat

SEQ ID NO: 181035 - DNA, 20 bp, Artificial sequence
  SiRNA target sequence
ctaaataattataaaggatc

SEQ ID NO: 181036 - DNA, 20 bp, Artificial sequence
  SiRNA target sequence
taaataattataaaggatct

SEQ ID NO: 181037 - DNA, 20 bp, Artificial sequence
  SiRNA target sequence
aaataattataaaggatctg

SEQ ID NO: 181038 - DNA, 20 bp, Artificial sequence
  SiRNA target sequence
aataattataaaggatctga

SEQ ID NO: 181039 - DNA, 20 bp, Artificial sequence
  SiRNA target sequence
ataattataaaggatctgaa

SEQ ID NO: 181040 - DNA, 20 bp, Artificial sequence
  SiRNA target sequence
taattataaaggatctgaac

SEQ ID NO: 181041 - DNA, 20 bp, Artificial sequence
  SiRNA target sequence
aattataaaggatctgaact

SEQ ID NO: 181042 - DNA, 20 bp, Artificial sequence
  SiRNA target sequence
attataaaggatctgaactt

SEQ ID NO: 181043 - DNA, 20 bp, Artificial sequence
  SiRNA target sequence
ttataaaggatctgaacttc

SEQ ID NO: 181044 - DNA, 20 bp, Artificial sequence
  SiRNA target sequence
tataaaggatctgaacttca

SEQ ID NO: 181045 - DNA, 20 bp, Artificial sequence
  SiRNA target sequence
ataaaggatctgaacttcat

SEQ ID NO: 181046 - DNA, 20 bp, Artificial sequence
  SiRNA target sequence
taaaggatctgaacttcatg

SEQ ID NO: 181047 - DNA, 20 bp, Artificial sequence
  SiRNA target sequence
aaaggatctgaacttcatgg

SEQ ID NO: 181048 - DNA, 20 bp, Artificial sequence
  SiRNA target sequence
aaggatctgaacttcatgga

SEQ ID NO: 181049 - DNA, 20 bp, Artificial sequence
  SiRNA target sequence
aggatctgaacttcatggat

SEQ ID NO: 181050 - DNA, 20 bp, Artificial sequence
  SiRNA target sequence
ggatctgaacttcatggatt

SEQ ID NO: 181051 - DNA, 20 bp, Artificial sequence
  SiRNA target sequence
gatctgaacttcatggattt

SEQ ID NO: 181052 - DNA, 20 bp, Artificial sequence
  SiRNA target sequence
atctgaacttcatggatttt

SEQ ID NO: 181053 - DNA, 20 bp, Artificial sequence
  SiRNA target sequence
tctgaacttcatggattttt

SEQ ID NO: 181054 - DNA, 20 bp, Artificial sequence
  SiRNA target sequence
ctgaacttcatggatttttt

SEQ ID NO: 181055 - DNA, 20 bp, Artificial sequence
  SiRNA target sequence
tgaacttcatggatttttta

SEQ ID NO: 181056 - DNA, 20 bp, Artificial sequence
  SiRNA target sequence
gaacttcatggattttttac

SEQ ID NO: 181057 - DNA, 20 bp, Artificial sequence
  SiRNA target sequence
aacttcatggattttttact

SEQ ID NO: 181058 - DNA, 20 bp, Artificial sequence
  SiRNA target sequence
acttcatggattttttacta

SEQ ID NO: 181059 - DNA, 20 bp, Artificial sequence
  SiRNA target sequence
cttcatggattttttactaa

SEQ ID NO: 181060 - DNA, 20 bp, Artificial sequence
  SiRNA target sequence
ttcatggattttttactaaa

SEQ ID NO: 181061 - DNA, 20 bp, Artificial sequence
  SiRNA target sequence
tcatggattttttactaaaa

SEQ ID NO: 181062 - DNA, 20 bp, Artificial sequence
  SiRNA target sequence
catggattttttactaaaat

SEQ ID NO: 181063 - DNA, 20 bp, Artificial sequence
  SiRNA target sequence
atggattttttactaaaatt

SEQ ID NO: 181064 - DNA, 20 bp, Artificial sequence
  SiRNA target sequence
tggattttttactaaaattt

SEQ ID NO: 181065 - DNA, 20 bp, Artificial sequence
  SiRNA target sequence
ggattttttactaaaatttt

SEQ ID NO: 181066 - DNA, 20 bp, Artificial sequence
  SiRNA target sequence
gattttttactaaaatttta

SEQ ID NO: 181067 - DNA, 20 bp, Artificial sequence
  SiRNA target sequence
attttttactaaaattttag

SEQ ID NO: 181068 - DNA, 20 bp, Artificial sequence
  SiRNA target sequence
ttttttactaaaattttaga

SEQ ID NO: 181069 - DNA, 20 bp, Artificial sequence
  SiRNA target sequence
tttttactaaaattttagaa

SEQ ID NO: 181070 - DNA, 20 bp, Artificial sequence
  SiRNA target sequence
ttttactaaaattttagaag

SEQ ID NO: 181071 - DNA, 20 bp, Artificial sequence
  SiRNA target sequence
tttactaaaattttagaagg

SEQ ID NO: 181072 - DNA, 20 bp, Artificial sequence
  SiRNA target sequence
ttactaaaattttagaaggg

SEQ ID NO: 181073 - DNA, 20 bp, Artificial sequence
  SiRNA target sequence
tactaaaattttagaagggt

SEQ ID NO: 181074 - DNA, 20 bp, Artificial sequence
  SiRNA target sequence
actaaaattttagaagggtc

SEQ ID NO: 181075 - DNA, 20 bp, Artificial sequence
  SiRNA target sequence
ctaaaattttagaagggtct

SEQ ID NO: 181076 - DNA, 20 bp, Artificial sequence
  SiRNA target sequence
taaaattttagaagggtcta

SEQ ID NO: 181077 - DNA, 20 bp, Artificial sequence
  SiRNA target sequence
aaaattttagaagggtctat

SEQ ID NO: 181078 - DNA, 20 bp, Artificial sequence
  SiRNA target sequence
aaattttagaagggtctatt

SEQ ID NO: 181079 - DNA, 20 bp, Artificial sequence
  SiRNA target sequence
aattttagaagggtctatta

SEQ ID NO: 181080 - DNA, 20 bp, Artificial sequence
  SiRNA target sequence
attttagaagggtctattaa

SEQ ID NO: 181081 - DNA, 20 bp, Artificial sequence
  SiRNA target sequence
ttttagaagggtctattaaa

SEQ ID NO: 181082 - DNA, 20 bp, Artificial sequence
  SiRNA target sequence
tttagaagggtctattaaag

SEQ ID NO: 181083 - DNA, 20 bp, Artificial sequence
  SiRNA target sequence
ttagaagggtctattaaagc

SEQ ID NO: 181084 - DNA, 20 bp, Artificial sequence
  SiRNA target sequence
tagaagggtctattaaagct

SEQ ID NO: 181085 - DNA, 20 bp, Artificial sequence
  SiRNA target sequence
agaagggtctattaaagcta

SEQ ID NO: 181086 - DNA, 20 bp, Artificial sequence
  SiRNA target sequence
gaagggtctattaaagctat

SEQ ID NO: 181087 - DNA, 20 bp, Artificial sequence
  SiRNA target sequence
aagggtctattaaagctatt

SEQ ID NO: 181088 - DNA, 20 bp, Artificial sequence
  SiRNA target sequence
agggtctattaaagctattt

SEQ ID NO: 181089 - DNA, 20 bp, Artificial sequence
  SiRNA target sequence
gggtctattaaagctatttc

SEQ ID NO: 181090 - DNA, 20 bp, Artificial sequence
  SiRNA target sequence
ggtctattaaagctatttct

SEQ ID NO: 181091 - DNA, 20 bp, Artificial sequence
  SiRNA target sequence
gtctattaaagctatttcta

SEQ ID NO: 181092 - DNA, 20 bp, Artificial sequence
  SiRNA target sequence
tctattaaagctatttctaa

SEQ ID NO: 181093 - DNA, 20 bp, Artificial sequence
  SiRNA target sequence
ctattaaagctatttctaag

SEQ ID NO: 181094 - DNA, 20 bp, Artificial sequence
  SiRNA target sequence
tattaaagctatttctaaga

SEQ ID NO: 181095 - DNA, 20 bp, Artificial sequence
  SiRNA target sequence
attaaagctatttctaagat

SEQ ID NO: 181096 - DNA, 20 bp, Artificial sequence
  SiRNA target sequence
ttaaagctatttctaagata

SEQ ID NO: 181097 - DNA, 20 bp, Artificial sequence
  SiRNA target sequence
taaagctatttctaagatac

SEQ ID NO: 181098 - DNA, 20 bp, Artificial sequence
  SiRNA target sequence
aaagctatttctaagataca

SEQ ID NO: 181099 - DNA, 20 bp, Artificial sequence
  SiRNA target sequence
aagctatttctaagatacag

SEQ ID NO: 181100 - DNA, 20 bp, Artificial sequence
  SiRNA target sequence
agctatttctaagatacagt

SEQ ID NO: 181101 - DNA, 20 bp, Artificial sequence
  SiRNA target sequence
gctatttctaagatacagta

SEQ ID NO: 181102 - DNA, 20 bp, Artificial sequence
  SiRNA target sequence
ctatttctaagatacagtat

SEQ ID NO: 181103 - DNA, 20 bp, Artificial sequence
  SiRNA target sequence
tatttctaagatacagtata

SEQ ID NO: 181104 - DNA, 20 bp, Artificial sequence
  SiRNA target sequence
atttctaagatacagtatat

SEQ ID NO: 181105 - DNA, 20 bp, Artificial sequence
  SiRNA target sequence
tttctaagatacagtatata

SEQ ID NO: 181106 - DNA, 20 bp, Artificial sequence
  SiRNA target sequence
ttctaagatacagtatatag

SEQ ID NO: 181107 - DNA, 20 bp, Artificial sequence
  SiRNA target sequence
tctaagatacagtatataga

SEQ ID NO: 181108 - DNA, 20 bp, Artificial sequence
  SiRNA target sequence
ctaagatacagtatatagat

SEQ ID NO: 181109 - DNA, 20 bp, Artificial sequence
  SiRNA target sequence
taagatacagtatatagata

SEQ ID NO: 181110 - DNA, 20 bp, Artificial sequence
  SiRNA target sequence
aagatacagtatatagataa

SEQ ID NO: 181111 - DNA, 20 bp, Artificial sequence
  SiRNA target sequence
agatacagtatatagataaa

SEQ ID NO: 181112 - DNA, 20 bp, Artificial sequence
  SiRNA target sequence
gatacagtatatagataaaa

SEQ ID NO: 181113 - DNA, 20 bp, Artificial sequence
  SiRNA target sequence
atacagtatatagataaaat

SEQ ID NO: 181114 - DNA, 20 bp, Artificial sequence
  SiRNA target sequence
tacagtatatagataaaatg

SEQ ID NO: 181115 - DNA, 20 bp, Artificial sequence
  SiRNA target sequence
acagtatatagataaaatgc

SEQ ID NO: 181116 - DNA, 20 bp, Artificial sequence
  SiRNA target sequence
cagtatatagataaaatgcc

SEQ ID NO: 181117 - DNA, 20 bp, Artificial sequence
  SiRNA target sequence
agtatatagataaaatgcct

SEQ ID NO: 181118 - DNA, 20 bp, Artificial sequence
  SiRNA target sequence
gtatatagataaaatgccta

SEQ ID NO: 181119 - DNA, 20 bp, Artificial sequence
  SiRNA target sequence
tatatagataaaatgcctaa

SEQ ID NO: 181120 - DNA, 20 bp, Artificial sequence
  SiRNA target sequence
atatagataaaatgcctaaa

SEQ ID NO: 181121 - DNA, 20 bp, Artificial sequence
  SiRNA target sequence
tatagataaaatgcctaaat

SEQ ID NO: 181122 - DNA, 20 bp, Artificial sequence
  SiRNA target sequence
atagataaaatgcctaaatt

SEQ ID NO: 181123 - DNA, 20 bp, Artificial sequence
  SiRNA target sequence
tagataaaatgcctaaattt

SEQ ID NO: 181124 - DNA, 20 bp, Artificial sequence
  SiRNA target sequence
agataaaatgcctaaatttt

SEQ ID NO: 181125 - DNA, 20 bp, Artificial sequence
  SiRNA target sequence
gataaaatgcctaaattttt

SEQ ID NO: 181126 - DNA, 20 bp, Artificial sequence
  SiRNA target sequence
ataaaatgcctaaattttta

SEQ ID NO: 181127 - DNA, 20 bp, Artificial sequence
  SiRNA target sequence
taaaatgcctaaatttttaa

SEQ ID NO: 181128 - DNA, 20 bp, Artificial sequence
  SiRNA target sequence
aaaatgcctaaatttttaaa

SEQ ID NO: 181129 - DNA, 20 bp, Artificial sequence
  SiRNA target sequence
aaatgcctaaatttttaaaa

SEQ ID NO: 181130 - DNA, 20 bp, Artificial sequence
  SiRNA target sequence
aatgcctaaatttttaaaag

SEQ ID NO: 181131 - DNA, 20 bp, Artificial sequence
  SiRNA target sequence
atgcctaaatttttaaaagg

SEQ ID NO: 181132 - DNA, 20 bp, Artificial sequence
  SiRNA target sequence
tgcctaaatttttaaaagga

SEQ ID NO: 181133 - DNA, 20 bp, Artificial sequence
  SiRNA target sequence
gcctaaatttttaaaaggac

SEQ ID NO: 181134 - DNA, 20 bp, Artificial sequence
  SiRNA target sequence
cctaaatttttaaaaggacg

SEQ ID NO: 181135 - DNA, 20 bp, Artificial sequence
  SiRNA target sequence
ctaaatttttaaaaggacgc

SEQ ID NO: 181136 - DNA, 20 bp, Artificial sequence
  SiRNA target sequence
taaatttttaaaaggacgct

SEQ ID NO: 181137 - DNA, 20 bp, Artificial sequence
  SiRNA target sequence
aaatttttaaaaggacgcta

SEQ ID NO: 181138 - DNA, 20 bp, Artificial sequence
  SiRNA target sequence
aatttttaaaaggacgctat

SEQ ID NO: 181139 - DNA, 20 bp, Artificial sequence
  SiRNA target sequence
atttttaaaaggacgctata

SEQ ID NO: 181140 - DNA, 20 bp, Artificial sequence
  SiRNA target sequence
tttttaaaaggacgctataa

SEQ ID NO: 181141 - DNA, 20 bp, Artificial sequence
  SiRNA target sequence
ttttaaaaggacgctataag

SEQ ID NO: 181142 - DNA, 20 bp, Artificial sequence
  SiRNA target sequence
tttaaaaggacgctataagt

SEQ ID NO: 181143 - DNA, 20 bp, Artificial sequence
  SiRNA target sequence
ttaaaaggacgctataagtc

SEQ ID NO: 181144 - DNA, 20 bp, Artificial sequence
  SiRNA target sequence
taaaaggacgctataagtca

SEQ ID NO: 181145 - DNA, 20 bp, Artificial sequence
  SiRNA target sequence
aaaaggacgctataagtcag

SEQ ID NO: 181146 - DNA, 20 bp, Artificial sequence
  SiRNA target sequence
aaaggacgctataagtcaga

SEQ ID NO: 181147 - DNA, 20 bp, Artificial sequence
  SiRNA target sequence
aaggacgctataagtcagaa

SEQ ID NO: 181148 - DNA, 20 bp, Artificial sequence
  SiRNA target sequence
aggacgctataagtcagaaa

SEQ ID NO: 181149 - DNA, 20 bp, Artificial sequence
  SiRNA target sequence
ggacgctataagtcagaaat

SEQ ID NO: 181150 - DNA, 20 bp, Artificial sequence
  SiRNA target sequence
gacgctataagtcagaaatc

SEQ ID NO: 181151 - DNA, 20 bp, Artificial sequence
  SiRNA target sequence
acgctataagtcagaaatcg

SEQ ID NO: 181152 - DNA, 20 bp, Artificial sequence
  SiRNA target sequence
cgctataagtcagaaatcgc

SEQ ID NO: 181153 - DNA, 20 bp, Artificial sequence
  SiRNA target sequence
gctataagtcagaaatcgcc

SEQ ID NO: 181154 - DNA, 20 bp, Artificial sequence
  SiRNA target sequence
ctataagtcagaaatcgcct

SEQ ID NO: 181155 - DNA, 20 bp, Artificial sequence
  SiRNA target sequence
tataagtcagaaatcgcctc

SEQ ID NO: 181156 - DNA, 20 bp, Artificial sequence
  SiRNA target sequence
ataagtcagaaatcgcctcc

SEQ ID NO: 181157 - DNA, 20 bp, Artificial sequence
  SiRNA target sequence
taagtcagaaatcgcctccg

SEQ ID NO: 181158 - DNA, 20 bp, Artificial sequence
  SiRNA target sequence
aagtcagaaatcgcctccgg

SEQ ID NO: 181159 - DNA, 20 bp, Artificial sequence
  SiRNA target sequence
agtcagaaatcgcctccgga

SEQ ID NO: 181160 - DNA, 20 bp, Artificial sequence
  SiRNA target sequence
gtcagaaatcgcctccggaa

SEQ ID NO: 181161 - DNA, 20 bp, Artificial sequence
  SiRNA target sequence
tcagaaatcgcctccggaaa

SEQ ID NO: 181162 - DNA, 20 bp, Artificial sequence
  SiRNA target sequence
cagaaatcgcctccggaaaa

SEQ ID NO: 181163 - DNA, 20 bp, Artificial sequence
  SiRNA target sequence
agaaatcgcctccggaaaaa

SEQ ID NO: 181164 - DNA, 20 bp, Artificial sequence
  SiRNA target sequence
gaaatcgcctccggaaaaat

SEQ ID NO: 181165 - DNA, 20 bp, Artificial sequence
  SiRNA target sequence
aaatcgcctccggaaaaatg

SEQ ID NO: 181166 - DNA, 20 bp, Artificial sequence
  SiRNA target sequence
aatcgcctccggaaaaatgt

SEQ ID NO: 181167 - DNA, 20 bp, Artificial sequence
  SiRNA target sequence
atcgcctccggaaaaatgtt

SEQ ID NO: 181168 - DNA, 20 bp, Artificial sequence
  SiRNA target sequence
tcgcctccggaaaaatgttg

SEQ ID NO: 181169 - DNA, 20 bp, Artificial sequence
  SiRNA target sequence
cgcctccggaaaaatgttgt

SEQ ID NO: 181170 - DNA, 20 bp, Artificial sequence
  SiRNA target sequence
gcctccggaaaaatgttgtt

SEQ ID NO: 181171 - DNA, 20 bp, Artificial sequence
  SiRNA target sequence
cctccggaaaaatgttgttt

SEQ ID NO: 181172 - DNA, 20 bp, Artificial sequence
  SiRNA target sequence
ctccggaaaaatgttgttta

SEQ ID NO: 181173 - DNA, 20 bp, Artificial sequence
  SiRNA target sequence
tccggaaaaatgttgtttac

SEQ ID NO: 181174 - DNA, 20 bp, Artificial sequence
  SiRNA target sequence
ccggaaaaatgttgtttact

SEQ ID NO: 181175 - DNA, 20 bp, Artificial sequence
  SiRNA target sequence
cggaaaaatgttgtttactg

SEQ ID NO: 181176 - DNA, 20 bp, Artificial sequence
  SiRNA target sequence
ggaaaaatgttgtttactgt

SEQ ID NO: 181177 - DNA, 20 bp, Artificial sequence
  SiRNA target sequence
gaaaaatgttgtttactgtt

SEQ ID NO: 181178 - DNA, 20 bp, Artificial sequence
  SiRNA target sequence
aaaaatgttgtttactgtta

SEQ ID NO: 181179 - DNA, 20 bp, Artificial sequence
  SiRNA target sequence
aaaatgttgtttactgttaa

SEQ ID NO: 181180 - DNA, 20 bp, Artificial sequence
  SiRNA target sequence
aaatgttgtttactgttaat

SEQ ID NO: 181181 - DNA, 20 bp, Artificial sequence
  SiRNA target sequence
aatgttgtttactgttaatg

SEQ ID NO: 181182 - DNA, 20 bp, Artificial sequence
  SiRNA target sequence
atgttgtttactgttaatga

SEQ ID NO: 181183 - DNA, 20 bp, Artificial sequence
  SiRNA target sequence
tgttgtttactgttaatgat

SEQ ID NO: 181184 - DNA, 20 bp, Artificial sequence
  SiRNA target sequence
gttgtttactgttaatgata

SEQ ID NO: 181185 - DNA, 20 bp, Artificial sequence
  SiRNA target sequence
ttgtttactgttaatgatat

SEQ ID NO: 181186 - DNA, 20 bp, Artificial sequence
  SiRNA target sequence
tgtttactgttaatgatata

SEQ ID NO: 181187 - DNA, 20 bp, Artificial sequence
  SiRNA target sequence
gtttactgttaatgatatat

SEQ ID NO: 181188 - DNA, 20 bp, Artificial sequence
  SiRNA target sequence
tttactgttaatgatatatt

SEQ ID NO: 181189 - DNA, 20 bp, Artificial sequence
  SiRNA target sequence
ttactgttaatgatatatta

SEQ ID NO: 181190 - DNA, 20 bp, Artificial sequence
  SiRNA target sequence
tactgttaatgatatattaa

SEQ ID NO: 181191 - DNA, 20 bp, Artificial sequence
  SiRNA target sequence
actgttaatgatatattaaa

SEQ ID NO: 181192 - DNA, 20 bp, Artificial sequence
  SiRNA target sequence
ctgttaatgatatattaaaa

SEQ ID NO: 181193 - DNA, 20 bp, Artificial sequence
  SiRNA target sequence
tgttaatgatatattaaaaa

SEQ ID NO: 181194 - DNA, 20 bp, Artificial sequence
  SiRNA target sequence
gttaatgatatattaaaaaa

SEQ ID NO: 181195 - DNA, 20 bp, Artificial sequence
  SiRNA target sequence
ttaatgatatattaaaaaaa

SEQ ID NO: 181196 - DNA, 20 bp, Artificial sequence
  SiRNA target sequence
taatgatatattaaaaaaag

SEQ ID NO: 181197 - DNA, 20 bp, Artificial sequence
  SiRNA target sequence
aatgatatattaaaaaaagt

SEQ ID NO: 181198 - DNA, 20 bp, Artificial sequence
  SiRNA target sequence
atgatatattaaaaaaagtt

SEQ ID NO: 181199 - DNA, 20 bp, Artificial sequence
  SiRNA target sequence
tgatatattaaaaaaagttg

SEQ ID NO: 181200 - DNA, 20 bp, Artificial sequence
  SiRNA target sequence
gatatattaaaaaaagttga

SEQ ID NO: 181201 - DNA, 20 bp, Artificial sequence
  SiRNA target sequence
atatattaaaaaaagttgat

SEQ ID NO: 181202 - DNA, 20 bp, Artificial sequence
  SiRNA target sequence
tatattaaaaaaagttgatg

SEQ ID NO: 181203 - DNA, 20 bp, Artificial sequence
  SiRNA target sequence
atattaaaaaaagttgatga

SEQ ID NO: 181204 - DNA, 20 bp, Artificial sequence
  SiRNA target sequence
tattaaaaaaagttgatgaa

SEQ ID NO: 181205 - DNA, 20 bp, Artificial sequence
  SiRNA target sequence
attaaaaaaagttgatgaaa

SEQ ID NO: 181206 - DNA, 20 bp, Artificial sequence
  SiRNA target sequence
ttaaaaaaagttgatgaaaa

SEQ ID NO: 181207 - DNA, 20 bp, Artificial sequence
  SiRNA target sequence
taaaaaaagttgatgaaaaa

SEQ ID NO: 181208 - DNA, 20 bp, Artificial sequence
  SiRNA target sequence
aaaaaaagttgatgaaaaaa

SEQ ID NO: 181209 - DNA, 20 bp, Artificial sequence
  SiRNA target sequence
aaaaaagttgatgaaaaaaa

SEQ ID NO: 181210 - DNA, 20 bp, Artificial sequence
  SiRNA target sequence
aaaaagttgatgaaaaaaat

SEQ ID NO: 181211 - DNA, 20 bp, Artificial sequence
  SiRNA target sequence
aaaagttgatgaaaaaaata

SEQ ID NO: 181212 - DNA, 20 bp, Artificial sequence
  SiRNA target sequence
aaagttgatgaaaaaaataa

SEQ ID NO: 181213 - DNA, 20 bp, Artificial sequence
  SiRNA target sequence
aagttgatgaaaaaaataaa

SEQ ID NO: 181214 - DNA, 20 bp, Artificial sequence
  SiRNA target sequence
agttgatgaaaaaaataaat

SEQ ID NO: 181215 - DNA, 20 bp, Artificial sequence
  SiRNA target sequence
gttgatgaaaaaaataaatt

SEQ ID NO: 181216 - DNA, 20 bp, Artificial sequence
  SiRNA target sequence
ttgatgaaaaaaataaattt

SEQ ID NO: 181217 - DNA, 20 bp, Artificial sequence
  SiRNA target sequence
tgatgaaaaaaataaatttg

SEQ ID NO: 181218 - DNA, 20 bp, Artificial sequence
  SiRNA target sequence
gatgaaaaaaataaatttga

SEQ ID NO: 181219 - DNA, 20 bp, Artificial sequence
  SiRNA target sequence
atgaaaaaaataaatttgac

SEQ ID NO: 181220 - DNA, 20 bp, Artificial sequence
  SiRNA target sequence
tgaaaaaaataaatttgact

SEQ ID NO: 181221 - DNA, 20 bp, Artificial sequence
  SiRNA target sequence
gaaaaaaataaatttgacta

SEQ ID NO: 181222 - DNA, 20 bp, Artificial sequence
  SiRNA target sequence
aaaaaaataaatttgactat

SEQ ID NO: 181223 - DNA, 20 bp, Artificial sequence
  SiRNA target sequence
aaaaaataaatttgactatt

SEQ ID NO: 181224 - DNA, 20 bp, Artificial sequence
  SiRNA target sequence
aaaaataaatttgactatta

SEQ ID NO: 181225 - DNA, 20 bp, Artificial sequence
  SiRNA target sequence
aaaataaatttgactattac

SEQ ID NO: 181226 - DNA, 20 bp, Artificial sequence
  SiRNA target sequence
aaataaatttgactattacg

SEQ ID NO: 181227 - DNA, 20 bp, Artificial sequence
  SiRNA target sequence
aataaatttgactattacgt

SEQ ID NO: 181228 - DNA, 20 bp, Artificial sequence
  SiRNA target sequence
ataaatttgactattacgta

SEQ ID NO: 181229 - DNA, 20 bp, Artificial sequence
  SiRNA target sequence
taaatttgactattacgtag

SEQ ID NO: 181230 - DNA, 20 bp, Artificial sequence
  SiRNA target sequence
aaatttgactattacgtaga

SEQ ID NO: 181231 - DNA, 20 bp, Artificial sequence
  SiRNA target sequence
aatttgactattacgtagat

SEQ ID NO: 181232 - DNA, 20 bp, Artificial sequence
  SiRNA target sequence
atttgactattacgtagata

SEQ ID NO: 181233 - DNA, 20 bp, Artificial sequence
  SiRNA target sequence
tttgactattacgtagataa

SEQ ID NO: 181234 - DNA, 20 bp, Artificial sequence
  SiRNA target sequence
ttgactattacgtagataaa

SEQ ID NO: 181235 - DNA, 20 bp, Artificial sequence
  SiRNA target sequence
tgactattacgtagataaaa

SEQ ID NO: 181236 - DNA, 20 bp, Artificial sequence
  SiRNA target sequence
gactattacgtagataaaat

SEQ ID NO: 181237 - DNA, 20 bp, Artificial sequence
  SiRNA target sequence
actattacgtagataaaatg

SEQ ID NO: 181238 - DNA, 20 bp, Artificial sequence
  SiRNA target sequence
ctattacgtagataaaatgg

SEQ ID NO: 181239 - DNA, 20 bp, Artificial sequence
  SiRNA target sequence
tattacgtagataaaatggc

SEQ ID NO: 181240 - DNA, 20 bp, Artificial sequence
  SiRNA target sequence
attacgtagataaaatggca

SEQ ID NO: 181241 - DNA, 20 bp, Artificial sequence
  SiRNA target sequence
ttacgtagataaaatggcac

SEQ ID NO: 181242 - DNA, 20 bp, Artificial sequence
  SiRNA target sequence
tacgtagataaaatggcact

SEQ ID NO: 181243 - DNA, 20 bp, Artificial sequence
  SiRNA target sequence
acgtagataaaatggcactt

SEQ ID NO: 181244 - DNA, 20 bp, Artificial sequence
  SiRNA target sequence
cgtagataaaatggcactta

SEQ ID NO: 181245 - DNA, 20 bp, Artificial sequence
  SiRNA target sequence
gtagataaaatggcacttaa

SEQ ID NO: 181246 - DNA, 20 bp, Artificial sequence
  SiRNA target sequence
tagataaaatggcacttaaa

SEQ ID NO: 181247 - DNA, 20 bp, Artificial sequence
  SiRNA target sequence
agataaaatggcacttaaaa

SEQ ID NO: 181248 - DNA, 20 bp, Artificial sequence
  SiRNA target sequence
gataaaatggcacttaaaaa

SEQ ID NO: 181249 - DNA, 20 bp, Artificial sequence
  SiRNA target sequence
ataaaatggcacttaaaaat

SEQ ID NO: 181250 - DNA, 20 bp, Artificial sequence
  SiRNA target sequence
taaaatggcacttaaaaatg

SEQ ID NO: 181251 - DNA, 20 bp, Artificial sequence
  SiRNA target sequence
aaaatggcacttaaaaatgt

SEQ ID NO: 181252 - DNA, 20 bp, Artificial sequence
  SiRNA target sequence
aaatggcacttaaaaatgta

SEQ ID NO: 181253 - DNA, 20 bp, Artificial sequence
  SiRNA target sequence
aatggcacttaaaaatgtat

SEQ ID NO: 181254 - DNA, 20 bp, Artificial sequence
  SiRNA target sequence
atggcacttaaaaatgtatt

SEQ ID NO: 181255 - DNA, 20 bp, Artificial sequence
  SiRNA target sequence
tggcacttaaaaatgtatta

SEQ ID NO: 181256 - DNA, 20 bp, Artificial sequence
  SiRNA target sequence
ggcacttaaaaatgtattaa

SEQ ID NO: 181257 - DNA, 20 bp, Artificial sequence
  SiRNA target sequence
gcacttaaaaatgtattaac

SEQ ID NO: 181258 - DNA, 20 bp, Artificial sequence
  SiRNA target sequence
cacttaaaaatgtattaaca

SEQ ID NO: 181259 - DNA, 20 bp, Artificial sequence
  SiRNA target sequence
acttaaaaatgtattaacaa

SEQ ID NO: 181260 - DNA, 20 bp, Artificial sequence
  SiRNA target sequence
cttaaaaatgtattaacaag

SEQ ID NO: 181261 - DNA, 20 bp, Artificial sequence
  SiRNA target sequence
ttaaaaatgtattaacaaga

SEQ ID NO: 181262 - DNA, 20 bp, Artificial sequence
  SiRNA target sequence
taaaaatgtattaacaagag

SEQ ID NO: 181263 - DNA, 20 bp, Artificial sequence
  SiRNA target sequence
aaaaatgtattaacaagaga

SEQ ID NO: 181264 - DNA, 20 bp, Artificial sequence
  SiRNA target sequence
aaaatgtattaacaagagaa

SEQ ID NO: 181265 - DNA, 20 bp, Artificial sequence
  SiRNA target sequence
aaatgtattaacaagagaat

SEQ ID NO: 181266 - DNA, 20 bp, Artificial sequence
  SiRNA target sequence
aatgtattaacaagagaatt

SEQ ID NO: 181267 - DNA, 20 bp, Artificial sequence
  SiRNA target sequence
atgtattaacaagagaatta

SEQ ID NO: 181268 - DNA, 20 bp, Artificial sequence
  SiRNA target sequence
tgtattaacaagagaattag

SEQ ID NO: 181269 - DNA, 20 bp, Artificial sequence
  SiRNA target sequence
gtattaacaagagaattaga

SEQ ID NO: 181270 - DNA, 20 bp, Artificial sequence
  SiRNA target sequence
tattaacaagagaattagag

SEQ ID NO: 181271 - DNA, 20 bp, Artificial sequence
  SiRNA target sequence
attaacaagagaattagagc

SEQ ID NO: 181272 - DNA, 20 bp, Artificial sequence
  SiRNA target sequence
ttaacaagagaattagagca

SEQ ID NO: 181273 - DNA, 20 bp, Artificial sequence
  SiRNA target sequence
taacaagagaattagagcaa

SEQ ID NO: 181274 - DNA, 20 bp, Artificial sequence
  SiRNA target sequence
aacaagagaattagagcaat

SEQ ID NO: 181275 - DNA, 20 bp, Artificial sequence
  SiRNA target sequence
acaagagaattagagcaatt

SEQ ID NO: 181276 - DNA, 20 bp, Artificial sequence
  SiRNA target sequence
caagagaattagagcaatta

SEQ ID NO: 181277 - DNA, 20 bp, Artificial sequence
  SiRNA target sequence
aagagaattagagcaattaa

SEQ ID NO: 181278 - DNA, 20 bp, Artificial sequence
  SiRNA target sequence
agagaattagagcaattaag

SEQ ID NO: 181279 - DNA, 20 bp, Artificial sequence
  SiRNA target sequence
gagaattagagcaattaagt

SEQ ID NO: 181280 - DNA, 20 bp, Artificial sequence
  SiRNA target sequence
agaattagagcaattaagtg

SEQ ID NO: 181281 - DNA, 20 bp, Artificial sequence
  SiRNA target sequence
gaattagagcaattaagtgg

SEQ ID NO: 181282 - DNA, 20 bp, Artificial sequence
  SiRNA target sequence
aattagagcaattaagtggt

SEQ ID NO: 181283 - DNA, 20 bp, Artificial sequence
  SiRNA target sequence
attagagcaattaagtggtg

SEQ ID NO: 181284 - DNA, 20 bp, Artificial sequence
  SiRNA target sequence
ttagagcaattaagtggtgg

SEQ ID NO: 181285 - DNA, 20 bp, Artificial sequence
  SiRNA target sequence
tagagcaattaagtggtggt

SEQ ID NO: 181286 - DNA, 20 bp, Artificial sequence
  SiRNA target sequence
agagcaattaagtggtggtg

SEQ ID NO: 181287 - DNA, 20 bp, Artificial sequence
  SiRNA target sequence
gagcaattaagtggtggtga

SEQ ID NO: 181288 - DNA, 20 bp, Artificial sequence
  SiRNA target sequence
agcaattaagtggtggtgaa

SEQ ID NO: 181289 - DNA, 20 bp, Artificial sequence
  SiRNA target sequence
gcaattaagtggtggtgaac

SEQ ID NO: 181290 - DNA, 20 bp, Artificial sequence
  SiRNA target sequence
caattaagtggtggtgaact

SEQ ID NO: 181291 - DNA, 20 bp, Artificial sequence
  SiRNA target sequence
aattaagtggtggtgaactt

SEQ ID NO: 181292 - DNA, 20 bp, Artificial sequence
  SiRNA target sequence
attaagtggtggtgaacttc

SEQ ID NO: 181293 - DNA, 20 bp, Artificial sequence
  SiRNA target sequence
ttaagtggtggtgaacttca

SEQ ID NO: 181294 - DNA, 20 bp, Artificial sequence
  SiRNA target sequence
taagtggtggtgaacttcaa

SEQ ID NO: 181295 - DNA, 20 bp, Artificial sequence
  SiRNA target sequence
aagtggtggtgaacttcaaa

SEQ ID NO: 181296 - DNA, 20 bp, Artificial sequence
  SiRNA target sequence
agtggtggtgaacttcaaag

SEQ ID NO: 181297 - DNA, 20 bp, Artificial sequence
  SiRNA target sequence
gtggtggtgaacttcaaaga

SEQ ID NO: 181298 - DNA, 20 bp, Artificial sequence
  SiRNA target sequence
tggtggtgaacttcaaagat

SEQ ID NO: 181299 - DNA, 20 bp, Artificial sequence
  SiRNA target sequence
ggtggtgaacttcaaagatt

SEQ ID NO: 181300 - DNA, 20 bp, Artificial sequence
  SiRNA target sequence
gtggtgaacttcaaagattt

SEQ ID NO: 181301 - DNA, 20 bp, Artificial sequence
  SiRNA target sequence
tggtgaacttcaaagatttt

SEQ ID NO: 181302 - DNA, 20 bp, Artificial sequence
  SiRNA target sequence
ggtgaacttcaaagattttg

SEQ ID NO: 181303 - DNA, 20 bp, Artificial sequence
  SiRNA target sequence
gtgaacttcaaagattttgt

SEQ ID NO: 181304 - DNA, 20 bp, Artificial sequence
  SiRNA target sequence
tgaacttcaaagattttgta

SEQ ID NO: 181305 - DNA, 20 bp, Artificial sequence
  SiRNA target sequence
gaacttcaaagattttgtat

SEQ ID NO: 181306 - DNA, 20 bp, Artificial sequence
  SiRNA target sequence
aacttcaaagattttgtatt

SEQ ID NO: 181307 - DNA, 20 bp, Artificial sequence
  SiRNA target sequence
acttcaaagattttgtattg

SEQ ID NO: 181308 - DNA, 20 bp, Artificial sequence
  SiRNA target sequence
cttcaaagattttgtattgc

SEQ ID NO: 181309 - DNA, 20 bp, Artificial sequence
  SiRNA target sequence
ttcaaagattttgtattgca

SEQ ID NO: 181310 - DNA, 20 bp, Artificial sequence
  SiRNA target sequence
tcaaagattttgtattgcat

SEQ ID NO: 181311 - DNA, 20 bp, Artificial sequence
  SiRNA target sequence
caaagattttgtattgcata

SEQ ID NO: 181312 - DNA, 20 bp, Artificial sequence
  SiRNA target sequence
aaagattttgtattgcatac

SEQ ID NO: 181313 - DNA, 20 bp, Artificial sequence
  SiRNA target sequence
aagattttgtattgcataca

SEQ ID NO: 181314 - DNA, 20 bp, Artificial sequence
  SiRNA target sequence
agattttgtattgcatacac

SEQ ID NO: 181315 - DNA, 20 bp, Artificial sequence
  SiRNA target sequence
gattttgtattgcatacaca

SEQ ID NO: 181316 - DNA, 20 bp, Artificial sequence
  SiRNA target sequence
attttgtattgcatacacat

SEQ ID NO: 181317 - DNA, 20 bp, Artificial sequence
  SiRNA target sequence
ttttgtattgcatacacatg

SEQ ID NO: 181318 - DNA, 20 bp, Artificial sequence
  SiRNA target sequence
tttgtattgcatacacatgt

SEQ ID NO: 181319 - DNA, 20 bp, Artificial sequence
  SiRNA target sequence
ttgtattgcatacacatgtt

SEQ ID NO: 181320 - DNA, 20 bp, Artificial sequence
  SiRNA target sequence
tgtattgcatacacatgttt

SEQ ID NO: 181321 - DNA, 20 bp, Artificial sequence
  SiRNA target sequence
gtattgcatacacatgttta

SEQ ID NO: 181322 - DNA, 20 bp, Artificial sequence
  SiRNA target sequence
tattgcatacacatgtttac

SEQ ID NO: 181323 - DNA, 20 bp, Artificial sequence
  SiRNA target sequence
attgcatacacatgtttaca

SEQ ID NO: 181324 - DNA, 20 bp, Artificial sequence
  SiRNA target sequence
ttgcatacacatgtttacaa

SEQ ID NO: 181325 - DNA, 20 bp, Artificial sequence
  SiRNA target sequence
tgcatacacatgtttacaag

SEQ ID NO: 181326 - DNA, 20 bp, Artificial sequence
  SiRNA target sequence
gcatacacatgtttacaaga

SEQ ID NO: 181327 - DNA, 20 bp, Artificial sequence
  SiRNA target sequence
catacacatgtttacaagaa

SEQ ID NO: 181328 - DNA, 20 bp, Artificial sequence
  SiRNA target sequence
atacacatgtttacaagaag

SEQ ID NO: 181329 - DNA, 20 bp, Artificial sequence
  SiRNA target sequence
tacacatgtttacaagaagg

SEQ ID NO: 181330 - DNA, 20 bp, Artificial sequence
  SiRNA target sequence
acacatgtttacaagaagga

SEQ ID NO: 181331 - DNA, 20 bp, Artificial sequence
  SiRNA target sequence
cacatgtttacaagaaggaa

SEQ ID NO: 181332 - DNA, 20 bp, Artificial sequence
  SiRNA target sequence
acatgtttacaagaaggaaa

SEQ ID NO: 181333 - DNA, 20 bp, Artificial sequence
  SiRNA target sequence
catgtttacaagaaggaaat

SEQ ID NO: 181334 - DNA, 20 bp, Artificial sequence
  SiRNA target sequence
atgtttacaagaaggaaatg

SEQ ID NO: 181335 - DNA, 20 bp, Artificial sequence
  SiRNA target sequence
tgtttacaagaaggaaatgt

SEQ ID NO: 181336 - DNA, 20 bp, Artificial sequence
  SiRNA target sequence
gtttacaagaaggaaatgtt

SEQ ID NO: 181337 - DNA, 20 bp, Artificial sequence
  SiRNA target sequence
tttacaagaaggaaatgttt

SEQ ID NO: 181338 - DNA, 20 bp, Artificial sequence
  SiRNA target sequence
ttacaagaaggaaatgttta

SEQ ID NO: 181339 - DNA, 20 bp, Artificial sequence
  SiRNA target sequence
tacaagaaggaaatgtttat

SEQ ID NO: 181340 - DNA, 20 bp, Artificial sequence
  SiRNA target sequence
acaagaaggaaatgtttata

SEQ ID NO: 181341 - DNA, 20 bp, Artificial sequence
  SiRNA target sequence
caagaaggaaatgtttatat

SEQ ID NO: 181342 - DNA, 20 bp, Artificial sequence
  SiRNA target sequence
aagaaggaaatgtttatatt

SEQ ID NO: 181343 - DNA, 20 bp, Artificial sequence
  SiRNA target sequence
agaaggaaatgtttatattt

SEQ ID NO: 181344 - DNA, 20 bp, Artificial sequence
  SiRNA target sequence
gaaggaaatgtttatatttt

SEQ ID NO: 181345 - DNA, 20 bp, Artificial sequence
  SiRNA target sequence
aaggaaatgtttatattttt

SEQ ID NO: 181346 - DNA, 20 bp, Artificial sequence
  SiRNA target sequence
aggaaatgtttatatttttg

SEQ ID NO: 181347 - DNA, 20 bp, Artificial sequence
  SiRNA target sequence
ggaaatgtttatatttttga

SEQ ID NO: 181348 - DNA, 20 bp, Artificial sequence
  SiRNA target sequence
gaaatgtttatatttttgat

SEQ ID NO: 181349 - DNA, 20 bp, Artificial sequence
  SiRNA target sequence
aaatgtttatatttttgatg

SEQ ID NO: 181350 - DNA, 20 bp, Artificial sequence
  SiRNA target sequence
aatgtttatatttttgatga

SEQ ID NO: 181351 - DNA, 20 bp, Artificial sequence
  SiRNA target sequence
atgtttatatttttgatgaa

SEQ ID NO: 181352 - DNA, 20 bp, Artificial sequence
  SiRNA target sequence
tgtttatatttttgatgaac

SEQ ID NO: 181353 - DNA, 20 bp, Artificial sequence
  SiRNA target sequence
gtttatatttttgatgaacc

SEQ ID NO: 181354 - DNA, 20 bp, Artificial sequence
  SiRNA target sequence
tttatatttttgatgaaccc

SEQ ID NO: 181355 - DNA, 20 bp, Artificial sequence
  SiRNA target sequence
ttatatttttgatgaaccca

SEQ ID NO: 181356 - DNA, 20 bp, Artificial sequence
  SiRNA target sequence
tatatttttgatgaacccac

SEQ ID NO: 181357 - DNA, 20 bp, Artificial sequence
  SiRNA target sequence
atatttttgatgaacccact

SEQ ID NO: 181358 - DNA, 20 bp, Artificial sequence
  SiRNA target sequence
tatttttgatgaacccacta

SEQ ID NO: 181359 - DNA, 20 bp, Artificial sequence
  SiRNA target sequence
atttttgatgaacccactag

SEQ ID NO: 181360 - DNA, 20 bp, Artificial sequence
  SiRNA target sequence
tttttgatgaacccactagt

SEQ ID NO: 181361 - DNA, 20 bp, Artificial sequence
  SiRNA target sequence
ttttgatgaacccactagtt

SEQ ID NO: 181362 - DNA, 20 bp, Artificial sequence
  SiRNA target sequence
tttgatgaacccactagttt

SEQ ID NO: 181363 - DNA, 20 bp, Artificial sequence
  SiRNA target sequence
ttgatgaacccactagtttt

SEQ ID NO: 181364 - DNA, 20 bp, Artificial sequence
  SiRNA target sequence
tgatgaacccactagttttt

SEQ ID NO: 181365 - DNA, 20 bp, Artificial sequence
  SiRNA target sequence
gatgaacccactagtttttt

SEQ ID NO: 181366 - DNA, 20 bp, Artificial sequence
  SiRNA target sequence
atgaacccactagttttttg

SEQ ID NO: 181367 - DNA, 20 bp, Artificial sequence
  SiRNA target sequence
tgaacccactagttttttgg

SEQ ID NO: 181368 - DNA, 20 bp, Artificial sequence
  SiRNA target sequence
gaacccactagttttttgga

SEQ ID NO: 181369 - DNA, 20 bp, Artificial sequence
  SiRNA target sequence
aacccactagttttttggat

SEQ ID NO: 181370 - DNA, 20 bp, Artificial sequence
  SiRNA target sequence
acccactagttttttggatg

SEQ ID NO: 181371 - DNA, 20 bp, Artificial sequence
  SiRNA target sequence
cccactagttttttggatgt

SEQ ID NO: 181372 - DNA, 20 bp, Artificial sequence
  SiRNA target sequence
ccactagttttttggatgtt

SEQ ID NO: 181373 - DNA, 20 bp, Artificial sequence
  SiRNA target sequence
cactagttttttggatgtta

SEQ ID NO: 181374 - DNA, 20 bp, Artificial sequence
  SiRNA target sequence
actagttttttggatgttaa

SEQ ID NO: 181375 - DNA, 20 bp, Artificial sequence
  SiRNA target sequence
ctagttttttggatgttaag

SEQ ID NO: 181376 - DNA, 20 bp, Artificial sequence
  SiRNA target sequence
tagttttttggatgttaagc

SEQ ID NO: 181377 - DNA, 20 bp, Artificial sequence
  SiRNA target sequence
agttttttggatgttaagca

SEQ ID NO: 181378 - DNA, 20 bp, Artificial sequence
  SiRNA target sequence
gttttttggatgttaagcag

SEQ ID NO: 181379 - DNA, 20 bp, Artificial sequence
  SiRNA target sequence
ttttttggatgttaagcagc

SEQ ID NO: 181380 - DNA, 20 bp, Artificial sequence
  SiRNA target sequence
tttttggatgttaagcagcg

SEQ ID NO: 181381 - DNA, 20 bp, Artificial sequence
  SiRNA target sequence
ttttggatgttaagcagcga

SEQ ID NO: 181382 - DNA, 20 bp, Artificial sequence
  SiRNA target sequence
tttggatgttaagcagcgac

SEQ ID NO: 181383 - DNA, 20 bp, Artificial sequence
  SiRNA target sequence
ttggatgttaagcagcgact

SEQ ID NO: 181384 - DNA, 20 bp, Artificial sequence
  SiRNA target sequence
tggatgttaagcagcgacta

SEQ ID NO: 181385 - DNA, 20 bp, Artificial sequence
  SiRNA target sequence
ggatgttaagcagcgactag

SEQ ID NO: 181386 - DNA, 20 bp, Artificial sequence
  SiRNA target sequence
gatgttaagcagcgactagc

SEQ ID NO: 181387 - DNA, 20 bp, Artificial sequence
  SiRNA target sequence
atgttaagcagcgactagca

SEQ ID NO: 181388 - DNA, 20 bp, Artificial sequence
  SiRNA target sequence
tgttaagcagcgactagcag

SEQ ID NO: 181389 - DNA, 20 bp, Artificial sequence
  SiRNA target sequence
gttaagcagcgactagcagc

SEQ ID NO: 181390 - DNA, 20 bp, Artificial sequence
  SiRNA target sequence
ttaagcagcgactagcagct

SEQ ID NO: 181391 - DNA, 20 bp, Artificial sequence
  SiRNA target sequence
taagcagcgactagcagctg

SEQ ID NO: 181392 - DNA, 20 bp, Artificial sequence
  SiRNA target sequence
aagcagcgactagcagctgc

SEQ ID NO: 181393 - DNA, 20 bp, Artificial sequence
  SiRNA target sequence
agcagcgactagcagctgct

SEQ ID NO: 181394 - DNA, 20 bp, Artificial sequence
  SiRNA target sequence
gcagcgactagcagctgcta

SEQ ID NO: 181395 - DNA, 20 bp, Artificial sequence
  SiRNA target sequence
cagcgactagcagctgctaa

SEQ ID NO: 181396 - DNA, 20 bp, Artificial sequence
  SiRNA target sequence
agcgactagcagctgctaag

SEQ ID NO: 181397 - DNA, 20 bp, Artificial sequence
  SiRNA target sequence
gcgactagcagctgctaagg

SEQ ID NO: 181398 - DNA, 20 bp, Artificial sequence
  SiRNA target sequence
cgactagcagctgctaagga

SEQ ID NO: 181399 - DNA, 20 bp, Artificial sequence
  SiRNA target sequence
gactagcagctgctaaggaa

SEQ ID NO: 181400 - DNA, 20 bp, Artificial sequence
  SiRNA target sequence
actagcagctgctaaggaaa

SEQ ID NO: 181401 - DNA, 20 bp, Artificial sequence
  SiRNA target sequence
ctagcagctgctaaggaaat

SEQ ID NO: 181402 - DNA, 20 bp, Artificial sequence
  SiRNA target sequence
tagcagctgctaaggaaata

SEQ ID NO: 181403 - DNA, 20 bp, Artificial sequence
  SiRNA target sequence
agcagctgctaaggaaataa

SEQ ID NO: 181404 - DNA, 20 bp, Artificial sequence
  SiRNA target sequence
gcagctgctaaggaaataag

SEQ ID NO: 181405 - DNA, 20 bp, Artificial sequence
  SiRNA target sequence
cagctgctaaggaaataaga

SEQ ID NO: 181406 - DNA, 20 bp, Artificial sequence
  SiRNA target sequence
agctgctaaggaaataagaa

SEQ ID NO: 181407 - DNA, 20 bp, Artificial sequence
  SiRNA target sequence
gctgctaaggaaataagaaa

SEQ ID NO: 181408 - DNA, 20 bp, Artificial sequence
  SiRNA target sequence
ctgctaaggaaataagaaat

SEQ ID NO: 181409 - DNA, 20 bp, Artificial sequence
  SiRNA target sequence
tgctaaggaaataagaaatt

SEQ ID NO: 181410 - DNA, 20 bp, Artificial sequence
  SiRNA target sequence
gctaaggaaataagaaattt

SEQ ID NO: 181411 - DNA, 20 bp, Artificial sequence
  SiRNA target sequence
ctaaggaaataagaaatttg

SEQ ID NO: 181412 - DNA, 20 bp, Artificial sequence
  SiRNA target sequence
taaggaaataagaaatttgt

SEQ ID NO: 181413 - DNA, 20 bp, Artificial sequence
  SiRNA target sequence
aaggaaataagaaatttgtg

SEQ ID NO: 181414 - DNA, 20 bp, Artificial sequence
  SiRNA target sequence
aggaaataagaaatttgtgt

SEQ ID NO: 181415 - DNA, 20 bp, Artificial sequence
  SiRNA target sequence
ggaaataagaaatttgtgtg

SEQ ID NO: 181416 - DNA, 20 bp, Artificial sequence
  SiRNA target sequence
gaaataagaaatttgtgtga

SEQ ID NO: 181417 - DNA, 20 bp, Artificial sequence
  SiRNA target sequence
aaataagaaatttgtgtgaa

SEQ ID NO: 181418 - DNA, 20 bp, Artificial sequence
  SiRNA target sequence
aataagaaatttgtgtgaag

SEQ ID NO: 181419 - DNA, 20 bp, Artificial sequence
  SiRNA target sequence
ataagaaatttgtgtgaaga

SEQ ID NO: 181420 - DNA, 20 bp, Artificial sequence
  SiRNA target sequence
taagaaatttgtgtgaagaa

SEQ ID NO: 181421 - DNA, 20 bp, Artificial sequence
  SiRNA target sequence
aagaaatttgtgtgaagaaa

SEQ ID NO: 181422 - DNA, 20 bp, Artificial sequence
  SiRNA target sequence
agaaatttgtgtgaagaaaa

SEQ ID NO: 181423 - DNA, 20 bp, Artificial sequence
  SiRNA target sequence
gaaatttgtgtgaagaaaat

SEQ ID NO: 181424 - DNA, 20 bp, Artificial sequence
  SiRNA target sequence
aaatttgtgtgaagaaaata

SEQ ID NO: 181425 - DNA, 20 bp, Artificial sequence
  SiRNA target sequence
aatttgtgtgaagaaaataa

SEQ ID NO: 181426 - DNA, 20 bp, Artificial sequence
  SiRNA target sequence
atttgtgtgaagaaaataaa

SEQ ID NO: 181427 - DNA, 20 bp, Artificial sequence
  SiRNA target sequence
tttgtgtgaagaaaataaat

SEQ ID NO: 181428 - DNA, 20 bp, Artificial sequence
  SiRNA target sequence
ttgtgtgaagaaaataaata

SEQ ID NO: 181429 - DNA, 20 bp, Artificial sequence
  SiRNA target sequence
tgtgtgaagaaaataaatat

SEQ ID NO: 181430 - DNA, 20 bp, Artificial sequence
  SiRNA target sequence
gtgtgaagaaaataaatatg

SEQ ID NO: 181431 - DNA, 20 bp, Artificial sequence
  SiRNA target sequence
tgtgaagaaaataaatatgt

SEQ ID NO: 181432 - DNA, 20 bp, Artificial sequence
  SiRNA target sequence
gtgaagaaaataaatatgtt

SEQ ID NO: 181433 - DNA, 20 bp, Artificial sequence
  SiRNA target sequence
tgaagaaaataaatatgttg

SEQ ID NO: 181434 - DNA, 20 bp, Artificial sequence
  SiRNA target sequence
gaagaaaataaatatgttgt

SEQ ID NO: 181435 - DNA, 20 bp, Artificial sequence
  SiRNA target sequence
aagaaaataaatatgttgta

SEQ ID NO: 181436 - DNA, 20 bp, Artificial sequence
  SiRNA target sequence
agaaaataaatatgttgtag

SEQ ID NO: 181437 - DNA, 20 bp, Artificial sequence
  SiRNA target sequence
gaaaataaatatgttgtagt

SEQ ID NO: 181438 - DNA, 20 bp, Artificial sequence
  SiRNA target sequence
aaaataaatatgttgtagtt

SEQ ID NO: 181439 - DNA, 20 bp, Artificial sequence
  SiRNA target sequence
aaataaatatgttgtagttg

SEQ ID NO: 181440 - DNA, 20 bp, Artificial sequence
  SiRNA target sequence
aataaatatgttgtagttgt

SEQ ID NO: 181441 - DNA, 20 bp, Artificial sequence
  SiRNA target sequence
ataaatatgttgtagttgtc

SEQ ID NO: 181442 - DNA, 20 bp, Artificial sequence
  SiRNA target sequence
taaatatgttgtagttgtcg

SEQ ID NO: 181443 - DNA, 20 bp, Artificial sequence
  SiRNA target sequence
aaatatgttgtagttgtcga

SEQ ID NO: 181444 - DNA, 20 bp, Artificial sequence
  SiRNA target sequence
aatatgttgtagttgtcgaa

SEQ ID NO: 181445 - DNA, 20 bp, Artificial sequence
  SiRNA target sequence
atatgttgtagttgtcgaac

SEQ ID NO: 181446 - DNA, 20 bp, Artificial sequence
  SiRNA target sequence
tatgttgtagttgtcgaaca

SEQ ID NO: 181447 - DNA, 20 bp, Artificial sequence
  SiRNA target sequence
atgttgtagttgtcgaacac

SEQ ID NO: 181448 - DNA, 20 bp, Artificial sequence
  SiRNA target sequence
tgttgtagttgtcgaacacg

SEQ ID NO: 181449 - DNA, 20 bp, Artificial sequence
  SiRNA target sequence
gttgtagttgtcgaacacga

SEQ ID NO: 181450 - DNA, 20 bp, Artificial sequence
  SiRNA target sequence
ttgtagttgtcgaacacgat

SEQ ID NO: 181451 - DNA, 20 bp, Artificial sequence
  SiRNA target sequence
tgtagttgtcgaacacgatt

SEQ ID NO: 181452 - DNA, 20 bp, Artificial sequence
  SiRNA target sequence
gtagttgtcgaacacgattt

SEQ ID NO: 181453 - DNA, 20 bp, Artificial sequence
  SiRNA target sequence
tagttgtcgaacacgattta

SEQ ID NO: 181454 - DNA, 20 bp, Artificial sequence
  SiRNA target sequence
agttgtcgaacacgatttag

SEQ ID NO: 181455 - DNA, 20 bp, Artificial sequence
  SiRNA target sequence
gttgtcgaacacgatttagc

SEQ ID NO: 181456 - DNA, 20 bp, Artificial sequence
  SiRNA target sequence
ttgtcgaacacgatttagcc

SEQ ID NO: 181457 - DNA, 20 bp, Artificial sequence
  SiRNA target sequence
tgtcgaacacgatttagcca

SEQ ID NO: 181458 - DNA, 20 bp, Artificial sequence
  SiRNA target sequence
gtcgaacacgatttagccat

SEQ ID NO: 181459 - DNA, 20 bp, Artificial sequence
  SiRNA target sequence
tcgaacacgatttagccatt

SEQ ID NO: 181460 - DNA, 20 bp, Artificial sequence
  SiRNA target sequence
cgaacacgatttagccattt

SEQ ID NO: 181461 - DNA, 20 bp, Artificial sequence
  SiRNA target sequence
gaacacgatttagccatttt

SEQ ID NO: 181462 - DNA, 20 bp, Artificial sequence
  SiRNA target sequence
aacacgatttagccatttta

SEQ ID NO: 181463 - DNA, 20 bp, Artificial sequence
  SiRNA target sequence
acacgatttagccattttag

SEQ ID NO: 181464 - DNA, 20 bp, Artificial sequence
  SiRNA target sequence
cacgatttagccattttaga

SEQ ID NO: 181465 - DNA, 20 bp, Artificial sequence
  SiRNA target sequence
acgatttagccattttagat

SEQ ID NO: 181466 - DNA, 20 bp, Artificial sequence
  SiRNA target sequence
cgatttagccattttagatt

SEQ ID NO: 181467 - DNA, 20 bp, Artificial sequence
  SiRNA target sequence
gatttagccattttagattt

SEQ ID NO: 181468 - DNA, 20 bp, Artificial sequence
  SiRNA target sequence
atttagccattttagatttg

SEQ ID NO: 181469 - DNA, 20 bp, Artificial sequence
  SiRNA target sequence
tttagccattttagatttga

SEQ ID NO: 181470 - DNA, 20 bp, Artificial sequence
  SiRNA target sequence
ttagccattttagatttgat

SEQ ID NO: 181471 - DNA, 20 bp, Artificial sequence
  SiRNA target sequence
tagccattttagatttgatg

SEQ ID NO: 181472 - DNA, 20 bp, Artificial sequence
  SiRNA target sequence
agccattttagatttgatgt

SEQ ID NO: 181473 - DNA, 20 bp, Artificial sequence
  SiRNA target sequence
gccattttagatttgatgtg

SEQ ID NO: 181474 - DNA, 20 bp, Artificial sequence
  SiRNA target sequence
ccattttagatttgatgtgt

SEQ ID NO: 181475 - DNA, 20 bp, Artificial sequence
  SiRNA target sequence
cattttagatttgatgtgtg

SEQ ID NO: 181476 - DNA, 20 bp, Artificial sequence
  SiRNA target sequence
attttagatttgatgtgtga

SEQ ID NO: 181477 - DNA, 20 bp, Artificial sequence
  SiRNA target sequence
ttttagatttgatgtgtgat

SEQ ID NO: 181478 - DNA, 20 bp, Artificial sequence
  SiRNA target sequence
tttagatttgatgtgtgatt

SEQ ID NO: 181479 - DNA, 20 bp, Artificial sequence
  SiRNA target sequence
ttagatttgatgtgtgattt

SEQ ID NO: 181480 - DNA, 20 bp, Artificial sequence
  SiRNA target sequence
tagatttgatgtgtgatttt

SEQ ID NO: 181481 - DNA, 20 bp, Artificial sequence
  SiRNA target sequence
agatttgatgtgtgattttg

SEQ ID NO: 181482 - DNA, 20 bp, Artificial sequence
  SiRNA target sequence
gatttgatgtgtgattttgg

SEQ ID NO: 181483 - DNA, 20 bp, Artificial sequence
  SiRNA target sequence
atttgatgtgtgattttgga

SEQ ID NO: 181484 - DNA, 20 bp, Artificial sequence
  SiRNA target sequence
tttgatgtgtgattttggat

SEQ ID NO: 181485 - DNA, 20 bp, Artificial sequence
  SiRNA target sequence
ttgatgtgtgattttggatg

SEQ ID NO: 181486 - DNA, 20 bp, Artificial sequence
  SiRNA target sequence
tgatgtgtgattttggatgt

SEQ ID NO: 181487 - DNA, 20 bp, Artificial sequence
  SiRNA target sequence
gatgtgtgattttggatgtg

SEQ ID NO: 181488 - DNA, 20 bp, Artificial sequence
  SiRNA target sequence
atgtgtgattttggatgtgt

SEQ ID NO: 181489 - DNA, 20 bp, Artificial sequence
  SiRNA target sequence
tgtgtgattttggatgtgtt

SEQ ID NO: 181490 - DNA, 20 bp, Artificial sequence
  SiRNA target sequence
gtgtgattttggatgtgttc

SEQ ID NO: 181491 - DNA, 20 bp, Artificial sequence
  SiRNA target sequence
tgtgattttggatgtgttct

SEQ ID NO: 181492 - DNA, 20 bp, Artificial sequence
  SiRNA target sequence
gtgattttggatgtgttcta

SEQ ID NO: 181493 - DNA, 20 bp, Artificial sequence
  SiRNA target sequence
tgattttggatgtgttctat

SEQ ID NO: 181494 - DNA, 20 bp, Artificial sequence
  SiRNA target sequence
gattttggatgtgttctata

SEQ ID NO: 181495 - DNA, 20 bp, Artificial sequence
  SiRNA target sequence
attttggatgtgttctatac

SEQ ID NO: 181496 - DNA, 20 bp, Artificial sequence
  SiRNA target sequence
ttttggatgtgttctatacg

SEQ ID NO: 181497 - DNA, 20 bp, Artificial sequence
  SiRNA target sequence
tttggatgtgttctatacgg

SEQ ID NO: 181498 - DNA, 20 bp, Artificial sequence
  SiRNA target sequence
ttggatgtgttctatacgga

SEQ ID NO: 181499 - DNA, 20 bp, Artificial sequence
  SiRNA target sequence
tggatgtgttctatacggac

SEQ ID NO: 181500 - DNA, 20 bp, Artificial sequence
  SiRNA target sequence
ggatgtgttctatacggaca

SEQ ID NO: 181501 - DNA, 20 bp, Artificial sequence
  SiRNA target sequence
gatgtgttctatacggacaa

SEQ ID NO: 181502 - DNA, 20 bp, Artificial sequence
  SiRNA target sequence
atgtgttctatacggacaat

SEQ ID NO: 181503 - DNA, 20 bp, Artificial sequence
  SiRNA target sequence
tgtgttctatacggacaatc

SEQ ID NO: 181504 - DNA, 20 bp, Artificial sequence
  SiRNA target sequence
gtgttctatacggacaatct

SEQ ID NO: 181505 - DNA, 20 bp, Artificial sequence
  SiRNA target sequence
tgttctatacggacaatctg

SEQ ID NO: 181506 - DNA, 20 bp, Artificial sequence
  SiRNA target sequence
gttctatacggacaatctgg

SEQ ID NO: 181507 - DNA, 20 bp, Artificial sequence
  SiRNA target sequence
ttctatacggacaatctggg

SEQ ID NO: 181508 - DNA, 20 bp, Artificial sequence
  SiRNA target sequence
tctatacggacaatctgggg

SEQ ID NO: 181509 - DNA, 20 bp, Artificial sequence
  SiRNA target sequence
ctatacggacaatctggggc

SEQ ID NO: 181510 - DNA, 20 bp, Artificial sequence
  SiRNA target sequence
tatacggacaatctggggca

SEQ ID NO: 181511 - DNA, 20 bp, Artificial sequence
  SiRNA target sequence
atacggacaatctggggcat

SEQ ID NO: 181512 - DNA, 20 bp, Artificial sequence
  SiRNA target sequence
tacggacaatctggggcata

SEQ ID NO: 181513 - DNA, 20 bp, Artificial sequence
  SiRNA target sequence
acggacaatctggggcatac

SEQ ID NO: 181514 - DNA, 20 bp, Artificial sequence
  SiRNA target sequence
cggacaatctggggcatacg

SEQ ID NO: 181515 - DNA, 20 bp, Artificial sequence
  SiRNA target sequence
ggacaatctggggcatacgg

SEQ ID NO: 181516 - DNA, 20 bp, Artificial sequence
  SiRNA target sequence
gacaatctggggcatacggt

SEQ ID NO: 181517 - DNA, 20 bp, Artificial sequence
  SiRNA target sequence
acaatctggggcatacggtg

SEQ ID NO: 181518 - DNA, 20 bp, Artificial sequence
  SiRNA target sequence
caatctggggcatacggtgt

SEQ ID NO: 181519 - DNA, 20 bp, Artificial sequence
  SiRNA target sequence
aatctggggcatacggtgta

SEQ ID NO: 181520 - DNA, 20 bp, Artificial sequence
  SiRNA target sequence
atctggggcatacggtgtaa

SEQ ID NO: 181521 - DNA, 20 bp, Artificial sequence
  SiRNA target sequence
tctggggcatacggtgtaat

SEQ ID NO: 181522 - DNA, 20 bp, Artificial sequence
  SiRNA target sequence
ctggggcatacggtgtaata

SEQ ID NO: 181523 - DNA, 20 bp, Artificial sequence
  SiRNA target sequence
tggggcatacggtgtaataa

SEQ ID NO: 181524 - DNA, 20 bp, Artificial sequence
  SiRNA target sequence
ggggcatacggtgtaataag

SEQ ID NO: 181525 - DNA, 20 bp, Artificial sequence
  SiRNA target sequence
gggcatacggtgtaataagc

SEQ ID NO: 181526 - DNA, 20 bp, Artificial sequence
  SiRNA target sequence
ggcatacggtgtaataagcg

SEQ ID NO: 181527 - DNA, 20 bp, Artificial sequence
  SiRNA target sequence
gcatacggtgtaataagcgc

SEQ ID NO: 181528 - DNA, 20 bp, Artificial sequence
  SiRNA target sequence
catacggtgtaataagcgca

SEQ ID NO: 181529 - DNA, 20 bp, Artificial sequence
  SiRNA target sequence
atacggtgtaataagcgcac

SEQ ID NO: 181530 - DNA, 20 bp, Artificial sequence
  SiRNA target sequence
tacggtgtaataagcgcacc

SEQ ID NO: 181531 - DNA, 20 bp, Artificial sequence
  SiRNA target sequence
acggtgtaataagcgcacca

SEQ ID NO: 181532 - DNA, 20 bp, Artificial sequence
  SiRNA target sequence
cggtgtaataagcgcaccat

SEQ ID NO: 181533 - DNA, 20 bp, Artificial sequence
  SiRNA target sequence
ggtgtaataagcgcaccata

SEQ ID NO: 181534 - DNA, 20 bp, Artificial sequence
  SiRNA target sequence
gtgtaataagcgcaccatac

SEQ ID NO: 181535 - DNA, 20 bp, Artificial sequence
  SiRNA target sequence
tgtaataagcgcaccatacg

SEQ ID NO: 181536 - DNA, 20 bp, Artificial sequence
  SiRNA target sequence
gtaataagcgcaccatacgt

SEQ ID NO: 181537 - DNA, 20 bp, Artificial sequence
  SiRNA target sequence
taataagcgcaccatacgtt

SEQ ID NO: 181538 - DNA, 20 bp, Artificial sequence
  SiRNA target sequence
aataagcgcaccatacgtta

SEQ ID NO: 181539 - DNA, 20 bp, Artificial sequence
  SiRNA target sequence
ataagcgcaccatacgttat

SEQ ID NO: 181540 - DNA, 20 bp, Artificial sequence
  SiRNA target sequence
taagcgcaccatacgttatt

SEQ ID NO: 181541 - DNA, 20 bp, Artificial sequence
  SiRNA target sequence
aagcgcaccatacgttatta

SEQ ID NO: 181542 - DNA, 20 bp, Artificial sequence
  SiRNA target sequence
agcgcaccatacgttattaa

SEQ ID NO: 181543 - DNA, 20 bp, Artificial sequence
  SiRNA target sequence
gcgcaccatacgttattaaa

SEQ ID NO: 181544 - DNA, 20 bp, Artificial sequence
  SiRNA target sequence
cgcaccatacgttattaaat

SEQ ID NO: 181545 - DNA, 20 bp, Artificial sequence
  SiRNA target sequence
gcaccatacgttattaaatc

SEQ ID NO: 181546 - DNA, 20 bp, Artificial sequence
  SiRNA target sequence
caccatacgttattaaatca

SEQ ID NO: 181547 - DNA, 20 bp, Artificial sequence
  SiRNA target sequence
accatacgttattaaatcag

SEQ ID NO: 181548 - DNA, 20 bp, Artificial sequence
  SiRNA target sequence
ccatacgttattaaatcagc

SEQ ID NO: 181549 - DNA, 20 bp, Artificial sequence
  SiRNA target sequence
catacgttattaaatcagca

SEQ ID NO: 181550 - DNA, 20 bp, Artificial sequence
  SiRNA target sequence
atacgttattaaatcagcaa

SEQ ID NO: 181551 - DNA, 20 bp, Artificial sequence
  SiRNA target sequence
tacgttattaaatcagcaat

SEQ ID NO: 181552 - DNA, 20 bp, Artificial sequence
  SiRNA target sequence
acgttattaaatcagcaata

SEQ ID NO: 181553 - DNA, 20 bp, Artificial sequence
  SiRNA target sequence
cgttattaaatcagcaataa

SEQ ID NO: 181554 - DNA, 20 bp, Artificial sequence
  SiRNA target sequence
gttattaaatcagcaataaa

SEQ ID NO: 181555 - DNA, 20 bp, Artificial sequence
  SiRNA target sequence
ttattaaatcagcaataaat

SEQ ID NO: 181556 - DNA, 20 bp, Artificial sequence
  SiRNA target sequence
tattaaatcagcaataaata

SEQ ID NO: 181557 - DNA, 20 bp, Artificial sequence
  SiRNA target sequence
attaaatcagcaataaatat

SEQ ID NO: 181558 - DNA, 20 bp, Artificial sequence
  SiRNA target sequence
ttaaatcagcaataaatata

SEQ ID NO: 181559 - DNA, 20 bp, Artificial sequence
  SiRNA target sequence
taaatcagcaataaatatat

SEQ ID NO: 181560 - DNA, 20 bp, Artificial sequence
  SiRNA target sequence
aaatcagcaataaatatatt

SEQ ID NO: 181561 - DNA, 20 bp, Artificial sequence
  SiRNA target sequence
aatcagcaataaatatattt

SEQ ID NO: 181562 - DNA, 20 bp, Artificial sequence
  SiRNA target sequence
atcagcaataaatatatttc

SEQ ID NO: 181563 - DNA, 20 bp, Artificial sequence
  SiRNA target sequence
tcagcaataaatatatttct

SEQ ID NO: 181564 - DNA, 20 bp, Artificial sequence
  SiRNA target sequence
cagcaataaatatatttctt

SEQ ID NO: 181565 - DNA, 20 bp, Artificial sequence
  SiRNA target sequence
agcaataaatatatttcttg

SEQ ID NO: 181566 - DNA, 20 bp, Artificial sequence
  SiRNA target sequence
gcaataaatatatttcttga

SEQ ID NO: 181567 - DNA, 20 bp, Artificial sequence
  SiRNA target sequence
caataaatatatttcttgat

SEQ ID NO: 181568 - DNA, 20 bp, Artificial sequence
  SiRNA target sequence
aataaatatatttcttgatg

SEQ ID NO: 181569 - DNA, 20 bp, Artificial sequence
  SiRNA target sequence
ataaatatatttcttgatgg

SEQ ID NO: 181570 - DNA, 20 bp, Artificial sequence
  SiRNA target sequence
taaatatatttcttgatgga

SEQ ID NO: 181571 - DNA, 20 bp, Artificial sequence
  SiRNA target sequence
aaatatatttcttgatggat

SEQ ID NO: 181572 - DNA, 20 bp, Artificial sequence
  SiRNA target sequence
aatatatttcttgatggatt

SEQ ID NO: 181573 - DNA, 20 bp, Artificial sequence
  SiRNA target sequence
atatatttcttgatggattt

SEQ ID NO: 181574 - DNA, 20 bp, Artificial sequence
  SiRNA target sequence
tatatttcttgatggatttt

SEQ ID NO: 181575 - DNA, 20 bp, Artificial sequence
  SiRNA target sequence
atatttcttgatggattttt

SEQ ID NO: 181576 - DNA, 20 bp, Artificial sequence
  SiRNA target sequence
tatttcttgatggatttttg

SEQ ID NO: 181577 - DNA, 20 bp, Artificial sequence
  SiRNA target sequence
atttcttgatggatttttgc

SEQ ID NO: 181578 - DNA, 20 bp, Artificial sequence
  SiRNA target sequence
tttcttgatggatttttgcc

SEQ ID NO: 181579 - DNA, 20 bp, Artificial sequence
  SiRNA target sequence
ttcttgatggatttttgcct

SEQ ID NO: 181580 - DNA, 20 bp, Artificial sequence
  SiRNA target sequence
tcttgatggatttttgccta

SEQ ID NO: 181581 - DNA, 20 bp, Artificial sequence
  SiRNA target sequence
cttgatggatttttgcctac

SEQ ID NO: 181582 - DNA, 20 bp, Artificial sequence
  SiRNA target sequence
ttgatggatttttgcctaca

SEQ ID NO: 181583 - DNA, 20 bp, Artificial sequence
  SiRNA target sequence
tgatggatttttgcctacag

SEQ ID NO: 181584 - DNA, 20 bp, Artificial sequence
  SiRNA target sequence
gatggatttttgcctacaga

SEQ ID NO: 181585 - DNA, 20 bp, Artificial sequence
  SiRNA target sequence
atggatttttgcctacagaa

SEQ ID NO: 181586 - DNA, 20 bp, Artificial sequence
  SiRNA target sequence
tggatttttgcctacagaaa

SEQ ID NO: 181587 - DNA, 20 bp, Artificial sequence
  SiRNA target sequence
ggatttttgcctacagaaaa

SEQ ID NO: 181588 - DNA, 20 bp, Artificial sequence
  SiRNA target sequence
gatttttgcctacagaaaac

SEQ ID NO: 181589 - DNA, 20 bp, Artificial sequence
  SiRNA target sequence
atttttgcctacagaaaaca

SEQ ID NO: 181590 - DNA, 20 bp, Artificial sequence
  SiRNA target sequence
tttttgcctacagaaaacat

SEQ ID NO: 181591 - DNA, 20 bp, Artificial sequence
  SiRNA target sequence
ttttgcctacagaaaacatg

SEQ ID NO: 181592 - DNA, 20 bp, Artificial sequence
  SiRNA target sequence
tttgcctacagaaaacatga

SEQ ID NO: 181593 - DNA, 20 bp, Artificial sequence
  SiRNA target sequence
ttgcctacagaaaacatgaa

SEQ ID NO: 181594 - DNA, 20 bp, Artificial sequence
  SiRNA target sequence
tgcctacagaaaacatgaaa

SEQ ID NO: 181595 - DNA, 20 bp, Artificial sequence
  SiRNA target sequence
gcctacagaaaacatgaaat

SEQ ID NO: 181596 - DNA, 20 bp, Artificial sequence
  SiRNA target sequence
cctacagaaaacatgaaatt

SEQ ID NO: 181597 - DNA, 20 bp, Artificial sequence
  SiRNA target sequence
ctacagaaaacatgaaattt

SEQ ID NO: 181598 - DNA, 20 bp, Artificial sequence
  SiRNA target sequence
tacagaaaacatgaaattta

SEQ ID NO: 181599 - DNA, 20 bp, Artificial sequence
  SiRNA target sequence
acagaaaacatgaaatttag

SEQ ID NO: 181600 - DNA, 20 bp, Artificial sequence
  SiRNA target sequence
cagaaaacatgaaatttaga

SEQ ID NO: 181601 - DNA, 20 bp, Artificial sequence
  SiRNA target sequence
agaaaacatgaaatttagaa

SEQ ID NO: 181602 - DNA, 20 bp, Artificial sequence
  SiRNA target sequence
gaaaacatgaaatttagaaa

SEQ ID NO: 181603 - DNA, 20 bp, Artificial sequence
  SiRNA target sequence
aaaacatgaaatttagaaat

SEQ ID NO: 181604 - DNA, 20 bp, Artificial sequence
  SiRNA target sequence
aaacatgaaatttagaaatt

SEQ ID NO: 181605 - DNA, 20 bp, Artificial sequence
  SiRNA target sequence
aacatgaaatttagaaattc

SEQ ID NO: 181606 - DNA, 20 bp, Artificial sequence
  SiRNA target sequence
acatgaaatttagaaattca

SEQ ID NO: 181607 - DNA, 20 bp, Artificial sequence
  SiRNA target sequence
catgaaatttagaaattcag

SEQ ID NO: 181608 - DNA, 20 bp, Artificial sequence
  SiRNA target sequence
atgaaatttagaaattcaga

SEQ ID NO: 181609 - DNA, 20 bp, Artificial sequence
  SiRNA target sequence
tgaaatttagaaattcagag

SEQ ID NO: 181610 - DNA, 20 bp, Artificial sequence
  SiRNA target sequence
gaaatttagaaattcagagt

SEQ ID NO: 181611 - DNA, 20 bp, Artificial sequence
  SiRNA target sequence
aaatttagaaattcagagtt

SEQ ID NO: 181612 - DNA, 20 bp, Artificial sequence
  SiRNA target sequence
aatttagaaattcagagtta

SEQ ID NO: 181613 - DNA, 20 bp, Artificial sequence
  SiRNA target sequence
atttagaaattcagagttaa

SEQ ID NO: 181614 - DNA, 20 bp, Artificial sequence
  SiRNA target sequence
tttagaaattcagagttaaa

SEQ ID NO: 181615 - DNA, 20 bp, Artificial sequence
  SiRNA target sequence
ttagaaattcagagttaaag

SEQ ID NO: 181616 - DNA, 20 bp, Artificial sequence
  SiRNA target sequence
tagaaattcagagttaaagt

SEQ ID NO: 181617 - DNA, 20 bp, Artificial sequence
  SiRNA target sequence
agaaattcagagttaaagtt

SEQ ID NO: 181618 - DNA, 20 bp, Artificial sequence
  SiRNA target sequence
gaaattcagagttaaagttt

SEQ ID NO: 181619 - DNA, 20 bp, Artificial sequence
  SiRNA target sequence
aaattcagagttaaagttta

SEQ ID NO: 181620 - DNA, 20 bp, Artificial sequence
  SiRNA target sequence
aattcagagttaaagtttaa

SEQ ID NO: 181621 - DNA, 20 bp, Artificial sequence
  SiRNA target sequence
attcagagttaaagtttaat

SEQ ID NO: 181622 - DNA, 20 bp, Artificial sequence
  SiRNA target sequence
ttcagagttaaagtttaata

SEQ ID NO: 181623 - DNA, 20 bp, Artificial sequence
  SiRNA target sequence
tcagagttaaagtttaatat

SEQ ID NO: 181624 - DNA, 20 bp, Artificial sequence
  SiRNA target sequence
cagagttaaagtttaatatt

SEQ ID NO: 181625 - DNA, 20 bp, Artificial sequence
  SiRNA target sequence
agagttaaagtttaatattt

SEQ ID NO: 181626 - DNA, 20 bp, Artificial sequence
  SiRNA target sequence
gagttaaagtttaatatttc

SEQ ID NO: 181627 - DNA, 20 bp, Artificial sequence
  SiRNA target sequence
agttaaagtttaatatttcg

SEQ ID NO: 181628 - DNA, 20 bp, Artificial sequence
  SiRNA target sequence
gttaaagtttaatatttcgg

SEQ ID NO: 181629 - DNA, 20 bp, Artificial sequence
  SiRNA target sequence
ttaaagtttaatatttcgga

SEQ ID NO: 181630 - DNA, 20 bp, Artificial sequence
  SiRNA target sequence
taaagtttaatatttcggaa

SEQ ID NO: 181631 - DNA, 20 bp, Artificial sequence
  SiRNA target sequence
aaagtttaatatttcggaaa

SEQ ID NO: 181632 - DNA, 20 bp, Artificial sequence
  SiRNA target sequence
aagtttaatatttcggaaac

SEQ ID NO: 181633 - DNA, 20 bp, Artificial sequence
  SiRNA target sequence
agtttaatatttcggaaaca

SEQ ID NO: 181634 - DNA, 20 bp, Artificial sequence
  SiRNA target sequence
gtttaatatttcggaaacac

SEQ ID NO: 181635 - DNA, 20 bp, Artificial sequence
  SiRNA target sequence
tttaatatttcggaaacact

SEQ ID NO: 181636 - DNA, 20 bp, Artificial sequence
  SiRNA target sequence
ttaatatttcggaaacactt

SEQ ID NO: 181637 - DNA, 20 bp, Artificial sequence
  SiRNA target sequence
taatatttcggaaacacttg

SEQ ID NO: 181638 - DNA, 20 bp, Artificial sequence
  SiRNA target sequence
aatatttcggaaacacttga

SEQ ID NO: 181639 - DNA, 20 bp, Artificial sequence
  SiRNA target sequence
atatttcggaaacacttgat

SEQ ID NO: 181640 - DNA, 20 bp, Artificial sequence
  SiRNA target sequence
tatttcggaaacacttgata

SEQ ID NO: 181641 - DNA, 20 bp, Artificial sequence
  SiRNA target sequence
atttcggaaacacttgatag

SEQ ID NO: 181642 - DNA, 20 bp, Artificial sequence
  SiRNA target sequence
tttcggaaacacttgatagt

SEQ ID NO: 181643 - DNA, 20 bp, Artificial sequence
  SiRNA target sequence
ttcggaaacacttgatagta

SEQ ID NO: 181644 - DNA, 20 bp, Artificial sequence
  SiRNA target sequence
tcggaaacacttgatagtat

SEQ ID NO: 181645 - DNA, 20 bp, Artificial sequence
  SiRNA target sequence
cggaaacacttgatagtatt

SEQ ID NO: 181646 - DNA, 20 bp, Artificial sequence
  SiRNA target sequence
ggaaacacttgatagtatta

SEQ ID NO: 181647 - DNA, 20 bp, Artificial sequence
  SiRNA target sequence
gaaacacttgatagtattat

SEQ ID NO: 181648 - DNA, 20 bp, Artificial sequence
  SiRNA target sequence
aaacacttgatagtattata

SEQ ID NO: 181649 - DNA, 20 bp, Artificial sequence
  SiRNA target sequence
aacacttgatagtattatat

SEQ ID NO: 181650 - DNA, 20 bp, Artificial sequence
  SiRNA target sequence
acacttgatagtattatatc

SEQ ID NO: 181651 - DNA, 20 bp, Artificial sequence
  SiRNA target sequence
cacttgatagtattatatct

SEQ ID NO: 181652 - DNA, 20 bp, Artificial sequence
  SiRNA target sequence
acttgatagtattatatcta

SEQ ID NO: 181653 - DNA, 20 bp, Artificial sequence
  SiRNA target sequence
cttgatagtattatatctac

SEQ ID NO: 181654 - DNA, 20 bp, Artificial sequence
  SiRNA target sequence
ttgatagtattatatctacc

SEQ ID NO: 181655 - DNA, 20 bp, Artificial sequence
  SiRNA target sequence
tgatagtattatatctacca

SEQ ID NO: 181656 - DNA, 20 bp, Artificial sequence
  SiRNA target sequence
gatagtattatatctaccag

SEQ ID NO: 181657 - DNA, 20 bp, Artificial sequence
  SiRNA target sequence
atagtattatatctaccaga

SEQ ID NO: 181658 - DNA, 20 bp, Artificial sequence
  SiRNA target sequence
tagtattatatctaccagag

SEQ ID NO: 181659 - DNA, 20 bp, Artificial sequence
  SiRNA target sequence
agtattatatctaccagaga

SEQ ID NO: 181660 - DNA, 20 bp, Artificial sequence
  SiRNA target sequence
gtattatatctaccagagac

SEQ ID NO: 181661 - DNA, 20 bp, Artificial sequence
  SiRNA target sequence
tattatatctaccagagacc

SEQ ID NO: 181662 - DNA, 20 bp, Artificial sequence
  SiRNA target sequence
attatatctaccagagacca

SEQ ID NO: 181663 - DNA, 20 bp, Artificial sequence
  SiRNA target sequence
ttatatctaccagagaccag

SEQ ID NO: 181664 - DNA, 20 bp, Artificial sequence
  SiRNA target sequence
tatatctaccagagaccagt

SEQ ID NO: 181665 - DNA, 20 bp, Artificial sequence
  SiRNA target sequence
atatctaccagagaccagta

SEQ ID NO: 181666 - DNA, 20 bp, Artificial sequence
  SiRNA target sequence
tatctaccagagaccagtat

SEQ ID NO: 181667 - DNA, 20 bp, Artificial sequence
  SiRNA target sequence
atctaccagagaccagtatc

SEQ ID NO: 181668 - DNA, 20 bp, Artificial sequence
  SiRNA target sequence
tctaccagagaccagtatca

SEQ ID NO: 181669 - DNA, 20 bp, Artificial sequence
  SiRNA target sequence
ctaccagagaccagtatcat

SEQ ID NO: 181670 - DNA, 20 bp, Artificial sequence
  SiRNA target sequence
taccagagaccagtatcatt

SEQ ID NO: 181671 - DNA, 20 bp, Artificial sequence
  SiRNA target sequence
accagagaccagtatcatta

SEQ ID NO: 181672 - DNA, 20 bp, Artificial sequence
  SiRNA target sequence
ccagagaccagtatcattat

SEQ ID NO: 181673 - DNA, 20 bp, Artificial sequence
  SiRNA target sequence
cagagaccagtatcattatc

SEQ ID NO: 181674 - DNA, 20 bp, Artificial sequence
  SiRNA target sequence
agagaccagtatcattatcc

SEQ ID NO: 181675 - DNA, 20 bp, Artificial sequence
  SiRNA target sequence
gagaccagtatcattatccc

SEQ ID NO: 181676 - DNA, 20 bp, Artificial sequence
  SiRNA target sequence
agaccagtatcattatccca

SEQ ID NO: 181677 - DNA, 20 bp, Artificial sequence
  SiRNA target sequence
gaccagtatcattatcccaa

SEQ ID NO: 181678 - DNA, 20 bp, Artificial sequence
  SiRNA target sequence
accagtatcattatcccaat

SEQ ID NO: 181679 - DNA, 20 bp, Artificial sequence
  SiRNA target sequence
ccagtatcattatcccaatt

SEQ ID NO: 181680 - DNA, 20 bp, Artificial sequence
  SiRNA target sequence
cagtatcattatcccaattt

SEQ ID NO: 181681 - DNA, 20 bp, Artificial sequence
  SiRNA target sequence
agtatcattatcccaatttg

SEQ ID NO: 181682 - DNA, 20 bp, Artificial sequence
  SiRNA target sequence
gtatcattatcccaatttga

SEQ ID NO: 181683 - DNA, 20 bp, Artificial sequence
  SiRNA target sequence
tatcattatcccaatttgat

SEQ ID NO: 181684 - DNA, 20 bp, Artificial sequence
  SiRNA target sequence
atcattatcccaatttgata

SEQ ID NO: 181685 - DNA, 20 bp, Artificial sequence
  SiRNA target sequence
tcattatcccaatttgataa

SEQ ID NO: 181686 - DNA, 20 bp, Artificial sequence
  SiRNA target sequence
cattatcccaatttgataaa

SEQ ID NO: 181687 - DNA, 20 bp, Artificial sequence
  SiRNA target sequence
attatcccaatttgataaaa

SEQ ID NO: 181688 - DNA, 20 bp, Artificial sequence
  SiRNA target sequence
ttatcccaatttgataaaaa

SEQ ID NO: 181689 - DNA, 20 bp, Artificial sequence
  SiRNA target sequence
tatcccaatttgataaaaac

SEQ ID NO: 181690 - DNA, 20 bp, Artificial sequence
  SiRNA target sequence
atcccaatttgataaaaaca

SEQ ID NO: 181691 - DNA, 20 bp, Artificial sequence
  SiRNA target sequence
tcccaatttgataaaaacat

SEQ ID NO: 181692 - DNA, 20 bp, Artificial sequence
  SiRNA target sequence
cccaatttgataaaaacata

SEQ ID NO: 181693 - DNA, 20 bp, Artificial sequence
  SiRNA target sequence
ccaatttgataaaaacatat

SEQ ID NO: 181694 - DNA, 20 bp, Artificial sequence
  SiRNA target sequence
caatttgataaaaacatatc

SEQ ID NO: 181695 - DNA, 20 bp, Artificial sequence
  SiRNA target sequence
aatttgataaaaacatatcc

SEQ ID NO: 181696 - DNA, 20 bp, Artificial sequence
  SiRNA target sequence
atttgataaaaacatatcca

SEQ ID NO: 181697 - DNA, 20 bp, Artificial sequence
  SiRNA target sequence
tttgataaaaacatatccaa

SEQ ID NO: 181698 - DNA, 20 bp, Artificial sequence
  SiRNA target sequence
ttgataaaaacatatccaaa

SEQ ID NO: 181699 - DNA, 20 bp, Artificial sequence
  SiRNA target sequence
tgataaaaacatatccaaat

SEQ ID NO: 181700 - DNA, 20 bp, Artificial sequence
  SiRNA target sequence
gataaaaacatatccaaatt

SEQ ID NO: 181701 - DNA, 20 bp, Artificial sequence
  SiRNA target sequence
ataaaaacatatccaaattt

SEQ ID NO: 181702 - DNA, 20 bp, Artificial sequence
  SiRNA target sequence
taaaaacatatccaaatttt

SEQ ID NO: 181703 - DNA, 20 bp, Artificial sequence
  SiRNA target sequence
aaaaacatatccaaatttta

SEQ ID NO: 181704 - DNA, 20 bp, Artificial sequence
  SiRNA target sequence
aaaacatatccaaattttac

SEQ ID NO: 181705 - DNA, 20 bp, Artificial sequence
  SiRNA target sequence
aaacatatccaaattttacg

SEQ ID NO: 181706 - DNA, 20 bp, Artificial sequence
  SiRNA target sequence
aacatatccaaattttacgc

SEQ ID NO: 181707 - DNA, 20 bp, Artificial sequence
  SiRNA target sequence
acatatccaaattttacgct

SEQ ID NO: 181708 - DNA, 20 bp, Artificial sequence
  SiRNA target sequence
catatccaaattttacgctt

SEQ ID NO: 181709 - DNA, 20 bp, Artificial sequence
  SiRNA target sequence
atatccaaattttacgctta

SEQ ID NO: 181710 - DNA, 20 bp, Artificial sequence
  SiRNA target sequence
tatccaaattttacgcttaa

SEQ ID NO: 181711 - DNA, 20 bp, Artificial sequence
  SiRNA target sequence
atccaaattttacgcttaaa

SEQ ID NO: 181712 - DNA, 20 bp, Artificial sequence
  SiRNA target sequence
tccaaattttacgcttaaag

SEQ ID NO: 181713 - DNA, 20 bp, Artificial sequence
  SiRNA target sequence
ccaaattttacgcttaaagt

SEQ ID NO: 181714 - DNA, 20 bp, Artificial sequence
  SiRNA target sequence
caaattttacgcttaaagtt

SEQ ID NO: 181715 - DNA, 20 bp, Artificial sequence
  SiRNA target sequence
aaattttacgcttaaagttg

SEQ ID NO: 181716 - DNA, 20 bp, Artificial sequence
  SiRNA target sequence
aattttacgcttaaagttga

SEQ ID NO: 181717 - DNA, 20 bp, Artificial sequence
  SiRNA target sequence
attttacgcttaaagttgaa

SEQ ID NO: 181718 - DNA, 20 bp, Artificial sequence
  SiRNA target sequence
ttttacgcttaaagttgaag

SEQ ID NO: 181719 - DNA, 20 bp, Artificial sequence
  SiRNA target sequence
tttacgcttaaagttgaagg

SEQ ID NO: 181720 - DNA, 20 bp, Artificial sequence
  SiRNA target sequence
ttacgcttaaagttgaaggc

SEQ ID NO: 181721 - DNA, 20 bp, Artificial sequence
  SiRNA target sequence
tacgcttaaagttgaaggcg

SEQ ID NO: 181722 - DNA, 20 bp, Artificial sequence
  SiRNA target sequence
acgcttaaagttgaaggcgg

SEQ ID NO: 181723 - DNA, 20 bp, Artificial sequence
  SiRNA target sequence
cgcttaaagttgaaggcggt

SEQ ID NO: 181724 - DNA, 20 bp, Artificial sequence
  SiRNA target sequence
gcttaaagttgaaggcggta

SEQ ID NO: 181725 - DNA, 20 bp, Artificial sequence
  SiRNA target sequence
cttaaagttgaaggcggtaa

SEQ ID NO: 181726 - DNA, 20 bp, Artificial sequence
  SiRNA target sequence
ttaaagttgaaggcggtaac

SEQ ID NO: 181727 - DNA, 20 bp, Artificial sequence
  SiRNA target sequence
taaagttgaaggcggtaact

SEQ ID NO: 181728 - DNA, 20 bp, Artificial sequence
  SiRNA target sequence
aaagttgaaggcggtaactt

SEQ ID NO: 181729 - DNA, 20 bp, Artificial sequence
  SiRNA target sequence
aagttgaaggcggtaacttt

SEQ ID NO: 181730 - DNA, 20 bp, Artificial sequence
  SiRNA target sequence
agttgaaggcggtaactttt

SEQ ID NO: 181731 - DNA, 20 bp, Artificial sequence
  SiRNA target sequence
gttgaaggcggtaacttttc

SEQ ID NO: 181732 - DNA, 20 bp, Artificial sequence
  SiRNA target sequence
ttgaaggcggtaacttttca

SEQ ID NO: 181733 - DNA, 20 bp, Artificial sequence
  SiRNA target sequence
tgaaggcggtaacttttcag

SEQ ID NO: 181734 - DNA, 20 bp, Artificial sequence
  SiRNA target sequence
gaaggcggtaacttttcaga

SEQ ID NO: 181735 - DNA, 20 bp, Artificial sequence
  SiRNA target sequence
aaggcggtaacttttcagat

SEQ ID NO: 181736 - DNA, 20 bp, Artificial sequence
  SiRNA target sequence
aggcggtaacttttcagatt

SEQ ID NO: 181737 - DNA, 20 bp, Artificial sequence
  SiRNA target sequence
ggcggtaacttttcagattc

SEQ ID NO: 181738 - DNA, 20 bp, Artificial sequence
  SiRNA target sequence
gcggtaacttttcagattct

SEQ ID NO: 181739 - DNA, 20 bp, Artificial sequence
  SiRNA target sequence
cggtaacttttcagattctg

SEQ ID NO: 181740 - DNA, 20 bp, Artificial sequence
  SiRNA target sequence
ggtaacttttcagattctga

SEQ ID NO: 181741 - DNA, 20 bp, Artificial sequence
  SiRNA target sequence
gtaacttttcagattctgaa

SEQ ID NO: 181742 - DNA, 20 bp, Artificial sequence
  SiRNA target sequence
taacttttcagattctgaaa

SEQ ID NO: 181743 - DNA, 20 bp, Artificial sequence
  SiRNA target sequence
aacttttcagattctgaaat

SEQ ID NO: 181744 - DNA, 20 bp, Artificial sequence
  SiRNA target sequence
acttttcagattctgaaatt

SEQ ID NO: 181745 - DNA, 20 bp, Artificial sequence
  SiRNA target sequence
cttttcagattctgaaattg

SEQ ID NO: 181746 - DNA, 20 bp, Artificial sequence
  SiRNA target sequence
ttttcagattctgaaattgt

SEQ ID NO: 181747 - DNA, 20 bp, Artificial sequence
  SiRNA target sequence
tttcagattctgaaattgtt

SEQ ID NO: 181748 - DNA, 20 bp, Artificial sequence
  SiRNA target sequence
ttcagattctgaaattgttg

SEQ ID NO: 181749 - DNA, 20 bp, Artificial sequence
  SiRNA target sequence
tcagattctgaaattgttgt

SEQ ID NO: 181750 - DNA, 20 bp, Artificial sequence
  SiRNA target sequence
cagattctgaaattgttgta

SEQ ID NO: 181751 - DNA, 20 bp, Artificial sequence
  SiRNA target sequence
agattctgaaattgttgtat

SEQ ID NO: 181752 - DNA, 20 bp, Artificial sequence
  SiRNA target sequence
gattctgaaattgttgtatt

SEQ ID NO: 181753 - DNA, 20 bp, Artificial sequence
  SiRNA target sequence
attctgaaattgttgtattt

SEQ ID NO: 181754 - DNA, 20 bp, Artificial sequence
  SiRNA target sequence
ttctgaaattgttgtatttc

SEQ ID NO: 181755 - DNA, 20 bp, Artificial sequence
  SiRNA target sequence
tctgaaattgttgtatttct

SEQ ID NO: 181756 - DNA, 20 bp, Artificial sequence
  SiRNA target sequence
ctgaaattgttgtatttctt

SEQ ID NO: 181757 - DNA, 20 bp, Artificial sequence
  SiRNA target sequence
tgaaattgttgtatttcttg

SEQ ID NO: 181758 - DNA, 20 bp, Artificial sequence
  SiRNA target sequence
gaaattgttgtatttcttgg

SEQ ID NO: 181759 - DNA, 20 bp, Artificial sequence
  SiRNA target sequence
aaattgttgtatttcttggt

SEQ ID NO: 181760 - DNA, 20 bp, Artificial sequence
  SiRNA target sequence
aattgttgtatttcttggtg

SEQ ID NO: 181761 - DNA, 20 bp, Artificial sequence
  SiRNA target sequence
attgttgtatttcttggtga

SEQ ID NO: 181762 - DNA, 20 bp, Artificial sequence
  SiRNA target sequence
ttgttgtatttcttggtgaa

SEQ ID NO: 181763 - DNA, 20 bp, Artificial sequence
  SiRNA target sequence
tgttgtatttcttggtgaaa

SEQ ID NO: 181764 - DNA, 20 bp, Artificial sequence
  SiRNA target sequence
gttgtatttcttggtgaaaa

SEQ ID NO: 181765 - DNA, 20 bp, Artificial sequence
  SiRNA target sequence
ttgtatttcttggtgaaaat

SEQ ID NO: 181766 - DNA, 20 bp, Artificial sequence
  SiRNA target sequence
tgtatttcttggtgaaaatg

SEQ ID NO: 181767 - DNA, 20 bp, Artificial sequence
  SiRNA target sequence
gtatttcttggtgaaaatgg

SEQ ID NO: 181768 - DNA, 20 bp, Artificial sequence
  SiRNA target sequence
tatttcttggtgaaaatgga

SEQ ID NO: 181769 - DNA, 20 bp, Artificial sequence
  SiRNA target sequence
atttcttggtgaaaatggaa

SEQ ID NO: 181770 - DNA, 20 bp, Artificial sequence
  SiRNA target sequence
tttcttggtgaaaatggaat

SEQ ID NO: 181771 - DNA, 20 bp, Artificial sequence
  SiRNA target sequence
ttcttggtgaaaatggaatg

SEQ ID NO: 181772 - DNA, 20 bp, Artificial sequence
  SiRNA target sequence
tcttggtgaaaatggaatgg

SEQ ID NO: 181773 - DNA, 20 bp, Artificial sequence
  SiRNA target sequence
cttggtgaaaatggaatggg

SEQ ID NO: 181774 - DNA, 20 bp, Artificial sequence
  SiRNA target sequence
ttggtgaaaatggaatgggc

SEQ ID NO: 181775 - DNA, 20 bp, Artificial sequence
  SiRNA target sequence
tggtgaaaatggaatgggca

SEQ ID NO: 181776 - DNA, 20 bp, Artificial sequence
  SiRNA target sequence
ggtgaaaatggaatgggcaa

SEQ ID NO: 181777 - DNA, 20 bp, Artificial sequence
  SiRNA target sequence
gtgaaaatggaatgggcaaa

SEQ ID NO: 181778 - DNA, 20 bp, Artificial sequence
  SiRNA target sequence
tgaaaatggaatgggcaaaa

SEQ ID NO: 181779 - DNA, 20 bp, Artificial sequence
  SiRNA target sequence
gaaaatggaatgggcaaaac

SEQ ID NO: 181780 - DNA, 20 bp, Artificial sequence
  SiRNA target sequence
aaaatggaatgggcaaaact

SEQ ID NO: 181781 - DNA, 20 bp, Artificial sequence
  SiRNA target sequence
aaatggaatgggcaaaacta

SEQ ID NO: 181782 - DNA, 20 bp, Artificial sequence
  SiRNA target sequence
aatggaatgggcaaaactac

SEQ ID NO: 181783 - DNA, 20 bp, Artificial sequence
  SiRNA target sequence
atggaatgggcaaaactact

SEQ ID NO: 181784 - DNA, 20 bp, Artificial sequence
  SiRNA target sequence
tggaatgggcaaaactactt

SEQ ID NO: 181785 - DNA, 20 bp, Artificial sequence
  SiRNA target sequence
ggaatgggcaaaactacttt

SEQ ID NO: 181786 - DNA, 20 bp, Artificial sequence
  SiRNA target sequence
gaatgggcaaaactacttta

SEQ ID NO: 181787 - DNA, 20 bp, Artificial sequence
  SiRNA target sequence
aatgggcaaaactactttag

SEQ ID NO: 181788 - DNA, 20 bp, Artificial sequence
  SiRNA target sequence
atgggcaaaactactttagt

SEQ ID NO: 181789 - DNA, 20 bp, Artificial sequence
  SiRNA target sequence
tgggcaaaactactttagta

SEQ ID NO: 181790 - DNA, 20 bp, Artificial sequence
  SiRNA target sequence
gggcaaaactactttagtag

SEQ ID NO: 181791 - DNA, 20 bp, Artificial sequence
  SiRNA target sequence
ggcaaaactactttagtagg

SEQ ID NO: 181792 - DNA, 20 bp, Artificial sequence
  SiRNA target sequence
gcaaaactactttagtaggt

SEQ ID NO: 181793 - DNA, 20 bp, Artificial sequence
  SiRNA target sequence
caaaactactttagtaggtt

SEQ ID NO: 181794 - DNA, 20 bp, Artificial sequence
  SiRNA target sequence
aaaactactttagtaggttt

SEQ ID NO: 181795 - DNA, 20 bp, Artificial sequence
  SiRNA target sequence
aaactactttagtaggtttg

SEQ ID NO: 181796 - DNA, 20 bp, Artificial sequence
  SiRNA target sequence
aactactttagtaggtttga

SEQ ID NO: 181797 - DNA, 20 bp, Artificial sequence
  SiRNA target sequence
actactttagtaggtttgat

SEQ ID NO: 181798 - DNA, 20 bp, Artificial sequence
  SiRNA target sequence
ctactttagtaggtttgatt

SEQ ID NO: 181799 - DNA, 20 bp, Artificial sequence
  SiRNA target sequence
tactttagtaggtttgattt

SEQ ID NO: 181800 - DNA, 20 bp, Artificial sequence
  SiRNA target sequence
actttagtaggtttgatttc

SEQ ID NO: 181801 - DNA, 20 bp, Artificial sequence
  SiRNA target sequence
ctttagtaggtttgatttcg

SEQ ID NO: 181802 - DNA, 20 bp, Artificial sequence
  SiRNA target sequence
tttagtaggtttgatttcgg

SEQ ID NO: 181803 - DNA, 20 bp, Artificial sequence
  SiRNA target sequence
ttagtaggtttgatttcggg

SEQ ID NO: 181804 - DNA, 20 bp, Artificial sequence
  SiRNA target sequence
tagtaggtttgatttcgggg

SEQ ID NO: 181805 - DNA, 20 bp, Artificial sequence
  SiRNA target sequence
agtaggtttgatttcggggt

SEQ ID NO: 181806 - DNA, 20 bp, Artificial sequence
  SiRNA target sequence
gtaggtttgatttcggggtt

SEQ ID NO: 181807 - DNA, 20 bp, Artificial sequence
  SiRNA target sequence
taggtttgatttcggggtta

SEQ ID NO: 181808 - DNA, 20 bp, Artificial sequence
  SiRNA target sequence
aggtttgatttcggggttaa

SEQ ID NO: 181809 - DNA, 20 bp, Artificial sequence
  SiRNA target sequence
ggtttgatttcggggttaat

SEQ ID NO: 181810 - DNA, 20 bp, Artificial sequence
  SiRNA target sequence
gtttgatttcggggttaatt

SEQ ID NO: 181811 - DNA, 20 bp, Artificial sequence
  SiRNA target sequence
tttgatttcggggttaatta

SEQ ID NO: 181812 - DNA, 20 bp, Artificial sequence
  SiRNA target sequence
ttgatttcggggttaattaa

SEQ ID NO: 181813 - DNA, 20 bp, Artificial sequence
  SiRNA target sequence
tgatttcggggttaattaaa

SEQ ID NO: 181814 - DNA, 20 bp, Artificial sequence
  SiRNA target sequence
gatttcggggttaattaaag

SEQ ID NO: 181815 - DNA, 20 bp, Artificial sequence
  SiRNA target sequence
atttcggggttaattaaaga

SEQ ID NO: 181816 - DNA, 20 bp, Artificial sequence
  SiRNA target sequence
tttcggggttaattaaagat

SEQ ID NO: 181817 - DNA, 20 bp, Artificial sequence
  SiRNA target sequence
ttcggggttaattaaagatg

SEQ ID NO: 181818 - DNA, 20 bp, Artificial sequence
  SiRNA target sequence
tcggggttaattaaagatga

SEQ ID NO: 181819 - DNA, 20 bp, Artificial sequence
  SiRNA target sequence
cggggttaattaaagatgat

SEQ ID NO: 181820 - DNA, 20 bp, Artificial sequence
  SiRNA target sequence
ggggttaattaaagatgata

SEQ ID NO: 181821 - DNA, 20 bp, Artificial sequence
  SiRNA target sequence
gggttaattaaagatgataa

SEQ ID NO: 181822 - DNA, 20 bp, Artificial sequence
  SiRNA target sequence
ggttaattaaagatgataac

SEQ ID NO: 181823 - DNA, 20 bp, Artificial sequence
  SiRNA target sequence
gttaattaaagatgataacg

SEQ ID NO: 181824 - DNA, 20 bp, Artificial sequence
  SiRNA target sequence
ttaattaaagatgataacgg

SEQ ID NO: 181825 - DNA, 20 bp, Artificial sequence
  SiRNA target sequence
taattaaagatgataacggg

SEQ ID NO: 181826 - DNA, 20 bp, Artificial sequence
  SiRNA target sequence
aattaaagatgataacgggg

SEQ ID NO: 181827 - DNA, 20 bp, Artificial sequence
  SiRNA target sequence
attaaagatgataacgggga

SEQ ID NO: 181828 - DNA, 20 bp, Artificial sequence
  SiRNA target sequence
ttaaagatgataacggggaa

SEQ ID NO: 181829 - DNA, 20 bp, Artificial sequence
  SiRNA target sequence
taaagatgataacggggaag

SEQ ID NO: 181830 - DNA, 20 bp, Artificial sequence
  SiRNA target sequence
aaagatgataacggggaaga

SEQ ID NO: 181831 - DNA, 20 bp, Artificial sequence
  SiRNA target sequence
aagatgataacggggaagag

SEQ ID NO: 181832 - DNA, 20 bp, Artificial sequence
  SiRNA target sequence
agatgataacggggaagagt

SEQ ID NO: 181833 - DNA, 20 bp, Artificial sequence
  SiRNA target sequence
gatgataacggggaagagtt

SEQ ID NO: 181834 - DNA, 20 bp, Artificial sequence
  SiRNA target sequence
atgataacggggaagagttc

SEQ ID NO: 181835 - DNA, 20 bp, Artificial sequence
  SiRNA target sequence
tgataacggggaagagttcg

SEQ ID NO: 181836 - DNA, 20 bp, Artificial sequence
  SiRNA target sequence
gataacggggaagagttcgg

SEQ ID NO: 181837 - DNA, 20 bp, Artificial sequence
  SiRNA target sequence
ataacggggaagagttcggt

SEQ ID NO: 181838 - DNA, 20 bp, Artificial sequence
  SiRNA target sequence
taacggggaagagttcggtt

SEQ ID NO: 181839 - DNA, 20 bp, Artificial sequence
  SiRNA target sequence
aacggggaagagttcggttt

SEQ ID NO: 181840 - DNA, 20 bp, Artificial sequence
  SiRNA target sequence
acggggaagagttcggtttg

SEQ ID NO: 181841 - DNA, 20 bp, Artificial sequence
  SiRNA target sequence
cggggaagagttcggtttgt

SEQ ID NO: 181842 - DNA, 20 bp, Artificial sequence
  SiRNA target sequence
ggggaagagttcggtttgtt

SEQ ID NO: 181843 - DNA, 20 bp, Artificial sequence
  SiRNA target sequence
gggaagagttcggtttgttg

SEQ ID NO: 181844 - DNA, 20 bp, Artificial sequence
  SiRNA target sequence
ggaagagttcggtttgttgt

SEQ ID NO: 181845 - DNA, 20 bp, Artificial sequence
  SiRNA target sequence
gaagagttcggtttgttgtc

SEQ ID NO: 181846 - DNA, 20 bp, Artificial sequence
  SiRNA target sequence
aagagttcggtttgttgtca

SEQ ID NO: 181847 - DNA, 20 bp, Artificial sequence
  SiRNA target sequence
agagttcggtttgttgtcat

SEQ ID NO: 181848 - DNA, 20 bp, Artificial sequence
  SiRNA target sequence
gagttcggtttgttgtcata

SEQ ID NO: 181849 - DNA, 20 bp, Artificial sequence
  SiRNA target sequence
agttcggtttgttgtcatat

SEQ ID NO: 181850 - DNA, 20 bp, Artificial sequence
  SiRNA target sequence
gttcggtttgttgtcatata

SEQ ID NO: 181851 - DNA, 20 bp, Artificial sequence
  SiRNA target sequence
ttcggtttgttgtcatatag

SEQ ID NO: 181852 - DNA, 20 bp, Artificial sequence
  SiRNA target sequence
tcggtttgttgtcatatagt

SEQ ID NO: 181853 - DNA, 20 bp, Artificial sequence
  SiRNA target sequence
cggtttgttgtcatatagtc

SEQ ID NO: 181854 - DNA, 20 bp, Artificial sequence
  SiRNA target sequence
ggtttgttgtcatatagtct

SEQ ID NO: 181855 - DNA, 20 bp, Artificial sequence
  SiRNA target sequence
gtttgttgtcatatagtctt

SEQ ID NO: 181856 - DNA, 20 bp, Artificial sequence
  SiRNA target sequence
tttgttgtcatatagtctta

SEQ ID NO: 181857 - DNA, 20 bp, Artificial sequence
  SiRNA target sequence
ttgttgtcatatagtcttaa

SEQ ID NO: 181858 - DNA, 20 bp, Artificial sequence
  SiRNA target sequence
tgttgtcatatagtcttaaa

SEQ ID NO: 181859 - DNA, 20 bp, Artificial sequence
  SiRNA target sequence
gttgtcatatagtcttaaac

SEQ ID NO: 181860 - DNA, 20 bp, Artificial sequence
  SiRNA target sequence
ttgtcatatagtcttaaacc

SEQ ID NO: 181861 - DNA, 20 bp, Artificial sequence
  SiRNA target sequence
tgtcatatagtcttaaaccg

SEQ ID NO: 181862 - DNA, 20 bp, Artificial sequence
  SiRNA target sequence
gtcatatagtcttaaaccgc

SEQ ID NO: 181863 - DNA, 20 bp, Artificial sequence
  SiRNA target sequence
tcatatagtcttaaaccgca

SEQ ID NO: 181864 - DNA, 20 bp, Artificial sequence
  SiRNA target sequence
catatagtcttaaaccgcaa

SEQ ID NO: 181865 - DNA, 20 bp, Artificial sequence
  SiRNA target sequence
atatagtcttaaaccgcaaa

SEQ ID NO: 181866 - DNA, 20 bp, Artificial sequence
  SiRNA target sequence
tatagtcttaaaccgcaaaa

SEQ ID NO: 181867 - DNA, 20 bp, Artificial sequence
  SiRNA target sequence
atagtcttaaaccgcaaaaa

SEQ ID NO: 181868 - DNA, 20 bp, Artificial sequence
  SiRNA target sequence
tagtcttaaaccgcaaaaaa

SEQ ID NO: 181869 - DNA, 20 bp, Artificial sequence
  SiRNA target sequence
agtcttaaaccgcaaaaaat

SEQ ID NO: 181870 - DNA, 20 bp, Artificial sequence
  SiRNA target sequence
gtcttaaaccgcaaaaaatc

SEQ ID NO: 181871 - DNA, 20 bp, Artificial sequence
  SiRNA target sequence
tcttaaaccgcaaaaaatca

SEQ ID NO: 181872 - DNA, 20 bp, Artificial sequence
  SiRNA target sequence
cttaaaccgcaaaaaatcat

SEQ ID NO: 181873 - DNA, 20 bp, Artificial sequence
  SiRNA target sequence
ttaaaccgcaaaaaatcata

SEQ ID NO: 181874 - DNA, 20 bp, Artificial sequence
  SiRNA target sequence
taaaccgcaaaaaatcatac

SEQ ID NO: 181875 - DNA, 20 bp, Artificial sequence
  SiRNA target sequence
aaaccgcaaaaaatcatacc

SEQ ID NO: 181876 - DNA, 20 bp, Artificial sequence
  SiRNA target sequence
aaccgcaaaaaatcataccg

SEQ ID NO: 181877 - DNA, 20 bp, Artificial sequence
  SiRNA target sequence
accgcaaaaaatcataccga

SEQ ID NO: 181878 - DNA, 20 bp, Artificial sequence
  SiRNA target sequence
ccgcaaaaaatcataccgaa

SEQ ID NO: 181879 - DNA, 20 bp, Artificial sequence
  SiRNA target sequence
cgcaaaaaatcataccgaaa

SEQ ID NO: 181880 - DNA, 20 bp, Artificial sequence
  SiRNA target sequence
gcaaaaaatcataccgaaat

SEQ ID NO: 181881 - DNA, 20 bp, Artificial sequence
  SiRNA target sequence
caaaaaatcataccgaaata

SEQ ID NO: 181882 - DNA, 20 bp, Artificial sequence
  SiRNA target sequence
aaaaaatcataccgaaatac

SEQ ID NO: 181883 - DNA, 20 bp, Artificial sequence
  SiRNA target sequence
aaaaatcataccgaaataca

SEQ ID NO: 181884 - DNA, 20 bp, Artificial sequence
  SiRNA target sequence
aaaatcataccgaaatacaa

SEQ ID NO: 181885 - DNA, 20 bp, Artificial sequence
  SiRNA target sequence
aaatcataccgaaatacaaa

SEQ ID NO: 181886 - DNA, 20 bp, Artificial sequence
  SiRNA target sequence
aatcataccgaaatacaaag

SEQ ID NO: 181887 - DNA, 20 bp, Artificial sequence
  SiRNA target sequence
atcataccgaaatacaaagg

SEQ ID NO: 181888 - DNA, 20 bp, Artificial sequence
  SiRNA target sequence
tcataccgaaatacaaagga

SEQ ID NO: 181889 - DNA, 20 bp, Artificial sequence
  SiRNA target sequence
cataccgaaatacaaaggaa

SEQ ID NO: 181890 - DNA, 20 bp, Artificial sequence
  SiRNA target sequence
ataccgaaatacaaaggaac

SEQ ID NO: 181891 - DNA, 20 bp, Artificial sequence
  SiRNA target sequence
taccgaaatacaaaggaaca

SEQ ID NO: 181892 - DNA, 20 bp, Artificial sequence
  SiRNA target sequence
accgaaatacaaaggaacag

SEQ ID NO: 181893 - DNA, 20 bp, Artificial sequence
  SiRNA target sequence
ccgaaatacaaaggaacagt

SEQ ID NO: 181894 - DNA, 20 bp, Artificial sequence
  SiRNA target sequence
cgaaatacaaaggaacagtt

SEQ ID NO: 181895 - DNA, 20 bp, Artificial sequence
  SiRNA target sequence
gaaatacaaaggaacagtta

SEQ ID NO: 181896 - DNA, 20 bp, Artificial sequence
  SiRNA target sequence
aaatacaaaggaacagttag

SEQ ID NO: 181897 - DNA, 20 bp, Artificial sequence
  SiRNA target sequence
aatacaaaggaacagttaga

SEQ ID NO: 181898 - DNA, 20 bp, Artificial sequence
  SiRNA target sequence
atacaaaggaacagttagag

SEQ ID NO: 181899 - DNA, 20 bp, Artificial sequence
  SiRNA target sequence
tacaaaggaacagttagaga

SEQ ID NO: 181900 - DNA, 20 bp, Artificial sequence
  SiRNA target sequence
acaaaggaacagttagagat

SEQ ID NO: 181901 - DNA, 20 bp, Artificial sequence
  SiRNA target sequence
caaaggaacagttagagatc

SEQ ID NO: 181902 - DNA, 20 bp, Artificial sequence
  SiRNA target sequence
aaaggaacagttagagatct

SEQ ID NO: 181903 - DNA, 20 bp, Artificial sequence
  SiRNA target sequence
aaggaacagttagagatctt

SEQ ID NO: 181904 - DNA, 20 bp, Artificial sequence
  SiRNA target sequence
aggaacagttagagatcttt

SEQ ID NO: 181905 - DNA, 20 bp, Artificial sequence
  SiRNA target sequence
ggaacagttagagatctttt

SEQ ID NO: 181906 - DNA, 20 bp, Artificial sequence
  SiRNA target sequence
gaacagttagagatcttttt

SEQ ID NO: 181907 - DNA, 20 bp, Artificial sequence
  SiRNA target sequence
aacagttagagatcttttta

SEQ ID NO: 181908 - DNA, 20 bp, Artificial sequence
  SiRNA target sequence
acagttagagatctttttat

SEQ ID NO: 181909 - DNA, 20 bp, Artificial sequence
  SiRNA target sequence
cagttagagatctttttatg

SEQ ID NO: 181910 - DNA, 20 bp, Artificial sequence
  SiRNA target sequence
agttagagatctttttatgt

SEQ ID NO: 181911 - DNA, 20 bp, Artificial sequence
  SiRNA target sequence
gttagagatctttttatgtc

SEQ ID NO: 181912 - DNA, 20 bp, Artificial sequence
  SiRNA target sequence
ttagagatctttttatgtca

SEQ ID NO: 181913 - DNA, 20 bp, Artificial sequence
  SiRNA target sequence
tagagatctttttatgtcaa

SEQ ID NO: 181914 - DNA, 20 bp, Artificial sequence
  SiRNA target sequence
agagatctttttatgtcaaa

SEQ ID NO: 181915 - DNA, 20 bp, Artificial sequence
  SiRNA target sequence
gagatctttttatgtcaaaa

SEQ ID NO: 181916 - DNA, 20 bp, Artificial sequence
  SiRNA target sequence
agatctttttatgtcaaaaa

SEQ ID NO: 181917 - DNA, 20 bp, Artificial sequence
  SiRNA target sequence
gatctttttatgtcaaaaat

SEQ ID NO: 181918 - DNA, 20 bp, Artificial sequence
  SiRNA target sequence
atctttttatgtcaaaaatt

SEQ ID NO: 181919 - DNA, 20 bp, Artificial sequence
  SiRNA target sequence
tctttttatgtcaaaaattc

SEQ ID NO: 181920 - DNA, 20 bp, Artificial sequence
  SiRNA target sequence
ctttttatgtcaaaaattcg

SEQ ID NO: 181921 - DNA, 20 bp, Artificial sequence
  SiRNA target sequence
tttttatgtcaaaaattcgt

SEQ ID NO: 181922 - DNA, 20 bp, Artificial sequence
  SiRNA target sequence
ttttatgtcaaaaattcgtt

SEQ ID NO: 181923 - DNA, 20 bp, Artificial sequence
  SiRNA target sequence
tttatgtcaaaaattcgttc

SEQ ID NO: 181924 - DNA, 20 bp, Artificial sequence
  SiRNA target sequence
ttatgtcaaaaattcgttct

SEQ ID NO: 181925 - DNA, 20 bp, Artificial sequence
  SiRNA target sequence
tatgtcaaaaattcgttctt

SEQ ID NO: 181926 - DNA, 20 bp, Artificial sequence
  SiRNA target sequence
atgtcaaaaattcgttcttc

SEQ ID NO: 181927 - DNA, 20 bp, Artificial sequence
  SiRNA target sequence
tgtcaaaaattcgttcttcc

SEQ ID NO: 181928 - DNA, 20 bp, Artificial sequence
  SiRNA target sequence
gtcaaaaattcgttcttcct

SEQ ID NO: 181929 - DNA, 20 bp, Artificial sequence
  SiRNA target sequence
tcaaaaattcgttcttcctt

SEQ ID NO: 181930 - DNA, 20 bp, Artificial sequence
  SiRNA target sequence
caaaaattcgttcttccttt

SEQ ID NO: 181931 - DNA, 20 bp, Artificial sequence
  SiRNA target sequence
aaaaattcgttcttcctttt

SEQ ID NO: 181932 - DNA, 20 bp, Artificial sequence
  SiRNA target sequence
aaaattcgttcttccttttt

SEQ ID NO: 181933 - DNA, 20 bp, Artificial sequence
  SiRNA target sequence
aaattcgttcttccttttta

SEQ ID NO: 181934 - DNA, 20 bp, Artificial sequence
  SiRNA target sequence
aattcgttcttcctttttag

SEQ ID NO: 181935 - DNA, 20 bp, Artificial sequence
  SiRNA target sequence
attcgttcttcctttttaga

SEQ ID NO: 181936 - DNA, 20 bp, Artificial sequence
  SiRNA target sequence
ttcgttcttcctttttagac

SEQ ID NO: 181937 - DNA, 20 bp, Artificial sequence
  SiRNA target sequence
tcgttcttcctttttagacg

SEQ ID NO: 181938 - DNA, 20 bp, Artificial sequence
  SiRNA target sequence
cgttcttcctttttagacgc

SEQ ID NO: 181939 - DNA, 20 bp, Artificial sequence
  SiRNA target sequence
gttcttcctttttagacgct

SEQ ID NO: 181940 - DNA, 20 bp, Artificial sequence
  SiRNA target sequence
ttcttcctttttagacgcta

SEQ ID NO: 181941 - DNA, 20 bp, Artificial sequence
  SiRNA target sequence
tcttcctttttagacgctaa

SEQ ID NO: 181942 - DNA, 20 bp, Artificial sequence
  SiRNA target sequence
cttcctttttagacgctaat

SEQ ID NO: 181943 - DNA, 20 bp, Artificial sequence
  SiRNA target sequence
ttcctttttagacgctaatt

SEQ ID NO: 181944 - DNA, 20 bp, Artificial sequence
  SiRNA target sequence
tcctttttagacgctaattt

SEQ ID NO: 181945 - DNA, 20 bp, Artificial sequence
  SiRNA target sequence
cctttttagacgctaatttt

SEQ ID NO: 181946 - DNA, 20 bp, Artificial sequence
  SiRNA target sequence
ctttttagacgctaattttg

SEQ ID NO: 181947 - DNA, 20 bp, Artificial sequence
  SiRNA target sequence
tttttagacgctaattttgt

SEQ ID NO: 181948 - DNA, 20 bp, Artificial sequence
  SiRNA target sequence
ttttagacgctaattttgtt

SEQ ID NO: 181949 - DNA, 20 bp, Artificial sequence
  SiRNA target sequence
tttagacgctaattttgtta

SEQ ID NO: 181950 - DNA, 20 bp, Artificial sequence
  SiRNA target sequence
ttagacgctaattttgttaa

SEQ ID NO: 181951 - DNA, 20 bp, Artificial sequence
  SiRNA target sequence
tagacgctaattttgttaat

SEQ ID NO: 181952 - DNA, 20 bp, Artificial sequence
  SiRNA target sequence
agacgctaattttgttaatg

SEQ ID NO: 181953 - DNA, 20 bp, Artificial sequence
  SiRNA target sequence
gacgctaattttgttaatga

SEQ ID NO: 181954 - DNA, 20 bp, Artificial sequence
  SiRNA target sequence
acgctaattttgttaatgaa

SEQ ID NO: 181955 - DNA, 20 bp, Artificial sequence
  SiRNA target sequence
cgctaattttgttaatgaag

SEQ ID NO: 181956 - DNA, 20 bp, Artificial sequence
  SiRNA target sequence
gctaattttgttaatgaagc

SEQ ID NO: 181957 - DNA, 20 bp, Artificial sequence
  SiRNA target sequence
ctaattttgttaatgaagct

SEQ ID NO: 181958 - DNA, 20 bp, Artificial sequence
  SiRNA target sequence
taattttgttaatgaagcta

SEQ ID NO: 181959 - DNA, 20 bp, Artificial sequence
  SiRNA target sequence
aattttgttaatgaagctat

SEQ ID NO: 181960 - DNA, 20 bp, Artificial sequence
  SiRNA target sequence
attttgttaatgaagctatt

SEQ ID NO: 181961 - DNA, 20 bp, Artificial sequence
  SiRNA target sequence
ttttgttaatgaagctatta

SEQ ID NO: 181962 - DNA, 20 bp, Artificial sequence
  SiRNA target sequence
tttgttaatgaagctattaa

SEQ ID NO: 181963 - DNA, 20 bp, Artificial sequence
  SiRNA target sequence
ttgttaatgaagctattaaa

SEQ ID NO: 181964 - DNA, 20 bp, Artificial sequence
  SiRNA target sequence
tgttaatgaagctattaaac

SEQ ID NO: 181965 - DNA, 20 bp, Artificial sequence
  SiRNA target sequence
gttaatgaagctattaaacc

SEQ ID NO: 181966 - DNA, 20 bp, Artificial sequence
  SiRNA target sequence
ttaatgaagctattaaacct

SEQ ID NO: 181967 - DNA, 20 bp, Artificial sequence
  SiRNA target sequence
taatgaagctattaaacctt

SEQ ID NO: 181968 - DNA, 20 bp, Artificial sequence
  SiRNA target sequence
aatgaagctattaaaccttt

SEQ ID NO: 181969 - DNA, 20 bp, Artificial sequence
  SiRNA target sequence
atgaagctattaaaccttta

SEQ ID NO: 181970 - DNA, 20 bp, Artificial sequence
  SiRNA target sequence
tgaagctattaaacctttag

SEQ ID NO: 181971 - DNA, 20 bp, Artificial sequence
  SiRNA target sequence
gaagctattaaacctttaga

SEQ ID NO: 181972 - DNA, 20 bp, Artificial sequence
  SiRNA target sequence
aagctattaaacctttagat

SEQ ID NO: 181973 - DNA, 20 bp, Artificial sequence
  SiRNA target sequence
agctattaaacctttagata

SEQ ID NO: 181974 - DNA, 20 bp, Artificial sequence
  SiRNA target sequence
gctattaaacctttagatat

SEQ ID NO: 181975 - DNA, 20 bp, Artificial sequence
  SiRNA target sequence
ctattaaacctttagatatt

SEQ ID NO: 181976 - DNA, 20 bp, Artificial sequence
  SiRNA target sequence
tattaaacctttagatattc

SEQ ID NO: 181977 - DNA, 20 bp, Artificial sequence
  SiRNA target sequence
attaaacctttagatattca

SEQ ID NO: 181978 - DNA, 20 bp, Artificial sequence
  SiRNA target sequence
ttaaacctttagatattcat

SEQ ID NO: 181979 - DNA, 20 bp, Artificial sequence
  SiRNA target sequence
taaacctttagatattcatc

SEQ ID NO: 181980 - DNA, 20 bp, Artificial sequence
  SiRNA target sequence
aaacctttagatattcatca

SEQ ID NO: 181981 - DNA, 20 bp, Artificial sequence
  SiRNA target sequence
aacctttagatattcatcat

SEQ ID NO: 181982 - DNA, 20 bp, Artificial sequence
  SiRNA target sequence
acctttagatattcatcatt

SEQ ID NO: 181983 - DNA, 20 bp, Artificial sequence
  SiRNA target sequence
cctttagatattcatcattt

SEQ ID NO: 181984 - DNA, 20 bp, Artificial sequence
  SiRNA target sequence
ctttagatattcatcattta

SEQ ID NO: 181985 - DNA, 20 bp, Artificial sequence
  SiRNA target sequence
tttagatattcatcatttat

SEQ ID NO: 181986 - DNA, 20 bp, Artificial sequence
  SiRNA target sequence
ttagatattcatcatttata

SEQ ID NO: 181987 - DNA, 20 bp, Artificial sequence
  SiRNA target sequence
tagatattcatcatttatac

SEQ ID NO: 181988 - DNA, 20 bp, Artificial sequence
  SiRNA target sequence
agatattcatcatttatacg

SEQ ID NO: 181989 - DNA, 20 bp, Artificial sequence
  SiRNA target sequence
gatattcatcatttatacga

SEQ ID NO: 181990 - DNA, 20 bp, Artificial sequence
  SiRNA target sequence
atattcatcatttatacgac

SEQ ID NO: 181991 - DNA, 20 bp, Artificial sequence
  SiRNA target sequence
tattcatcatttatacgacc

SEQ ID NO: 181992 - DNA, 20 bp, Artificial sequence
  SiRNA target sequence
attcatcatttatacgacca

SEQ ID NO: 181993 - DNA, 20 bp, Artificial sequence
  SiRNA target sequence
ttcatcatttatacgaccaa

SEQ ID NO: 181994 - DNA, 20 bp, Artificial sequence
  SiRNA target sequence
tcatcatttatacgaccaac

SEQ ID NO: 181995 - DNA, 20 bp, Artificial sequence
  SiRNA target sequence
catcatttatacgaccaact

SEQ ID NO: 181996 - DNA, 20 bp, Artificial sequence
  SiRNA target sequence
atcatttatacgaccaactt

SEQ ID NO: 181997 - DNA, 20 bp, Artificial sequence
  SiRNA target sequence
tcatttatacgaccaacttg

SEQ ID NO: 181998 - DNA, 20 bp, Artificial sequence
  SiRNA target sequence
catttatacgaccaacttgt

SEQ ID NO: 181999 - DNA, 20 bp, Artificial sequence
  SiRNA target sequence
atttatacgaccaacttgta

SEQ ID NO: 182000 - DNA, 20 bp, Artificial sequence
  SiRNA target sequence
tttatacgaccaacttgtag

SEQ ID NO: 182001 - DNA, 20 bp, Artificial sequence
  SiRNA target sequence
ttatacgaccaacttgtaga

SEQ ID NO: 182002 - DNA, 20 bp, Artificial sequence
  SiRNA target sequence
tatacgaccaacttgtagaa

SEQ ID NO: 182003 - DNA, 20 bp, Artificial sequence
  SiRNA target sequence
atacgaccaacttgtagaaa

SEQ ID NO: 182004 - DNA, 20 bp, Artificial sequence
  SiRNA target sequence
tacgaccaacttgtagaaaa

SEQ ID NO: 182005 - DNA, 20 bp, Artificial sequence
  SiRNA target sequence
acgaccaacttgtagaaaac

SEQ ID NO: 182006 - DNA, 20 bp, Artificial sequence
  SiRNA target sequence
cgaccaacttgtagaaaact

SEQ ID NO: 182007 - DNA, 20 bp, Artificial sequence
  SiRNA target sequence
gaccaacttgtagaaaactt

SEQ ID NO: 182008 - DNA, 20 bp, Artificial sequence
  SiRNA target sequence
accaacttgtagaaaacttg

SEQ ID NO: 182009 - DNA, 20 bp, Artificial sequence
  SiRNA target sequence
ccaacttgtagaaaacttga

SEQ ID NO: 182010 - DNA, 20 bp, Artificial sequence
  SiRNA target sequence
caacttgtagaaaacttgag

SEQ ID NO: 182011 - DNA, 20 bp, Artificial sequence
  SiRNA target sequence
aacttgtagaaaacttgagt

SEQ ID NO: 182012 - DNA, 20 bp, Artificial sequence
  SiRNA target sequence
acttgtagaaaacttgagtg

SEQ ID NO: 182013 - DNA, 20 bp, Artificial sequence
  SiRNA target sequence
cttgtagaaaacttgagtgg

SEQ ID NO: 182014 - DNA, 20 bp, Artificial sequence
  SiRNA target sequence
ttgtagaaaacttgagtggt

SEQ ID NO: 182015 - DNA, 20 bp, Artificial sequence
  SiRNA target sequence
tgtagaaaacttgagtggtg

SEQ ID NO: 182016 - DNA, 20 bp, Artificial sequence
  SiRNA target sequence
gtagaaaacttgagtggtgg

SEQ ID NO: 182017 - DNA, 20 bp, Artificial sequence
  SiRNA target sequence
tagaaaacttgagtggtgga

SEQ ID NO: 182018 - DNA, 20 bp, Artificial sequence
  SiRNA target sequence
agaaaacttgagtggtggag

SEQ ID NO: 182019 - DNA, 20 bp, Artificial sequence
  SiRNA target sequence
gaaaacttgagtggtggaga

SEQ ID NO: 182020 - DNA, 20 bp, Artificial sequence
  SiRNA target sequence
aaaacttgagtggtggagaa

SEQ ID NO: 182021 - DNA, 20 bp, Artificial sequence
  SiRNA target sequence
aaacttgagtggtggagaat

SEQ ID NO: 182022 - DNA, 20 bp, Artificial sequence
  SiRNA target sequence
aacttgagtggtggagaatt

SEQ ID NO: 182023 - DNA, 20 bp, Artificial sequence
  SiRNA target sequence
acttgagtggtggagaatta

SEQ ID NO: 182024 - DNA, 20 bp, Artificial sequence
  SiRNA target sequence
cttgagtggtggagaattac

SEQ ID NO: 182025 - DNA, 20 bp, Artificial sequence
  SiRNA target sequence
ttgagtggtggagaattaca

SEQ ID NO: 182026 - DNA, 20 bp, Artificial sequence
  SiRNA target sequence
tgagtggtggagaattacaa

SEQ ID NO: 182027 - DNA, 20 bp, Artificial sequence
  SiRNA target sequence
gagtggtggagaattacaaa

SEQ ID NO: 182028 - DNA, 20 bp, Artificial sequence
  SiRNA target sequence
agtggtggagaattacaaag

SEQ ID NO: 182029 - DNA, 20 bp, Artificial sequence
  SiRNA target sequence
gtggtggagaattacaaaga

SEQ ID NO: 182030 - DNA, 20 bp, Artificial sequence
  SiRNA target sequence
tggtggagaattacaaagaa

SEQ ID NO: 182031 - DNA, 20 bp, Artificial sequence
  SiRNA target sequence
ggtggagaattacaaagaat

SEQ ID NO: 182032 - DNA, 20 bp, Artificial sequence
  SiRNA target sequence
gtggagaattacaaagaatt

SEQ ID NO: 182033 - DNA, 20 bp, Artificial sequence
  SiRNA target sequence
tggagaattacaaagaattg

SEQ ID NO: 182034 - DNA, 20 bp, Artificial sequence
  SiRNA target sequence
ggagaattacaaagaattgc

SEQ ID NO: 182035 - DNA, 20 bp, Artificial sequence
  SiRNA target sequence
gagaattacaaagaattgca

SEQ ID NO: 182036 - DNA, 20 bp, Artificial sequence
  SiRNA target sequence
agaattacaaagaattgcaa

SEQ ID NO: 182037 - DNA, 20 bp, Artificial sequence
  SiRNA target sequence
gaattacaaagaattgcaat

SEQ ID NO: 182038 - DNA, 20 bp, Artificial sequence
  SiRNA target sequence
aattacaaagaattgcaata

SEQ ID NO: 182039 - DNA, 20 bp, Artificial sequence
  SiRNA target sequence
attacaaagaattgcaataa

SEQ ID NO: 182040 - DNA, 20 bp, Artificial sequence
  SiRNA target sequence
ttacaaagaattgcaataat

SEQ ID NO: 182041 - DNA, 20 bp, Artificial sequence
  SiRNA target sequence
tacaaagaattgcaataata

SEQ ID NO: 182042 - DNA, 20 bp, Artificial sequence
  SiRNA target sequence
acaaagaattgcaataataa

SEQ ID NO: 182043 - DNA, 20 bp, Artificial sequence
  SiRNA target sequence
caaagaattgcaataataat

SEQ ID NO: 182044 - DNA, 20 bp, Artificial sequence
  SiRNA target sequence
aaagaattgcaataataata

SEQ ID NO: 182045 - DNA, 20 bp, Artificial sequence
  SiRNA target sequence
aagaattgcaataataatat

SEQ ID NO: 182046 - DNA, 20 bp, Artificial sequence
  SiRNA target sequence
agaattgcaataataatatg

SEQ ID NO: 182047 - DNA, 20 bp, Artificial sequence
  SiRNA target sequence
gaattgcaataataatatgt

SEQ ID NO: 182048 - DNA, 20 bp, Artificial sequence
  SiRNA target sequence
aattgcaataataatatgtt

SEQ ID NO: 182049 - DNA, 20 bp, Artificial sequence
  SiRNA target sequence
attgcaataataatatgttt

SEQ ID NO: 182050 - DNA, 20 bp, Artificial sequence
  SiRNA target sequence
ttgcaataataatatgttta

SEQ ID NO: 182051 - DNA, 20 bp, Artificial sequence
  SiRNA target sequence
tgcaataataatatgtttag

SEQ ID NO: 182052 - DNA, 20 bp, Artificial sequence
  SiRNA target sequence
gcaataataatatgtttagg

SEQ ID NO: 182053 - DNA, 20 bp, Artificial sequence
  SiRNA target sequence
caataataatatgtttagga

SEQ ID NO: 182054 - DNA, 20 bp, Artificial sequence
  SiRNA target sequence
aataataatatgtttaggaa

SEQ ID NO: 182055 - DNA, 20 bp, Artificial sequence
  SiRNA target sequence
ataataatatgtttaggaaa

SEQ ID NO: 182056 - DNA, 20 bp, Artificial sequence
  SiRNA target sequence
taataatatgtttaggaaaa

SEQ ID NO: 182057 - DNA, 20 bp, Artificial sequence
  SiRNA target sequence
aataatatgtttaggaaaag

SEQ ID NO: 182058 - DNA, 20 bp, Artificial sequence
  SiRNA target sequence
ataatatgtttaggaaaaga

SEQ ID NO: 182059 - DNA, 20 bp, Artificial sequence
  SiRNA target sequence
taatatgtttaggaaaagat

SEQ ID NO: 182060 - DNA, 20 bp, Artificial sequence
  SiRNA target sequence
aatatgtttaggaaaagatg

SEQ ID NO: 182061 - DNA, 20 bp, Artificial sequence
  SiRNA target sequence
atatgtttaggaaaagatgc

SEQ ID NO: 182062 - DNA, 20 bp, Artificial sequence
  SiRNA target sequence
tatgtttaggaaaagatgct

SEQ ID NO: 182063 - DNA, 20 bp, Artificial sequence
  SiRNA target sequence
atgtttaggaaaagatgcta

SEQ ID NO: 182064 - DNA, 20 bp, Artificial sequence
  SiRNA target sequence
tgtttaggaaaagatgctaa

SEQ ID NO: 182065 - DNA, 20 bp, Artificial sequence
  SiRNA target sequence
gtttaggaaaagatgctaac

SEQ ID NO: 182066 - DNA, 20 bp, Artificial sequence
  SiRNA target sequence
tttaggaaaagatgctaacc

SEQ ID NO: 182067 - DNA, 20 bp, Artificial sequence
  SiRNA target sequence
ttaggaaaagatgctaacct

SEQ ID NO: 182068 - DNA, 20 bp, Artificial sequence
  SiRNA target sequence
taggaaaagatgctaacctt

SEQ ID NO: 182069 - DNA, 20 bp, Artificial sequence
  SiRNA target sequence
aggaaaagatgctaaccttt

SEQ ID NO: 182070 - DNA, 20 bp, Artificial sequence
  SiRNA target sequence
ggaaaagatgctaaccttta

SEQ ID NO: 182071 - DNA, 20 bp, Artificial sequence
  SiRNA target sequence
gaaaagatgctaacctttat

SEQ ID NO: 182072 - DNA, 20 bp, Artificial sequence
  SiRNA target sequence
aaaagatgctaacctttatt

SEQ ID NO: 182073 - DNA, 20 bp, Artificial sequence
  SiRNA target sequence
aaagatgctaacctttattt

SEQ ID NO: 182074 - DNA, 20 bp, Artificial sequence
  SiRNA target sequence
aagatgctaacctttattta

SEQ ID NO: 182075 - DNA, 20 bp, Artificial sequence
  SiRNA target sequence
agatgctaacctttatttat

SEQ ID NO: 182076 - DNA, 20 bp, Artificial sequence
  SiRNA target sequence
gatgctaacctttatttatt

SEQ ID NO: 182077 - DNA, 20 bp, Artificial sequence
  SiRNA target sequence
atgctaacctttatttatta

SEQ ID NO: 182078 - DNA, 20 bp, Artificial sequence
  SiRNA target sequence
tgctaacctttatttattag

SEQ ID NO: 182079 - DNA, 20 bp, Artificial sequence
  SiRNA target sequence
gctaacctttatttattaga

SEQ ID NO: 182080 - DNA, 20 bp, Artificial sequence
  SiRNA target sequence
ctaacctttatttattagat

SEQ ID NO: 182081 - DNA, 20 bp, Artificial sequence
  SiRNA target sequence
taacctttatttattagatg

SEQ ID NO: 182082 - DNA, 20 bp, Artificial sequence
  SiRNA target sequence
aacctttatttattagatga

SEQ ID NO: 182083 - DNA, 20 bp, Artificial sequence
  SiRNA target sequence
acctttatttattagatgaa

SEQ ID NO: 182084 - DNA, 20 bp, Artificial sequence
  SiRNA target sequence
cctttatttattagatgaac

SEQ ID NO: 182085 - DNA, 20 bp, Artificial sequence
  SiRNA target sequence
ctttatttattagatgaacc

SEQ ID NO: 182086 - DNA, 20 bp, Artificial sequence
  SiRNA target sequence
tttatttattagatgaacct

SEQ ID NO: 182087 - DNA, 20 bp, Artificial sequence
  SiRNA target sequence
ttatttattagatgaacctt

SEQ ID NO: 182088 - DNA, 20 bp, Artificial sequence
  SiRNA target sequence
tatttattagatgaaccttc

SEQ ID NO: 182089 - DNA, 20 bp, Artificial sequence
  SiRNA target sequence
atttattagatgaaccttct

SEQ ID NO: 182090 - DNA, 20 bp, Artificial sequence
  SiRNA target sequence
tttattagatgaaccttctg

SEQ ID NO: 182091 - DNA, 20 bp, Artificial sequence
  SiRNA target sequence
ttattagatgaaccttctgc

SEQ ID NO: 182092 - DNA, 20 bp, Artificial sequence
  SiRNA target sequence
tattagatgaaccttctgcg

SEQ ID NO: 182093 - DNA, 20 bp, Artificial sequence
  SiRNA target sequence
attagatgaaccttctgcgt

SEQ ID NO: 182094 - DNA, 20 bp, Artificial sequence
  SiRNA target sequence
ttagatgaaccttctgcgta

SEQ ID NO: 182095 - DNA, 20 bp, Artificial sequence
  SiRNA target sequence
tagatgaaccttctgcgtat

SEQ ID NO: 182096 - DNA, 20 bp, Artificial sequence
  SiRNA target sequence
agatgaaccttctgcgtatc

SEQ ID NO: 182097 - DNA, 20 bp, Artificial sequence
  SiRNA target sequence
gatgaaccttctgcgtatct

SEQ ID NO: 182098 - DNA, 20 bp, Artificial sequence
  SiRNA target sequence
atgaaccttctgcgtatcta

SEQ ID NO: 182099 - DNA, 20 bp, Artificial sequence
  SiRNA target sequence
tgaaccttctgcgtatctag

SEQ ID NO: 182100 - DNA, 20 bp, Artificial sequence
  SiRNA target sequence
gaaccttctgcgtatctaga

SEQ ID NO: 182101 - DNA, 20 bp, Artificial sequence
  SiRNA target sequence
aaccttctgcgtatctagat

SEQ ID NO: 182102 - DNA, 20 bp, Artificial sequence
  SiRNA target sequence
accttctgcgtatctagatt

SEQ ID NO: 182103 - DNA, 20 bp, Artificial sequence
  SiRNA target sequence
ccttctgcgtatctagattc

SEQ ID NO: 182104 - DNA, 20 bp, Artificial sequence
  SiRNA target sequence
cttctgcgtatctagattca

SEQ ID NO: 182105 - DNA, 20 bp, Artificial sequence
  SiRNA target sequence
ttctgcgtatctagattcag

SEQ ID NO: 182106 - DNA, 20 bp, Artificial sequence
  SiRNA target sequence
tctgcgtatctagattcaga

SEQ ID NO: 182107 - DNA, 20 bp, Artificial sequence
  SiRNA target sequence
ctgcgtatctagattcagat

SEQ ID NO: 182108 - DNA, 20 bp, Artificial sequence
  SiRNA target sequence
tgcgtatctagattcagatc

SEQ ID NO: 182109 - DNA, 20 bp, Artificial sequence
  SiRNA target sequence
gcgtatctagattcagatca

SEQ ID NO: 182110 - DNA, 20 bp, Artificial sequence
  SiRNA target sequence
cgtatctagattcagatcag

SEQ ID NO: 182111 - DNA, 20 bp, Artificial sequence
  SiRNA target sequence
gtatctagattcagatcaga

SEQ ID NO: 182112 - DNA, 20 bp, Artificial sequence
  SiRNA target sequence
tatctagattcagatcagag

SEQ ID NO: 182113 - DNA, 20 bp, Artificial sequence
  SiRNA target sequence
atctagattcagatcagaga

SEQ ID NO: 182114 - DNA, 20 bp, Artificial sequence
  SiRNA target sequence
tctagattcagatcagagaa

SEQ ID NO: 182115 - DNA, 20 bp, Artificial sequence
  SiRNA target sequence
ctagattcagatcagagaat

SEQ ID NO: 182116 - DNA, 20 bp, Artificial sequence
  SiRNA target sequence
tagattcagatcagagaata

SEQ ID NO: 182117 - DNA, 20 bp, Artificial sequence
  SiRNA target sequence
agattcagatcagagaatag

SEQ ID NO: 182118 - DNA, 20 bp, Artificial sequence
  SiRNA target sequence
gattcagatcagagaatagc

SEQ ID NO: 182119 - DNA, 20 bp, Artificial sequence
  SiRNA target sequence
attcagatcagagaatagcg

SEQ ID NO: 182120 - DNA, 20 bp, Artificial sequence
  SiRNA target sequence
ttcagatcagagaatagcga

SEQ ID NO: 182121 - DNA, 20 bp, Artificial sequence
  SiRNA target sequence
tcagatcagagaatagcgat

SEQ ID NO: 182122 - DNA, 20 bp, Artificial sequence
  SiRNA target sequence
cagatcagagaatagcgatt

SEQ ID NO: 182123 - DNA, 20 bp, Artificial sequence
  SiRNA target sequence
agatcagagaatagcgattt

SEQ ID NO: 182124 - DNA, 20 bp, Artificial sequence
  SiRNA target sequence
gatcagagaatagcgatttc

SEQ ID NO: 182125 - DNA, 20 bp, Artificial sequence
  SiRNA target sequence
atcagagaatagcgatttca

SEQ ID NO: 182126 - DNA, 20 bp, Artificial sequence
  SiRNA target sequence
tcagagaatagcgatttcaa

SEQ ID NO: 182127 - DNA, 20 bp, Artificial sequence
  SiRNA target sequence
cagagaatagcgatttcaaa

SEQ ID NO: 182128 - DNA, 20 bp, Artificial sequence
  SiRNA target sequence
agagaatagcgatttcaaaa

SEQ ID NO: 182129 - DNA, 20 bp, Artificial sequence
  SiRNA target sequence
gagaatagcgatttcaaaag

SEQ ID NO: 182130 - DNA, 20 bp, Artificial sequence
  SiRNA target sequence
agaatagcgatttcaaaagt

SEQ ID NO: 182131 - DNA, 20 bp, Artificial sequence
  SiRNA target sequence
gaatagcgatttcaaaagtt

SEQ ID NO: 182132 - DNA, 20 bp, Artificial sequence
  SiRNA target sequence
aatagcgatttcaaaagtta

SEQ ID NO: 182133 - DNA, 20 bp, Artificial sequence
  SiRNA target sequence
atagcgatttcaaaagttat

SEQ ID NO: 182134 - DNA, 20 bp, Artificial sequence
  SiRNA target sequence
tagcgatttcaaaagttata

SEQ ID NO: 182135 - DNA, 20 bp, Artificial sequence
  SiRNA target sequence
agcgatttcaaaagttataa

SEQ ID NO: 182136 - DNA, 20 bp, Artificial sequence
  SiRNA target sequence
gcgatttcaaaagttataaa

SEQ ID NO: 182137 - DNA, 20 bp, Artificial sequence
  SiRNA target sequence
cgatttcaaaagttataaaa

SEQ ID NO: 182138 - DNA, 20 bp, Artificial sequence
  SiRNA target sequence
gatttcaaaagttataaaaa

SEQ ID NO: 182139 - DNA, 20 bp, Artificial sequence
  SiRNA target sequence
atttcaaaagttataaaaag

SEQ ID NO: 182140 - DNA, 20 bp, Artificial sequence
  SiRNA target sequence
tttcaaaagttataaaaagg

SEQ ID NO: 182141 - DNA, 20 bp, Artificial sequence
  SiRNA target sequence
ttcaaaagttataaaaaggt

SEQ ID NO: 182142 - DNA, 20 bp, Artificial sequence
  SiRNA target sequence
tcaaaagttataaaaaggtt

SEQ ID NO: 182143 - DNA, 20 bp, Artificial sequence
  SiRNA target sequence
caaaagttataaaaaggttt

SEQ ID NO: 182144 - DNA, 20 bp, Artificial sequence
  SiRNA target sequence
aaaagttataaaaaggttta

SEQ ID NO: 182145 - DNA, 20 bp, Artificial sequence
  SiRNA target sequence
aaagttataaaaaggtttat

SEQ ID NO: 182146 - DNA, 20 bp, Artificial sequence
  SiRNA target sequence
aagttataaaaaggtttatt

SEQ ID NO: 182147 - DNA, 20 bp, Artificial sequence
  SiRNA target sequence
agttataaaaaggtttattt

SEQ ID NO: 182148 - DNA, 20 bp, Artificial sequence
  SiRNA target sequence
gttataaaaaggtttattta

SEQ ID NO: 182149 - DNA, 20 bp, Artificial sequence
  SiRNA target sequence
ttataaaaaggtttatttat

SEQ ID NO: 182150 - DNA, 20 bp, Artificial sequence
  SiRNA target sequence
tataaaaaggtttatttatg

SEQ ID NO: 182151 - DNA, 20 bp, Artificial sequence
  SiRNA target sequence
ataaaaaggtttatttatgg

SEQ ID NO: 182152 - DNA, 20 bp, Artificial sequence
  SiRNA target sequence
taaaaaggtttatttatggg

SEQ ID NO: 182153 - DNA, 20 bp, Artificial sequence
  SiRNA target sequence
aaaaaggtttatttatggga

SEQ ID NO: 182154 - DNA, 20 bp, Artificial sequence
  SiRNA target sequence
aaaaggtttatttatgggaa

SEQ ID NO: 182155 - DNA, 20 bp, Artificial sequence
  SiRNA target sequence
aaaggtttatttatgggaag

SEQ ID NO: 182156 - DNA, 20 bp, Artificial sequence
  SiRNA target sequence
aaggtttatttatgggaaga

SEQ ID NO: 182157 - DNA, 20 bp, Artificial sequence
  SiRNA target sequence
aggtttatttatgggaagaa

SEQ ID NO: 182158 - DNA, 20 bp, Artificial sequence
  SiRNA target sequence
ggtttatttatgggaagaag

SEQ ID NO: 182159 - DNA, 20 bp, Artificial sequence
  SiRNA target sequence
gtttatttatgggaagaagc

SEQ ID NO: 182160 - DNA, 20 bp, Artificial sequence
  SiRNA target sequence
tttatttatgggaagaagcg

SEQ ID NO: 182161 - DNA, 20 bp, Artificial sequence
  SiRNA target sequence
ttatttatgggaagaagcga

SEQ ID NO: 182162 - DNA, 20 bp, Artificial sequence
  SiRNA target sequence
tatttatgggaagaagcgaa

SEQ ID NO: 182163 - DNA, 20 bp, Artificial sequence
  SiRNA target sequence
atttatgggaagaagcgaac

SEQ ID NO: 182164 - DNA, 20 bp, Artificial sequence
  SiRNA target sequence
tttatgggaagaagcgaaca

SEQ ID NO: 182165 - DNA, 20 bp, Artificial sequence
  SiRNA target sequence
ttatgggaagaagcgaacag

SEQ ID NO: 182166 - DNA, 20 bp, Artificial sequence
  SiRNA target sequence
tatgggaagaagcgaacagc

SEQ ID NO: 182167 - DNA, 20 bp, Artificial sequence
  SiRNA target sequence
atgggaagaagcgaacagcc

SEQ ID NO: 182168 - DNA, 20 bp, Artificial sequence
  SiRNA target sequence
tgggaagaagcgaacagcct

SEQ ID NO: 182169 - DNA, 20 bp, Artificial sequence
  SiRNA target sequence
gggaagaagcgaacagcctt

SEQ ID NO: 182170 - DNA, 20 bp, Artificial sequence
  SiRNA target sequence
ggaagaagcgaacagccttt

SEQ ID NO: 182171 - DNA, 20 bp, Artificial sequence
  SiRNA target sequence
gaagaagcgaacagcctttg

SEQ ID NO: 182172 - DNA, 20 bp, Artificial sequence
  SiRNA target sequence
aagaagcgaacagcctttgt

SEQ ID NO: 182173 - DNA, 20 bp, Artificial sequence
  SiRNA target sequence
agaagcgaacagcctttgtg

SEQ ID NO: 182174 - DNA, 20 bp, Artificial sequence
  SiRNA target sequence
gaagcgaacagcctttgtgg

SEQ ID NO: 182175 - DNA, 20 bp, Artificial sequence
  SiRNA target sequence
aagcgaacagcctttgtggt

SEQ ID NO: 182176 - DNA, 20 bp, Artificial sequence
  SiRNA target sequence
agcgaacagcctttgtggtt

SEQ ID NO: 182177 - DNA, 20 bp, Artificial sequence
  SiRNA target sequence
gcgaacagcctttgtggttg

SEQ ID NO: 182178 - DNA, 20 bp, Artificial sequence
  SiRNA target sequence
cgaacagcctttgtggttga

SEQ ID NO: 182179 - DNA, 20 bp, Artificial sequence
  SiRNA target sequence
gaacagcctttgtggttgaa

SEQ ID NO: 182180 - DNA, 20 bp, Artificial sequence
  SiRNA target sequence
aacagcctttgtggttgaac

SEQ ID NO: 182181 - DNA, 20 bp, Artificial sequence
  SiRNA target sequence
acagcctttgtggttgaaca

SEQ ID NO: 182182 - DNA, 20 bp, Artificial sequence
  SiRNA target sequence
cagcctttgtggttgaacat

SEQ ID NO: 182183 - DNA, 20 bp, Artificial sequence
  SiRNA target sequence
agcctttgtggttgaacatg

SEQ ID NO: 182184 - DNA, 20 bp, Artificial sequence
  SiRNA target sequence
gcctttgtggttgaacatga

SEQ ID NO: 182185 - DNA, 20 bp, Artificial sequence
  SiRNA target sequence
cctttgtggttgaacatgat

SEQ ID NO: 182186 - DNA, 20 bp, Artificial sequence
  SiRNA target sequence
ctttgtggttgaacatgatt

SEQ ID NO: 182187 - DNA, 20 bp, Artificial sequence
  SiRNA target sequence
tttgtggttgaacatgattt

SEQ ID NO: 182188 - DNA, 20 bp, Artificial sequence
  SiRNA target sequence
ttgtggttgaacatgattta

SEQ ID NO: 182189 - DNA, 20 bp, Artificial sequence
  SiRNA target sequence
tgtggttgaacatgatttaa

SEQ ID NO: 182190 - DNA, 20 bp, Artificial sequence
  SiRNA target sequence
gtggttgaacatgatttaat

SEQ ID NO: 182191 - DNA, 20 bp, Artificial sequence
  SiRNA target sequence
tggttgaacatgatttaatt

SEQ ID NO: 182192 - DNA, 20 bp, Artificial sequence
  SiRNA target sequence
ggttgaacatgatttaattg

SEQ ID NO: 182193 - DNA, 20 bp, Artificial sequence
  SiRNA target sequence
gttgaacatgatttaattgt

SEQ ID NO: 182194 - DNA, 20 bp, Artificial sequence
  SiRNA target sequence
ttgaacatgatttaattgta

SEQ ID NO: 182195 - DNA, 20 bp, Artificial sequence
  SiRNA target sequence
tgaacatgatttaattgtag

SEQ ID NO: 182196 - DNA, 20 bp, Artificial sequence
  SiRNA target sequence
gaacatgatttaattgtagg

SEQ ID NO: 182197 - DNA, 20 bp, Artificial sequence
  SiRNA target sequence
aacatgatttaattgtaggt

SEQ ID NO: 182198 - DNA, 20 bp, Artificial sequence
  SiRNA target sequence
acatgatttaattgtaggta

SEQ ID NO: 182199 - DNA, 20 bp, Artificial sequence
  SiRNA target sequence
catgatttaattgtaggtac

SEQ ID NO: 182200 - DNA, 20 bp, Artificial sequence
  SiRNA target sequence
atgatttaattgtaggtaca

SEQ ID NO: 182201 - DNA, 20 bp, Artificial sequence
  SiRNA target sequence
tgatttaattgtaggtacat

SEQ ID NO: 182202 - DNA, 20 bp, Artificial sequence
  SiRNA target sequence
gatttaattgtaggtacata

SEQ ID NO: 182203 - DNA, 20 bp, Artificial sequence
  SiRNA target sequence
atttaattgtaggtacatat

SEQ ID NO: 182204 - DNA, 20 bp, Artificial sequence
  SiRNA target sequence
tttaattgtaggtacatatt

SEQ ID NO: 182205 - DNA, 20 bp, Artificial sequence
  SiRNA target sequence
ttaattgtaggtacatattt

SEQ ID NO: 182206 - DNA, 20 bp, Artificial sequence
  SiRNA target sequence
taattgtaggtacatatttg

SEQ ID NO: 182207 - DNA, 20 bp, Artificial sequence
  SiRNA target sequence
aattgtaggtacatatttgg

SEQ ID NO: 182208 - DNA, 20 bp, Artificial sequence
  SiRNA target sequence
attgtaggtacatatttggc

SEQ ID NO: 182209 - DNA, 20 bp, Artificial sequence
  SiRNA target sequence
ttgtaggtacatatttggct

SEQ ID NO: 182210 - DNA, 20 bp, Artificial sequence
  SiRNA target sequence
tgtaggtacatatttggctg

SEQ ID NO: 182211 - DNA, 20 bp, Artificial sequence
  SiRNA target sequence
gtaggtacatatttggctga

SEQ ID NO: 182212 - DNA, 20 bp, Artificial sequence
  SiRNA target sequence
taggtacatatttggctgat

SEQ ID NO: 182213 - DNA, 20 bp, Artificial sequence
  SiRNA target sequence
aggtacatatttggctgata

SEQ ID NO: 182214 - DNA, 20 bp, Artificial sequence
  SiRNA target sequence
ggtacatatttggctgataa

SEQ ID NO: 182215 - DNA, 20 bp, Artificial sequence
  SiRNA target sequence
gtacatatttggctgataaa

SEQ ID NO: 182216 - DNA, 20 bp, Artificial sequence
  SiRNA target sequence
tacatatttggctgataaag

SEQ ID NO: 182217 - DNA, 20 bp, Artificial sequence
  SiRNA target sequence
acatatttggctgataaagt

SEQ ID NO: 182218 - DNA, 20 bp, Artificial sequence
  SiRNA target sequence
catatttggctgataaagtt

SEQ ID NO: 182219 - DNA, 20 bp, Artificial sequence
  SiRNA target sequence
atatttggctgataaagttg

SEQ ID NO: 182220 - DNA, 20 bp, Artificial sequence
  SiRNA target sequence
tatttggctgataaagttgt

SEQ ID NO: 182221 - DNA, 20 bp, Artificial sequence
  SiRNA target sequence
atttggctgataaagttgtt

SEQ ID NO: 182222 - DNA, 20 bp, Artificial sequence
  SiRNA target sequence
tttggctgataaagttgttg

SEQ ID NO: 182223 - DNA, 20 bp, Artificial sequence
  SiRNA target sequence
ttggctgataaagttgttgt

SEQ ID NO: 182224 - DNA, 20 bp, Artificial sequence
  SiRNA target sequence
tggctgataaagttgttgtt

SEQ ID NO: 182225 - DNA, 20 bp, Artificial sequence
  SiRNA target sequence
ggctgataaagttgttgttt

SEQ ID NO: 182226 - DNA, 20 bp, Artificial sequence
  SiRNA target sequence
gctgataaagttgttgtttt

SEQ ID NO: 182227 - DNA, 20 bp, Artificial sequence
  SiRNA target sequence
ctgataaagttgttgttttt

SEQ ID NO: 182228 - DNA, 20 bp, Artificial sequence
  SiRNA target sequence
tgataaagttgttgtttttg

SEQ ID NO: 182229 - DNA, 20 bp, Artificial sequence
  SiRNA target sequence
gataaagttgttgtttttga

SEQ ID NO: 182230 - DNA, 20 bp, Artificial sequence
  SiRNA target sequence
ataaagttgttgtttttgag

SEQ ID NO: 182231 - DNA, 20 bp, Artificial sequence
  SiRNA target sequence
taaagttgttgtttttgagg

SEQ ID NO: 182232 - DNA, 20 bp, Artificial sequence
  SiRNA target sequence
aaagttgttgtttttgaggg

SEQ ID NO: 182233 - DNA, 20 bp, Artificial sequence
  SiRNA target sequence
aagttgttgtttttgaggga

SEQ ID NO: 182234 - DNA, 20 bp, Artificial sequence
  SiRNA target sequence
agttgttgtttttgagggaa

SEQ ID NO: 182235 - DNA, 20 bp, Artificial sequence
  SiRNA target sequence
gttgttgtttttgagggaag

SEQ ID NO: 182236 - DNA, 20 bp, Artificial sequence
  SiRNA target sequence
ttgttgtttttgagggaagc

SEQ ID NO: 182237 - DNA, 20 bp, Artificial sequence
  SiRNA target sequence
tgttgtttttgagggaagcc

SEQ ID NO: 182238 - DNA, 20 bp, Artificial sequence
  SiRNA target sequence
gttgtttttgagggaagccc

SEQ ID NO: 182239 - DNA, 20 bp, Artificial sequence
  SiRNA target sequence
ttgtttttgagggaagccct

SEQ ID NO: 182240 - DNA, 20 bp, Artificial sequence
  SiRNA target sequence
tgtttttgagggaagcccta

SEQ ID NO: 182241 - DNA, 20 bp, Artificial sequence
  SiRNA target sequence
gtttttgagggaagccctag

SEQ ID NO: 182242 - DNA, 20 bp, Artificial sequence
  SiRNA target sequence
tttttgagggaagccctagt

SEQ ID NO: 182243 - DNA, 20 bp, Artificial sequence
  SiRNA target sequence
ttttgagggaagccctagtg

SEQ ID NO: 182244 - DNA, 20 bp, Artificial sequence
  SiRNA target sequence
tttgagggaagccctagtgt

SEQ ID NO: 182245 - DNA, 20 bp, Artificial sequence
  SiRNA target sequence
ttgagggaagccctagtgtt

SEQ ID NO: 182246 - DNA, 20 bp, Artificial sequence
  SiRNA target sequence
tgagggaagccctagtgttc

SEQ ID NO: 182247 - DNA, 20 bp, Artificial sequence
  SiRNA target sequence
gagggaagccctagtgttca

SEQ ID NO: 182248 - DNA, 20 bp, Artificial sequence
  SiRNA target sequence
agggaagccctagtgttcat

SEQ ID NO: 182249 - DNA, 20 bp, Artificial sequence
  SiRNA target sequence
gggaagccctagtgttcata

SEQ ID NO: 182250 - DNA, 20 bp, Artificial sequence
  SiRNA target sequence
ggaagccctagtgttcatag

SEQ ID NO: 182251 - DNA, 20 bp, Artificial sequence
  SiRNA target sequence
gaagccctagtgttcatagc

SEQ ID NO: 182252 - DNA, 20 bp, Artificial sequence
  SiRNA target sequence
aagccctagtgttcatagca

SEQ ID NO: 182253 - DNA, 20 bp, Artificial sequence
  SiRNA target sequence
agccctagtgttcatagcac

SEQ ID NO: 182254 - DNA, 20 bp, Artificial sequence
  SiRNA target sequence
gccctagtgttcatagcact

SEQ ID NO: 182255 - DNA, 20 bp, Artificial sequence
  SiRNA target sequence
ccctagtgttcatagcactg

SEQ ID NO: 182256 - DNA, 20 bp, Artificial sequence
  SiRNA target sequence
cctagtgttcatagcactgc

SEQ ID NO: 182257 - DNA, 20 bp, Artificial sequence
  SiRNA target sequence
ctagtgttcatagcactgct

SEQ ID NO: 182258 - DNA, 20 bp, Artificial sequence
  SiRNA target sequence
tagtgttcatagcactgctc

SEQ ID NO: 182259 - DNA, 20 bp, Artificial sequence
  SiRNA target sequence
agtgttcatagcactgctca

SEQ ID NO: 182260 - DNA, 20 bp, Artificial sequence
  SiRNA target sequence
gtgttcatagcactgctcat

SEQ ID NO: 182261 - DNA, 20 bp, Artificial sequence
  SiRNA target sequence
tgttcatagcactgctcata

SEQ ID NO: 182262 - DNA, 20 bp, Artificial sequence
  SiRNA target sequence
gttcatagcactgctcataa

SEQ ID NO: 182263 - DNA, 20 bp, Artificial sequence
  SiRNA target sequence
ttcatagcactgctcataaa

SEQ ID NO: 182264 - DNA, 20 bp, Artificial sequence
  SiRNA target sequence
tcatagcactgctcataaac

SEQ ID NO: 182265 - DNA, 20 bp, Artificial sequence
  SiRNA target sequence
catagcactgctcataaacc

SEQ ID NO: 182266 - DNA, 20 bp, Artificial sequence
  SiRNA target sequence
atagcactgctcataaaccg

SEQ ID NO: 182267 - DNA, 20 bp, Artificial sequence
  SiRNA target sequence
tagcactgctcataaaccga

SEQ ID NO: 182268 - DNA, 20 bp, Artificial sequence
  SiRNA target sequence
agcactgctcataaaccgat

SEQ ID NO: 182269 - DNA, 20 bp, Artificial sequence
  SiRNA target sequence
gcactgctcataaaccgatg

SEQ ID NO: 182270 - DNA, 20 bp, Artificial sequence
  SiRNA target sequence
cactgctcataaaccgatgg

SEQ ID NO: 182271 - DNA, 20 bp, Artificial sequence
  SiRNA target sequence
actgctcataaaccgatgga

SEQ ID NO: 182272 - DNA, 20 bp, Artificial sequence
  SiRNA target sequence
ctgctcataaaccgatggat

SEQ ID NO: 182273 - DNA, 20 bp, Artificial sequence
  SiRNA target sequence
tgctcataaaccgatggatt

SEQ ID NO: 182274 - DNA, 20 bp, Artificial sequence
  SiRNA target sequence
gctcataaaccgatggattt

SEQ ID NO: 182275 - DNA, 20 bp, Artificial sequence
  SiRNA target sequence
ctcataaaccgatggatttg

SEQ ID NO: 182276 - DNA, 20 bp, Artificial sequence
  SiRNA target sequence
tcataaaccgatggatttgc

SEQ ID NO: 182277 - DNA, 20 bp, Artificial sequence
  SiRNA target sequence
cataaaccgatggatttgca

SEQ ID NO: 182278 - DNA, 20 bp, Artificial sequence
  SiRNA target sequence
ataaaccgatggatttgcat

SEQ ID NO: 182279 - DNA, 20 bp, Artificial sequence
  SiRNA target sequence
taaaccgatggatttgcata

SEQ ID NO: 182280 - DNA, 20 bp, Artificial sequence
  SiRNA target sequence
aaaccgatggatttgcatag

SEQ ID NO: 182281 - DNA, 20 bp, Artificial sequence
  SiRNA target sequence
aaccgatggatttgcatagt

SEQ ID NO: 182282 - DNA, 20 bp, Artificial sequence
  SiRNA target sequence
accgatggatttgcatagtg

SEQ ID NO: 182283 - DNA, 20 bp, Artificial sequence
  SiRNA target sequence
ccgatggatttgcatagtgg

SEQ ID NO: 182284 - DNA, 20 bp, Artificial sequence
  SiRNA target sequence
cgatggatttgcatagtgga

SEQ ID NO: 182285 - DNA, 20 bp, Artificial sequence
  SiRNA target sequence
gatggatttgcatagtggaa

SEQ ID NO: 182286 - DNA, 20 bp, Artificial sequence
  SiRNA target sequence
atggatttgcatagtggaat

SEQ ID NO: 182287 - DNA, 20 bp, Artificial sequence
  SiRNA target sequence
tggatttgcatagtggaatg

SEQ ID NO: 182288 - DNA, 20 bp, Artificial sequence
  SiRNA target sequence
ggatttgcatagtggaatga

SEQ ID NO: 182289 - DNA, 20 bp, Artificial sequence
  SiRNA target sequence
gatttgcatagtggaatgaa

SEQ ID NO: 182290 - DNA, 20 bp, Artificial sequence
  SiRNA target sequence
atttgcatagtggaatgaat

SEQ ID NO: 182291 - DNA, 20 bp, Artificial sequence
  SiRNA target sequence
tttgcatagtggaatgaata

SEQ ID NO: 182292 - DNA, 20 bp, Artificial sequence
  SiRNA target sequence
ttgcatagtggaatgaatat

SEQ ID NO: 182293 - DNA, 20 bp, Artificial sequence
  SiRNA target sequence
tgcatagtggaatgaatatt

SEQ ID NO: 182294 - DNA, 20 bp, Artificial sequence
  SiRNA target sequence
gcatagtggaatgaatattt

SEQ ID NO: 182295 - DNA, 20 bp, Artificial sequence
  SiRNA target sequence
catagtggaatgaatatttt

SEQ ID NO: 182296 - DNA, 20 bp, Artificial sequence
  SiRNA target sequence
atagtggaatgaatattttt

SEQ ID NO: 182297 - DNA, 20 bp, Artificial sequence
  SiRNA target sequence
tagtggaatgaatatttttt

SEQ ID NO: 182298 - DNA, 20 bp, Artificial sequence
  SiRNA target sequence
agtggaatgaatattttttt

SEQ ID NO: 182299 - DNA, 20 bp, Artificial sequence
  SiRNA target sequence
gtggaatgaatattttttta

SEQ ID NO: 182300 - DNA, 20 bp, Artificial sequence
  SiRNA target sequence
tggaatgaatatttttttaa

SEQ ID NO: 182301 - DNA, 20 bp, Artificial sequence
  SiRNA target sequence
ggaatgaatatttttttaaa

SEQ ID NO: 182302 - DNA, 20 bp, Artificial sequence
  SiRNA target sequence
gaatgaatatttttttaaag

SEQ ID NO: 182303 - DNA, 20 bp, Artificial sequence
  SiRNA target sequence
aatgaatatttttttaaaga

SEQ ID NO: 182304 - DNA, 20 bp, Artificial sequence
  SiRNA target sequence
atgaatatttttttaaagaa

SEQ ID NO: 182305 - DNA, 20 bp, Artificial sequence
  SiRNA target sequence
tgaatatttttttaaagaat

SEQ ID NO: 182306 - DNA, 20 bp, Artificial sequence
  SiRNA target sequence
gaatatttttttaaagaatc

SEQ ID NO: 182307 - DNA, 20 bp, Artificial sequence
  SiRNA target sequence
aatatttttttaaagaatct

SEQ ID NO: 182308 - DNA, 20 bp, Artificial sequence
  SiRNA target sequence
atatttttttaaagaatctt

SEQ ID NO: 182309 - DNA, 20 bp, Artificial sequence
  SiRNA target sequence
tatttttttaaagaatcttg

SEQ ID NO: 182310 - DNA, 20 bp, Artificial sequence
  SiRNA target sequence
atttttttaaagaatcttga

SEQ ID NO: 182311 - DNA, 20 bp, Artificial sequence
  SiRNA target sequence
tttttttaaagaatcttgat

SEQ ID NO: 182312 - DNA, 20 bp, Artificial sequence
  SiRNA target sequence
ttttttaaagaatcttgata

SEQ ID NO: 182313 - DNA, 20 bp, Artificial sequence
  SiRNA target sequence
tttttaaagaatcttgatat

SEQ ID NO: 182314 - DNA, 20 bp, Artificial sequence
  SiRNA target sequence
ttttaaagaatcttgatatt

SEQ ID NO: 182315 - DNA, 20 bp, Artificial sequence
  SiRNA target sequence
tttaaagaatcttgatatta

SEQ ID NO: 182316 - DNA, 20 bp, Artificial sequence
  SiRNA target sequence
ttaaagaatcttgatattac

SEQ ID NO: 182317 - DNA, 20 bp, Artificial sequence
  SiRNA target sequence
taaagaatcttgatattact

SEQ ID NO: 182318 - DNA, 20 bp, Artificial sequence
  SiRNA target sequence
aaagaatcttgatattactt

SEQ ID NO: 182319 - DNA, 20 bp, Artificial sequence
  SiRNA target sequence
aagaatcttgatattacttt

SEQ ID NO: 182320 - DNA, 20 bp, Artificial sequence
  SiRNA target sequence
agaatcttgatattactttt

SEQ ID NO: 182321 - DNA, 20 bp, Artificial sequence
  SiRNA target sequence
gaatcttgatattactttta

SEQ ID NO: 182322 - DNA, 20 bp, Artificial sequence
  SiRNA target sequence
aatcttgatattacttttag

SEQ ID NO: 182323 - DNA, 20 bp, Artificial sequence
  SiRNA target sequence
atcttgatattacttttaga

SEQ ID NO: 182324 - DNA, 20 bp, Artificial sequence
  SiRNA target sequence
tcttgatattacttttagaa

SEQ ID NO: 182325 - DNA, 20 bp, Artificial sequence
  SiRNA target sequence
cttgatattacttttagaag

SEQ ID NO: 182326 - DNA, 20 bp, Artificial sequence
  SiRNA target sequence
ttgatattacttttagaaga

SEQ ID NO: 182327 - DNA, 20 bp, Artificial sequence
  SiRNA target sequence
tgatattacttttagaagag

SEQ ID NO: 182328 - DNA, 20 bp, Artificial sequence
  SiRNA target sequence
gatattacttttagaagaga

SEQ ID NO: 182329 - DNA, 20 bp, Artificial sequence
  SiRNA target sequence
atattacttttagaagagac

SEQ ID NO: 182330 - DNA, 20 bp, Artificial sequence
  SiRNA target sequence
tattacttttagaagagact

SEQ ID NO: 182331 - DNA, 20 bp, Artificial sequence
  SiRNA target sequence
attacttttagaagagactc

SEQ ID NO: 182332 - DNA, 20 bp, Artificial sequence
  SiRNA target sequence
ttacttttagaagagactct

SEQ ID NO: 182333 - DNA, 20 bp, Artificial sequence
  SiRNA target sequence
tacttttagaagagactctt

SEQ ID NO: 182334 - DNA, 20 bp, Artificial sequence
  SiRNA target sequence
acttttagaagagactcttc

SEQ ID NO: 182335 - DNA, 20 bp, Artificial sequence
  SiRNA target sequence
cttttagaagagactcttcc

SEQ ID NO: 182336 - DNA, 20 bp, Artificial sequence
  SiRNA target sequence
ttttagaagagactcttcca

SEQ ID NO: 182337 - DNA, 20 bp, Artificial sequence
  SiRNA target sequence
tttagaagagactcttccaa

SEQ ID NO: 182338 - DNA, 20 bp, Artificial sequence
  SiRNA target sequence
ttagaagagactcttccaat

SEQ ID NO: 182339 - DNA, 20 bp, Artificial sequence
  SiRNA target sequence
tagaagagactcttccaatt

SEQ ID NO: 182340 - DNA, 20 bp, Artificial sequence
  SiRNA target sequence
agaagagactcttccaattt

SEQ ID NO: 182341 - DNA, 20 bp, Artificial sequence
  SiRNA target sequence
gaagagactcttccaatttt

SEQ ID NO: 182342 - DNA, 20 bp, Artificial sequence
  SiRNA target sequence
aagagactcttccaatttta

SEQ ID NO: 182343 - DNA, 20 bp, Artificial sequence
  SiRNA target sequence
agagactcttccaattttag

SEQ ID NO: 182344 - DNA, 20 bp, Artificial sequence
  SiRNA target sequence
gagactcttccaattttaga

SEQ ID NO: 182345 - DNA, 20 bp, Artificial sequence
  SiRNA target sequence
agactcttccaattttagac

SEQ ID NO: 182346 - DNA, 20 bp, Artificial sequence
  SiRNA target sequence
gactcttccaattttagacc

SEQ ID NO: 182347 - DNA, 20 bp, Artificial sequence
  SiRNA target sequence
actcttccaattttagacca

SEQ ID NO: 182348 - DNA, 20 bp, Artificial sequence
  SiRNA target sequence
ctcttccaattttagaccaa

SEQ ID NO: 182349 - DNA, 20 bp, Artificial sequence
  SiRNA target sequence
tcttccaattttagaccaag

SEQ ID NO: 182350 - DNA, 20 bp, Artificial sequence
  SiRNA target sequence
cttccaattttagaccaaga

SEQ ID NO: 182351 - DNA, 20 bp, Artificial sequence
  SiRNA target sequence
ttccaattttagaccaagag

SEQ ID NO: 182352 - DNA, 20 bp, Artificial sequence
  SiRNA target sequence
tccaattttagaccaagagt

SEQ ID NO: 182353 - DNA, 20 bp, Artificial sequence
  SiRNA target sequence
ccaattttagaccaagagtt

SEQ ID NO: 182354 - DNA, 20 bp, Artificial sequence
  SiRNA target sequence
caattttagaccaagagtta

SEQ ID NO: 182355 - DNA, 20 bp, Artificial sequence
  SiRNA target sequence
aattttagaccaagagttaa

SEQ ID NO: 182356 - DNA, 20 bp, Artificial sequence
  SiRNA target sequence
attttagaccaagagttaat

SEQ ID NO: 182357 - DNA, 20 bp, Artificial sequence
  SiRNA target sequence
ttttagaccaagagttaata

SEQ ID NO: 182358 - DNA, 20 bp, Artificial sequence
  SiRNA target sequence
tttagaccaagagttaataa

SEQ ID NO: 182359 - DNA, 20 bp, Artificial sequence
  SiRNA target sequence
ttagaccaagagttaataag

SEQ ID NO: 182360 - DNA, 20 bp, Artificial sequence
  SiRNA target sequence
tagaccaagagttaataagc

SEQ ID NO: 182361 - DNA, 20 bp, Artificial sequence
  SiRNA target sequence
agaccaagagttaataagcc

SEQ ID NO: 182362 - DNA, 20 bp, Artificial sequence
  SiRNA target sequence
gaccaagagttaataagccg

SEQ ID NO: 182363 - DNA, 20 bp, Artificial sequence
  SiRNA target sequence
accaagagttaataagccga

SEQ ID NO: 182364 - DNA, 20 bp, Artificial sequence
  SiRNA target sequence
ccaagagttaataagccgaa

SEQ ID NO: 182365 - DNA, 20 bp, Artificial sequence
  SiRNA target sequence
caagagttaataagccgaat

SEQ ID NO: 182366 - DNA, 20 bp, Artificial sequence
  SiRNA target sequence
aagagttaataagccgaatt

SEQ ID NO: 182367 - DNA, 20 bp, Artificial sequence
  SiRNA target sequence
agagttaataagccgaattc

SEQ ID NO: 182368 - DNA, 20 bp, Artificial sequence
  SiRNA target sequence
gagttaataagccgaattcc

SEQ ID NO: 182369 - DNA, 20 bp, Artificial sequence
  SiRNA target sequence
agttaataagccgaattccg

SEQ ID NO: 182370 - DNA, 20 bp, Artificial sequence
  SiRNA target sequence
gttaataagccgaattccgc

SEQ ID NO: 182371 - DNA, 20 bp, Artificial sequence
  SiRNA target sequence
ttaataagccgaattccgca

SEQ ID NO: 182372 - DNA, 20 bp, Artificial sequence
  SiRNA target sequence
taataagccgaattccgcaa

SEQ ID NO: 182373 - DNA, 20 bp, Artificial sequence
  SiRNA target sequence
aataagccgaattccgcaaa

SEQ ID NO: 182374 - DNA, 20 bp, Artificial sequence
  SiRNA target sequence
ataagccgaattccgcaaaa

SEQ ID NO: 182375 - DNA, 20 bp, Artificial sequence
  SiRNA target sequence
taagccgaattccgcaaaag

SEQ ID NO: 182376 - DNA, 20 bp, Artificial sequence
  SiRNA target sequence
aagccgaattccgcaaaaga

SEQ ID NO: 182377 - DNA, 20 bp, Artificial sequence
  SiRNA target sequence
agccgaattccgcaaaagac

SEQ ID NO: 182378 - DNA, 20 bp, Artificial sequence
  SiRNA target sequence
gccgaattccgcaaaagaca

SEQ ID NO: 182379 - DNA, 20 bp, Artificial sequence
  SiRNA target sequence
ccgaattccgcaaaagacag

SEQ ID NO: 182380 - DNA, 20 bp, Artificial sequence
  SiRNA target sequence
cgaattccgcaaaagacaga

SEQ ID NO: 182381 - DNA, 20 bp, Artificial sequence
  SiRNA target sequence
gaattccgcaaaagacagaa

SEQ ID NO: 182382 - DNA, 20 bp, Artificial sequence
  SiRNA target sequence
aattccgcaaaagacagaac

SEQ ID NO: 182383 - DNA, 20 bp, Artificial sequence
  SiRNA target sequence
attccgcaaaagacagaact

SEQ ID NO: 182384 - DNA, 20 bp, Artificial sequence
  SiRNA target sequence
ttccgcaaaagacagaactc

SEQ ID NO: 182385 - DNA, 20 bp, Artificial sequence
  SiRNA target sequence
tccgcaaaagacagaactca

SEQ ID NO: 182386 - DNA, 20 bp, Artificial sequence
  SiRNA target sequence
ccgcaaaagacagaactcag

SEQ ID NO: 182387 - DNA, 20 bp, Artificial sequence
  SiRNA target sequence
cgcaaaagacagaactcaga

SEQ ID NO: 182388 - DNA, 20 bp, Artificial sequence
  SiRNA target sequence
gcaaaagacagaactcagaa

SEQ ID NO: 182389 - DNA, 20 bp, Artificial sequence
  SiRNA target sequence
caaaagacagaactcagaaa

SEQ ID NO: 182390 - DNA, 20 bp, Artificial sequence
  SiRNA target sequence
aaaagacagaactcagaaag

SEQ ID NO: 182391 - DNA, 20 bp, Artificial sequence
  SiRNA target sequence
aaagacagaactcagaaaga

SEQ ID NO: 182392 - DNA, 20 bp, Artificial sequence
  SiRNA target sequence
aagacagaactcagaaagaa

SEQ ID NO: 182393 - DNA, 20 bp, Artificial sequence
  SiRNA target sequence
agacagaactcagaaagaag

SEQ ID NO: 182394 - DNA, 20 bp, Artificial sequence
  SiRNA target sequence
gacagaactcagaaagaaga

SEQ ID NO: 182395 - DNA, 20 bp, Artificial sequence
  SiRNA target sequence
acagaactcagaaagaagag

SEQ ID NO: 182396 - DNA, 20 bp, Artificial sequence
  SiRNA target sequence
cagaactcagaaagaagaga

SEQ ID NO: 182397 - DNA, 20 bp, Artificial sequence
  SiRNA target sequence
agaactcagaaagaagagaa

SEQ ID NO: 182398 - DNA, 20 bp, Artificial sequence
  SiRNA target sequence
gaactcagaaagaagagaat

SEQ ID NO: 182399 - DNA, 20 bp, Artificial sequence
  SiRNA target sequence
aactcagaaagaagagaata

SEQ ID NO: 182400 - DNA, 20 bp, Artificial sequence
  SiRNA target sequence
actcagaaagaagagaataa

SEQ ID NO: 182401 - DNA, 20 bp, Artificial sequence
  SiRNA target sequence
ctcagaaagaagagaataaa

SEQ ID NO: 182402 - DNA, 20 bp, Artificial sequence
  SiRNA target sequence
tcagaaagaagagaataaat

SEQ ID NO: 182403 - DNA, 20 bp, Artificial sequence
  SiRNA target sequence
cagaaagaagagaataaata

SEQ ID NO: 182404 - DNA, 20 bp, Artificial sequence
  SiRNA target sequence
agaaagaagagaataaatat

SEQ ID NO: 182405 - DNA, 20 bp, Artificial sequence
  SiRNA target sequence
gaaagaagagaataaatatt

SEQ ID NO: 182406 - DNA, 20 bp, Artificial sequence
  SiRNA target sequence
aaagaagagaataaatattt

SEQ ID NO: 182407 - DNA, 20 bp, Artificial sequence
  SiRNA target sequence
aagaagagaataaatatttt

SEQ ID NO: 182408 - DNA, 20 bp, Artificial sequence
  SiRNA target sequence
agaagagaataaatattttt

SEQ ID NO: 182409 - DNA, 20 bp, Artificial sequence
  SiRNA target sequence
gaagagaataaatatttttt

SEQ ID NO: 182410 - DNA, 20 bp, Artificial sequence
  SiRNA target sequence
aagagaataaatattttttt

SEQ ID NO: 182411 - DNA, 20 bp, Artificial sequence
  SiRNA target sequence
agagaataaatatttttttt

SEQ ID NO: 182412 - DNA, 20 bp, Artificial sequence
  SiRNA target sequence
gagaataaatattttttttg

SEQ ID NO: 182413 - DNA, 20 bp, Artificial sequence
  SiRNA target sequence
agaataaatattttttttga

SEQ ID NO: 182414 - DNA, 21 bp, Artificial sequence
  SiRNA target sequence
atggccaagaatgaatctaat

SEQ ID NO: 182415 - DNA, 21 bp, Artificial sequence
  SiRNA target sequence
tggccaagaatgaatctaata

SEQ ID NO: 182416 - DNA, 21 bp, Artificial sequence
  SiRNA target sequence
ggccaagaatgaatctaataa

SEQ ID NO: 182417 - DNA, 21 bp, Artificial sequence
  SiRNA target sequence
gccaagaatgaatctaataaa

SEQ ID NO: 182418 - DNA, 21 bp, Artificial sequence
  SiRNA target sequence
ccaagaatgaatctaataaaa

SEQ ID NO: 182419 - DNA, 21 bp, Artificial sequence
  SiRNA target sequence
caagaatgaatctaataaaat

SEQ ID NO: 182420 - DNA, 21 bp, Artificial sequence
  SiRNA target sequence
aagaatgaatctaataaaata

SEQ ID NO: 182421 - DNA, 21 bp, Artificial sequence
  SiRNA target sequence
agaatgaatctaataaaataa

SEQ ID NO: 182422 - DNA, 21 bp, Artificial sequence
  SiRNA target sequence
gaatgaatctaataaaataac

SEQ ID NO: 182423 - DNA, 21 bp, Artificial sequence
  SiRNA target sequence
aatgaatctaataaaataacg

SEQ ID NO: 182424 - DNA, 21 bp, Artificial sequence
  SiRNA target sequence
atgaatctaataaaataacga

SEQ ID NO: 182425 - DNA, 21 bp, Artificial sequence
  SiRNA target sequence
tgaatctaataaaataacgag

SEQ ID NO: 182426 - DNA, 21 bp, Artificial sequence
  SiRNA target sequence
gaatctaataaaataacgaga

SEQ ID NO: 182427 - DNA, 21 bp, Artificial sequence
  SiRNA target sequence
aatctaataaaataacgagac

SEQ ID NO: 182428 - DNA, 21 bp, Artificial sequence
  SiRNA target sequence
atctaataaaataacgagact

SEQ ID NO: 182429 - DNA, 21 bp, Artificial sequence
  SiRNA target sequence
tctaataaaataacgagactg

SEQ ID NO: 182430 - DNA, 21 bp, Artificial sequence
  SiRNA target sequence
ctaataaaataacgagactgg

SEQ ID NO: 182431 - DNA, 21 bp, Artificial sequence
  SiRNA target sequence
taataaaataacgagactggc

SEQ ID NO: 182432 - DNA, 21 bp, Artificial sequence
  SiRNA target sequence
aataaaataacgagactggca

SEQ ID NO: 182433 - DNA, 21 bp, Artificial sequence
  SiRNA target sequence
ataaaataacgagactggcaa

SEQ ID NO: 182434 - DNA, 21 bp, Artificial sequence
  SiRNA target sequence
taaaataacgagactggcaat

SEQ ID NO: 182435 - DNA, 21 bp, Artificial sequence
  SiRNA target sequence
aaaataacgagactggcaatt

SEQ ID NO: 182436 - DNA, 21 bp, Artificial sequence
  SiRNA target sequence
aaataacgagactggcaattg

SEQ ID NO: 182437 - DNA, 21 bp, Artificial sequence
  SiRNA target sequence
aataacgagactggcaattgt

SEQ ID NO: 182438 - DNA, 21 bp, Artificial sequence
  SiRNA target sequence
ataacgagactggcaattgtt

SEQ ID NO: 182439 - DNA, 21 bp, Artificial sequence
  SiRNA target sequence
taacgagactggcaattgtta

SEQ ID NO: 182440 - DNA, 21 bp, Artificial sequence
  SiRNA target sequence
aacgagactggcaattgttaa

SEQ ID NO: 182441 - DNA, 21 bp, Artificial sequence
  SiRNA target sequence
acgagactggcaattgttaat

SEQ ID NO: 182442 - DNA, 21 bp, Artificial sequence
  SiRNA target sequence
cgagactggcaattgttaatt

SEQ ID NO: 182443 - DNA, 21 bp, Artificial sequence
  SiRNA target sequence
gagactggcaattgttaatta

SEQ ID NO: 182444 - DNA, 21 bp, Artificial sequence
  SiRNA target sequence
agactggcaattgttaattat

SEQ ID NO: 182445 - DNA, 21 bp, Artificial sequence
  SiRNA target sequence
gactggcaattgttaattatg

SEQ ID NO: 182446 - DNA, 21 bp, Artificial sequence
  SiRNA target sequence
actggcaattgttaattatga

SEQ ID NO: 182447 - DNA, 21 bp, Artificial sequence
  SiRNA target sequence
ctggcaattgttaattatgaa

SEQ ID NO: 182448 - DNA, 21 bp, Artificial sequence
  SiRNA target sequence
tggcaattgttaattatgaac

SEQ ID NO: 182449 - DNA, 21 bp, Artificial sequence
  SiRNA target sequence
ggcaattgttaattatgaact

SEQ ID NO: 182450 - DNA, 21 bp, Artificial sequence
  SiRNA target sequence
gcaattgttaattatgaacta

SEQ ID NO: 182451 - DNA, 21 bp, Artificial sequence
  SiRNA target sequence
caattgttaattatgaactat

SEQ ID NO: 182452 - DNA, 21 bp, Artificial sequence
  SiRNA target sequence
aattgttaattatgaactatg

SEQ ID NO: 182453 - DNA, 21 bp, Artificial sequence
  SiRNA target sequence
attgttaattatgaactatgt

SEQ ID NO: 182454 - DNA, 21 bp, Artificial sequence
  SiRNA target sequence
ttgttaattatgaactatgta

SEQ ID NO: 182455 - DNA, 21 bp, Artificial sequence
  SiRNA target sequence
tgttaattatgaactatgtaa

SEQ ID NO: 182456 - DNA, 21 bp, Artificial sequence
  SiRNA target sequence
gttaattatgaactatgtaaa

SEQ ID NO: 182457 - DNA, 21 bp, Artificial sequence
  SiRNA target sequence
ttaattatgaactatgtaaac

SEQ ID NO: 182458 - DNA, 21 bp, Artificial sequence
  SiRNA target sequence
taattatgaactatgtaaacc

SEQ ID NO: 182459 - DNA, 21 bp, Artificial sequence
  SiRNA target sequence
aattatgaactatgtaaaccg

SEQ ID NO: 182460 - DNA, 21 bp, Artificial sequence
  SiRNA target sequence
attatgaactatgtaaaccga

SEQ ID NO: 182461 - DNA, 21 bp, Artificial sequence
  SiRNA target sequence
ttatgaactatgtaaaccgaa

SEQ ID NO: 182462 - DNA, 21 bp, Artificial sequence
  SiRNA target sequence
tatgaactatgtaaaccgaag

SEQ ID NO: 182463 - DNA, 21 bp, Artificial sequence
  SiRNA target sequence
atgaactatgtaaaccgaagg

SEQ ID NO: 182464 - DNA, 21 bp, Artificial sequence
  SiRNA target sequence
tgaactatgtaaaccgaagga

SEQ ID NO: 182465 - DNA, 21 bp, Artificial sequence
  SiRNA target sequence
gaactatgtaaaccgaaggaa

SEQ ID NO: 182466 - DNA, 21 bp, Artificial sequence
  SiRNA target sequence
aactatgtaaaccgaaggaat

SEQ ID NO: 182467 - DNA, 21 bp, Artificial sequence
  SiRNA target sequence
actatgtaaaccgaaggaatg

SEQ ID NO: 182468 - DNA, 21 bp, Artificial sequence
  SiRNA target sequence
ctatgtaaaccgaaggaatgt

SEQ ID NO: 182469 - DNA, 21 bp, Artificial sequence
  SiRNA target sequence
tatgtaaaccgaaggaatgta

SEQ ID NO: 182470 - DNA, 21 bp, Artificial sequence
  SiRNA target sequence
atgtaaaccgaaggaatgtat

SEQ ID NO: 182471 - DNA, 21 bp, Artificial sequence
  SiRNA target sequence
tgtaaaccgaaggaatgtatg

SEQ ID NO: 182472 - DNA, 21 bp, Artificial sequence
  SiRNA target sequence
gtaaaccgaaggaatgtatgt

SEQ ID NO: 182473 - DNA, 21 bp, Artificial sequence
  SiRNA target sequence
taaaccgaaggaatgtatgtc

SEQ ID NO: 182474 - DNA, 21 bp, Artificial sequence
  SiRNA target sequence
aaaccgaaggaatgtatgtca

SEQ ID NO: 182475 - DNA, 21 bp, Artificial sequence
  SiRNA target sequence
aaccgaaggaatgtatgtcag

SEQ ID NO: 182476 - DNA, 21 bp, Artificial sequence
  SiRNA target sequence
accgaaggaatgtatgtcaga

SEQ ID NO: 182477 - DNA, 21 bp, Artificial sequence
  SiRNA target sequence
ccgaaggaatgtatgtcagaa

SEQ ID NO: 182478 - DNA, 21 bp, Artificial sequence
  SiRNA target sequence
cgaaggaatgtatgtcagaat

SEQ ID NO: 182479 - DNA, 21 bp, Artificial sequence
  SiRNA target sequence
gaaggaatgtatgtcagaatg

SEQ ID NO: 182480 - DNA, 21 bp, Artificial sequence
  SiRNA target sequence
aaggaatgtatgtcagaatgt

SEQ ID NO: 182481 - DNA, 21 bp, Artificial sequence
  SiRNA target sequence
aggaatgtatgtcagaatgta

SEQ ID NO: 182482 - DNA, 21 bp, Artificial sequence
  SiRNA target sequence
ggaatgtatgtcagaatgtaa

SEQ ID NO: 182483 - DNA, 21 bp, Artificial sequence
  SiRNA target sequence
gaatgtatgtcagaatgtaaa

SEQ ID NO: 182484 - DNA, 21 bp, Artificial sequence
  SiRNA target sequence
aatgtatgtcagaatgtaaaa

SEQ ID NO: 182485 - DNA, 21 bp, Artificial sequence
  SiRNA target sequence
atgtatgtcagaatgtaaaaa

SEQ ID NO: 182486 - DNA, 21 bp, Artificial sequence
  SiRNA target sequence
tgtatgtcagaatgtaaaaag

SEQ ID NO: 182487 - DNA, 21 bp, Artificial sequence
  SiRNA target sequence
gtatgtcagaatgtaaaaagg

SEQ ID NO: 182488 - DNA, 21 bp, Artificial sequence
  SiRNA target sequence
tatgtcagaatgtaaaaaggc

SEQ ID NO: 182489 - DNA, 21 bp, Artificial sequence
  SiRNA target sequence
atgtcagaatgtaaaaaggcg

SEQ ID NO: 182490 - DNA, 21 bp, Artificial sequence
  SiRNA target sequence
tgtcagaatgtaaaaaggcgt

SEQ ID NO: 182491 - DNA, 21 bp, Artificial sequence
  SiRNA target sequence
gtcagaatgtaaaaaggcgtg

SEQ ID NO: 182492 - DNA, 21 bp, Artificial sequence
  SiRNA target sequence
tcagaatgtaaaaaggcgtgt

SEQ ID NO: 182493 - DNA, 21 bp, Artificial sequence
  SiRNA target sequence
cagaatgtaaaaaggcgtgtc

SEQ ID NO: 182494 - DNA, 21 bp, Artificial sequence
  SiRNA target sequence
agaatgtaaaaaggcgtgtcc

SEQ ID NO: 182495 - DNA, 21 bp, Artificial sequence
  SiRNA target sequence
gaatgtaaaaaggcgtgtcct

SEQ ID NO: 182496 - DNA, 21 bp, Artificial sequence
  SiRNA target sequence
aatgtaaaaaggcgtgtcctg

SEQ ID NO: 182497 - DNA, 21 bp, Artificial sequence
  SiRNA target sequence
atgtaaaaaggcgtgtcctgt

SEQ ID NO: 182498 - DNA, 21 bp, Artificial sequence
  SiRNA target sequence
tgtaaaaaggcgtgtcctgtt

SEQ ID NO: 182499 - DNA, 21 bp, Artificial sequence
  SiRNA target sequence
gtaaaaaggcgtgtcctgtta

SEQ ID NO: 182500 - DNA, 21 bp, Artificial sequence
  SiRNA target sequence
taaaaaggcgtgtcctgttaa

SEQ ID NO: 182501 - DNA, 21 bp, Artificial sequence
  SiRNA target sequence
aaaaaggcgtgtcctgttaat

SEQ ID NO: 182502 - DNA, 21 bp, Artificial sequence
  SiRNA target sequence
aaaaggcgtgtcctgttaata

SEQ ID NO: 182503 - DNA, 21 bp, Artificial sequence
  SiRNA target sequence
aaaggcgtgtcctgttaataa

SEQ ID NO: 182504 - DNA, 21 bp, Artificial sequence
  SiRNA target sequence
aaggcgtgtcctgttaataaa

SEQ ID NO: 182505 - DNA, 21 bp, Artificial sequence
  SiRNA target sequence
aggcgtgtcctgttaataaaa

SEQ ID NO: 182506 - DNA, 21 bp, Artificial sequence
  SiRNA target sequence
ggcgtgtcctgttaataaaac

SEQ ID NO: 182507 - DNA, 21 bp, Artificial sequence
  SiRNA target sequence
gcgtgtcctgttaataaaaca

SEQ ID NO: 182508 - DNA, 21 bp, Artificial sequence
  SiRNA target sequence
cgtgtcctgttaataaaacag

SEQ ID NO: 182509 - DNA, 21 bp, Artificial sequence
  SiRNA target sequence
gtgtcctgttaataaaacagg

SEQ ID NO: 182510 - DNA, 21 bp, Artificial sequence
  SiRNA target sequence
tgtcctgttaataaaacagga

SEQ ID NO: 182511 - DNA, 21 bp, Artificial sequence
  SiRNA target sequence
gtcctgttaataaaacaggaa

SEQ ID NO: 182512 - DNA, 21 bp, Artificial sequence
  SiRNA target sequence
tcctgttaataaaacaggaaa

SEQ ID NO: 182513 - DNA, 21 bp, Artificial sequence
  SiRNA target sequence
cctgttaataaaacaggaaag

SEQ ID NO: 182514 - DNA, 21 bp, Artificial sequence
  SiRNA target sequence
ctgttaataaaacaggaaagg

SEQ ID NO: 182515 - DNA, 21 bp, Artificial sequence
  SiRNA target sequence
tgttaataaaacaggaaagga

SEQ ID NO: 182516 - DNA, 21 bp, Artificial sequence
  SiRNA target sequence
gttaataaaacaggaaaggag

SEQ ID NO: 182517 - DNA, 21 bp, Artificial sequence
  SiRNA target sequence
ttaataaaacaggaaaggagt

SEQ ID NO: 182518 - DNA, 21 bp, Artificial sequence
  SiRNA target sequence
taataaaacaggaaaggagtg

SEQ ID NO: 182519 - DNA, 21 bp, Artificial sequence
  SiRNA target sequence
aataaaacaggaaaggagtgt

SEQ ID NO: 182520 - DNA, 21 bp, Artificial sequence
  SiRNA target sequence
ataaaacaggaaaggagtgta

SEQ ID NO: 182521 - DNA, 21 bp, Artificial sequence
  SiRNA target sequence
taaaacaggaaaggagtgtat

SEQ ID NO: 182522 - DNA, 21 bp, Artificial sequence
  SiRNA target sequence
aaaacaggaaaggagtgtatt

SEQ ID NO: 182523 - DNA, 21 bp, Artificial sequence
  SiRNA target sequence
aaacaggaaaggagtgtatta

SEQ ID NO: 182524 - DNA, 21 bp, Artificial sequence
  SiRNA target sequence
aacaggaaaggagtgtattac

SEQ ID NO: 182525 - DNA, 21 bp, Artificial sequence
  SiRNA target sequence
acaggaaaggagtgtattaca

SEQ ID NO: 182526 - DNA, 21 bp, Artificial sequence
  SiRNA target sequence
caggaaaggagtgtattacaa

SEQ ID NO: 182527 - DNA, 21 bp, Artificial sequence
  SiRNA target sequence
aggaaaggagtgtattacaat

SEQ ID NO: 182528 - DNA, 21 bp, Artificial sequence
  SiRNA target sequence
ggaaaggagtgtattacaatt

SEQ ID NO: 182529 - DNA, 21 bp, Artificial sequence
  SiRNA target sequence
gaaaggagtgtattacaattg

SEQ ID NO: 182530 - DNA, 21 bp, Artificial sequence
  SiRNA target sequence
aaaggagtgtattacaattga

SEQ ID NO: 182531 - DNA, 21 bp, Artificial sequence
  SiRNA target sequence
aaggagtgtattacaattgat

SEQ ID NO: 182532 - DNA, 21 bp, Artificial sequence
  SiRNA target sequence
aggagtgtattacaattgata

SEQ ID NO: 182533 - DNA, 21 bp, Artificial sequence
  SiRNA target sequence
ggagtgtattacaattgatac

SEQ ID NO: 182534 - DNA, 21 bp, Artificial sequence
  SiRNA target sequence
gagtgtattacaattgatact

SEQ ID NO: 182535 - DNA, 21 bp, Artificial sequence
  SiRNA target sequence
agtgtattacaattgatacta

SEQ ID NO: 182536 - DNA, 21 bp, Artificial sequence
  SiRNA target sequence
gtgtattacaattgatactaa

SEQ ID NO: 182537 - DNA, 21 bp, Artificial sequence
  SiRNA target sequence
tgtattacaattgatactaaa

SEQ ID NO: 182538 - DNA, 21 bp, Artificial sequence
  SiRNA target sequence
gtattacaattgatactaaat

SEQ ID NO: 182539 - DNA, 21 bp, Artificial sequence
  SiRNA target sequence
tattacaattgatactaaatc

SEQ ID NO: 182540 - DNA, 21 bp, Artificial sequence
  SiRNA target sequence
attacaattgatactaaatca

SEQ ID NO: 182541 - DNA, 21 bp, Artificial sequence
  SiRNA target sequence
ttacaattgatactaaatcac

SEQ ID NO: 182542 - DNA, 21 bp, Artificial sequence
  SiRNA target sequence
tacaattgatactaaatcaca

SEQ ID NO: 182543 - DNA, 21 bp, Artificial sequence
  SiRNA target sequence
acaattgatactaaatcacat

SEQ ID NO: 182544 - DNA, 21 bp, Artificial sequence
  SiRNA target sequence
caattgatactaaatcacata

SEQ ID NO: 182545 - DNA, 21 bp, Artificial sequence
  SiRNA target sequence
aattgatactaaatcacatat

SEQ ID NO: 182546 - DNA, 21 bp, Artificial sequence
  SiRNA target sequence
attgatactaaatcacatatc

SEQ ID NO: 182547 - DNA, 21 bp, Artificial sequence
  SiRNA target sequence
ttgatactaaatcacatatct

SEQ ID NO: 182548 - DNA, 21 bp, Artificial sequence
  SiRNA target sequence
tgatactaaatcacatatctc

SEQ ID NO: 182549 - DNA, 21 bp, Artificial sequence
  SiRNA target sequence
gatactaaatcacatatctca

SEQ ID NO: 182550 - DNA, 21 bp, Artificial sequence
  SiRNA target sequence
atactaaatcacatatctcag

SEQ ID NO: 182551 - DNA, 21 bp, Artificial sequence
  SiRNA target sequence
tactaaatcacatatctcaga

SEQ ID NO: 182552 - DNA, 21 bp, Artificial sequence
  SiRNA target sequence
actaaatcacatatctcagaa

SEQ ID NO: 182553 - DNA, 21 bp, Artificial sequence
  SiRNA target sequence
ctaaatcacatatctcagaaa

SEQ ID NO: 182554 - DNA, 21 bp, Artificial sequence
  SiRNA target sequence
taaatcacatatctcagaaat

SEQ ID NO: 182555 - DNA, 21 bp, Artificial sequence
  SiRNA target sequence
aaatcacatatctcagaaatt

SEQ ID NO: 182556 - DNA, 21 bp, Artificial sequence
  SiRNA target sequence
aatcacatatctcagaaattc

SEQ ID NO: 182557 - DNA, 21 bp, Artificial sequence
  SiRNA target sequence
atcacatatctcagaaattct

SEQ ID NO: 182558 - DNA, 21 bp, Artificial sequence
  SiRNA target sequence
tcacatatctcagaaattctg

SEQ ID NO: 182559 - DNA, 21 bp, Artificial sequence
  SiRNA target sequence
cacatatctcagaaattctgt

SEQ ID NO: 182560 - DNA, 21 bp, Artificial sequence
  SiRNA target sequence
acatatctcagaaattctgtg

SEQ ID NO: 182561 - DNA, 21 bp, Artificial sequence
  SiRNA target sequence
catatctcagaaattctgtgt

SEQ ID NO: 182562 - DNA, 21 bp, Artificial sequence
  SiRNA target sequence
atatctcagaaattctgtgta

SEQ ID NO: 182563 - DNA, 21 bp, Artificial sequence
  SiRNA target sequence
tatctcagaaattctgtgtat

SEQ ID NO: 182564 - DNA, 21 bp, Artificial sequence
  SiRNA target sequence
atctcagaaattctgtgtata

SEQ ID NO: 182565 - DNA, 21 bp, Artificial sequence
  SiRNA target sequence
tctcagaaattctgtgtatag

SEQ ID NO: 182566 - DNA, 21 bp, Artificial sequence
  SiRNA target sequence
ctcagaaattctgtgtatagg

SEQ ID NO: 182567 - DNA, 21 bp, Artificial sequence
  SiRNA target sequence
tcagaaattctgtgtatagga

SEQ ID NO: 182568 - DNA, 21 bp, Artificial sequence
  SiRNA target sequence
cagaaattctgtgtataggat

SEQ ID NO: 182569 - DNA, 21 bp, Artificial sequence
  SiRNA target sequence
agaaattctgtgtataggatg

SEQ ID NO: 182570 - DNA, 21 bp, Artificial sequence
  SiRNA target sequence
gaaattctgtgtataggatgt

SEQ ID NO: 182571 - DNA, 21 bp, Artificial sequence
  SiRNA target sequence
aaattctgtgtataggatgtt

SEQ ID NO: 182572 - DNA, 21 bp, Artificial sequence
  SiRNA target sequence
aattctgtgtataggatgttc

SEQ ID NO: 182573 - DNA, 21 bp, Artificial sequence
  SiRNA target sequence
attctgtgtataggatgttct

SEQ ID NO: 182574 - DNA, 21 bp, Artificial sequence
  SiRNA target sequence
ttctgtgtataggatgttctg

SEQ ID NO: 182575 - DNA, 21 bp, Artificial sequence
  SiRNA target sequence
tctgtgtataggatgttctgc

SEQ ID NO: 182576 - DNA, 21 bp, Artificial sequence
  SiRNA target sequence
ctgtgtataggatgttctgcg

SEQ ID NO: 182577 - DNA, 21 bp, Artificial sequence
  SiRNA target sequence
tgtgtataggatgttctgcgt

SEQ ID NO: 182578 - DNA, 21 bp, Artificial sequence
  SiRNA target sequence
gtgtataggatgttctgcgtg

SEQ ID NO: 182579 - DNA, 21 bp, Artificial sequence
  SiRNA target sequence
tgtataggatgttctgcgtgt

SEQ ID NO: 182580 - DNA, 21 bp, Artificial sequence
  SiRNA target sequence
gtataggatgttctgcgtgtc

SEQ ID NO: 182581 - DNA, 21 bp, Artificial sequence
  SiRNA target sequence
tataggatgttctgcgtgtca

SEQ ID NO: 182582 - DNA, 21 bp, Artificial sequence
  SiRNA target sequence
ataggatgttctgcgtgtcaa

SEQ ID NO: 182583 - DNA, 21 bp, Artificial sequence
  SiRNA target sequence
taggatgttctgcgtgtcaaa

SEQ ID NO: 182584 - DNA, 21 bp, Artificial sequence
  SiRNA target sequence
aggatgttctgcgtgtcaaaa

SEQ ID NO: 182585 - DNA, 21 bp, Artificial sequence
  SiRNA target sequence
ggatgttctgcgtgtcaaaag

SEQ ID NO: 182586 - DNA, 21 bp, Artificial sequence
  SiRNA target sequence
gatgttctgcgtgtcaaaaga

SEQ ID NO: 182587 - DNA, 21 bp, Artificial sequence
  SiRNA target sequence
atgttctgcgtgtcaaaagaa

SEQ ID NO: 182588 - DNA, 21 bp, Artificial sequence
  SiRNA target sequence
tgttctgcgtgtcaaaagaaa

SEQ ID NO: 182589 - DNA, 21 bp, Artificial sequence
  SiRNA target sequence
gttctgcgtgtcaaaagaaat

SEQ ID NO: 182590 - DNA, 21 bp, Artificial sequence
  SiRNA target sequence
ttctgcgtgtcaaaagaaatg

SEQ ID NO: 182591 - DNA, 21 bp, Artificial sequence
  SiRNA target sequence
tctgcgtgtcaaaagaaatgt

SEQ ID NO: 182592 - DNA, 21 bp, Artificial sequence
  SiRNA target sequence
ctgcgtgtcaaaagaaatgtc

SEQ ID NO: 182593 - DNA, 21 bp, Artificial sequence
  SiRNA target sequence
tgcgtgtcaaaagaaatgtcc

SEQ ID NO: 182594 - DNA, 21 bp, Artificial sequence
  SiRNA target sequence
gcgtgtcaaaagaaatgtcct

SEQ ID NO: 182595 - DNA, 21 bp, Artificial sequence
  SiRNA target sequence
cgtgtcaaaagaaatgtcctt

SEQ ID NO: 182596 - DNA, 21 bp, Artificial sequence
  SiRNA target sequence
gtgtcaaaagaaatgtccttt

SEQ ID NO: 182597 - DNA, 21 bp, Artificial sequence
  SiRNA target sequence
tgtcaaaagaaatgtcctttt

SEQ ID NO: 182598 - DNA, 21 bp, Artificial sequence
  SiRNA target sequence
gtcaaaagaaatgtcctttta

SEQ ID NO: 182599 - DNA, 21 bp, Artificial sequence
  SiRNA target sequence
tcaaaagaaatgtccttttaa

SEQ ID NO: 182600 - DNA, 21 bp, Artificial sequence
  SiRNA target sequence
caaaagaaatgtccttttaag

SEQ ID NO: 182601 - DNA, 21 bp, Artificial sequence
  SiRNA target sequence
aaaagaaatgtccttttaagg

SEQ ID NO: 182602 - DNA, 21 bp, Artificial sequence
  SiRNA target sequence
aaagaaatgtccttttaaggc

SEQ ID NO: 182603 - DNA, 21 bp, Artificial sequence
  SiRNA target sequence
aagaaatgtccttttaaggcg

SEQ ID NO: 182604 - DNA, 21 bp, Artificial sequence
  SiRNA target sequence
agaaatgtccttttaaggcga

SEQ ID NO: 182605 - DNA, 21 bp, Artificial sequence
  SiRNA target sequence
gaaatgtccttttaaggcgat

SEQ ID NO: 182606 - DNA, 21 bp, Artificial sequence
  SiRNA target sequence
aaatgtccttttaaggcgatt

SEQ ID NO: 182607 - DNA, 21 bp, Artificial sequence
  SiRNA target sequence
aatgtccttttaaggcgatta

SEQ ID NO: 182608 - DNA, 21 bp, Artificial sequence
  SiRNA target sequence
atgtccttttaaggcgattac

SEQ ID NO: 182609 - DNA, 21 bp, Artificial sequence
  SiRNA target sequence
tgtccttttaaggcgattaca

SEQ ID NO: 182610 - DNA, 21 bp, Artificial sequence
  SiRNA target sequence
gtccttttaaggcgattacaa

SEQ ID NO: 182611 - DNA, 21 bp, Artificial sequence
  SiRNA target sequence
tccttttaaggcgattacaat

SEQ ID NO: 182612 - DNA, 21 bp, Artificial sequence
  SiRNA target sequence
ccttttaaggcgattacaatt

SEQ ID NO: 182613 - DNA, 21 bp, Artificial sequence
  SiRNA target sequence
cttttaaggcgattacaattg

SEQ ID NO: 182614 - DNA, 21 bp, Artificial sequence
  SiRNA target sequence
ttttaaggcgattacaattgt

SEQ ID NO: 182615 - DNA, 21 bp, Artificial sequence
  SiRNA target sequence
tttaaggcgattacaattgta

SEQ ID NO: 182616 - DNA, 21 bp, Artificial sequence
  SiRNA target sequence
ttaaggcgattacaattgtaa

SEQ ID NO: 182617 - DNA, 21 bp, Artificial sequence
  SiRNA target sequence
taaggcgattacaattgtaaa

SEQ ID NO: 182618 - DNA, 21 bp, Artificial sequence
  SiRNA target sequence
aaggcgattacaattgtaaat

SEQ ID NO: 182619 - DNA, 21 bp, Artificial sequence
  SiRNA target sequence
aggcgattacaattgtaaatt

SEQ ID NO: 182620 - DNA, 21 bp, Artificial sequence
  SiRNA target sequence
ggcgattacaattgtaaattt

SEQ ID NO: 182621 - DNA, 21 bp, Artificial sequence
  SiRNA target sequence
gcgattacaattgtaaattta

SEQ ID NO: 182622 - DNA, 21 bp, Artificial sequence
  SiRNA target sequence
cgattacaattgtaaatttac

SEQ ID NO: 182623 - DNA, 21 bp, Artificial sequence
  SiRNA target sequence
gattacaattgtaaatttacc

SEQ ID NO: 182624 - DNA, 21 bp, Artificial sequence
  SiRNA target sequence
attacaattgtaaatttacct

SEQ ID NO: 182625 - DNA, 21 bp, Artificial sequence
  SiRNA target sequence
ttacaattgtaaatttaccta

SEQ ID NO: 182626 - DNA, 21 bp, Artificial sequence
  SiRNA target sequence
tacaattgtaaatttacctac

SEQ ID NO: 182627 - DNA, 21 bp, Artificial sequence
  SiRNA target sequence
acaattgtaaatttacctaca

SEQ ID NO: 182628 - DNA, 21 bp, Artificial sequence
  SiRNA target sequence
caattgtaaatttacctacaa

SEQ ID NO: 182629 - DNA, 21 bp, Artificial sequence
  SiRNA target sequence
aattgtaaatttacctacaaa

SEQ ID NO: 182630 - DNA, 21 bp, Artificial sequence
  SiRNA target sequence
attgtaaatttacctacaaat

SEQ ID NO: 182631 - DNA, 21 bp, Artificial sequence
  SiRNA target sequence
ttgtaaatttacctacaaatc

SEQ ID NO: 182632 - DNA, 21 bp, Artificial sequence
  SiRNA target sequence
tgtaaatttacctacaaatct

SEQ ID NO: 182633 - DNA, 21 bp, Artificial sequence
  SiRNA target sequence
gtaaatttacctacaaatcta

SEQ ID NO: 182634 - DNA, 21 bp, Artificial sequence
  SiRNA target sequence
taaatttacctacaaatctag

SEQ ID NO: 182635 - DNA, 21 bp, Artificial sequence
  SiRNA target sequence
aaatttacctacaaatctaga

SEQ ID NO: 182636 - DNA, 21 bp, Artificial sequence
  SiRNA target sequence
aatttacctacaaatctagat

SEQ ID NO: 182637 - DNA, 21 bp, Artificial sequence
  SiRNA target sequence
atttacctacaaatctagata

SEQ ID NO: 182638 - DNA, 21 bp, Artificial sequence
  SiRNA target sequence
tttacctacaaatctagataa

SEQ ID NO: 182639 - DNA, 21 bp, Artificial sequence
  SiRNA target sequence
ttacctacaaatctagataaa

SEQ ID NO: 182640 - DNA, 21 bp, Artificial sequence
  SiRNA target sequence
tacctacaaatctagataaag

SEQ ID NO: 182641 - DNA, 21 bp, Artificial sequence
  SiRNA target sequence
acctacaaatctagataaaga

SEQ ID NO: 182642 - DNA, 21 bp, Artificial sequence
  SiRNA target sequence
cctacaaatctagataaagac

SEQ ID NO: 182643 - DNA, 21 bp, Artificial sequence
  SiRNA target sequence
ctacaaatctagataaagaca

SEQ ID NO: 182644 - DNA, 21 bp, Artificial sequence
  SiRNA target sequence
tacaaatctagataaagacat

SEQ ID NO: 182645 - DNA, 21 bp, Artificial sequence
  SiRNA target sequence
acaaatctagataaagacatt

SEQ ID NO: 182646 - DNA, 21 bp, Artificial sequence
  SiRNA target sequence
caaatctagataaagacattt

SEQ ID NO: 182647 - DNA, 21 bp, Artificial sequence
  SiRNA target sequence
aaatctagataaagacatttc

SEQ ID NO: 182648 - DNA, 21 bp, Artificial sequence
  SiRNA target sequence
aatctagataaagacatttca

SEQ ID NO: 182649 - DNA, 21 bp, Artificial sequence
  SiRNA target sequence
atctagataaagacatttcac

SEQ ID NO: 182650 - DNA, 21 bp, Artificial sequence
  SiRNA target sequence
tctagataaagacatttcaca

SEQ ID NO: 182651 - DNA, 21 bp, Artificial sequence
  SiRNA target sequence
ctagataaagacatttcacat

SEQ ID NO: 182652 - DNA, 21 bp, Artificial sequence
  SiRNA target sequence
tagataaagacatttcacata

SEQ ID NO: 182653 - DNA, 21 bp, Artificial sequence
  SiRNA target sequence
agataaagacatttcacatag

SEQ ID NO: 182654 - DNA, 21 bp, Artificial sequence
  SiRNA target sequence
gataaagacatttcacataga

SEQ ID NO: 182655 - DNA, 21 bp, Artificial sequence
  SiRNA target sequence
ataaagacatttcacatagat

SEQ ID NO: 182656 - DNA, 21 bp, Artificial sequence
  SiRNA target sequence
taaagacatttcacatagata

SEQ ID NO: 182657 - DNA, 21 bp, Artificial sequence
  SiRNA target sequence
aaagacatttcacatagatat

SEQ ID NO: 182658 - DNA, 21 bp, Artificial sequence
  SiRNA target sequence
aagacatttcacatagatatt

SEQ ID NO: 182659 - DNA, 21 bp, Artificial sequence
  SiRNA target sequence
agacatttcacatagatattc

SEQ ID NO: 182660 - DNA, 21 bp, Artificial sequence
  SiRNA target sequence
gacatttcacatagatattcg

SEQ ID NO: 182661 - DNA, 21 bp, Artificial sequence
  SiRNA target sequence
acatttcacatagatattcgg

SEQ ID NO: 182662 - DNA, 21 bp, Artificial sequence
  SiRNA target sequence
catttcacatagatattcggc

SEQ ID NO: 182663 - DNA, 21 bp, Artificial sequence
  SiRNA target sequence
atttcacatagatattcggca

SEQ ID NO: 182664 - DNA, 21 bp, Artificial sequence
  SiRNA target sequence
tttcacatagatattcggcaa

SEQ ID NO: 182665 - DNA, 21 bp, Artificial sequence
  SiRNA target sequence
ttcacatagatattcggcaaa

SEQ ID NO: 182666 - DNA, 21 bp, Artificial sequence
  SiRNA target sequence
tcacatagatattcggcaaat

SEQ ID NO: 182667 - DNA, 21 bp, Artificial sequence
  SiRNA target sequence
cacatagatattcggcaaatg

SEQ ID NO: 182668 - DNA, 21 bp, Artificial sequence
  SiRNA target sequence
acatagatattcggcaaatgg

SEQ ID NO: 182669 - DNA, 21 bp, Artificial sequence
  SiRNA target sequence
catagatattcggcaaatggt

SEQ ID NO: 182670 - DNA, 21 bp, Artificial sequence
  SiRNA target sequence
atagatattcggcaaatggtt

SEQ ID NO: 182671 - DNA, 21 bp, Artificial sequence
  SiRNA target sequence
tagatattcggcaaatggttt

SEQ ID NO: 182672 - DNA, 21 bp, Artificial sequence
  SiRNA target sequence
agatattcggcaaatggtttt

SEQ ID NO: 182673 - DNA, 21 bp, Artificial sequence
  SiRNA target sequence
gatattcggcaaatggtttta

SEQ ID NO: 182674 - DNA, 21 bp, Artificial sequence
  SiRNA target sequence
atattcggcaaatggttttaa

SEQ ID NO: 182675 - DNA, 21 bp, Artificial sequence
  SiRNA target sequence
tattcggcaaatggttttaaa

SEQ ID NO: 182676 - DNA, 21 bp, Artificial sequence
  SiRNA target sequence
attcggcaaatggttttaaac

SEQ ID NO: 182677 - DNA, 21 bp, Artificial sequence
  SiRNA target sequence
ttcggcaaatggttttaaact

SEQ ID NO: 182678 - DNA, 21 bp, Artificial sequence
  SiRNA target sequence
tcggcaaatggttttaaactt

SEQ ID NO: 182679 - DNA, 21 bp, Artificial sequence
  SiRNA target sequence
cggcaaatggttttaaacttc

SEQ ID NO: 182680 - DNA, 21 bp, Artificial sequence
  SiRNA target sequence
ggcaaatggttttaaacttca

SEQ ID NO: 182681 - DNA, 21 bp, Artificial sequence
  SiRNA target sequence
gcaaatggttttaaacttcac

SEQ ID NO: 182682 - DNA, 21 bp, Artificial sequence
  SiRNA target sequence
caaatggttttaaacttcaca

SEQ ID NO: 182683 - DNA, 21 bp, Artificial sequence
  SiRNA target sequence
aaatggttttaaacttcacag

SEQ ID NO: 182684 - DNA, 21 bp, Artificial sequence
  SiRNA target sequence
aatggttttaaacttcacaga

SEQ ID NO: 182685 - DNA, 21 bp, Artificial sequence
  SiRNA target sequence
atggttttaaacttcacagat

SEQ ID NO: 182686 - DNA, 21 bp, Artificial sequence
  SiRNA target sequence
tggttttaaacttcacagatt

SEQ ID NO: 182687 - DNA, 21 bp, Artificial sequence
  SiRNA target sequence
ggttttaaacttcacagatta

SEQ ID NO: 182688 - DNA, 21 bp, Artificial sequence
  SiRNA target sequence
gttttaaacttcacagattac

SEQ ID NO: 182689 - DNA, 21 bp, Artificial sequence
  SiRNA target sequence
ttttaaacttcacagattacc

SEQ ID NO: 182690 - DNA, 21 bp, Artificial sequence
  SiRNA target sequence
tttaaacttcacagattacca

SEQ ID NO: 182691 - DNA, 21 bp, Artificial sequence
  SiRNA target sequence
ttaaacttcacagattaccaa

SEQ ID NO: 182692 - DNA, 21 bp, Artificial sequence
  SiRNA target sequence
taaacttcacagattaccaat

SEQ ID NO: 182693 - DNA, 21 bp, Artificial sequence
  SiRNA target sequence
aaacttcacagattaccaatc

SEQ ID NO: 182694 - DNA, 21 bp, Artificial sequence
  SiRNA target sequence
aacttcacagattaccaatcc

SEQ ID NO: 182695 - DNA, 21 bp, Artificial sequence
  SiRNA target sequence
acttcacagattaccaatccc

SEQ ID NO: 182696 - DNA, 21 bp, Artificial sequence
  SiRNA target sequence
cttcacagattaccaatccct

SEQ ID NO: 182697 - DNA, 21 bp, Artificial sequence
  SiRNA target sequence
ttcacagattaccaatcccta

SEQ ID NO: 182698 - DNA, 21 bp, Artificial sequence
  SiRNA target sequence
tcacagattaccaatccctaa

SEQ ID NO: 182699 - DNA, 21 bp, Artificial sequence
  SiRNA target sequence
cacagattaccaatccctaaa

SEQ ID NO: 182700 - DNA, 21 bp, Artificial sequence
  SiRNA target sequence
acagattaccaatccctaaat

SEQ ID NO: 182701 - DNA, 21 bp, Artificial sequence
  SiRNA target sequence
cagattaccaatccctaaata

SEQ ID NO: 182702 - DNA, 21 bp, Artificial sequence
  SiRNA target sequence
agattaccaatccctaaatat

SEQ ID NO: 182703 - DNA, 21 bp, Artificial sequence
  SiRNA target sequence
gattaccaatccctaaatatg

SEQ ID NO: 182704 - DNA, 21 bp, Artificial sequence
  SiRNA target sequence
attaccaatccctaaatatgg

SEQ ID NO: 182705 - DNA, 21 bp, Artificial sequence
  SiRNA target sequence
ttaccaatccctaaatatggt

SEQ ID NO: 182706 - DNA, 21 bp, Artificial sequence
  SiRNA target sequence
taccaatccctaaatatggta

SEQ ID NO: 182707 - DNA, 21 bp, Artificial sequence
  SiRNA target sequence
accaatccctaaatatggtaa

SEQ ID NO: 182708 - DNA, 21 bp, Artificial sequence
  SiRNA target sequence
ccaatccctaaatatggtaag

SEQ ID NO: 182709 - DNA, 21 bp, Artificial sequence
  SiRNA target sequence
caatccctaaatatggtaagg

SEQ ID NO: 182710 - DNA, 21 bp, Artificial sequence
  SiRNA target sequence
aatccctaaatatggtaaggt

SEQ ID NO: 182711 - DNA, 21 bp, Artificial sequence
  SiRNA target sequence
atccctaaatatggtaaggtt

SEQ ID NO: 182712 - DNA, 21 bp, Artificial sequence
  SiRNA target sequence
tccctaaatatggtaaggttt

SEQ ID NO: 182713 - DNA, 21 bp, Artificial sequence
  SiRNA target sequence
ccctaaatatggtaaggtttt

SEQ ID NO: 182714 - DNA, 21 bp, Artificial sequence
  SiRNA target sequence
cctaaatatggtaaggtttta

SEQ ID NO: 182715 - DNA, 21 bp, Artificial sequence
  SiRNA target sequence
ctaaatatggtaaggttttag

SEQ ID NO: 182716 - DNA, 21 bp, Artificial sequence
  SiRNA target sequence
taaatatggtaaggttttagg

SEQ ID NO: 182717 - DNA, 21 bp, Artificial sequence
  SiRNA target sequence
aaatatggtaaggttttaggg

SEQ ID NO: 182718 - DNA, 21 bp, Artificial sequence
  SiRNA target sequence
aatatggtaaggttttagggc

SEQ ID NO: 182719 - DNA, 21 bp, Artificial sequence
  SiRNA target sequence
atatggtaaggttttagggct

SEQ ID NO: 182720 - DNA, 21 bp, Artificial sequence
  SiRNA target sequence
tatggtaaggttttagggcta

SEQ ID NO: 182721 - DNA, 21 bp, Artificial sequence
  SiRNA target sequence
atggtaaggttttagggctag

SEQ ID NO: 182722 - DNA, 21 bp, Artificial sequence
  SiRNA target sequence
tggtaaggttttagggctagt

SEQ ID NO: 182723 - DNA, 21 bp, Artificial sequence
  SiRNA target sequence
ggtaaggttttagggctagta

SEQ ID NO: 182724 - DNA, 21 bp, Artificial sequence
  SiRNA target sequence
gtaaggttttagggctagtag

SEQ ID NO: 182725 - DNA, 21 bp, Artificial sequence
  SiRNA target sequence
taaggttttagggctagtagg

SEQ ID NO: 182726 - DNA, 21 bp, Artificial sequence
  SiRNA target sequence
aaggttttagggctagtaggc

SEQ ID NO: 182727 - DNA, 21 bp, Artificial sequence
  SiRNA target sequence
aggttttagggctagtaggca

SEQ ID NO: 182728 - DNA, 21 bp, Artificial sequence
  SiRNA target sequence
ggttttagggctagtaggcac

SEQ ID NO: 182729 - DNA, 21 bp, Artificial sequence
  SiRNA target sequence
gttttagggctagtaggcact

SEQ ID NO: 182730 - DNA, 21 bp, Artificial sequence
  SiRNA target sequence
ttttagggctagtaggcacta

SEQ ID NO: 182731 - DNA, 21 bp, Artificial sequence
  SiRNA target sequence
tttagggctagtaggcactaa

SEQ ID NO: 182732 - DNA, 21 bp, Artificial sequence
  SiRNA target sequence
ttagggctagtaggcactaat

SEQ ID NO: 182733 - DNA, 21 bp, Artificial sequence
  SiRNA target sequence
tagggctagtaggcactaatg

SEQ ID NO: 182734 - DNA, 21 bp, Artificial sequence
  SiRNA target sequence
agggctagtaggcactaatgg

SEQ ID NO: 182735 - DNA, 21 bp, Artificial sequence
  SiRNA target sequence
gggctagtaggcactaatggt

SEQ ID NO: 182736 - DNA, 21 bp, Artificial sequence
  SiRNA target sequence
ggctagtaggcactaatggta

SEQ ID NO: 182737 - DNA, 21 bp, Artificial sequence
  SiRNA target sequence
gctagtaggcactaatggtat

SEQ ID NO: 182738 - DNA, 21 bp, Artificial sequence
  SiRNA target sequence
ctagtaggcactaatggtata

SEQ ID NO: 182739 - DNA, 21 bp, Artificial sequence
  SiRNA target sequence
tagtaggcactaatggtatag

SEQ ID NO: 182740 - DNA, 21 bp, Artificial sequence
  SiRNA target sequence
agtaggcactaatggtatagg

SEQ ID NO: 182741 - DNA, 21 bp, Artificial sequence
  SiRNA target sequence
gtaggcactaatggtatagga

SEQ ID NO: 182742 - DNA, 21 bp, Artificial sequence
  SiRNA target sequence
taggcactaatggtataggaa

SEQ ID NO: 182743 - DNA, 21 bp, Artificial sequence
  SiRNA target sequence
aggcactaatggtataggaaa

SEQ ID NO: 182744 - DNA, 21 bp, Artificial sequence
  SiRNA target sequence
ggcactaatggtataggaaaa

SEQ ID NO: 182745 - DNA, 21 bp, Artificial sequence
  SiRNA target sequence
gcactaatggtataggaaaaa

SEQ ID NO: 182746 - DNA, 21 bp, Artificial sequence
  SiRNA target sequence
cactaatggtataggaaaaag

SEQ ID NO: 182747 - DNA, 21 bp, Artificial sequence
  SiRNA target sequence
actaatggtataggaaaaagt

SEQ ID NO: 182748 - DNA, 21 bp, Artificial sequence
  SiRNA target sequence
ctaatggtataggaaaaagta

SEQ ID NO: 182749 - DNA, 21 bp, Artificial sequence
  SiRNA target sequence
taatggtataggaaaaagtac

SEQ ID NO: 182750 - DNA, 21 bp, Artificial sequence
  SiRNA target sequence
aatggtataggaaaaagtact

SEQ ID NO: 182751 - DNA, 21 bp, Artificial sequence
  SiRNA target sequence
atggtataggaaaaagtactg

SEQ ID NO: 182752 - DNA, 21 bp, Artificial sequence
  SiRNA target sequence
tggtataggaaaaagtactgc

SEQ ID NO: 182753 - DNA, 21 bp, Artificial sequence
  SiRNA target sequence
ggtataggaaaaagtactgca

SEQ ID NO: 182754 - DNA, 21 bp, Artificial sequence
  SiRNA target sequence
gtataggaaaaagtactgcac

SEQ ID NO: 182755 - DNA, 21 bp, Artificial sequence
  SiRNA target sequence
tataggaaaaagtactgcact

SEQ ID NO: 182756 - DNA, 21 bp, Artificial sequence
  SiRNA target sequence
ataggaaaaagtactgcactt

SEQ ID NO: 182757 - DNA, 21 bp, Artificial sequence
  SiRNA target sequence
taggaaaaagtactgcactta

SEQ ID NO: 182758 - DNA, 21 bp, Artificial sequence
  SiRNA target sequence
aggaaaaagtactgcacttaa

SEQ ID NO: 182759 - DNA, 21 bp, Artificial sequence
  SiRNA target sequence
ggaaaaagtactgcacttaaa

SEQ ID NO: 182760 - DNA, 21 bp, Artificial sequence
  SiRNA target sequence
gaaaaagtactgcacttaaaa

SEQ ID NO: 182761 - DNA, 21 bp, Artificial sequence
  SiRNA target sequence
aaaaagtactgcacttaaaat

SEQ ID NO: 182762 - DNA, 21 bp, Artificial sequence
  SiRNA target sequence
aaaagtactgcacttaaaata

SEQ ID NO: 182763 - DNA, 21 bp, Artificial sequence
  SiRNA target sequence
aaagtactgcacttaaaatat

SEQ ID NO: 182764 - DNA, 21 bp, Artificial sequence
  SiRNA target sequence
aagtactgcacttaaaatatt

SEQ ID NO: 182765 - DNA, 21 bp, Artificial sequence
  SiRNA target sequence
agtactgcacttaaaatatta

SEQ ID NO: 182766 - DNA, 21 bp, Artificial sequence
  SiRNA target sequence
gtactgcacttaaaatattat

SEQ ID NO: 182767 - DNA, 21 bp, Artificial sequence
  SiRNA target sequence
tactgcacttaaaatattatc

SEQ ID NO: 182768 - DNA, 21 bp, Artificial sequence
  SiRNA target sequence
actgcacttaaaatattatcg

SEQ ID NO: 182769 - DNA, 21 bp, Artificial sequence
  SiRNA target sequence
ctgcacttaaaatattatcgg

SEQ ID NO: 182770 - DNA, 21 bp, Artificial sequence
  SiRNA target sequence
tgcacttaaaatattatcggg

SEQ ID NO: 182771 - DNA, 21 bp, Artificial sequence
  SiRNA target sequence
gcacttaaaatattatcgggc

SEQ ID NO: 182772 - DNA, 21 bp, Artificial sequence
  SiRNA target sequence
cacttaaaatattatcgggca

SEQ ID NO: 182773 - DNA, 21 bp, Artificial sequence
  SiRNA target sequence
acttaaaatattatcgggcaa

SEQ ID NO: 182774 - DNA, 21 bp, Artificial sequence
  SiRNA target sequence
cttaaaatattatcgggcaat

SEQ ID NO: 182775 - DNA, 21 bp, Artificial sequence
  SiRNA target sequence
ttaaaatattatcgggcaatc

SEQ ID NO: 182776 - DNA, 21 bp, Artificial sequence
  SiRNA target sequence
taaaatattatcgggcaatct

SEQ ID NO: 182777 - DNA, 21 bp, Artificial sequence
  SiRNA target sequence
aaaatattatcgggcaatctt

SEQ ID NO: 182778 - DNA, 21 bp, Artificial sequence
  SiRNA target sequence
aaatattatcgggcaatctta

SEQ ID NO: 182779 - DNA, 21 bp, Artificial sequence
  SiRNA target sequence
aatattatcgggcaatcttaa

SEQ ID NO: 182780 - DNA, 21 bp, Artificial sequence
  SiRNA target sequence
atattatcgggcaatcttaaa

SEQ ID NO: 182781 - DNA, 21 bp, Artificial sequence
  SiRNA target sequence
tattatcgggcaatcttaaac

SEQ ID NO: 182782 - DNA, 21 bp, Artificial sequence
  SiRNA target sequence
attatcgggcaatcttaaacc

SEQ ID NO: 182783 - DNA, 21 bp, Artificial sequence
  SiRNA target sequence
ttatcgggcaatcttaaacca

SEQ ID NO: 182784 - DNA, 21 bp, Artificial sequence
  SiRNA target sequence
tatcgggcaatcttaaaccaa

SEQ ID NO: 182785 - DNA, 21 bp, Artificial sequence
  SiRNA target sequence
atcgggcaatcttaaaccaaa

SEQ ID NO: 182786 - DNA, 21 bp, Artificial sequence
  SiRNA target sequence
tcgggcaatcttaaaccaaac

SEQ ID NO: 182787 - DNA, 21 bp, Artificial sequence
  SiRNA target sequence
cgggcaatcttaaaccaaact

SEQ ID NO: 182788 - DNA, 21 bp, Artificial sequence
  SiRNA target sequence
gggcaatcttaaaccaaactt

SEQ ID NO: 182789 - DNA, 21 bp, Artificial sequence
  SiRNA target sequence
ggcaatcttaaaccaaactta

SEQ ID NO: 182790 - DNA, 21 bp, Artificial sequence
  SiRNA target sequence
gcaatcttaaaccaaacttag

SEQ ID NO: 182791 - DNA, 21 bp, Artificial sequence
  SiRNA target sequence
caatcttaaaccaaacttagg

SEQ ID NO: 182792 - DNA, 21 bp, Artificial sequence
  SiRNA target sequence
aatcttaaaccaaacttagga

SEQ ID NO: 182793 - DNA, 21 bp, Artificial sequence
  SiRNA target sequence
atcttaaaccaaacttaggaa

SEQ ID NO: 182794 - DNA, 21 bp, Artificial sequence
  SiRNA target sequence
tcttaaaccaaacttaggaaa

SEQ ID NO: 182795 - DNA, 21 bp, Artificial sequence
  SiRNA target sequence
cttaaaccaaacttaggaaag

SEQ ID NO: 182796 - DNA, 21 bp, Artificial sequence
  SiRNA target sequence
ttaaaccaaacttaggaaagt

SEQ ID NO: 182797 - DNA, 21 bp, Artificial sequence
  SiRNA target sequence
taaaccaaacttaggaaagtt

SEQ ID NO: 182798 - DNA, 21 bp, Artificial sequence
  SiRNA target sequence
aaaccaaacttaggaaagttc

SEQ ID NO: 182799 - DNA, 21 bp, Artificial sequence
  SiRNA target sequence
aaccaaacttaggaaagttcg

SEQ ID NO: 182800 - DNA, 21 bp, Artificial sequence
  SiRNA target sequence
accaaacttaggaaagttcga

SEQ ID NO: 182801 - DNA, 21 bp, Artificial sequence
  SiRNA target sequence
ccaaacttaggaaagttcgac

SEQ ID NO: 182802 - DNA, 21 bp, Artificial sequence
  SiRNA target sequence
caaacttaggaaagttcgacg

SEQ ID NO: 182803 - DNA, 21 bp, Artificial sequence
  SiRNA target sequence
aaacttaggaaagttcgacgt

SEQ ID NO: 182804 - DNA, 21 bp, Artificial sequence
  SiRNA target sequence
aacttaggaaagttcgacgtt

SEQ ID NO: 182805 - DNA, 21 bp, Artificial sequence
  SiRNA target sequence
acttaggaaagttcgacgtta

SEQ ID NO: 182806 - DNA, 21 bp, Artificial sequence
  SiRNA target sequence
cttaggaaagttcgacgttac

SEQ ID NO: 182807 - DNA, 21 bp, Artificial sequence
  SiRNA target sequence
ttaggaaagttcgacgttacg

SEQ ID NO: 182808 - DNA, 21 bp, Artificial sequence
  SiRNA target sequence
taggaaagttcgacgttacgc

SEQ ID NO: 182809 - DNA, 21 bp, Artificial sequence
  SiRNA target sequence
aggaaagttcgacgttacgcc

SEQ ID NO: 182810 - DNA, 21 bp, Artificial sequence
  SiRNA target sequence
ggaaagttcgacgttacgccc

SEQ ID NO: 182811 - DNA, 21 bp, Artificial sequence
  SiRNA target sequence
gaaagttcgacgttacgcccg

SEQ ID NO: 182812 - DNA, 21 bp, Artificial sequence
  SiRNA target sequence
aaagttcgacgttacgcccga

SEQ ID NO: 182813 - DNA, 21 bp, Artificial sequence
  SiRNA target sequence
aagttcgacgttacgcccgac

SEQ ID NO: 182814 - DNA, 21 bp, Artificial sequence
  SiRNA target sequence
agttcgacgttacgcccgact

SEQ ID NO: 182815 - DNA, 21 bp, Artificial sequence
  SiRNA target sequence
gttcgacgttacgcccgactg

SEQ ID NO: 182816 - DNA, 21 bp, Artificial sequence
  SiRNA target sequence
ttcgacgttacgcccgactgg

SEQ ID NO: 182817 - DNA, 21 bp, Artificial sequence
  SiRNA target sequence
tcgacgttacgcccgactggg

SEQ ID NO: 182818 - DNA, 21 bp, Artificial sequence
  SiRNA target sequence
cgacgttacgcccgactgggc

SEQ ID NO: 182819 - DNA, 21 bp, Artificial sequence
  SiRNA target sequence
gacgttacgcccgactgggca

SEQ ID NO: 182820 - DNA, 21 bp, Artificial sequence
  SiRNA target sequence
acgttacgcccgactgggcag

SEQ ID NO: 182821 - DNA, 21 bp, Artificial sequence
  SiRNA target sequence
cgttacgcccgactgggcagc

SEQ ID NO: 182822 - DNA, 21 bp, Artificial sequence
  SiRNA target sequence
gttacgcccgactgggcagca

SEQ ID NO: 182823 - DNA, 21 bp, Artificial sequence
  SiRNA target sequence
ttacgcccgactgggcagcaa

SEQ ID NO: 182824 - DNA, 21 bp, Artificial sequence
  SiRNA target sequence
tacgcccgactgggcagcaat

SEQ ID NO: 182825 - DNA, 21 bp, Artificial sequence
  SiRNA target sequence
acgcccgactgggcagcaatt

SEQ ID NO: 182826 - DNA, 21 bp, Artificial sequence
  SiRNA target sequence
cgcccgactgggcagcaattc

SEQ ID NO: 182827 - DNA, 21 bp, Artificial sequence
  SiRNA target sequence
gcccgactgggcagcaattct

SEQ ID NO: 182828 - DNA, 21 bp, Artificial sequence
  SiRNA target sequence
cccgactgggcagcaattcta

SEQ ID NO: 182829 - DNA, 21 bp, Artificial sequence
  SiRNA target sequence
ccgactgggcagcaattctaa

SEQ ID NO: 182830 - DNA, 21 bp, Artificial sequence
  SiRNA target sequence
cgactgggcagcaattctaaa

SEQ ID NO: 182831 - DNA, 21 bp, Artificial sequence
  SiRNA target sequence
gactgggcagcaattctaaat

SEQ ID NO: 182832 - DNA, 21 bp, Artificial sequence
  SiRNA target sequence
actgggcagcaattctaaata

SEQ ID NO: 182833 - DNA, 21 bp, Artificial sequence
  SiRNA target sequence
ctgggcagcaattctaaataa

SEQ ID NO: 182834 - DNA, 21 bp, Artificial sequence
  SiRNA target sequence
tgggcagcaattctaaataat

SEQ ID NO: 182835 - DNA, 21 bp, Artificial sequence
  SiRNA target sequence
gggcagcaattctaaataatt

SEQ ID NO: 182836 - DNA, 21 bp, Artificial sequence
  SiRNA target sequence
ggcagcaattctaaataatta

SEQ ID NO: 182837 - DNA, 21 bp, Artificial sequence
  SiRNA target sequence
gcagcaattctaaataattat

SEQ ID NO: 182838 - DNA, 21 bp, Artificial sequence
  SiRNA target sequence
cagcaattctaaataattata

SEQ ID NO: 182839 - DNA, 21 bp, Artificial sequence
  SiRNA target sequence
agcaattctaaataattataa

SEQ ID NO: 182840 - DNA, 21 bp, Artificial sequence
  SiRNA target sequence
gcaattctaaataattataaa

SEQ ID NO: 182841 - DNA, 21 bp, Artificial sequence
  SiRNA target sequence
caattctaaataattataaag

SEQ ID NO: 182842 - DNA, 21 bp, Artificial sequence
  SiRNA target sequence
aattctaaataattataaagg

SEQ ID NO: 182843 - DNA, 21 bp, Artificial sequence
  SiRNA target sequence
attctaaataattataaagga

SEQ ID NO: 182844 - DNA, 21 bp, Artificial sequence
  SiRNA target sequence
ttctaaataattataaaggat

SEQ ID NO: 182845 - DNA, 21 bp, Artificial sequence
  SiRNA target sequence
tctaaataattataaaggatc

SEQ ID NO: 182846 - DNA, 21 bp, Artificial sequence
  SiRNA target sequence
ctaaataattataaaggatct

SEQ ID NO: 182847 - DNA, 21 bp, Artificial sequence
  SiRNA target sequence
taaataattataaaggatctg

SEQ ID NO: 182848 - DNA, 21 bp, Artificial sequence
  SiRNA target sequence
aaataattataaaggatctga

SEQ ID NO: 182849 - DNA, 21 bp, Artificial sequence
  SiRNA target sequence
aataattataaaggatctgaa

SEQ ID NO: 182850 - DNA, 21 bp, Artificial sequence
  SiRNA target sequence
ataattataaaggatctgaac

SEQ ID NO: 182851 - DNA, 21 bp, Artificial sequence
  SiRNA target sequence
taattataaaggatctgaact

SEQ ID NO: 182852 - DNA, 21 bp, Artificial sequence
  SiRNA target sequence
aattataaaggatctgaactt

SEQ ID NO: 182853 - DNA, 21 bp, Artificial sequence
  SiRNA target sequence
attataaaggatctgaacttc

SEQ ID NO: 182854 - DNA, 21 bp, Artificial sequence
  SiRNA target sequence
ttataaaggatctgaacttca

SEQ ID NO: 182855 - DNA, 21 bp, Artificial sequence
  SiRNA target sequence
tataaaggatctgaacttcat

SEQ ID NO: 182856 - DNA, 21 bp, Artificial sequence
  SiRNA target sequence
ataaaggatctgaacttcatg

SEQ ID NO: 182857 - DNA, 21 bp, Artificial sequence
  SiRNA target sequence
taaaggatctgaacttcatgg

SEQ ID NO: 182858 - DNA, 21 bp, Artificial sequence
  SiRNA target sequence
aaaggatctgaacttcatgga

SEQ ID NO: 182859 - DNA, 21 bp, Artificial sequence
  SiRNA target sequence
aaggatctgaacttcatggat

SEQ ID NO: 182860 - DNA, 21 bp, Artificial sequence
  SiRNA target sequence
aggatctgaacttcatggatt

SEQ ID NO: 182861 - DNA, 21 bp, Artificial sequence
  SiRNA target sequence
ggatctgaacttcatggattt

SEQ ID NO: 182862 - DNA, 21 bp, Artificial sequence
  SiRNA target sequence
gatctgaacttcatggatttt

SEQ ID NO: 182863 - DNA, 21 bp, Artificial sequence
  SiRNA target sequence
atctgaacttcatggattttt

SEQ ID NO: 182864 - DNA, 21 bp, Artificial sequence
  SiRNA target sequence
tctgaacttcatggatttttt

SEQ ID NO: 182865 - DNA, 21 bp, Artificial sequence
  SiRNA target sequence
ctgaacttcatggatttttta

SEQ ID NO: 182866 - DNA, 21 bp, Artificial sequence
  SiRNA target sequence
tgaacttcatggattttttac

SEQ ID NO: 182867 - DNA, 21 bp, Artificial sequence
  SiRNA target sequence
gaacttcatggattttttact

SEQ ID NO: 182868 - DNA, 21 bp, Artificial sequence
  SiRNA target sequence
aacttcatggattttttacta

SEQ ID NO: 182869 - DNA, 21 bp, Artificial sequence
  SiRNA target sequence
acttcatggattttttactaa

SEQ ID NO: 182870 - DNA, 21 bp, Artificial sequence
  SiRNA target sequence
cttcatggattttttactaaa

SEQ ID NO: 182871 - DNA, 21 bp, Artificial sequence
  SiRNA target sequence
ttcatggattttttactaaaa

SEQ ID NO: 182872 - DNA, 21 bp, Artificial sequence
  SiRNA target sequence
tcatggattttttactaaaat

SEQ ID NO: 182873 - DNA, 21 bp, Artificial sequence
  SiRNA target sequence
catggattttttactaaaatt

SEQ ID NO: 182874 - DNA, 21 bp, Artificial sequence
  SiRNA target sequence
atggattttttactaaaattt

SEQ ID NO: 182875 - DNA, 21 bp, Artificial sequence
  SiRNA target sequence
tggattttttactaaaatttt

SEQ ID NO: 182876 - DNA, 21 bp, Artificial sequence
  SiRNA target sequence
ggattttttactaaaatttta

SEQ ID NO: 182877 - DNA, 21 bp, Artificial sequence
  SiRNA target sequence
gattttttactaaaattttag

SEQ ID NO: 182878 - DNA, 21 bp, Artificial sequence
  SiRNA target sequence
attttttactaaaattttaga

SEQ ID NO: 182879 - DNA, 21 bp, Artificial sequence
  SiRNA target sequence
ttttttactaaaattttagaa

SEQ ID NO: 182880 - DNA, 21 bp, Artificial sequence
  SiRNA target sequence
tttttactaaaattttagaag

SEQ ID NO: 182881 - DNA, 21 bp, Artificial sequence
  SiRNA target sequence
ttttactaaaattttagaagg

SEQ ID NO: 182882 - DNA, 21 bp, Artificial sequence
  SiRNA target sequence
tttactaaaattttagaaggg

SEQ ID NO: 182883 - DNA, 21 bp, Artificial sequence
  SiRNA target sequence
ttactaaaattttagaagggt

SEQ ID NO: 182884 - DNA, 21 bp, Artificial sequence
  SiRNA target sequence
tactaaaattttagaagggtc

SEQ ID NO: 182885 - DNA, 21 bp, Artificial sequence
  SiRNA target sequence
actaaaattttagaagggtct

SEQ ID NO: 182886 - DNA, 21 bp, Artificial sequence
  SiRNA target sequence
ctaaaattttagaagggtcta

SEQ ID NO: 182887 - DNA, 21 bp, Artificial sequence
  SiRNA target sequence
taaaattttagaagggtctat

SEQ ID NO: 182888 - DNA, 21 bp, Artificial sequence
  SiRNA target sequence
aaaattttagaagggtctatt

SEQ ID NO: 182889 - DNA, 21 bp, Artificial sequence
  SiRNA target sequence
aaattttagaagggtctatta

SEQ ID NO: 182890 - DNA, 21 bp, Artificial sequence
  SiRNA target sequence
aattttagaagggtctattaa

SEQ ID NO: 182891 - DNA, 21 bp, Artificial sequence
  SiRNA target sequence
attttagaagggtctattaaa

SEQ ID NO: 182892 - DNA, 21 bp, Artificial sequence
  SiRNA target sequence
ttttagaagggtctattaaag

SEQ ID NO: 182893 - DNA, 21 bp, Artificial sequence
  SiRNA target sequence
tttagaagggtctattaaagc

SEQ ID NO: 182894 - DNA, 21 bp, Artificial sequence
  SiRNA target sequence
ttagaagggtctattaaagct

SEQ ID NO: 182895 - DNA, 21 bp, Artificial sequence
  SiRNA target sequence
tagaagggtctattaaagcta

SEQ ID NO: 182896 - DNA, 21 bp, Artificial sequence
  SiRNA target sequence
agaagggtctattaaagctat

SEQ ID NO: 182897 - DNA, 21 bp, Artificial sequence
  SiRNA target sequence
gaagggtctattaaagctatt

SEQ ID NO: 182898 - DNA, 21 bp, Artificial sequence
  SiRNA target sequence
aagggtctattaaagctattt

SEQ ID NO: 182899 - DNA, 21 bp, Artificial sequence
  SiRNA target sequence
agggtctattaaagctatttc

SEQ ID NO: 182900 - DNA, 21 bp, Artificial sequence
  SiRNA target sequence
gggtctattaaagctatttct

SEQ ID NO: 182901 - DNA, 21 bp, Artificial sequence
  SiRNA target sequence
ggtctattaaagctatttcta

SEQ ID NO: 182902 - DNA, 21 bp, Artificial sequence
  SiRNA target sequence
gtctattaaagctatttctaa

SEQ ID NO: 182903 - DNA, 21 bp, Artificial sequence
  SiRNA target sequence
tctattaaagctatttctaag

SEQ ID NO: 182904 - DNA, 21 bp, Artificial sequence
  SiRNA target sequence
ctattaaagctatttctaaga

SEQ ID NO: 182905 - DNA, 21 bp, Artificial sequence
  SiRNA target sequence
tattaaagctatttctaagat

SEQ ID NO: 182906 - DNA, 21 bp, Artificial sequence
  SiRNA target sequence
attaaagctatttctaagata

SEQ ID NO: 182907 - DNA, 21 bp, Artificial sequence
  SiRNA target sequence
ttaaagctatttctaagatac

SEQ ID NO: 182908 - DNA, 21 bp, Artificial sequence
  SiRNA target sequence
taaagctatttctaagataca

SEQ ID NO: 182909 - DNA, 21 bp, Artificial sequence
  SiRNA target sequence
aaagctatttctaagatacag

SEQ ID NO: 182910 - DNA, 21 bp, Artificial sequence
  SiRNA target sequence
aagctatttctaagatacagt

SEQ ID NO: 182911 - DNA, 21 bp, Artificial sequence
  SiRNA target sequence
agctatttctaagatacagta

SEQ ID NO: 182912 - DNA, 21 bp, Artificial sequence
  SiRNA target sequence
gctatttctaagatacagtat

SEQ ID NO: 182913 - DNA, 21 bp, Artificial sequence
  SiRNA target sequence
ctatttctaagatacagtata

SEQ ID NO: 182914 - DNA, 21 bp, Artificial sequence
  SiRNA target sequence
tatttctaagatacagtatat

SEQ ID NO: 182915 - DNA, 21 bp, Artificial sequence
  SiRNA target sequence
atttctaagatacagtatata

SEQ ID NO: 182916 - DNA, 21 bp, Artificial sequence
  SiRNA target sequence
tttctaagatacagtatatag

SEQ ID NO: 182917 - DNA, 21 bp, Artificial sequence
  SiRNA target sequence
ttctaagatacagtatataga

SEQ ID NO: 182918 - DNA, 21 bp, Artificial sequence
  SiRNA target sequence
tctaagatacagtatatagat

SEQ ID NO: 182919 - DNA, 21 bp, Artificial sequence
  SiRNA target sequence
ctaagatacagtatatagata

SEQ ID NO: 182920 - DNA, 21 bp, Artificial sequence
  SiRNA target sequence
taagatacagtatatagataa

SEQ ID NO: 182921 - DNA, 21 bp, Artificial sequence
  SiRNA target sequence
aagatacagtatatagataaa

SEQ ID NO: 182922 - DNA, 21 bp, Artificial sequence
  SiRNA target sequence
agatacagtatatagataaaa

SEQ ID NO: 182923 - DNA, 21 bp, Artificial sequence
  SiRNA target sequence
gatacagtatatagataaaat

SEQ ID NO: 182924 - DNA, 21 bp, Artificial sequence
  SiRNA target sequence
atacagtatatagataaaatg

SEQ ID NO: 182925 - DNA, 21 bp, Artificial sequence
  SiRNA target sequence
tacagtatatagataaaatgc

SEQ ID NO: 182926 - DNA, 21 bp, Artificial sequence
  SiRNA target sequence
acagtatatagataaaatgcc

SEQ ID NO: 182927 - DNA, 21 bp, Artificial sequence
  SiRNA target sequence
cagtatatagataaaatgcct

SEQ ID NO: 182928 - DNA, 21 bp, Artificial sequence
  SiRNA target sequence
agtatatagataaaatgccta

SEQ ID NO: 182929 - DNA, 21 bp, Artificial sequence
  SiRNA target sequence
gtatatagataaaatgcctaa

SEQ ID NO: 182930 - DNA, 21 bp, Artificial sequence
  SiRNA target sequence
tatatagataaaatgcctaaa

SEQ ID NO: 182931 - DNA, 21 bp, Artificial sequence
  SiRNA target sequence
atatagataaaatgcctaaat

SEQ ID NO: 182932 - DNA, 21 bp, Artificial sequence
  SiRNA target sequence
tatagataaaatgcctaaatt

SEQ ID NO: 182933 - DNA, 21 bp, Artificial sequence
  SiRNA target sequence
atagataaaatgcctaaattt

SEQ ID NO: 182934 - DNA, 21 bp, Artificial sequence
  SiRNA target sequence
tagataaaatgcctaaatttt

SEQ ID NO: 182935 - DNA, 21 bp, Artificial sequence
  SiRNA target sequence
agataaaatgcctaaattttt

SEQ ID NO: 182936 - DNA, 21 bp, Artificial sequence
  SiRNA target sequence
gataaaatgcctaaattttta

SEQ ID NO: 182937 - DNA, 21 bp, Artificial sequence
  SiRNA target sequence
ataaaatgcctaaatttttaa

SEQ ID NO: 182938 - DNA, 21 bp, Artificial sequence
  SiRNA target sequence
taaaatgcctaaatttttaaa

SEQ ID NO: 182939 - DNA, 21 bp, Artificial sequence
  SiRNA target sequence
aaaatgcctaaatttttaaaa

SEQ ID NO: 182940 - DNA, 21 bp, Artificial sequence
  SiRNA target sequence
aaatgcctaaatttttaaaag

SEQ ID NO: 182941 - DNA, 21 bp, Artificial sequence
  SiRNA target sequence
aatgcctaaatttttaaaagg

SEQ ID NO: 182942 - DNA, 21 bp, Artificial sequence
  SiRNA target sequence
atgcctaaatttttaaaagga

SEQ ID NO: 182943 - DNA, 21 bp, Artificial sequence
  SiRNA target sequence
tgcctaaatttttaaaaggac

SEQ ID NO: 182944 - DNA, 21 bp, Artificial sequence
  SiRNA target sequence
gcctaaatttttaaaaggacg

SEQ ID NO: 182945 - DNA, 21 bp, Artificial sequence
  SiRNA target sequence
cctaaatttttaaaaggacgc

SEQ ID NO: 182946 - DNA, 21 bp, Artificial sequence
  SiRNA target sequence
ctaaatttttaaaaggacgct

SEQ ID NO: 182947 - DNA, 21 bp, Artificial sequence
  SiRNA target sequence
taaatttttaaaaggacgcta

SEQ ID NO: 182948 - DNA, 21 bp, Artificial sequence
  SiRNA target sequence
aaatttttaaaaggacgctat

SEQ ID NO: 182949 - DNA, 21 bp, Artificial sequence
  SiRNA target sequence
aatttttaaaaggacgctata

SEQ ID NO: 182950 - DNA, 21 bp, Artificial sequence
  SiRNA target sequence
atttttaaaaggacgctataa

SEQ ID NO: 182951 - DNA, 21 bp, Artificial sequence
  SiRNA target sequence
tttttaaaaggacgctataag

SEQ ID NO: 182952 - DNA, 21 bp, Artificial sequence
  SiRNA target sequence
ttttaaaaggacgctataagt

SEQ ID NO: 182953 - DNA, 21 bp, Artificial sequence
  SiRNA target sequence
tttaaaaggacgctataagtc

SEQ ID NO: 182954 - DNA, 21 bp, Artificial sequence
  SiRNA target sequence
ttaaaaggacgctataagtca

SEQ ID NO: 182955 - DNA, 21 bp, Artificial sequence
  SiRNA target sequence
taaaaggacgctataagtcag

SEQ ID NO: 182956 - DNA, 21 bp, Artificial sequence
  SiRNA target sequence
aaaaggacgctataagtcaga

SEQ ID NO: 182957 - DNA, 21 bp, Artificial sequence
  SiRNA target sequence
aaaggacgctataagtcagaa

SEQ ID NO: 182958 - DNA, 21 bp, Artificial sequence
  SiRNA target sequence
aaggacgctataagtcagaaa

SEQ ID NO: 182959 - DNA, 21 bp, Artificial sequence
  SiRNA target sequence
aggacgctataagtcagaaat

SEQ ID NO: 182960 - DNA, 21 bp, Artificial sequence
  SiRNA target sequence
ggacgctataagtcagaaatc

SEQ ID NO: 182961 - DNA, 21 bp, Artificial sequence
  SiRNA target sequence
gacgctataagtcagaaatcg

SEQ ID NO: 182962 - DNA, 21 bp, Artificial sequence
  SiRNA target sequence
acgctataagtcagaaatcgc

SEQ ID NO: 182963 - DNA, 21 bp, Artificial sequence
  SiRNA target sequence
cgctataagtcagaaatcgcc

SEQ ID NO: 182964 - DNA, 21 bp, Artificial sequence
  SiRNA target sequence
gctataagtcagaaatcgcct

SEQ ID NO: 182965 - DNA, 21 bp, Artificial sequence
  SiRNA target sequence
ctataagtcagaaatcgcctc

SEQ ID NO: 182966 - DNA, 21 bp, Artificial sequence
  SiRNA target sequence
tataagtcagaaatcgcctcc

SEQ ID NO: 182967 - DNA, 21 bp, Artificial sequence
  SiRNA target sequence
ataagtcagaaatcgcctccg

SEQ ID NO: 182968 - DNA, 21 bp, Artificial sequence
  SiRNA target sequence
taagtcagaaatcgcctccgg

SEQ ID NO: 182969 - DNA, 21 bp, Artificial sequence
  SiRNA target sequence
aagtcagaaatcgcctccgga

SEQ ID NO: 182970 - DNA, 21 bp, Artificial sequence
  SiRNA target sequence
agtcagaaatcgcctccggaa

SEQ ID NO: 182971 - DNA, 21 bp, Artificial sequence
  SiRNA target sequence
gtcagaaatcgcctccggaaa

SEQ ID NO: 182972 - DNA, 21 bp, Artificial sequence
  SiRNA target sequence
tcagaaatcgcctccggaaaa

SEQ ID NO: 182973 - DNA, 21 bp, Artificial sequence
  SiRNA target sequence
cagaaatcgcctccggaaaaa

SEQ ID NO: 182974 - DNA, 21 bp, Artificial sequence
  SiRNA target sequence
agaaatcgcctccggaaaaat

SEQ ID NO: 182975 - DNA, 21 bp, Artificial sequence
  SiRNA target sequence
gaaatcgcctccggaaaaatg

SEQ ID NO: 182976 - DNA, 21 bp, Artificial sequence
  SiRNA target sequence
aaatcgcctccggaaaaatgt

SEQ ID NO: 182977 - DNA, 21 bp, Artificial sequence
  SiRNA target sequence
aatcgcctccggaaaaatgtt

SEQ ID NO: 182978 - DNA, 21 bp, Artificial sequence
  SiRNA target sequence
atcgcctccggaaaaatgttg

SEQ ID NO: 182979 - DNA, 21 bp, Artificial sequence
  SiRNA target sequence
tcgcctccggaaaaatgttgt

SEQ ID NO: 182980 - DNA, 21 bp, Artificial sequence
  SiRNA target sequence
cgcctccggaaaaatgttgtt

SEQ ID NO: 182981 - DNA, 21 bp, Artificial sequence
  SiRNA target sequence
gcctccggaaaaatgttgttt

SEQ ID NO: 182982 - DNA, 21 bp, Artificial sequence
  SiRNA target sequence
cctccggaaaaatgttgttta

SEQ ID NO: 182983 - DNA, 21 bp, Artificial sequence
  SiRNA target sequence
ctccggaaaaatgttgtttac

SEQ ID NO: 182984 - DNA, 21 bp, Artificial sequence
  SiRNA target sequence
tccggaaaaatgttgtttact

SEQ ID NO: 182985 - DNA, 21 bp, Artificial sequence
  SiRNA target sequence
ccggaaaaatgttgtttactg

SEQ ID NO: 182986 - DNA, 21 bp, Artificial sequence
  SiRNA target sequence
cggaaaaatgttgtttactgt

SEQ ID NO: 182987 - DNA, 21 bp, Artificial sequence
  SiRNA target sequence
ggaaaaatgttgtttactgtt

SEQ ID NO: 182988 - DNA, 21 bp, Artificial sequence
  SiRNA target sequence
gaaaaatgttgtttactgtta

SEQ ID NO: 182989 - DNA, 21 bp, Artificial sequence
  SiRNA target sequence
aaaaatgttgtttactgttaa

SEQ ID NO: 182990 - DNA, 21 bp, Artificial sequence
  SiRNA target sequence
aaaatgttgtttactgttaat

SEQ ID NO: 182991 - DNA, 21 bp, Artificial sequence
  SiRNA target sequence
aaatgttgtttactgttaatg

SEQ ID NO: 182992 - DNA, 21 bp, Artificial sequence
  SiRNA target sequence
aatgttgtttactgttaatga

SEQ ID NO: 182993 - DNA, 21 bp, Artificial sequence
  SiRNA target sequence
atgttgtttactgttaatgat

SEQ ID NO: 182994 - DNA, 21 bp, Artificial sequence
  SiRNA target sequence
tgttgtttactgttaatgata

SEQ ID NO: 182995 - DNA, 21 bp, Artificial sequence
  SiRNA target sequence
gttgtttactgttaatgatat

SEQ ID NO: 182996 - DNA, 21 bp, Artificial sequence
  SiRNA target sequence
ttgtttactgttaatgatata

SEQ ID NO: 182997 - DNA, 21 bp, Artificial sequence
  SiRNA target sequence
tgtttactgttaatgatatat

SEQ ID NO: 182998 - DNA, 21 bp, Artificial sequence
  SiRNA target sequence
gtttactgttaatgatatatt

SEQ ID NO: 182999 - DNA, 21 bp, Artificial sequence
  SiRNA target sequence
tttactgttaatgatatatta

SEQ ID NO: 183000 - DNA, 21 bp, Artificial sequence
  SiRNA target sequence
ttactgttaatgatatattaa

SEQ ID NO: 183001 - DNA, 21 bp, Artificial sequence
  SiRNA target sequence
tactgttaatgatatattaaa

SEQ ID NO: 183002 - DNA, 21 bp, Artificial sequence
  SiRNA target sequence
actgttaatgatatattaaaa

SEQ ID NO: 183003 - DNA, 21 bp, Artificial sequence
  SiRNA target sequence
ctgttaatgatatattaaaaa

SEQ ID NO: 183004 - DNA, 21 bp, Artificial sequence
  SiRNA target sequence
tgttaatgatatattaaaaaa

SEQ ID NO: 183005 - DNA, 21 bp, Artificial sequence
  SiRNA target sequence
gttaatgatatattaaaaaaa

SEQ ID NO: 183006 - DNA, 21 bp, Artificial sequence
  SiRNA target sequence
ttaatgatatattaaaaaaag

SEQ ID NO: 183007 - DNA, 21 bp, Artificial sequence
  SiRNA target sequence
taatgatatattaaaaaaagt

SEQ ID NO: 183008 - DNA, 21 bp, Artificial sequence
  SiRNA target sequence
aatgatatattaaaaaaagtt

SEQ ID NO: 183009 - DNA, 21 bp, Artificial sequence
  SiRNA target sequence
atgatatattaaaaaaagttg

SEQ ID NO: 183010 - DNA, 21 bp, Artificial sequence
  SiRNA target sequence
tgatatattaaaaaaagttga

SEQ ID NO: 183011 - DNA, 21 bp, Artificial sequence
  SiRNA target sequence
gatatattaaaaaaagttgat

SEQ ID NO: 183012 - DNA, 21 bp, Artificial sequence
  SiRNA target sequence
atatattaaaaaaagttgatg

SEQ ID NO: 183013 - DNA, 21 bp, Artificial sequence
  SiRNA target sequence
tatattaaaaaaagttgatga

SEQ ID NO: 183014 - DNA, 21 bp, Artificial sequence
  SiRNA target sequence
atattaaaaaaagttgatgaa

SEQ ID NO: 183015 - DNA, 21 bp, Artificial sequence
  SiRNA target sequence
tattaaaaaaagttgatgaaa

SEQ ID NO: 183016 - DNA, 21 bp, Artificial sequence
  SiRNA target sequence
attaaaaaaagttgatgaaaa

SEQ ID NO: 183017 - DNA, 21 bp, Artificial sequence
  SiRNA target sequence
ttaaaaaaagttgatgaaaaa

SEQ ID NO: 183018 - DNA, 21 bp, Artificial sequence
  SiRNA target sequence
taaaaaaagttgatgaaaaaa

SEQ ID NO: 183019 - DNA, 21 bp, Artificial sequence
  SiRNA target sequence
aaaaaaagttgatgaaaaaaa

SEQ ID NO: 183020 - DNA, 21 bp, Artificial sequence
  SiRNA target sequence
aaaaaagttgatgaaaaaaat

SEQ ID NO: 183021 - DNA, 21 bp, Artificial sequence
  SiRNA target sequence
aaaaagttgatgaaaaaaata

SEQ ID NO: 183022 - DNA, 21 bp, Artificial sequence
  SiRNA target sequence
aaaagttgatgaaaaaaataa

SEQ ID NO: 183023 - DNA, 21 bp, Artificial sequence
  SiRNA target sequence
aaagttgatgaaaaaaataaa

SEQ ID NO: 183024 - DNA, 21 bp, Artificial sequence
  SiRNA target sequence
aagttgatgaaaaaaataaat

SEQ ID NO: 183025 - DNA, 21 bp, Artificial sequence
  SiRNA target sequence
agttgatgaaaaaaataaatt

SEQ ID NO: 183026 - DNA, 21 bp, Artificial sequence
  SiRNA target sequence
gttgatgaaaaaaataaattt

SEQ ID NO: 183027 - DNA, 21 bp, Artificial sequence
  SiRNA target sequence
ttgatgaaaaaaataaatttg

SEQ ID NO: 183028 - DNA, 21 bp, Artificial sequence
  SiRNA target sequence
tgatgaaaaaaataaatttga

SEQ ID NO: 183029 - DNA, 21 bp, Artificial sequence
  SiRNA target sequence
gatgaaaaaaataaatttgac

SEQ ID NO: 183030 - DNA, 21 bp, Artificial sequence
  SiRNA target sequence
atgaaaaaaataaatttgact

SEQ ID NO: 183031 - DNA, 21 bp, Artificial sequence
  SiRNA target sequence
tgaaaaaaataaatttgacta

SEQ ID NO: 183032 - DNA, 21 bp, Artificial sequence
  SiRNA target sequence
gaaaaaaataaatttgactat

SEQ ID NO: 183033 - DNA, 21 bp, Artificial sequence
  SiRNA target sequence
aaaaaaataaatttgactatt

SEQ ID NO: 183034 - DNA, 21 bp, Artificial sequence
  SiRNA target sequence
aaaaaataaatttgactatta

SEQ ID NO: 183035 - DNA, 21 bp, Artificial sequence
  SiRNA target sequence
aaaaataaatttgactattac

SEQ ID NO: 183036 - DNA, 21 bp, Artificial sequence
  SiRNA target sequence
aaaataaatttgactattacg

SEQ ID NO: 183037 - DNA, 21 bp, Artificial sequence
  SiRNA target sequence
aaataaatttgactattacgt

SEQ ID NO: 183038 - DNA, 21 bp, Artificial sequence
  SiRNA target sequence
aataaatttgactattacgta

SEQ ID NO: 183039 - DNA, 21 bp, Artificial sequence
  SiRNA target sequence
ataaatttgactattacgtag

SEQ ID NO: 183040 - DNA, 21 bp, Artificial sequence
  SiRNA target sequence
taaatttgactattacgtaga

SEQ ID NO: 183041 - DNA, 21 bp, Artificial sequence
  SiRNA target sequence
aaatttgactattacgtagat

SEQ ID NO: 183042 - DNA, 21 bp, Artificial sequence
  SiRNA target sequence
aatttgactattacgtagata

SEQ ID NO: 183043 - DNA, 21 bp, Artificial sequence
  SiRNA target sequence
atttgactattacgtagataa

SEQ ID NO: 183044 - DNA, 21 bp, Artificial sequence
  SiRNA target sequence
tttgactattacgtagataaa

SEQ ID NO: 183045 - DNA, 21 bp, Artificial sequence
  SiRNA target sequence
ttgactattacgtagataaaa

SEQ ID NO: 183046 - DNA, 21 bp, Artificial sequence
  SiRNA target sequence
tgactattacgtagataaaat

SEQ ID NO: 183047 - DNA, 21 bp, Artificial sequence
  SiRNA target sequence
gactattacgtagataaaatg

SEQ ID NO: 183048 - DNA, 21 bp, Artificial sequence
  SiRNA target sequence
actattacgtagataaaatgg

SEQ ID NO: 183049 - DNA, 21 bp, Artificial sequence
  SiRNA target sequence
ctattacgtagataaaatggc

SEQ ID NO: 183050 - DNA, 21 bp, Artificial sequence
  SiRNA target sequence
tattacgtagataaaatggca

SEQ ID NO: 183051 - DNA, 21 bp, Artificial sequence
  SiRNA target sequence
attacgtagataaaatggcac

SEQ ID NO: 183052 - DNA, 21 bp, Artificial sequence
  SiRNA target sequence
ttacgtagataaaatggcact

SEQ ID NO: 183053 - DNA, 21 bp, Artificial sequence
  SiRNA target sequence
tacgtagataaaatggcactt

SEQ ID NO: 183054 - DNA, 21 bp, Artificial sequence
  SiRNA target sequence
acgtagataaaatggcactta

SEQ ID NO: 183055 - DNA, 21 bp, Artificial sequence
  SiRNA target sequence
cgtagataaaatggcacttaa

SEQ ID NO: 183056 - DNA, 21 bp, Artificial sequence
  SiRNA target sequence
gtagataaaatggcacttaaa

SEQ ID NO: 183057 - DNA, 21 bp, Artificial sequence
  SiRNA target sequence
tagataaaatggcacttaaaa

SEQ ID NO: 183058 - DNA, 21 bp, Artificial sequence
  SiRNA target sequence
agataaaatggcacttaaaaa

SEQ ID NO: 183059 - DNA, 21 bp, Artificial sequence
  SiRNA target sequence
gataaaatggcacttaaaaat

SEQ ID NO: 183060 - DNA, 21 bp, Artificial sequence
  SiRNA target sequence
ataaaatggcacttaaaaatg

SEQ ID NO: 183061 - DNA, 21 bp, Artificial sequence
  SiRNA target sequence
taaaatggcacttaaaaatgt

SEQ ID NO: 183062 - DNA, 21 bp, Artificial sequence
  SiRNA target sequence
aaaatggcacttaaaaatgta

SEQ ID NO: 183063 - DNA, 21 bp, Artificial sequence
  SiRNA target sequence
aaatggcacttaaaaatgtat

SEQ ID NO: 183064 - DNA, 21 bp, Artificial sequence
  SiRNA target sequence
aatggcacttaaaaatgtatt

SEQ ID NO: 183065 - DNA, 21 bp, Artificial sequence
  SiRNA target sequence
atggcacttaaaaatgtatta

SEQ ID NO: 183066 - DNA, 21 bp, Artificial sequence
  SiRNA target sequence
tggcacttaaaaatgtattaa

SEQ ID NO: 183067 - DNA, 21 bp, Artificial sequence
  SiRNA target sequence
ggcacttaaaaatgtattaac

SEQ ID NO: 183068 - DNA, 21 bp, Artificial sequence
  SiRNA target sequence
gcacttaaaaatgtattaaca

SEQ ID NO: 183069 - DNA, 21 bp, Artificial sequence
  SiRNA target sequence
cacttaaaaatgtattaacaa

SEQ ID NO: 183070 - DNA, 21 bp, Artificial sequence
  SiRNA target sequence
acttaaaaatgtattaacaag

SEQ ID NO: 183071 - DNA, 21 bp, Artificial sequence
  SiRNA target sequence
cttaaaaatgtattaacaaga

SEQ ID NO: 183072 - DNA, 21 bp, Artificial sequence
  SiRNA target sequence
ttaaaaatgtattaacaagag

SEQ ID NO: 183073 - DNA, 21 bp, Artificial sequence
  SiRNA target sequence
taaaaatgtattaacaagaga

SEQ ID NO: 183074 - DNA, 21 bp, Artificial sequence
  SiRNA target sequence
aaaaatgtattaacaagagaa

SEQ ID NO: 183075 - DNA, 21 bp, Artificial sequence
  SiRNA target sequence
aaaatgtattaacaagagaat

SEQ ID NO: 183076 - DNA, 21 bp, Artificial sequence
  SiRNA target sequence
aaatgtattaacaagagaatt

SEQ ID NO: 183077 - DNA, 21 bp, Artificial sequence
  SiRNA target sequence
aatgtattaacaagagaatta

SEQ ID NO: 183078 - DNA, 21 bp, Artificial sequence
  SiRNA target sequence
atgtattaacaagagaattag

SEQ ID NO: 183079 - DNA, 21 bp, Artificial sequence
  SiRNA target sequence
tgtattaacaagagaattaga

SEQ ID NO: 183080 - DNA, 21 bp, Artificial sequence
  SiRNA target sequence
gtattaacaagagaattagag

SEQ ID NO: 183081 - DNA, 21 bp, Artificial sequence
  SiRNA target sequence
tattaacaagagaattagagc

SEQ ID NO: 183082 - DNA, 21 bp, Artificial sequence
  SiRNA target sequence
attaacaagagaattagagca

SEQ ID NO: 183083 - DNA, 21 bp, Artificial sequence
  SiRNA target sequence
ttaacaagagaattagagcaa

SEQ ID NO: 183084 - DNA, 21 bp, Artificial sequence
  SiRNA target sequence
taacaagagaattagagcaat

SEQ ID NO: 183085 - DNA, 21 bp, Artificial sequence
  SiRNA target sequence
aacaagagaattagagcaatt

SEQ ID NO: 183086 - DNA, 21 bp, Artificial sequence
  SiRNA target sequence
acaagagaattagagcaatta

SEQ ID NO: 183087 - DNA, 21 bp, Artificial sequence
  SiRNA target sequence
caagagaattagagcaattaa

SEQ ID NO: 183088 - DNA, 21 bp, Artificial sequence
  SiRNA target sequence
aagagaattagagcaattaag

SEQ ID NO: 183089 - DNA, 21 bp, Artificial sequence
  SiRNA target sequence
agagaattagagcaattaagt

SEQ ID NO: 183090 - DNA, 21 bp, Artificial sequence
  SiRNA target sequence
gagaattagagcaattaagtg

SEQ ID NO: 183091 - DNA, 21 bp, Artificial sequence
  SiRNA target sequence
agaattagagcaattaagtgg

SEQ ID NO: 183092 - DNA, 21 bp, Artificial sequence
  SiRNA target sequence
gaattagagcaattaagtggt

SEQ ID NO: 183093 - DNA, 21 bp, Artificial sequence
  SiRNA target sequence
aattagagcaattaagtggtg

SEQ ID NO: 183094 - DNA, 21 bp, Artificial sequence
  SiRNA target sequence
attagagcaattaagtggtgg

SEQ ID NO: 183095 - DNA, 21 bp, Artificial sequence
  SiRNA target sequence
ttagagcaattaagtggtggt

SEQ ID NO: 183096 - DNA, 21 bp, Artificial sequence
  SiRNA target sequence
tagagcaattaagtggtggtg

SEQ ID NO: 183097 - DNA, 21 bp, Artificial sequence
  SiRNA target sequence
agagcaattaagtggtggtga

SEQ ID NO: 183098 - DNA, 21 bp, Artificial sequence
  SiRNA target sequence
gagcaattaagtggtggtgaa

SEQ ID NO: 183099 - DNA, 21 bp, Artificial sequence
  SiRNA target sequence
agcaattaagtggtggtgaac

SEQ ID NO: 183100 - DNA, 21 bp, Artificial sequence
  SiRNA target sequence
gcaattaagtggtggtgaact

SEQ ID NO: 183101 - DNA, 21 bp, Artificial sequence
  SiRNA target sequence
caattaagtggtggtgaactt

SEQ ID NO: 183102 - DNA, 21 bp, Artificial sequence
  SiRNA target sequence
aattaagtggtggtgaacttc

SEQ ID NO: 183103 - DNA, 21 bp, Artificial sequence
  SiRNA target sequence
attaagtggtggtgaacttca

SEQ ID NO: 183104 - DNA, 21 bp, Artificial sequence
  SiRNA target sequence
ttaagtggtggtgaacttcaa

SEQ ID NO: 183105 - DNA, 21 bp, Artificial sequence
  SiRNA target sequence
taagtggtggtgaacttcaaa

SEQ ID NO: 183106 - DNA, 21 bp, Artificial sequence
  SiRNA target sequence
aagtggtggtgaacttcaaag

SEQ ID NO: 183107 - DNA, 21 bp, Artificial sequence
  SiRNA target sequence
agtggtggtgaacttcaaaga

SEQ ID NO: 183108 - DNA, 21 bp, Artificial sequence
  SiRNA target sequence
gtggtggtgaacttcaaagat

SEQ ID NO: 183109 - DNA, 21 bp, Artificial sequence
  SiRNA target sequence
tggtggtgaacttcaaagatt

SEQ ID NO: 183110 - DNA, 21 bp, Artificial sequence
  SiRNA target sequence
ggtggtgaacttcaaagattt

SEQ ID NO: 183111 - DNA, 21 bp, Artificial sequence
  SiRNA target sequence
gtggtgaacttcaaagatttt

SEQ ID NO: 183112 - DNA, 21 bp, Artificial sequence
  SiRNA target sequence
tggtgaacttcaaagattttg

SEQ ID NO: 183113 - DNA, 21 bp, Artificial sequence
  SiRNA target sequence
ggtgaacttcaaagattttgt

SEQ ID NO: 183114 - DNA, 21 bp, Artificial sequence
  SiRNA target sequence
gtgaacttcaaagattttgta

SEQ ID NO: 183115 - DNA, 21 bp, Artificial sequence
  SiRNA target sequence
tgaacttcaaagattttgtat

SEQ ID NO: 183116 - DNA, 21 bp, Artificial sequence
  SiRNA target sequence
gaacttcaaagattttgtatt

SEQ ID NO: 183117 - DNA, 21 bp, Artificial sequence
  SiRNA target sequence
aacttcaaagattttgtattg

SEQ ID NO: 183118 - DNA, 21 bp, Artificial sequence
  SiRNA target sequence
acttcaaagattttgtattgc

SEQ ID NO: 183119 - DNA, 21 bp, Artificial sequence
  SiRNA target sequence
cttcaaagattttgtattgca

SEQ ID NO: 183120 - DNA, 21 bp, Artificial sequence
  SiRNA target sequence
ttcaaagattttgtattgcat

SEQ ID NO: 183121 - DNA, 21 bp, Artificial sequence
  SiRNA target sequence
tcaaagattttgtattgcata

SEQ ID NO: 183122 - DNA, 21 bp, Artificial sequence
  SiRNA target sequence
caaagattttgtattgcatac

SEQ ID NO: 183123 - DNA, 21 bp, Artificial sequence
  SiRNA target sequence
aaagattttgtattgcataca

SEQ ID NO: 183124 - DNA, 21 bp, Artificial sequence
  SiRNA target sequence
aagattttgtattgcatacac

SEQ ID NO: 183125 - DNA, 21 bp, Artificial sequence
  SiRNA target sequence
agattttgtattgcatacaca

SEQ ID NO: 183126 - DNA, 21 bp, Artificial sequence
  SiRNA target sequence
gattttgtattgcatacacat

SEQ ID NO: 183127 - DNA, 21 bp, Artificial sequence
  SiRNA target sequence
attttgtattgcatacacatg

SEQ ID NO: 183128 - DNA, 21 bp, Artificial sequence
  SiRNA target sequence
ttttgtattgcatacacatgt

SEQ ID NO: 183129 - DNA, 21 bp, Artificial sequence
  SiRNA target sequence
tttgtattgcatacacatgtt

SEQ ID NO: 183130 - DNA, 21 bp, Artificial sequence
  SiRNA target sequence
ttgtattgcatacacatgttt

SEQ ID NO: 183131 - DNA, 21 bp, Artificial sequence
  SiRNA target sequence
tgtattgcatacacatgttta

SEQ ID NO: 183132 - DNA, 21 bp, Artificial sequence
  SiRNA target sequence
gtattgcatacacatgtttac

SEQ ID NO: 183133 - DNA, 21 bp, Artificial sequence
  SiRNA target sequence
tattgcatacacatgtttaca

SEQ ID NO: 183134 - DNA, 21 bp, Artificial sequence
  SiRNA target sequence
attgcatacacatgtttacaa

SEQ ID NO: 183135 - DNA, 21 bp, Artificial sequence
  SiRNA target sequence
ttgcatacacatgtttacaag

SEQ ID NO: 183136 - DNA, 21 bp, Artificial sequence
  SiRNA target sequence
tgcatacacatgtttacaaga

SEQ ID NO: 183137 - DNA, 21 bp, Artificial sequence
  SiRNA target sequence
gcatacacatgtttacaagaa

SEQ ID NO: 183138 - DNA, 21 bp, Artificial sequence
  SiRNA target sequence
catacacatgtttacaagaag

SEQ ID NO: 183139 - DNA, 21 bp, Artificial sequence
  SiRNA target sequence
atacacatgtttacaagaagg

SEQ ID NO: 183140 - DNA, 21 bp, Artificial sequence
  SiRNA target sequence
tacacatgtttacaagaagga

SEQ ID NO: 183141 - DNA, 21 bp, Artificial sequence
  SiRNA target sequence
acacatgtttacaagaaggaa

SEQ ID NO: 183142 - DNA, 21 bp, Artificial sequence
  SiRNA target sequence
cacatgtttacaagaaggaaa

SEQ ID NO: 183143 - DNA, 21 bp, Artificial sequence
  SiRNA target sequence
acatgtttacaagaaggaaat

SEQ ID NO: 183144 - DNA, 21 bp, Artificial sequence
  SiRNA target sequence
catgtttacaagaaggaaatg

SEQ ID NO: 183145 - DNA, 21 bp, Artificial sequence
  SiRNA target sequence
atgtttacaagaaggaaatgt

SEQ ID NO: 183146 - DNA, 21 bp, Artificial sequence
  SiRNA target sequence
tgtttacaagaaggaaatgtt

SEQ ID NO: 183147 - DNA, 21 bp, Artificial sequence
  SiRNA target sequence
gtttacaagaaggaaatgttt

SEQ ID NO: 183148 - DNA, 21 bp, Artificial sequence
  SiRNA target sequence
tttacaagaaggaaatgttta

SEQ ID NO: 183149 - DNA, 21 bp, Artificial sequence
  SiRNA target sequence
ttacaagaaggaaatgtttat

SEQ ID NO: 183150 - DNA, 21 bp, Artificial sequence
  SiRNA target sequence
tacaagaaggaaatgtttata

SEQ ID NO: 183151 - DNA, 21 bp, Artificial sequence
  SiRNA target sequence
acaagaaggaaatgtttatat

SEQ ID NO: 183152 - DNA, 21 bp, Artificial sequence
  SiRNA target sequence
caagaaggaaatgtttatatt

SEQ ID NO: 183153 - DNA, 21 bp, Artificial sequence
  SiRNA target sequence
aagaaggaaatgtttatattt

SEQ ID NO: 183154 - DNA, 21 bp, Artificial sequence
  SiRNA target sequence
agaaggaaatgtttatatttt

SEQ ID NO: 183155 - DNA, 21 bp, Artificial sequence
  SiRNA target sequence
gaaggaaatgtttatattttt

SEQ ID NO: 183156 - DNA, 21 bp, Artificial sequence
  SiRNA target sequence
aaggaaatgtttatatttttg

SEQ ID NO: 183157 - DNA, 21 bp, Artificial sequence
  SiRNA target sequence
aggaaatgtttatatttttga

SEQ ID NO: 183158 - DNA, 21 bp, Artificial sequence
  SiRNA target sequence
ggaaatgtttatatttttgat

SEQ ID NO: 183159 - DNA, 21 bp, Artificial sequence
  SiRNA target sequence
gaaatgtttatatttttgatg

SEQ ID NO: 183160 - DNA, 21 bp, Artificial sequence
  SiRNA target sequence
aaatgtttatatttttgatga

SEQ ID NO: 183161 - DNA, 21 bp, Artificial sequence
  SiRNA target sequence
aatgtttatatttttgatgaa

SEQ ID NO: 183162 - DNA, 21 bp, Artificial sequence
  SiRNA target sequence
atgtttatatttttgatgaac

SEQ ID NO: 183163 - DNA, 21 bp, Artificial sequence
  SiRNA target sequence
tgtttatatttttgatgaacc

SEQ ID NO: 183164 - DNA, 21 bp, Artificial sequence
  SiRNA target sequence
gtttatatttttgatgaaccc

SEQ ID NO: 183165 - DNA, 21 bp, Artificial sequence
  SiRNA target sequence
tttatatttttgatgaaccca

SEQ ID NO: 183166 - DNA, 21 bp, Artificial sequence
  SiRNA target sequence
ttatatttttgatgaacccac

SEQ ID NO: 183167 - DNA, 21 bp, Artificial sequence
  SiRNA target sequence
tatatttttgatgaacccact

SEQ ID NO: 183168 - DNA, 21 bp, Artificial sequence
  SiRNA target sequence
atatttttgatgaacccacta

SEQ ID NO: 183169 - DNA, 21 bp, Artificial sequence
  SiRNA target sequence
tatttttgatgaacccactag

SEQ ID NO: 183170 - DNA, 21 bp, Artificial sequence
  SiRNA target sequence
atttttgatgaacccactagt

SEQ ID NO: 183171 - DNA, 21 bp, Artificial sequence
  SiRNA target sequence
tttttgatgaacccactagtt

SEQ ID NO: 183172 - DNA, 21 bp, Artificial sequence
  SiRNA target sequence
ttttgatgaacccactagttt

SEQ ID NO: 183173 - DNA, 21 bp, Artificial sequence
  SiRNA target sequence
tttgatgaacccactagtttt

SEQ ID NO: 183174 - DNA, 21 bp, Artificial sequence
  SiRNA target sequence
ttgatgaacccactagttttt

SEQ ID NO: 183175 - DNA, 21 bp, Artificial sequence
  SiRNA target sequence
tgatgaacccactagtttttt

SEQ ID NO: 183176 - DNA, 21 bp, Artificial sequence
  SiRNA target sequence
gatgaacccactagttttttg

SEQ ID NO: 183177 - DNA, 21 bp, Artificial sequence
  SiRNA target sequence
atgaacccactagttttttgg

SEQ ID NO: 183178 - DNA, 21 bp, Artificial sequence
  SiRNA target sequence
tgaacccactagttttttgga

SEQ ID NO: 183179 - DNA, 21 bp, Artificial sequence
  SiRNA target sequence
gaacccactagttttttggat

SEQ ID NO: 183180 - DNA, 21 bp, Artificial sequence
  SiRNA target sequence
aacccactagttttttggatg

SEQ ID NO: 183181 - DNA, 21 bp, Artificial sequence
  SiRNA target sequence
acccactagttttttggatgt

SEQ ID NO: 183182 - DNA, 21 bp, Artificial sequence
  SiRNA target sequence
cccactagttttttggatgtt

SEQ ID NO: 183183 - DNA, 21 bp, Artificial sequence
  SiRNA target sequence
ccactagttttttggatgtta

SEQ ID NO: 183184 - DNA, 21 bp, Artificial sequence
  SiRNA target sequence
cactagttttttggatgttaa

SEQ ID NO: 183185 - DNA, 21 bp, Artificial sequence
  SiRNA target sequence
actagttttttggatgttaag

SEQ ID NO: 183186 - DNA, 21 bp, Artificial sequence
  SiRNA target sequence
ctagttttttggatgttaagc

SEQ ID NO: 183187 - DNA, 21 bp, Artificial sequence
  SiRNA target sequence
tagttttttggatgttaagca

SEQ ID NO: 183188 - DNA, 21 bp, Artificial sequence
  SiRNA target sequence
agttttttggatgttaagcag

SEQ ID NO: 183189 - DNA, 21 bp, Artificial sequence
  SiRNA target sequence
gttttttggatgttaagcagc

SEQ ID NO: 183190 - DNA, 21 bp, Artificial sequence
  SiRNA target sequence
ttttttggatgttaagcagcg

SEQ ID NO: 183191 - DNA, 21 bp, Artificial sequence
  SiRNA target sequence
tttttggatgttaagcagcga

SEQ ID NO: 183192 - DNA, 21 bp, Artificial sequence
  SiRNA target sequence
ttttggatgttaagcagcgac

SEQ ID NO: 183193 - DNA, 21 bp, Artificial sequence
  SiRNA target sequence
tttggatgttaagcagcgact

SEQ ID NO: 183194 - DNA, 21 bp, Artificial sequence
  SiRNA target sequence
ttggatgttaagcagcgacta

SEQ ID NO: 183195 - DNA, 21 bp, Artificial sequence
  SiRNA target sequence
tggatgttaagcagcgactag

SEQ ID NO: 183196 - DNA, 21 bp, Artificial sequence
  SiRNA target sequence
ggatgttaagcagcgactagc

SEQ ID NO: 183197 - DNA, 21 bp, Artificial sequence
  SiRNA target sequence
gatgttaagcagcgactagca

SEQ ID NO: 183198 - DNA, 21 bp, Artificial sequence
  SiRNA target sequence
atgttaagcagcgactagcag

SEQ ID NO: 183199 - DNA, 21 bp, Artificial sequence
  SiRNA target sequence
tgttaagcagcgactagcagc

SEQ ID NO: 183200 - DNA, 21 bp, Artificial sequence
  SiRNA target sequence
gttaagcagcgactagcagct

SEQ ID NO: 183201 - DNA, 21 bp, Artificial sequence
  SiRNA target sequence
ttaagcagcgactagcagctg

SEQ ID NO: 183202 - DNA, 21 bp, Artificial sequence
  SiRNA target sequence
taagcagcgactagcagctgc

SEQ ID NO: 183203 - DNA, 21 bp, Artificial sequence
  SiRNA target sequence
aagcagcgactagcagctgct

SEQ ID NO: 183204 - DNA, 21 bp, Artificial sequence
  SiRNA target sequence
agcagcgactagcagctgcta

SEQ ID NO: 183205 - DNA, 21 bp, Artificial sequence
  SiRNA target sequence
gcagcgactagcagctgctaa

SEQ ID NO: 183206 - DNA, 21 bp, Artificial sequence
  SiRNA target sequence
cagcgactagcagctgctaag

SEQ ID NO: 183207 - DNA, 21 bp, Artificial sequence
  SiRNA target sequence
agcgactagcagctgctaagg

SEQ ID NO: 183208 - DNA, 21 bp, Artificial sequence
  SiRNA target sequence
gcgactagcagctgctaagga

SEQ ID NO: 183209 - DNA, 21 bp, Artificial sequence
  SiRNA target sequence
cgactagcagctgctaaggaa

SEQ ID NO: 183210 - DNA, 21 bp, Artificial sequence
  SiRNA target sequence
gactagcagctgctaaggaaa

SEQ ID NO: 183211 - DNA, 21 bp, Artificial sequence
  SiRNA target sequence
actagcagctgctaaggaaat

SEQ ID NO: 183212 - DNA, 21 bp, Artificial sequence
  SiRNA target sequence
ctagcagctgctaaggaaata

SEQ ID NO: 183213 - DNA, 21 bp, Artificial sequence
  SiRNA target sequence
tagcagctgctaaggaaataa

SEQ ID NO: 183214 - DNA, 21 bp, Artificial sequence
  SiRNA target sequence
agcagctgctaaggaaataag

SEQ ID NO: 183215 - DNA, 21 bp, Artificial sequence
  SiRNA target sequence
gcagctgctaaggaaataaga

SEQ ID NO: 183216 - DNA, 21 bp, Artificial sequence
  SiRNA target sequence
cagctgctaaggaaataagaa

SEQ ID NO: 183217 - DNA, 21 bp, Artificial sequence
  SiRNA target sequence
agctgctaaggaaataagaaa

SEQ ID NO: 183218 - DNA, 21 bp, Artificial sequence
  SiRNA target sequence
gctgctaaggaaataagaaat

SEQ ID NO: 183219 - DNA, 21 bp, Artificial sequence
  SiRNA target sequence
ctgctaaggaaataagaaatt

SEQ ID NO: 183220 - DNA, 21 bp, Artificial sequence
  SiRNA target sequence
tgctaaggaaataagaaattt

SEQ ID NO: 183221 - DNA, 21 bp, Artificial sequence
  SiRNA target sequence
gctaaggaaataagaaatttg

SEQ ID NO: 183222 - DNA, 21 bp, Artificial sequence
  SiRNA target sequence
ctaaggaaataagaaatttgt

SEQ ID NO: 183223 - DNA, 21 bp, Artificial sequence
  SiRNA target sequence
taaggaaataagaaatttgtg

SEQ ID NO: 183224 - DNA, 21 bp, Artificial sequence
  SiRNA target sequence
aaggaaataagaaatttgtgt

SEQ ID NO: 183225 - DNA, 21 bp, Artificial sequence
  SiRNA target sequence
aggaaataagaaatttgtgtg

SEQ ID NO: 183226 - DNA, 21 bp, Artificial sequence
  SiRNA target sequence
ggaaataagaaatttgtgtga

SEQ ID NO: 183227 - DNA, 21 bp, Artificial sequence
  SiRNA target sequence
gaaataagaaatttgtgtgaa

SEQ ID NO: 183228 - DNA, 21 bp, Artificial sequence
  SiRNA target sequence
aaataagaaatttgtgtgaag

SEQ ID NO: 183229 - DNA, 21 bp, Artificial sequence
  SiRNA target sequence
aataagaaatttgtgtgaaga

SEQ ID NO: 183230 - DNA, 21 bp, Artificial sequence
  SiRNA target sequence
ataagaaatttgtgtgaagaa

SEQ ID NO: 183231 - DNA, 21 bp, Artificial sequence
  SiRNA target sequence
taagaaatttgtgtgaagaaa

SEQ ID NO: 183232 - DNA, 21 bp, Artificial sequence
  SiRNA target sequence
aagaaatttgtgtgaagaaaa

SEQ ID NO: 183233 - DNA, 21 bp, Artificial sequence
  SiRNA target sequence
agaaatttgtgtgaagaaaat

SEQ ID NO: 183234 - DNA, 21 bp, Artificial sequence
  SiRNA target sequence
gaaatttgtgtgaagaaaata

SEQ ID NO: 183235 - DNA, 21 bp, Artificial sequence
  SiRNA target sequence
aaatttgtgtgaagaaaataa

SEQ ID NO: 183236 - DNA, 21 bp, Artificial sequence
  SiRNA target sequence
aatttgtgtgaagaaaataaa

SEQ ID NO: 183237 - DNA, 21 bp, Artificial sequence
  SiRNA target sequence
atttgtgtgaagaaaataaat

SEQ ID NO: 183238 - DNA, 21 bp, Artificial sequence
  SiRNA target sequence
tttgtgtgaagaaaataaata

SEQ ID NO: 183239 - DNA, 21 bp, Artificial sequence
  SiRNA target sequence
ttgtgtgaagaaaataaatat

SEQ ID NO: 183240 - DNA, 21 bp, Artificial sequence
  SiRNA target sequence
tgtgtgaagaaaataaatatg

SEQ ID NO: 183241 - DNA, 21 bp, Artificial sequence
  SiRNA target sequence
gtgtgaagaaaataaatatgt

SEQ ID NO: 183242 - DNA, 21 bp, Artificial sequence
  SiRNA target sequence
tgtgaagaaaataaatatgtt

SEQ ID NO: 183243 - DNA, 21 bp, Artificial sequence
  SiRNA target sequence
gtgaagaaaataaatatgttg

SEQ ID NO: 183244 - DNA, 21 bp, Artificial sequence
  SiRNA target sequence
tgaagaaaataaatatgttgt

SEQ ID NO: 183245 - DNA, 21 bp, Artificial sequence
  SiRNA target sequence
gaagaaaataaatatgttgta

SEQ ID NO: 183246 - DNA, 21 bp, Artificial sequence
  SiRNA target sequence
aagaaaataaatatgttgtag

SEQ ID NO: 183247 - DNA, 21 bp, Artificial sequence
  SiRNA target sequence
agaaaataaatatgttgtagt

SEQ ID NO: 183248 - DNA, 21 bp, Artificial sequence
  SiRNA target sequence
gaaaataaatatgttgtagtt

SEQ ID NO: 183249 - DNA, 21 bp, Artificial sequence
  SiRNA target sequence
aaaataaatatgttgtagttg

SEQ ID NO: 183250 - DNA, 21 bp, Artificial sequence
  SiRNA target sequence
aaataaatatgttgtagttgt

SEQ ID NO: 183251 - DNA, 21 bp, Artificial sequence
  SiRNA target sequence
aataaatatgttgtagttgtc

SEQ ID NO: 183252 - DNA, 21 bp, Artificial sequence
  SiRNA target sequence
ataaatatgttgtagttgtcg

SEQ ID NO: 183253 - DNA, 21 bp, Artificial sequence
  SiRNA target sequence
taaatatgttgtagttgtcga

SEQ ID NO: 183254 - DNA, 21 bp, Artificial sequence
  SiRNA target sequence
aaatatgttgtagttgtcgaa

SEQ ID NO: 183255 - DNA, 21 bp, Artificial sequence
  SiRNA target sequence
aatatgttgtagttgtcgaac

SEQ ID NO: 183256 - DNA, 21 bp, Artificial sequence
  SiRNA target sequence
atatgttgtagttgtcgaaca

SEQ ID NO: 183257 - DNA, 21 bp, Artificial sequence
  SiRNA target sequence
tatgttgtagttgtcgaacac

SEQ ID NO: 183258 - DNA, 21 bp, Artificial sequence
  SiRNA target sequence
atgttgtagttgtcgaacacg

SEQ ID NO: 183259 - DNA, 21 bp, Artificial sequence
  SiRNA target sequence
tgttgtagttgtcgaacacga

SEQ ID NO: 183260 - DNA, 21 bp, Artificial sequence
  SiRNA target sequence
gttgtagttgtcgaacacgat

SEQ ID NO: 183261 - DNA, 21 bp, Artificial sequence
  SiRNA target sequence
ttgtagttgtcgaacacgatt

SEQ ID NO: 183262 - DNA, 21 bp, Artificial sequence
  SiRNA target sequence
tgtagttgtcgaacacgattt

SEQ ID NO: 183263 - DNA, 21 bp, Artificial sequence
  SiRNA target sequence
gtagttgtcgaacacgattta

SEQ ID NO: 183264 - DNA, 21 bp, Artificial sequence
  SiRNA target sequence
tagttgtcgaacacgatttag

SEQ ID NO: 183265 - DNA, 21 bp, Artificial sequence
  SiRNA target sequence
agttgtcgaacacgatttagc

SEQ ID NO: 183266 - DNA, 21 bp, Artificial sequence
  SiRNA target sequence
gttgtcgaacacgatttagcc

SEQ ID NO: 183267 - DNA, 21 bp, Artificial sequence
  SiRNA target sequence
ttgtcgaacacgatttagcca

SEQ ID NO: 183268 - DNA, 21 bp, Artificial sequence
  SiRNA target sequence
tgtcgaacacgatttagccat

SEQ ID NO: 183269 - DNA, 21 bp, Artificial sequence
  SiRNA target sequence
gtcgaacacgatttagccatt

SEQ ID NO: 183270 - DNA, 21 bp, Artificial sequence
  SiRNA target sequence
tcgaacacgatttagccattt

SEQ ID NO: 183271 - DNA, 21 bp, Artificial sequence
  SiRNA target sequence
cgaacacgatttagccatttt

SEQ ID NO: 183272 - DNA, 21 bp, Artificial sequence
  SiRNA target sequence
gaacacgatttagccatttta

SEQ ID NO: 183273 - DNA, 21 bp, Artificial sequence
  SiRNA target sequence
aacacgatttagccattttag

SEQ ID NO: 183274 - DNA, 21 bp, Artificial sequence
  SiRNA target sequence
acacgatttagccattttaga

SEQ ID NO: 183275 - DNA, 21 bp, Artificial sequence
  SiRNA target sequence
cacgatttagccattttagat

SEQ ID NO: 183276 - DNA, 21 bp, Artificial sequence
  SiRNA target sequence
acgatttagccattttagatt

SEQ ID NO: 183277 - DNA, 21 bp, Artificial sequence
  SiRNA target sequence
cgatttagccattttagattt

SEQ ID NO: 183278 - DNA, 21 bp, Artificial sequence
  SiRNA target sequence
gatttagccattttagatttg

SEQ ID NO: 183279 - DNA, 21 bp, Artificial sequence
  SiRNA target sequence
atttagccattttagatttga

SEQ ID NO: 183280 - DNA, 21 bp, Artificial sequence
  SiRNA target sequence
tttagccattttagatttgat

SEQ ID NO: 183281 - DNA, 21 bp, Artificial sequence
  SiRNA target sequence
ttagccattttagatttgatg

SEQ ID NO: 183282 - DNA, 21 bp, Artificial sequence
  SiRNA target sequence
tagccattttagatttgatgt

SEQ ID NO: 183283 - DNA, 21 bp, Artificial sequence
  SiRNA target sequence
agccattttagatttgatgtg

SEQ ID NO: 183284 - DNA, 21 bp, Artificial sequence
  SiRNA target sequence
gccattttagatttgatgtgt

SEQ ID NO: 183285 - DNA, 21 bp, Artificial sequence
  SiRNA target sequence
ccattttagatttgatgtgtg

SEQ ID NO: 183286 - DNA, 21 bp, Artificial sequence
  SiRNA target sequence
cattttagatttgatgtgtga

SEQ ID NO: 183287 - DNA, 21 bp, Artificial sequence
  SiRNA target sequence
attttagatttgatgtgtgat

SEQ ID NO: 183288 - DNA, 21 bp, Artificial sequence
  SiRNA target sequence
ttttagatttgatgtgtgatt

SEQ ID NO: 183289 - DNA, 21 bp, Artificial sequence
  SiRNA target sequence
tttagatttgatgtgtgattt

SEQ ID NO: 183290 - DNA, 21 bp, Artificial sequence
  SiRNA target sequence
ttagatttgatgtgtgatttt

SEQ ID NO: 183291 - DNA, 21 bp, Artificial sequence
  SiRNA target sequence
tagatttgatgtgtgattttg

SEQ ID NO: 183292 - DNA, 21 bp, Artificial sequence
  SiRNA target sequence
agatttgatgtgtgattttgg

SEQ ID NO: 183293 - DNA, 21 bp, Artificial sequence
  SiRNA target sequence
gatttgatgtgtgattttgga

SEQ ID NO: 183294 - DNA, 21 bp, Artificial sequence
  SiRNA target sequence
atttgatgtgtgattttggat

SEQ ID NO: 183295 - DNA, 21 bp, Artificial sequence
  SiRNA target sequence
tttgatgtgtgattttggatg

SEQ ID NO: 183296 - DNA, 21 bp, Artificial sequence
  SiRNA target sequence
ttgatgtgtgattttggatgt

SEQ ID NO: 183297 - DNA, 21 bp, Artificial sequence
  SiRNA target sequence
tgatgtgtgattttggatgtg

SEQ ID NO: 183298 - DNA, 21 bp, Artificial sequence
  SiRNA target sequence
gatgtgtgattttggatgtgt

SEQ ID NO: 183299 - DNA, 21 bp, Artificial sequence
  SiRNA target sequence
atgtgtgattttggatgtgtt

SEQ ID NO: 183300 - DNA, 21 bp, Artificial sequence
  SiRNA target sequence
tgtgtgattttggatgtgttc

SEQ ID NO: 183301 - DNA, 21 bp, Artificial sequence
  SiRNA target sequence
gtgtgattttggatgtgttct

SEQ ID NO: 183302 - DNA, 21 bp, Artificial sequence
  SiRNA target sequence
tgtgattttggatgtgttcta

SEQ ID NO: 183303 - DNA, 21 bp, Artificial sequence
  SiRNA target sequence
gtgattttggatgtgttctat

SEQ ID NO: 183304 - DNA, 21 bp, Artificial sequence
  SiRNA target sequence
tgattttggatgtgttctata

SEQ ID NO: 183305 - DNA, 21 bp, Artificial sequence
  SiRNA target sequence
gattttggatgtgttctatac

SEQ ID NO: 183306 - DNA, 21 bp, Artificial sequence
  SiRNA target sequence
attttggatgtgttctatacg

SEQ ID NO: 183307 - DNA, 21 bp, Artificial sequence
  SiRNA target sequence
ttttggatgtgttctatacgg

SEQ ID NO: 183308 - DNA, 21 bp, Artificial sequence
  SiRNA target sequence
tttggatgtgttctatacgga

SEQ ID NO: 183309 - DNA, 21 bp, Artificial sequence
  SiRNA target sequence
ttggatgtgttctatacggac

SEQ ID NO: 183310 - DNA, 21 bp, Artificial sequence
  SiRNA target sequence
tggatgtgttctatacggaca

SEQ ID NO: 183311 - DNA, 21 bp, Artificial sequence
  SiRNA target sequence
ggatgtgttctatacggacaa

SEQ ID NO: 183312 - DNA, 21 bp, Artificial sequence
  SiRNA target sequence
gatgtgttctatacggacaat

SEQ ID NO: 183313 - DNA, 21 bp, Artificial sequence
  SiRNA target sequence
atgtgttctatacggacaatc

SEQ ID NO: 183314 - DNA, 21 bp, Artificial sequence
  SiRNA target sequence
tgtgttctatacggacaatct

SEQ ID NO: 183315 - DNA, 21 bp, Artificial sequence
  SiRNA target sequence
gtgttctatacggacaatctg

SEQ ID NO: 183316 - DNA, 21 bp, Artificial sequence
  SiRNA target sequence
tgttctatacggacaatctgg

SEQ ID NO: 183317 - DNA, 21 bp, Artificial sequence
  SiRNA target sequence
gttctatacggacaatctggg

SEQ ID NO: 183318 - DNA, 21 bp, Artificial sequence
  SiRNA target sequence
ttctatacggacaatctgggg

SEQ ID NO: 183319 - DNA, 21 bp, Artificial sequence
  SiRNA target sequence
tctatacggacaatctggggc

SEQ ID NO: 183320 - DNA, 21 bp, Artificial sequence
  SiRNA target sequence
ctatacggacaatctggggca

SEQ ID NO: 183321 - DNA, 21 bp, Artificial sequence
  SiRNA target sequence
tatacggacaatctggggcat

SEQ ID NO: 183322 - DNA, 21 bp, Artificial sequence
  SiRNA target sequence
atacggacaatctggggcata

SEQ ID NO: 183323 - DNA, 21 bp, Artificial sequence
  SiRNA target sequence
tacggacaatctggggcatac

SEQ ID NO: 183324 - DNA, 21 bp, Artificial sequence
  SiRNA target sequence
acggacaatctggggcatacg

SEQ ID NO: 183325 - DNA, 21 bp, Artificial sequence
  SiRNA target sequence
cggacaatctggggcatacgg

SEQ ID NO: 183326 - DNA, 21 bp, Artificial sequence
  SiRNA target sequence
ggacaatctggggcatacggt

SEQ ID NO: 183327 - DNA, 21 bp, Artificial sequence
  SiRNA target sequence
gacaatctggggcatacggtg

SEQ ID NO: 183328 - DNA, 21 bp, Artificial sequence
  SiRNA target sequence
acaatctggggcatacggtgt

SEQ ID NO: 183329 - DNA, 21 bp, Artificial sequence
  SiRNA target sequence
caatctggggcatacggtgta

SEQ ID NO: 183330 - DNA, 21 bp, Artificial sequence
  SiRNA target sequence
aatctggggcatacggtgtaa

SEQ ID NO: 183331 - DNA, 21 bp, Artificial sequence
  SiRNA target sequence
atctggggcatacggtgtaat

SEQ ID NO: 183332 - DNA, 21 bp, Artificial sequence
  SiRNA target sequence
tctggggcatacggtgtaata

SEQ ID NO: 183333 - DNA, 21 bp, Artificial sequence
  SiRNA target sequence
ctggggcatacggtgtaataa

SEQ ID NO: 183334 - DNA, 21 bp, Artificial sequence
  SiRNA target sequence
tggggcatacggtgtaataag

SEQ ID NO: 183335 - DNA, 21 bp, Artificial sequence
  SiRNA target sequence
ggggcatacggtgtaataagc

SEQ ID NO: 183336 - DNA, 21 bp, Artificial sequence
  SiRNA target sequence
gggcatacggtgtaataagcg

SEQ ID NO: 183337 - DNA, 21 bp, Artificial sequence
  SiRNA target sequence
ggcatacggtgtaataagcgc

SEQ ID NO: 183338 - DNA, 21 bp, Artificial sequence
  SiRNA target sequence
gcatacggtgtaataagcgca

SEQ ID NO: 183339 - DNA, 21 bp, Artificial sequence
  SiRNA target sequence
catacggtgtaataagcgcac

SEQ ID NO: 183340 - DNA, 21 bp, Artificial sequence
  SiRNA target sequence
atacggtgtaataagcgcacc

SEQ ID NO: 183341 - DNA, 21 bp, Artificial sequence
  SiRNA target sequence
tacggtgtaataagcgcacca

SEQ ID NO: 183342 - DNA, 21 bp, Artificial sequence
  SiRNA target sequence
acggtgtaataagcgcaccat

SEQ ID NO: 183343 - DNA, 21 bp, Artificial sequence
  SiRNA target sequence
cggtgtaataagcgcaccata

SEQ ID NO: 183344 - DNA, 21 bp, Artificial sequence
  SiRNA target sequence
ggtgtaataagcgcaccatac

SEQ ID NO: 183345 - DNA, 21 bp, Artificial sequence
  SiRNA target sequence
gtgtaataagcgcaccatacg

SEQ ID NO: 183346 - DNA, 21 bp, Artificial sequence
  SiRNA target sequence
tgtaataagcgcaccatacgt

SEQ ID NO: 183347 - DNA, 21 bp, Artificial sequence
  SiRNA target sequence
gtaataagcgcaccatacgtt

SEQ ID NO: 183348 - DNA, 21 bp, Artificial sequence
  SiRNA target sequence
taataagcgcaccatacgtta

SEQ ID NO: 183349 - DNA, 21 bp, Artificial sequence
  SiRNA target sequence
aataagcgcaccatacgttat

SEQ ID NO: 183350 - DNA, 21 bp, Artificial sequence
  SiRNA target sequence
ataagcgcaccatacgttatt

SEQ ID NO: 183351 - DNA, 21 bp, Artificial sequence
  SiRNA target sequence
taagcgcaccatacgttatta

SEQ ID NO: 183352 - DNA, 21 bp, Artificial sequence
  SiRNA target sequence
aagcgcaccatacgttattaa

SEQ ID NO: 183353 - DNA, 21 bp, Artificial sequence
  SiRNA target sequence
agcgcaccatacgttattaaa

SEQ ID NO: 183354 - DNA, 21 bp, Artificial sequence
  SiRNA target sequence
gcgcaccatacgttattaaat

SEQ ID NO: 183355 - DNA, 21 bp, Artificial sequence
  SiRNA target sequence
cgcaccatacgttattaaatc

SEQ ID NO: 183356 - DNA, 21 bp, Artificial sequence
  SiRNA target sequence
gcaccatacgttattaaatca

SEQ ID NO: 183357 - DNA, 21 bp, Artificial sequence
  SiRNA target sequence
caccatacgttattaaatcag

SEQ ID NO: 183358 - DNA, 21 bp, Artificial sequence
  SiRNA target sequence
accatacgttattaaatcagc

SEQ ID NO: 183359 - DNA, 21 bp, Artificial sequence
  SiRNA target sequence
ccatacgttattaaatcagca

SEQ ID NO: 183360 - DNA, 21 bp, Artificial sequence
  SiRNA target sequence
catacgttattaaatcagcaa

SEQ ID NO: 183361 - DNA, 21 bp, Artificial sequence
  SiRNA target sequence
atacgttattaaatcagcaat

SEQ ID NO: 183362 - DNA, 21 bp, Artificial sequence
  SiRNA target sequence
tacgttattaaatcagcaata

SEQ ID NO: 183363 - DNA, 21 bp, Artificial sequence
  SiRNA target sequence
acgttattaaatcagcaataa

SEQ ID NO: 183364 - DNA, 21 bp, Artificial sequence
  SiRNA target sequence
cgttattaaatcagcaataaa

SEQ ID NO: 183365 - DNA, 21 bp, Artificial sequence
  SiRNA target sequence
gttattaaatcagcaataaat

SEQ ID NO: 183366 - DNA, 21 bp, Artificial sequence
  SiRNA target sequence
ttattaaatcagcaataaata

SEQ ID NO: 183367 - DNA, 21 bp, Artificial sequence
  SiRNA target sequence
tattaaatcagcaataaatat

SEQ ID NO: 183368 - DNA, 21 bp, Artificial sequence
  SiRNA target sequence
attaaatcagcaataaatata

SEQ ID NO: 183369 - DNA, 21 bp, Artificial sequence
  SiRNA target sequence
ttaaatcagcaataaatatat

SEQ ID NO: 183370 - DNA, 21 bp, Artificial sequence
  SiRNA target sequence
taaatcagcaataaatatatt

SEQ ID NO: 183371 - DNA, 21 bp, Artificial sequence
  SiRNA target sequence
aaatcagcaataaatatattt

SEQ ID NO: 183372 - DNA, 21 bp, Artificial sequence
  SiRNA target sequence
aatcagcaataaatatatttc

SEQ ID NO: 183373 - DNA, 21 bp, Artificial sequence
  SiRNA target sequence
atcagcaataaatatatttct

SEQ ID NO: 183374 - DNA, 21 bp, Artificial sequence
  SiRNA target sequence
tcagcaataaatatatttctt

SEQ ID NO: 183375 - DNA, 21 bp, Artificial sequence
  SiRNA target sequence
cagcaataaatatatttcttg

SEQ ID NO: 183376 - DNA, 21 bp, Artificial sequence
  SiRNA target sequence
agcaataaatatatttcttga

SEQ ID NO: 183377 - DNA, 21 bp, Artificial sequence
  SiRNA target sequence
gcaataaatatatttcttgat

SEQ ID NO: 183378 - DNA, 21 bp, Artificial sequence
  SiRNA target sequence
caataaatatatttcttgatg

SEQ ID NO: 183379 - DNA, 21 bp, Artificial sequence
  SiRNA target sequence
aataaatatatttcttgatgg

SEQ ID NO: 183380 - DNA, 21 bp, Artificial sequence
  SiRNA target sequence
ataaatatatttcttgatgga

SEQ ID NO: 183381 - DNA, 21 bp, Artificial sequence
  SiRNA target sequence
taaatatatttcttgatggat

SEQ ID NO: 183382 - DNA, 21 bp, Artificial sequence
  SiRNA target sequence
aaatatatttcttgatggatt

SEQ ID NO: 183383 - DNA, 21 bp, Artificial sequence
  SiRNA target sequence
aatatatttcttgatggattt

SEQ ID NO: 183384 - DNA, 21 bp, Artificial sequence
  SiRNA target sequence
atatatttcttgatggatttt

SEQ ID NO: 183385 - DNA, 21 bp, Artificial sequence
  SiRNA target sequence
tatatttcttgatggattttt

SEQ ID NO: 183386 - DNA, 21 bp, Artificial sequence
  SiRNA target sequence
atatttcttgatggatttttg

SEQ ID NO: 183387 - DNA, 21 bp, Artificial sequence
  SiRNA target sequence
tatttcttgatggatttttgc

SEQ ID NO: 183388 - DNA, 21 bp, Artificial sequence
  SiRNA target sequence
atttcttgatggatttttgcc

SEQ ID NO: 183389 - DNA, 21 bp, Artificial sequence
  SiRNA target sequence
tttcttgatggatttttgcct

SEQ ID NO: 183390 - DNA, 21 bp, Artificial sequence
  SiRNA target sequence
ttcttgatggatttttgccta

SEQ ID NO: 183391 - DNA, 21 bp, Artificial sequence
  SiRNA target sequence
tcttgatggatttttgcctac

SEQ ID NO: 183392 - DNA, 21 bp, Artificial sequence
  SiRNA target sequence
cttgatggatttttgcctaca

SEQ ID NO: 183393 - DNA, 21 bp, Artificial sequence
  SiRNA target sequence
ttgatggatttttgcctacag

SEQ ID NO: 183394 - DNA, 21 bp, Artificial sequence
  SiRNA target sequence
tgatggatttttgcctacaga

SEQ ID NO: 183395 - DNA, 21 bp, Artificial sequence
  SiRNA target sequence
gatggatttttgcctacagaa

SEQ ID NO: 183396 - DNA, 21 bp, Artificial sequence
  SiRNA target sequence
atggatttttgcctacagaaa

SEQ ID NO: 183397 - DNA, 21 bp, Artificial sequence
  SiRNA target sequence
tggatttttgcctacagaaaa

SEQ ID NO: 183398 - DNA, 21 bp, Artificial sequence
  SiRNA target sequence
ggatttttgcctacagaaaac

SEQ ID NO: 183399 - DNA, 21 bp, Artificial sequence
  SiRNA target sequence
gatttttgcctacagaaaaca

SEQ ID NO: 183400 - DNA, 21 bp, Artificial sequence
  SiRNA target sequence
atttttgcctacagaaaacat

SEQ ID NO: 183401 - DNA, 21 bp, Artificial sequence
  SiRNA target sequence
tttttgcctacagaaaacatg

SEQ ID NO: 183402 - DNA, 21 bp, Artificial sequence
  SiRNA target sequence
ttttgcctacagaaaacatga

SEQ ID NO: 183403 - DNA, 21 bp, Artificial sequence
  SiRNA target sequence
tttgcctacagaaaacatgaa

SEQ ID NO: 183404 - DNA, 21 bp, Artificial sequence
  SiRNA target sequence
ttgcctacagaaaacatgaaa

SEQ ID NO: 183405 - DNA, 21 bp, Artificial sequence
  SiRNA target sequence
tgcctacagaaaacatgaaat

SEQ ID NO: 183406 - DNA, 21 bp, Artificial sequence
  SiRNA target sequence
gcctacagaaaacatgaaatt

SEQ ID NO: 183407 - DNA, 21 bp, Artificial sequence
  SiRNA target sequence
cctacagaaaacatgaaattt

SEQ ID NO: 183408 - DNA, 21 bp, Artificial sequence
  SiRNA target sequence
ctacagaaaacatgaaattta

SEQ ID NO: 183409 - DNA, 21 bp, Artificial sequence
  SiRNA target sequence
tacagaaaacatgaaatttag

SEQ ID NO: 183410 - DNA, 21 bp, Artificial sequence
  SiRNA target sequence
acagaaaacatgaaatttaga

SEQ ID NO: 183411 - DNA, 21 bp, Artificial sequence
  SiRNA target sequence
cagaaaacatgaaatttagaa

SEQ ID NO: 183412 - DNA, 21 bp, Artificial sequence
  SiRNA target sequence
agaaaacatgaaatttagaaa

SEQ ID NO: 183413 - DNA, 21 bp, Artificial sequence
  SiRNA target sequence
gaaaacatgaaatttagaaat

SEQ ID NO: 183414 - DNA, 21 bp, Artificial sequence
  SiRNA target sequence
aaaacatgaaatttagaaatt

SEQ ID NO: 183415 - DNA, 21 bp, Artificial sequence
  SiRNA target sequence
aaacatgaaatttagaaattc

SEQ ID NO: 183416 - DNA, 21 bp, Artificial sequence
  SiRNA target sequence
aacatgaaatttagaaattca

SEQ ID NO: 183417 - DNA, 21 bp, Artificial sequence
  SiRNA target sequence
acatgaaatttagaaattcag

SEQ ID NO: 183418 - DNA, 21 bp, Artificial sequence
  SiRNA target sequence
catgaaatttagaaattcaga

SEQ ID NO: 183419 - DNA, 21 bp, Artificial sequence
  SiRNA target sequence
atgaaatttagaaattcagag

SEQ ID NO: 183420 - DNA, 21 bp, Artificial sequence
  SiRNA target sequence
tgaaatttagaaattcagagt

SEQ ID NO: 183421 - DNA, 21 bp, Artificial sequence
  SiRNA target sequence
gaaatttagaaattcagagtt

SEQ ID NO: 183422 - DNA, 21 bp, Artificial sequence
  SiRNA target sequence
aaatttagaaattcagagtta

SEQ ID NO: 183423 - DNA, 21 bp, Artificial sequence
  SiRNA target sequence
aatttagaaattcagagttaa

SEQ ID NO: 183424 - DNA, 21 bp, Artificial sequence
  SiRNA target sequence
atttagaaattcagagttaaa

SEQ ID NO: 183425 - DNA, 21 bp, Artificial sequence
  SiRNA target sequence
tttagaaattcagagttaaag

SEQ ID NO: 183426 - DNA, 21 bp, Artificial sequence
  SiRNA target sequence
ttagaaattcagagttaaagt

SEQ ID NO: 183427 - DNA, 21 bp, Artificial sequence
  SiRNA target sequence
tagaaattcagagttaaagtt

SEQ ID NO: 183428 - DNA, 21 bp, Artificial sequence
  SiRNA target sequence
agaaattcagagttaaagttt

SEQ ID NO: 183429 - DNA, 21 bp, Artificial sequence
  SiRNA target sequence
gaaattcagagttaaagttta

SEQ ID NO: 183430 - DNA, 21 bp, Artificial sequence
  SiRNA target sequence
aaattcagagttaaagtttaa

SEQ ID NO: 183431 - DNA, 21 bp, Artificial sequence
  SiRNA target sequence
aattcagagttaaagtttaat

SEQ ID NO: 183432 - DNA, 21 bp, Artificial sequence
  SiRNA target sequence
attcagagttaaagtttaata

SEQ ID NO: 183433 - DNA, 21 bp, Artificial sequence
  SiRNA target sequence
ttcagagttaaagtttaatat

SEQ ID NO: 183434 - DNA, 21 bp, Artificial sequence
  SiRNA target sequence
tcagagttaaagtttaatatt

SEQ ID NO: 183435 - DNA, 21 bp, Artificial sequence
  SiRNA target sequence
cagagttaaagtttaatattt

SEQ ID NO: 183436 - DNA, 21 bp, Artificial sequence
  SiRNA target sequence
agagttaaagtttaatatttc

SEQ ID NO: 183437 - DNA, 21 bp, Artificial sequence
  SiRNA target sequence
gagttaaagtttaatatttcg

SEQ ID NO: 183438 - DNA, 21 bp, Artificial sequence
  SiRNA target sequence
agttaaagtttaatatttcgg

SEQ ID NO: 183439 - DNA, 21 bp, Artificial sequence
  SiRNA target sequence
gttaaagtttaatatttcgga

SEQ ID NO: 183440 - DNA, 21 bp, Artificial sequence
  SiRNA target sequence
ttaaagtttaatatttcggaa

SEQ ID NO: 183441 - DNA, 21 bp, Artificial sequence
  SiRNA target sequence
taaagtttaatatttcggaaa

SEQ ID NO: 183442 - DNA, 21 bp, Artificial sequence
  SiRNA target sequence
aaagtttaatatttcggaaac

SEQ ID NO: 183443 - DNA, 21 bp, Artificial sequence
  SiRNA target sequence
aagtttaatatttcggaaaca

SEQ ID NO: 183444 - DNA, 21 bp, Artificial sequence
  SiRNA target sequence
agtttaatatttcggaaacac

SEQ ID NO: 183445 - DNA, 21 bp, Artificial sequence
  SiRNA target sequence
gtttaatatttcggaaacact

SEQ ID NO: 183446 - DNA, 21 bp, Artificial sequence
  SiRNA target sequence
tttaatatttcggaaacactt

SEQ ID NO: 183447 - DNA, 21 bp, Artificial sequence
  SiRNA target sequence
ttaatatttcggaaacacttg

SEQ ID NO: 183448 - DNA, 21 bp, Artificial sequence
  SiRNA target sequence
taatatttcggaaacacttga

SEQ ID NO: 183449 - DNA, 21 bp, Artificial sequence
  SiRNA target sequence
aatatttcggaaacacttgat

SEQ ID NO: 183450 - DNA, 21 bp, Artificial sequence
  SiRNA target sequence
atatttcggaaacacttgata

SEQ ID NO: 183451 - DNA, 21 bp, Artificial sequence
  SiRNA target sequence
tatttcggaaacacttgatag

SEQ ID NO: 183452 - DNA, 21 bp, Artificial sequence
  SiRNA target sequence
atttcggaaacacttgatagt

SEQ ID NO: 183453 - DNA, 21 bp, Artificial sequence
  SiRNA target sequence
tttcggaaacacttgatagta

SEQ ID NO: 183454 - DNA, 21 bp, Artificial sequence
  SiRNA target sequence
ttcggaaacacttgatagtat

SEQ ID NO: 183455 - DNA, 21 bp, Artificial sequence
  SiRNA target sequence
tcggaaacacttgatagtatt

SEQ ID NO: 183456 - DNA, 21 bp, Artificial sequence
  SiRNA target sequence
cggaaacacttgatagtatta

SEQ ID NO: 183457 - DNA, 21 bp, Artificial sequence
  SiRNA target sequence
ggaaacacttgatagtattat

SEQ ID NO: 183458 - DNA, 21 bp, Artificial sequence
  SiRNA target sequence
gaaacacttgatagtattata

SEQ ID NO: 183459 - DNA, 21 bp, Artificial sequence
  SiRNA target sequence
aaacacttgatagtattatat

SEQ ID NO: 183460 - DNA, 21 bp, Artificial sequence
  SiRNA target sequence
aacacttgatagtattatatc

SEQ ID NO: 183461 - DNA, 21 bp, Artificial sequence
  SiRNA target sequence
acacttgatagtattatatct

SEQ ID NO: 183462 - DNA, 21 bp, Artificial sequence
  SiRNA target sequence
cacttgatagtattatatcta

SEQ ID NO: 183463 - DNA, 21 bp, Artificial sequence
  SiRNA target sequence
acttgatagtattatatctac

SEQ ID NO: 183464 - DNA, 21 bp, Artificial sequence
  SiRNA target sequence
cttgatagtattatatctacc

SEQ ID NO: 183465 - DNA, 21 bp, Artificial sequence
  SiRNA target sequence
ttgatagtattatatctacca

SEQ ID NO: 183466 - DNA, 21 bp, Artificial sequence
  SiRNA target sequence
tgatagtattatatctaccag

SEQ ID NO: 183467 - DNA, 21 bp, Artificial sequence
  SiRNA target sequence
gatagtattatatctaccaga

SEQ ID NO: 183468 - DNA, 21 bp, Artificial sequence
  SiRNA target sequence
atagtattatatctaccagag

SEQ ID NO: 183469 - DNA, 21 bp, Artificial sequence
  SiRNA target sequence
tagtattatatctaccagaga

SEQ ID NO: 183470 - DNA, 21 bp, Artificial sequence
  SiRNA target sequence
agtattatatctaccagagac

SEQ ID NO: 183471 - DNA, 21 bp, Artificial sequence
  SiRNA target sequence
gtattatatctaccagagacc

SEQ ID NO: 183472 - DNA, 21 bp, Artificial sequence
  SiRNA target sequence
tattatatctaccagagacca

SEQ ID NO: 183473 - DNA, 21 bp, Artificial sequence
  SiRNA target sequence
attatatctaccagagaccag

SEQ ID NO: 183474 - DNA, 21 bp, Artificial sequence
  SiRNA target sequence
ttatatctaccagagaccagt

SEQ ID NO: 183475 - DNA, 21 bp, Artificial sequence
  SiRNA target sequence
tatatctaccagagaccagta

SEQ ID NO: 183476 - DNA, 21 bp, Artificial sequence
  SiRNA target sequence
atatctaccagagaccagtat

SEQ ID NO: 183477 - DNA, 21 bp, Artificial sequence
  SiRNA target sequence
tatctaccagagaccagtatc

SEQ ID NO: 183478 - DNA, 21 bp, Artificial sequence
  SiRNA target sequence
atctaccagagaccagtatca

SEQ ID NO: 183479 - DNA, 21 bp, Artificial sequence
  SiRNA target sequence
tctaccagagaccagtatcat

SEQ ID NO: 183480 - DNA, 21 bp, Artificial sequence
  SiRNA target sequence
ctaccagagaccagtatcatt

SEQ ID NO: 183481 - DNA, 21 bp, Artificial sequence
  SiRNA target sequence
taccagagaccagtatcatta

SEQ ID NO: 183482 - DNA, 21 bp, Artificial sequence
  SiRNA target sequence
accagagaccagtatcattat

SEQ ID NO: 183483 - DNA, 21 bp, Artificial sequence
  SiRNA target sequence
ccagagaccagtatcattatc

SEQ ID NO: 183484 - DNA, 21 bp, Artificial sequence
  SiRNA target sequence
cagagaccagtatcattatcc

SEQ ID NO: 183485 - DNA, 21 bp, Artificial sequence
  SiRNA target sequence
agagaccagtatcattatccc

SEQ ID NO: 183486 - DNA, 21 bp, Artificial sequence
  SiRNA target sequence
gagaccagtatcattatccca

SEQ ID NO: 183487 - DNA, 21 bp, Artificial sequence
  SiRNA target sequence
agaccagtatcattatcccaa

SEQ ID NO: 183488 - DNA, 21 bp, Artificial sequence
  SiRNA target sequence
gaccagtatcattatcccaat

SEQ ID NO: 183489 - DNA, 21 bp, Artificial sequence
  SiRNA target sequence
accagtatcattatcccaatt

SEQ ID NO: 183490 - DNA, 21 bp, Artificial sequence
  SiRNA target sequence
ccagtatcattatcccaattt

SEQ ID NO: 183491 - DNA, 21 bp, Artificial sequence
  SiRNA target sequence
cagtatcattatcccaatttg

SEQ ID NO: 183492 - DNA, 21 bp, Artificial sequence
  SiRNA target sequence
agtatcattatcccaatttga

SEQ ID NO: 183493 - DNA, 21 bp, Artificial sequence
  SiRNA target sequence
gtatcattatcccaatttgat

SEQ ID NO: 183494 - DNA, 21 bp, Artificial sequence
  SiRNA target sequence
tatcattatcccaatttgata

SEQ ID NO: 183495 - DNA, 21 bp, Artificial sequence
  SiRNA target sequence
atcattatcccaatttgataa

SEQ ID NO: 183496 - DNA, 21 bp, Artificial sequence
  SiRNA target sequence
tcattatcccaatttgataaa

SEQ ID NO: 183497 - DNA, 21 bp, Artificial sequence
  SiRNA target sequence
cattatcccaatttgataaaa

SEQ ID NO: 183498 - DNA, 21 bp, Artificial sequence
  SiRNA target sequence
attatcccaatttgataaaaa

SEQ ID NO: 183499 - DNA, 21 bp, Artificial sequence
  SiRNA target sequence
ttatcccaatttgataaaaac

SEQ ID NO: 183500 - DNA, 21 bp, Artificial sequence
  SiRNA target sequence
tatcccaatttgataaaaaca

SEQ ID NO: 183501 - DNA, 21 bp, Artificial sequence
  SiRNA target sequence
atcccaatttgataaaaacat

SEQ ID NO: 183502 - DNA, 21 bp, Artificial sequence
  SiRNA target sequence
tcccaatttgataaaaacata

SEQ ID NO: 183503 - DNA, 21 bp, Artificial sequence
  SiRNA target sequence
cccaatttgataaaaacatat

SEQ ID NO: 183504 - DNA, 21 bp, Artificial sequence
  SiRNA target sequence
ccaatttgataaaaacatatc

SEQ ID NO: 183505 - DNA, 21 bp, Artificial sequence
  SiRNA target sequence
caatttgataaaaacatatcc

SEQ ID NO: 183506 - DNA, 21 bp, Artificial sequence
  SiRNA target sequence
aatttgataaaaacatatcca

SEQ ID NO: 183507 - DNA, 21 bp, Artificial sequence
  SiRNA target sequence
atttgataaaaacatatccaa

SEQ ID NO: 183508 - DNA, 21 bp, Artificial sequence
  SiRNA target sequence
tttgataaaaacatatccaaa

SEQ ID NO: 183509 - DNA, 21 bp, Artificial sequence
  SiRNA target sequence
ttgataaaaacatatccaaat

SEQ ID NO: 183510 - DNA, 21 bp, Artificial sequence
  SiRNA target sequence
tgataaaaacatatccaaatt

SEQ ID NO: 183511 - DNA, 21 bp, Artificial sequence
  SiRNA target sequence
gataaaaacatatccaaattt

SEQ ID NO: 183512 - DNA, 21 bp, Artificial sequence
  SiRNA target sequence
ataaaaacatatccaaatttt

SEQ ID NO: 183513 - DNA, 21 bp, Artificial sequence
  SiRNA target sequence
taaaaacatatccaaatttta

SEQ ID NO: 183514 - DNA, 21 bp, Artificial sequence
  SiRNA target sequence
aaaaacatatccaaattttac

SEQ ID NO: 183515 - DNA, 21 bp, Artificial sequence
  SiRNA target sequence
aaaacatatccaaattttacg

SEQ ID NO: 183516 - DNA, 21 bp, Artificial sequence
  SiRNA target sequence
aaacatatccaaattttacgc

SEQ ID NO: 183517 - DNA, 21 bp, Artificial sequence
  SiRNA target sequence
aacatatccaaattttacgct

SEQ ID NO: 183518 - DNA, 21 bp, Artificial sequence
  SiRNA target sequence
acatatccaaattttacgctt

SEQ ID NO: 183519 - DNA, 21 bp, Artificial sequence
  SiRNA target sequence
catatccaaattttacgctta

SEQ ID NO: 183520 - DNA, 21 bp, Artificial sequence
  SiRNA target sequence
atatccaaattttacgcttaa

SEQ ID NO: 183521 - DNA, 21 bp, Artificial sequence
  SiRNA target sequence
tatccaaattttacgcttaaa

SEQ ID NO: 183522 - DNA, 21 bp, Artificial sequence
  SiRNA target sequence
atccaaattttacgcttaaag

SEQ ID NO: 183523 - DNA, 21 bp, Artificial sequence
  SiRNA target sequence
tccaaattttacgcttaaagt

SEQ ID NO: 183524 - DNA, 21 bp, Artificial sequence
  SiRNA target sequence
ccaaattttacgcttaaagtt

SEQ ID NO: 183525 - DNA, 21 bp, Artificial sequence
  SiRNA target sequence
caaattttacgcttaaagttg

SEQ ID NO: 183526 - DNA, 21 bp, Artificial sequence
  SiRNA target sequence
aaattttacgcttaaagttga

SEQ ID NO: 183527 - DNA, 21 bp, Artificial sequence
  SiRNA target sequence
aattttacgcttaaagttgaa

SEQ ID NO: 183528 - DNA, 21 bp, Artificial sequence
  SiRNA target sequence
attttacgcttaaagttgaag

SEQ ID NO: 183529 - DNA, 21 bp, Artificial sequence
  SiRNA target sequence
ttttacgcttaaagttgaagg

SEQ ID NO: 183530 - DNA, 21 bp, Artificial sequence
  SiRNA target sequence
tttacgcttaaagttgaaggc

SEQ ID NO: 183531 - DNA, 21 bp, Artificial sequence
  SiRNA target sequence
ttacgcttaaagttgaaggcg

SEQ ID NO: 183532 - DNA, 21 bp, Artificial sequence
  SiRNA target sequence
tacgcttaaagttgaaggcgg

SEQ ID NO: 183533 - DNA, 21 bp, Artificial sequence
  SiRNA target sequence
acgcttaaagttgaaggcggt

SEQ ID NO: 183534 - DNA, 21 bp, Artificial sequence
  SiRNA target sequence
cgcttaaagttgaaggcggta

SEQ ID NO: 183535 - DNA, 21 bp, Artificial sequence
  SiRNA target sequence
gcttaaagttgaaggcggtaa

SEQ ID NO: 183536 - DNA, 21 bp, Artificial sequence
  SiRNA target sequence
cttaaagttgaaggcggtaac

SEQ ID NO: 183537 - DNA, 21 bp, Artificial sequence
  SiRNA target sequence
ttaaagttgaaggcggtaact

SEQ ID NO: 183538 - DNA, 21 bp, Artificial sequence
  SiRNA target sequence
taaagttgaaggcggtaactt

SEQ ID NO: 183539 - DNA, 21 bp, Artificial sequence
  SiRNA target sequence
aaagttgaaggcggtaacttt

SEQ ID NO: 183540 - DNA, 21 bp, Artificial sequence
  SiRNA target sequence
aagttgaaggcggtaactttt

SEQ ID NO: 183541 - DNA, 21 bp, Artificial sequence
  SiRNA target sequence
agttgaaggcggtaacttttc

SEQ ID NO: 183542 - DNA, 21 bp, Artificial sequence
  SiRNA target sequence
gttgaaggcggtaacttttca

SEQ ID NO: 183543 - DNA, 21 bp, Artificial sequence
  SiRNA target sequence
ttgaaggcggtaacttttcag

SEQ ID NO: 183544 - DNA, 21 bp, Artificial sequence
  SiRNA target sequence
tgaaggcggtaacttttcaga

SEQ ID NO: 183545 - DNA, 21 bp, Artificial sequence
  SiRNA target sequence
gaaggcggtaacttttcagat

SEQ ID NO: 183546 - DNA, 21 bp, Artificial sequence
  SiRNA target sequence
aaggcggtaacttttcagatt

SEQ ID NO: 183547 - DNA, 21 bp, Artificial sequence
  SiRNA target sequence
aggcggtaacttttcagattc

SEQ ID NO: 183548 - DNA, 21 bp, Artificial sequence
  SiRNA target sequence
ggcggtaacttttcagattct

SEQ ID NO: 183549 - DNA, 21 bp, Artificial sequence
  SiRNA target sequence
gcggtaacttttcagattctg

SEQ ID NO: 183550 - DNA, 21 bp, Artificial sequence
  SiRNA target sequence
cggtaacttttcagattctga

SEQ ID NO: 183551 - DNA, 21 bp, Artificial sequence
  SiRNA target sequence
ggtaacttttcagattctgaa

SEQ ID NO: 183552 - DNA, 21 bp, Artificial sequence
  SiRNA target sequence
gtaacttttcagattctgaaa

SEQ ID NO: 183553 - DNA, 21 bp, Artificial sequence
  SiRNA target sequence
taacttttcagattctgaaat

SEQ ID NO: 183554 - DNA, 21 bp, Artificial sequence
  SiRNA target sequence
aacttttcagattctgaaatt

SEQ ID NO: 183555 - DNA, 21 bp, Artificial sequence
  SiRNA target sequence
acttttcagattctgaaattg

SEQ ID NO: 183556 - DNA, 21 bp, Artificial sequence
  SiRNA target sequence
cttttcagattctgaaattgt

SEQ ID NO: 183557 - DNA, 21 bp, Artificial sequence
  SiRNA target sequence
ttttcagattctgaaattgtt

SEQ ID NO: 183558 - DNA, 21 bp, Artificial sequence
  SiRNA target sequence
tttcagattctgaaattgttg

SEQ ID NO: 183559 - DNA, 21 bp, Artificial sequence
  SiRNA target sequence
ttcagattctgaaattgttgt

SEQ ID NO: 183560 - DNA, 21 bp, Artificial sequence
  SiRNA target sequence
tcagattctgaaattgttgta

SEQ ID NO: 183561 - DNA, 21 bp, Artificial sequence
  SiRNA target sequence
cagattctgaaattgttgtat

SEQ ID NO: 183562 - DNA, 21 bp, Artificial sequence
  SiRNA target sequence
agattctgaaattgttgtatt

SEQ ID NO: 183563 - DNA, 21 bp, Artificial sequence
  SiRNA target sequence
gattctgaaattgttgtattt

SEQ ID NO: 183564 - DNA, 21 bp, Artificial sequence
  SiRNA target sequence
attctgaaattgttgtatttc

SEQ ID NO: 183565 - DNA, 21 bp, Artificial sequence
  SiRNA target sequence
ttctgaaattgttgtatttct

SEQ ID NO: 183566 - DNA, 21 bp, Artificial sequence
  SiRNA target sequence
tctgaaattgttgtatttctt

SEQ ID NO: 183567 - DNA, 21 bp, Artificial sequence
  SiRNA target sequence
ctgaaattgttgtatttcttg

SEQ ID NO: 183568 - DNA, 21 bp, Artificial sequence
  SiRNA target sequence
tgaaattgttgtatttcttgg

SEQ ID NO: 183569 - DNA, 21 bp, Artificial sequence
  SiRNA target sequence
gaaattgttgtatttcttggt

SEQ ID NO: 183570 - DNA, 21 bp, Artificial sequence
  SiRNA target sequence
aaattgttgtatttcttggtg

SEQ ID NO: 183571 - DNA, 21 bp, Artificial sequence
  SiRNA target sequence
aattgttgtatttcttggtga

SEQ ID NO: 183572 - DNA, 21 bp, Artificial sequence
  SiRNA target sequence
attgttgtatttcttggtgaa

SEQ ID NO: 183573 - DNA, 21 bp, Artificial sequence
  SiRNA target sequence
ttgttgtatttcttggtgaaa

SEQ ID NO: 183574 - DNA, 21 bp, Artificial sequence
  SiRNA target sequence
tgttgtatttcttggtgaaaa

SEQ ID NO: 183575 - DNA, 21 bp, Artificial sequence
  SiRNA target sequence
gttgtatttcttggtgaaaat

SEQ ID NO: 183576 - DNA, 21 bp, Artificial sequence
  SiRNA target sequence
ttgtatttcttggtgaaaatg

SEQ ID NO: 183577 - DNA, 21 bp, Artificial sequence
  SiRNA target sequence
tgtatttcttggtgaaaatgg

SEQ ID NO: 183578 - DNA, 21 bp, Artificial sequence
  SiRNA target sequence
gtatttcttggtgaaaatgga

SEQ ID NO: 183579 - DNA, 21 bp, Artificial sequence
  SiRNA target sequence
tatttcttggtgaaaatggaa

SEQ ID NO: 183580 - DNA, 21 bp, Artificial sequence
  SiRNA target sequence
atttcttggtgaaaatggaat

SEQ ID NO: 183581 - DNA, 21 bp, Artificial sequence
  SiRNA target sequence
tttcttggtgaaaatggaatg

SEQ ID NO: 183582 - DNA, 21 bp, Artificial sequence
  SiRNA target sequence
ttcttggtgaaaatggaatgg

SEQ ID NO: 183583 - DNA, 21 bp, Artificial sequence
  SiRNA target sequence
tcttggtgaaaatggaatggg

SEQ ID NO: 183584 - DNA, 21 bp, Artificial sequence
  SiRNA target sequence
cttggtgaaaatggaatgggc

SEQ ID NO: 183585 - DNA, 21 bp, Artificial sequence
  SiRNA target sequence
ttggtgaaaatggaatgggca

SEQ ID NO: 183586 - DNA, 21 bp, Artificial sequence
  SiRNA target sequence
tggtgaaaatggaatgggcaa

SEQ ID NO: 183587 - DNA, 21 bp, Artificial sequence
  SiRNA target sequence
ggtgaaaatggaatgggcaaa

SEQ ID NO: 183588 - DNA, 21 bp, Artificial sequence
  SiRNA target sequence
gtgaaaatggaatgggcaaaa

SEQ ID NO: 183589 - DNA, 21 bp, Artificial sequence
  SiRNA target sequence
tgaaaatggaatgggcaaaac

SEQ ID NO: 183590 - DNA, 21 bp, Artificial sequence
  SiRNA target sequence
gaaaatggaatgggcaaaact

SEQ ID NO: 183591 - DNA, 21 bp, Artificial sequence
  SiRNA target sequence
aaaatggaatgggcaaaacta

SEQ ID NO: 183592 - DNA, 21 bp, Artificial sequence
  SiRNA target sequence
aaatggaatgggcaaaactac

SEQ ID NO: 183593 - DNA, 21 bp, Artificial sequence
  SiRNA target sequence
aatggaatgggcaaaactact

SEQ ID NO: 183594 - DNA, 21 bp, Artificial sequence
  SiRNA target sequence
atggaatgggcaaaactactt

SEQ ID NO: 183595 - DNA, 21 bp, Artificial sequence
  SiRNA target sequence
tggaatgggcaaaactacttt

SEQ ID NO: 183596 - DNA, 21 bp, Artificial sequence
  SiRNA target sequence
ggaatgggcaaaactacttta

SEQ ID NO: 183597 - DNA, 21 bp, Artificial sequence
  SiRNA target sequence
gaatgggcaaaactactttag

SEQ ID NO: 183598 - DNA, 21 bp, Artificial sequence
  SiRNA target sequence
aatgggcaaaactactttagt

SEQ ID NO: 183599 - DNA, 21 bp, Artificial sequence
  SiRNA target sequence
atgggcaaaactactttagta

SEQ ID NO: 183600 - DNA, 21 bp, Artificial sequence
  SiRNA target sequence
tgggcaaaactactttagtag

SEQ ID NO: 183601 - DNA, 21 bp, Artificial sequence
  SiRNA target sequence
gggcaaaactactttagtagg

SEQ ID NO: 183602 - DNA, 21 bp, Artificial sequence
  SiRNA target sequence
ggcaaaactactttagtaggt

SEQ ID NO: 183603 - DNA, 21 bp, Artificial sequence
  SiRNA target sequence
gcaaaactactttagtaggtt

SEQ ID NO: 183604 - DNA, 21 bp, Artificial sequence
  SiRNA target sequence
caaaactactttagtaggttt

SEQ ID NO: 183605 - DNA, 21 bp, Artificial sequence
  SiRNA target sequence
aaaactactttagtaggtttg

SEQ ID NO: 183606 - DNA, 21 bp, Artificial sequence
  SiRNA target sequence
aaactactttagtaggtttga

SEQ ID NO: 183607 - DNA, 21 bp, Artificial sequence
  SiRNA target sequence
aactactttagtaggtttgat

SEQ ID NO: 183608 - DNA, 21 bp, Artificial sequence
  SiRNA target sequence
actactttagtaggtttgatt

SEQ ID NO: 183609 - DNA, 21 bp, Artificial sequence
  SiRNA target sequence
ctactttagtaggtttgattt

SEQ ID NO: 183610 - DNA, 21 bp, Artificial sequence
  SiRNA target sequence
tactttagtaggtttgatttc

SEQ ID NO: 183611 - DNA, 21 bp, Artificial sequence
  SiRNA target sequence
actttagtaggtttgatttcg

SEQ ID NO: 183612 - DNA, 21 bp, Artificial sequence
  SiRNA target sequence
ctttagtaggtttgatttcgg

SEQ ID NO: 183613 - DNA, 21 bp, Artificial sequence
  SiRNA target sequence
tttagtaggtttgatttcggg

SEQ ID NO: 183614 - DNA, 21 bp, Artificial sequence
  SiRNA target sequence
ttagtaggtttgatttcgggg

SEQ ID NO: 183615 - DNA, 21 bp, Artificial sequence
  SiRNA target sequence
tagtaggtttgatttcggggt

SEQ ID NO: 183616 - DNA, 21 bp, Artificial sequence
  SiRNA target sequence
agtaggtttgatttcggggtt

SEQ ID NO: 183617 - DNA, 21 bp, Artificial sequence
  SiRNA target sequence
gtaggtttgatttcggggtta

SEQ ID NO: 183618 - DNA, 21 bp, Artificial sequence
  SiRNA target sequence
taggtttgatttcggggttaa

SEQ ID NO: 183619 - DNA, 21 bp, Artificial sequence
  SiRNA target sequence
aggtttgatttcggggttaat

SEQ ID NO: 183620 - DNA, 21 bp, Artificial sequence
  SiRNA target sequence
ggtttgatttcggggttaatt

SEQ ID NO: 183621 - DNA, 21 bp, Artificial sequence
  SiRNA target sequence
gtttgatttcggggttaatta

SEQ ID NO: 183622 - DNA, 21 bp, Artificial sequence
  SiRNA target sequence
tttgatttcggggttaattaa

SEQ ID NO: 183623 - DNA, 21 bp, Artificial sequence
  SiRNA target sequence
ttgatttcggggttaattaaa

SEQ ID NO: 183624 - DNA, 21 bp, Artificial sequence
  SiRNA target sequence
tgatttcggggttaattaaag

SEQ ID NO: 183625 - DNA, 21 bp, Artificial sequence
  SiRNA target sequence
gatttcggggttaattaaaga

SEQ ID NO: 183626 - DNA, 21 bp, Artificial sequence
  SiRNA target sequence
atttcggggttaattaaagat

SEQ ID NO: 183627 - DNA, 21 bp, Artificial sequence
  SiRNA target sequence
tttcggggttaattaaagatg

SEQ ID NO: 183628 - DNA, 21 bp, Artificial sequence
  SiRNA target sequence
ttcggggttaattaaagatga

SEQ ID NO: 183629 - DNA, 21 bp, Artificial sequence
  SiRNA target sequence
tcggggttaattaaagatgat

SEQ ID NO: 183630 - DNA, 21 bp, Artificial sequence
  SiRNA target sequence
cggggttaattaaagatgata

SEQ ID NO: 183631 - DNA, 21 bp, Artificial sequence
  SiRNA target sequence
ggggttaattaaagatgataa

SEQ ID NO: 183632 - DNA, 21 bp, Artificial sequence
  SiRNA target sequence
gggttaattaaagatgataac

SEQ ID NO: 183633 - DNA, 21 bp, Artificial sequence
  SiRNA target sequence
ggttaattaaagatgataacg

SEQ ID NO: 183634 - DNA, 21 bp, Artificial sequence
  SiRNA target sequence
gttaattaaagatgataacgg

SEQ ID NO: 183635 - DNA, 21 bp, Artificial sequence
  SiRNA target sequence
ttaattaaagatgataacggg

SEQ ID NO: 183636 - DNA, 21 bp, Artificial sequence
  SiRNA target sequence
taattaaagatgataacgggg

SEQ ID NO: 183637 - DNA, 21 bp, Artificial sequence
  SiRNA target sequence
aattaaagatgataacgggga

SEQ ID NO: 183638 - DNA, 21 bp, Artificial sequence
  SiRNA target sequence
attaaagatgataacggggaa

SEQ ID NO: 183639 - DNA, 21 bp, Artificial sequence
  SiRNA target sequence
ttaaagatgataacggggaag

SEQ ID NO: 183640 - DNA, 21 bp, Artificial sequence
  SiRNA target sequence
taaagatgataacggggaaga

SEQ ID NO: 183641 - DNA, 21 bp, Artificial sequence
  SiRNA target sequence
aaagatgataacggggaagag

SEQ ID NO: 183642 - DNA, 21 bp, Artificial sequence
  SiRNA target sequence
aagatgataacggggaagagt

SEQ ID NO: 183643 - DNA, 21 bp, Artificial sequence
  SiRNA target sequence
agatgataacggggaagagtt

SEQ ID NO: 183644 - DNA, 21 bp, Artificial sequence
  SiRNA target sequence
gatgataacggggaagagttc

SEQ ID NO: 183645 - DNA, 21 bp, Artificial sequence
  SiRNA target sequence
atgataacggggaagagttcg

SEQ ID NO: 183646 - DNA, 21 bp, Artificial sequence
  SiRNA target sequence
tgataacggggaagagttcgg

SEQ ID NO: 183647 - DNA, 21 bp, Artificial sequence
  SiRNA target sequence
gataacggggaagagttcggt

SEQ ID NO: 183648 - DNA, 21 bp, Artificial sequence
  SiRNA target sequence
ataacggggaagagttcggtt

SEQ ID NO: 183649 - DNA, 21 bp, Artificial sequence
  SiRNA target sequence
taacggggaagagttcggttt

SEQ ID NO: 183650 - DNA, 21 bp, Artificial sequence
  SiRNA target sequence
aacggggaagagttcggtttg

SEQ ID NO: 183651 - DNA, 21 bp, Artificial sequence
  SiRNA target sequence
acggggaagagttcggtttgt

SEQ ID NO: 183652 - DNA, 21 bp, Artificial sequence
  SiRNA target sequence
cggggaagagttcggtttgtt

SEQ ID NO: 183653 - DNA, 21 bp, Artificial sequence
  SiRNA target sequence
ggggaagagttcggtttgttg

SEQ ID NO: 183654 - DNA, 21 bp, Artificial sequence
  SiRNA target sequence
gggaagagttcggtttgttgt

SEQ ID NO: 183655 - DNA, 21 bp, Artificial sequence
  SiRNA target sequence
ggaagagttcggtttgttgtc

SEQ ID NO: 183656 - DNA, 21 bp, Artificial sequence
  SiRNA target sequence
gaagagttcggtttgttgtca

SEQ ID NO: 183657 - DNA, 21 bp, Artificial sequence
  SiRNA target sequence
aagagttcggtttgttgtcat

SEQ ID NO: 183658 - DNA, 21 bp, Artificial sequence
  SiRNA target sequence
agagttcggtttgttgtcata

SEQ ID NO: 183659 - DNA, 21 bp, Artificial sequence
  SiRNA target sequence
gagttcggtttgttgtcatat

SEQ ID NO: 183660 - DNA, 21 bp, Artificial sequence
  SiRNA target sequence
agttcggtttgttgtcatata

SEQ ID NO: 183661 - DNA, 21 bp, Artificial sequence
  SiRNA target sequence
gttcggtttgttgtcatatag

SEQ ID NO: 183662 - DNA, 21 bp, Artificial sequence
  SiRNA target sequence
ttcggtttgttgtcatatagt

SEQ ID NO: 183663 - DNA, 21 bp, Artificial sequence
  SiRNA target sequence
tcggtttgttgtcatatagtc

SEQ ID NO: 183664 - DNA, 21 bp, Artificial sequence
  SiRNA target sequence
cggtttgttgtcatatagtct

SEQ ID NO: 183665 - DNA, 21 bp, Artificial sequence
  SiRNA target sequence
ggtttgttgtcatatagtctt

SEQ ID NO: 183666 - DNA, 21 bp, Artificial sequence
  SiRNA target sequence
gtttgttgtcatatagtctta

SEQ ID NO: 183667 - DNA, 21 bp, Artificial sequence
  SiRNA target sequence
tttgttgtcatatagtcttaa

SEQ ID NO: 183668 - DNA, 21 bp, Artificial sequence
  SiRNA target sequence
ttgttgtcatatagtcttaaa

SEQ ID NO: 183669 - DNA, 21 bp, Artificial sequence
  SiRNA target sequence
tgttgtcatatagtcttaaac

SEQ ID NO: 183670 - DNA, 21 bp, Artificial sequence
  SiRNA target sequence
gttgtcatatagtcttaaacc

SEQ ID NO: 183671 - DNA, 21 bp, Artificial sequence
  SiRNA target sequence
ttgtcatatagtcttaaaccg

SEQ ID NO: 183672 - DNA, 21 bp, Artificial sequence
  SiRNA target sequence
tgtcatatagtcttaaaccgc

SEQ ID NO: 183673 - DNA, 21 bp, Artificial sequence
  SiRNA target sequence
gtcatatagtcttaaaccgca

SEQ ID NO: 183674 - DNA, 21 bp, Artificial sequence
  SiRNA target sequence
tcatatagtcttaaaccgcaa

SEQ ID NO: 183675 - DNA, 21 bp, Artificial sequence
  SiRNA target sequence
catatagtcttaaaccgcaaa

SEQ ID NO: 183676 - DNA, 21 bp, Artificial sequence
  SiRNA target sequence
atatagtcttaaaccgcaaaa

SEQ ID NO: 183677 - DNA, 21 bp, Artificial sequence
  SiRNA target sequence
tatagtcttaaaccgcaaaaa

SEQ ID NO: 183678 - DNA, 21 bp, Artificial sequence
  SiRNA target sequence
atagtcttaaaccgcaaaaaa

SEQ ID NO: 183679 - DNA, 21 bp, Artificial sequence
  SiRNA target sequence
tagtcttaaaccgcaaaaaat

SEQ ID NO: 183680 - DNA, 21 bp, Artificial sequence
  SiRNA target sequence
agtcttaaaccgcaaaaaatc

SEQ ID NO: 183681 - DNA, 21 bp, Artificial sequence
  SiRNA target sequence
gtcttaaaccgcaaaaaatca

SEQ ID NO: 183682 - DNA, 21 bp, Artificial sequence
  SiRNA target sequence
tcttaaaccgcaaaaaatcat

SEQ ID NO: 183683 - DNA, 21 bp, Artificial sequence
  SiRNA target sequence
cttaaaccgcaaaaaatcata

SEQ ID NO: 183684 - DNA, 21 bp, Artificial sequence
  SiRNA target sequence
ttaaaccgcaaaaaatcatac

SEQ ID NO: 183685 - DNA, 21 bp, Artificial sequence
  SiRNA target sequence
taaaccgcaaaaaatcatacc

SEQ ID NO: 183686 - DNA, 21 bp, Artificial sequence
  SiRNA target sequence
aaaccgcaaaaaatcataccg

SEQ ID NO: 183687 - DNA, 21 bp, Artificial sequence
  SiRNA target sequence
aaccgcaaaaaatcataccga

SEQ ID NO: 183688 - DNA, 21 bp, Artificial sequence
  SiRNA target sequence
accgcaaaaaatcataccgaa

SEQ ID NO: 183689 - DNA, 21 bp, Artificial sequence
  SiRNA target sequence
ccgcaaaaaatcataccgaaa

SEQ ID NO: 183690 - DNA, 21 bp, Artificial sequence
  SiRNA target sequence
cgcaaaaaatcataccgaaat

SEQ ID NO: 183691 - DNA, 21 bp, Artificial sequence
  SiRNA target sequence
gcaaaaaatcataccgaaata

SEQ ID NO: 183692 - DNA, 21 bp, Artificial sequence
  SiRNA target sequence
caaaaaatcataccgaaatac

SEQ ID NO: 183693 - DNA, 21 bp, Artificial sequence
  SiRNA target sequence
aaaaaatcataccgaaataca

SEQ ID NO: 183694 - DNA, 21 bp, Artificial sequence
  SiRNA target sequence
aaaaatcataccgaaatacaa

SEQ ID NO: 183695 - DNA, 21 bp, Artificial sequence
  SiRNA target sequence
aaaatcataccgaaatacaaa

SEQ ID NO: 183696 - DNA, 21 bp, Artificial sequence
  SiRNA target sequence
aaatcataccgaaatacaaag

SEQ ID NO: 183697 - DNA, 21 bp, Artificial sequence
  SiRNA target sequence
aatcataccgaaatacaaagg

SEQ ID NO: 183698 - DNA, 21 bp, Artificial sequence
  SiRNA target sequence
atcataccgaaatacaaagga

SEQ ID NO: 183699 - DNA, 21 bp, Artificial sequence
  SiRNA target sequence
tcataccgaaatacaaaggaa

SEQ ID NO: 183700 - DNA, 21 bp, Artificial sequence
  SiRNA target sequence
cataccgaaatacaaaggaac

SEQ ID NO: 183701 - DNA, 21 bp, Artificial sequence
  SiRNA target sequence
ataccgaaatacaaaggaaca

SEQ ID NO: 183702 - DNA, 21 bp, Artificial sequence
  SiRNA target sequence
taccgaaatacaaaggaacag

SEQ ID NO: 183703 - DNA, 21 bp, Artificial sequence
  SiRNA target sequence
accgaaatacaaaggaacagt

SEQ ID NO: 183704 - DNA, 21 bp, Artificial sequence
  SiRNA target sequence
ccgaaatacaaaggaacagtt

SEQ ID NO: 183705 - DNA, 21 bp, Artificial sequence
  SiRNA target sequence
cgaaatacaaaggaacagtta

SEQ ID NO: 183706 - DNA, 21 bp, Artificial sequence
  SiRNA target sequence
gaaatacaaaggaacagttag

SEQ ID NO: 183707 - DNA, 21 bp, Artificial sequence
  SiRNA target sequence
aaatacaaaggaacagttaga

SEQ ID NO: 183708 - DNA, 21 bp, Artificial sequence
  SiRNA target sequence
aatacaaaggaacagttagag

SEQ ID NO: 183709 - DNA, 21 bp, Artificial sequence
  SiRNA target sequence
atacaaaggaacagttagaga

SEQ ID NO: 183710 - DNA, 21 bp, Artificial sequence
  SiRNA target sequence
tacaaaggaacagttagagat

SEQ ID NO: 183711 - DNA, 21 bp, Artificial sequence
  SiRNA target sequence
acaaaggaacagttagagatc

SEQ ID NO: 183712 - DNA, 21 bp, Artificial sequence
  SiRNA target sequence
caaaggaacagttagagatct

SEQ ID NO: 183713 - DNA, 21 bp, Artificial sequence
  SiRNA target sequence
aaaggaacagttagagatctt

SEQ ID NO: 183714 - DNA, 21 bp, Artificial sequence
  SiRNA target sequence
aaggaacagttagagatcttt

SEQ ID NO: 183715 - DNA, 21 bp, Artificial sequence
  SiRNA target sequence
aggaacagttagagatctttt

SEQ ID NO: 183716 - DNA, 21 bp, Artificial sequence
  SiRNA target sequence
ggaacagttagagatcttttt

SEQ ID NO: 183717 - DNA, 21 bp, Artificial sequence
  SiRNA target sequence
gaacagttagagatcttttta

SEQ ID NO: 183718 - DNA, 21 bp, Artificial sequence
  SiRNA target sequence
aacagttagagatctttttat

SEQ ID NO: 183719 - DNA, 21 bp, Artificial sequence
  SiRNA target sequence
acagttagagatctttttatg

SEQ ID NO: 183720 - DNA, 21 bp, Artificial sequence
  SiRNA target sequence
cagttagagatctttttatgt

SEQ ID NO: 183721 - DNA, 21 bp, Artificial sequence
  SiRNA target sequence
agttagagatctttttatgtc

SEQ ID NO: 183722 - DNA, 21 bp, Artificial sequence
  SiRNA target sequence
gttagagatctttttatgtca

SEQ ID NO: 183723 - DNA, 21 bp, Artificial sequence
  SiRNA target sequence
ttagagatctttttatgtcaa

SEQ ID NO: 183724 - DNA, 21 bp, Artificial sequence
  SiRNA target sequence
tagagatctttttatgtcaaa

SEQ ID NO: 183725 - DNA, 21 bp, Artificial sequence
  SiRNA target sequence
agagatctttttatgtcaaaa

SEQ ID NO: 183726 - DNA, 21 bp, Artificial sequence
  SiRNA target sequence
gagatctttttatgtcaaaaa

SEQ ID NO: 183727 - DNA, 21 bp, Artificial sequence
  SiRNA target sequence
agatctttttatgtcaaaaat

SEQ ID NO: 183728 - DNA, 21 bp, Artificial sequence
  SiRNA target sequence
gatctttttatgtcaaaaatt

SEQ ID NO: 183729 - DNA, 21 bp, Artificial sequence
  SiRNA target sequence
atctttttatgtcaaaaattc

SEQ ID NO: 183730 - DNA, 21 bp, Artificial sequence
  SiRNA target sequence
tctttttatgtcaaaaattcg

SEQ ID NO: 183731 - DNA, 21 bp, Artificial sequence
  SiRNA target sequence
ctttttatgtcaaaaattcgt

SEQ ID NO: 183732 - DNA, 21 bp, Artificial sequence
  SiRNA target sequence
tttttatgtcaaaaattcgtt

SEQ ID NO: 183733 - DNA, 21 bp, Artificial sequence
  SiRNA target sequence
ttttatgtcaaaaattcgttc

SEQ ID NO: 183734 - DNA, 21 bp, Artificial sequence
  SiRNA target sequence
tttatgtcaaaaattcgttct

SEQ ID NO: 183735 - DNA, 21 bp, Artificial sequence
  SiRNA target sequence
ttatgtcaaaaattcgttctt

SEQ ID NO: 183736 - DNA, 21 bp, Artificial sequence
  SiRNA target sequence
tatgtcaaaaattcgttcttc

SEQ ID NO: 183737 - DNA, 21 bp, Artificial sequence
  SiRNA target sequence
atgtcaaaaattcgttcttcc

SEQ ID NO: 183738 - DNA, 21 bp, Artificial sequence
  SiRNA target sequence
tgtcaaaaattcgttcttcct

SEQ ID NO: 183739 - DNA, 21 bp, Artificial sequence
  SiRNA target sequence
gtcaaaaattcgttcttcctt

SEQ ID NO: 183740 - DNA, 21 bp, Artificial sequence
  SiRNA target sequence
tcaaaaattcgttcttccttt

SEQ ID NO: 183741 - DNA, 21 bp, Artificial sequence
  SiRNA target sequence
caaaaattcgttcttcctttt

SEQ ID NO: 183742 - DNA, 21 bp, Artificial sequence
  SiRNA target sequence
aaaaattcgttcttccttttt

SEQ ID NO: 183743 - DNA, 21 bp, Artificial sequence
  SiRNA target sequence
aaaattcgttcttccttttta

SEQ ID NO: 183744 - DNA, 21 bp, Artificial sequence
  SiRNA target sequence
aaattcgttcttcctttttag

SEQ ID NO: 183745 - DNA, 21 bp, Artificial sequence
  SiRNA target sequence
aattcgttcttcctttttaga

SEQ ID NO: 183746 - DNA, 21 bp, Artificial sequence
  SiRNA target sequence
attcgttcttcctttttagac

SEQ ID NO: 183747 - DNA, 21 bp, Artificial sequence
  SiRNA target sequence
ttcgttcttcctttttagacg

SEQ ID NO: 183748 - DNA, 21 bp, Artificial sequence
  SiRNA target sequence
tcgttcttcctttttagacgc

SEQ ID NO: 183749 - DNA, 21 bp, Artificial sequence
  SiRNA target sequence
cgttcttcctttttagacgct

SEQ ID NO: 183750 - DNA, 21 bp, Artificial sequence
  SiRNA target sequence
gttcttcctttttagacgcta

SEQ ID NO: 183751 - DNA, 21 bp, Artificial sequence
  SiRNA target sequence
ttcttcctttttagacgctaa

SEQ ID NO: 183752 - DNA, 21 bp, Artificial sequence
  SiRNA target sequence
tcttcctttttagacgctaat

SEQ ID NO: 183753 - DNA, 21 bp, Artificial sequence
  SiRNA target sequence
cttcctttttagacgctaatt

SEQ ID NO: 183754 - DNA, 21 bp, Artificial sequence
  SiRNA target sequence
ttcctttttagacgctaattt

SEQ ID NO: 183755 - DNA, 21 bp, Artificial sequence
  SiRNA target sequence
tcctttttagacgctaatttt

SEQ ID NO: 183756 - DNA, 21 bp, Artificial sequence
  SiRNA target sequence
cctttttagacgctaattttg

SEQ ID NO: 183757 - DNA, 21 bp, Artificial sequence
  SiRNA target sequence
ctttttagacgctaattttgt

SEQ ID NO: 183758 - DNA, 21 bp, Artificial sequence
  SiRNA target sequence
tttttagacgctaattttgtt

SEQ ID NO: 183759 - DNA, 21 bp, Artificial sequence
  SiRNA target sequence
ttttagacgctaattttgtta

SEQ ID NO: 183760 - DNA, 21 bp, Artificial sequence
  SiRNA target sequence
tttagacgctaattttgttaa

SEQ ID NO: 183761 - DNA, 21 bp, Artificial sequence
  SiRNA target sequence
ttagacgctaattttgttaat

SEQ ID NO: 183762 - DNA, 21 bp, Artificial sequence
  SiRNA target sequence
tagacgctaattttgttaatg

SEQ ID NO: 183763 - DNA, 21 bp, Artificial sequence
  SiRNA target sequence
agacgctaattttgttaatga

SEQ ID NO: 183764 - DNA, 21 bp, Artificial sequence
  SiRNA target sequence
gacgctaattttgttaatgaa

SEQ ID NO: 183765 - DNA, 21 bp, Artificial sequence
  SiRNA target sequence
acgctaattttgttaatgaag

SEQ ID NO: 183766 - DNA, 21 bp, Artificial sequence
  SiRNA target sequence
cgctaattttgttaatgaagc

SEQ ID NO: 183767 - DNA, 21 bp, Artificial sequence
  SiRNA target sequence
gctaattttgttaatgaagct

SEQ ID NO: 183768 - DNA, 21 bp, Artificial sequence
  SiRNA target sequence
ctaattttgttaatgaagcta

SEQ ID NO: 183769 - DNA, 21 bp, Artificial sequence
  SiRNA target sequence
taattttgttaatgaagctat

SEQ ID NO: 183770 - DNA, 21 bp, Artificial sequence
  SiRNA target sequence
aattttgttaatgaagctatt

SEQ ID NO: 183771 - DNA, 21 bp, Artificial sequence
  SiRNA target sequence
attttgttaatgaagctatta

SEQ ID NO: 183772 - DNA, 21 bp, Artificial sequence
  SiRNA target sequence
ttttgttaatgaagctattaa

SEQ ID NO: 183773 - DNA, 21 bp, Artificial sequence
  SiRNA target sequence
tttgttaatgaagctattaaa

SEQ ID NO: 183774 - DNA, 21 bp, Artificial sequence
  SiRNA target sequence
ttgttaatgaagctattaaac

SEQ ID NO: 183775 - DNA, 21 bp, Artificial sequence
  SiRNA target sequence
tgttaatgaagctattaaacc

SEQ ID NO: 183776 - DNA, 21 bp, Artificial sequence
  SiRNA target sequence
gttaatgaagctattaaacct

SEQ ID NO: 183777 - DNA, 21 bp, Artificial sequence
  SiRNA target sequence
ttaatgaagctattaaacctt

SEQ ID NO: 183778 - DNA, 21 bp, Artificial sequence
  SiRNA target sequence
taatgaagctattaaaccttt

SEQ ID NO: 183779 - DNA, 21 bp, Artificial sequence
  SiRNA target sequence
aatgaagctattaaaccttta

SEQ ID NO: 183780 - DNA, 21 bp, Artificial sequence
  SiRNA target sequence
atgaagctattaaacctttag

SEQ ID NO: 183781 - DNA, 21 bp, Artificial sequence
  SiRNA target sequence
tgaagctattaaacctttaga

SEQ ID NO: 183782 - DNA, 21 bp, Artificial sequence
  SiRNA target sequence
gaagctattaaacctttagat

SEQ ID NO: 183783 - DNA, 21 bp, Artificial sequence
  SiRNA target sequence
aagctattaaacctttagata

SEQ ID NO: 183784 - DNA, 21 bp, Artificial sequence
  SiRNA target sequence
agctattaaacctttagatat

SEQ ID NO: 183785 - DNA, 21 bp, Artificial sequence
  SiRNA target sequence
gctattaaacctttagatatt

SEQ ID NO: 183786 - DNA, 21 bp, Artificial sequence
  SiRNA target sequence
ctattaaacctttagatattc

SEQ ID NO: 183787 - DNA, 21 bp, Artificial sequence
  SiRNA target sequence
tattaaacctttagatattca

SEQ ID NO: 183788 - DNA, 21 bp, Artificial sequence
  SiRNA target sequence
attaaacctttagatattcat

SEQ ID NO: 183789 - DNA, 21 bp, Artificial sequence
  SiRNA target sequence
ttaaacctttagatattcatc

SEQ ID NO: 183790 - DNA, 21 bp, Artificial sequence
  SiRNA target sequence
taaacctttagatattcatca

SEQ ID NO: 183791 - DNA, 21 bp, Artificial sequence
  SiRNA target sequence
aaacctttagatattcatcat

SEQ ID NO: 183792 - DNA, 21 bp, Artificial sequence
  SiRNA target sequence
aacctttagatattcatcatt

SEQ ID NO: 183793 - DNA, 21 bp, Artificial sequence
  SiRNA target sequence
acctttagatattcatcattt

SEQ ID NO: 183794 - DNA, 21 bp, Artificial sequence
  SiRNA target sequence
cctttagatattcatcattta

SEQ ID NO: 183795 - DNA, 21 bp, Artificial sequence
  SiRNA target sequence
ctttagatattcatcatttat

SEQ ID NO: 183796 - DNA, 21 bp, Artificial sequence
  SiRNA target sequence
tttagatattcatcatttata

SEQ ID NO: 183797 - DNA, 21 bp, Artificial sequence
  SiRNA target sequence
ttagatattcatcatttatac

SEQ ID NO: 183798 - DNA, 21 bp, Artificial sequence
  SiRNA target sequence
tagatattcatcatttatacg

SEQ ID NO: 183799 - DNA, 21 bp, Artificial sequence
  SiRNA target sequence
agatattcatcatttatacga

SEQ ID NO: 183800 - DNA, 21 bp, Artificial sequence
  SiRNA target sequence
gatattcatcatttatacgac

SEQ ID NO: 183801 - DNA, 21 bp, Artificial sequence
  SiRNA target sequence
atattcatcatttatacgacc

SEQ ID NO: 183802 - DNA, 21 bp, Artificial sequence
  SiRNA target sequence
tattcatcatttatacgacca

SEQ ID NO: 183803 - DNA, 21 bp, Artificial sequence
  SiRNA target sequence
attcatcatttatacgaccaa

SEQ ID NO: 183804 - DNA, 21 bp, Artificial sequence
  SiRNA target sequence
ttcatcatttatacgaccaac

SEQ ID NO: 183805 - DNA, 21 bp, Artificial sequence
  SiRNA target sequence
tcatcatttatacgaccaact

SEQ ID NO: 183806 - DNA, 21 bp, Artificial sequence
  SiRNA target sequence
catcatttatacgaccaactt

SEQ ID NO: 183807 - DNA, 21 bp, Artificial sequence
  SiRNA target sequence
atcatttatacgaccaacttg

SEQ ID NO: 183808 - DNA, 21 bp, Artificial sequence
  SiRNA target sequence
tcatttatacgaccaacttgt

SEQ ID NO: 183809 - DNA, 21 bp, Artificial sequence
  SiRNA target sequence
catttatacgaccaacttgta

SEQ ID NO: 183810 - DNA, 21 bp, Artificial sequence
  SiRNA target sequence
atttatacgaccaacttgtag

SEQ ID NO: 183811 - DNA, 21 bp, Artificial sequence
  SiRNA target sequence
tttatacgaccaacttgtaga

SEQ ID NO: 183812 - DNA, 21 bp, Artificial sequence
  SiRNA target sequence
ttatacgaccaacttgtagaa

SEQ ID NO: 183813 - DNA, 21 bp, Artificial sequence
  SiRNA target sequence
tatacgaccaacttgtagaaa

SEQ ID NO: 183814 - DNA, 21 bp, Artificial sequence
  SiRNA target sequence
atacgaccaacttgtagaaaa

SEQ ID NO: 183815 - DNA, 21 bp, Artificial sequence
  SiRNA target sequence
tacgaccaacttgtagaaaac

SEQ ID NO: 183816 - DNA, 21 bp, Artificial sequence
  SiRNA target sequence
acgaccaacttgtagaaaact

SEQ ID NO: 183817 - DNA, 21 bp, Artificial sequence
  SiRNA target sequence
cgaccaacttgtagaaaactt

SEQ ID NO: 183818 - DNA, 21 bp, Artificial sequence
  SiRNA target sequence
gaccaacttgtagaaaacttg

SEQ ID NO: 183819 - DNA, 21 bp, Artificial sequence
  SiRNA target sequence
accaacttgtagaaaacttga

SEQ ID NO: 183820 - DNA, 21 bp, Artificial sequence
  SiRNA target sequence
ccaacttgtagaaaacttgag

SEQ ID NO: 183821 - DNA, 21 bp, Artificial sequence
  SiRNA target sequence
caacttgtagaaaacttgagt

SEQ ID NO: 183822 - DNA, 21 bp, Artificial sequence
  SiRNA target sequence
aacttgtagaaaacttgagtg

SEQ ID NO: 183823 - DNA, 21 bp, Artificial sequence
  SiRNA target sequence
acttgtagaaaacttgagtgg

SEQ ID NO: 183824 - DNA, 21 bp, Artificial sequence
  SiRNA target sequence
cttgtagaaaacttgagtggt

SEQ ID NO: 183825 - DNA, 21 bp, Artificial sequence
  SiRNA target sequence
ttgtagaaaacttgagtggtg

SEQ ID NO: 183826 - DNA, 21 bp, Artificial sequence
  SiRNA target sequence
tgtagaaaacttgagtggtgg

SEQ ID NO: 183827 - DNA, 21 bp, Artificial sequence
  SiRNA target sequence
gtagaaaacttgagtggtgga

SEQ ID NO: 183828 - DNA, 21 bp, Artificial sequence
  SiRNA target sequence
tagaaaacttgagtggtggag

SEQ ID NO: 183829 - DNA, 21 bp, Artificial sequence
  SiRNA target sequence
agaaaacttgagtggtggaga

SEQ ID NO: 183830 - DNA, 21 bp, Artificial sequence
  SiRNA target sequence
gaaaacttgagtggtggagaa

SEQ ID NO: 183831 - DNA, 21 bp, Artificial sequence
  SiRNA target sequence
aaaacttgagtggtggagaat

SEQ ID NO: 183832 - DNA, 21 bp, Artificial sequence
  SiRNA target sequence
aaacttgagtggtggagaatt

SEQ ID NO: 183833 - DNA, 21 bp, Artificial sequence
  SiRNA target sequence
aacttgagtggtggagaatta

SEQ ID NO: 183834 - DNA, 21 bp, Artificial sequence
  SiRNA target sequence
acttgagtggtggagaattac

SEQ ID NO: 183835 - DNA, 21 bp, Artificial sequence
  SiRNA target sequence
cttgagtggtggagaattaca

SEQ ID NO: 183836 - DNA, 21 bp, Artificial sequence
  SiRNA target sequence
ttgagtggtggagaattacaa

SEQ ID NO: 183837 - DNA, 21 bp, Artificial sequence
  SiRNA target sequence
tgagtggtggagaattacaaa

SEQ ID NO: 183838 - DNA, 21 bp, Artificial sequence
  SiRNA target sequence
gagtggtggagaattacaaag

SEQ ID NO: 183839 - DNA, 21 bp, Artificial sequence
  SiRNA target sequence
agtggtggagaattacaaaga

SEQ ID NO: 183840 - DNA, 21 bp, Artificial sequence
  SiRNA target sequence
gtggtggagaattacaaagaa

SEQ ID NO: 183841 - DNA, 21 bp, Artificial sequence
  SiRNA target sequence
tggtggagaattacaaagaat

SEQ ID NO: 183842 - DNA, 21 bp, Artificial sequence
  SiRNA target sequence
ggtggagaattacaaagaatt

SEQ ID NO: 183843 - DNA, 21 bp, Artificial sequence
  SiRNA target sequence
gtggagaattacaaagaattg

SEQ ID NO: 183844 - DNA, 21 bp, Artificial sequence
  SiRNA target sequence
tggagaattacaaagaattgc

SEQ ID NO: 183845 - DNA, 21 bp, Artificial sequence
  SiRNA target sequence
ggagaattacaaagaattgca

SEQ ID NO: 183846 - DNA, 21 bp, Artificial sequence
  SiRNA target sequence
gagaattacaaagaattgcaa

SEQ ID NO: 183847 - DNA, 21 bp, Artificial sequence
  SiRNA target sequence
agaattacaaagaattgcaat

SEQ ID NO: 183848 - DNA, 21 bp, Artificial sequence
  SiRNA target sequence
gaattacaaagaattgcaata

SEQ ID NO: 183849 - DNA, 21 bp, Artificial sequence
  SiRNA target sequence
aattacaaagaattgcaataa

SEQ ID NO: 183850 - DNA, 21 bp, Artificial sequence
  SiRNA target sequence
attacaaagaattgcaataat

SEQ ID NO: 183851 - DNA, 21 bp, Artificial sequence
  SiRNA target sequence
ttacaaagaattgcaataata

SEQ ID NO: 183852 - DNA, 21 bp, Artificial sequence
  SiRNA target sequence
tacaaagaattgcaataataa

SEQ ID NO: 183853 - DNA, 21 bp, Artificial sequence
  SiRNA target sequence
acaaagaattgcaataataat

SEQ ID NO: 183854 - DNA, 21 bp, Artificial sequence
  SiRNA target sequence
caaagaattgcaataataata

SEQ ID NO: 183855 - DNA, 21 bp, Artificial sequence
  SiRNA target sequence
aaagaattgcaataataatat

SEQ ID NO: 183856 - DNA, 21 bp, Artificial sequence
  SiRNA target sequence
aagaattgcaataataatatg

SEQ ID NO: 183857 - DNA, 21 bp, Artificial sequence
  SiRNA target sequence
agaattgcaataataatatgt

SEQ ID NO: 183858 - DNA, 21 bp, Artificial sequence
  SiRNA target sequence
gaattgcaataataatatgtt

SEQ ID NO: 183859 - DNA, 21 bp, Artificial sequence
  SiRNA target sequence
aattgcaataataatatgttt

SEQ ID NO: 183860 - DNA, 21 bp, Artificial sequence
  SiRNA target sequence
attgcaataataatatgttta

SEQ ID NO: 183861 - DNA, 21 bp, Artificial sequence
  SiRNA target sequence
ttgcaataataatatgtttag

SEQ ID NO: 183862 - DNA, 21 bp, Artificial sequence
  SiRNA target sequence
tgcaataataatatgtttagg

SEQ ID NO: 183863 - DNA, 21 bp, Artificial sequence
  SiRNA target sequence
gcaataataatatgtttagga

SEQ ID NO: 183864 - DNA, 21 bp, Artificial sequence
  SiRNA target sequence
caataataatatgtttaggaa

SEQ ID NO: 183865 - DNA, 21 bp, Artificial sequence
  SiRNA target sequence
aataataatatgtttaggaaa

SEQ ID NO: 183866 - DNA, 21 bp, Artificial sequence
  SiRNA target sequence
ataataatatgtttaggaaaa

SEQ ID NO: 183867 - DNA, 21 bp, Artificial sequence
  SiRNA target sequence
taataatatgtttaggaaaag

SEQ ID NO: 183868 - DNA, 21 bp, Artificial sequence
  SiRNA target sequence
aataatatgtttaggaaaaga

SEQ ID NO: 183869 - DNA, 21 bp, Artificial sequence
  SiRNA target sequence
ataatatgtttaggaaaagat

SEQ ID NO: 183870 - DNA, 21 bp, Artificial sequence
  SiRNA target sequence
taatatgtttaggaaaagatg

SEQ ID NO: 183871 - DNA, 21 bp, Artificial sequence
  SiRNA target sequence
aatatgtttaggaaaagatgc

SEQ ID NO: 183872 - DNA, 21 bp, Artificial sequence
  SiRNA target sequence
atatgtttaggaaaagatgct

SEQ ID NO: 183873 - DNA, 21 bp, Artificial sequence
  SiRNA target sequence
tatgtttaggaaaagatgcta

SEQ ID NO: 183874 - DNA, 21 bp, Artificial sequence
  SiRNA target sequence
atgtttaggaaaagatgctaa

SEQ ID NO: 183875 - DNA, 21 bp, Artificial sequence
  SiRNA target sequence
tgtttaggaaaagatgctaac

SEQ ID NO: 183876 - DNA, 21 bp, Artificial sequence
  SiRNA target sequence
gtttaggaaaagatgctaacc

SEQ ID NO: 183877 - DNA, 21 bp, Artificial sequence
  SiRNA target sequence
tttaggaaaagatgctaacct

SEQ ID NO: 183878 - DNA, 21 bp, Artificial sequence
  SiRNA target sequence
ttaggaaaagatgctaacctt

SEQ ID NO: 183879 - DNA, 21 bp, Artificial sequence
  SiRNA target sequence
taggaaaagatgctaaccttt

SEQ ID NO: 183880 - DNA, 21 bp, Artificial sequence
  SiRNA target sequence
aggaaaagatgctaaccttta

SEQ ID NO: 183881 - DNA, 21 bp, Artificial sequence
  SiRNA target sequence
ggaaaagatgctaacctttat

SEQ ID NO: 183882 - DNA, 21 bp, Artificial sequence
  SiRNA target sequence
gaaaagatgctaacctttatt

SEQ ID NO: 183883 - DNA, 21 bp, Artificial sequence
  SiRNA target sequence
aaaagatgctaacctttattt

SEQ ID NO: 183884 - DNA, 21 bp, Artificial sequence
  SiRNA target sequence
aaagatgctaacctttattta

SEQ ID NO: 183885 - DNA, 21 bp, Artificial sequence
  SiRNA target sequence
aagatgctaacctttatttat

SEQ ID NO: 183886 - DNA, 21 bp, Artificial sequence
  SiRNA target sequence
agatgctaacctttatttatt

SEQ ID NO: 183887 - DNA, 21 bp, Artificial sequence
  SiRNA target sequence
gatgctaacctttatttatta

SEQ ID NO: 183888 - DNA, 21 bp, Artificial sequence
  SiRNA target sequence
atgctaacctttatttattag

SEQ ID NO: 183889 - DNA, 21 bp, Artificial sequence
  SiRNA target sequence
tgctaacctttatttattaga

SEQ ID NO: 183890 - DNA, 21 bp, Artificial sequence
  SiRNA target sequence
gctaacctttatttattagat

SEQ ID NO: 183891 - DNA, 21 bp, Artificial sequence
  SiRNA target sequence
ctaacctttatttattagatg

SEQ ID NO: 183892 - DNA, 21 bp, Artificial sequence
  SiRNA target sequence
taacctttatttattagatga

SEQ ID NO: 183893 - DNA, 21 bp, Artificial sequence
  SiRNA target sequence
aacctttatttattagatgaa

SEQ ID NO: 183894 - DNA, 21 bp, Artificial sequence
  SiRNA target sequence
acctttatttattagatgaac

SEQ ID NO: 183895 - DNA, 21 bp, Artificial sequence
  SiRNA target sequence
cctttatttattagatgaacc

SEQ ID NO: 183896 - DNA, 21 bp, Artificial sequence
  SiRNA target sequence
ctttatttattagatgaacct

SEQ ID NO: 183897 - DNA, 21 bp, Artificial sequence
  SiRNA target sequence
tttatttattagatgaacctt

SEQ ID NO: 183898 - DNA, 21 bp, Artificial sequence
  SiRNA target sequence
ttatttattagatgaaccttc

SEQ ID NO: 183899 - DNA, 21 bp, Artificial sequence
  SiRNA target sequence
tatttattagatgaaccttct

SEQ ID NO: 183900 - DNA, 21 bp, Artificial sequence
  SiRNA target sequence
atttattagatgaaccttctg

SEQ ID NO: 183901 - DNA, 21 bp, Artificial sequence
  SiRNA target sequence
tttattagatgaaccttctgc

SEQ ID NO: 183902 - DNA, 21 bp, Artificial sequence
  SiRNA target sequence
ttattagatgaaccttctgcg

SEQ ID NO: 183903 - DNA, 21 bp, Artificial sequence
  SiRNA target sequence
tattagatgaaccttctgcgt

SEQ ID NO: 183904 - DNA, 21 bp, Artificial sequence
  SiRNA target sequence
attagatgaaccttctgcgta

SEQ ID NO: 183905 - DNA, 21 bp, Artificial sequence
  SiRNA target sequence
ttagatgaaccttctgcgtat

SEQ ID NO: 183906 - DNA, 21 bp, Artificial sequence
  SiRNA target sequence
tagatgaaccttctgcgtatc

SEQ ID NO: 183907 - DNA, 21 bp, Artificial sequence
  SiRNA target sequence
agatgaaccttctgcgtatct

SEQ ID NO: 183908 - DNA, 21 bp, Artificial sequence
  SiRNA target sequence
gatgaaccttctgcgtatcta

SEQ ID NO: 183909 - DNA, 21 bp, Artificial sequence
  SiRNA target sequence
atgaaccttctgcgtatctag

SEQ ID NO: 183910 - DNA, 21 bp, Artificial sequence
  SiRNA target sequence
tgaaccttctgcgtatctaga

SEQ ID NO: 183911 - DNA, 21 bp, Artificial sequence
  SiRNA target sequence
gaaccttctgcgtatctagat

SEQ ID NO: 183912 - DNA, 21 bp, Artificial sequence
  SiRNA target sequence
aaccttctgcgtatctagatt

SEQ ID NO: 183913 - DNA, 21 bp, Artificial sequence
  SiRNA target sequence
accttctgcgtatctagattc

SEQ ID NO: 183914 - DNA, 21 bp, Artificial sequence
  SiRNA target sequence
ccttctgcgtatctagattca

SEQ ID NO: 183915 - DNA, 21 bp, Artificial sequence
  SiRNA target sequence
cttctgcgtatctagattcag

SEQ ID NO: 183916 - DNA, 21 bp, Artificial sequence
  SiRNA target sequence
ttctgcgtatctagattcaga

SEQ ID NO: 183917 - DNA, 21 bp, Artificial sequence
  SiRNA target sequence
tctgcgtatctagattcagat

SEQ ID NO: 183918 - DNA, 21 bp, Artificial sequence
  SiRNA target sequence
ctgcgtatctagattcagatc

SEQ ID NO: 183919 - DNA, 21 bp, Artificial sequence
  SiRNA target sequence
tgcgtatctagattcagatca

SEQ ID NO: 183920 - DNA, 21 bp, Artificial sequence
  SiRNA target sequence
gcgtatctagattcagatcag

SEQ ID NO: 183921 - DNA, 21 bp, Artificial sequence
  SiRNA target sequence
cgtatctagattcagatcaga

SEQ ID NO: 183922 - DNA, 21 bp, Artificial sequence
  SiRNA target sequence
gtatctagattcagatcagag

SEQ ID NO: 183923 - DNA, 21 bp, Artificial sequence
  SiRNA target sequence
tatctagattcagatcagaga

SEQ ID NO: 183924 - DNA, 21 bp, Artificial sequence
  SiRNA target sequence
atctagattcagatcagagaa

SEQ ID NO: 183925 - DNA, 21 bp, Artificial sequence
  SiRNA target sequence
tctagattcagatcagagaat

SEQ ID NO: 183926 - DNA, 21 bp, Artificial sequence
  SiRNA target sequence
ctagattcagatcagagaata

SEQ ID NO: 183927 - DNA, 21 bp, Artificial sequence
  SiRNA target sequence
tagattcagatcagagaatag

SEQ ID NO: 183928 - DNA, 21 bp, Artificial sequence
  SiRNA target sequence
agattcagatcagagaatagc

SEQ ID NO: 183929 - DNA, 21 bp, Artificial sequence
  SiRNA target sequence
gattcagatcagagaatagcg

SEQ ID NO: 183930 - DNA, 21 bp, Artificial sequence
  SiRNA target sequence
attcagatcagagaatagcga

SEQ ID NO: 183931 - DNA, 21 bp, Artificial sequence
  SiRNA target sequence
ttcagatcagagaatagcgat

SEQ ID NO: 183932 - DNA, 21 bp, Artificial sequence
  SiRNA target sequence
tcagatcagagaatagcgatt

SEQ ID NO: 183933 - DNA, 21 bp, Artificial sequence
  SiRNA target sequence
cagatcagagaatagcgattt

SEQ ID NO: 183934 - DNA, 21 bp, Artificial sequence
  SiRNA target sequence
agatcagagaatagcgatttc

SEQ ID NO: 183935 - DNA, 21 bp, Artificial sequence
  SiRNA target sequence
gatcagagaatagcgatttca

SEQ ID NO: 183936 - DNA, 21 bp, Artificial sequence
  SiRNA target sequence
atcagagaatagcgatttcaa

SEQ ID NO: 183937 - DNA, 21 bp, Artificial sequence
  SiRNA target sequence
tcagagaatagcgatttcaaa

SEQ ID NO: 183938 - DNA, 21 bp, Artificial sequence
  SiRNA target sequence
cagagaatagcgatttcaaaa

SEQ ID NO: 183939 - DNA, 21 bp, Artificial sequence
  SiRNA target sequence
agagaatagcgatttcaaaag

SEQ ID NO: 183940 - DNA, 21 bp, Artificial sequence
  SiRNA target sequence
gagaatagcgatttcaaaagt

SEQ ID NO: 183941 - DNA, 21 bp, Artificial sequence
  SiRNA target sequence
agaatagcgatttcaaaagtt

SEQ ID NO: 183942 - DNA, 21 bp, Artificial sequence
  SiRNA target sequence
gaatagcgatttcaaaagtta

SEQ ID NO: 183943 - DNA, 21 bp, Artificial sequence
  SiRNA target sequence
aatagcgatttcaaaagttat

SEQ ID NO: 183944 - DNA, 21 bp, Artificial sequence
  SiRNA target sequence
atagcgatttcaaaagttata

SEQ ID NO: 183945 - DNA, 21 bp, Artificial sequence
  SiRNA target sequence
tagcgatttcaaaagttataa

SEQ ID NO: 183946 - DNA, 21 bp, Artificial sequence
  SiRNA target sequence
agcgatttcaaaagttataaa

SEQ ID NO: 183947 - DNA, 21 bp, Artificial sequence
  SiRNA target sequence
gcgatttcaaaagttataaaa

SEQ ID NO: 183948 - DNA, 21 bp, Artificial sequence
  SiRNA target sequence
cgatttcaaaagttataaaaa

SEQ ID NO: 183949 - DNA, 21 bp, Artificial sequence
  SiRNA target sequence
gatttcaaaagttataaaaag

SEQ ID NO: 183950 - DNA, 21 bp, Artificial sequence
  SiRNA target sequence
atttcaaaagttataaaaagg

SEQ ID NO: 183951 - DNA, 21 bp, Artificial sequence
  SiRNA target sequence
tttcaaaagttataaaaaggt

SEQ ID NO: 183952 - DNA, 21 bp, Artificial sequence
  SiRNA target sequence
ttcaaaagttataaaaaggtt

SEQ ID NO: 183953 - DNA, 21 bp, Artificial sequence
  SiRNA target sequence
tcaaaagttataaaaaggttt

SEQ ID NO: 183954 - DNA, 21 bp, Artificial sequence
  SiRNA target sequence
caaaagttataaaaaggttta

SEQ ID NO: 183955 - DNA, 21 bp, Artificial sequence
  SiRNA target sequence
aaaagttataaaaaggtttat

SEQ ID NO: 183956 - DNA, 21 bp, Artificial sequence
  SiRNA target sequence
aaagttataaaaaggtttatt

SEQ ID NO: 183957 - DNA, 21 bp, Artificial sequence
  SiRNA target sequence
aagttataaaaaggtttattt

SEQ ID NO: 183958 - DNA, 21 bp, Artificial sequence
  SiRNA target sequence
agttataaaaaggtttattta

SEQ ID NO: 183959 - DNA, 21 bp, Artificial sequence
  SiRNA target sequence
gttataaaaaggtttatttat

SEQ ID NO: 183960 - DNA, 21 bp, Artificial sequence
  SiRNA target sequence
ttataaaaaggtttatttatg

SEQ ID NO: 183961 - DNA, 21 bp, Artificial sequence
  SiRNA target sequence
tataaaaaggtttatttatgg

SEQ ID NO: 183962 - DNA, 21 bp, Artificial sequence
  SiRNA target sequence
ataaaaaggtttatttatggg

SEQ ID NO: 183963 - DNA, 21 bp, Artificial sequence
  SiRNA target sequence
taaaaaggtttatttatggga

SEQ ID NO: 183964 - DNA, 21 bp, Artificial sequence
  SiRNA target sequence
aaaaaggtttatttatgggaa

SEQ ID NO: 183965 - DNA, 21 bp, Artificial sequence
  SiRNA target sequence
aaaaggtttatttatgggaag

SEQ ID NO: 183966 - DNA, 21 bp, Artificial sequence
  SiRNA target sequence
aaaggtttatttatgggaaga

SEQ ID NO: 183967 - DNA, 21 bp, Artificial sequence
  SiRNA target sequence
aaggtttatttatgggaagaa

SEQ ID NO: 183968 - DNA, 21 bp, Artificial sequence
  SiRNA target sequence
aggtttatttatgggaagaag

SEQ ID NO: 183969 - DNA, 21 bp, Artificial sequence
  SiRNA target sequence
ggtttatttatgggaagaagc

SEQ ID NO: 183970 - DNA, 21 bp, Artificial sequence
  SiRNA target sequence
gtttatttatgggaagaagcg

SEQ ID NO: 183971 - DNA, 21 bp, Artificial sequence
  SiRNA target sequence
tttatttatgggaagaagcga

SEQ ID NO: 183972 - DNA, 21 bp, Artificial sequence
  SiRNA target sequence
ttatttatgggaagaagcgaa

SEQ ID NO: 183973 - DNA, 21 bp, Artificial sequence
  SiRNA target sequence
tatttatgggaagaagcgaac

SEQ ID NO: 183974 - DNA, 21 bp, Artificial sequence
  SiRNA target sequence
atttatgggaagaagcgaaca

SEQ ID NO: 183975 - DNA, 21 bp, Artificial sequence
  SiRNA target sequence
tttatgggaagaagcgaacag

SEQ ID NO: 183976 - DNA, 21 bp, Artificial sequence
  SiRNA target sequence
ttatgggaagaagcgaacagc

SEQ ID NO: 183977 - DNA, 21 bp, Artificial sequence
  SiRNA target sequence
tatgggaagaagcgaacagcc

SEQ ID NO: 183978 - DNA, 21 bp, Artificial sequence
  SiRNA target sequence
atgggaagaagcgaacagcct

SEQ ID NO: 183979 - DNA, 21 bp, Artificial sequence
  SiRNA target sequence
tgggaagaagcgaacagcctt

SEQ ID NO: 183980 - DNA, 21 bp, Artificial sequence
  SiRNA target sequence
gggaagaagcgaacagccttt

SEQ ID NO: 183981 - DNA, 21 bp, Artificial sequence
  SiRNA target sequence
ggaagaagcgaacagcctttg

SEQ ID NO: 183982 - DNA, 21 bp, Artificial sequence
  SiRNA target sequence
gaagaagcgaacagcctttgt

SEQ ID NO: 183983 - DNA, 21 bp, Artificial sequence
  SiRNA target sequence
aagaagcgaacagcctttgtg

SEQ ID NO: 183984 - DNA, 21 bp, Artificial sequence
  SiRNA target sequence
agaagcgaacagcctttgtgg

SEQ ID NO: 183985 - DNA, 21 bp, Artificial sequence
  SiRNA target sequence
gaagcgaacagcctttgtggt

SEQ ID NO: 183986 - DNA, 21 bp, Artificial sequence
  SiRNA target sequence
aagcgaacagcctttgtggtt

SEQ ID NO: 183987 - DNA, 21 bp, Artificial sequence
  SiRNA target sequence
agcgaacagcctttgtggttg

SEQ ID NO: 183988 - DNA, 21 bp, Artificial sequence
  SiRNA target sequence
gcgaacagcctttgtggttga

SEQ ID NO: 183989 - DNA, 21 bp, Artificial sequence
  SiRNA target sequence
cgaacagcctttgtggttgaa

SEQ ID NO: 183990 - DNA, 21 bp, Artificial sequence
  SiRNA target sequence
gaacagcctttgtggttgaac

SEQ ID NO: 183991 - DNA, 21 bp, Artificial sequence
  SiRNA target sequence
aacagcctttgtggttgaaca

SEQ ID NO: 183992 - DNA, 21 bp, Artificial sequence
  SiRNA target sequence
acagcctttgtggttgaacat

SEQ ID NO: 183993 - DNA, 21 bp, Artificial sequence
  SiRNA target sequence
cagcctttgtggttgaacatg

SEQ ID NO: 183994 - DNA, 21 bp, Artificial sequence
  SiRNA target sequence
agcctttgtggttgaacatga

SEQ ID NO: 183995 - DNA, 21 bp, Artificial sequence
  SiRNA target sequence
gcctttgtggttgaacatgat

SEQ ID NO: 183996 - DNA, 21 bp, Artificial sequence
  SiRNA target sequence
cctttgtggttgaacatgatt

SEQ ID NO: 183997 - DNA, 21 bp, Artificial sequence
  SiRNA target sequence
ctttgtggttgaacatgattt

SEQ ID NO: 183998 - DNA, 21 bp, Artificial sequence
  SiRNA target sequence
tttgtggttgaacatgattta

SEQ ID NO: 183999 - DNA, 21 bp, Artificial sequence
  SiRNA target sequence
ttgtggttgaacatgatttaa

SEQ ID NO: 184000 - DNA, 21 bp, Artificial sequence
  SiRNA target sequence
tgtggttgaacatgatttaat

SEQ ID NO: 184001 - DNA, 21 bp, Artificial sequence
  SiRNA target sequence
gtggttgaacatgatttaatt

SEQ ID NO: 184002 - DNA, 21 bp, Artificial sequence
  SiRNA target sequence
tggttgaacatgatttaattg

SEQ ID NO: 184003 - DNA, 21 bp, Artificial sequence
  SiRNA target sequence
ggttgaacatgatttaattgt

SEQ ID NO: 184004 - DNA, 21 bp, Artificial sequence
  SiRNA target sequence
gttgaacatgatttaattgta

SEQ ID NO: 184005 - DNA, 21 bp, Artificial sequence
  SiRNA target sequence
ttgaacatgatttaattgtag

SEQ ID NO: 184006 - DNA, 21 bp, Artificial sequence
  SiRNA target sequence
tgaacatgatttaattgtagg

SEQ ID NO: 184007 - DNA, 21 bp, Artificial sequence
  SiRNA target sequence
gaacatgatttaattgtaggt

SEQ ID NO: 184008 - DNA, 21 bp, Artificial sequence
  SiRNA target sequence
aacatgatttaattgtaggta

SEQ ID NO: 184009 - DNA, 21 bp, Artificial sequence
  SiRNA target sequence
acatgatttaattgtaggtac

SEQ ID NO: 184010 - DNA, 21 bp, Artificial sequence
  SiRNA target sequence
catgatttaattgtaggtaca

SEQ ID NO: 184011 - DNA, 21 bp, Artificial sequence
  SiRNA target sequence
atgatttaattgtaggtacat

SEQ ID NO: 184012 - DNA, 21 bp, Artificial sequence
  SiRNA target sequence
tgatttaattgtaggtacata

SEQ ID NO: 184013 - DNA, 21 bp, Artificial sequence
  SiRNA target sequence
gatttaattgtaggtacatat

SEQ ID NO: 184014 - DNA, 21 bp, Artificial sequence
  SiRNA target sequence
atttaattgtaggtacatatt

SEQ ID NO: 184015 - DNA, 21 bp, Artificial sequence
  SiRNA target sequence
tttaattgtaggtacatattt

SEQ ID NO: 184016 - DNA, 21 bp, Artificial sequence
  SiRNA target sequence
ttaattgtaggtacatatttg

SEQ ID NO: 184017 - DNA, 21 bp, Artificial sequence
  SiRNA target sequence
taattgtaggtacatatttgg

SEQ ID NO: 184018 - DNA, 21 bp, Artificial sequence
  SiRNA target sequence
aattgtaggtacatatttggc

SEQ ID NO: 184019 - DNA, 21 bp, Artificial sequence
  SiRNA target sequence
attgtaggtacatatttggct

SEQ ID NO: 184020 - DNA, 21 bp, Artificial sequence
  SiRNA target sequence
ttgtaggtacatatttggctg

SEQ ID NO: 184021 - DNA, 21 bp, Artificial sequence
  SiRNA target sequence
tgtaggtacatatttggctga

SEQ ID NO: 184022 - DNA, 21 bp, Artificial sequence
  SiRNA target sequence
gtaggtacatatttggctgat

SEQ ID NO: 184023 - DNA, 21 bp, Artificial sequence
  SiRNA target sequence
taggtacatatttggctgata

SEQ ID NO: 184024 - DNA, 21 bp, Artificial sequence
  SiRNA target sequence
aggtacatatttggctgataa

SEQ ID NO: 184025 - DNA, 21 bp, Artificial sequence
  SiRNA target sequence
ggtacatatttggctgataaa

SEQ ID NO: 184026 - DNA, 21 bp, Artificial sequence
  SiRNA target sequence
gtacatatttggctgataaag

SEQ ID NO: 184027 - DNA, 21 bp, Artificial sequence
  SiRNA target sequence
tacatatttggctgataaagt

SEQ ID NO: 184028 - DNA, 21 bp, Artificial sequence
  SiRNA target sequence
acatatttggctgataaagtt

SEQ ID NO: 184029 - DNA, 21 bp, Artificial sequence
  SiRNA target sequence
catatttggctgataaagttg

SEQ ID NO: 184030 - DNA, 21 bp, Artificial sequence
  SiRNA target sequence
atatttggctgataaagttgt

SEQ ID NO: 184031 - DNA, 21 bp, Artificial sequence
  SiRNA target sequence
tatttggctgataaagttgtt

SEQ ID NO: 184032 - DNA, 21 bp, Artificial sequence
  SiRNA target sequence
atttggctgataaagttgttg

SEQ ID NO: 184033 - DNA, 21 bp, Artificial sequence
  SiRNA target sequence
tttggctgataaagttgttgt

SEQ ID NO: 184034 - DNA, 21 bp, Artificial sequence
  SiRNA target sequence
ttggctgataaagttgttgtt

SEQ ID NO: 184035 - DNA, 21 bp, Artificial sequence
  SiRNA target sequence
tggctgataaagttgttgttt

SEQ ID NO: 184036 - DNA, 21 bp, Artificial sequence
  SiRNA target sequence
ggctgataaagttgttgtttt

SEQ ID NO: 184037 - DNA, 21 bp, Artificial sequence
  SiRNA target sequence
gctgataaagttgttgttttt

SEQ ID NO: 184038 - DNA, 21 bp, Artificial sequence
  SiRNA target sequence
ctgataaagttgttgtttttg

SEQ ID NO: 184039 - DNA, 21 bp, Artificial sequence
  SiRNA target sequence
tgataaagttgttgtttttga

SEQ ID NO: 184040 - DNA, 21 bp, Artificial sequence
  SiRNA target sequence
gataaagttgttgtttttgag

SEQ ID NO: 184041 - DNA, 21 bp, Artificial sequence
  SiRNA target sequence
ataaagttgttgtttttgagg

SEQ ID NO: 184042 - DNA, 21 bp, Artificial sequence
  SiRNA target sequence
taaagttgttgtttttgaggg

SEQ ID NO: 184043 - DNA, 21 bp, Artificial sequence
  SiRNA target sequence
aaagttgttgtttttgaggga

SEQ ID NO: 184044 - DNA, 21 bp, Artificial sequence
  SiRNA target sequence
aagttgttgtttttgagggaa

SEQ ID NO: 184045 - DNA, 21 bp, Artificial sequence
  SiRNA target sequence
agttgttgtttttgagggaag

SEQ ID NO: 184046 - DNA, 21 bp, Artificial sequence
  SiRNA target sequence
gttgttgtttttgagggaagc

SEQ ID NO: 184047 - DNA, 21 bp, Artificial sequence
  SiRNA target sequence
ttgttgtttttgagggaagcc

SEQ ID NO: 184048 - DNA, 21 bp, Artificial sequence
  SiRNA target sequence
tgttgtttttgagggaagccc

SEQ ID NO: 184049 - DNA, 21 bp, Artificial sequence
  SiRNA target sequence
gttgtttttgagggaagccct

SEQ ID NO: 184050 - DNA, 21 bp, Artificial sequence
  SiRNA target sequence
ttgtttttgagggaagcccta

SEQ ID NO: 184051 - DNA, 21 bp, Artificial sequence
  SiRNA target sequence
tgtttttgagggaagccctag

SEQ ID NO: 184052 - DNA, 21 bp, Artificial sequence
  SiRNA target sequence
gtttttgagggaagccctagt

SEQ ID NO: 184053 - DNA, 21 bp, Artificial sequence
  SiRNA target sequence
tttttgagggaagccctagtg

SEQ ID NO: 184054 - DNA, 21 bp, Artificial sequence
  SiRNA target sequence
ttttgagggaagccctagtgt

SEQ ID NO: 184055 - DNA, 21 bp, Artificial sequence
  SiRNA target sequence
tttgagggaagccctagtgtt

SEQ ID NO: 184056 - DNA, 21 bp, Artificial sequence
  SiRNA target sequence
ttgagggaagccctagtgttc

SEQ ID NO: 184057 - DNA, 21 bp, Artificial sequence
  SiRNA target sequence
tgagggaagccctagtgttca

SEQ ID NO: 184058 - DNA, 21 bp, Artificial sequence
  SiRNA target sequence
gagggaagccctagtgttcat

SEQ ID NO: 184059 - DNA, 21 bp, Artificial sequence
  SiRNA target sequence
agggaagccctagtgttcata

SEQ ID NO: 184060 - DNA, 21 bp, Artificial sequence
  SiRNA target sequence
gggaagccctagtgttcatag

SEQ ID NO: 184061 - DNA, 21 bp, Artificial sequence
  SiRNA target sequence
ggaagccctagtgttcatagc

SEQ ID NO: 184062 - DNA, 21 bp, Artificial sequence
  SiRNA target sequence
gaagccctagtgttcatagca

SEQ ID NO: 184063 - DNA, 21 bp, Artificial sequence
  SiRNA target sequence
aagccctagtgttcatagcac

SEQ ID NO: 184064 - DNA, 21 bp, Artificial sequence
  SiRNA target sequence
agccctagtgttcatagcact

SEQ ID NO: 184065 - DNA, 21 bp, Artificial sequence
  SiRNA target sequence
gccctagtgttcatagcactg

SEQ ID NO: 184066 - DNA, 21 bp, Artificial sequence
  SiRNA target sequence
ccctagtgttcatagcactgc

SEQ ID NO: 184067 - DNA, 21 bp, Artificial sequence
  SiRNA target sequence
cctagtgttcatagcactgct

SEQ ID NO: 184068 - DNA, 21 bp, Artificial sequence
  SiRNA target sequence
ctagtgttcatagcactgctc

SEQ ID NO: 184069 - DNA, 21 bp, Artificial sequence
  SiRNA target sequence
tagtgttcatagcactgctca

SEQ ID NO: 184070 - DNA, 21 bp, Artificial sequence
  SiRNA target sequence
agtgttcatagcactgctcat

SEQ ID NO: 184071 - DNA, 21 bp, Artificial sequence
  SiRNA target sequence
gtgttcatagcactgctcata

SEQ ID NO: 184072 - DNA, 21 bp, Artificial sequence
  SiRNA target sequence
tgttcatagcactgctcataa

SEQ ID NO: 184073 - DNA, 21 bp, Artificial sequence
  SiRNA target sequence
gttcatagcactgctcataaa

SEQ ID NO: 184074 - DNA, 21 bp, Artificial sequence
  SiRNA target sequence
ttcatagcactgctcataaac

SEQ ID NO: 184075 - DNA, 21 bp, Artificial sequence
  SiRNA target sequence
tcatagcactgctcataaacc

SEQ ID NO: 184076 - DNA, 21 bp, Artificial sequence
  SiRNA target sequence
catagcactgctcataaaccg

SEQ ID NO: 184077 - DNA, 21 bp, Artificial sequence
  SiRNA target sequence
atagcactgctcataaaccga

SEQ ID NO: 184078 - DNA, 21 bp, Artificial sequence
  SiRNA target sequence
tagcactgctcataaaccgat

SEQ ID NO: 184079 - DNA, 21 bp, Artificial sequence
  SiRNA target sequence
agcactgctcataaaccgatg

SEQ ID NO: 184080 - DNA, 21 bp, Artificial sequence
  SiRNA target sequence
gcactgctcataaaccgatgg

SEQ ID NO: 184081 - DNA, 21 bp, Artificial sequence
  SiRNA target sequence
cactgctcataaaccgatgga

SEQ ID NO: 184082 - DNA, 21 bp, Artificial sequence
  SiRNA target sequence
actgctcataaaccgatggat

SEQ ID NO: 184083 - DNA, 21 bp, Artificial sequence
  SiRNA target sequence
ctgctcataaaccgatggatt

SEQ ID NO: 184084 - DNA, 21 bp, Artificial sequence
  SiRNA target sequence
tgctcataaaccgatggattt

SEQ ID NO: 184085 - DNA, 21 bp, Artificial sequence
  SiRNA target sequence
gctcataaaccgatggatttg

SEQ ID NO: 184086 - DNA, 21 bp, Artificial sequence
  SiRNA target sequence
ctcataaaccgatggatttgc

SEQ ID NO: 184087 - DNA, 21 bp, Artificial sequence
  SiRNA target sequence
tcataaaccgatggatttgca

SEQ ID NO: 184088 - DNA, 21 bp, Artificial sequence
  SiRNA target sequence
cataaaccgatggatttgcat

SEQ ID NO: 184089 - DNA, 21 bp, Artificial sequence
  SiRNA target sequence
ataaaccgatggatttgcata

SEQ ID NO: 184090 - DNA, 21 bp, Artificial sequence
  SiRNA target sequence
taaaccgatggatttgcatag

SEQ ID NO: 184091 - DNA, 21 bp, Artificial sequence
  SiRNA target sequence
aaaccgatggatttgcatagt

SEQ ID NO: 184092 - DNA, 21 bp, Artificial sequence
  SiRNA target sequence
aaccgatggatttgcatagtg

SEQ ID NO: 184093 - DNA, 21 bp, Artificial sequence
  SiRNA target sequence
accgatggatttgcatagtgg

SEQ ID NO: 184094 - DNA, 21 bp, Artificial sequence
  SiRNA target sequence
ccgatggatttgcatagtgga

SEQ ID NO: 184095 - DNA, 21 bp, Artificial sequence
  SiRNA target sequence
cgatggatttgcatagtggaa

SEQ ID NO: 184096 - DNA, 21 bp, Artificial sequence
  SiRNA target sequence
gatggatttgcatagtggaat

SEQ ID NO: 184097 - DNA, 21 bp, Artificial sequence
  SiRNA target sequence
atggatttgcatagtggaatg

SEQ ID NO: 184098 - DNA, 21 bp, Artificial sequence
  SiRNA target sequence
tggatttgcatagtggaatga

SEQ ID NO: 184099 - DNA, 21 bp, Artificial sequence
  SiRNA target sequence
ggatttgcatagtggaatgaa

SEQ ID NO: 184100 - DNA, 21 bp, Artificial sequence
  SiRNA target sequence
gatttgcatagtggaatgaat

SEQ ID NO: 184101 - DNA, 21 bp, Artificial sequence
  SiRNA target sequence
atttgcatagtggaatgaata

SEQ ID NO: 184102 - DNA, 21 bp, Artificial sequence
  SiRNA target sequence
tttgcatagtggaatgaatat

SEQ ID NO: 184103 - DNA, 21 bp, Artificial sequence
  SiRNA target sequence
ttgcatagtggaatgaatatt

SEQ ID NO: 184104 - DNA, 21 bp, Artificial sequence
  SiRNA target sequence
tgcatagtggaatgaatattt

SEQ ID NO: 184105 - DNA, 21 bp, Artificial sequence
  SiRNA target sequence
gcatagtggaatgaatatttt

SEQ ID NO: 184106 - DNA, 21 bp, Artificial sequence
  SiRNA target sequence
catagtggaatgaatattttt

SEQ ID NO: 184107 - DNA, 21 bp, Artificial sequence
  SiRNA target sequence
atagtggaatgaatatttttt

SEQ ID NO: 184108 - DNA, 21 bp, Artificial sequence
  SiRNA target sequence
tagtggaatgaatattttttt

SEQ ID NO: 184109 - DNA, 21 bp, Artificial sequence
  SiRNA target sequence
agtggaatgaatattttttta

SEQ ID NO: 184110 - DNA, 21 bp, Artificial sequence
  SiRNA target sequence
gtggaatgaatatttttttaa

SEQ ID NO: 184111 - DNA, 21 bp, Artificial sequence
  SiRNA target sequence
tggaatgaatatttttttaaa

SEQ ID NO: 184112 - DNA, 21 bp, Artificial sequence
  SiRNA target sequence
ggaatgaatatttttttaaag

SEQ ID NO: 184113 - DNA, 21 bp, Artificial sequence
  SiRNA target sequence
gaatgaatatttttttaaaga

SEQ ID NO: 184114 - DNA, 21 bp, Artificial sequence
  SiRNA target sequence
aatgaatatttttttaaagaa

SEQ ID NO: 184115 - DNA, 21 bp, Artificial sequence
  SiRNA target sequence
atgaatatttttttaaagaat

SEQ ID NO: 184116 - DNA, 21 bp, Artificial sequence
  SiRNA target sequence
tgaatatttttttaaagaatc

SEQ ID NO: 184117 - DNA, 21 bp, Artificial sequence
  SiRNA target sequence
gaatatttttttaaagaatct

SEQ ID NO: 184118 - DNA, 21 bp, Artificial sequence
  SiRNA target sequence
aatatttttttaaagaatctt

SEQ ID NO: 184119 - DNA, 21 bp, Artificial sequence
  SiRNA target sequence
atatttttttaaagaatcttg

SEQ ID NO: 184120 - DNA, 21 bp, Artificial sequence
  SiRNA target sequence
tatttttttaaagaatcttga

SEQ ID NO: 184121 - DNA, 21 bp, Artificial sequence
  SiRNA target sequence
atttttttaaagaatcttgat

SEQ ID NO: 184122 - DNA, 21 bp, Artificial sequence
  SiRNA target sequence
tttttttaaagaatcttgata

SEQ ID NO: 184123 - DNA, 21 bp, Artificial sequence
  SiRNA target sequence
ttttttaaagaatcttgatat

SEQ ID NO: 184124 - DNA, 21 bp, Artificial sequence
  SiRNA target sequence
tttttaaagaatcttgatatt

SEQ ID NO: 184125 - DNA, 21 bp, Artificial sequence
  SiRNA target sequence
ttttaaagaatcttgatatta

SEQ ID NO: 184126 - DNA, 21 bp, Artificial sequence
  SiRNA target sequence
tttaaagaatcttgatattac

SEQ ID NO: 184127 - DNA, 21 bp, Artificial sequence
  SiRNA target sequence
ttaaagaatcttgatattact

SEQ ID NO: 184128 - DNA, 21 bp, Artificial sequence
  SiRNA target sequence
taaagaatcttgatattactt

SEQ ID NO: 184129 - DNA, 21 bp, Artificial sequence
  SiRNA target sequence
aaagaatcttgatattacttt

SEQ ID NO: 184130 - DNA, 21 bp, Artificial sequence
  SiRNA target sequence
aagaatcttgatattactttt

SEQ ID NO: 184131 - DNA, 21 bp, Artificial sequence
  SiRNA target sequence
agaatcttgatattactttta

SEQ ID NO: 184132 - DNA, 21 bp, Artificial sequence
  SiRNA target sequence
gaatcttgatattacttttag

SEQ ID NO: 184133 - DNA, 21 bp, Artificial sequence
  SiRNA target sequence
aatcttgatattacttttaga

SEQ ID NO: 184134 - DNA, 21 bp, Artificial sequence
  SiRNA target sequence
atcttgatattacttttagaa

SEQ ID NO: 184135 - DNA, 21 bp, Artificial sequence
  SiRNA target sequence
tcttgatattacttttagaag

SEQ ID NO: 184136 - DNA, 21 bp, Artificial sequence
  SiRNA target sequence
cttgatattacttttagaaga

SEQ ID NO: 184137 - DNA, 21 bp, Artificial sequence
  SiRNA target sequence
ttgatattacttttagaagag

SEQ ID NO: 184138 - DNA, 21 bp, Artificial sequence
  SiRNA target sequence
tgatattacttttagaagaga

SEQ ID NO: 184139 - DNA, 21 bp, Artificial sequence
  SiRNA target sequence
gatattacttttagaagagac

SEQ ID NO: 184140 - DNA, 21 bp, Artificial sequence
  SiRNA target sequence
atattacttttagaagagact

SEQ ID NO: 184141 - DNA, 21 bp, Artificial sequence
  SiRNA target sequence
tattacttttagaagagactc

SEQ ID NO: 184142 - DNA, 21 bp, Artificial sequence
  SiRNA target sequence
attacttttagaagagactct

SEQ ID NO: 184143 - DNA, 21 bp, Artificial sequence
  SiRNA target sequence
ttacttttagaagagactctt

SEQ ID NO: 184144 - DNA, 21 bp, Artificial sequence
  SiRNA target sequence
tacttttagaagagactcttc

SEQ ID NO: 184145 - DNA, 21 bp, Artificial sequence
  SiRNA target sequence
acttttagaagagactcttcc

SEQ ID NO: 184146 - DNA, 21 bp, Artificial sequence
  SiRNA target sequence
cttttagaagagactcttcca

SEQ ID NO: 184147 - DNA, 21 bp, Artificial sequence
  SiRNA target sequence
ttttagaagagactcttccaa

SEQ ID NO: 184148 - DNA, 21 bp, Artificial sequence
  SiRNA target sequence
tttagaagagactcttccaat

SEQ ID NO: 184149 - DNA, 21 bp, Artificial sequence
  SiRNA target sequence
ttagaagagactcttccaatt

SEQ ID NO: 184150 - DNA, 21 bp, Artificial sequence
  SiRNA target sequence
tagaagagactcttccaattt

SEQ ID NO: 184151 - DNA, 21 bp, Artificial sequence
  SiRNA target sequence
agaagagactcttccaatttt

SEQ ID NO: 184152 - DNA, 21 bp, Artificial sequence
  SiRNA target sequence
gaagagactcttccaatttta

SEQ ID NO: 184153 - DNA, 21 bp, Artificial sequence
  SiRNA target sequence
aagagactcttccaattttag

SEQ ID NO: 184154 - DNA, 21 bp, Artificial sequence
  SiRNA target sequence
agagactcttccaattttaga

SEQ ID NO: 184155 - DNA, 21 bp, Artificial sequence
  SiRNA target sequence
gagactcttccaattttagac

SEQ ID NO: 184156 - DNA, 21 bp, Artificial sequence
  SiRNA target sequence
agactcttccaattttagacc

SEQ ID NO: 184157 - DNA, 21 bp, Artificial sequence
  SiRNA target sequence
gactcttccaattttagacca

SEQ ID NO: 184158 - DNA, 21 bp, Artificial sequence
  SiRNA target sequence
actcttccaattttagaccaa

SEQ ID NO: 184159 - DNA, 21 bp, Artificial sequence
  SiRNA target sequence
ctcttccaattttagaccaag

SEQ ID NO: 184160 - DNA, 21 bp, Artificial sequence
  SiRNA target sequence
tcttccaattttagaccaaga

SEQ ID NO: 184161 - DNA, 21 bp, Artificial sequence
  SiRNA target sequence
cttccaattttagaccaagag

SEQ ID NO: 184162 - DNA, 21 bp, Artificial sequence
  SiRNA target sequence
ttccaattttagaccaagagt

SEQ ID NO: 184163 - DNA, 21 bp, Artificial sequence
  SiRNA target sequence
tccaattttagaccaagagtt

SEQ ID NO: 184164 - DNA, 21 bp, Artificial sequence
  SiRNA target sequence
ccaattttagaccaagagtta

SEQ ID NO: 184165 - DNA, 21 bp, Artificial sequence
  SiRNA target sequence
caattttagaccaagagttaa

SEQ ID NO: 184166 - DNA, 21 bp, Artificial sequence
  SiRNA target sequence
aattttagaccaagagttaat

SEQ ID NO: 184167 - DNA, 21 bp, Artificial sequence
  SiRNA target sequence
attttagaccaagagttaata

SEQ ID NO: 184168 - DNA, 21 bp, Artificial sequence
  SiRNA target sequence
ttttagaccaagagttaataa

SEQ ID NO: 184169 - DNA, 21 bp, Artificial sequence
  SiRNA target sequence
tttagaccaagagttaataag

SEQ ID NO: 184170 - DNA, 21 bp, Artificial sequence
  SiRNA target sequence
ttagaccaagagttaataagc

SEQ ID NO: 184171 - DNA, 21 bp, Artificial sequence
  SiRNA target sequence
tagaccaagagttaataagcc

SEQ ID NO: 184172 - DNA, 21 bp, Artificial sequence
  SiRNA target sequence
agaccaagagttaataagccg

SEQ ID NO: 184173 - DNA, 21 bp, Artificial sequence
  SiRNA target sequence
gaccaagagttaataagccga

SEQ ID NO: 184174 - DNA, 21 bp, Artificial sequence
  SiRNA target sequence
accaagagttaataagccgaa

SEQ ID NO: 184175 - DNA, 21 bp, Artificial sequence
  SiRNA target sequence
ccaagagttaataagccgaat

SEQ ID NO: 184176 - DNA, 21 bp, Artificial sequence
  SiRNA target sequence
caagagttaataagccgaatt

SEQ ID NO: 184177 - DNA, 21 bp, Artificial sequence
  SiRNA target sequence
aagagttaataagccgaattc

SEQ ID NO: 184178 - DNA, 21 bp, Artificial sequence
  SiRNA target sequence
agagttaataagccgaattcc

SEQ ID NO: 184179 - DNA, 21 bp, Artificial sequence
  SiRNA target sequence
gagttaataagccgaattccg

SEQ ID NO: 184180 - DNA, 21 bp, Artificial sequence
  SiRNA target sequence
agttaataagccgaattccgc

SEQ ID NO: 184181 - DNA, 21 bp, Artificial sequence
  SiRNA target sequence
gttaataagccgaattccgca

SEQ ID NO: 184182 - DNA, 21 bp, Artificial sequence
  SiRNA target sequence
ttaataagccgaattccgcaa

SEQ ID NO: 184183 - DNA, 21 bp, Artificial sequence
  SiRNA target sequence
taataagccgaattccgcaaa

SEQ ID NO: 184184 - DNA, 21 bp, Artificial sequence
  SiRNA target sequence
aataagccgaattccgcaaaa

SEQ ID NO: 184185 - DNA, 21 bp, Artificial sequence
  SiRNA target sequence
ataagccgaattccgcaaaag

SEQ ID NO: 184186 - DNA, 21 bp, Artificial sequence
  SiRNA target sequence
taagccgaattccgcaaaaga

SEQ ID NO: 184187 - DNA, 21 bp, Artificial sequence
  SiRNA target sequence
aagccgaattccgcaaaagac

SEQ ID NO: 184188 - DNA, 21 bp, Artificial sequence
  SiRNA target sequence
agccgaattccgcaaaagaca

SEQ ID NO: 184189 - DNA, 21 bp, Artificial sequence
  SiRNA target sequence
gccgaattccgcaaaagacag

SEQ ID NO: 184190 - DNA, 21 bp, Artificial sequence
  SiRNA target sequence
ccgaattccgcaaaagacaga

SEQ ID NO: 184191 - DNA, 21 bp, Artificial sequence
  SiRNA target sequence
cgaattccgcaaaagacagaa

SEQ ID NO: 184192 - DNA, 21 bp, Artificial sequence
  SiRNA target sequence
gaattccgcaaaagacagaac

SEQ ID NO: 184193 - DNA, 21 bp, Artificial sequence
  SiRNA target sequence
aattccgcaaaagacagaact

SEQ ID NO: 184194 - DNA, 21 bp, Artificial sequence
  SiRNA target sequence
attccgcaaaagacagaactc

SEQ ID NO: 184195 - DNA, 21 bp, Artificial sequence
  SiRNA target sequence
ttccgcaaaagacagaactca

SEQ ID NO: 184196 - DNA, 21 bp, Artificial sequence
  SiRNA target sequence
tccgcaaaagacagaactcag

SEQ ID NO: 184197 - DNA, 21 bp, Artificial sequence
  SiRNA target sequence
ccgcaaaagacagaactcaga

SEQ ID NO: 184198 - DNA, 21 bp, Artificial sequence
  SiRNA target sequence
cgcaaaagacagaactcagaa

SEQ ID NO: 184199 - DNA, 21 bp, Artificial sequence
  SiRNA target sequence
gcaaaagacagaactcagaaa

SEQ ID NO: 184200 - DNA, 21 bp, Artificial sequence
  SiRNA target sequence
caaaagacagaactcagaaag

SEQ ID NO: 184201 - DNA, 21 bp, Artificial sequence
  SiRNA target sequence
aaaagacagaactcagaaaga

SEQ ID NO: 184202 - DNA, 21 bp, Artificial sequence
  SiRNA target sequence
aaagacagaactcagaaagaa

SEQ ID NO: 184203 - DNA, 21 bp, Artificial sequence
  SiRNA target sequence
aagacagaactcagaaagaag

SEQ ID NO: 184204 - DNA, 21 bp, Artificial sequence
  SiRNA target sequence
agacagaactcagaaagaaga

SEQ ID NO: 184205 - DNA, 21 bp, Artificial sequence
  SiRNA target sequence
gacagaactcagaaagaagag

SEQ ID NO: 184206 - DNA, 21 bp, Artificial sequence
  SiRNA target sequence
acagaactcagaaagaagaga

SEQ ID NO: 184207 - DNA, 21 bp, Artificial sequence
  SiRNA target sequence
cagaactcagaaagaagagaa

SEQ ID NO: 184208 - DNA, 21 bp, Artificial sequence
  SiRNA target sequence
agaactcagaaagaagagaat

SEQ ID NO: 184209 - DNA, 21 bp, Artificial sequence
  SiRNA target sequence
gaactcagaaagaagagaata

SEQ ID NO: 184210 - DNA, 21 bp, Artificial sequence
  SiRNA target sequence
aactcagaaagaagagaataa

SEQ ID NO: 184211 - DNA, 21 bp, Artificial sequence
  SiRNA target sequence
actcagaaagaagagaataaa

SEQ ID NO: 184212 - DNA, 21 bp, Artificial sequence
  SiRNA target sequence
ctcagaaagaagagaataaat

SEQ ID NO: 184213 - DNA, 21 bp, Artificial sequence
  SiRNA target sequence
tcagaaagaagagaataaata

SEQ ID NO: 184214 - DNA, 21 bp, Artificial sequence
  SiRNA target sequence
cagaaagaagagaataaatat

SEQ ID NO: 184215 - DNA, 21 bp, Artificial sequence
  SiRNA target sequence
agaaagaagagaataaatatt

SEQ ID NO: 184216 - DNA, 21 bp, Artificial sequence
  SiRNA target sequence
gaaagaagagaataaatattt

SEQ ID NO: 184217 - DNA, 21 bp, Artificial sequence
  SiRNA target sequence
aaagaagagaataaatatttt

SEQ ID NO: 184218 - DNA, 21 bp, Artificial sequence
  SiRNA target sequence
aagaagagaataaatattttt

SEQ ID NO: 184219 - DNA, 21 bp, Artificial sequence
  SiRNA target sequence
agaagagaataaatatttttt

SEQ ID NO: 184220 - DNA, 21 bp, Artificial sequence
  SiRNA target sequence
gaagagaataaatattttttt

SEQ ID NO: 184221 - DNA, 21 bp, Artificial sequence
  SiRNA target sequence
aagagaataaatatttttttt

SEQ ID NO: 184222 - DNA, 21 bp, Artificial sequence
  SiRNA target sequence
agagaataaatattttttttg

SEQ ID NO: 184223 - DNA, 21 bp, Artificial sequence
  SiRNA target sequence
gagaataaatattttttttga

SEQ ID NO: 184224 - DNA, 22 bp, Artificial sequence
  SiRNA target sequence
atggccaagaatgaatctaata

SEQ ID NO: 184225 - DNA, 22 bp, Artificial sequence
  SiRNA target sequence
tggccaagaatgaatctaataa

SEQ ID NO: 184226 - DNA, 22 bp, Artificial sequence
  SiRNA target sequence
ggccaagaatgaatctaataaa

SEQ ID NO: 184227 - DNA, 22 bp, Artificial sequence
  SiRNA target sequence
gccaagaatgaatctaataaaa

SEQ ID NO: 184228 - DNA, 22 bp, Artificial sequence
  SiRNA target sequence
ccaagaatgaatctaataaaat

SEQ ID NO: 184229 - DNA, 22 bp, Artificial sequence
  SiRNA target sequence
caagaatgaatctaataaaata

SEQ ID NO: 184230 - DNA, 22 bp, Artificial sequence
  SiRNA target sequence
aagaatgaatctaataaaataa

SEQ ID NO: 184231 - DNA, 22 bp, Artificial sequence
  SiRNA target sequence
agaatgaatctaataaaataac

SEQ ID NO: 184232 - DNA, 22 bp, Artificial sequence
  SiRNA target sequence
gaatgaatctaataaaataacg

SEQ ID NO: 184233 - DNA, 22 bp, Artificial sequence
  SiRNA target sequence
aatgaatctaataaaataacga

SEQ ID NO: 184234 - DNA, 22 bp, Artificial sequence
  SiRNA target sequence
atgaatctaataaaataacgag

SEQ ID NO: 184235 - DNA, 22 bp, Artificial sequence
  SiRNA target sequence
tgaatctaataaaataacgaga

SEQ ID NO: 184236 - DNA, 22 bp, Artificial sequence
  SiRNA target sequence
gaatctaataaaataacgagac

SEQ ID NO: 184237 - DNA, 22 bp, Artificial sequence
  SiRNA target sequence
aatctaataaaataacgagact

SEQ ID NO: 184238 - DNA, 22 bp, Artificial sequence
  SiRNA target sequence
atctaataaaataacgagactg

SEQ ID NO: 184239 - DNA, 22 bp, Artificial sequence
  SiRNA target sequence
tctaataaaataacgagactgg

SEQ ID NO: 184240 - DNA, 22 bp, Artificial sequence
  SiRNA target sequence
ctaataaaataacgagactggc

SEQ ID NO: 184241 - DNA, 22 bp, Artificial sequence
  SiRNA target sequence
taataaaataacgagactggca

SEQ ID NO: 184242 - DNA, 22 bp, Artificial sequence
  SiRNA target sequence
aataaaataacgagactggcaa

SEQ ID NO: 184243 - DNA, 22 bp, Artificial sequence
  SiRNA target sequence
ataaaataacgagactggcaat

SEQ ID NO: 184244 - DNA, 22 bp, Artificial sequence
  SiRNA target sequence
taaaataacgagactggcaatt

SEQ ID NO: 184245 - DNA, 22 bp, Artificial sequence
  SiRNA target sequence
aaaataacgagactggcaattg

SEQ ID NO: 184246 - DNA, 22 bp, Artificial sequence
  SiRNA target sequence
aaataacgagactggcaattgt

SEQ ID NO: 184247 - DNA, 22 bp, Artificial sequence
  SiRNA target sequence
aataacgagactggcaattgtt

SEQ ID NO: 184248 - DNA, 22 bp, Artificial sequence
  SiRNA target sequence
ataacgagactggcaattgtta

SEQ ID NO: 184249 - DNA, 22 bp, Artificial sequence
  SiRNA target sequence
taacgagactggcaattgttaa

SEQ ID NO: 184250 - DNA, 22 bp, Artificial sequence
  SiRNA target sequence
aacgagactggcaattgttaat

SEQ ID NO: 184251 - DNA, 22 bp, Artificial sequence
  SiRNA target sequence
acgagactggcaattgttaatt

SEQ ID NO: 184252 - DNA, 22 bp, Artificial sequence
  SiRNA target sequence
cgagactggcaattgttaatta

SEQ ID NO: 184253 - DNA, 22 bp, Artificial sequence
  SiRNA target sequence
gagactggcaattgttaattat

SEQ ID NO: 184254 - DNA, 22 bp, Artificial sequence
  SiRNA target sequence
agactggcaattgttaattatg

SEQ ID NO: 184255 - DNA, 22 bp, Artificial sequence
  SiRNA target sequence
gactggcaattgttaattatga

SEQ ID NO: 184256 - DNA, 22 bp, Artificial sequence
  SiRNA target sequence
actggcaattgttaattatgaa

SEQ ID NO: 184257 - DNA, 22 bp, Artificial sequence
  SiRNA target sequence
ctggcaattgttaattatgaac

SEQ ID NO: 184258 - DNA, 22 bp, Artificial sequence
  SiRNA target sequence
tggcaattgttaattatgaact

SEQ ID NO: 184259 - DNA, 22 bp, Artificial sequence
  SiRNA target sequence
ggcaattgttaattatgaacta

SEQ ID NO: 184260 - DNA, 22 bp, Artificial sequence
  SiRNA target sequence
gcaattgttaattatgaactat

SEQ ID NO: 184261 - DNA, 22 bp, Artificial sequence
  SiRNA target sequence
caattgttaattatgaactatg

SEQ ID NO: 184262 - DNA, 22 bp, Artificial sequence
  SiRNA target sequence
aattgttaattatgaactatgt

SEQ ID NO: 184263 - DNA, 22 bp, Artificial sequence
  SiRNA target sequence
attgttaattatgaactatgta

SEQ ID NO: 184264 - DNA, 22 bp, Artificial sequence
  SiRNA target sequence
ttgttaattatgaactatgtaa

SEQ ID NO: 184265 - DNA, 22 bp, Artificial sequence
  SiRNA target sequence
tgttaattatgaactatgtaaa

SEQ ID NO: 184266 - DNA, 22 bp, Artificial sequence
  SiRNA target sequence
gttaattatgaactatgtaaac

SEQ ID NO: 184267 - DNA, 22 bp, Artificial sequence
  SiRNA target sequence
ttaattatgaactatgtaaacc

SEQ ID NO: 184268 - DNA, 22 bp, Artificial sequence
  SiRNA target sequence
taattatgaactatgtaaaccg

SEQ ID NO: 184269 - DNA, 22 bp, Artificial sequence
  SiRNA target sequence
aattatgaactatgtaaaccga

SEQ ID NO: 184270 - DNA, 22 bp, Artificial sequence
  SiRNA target sequence
attatgaactatgtaaaccgaa

SEQ ID NO: 184271 - DNA, 22 bp, Artificial sequence
  SiRNA target sequence
ttatgaactatgtaaaccgaag

SEQ ID NO: 184272 - DNA, 22 bp, Artificial sequence
  SiRNA target sequence
tatgaactatgtaaaccgaagg

SEQ ID NO: 184273 - DNA, 22 bp, Artificial sequence
  SiRNA target sequence
atgaactatgtaaaccgaagga

SEQ ID NO: 184274 - DNA, 22 bp, Artificial sequence
  SiRNA target sequence
tgaactatgtaaaccgaaggaa

SEQ ID NO: 184275 - DNA, 22 bp, Artificial sequence
  SiRNA target sequence
gaactatgtaaaccgaaggaat

SEQ ID NO: 184276 - DNA, 22 bp, Artificial sequence
  SiRNA target sequence
aactatgtaaaccgaaggaatg

SEQ ID NO: 184277 - DNA, 22 bp, Artificial sequence
  SiRNA target sequence
actatgtaaaccgaaggaatgt

SEQ ID NO: 184278 - DNA, 22 bp, Artificial sequence
  SiRNA target sequence
ctatgtaaaccgaaggaatgta

SEQ ID NO: 184279 - DNA, 22 bp, Artificial sequence
  SiRNA target sequence
tatgtaaaccgaaggaatgtat

SEQ ID NO: 184280 - DNA, 22 bp, Artificial sequence
  SiRNA target sequence
atgtaaaccgaaggaatgtatg

SEQ ID NO: 184281 - DNA, 22 bp, Artificial sequence
  SiRNA target sequence
tgtaaaccgaaggaatgtatgt

SEQ ID NO: 184282 - DNA, 22 bp, Artificial sequence
  SiRNA target sequence
gtaaaccgaaggaatgtatgtc

SEQ ID NO: 184283 - DNA, 22 bp, Artificial sequence
  SiRNA target sequence
taaaccgaaggaatgtatgtca

SEQ ID NO: 184284 - DNA, 22 bp, Artificial sequence
  SiRNA target sequence
aaaccgaaggaatgtatgtcag

SEQ ID NO: 184285 - DNA, 22 bp, Artificial sequence
  SiRNA target sequence
aaccgaaggaatgtatgtcaga

SEQ ID NO: 184286 - DNA, 22 bp, Artificial sequence
  SiRNA target sequence
accgaaggaatgtatgtcagaa

SEQ ID NO: 184287 - DNA, 22 bp, Artificial sequence
  SiRNA target sequence
ccgaaggaatgtatgtcagaat

SEQ ID NO: 184288 - DNA, 22 bp, Artificial sequence
  SiRNA target sequence
cgaaggaatgtatgtcagaatg

SEQ ID NO: 184289 - DNA, 22 bp, Artificial sequence
  SiRNA target sequence
gaaggaatgtatgtcagaatgt

SEQ ID NO: 184290 - DNA, 22 bp, Artificial sequence
  SiRNA target sequence
aaggaatgtatgtcagaatgta

SEQ ID NO: 184291 - DNA, 22 bp, Artificial sequence
  SiRNA target sequence
aggaatgtatgtcagaatgtaa

SEQ ID NO: 184292 - DNA, 22 bp, Artificial sequence
  SiRNA target sequence
ggaatgtatgtcagaatgtaaa

SEQ ID NO: 184293 - DNA, 22 bp, Artificial sequence
  SiRNA target sequence
gaatgtatgtcagaatgtaaaa

SEQ ID NO: 184294 - DNA, 22 bp, Artificial sequence
  SiRNA target sequence
aatgtatgtcagaatgtaaaaa

SEQ ID NO: 184295 - DNA, 22 bp, Artificial sequence
  SiRNA target sequence
atgtatgtcagaatgtaaaaag

SEQ ID NO: 184296 - DNA, 22 bp, Artificial sequence
  SiRNA target sequence
tgtatgtcagaatgtaaaaagg

SEQ ID NO: 184297 - DNA, 22 bp, Artificial sequence
  SiRNA target sequence
gtatgtcagaatgtaaaaaggc

SEQ ID NO: 184298 - DNA, 22 bp, Artificial sequence
  SiRNA target sequence
tatgtcagaatgtaaaaaggcg

SEQ ID NO: 184299 - DNA, 22 bp, Artificial sequence
  SiRNA target sequence
atgtcagaatgtaaaaaggcgt

SEQ ID NO: 184300 - DNA, 22 bp, Artificial sequence
  SiRNA target sequence
tgtcagaatgtaaaaaggcgtg

SEQ ID NO: 184301 - DNA, 22 bp, Artificial sequence
  SiRNA target sequence
gtcagaatgtaaaaaggcgtgt

SEQ ID NO: 184302 - DNA, 22 bp, Artificial sequence
  SiRNA target sequence
tcagaatgtaaaaaggcgtgtc

SEQ ID NO: 184303 - DNA, 22 bp, Artificial sequence
  SiRNA target sequence
cagaatgtaaaaaggcgtgtcc

SEQ ID NO: 184304 - DNA, 22 bp, Artificial sequence
  SiRNA target sequence
agaatgtaaaaaggcgtgtcct

SEQ ID NO: 184305 - DNA, 22 bp, Artificial sequence
  SiRNA target sequence
gaatgtaaaaaggcgtgtcctg

SEQ ID NO: 184306 - DNA, 22 bp, Artificial sequence
  SiRNA target sequence
aatgtaaaaaggcgtgtcctgt

SEQ ID NO: 184307 - DNA, 22 bp, Artificial sequence
  SiRNA target sequence
atgtaaaaaggcgtgtcctgtt

SEQ ID NO: 184308 - DNA, 22 bp, Artificial sequence
  SiRNA target sequence
tgtaaaaaggcgtgtcctgtta

SEQ ID NO: 184309 - DNA, 22 bp, Artificial sequence
  SiRNA target sequence
gtaaaaaggcgtgtcctgttaa

SEQ ID NO: 184310 - DNA, 22 bp, Artificial sequence
  SiRNA target sequence
taaaaaggcgtgtcctgttaat

SEQ ID NO: 184311 - DNA, 22 bp, Artificial sequence
  SiRNA target sequence
aaaaaggcgtgtcctgttaata

SEQ ID NO: 184312 - DNA, 22 bp, Artificial sequence
  SiRNA target sequence
aaaaggcgtgtcctgttaataa

SEQ ID NO: 184313 - DNA, 22 bp, Artificial sequence
  SiRNA target sequence
aaaggcgtgtcctgttaataaa

SEQ ID NO: 184314 - DNA, 22 bp, Artificial sequence
  SiRNA target sequence
aaggcgtgtcctgttaataaaa

SEQ ID NO: 184315 - DNA, 22 bp, Artificial sequence
  SiRNA target sequence
aggcgtgtcctgttaataaaac

SEQ ID NO: 184316 - DNA, 22 bp, Artificial sequence
  SiRNA target sequence
ggcgtgtcctgttaataaaaca

SEQ ID NO: 184317 - DNA, 22 bp, Artificial sequence
  SiRNA target sequence
gcgtgtcctgttaataaaacag

SEQ ID NO: 184318 - DNA, 22 bp, Artificial sequence
  SiRNA target sequence
cgtgtcctgttaataaaacagg

SEQ ID NO: 184319 - DNA, 22 bp, Artificial sequence
  SiRNA target sequence
gtgtcctgttaataaaacagga

SEQ ID NO: 184320 - DNA, 22 bp, Artificial sequence
  SiRNA target sequence
tgtcctgttaataaaacaggaa

SEQ ID NO: 184321 - DNA, 22 bp, Artificial sequence
  SiRNA target sequence
gtcctgttaataaaacaggaaa

SEQ ID NO: 184322 - DNA, 22 bp, Artificial sequence
  SiRNA target sequence
tcctgttaataaaacaggaaag

SEQ ID NO: 184323 - DNA, 22 bp, Artificial sequence
  SiRNA target sequence
cctgttaataaaacaggaaagg

SEQ ID NO: 184324 - DNA, 22 bp, Artificial sequence
  SiRNA target sequence
ctgttaataaaacaggaaagga

SEQ ID NO: 184325 - DNA, 22 bp, Artificial sequence
  SiRNA target sequence
tgttaataaaacaggaaaggag

SEQ ID NO: 184326 - DNA, 22 bp, Artificial sequence
  SiRNA target sequence
gttaataaaacaggaaaggagt

SEQ ID NO: 184327 - DNA, 22 bp, Artificial sequence
  SiRNA target sequence
ttaataaaacaggaaaggagtg

SEQ ID NO: 184328 - DNA, 22 bp, Artificial sequence
  SiRNA target sequence
taataaaacaggaaaggagtgt

SEQ ID NO: 184329 - DNA, 22 bp, Artificial sequence
  SiRNA target sequence
aataaaacaggaaaggagtgta

SEQ ID NO: 184330 - DNA, 22 bp, Artificial sequence
  SiRNA target sequence
ataaaacaggaaaggagtgtat

SEQ ID NO: 184331 - DNA, 22 bp, Artificial sequence
  SiRNA target sequence
taaaacaggaaaggagtgtatt

SEQ ID NO: 184332 - DNA, 22 bp, Artificial sequence
  SiRNA target sequence
aaaacaggaaaggagtgtatta

SEQ ID NO: 184333 - DNA, 22 bp, Artificial sequence
  SiRNA target sequence
aaacaggaaaggagtgtattac

SEQ ID NO: 184334 - DNA, 22 bp, Artificial sequence
  SiRNA target sequence
aacaggaaaggagtgtattaca

SEQ ID NO: 184335 - DNA, 22 bp, Artificial sequence
  SiRNA target sequence
acaggaaaggagtgtattacaa

SEQ ID NO: 184336 - DNA, 22 bp, Artificial sequence
  SiRNA target sequence
caggaaaggagtgtattacaat

SEQ ID NO: 184337 - DNA, 22 bp, Artificial sequence
  SiRNA target sequence
aggaaaggagtgtattacaatt

SEQ ID NO: 184338 - DNA, 22 bp, Artificial sequence
  SiRNA target sequence
ggaaaggagtgtattacaattg

SEQ ID NO: 184339 - DNA, 22 bp, Artificial sequence
  SiRNA target sequence
gaaaggagtgtattacaattga

SEQ ID NO: 184340 - DNA, 22 bp, Artificial sequence
  SiRNA target sequence
aaaggagtgtattacaattgat

SEQ ID NO: 184341 - DNA, 22 bp, Artificial sequence
  SiRNA target sequence
aaggagtgtattacaattgata

SEQ ID NO: 184342 - DNA, 22 bp, Artificial sequence
  SiRNA target sequence
aggagtgtattacaattgatac

SEQ ID NO: 184343 - DNA, 22 bp, Artificial sequence
  SiRNA target sequence
ggagtgtattacaattgatact

SEQ ID NO: 184344 - DNA, 22 bp, Artificial sequence
  SiRNA target sequence
gagtgtattacaattgatacta

SEQ ID NO: 184345 - DNA, 22 bp, Artificial sequence
  SiRNA target sequence
agtgtattacaattgatactaa

SEQ ID NO: 184346 - DNA, 22 bp, Artificial sequence
  SiRNA target sequence
gtgtattacaattgatactaaa

SEQ ID NO: 184347 - DNA, 22 bp, Artificial sequence
  SiRNA target sequence
tgtattacaattgatactaaat

SEQ ID NO: 184348 - DNA, 22 bp, Artificial sequence
  SiRNA target sequence
gtattacaattgatactaaatc

SEQ ID NO: 184349 - DNA, 22 bp, Artificial sequence
  SiRNA target sequence
tattacaattgatactaaatca

SEQ ID NO: 184350 - DNA, 22 bp, Artificial sequence
  SiRNA target sequence
attacaattgatactaaatcac

SEQ ID NO: 184351 - DNA, 22 bp, Artificial sequence
  SiRNA target sequence
ttacaattgatactaaatcaca

SEQ ID NO: 184352 - DNA, 22 bp, Artificial sequence
  SiRNA target sequence
tacaattgatactaaatcacat

SEQ ID NO: 184353 - DNA, 22 bp, Artificial sequence
  SiRNA target sequence
acaattgatactaaatcacata

SEQ ID NO: 184354 - DNA, 22 bp, Artificial sequence
  SiRNA target sequence
caattgatactaaatcacatat

SEQ ID NO: 184355 - DNA, 22 bp, Artificial sequence
  SiRNA target sequence
aattgatactaaatcacatatc

SEQ ID NO: 184356 - DNA, 22 bp, Artificial sequence
  SiRNA target sequence
attgatactaaatcacatatct

SEQ ID NO: 184357 - DNA, 22 bp, Artificial sequence
  SiRNA target sequence
ttgatactaaatcacatatctc

SEQ ID NO: 184358 - DNA, 22 bp, Artificial sequence
  SiRNA target sequence
tgatactaaatcacatatctca

SEQ ID NO: 184359 - DNA, 22 bp, Artificial sequence
  SiRNA target sequence
gatactaaatcacatatctcag

SEQ ID NO: 184360 - DNA, 22 bp, Artificial sequence
  SiRNA target sequence
atactaaatcacatatctcaga

SEQ ID NO: 184361 - DNA, 22 bp, Artificial sequence
  SiRNA target sequence
tactaaatcacatatctcagaa

SEQ ID NO: 184362 - DNA, 22 bp, Artificial sequence
  SiRNA target sequence
actaaatcacatatctcagaaa

SEQ ID NO: 184363 - DNA, 22 bp, Artificial sequence
  SiRNA target sequence
ctaaatcacatatctcagaaat

SEQ ID NO: 184364 - DNA, 22 bp, Artificial sequence
  SiRNA target sequence
taaatcacatatctcagaaatt

SEQ ID NO: 184365 - DNA, 22 bp, Artificial sequence
  SiRNA target sequence
aaatcacatatctcagaaattc

SEQ ID NO: 184366 - DNA, 22 bp, Artificial sequence
  SiRNA target sequence
aatcacatatctcagaaattct

SEQ ID NO: 184367 - DNA, 22 bp, Artificial sequence
  SiRNA target sequence
atcacatatctcagaaattctg

SEQ ID NO: 184368 - DNA, 22 bp, Artificial sequence
  SiRNA target sequence
tcacatatctcagaaattctgt

SEQ ID NO: 184369 - DNA, 22 bp, Artificial sequence
  SiRNA target sequence
cacatatctcagaaattctgtg

SEQ ID NO: 184370 - DNA, 22 bp, Artificial sequence
  SiRNA target sequence
acatatctcagaaattctgtgt

SEQ ID NO: 184371 - DNA, 22 bp, Artificial sequence
  SiRNA target sequence
catatctcagaaattctgtgta

SEQ ID NO: 184372 - DNA, 22 bp, Artificial sequence
  SiRNA target sequence
atatctcagaaattctgtgtat

SEQ ID NO: 184373 - DNA, 22 bp, Artificial sequence
  SiRNA target sequence
tatctcagaaattctgtgtata

SEQ ID NO: 184374 - DNA, 22 bp, Artificial sequence
  SiRNA target sequence
atctcagaaattctgtgtatag

SEQ ID NO: 184375 - DNA, 22 bp, Artificial sequence
  SiRNA target sequence
tctcagaaattctgtgtatagg

SEQ ID NO: 184376 - DNA, 22 bp, Artificial sequence
  SiRNA target sequence
ctcagaaattctgtgtatagga

SEQ ID NO: 184377 - DNA, 22 bp, Artificial sequence
  SiRNA target sequence
tcagaaattctgtgtataggat

SEQ ID NO: 184378 - DNA, 22 bp, Artificial sequence
  SiRNA target sequence
cagaaattctgtgtataggatg

SEQ ID NO: 184379 - DNA, 22 bp, Artificial sequence
  SiRNA target sequence
agaaattctgtgtataggatgt

SEQ ID NO: 184380 - DNA, 22 bp, Artificial sequence
  SiRNA target sequence
gaaattctgtgtataggatgtt

SEQ ID NO: 184381 - DNA, 22 bp, Artificial sequence
  SiRNA target sequence
aaattctgtgtataggatgttc

SEQ ID NO: 184382 - DNA, 22 bp, Artificial sequence
  SiRNA target sequence
aattctgtgtataggatgttct

SEQ ID NO: 184383 - DNA, 22 bp, Artificial sequence
  SiRNA target sequence
attctgtgtataggatgttctg

SEQ ID NO: 184384 - DNA, 22 bp, Artificial sequence
  SiRNA target sequence
ttctgtgtataggatgttctgc

SEQ ID NO: 184385 - DNA, 22 bp, Artificial sequence
  SiRNA target sequence
tctgtgtataggatgttctgcg

SEQ ID NO: 184386 - DNA, 22 bp, Artificial sequence
  SiRNA target sequence
ctgtgtataggatgttctgcgt

SEQ ID NO: 184387 - DNA, 22 bp, Artificial sequence
  SiRNA target sequence
tgtgtataggatgttctgcgtg

SEQ ID NO: 184388 - DNA, 22 bp, Artificial sequence
  SiRNA target sequence
gtgtataggatgttctgcgtgt

SEQ ID NO: 184389 - DNA, 22 bp, Artificial sequence
  SiRNA target sequence
tgtataggatgttctgcgtgtc

SEQ ID NO: 184390 - DNA, 22 bp, Artificial sequence
  SiRNA target sequence
gtataggatgttctgcgtgtca

SEQ ID NO: 184391 - DNA, 22 bp, Artificial sequence
  SiRNA target sequence
tataggatgttctgcgtgtcaa

SEQ ID NO: 184392 - DNA, 22 bp, Artificial sequence
  SiRNA target sequence
ataggatgttctgcgtgtcaaa

SEQ ID NO: 184393 - DNA, 22 bp, Artificial sequence
  SiRNA target sequence
taggatgttctgcgtgtcaaaa

SEQ ID NO: 184394 - DNA, 22 bp, Artificial sequence
  SiRNA target sequence
aggatgttctgcgtgtcaaaag

SEQ ID NO: 184395 - DNA, 22 bp, Artificial sequence
  SiRNA target sequence
ggatgttctgcgtgtcaaaaga

SEQ ID NO: 184396 - DNA, 22 bp, Artificial sequence
  SiRNA target sequence
gatgttctgcgtgtcaaaagaa

SEQ ID NO: 184397 - DNA, 22 bp, Artificial sequence
  SiRNA target sequence
atgttctgcgtgtcaaaagaaa

SEQ ID NO: 184398 - DNA, 22 bp, Artificial sequence
  SiRNA target sequence
tgttctgcgtgtcaaaagaaat

SEQ ID NO: 184399 - DNA, 22 bp, Artificial sequence
  SiRNA target sequence
gttctgcgtgtcaaaagaaatg

SEQ ID NO: 184400 - DNA, 22 bp, Artificial sequence
  SiRNA target sequence
ttctgcgtgtcaaaagaaatgt

SEQ ID NO: 184401 - DNA, 22 bp, Artificial sequence
  SiRNA target sequence
tctgcgtgtcaaaagaaatgtc

SEQ ID NO: 184402 - DNA, 22 bp, Artificial sequence
  SiRNA target sequence
ctgcgtgtcaaaagaaatgtcc

SEQ ID NO: 184403 - DNA, 22 bp, Artificial sequence
  SiRNA target sequence
tgcgtgtcaaaagaaatgtcct

SEQ ID NO: 184404 - DNA, 22 bp, Artificial sequence
  SiRNA target sequence
gcgtgtcaaaagaaatgtcctt

SEQ ID NO: 184405 - DNA, 22 bp, Artificial sequence
  SiRNA target sequence
cgtgtcaaaagaaatgtccttt

SEQ ID NO: 184406 - DNA, 22 bp, Artificial sequence
  SiRNA target sequence
gtgtcaaaagaaatgtcctttt

SEQ ID NO: 184407 - DNA, 22 bp, Artificial sequence
  SiRNA target sequence
tgtcaaaagaaatgtcctttta

SEQ ID NO: 184408 - DNA, 22 bp, Artificial sequence
  SiRNA target sequence
gtcaaaagaaatgtccttttaa

SEQ ID NO: 184409 - DNA, 22 bp, Artificial sequence
  SiRNA target sequence
tcaaaagaaatgtccttttaag

SEQ ID NO: 184410 - DNA, 22 bp, Artificial sequence
  SiRNA target sequence
caaaagaaatgtccttttaagg

SEQ ID NO: 184411 - DNA, 22 bp, Artificial sequence
  SiRNA target sequence
aaaagaaatgtccttttaaggc

SEQ ID NO: 184412 - DNA, 22 bp, Artificial sequence
  SiRNA target sequence
aaagaaatgtccttttaaggcg

SEQ ID NO: 184413 - DNA, 22 bp, Artificial sequence
  SiRNA target sequence
aagaaatgtccttttaaggcga

SEQ ID NO: 184414 - DNA, 22 bp, Artificial sequence
  SiRNA target sequence
agaaatgtccttttaaggcgat

SEQ ID NO: 184415 - DNA, 22 bp, Artificial sequence
  SiRNA target sequence
gaaatgtccttttaaggcgatt

SEQ ID NO: 184416 - DNA, 22 bp, Artificial sequence
  SiRNA target sequence
aaatgtccttttaaggcgatta

SEQ ID NO: 184417 - DNA, 22 bp, Artificial sequence
  SiRNA target sequence
aatgtccttttaaggcgattac

SEQ ID NO: 184418 - DNA, 22 bp, Artificial sequence
  SiRNA target sequence
atgtccttttaaggcgattaca

SEQ ID NO: 184419 - DNA, 22 bp, Artificial sequence
  SiRNA target sequence
tgtccttttaaggcgattacaa

SEQ ID NO: 184420 - DNA, 22 bp, Artificial sequence
  SiRNA target sequence
gtccttttaaggcgattacaat

SEQ ID NO: 184421 - DNA, 22 bp, Artificial sequence
  SiRNA target sequence
tccttttaaggcgattacaatt

SEQ ID NO: 184422 - DNA, 22 bp, Artificial sequence
  SiRNA target sequence
ccttttaaggcgattacaattg

SEQ ID NO: 184423 - DNA, 22 bp, Artificial sequence
  SiRNA target sequence
cttttaaggcgattacaattgt

SEQ ID NO: 184424 - DNA, 22 bp, Artificial sequence
  SiRNA target sequence
ttttaaggcgattacaattgta

SEQ ID NO: 184425 - DNA, 22 bp, Artificial sequence
  SiRNA target sequence
tttaaggcgattacaattgtaa

SEQ ID NO: 184426 - DNA, 22 bp, Artificial sequence
  SiRNA target sequence
ttaaggcgattacaattgtaaa

SEQ ID NO: 184427 - DNA, 22 bp, Artificial sequence
  SiRNA target sequence
taaggcgattacaattgtaaat

SEQ ID NO: 184428 - DNA, 22 bp, Artificial sequence
  SiRNA target sequence
aaggcgattacaattgtaaatt

SEQ ID NO: 184429 - DNA, 22 bp, Artificial sequence
  SiRNA target sequence
aggcgattacaattgtaaattt

SEQ ID NO: 184430 - DNA, 22 bp, Artificial sequence
  SiRNA target sequence
ggcgattacaattgtaaattta

SEQ ID NO: 184431 - DNA, 22 bp, Artificial sequence
  SiRNA target sequence
gcgattacaattgtaaatttac

SEQ ID NO: 184432 - DNA, 22 bp, Artificial sequence
  SiRNA target sequence
cgattacaattgtaaatttacc

SEQ ID NO: 184433 - DNA, 22 bp, Artificial sequence
  SiRNA target sequence
gattacaattgtaaatttacct

SEQ ID NO: 184434 - DNA, 22 bp, Artificial sequence
  SiRNA target sequence
attacaattgtaaatttaccta

SEQ ID NO: 184435 - DNA, 22 bp, Artificial sequence
  SiRNA target sequence
ttacaattgtaaatttacctac

SEQ ID NO: 184436 - DNA, 22 bp, Artificial sequence
  SiRNA target sequence
tacaattgtaaatttacctaca

SEQ ID NO: 184437 - DNA, 22 bp, Artificial sequence
  SiRNA target sequence
acaattgtaaatttacctacaa

SEQ ID NO: 184438 - DNA, 22 bp, Artificial sequence
  SiRNA target sequence
caattgtaaatttacctacaaa

SEQ ID NO: 184439 - DNA, 22 bp, Artificial sequence
  SiRNA target sequence
aattgtaaatttacctacaaat

SEQ ID NO: 184440 - DNA, 22 bp, Artificial sequence
  SiRNA target sequence
attgtaaatttacctacaaatc

SEQ ID NO: 184441 - DNA, 22 bp, Artificial sequence
  SiRNA target sequence
ttgtaaatttacctacaaatct

SEQ ID NO: 184442 - DNA, 22 bp, Artificial sequence
  SiRNA target sequence
tgtaaatttacctacaaatcta

SEQ ID NO: 184443 - DNA, 22 bp, Artificial sequence
  SiRNA target sequence
gtaaatttacctacaaatctag

SEQ ID NO: 184444 - DNA, 22 bp, Artificial sequence
  SiRNA target sequence
taaatttacctacaaatctaga

SEQ ID NO: 184445 - DNA, 22 bp, Artificial sequence
  SiRNA target sequence
aaatttacctacaaatctagat

SEQ ID NO: 184446 - DNA, 22 bp, Artificial sequence
  SiRNA target sequence
aatttacctacaaatctagata

SEQ ID NO: 184447 - DNA, 22 bp, Artificial sequence
  SiRNA target sequence
atttacctacaaatctagataa

SEQ ID NO: 184448 - DNA, 22 bp, Artificial sequence
  SiRNA target sequence
tttacctacaaatctagataaa

SEQ ID NO: 184449 - DNA, 22 bp, Artificial sequence
  SiRNA target sequence
ttacctacaaatctagataaag

SEQ ID NO: 184450 - DNA, 22 bp, Artificial sequence
  SiRNA target sequence
tacctacaaatctagataaaga

SEQ ID NO: 184451 - DNA, 22 bp, Artificial sequence
  SiRNA target sequence
acctacaaatctagataaagac

SEQ ID NO: 184452 - DNA, 22 bp, Artificial sequence
  SiRNA target sequence
cctacaaatctagataaagaca

SEQ ID NO: 184453 - DNA, 22 bp, Artificial sequence
  SiRNA target sequence
ctacaaatctagataaagacat

SEQ ID NO: 184454 - DNA, 22 bp, Artificial sequence
  SiRNA target sequence
tacaaatctagataaagacatt

SEQ ID NO: 184455 - DNA, 22 bp, Artificial sequence
  SiRNA target sequence
acaaatctagataaagacattt

SEQ ID NO: 184456 - DNA, 22 bp, Artificial sequence
  SiRNA target sequence
caaatctagataaagacatttc

SEQ ID NO: 184457 - DNA, 22 bp, Artificial sequence
  SiRNA target sequence
aaatctagataaagacatttca

SEQ ID NO: 184458 - DNA, 22 bp, Artificial sequence
  SiRNA target sequence
aatctagataaagacatttcac

SEQ ID NO: 184459 - DNA, 22 bp, Artificial sequence
  SiRNA target sequence
atctagataaagacatttcaca

SEQ ID NO: 184460 - DNA, 22 bp, Artificial sequence
  SiRNA target sequence
tctagataaagacatttcacat

SEQ ID NO: 184461 - DNA, 22 bp, Artificial sequence
  SiRNA target sequence
ctagataaagacatttcacata

SEQ ID NO: 184462 - DNA, 22 bp, Artificial sequence
  SiRNA target sequence
tagataaagacatttcacatag

SEQ ID NO: 184463 - DNA, 22 bp, Artificial sequence
  SiRNA target sequence
agataaagacatttcacataga

SEQ ID NO: 184464 - DNA, 22 bp, Artificial sequence
  SiRNA target sequence
gataaagacatttcacatagat

SEQ ID NO: 184465 - DNA, 22 bp, Artificial sequence
  SiRNA target sequence
ataaagacatttcacatagata

SEQ ID NO: 184466 - DNA, 22 bp, Artificial sequence
  SiRNA target sequence
taaagacatttcacatagatat

SEQ ID NO: 184467 - DNA, 22 bp, Artificial sequence
  SiRNA target sequence
aaagacatttcacatagatatt

SEQ ID NO: 184468 - DNA, 22 bp, Artificial sequence
  SiRNA target sequence
aagacatttcacatagatattc

SEQ ID NO: 184469 - DNA, 22 bp, Artificial sequence
  SiRNA target sequence
agacatttcacatagatattcg

SEQ ID NO: 184470 - DNA, 22 bp, Artificial sequence
  SiRNA target sequence
gacatttcacatagatattcgg

SEQ ID NO: 184471 - DNA, 22 bp, Artificial sequence
  SiRNA target sequence
acatttcacatagatattcggc

SEQ ID NO: 184472 - DNA, 22 bp, Artificial sequence
  SiRNA target sequence
catttcacatagatattcggca

SEQ ID NO: 184473 - DNA, 22 bp, Artificial sequence
  SiRNA target sequence
atttcacatagatattcggcaa

SEQ ID NO: 184474 - DNA, 22 bp, Artificial sequence
  SiRNA target sequence
tttcacatagatattcggcaaa

SEQ ID NO: 184475 - DNA, 22 bp, Artificial sequence
  SiRNA target sequence
ttcacatagatattcggcaaat

SEQ ID NO: 184476 - DNA, 22 bp, Artificial sequence
  SiRNA target sequence
tcacatagatattcggcaaatg

SEQ ID NO: 184477 - DNA, 22 bp, Artificial sequence
  SiRNA target sequence
cacatagatattcggcaaatgg

SEQ ID NO: 184478 - DNA, 22 bp, Artificial sequence
  SiRNA target sequence
acatagatattcggcaaatggt

SEQ ID NO: 184479 - DNA, 22 bp, Artificial sequence
  SiRNA target sequence
catagatattcggcaaatggtt

SEQ ID NO: 184480 - DNA, 22 bp, Artificial sequence
  SiRNA target sequence
atagatattcggcaaatggttt

SEQ ID NO: 184481 - DNA, 22 bp, Artificial sequence
  SiRNA target sequence
tagatattcggcaaatggtttt

SEQ ID NO: 184482 - DNA, 22 bp, Artificial sequence
  SiRNA target sequence
agatattcggcaaatggtttta

SEQ ID NO: 184483 - DNA, 22 bp, Artificial sequence
  SiRNA target sequence
gatattcggcaaatggttttaa

SEQ ID NO: 184484 - DNA, 22 bp, Artificial sequence
  SiRNA target sequence
atattcggcaaatggttttaaa

SEQ ID NO: 184485 - DNA, 22 bp, Artificial sequence
  SiRNA target sequence
tattcggcaaatggttttaaac

SEQ ID NO: 184486 - DNA, 22 bp, Artificial sequence
  SiRNA target sequence
attcggcaaatggttttaaact

SEQ ID NO: 184487 - DNA, 22 bp, Artificial sequence
  SiRNA target sequence
ttcggcaaatggttttaaactt

SEQ ID NO: 184488 - DNA, 22 bp, Artificial sequence
  SiRNA target sequence
tcggcaaatggttttaaacttc

SEQ ID NO: 184489 - DNA, 22 bp, Artificial sequence
  SiRNA target sequence
cggcaaatggttttaaacttca

SEQ ID NO: 184490 - DNA, 22 bp, Artificial sequence
  SiRNA target sequence
ggcaaatggttttaaacttcac

SEQ ID NO: 184491 - DNA, 22 bp, Artificial sequence
  SiRNA target sequence
gcaaatggttttaaacttcaca

SEQ ID NO: 184492 - DNA, 22 bp, Artificial sequence
  SiRNA target sequence
caaatggttttaaacttcacag

SEQ ID NO: 184493 - DNA, 22 bp, Artificial sequence
  SiRNA target sequence
aaatggttttaaacttcacaga

SEQ ID NO: 184494 - DNA, 22 bp, Artificial sequence
  SiRNA target sequence
aatggttttaaacttcacagat

SEQ ID NO: 184495 - DNA, 22 bp, Artificial sequence
  SiRNA target sequence
atggttttaaacttcacagatt

SEQ ID NO: 184496 - DNA, 22 bp, Artificial sequence
  SiRNA target sequence
tggttttaaacttcacagatta

SEQ ID NO: 184497 - DNA, 22 bp, Artificial sequence
  SiRNA target sequence
ggttttaaacttcacagattac

SEQ ID NO: 184498 - DNA, 22 bp, Artificial sequence
  SiRNA target sequence
gttttaaacttcacagattacc

SEQ ID NO: 184499 - DNA, 22 bp, Artificial sequence
  SiRNA target sequence
ttttaaacttcacagattacca

SEQ ID NO: 184500 - DNA, 22 bp, Artificial sequence
  SiRNA target sequence
tttaaacttcacagattaccaa

SEQ ID NO: 184501 - DNA, 22 bp, Artificial sequence
  SiRNA target sequence
ttaaacttcacagattaccaat

SEQ ID NO: 184502 - DNA, 22 bp, Artificial sequence
  SiRNA target sequence
taaacttcacagattaccaatc

SEQ ID NO: 184503 - DNA, 22 bp, Artificial sequence
  SiRNA target sequence
aaacttcacagattaccaatcc

SEQ ID NO: 184504 - DNA, 22 bp, Artificial sequence
  SiRNA target sequence
aacttcacagattaccaatccc

SEQ ID NO: 184505 - DNA, 22 bp, Artificial sequence
  SiRNA target sequence
acttcacagattaccaatccct

SEQ ID NO: 184506 - DNA, 22 bp, Artificial sequence
  SiRNA target sequence
cttcacagattaccaatcccta

SEQ ID NO: 184507 - DNA, 22 bp, Artificial sequence
  SiRNA target sequence
ttcacagattaccaatccctaa

SEQ ID NO: 184508 - DNA, 22 bp, Artificial sequence
  SiRNA target sequence
tcacagattaccaatccctaaa

SEQ ID NO: 184509 - DNA, 22 bp, Artificial sequence
  SiRNA target sequence
cacagattaccaatccctaaat

SEQ ID NO: 184510 - DNA, 22 bp, Artificial sequence
  SiRNA target sequence
acagattaccaatccctaaata

SEQ ID NO: 184511 - DNA, 22 bp, Artificial sequence
  SiRNA target sequence
cagattaccaatccctaaatat

SEQ ID NO: 184512 - DNA, 22 bp, Artificial sequence
  SiRNA target sequence
agattaccaatccctaaatatg

SEQ ID NO: 184513 - DNA, 22 bp, Artificial sequence
  SiRNA target sequence
gattaccaatccctaaatatgg

SEQ ID NO: 184514 - DNA, 22 bp, Artificial sequence
  SiRNA target sequence
attaccaatccctaaatatggt

SEQ ID NO: 184515 - DNA, 22 bp, Artificial sequence
  SiRNA target sequence
ttaccaatccctaaatatggta

SEQ ID NO: 184516 - DNA, 22 bp, Artificial sequence
  SiRNA target sequence
taccaatccctaaatatggtaa

SEQ ID NO: 184517 - DNA, 22 bp, Artificial sequence
  SiRNA target sequence
accaatccctaaatatggtaag

SEQ ID NO: 184518 - DNA, 22 bp, Artificial sequence
  SiRNA target sequence
ccaatccctaaatatggtaagg

SEQ ID NO: 184519 - DNA, 22 bp, Artificial sequence
  SiRNA target sequence
caatccctaaatatggtaaggt

SEQ ID NO: 184520 - DNA, 22 bp, Artificial sequence
  SiRNA target sequence
aatccctaaatatggtaaggtt

SEQ ID NO: 184521 - DNA, 22 bp, Artificial sequence
  SiRNA target sequence
atccctaaatatggtaaggttt

SEQ ID NO: 184522 - DNA, 22 bp, Artificial sequence
  SiRNA target sequence
tccctaaatatggtaaggtttt

SEQ ID NO: 184523 - DNA, 22 bp, Artificial sequence
  SiRNA target sequence
ccctaaatatggtaaggtttta

SEQ ID NO: 184524 - DNA, 22 bp, Artificial sequence
  SiRNA target sequence
cctaaatatggtaaggttttag

SEQ ID NO: 184525 - DNA, 22 bp, Artificial sequence
  SiRNA target sequence
ctaaatatggtaaggttttagg

SEQ ID NO: 184526 - DNA, 22 bp, Artificial sequence
  SiRNA target sequence
taaatatggtaaggttttaggg

SEQ ID NO: 184527 - DNA, 22 bp, Artificial sequence
  SiRNA target sequence
aaatatggtaaggttttagggc

SEQ ID NO: 184528 - DNA, 22 bp, Artificial sequence
  SiRNA target sequence
aatatggtaaggttttagggct

SEQ ID NO: 184529 - DNA, 22 bp, Artificial sequence
  SiRNA target sequence
atatggtaaggttttagggcta

SEQ ID NO: 184530 - DNA, 22 bp, Artificial sequence
  SiRNA target sequence
tatggtaaggttttagggctag

SEQ ID NO: 184531 - DNA, 22 bp, Artificial sequence
  SiRNA target sequence
atggtaaggttttagggctagt

SEQ ID NO: 184532 - DNA, 22 bp, Artificial sequence
  SiRNA target sequence
tggtaaggttttagggctagta

SEQ ID NO: 184533 - DNA, 22 bp, Artificial sequence
  SiRNA target sequence
ggtaaggttttagggctagtag

SEQ ID NO: 184534 - DNA, 22 bp, Artificial sequence
  SiRNA target sequence
gtaaggttttagggctagtagg

SEQ ID NO: 184535 - DNA, 22 bp, Artificial sequence
  SiRNA target sequence
taaggttttagggctagtaggc

SEQ ID NO: 184536 - DNA, 22 bp, Artificial sequence
  SiRNA target sequence
aaggttttagggctagtaggca

SEQ ID NO: 184537 - DNA, 22 bp, Artificial sequence
  SiRNA target sequence
aggttttagggctagtaggcac

SEQ ID NO: 184538 - DNA, 22 bp, Artificial sequence
  SiRNA target sequence
ggttttagggctagtaggcact

SEQ ID NO: 184539 - DNA, 22 bp, Artificial sequence
  SiRNA target sequence
gttttagggctagtaggcacta

SEQ ID NO: 184540 - DNA, 22 bp, Artificial sequence
  SiRNA target sequence
ttttagggctagtaggcactaa

SEQ ID NO: 184541 - DNA, 22 bp, Artificial sequence
  SiRNA target sequence
tttagggctagtaggcactaat

SEQ ID NO: 184542 - DNA, 22 bp, Artificial sequence
  SiRNA target sequence
ttagggctagtaggcactaatg

SEQ ID NO: 184543 - DNA, 22 bp, Artificial sequence
  SiRNA target sequence
tagggctagtaggcactaatgg

SEQ ID NO: 184544 - DNA, 22 bp, Artificial sequence
  SiRNA target sequence
agggctagtaggcactaatggt

SEQ ID NO: 184545 - DNA, 22 bp, Artificial sequence
  SiRNA target sequence
gggctagtaggcactaatggta

SEQ ID NO: 184546 - DNA, 22 bp, Artificial sequence
  SiRNA target sequence
ggctagtaggcactaatggtat

SEQ ID NO: 184547 - DNA, 22 bp, Artificial sequence
  SiRNA target sequence
gctagtaggcactaatggtata

SEQ ID NO: 184548 - DNA, 22 bp, Artificial sequence
  SiRNA target sequence
ctagtaggcactaatggtatag

SEQ ID NO: 184549 - DNA, 22 bp, Artificial sequence
  SiRNA target sequence
tagtaggcactaatggtatagg

SEQ ID NO: 184550 - DNA, 22 bp, Artificial sequence
  SiRNA target sequence
agtaggcactaatggtatagga

SEQ ID NO: 184551 - DNA, 22 bp, Artificial sequence
  SiRNA target sequence
gtaggcactaatggtataggaa

SEQ ID NO: 184552 - DNA, 22 bp, Artificial sequence
  SiRNA target sequence
taggcactaatggtataggaaa

SEQ ID NO: 184553 - DNA, 22 bp, Artificial sequence
  SiRNA target sequence
aggcactaatggtataggaaaa

SEQ ID NO: 184554 - DNA, 22 bp, Artificial sequence
  SiRNA target sequence
ggcactaatggtataggaaaaa

SEQ ID NO: 184555 - DNA, 22 bp, Artificial sequence
  SiRNA target sequence
gcactaatggtataggaaaaag

SEQ ID NO: 184556 - DNA, 22 bp, Artificial sequence
  SiRNA target sequence
cactaatggtataggaaaaagt

SEQ ID NO: 184557 - DNA, 22 bp, Artificial sequence
  SiRNA target sequence
actaatggtataggaaaaagta

SEQ ID NO: 184558 - DNA, 22 bp, Artificial sequence
  SiRNA target sequence
ctaatggtataggaaaaagtac

SEQ ID NO: 184559 - DNA, 22 bp, Artificial sequence
  SiRNA target sequence
taatggtataggaaaaagtact

SEQ ID NO: 184560 - DNA, 22 bp, Artificial sequence
  SiRNA target sequence
aatggtataggaaaaagtactg

SEQ ID NO: 184561 - DNA, 22 bp, Artificial sequence
  SiRNA target sequence
atggtataggaaaaagtactgc

SEQ ID NO: 184562 - DNA, 22 bp, Artificial sequence
  SiRNA target sequence
tggtataggaaaaagtactgca

SEQ ID NO: 184563 - DNA, 22 bp, Artificial sequence
  SiRNA target sequence
ggtataggaaaaagtactgcac

SEQ ID NO: 184564 - DNA, 22 bp, Artificial sequence
  SiRNA target sequence
gtataggaaaaagtactgcact

SEQ ID NO: 184565 - DNA, 22 bp, Artificial sequence
  SiRNA target sequence
tataggaaaaagtactgcactt

SEQ ID NO: 184566 - DNA, 22 bp, Artificial sequence
  SiRNA target sequence
ataggaaaaagtactgcactta

SEQ ID NO: 184567 - DNA, 22 bp, Artificial sequence
  SiRNA target sequence
taggaaaaagtactgcacttaa

SEQ ID NO: 184568 - DNA, 22 bp, Artificial sequence
  SiRNA target sequence
aggaaaaagtactgcacttaaa

SEQ ID NO: 184569 - DNA, 22 bp, Artificial sequence
  SiRNA target sequence
ggaaaaagtactgcacttaaaa

SEQ ID NO: 184570 - DNA, 22 bp, Artificial sequence
  SiRNA target sequence
gaaaaagtactgcacttaaaat

SEQ ID NO: 184571 - DNA, 22 bp, Artificial sequence
  SiRNA target sequence
aaaaagtactgcacttaaaata

SEQ ID NO: 184572 - DNA, 22 bp, Artificial sequence
  SiRNA target sequence
aaaagtactgcacttaaaatat

SEQ ID NO: 184573 - DNA, 22 bp, Artificial sequence
  SiRNA target sequence
aaagtactgcacttaaaatatt

SEQ ID NO: 184574 - DNA, 22 bp, Artificial sequence
  SiRNA target sequence
aagtactgcacttaaaatatta

SEQ ID NO: 184575 - DNA, 22 bp, Artificial sequence
  SiRNA target sequence
agtactgcacttaaaatattat

SEQ ID NO: 184576 - DNA, 22 bp, Artificial sequence
  SiRNA target sequence
gtactgcacttaaaatattatc

SEQ ID NO: 184577 - DNA, 22 bp, Artificial sequence
  SiRNA target sequence
tactgcacttaaaatattatcg

SEQ ID NO: 184578 - DNA, 22 bp, Artificial sequence
  SiRNA target sequence
actgcacttaaaatattatcgg

SEQ ID NO: 184579 - DNA, 22 bp, Artificial sequence
  SiRNA target sequence
ctgcacttaaaatattatcggg

SEQ ID NO: 184580 - DNA, 22 bp, Artificial sequence
  SiRNA target sequence
tgcacttaaaatattatcgggc

SEQ ID NO: 184581 - DNA, 22 bp, Artificial sequence
  SiRNA target sequence
gcacttaaaatattatcgggca

SEQ ID NO: 184582 - DNA, 22 bp, Artificial sequence
  SiRNA target sequence
cacttaaaatattatcgggcaa

SEQ ID NO: 184583 - DNA, 22 bp, Artificial sequence
  SiRNA target sequence
acttaaaatattatcgggcaat

SEQ ID NO: 184584 - DNA, 22 bp, Artificial sequence
  SiRNA target sequence
cttaaaatattatcgggcaatc

SEQ ID NO: 184585 - DNA, 22 bp, Artificial sequence
  SiRNA target sequence
ttaaaatattatcgggcaatct

SEQ ID NO: 184586 - DNA, 22 bp, Artificial sequence
  SiRNA target sequence
taaaatattatcgggcaatctt

SEQ ID NO: 184587 - DNA, 22 bp, Artificial sequence
  SiRNA target sequence
aaaatattatcgggcaatctta

SEQ ID NO: 184588 - DNA, 22 bp, Artificial sequence
  SiRNA target sequence
aaatattatcgggcaatcttaa

SEQ ID NO: 184589 - DNA, 22 bp, Artificial sequence
  SiRNA target sequence
aatattatcgggcaatcttaaa

SEQ ID NO: 184590 - DNA, 22 bp, Artificial sequence
  SiRNA target sequence
atattatcgggcaatcttaaac

SEQ ID NO: 184591 - DNA, 22 bp, Artificial sequence
  SiRNA target sequence
tattatcgggcaatcttaaacc

SEQ ID NO: 184592 - DNA, 22 bp, Artificial sequence
  SiRNA target sequence
attatcgggcaatcttaaacca

SEQ ID NO: 184593 - DNA, 22 bp, Artificial sequence
  SiRNA target sequence
ttatcgggcaatcttaaaccaa

SEQ ID NO: 184594 - DNA, 22 bp, Artificial sequence
  SiRNA target sequence
tatcgggcaatcttaaaccaaa

SEQ ID NO: 184595 - DNA, 22 bp, Artificial sequence
  SiRNA target sequence
atcgggcaatcttaaaccaaac

SEQ ID NO: 184596 - DNA, 22 bp, Artificial sequence
  SiRNA target sequence
tcgggcaatcttaaaccaaact

SEQ ID NO: 184597 - DNA, 22 bp, Artificial sequence
  SiRNA target sequence
cgggcaatcttaaaccaaactt

SEQ ID NO: 184598 - DNA, 22 bp, Artificial sequence
  SiRNA target sequence
gggcaatcttaaaccaaactta

SEQ ID NO: 184599 - DNA, 22 bp, Artificial sequence
  SiRNA target sequence
ggcaatcttaaaccaaacttag

SEQ ID NO: 184600 - DNA, 22 bp, Artificial sequence
  SiRNA target sequence
gcaatcttaaaccaaacttagg

SEQ ID NO: 184601 - DNA, 22 bp, Artificial sequence
  SiRNA target sequence
caatcttaaaccaaacttagga

SEQ ID NO: 184602 - DNA, 22 bp, Artificial sequence
  SiRNA target sequence
aatcttaaaccaaacttaggaa

SEQ ID NO: 184603 - DNA, 22 bp, Artificial sequence
  SiRNA target sequence
atcttaaaccaaacttaggaaa

SEQ ID NO: 184604 - DNA, 22 bp, Artificial sequence
  SiRNA target sequence
tcttaaaccaaacttaggaaag

SEQ ID NO: 184605 - DNA, 22 bp, Artificial sequence
  SiRNA target sequence
cttaaaccaaacttaggaaagt

SEQ ID NO: 184606 - DNA, 22 bp, Artificial sequence
  SiRNA target sequence
ttaaaccaaacttaggaaagtt

SEQ ID NO: 184607 - DNA, 22 bp, Artificial sequence
  SiRNA target sequence
taaaccaaacttaggaaagttc

SEQ ID NO: 184608 - DNA, 22 bp, Artificial sequence
  SiRNA target sequence
aaaccaaacttaggaaagttcg

SEQ ID NO: 184609 - DNA, 22 bp, Artificial sequence
  SiRNA target sequence
aaccaaacttaggaaagttcga

SEQ ID NO: 184610 - DNA, 22 bp, Artificial sequence
  SiRNA target sequence
accaaacttaggaaagttcgac

SEQ ID NO: 184611 - DNA, 22 bp, Artificial sequence
  SiRNA target sequence
ccaaacttaggaaagttcgacg

SEQ ID NO: 184612 - DNA, 22 bp, Artificial sequence
  SiRNA target sequence
caaacttaggaaagttcgacgt

SEQ ID NO: 184613 - DNA, 22 bp, Artificial sequence
  SiRNA target sequence
aaacttaggaaagttcgacgtt

SEQ ID NO: 184614 - DNA, 22 bp, Artificial sequence
  SiRNA target sequence
aacttaggaaagttcgacgtta

SEQ ID NO: 184615 - DNA, 22 bp, Artificial sequence
  SiRNA target sequence
acttaggaaagttcgacgttac

SEQ ID NO: 184616 - DNA, 22 bp, Artificial sequence
  SiRNA target sequence
cttaggaaagttcgacgttacg

SEQ ID NO: 184617 - DNA, 22 bp, Artificial sequence
  SiRNA target sequence
ttaggaaagttcgacgttacgc

SEQ ID NO: 184618 - DNA, 22 bp, Artificial sequence
  SiRNA target sequence
taggaaagttcgacgttacgcc

SEQ ID NO: 184619 - DNA, 22 bp, Artificial sequence
  SiRNA target sequence
aggaaagttcgacgttacgccc

SEQ ID NO: 184620 - DNA, 22 bp, Artificial sequence
  SiRNA target sequence
ggaaagttcgacgttacgcccg

SEQ ID NO: 184621 - DNA, 22 bp, Artificial sequence
  SiRNA target sequence
gaaagttcgacgttacgcccga

SEQ ID NO: 184622 - DNA, 22 bp, Artificial sequence
  SiRNA target sequence
aaagttcgacgttacgcccgac

SEQ ID NO: 184623 - DNA, 22 bp, Artificial sequence
  SiRNA target sequence
aagttcgacgttacgcccgact

SEQ ID NO: 184624 - DNA, 22 bp, Artificial sequence
  SiRNA target sequence
agttcgacgttacgcccgactg

SEQ ID NO: 184625 - DNA, 22 bp, Artificial sequence
  SiRNA target sequence
gttcgacgttacgcccgactgg

SEQ ID NO: 184626 - DNA, 22 bp, Artificial sequence
  SiRNA target sequence
ttcgacgttacgcccgactggg

SEQ ID NO: 184627 - DNA, 22 bp, Artificial sequence
  SiRNA target sequence
tcgacgttacgcccgactgggc

SEQ ID NO: 184628 - DNA, 22 bp, Artificial sequence
  SiRNA target sequence
cgacgttacgcccgactgggca

SEQ ID NO: 184629 - DNA, 22 bp, Artificial sequence
  SiRNA target sequence
gacgttacgcccgactgggcag

SEQ ID NO: 184630 - DNA, 22 bp, Artificial sequence
  SiRNA target sequence
acgttacgcccgactgggcagc

SEQ ID NO: 184631 - DNA, 22 bp, Artificial sequence
  SiRNA target sequence
cgttacgcccgactgggcagca

SEQ ID NO: 184632 - DNA, 22 bp, Artificial sequence
  SiRNA target sequence
gttacgcccgactgggcagcaa

SEQ ID NO: 184633 - DNA, 22 bp, Artificial sequence
  SiRNA target sequence
ttacgcccgactgggcagcaat

SEQ ID NO: 184634 - DNA, 22 bp, Artificial sequence
  SiRNA target sequence
tacgcccgactgggcagcaatt

SEQ ID NO: 184635 - DNA, 22 bp, Artificial sequence
  SiRNA target sequence
acgcccgactgggcagcaattc

SEQ ID NO: 184636 - DNA, 22 bp, Artificial sequence
  SiRNA target sequence
cgcccgactgggcagcaattct

SEQ ID NO: 184637 - DNA, 22 bp, Artificial sequence
  SiRNA target sequence
gcccgactgggcagcaattcta

SEQ ID NO: 184638 - DNA, 22 bp, Artificial sequence
  SiRNA target sequence
cccgactgggcagcaattctaa

SEQ ID NO: 184639 - DNA, 22 bp, Artificial sequence
  SiRNA target sequence
ccgactgggcagcaattctaaa

SEQ ID NO: 184640 - DNA, 22 bp, Artificial sequence
  SiRNA target sequence
cgactgggcagcaattctaaat

SEQ ID NO: 184641 - DNA, 22 bp, Artificial sequence
  SiRNA target sequence
gactgggcagcaattctaaata

SEQ ID NO: 184642 - DNA, 22 bp, Artificial sequence
  SiRNA target sequence
actgggcagcaattctaaataa

SEQ ID NO: 184643 - DNA, 22 bp, Artificial sequence
  SiRNA target sequence
ctgggcagcaattctaaataat

SEQ ID NO: 184644 - DNA, 22 bp, Artificial sequence
  SiRNA target sequence
tgggcagcaattctaaataatt

SEQ ID NO: 184645 - DNA, 22 bp, Artificial sequence
  SiRNA target sequence
gggcagcaattctaaataatta

SEQ ID NO: 184646 - DNA, 22 bp, Artificial sequence
  SiRNA target sequence
ggcagcaattctaaataattat

SEQ ID NO: 184647 - DNA, 22 bp, Artificial sequence
  SiRNA target sequence
gcagcaattctaaataattata

SEQ ID NO: 184648 - DNA, 22 bp, Artificial sequence
  SiRNA target sequence
cagcaattctaaataattataa

SEQ ID NO: 184649 - DNA, 22 bp, Artificial sequence
  SiRNA target sequence
agcaattctaaataattataaa

SEQ ID NO: 184650 - DNA, 22 bp, Artificial sequence
  SiRNA target sequence
gcaattctaaataattataaag

SEQ ID NO: 184651 - DNA, 22 bp, Artificial sequence
  SiRNA target sequence
caattctaaataattataaagg

SEQ ID NO: 184652 - DNA, 22 bp, Artificial sequence
  SiRNA target sequence
aattctaaataattataaagga

SEQ ID NO: 184653 - DNA, 22 bp, Artificial sequence
  SiRNA target sequence
attctaaataattataaaggat

SEQ ID NO: 184654 - DNA, 22 bp, Artificial sequence
  SiRNA target sequence
ttctaaataattataaaggatc

SEQ ID NO: 184655 - DNA, 22 bp, Artificial sequence
  SiRNA target sequence
tctaaataattataaaggatct

SEQ ID NO: 184656 - DNA, 22 bp, Artificial sequence
  SiRNA target sequence
ctaaataattataaaggatctg

SEQ ID NO: 184657 - DNA, 22 bp, Artificial sequence
  SiRNA target sequence
taaataattataaaggatctga

SEQ ID NO: 184658 - DNA, 22 bp, Artificial sequence
  SiRNA target sequence
aaataattataaaggatctgaa

SEQ ID NO: 184659 - DNA, 22 bp, Artificial sequence
  SiRNA target sequence
aataattataaaggatctgaac

SEQ ID NO: 184660 - DNA, 22 bp, Artificial sequence
  SiRNA target sequence
ataattataaaggatctgaact

SEQ ID NO: 184661 - DNA, 22 bp, Artificial sequence
  SiRNA target sequence
taattataaaggatctgaactt

SEQ ID NO: 184662 - DNA, 22 bp, Artificial sequence
  SiRNA target sequence
aattataaaggatctgaacttc

SEQ ID NO: 184663 - DNA, 22 bp, Artificial sequence
  SiRNA target sequence
attataaaggatctgaacttca

SEQ ID NO: 184664 - DNA, 22 bp, Artificial sequence
  SiRNA target sequence
ttataaaggatctgaacttcat

SEQ ID NO: 184665 - DNA, 22 bp, Artificial sequence
  SiRNA target sequence
tataaaggatctgaacttcatg

SEQ ID NO: 184666 - DNA, 22 bp, Artificial sequence
  SiRNA target sequence
ataaaggatctgaacttcatgg

SEQ ID NO: 184667 - DNA, 22 bp, Artificial sequence
  SiRNA target sequence
taaaggatctgaacttcatgga

SEQ ID NO: 184668 - DNA, 22 bp, Artificial sequence
  SiRNA target sequence
aaaggatctgaacttcatggat

SEQ ID NO: 184669 - DNA, 22 bp, Artificial sequence
  SiRNA target sequence
aaggatctgaacttcatggatt

SEQ ID NO: 184670 - DNA, 22 bp, Artificial sequence
  SiRNA target sequence
aggatctgaacttcatggattt

SEQ ID NO: 184671 - DNA, 22 bp, Artificial sequence
  SiRNA target sequence
ggatctgaacttcatggatttt

SEQ ID NO: 184672 - DNA, 22 bp, Artificial sequence
  SiRNA target sequence
gatctgaacttcatggattttt

SEQ ID NO: 184673 - DNA, 22 bp, Artificial sequence
  SiRNA target sequence
atctgaacttcatggatttttt

SEQ ID NO: 184674 - DNA, 22 bp, Artificial sequence
  SiRNA target sequence
tctgaacttcatggatttttta

SEQ ID NO: 184675 - DNA, 22 bp, Artificial sequence
  SiRNA target sequence
ctgaacttcatggattttttac

SEQ ID NO: 184676 - DNA, 22 bp, Artificial sequence
  SiRNA target sequence
tgaacttcatggattttttact

SEQ ID NO: 184677 - DNA, 22 bp, Artificial sequence
  SiRNA target sequence
gaacttcatggattttttacta

SEQ ID NO: 184678 - DNA, 22 bp, Artificial sequence
  SiRNA target sequence
aacttcatggattttttactaa

SEQ ID NO: 184679 - DNA, 22 bp, Artificial sequence
  SiRNA target sequence
acttcatggattttttactaaa

SEQ ID NO: 184680 - DNA, 22 bp, Artificial sequence
  SiRNA target sequence
cttcatggattttttactaaaa

SEQ ID NO: 184681 - DNA, 22 bp, Artificial sequence
  SiRNA target sequence
ttcatggattttttactaaaat

SEQ ID NO: 184682 - DNA, 22 bp, Artificial sequence
  SiRNA target sequence
tcatggattttttactaaaatt

SEQ ID NO: 184683 - DNA, 22 bp, Artificial sequence
  SiRNA target sequence
catggattttttactaaaattt

SEQ ID NO: 184684 - DNA, 22 bp, Artificial sequence
  SiRNA target sequence
atggattttttactaaaatttt

SEQ ID NO: 184685 - DNA, 22 bp, Artificial sequence
  SiRNA target sequence
tggattttttactaaaatttta

SEQ ID NO: 184686 - DNA, 22 bp, Artificial sequence
  SiRNA target sequence
ggattttttactaaaattttag

SEQ ID NO: 184687 - DNA, 22 bp, Artificial sequence
  SiRNA target sequence
gattttttactaaaattttaga

SEQ ID NO: 184688 - DNA, 22 bp, Artificial sequence
  SiRNA target sequence
attttttactaaaattttagaa

SEQ ID NO: 184689 - DNA, 22 bp, Artificial sequence
  SiRNA target sequence
ttttttactaaaattttagaag

SEQ ID NO: 184690 - DNA, 22 bp, Artificial sequence
  SiRNA target sequence
tttttactaaaattttagaagg

SEQ ID NO: 184691 - DNA, 22 bp, Artificial sequence
  SiRNA target sequence
ttttactaaaattttagaaggg

SEQ ID NO: 184692 - DNA, 22 bp, Artificial sequence
  SiRNA target sequence
tttactaaaattttagaagggt

SEQ ID NO: 184693 - DNA, 22 bp, Artificial sequence
  SiRNA target sequence
ttactaaaattttagaagggtc

SEQ ID NO: 184694 - DNA, 22 bp, Artificial sequence
  SiRNA target sequence
tactaaaattttagaagggtct

SEQ ID NO: 184695 - DNA, 22 bp, Artificial sequence
  SiRNA target sequence
actaaaattttagaagggtcta

SEQ ID NO: 184696 - DNA, 22 bp, Artificial sequence
  SiRNA target sequence
ctaaaattttagaagggtctat

SEQ ID NO: 184697 - DNA, 22 bp, Artificial sequence
  SiRNA target sequence
taaaattttagaagggtctatt

SEQ ID NO: 184698 - DNA, 22 bp, Artificial sequence
  SiRNA target sequence
aaaattttagaagggtctatta

SEQ ID NO: 184699 - DNA, 22 bp, Artificial sequence
  SiRNA target sequence
aaattttagaagggtctattaa

SEQ ID NO: 184700 - DNA, 22 bp, Artificial sequence
  SiRNA target sequence
aattttagaagggtctattaaa

SEQ ID NO: 184701 - DNA, 22 bp, Artificial sequence
  SiRNA target sequence
attttagaagggtctattaaag

SEQ ID NO: 184702 - DNA, 22 bp, Artificial sequence
  SiRNA target sequence
ttttagaagggtctattaaagc

SEQ ID NO: 184703 - DNA, 22 bp, Artificial sequence
  SiRNA target sequence
tttagaagggtctattaaagct

SEQ ID NO: 184704 - DNA, 22 bp, Artificial sequence
  SiRNA target sequence
ttagaagggtctattaaagcta

SEQ ID NO: 184705 - DNA, 22 bp, Artificial sequence
  SiRNA target sequence
tagaagggtctattaaagctat

SEQ ID NO: 184706 - DNA, 22 bp, Artificial sequence
  SiRNA target sequence
agaagggtctattaaagctatt

SEQ ID NO: 184707 - DNA, 22 bp, Artificial sequence
  SiRNA target sequence
gaagggtctattaaagctattt

SEQ ID NO: 184708 - DNA, 22 bp, Artificial sequence
  SiRNA target sequence
aagggtctattaaagctatttc

SEQ ID NO: 184709 - DNA, 22 bp, Artificial sequence
  SiRNA target sequence
agggtctattaaagctatttct

SEQ ID NO: 184710 - DNA, 22 bp, Artificial sequence
  SiRNA target sequence
gggtctattaaagctatttcta

SEQ ID NO: 184711 - DNA, 22 bp, Artificial sequence
  SiRNA target sequence
ggtctattaaagctatttctaa

SEQ ID NO: 184712 - DNA, 22 bp, Artificial sequence
  SiRNA target sequence
gtctattaaagctatttctaag

SEQ ID NO: 184713 - DNA, 22 bp, Artificial sequence
  SiRNA target sequence
tctattaaagctatttctaaga

SEQ ID NO: 184714 - DNA, 22 bp, Artificial sequence
  SiRNA target sequence
ctattaaagctatttctaagat

SEQ ID NO: 184715 - DNA, 22 bp, Artificial sequence
  SiRNA target sequence
tattaaagctatttctaagata

SEQ ID NO: 184716 - DNA, 22 bp, Artificial sequence
  SiRNA target sequence
attaaagctatttctaagatac

SEQ ID NO: 184717 - DNA, 22 bp, Artificial sequence
  SiRNA target sequence
ttaaagctatttctaagataca

SEQ ID NO: 184718 - DNA, 22 bp, Artificial sequence
  SiRNA target sequence
taaagctatttctaagatacag

SEQ ID NO: 184719 - DNA, 22 bp, Artificial sequence
  SiRNA target sequence
aaagctatttctaagatacagt

SEQ ID NO: 184720 - DNA, 22 bp, Artificial sequence
  SiRNA target sequence
aagctatttctaagatacagta

SEQ ID NO: 184721 - DNA, 22 bp, Artificial sequence
  SiRNA target sequence
agctatttctaagatacagtat

SEQ ID NO: 184722 - DNA, 22 bp, Artificial sequence
  SiRNA target sequence
gctatttctaagatacagtata

SEQ ID NO: 184723 - DNA, 22 bp, Artificial sequence
  SiRNA target sequence
ctatttctaagatacagtatat

SEQ ID NO: 184724 - DNA, 22 bp, Artificial sequence
  SiRNA target sequence
tatttctaagatacagtatata

SEQ ID NO: 184725 - DNA, 22 bp, Artificial sequence
  SiRNA target sequence
atttctaagatacagtatatag

SEQ ID NO: 184726 - DNA, 22 bp, Artificial sequence
  SiRNA target sequence
tttctaagatacagtatataga

SEQ ID NO: 184727 - DNA, 22 bp, Artificial sequence
  SiRNA target sequence
ttctaagatacagtatatagat

SEQ ID NO: 184728 - DNA, 22 bp, Artificial sequence
  SiRNA target sequence
tctaagatacagtatatagata

SEQ ID NO: 184729 - DNA, 22 bp, Artificial sequence
  SiRNA target sequence
ctaagatacagtatatagataa

SEQ ID NO: 184730 - DNA, 22 bp, Artificial sequence
  SiRNA target sequence
taagatacagtatatagataaa

SEQ ID NO: 184731 - DNA, 22 bp, Artificial sequence
  SiRNA target sequence
aagatacagtatatagataaaa

SEQ ID NO: 184732 - DNA, 22 bp, Artificial sequence
  SiRNA target sequence
agatacagtatatagataaaat

SEQ ID NO: 184733 - DNA, 22 bp, Artificial sequence
  SiRNA target sequence
gatacagtatatagataaaatg

SEQ ID NO: 184734 - DNA, 22 bp, Artificial sequence
  SiRNA target sequence
atacagtatatagataaaatgc

SEQ ID NO: 184735 - DNA, 22 bp, Artificial sequence
  SiRNA target sequence
tacagtatatagataaaatgcc

SEQ ID NO: 184736 - DNA, 22 bp, Artificial sequence
  SiRNA target sequence
acagtatatagataaaatgcct

SEQ ID NO: 184737 - DNA, 22 bp, Artificial sequence
  SiRNA target sequence
cagtatatagataaaatgccta

SEQ ID NO: 184738 - DNA, 22 bp, Artificial sequence
  SiRNA target sequence
agtatatagataaaatgcctaa

SEQ ID NO: 184739 - DNA, 22 bp, Artificial sequence
  SiRNA target sequence
gtatatagataaaatgcctaaa

SEQ ID NO: 184740 - DNA, 22 bp, Artificial sequence
  SiRNA target sequence
tatatagataaaatgcctaaat

SEQ ID NO: 184741 - DNA, 22 bp, Artificial sequence
  SiRNA target sequence
atatagataaaatgcctaaatt

SEQ ID NO: 184742 - DNA, 22 bp, Artificial sequence
  SiRNA target sequence
tatagataaaatgcctaaattt

SEQ ID NO: 184743 - DNA, 22 bp, Artificial sequence
  SiRNA target sequence
atagataaaatgcctaaatttt

SEQ ID NO: 184744 - DNA, 22 bp, Artificial sequence
  SiRNA target sequence
tagataaaatgcctaaattttt

SEQ ID NO: 184745 - DNA, 22 bp, Artificial sequence
  SiRNA target sequence
agataaaatgcctaaattttta

SEQ ID NO: 184746 - DNA, 22 bp, Artificial sequence
  SiRNA target sequence
gataaaatgcctaaatttttaa

SEQ ID NO: 184747 - DNA, 22 bp, Artificial sequence
  SiRNA target sequence
ataaaatgcctaaatttttaaa

SEQ ID NO: 184748 - DNA, 22 bp, Artificial sequence
  SiRNA target sequence
taaaatgcctaaatttttaaaa

SEQ ID NO: 184749 - DNA, 22 bp, Artificial sequence
  SiRNA target sequence
aaaatgcctaaatttttaaaag

SEQ ID NO: 184750 - DNA, 22 bp, Artificial sequence
  SiRNA target sequence
aaatgcctaaatttttaaaagg

SEQ ID NO: 184751 - DNA, 22 bp, Artificial sequence
  SiRNA target sequence
aatgcctaaatttttaaaagga

SEQ ID NO: 184752 - DNA, 22 bp, Artificial sequence
  SiRNA target sequence
atgcctaaatttttaaaaggac

SEQ ID NO: 184753 - DNA, 22 bp, Artificial sequence
  SiRNA target sequence
tgcctaaatttttaaaaggacg

SEQ ID NO: 184754 - DNA, 22 bp, Artificial sequence
  SiRNA target sequence
gcctaaatttttaaaaggacgc

SEQ ID NO: 184755 - DNA, 22 bp, Artificial sequence
  SiRNA target sequence
cctaaatttttaaaaggacgct

SEQ ID NO: 184756 - DNA, 22 bp, Artificial sequence
  SiRNA target sequence
ctaaatttttaaaaggacgcta

SEQ ID NO: 184757 - DNA, 22 bp, Artificial sequence
  SiRNA target sequence
taaatttttaaaaggacgctat

SEQ ID NO: 184758 - DNA, 22 bp, Artificial sequence
  SiRNA target sequence
aaatttttaaaaggacgctata

SEQ ID NO: 184759 - DNA, 22 bp, Artificial sequence
  SiRNA target sequence
aatttttaaaaggacgctataa

SEQ ID NO: 184760 - DNA, 22 bp, Artificial sequence
  SiRNA target sequence
atttttaaaaggacgctataag

SEQ ID NO: 184761 - DNA, 22 bp, Artificial sequence
  SiRNA target sequence
tttttaaaaggacgctataagt

SEQ ID NO: 184762 - DNA, 22 bp, Artificial sequence
  SiRNA target sequence
ttttaaaaggacgctataagtc

SEQ ID NO: 184763 - DNA, 22 bp, Artificial sequence
  SiRNA target sequence
tttaaaaggacgctataagtca

SEQ ID NO: 184764 - DNA, 22 bp, Artificial sequence
  SiRNA target sequence
ttaaaaggacgctataagtcag

SEQ ID NO: 184765 - DNA, 22 bp, Artificial sequence
  SiRNA target sequence
taaaaggacgctataagtcaga

SEQ ID NO: 184766 - DNA, 22 bp, Artificial sequence
  SiRNA target sequence
aaaaggacgctataagtcagaa

SEQ ID NO: 184767 - DNA, 22 bp, Artificial sequence
  SiRNA target sequence
aaaggacgctataagtcagaaa

SEQ ID NO: 184768 - DNA, 22 bp, Artificial sequence
  SiRNA target sequence
aaggacgctataagtcagaaat

SEQ ID NO: 184769 - DNA, 22 bp, Artificial sequence
  SiRNA target sequence
aggacgctataagtcagaaatc

SEQ ID NO: 184770 - DNA, 22 bp, Artificial sequence
  SiRNA target sequence
ggacgctataagtcagaaatcg

SEQ ID NO: 184771 - DNA, 22 bp, Artificial sequence
  SiRNA target sequence
gacgctataagtcagaaatcgc

SEQ ID NO: 184772 - DNA, 22 bp, Artificial sequence
  SiRNA target sequence
acgctataagtcagaaatcgcc

SEQ ID NO: 184773 - DNA, 22 bp, Artificial sequence
  SiRNA target sequence
cgctataagtcagaaatcgcct

SEQ ID NO: 184774 - DNA, 22 bp, Artificial sequence
  SiRNA target sequence
gctataagtcagaaatcgcctc

SEQ ID NO: 184775 - DNA, 22 bp, Artificial sequence
  SiRNA target sequence
ctataagtcagaaatcgcctcc

SEQ ID NO: 184776 - DNA, 22 bp, Artificial sequence
  SiRNA target sequence
tataagtcagaaatcgcctccg

SEQ ID NO: 184777 - DNA, 22 bp, Artificial sequence
  SiRNA target sequence
ataagtcagaaatcgcctccgg

SEQ ID NO: 184778 - DNA, 22 bp, Artificial sequence
  SiRNA target sequence
taagtcagaaatcgcctccgga

SEQ ID NO: 184779 - DNA, 22 bp, Artificial sequence
  SiRNA target sequence
aagtcagaaatcgcctccggaa

SEQ ID NO: 184780 - DNA, 22 bp, Artificial sequence
  SiRNA target sequence
agtcagaaatcgcctccggaaa

SEQ ID NO: 184781 - DNA, 22 bp, Artificial sequence
  SiRNA target sequence
gtcagaaatcgcctccggaaaa

SEQ ID NO: 184782 - DNA, 22 bp, Artificial sequence
  SiRNA target sequence
tcagaaatcgcctccggaaaaa

SEQ ID NO: 184783 - DNA, 22 bp, Artificial sequence
  SiRNA target sequence
cagaaatcgcctccggaaaaat

SEQ ID NO: 184784 - DNA, 22 bp, Artificial sequence
  SiRNA target sequence
agaaatcgcctccggaaaaatg

SEQ ID NO: 184785 - DNA, 22 bp, Artificial sequence
  SiRNA target sequence
gaaatcgcctccggaaaaatgt

SEQ ID NO: 184786 - DNA, 22 bp, Artificial sequence
  SiRNA target sequence
aaatcgcctccggaaaaatgtt

SEQ ID NO: 184787 - DNA, 22 bp, Artificial sequence
  SiRNA target sequence
aatcgcctccggaaaaatgttg

SEQ ID NO: 184788 - DNA, 22 bp, Artificial sequence
  SiRNA target sequence
atcgcctccggaaaaatgttgt

SEQ ID NO: 184789 - DNA, 22 bp, Artificial sequence
  SiRNA target sequence
tcgcctccggaaaaatgttgtt

SEQ ID NO: 184790 - DNA, 22 bp, Artificial sequence
  SiRNA target sequence
cgcctccggaaaaatgttgttt

SEQ ID NO: 184791 - DNA, 22 bp, Artificial sequence
  SiRNA target sequence
gcctccggaaaaatgttgttta

SEQ ID NO: 184792 - DNA, 22 bp, Artificial sequence
  SiRNA target sequence
cctccggaaaaatgttgtttac

SEQ ID NO: 184793 - DNA, 22 bp, Artificial sequence
  SiRNA target sequence
ctccggaaaaatgttgtttact

SEQ ID NO: 184794 - DNA, 22 bp, Artificial sequence
  SiRNA target sequence
tccggaaaaatgttgtttactg

SEQ ID NO: 184795 - DNA, 22 bp, Artificial sequence
  SiRNA target sequence
ccggaaaaatgttgtttactgt

SEQ ID NO: 184796 - DNA, 22 bp, Artificial sequence
  SiRNA target sequence
cggaaaaatgttgtttactgtt

SEQ ID NO: 184797 - DNA, 22 bp, Artificial sequence
  SiRNA target sequence
ggaaaaatgttgtttactgtta

SEQ ID NO: 184798 - DNA, 22 bp, Artificial sequence
  SiRNA target sequence
gaaaaatgttgtttactgttaa

SEQ ID NO: 184799 - DNA, 22 bp, Artificial sequence
  SiRNA target sequence
aaaaatgttgtttactgttaat

SEQ ID NO: 184800 - DNA, 22 bp, Artificial sequence
  SiRNA target sequence
aaaatgttgtttactgttaatg

SEQ ID NO: 184801 - DNA, 22 bp, Artificial sequence
  SiRNA target sequence
aaatgttgtttactgttaatga

SEQ ID NO: 184802 - DNA, 22 bp, Artificial sequence
  SiRNA target sequence
aatgttgtttactgttaatgat

SEQ ID NO: 184803 - DNA, 22 bp, Artificial sequence
  SiRNA target sequence
atgttgtttactgttaatgata

SEQ ID NO: 184804 - DNA, 22 bp, Artificial sequence
  SiRNA target sequence
tgttgtttactgttaatgatat

SEQ ID NO: 184805 - DNA, 22 bp, Artificial sequence
  SiRNA target sequence
gttgtttactgttaatgatata

SEQ ID NO: 184806 - DNA, 22 bp, Artificial sequence
  SiRNA target sequence
ttgtttactgttaatgatatat

SEQ ID NO: 184807 - DNA, 22 bp, Artificial sequence
  SiRNA target sequence
tgtttactgttaatgatatatt

SEQ ID NO: 184808 - DNA, 22 bp, Artificial sequence
  SiRNA target sequence
gtttactgttaatgatatatta

SEQ ID NO: 184809 - DNA, 22 bp, Artificial sequence
  SiRNA target sequence
tttactgttaatgatatattaa

SEQ ID NO: 184810 - DNA, 22 bp, Artificial sequence
  SiRNA target sequence
ttactgttaatgatatattaaa

SEQ ID NO: 184811 - DNA, 22 bp, Artificial sequence
  SiRNA target sequence
tactgttaatgatatattaaaa

SEQ ID NO: 184812 - DNA, 22 bp, Artificial sequence
  SiRNA target sequence
actgttaatgatatattaaaaa

SEQ ID NO: 184813 - DNA, 22 bp, Artificial sequence
  SiRNA target sequence
ctgttaatgatatattaaaaaa

SEQ ID NO: 184814 - DNA, 22 bp, Artificial sequence
  SiRNA target sequence
tgttaatgatatattaaaaaaa

SEQ ID NO: 184815 - DNA, 22 bp, Artificial sequence
  SiRNA target sequence
gttaatgatatattaaaaaaag

SEQ ID NO: 184816 - DNA, 22 bp, Artificial sequence
  SiRNA target sequence
ttaatgatatattaaaaaaagt

SEQ ID NO: 184817 - DNA, 22 bp, Artificial sequence
  SiRNA target sequence
taatgatatattaaaaaaagtt

SEQ ID NO: 184818 - DNA, 22 bp, Artificial sequence
  SiRNA target sequence
aatgatatattaaaaaaagttg

SEQ ID NO: 184819 - DNA, 22 bp, Artificial sequence
  SiRNA target sequence
atgatatattaaaaaaagttga

SEQ ID NO: 184820 - DNA, 22 bp, Artificial sequence
  SiRNA target sequence
tgatatattaaaaaaagttgat

SEQ ID NO: 184821 - DNA, 22 bp, Artificial sequence
  SiRNA target sequence
gatatattaaaaaaagttgatg

SEQ ID NO: 184822 - DNA, 22 bp, Artificial sequence
  SiRNA target sequence
atatattaaaaaaagttgatga

SEQ ID NO: 184823 - DNA, 22 bp, Artificial sequence
  SiRNA target sequence
tatattaaaaaaagttgatgaa

SEQ ID NO: 184824 - DNA, 22 bp, Artificial sequence
  SiRNA target sequence
atattaaaaaaagttgatgaaa

SEQ ID NO: 184825 - DNA, 22 bp, Artificial sequence
  SiRNA target sequence
tattaaaaaaagttgatgaaaa

SEQ ID NO: 184826 - DNA, 22 bp, Artificial sequence
  SiRNA target sequence
attaaaaaaagttgatgaaaaa

SEQ ID NO: 184827 - DNA, 22 bp, Artificial sequence
  SiRNA target sequence
ttaaaaaaagttgatgaaaaaa

SEQ ID NO: 184828 - DNA, 22 bp, Artificial sequence
  SiRNA target sequence
taaaaaaagttgatgaaaaaaa

SEQ ID NO: 184829 - DNA, 22 bp, Artificial sequence
  SiRNA target sequence
aaaaaaagttgatgaaaaaaat

SEQ ID NO: 184830 - DNA, 22 bp, Artificial sequence
  SiRNA target sequence
aaaaaagttgatgaaaaaaata

SEQ ID NO: 184831 - DNA, 22 bp, Artificial sequence
  SiRNA target sequence
aaaaagttgatgaaaaaaataa

SEQ ID NO: 184832 - DNA, 22 bp, Artificial sequence
  SiRNA target sequence
aaaagttgatgaaaaaaataaa

SEQ ID NO: 184833 - DNA, 22 bp, Artificial sequence
  SiRNA target sequence
aaagttgatgaaaaaaataaat

SEQ ID NO: 184834 - DNA, 22 bp, Artificial sequence
  SiRNA target sequence
aagttgatgaaaaaaataaatt

SEQ ID NO: 184835 - DNA, 22 bp, Artificial sequence
  SiRNA target sequence
agttgatgaaaaaaataaattt

SEQ ID NO: 184836 - DNA, 22 bp, Artificial sequence
  SiRNA target sequence
gttgatgaaaaaaataaatttg

SEQ ID NO: 184837 - DNA, 22 bp, Artificial sequence
  SiRNA target sequence
ttgatgaaaaaaataaatttga

SEQ ID NO: 184838 - DNA, 22 bp, Artificial sequence
  SiRNA target sequence
tgatgaaaaaaataaatttgac

SEQ ID NO: 184839 - DNA, 22 bp, Artificial sequence
  SiRNA target sequence
gatgaaaaaaataaatttgact

SEQ ID NO: 184840 - DNA, 22 bp, Artificial sequence
  SiRNA target sequence
atgaaaaaaataaatttgacta

SEQ ID NO: 184841 - DNA, 22 bp, Artificial sequence
  SiRNA target sequence
tgaaaaaaataaatttgactat

SEQ ID NO: 184842 - DNA, 22 bp, Artificial sequence
  SiRNA target sequence
gaaaaaaataaatttgactatt

SEQ ID NO: 184843 - DNA, 22 bp, Artificial sequence
  SiRNA target sequence
aaaaaaataaatttgactatta

SEQ ID NO: 184844 - DNA, 22 bp, Artificial sequence
  SiRNA target sequence
aaaaaataaatttgactattac

SEQ ID NO: 184845 - DNA, 22 bp, Artificial sequence
  SiRNA target sequence
aaaaataaatttgactattacg

SEQ ID NO: 184846 - DNA, 22 bp, Artificial sequence
  SiRNA target sequence
aaaataaatttgactattacgt

SEQ ID NO: 184847 - DNA, 22 bp, Artificial sequence
  SiRNA target sequence
aaataaatttgactattacgta

SEQ ID NO: 184848 - DNA, 22 bp, Artificial sequence
  SiRNA target sequence
aataaatttgactattacgtag

SEQ ID NO: 184849 - DNA, 22 bp, Artificial sequence
  SiRNA target sequence
ataaatttgactattacgtaga

SEQ ID NO: 184850 - DNA, 22 bp, Artificial sequence
  SiRNA target sequence
taaatttgactattacgtagat

SEQ ID NO: 184851 - DNA, 22 bp, Artificial sequence
  SiRNA target sequence
aaatttgactattacgtagata

SEQ ID NO: 184852 - DNA, 22 bp, Artificial sequence
  SiRNA target sequence
aatttgactattacgtagataa

SEQ ID NO: 184853 - DNA, 22 bp, Artificial sequence
  SiRNA target sequence
atttgactattacgtagataaa

SEQ ID NO: 184854 - DNA, 22 bp, Artificial sequence
  SiRNA target sequence
tttgactattacgtagataaaa

SEQ ID NO: 184855 - DNA, 22 bp, Artificial sequence
  SiRNA target sequence
ttgactattacgtagataaaat

SEQ ID NO: 184856 - DNA, 22 bp, Artificial sequence
  SiRNA target sequence
tgactattacgtagataaaatg

SEQ ID NO: 184857 - DNA, 22 bp, Artificial sequence
  SiRNA target sequence
gactattacgtagataaaatgg

SEQ ID NO: 184858 - DNA, 22 bp, Artificial sequence
  SiRNA target sequence
actattacgtagataaaatggc

SEQ ID NO: 184859 - DNA, 22 bp, Artificial sequence
  SiRNA target sequence
ctattacgtagataaaatggca

SEQ ID NO: 184860 - DNA, 22 bp, Artificial sequence
  SiRNA target sequence
tattacgtagataaaatggcac

SEQ ID NO: 184861 - DNA, 22 bp, Artificial sequence
  SiRNA target sequence
attacgtagataaaatggcact

SEQ ID NO: 184862 - DNA, 22 bp, Artificial sequence
  SiRNA target sequence
ttacgtagataaaatggcactt

SEQ ID NO: 184863 - DNA, 22 bp, Artificial sequence
  SiRNA target sequence
tacgtagataaaatggcactta

SEQ ID NO: 184864 - DNA, 22 bp, Artificial sequence
  SiRNA target sequence
acgtagataaaatggcacttaa

SEQ ID NO: 184865 - DNA, 22 bp, Artificial sequence
  SiRNA target sequence
cgtagataaaatggcacttaaa

SEQ ID NO: 184866 - DNA, 22 bp, Artificial sequence
  SiRNA target sequence
gtagataaaatggcacttaaaa

SEQ ID NO: 184867 - DNA, 22 bp, Artificial sequence
  SiRNA target sequence
tagataaaatggcacttaaaaa

SEQ ID NO: 184868 - DNA, 22 bp, Artificial sequence
  SiRNA target sequence
agataaaatggcacttaaaaat

SEQ ID NO: 184869 - DNA, 22 bp, Artificial sequence
  SiRNA target sequence
gataaaatggcacttaaaaatg

SEQ ID NO: 184870 - DNA, 22 bp, Artificial sequence
  SiRNA target sequence
ataaaatggcacttaaaaatgt

SEQ ID NO: 184871 - DNA, 22 bp, Artificial sequence
  SiRNA target sequence
taaaatggcacttaaaaatgta

SEQ ID NO: 184872 - DNA, 22 bp, Artificial sequence
  SiRNA target sequence
aaaatggcacttaaaaatgtat

SEQ ID NO: 184873 - DNA, 22 bp, Artificial sequence
  SiRNA target sequence
aaatggcacttaaaaatgtatt

SEQ ID NO: 184874 - DNA, 22 bp, Artificial sequence
  SiRNA target sequence
aatggcacttaaaaatgtatta

SEQ ID NO: 184875 - DNA, 22 bp, Artificial sequence
  SiRNA target sequence
atggcacttaaaaatgtattaa

SEQ ID NO: 184876 - DNA, 22 bp, Artificial sequence
  SiRNA target sequence
tggcacttaaaaatgtattaac

SEQ ID NO: 184877 - DNA, 22 bp, Artificial sequence
  SiRNA target sequence
ggcacttaaaaatgtattaaca

SEQ ID NO: 184878 - DNA, 22 bp, Artificial sequence
  SiRNA target sequence
gcacttaaaaatgtattaacaa

SEQ ID NO: 184879 - DNA, 22 bp, Artificial sequence
  SiRNA target sequence
cacttaaaaatgtattaacaag

SEQ ID NO: 184880 - DNA, 22 bp, Artificial sequence
  SiRNA target sequence
acttaaaaatgtattaacaaga

SEQ ID NO: 184881 - DNA, 22 bp, Artificial sequence
  SiRNA target sequence
cttaaaaatgtattaacaagag

SEQ ID NO: 184882 - DNA, 22 bp, Artificial sequence
  SiRNA target sequence
ttaaaaatgtattaacaagaga

SEQ ID NO: 184883 - DNA, 22 bp, Artificial sequence
  SiRNA target sequence
taaaaatgtattaacaagagaa

SEQ ID NO: 184884 - DNA, 22 bp, Artificial sequence
  SiRNA target sequence
aaaaatgtattaacaagagaat

SEQ ID NO: 184885 - DNA, 22 bp, Artificial sequence
  SiRNA target sequence
aaaatgtattaacaagagaatt

SEQ ID NO: 184886 - DNA, 22 bp, Artificial sequence
  SiRNA target sequence
aaatgtattaacaagagaatta

SEQ ID NO: 184887 - DNA, 22 bp, Artificial sequence
  SiRNA target sequence
aatgtattaacaagagaattag

SEQ ID NO: 184888 - DNA, 22 bp, Artificial sequence
  SiRNA target sequence
atgtattaacaagagaattaga

SEQ ID NO: 184889 - DNA, 22 bp, Artificial sequence
  SiRNA target sequence
tgtattaacaagagaattagag

SEQ ID NO: 184890 - DNA, 22 bp, Artificial sequence
  SiRNA target sequence
gtattaacaagagaattagagc

SEQ ID NO: 184891 - DNA, 22 bp, Artificial sequence
  SiRNA target sequence
tattaacaagagaattagagca

SEQ ID NO: 184892 - DNA, 22 bp, Artificial sequence
  SiRNA target sequence
attaacaagagaattagagcaa

SEQ ID NO: 184893 - DNA, 22 bp, Artificial sequence
  SiRNA target sequence
ttaacaagagaattagagcaat

SEQ ID NO: 184894 - DNA, 22 bp, Artificial sequence
  SiRNA target sequence
taacaagagaattagagcaatt

SEQ ID NO: 184895 - DNA, 22 bp, Artificial sequence
  SiRNA target sequence
aacaagagaattagagcaatta

SEQ ID NO: 184896 - DNA, 22 bp, Artificial sequence
  SiRNA target sequence
acaagagaattagagcaattaa

SEQ ID NO: 184897 - DNA, 22 bp, Artificial sequence
  SiRNA target sequence
caagagaattagagcaattaag

SEQ ID NO: 184898 - DNA, 22 bp, Artificial sequence
  SiRNA target sequence
aagagaattagagcaattaagt

SEQ ID NO: 184899 - DNA, 22 bp, Artificial sequence
  SiRNA target sequence
agagaattagagcaattaagtg

SEQ ID NO: 184900 - DNA, 22 bp, Artificial sequence
  SiRNA target sequence
gagaattagagcaattaagtgg

SEQ ID NO: 184901 - DNA, 22 bp, Artificial sequence
  SiRNA target sequence
agaattagagcaattaagtggt

SEQ ID NO: 184902 - DNA, 22 bp, Artificial sequence
  SiRNA target sequence
gaattagagcaattaagtggtg

SEQ ID NO: 184903 - DNA, 22 bp, Artificial sequence
  SiRNA target sequence
aattagagcaattaagtggtgg

SEQ ID NO: 184904 - DNA, 22 bp, Artificial sequence
  SiRNA target sequence
attagagcaattaagtggtggt

SEQ ID NO: 184905 - DNA, 22 bp, Artificial sequence
  SiRNA target sequence
ttagagcaattaagtggtggtg

SEQ ID NO: 184906 - DNA, 22 bp, Artificial sequence
  SiRNA target sequence
tagagcaattaagtggtggtga

SEQ ID NO: 184907 - DNA, 22 bp, Artificial sequence
  SiRNA target sequence
agagcaattaagtggtggtgaa

SEQ ID NO: 184908 - DNA, 22 bp, Artificial sequence
  SiRNA target sequence
gagcaattaagtggtggtgaac

SEQ ID NO: 184909 - DNA, 22 bp, Artificial sequence
  SiRNA target sequence
agcaattaagtggtggtgaact

SEQ ID NO: 184910 - DNA, 22 bp, Artificial sequence
  SiRNA target sequence
gcaattaagtggtggtgaactt

SEQ ID NO: 184911 - DNA, 22 bp, Artificial sequence
  SiRNA target sequence
caattaagtggtggtgaacttc

SEQ ID NO: 184912 - DNA, 22 bp, Artificial sequence
  SiRNA target sequence
aattaagtggtggtgaacttca

SEQ ID NO: 184913 - DNA, 22 bp, Artificial sequence
  SiRNA target sequence
attaagtggtggtgaacttcaa

SEQ ID NO: 184914 - DNA, 22 bp, Artificial sequence
  SiRNA target sequence
ttaagtggtggtgaacttcaaa

SEQ ID NO: 184915 - DNA, 22 bp, Artificial sequence
  SiRNA target sequence
taagtggtggtgaacttcaaag

SEQ ID NO: 184916 - DNA, 22 bp, Artificial sequence
  SiRNA target sequence
aagtggtggtgaacttcaaaga

SEQ ID NO: 184917 - DNA, 22 bp, Artificial sequence
  SiRNA target sequence
agtggtggtgaacttcaaagat

SEQ ID NO: 184918 - DNA, 22 bp, Artificial sequence
  SiRNA target sequence
gtggtggtgaacttcaaagatt

SEQ ID NO: 184919 - DNA, 22 bp, Artificial sequence
  SiRNA target sequence
tggtggtgaacttcaaagattt

SEQ ID NO: 184920 - DNA, 22 bp, Artificial sequence
  SiRNA target sequence
ggtggtgaacttcaaagatttt

SEQ ID NO: 184921 - DNA, 22 bp, Artificial sequence
  SiRNA target sequence
gtggtgaacttcaaagattttg

SEQ ID NO: 184922 - DNA, 22 bp, Artificial sequence
  SiRNA target sequence
tggtgaacttcaaagattttgt

SEQ ID NO: 184923 - DNA, 22 bp, Artificial sequence
  SiRNA target sequence
ggtgaacttcaaagattttgta

SEQ ID NO: 184924 - DNA, 22 bp, Artificial sequence
  SiRNA target sequence
gtgaacttcaaagattttgtat

SEQ ID NO: 184925 - DNA, 22 bp, Artificial sequence
  SiRNA target sequence
tgaacttcaaagattttgtatt

SEQ ID NO: 184926 - DNA, 22 bp, Artificial sequence
  SiRNA target sequence
gaacttcaaagattttgtattg

SEQ ID NO: 184927 - DNA, 22 bp, Artificial sequence
  SiRNA target sequence
aacttcaaagattttgtattgc

SEQ ID NO: 184928 - DNA, 22 bp, Artificial sequence
  SiRNA target sequence
acttcaaagattttgtattgca

SEQ ID NO: 184929 - DNA, 22 bp, Artificial sequence
  SiRNA target sequence
cttcaaagattttgtattgcat

SEQ ID NO: 184930 - DNA, 22 bp, Artificial sequence
  SiRNA target sequence
ttcaaagattttgtattgcata

SEQ ID NO: 184931 - DNA, 22 bp, Artificial sequence
  SiRNA target sequence
tcaaagattttgtattgcatac

SEQ ID NO: 184932 - DNA, 22 bp, Artificial sequence
  SiRNA target sequence
caaagattttgtattgcataca

SEQ ID NO: 184933 - DNA, 22 bp, Artificial sequence
  SiRNA target sequence
aaagattttgtattgcatacac

SEQ ID NO: 184934 - DNA, 22 bp, Artificial sequence
  SiRNA target sequence
aagattttgtattgcatacaca

SEQ ID NO: 184935 - DNA, 22 bp, Artificial sequence
  SiRNA target sequence
agattttgtattgcatacacat

SEQ ID NO: 184936 - DNA, 22 bp, Artificial sequence
  SiRNA target sequence
gattttgtattgcatacacatg

SEQ ID NO: 184937 - DNA, 22 bp, Artificial sequence
  SiRNA target sequence
attttgtattgcatacacatgt

SEQ ID NO: 184938 - DNA, 22 bp, Artificial sequence
  SiRNA target sequence
ttttgtattgcatacacatgtt

SEQ ID NO: 184939 - DNA, 22 bp, Artificial sequence
  SiRNA target sequence
tttgtattgcatacacatgttt

SEQ ID NO: 184940 - DNA, 22 bp, Artificial sequence
  SiRNA target sequence
ttgtattgcatacacatgttta

SEQ ID NO: 184941 - DNA, 22 bp, Artificial sequence
  SiRNA target sequence
tgtattgcatacacatgtttac

SEQ ID NO: 184942 - DNA, 22 bp, Artificial sequence
  SiRNA target sequence
gtattgcatacacatgtttaca

SEQ ID NO: 184943 - DNA, 22 bp, Artificial sequence
  SiRNA target sequence
tattgcatacacatgtttacaa

SEQ ID NO: 184944 - DNA, 22 bp, Artificial sequence
  SiRNA target sequence
attgcatacacatgtttacaag

SEQ ID NO: 184945 - DNA, 22 bp, Artificial sequence
  SiRNA target sequence
ttgcatacacatgtttacaaga

SEQ ID NO: 184946 - DNA, 22 bp, Artificial sequence
  SiRNA target sequence
tgcatacacatgtttacaagaa

SEQ ID NO: 184947 - DNA, 22 bp, Artificial sequence
  SiRNA target sequence
gcatacacatgtttacaagaag

SEQ ID NO: 184948 - DNA, 22 bp, Artificial sequence
  SiRNA target sequence
catacacatgtttacaagaagg

SEQ ID NO: 184949 - DNA, 22 bp, Artificial sequence
  SiRNA target sequence
atacacatgtttacaagaagga

SEQ ID NO: 184950 - DNA, 22 bp, Artificial sequence
  SiRNA target sequence
tacacatgtttacaagaaggaa

SEQ ID NO: 184951 - DNA, 22 bp, Artificial sequence
  SiRNA target sequence
acacatgtttacaagaaggaaa

SEQ ID NO: 184952 - DNA, 22 bp, Artificial sequence
  SiRNA target sequence
cacatgtttacaagaaggaaat

SEQ ID NO: 184953 - DNA, 22 bp, Artificial sequence
  SiRNA target sequence
acatgtttacaagaaggaaatg

SEQ ID NO: 184954 - DNA, 22 bp, Artificial sequence
  SiRNA target sequence
catgtttacaagaaggaaatgt

SEQ ID NO: 184955 - DNA, 22 bp, Artificial sequence
  SiRNA target sequence
atgtttacaagaaggaaatgtt

SEQ ID NO: 184956 - DNA, 22 bp, Artificial sequence
  SiRNA target sequence
tgtttacaagaaggaaatgttt

SEQ ID NO: 184957 - DNA, 22 bp, Artificial sequence
  SiRNA target sequence
gtttacaagaaggaaatgttta

SEQ ID NO: 184958 - DNA, 22 bp, Artificial sequence
  SiRNA target sequence
tttacaagaaggaaatgtttat

SEQ ID NO: 184959 - DNA, 22 bp, Artificial sequence
  SiRNA target sequence
ttacaagaaggaaatgtttata

SEQ ID NO: 184960 - DNA, 22 bp, Artificial sequence
  SiRNA target sequence
tacaagaaggaaatgtttatat

SEQ ID NO: 184961 - DNA, 22 bp, Artificial sequence
  SiRNA target sequence
acaagaaggaaatgtttatatt

SEQ ID NO: 184962 - DNA, 22 bp, Artificial sequence
  SiRNA target sequence
caagaaggaaatgtttatattt

SEQ ID NO: 184963 - DNA, 22 bp, Artificial sequence
  SiRNA target sequence
aagaaggaaatgtttatatttt

SEQ ID NO: 184964 - DNA, 22 bp, Artificial sequence
  SiRNA target sequence
agaaggaaatgtttatattttt

SEQ ID NO: 184965 - DNA, 22 bp, Artificial sequence
  SiRNA target sequence
gaaggaaatgtttatatttttg

SEQ ID NO: 184966 - DNA, 22 bp, Artificial sequence
  SiRNA target sequence
aaggaaatgtttatatttttga

SEQ ID NO: 184967 - DNA, 22 bp, Artificial sequence
  SiRNA target sequence
aggaaatgtttatatttttgat

SEQ ID NO: 184968 - DNA, 22 bp, Artificial sequence
  SiRNA target sequence
ggaaatgtttatatttttgatg

SEQ ID NO: 184969 - DNA, 22 bp, Artificial sequence
  SiRNA target sequence
gaaatgtttatatttttgatga

SEQ ID NO: 184970 - DNA, 22 bp, Artificial sequence
  SiRNA target sequence
aaatgtttatatttttgatgaa

SEQ ID NO: 184971 - DNA, 22 bp, Artificial sequence
  SiRNA target sequence
aatgtttatatttttgatgaac

SEQ ID NO: 184972 - DNA, 22 bp, Artificial sequence
  SiRNA target sequence
atgtttatatttttgatgaacc

SEQ ID NO: 184973 - DNA, 22 bp, Artificial sequence
  SiRNA target sequence
tgtttatatttttgatgaaccc

SEQ ID NO: 184974 - DNA, 22 bp, Artificial sequence
  SiRNA target sequence
gtttatatttttgatgaaccca

SEQ ID NO: 184975 - DNA, 22 bp, Artificial sequence
  SiRNA target sequence
tttatatttttgatgaacccac

SEQ ID NO: 184976 - DNA, 22 bp, Artificial sequence
  SiRNA target sequence
ttatatttttgatgaacccact

SEQ ID NO: 184977 - DNA, 22 bp, Artificial sequence
  SiRNA target sequence
tatatttttgatgaacccacta

SEQ ID NO: 184978 - DNA, 22 bp, Artificial sequence
  SiRNA target sequence
atatttttgatgaacccactag

SEQ ID NO: 184979 - DNA, 22 bp, Artificial sequence
  SiRNA target sequence
tatttttgatgaacccactagt

SEQ ID NO: 184980 - DNA, 22 bp, Artificial sequence
  SiRNA target sequence
atttttgatgaacccactagtt

SEQ ID NO: 184981 - DNA, 22 bp, Artificial sequence
  SiRNA target sequence
tttttgatgaacccactagttt

SEQ ID NO: 184982 - DNA, 22 bp, Artificial sequence
  SiRNA target sequence
ttttgatgaacccactagtttt

SEQ ID NO: 184983 - DNA, 22 bp, Artificial sequence
  SiRNA target sequence
tttgatgaacccactagttttt

SEQ ID NO: 184984 - DNA, 22 bp, Artificial sequence
  SiRNA target sequence
ttgatgaacccactagtttttt

SEQ ID NO: 184985 - DNA, 22 bp, Artificial sequence
  SiRNA target sequence
tgatgaacccactagttttttg

SEQ ID NO: 184986 - DNA, 22 bp, Artificial sequence
  SiRNA target sequence
gatgaacccactagttttttgg

SEQ ID NO: 184987 - DNA, 22 bp, Artificial sequence
  SiRNA target sequence
atgaacccactagttttttgga

SEQ ID NO: 184988 - DNA, 22 bp, Artificial sequence
  SiRNA target sequence
tgaacccactagttttttggat

SEQ ID NO: 184989 - DNA, 22 bp, Artificial sequence
  SiRNA target sequence
gaacccactagttttttggatg

SEQ ID NO: 184990 - DNA, 22 bp, Artificial sequence
  SiRNA target sequence
aacccactagttttttggatgt

SEQ ID NO: 184991 - DNA, 22 bp, Artificial sequence
  SiRNA target sequence
acccactagttttttggatgtt

SEQ ID NO: 184992 - DNA, 22 bp, Artificial sequence
  SiRNA target sequence
cccactagttttttggatgtta

SEQ ID NO: 184993 - DNA, 22 bp, Artificial sequence
  SiRNA target sequence
ccactagttttttggatgttaa

SEQ ID NO: 184994 - DNA, 22 bp, Artificial sequence
  SiRNA target sequence
cactagttttttggatgttaag

SEQ ID NO: 184995 - DNA, 22 bp, Artificial sequence
  SiRNA target sequence
actagttttttggatgttaagc

SEQ ID NO: 184996 - DNA, 22 bp, Artificial sequence
  SiRNA target sequence
ctagttttttggatgttaagca

SEQ ID NO: 184997 - DNA, 22 bp, Artificial sequence
  SiRNA target sequence
tagttttttggatgttaagcag

SEQ ID NO: 184998 - DNA, 22 bp, Artificial sequence
  SiRNA target sequence
agttttttggatgttaagcagc

SEQ ID NO: 184999 - DNA, 22 bp, Artificial sequence
  SiRNA target sequence
gttttttggatgttaagcagcg

SEQ ID NO: 185000 - DNA, 22 bp, Artificial sequence
  SiRNA target sequence
ttttttggatgttaagcagcga

SEQ ID NO: 185001 - DNA, 22 bp, Artificial sequence
  SiRNA target sequence
tttttggatgttaagcagcgac

SEQ ID NO: 185002 - DNA, 22 bp, Artificial sequence
  SiRNA target sequence
ttttggatgttaagcagcgact

SEQ ID NO: 185003 - DNA, 22 bp, Artificial sequence
  SiRNA target sequence
tttggatgttaagcagcgacta

SEQ ID NO: 185004 - DNA, 22 bp, Artificial sequence
  SiRNA target sequence
ttggatgttaagcagcgactag

SEQ ID NO: 185005 - DNA, 22 bp, Artificial sequence
  SiRNA target sequence
tggatgttaagcagcgactagc

SEQ ID NO: 185006 - DNA, 22 bp, Artificial sequence
  SiRNA target sequence
ggatgttaagcagcgactagca

SEQ ID NO: 185007 - DNA, 22 bp, Artificial sequence
  SiRNA target sequence
gatgttaagcagcgactagcag

SEQ ID NO: 185008 - DNA, 22 bp, Artificial sequence
  SiRNA target sequence
atgttaagcagcgactagcagc

SEQ ID NO: 185009 - DNA, 22 bp, Artificial sequence
  SiRNA target sequence
tgttaagcagcgactagcagct

SEQ ID NO: 185010 - DNA, 22 bp, Artificial sequence
  SiRNA target sequence
gttaagcagcgactagcagctg

SEQ ID NO: 185011 - DNA, 22 bp, Artificial sequence
  SiRNA target sequence
ttaagcagcgactagcagctgc

SEQ ID NO: 185012 - DNA, 22 bp, Artificial sequence
  SiRNA target sequence
taagcagcgactagcagctgct

SEQ ID NO: 185013 - DNA, 22 bp, Artificial sequence
  SiRNA target sequence
aagcagcgactagcagctgcta

SEQ ID NO: 185014 - DNA, 22 bp, Artificial sequence
  SiRNA target sequence
agcagcgactagcagctgctaa

SEQ ID NO: 185015 - DNA, 22 bp, Artificial sequence
  SiRNA target sequence
gcagcgactagcagctgctaag

SEQ ID NO: 185016 - DNA, 22 bp, Artificial sequence
  SiRNA target sequence
cagcgactagcagctgctaagg

SEQ ID NO: 185017 - DNA, 22 bp, Artificial sequence
  SiRNA target sequence
agcgactagcagctgctaagga

SEQ ID NO: 185018 - DNA, 22 bp, Artificial sequence
  SiRNA target sequence
gcgactagcagctgctaaggaa

SEQ ID NO: 185019 - DNA, 22 bp, Artificial sequence
  SiRNA target sequence
cgactagcagctgctaaggaaa

SEQ ID NO: 185020 - DNA, 22 bp, Artificial sequence
  SiRNA target sequence
gactagcagctgctaaggaaat

SEQ ID NO: 185021 - DNA, 22 bp, Artificial sequence
  SiRNA target sequence
actagcagctgctaaggaaata

SEQ ID NO: 185022 - DNA, 22 bp, Artificial sequence
  SiRNA target sequence
ctagcagctgctaaggaaataa

SEQ ID NO: 185023 - DNA, 22 bp, Artificial sequence
  SiRNA target sequence
tagcagctgctaaggaaataag

SEQ ID NO: 185024 - DNA, 22 bp, Artificial sequence
  SiRNA target sequence
agcagctgctaaggaaataaga

SEQ ID NO: 185025 - DNA, 22 bp, Artificial sequence
  SiRNA target sequence
gcagctgctaaggaaataagaa

SEQ ID NO: 185026 - DNA, 22 bp, Artificial sequence
  SiRNA target sequence
cagctgctaaggaaataagaaa

SEQ ID NO: 185027 - DNA, 22 bp, Artificial sequence
  SiRNA target sequence
agctgctaaggaaataagaaat

SEQ ID NO: 185028 - DNA, 22 bp, Artificial sequence
  SiRNA target sequence
gctgctaaggaaataagaaatt

SEQ ID NO: 185029 - DNA, 22 bp, Artificial sequence
  SiRNA target sequence
ctgctaaggaaataagaaattt

SEQ ID NO: 185030 - DNA, 22 bp, Artificial sequence
  SiRNA target sequence
tgctaaggaaataagaaatttg

SEQ ID NO: 185031 - DNA, 22 bp, Artificial sequence
  SiRNA target sequence
gctaaggaaataagaaatttgt

SEQ ID NO: 185032 - DNA, 22 bp, Artificial sequence
  SiRNA target sequence
ctaaggaaataagaaatttgtg

SEQ ID NO: 185033 - DNA, 22 bp, Artificial sequence
  SiRNA target sequence
taaggaaataagaaatttgtgt

SEQ ID NO: 185034 - DNA, 22 bp, Artificial sequence
  SiRNA target sequence
aaggaaataagaaatttgtgtg

SEQ ID NO: 185035 - DNA, 22 bp, Artificial sequence
  SiRNA target sequence
aggaaataagaaatttgtgtga

SEQ ID NO: 185036 - DNA, 22 bp, Artificial sequence
  SiRNA target sequence
ggaaataagaaatttgtgtgaa

SEQ ID NO: 185037 - DNA, 22 bp, Artificial sequence
  SiRNA target sequence
gaaataagaaatttgtgtgaag

SEQ ID NO: 185038 - DNA, 22 bp, Artificial sequence
  SiRNA target sequence
aaataagaaatttgtgtgaaga

SEQ ID NO: 185039 - DNA, 22 bp, Artificial sequence
  SiRNA target sequence
aataagaaatttgtgtgaagaa

SEQ ID NO: 185040 - DNA, 22 bp, Artificial sequence
  SiRNA target sequence
ataagaaatttgtgtgaagaaa

SEQ ID NO: 185041 - DNA, 22 bp, Artificial sequence
  SiRNA target sequence
taagaaatttgtgtgaagaaaa

SEQ ID NO: 185042 - DNA, 22 bp, Artificial sequence
  SiRNA target sequence
aagaaatttgtgtgaagaaaat

SEQ ID NO: 185043 - DNA, 22 bp, Artificial sequence
  SiRNA target sequence
agaaatttgtgtgaagaaaata

SEQ ID NO: 185044 - DNA, 22 bp, Artificial sequence
  SiRNA target sequence
gaaatttgtgtgaagaaaataa

SEQ ID NO: 185045 - DNA, 22 bp, Artificial sequence
  SiRNA target sequence
aaatttgtgtgaagaaaataaa

SEQ ID NO: 185046 - DNA, 22 bp, Artificial sequence
  SiRNA target sequence
aatttgtgtgaagaaaataaat

SEQ ID NO: 185047 - DNA, 22 bp, Artificial sequence
  SiRNA target sequence
atttgtgtgaagaaaataaata

SEQ ID NO: 185048 - DNA, 22 bp, Artificial sequence
  SiRNA target sequence
tttgtgtgaagaaaataaatat

SEQ ID NO: 185049 - DNA, 22 bp, Artificial sequence
  SiRNA target sequence
ttgtgtgaagaaaataaatatg

SEQ ID NO: 185050 - DNA, 22 bp, Artificial sequence
  SiRNA target sequence
tgtgtgaagaaaataaatatgt

SEQ ID NO: 185051 - DNA, 22 bp, Artificial sequence
  SiRNA target sequence
gtgtgaagaaaataaatatgtt

SEQ ID NO: 185052 - DNA, 22 bp, Artificial sequence
  SiRNA target sequence
tgtgaagaaaataaatatgttg

SEQ ID NO: 185053 - DNA, 22 bp, Artificial sequence
  SiRNA target sequence
gtgaagaaaataaatatgttgt

SEQ ID NO: 185054 - DNA, 22 bp, Artificial sequence
  SiRNA target sequence
tgaagaaaataaatatgttgta

SEQ ID NO: 185055 - DNA, 22 bp, Artificial sequence
  SiRNA target sequence
gaagaaaataaatatgttgtag

SEQ ID NO: 185056 - DNA, 22 bp, Artificial sequence
  SiRNA target sequence
aagaaaataaatatgttgtagt

SEQ ID NO: 185057 - DNA, 22 bp, Artificial sequence
  SiRNA target sequence
agaaaataaatatgttgtagtt

SEQ ID NO: 185058 - DNA, 22 bp, Artificial sequence
  SiRNA target sequence
gaaaataaatatgttgtagttg

SEQ ID NO: 185059 - DNA, 22 bp, Artificial sequence
  SiRNA target sequence
aaaataaatatgttgtagttgt

SEQ ID NO: 185060 - DNA, 22 bp, Artificial sequence
  SiRNA target sequence
aaataaatatgttgtagttgtc

SEQ ID NO: 185061 - DNA, 22 bp, Artificial sequence
  SiRNA target sequence
aataaatatgttgtagttgtcg

SEQ ID NO: 185062 - DNA, 22 bp, Artificial sequence
  SiRNA target sequence
ataaatatgttgtagttgtcga

SEQ ID NO: 185063 - DNA, 22 bp, Artificial sequence
  SiRNA target sequence
taaatatgttgtagttgtcgaa

SEQ ID NO: 185064 - DNA, 22 bp, Artificial sequence
  SiRNA target sequence
aaatatgttgtagttgtcgaac

SEQ ID NO: 185065 - DNA, 22 bp, Artificial sequence
  SiRNA target sequence
aatatgttgtagttgtcgaaca

SEQ ID NO: 185066 - DNA, 22 bp, Artificial sequence
  SiRNA target sequence
atatgttgtagttgtcgaacac

SEQ ID NO: 185067 - DNA, 22 bp, Artificial sequence
  SiRNA target sequence
tatgttgtagttgtcgaacacg

SEQ ID NO: 185068 - DNA, 22 bp, Artificial sequence
  SiRNA target sequence
atgttgtagttgtcgaacacga

SEQ ID NO: 185069 - DNA, 22 bp, Artificial sequence
  SiRNA target sequence
tgttgtagttgtcgaacacgat

SEQ ID NO: 185070 - DNA, 22 bp, Artificial sequence
  SiRNA target sequence
gttgtagttgtcgaacacgatt

SEQ ID NO: 185071 - DNA, 22 bp, Artificial sequence
  SiRNA target sequence
ttgtagttgtcgaacacgattt

SEQ ID NO: 185072 - DNA, 22 bp, Artificial sequence
  SiRNA target sequence
tgtagttgtcgaacacgattta

SEQ ID NO: 185073 - DNA, 22 bp, Artificial sequence
  SiRNA target sequence
gtagttgtcgaacacgatttag

SEQ ID NO: 185074 - DNA, 22 bp, Artificial sequence
  SiRNA target sequence
tagttgtcgaacacgatttagc

SEQ ID NO: 185075 - DNA, 22 bp, Artificial sequence
  SiRNA target sequence
agttgtcgaacacgatttagcc

SEQ ID NO: 185076 - DNA, 22 bp, Artificial sequence
  SiRNA target sequence
gttgtcgaacacgatttagcca

SEQ ID NO: 185077 - DNA, 22 bp, Artificial sequence
  SiRNA target sequence
ttgtcgaacacgatttagccat

SEQ ID NO: 185078 - DNA, 22 bp, Artificial sequence
  SiRNA target sequence
tgtcgaacacgatttagccatt

SEQ ID NO: 185079 - DNA, 22 bp, Artificial sequence
  SiRNA target sequence
gtcgaacacgatttagccattt

SEQ ID NO: 185080 - DNA, 22 bp, Artificial sequence
  SiRNA target sequence
tcgaacacgatttagccatttt

SEQ ID NO: 185081 - DNA, 22 bp, Artificial sequence
  SiRNA target sequence
cgaacacgatttagccatttta

SEQ ID NO: 185082 - DNA, 22 bp, Artificial sequence
  SiRNA target sequence
gaacacgatttagccattttag

SEQ ID NO: 185083 - DNA, 22 bp, Artificial sequence
  SiRNA target sequence
aacacgatttagccattttaga

SEQ ID NO: 185084 - DNA, 22 bp, Artificial sequence
  SiRNA target sequence
acacgatttagccattttagat

SEQ ID NO: 185085 - DNA, 22 bp, Artificial sequence
  SiRNA target sequence
cacgatttagccattttagatt

SEQ ID NO: 185086 - DNA, 22 bp, Artificial sequence
  SiRNA target sequence
acgatttagccattttagattt

SEQ ID NO: 185087 - DNA, 22 bp, Artificial sequence
  SiRNA target sequence
cgatttagccattttagatttg

SEQ ID NO: 185088 - DNA, 22 bp, Artificial sequence
  SiRNA target sequence
gatttagccattttagatttga

SEQ ID NO: 185089 - DNA, 22 bp, Artificial sequence
  SiRNA target sequence
atttagccattttagatttgat

SEQ ID NO: 185090 - DNA, 22 bp, Artificial sequence
  SiRNA target sequence
tttagccattttagatttgatg

SEQ ID NO: 185091 - DNA, 22 bp, Artificial sequence
  SiRNA target sequence
ttagccattttagatttgatgt

SEQ ID NO: 185092 - DNA, 22 bp, Artificial sequence
  SiRNA target sequence
tagccattttagatttgatgtg

SEQ ID NO: 185093 - DNA, 22 bp, Artificial sequence
  SiRNA target sequence
agccattttagatttgatgtgt

SEQ ID NO: 185094 - DNA, 22 bp, Artificial sequence
  SiRNA target sequence
gccattttagatttgatgtgtg

SEQ ID NO: 185095 - DNA, 22 bp, Artificial sequence
  SiRNA target sequence
ccattttagatttgatgtgtga

SEQ ID NO: 185096 - DNA, 22 bp, Artificial sequence
  SiRNA target sequence
cattttagatttgatgtgtgat

SEQ ID NO: 185097 - DNA, 22 bp, Artificial sequence
  SiRNA target sequence
attttagatttgatgtgtgatt

SEQ ID NO: 185098 - DNA, 22 bp, Artificial sequence
  SiRNA target sequence
ttttagatttgatgtgtgattt

SEQ ID NO: 185099 - DNA, 22 bp, Artificial sequence
  SiRNA target sequence
tttagatttgatgtgtgatttt

SEQ ID NO: 185100 - DNA, 22 bp, Artificial sequence
  SiRNA target sequence
ttagatttgatgtgtgattttg

SEQ ID NO: 185101 - DNA, 22 bp, Artificial sequence
  SiRNA target sequence
tagatttgatgtgtgattttgg

SEQ ID NO: 185102 - DNA, 22 bp, Artificial sequence
  SiRNA target sequence
agatttgatgtgtgattttgga

SEQ ID NO: 185103 - DNA, 22 bp, Artificial sequence
  SiRNA target sequence
gatttgatgtgtgattttggat

SEQ ID NO: 185104 - DNA, 22 bp, Artificial sequence
  SiRNA target sequence
atttgatgtgtgattttggatg

SEQ ID NO: 185105 - DNA, 22 bp, Artificial sequence
  SiRNA target sequence
tttgatgtgtgattttggatgt

SEQ ID NO: 185106 - DNA, 22 bp, Artificial sequence
  SiRNA target sequence
ttgatgtgtgattttggatgtg

SEQ ID NO: 185107 - DNA, 22 bp, Artificial sequence
  SiRNA target sequence
tgatgtgtgattttggatgtgt

SEQ ID NO: 185108 - DNA, 22 bp, Artificial sequence
  SiRNA target sequence
gatgtgtgattttggatgtgtt

SEQ ID NO: 185109 - DNA, 22 bp, Artificial sequence
  SiRNA target sequence
atgtgtgattttggatgtgttc

SEQ ID NO: 185110 - DNA, 22 bp, Artificial sequence
  SiRNA target sequence
tgtgtgattttggatgtgttct

SEQ ID NO: 185111 - DNA, 22 bp, Artificial sequence
  SiRNA target sequence
gtgtgattttggatgtgttcta

SEQ ID NO: 185112 - DNA, 22 bp, Artificial sequence
  SiRNA target sequence
tgtgattttggatgtgttctat

SEQ ID NO: 185113 - DNA, 22 bp, Artificial sequence
  SiRNA target sequence
gtgattttggatgtgttctata

SEQ ID NO: 185114 - DNA, 22 bp, Artificial sequence
  SiRNA target sequence
tgattttggatgtgttctatac

SEQ ID NO: 185115 - DNA, 22 bp, Artificial sequence
  SiRNA target sequence
gattttggatgtgttctatacg

SEQ ID NO: 185116 - DNA, 22 bp, Artificial sequence
  SiRNA target sequence
attttggatgtgttctatacgg

SEQ ID NO: 185117 - DNA, 22 bp, Artificial sequence
  SiRNA target sequence
ttttggatgtgttctatacgga

SEQ ID NO: 185118 - DNA, 22 bp, Artificial sequence
  SiRNA target sequence
tttggatgtgttctatacggac

SEQ ID NO: 185119 - DNA, 22 bp, Artificial sequence
  SiRNA target sequence
ttggatgtgttctatacggaca

SEQ ID NO: 185120 - DNA, 22 bp, Artificial sequence
  SiRNA target sequence
tggatgtgttctatacggacaa

SEQ ID NO: 185121 - DNA, 22 bp, Artificial sequence
  SiRNA target sequence
ggatgtgttctatacggacaat

SEQ ID NO: 185122 - DNA, 22 bp, Artificial sequence
  SiRNA target sequence
gatgtgttctatacggacaatc

SEQ ID NO: 185123 - DNA, 22 bp, Artificial sequence
  SiRNA target sequence
atgtgttctatacggacaatct

SEQ ID NO: 185124 - DNA, 22 bp, Artificial sequence
  SiRNA target sequence
tgtgttctatacggacaatctg

SEQ ID NO: 185125 - DNA, 22 bp, Artificial sequence
  SiRNA target sequence
gtgttctatacggacaatctgg

SEQ ID NO: 185126 - DNA, 22 bp, Artificial sequence
  SiRNA target sequence
tgttctatacggacaatctggg

SEQ ID NO: 185127 - DNA, 22 bp, Artificial sequence
  SiRNA target sequence
gttctatacggacaatctgggg

SEQ ID NO: 185128 - DNA, 22 bp, Artificial sequence
  SiRNA target sequence
ttctatacggacaatctggggc

SEQ ID NO: 185129 - DNA, 22 bp, Artificial sequence
  SiRNA target sequence
tctatacggacaatctggggca

SEQ ID NO: 185130 - DNA, 22 bp, Artificial sequence
  SiRNA target sequence
ctatacggacaatctggggcat

SEQ ID NO: 185131 - DNA, 22 bp, Artificial sequence
  SiRNA target sequence
tatacggacaatctggggcata

SEQ ID NO: 185132 - DNA, 22 bp, Artificial sequence
  SiRNA target sequence
atacggacaatctggggcatac

SEQ ID NO: 185133 - DNA, 22 bp, Artificial sequence
  SiRNA target sequence
tacggacaatctggggcatacg

SEQ ID NO: 185134 - DNA, 22 bp, Artificial sequence
  SiRNA target sequence
acggacaatctggggcatacgg

SEQ ID NO: 185135 - DNA, 22 bp, Artificial sequence
  SiRNA target sequence
cggacaatctggggcatacggt

SEQ ID NO: 185136 - DNA, 22 bp, Artificial sequence
  SiRNA target sequence
ggacaatctggggcatacggtg

SEQ ID NO: 185137 - DNA, 22 bp, Artificial sequence
  SiRNA target sequence
gacaatctggggcatacggtgt

SEQ ID NO: 185138 - DNA, 22 bp, Artificial sequence
  SiRNA target sequence
acaatctggggcatacggtgta

SEQ ID NO: 185139 - DNA, 22 bp, Artificial sequence
  SiRNA target sequence
caatctggggcatacggtgtaa

SEQ ID NO: 185140 - DNA, 22 bp, Artificial sequence
  SiRNA target sequence
aatctggggcatacggtgtaat

SEQ ID NO: 185141 - DNA, 22 bp, Artificial sequence
  SiRNA target sequence
atctggggcatacggtgtaata

SEQ ID NO: 185142 - DNA, 22 bp, Artificial sequence
  SiRNA target sequence
tctggggcatacggtgtaataa

SEQ ID NO: 185143 - DNA, 22 bp, Artificial sequence
  SiRNA target sequence
ctggggcatacggtgtaataag

SEQ ID NO: 185144 - DNA, 22 bp, Artificial sequence
  SiRNA target sequence
tggggcatacggtgtaataagc

SEQ ID NO: 185145 - DNA, 22 bp, Artificial sequence
  SiRNA target sequence
ggggcatacggtgtaataagcg

SEQ ID NO: 185146 - DNA, 22 bp, Artificial sequence
  SiRNA target sequence
gggcatacggtgtaataagcgc

SEQ ID NO: 185147 - DNA, 22 bp, Artificial sequence
  SiRNA target sequence
ggcatacggtgtaataagcgca

SEQ ID NO: 185148 - DNA, 22 bp, Artificial sequence
  SiRNA target sequence
gcatacggtgtaataagcgcac

SEQ ID NO: 185149 - DNA, 22 bp, Artificial sequence
  SiRNA target sequence
catacggtgtaataagcgcacc

SEQ ID NO: 185150 - DNA, 22 bp, Artificial sequence
  SiRNA target sequence
atacggtgtaataagcgcacca

SEQ ID NO: 185151 - DNA, 22 bp, Artificial sequence
  SiRNA target sequence
tacggtgtaataagcgcaccat

SEQ ID NO: 185152 - DNA, 22 bp, Artificial sequence
  SiRNA target sequence
acggtgtaataagcgcaccata

SEQ ID NO: 185153 - DNA, 22 bp, Artificial sequence
  SiRNA target sequence
cggtgtaataagcgcaccatac

SEQ ID NO: 185154 - DNA, 22 bp, Artificial sequence
  SiRNA target sequence
ggtgtaataagcgcaccatacg

SEQ ID NO: 185155 - DNA, 22 bp, Artificial sequence
  SiRNA target sequence
gtgtaataagcgcaccatacgt

SEQ ID NO: 185156 - DNA, 22 bp, Artificial sequence
  SiRNA target sequence
tgtaataagcgcaccatacgtt

SEQ ID NO: 185157 - DNA, 22 bp, Artificial sequence
  SiRNA target sequence
gtaataagcgcaccatacgtta

SEQ ID NO: 185158 - DNA, 22 bp, Artificial sequence
  SiRNA target sequence
taataagcgcaccatacgttat

SEQ ID NO: 185159 - DNA, 22 bp, Artificial sequence
  SiRNA target sequence
aataagcgcaccatacgttatt

SEQ ID NO: 185160 - DNA, 22 bp, Artificial sequence
  SiRNA target sequence
ataagcgcaccatacgttatta

SEQ ID NO: 185161 - DNA, 22 bp, Artificial sequence
  SiRNA target sequence
taagcgcaccatacgttattaa

SEQ ID NO: 185162 - DNA, 22 bp, Artificial sequence
  SiRNA target sequence
aagcgcaccatacgttattaaa

SEQ ID NO: 185163 - DNA, 22 bp, Artificial sequence
  SiRNA target sequence
agcgcaccatacgttattaaat

SEQ ID NO: 185164 - DNA, 22 bp, Artificial sequence
  SiRNA target sequence
gcgcaccatacgttattaaatc

SEQ ID NO: 185165 - DNA, 22 bp, Artificial sequence
  SiRNA target sequence
cgcaccatacgttattaaatca

SEQ ID NO: 185166 - DNA, 22 bp, Artificial sequence
  SiRNA target sequence
gcaccatacgttattaaatcag

SEQ ID NO: 185167 - DNA, 22 bp, Artificial sequence
  SiRNA target sequence
caccatacgttattaaatcagc

SEQ ID NO: 185168 - DNA, 22 bp, Artificial sequence
  SiRNA target sequence
accatacgttattaaatcagca

SEQ ID NO: 185169 - DNA, 22 bp, Artificial sequence
  SiRNA target sequence
ccatacgttattaaatcagcaa

SEQ ID NO: 185170 - DNA, 22 bp, Artificial sequence
  SiRNA target sequence
catacgttattaaatcagcaat

SEQ ID NO: 185171 - DNA, 22 bp, Artificial sequence
  SiRNA target sequence
atacgttattaaatcagcaata

SEQ ID NO: 185172 - DNA, 22 bp, Artificial sequence
  SiRNA target sequence
tacgttattaaatcagcaataa

SEQ ID NO: 185173 - DNA, 22 bp, Artificial sequence
  SiRNA target sequence
acgttattaaatcagcaataaa

SEQ ID NO: 185174 - DNA, 22 bp, Artificial sequence
  SiRNA target sequence
cgttattaaatcagcaataaat

SEQ ID NO: 185175 - DNA, 22 bp, Artificial sequence
  SiRNA target sequence
gttattaaatcagcaataaata

SEQ ID NO: 185176 - DNA, 22 bp, Artificial sequence
  SiRNA target sequence
ttattaaatcagcaataaatat

SEQ ID NO: 185177 - DNA, 22 bp, Artificial sequence
  SiRNA target sequence
tattaaatcagcaataaatata

SEQ ID NO: 185178 - DNA, 22 bp, Artificial sequence
  SiRNA target sequence
attaaatcagcaataaatatat

SEQ ID NO: 185179 - DNA, 22 bp, Artificial sequence
  SiRNA target sequence
ttaaatcagcaataaatatatt

SEQ ID NO: 185180 - DNA, 22 bp, Artificial sequence
  SiRNA target sequence
taaatcagcaataaatatattt

SEQ ID NO: 185181 - DNA, 22 bp, Artificial sequence
  SiRNA target sequence
aaatcagcaataaatatatttc

SEQ ID NO: 185182 - DNA, 22 bp, Artificial sequence
  SiRNA target sequence
aatcagcaataaatatatttct

SEQ ID NO: 185183 - DNA, 22 bp, Artificial sequence
  SiRNA target sequence
atcagcaataaatatatttctt

SEQ ID NO: 185184 - DNA, 22 bp, Artificial sequence
  SiRNA target sequence
tcagcaataaatatatttcttg

SEQ ID NO: 185185 - DNA, 22 bp, Artificial sequence
  SiRNA target sequence
cagcaataaatatatttcttga

SEQ ID NO: 185186 - DNA, 22 bp, Artificial sequence
  SiRNA target sequence
agcaataaatatatttcttgat

SEQ ID NO: 185187 - DNA, 22 bp, Artificial sequence
  SiRNA target sequence
gcaataaatatatttcttgatg

SEQ ID NO: 185188 - DNA, 22 bp, Artificial sequence
  SiRNA target sequence
caataaatatatttcttgatgg

SEQ ID NO: 185189 - DNA, 22 bp, Artificial sequence
  SiRNA target sequence
aataaatatatttcttgatgga

SEQ ID NO: 185190 - DNA, 22 bp, Artificial sequence
  SiRNA target sequence
ataaatatatttcttgatggat

SEQ ID NO: 185191 - DNA, 22 bp, Artificial sequence
  SiRNA target sequence
taaatatatttcttgatggatt

SEQ ID NO: 185192 - DNA, 22 bp, Artificial sequence
  SiRNA target sequence
aaatatatttcttgatggattt

SEQ ID NO: 185193 - DNA, 22 bp, Artificial sequence
  SiRNA target sequence
aatatatttcttgatggatttt

SEQ ID NO: 185194 - DNA, 22 bp, Artificial sequence
  SiRNA target sequence
atatatttcttgatggattttt

SEQ ID NO: 185195 - DNA, 22 bp, Artificial sequence
  SiRNA target sequence
tatatttcttgatggatttttg

SEQ ID NO: 185196 - DNA, 22 bp, Artificial sequence
  SiRNA target sequence
atatttcttgatggatttttgc

SEQ ID NO: 185197 - DNA, 22 bp, Artificial sequence
  SiRNA target sequence
tatttcttgatggatttttgcc

SEQ ID NO: 185198 - DNA, 22 bp, Artificial sequence
  SiRNA target sequence
atttcttgatggatttttgcct

SEQ ID NO: 185199 - DNA, 22 bp, Artificial sequence
  SiRNA target sequence
tttcttgatggatttttgccta

SEQ ID NO: 185200 - DNA, 22 bp, Artificial sequence
  SiRNA target sequence
ttcttgatggatttttgcctac

SEQ ID NO: 185201 - DNA, 22 bp, Artificial sequence
  SiRNA target sequence
tcttgatggatttttgcctaca

SEQ ID NO: 185202 - DNA, 22 bp, Artificial sequence
  SiRNA target sequence
cttgatggatttttgcctacag

SEQ ID NO: 185203 - DNA, 22 bp, Artificial sequence
  SiRNA target sequence
ttgatggatttttgcctacaga

SEQ ID NO: 185204 - DNA, 22 bp, Artificial sequence
  SiRNA target sequence
tgatggatttttgcctacagaa

SEQ ID NO: 185205 - DNA, 22 bp, Artificial sequence
  SiRNA target sequence
gatggatttttgcctacagaaa

SEQ ID NO: 185206 - DNA, 22 bp, Artificial sequence
  SiRNA target sequence
atggatttttgcctacagaaaa

SEQ ID NO: 185207 - DNA, 22 bp, Artificial sequence
  SiRNA target sequence
tggatttttgcctacagaaaac

SEQ ID NO: 185208 - DNA, 22 bp, Artificial sequence
  SiRNA target sequence
ggatttttgcctacagaaaaca

SEQ ID NO: 185209 - DNA, 22 bp, Artificial sequence
  SiRNA target sequence
gatttttgcctacagaaaacat

SEQ ID NO: 185210 - DNA, 22 bp, Artificial sequence
  SiRNA target sequence
atttttgcctacagaaaacatg

SEQ ID NO: 185211 - DNA, 22 bp, Artificial sequence
  SiRNA target sequence
tttttgcctacagaaaacatga

SEQ ID NO: 185212 - DNA, 22 bp, Artificial sequence
  SiRNA target sequence
ttttgcctacagaaaacatgaa

SEQ ID NO: 185213 - DNA, 22 bp, Artificial sequence
  SiRNA target sequence
tttgcctacagaaaacatgaaa

SEQ ID NO: 185214 - DNA, 22 bp, Artificial sequence
  SiRNA target sequence
ttgcctacagaaaacatgaaat

SEQ ID NO: 185215 - DNA, 22 bp, Artificial sequence
  SiRNA target sequence
tgcctacagaaaacatgaaatt

SEQ ID NO: 185216 - DNA, 22 bp, Artificial sequence
  SiRNA target sequence
gcctacagaaaacatgaaattt

SEQ ID NO: 185217 - DNA, 22 bp, Artificial sequence
  SiRNA target sequence
cctacagaaaacatgaaattta

SEQ ID NO: 185218 - DNA, 22 bp, Artificial sequence
  SiRNA target sequence
ctacagaaaacatgaaatttag

SEQ ID NO: 185219 - DNA, 22 bp, Artificial sequence
  SiRNA target sequence
tacagaaaacatgaaatttaga

SEQ ID NO: 185220 - DNA, 22 bp, Artificial sequence
  SiRNA target sequence
acagaaaacatgaaatttagaa

SEQ ID NO: 185221 - DNA, 22 bp, Artificial sequence
  SiRNA target sequence
cagaaaacatgaaatttagaaa

SEQ ID NO: 185222 - DNA, 22 bp, Artificial sequence
  SiRNA target sequence
agaaaacatgaaatttagaaat

SEQ ID NO: 185223 - DNA, 22 bp, Artificial sequence
  SiRNA target sequence
gaaaacatgaaatttagaaatt

SEQ ID NO: 185224 - DNA, 22 bp, Artificial sequence
  SiRNA target sequence
aaaacatgaaatttagaaattc

SEQ ID NO: 185225 - DNA, 22 bp, Artificial sequence
  SiRNA target sequence
aaacatgaaatttagaaattca

SEQ ID NO: 185226 - DNA, 22 bp, Artificial sequence
  SiRNA target sequence
aacatgaaatttagaaattcag

SEQ ID NO: 185227 - DNA, 22 bp, Artificial sequence
  SiRNA target sequence
acatgaaatttagaaattcaga

SEQ ID NO: 185228 - DNA, 22 bp, Artificial sequence
  SiRNA target sequence
catgaaatttagaaattcagag

SEQ ID NO: 185229 - DNA, 22 bp, Artificial sequence
  SiRNA target sequence
atgaaatttagaaattcagagt

SEQ ID NO: 185230 - DNA, 22 bp, Artificial sequence
  SiRNA target sequence
tgaaatttagaaattcagagtt

SEQ ID NO: 185231 - DNA, 22 bp, Artificial sequence
  SiRNA target sequence
gaaatttagaaattcagagtta

SEQ ID NO: 185232 - DNA, 22 bp, Artificial sequence
  SiRNA target sequence
aaatttagaaattcagagttaa

SEQ ID NO: 185233 - DNA, 22 bp, Artificial sequence
  SiRNA target sequence
aatttagaaattcagagttaaa

SEQ ID NO: 185234 - DNA, 22 bp, Artificial sequence
  SiRNA target sequence
atttagaaattcagagttaaag

SEQ ID NO: 185235 - DNA, 22 bp, Artificial sequence
  SiRNA target sequence
tttagaaattcagagttaaagt

SEQ ID NO: 185236 - DNA, 22 bp, Artificial sequence
  SiRNA target sequence
ttagaaattcagagttaaagtt

SEQ ID NO: 185237 - DNA, 22 bp, Artificial sequence
  SiRNA target sequence
tagaaattcagagttaaagttt

SEQ ID NO: 185238 - DNA, 22 bp, Artificial sequence
  SiRNA target sequence
agaaattcagagttaaagttta

SEQ ID NO: 185239 - DNA, 22 bp, Artificial sequence
  SiRNA target sequence
gaaattcagagttaaagtttaa

SEQ ID NO: 185240 - DNA, 22 bp, Artificial sequence
  SiRNA target sequence
aaattcagagttaaagtttaat

SEQ ID NO: 185241 - DNA, 22 bp, Artificial sequence
  SiRNA target sequence
aattcagagttaaagtttaata

SEQ ID NO: 185242 - DNA, 22 bp, Artificial sequence
  SiRNA target sequence
attcagagttaaagtttaatat

SEQ ID NO: 185243 - DNA, 22 bp, Artificial sequence
  SiRNA target sequence
ttcagagttaaagtttaatatt

SEQ ID NO: 185244 - DNA, 22 bp, Artificial sequence
  SiRNA target sequence
tcagagttaaagtttaatattt

SEQ ID NO: 185245 - DNA, 22 bp, Artificial sequence
  SiRNA target sequence
cagagttaaagtttaatatttc

SEQ ID NO: 185246 - DNA, 22 bp, Artificial sequence
  SiRNA target sequence
agagttaaagtttaatatttcg

SEQ ID NO: 185247 - DNA, 22 bp, Artificial sequence
  SiRNA target sequence
gagttaaagtttaatatttcgg

SEQ ID NO: 185248 - DNA, 22 bp, Artificial sequence
  SiRNA target sequence
agttaaagtttaatatttcgga

SEQ ID NO: 185249 - DNA, 22 bp, Artificial sequence
  SiRNA target sequence
gttaaagtttaatatttcggaa

SEQ ID NO: 185250 - DNA, 22 bp, Artificial sequence
  SiRNA target sequence
ttaaagtttaatatttcggaaa

SEQ ID NO: 185251 - DNA, 22 bp, Artificial sequence
  SiRNA target sequence
taaagtttaatatttcggaaac

SEQ ID NO: 185252 - DNA, 22 bp, Artificial sequence
  SiRNA target sequence
aaagtttaatatttcggaaaca

SEQ ID NO: 185253 - DNA, 22 bp, Artificial sequence
  SiRNA target sequence
aagtttaatatttcggaaacac

SEQ ID NO: 185254 - DNA, 22 bp, Artificial sequence
  SiRNA target sequence
agtttaatatttcggaaacact

SEQ ID NO: 185255 - DNA, 22 bp, Artificial sequence
  SiRNA target sequence
gtttaatatttcggaaacactt

SEQ ID NO: 185256 - DNA, 22 bp, Artificial sequence
  SiRNA target sequence
tttaatatttcggaaacacttg

SEQ ID NO: 185257 - DNA, 22 bp, Artificial sequence
  SiRNA target sequence
ttaatatttcggaaacacttga

SEQ ID NO: 185258 - DNA, 22 bp, Artificial sequence
  SiRNA target sequence
taatatttcggaaacacttgat

SEQ ID NO: 185259 - DNA, 22 bp, Artificial sequence
  SiRNA target sequence
aatatttcggaaacacttgata

SEQ ID NO: 185260 - DNA, 22 bp, Artificial sequence
  SiRNA target sequence
atatttcggaaacacttgatag

SEQ ID NO: 185261 - DNA, 22 bp, Artificial sequence
  SiRNA target sequence
tatttcggaaacacttgatagt

SEQ ID NO: 185262 - DNA, 22 bp, Artificial sequence
  SiRNA target sequence
atttcggaaacacttgatagta

SEQ ID NO: 185263 - DNA, 22 bp, Artificial sequence
  SiRNA target sequence
tttcggaaacacttgatagtat

SEQ ID NO: 185264 - DNA, 22 bp, Artificial sequence
  SiRNA target sequence
ttcggaaacacttgatagtatt

SEQ ID NO: 185265 - DNA, 22 bp, Artificial sequence
  SiRNA target sequence
tcggaaacacttgatagtatta

SEQ ID NO: 185266 - DNA, 22 bp, Artificial sequence
  SiRNA target sequence
cggaaacacttgatagtattat

SEQ ID NO: 185267 - DNA, 22 bp, Artificial sequence
  SiRNA target sequence
ggaaacacttgatagtattata

SEQ ID NO: 185268 - DNA, 22 bp, Artificial sequence
  SiRNA target sequence
gaaacacttgatagtattatat

SEQ ID NO: 185269 - DNA, 22 bp, Artificial sequence
  SiRNA target sequence
aaacacttgatagtattatatc

SEQ ID NO: 185270 - DNA, 22 bp, Artificial sequence
  SiRNA target sequence
aacacttgatagtattatatct

SEQ ID NO: 185271 - DNA, 22 bp, Artificial sequence
  SiRNA target sequence
acacttgatagtattatatcta

SEQ ID NO: 185272 - DNA, 22 bp, Artificial sequence
  SiRNA target sequence
cacttgatagtattatatctac

SEQ ID NO: 185273 - DNA, 22 bp, Artificial sequence
  SiRNA target sequence
acttgatagtattatatctacc

SEQ ID NO: 185274 - DNA, 22 bp, Artificial sequence
  SiRNA target sequence
cttgatagtattatatctacca

SEQ ID NO: 185275 - DNA, 22 bp, Artificial sequence
  SiRNA target sequence
ttgatagtattatatctaccag

SEQ ID NO: 185276 - DNA, 22 bp, Artificial sequence
  SiRNA target sequence
tgatagtattatatctaccaga

SEQ ID NO: 185277 - DNA, 22 bp, Artificial sequence
  SiRNA target sequence
gatagtattatatctaccagag

SEQ ID NO: 185278 - DNA, 22 bp, Artificial sequence
  SiRNA target sequence
atagtattatatctaccagaga

SEQ ID NO: 185279 - DNA, 22 bp, Artificial sequence
  SiRNA target sequence
tagtattatatctaccagagac

SEQ ID NO: 185280 - DNA, 22 bp, Artificial sequence
  SiRNA target sequence
agtattatatctaccagagacc

SEQ ID NO: 185281 - DNA, 22 bp, Artificial sequence
  SiRNA target sequence
gtattatatctaccagagacca

SEQ ID NO: 185282 - DNA, 22 bp, Artificial sequence
  SiRNA target sequence
tattatatctaccagagaccag

SEQ ID NO: 185283 - DNA, 22 bp, Artificial sequence
  SiRNA target sequence
attatatctaccagagaccagt

SEQ ID NO: 185284 - DNA, 22 bp, Artificial sequence
  SiRNA target sequence
ttatatctaccagagaccagta

SEQ ID NO: 185285 - DNA, 22 bp, Artificial sequence
  SiRNA target sequence
tatatctaccagagaccagtat

SEQ ID NO: 185286 - DNA, 22 bp, Artificial sequence
  SiRNA target sequence
atatctaccagagaccagtatc

SEQ ID NO: 185287 - DNA, 22 bp, Artificial sequence
  SiRNA target sequence
tatctaccagagaccagtatca

SEQ ID NO: 185288 - DNA, 22 bp, Artificial sequence
  SiRNA target sequence
atctaccagagaccagtatcat

SEQ ID NO: 185289 - DNA, 22 bp, Artificial sequence
  SiRNA target sequence
tctaccagagaccagtatcatt

SEQ ID NO: 185290 - DNA, 22 bp, Artificial sequence
  SiRNA target sequence
ctaccagagaccagtatcatta

SEQ ID NO: 185291 - DNA, 22 bp, Artificial sequence
  SiRNA target sequence
taccagagaccagtatcattat

SEQ ID NO: 185292 - DNA, 22 bp, Artificial sequence
  SiRNA target sequence
accagagaccagtatcattatc

SEQ ID NO: 185293 - DNA, 22 bp, Artificial sequence
  SiRNA target sequence
ccagagaccagtatcattatcc

SEQ ID NO: 185294 - DNA, 22 bp, Artificial sequence
  SiRNA target sequence
cagagaccagtatcattatccc

SEQ ID NO: 185295 - DNA, 22 bp, Artificial sequence
  SiRNA target sequence
agagaccagtatcattatccca

SEQ ID NO: 185296 - DNA, 22 bp, Artificial sequence
  SiRNA target sequence
gagaccagtatcattatcccaa

SEQ ID NO: 185297 - DNA, 22 bp, Artificial sequence
  SiRNA target sequence
agaccagtatcattatcccaat

SEQ ID NO: 185298 - DNA, 22 bp, Artificial sequence
  SiRNA target sequence
gaccagtatcattatcccaatt

SEQ ID NO: 185299 - DNA, 22 bp, Artificial sequence
  SiRNA target sequence
accagtatcattatcccaattt

SEQ ID NO: 185300 - DNA, 22 bp, Artificial sequence
  SiRNA target sequence
ccagtatcattatcccaatttg

SEQ ID NO: 185301 - DNA, 22 bp, Artificial sequence
  SiRNA target sequence
cagtatcattatcccaatttga

SEQ ID NO: 185302 - DNA, 22 bp, Artificial sequence
  SiRNA target sequence
agtatcattatcccaatttgat

SEQ ID NO: 185303 - DNA, 22 bp, Artificial sequence
  SiRNA target sequence
gtatcattatcccaatttgata

SEQ ID NO: 185304 - DNA, 22 bp, Artificial sequence
  SiRNA target sequence
tatcattatcccaatttgataa

SEQ ID NO: 185305 - DNA, 22 bp, Artificial sequence
  SiRNA target sequence
atcattatcccaatttgataaa

SEQ ID NO: 185306 - DNA, 22 bp, Artificial sequence
  SiRNA target sequence
tcattatcccaatttgataaaa

SEQ ID NO: 185307 - DNA, 22 bp, Artificial sequence
  SiRNA target sequence
cattatcccaatttgataaaaa

SEQ ID NO: 185308 - DNA, 22 bp, Artificial sequence
  SiRNA target sequence
attatcccaatttgataaaaac

SEQ ID NO: 185309 - DNA, 22 bp, Artificial sequence
  SiRNA target sequence
ttatcccaatttgataaaaaca

SEQ ID NO: 185310 - DNA, 22 bp, Artificial sequence
  SiRNA target sequence
tatcccaatttgataaaaacat

SEQ ID NO: 185311 - DNA, 22 bp, Artificial sequence
  SiRNA target sequence
atcccaatttgataaaaacata

SEQ ID NO: 185312 - DNA, 22 bp, Artificial sequence
  SiRNA target sequence
tcccaatttgataaaaacatat

SEQ ID NO: 185313 - DNA, 22 bp, Artificial sequence
  SiRNA target sequence
cccaatttgataaaaacatatc

SEQ ID NO: 185314 - DNA, 22 bp, Artificial sequence
  SiRNA target sequence
ccaatttgataaaaacatatcc

SEQ ID NO: 185315 - DNA, 22 bp, Artificial sequence
  SiRNA target sequence
caatttgataaaaacatatcca

SEQ ID NO: 185316 - DNA, 22 bp, Artificial sequence
  SiRNA target sequence
aatttgataaaaacatatccaa

SEQ ID NO: 185317 - DNA, 22 bp, Artificial sequence
  SiRNA target sequence
atttgataaaaacatatccaaa

SEQ ID NO: 185318 - DNA, 22 bp, Artificial sequence
  SiRNA target sequence
tttgataaaaacatatccaaat

SEQ ID NO: 185319 - DNA, 22 bp, Artificial sequence
  SiRNA target sequence
ttgataaaaacatatccaaatt

SEQ ID NO: 185320 - DNA, 22 bp, Artificial sequence
  SiRNA target sequence
tgataaaaacatatccaaattt

SEQ ID NO: 185321 - DNA, 22 bp, Artificial sequence
  SiRNA target sequence
gataaaaacatatccaaatttt

SEQ ID NO: 185322 - DNA, 22 bp, Artificial sequence
  SiRNA target sequence
ataaaaacatatccaaatttta

SEQ ID NO: 185323 - DNA, 22 bp, Artificial sequence
  SiRNA target sequence
taaaaacatatccaaattttac

SEQ ID NO: 185324 - DNA, 22 bp, Artificial sequence
  SiRNA target sequence
aaaaacatatccaaattttacg

SEQ ID NO: 185325 - DNA, 22 bp, Artificial sequence
  SiRNA target sequence
aaaacatatccaaattttacgc

SEQ ID NO: 185326 - DNA, 22 bp, Artificial sequence
  SiRNA target sequence
aaacatatccaaattttacgct

SEQ ID NO: 185327 - DNA, 22 bp, Artificial sequence
  SiRNA target sequence
aacatatccaaattttacgctt

SEQ ID NO: 185328 - DNA, 22 bp, Artificial sequence
  SiRNA target sequence
acatatccaaattttacgctta

SEQ ID NO: 185329 - DNA, 22 bp, Artificial sequence
  SiRNA target sequence
catatccaaattttacgcttaa

SEQ ID NO: 185330 - DNA, 22 bp, Artificial sequence
  SiRNA target sequence
atatccaaattttacgcttaaa

SEQ ID NO: 185331 - DNA, 22 bp, Artificial sequence
  SiRNA target sequence
tatccaaattttacgcttaaag

SEQ ID NO: 185332 - DNA, 22 bp, Artificial sequence
  SiRNA target sequence
atccaaattttacgcttaaagt

SEQ ID NO: 185333 - DNA, 22 bp, Artificial sequence
  SiRNA target sequence
tccaaattttacgcttaaagtt

SEQ ID NO: 185334 - DNA, 22 bp, Artificial sequence
  SiRNA target sequence
ccaaattttacgcttaaagttg

SEQ ID NO: 185335 - DNA, 22 bp, Artificial sequence
  SiRNA target sequence
caaattttacgcttaaagttga

SEQ ID NO: 185336 - DNA, 22 bp, Artificial sequence
  SiRNA target sequence
aaattttacgcttaaagttgaa

SEQ ID NO: 185337 - DNA, 22 bp, Artificial sequence
  SiRNA target sequence
aattttacgcttaaagttgaag

SEQ ID NO: 185338 - DNA, 22 bp, Artificial sequence
  SiRNA target sequence
attttacgcttaaagttgaagg

SEQ ID NO: 185339 - DNA, 22 bp, Artificial sequence
  SiRNA target sequence
ttttacgcttaaagttgaaggc

SEQ ID NO: 185340 - DNA, 22 bp, Artificial sequence
  SiRNA target sequence
tttacgcttaaagttgaaggcg

SEQ ID NO: 185341 - DNA, 22 bp, Artificial sequence
  SiRNA target sequence
ttacgcttaaagttgaaggcgg

SEQ ID NO: 185342 - DNA, 22 bp, Artificial sequence
  SiRNA target sequence
tacgcttaaagttgaaggcggt

SEQ ID NO: 185343 - DNA, 22 bp, Artificial sequence
  SiRNA target sequence
acgcttaaagttgaaggcggta

SEQ ID NO: 185344 - DNA, 22 bp, Artificial sequence
  SiRNA target sequence
cgcttaaagttgaaggcggtaa

SEQ ID NO: 185345 - DNA, 22 bp, Artificial sequence
  SiRNA target sequence
gcttaaagttgaaggcggtaac

SEQ ID NO: 185346 - DNA, 22 bp, Artificial sequence
  SiRNA target sequence
cttaaagttgaaggcggtaact

SEQ ID NO: 185347 - DNA, 22 bp, Artificial sequence
  SiRNA target sequence
ttaaagttgaaggcggtaactt

SEQ ID NO: 185348 - DNA, 22 bp, Artificial sequence
  SiRNA target sequence
taaagttgaaggcggtaacttt

SEQ ID NO: 185349 - DNA, 22 bp, Artificial sequence
  SiRNA target sequence
aaagttgaaggcggtaactttt

SEQ ID NO: 185350 - DNA, 22 bp, Artificial sequence
  SiRNA target sequence
aagttgaaggcggtaacttttc

SEQ ID NO: 185351 - DNA, 22 bp, Artificial sequence
  SiRNA target sequence
agttgaaggcggtaacttttca

SEQ ID NO: 185352 - DNA, 22 bp, Artificial sequence
  SiRNA target sequence
gttgaaggcggtaacttttcag

SEQ ID NO: 185353 - DNA, 22 bp, Artificial sequence
  SiRNA target sequence
ttgaaggcggtaacttttcaga

SEQ ID NO: 185354 - DNA, 22 bp, Artificial sequence
  SiRNA target sequence
tgaaggcggtaacttttcagat

SEQ ID NO: 185355 - DNA, 22 bp, Artificial sequence
  SiRNA target sequence
gaaggcggtaacttttcagatt

SEQ ID NO: 185356 - DNA, 22 bp, Artificial sequence
  SiRNA target sequence
aaggcggtaacttttcagattc

SEQ ID NO: 185357 - DNA, 22 bp, Artificial sequence
  SiRNA target sequence
aggcggtaacttttcagattct

SEQ ID NO: 185358 - DNA, 22 bp, Artificial sequence
  SiRNA target sequence
ggcggtaacttttcagattctg

SEQ ID NO: 185359 - DNA, 22 bp, Artificial sequence
  SiRNA target sequence
gcggtaacttttcagattctga

SEQ ID NO: 185360 - DNA, 22 bp, Artificial sequence
  SiRNA target sequence
cggtaacttttcagattctgaa

SEQ ID NO: 185361 - DNA, 22 bp, Artificial sequence
  SiRNA target sequence
ggtaacttttcagattctgaaa

SEQ ID NO: 185362 - DNA, 22 bp, Artificial sequence
  SiRNA target sequence
gtaacttttcagattctgaaat

SEQ ID NO: 185363 - DNA, 22 bp, Artificial sequence
  SiRNA target sequence
taacttttcagattctgaaatt

SEQ ID NO: 185364 - DNA, 22 bp, Artificial sequence
  SiRNA target sequence
aacttttcagattctgaaattg

SEQ ID NO: 185365 - DNA, 22 bp, Artificial sequence
  SiRNA target sequence
acttttcagattctgaaattgt

SEQ ID NO: 185366 - DNA, 22 bp, Artificial sequence
  SiRNA target sequence
cttttcagattctgaaattgtt

SEQ ID NO: 185367 - DNA, 22 bp, Artificial sequence
  SiRNA target sequence
ttttcagattctgaaattgttg

SEQ ID NO: 185368 - DNA, 22 bp, Artificial sequence
  SiRNA target sequence
tttcagattctgaaattgttgt

SEQ ID NO: 185369 - DNA, 22 bp, Artificial sequence
  SiRNA target sequence
ttcagattctgaaattgttgta

SEQ ID NO: 185370 - DNA, 22 bp, Artificial sequence
  SiRNA target sequence
tcagattctgaaattgttgtat

SEQ ID NO: 185371 - DNA, 22 bp, Artificial sequence
  SiRNA target sequence
cagattctgaaattgttgtatt

SEQ ID NO: 185372 - DNA, 22 bp, Artificial sequence
  SiRNA target sequence
agattctgaaattgttgtattt

SEQ ID NO: 185373 - DNA, 22 bp, Artificial sequence
  SiRNA target sequence
gattctgaaattgttgtatttc

SEQ ID NO: 185374 - DNA, 22 bp, Artificial sequence
  SiRNA target sequence
attctgaaattgttgtatttct

SEQ ID NO: 185375 - DNA, 22 bp, Artificial sequence
  SiRNA target sequence
ttctgaaattgttgtatttctt

SEQ ID NO: 185376 - DNA, 22 bp, Artificial sequence
  SiRNA target sequence
tctgaaattgttgtatttcttg

SEQ ID NO: 185377 - DNA, 22 bp, Artificial sequence
  SiRNA target sequence
ctgaaattgttgtatttcttgg

SEQ ID NO: 185378 - DNA, 22 bp, Artificial sequence
  SiRNA target sequence
tgaaattgttgtatttcttggt

SEQ ID NO: 185379 - DNA, 22 bp, Artificial sequence
  SiRNA target sequence
gaaattgttgtatttcttggtg

SEQ ID NO: 185380 - DNA, 22 bp, Artificial sequence
  SiRNA target sequence
aaattgttgtatttcttggtga

SEQ ID NO: 185381 - DNA, 22 bp, Artificial sequence
  SiRNA target sequence
aattgttgtatttcttggtgaa

SEQ ID NO: 185382 - DNA, 22 bp, Artificial sequence
  SiRNA target sequence
attgttgtatttcttggtgaaa

SEQ ID NO: 185383 - DNA, 22 bp, Artificial sequence
  SiRNA target sequence
ttgttgtatttcttggtgaaaa

SEQ ID NO: 185384 - DNA, 22 bp, Artificial sequence
  SiRNA target sequence
tgttgtatttcttggtgaaaat

SEQ ID NO: 185385 - DNA, 22 bp, Artificial sequence
  SiRNA target sequence
gttgtatttcttggtgaaaatg

SEQ ID NO: 185386 - DNA, 22 bp, Artificial sequence
  SiRNA target sequence
ttgtatttcttggtgaaaatgg

SEQ ID NO: 185387 - DNA, 22 bp, Artificial sequence
  SiRNA target sequence
tgtatttcttggtgaaaatgga

SEQ ID NO: 185388 - DNA, 22 bp, Artificial sequence
  SiRNA target sequence
gtatttcttggtgaaaatggaa

SEQ ID NO: 185389 - DNA, 22 bp, Artificial sequence
  SiRNA target sequence
tatttcttggtgaaaatggaat

SEQ ID NO: 185390 - DNA, 22 bp, Artificial sequence
  SiRNA target sequence
atttcttggtgaaaatggaatg

SEQ ID NO: 185391 - DNA, 22 bp, Artificial sequence
  SiRNA target sequence
tttcttggtgaaaatggaatgg

SEQ ID NO: 185392 - DNA, 22 bp, Artificial sequence
  SiRNA target sequence
ttcttggtgaaaatggaatggg

SEQ ID NO: 185393 - DNA, 22 bp, Artificial sequence
  SiRNA target sequence
tcttggtgaaaatggaatgggc

SEQ ID NO: 185394 - DNA, 22 bp, Artificial sequence
  SiRNA target sequence
cttggtgaaaatggaatgggca

SEQ ID NO: 185395 - DNA, 22 bp, Artificial sequence
  SiRNA target sequence
ttggtgaaaatggaatgggcaa

SEQ ID NO: 185396 - DNA, 22 bp, Artificial sequence
  SiRNA target sequence
tggtgaaaatggaatgggcaaa

SEQ ID NO: 185397 - DNA, 22 bp, Artificial sequence
  SiRNA target sequence
ggtgaaaatggaatgggcaaaa

SEQ ID NO: 185398 - DNA, 22 bp, Artificial sequence
  SiRNA target sequence
gtgaaaatggaatgggcaaaac

SEQ ID NO: 185399 - DNA, 22 bp, Artificial sequence
  SiRNA target sequence
tgaaaatggaatgggcaaaact

SEQ ID NO: 185400 - DNA, 22 bp, Artificial sequence
  SiRNA target sequence
gaaaatggaatgggcaaaacta

SEQ ID NO: 185401 - DNA, 22 bp, Artificial sequence
  SiRNA target sequence
aaaatggaatgggcaaaactac

SEQ ID NO: 185402 - DNA, 22 bp, Artificial sequence
  SiRNA target sequence
aaatggaatgggcaaaactact

SEQ ID NO: 185403 - DNA, 22 bp, Artificial sequence
  SiRNA target sequence
aatggaatgggcaaaactactt

SEQ ID NO: 185404 - DNA, 22 bp, Artificial sequence
  SiRNA target sequence
atggaatgggcaaaactacttt

SEQ ID NO: 185405 - DNA, 22 bp, Artificial sequence
  SiRNA target sequence
tggaatgggcaaaactacttta

SEQ ID NO: 185406 - DNA, 22 bp, Artificial sequence
  SiRNA target sequence
ggaatgggcaaaactactttag

SEQ ID NO: 185407 - DNA, 22 bp, Artificial sequence
  SiRNA target sequence
gaatgggcaaaactactttagt

SEQ ID NO: 185408 - DNA, 22 bp, Artificial sequence
  SiRNA target sequence
aatgggcaaaactactttagta

SEQ ID NO: 185409 - DNA, 22 bp, Artificial sequence
  SiRNA target sequence
atgggcaaaactactttagtag

SEQ ID NO: 185410 - DNA, 22 bp, Artificial sequence
  SiRNA target sequence
tgggcaaaactactttagtagg

SEQ ID NO: 185411 - DNA, 22 bp, Artificial sequence
  SiRNA target sequence
gggcaaaactactttagtaggt

SEQ ID NO: 185412 - DNA, 22 bp, Artificial sequence
  SiRNA target sequence
ggcaaaactactttagtaggtt

SEQ ID NO: 185413 - DNA, 22 bp, Artificial sequence
  SiRNA target sequence
gcaaaactactttagtaggttt

SEQ ID NO: 185414 - DNA, 22 bp, Artificial sequence
  SiRNA target sequence
caaaactactttagtaggtttg

SEQ ID NO: 185415 - DNA, 22 bp, Artificial sequence
  SiRNA target sequence
aaaactactttagtaggtttga

SEQ ID NO: 185416 - DNA, 22 bp, Artificial sequence
  SiRNA target sequence
aaactactttagtaggtttgat

SEQ ID NO: 185417 - DNA, 22 bp, Artificial sequence
  SiRNA target sequence
aactactttagtaggtttgatt

SEQ ID NO: 185418 - DNA, 22 bp, Artificial sequence
  SiRNA target sequence
actactttagtaggtttgattt

SEQ ID NO: 185419 - DNA, 22 bp, Artificial sequence
  SiRNA target sequence
ctactttagtaggtttgatttc

SEQ ID NO: 185420 - DNA, 22 bp, Artificial sequence
  SiRNA target sequence
tactttagtaggtttgatttcg

SEQ ID NO: 185421 - DNA, 22 bp, Artificial sequence
  SiRNA target sequence
actttagtaggtttgatttcgg

SEQ ID NO: 185422 - DNA, 22 bp, Artificial sequence
  SiRNA target sequence
ctttagtaggtttgatttcggg

SEQ ID NO: 185423 - DNA, 22 bp, Artificial sequence
  SiRNA target sequence
tttagtaggtttgatttcgggg

SEQ ID NO: 185424 - DNA, 22 bp, Artificial sequence
  SiRNA target sequence
ttagtaggtttgatttcggggt

SEQ ID NO: 185425 - DNA, 22 bp, Artificial sequence
  SiRNA target sequence
tagtaggtttgatttcggggtt

SEQ ID NO: 185426 - DNA, 22 bp, Artificial sequence
  SiRNA target sequence
agtaggtttgatttcggggtta

SEQ ID NO: 185427 - DNA, 22 bp, Artificial sequence
  SiRNA target sequence
gtaggtttgatttcggggttaa

SEQ ID NO: 185428 - DNA, 22 bp, Artificial sequence
  SiRNA target sequence
taggtttgatttcggggttaat

SEQ ID NO: 185429 - DNA, 22 bp, Artificial sequence
  SiRNA target sequence
aggtttgatttcggggttaatt

SEQ ID NO: 185430 - DNA, 22 bp, Artificial sequence
  SiRNA target sequence
ggtttgatttcggggttaatta

SEQ ID NO: 185431 - DNA, 22 bp, Artificial sequence
  SiRNA target sequence
gtttgatttcggggttaattaa

SEQ ID NO: 185432 - DNA, 22 bp, Artificial sequence
  SiRNA target sequence
tttgatttcggggttaattaaa

SEQ ID NO: 185433 - DNA, 22 bp, Artificial sequence
  SiRNA target sequence
ttgatttcggggttaattaaag

SEQ ID NO: 185434 - DNA, 22 bp, Artificial sequence
  SiRNA target sequence
tgatttcggggttaattaaaga

SEQ ID NO: 185435 - DNA, 22 bp, Artificial sequence
  SiRNA target sequence
gatttcggggttaattaaagat

SEQ ID NO: 185436 - DNA, 22 bp, Artificial sequence
  SiRNA target sequence
atttcggggttaattaaagatg

SEQ ID NO: 185437 - DNA, 22 bp, Artificial sequence
  SiRNA target sequence
tttcggggttaattaaagatga

SEQ ID NO: 185438 - DNA, 22 bp, Artificial sequence
  SiRNA target sequence
ttcggggttaattaaagatgat

SEQ ID NO: 185439 - DNA, 22 bp, Artificial sequence
  SiRNA target sequence
tcggggttaattaaagatgata

SEQ ID NO: 185440 - DNA, 22 bp, Artificial sequence
  SiRNA target sequence
cggggttaattaaagatgataa

SEQ ID NO: 185441 - DNA, 22 bp, Artificial sequence
  SiRNA target sequence
ggggttaattaaagatgataac

SEQ ID NO: 185442 - DNA, 22 bp, Artificial sequence
  SiRNA target sequence
gggttaattaaagatgataacg

SEQ ID NO: 185443 - DNA, 22 bp, Artificial sequence
  SiRNA target sequence
ggttaattaaagatgataacgg

SEQ ID NO: 185444 - DNA, 22 bp, Artificial sequence
  SiRNA target sequence
gttaattaaagatgataacggg

SEQ ID NO: 185445 - DNA, 22 bp, Artificial sequence
  SiRNA target sequence
ttaattaaagatgataacgggg

SEQ ID NO: 185446 - DNA, 22 bp, Artificial sequence
  SiRNA target sequence
taattaaagatgataacgggga

SEQ ID NO: 185447 - DNA, 22 bp, Artificial sequence
  SiRNA target sequence
aattaaagatgataacggggaa

SEQ ID NO: 185448 - DNA, 22 bp, Artificial sequence
  SiRNA target sequence
attaaagatgataacggggaag

SEQ ID NO: 185449 - DNA, 22 bp, Artificial sequence
  SiRNA target sequence
ttaaagatgataacggggaaga

SEQ ID NO: 185450 - DNA, 22 bp, Artificial sequence
  SiRNA target sequence
taaagatgataacggggaagag

SEQ ID NO: 185451 - DNA, 22 bp, Artificial sequence
  SiRNA target sequence
aaagatgataacggggaagagt

SEQ ID NO: 185452 - DNA, 22 bp, Artificial sequence
  SiRNA target sequence
aagatgataacggggaagagtt

SEQ ID NO: 185453 - DNA, 22 bp, Artificial sequence
  SiRNA target sequence
agatgataacggggaagagttc

SEQ ID NO: 185454 - DNA, 22 bp, Artificial sequence
  SiRNA target sequence
gatgataacggggaagagttcg

SEQ ID NO: 185455 - DNA, 22 bp, Artificial sequence
  SiRNA target sequence
atgataacggggaagagttcgg

SEQ ID NO: 185456 - DNA, 22 bp, Artificial sequence
  SiRNA target sequence
tgataacggggaagagttcggt

SEQ ID NO: 185457 - DNA, 22 bp, Artificial sequence
  SiRNA target sequence
gataacggggaagagttcggtt

SEQ ID NO: 185458 - DNA, 22 bp, Artificial sequence
  SiRNA target sequence
ataacggggaagagttcggttt

SEQ ID NO: 185459 - DNA, 22 bp, Artificial sequence
  SiRNA target sequence
taacggggaagagttcggtttg

SEQ ID NO: 185460 - DNA, 22 bp, Artificial sequence
  SiRNA target sequence
aacggggaagagttcggtttgt

SEQ ID NO: 185461 - DNA, 22 bp, Artificial sequence
  SiRNA target sequence
acggggaagagttcggtttgtt

SEQ ID NO: 185462 - DNA, 22 bp, Artificial sequence
  SiRNA target sequence
cggggaagagttcggtttgttg

SEQ ID NO: 185463 - DNA, 22 bp, Artificial sequence
  SiRNA target sequence
ggggaagagttcggtttgttgt

SEQ ID NO: 185464 - DNA, 22 bp, Artificial sequence
  SiRNA target sequence
gggaagagttcggtttgttgtc

SEQ ID NO: 185465 - DNA, 22 bp, Artificial sequence
  SiRNA target sequence
ggaagagttcggtttgttgtca

SEQ ID NO: 185466 - DNA, 22 bp, Artificial sequence
  SiRNA target sequence
gaagagttcggtttgttgtcat

SEQ ID NO: 185467 - DNA, 22 bp, Artificial sequence
  SiRNA target sequence
aagagttcggtttgttgtcata

SEQ ID NO: 185468 - DNA, 22 bp, Artificial sequence
  SiRNA target sequence
agagttcggtttgttgtcatat

SEQ ID NO: 185469 - DNA, 22 bp, Artificial sequence
  SiRNA target sequence
gagttcggtttgttgtcatata

SEQ ID NO: 185470 - DNA, 22 bp, Artificial sequence
  SiRNA target sequence
agttcggtttgttgtcatatag

SEQ ID NO: 185471 - DNA, 22 bp, Artificial sequence
  SiRNA target sequence
gttcggtttgttgtcatatagt

SEQ ID NO: 185472 - DNA, 22 bp, Artificial sequence
  SiRNA target sequence
ttcggtttgttgtcatatagtc

SEQ ID NO: 185473 - DNA, 22 bp, Artificial sequence
  SiRNA target sequence
tcggtttgttgtcatatagtct

SEQ ID NO: 185474 - DNA, 22 bp, Artificial sequence
  SiRNA target sequence
cggtttgttgtcatatagtctt

SEQ ID NO: 185475 - DNA, 22 bp, Artificial sequence
  SiRNA target sequence
ggtttgttgtcatatagtctta

SEQ ID NO: 185476 - DNA, 22 bp, Artificial sequence
  SiRNA target sequence
gtttgttgtcatatagtcttaa

SEQ ID NO: 185477 - DNA, 22 bp, Artificial sequence
  SiRNA target sequence
tttgttgtcatatagtcttaaa

SEQ ID NO: 185478 - DNA, 22 bp, Artificial sequence
  SiRNA target sequence
ttgttgtcatatagtcttaaac

SEQ ID NO: 185479 - DNA, 22 bp, Artificial sequence
  SiRNA target sequence
tgttgtcatatagtcttaaacc

SEQ ID NO: 185480 - DNA, 22 bp, Artificial sequence
  SiRNA target sequence
gttgtcatatagtcttaaaccg

SEQ ID NO: 185481 - DNA, 22 bp, Artificial sequence
  SiRNA target sequence
ttgtcatatagtcttaaaccgc

SEQ ID NO: 185482 - DNA, 22 bp, Artificial sequence
  SiRNA target sequence
tgtcatatagtcttaaaccgca

SEQ ID NO: 185483 - DNA, 22 bp, Artificial sequence
  SiRNA target sequence
gtcatatagtcttaaaccgcaa

SEQ ID NO: 185484 - DNA, 22 bp, Artificial sequence
  SiRNA target sequence
tcatatagtcttaaaccgcaaa

SEQ ID NO: 185485 - DNA, 22 bp, Artificial sequence
  SiRNA target sequence
catatagtcttaaaccgcaaaa

SEQ ID NO: 185486 - DNA, 22 bp, Artificial sequence
  SiRNA target sequence
atatagtcttaaaccgcaaaaa

SEQ ID NO: 185487 - DNA, 22 bp, Artificial sequence
  SiRNA target sequence
tatagtcttaaaccgcaaaaaa

SEQ ID NO: 185488 - DNA, 22 bp, Artificial sequence
  SiRNA target sequence
atagtcttaaaccgcaaaaaat

SEQ ID NO: 185489 - DNA, 22 bp, Artificial sequence
  SiRNA target sequence
tagtcttaaaccgcaaaaaatc

SEQ ID NO: 185490 - DNA, 22 bp, Artificial sequence
  SiRNA target sequence
agtcttaaaccgcaaaaaatca

SEQ ID NO: 185491 - DNA, 22 bp, Artificial sequence
  SiRNA target sequence
gtcttaaaccgcaaaaaatcat

SEQ ID NO: 185492 - DNA, 22 bp, Artificial sequence
  SiRNA target sequence
tcttaaaccgcaaaaaatcata

SEQ ID NO: 185493 - DNA, 22 bp, Artificial sequence
  SiRNA target sequence
cttaaaccgcaaaaaatcatac

SEQ ID NO: 185494 - DNA, 22 bp, Artificial sequence
  SiRNA target sequence
ttaaaccgcaaaaaatcatacc

SEQ ID NO: 185495 - DNA, 22 bp, Artificial sequence
  SiRNA target sequence
taaaccgcaaaaaatcataccg

SEQ ID NO: 185496 - DNA, 22 bp, Artificial sequence
  SiRNA target sequence
aaaccgcaaaaaatcataccga

SEQ ID NO: 185497 - DNA, 22 bp, Artificial sequence
  SiRNA target sequence
aaccgcaaaaaatcataccgaa

SEQ ID NO: 185498 - DNA, 22 bp, Artificial sequence
  SiRNA target sequence
accgcaaaaaatcataccgaaa

SEQ ID NO: 185499 - DNA, 22 bp, Artificial sequence
  SiRNA target sequence
ccgcaaaaaatcataccgaaat

SEQ ID NO: 185500 - DNA, 22 bp, Artificial sequence
  SiRNA target sequence
cgcaaaaaatcataccgaaata

SEQ ID NO: 185501 - DNA, 22 bp, Artificial sequence
  SiRNA target sequence
gcaaaaaatcataccgaaatac

SEQ ID NO: 185502 - DNA, 22 bp, Artificial sequence
  SiRNA target sequence
caaaaaatcataccgaaataca

SEQ ID NO: 185503 - DNA, 22 bp, Artificial sequence
  SiRNA target sequence
aaaaaatcataccgaaatacaa

SEQ ID NO: 185504 - DNA, 22 bp, Artificial sequence
  SiRNA target sequence
aaaaatcataccgaaatacaaa

SEQ ID NO: 185505 - DNA, 22 bp, Artificial sequence
  SiRNA target sequence
aaaatcataccgaaatacaaag

SEQ ID NO: 185506 - DNA, 22 bp, Artificial sequence
  SiRNA target sequence
aaatcataccgaaatacaaagg

SEQ ID NO: 185507 - DNA, 22 bp, Artificial sequence
  SiRNA target sequence
aatcataccgaaatacaaagga

SEQ ID NO: 185508 - DNA, 22 bp, Artificial sequence
  SiRNA target sequence
atcataccgaaatacaaaggaa

SEQ ID NO: 185509 - DNA, 22 bp, Artificial sequence
  SiRNA target sequence
tcataccgaaatacaaaggaac

SEQ ID NO: 185510 - DNA, 22 bp, Artificial sequence
  SiRNA target sequence
cataccgaaatacaaaggaaca

SEQ ID NO: 185511 - DNA, 22 bp, Artificial sequence
  SiRNA target sequence
ataccgaaatacaaaggaacag

SEQ ID NO: 185512 - DNA, 22 bp, Artificial sequence
  SiRNA target sequence
taccgaaatacaaaggaacagt

SEQ ID NO: 185513 - DNA, 22 bp, Artificial sequence
  SiRNA target sequence
accgaaatacaaaggaacagtt

SEQ ID NO: 185514 - DNA, 22 bp, Artificial sequence
  SiRNA target sequence
ccgaaatacaaaggaacagtta

SEQ ID NO: 185515 - DNA, 22 bp, Artificial sequence
  SiRNA target sequence
cgaaatacaaaggaacagttag

SEQ ID NO: 185516 - DNA, 22 bp, Artificial sequence
  SiRNA target sequence
gaaatacaaaggaacagttaga

SEQ ID NO: 185517 - DNA, 22 bp, Artificial sequence
  SiRNA target sequence
aaatacaaaggaacagttagag

SEQ ID NO: 185518 - DNA, 22 bp, Artificial sequence
  SiRNA target sequence
aatacaaaggaacagttagaga

SEQ ID NO: 185519 - DNA, 22 bp, Artificial sequence
  SiRNA target sequence
atacaaaggaacagttagagat

SEQ ID NO: 185520 - DNA, 22 bp, Artificial sequence
  SiRNA target sequence
tacaaaggaacagttagagatc

SEQ ID NO: 185521 - DNA, 22 bp, Artificial sequence
  SiRNA target sequence
acaaaggaacagttagagatct

SEQ ID NO: 185522 - DNA, 22 bp, Artificial sequence
  SiRNA target sequence
caaaggaacagttagagatctt

SEQ ID NO: 185523 - DNA, 22 bp, Artificial sequence
  SiRNA target sequence
aaaggaacagttagagatcttt

SEQ ID NO: 185524 - DNA, 22 bp, Artificial sequence
  SiRNA target sequence
aaggaacagttagagatctttt

SEQ ID NO: 185525 - DNA, 22 bp, Artificial sequence
  SiRNA target sequence
aggaacagttagagatcttttt

SEQ ID NO: 185526 - DNA, 22 bp, Artificial sequence
  SiRNA target sequence
ggaacagttagagatcttttta

SEQ ID NO: 185527 - DNA, 22 bp, Artificial sequence
  SiRNA target sequence
gaacagttagagatctttttat

SEQ ID NO: 185528 - DNA, 22 bp, Artificial sequence
  SiRNA target sequence
aacagttagagatctttttatg

SEQ ID NO: 185529 - DNA, 22 bp, Artificial sequence
  SiRNA target sequence
acagttagagatctttttatgt

SEQ ID NO: 185530 - DNA, 22 bp, Artificial sequence
  SiRNA target sequence
cagttagagatctttttatgtc

SEQ ID NO: 185531 - DNA, 22 bp, Artificial sequence
  SiRNA target sequence
agttagagatctttttatgtca

SEQ ID NO: 185532 - DNA, 22 bp, Artificial sequence
  SiRNA target sequence
gttagagatctttttatgtcaa

SEQ ID NO: 185533 - DNA, 22 bp, Artificial sequence
  SiRNA target sequence
ttagagatctttttatgtcaaa

SEQ ID NO: 185534 - DNA, 22 bp, Artificial sequence
  SiRNA target sequence
tagagatctttttatgtcaaaa

SEQ ID NO: 185535 - DNA, 22 bp, Artificial sequence
  SiRNA target sequence
agagatctttttatgtcaaaaa

SEQ ID NO: 185536 - DNA, 22 bp, Artificial sequence
  SiRNA target sequence
gagatctttttatgtcaaaaat

SEQ ID NO: 185537 - DNA, 22 bp, Artificial sequence
  SiRNA target sequence
agatctttttatgtcaaaaatt

SEQ ID NO: 185538 - DNA, 22 bp, Artificial sequence
  SiRNA target sequence
gatctttttatgtcaaaaattc

SEQ ID NO: 185539 - DNA, 22 bp, Artificial sequence
  SiRNA target sequence
atctttttatgtcaaaaattcg

SEQ ID NO: 185540 - DNA, 22 bp, Artificial sequence
  SiRNA target sequence
tctttttatgtcaaaaattcgt

SEQ ID NO: 185541 - DNA, 22 bp, Artificial sequence
  SiRNA target sequence
ctttttatgtcaaaaattcgtt

SEQ ID NO: 185542 - DNA, 22 bp, Artificial sequence
  SiRNA target sequence
tttttatgtcaaaaattcgttc

SEQ ID NO: 185543 - DNA, 22 bp, Artificial sequence
  SiRNA target sequence
ttttatgtcaaaaattcgttct

SEQ ID NO: 185544 - DNA, 22 bp, Artificial sequence
  SiRNA target sequence
tttatgtcaaaaattcgttctt

SEQ ID NO: 185545 - DNA, 22 bp, Artificial sequence
  SiRNA target sequence
ttatgtcaaaaattcgttcttc

SEQ ID NO: 185546 - DNA, 22 bp, Artificial sequence
  SiRNA target sequence
tatgtcaaaaattcgttcttcc

SEQ ID NO: 185547 - DNA, 22 bp, Artificial sequence
  SiRNA target sequence
atgtcaaaaattcgttcttcct

SEQ ID NO: 185548 - DNA, 22 bp, Artificial sequence
  SiRNA target sequence
tgtcaaaaattcgttcttcctt

SEQ ID NO: 185549 - DNA, 22 bp, Artificial sequence
  SiRNA target sequence
gtcaaaaattcgttcttccttt

SEQ ID NO: 185550 - DNA, 22 bp, Artificial sequence
  SiRNA target sequence
tcaaaaattcgttcttcctttt

SEQ ID NO: 185551 - DNA, 22 bp, Artificial sequence
  SiRNA target sequence
caaaaattcgttcttccttttt

SEQ ID NO: 185552 - DNA, 22 bp, Artificial sequence
  SiRNA target sequence
aaaaattcgttcttccttttta

SEQ ID NO: 185553 - DNA, 22 bp, Artificial sequence
  SiRNA target sequence
aaaattcgttcttcctttttag

SEQ ID NO: 185554 - DNA, 22 bp, Artificial sequence
  SiRNA target sequence
aaattcgttcttcctttttaga

SEQ ID NO: 185555 - DNA, 22 bp, Artificial sequence
  SiRNA target sequence
aattcgttcttcctttttagac

SEQ ID NO: 185556 - DNA, 22 bp, Artificial sequence
  SiRNA target sequence
attcgttcttcctttttagacg

SEQ ID NO: 185557 - DNA, 22 bp, Artificial sequence
  SiRNA target sequence
ttcgttcttcctttttagacgc

SEQ ID NO: 185558 - DNA, 22 bp, Artificial sequence
  SiRNA target sequence
tcgttcttcctttttagacgct

SEQ ID NO: 185559 - DNA, 22 bp, Artificial sequence
  SiRNA target sequence
cgttcttcctttttagacgcta

SEQ ID NO: 185560 - DNA, 22 bp, Artificial sequence
  SiRNA target sequence
gttcttcctttttagacgctaa

SEQ ID NO: 185561 - DNA, 22 bp, Artificial sequence
  SiRNA target sequence
ttcttcctttttagacgctaat

SEQ ID NO: 185562 - DNA, 22 bp, Artificial sequence
  SiRNA target sequence
tcttcctttttagacgctaatt

SEQ ID NO: 185563 - DNA, 22 bp, Artificial sequence
  SiRNA target sequence
cttcctttttagacgctaattt

SEQ ID NO: 185564 - DNA, 22 bp, Artificial sequence
  SiRNA target sequence
ttcctttttagacgctaatttt

SEQ ID NO: 185565 - DNA, 22 bp, Artificial sequence
  SiRNA target sequence
tcctttttagacgctaattttg

SEQ ID NO: 185566 - DNA, 22 bp, Artificial sequence
  SiRNA target sequence
cctttttagacgctaattttgt

SEQ ID NO: 185567 - DNA, 22 bp, Artificial sequence
  SiRNA target sequence
ctttttagacgctaattttgtt

SEQ ID NO: 185568 - DNA, 22 bp, Artificial sequence
  SiRNA target sequence
tttttagacgctaattttgtta

SEQ ID NO: 185569 - DNA, 22 bp, Artificial sequence
  SiRNA target sequence
ttttagacgctaattttgttaa

SEQ ID NO: 185570 - DNA, 22 bp, Artificial sequence
  SiRNA target sequence
tttagacgctaattttgttaat

SEQ ID NO: 185571 - DNA, 22 bp, Artificial sequence
  SiRNA target sequence
ttagacgctaattttgttaatg

SEQ ID NO: 185572 - DNA, 22 bp, Artificial sequence
  SiRNA target sequence
tagacgctaattttgttaatga

SEQ ID NO: 185573 - DNA, 22 bp, Artificial sequence
  SiRNA target sequence
agacgctaattttgttaatgaa

SEQ ID NO: 185574 - DNA, 22 bp, Artificial sequence
  SiRNA target sequence
gacgctaattttgttaatgaag

SEQ ID NO: 185575 - DNA, 22 bp, Artificial sequence
  SiRNA target sequence
acgctaattttgttaatgaagc

SEQ ID NO: 185576 - DNA, 22 bp, Artificial sequence
  SiRNA target sequence
cgctaattttgttaatgaagct

SEQ ID NO: 185577 - DNA, 22 bp, Artificial sequence
  SiRNA target sequence
gctaattttgttaatgaagcta

SEQ ID NO: 185578 - DNA, 22 bp, Artificial sequence
  SiRNA target sequence
ctaattttgttaatgaagctat

SEQ ID NO: 185579 - DNA, 22 bp, Artificial sequence
  SiRNA target sequence
taattttgttaatgaagctatt

SEQ ID NO: 185580 - DNA, 22 bp, Artificial sequence
  SiRNA target sequence
aattttgttaatgaagctatta

SEQ ID NO: 185581 - DNA, 22 bp, Artificial sequence
  SiRNA target sequence
attttgttaatgaagctattaa

SEQ ID NO: 185582 - DNA, 22 bp, Artificial sequence
  SiRNA target sequence
ttttgttaatgaagctattaaa

SEQ ID NO: 185583 - DNA, 22 bp, Artificial sequence
  SiRNA target sequence
tttgttaatgaagctattaaac

SEQ ID NO: 185584 - DNA, 22 bp, Artificial sequence
  SiRNA target sequence
ttgttaatgaagctattaaacc

SEQ ID NO: 185585 - DNA, 22 bp, Artificial sequence
  SiRNA target sequence
tgttaatgaagctattaaacct

SEQ ID NO: 185586 - DNA, 22 bp, Artificial sequence
  SiRNA target sequence
gttaatgaagctattaaacctt

SEQ ID NO: 185587 - DNA, 22 bp, Artificial sequence
  SiRNA target sequence
ttaatgaagctattaaaccttt

SEQ ID NO: 185588 - DNA, 22 bp, Artificial sequence
  SiRNA target sequence
taatgaagctattaaaccttta

SEQ ID NO: 185589 - DNA, 22 bp, Artificial sequence
  SiRNA target sequence
aatgaagctattaaacctttag

SEQ ID NO: 185590 - DNA, 22 bp, Artificial sequence
  SiRNA target sequence
atgaagctattaaacctttaga

SEQ ID NO: 185591 - DNA, 22 bp, Artificial sequence
  SiRNA target sequence
tgaagctattaaacctttagat

SEQ ID NO: 185592 - DNA, 22 bp, Artificial sequence
  SiRNA target sequence
gaagctattaaacctttagata

SEQ ID NO: 185593 - DNA, 22 bp, Artificial sequence
  SiRNA target sequence
aagctattaaacctttagatat

SEQ ID NO: 185594 - DNA, 22 bp, Artificial sequence
  SiRNA target sequence
agctattaaacctttagatatt

SEQ ID NO: 185595 - DNA, 22 bp, Artificial sequence
  SiRNA target sequence
gctattaaacctttagatattc

SEQ ID NO: 185596 - DNA, 22 bp, Artificial sequence
  SiRNA target sequence
ctattaaacctttagatattca

SEQ ID NO: 185597 - DNA, 22 bp, Artificial sequence
  SiRNA target sequence
tattaaacctttagatattcat

SEQ ID NO: 185598 - DNA, 22 bp, Artificial sequence
  SiRNA target sequence
attaaacctttagatattcatc

SEQ ID NO: 185599 - DNA, 22 bp, Artificial sequence
  SiRNA target sequence
ttaaacctttagatattcatca

SEQ ID NO: 185600 - DNA, 22 bp, Artificial sequence
  SiRNA target sequence
taaacctttagatattcatcat

SEQ ID NO: 185601 - DNA, 22 bp, Artificial sequence
  SiRNA target sequence
aaacctttagatattcatcatt

SEQ ID NO: 185602 - DNA, 22 bp, Artificial sequence
  SiRNA target sequence
aacctttagatattcatcattt

SEQ ID NO: 185603 - DNA, 22 bp, Artificial sequence
  SiRNA target sequence
acctttagatattcatcattta

SEQ ID NO: 185604 - DNA, 22 bp, Artificial sequence
  SiRNA target sequence
cctttagatattcatcatttat

SEQ ID NO: 185605 - DNA, 22 bp, Artificial sequence
  SiRNA target sequence
ctttagatattcatcatttata

SEQ ID NO: 185606 - DNA, 22 bp, Artificial sequence
  SiRNA target sequence
tttagatattcatcatttatac

SEQ ID NO: 185607 - DNA, 22 bp, Artificial sequence
  SiRNA target sequence
ttagatattcatcatttatacg

SEQ ID NO: 185608 - DNA, 22 bp, Artificial sequence
  SiRNA target sequence
tagatattcatcatttatacga

SEQ ID NO: 185609 - DNA, 22 bp, Artificial sequence
  SiRNA target sequence
agatattcatcatttatacgac

SEQ ID NO: 185610 - DNA, 22 bp, Artificial sequence
  SiRNA target sequence
gatattcatcatttatacgacc

SEQ ID NO: 185611 - DNA, 22 bp, Artificial sequence
  SiRNA target sequence
atattcatcatttatacgacca

SEQ ID NO: 185612 - DNA, 22 bp, Artificial sequence
  SiRNA target sequence
tattcatcatttatacgaccaa

SEQ ID NO: 185613 - DNA, 22 bp, Artificial sequence
  SiRNA target sequence
attcatcatttatacgaccaac

SEQ ID NO: 185614 - DNA, 22 bp, Artificial sequence
  SiRNA target sequence
ttcatcatttatacgaccaact

SEQ ID NO: 185615 - DNA, 22 bp, Artificial sequence
  SiRNA target sequence
tcatcatttatacgaccaactt

SEQ ID NO: 185616 - DNA, 22 bp, Artificial sequence
  SiRNA target sequence
catcatttatacgaccaacttg

SEQ ID NO: 185617 - DNA, 22 bp, Artificial sequence
  SiRNA target sequence
atcatttatacgaccaacttgt

SEQ ID NO: 185618 - DNA, 22 bp, Artificial sequence
  SiRNA target sequence
tcatttatacgaccaacttgta

SEQ ID NO: 185619 - DNA, 22 bp, Artificial sequence
  SiRNA target sequence
catttatacgaccaacttgtag

SEQ ID NO: 185620 - DNA, 22 bp, Artificial sequence
  SiRNA target sequence
atttatacgaccaacttgtaga

SEQ ID NO: 185621 - DNA, 22 bp, Artificial sequence
  SiRNA target sequence
tttatacgaccaacttgtagaa

SEQ ID NO: 185622 - DNA, 22 bp, Artificial sequence
  SiRNA target sequence
ttatacgaccaacttgtagaaa

SEQ ID NO: 185623 - DNA, 22 bp, Artificial sequence
  SiRNA target sequence
tatacgaccaacttgtagaaaa

SEQ ID NO: 185624 - DNA, 22 bp, Artificial sequence
  SiRNA target sequence
atacgaccaacttgtagaaaac

SEQ ID NO: 185625 - DNA, 22 bp, Artificial sequence
  SiRNA target sequence
tacgaccaacttgtagaaaact

SEQ ID NO: 185626 - DNA, 22 bp, Artificial sequence
  SiRNA target sequence
acgaccaacttgtagaaaactt

SEQ ID NO: 185627 - DNA, 22 bp, Artificial sequence
  SiRNA target sequence
cgaccaacttgtagaaaacttg

SEQ ID NO: 185628 - DNA, 22 bp, Artificial sequence
  SiRNA target sequence
gaccaacttgtagaaaacttga

SEQ ID NO: 185629 - DNA, 22 bp, Artificial sequence
  SiRNA target sequence
accaacttgtagaaaacttgag

SEQ ID NO: 185630 - DNA, 22 bp, Artificial sequence
  SiRNA target sequence
ccaacttgtagaaaacttgagt

SEQ ID NO: 185631 - DNA, 22 bp, Artificial sequence
  SiRNA target sequence
caacttgtagaaaacttgagtg

SEQ ID NO: 185632 - DNA, 22 bp, Artificial sequence
  SiRNA target sequence
aacttgtagaaaacttgagtgg

SEQ ID NO: 185633 - DNA, 22 bp, Artificial sequence
  SiRNA target sequence
acttgtagaaaacttgagtggt

SEQ ID NO: 185634 - DNA, 22 bp, Artificial sequence
  SiRNA target sequence
cttgtagaaaacttgagtggtg

SEQ ID NO: 185635 - DNA, 22 bp, Artificial sequence
  SiRNA target sequence
ttgtagaaaacttgagtggtgg

SEQ ID NO: 185636 - DNA, 22 bp, Artificial sequence
  SiRNA target sequence
tgtagaaaacttgagtggtgga

SEQ ID NO: 185637 - DNA, 22 bp, Artificial sequence
  SiRNA target sequence
gtagaaaacttgagtggtggag

SEQ ID NO: 185638 - DNA, 22 bp, Artificial sequence
  SiRNA target sequence
tagaaaacttgagtggtggaga

SEQ ID NO: 185639 - DNA, 22 bp, Artificial sequence
  SiRNA target sequence
agaaaacttgagtggtggagaa

SEQ ID NO: 185640 - DNA, 22 bp, Artificial sequence
  SiRNA target sequence
gaaaacttgagtggtggagaat

SEQ ID NO: 185641 - DNA, 22 bp, Artificial sequence
  SiRNA target sequence
aaaacttgagtggtggagaatt

SEQ ID NO: 185642 - DNA, 22 bp, Artificial sequence
  SiRNA target sequence
aaacttgagtggtggagaatta

SEQ ID NO: 185643 - DNA, 22 bp, Artificial sequence
  SiRNA target sequence
aacttgagtggtggagaattac

SEQ ID NO: 185644 - DNA, 22 bp, Artificial sequence
  SiRNA target sequence
acttgagtggtggagaattaca

SEQ ID NO: 185645 - DNA, 22 bp, Artificial sequence
  SiRNA target sequence
cttgagtggtggagaattacaa

SEQ ID NO: 185646 - DNA, 22 bp, Artificial sequence
  SiRNA target sequence
ttgagtggtggagaattacaaa

SEQ ID NO: 185647 - DNA, 22 bp, Artificial sequence
  SiRNA target sequence
tgagtggtggagaattacaaag

SEQ ID NO: 185648 - DNA, 22 bp, Artificial sequence
  SiRNA target sequence
gagtggtggagaattacaaaga

SEQ ID NO: 185649 - DNA, 22 bp, Artificial sequence
  SiRNA target sequence
agtggtggagaattacaaagaa

SEQ ID NO: 185650 - DNA, 22 bp, Artificial sequence
  SiRNA target sequence
gtggtggagaattacaaagaat

SEQ ID NO: 185651 - DNA, 22 bp, Artificial sequence
  SiRNA target sequence
tggtggagaattacaaagaatt

SEQ ID NO: 185652 - DNA, 22 bp, Artificial sequence
  SiRNA target sequence
ggtggagaattacaaagaattg

SEQ ID NO: 185653 - DNA, 22 bp, Artificial sequence
  SiRNA target sequence
gtggagaattacaaagaattgc

SEQ ID NO: 185654 - DNA, 22 bp, Artificial sequence
  SiRNA target sequence
tggagaattacaaagaattgca

SEQ ID NO: 185655 - DNA, 22 bp, Artificial sequence
  SiRNA target sequence
ggagaattacaaagaattgcaa

SEQ ID NO: 185656 - DNA, 22 bp, Artificial sequence
  SiRNA target sequence
gagaattacaaagaattgcaat

SEQ ID NO: 185657 - DNA, 22 bp, Artificial sequence
  SiRNA target sequence
agaattacaaagaattgcaata

SEQ ID NO: 185658 - DNA, 22 bp, Artificial sequence
  SiRNA target sequence
gaattacaaagaattgcaataa

SEQ ID NO: 185659 - DNA, 22 bp, Artificial sequence
  SiRNA target sequence
aattacaaagaattgcaataat

SEQ ID NO: 185660 - DNA, 22 bp, Artificial sequence
  SiRNA target sequence
attacaaagaattgcaataata

SEQ ID NO: 185661 - DNA, 22 bp, Artificial sequence
  SiRNA target sequence
ttacaaagaattgcaataataa

SEQ ID NO: 185662 - DNA, 22 bp, Artificial sequence
  SiRNA target sequence
tacaaagaattgcaataataat

SEQ ID NO: 185663 - DNA, 22 bp, Artificial sequence
  SiRNA target sequence
acaaagaattgcaataataata

SEQ ID NO: 185664 - DNA, 22 bp, Artificial sequence
  SiRNA target sequence
caaagaattgcaataataatat

SEQ ID NO: 185665 - DNA, 22 bp, Artificial sequence
  SiRNA target sequence
aaagaattgcaataataatatg

SEQ ID NO: 185666 - DNA, 22 bp, Artificial sequence
  SiRNA target sequence
aagaattgcaataataatatgt

SEQ ID NO: 185667 - DNA, 22 bp, Artificial sequence
  SiRNA target sequence
agaattgcaataataatatgtt

SEQ ID NO: 185668 - DNA, 22 bp, Artificial sequence
  SiRNA target sequence
gaattgcaataataatatgttt

SEQ ID NO: 185669 - DNA, 22 bp, Artificial sequence
  SiRNA target sequence
aattgcaataataatatgttta

SEQ ID NO: 185670 - DNA, 22 bp, Artificial sequence
  SiRNA target sequence
attgcaataataatatgtttag

SEQ ID NO: 185671 - DNA, 22 bp, Artificial sequence
  SiRNA target sequence
ttgcaataataatatgtttagg

SEQ ID NO: 185672 - DNA, 22 bp, Artificial sequence
  SiRNA target sequence
tgcaataataatatgtttagga

SEQ ID NO: 185673 - DNA, 22 bp, Artificial sequence
  SiRNA target sequence
gcaataataatatgtttaggaa

SEQ ID NO: 185674 - DNA, 22 bp, Artificial sequence
  SiRNA target sequence
caataataatatgtttaggaaa

SEQ ID NO: 185675 - DNA, 22 bp, Artificial sequence
  SiRNA target sequence
aataataatatgtttaggaaaa

SEQ ID NO: 185676 - DNA, 22 bp, Artificial sequence
  SiRNA target sequence
ataataatatgtttaggaaaag

SEQ ID NO: 185677 - DNA, 22 bp, Artificial sequence
  SiRNA target sequence
taataatatgtttaggaaaaga

SEQ ID NO: 185678 - DNA, 22 bp, Artificial sequence
  SiRNA target sequence
aataatatgtttaggaaaagat

SEQ ID NO: 185679 - DNA, 22 bp, Artificial sequence
  SiRNA target sequence
ataatatgtttaggaaaagatg

SEQ ID NO: 185680 - DNA, 22 bp, Artificial sequence
  SiRNA target sequence
taatatgtttaggaaaagatgc

SEQ ID NO: 185681 - DNA, 22 bp, Artificial sequence
  SiRNA target sequence
aatatgtttaggaaaagatgct

SEQ ID NO: 185682 - DNA, 22 bp, Artificial sequence
  SiRNA target sequence
atatgtttaggaaaagatgcta

SEQ ID NO: 185683 - DNA, 22 bp, Artificial sequence
  SiRNA target sequence
tatgtttaggaaaagatgctaa

SEQ ID NO: 185684 - DNA, 22 bp, Artificial sequence
  SiRNA target sequence
atgtttaggaaaagatgctaac

SEQ ID NO: 185685 - DNA, 22 bp, Artificial sequence
  SiRNA target sequence
tgtttaggaaaagatgctaacc

SEQ ID NO: 185686 - DNA, 22 bp, Artificial sequence
  SiRNA target sequence
gtttaggaaaagatgctaacct

SEQ ID NO: 185687 - DNA, 22 bp, Artificial sequence
  SiRNA target sequence
tttaggaaaagatgctaacctt

SEQ ID NO: 185688 - DNA, 22 bp, Artificial sequence
  SiRNA target sequence
ttaggaaaagatgctaaccttt

SEQ ID NO: 185689 - DNA, 22 bp, Artificial sequence
  SiRNA target sequence
taggaaaagatgctaaccttta

SEQ ID NO: 185690 - DNA, 22 bp, Artificial sequence
  SiRNA target sequence
aggaaaagatgctaacctttat

SEQ ID NO: 185691 - DNA, 22 bp, Artificial sequence
  SiRNA target sequence
ggaaaagatgctaacctttatt

SEQ ID NO: 185692 - DNA, 22 bp, Artificial sequence
  SiRNA target sequence
gaaaagatgctaacctttattt

SEQ ID NO: 185693 - DNA, 22 bp, Artificial sequence
  SiRNA target sequence
aaaagatgctaacctttattta

SEQ ID NO: 185694 - DNA, 22 bp, Artificial sequence
  SiRNA target sequence
aaagatgctaacctttatttat

SEQ ID NO: 185695 - DNA, 22 bp, Artificial sequence
  SiRNA target sequence
aagatgctaacctttatttatt

SEQ ID NO: 185696 - DNA, 22 bp, Artificial sequence
  SiRNA target sequence
agatgctaacctttatttatta

SEQ ID NO: 185697 - DNA, 22 bp, Artificial sequence
  SiRNA target sequence
gatgctaacctttatttattag

SEQ ID NO: 185698 - DNA, 22 bp, Artificial sequence
  SiRNA target sequence
atgctaacctttatttattaga

SEQ ID NO: 185699 - DNA, 22 bp, Artificial sequence
  SiRNA target sequence
tgctaacctttatttattagat

SEQ ID NO: 185700 - DNA, 22 bp, Artificial sequence
  SiRNA target sequence
gctaacctttatttattagatg

SEQ ID NO: 185701 - DNA, 22 bp, Artificial sequence
  SiRNA target sequence
ctaacctttatttattagatga

SEQ ID NO: 185702 - DNA, 22 bp, Artificial sequence
  SiRNA target sequence
taacctttatttattagatgaa

SEQ ID NO: 185703 - DNA, 22 bp, Artificial sequence
  SiRNA target sequence
aacctttatttattagatgaac

SEQ ID NO: 185704 - DNA, 22 bp, Artificial sequence
  SiRNA target sequence
acctttatttattagatgaacc

SEQ ID NO: 185705 - DNA, 22 bp, Artificial sequence
  SiRNA target sequence
cctttatttattagatgaacct

SEQ ID NO: 185706 - DNA, 22 bp, Artificial sequence
  SiRNA target sequence
ctttatttattagatgaacctt

SEQ ID NO: 185707 - DNA, 22 bp, Artificial sequence
  SiRNA target sequence
tttatttattagatgaaccttc

SEQ ID NO: 185708 - DNA, 22 bp, Artificial sequence
  SiRNA target sequence
ttatttattagatgaaccttct

SEQ ID NO: 185709 - DNA, 22 bp, Artificial sequence
  SiRNA target sequence
tatttattagatgaaccttctg

SEQ ID NO: 185710 - DNA, 22 bp, Artificial sequence
  SiRNA target sequence
atttattagatgaaccttctgc

SEQ ID NO: 185711 - DNA, 22 bp, Artificial sequence
  SiRNA target sequence
tttattagatgaaccttctgcg

SEQ ID NO: 185712 - DNA, 22 bp, Artificial sequence
  SiRNA target sequence
ttattagatgaaccttctgcgt

SEQ ID NO: 185713 - DNA, 22 bp, Artificial sequence
  SiRNA target sequence
tattagatgaaccttctgcgta

SEQ ID NO: 185714 - DNA, 22 bp, Artificial sequence
  SiRNA target sequence
attagatgaaccttctgcgtat

SEQ ID NO: 185715 - DNA, 22 bp, Artificial sequence
  SiRNA target sequence
ttagatgaaccttctgcgtatc

SEQ ID NO: 185716 - DNA, 22 bp, Artificial sequence
  SiRNA target sequence
tagatgaaccttctgcgtatct

SEQ ID NO: 185717 - DNA, 22 bp, Artificial sequence
  SiRNA target sequence
agatgaaccttctgcgtatcta

SEQ ID NO: 185718 - DNA, 22 bp, Artificial sequence
  SiRNA target sequence
gatgaaccttctgcgtatctag

SEQ ID NO: 185719 - DNA, 22 bp, Artificial sequence
  SiRNA target sequence
atgaaccttctgcgtatctaga

SEQ ID NO: 185720 - DNA, 22 bp, Artificial sequence
  SiRNA target sequence
tgaaccttctgcgtatctagat

SEQ ID NO: 185721 - DNA, 22 bp, Artificial sequence
  SiRNA target sequence
gaaccttctgcgtatctagatt

SEQ ID NO: 185722 - DNA, 22 bp, Artificial sequence
  SiRNA target sequence
aaccttctgcgtatctagattc

SEQ ID NO: 185723 - DNA, 22 bp, Artificial sequence
  SiRNA target sequence
accttctgcgtatctagattca

SEQ ID NO: 185724 - DNA, 22 bp, Artificial sequence
  SiRNA target sequence
ccttctgcgtatctagattcag

SEQ ID NO: 185725 - DNA, 22 bp, Artificial sequence
  SiRNA target sequence
cttctgcgtatctagattcaga

SEQ ID NO: 185726 - DNA, 22 bp, Artificial sequence
  SiRNA target sequence
ttctgcgtatctagattcagat

SEQ ID NO: 185727 - DNA, 22 bp, Artificial sequence
  SiRNA target sequence
tctgcgtatctagattcagatc

SEQ ID NO: 185728 - DNA, 22 bp, Artificial sequence
  SiRNA target sequence
ctgcgtatctagattcagatca

SEQ ID NO: 185729 - DNA, 22 bp, Artificial sequence
  SiRNA target sequence
tgcgtatctagattcagatcag

SEQ ID NO: 185730 - DNA, 22 bp, Artificial sequence
  SiRNA target sequence
gcgtatctagattcagatcaga

SEQ ID NO: 185731 - DNA, 22 bp, Artificial sequence
  SiRNA target sequence
cgtatctagattcagatcagag

SEQ ID NO: 185732 - DNA, 22 bp, Artificial sequence
  SiRNA target sequence
gtatctagattcagatcagaga

SEQ ID NO: 185733 - DNA, 22 bp, Artificial sequence
  SiRNA target sequence
tatctagattcagatcagagaa

SEQ ID NO: 185734 - DNA, 22 bp, Artificial sequence
  SiRNA target sequence
atctagattcagatcagagaat

SEQ ID NO: 185735 - DNA, 22 bp, Artificial sequence
  SiRNA target sequence
tctagattcagatcagagaata

SEQ ID NO: 185736 - DNA, 22 bp, Artificial sequence
  SiRNA target sequence
ctagattcagatcagagaatag

SEQ ID NO: 185737 - DNA, 22 bp, Artificial sequence
  SiRNA target sequence
tagattcagatcagagaatagc

SEQ ID NO: 185738 - DNA, 22 bp, Artificial sequence
  SiRNA target sequence
agattcagatcagagaatagcg

SEQ ID NO: 185739 - DNA, 22 bp, Artificial sequence
  SiRNA target sequence
gattcagatcagagaatagcga

SEQ ID NO: 185740 - DNA, 22 bp, Artificial sequence
  SiRNA target sequence
attcagatcagagaatagcgat

SEQ ID NO: 185741 - DNA, 22 bp, Artificial sequence
  SiRNA target sequence
ttcagatcagagaatagcgatt

SEQ ID NO: 185742 - DNA, 22 bp, Artificial sequence
  SiRNA target sequence
tcagatcagagaatagcgattt

SEQ ID NO: 185743 - DNA, 22 bp, Artificial sequence
  SiRNA target sequence
cagatcagagaatagcgatttc

SEQ ID NO: 185744 - DNA, 22 bp, Artificial sequence
  SiRNA target sequence
agatcagagaatagcgatttca

SEQ ID NO: 185745 - DNA, 22 bp, Artificial sequence
  SiRNA target sequence
gatcagagaatagcgatttcaa

SEQ ID NO: 185746 - DNA, 22 bp, Artificial sequence
  SiRNA target sequence
atcagagaatagcgatttcaaa

SEQ ID NO: 185747 - DNA, 22 bp, Artificial sequence
  SiRNA target sequence
tcagagaatagcgatttcaaaa

SEQ ID NO: 185748 - DNA, 22 bp, Artificial sequence
  SiRNA target sequence
cagagaatagcgatttcaaaag

SEQ ID NO: 185749 - DNA, 22 bp, Artificial sequence
  SiRNA target sequence
agagaatagcgatttcaaaagt

SEQ ID NO: 185750 - DNA, 22 bp, Artificial sequence
  SiRNA target sequence
gagaatagcgatttcaaaagtt

SEQ ID NO: 185751 - DNA, 22 bp, Artificial sequence
  SiRNA target sequence
agaatagcgatttcaaaagtta

SEQ ID NO: 185752 - DNA, 22 bp, Artificial sequence
  SiRNA target sequence
gaatagcgatttcaaaagttat

SEQ ID NO: 185753 - DNA, 22 bp, Artificial sequence
  SiRNA target sequence
aatagcgatttcaaaagttata

SEQ ID NO: 185754 - DNA, 22 bp, Artificial sequence
  SiRNA target sequence
atagcgatttcaaaagttataa

SEQ ID NO: 185755 - DNA, 22 bp, Artificial sequence
  SiRNA target sequence
tagcgatttcaaaagttataaa

SEQ ID NO: 185756 - DNA, 22 bp, Artificial sequence
  SiRNA target sequence
agcgatttcaaaagttataaaa

SEQ ID NO: 185757 - DNA, 22 bp, Artificial sequence
  SiRNA target sequence
gcgatttcaaaagttataaaaa

SEQ ID NO: 185758 - DNA, 22 bp, Artificial sequence
  SiRNA target sequence
cgatttcaaaagttataaaaag

SEQ ID NO: 185759 - DNA, 22 bp, Artificial sequence
  SiRNA target sequence
gatttcaaaagttataaaaagg

SEQ ID NO: 185760 - DNA, 22 bp, Artificial sequence
  SiRNA target sequence
atttcaaaagttataaaaaggt

SEQ ID NO: 185761 - DNA, 22 bp, Artificial sequence
  SiRNA target sequence
tttcaaaagttataaaaaggtt

SEQ ID NO: 185762 - DNA, 22 bp, Artificial sequence
  SiRNA target sequence
ttcaaaagttataaaaaggttt

SEQ ID NO: 185763 - DNA, 22 bp, Artificial sequence
  SiRNA target sequence
tcaaaagttataaaaaggttta

SEQ ID NO: 185764 - DNA, 22 bp, Artificial sequence
  SiRNA target sequence
caaaagttataaaaaggtttat

SEQ ID NO: 185765 - DNA, 22 bp, Artificial sequence
  SiRNA target sequence
aaaagttataaaaaggtttatt

SEQ ID NO: 185766 - DNA, 22 bp, Artificial sequence
  SiRNA target sequence
aaagttataaaaaggtttattt

SEQ ID NO: 185767 - DNA, 22 bp, Artificial sequence
  SiRNA target sequence
aagttataaaaaggtttattta

SEQ ID NO: 185768 - DNA, 22 bp, Artificial sequence
  SiRNA target sequence
agttataaaaaggtttatttat

SEQ ID NO: 185769 - DNA, 22 bp, Artificial sequence
  SiRNA target sequence
gttataaaaaggtttatttatg

SEQ ID NO: 185770 - DNA, 22 bp, Artificial sequence
  SiRNA target sequence
ttataaaaaggtttatttatgg

SEQ ID NO: 185771 - DNA, 22 bp, Artificial sequence
  SiRNA target sequence
tataaaaaggtttatttatggg

SEQ ID NO: 185772 - DNA, 22 bp, Artificial sequence
  SiRNA target sequence
ataaaaaggtttatttatggga

SEQ ID NO: 185773 - DNA, 22 bp, Artificial sequence
  SiRNA target sequence
taaaaaggtttatttatgggaa

SEQ ID NO: 185774 - DNA, 22 bp, Artificial sequence
  SiRNA target sequence
aaaaaggtttatttatgggaag

SEQ ID NO: 185775 - DNA, 22 bp, Artificial sequence
  SiRNA target sequence
aaaaggtttatttatgggaaga

SEQ ID NO: 185776 - DNA, 22 bp, Artificial sequence
  SiRNA target sequence
aaaggtttatttatgggaagaa

SEQ ID NO: 185777 - DNA, 22 bp, Artificial sequence
  SiRNA target sequence
aaggtttatttatgggaagaag

SEQ ID NO: 185778 - DNA, 22 bp, Artificial sequence
  SiRNA target sequence
aggtttatttatgggaagaagc

SEQ ID NO: 185779 - DNA, 22 bp, Artificial sequence
  SiRNA target sequence
ggtttatttatgggaagaagcg

SEQ ID NO: 185780 - DNA, 22 bp, Artificial sequence
  SiRNA target sequence
gtttatttatgggaagaagcga

SEQ ID NO: 185781 - DNA, 22 bp, Artificial sequence
  SiRNA target sequence
tttatttatgggaagaagcgaa

SEQ ID NO: 185782 - DNA, 22 bp, Artificial sequence
  SiRNA target sequence
ttatttatgggaagaagcgaac

SEQ ID NO: 185783 - DNA, 22 bp, Artificial sequence
  SiRNA target sequence
tatttatgggaagaagcgaaca

SEQ ID NO: 185784 - DNA, 22 bp, Artificial sequence
  SiRNA target sequence
atttatgggaagaagcgaacag

SEQ ID NO: 185785 - DNA, 22 bp, Artificial sequence
  SiRNA target sequence
tttatgggaagaagcgaacagc

SEQ ID NO: 185786 - DNA, 22 bp, Artificial sequence
  SiRNA target sequence
ttatgggaagaagcgaacagcc

SEQ ID NO: 185787 - DNA, 22 bp, Artificial sequence
  SiRNA target sequence
tatgggaagaagcgaacagcct

SEQ ID NO: 185788 - DNA, 22 bp, Artificial sequence
  SiRNA target sequence
atgggaagaagcgaacagcctt

SEQ ID NO: 185789 - DNA, 22 bp, Artificial sequence
  SiRNA target sequence
tgggaagaagcgaacagccttt

SEQ ID NO: 185790 - DNA, 22 bp, Artificial sequence
  SiRNA target sequence
gggaagaagcgaacagcctttg

SEQ ID NO: 185791 - DNA, 22 bp, Artificial sequence
  SiRNA target sequence
ggaagaagcgaacagcctttgt

SEQ ID NO: 185792 - DNA, 22 bp, Artificial sequence
  SiRNA target sequence
gaagaagcgaacagcctttgtg

SEQ ID NO: 185793 - DNA, 22 bp, Artificial sequence
  SiRNA target sequence
aagaagcgaacagcctttgtgg

SEQ ID NO: 185794 - DNA, 22 bp, Artificial sequence
  SiRNA target sequence
agaagcgaacagcctttgtggt

SEQ ID NO: 185795 - DNA, 22 bp, Artificial sequence
  SiRNA target sequence
gaagcgaacagcctttgtggtt

SEQ ID NO: 185796 - DNA, 22 bp, Artificial sequence
  SiRNA target sequence
aagcgaacagcctttgtggttg

SEQ ID NO: 185797 - DNA, 22 bp, Artificial sequence
  SiRNA target sequence
agcgaacagcctttgtggttga

SEQ ID NO: 185798 - DNA, 22 bp, Artificial sequence
  SiRNA target sequence
gcgaacagcctttgtggttgaa

SEQ ID NO: 185799 - DNA, 22 bp, Artificial sequence
  SiRNA target sequence
cgaacagcctttgtggttgaac

SEQ ID NO: 185800 - DNA, 22 bp, Artificial sequence
  SiRNA target sequence
gaacagcctttgtggttgaaca

SEQ ID NO: 185801 - DNA, 22 bp, Artificial sequence
  SiRNA target sequence
aacagcctttgtggttgaacat

SEQ ID NO: 185802 - DNA, 22 bp, Artificial sequence
  SiRNA target sequence
acagcctttgtggttgaacatg

SEQ ID NO: 185803 - DNA, 22 bp, Artificial sequence
  SiRNA target sequence
cagcctttgtggttgaacatga

SEQ ID NO: 185804 - DNA, 22 bp, Artificial sequence
  SiRNA target sequence
agcctttgtggttgaacatgat

SEQ ID NO: 185805 - DNA, 22 bp, Artificial sequence
  SiRNA target sequence
gcctttgtggttgaacatgatt

SEQ ID NO: 185806 - DNA, 22 bp, Artificial sequence
  SiRNA target sequence
cctttgtggttgaacatgattt

SEQ ID NO: 185807 - DNA, 22 bp, Artificial sequence
  SiRNA target sequence
ctttgtggttgaacatgattta

SEQ ID NO: 185808 - DNA, 22 bp, Artificial sequence
  SiRNA target sequence
tttgtggttgaacatgatttaa

SEQ ID NO: 185809 - DNA, 22 bp, Artificial sequence
  SiRNA target sequence
ttgtggttgaacatgatttaat

SEQ ID NO: 185810 - DNA, 22 bp, Artificial sequence
  SiRNA target sequence
tgtggttgaacatgatttaatt

SEQ ID NO: 185811 - DNA, 22 bp, Artificial sequence
  SiRNA target sequence
gtggttgaacatgatttaattg

SEQ ID NO: 185812 - DNA, 22 bp, Artificial sequence
  SiRNA target sequence
tggttgaacatgatttaattgt

SEQ ID NO: 185813 - DNA, 22 bp, Artificial sequence
  SiRNA target sequence
ggttgaacatgatttaattgta

SEQ ID NO: 185814 - DNA, 22 bp, Artificial sequence
  SiRNA target sequence
gttgaacatgatttaattgtag

SEQ ID NO: 185815 - DNA, 22 bp, Artificial sequence
  SiRNA target sequence
ttgaacatgatttaattgtagg

SEQ ID NO: 185816 - DNA, 22 bp, Artificial sequence
  SiRNA target sequence
tgaacatgatttaattgtaggt

SEQ ID NO: 185817 - DNA, 22 bp, Artificial sequence
  SiRNA target sequence
gaacatgatttaattgtaggta

SEQ ID NO: 185818 - DNA, 22 bp, Artificial sequence
  SiRNA target sequence
aacatgatttaattgtaggtac

SEQ ID NO: 185819 - DNA, 22 bp, Artificial sequence
  SiRNA target sequence
acatgatttaattgtaggtaca

SEQ ID NO: 185820 - DNA, 22 bp, Artificial sequence
  SiRNA target sequence
catgatttaattgtaggtacat

SEQ ID NO: 185821 - DNA, 22 bp, Artificial sequence
  SiRNA target sequence
atgatttaattgtaggtacata

SEQ ID NO: 185822 - DNA, 22 bp, Artificial sequence
  SiRNA target sequence
tgatttaattgtaggtacatat

SEQ ID NO: 185823 - DNA, 22 bp, Artificial sequence
  SiRNA target sequence
gatttaattgtaggtacatatt

SEQ ID NO: 185824 - DNA, 22 bp, Artificial sequence
  SiRNA target sequence
atttaattgtaggtacatattt

SEQ ID NO: 185825 - DNA, 22 bp, Artificial sequence
  SiRNA target sequence
tttaattgtaggtacatatttg

SEQ ID NO: 185826 - DNA, 22 bp, Artificial sequence
  SiRNA target sequence
ttaattgtaggtacatatttgg

SEQ ID NO: 185827 - DNA, 22 bp, Artificial sequence
  SiRNA target sequence
taattgtaggtacatatttggc

SEQ ID NO: 185828 - DNA, 22 bp, Artificial sequence
  SiRNA target sequence
aattgtaggtacatatttggct

SEQ ID NO: 185829 - DNA, 22 bp, Artificial sequence
  SiRNA target sequence
attgtaggtacatatttggctg

SEQ ID NO: 185830 - DNA, 22 bp, Artificial sequence
  SiRNA target sequence
ttgtaggtacatatttggctga

SEQ ID NO: 185831 - DNA, 22 bp, Artificial sequence
  SiRNA target sequence
tgtaggtacatatttggctgat

SEQ ID NO: 185832 - DNA, 22 bp, Artificial sequence
  SiRNA target sequence
gtaggtacatatttggctgata

SEQ ID NO: 185833 - DNA, 22 bp, Artificial sequence
  SiRNA target sequence
taggtacatatttggctgataa

SEQ ID NO: 185834 - DNA, 22 bp, Artificial sequence
  SiRNA target sequence
aggtacatatttggctgataaa

SEQ ID NO: 185835 - DNA, 22 bp, Artificial sequence
  SiRNA target sequence
ggtacatatttggctgataaag

SEQ ID NO: 185836 - DNA, 22 bp, Artificial sequence
  SiRNA target sequence
gtacatatttggctgataaagt

SEQ ID NO: 185837 - DNA, 22 bp, Artificial sequence
  SiRNA target sequence
tacatatttggctgataaagtt

SEQ ID NO: 185838 - DNA, 22 bp, Artificial sequence
  SiRNA target sequence
acatatttggctgataaagttg

SEQ ID NO: 185839 - DNA, 22 bp, Artificial sequence
  SiRNA target sequence
catatttggctgataaagttgt

SEQ ID NO: 185840 - DNA, 22 bp, Artificial sequence
  SiRNA target sequence
atatttggctgataaagttgtt

SEQ ID NO: 185841 - DNA, 22 bp, Artificial sequence
  SiRNA target sequence
tatttggctgataaagttgttg

SEQ ID NO: 185842 - DNA, 22 bp, Artificial sequence
  SiRNA target sequence
atttggctgataaagttgttgt

SEQ ID NO: 185843 - DNA, 22 bp, Artificial sequence
  SiRNA target sequence
tttggctgataaagttgttgtt

SEQ ID NO: 185844 - DNA, 22 bp, Artificial sequence
  SiRNA target sequence
ttggctgataaagttgttgttt

SEQ ID NO: 185845 - DNA, 22 bp, Artificial sequence
  SiRNA target sequence
tggctgataaagttgttgtttt

SEQ ID NO: 185846 - DNA, 22 bp, Artificial sequence
  SiRNA target sequence
ggctgataaagttgttgttttt

SEQ ID NO: 185847 - DNA, 22 bp, Artificial sequence
  SiRNA target sequence
gctgataaagttgttgtttttg

SEQ ID NO: 185848 - DNA, 22 bp, Artificial sequence
  SiRNA target sequence
ctgataaagttgttgtttttga

SEQ ID NO: 185849 - DNA, 22 bp, Artificial sequence
  SiRNA target sequence
tgataaagttgttgtttttgag

SEQ ID NO: 185850 - DNA, 22 bp, Artificial sequence
  SiRNA target sequence
gataaagttgttgtttttgagg

SEQ ID NO: 185851 - DNA, 22 bp, Artificial sequence
  SiRNA target sequence
ataaagttgttgtttttgaggg

SEQ ID NO: 185852 - DNA, 22 bp, Artificial sequence
  SiRNA target sequence
taaagttgttgtttttgaggga

SEQ ID NO: 185853 - DNA, 22 bp, Artificial sequence
  SiRNA target sequence
aaagttgttgtttttgagggaa

SEQ ID NO: 185854 - DNA, 22 bp, Artificial sequence
  SiRNA target sequence
aagttgttgtttttgagggaag

SEQ ID NO: 185855 - DNA, 22 bp, Artificial sequence
  SiRNA target sequence
agttgttgtttttgagggaagc

SEQ ID NO: 185856 - DNA, 22 bp, Artificial sequence
  SiRNA target sequence
gttgttgtttttgagggaagcc

SEQ ID NO: 185857 - DNA, 22 bp, Artificial sequence
  SiRNA target sequence
ttgttgtttttgagggaagccc

SEQ ID NO: 185858 - DNA, 22 bp, Artificial sequence
  SiRNA target sequence
tgttgtttttgagggaagccct

SEQ ID NO: 185859 - DNA, 22 bp, Artificial sequence
  SiRNA target sequence
gttgtttttgagggaagcccta

SEQ ID NO: 185860 - DNA, 22 bp, Artificial sequence
  SiRNA target sequence
ttgtttttgagggaagccctag

SEQ ID NO: 185861 - DNA, 22 bp, Artificial sequence
  SiRNA target sequence
tgtttttgagggaagccctagt

SEQ ID NO: 185862 - DNA, 22 bp, Artificial sequence
  SiRNA target sequence
gtttttgagggaagccctagtg

SEQ ID NO: 185863 - DNA, 22 bp, Artificial sequence
  SiRNA target sequence
tttttgagggaagccctagtgt

SEQ ID NO: 185864 - DNA, 22 bp, Artificial sequence
  SiRNA target sequence
ttttgagggaagccctagtgtt

SEQ ID NO: 185865 - DNA, 22 bp, Artificial sequence
  SiRNA target sequence
tttgagggaagccctagtgttc

SEQ ID NO: 185866 - DNA, 22 bp, Artificial sequence
  SiRNA target sequence
ttgagggaagccctagtgttca

SEQ ID NO: 185867 - DNA, 22 bp, Artificial sequence
  SiRNA target sequence
tgagggaagccctagtgttcat

SEQ ID NO: 185868 - DNA, 22 bp, Artificial sequence
  SiRNA target sequence
gagggaagccctagtgttcata

SEQ ID NO: 185869 - DNA, 22 bp, Artificial sequence
  SiRNA target sequence
agggaagccctagtgttcatag

SEQ ID NO: 185870 - DNA, 22 bp, Artificial sequence
  SiRNA target sequence
gggaagccctagtgttcatagc

SEQ ID NO: 185871 - DNA, 22 bp, Artificial sequence
  SiRNA target sequence
ggaagccctagtgttcatagca

SEQ ID NO: 185872 - DNA, 22 bp, Artificial sequence
  SiRNA target sequence
gaagccctagtgttcatagcac

SEQ ID NO: 185873 - DNA, 22 bp, Artificial sequence
  SiRNA target sequence
aagccctagtgttcatagcact

SEQ ID NO: 185874 - DNA, 22 bp, Artificial sequence
  SiRNA target sequence
agccctagtgttcatagcactg

SEQ ID NO: 185875 - DNA, 22 bp, Artificial sequence
  SiRNA target sequence
gccctagtgttcatagcactgc

SEQ ID NO: 185876 - DNA, 22 bp, Artificial sequence
  SiRNA target sequence
ccctagtgttcatagcactgct

SEQ ID NO: 185877 - DNA, 22 bp, Artificial sequence
  SiRNA target sequence
cctagtgttcatagcactgctc

SEQ ID NO: 185878 - DNA, 22 bp, Artificial sequence
  SiRNA target sequence
ctagtgttcatagcactgctca

SEQ ID NO: 185879 - DNA, 22 bp, Artificial sequence
  SiRNA target sequence
tagtgttcatagcactgctcat

SEQ ID NO: 185880 - DNA, 22 bp, Artificial sequence
  SiRNA target sequence
agtgttcatagcactgctcata

SEQ ID NO: 185881 - DNA, 22 bp, Artificial sequence
  SiRNA target sequence
gtgttcatagcactgctcataa

SEQ ID NO: 185882 - DNA, 22 bp, Artificial sequence
  SiRNA target sequence
tgttcatagcactgctcataaa

SEQ ID NO: 185883 - DNA, 22 bp, Artificial sequence
  SiRNA target sequence
gttcatagcactgctcataaac

SEQ ID NO: 185884 - DNA, 22 bp, Artificial sequence
  SiRNA target sequence
ttcatagcactgctcataaacc

SEQ ID NO: 185885 - DNA, 22 bp, Artificial sequence
  SiRNA target sequence
tcatagcactgctcataaaccg

SEQ ID NO: 185886 - DNA, 22 bp, Artificial sequence
  SiRNA target sequence
catagcactgctcataaaccga

SEQ ID NO: 185887 - DNA, 22 bp, Artificial sequence
  SiRNA target sequence
atagcactgctcataaaccgat

SEQ ID NO: 185888 - DNA, 22 bp, Artificial sequence
  SiRNA target sequence
tagcactgctcataaaccgatg

SEQ ID NO: 185889 - DNA, 22 bp, Artificial sequence
  SiRNA target sequence
agcactgctcataaaccgatgg

SEQ ID NO: 185890 - DNA, 22 bp, Artificial sequence
  SiRNA target sequence
gcactgctcataaaccgatgga

SEQ ID NO: 185891 - DNA, 22 bp, Artificial sequence
  SiRNA target sequence
cactgctcataaaccgatggat

SEQ ID NO: 185892 - DNA, 22 bp, Artificial sequence
  SiRNA target sequence
actgctcataaaccgatggatt

SEQ ID NO: 185893 - DNA, 22 bp, Artificial sequence
  SiRNA target sequence
ctgctcataaaccgatggattt

SEQ ID NO: 185894 - DNA, 22 bp, Artificial sequence
  SiRNA target sequence
tgctcataaaccgatggatttg

SEQ ID NO: 185895 - DNA, 22 bp, Artificial sequence
  SiRNA target sequence
gctcataaaccgatggatttgc

SEQ ID NO: 185896 - DNA, 22 bp, Artificial sequence
  SiRNA target sequence
ctcataaaccgatggatttgca

SEQ ID NO: 185897 - DNA, 22 bp, Artificial sequence
  SiRNA target sequence
tcataaaccgatggatttgcat

SEQ ID NO: 185898 - DNA, 22 bp, Artificial sequence
  SiRNA target sequence
cataaaccgatggatttgcata

SEQ ID NO: 185899 - DNA, 22 bp, Artificial sequence
  SiRNA target sequence
ataaaccgatggatttgcatag

SEQ ID NO: 185900 - DNA, 22 bp, Artificial sequence
  SiRNA target sequence
taaaccgatggatttgcatagt

SEQ ID NO: 185901 - DNA, 22 bp, Artificial sequence
  SiRNA target sequence
aaaccgatggatttgcatagtg

SEQ ID NO: 185902 - DNA, 22 bp, Artificial sequence
  SiRNA target sequence
aaccgatggatttgcatagtgg

SEQ ID NO: 185903 - DNA, 22 bp, Artificial sequence
  SiRNA target sequence
accgatggatttgcatagtgga

SEQ ID NO: 185904 - DNA, 22 bp, Artificial sequence
  SiRNA target sequence
ccgatggatttgcatagtggaa

SEQ ID NO: 185905 - DNA, 22 bp, Artificial sequence
  SiRNA target sequence
cgatggatttgcatagtggaat

SEQ ID NO: 185906 - DNA, 22 bp, Artificial sequence
  SiRNA target sequence
gatggatttgcatagtggaatg

SEQ ID NO: 185907 - DNA, 22 bp, Artificial sequence
  SiRNA target sequence
atggatttgcatagtggaatga

SEQ ID NO: 185908 - DNA, 22 bp, Artificial sequence
  SiRNA target sequence
tggatttgcatagtggaatgaa

SEQ ID NO: 185909 - DNA, 22 bp, Artificial sequence
  SiRNA target sequence
ggatttgcatagtggaatgaat

SEQ ID NO: 185910 - DNA, 22 bp, Artificial sequence
  SiRNA target sequence
gatttgcatagtggaatgaata

SEQ ID NO: 185911 - DNA, 22 bp, Artificial sequence
  SiRNA target sequence
atttgcatagtggaatgaatat

SEQ ID NO: 185912 - DNA, 22 bp, Artificial sequence
  SiRNA target sequence
tttgcatagtggaatgaatatt

SEQ ID NO: 185913 - DNA, 22 bp, Artificial sequence
  SiRNA target sequence
ttgcatagtggaatgaatattt

SEQ ID NO: 185914 - DNA, 22 bp, Artificial sequence
  SiRNA target sequence
tgcatagtggaatgaatatttt

SEQ ID NO: 185915 - DNA, 22 bp, Artificial sequence
  SiRNA target sequence
gcatagtggaatgaatattttt

SEQ ID NO: 185916 - DNA, 22 bp, Artificial sequence
  SiRNA target sequence
catagtggaatgaatatttttt

SEQ ID NO: 185917 - DNA, 22 bp, Artificial sequence
  SiRNA target sequence
atagtggaatgaatattttttt

SEQ ID NO: 185918 - DNA, 22 bp, Artificial sequence
  SiRNA target sequence
tagtggaatgaatattttttta

SEQ ID NO: 185919 - DNA, 22 bp, Artificial sequence
  SiRNA target sequence
agtggaatgaatatttttttaa

SEQ ID NO: 185920 - DNA, 22 bp, Artificial sequence
  SiRNA target sequence
gtggaatgaatatttttttaaa

SEQ ID NO: 185921 - DNA, 22 bp, Artificial sequence
  SiRNA target sequence
tggaatgaatatttttttaaag

SEQ ID NO: 185922 - DNA, 22 bp, Artificial sequence
  SiRNA target sequence
ggaatgaatatttttttaaaga

SEQ ID NO: 185923 - DNA, 22 bp, Artificial sequence
  SiRNA target sequence
gaatgaatatttttttaaagaa

SEQ ID NO: 185924 - DNA, 22 bp, Artificial sequence
  SiRNA target sequence
aatgaatatttttttaaagaat

SEQ ID NO: 185925 - DNA, 22 bp, Artificial sequence
  SiRNA target sequence
atgaatatttttttaaagaatc

SEQ ID NO: 185926 - DNA, 22 bp, Artificial sequence
  SiRNA target sequence
tgaatatttttttaaagaatct

SEQ ID NO: 185927 - DNA, 22 bp, Artificial sequence
  SiRNA target sequence
gaatatttttttaaagaatctt

SEQ ID NO: 185928 - DNA, 22 bp, Artificial sequence
  SiRNA target sequence
aatatttttttaaagaatcttg

SEQ ID NO: 185929 - DNA, 22 bp, Artificial sequence
  SiRNA target sequence
atatttttttaaagaatcttga

SEQ ID NO: 185930 - DNA, 22 bp, Artificial sequence
  SiRNA target sequence
tatttttttaaagaatcttgat

SEQ ID NO: 185931 - DNA, 22 bp, Artificial sequence
  SiRNA target sequence
atttttttaaagaatcttgata

SEQ ID NO: 185932 - DNA, 22 bp, Artificial sequence
  SiRNA target sequence
tttttttaaagaatcttgatat

SEQ ID NO: 185933 - DNA, 22 bp, Artificial sequence
  SiRNA target sequence
ttttttaaagaatcttgatatt

SEQ ID NO: 185934 - DNA, 22 bp, Artificial sequence
  SiRNA target sequence
tttttaaagaatcttgatatta

SEQ ID NO: 185935 - DNA, 22 bp, Artificial sequence
  SiRNA target sequence
ttttaaagaatcttgatattac

SEQ ID NO: 185936 - DNA, 22 bp, Artificial sequence
  SiRNA target sequence
tttaaagaatcttgatattact

SEQ ID NO: 185937 - DNA, 22 bp, Artificial sequence
  SiRNA target sequence
ttaaagaatcttgatattactt

SEQ ID NO: 185938 - DNA, 22 bp, Artificial sequence
  SiRNA target sequence
taaagaatcttgatattacttt

SEQ ID NO: 185939 - DNA, 22 bp, Artificial sequence
  SiRNA target sequence
aaagaatcttgatattactttt

SEQ ID NO: 185940 - DNA, 22 bp, Artificial sequence
  SiRNA target sequence
aagaatcttgatattactttta

SEQ ID NO: 185941 - DNA, 22 bp, Artificial sequence
  SiRNA target sequence
agaatcttgatattacttttag

SEQ ID NO: 185942 - DNA, 22 bp, Artificial sequence
  SiRNA target sequence
gaatcttgatattacttttaga

SEQ ID NO: 185943 - DNA, 22 bp, Artificial sequence
  SiRNA target sequence
aatcttgatattacttttagaa

SEQ ID NO: 185944 - DNA, 22 bp, Artificial sequence
  SiRNA target sequence
atcttgatattacttttagaag

SEQ ID NO: 185945 - DNA, 22 bp, Artificial sequence
  SiRNA target sequence
tcttgatattacttttagaaga

SEQ ID NO: 185946 - DNA, 22 bp, Artificial sequence
  SiRNA target sequence
cttgatattacttttagaagag

SEQ ID NO: 185947 - DNA, 22 bp, Artificial sequence
  SiRNA target sequence
ttgatattacttttagaagaga

SEQ ID NO: 185948 - DNA, 22 bp, Artificial sequence
  SiRNA target sequence
tgatattacttttagaagagac

SEQ ID NO: 185949 - DNA, 22 bp, Artificial sequence
  SiRNA target sequence
gatattacttttagaagagact

SEQ ID NO: 185950 - DNA, 22 bp, Artificial sequence
  SiRNA target sequence
atattacttttagaagagactc

SEQ ID NO: 185951 - DNA, 22 bp, Artificial sequence
  SiRNA target sequence
tattacttttagaagagactct

SEQ ID NO: 185952 - DNA, 22 bp, Artificial sequence
  SiRNA target sequence
attacttttagaagagactctt

SEQ ID NO: 185953 - DNA, 22 bp, Artificial sequence
  SiRNA target sequence
ttacttttagaagagactcttc

SEQ ID NO: 185954 - DNA, 22 bp, Artificial sequence
  SiRNA target sequence
tacttttagaagagactcttcc

SEQ ID NO: 185955 - DNA, 22 bp, Artificial sequence
  SiRNA target sequence
acttttagaagagactcttcca

SEQ ID NO: 185956 - DNA, 22 bp, Artificial sequence
  SiRNA target sequence
cttttagaagagactcttccaa

SEQ ID NO: 185957 - DNA, 22 bp, Artificial sequence
  SiRNA target sequence
ttttagaagagactcttccaat

SEQ ID NO: 185958 - DNA, 22 bp, Artificial sequence
  SiRNA target sequence
tttagaagagactcttccaatt

SEQ ID NO: 185959 - DNA, 22 bp, Artificial sequence
  SiRNA target sequence
ttagaagagactcttccaattt

SEQ ID NO: 185960 - DNA, 22 bp, Artificial sequence
  SiRNA target sequence
tagaagagactcttccaatttt

SEQ ID NO: 185961 - DNA, 22 bp, Artificial sequence
  SiRNA target sequence
agaagagactcttccaatttta

SEQ ID NO: 185962 - DNA, 22 bp, Artificial sequence
  SiRNA target sequence
gaagagactcttccaattttag

SEQ ID NO: 185963 - DNA, 22 bp, Artificial sequence
  SiRNA target sequence
aagagactcttccaattttaga

SEQ ID NO: 185964 - DNA, 22 bp, Artificial sequence
  SiRNA target sequence
agagactcttccaattttagac

SEQ ID NO: 185965 - DNA, 22 bp, Artificial sequence
  SiRNA target sequence
gagactcttccaattttagacc

SEQ ID NO: 185966 - DNA, 22 bp, Artificial sequence
  SiRNA target sequence
agactcttccaattttagacca

SEQ ID NO: 185967 - DNA, 22 bp, Artificial sequence
  SiRNA target sequence
gactcttccaattttagaccaa

SEQ ID NO: 185968 - DNA, 22 bp, Artificial sequence
  SiRNA target sequence
actcttccaattttagaccaag

SEQ ID NO: 185969 - DNA, 22 bp, Artificial sequence
  SiRNA target sequence
ctcttccaattttagaccaaga

SEQ ID NO: 185970 - DNA, 22 bp, Artificial sequence
  SiRNA target sequence
tcttccaattttagaccaagag

SEQ ID NO: 185971 - DNA, 22 bp, Artificial sequence
  SiRNA target sequence
cttccaattttagaccaagagt

SEQ ID NO: 185972 - DNA, 22 bp, Artificial sequence
  SiRNA target sequence
ttccaattttagaccaagagtt

SEQ ID NO: 185973 - DNA, 22 bp, Artificial sequence
  SiRNA target sequence
tccaattttagaccaagagtta

SEQ ID NO: 185974 - DNA, 22 bp, Artificial sequence
  SiRNA target sequence
ccaattttagaccaagagttaa

SEQ ID NO: 185975 - DNA, 22 bp, Artificial sequence
  SiRNA target sequence
caattttagaccaagagttaat

SEQ ID NO: 185976 - DNA, 22 bp, Artificial sequence
  SiRNA target sequence
aattttagaccaagagttaata

SEQ ID NO: 185977 - DNA, 22 bp, Artificial sequence
  SiRNA target sequence
attttagaccaagagttaataa

SEQ ID NO: 185978 - DNA, 22 bp, Artificial sequence
  SiRNA target sequence
ttttagaccaagagttaataag

SEQ ID NO: 185979 - DNA, 22 bp, Artificial sequence
  SiRNA target sequence
tttagaccaagagttaataagc

SEQ ID NO: 185980 - DNA, 22 bp, Artificial sequence
  SiRNA target sequence
ttagaccaagagttaataagcc

SEQ ID NO: 185981 - DNA, 22 bp, Artificial sequence
  SiRNA target sequence
tagaccaagagttaataagccg

SEQ ID NO: 185982 - DNA, 22 bp, Artificial sequence
  SiRNA target sequence
agaccaagagttaataagccga

SEQ ID NO: 185983 - DNA, 22 bp, Artificial sequence
  SiRNA target sequence
gaccaagagttaataagccgaa

SEQ ID NO: 185984 - DNA, 22 bp, Artificial sequence
  SiRNA target sequence
accaagagttaataagccgaat

SEQ ID NO: 185985 - DNA, 22 bp, Artificial sequence
  SiRNA target sequence
ccaagagttaataagccgaatt

SEQ ID NO: 185986 - DNA, 22 bp, Artificial sequence
  SiRNA target sequence
caagagttaataagccgaattc

SEQ ID NO: 185987 - DNA, 22 bp, Artificial sequence
  SiRNA target sequence
aagagttaataagccgaattcc

SEQ ID NO: 185988 - DNA, 22 bp, Artificial sequence
  SiRNA target sequence
agagttaataagccgaattccg

SEQ ID NO: 185989 - DNA, 22 bp, Artificial sequence
  SiRNA target sequence
gagttaataagccgaattccgc

SEQ ID NO: 185990 - DNA, 22 bp, Artificial sequence
  SiRNA target sequence
agttaataagccgaattccgca

SEQ ID NO: 185991 - DNA, 22 bp, Artificial sequence
  SiRNA target sequence
gttaataagccgaattccgcaa

SEQ ID NO: 185992 - DNA, 22 bp, Artificial sequence
  SiRNA target sequence
ttaataagccgaattccgcaaa

SEQ ID NO: 185993 - DNA, 22 bp, Artificial sequence
  SiRNA target sequence
taataagccgaattccgcaaaa

SEQ ID NO: 185994 - DNA, 22 bp, Artificial sequence
  SiRNA target sequence
aataagccgaattccgcaaaag

SEQ ID NO: 185995 - DNA, 22 bp, Artificial sequence
  SiRNA target sequence
ataagccgaattccgcaaaaga

SEQ ID NO: 185996 - DNA, 22 bp, Artificial sequence
  SiRNA target sequence
taagccgaattccgcaaaagac

SEQ ID NO: 185997 - DNA, 22 bp, Artificial sequence
  SiRNA target sequence
aagccgaattccgcaaaagaca

SEQ ID NO: 185998 - DNA, 22 bp, Artificial sequence
  SiRNA target sequence
agccgaattccgcaaaagacag

SEQ ID NO: 185999 - DNA, 22 bp, Artificial sequence
  SiRNA target sequence
gccgaattccgcaaaagacaga

SEQ ID NO: 186000 - DNA, 22 bp, Artificial sequence
  SiRNA target sequence
ccgaattccgcaaaagacagaa

SEQ ID NO: 186001 - DNA, 22 bp, Artificial sequence
  SiRNA target sequence
cgaattccgcaaaagacagaac

SEQ ID NO: 186002 - DNA, 22 bp, Artificial sequence
  SiRNA target sequence
gaattccgcaaaagacagaact

SEQ ID NO: 186003 - DNA, 22 bp, Artificial sequence
  SiRNA target sequence
aattccgcaaaagacagaactc

SEQ ID NO: 186004 - DNA, 22 bp, Artificial sequence
  SiRNA target sequence
attccgcaaaagacagaactca

SEQ ID NO: 186005 - DNA, 22 bp, Artificial sequence
  SiRNA target sequence
ttccgcaaaagacagaactcag

SEQ ID NO: 186006 - DNA, 22 bp, Artificial sequence
  SiRNA target sequence
tccgcaaaagacagaactcaga

SEQ ID NO: 186007 - DNA, 22 bp, Artificial sequence
  SiRNA target sequence
ccgcaaaagacagaactcagaa

SEQ ID NO: 186008 - DNA, 22 bp, Artificial sequence
  SiRNA target sequence
cgcaaaagacagaactcagaaa

SEQ ID NO: 186009 - DNA, 22 bp, Artificial sequence
  SiRNA target sequence
gcaaaagacagaactcagaaag

SEQ ID NO: 186010 - DNA, 22 bp, Artificial sequence
  SiRNA target sequence
caaaagacagaactcagaaaga

SEQ ID NO: 186011 - DNA, 22 bp, Artificial sequence
  SiRNA target sequence
aaaagacagaactcagaaagaa

SEQ ID NO: 186012 - DNA, 22 bp, Artificial sequence
  SiRNA target sequence
aaagacagaactcagaaagaag

SEQ ID NO: 186013 - DNA, 22 bp, Artificial sequence
  SiRNA target sequence
aagacagaactcagaaagaaga

SEQ ID NO: 186014 - DNA, 22 bp, Artificial sequence
  SiRNA target sequence
agacagaactcagaaagaagag

SEQ ID NO: 186015 - DNA, 22 bp, Artificial sequence
  SiRNA target sequence
gacagaactcagaaagaagaga

SEQ ID NO: 186016 - DNA, 22 bp, Artificial sequence
  SiRNA target sequence
acagaactcagaaagaagagaa

SEQ ID NO: 186017 - DNA, 22 bp, Artificial sequence
  SiRNA target sequence
cagaactcagaaagaagagaat

SEQ ID NO: 186018 - DNA, 22 bp, Artificial sequence
  SiRNA target sequence
agaactcagaaagaagagaata

SEQ ID NO: 186019 - DNA, 22 bp, Artificial sequence
  SiRNA target sequence
gaactcagaaagaagagaataa

SEQ ID NO: 186020 - DNA, 22 bp, Artificial sequence
  SiRNA target sequence
aactcagaaagaagagaataaa

SEQ ID NO: 186021 - DNA, 22 bp, Artificial sequence
  SiRNA target sequence
actcagaaagaagagaataaat

SEQ ID NO: 186022 - DNA, 22 bp, Artificial sequence
  SiRNA target sequence
ctcagaaagaagagaataaata

SEQ ID NO: 186023 - DNA, 22 bp, Artificial sequence
  SiRNA target sequence
tcagaaagaagagaataaatat

SEQ ID NO: 186024 - DNA, 22 bp, Artificial sequence
  SiRNA target sequence
cagaaagaagagaataaatatt

SEQ ID NO: 186025 - DNA, 22 bp, Artificial sequence
  SiRNA target sequence
agaaagaagagaataaatattt

SEQ ID NO: 186026 - DNA, 22 bp, Artificial sequence
  SiRNA target sequence
gaaagaagagaataaatatttt

SEQ ID NO: 186027 - DNA, 22 bp, Artificial sequence
  SiRNA target sequence
aaagaagagaataaatattttt

SEQ ID NO: 186028 - DNA, 22 bp, Artificial sequence
  SiRNA target sequence
aagaagagaataaatatttttt

SEQ ID NO: 186029 - DNA, 22 bp, Artificial sequence
  SiRNA target sequence
agaagagaataaatattttttt

SEQ ID NO: 186030 - DNA, 22 bp, Artificial sequence
  SiRNA target sequence
gaagagaataaatatttttttt

SEQ ID NO: 186031 - DNA, 22 bp, Artificial sequence
  SiRNA target sequence
aagagaataaatattttttttg

SEQ ID NO: 186032 - DNA, 22 bp, Artificial sequence
  SiRNA target sequence
agagaataaatattttttttga

SEQ ID NO: 186033 - DNA, 23 bp, Artificial sequence
  SiRNA target sequence
atggccaagaatgaatctaataa

SEQ ID NO: 186034 - DNA, 23 bp, Artificial sequence
  SiRNA target sequence
tggccaagaatgaatctaataaa

SEQ ID NO: 186035 - DNA, 23 bp, Artificial sequence
  SiRNA target sequence
ggccaagaatgaatctaataaaa

SEQ ID NO: 186036 - DNA, 23 bp, Artificial sequence
  SiRNA target sequence
gccaagaatgaatctaataaaat

SEQ ID NO: 186037 - DNA, 23 bp, Artificial sequence
  SiRNA target sequence
ccaagaatgaatctaataaaata

SEQ ID NO: 186038 - DNA, 23 bp, Artificial sequence
  SiRNA target sequence
caagaatgaatctaataaaataa

SEQ ID NO: 186039 - DNA, 23 bp, Artificial sequence
  SiRNA target sequence
aagaatgaatctaataaaataac

SEQ ID NO: 186040 - DNA, 23 bp, Artificial sequence
  SiRNA target sequence
agaatgaatctaataaaataacg

SEQ ID NO: 186041 - DNA, 23 bp, Artificial sequence
  SiRNA target sequence
gaatgaatctaataaaataacga

SEQ ID NO: 186042 - DNA, 23 bp, Artificial sequence
  SiRNA target sequence
aatgaatctaataaaataacgag

SEQ ID NO: 186043 - DNA, 23 bp, Artificial sequence
  SiRNA target sequence
atgaatctaataaaataacgaga

SEQ ID NO: 186044 - DNA, 23 bp, Artificial sequence
  SiRNA target sequence
tgaatctaataaaataacgagac

SEQ ID NO: 186045 - DNA, 23 bp, Artificial sequence
  SiRNA target sequence
gaatctaataaaataacgagact

SEQ ID NO: 186046 - DNA, 23 bp, Artificial sequence
  SiRNA target sequence
aatctaataaaataacgagactg

SEQ ID NO: 186047 - DNA, 23 bp, Artificial sequence
  SiRNA target sequence
atctaataaaataacgagactgg

SEQ ID NO: 186048 - DNA, 23 bp, Artificial sequence
  SiRNA target sequence
tctaataaaataacgagactggc

SEQ ID NO: 186049 - DNA, 23 bp, Artificial sequence
  SiRNA target sequence
ctaataaaataacgagactggca

SEQ ID NO: 186050 - DNA, 23 bp, Artificial sequence
  SiRNA target sequence
taataaaataacgagactggcaa

SEQ ID NO: 186051 - DNA, 23 bp, Artificial sequence
  SiRNA target sequence
aataaaataacgagactggcaat

SEQ ID NO: 186052 - DNA, 23 bp, Artificial sequence
  SiRNA target sequence
ataaaataacgagactggcaatt

SEQ ID NO: 186053 - DNA, 23 bp, Artificial sequence
  SiRNA target sequence
taaaataacgagactggcaattg

SEQ ID NO: 186054 - DNA, 23 bp, Artificial sequence
  SiRNA target sequence
aaaataacgagactggcaattgt

SEQ ID NO: 186055 - DNA, 23 bp, Artificial sequence
  SiRNA target sequence
aaataacgagactggcaattgtt

SEQ ID NO: 186056 - DNA, 23 bp, Artificial sequence
  SiRNA target sequence
aataacgagactggcaattgtta

SEQ ID NO: 186057 - DNA, 23 bp, Artificial sequence
  SiRNA target sequence
ataacgagactggcaattgttaa

SEQ ID NO: 186058 - DNA, 23 bp, Artificial sequence
  SiRNA target sequence
taacgagactggcaattgttaat

SEQ ID NO: 186059 - DNA, 23 bp, Artificial sequence
  SiRNA target sequence
aacgagactggcaattgttaatt

SEQ ID NO: 186060 - DNA, 23 bp, Artificial sequence
  SiRNA target sequence
acgagactggcaattgttaatta

SEQ ID NO: 186061 - DNA, 23 bp, Artificial sequence
  SiRNA target sequence
cgagactggcaattgttaattat

SEQ ID NO: 186062 - DNA, 23 bp, Artificial sequence
  SiRNA target sequence
gagactggcaattgttaattatg

SEQ ID NO: 186063 - DNA, 23 bp, Artificial sequence
  SiRNA target sequence
agactggcaattgttaattatga

SEQ ID NO: 186064 - DNA, 23 bp, Artificial sequence
  SiRNA target sequence
gactggcaattgttaattatgaa

SEQ ID NO: 186065 - DNA, 23 bp, Artificial sequence
  SiRNA target sequence
actggcaattgttaattatgaac

SEQ ID NO: 186066 - DNA, 23 bp, Artificial sequence
  SiRNA target sequence
ctggcaattgttaattatgaact

SEQ ID NO: 186067 - DNA, 23 bp, Artificial sequence
  SiRNA target sequence
tggcaattgttaattatgaacta

SEQ ID NO: 186068 - DNA, 23 bp, Artificial sequence
  SiRNA target sequence
ggcaattgttaattatgaactat

SEQ ID NO: 186069 - DNA, 23 bp, Artificial sequence
  SiRNA target sequence
gcaattgttaattatgaactatg

SEQ ID NO: 186070 - DNA, 23 bp, Artificial sequence
  SiRNA target sequence
caattgttaattatgaactatgt

SEQ ID NO: 186071 - DNA, 23 bp, Artificial sequence
  SiRNA target sequence
aattgttaattatgaactatgta

SEQ ID NO: 186072 - DNA, 23 bp, Artificial sequence
  SiRNA target sequence
attgttaattatgaactatgtaa

SEQ ID NO: 186073 - DNA, 23 bp, Artificial sequence
  SiRNA target sequence
ttgttaattatgaactatgtaaa

SEQ ID NO: 186074 - DNA, 23 bp, Artificial sequence
  SiRNA target sequence
tgttaattatgaactatgtaaac

SEQ ID NO: 186075 - DNA, 23 bp, Artificial sequence
  SiRNA target sequence
gttaattatgaactatgtaaacc

SEQ ID NO: 186076 - DNA, 23 bp, Artificial sequence
  SiRNA target sequence
ttaattatgaactatgtaaaccg

SEQ ID NO: 186077 - DNA, 23 bp, Artificial sequence
  SiRNA target sequence
taattatgaactatgtaaaccga

SEQ ID NO: 186078 - DNA, 23 bp, Artificial sequence
  SiRNA target sequence
aattatgaactatgtaaaccgaa

SEQ ID NO: 186079 - DNA, 23 bp, Artificial sequence
  SiRNA target sequence
attatgaactatgtaaaccgaag

SEQ ID NO: 186080 - DNA, 23 bp, Artificial sequence
  SiRNA target sequence
ttatgaactatgtaaaccgaagg

SEQ ID NO: 186081 - DNA, 23 bp, Artificial sequence
  SiRNA target sequence
tatgaactatgtaaaccgaagga

SEQ ID NO: 186082 - DNA, 23 bp, Artificial sequence
  SiRNA target sequence
atgaactatgtaaaccgaaggaa

SEQ ID NO: 186083 - DNA, 23 bp, Artificial sequence
  SiRNA target sequence
tgaactatgtaaaccgaaggaat

SEQ ID NO: 186084 - DNA, 23 bp, Artificial sequence
  SiRNA target sequence
gaactatgtaaaccgaaggaatg

SEQ ID NO: 186085 - DNA, 23 bp, Artificial sequence
  SiRNA target sequence
aactatgtaaaccgaaggaatgt

SEQ ID NO: 186086 - DNA, 23 bp, Artificial sequence
  SiRNA target sequence
actatgtaaaccgaaggaatgta

SEQ ID NO: 186087 - DNA, 23 bp, Artificial sequence
  SiRNA target sequence
ctatgtaaaccgaaggaatgtat

SEQ ID NO: 186088 - DNA, 23 bp, Artificial sequence
  SiRNA target sequence
tatgtaaaccgaaggaatgtatg

SEQ ID NO: 186089 - DNA, 23 bp, Artificial sequence
  SiRNA target sequence
atgtaaaccgaaggaatgtatgt

SEQ ID NO: 186090 - DNA, 23 bp, Artificial sequence
  SiRNA target sequence
tgtaaaccgaaggaatgtatgtc

SEQ ID NO: 186091 - DNA, 23 bp, Artificial sequence
  SiRNA target sequence
gtaaaccgaaggaatgtatgtca

SEQ ID NO: 186092 - DNA, 23 bp, Artificial sequence
  SiRNA target sequence
taaaccgaaggaatgtatgtcag

SEQ ID NO: 186093 - DNA, 23 bp, Artificial sequence
  SiRNA target sequence
aaaccgaaggaatgtatgtcaga

SEQ ID NO: 186094 - DNA, 23 bp, Artificial sequence
  SiRNA target sequence
aaccgaaggaatgtatgtcagaa

SEQ ID NO: 186095 - DNA, 23 bp, Artificial sequence
  SiRNA target sequence
accgaaggaatgtatgtcagaat

SEQ ID NO: 186096 - DNA, 23 bp, Artificial sequence
  SiRNA target sequence
ccgaaggaatgtatgtcagaatg

SEQ ID NO: 186097 - DNA, 23 bp, Artificial sequence
  SiRNA target sequence
cgaaggaatgtatgtcagaatgt

SEQ ID NO: 186098 - DNA, 23 bp, Artificial sequence
  SiRNA target sequence
gaaggaatgtatgtcagaatgta

SEQ ID NO: 186099 - DNA, 23 bp, Artificial sequence
  SiRNA target sequence
aaggaatgtatgtcagaatgtaa

SEQ ID NO: 186100 - DNA, 23 bp, Artificial sequence
  SiRNA target sequence
aggaatgtatgtcagaatgtaaa

SEQ ID NO: 186101 - DNA, 23 bp, Artificial sequence
  SiRNA target sequence
ggaatgtatgtcagaatgtaaaa

SEQ ID NO: 186102 - DNA, 23 bp, Artificial sequence
  SiRNA target sequence
gaatgtatgtcagaatgtaaaaa

SEQ ID NO: 186103 - DNA, 23 bp, Artificial sequence
  SiRNA target sequence
aatgtatgtcagaatgtaaaaag

SEQ ID NO: 186104 - DNA, 23 bp, Artificial sequence
  SiRNA target sequence
atgtatgtcagaatgtaaaaagg

SEQ ID NO: 186105 - DNA, 23 bp, Artificial sequence
  SiRNA target sequence
tgtatgtcagaatgtaaaaaggc

SEQ ID NO: 186106 - DNA, 23 bp, Artificial sequence
  SiRNA target sequence
gtatgtcagaatgtaaaaaggcg

SEQ ID NO: 186107 - DNA, 23 bp, Artificial sequence
  SiRNA target sequence
tatgtcagaatgtaaaaaggcgt

SEQ ID NO: 186108 - DNA, 23 bp, Artificial sequence
  SiRNA target sequence
atgtcagaatgtaaaaaggcgtg

SEQ ID NO: 186109 - DNA, 23 bp, Artificial sequence
  SiRNA target sequence
tgtcagaatgtaaaaaggcgtgt

SEQ ID NO: 186110 - DNA, 23 bp, Artificial sequence
  SiRNA target sequence
gtcagaatgtaaaaaggcgtgtc

SEQ ID NO: 186111 - DNA, 23 bp, Artificial sequence
  SiRNA target sequence
tcagaatgtaaaaaggcgtgtcc

SEQ ID NO: 186112 - DNA, 23 bp, Artificial sequence
  SiRNA target sequence
cagaatgtaaaaaggcgtgtcct

SEQ ID NO: 186113 - DNA, 23 bp, Artificial sequence
  SiRNA target sequence
agaatgtaaaaaggcgtgtcctg

SEQ ID NO: 186114 - DNA, 23 bp, Artificial sequence
  SiRNA target sequence
gaatgtaaaaaggcgtgtcctgt

SEQ ID NO: 186115 - DNA, 23 bp, Artificial sequence
  SiRNA target sequence
aatgtaaaaaggcgtgtcctgtt

SEQ ID NO: 186116 - DNA, 23 bp, Artificial sequence
  SiRNA target sequence
atgtaaaaaggcgtgtcctgtta

SEQ ID NO: 186117 - DNA, 23 bp, Artificial sequence
  SiRNA target sequence
tgtaaaaaggcgtgtcctgttaa

SEQ ID NO: 186118 - DNA, 23 bp, Artificial sequence
  SiRNA target sequence
gtaaaaaggcgtgtcctgttaat

SEQ ID NO: 186119 - DNA, 23 bp, Artificial sequence
  SiRNA target sequence
taaaaaggcgtgtcctgttaata

SEQ ID NO: 186120 - DNA, 23 bp, Artificial sequence
  SiRNA target sequence
aaaaaggcgtgtcctgttaataa

SEQ ID NO: 186121 - DNA, 23 bp, Artificial sequence
  SiRNA target sequence
aaaaggcgtgtcctgttaataaa

SEQ ID NO: 186122 - DNA, 23 bp, Artificial sequence
  SiRNA target sequence
aaaggcgtgtcctgttaataaaa

SEQ ID NO: 186123 - DNA, 23 bp, Artificial sequence
  SiRNA target sequence
aaggcgtgtcctgttaataaaac

SEQ ID NO: 186124 - DNA, 23 bp, Artificial sequence
  SiRNA target sequence
aggcgtgtcctgttaataaaaca

SEQ ID NO: 186125 - DNA, 23 bp, Artificial sequence
  SiRNA target sequence
ggcgtgtcctgttaataaaacag

SEQ ID NO: 186126 - DNA, 23 bp, Artificial sequence
  SiRNA target sequence
gcgtgtcctgttaataaaacagg

SEQ ID NO: 186127 - DNA, 23 bp, Artificial sequence
  SiRNA target sequence
cgtgtcctgttaataaaacagga

SEQ ID NO: 186128 - DNA, 23 bp, Artificial sequence
  SiRNA target sequence
gtgtcctgttaataaaacaggaa

SEQ ID NO: 186129 - DNA, 23 bp, Artificial sequence
  SiRNA target sequence
tgtcctgttaataaaacaggaaa

SEQ ID NO: 186130 - DNA, 23 bp, Artificial sequence
  SiRNA target sequence
gtcctgttaataaaacaggaaag

SEQ ID NO: 186131 - DNA, 23 bp, Artificial sequence
  SiRNA target sequence
tcctgttaataaaacaggaaagg

SEQ ID NO: 186132 - DNA, 23 bp, Artificial sequence
  SiRNA target sequence
cctgttaataaaacaggaaagga

SEQ ID NO: 186133 - DNA, 23 bp, Artificial sequence
  SiRNA target sequence
ctgttaataaaacaggaaaggag

SEQ ID NO: 186134 - DNA, 23 bp, Artificial sequence
  SiRNA target sequence
tgttaataaaacaggaaaggagt

SEQ ID NO: 186135 - DNA, 23 bp, Artificial sequence
  SiRNA target sequence
gttaataaaacaggaaaggagtg

SEQ ID NO: 186136 - DNA, 23 bp, Artificial sequence
  SiRNA target sequence
ttaataaaacaggaaaggagtgt

SEQ ID NO: 186137 - DNA, 23 bp, Artificial sequence
  SiRNA target sequence
taataaaacaggaaaggagtgta

SEQ ID NO: 186138 - DNA, 23 bp, Artificial sequence
  SiRNA target sequence
aataaaacaggaaaggagtgtat

SEQ ID NO: 186139 - DNA, 23 bp, Artificial sequence
  SiRNA target sequence
ataaaacaggaaaggagtgtatt

SEQ ID NO: 186140 - DNA, 23 bp, Artificial sequence
  SiRNA target sequence
taaaacaggaaaggagtgtatta

SEQ ID NO: 186141 - DNA, 23 bp, Artificial sequence
  SiRNA target sequence
aaaacaggaaaggagtgtattac

SEQ ID NO: 186142 - DNA, 23 bp, Artificial sequence
  SiRNA target sequence
aaacaggaaaggagtgtattaca

SEQ ID NO: 186143 - DNA, 23 bp, Artificial sequence
  SiRNA target sequence
aacaggaaaggagtgtattacaa

SEQ ID NO: 186144 - DNA, 23 bp, Artificial sequence
  SiRNA target sequence
acaggaaaggagtgtattacaat

SEQ ID NO: 186145 - DNA, 23 bp, Artificial sequence
  SiRNA target sequence
caggaaaggagtgtattacaatt

SEQ ID NO: 186146 - DNA, 23 bp, Artificial sequence
  SiRNA target sequence
aggaaaggagtgtattacaattg

SEQ ID NO: 186147 - DNA, 23 bp, Artificial sequence
  SiRNA target sequence
ggaaaggagtgtattacaattga

SEQ ID NO: 186148 - DNA, 23 bp, Artificial sequence
  SiRNA target sequence
gaaaggagtgtattacaattgat

SEQ ID NO: 186149 - DNA, 23 bp, Artificial sequence
  SiRNA target sequence
aaaggagtgtattacaattgata

SEQ ID NO: 186150 - DNA, 23 bp, Artificial sequence
  SiRNA target sequence
aaggagtgtattacaattgatac

SEQ ID NO: 186151 - DNA, 23 bp, Artificial sequence
  SiRNA target sequence
aggagtgtattacaattgatact

SEQ ID NO: 186152 - DNA, 23 bp, Artificial sequence
  SiRNA target sequence
ggagtgtattacaattgatacta

SEQ ID NO: 186153 - DNA, 23 bp, Artificial sequence
  SiRNA target sequence
gagtgtattacaattgatactaa

SEQ ID NO: 186154 - DNA, 23 bp, Artificial sequence
  SiRNA target sequence
agtgtattacaattgatactaaa

SEQ ID NO: 186155 - DNA, 23 bp, Artificial sequence
  SiRNA target sequence
gtgtattacaattgatactaaat

SEQ ID NO: 186156 - DNA, 23 bp, Artificial sequence
  SiRNA target sequence
tgtattacaattgatactaaatc

SEQ ID NO: 186157 - DNA, 23 bp, Artificial sequence
  SiRNA target sequence
gtattacaattgatactaaatca

SEQ ID NO: 186158 - DNA, 23 bp, Artificial sequence
  SiRNA target sequence
tattacaattgatactaaatcac

SEQ ID NO: 186159 - DNA, 23 bp, Artificial sequence
  SiRNA target sequence
attacaattgatactaaatcaca

SEQ ID NO: 186160 - DNA, 23 bp, Artificial sequence
  SiRNA target sequence
ttacaattgatactaaatcacat

SEQ ID NO: 186161 - DNA, 23 bp, Artificial sequence
  SiRNA target sequence
tacaattgatactaaatcacata

SEQ ID NO: 186162 - DNA, 23 bp, Artificial sequence
  SiRNA target sequence
acaattgatactaaatcacatat

SEQ ID NO: 186163 - DNA, 23 bp, Artificial sequence
  SiRNA target sequence
caattgatactaaatcacatatc

SEQ ID NO: 186164 - DNA, 23 bp, Artificial sequence
  SiRNA target sequence
aattgatactaaatcacatatct

SEQ ID NO: 186165 - DNA, 23 bp, Artificial sequence
  SiRNA target sequence
attgatactaaatcacatatctc

SEQ ID NO: 186166 - DNA, 23 bp, Artificial sequence
  SiRNA target sequence
ttgatactaaatcacatatctca

SEQ ID NO: 186167 - DNA, 23 bp, Artificial sequence
  SiRNA target sequence
tgatactaaatcacatatctcag

SEQ ID NO: 186168 - DNA, 23 bp, Artificial sequence
  SiRNA target sequence
gatactaaatcacatatctcaga

SEQ ID NO: 186169 - DNA, 23 bp, Artificial sequence
  SiRNA target sequence
atactaaatcacatatctcagaa

SEQ ID NO: 186170 - DNA, 23 bp, Artificial sequence
  SiRNA target sequence
tactaaatcacatatctcagaaa

SEQ ID NO: 186171 - DNA, 23 bp, Artificial sequence
  SiRNA target sequence
actaaatcacatatctcagaaat

SEQ ID NO: 186172 - DNA, 23 bp, Artificial sequence
  SiRNA target sequence
ctaaatcacatatctcagaaatt

SEQ ID NO: 186173 - DNA, 23 bp, Artificial sequence
  SiRNA target sequence
taaatcacatatctcagaaattc

SEQ ID NO: 186174 - DNA, 23 bp, Artificial sequence
  SiRNA target sequence
aaatcacatatctcagaaattct

SEQ ID NO: 186175 - DNA, 23 bp, Artificial sequence
  SiRNA target sequence
aatcacatatctcagaaattctg

SEQ ID NO: 186176 - DNA, 23 bp, Artificial sequence
  SiRNA target sequence
atcacatatctcagaaattctgt

SEQ ID NO: 186177 - DNA, 23 bp, Artificial sequence
  SiRNA target sequence
tcacatatctcagaaattctgtg

SEQ ID NO: 186178 - DNA, 23 bp, Artificial sequence
  SiRNA target sequence
cacatatctcagaaattctgtgt

SEQ ID NO: 186179 - DNA, 23 bp, Artificial sequence
  SiRNA target sequence
acatatctcagaaattctgtgta

SEQ ID NO: 186180 - DNA, 23 bp, Artificial sequence
  SiRNA target sequence
catatctcagaaattctgtgtat

SEQ ID NO: 186181 - DNA, 23 bp, Artificial sequence
  SiRNA target sequence
atatctcagaaattctgtgtata

SEQ ID NO: 186182 - DNA, 23 bp, Artificial sequence
  SiRNA target sequence
tatctcagaaattctgtgtatag

SEQ ID NO: 186183 - DNA, 23 bp, Artificial sequence
  SiRNA target sequence
atctcagaaattctgtgtatagg

SEQ ID NO: 186184 - DNA, 23 bp, Artificial sequence
  SiRNA target sequence
tctcagaaattctgtgtatagga

SEQ ID NO: 186185 - DNA, 23 bp, Artificial sequence
  SiRNA target sequence
ctcagaaattctgtgtataggat

SEQ ID NO: 186186 - DNA, 23 bp, Artificial sequence
  SiRNA target sequence
tcagaaattctgtgtataggatg

SEQ ID NO: 186187 - DNA, 23 bp, Artificial sequence
  SiRNA target sequence
cagaaattctgtgtataggatgt

SEQ ID NO: 186188 - DNA, 23 bp, Artificial sequence
  SiRNA target sequence
agaaattctgtgtataggatgtt

SEQ ID NO: 186189 - DNA, 23 bp, Artificial sequence
  SiRNA target sequence
gaaattctgtgtataggatgttc

SEQ ID NO: 186190 - DNA, 23 bp, Artificial sequence
  SiRNA target sequence
aaattctgtgtataggatgttct

SEQ ID NO: 186191 - DNA, 23 bp, Artificial sequence
  SiRNA target sequence
aattctgtgtataggatgttctg

SEQ ID NO: 186192 - DNA, 23 bp, Artificial sequence
  SiRNA target sequence
attctgtgtataggatgttctgc

SEQ ID NO: 186193 - DNA, 23 bp, Artificial sequence
  SiRNA target sequence
ttctgtgtataggatgttctgcg

SEQ ID NO: 186194 - DNA, 23 bp, Artificial sequence
  SiRNA target sequence
tctgtgtataggatgttctgcgt

SEQ ID NO: 186195 - DNA, 23 bp, Artificial sequence
  SiRNA target sequence
ctgtgtataggatgttctgcgtg

SEQ ID NO: 186196 - DNA, 23 bp, Artificial sequence
  SiRNA target sequence
tgtgtataggatgttctgcgtgt

SEQ ID NO: 186197 - DNA, 23 bp, Artificial sequence
  SiRNA target sequence
gtgtataggatgttctgcgtgtc

SEQ ID NO: 186198 - DNA, 23 bp, Artificial sequence
  SiRNA target sequence
tgtataggatgttctgcgtgtca

SEQ ID NO: 186199 - DNA, 23 bp, Artificial sequence
  SiRNA target sequence
gtataggatgttctgcgtgtcaa

SEQ ID NO: 186200 - DNA, 23 bp, Artificial sequence
  SiRNA target sequence
tataggatgttctgcgtgtcaaa

SEQ ID NO: 186201 - DNA, 23 bp, Artificial sequence
  SiRNA target sequence
ataggatgttctgcgtgtcaaaa

SEQ ID NO: 186202 - DNA, 23 bp, Artificial sequence
  SiRNA target sequence
taggatgttctgcgtgtcaaaag

SEQ ID NO: 186203 - DNA, 23 bp, Artificial sequence
  SiRNA target sequence
aggatgttctgcgtgtcaaaaga

SEQ ID NO: 186204 - DNA, 23 bp, Artificial sequence
  SiRNA target sequence
ggatgttctgcgtgtcaaaagaa

SEQ ID NO: 186205 - DNA, 23 bp, Artificial sequence
  SiRNA target sequence
gatgttctgcgtgtcaaaagaaa

SEQ ID NO: 186206 - DNA, 23 bp, Artificial sequence
  SiRNA target sequence
atgttctgcgtgtcaaaagaaat

SEQ ID NO: 186207 - DNA, 23 bp, Artificial sequence
  SiRNA target sequence
tgttctgcgtgtcaaaagaaatg

SEQ ID NO: 186208 - DNA, 23 bp, Artificial sequence
  SiRNA target sequence
gttctgcgtgtcaaaagaaatgt

SEQ ID NO: 186209 - DNA, 23 bp, Artificial sequence
  SiRNA target sequence
ttctgcgtgtcaaaagaaatgtc

SEQ ID NO: 186210 - DNA, 23 bp, Artificial sequence
  SiRNA target sequence
tctgcgtgtcaaaagaaatgtcc

SEQ ID NO: 186211 - DNA, 23 bp, Artificial sequence
  SiRNA target sequence
ctgcgtgtcaaaagaaatgtcct

SEQ ID NO: 186212 - DNA, 23 bp, Artificial sequence
  SiRNA target sequence
tgcgtgtcaaaagaaatgtcctt

SEQ ID NO: 186213 - DNA, 23 bp, Artificial sequence
  SiRNA target sequence
gcgtgtcaaaagaaatgtccttt

SEQ ID NO: 186214 - DNA, 23 bp, Artificial sequence
  SiRNA target sequence
cgtgtcaaaagaaatgtcctttt

SEQ ID NO: 186215 - DNA, 23 bp, Artificial sequence
  SiRNA target sequence
gtgtcaaaagaaatgtcctttta

SEQ ID NO: 186216 - DNA, 23 bp, Artificial sequence
  SiRNA target sequence
tgtcaaaagaaatgtccttttaa

SEQ ID NO: 186217 - DNA, 23 bp, Artificial sequence
  SiRNA target sequence
gtcaaaagaaatgtccttttaag

SEQ ID NO: 186218 - DNA, 23 bp, Artificial sequence
  SiRNA target sequence
tcaaaagaaatgtccttttaagg

SEQ ID NO: 186219 - DNA, 23 bp, Artificial sequence
  SiRNA target sequence
caaaagaaatgtccttttaaggc

SEQ ID NO: 186220 - DNA, 23 bp, Artificial sequence
  SiRNA target sequence
aaaagaaatgtccttttaaggcg

SEQ ID NO: 186221 - DNA, 23 bp, Artificial sequence
  SiRNA target sequence
aaagaaatgtccttttaaggcga

SEQ ID NO: 186222 - DNA, 23 bp, Artificial sequence
  SiRNA target sequence
aagaaatgtccttttaaggcgat

SEQ ID NO: 186223 - DNA, 23 bp, Artificial sequence
  SiRNA target sequence
agaaatgtccttttaaggcgatt

SEQ ID NO: 186224 - DNA, 23 bp, Artificial sequence
  SiRNA target sequence
gaaatgtccttttaaggcgatta

SEQ ID NO: 186225 - DNA, 23 bp, Artificial sequence
  SiRNA target sequence
aaatgtccttttaaggcgattac

SEQ ID NO: 186226 - DNA, 23 bp, Artificial sequence
  SiRNA target sequence
aatgtccttttaaggcgattaca

SEQ ID NO: 186227 - DNA, 23 bp, Artificial sequence
  SiRNA target sequence
atgtccttttaaggcgattacaa

SEQ ID NO: 186228 - DNA, 23 bp, Artificial sequence
  SiRNA target sequence
tgtccttttaaggcgattacaat

SEQ ID NO: 186229 - DNA, 23 bp, Artificial sequence
  SiRNA target sequence
gtccttttaaggcgattacaatt

SEQ ID NO: 186230 - DNA, 23 bp, Artificial sequence
  SiRNA target sequence
tccttttaaggcgattacaattg

SEQ ID NO: 186231 - DNA, 23 bp, Artificial sequence
  SiRNA target sequence
ccttttaaggcgattacaattgt

SEQ ID NO: 186232 - DNA, 23 bp, Artificial sequence
  SiRNA target sequence
cttttaaggcgattacaattgta

SEQ ID NO: 186233 - DNA, 23 bp, Artificial sequence
  SiRNA target sequence
ttttaaggcgattacaattgtaa

SEQ ID NO: 186234 - DNA, 23 bp, Artificial sequence
  SiRNA target sequence
tttaaggcgattacaattgtaaa

SEQ ID NO: 186235 - DNA, 23 bp, Artificial sequence
  SiRNA target sequence
ttaaggcgattacaattgtaaat

SEQ ID NO: 186236 - DNA, 23 bp, Artificial sequence
  SiRNA target sequence
taaggcgattacaattgtaaatt

SEQ ID NO: 186237 - DNA, 23 bp, Artificial sequence
  SiRNA target sequence
aaggcgattacaattgtaaattt

SEQ ID NO: 186238 - DNA, 23 bp, Artificial sequence
  SiRNA target sequence
aggcgattacaattgtaaattta

SEQ ID NO: 186239 - DNA, 23 bp, Artificial sequence
  SiRNA target sequence
ggcgattacaattgtaaatttac

SEQ ID NO: 186240 - DNA, 23 bp, Artificial sequence
  SiRNA target sequence
gcgattacaattgtaaatttacc

SEQ ID NO: 186241 - DNA, 23 bp, Artificial sequence
  SiRNA target sequence
cgattacaattgtaaatttacct

SEQ ID NO: 186242 - DNA, 23 bp, Artificial sequence
  SiRNA target sequence
gattacaattgtaaatttaccta

SEQ ID NO: 186243 - DNA, 23 bp, Artificial sequence
  SiRNA target sequence
attacaattgtaaatttacctac

SEQ ID NO: 186244 - DNA, 23 bp, Artificial sequence
  SiRNA target sequence
ttacaattgtaaatttacctaca

SEQ ID NO: 186245 - DNA, 23 bp, Artificial sequence
  SiRNA target sequence
tacaattgtaaatttacctacaa

SEQ ID NO: 186246 - DNA, 23 bp, Artificial sequence
  SiRNA target sequence
acaattgtaaatttacctacaaa

SEQ ID NO: 186247 - DNA, 23 bp, Artificial sequence
  SiRNA target sequence
caattgtaaatttacctacaaat

SEQ ID NO: 186248 - DNA, 23 bp, Artificial sequence
  SiRNA target sequence
aattgtaaatttacctacaaatc

SEQ ID NO: 186249 - DNA, 23 bp, Artificial sequence
  SiRNA target sequence
attgtaaatttacctacaaatct

SEQ ID NO: 186250 - DNA, 23 bp, Artificial sequence
  SiRNA target sequence
ttgtaaatttacctacaaatcta

SEQ ID NO: 186251 - DNA, 23 bp, Artificial sequence
  SiRNA target sequence
tgtaaatttacctacaaatctag

SEQ ID NO: 186252 - DNA, 23 bp, Artificial sequence
  SiRNA target sequence
gtaaatttacctacaaatctaga

SEQ ID NO: 186253 - DNA, 23 bp, Artificial sequence
  SiRNA target sequence
taaatttacctacaaatctagat

SEQ ID NO: 186254 - DNA, 23 bp, Artificial sequence
  SiRNA target sequence
aaatttacctacaaatctagata

SEQ ID NO: 186255 - DNA, 23 bp, Artificial sequence
  SiRNA target sequence
aatttacctacaaatctagataa

SEQ ID NO: 186256 - DNA, 23 bp, Artificial sequence
  SiRNA target sequence
atttacctacaaatctagataaa

SEQ ID NO: 186257 - DNA, 23 bp, Artificial sequence
  SiRNA target sequence
tttacctacaaatctagataaag

SEQ ID NO: 186258 - DNA, 23 bp, Artificial sequence
  SiRNA target sequence
ttacctacaaatctagataaaga

SEQ ID NO: 186259 - DNA, 23 bp, Artificial sequence
  SiRNA target sequence
tacctacaaatctagataaagac

SEQ ID NO: 186260 - DNA, 23 bp, Artificial sequence
  SiRNA target sequence
acctacaaatctagataaagaca

SEQ ID NO: 186261 - DNA, 23 bp, Artificial sequence
  SiRNA target sequence
cctacaaatctagataaagacat

SEQ ID NO: 186262 - DNA, 23 bp, Artificial sequence
  SiRNA target sequence
ctacaaatctagataaagacatt

SEQ ID NO: 186263 - DNA, 23 bp, Artificial sequence
  SiRNA target sequence
tacaaatctagataaagacattt

SEQ ID NO: 186264 - DNA, 23 bp, Artificial sequence
  SiRNA target sequence
acaaatctagataaagacatttc

SEQ ID NO: 186265 - DNA, 23 bp, Artificial sequence
  SiRNA target sequence
caaatctagataaagacatttca

SEQ ID NO: 186266 - DNA, 23 bp, Artificial sequence
  SiRNA target sequence
aaatctagataaagacatttcac

SEQ ID NO: 186267 - DNA, 23 bp, Artificial sequence
  SiRNA target sequence
aatctagataaagacatttcaca

SEQ ID NO: 186268 - DNA, 23 bp, Artificial sequence
  SiRNA target sequence
atctagataaagacatttcacat

SEQ ID NO: 186269 - DNA, 23 bp, Artificial sequence
  SiRNA target sequence
tctagataaagacatttcacata

SEQ ID NO: 186270 - DNA, 23 bp, Artificial sequence
  SiRNA target sequence
ctagataaagacatttcacatag

SEQ ID NO: 186271 - DNA, 23 bp, Artificial sequence
  SiRNA target sequence
tagataaagacatttcacataga

SEQ ID NO: 186272 - DNA, 23 bp, Artificial sequence
  SiRNA target sequence
agataaagacatttcacatagat

SEQ ID NO: 186273 - DNA, 23 bp, Artificial sequence
  SiRNA target sequence
gataaagacatttcacatagata

SEQ ID NO: 186274 - DNA, 23 bp, Artificial sequence
  SiRNA target sequence
ataaagacatttcacatagatat

SEQ ID NO: 186275 - DNA, 23 bp, Artificial sequence
  SiRNA target sequence
taaagacatttcacatagatatt

SEQ ID NO: 186276 - DNA, 23 bp, Artificial sequence
  SiRNA target sequence
aaagacatttcacatagatattc

SEQ ID NO: 186277 - DNA, 23 bp, Artificial sequence
  SiRNA target sequence
aagacatttcacatagatattcg

SEQ ID NO: 186278 - DNA, 23 bp, Artificial sequence
  SiRNA target sequence
agacatttcacatagatattcgg

SEQ ID NO: 186279 - DNA, 23 bp, Artificial sequence
  SiRNA target sequence
gacatttcacatagatattcggc

SEQ ID NO: 186280 - DNA, 23 bp, Artificial sequence
  SiRNA target sequence
acatttcacatagatattcggca

SEQ ID NO: 186281 - DNA, 23 bp, Artificial sequence
  SiRNA target sequence
catttcacatagatattcggcaa

SEQ ID NO: 186282 - DNA, 23 bp, Artificial sequence
  SiRNA target sequence
atttcacatagatattcggcaaa

SEQ ID NO: 186283 - DNA, 23 bp, Artificial sequence
  SiRNA target sequence
tttcacatagatattcggcaaat

SEQ ID NO: 186284 - DNA, 23 bp, Artificial sequence
  SiRNA target sequence
ttcacatagatattcggcaaatg

SEQ ID NO: 186285 - DNA, 23 bp, Artificial sequence
  SiRNA target sequence
tcacatagatattcggcaaatgg

SEQ ID NO: 186286 - DNA, 23 bp, Artificial sequence
  SiRNA target sequence
cacatagatattcggcaaatggt

SEQ ID NO: 186287 - DNA, 23 bp, Artificial sequence
  SiRNA target sequence
acatagatattcggcaaatggtt

SEQ ID NO: 186288 - DNA, 23 bp, Artificial sequence
  SiRNA target sequence
catagatattcggcaaatggttt

SEQ ID NO: 186289 - DNA, 23 bp, Artificial sequence
  SiRNA target sequence
atagatattcggcaaatggtttt

SEQ ID NO: 186290 - DNA, 23 bp, Artificial sequence
  SiRNA target sequence
tagatattcggcaaatggtttta

SEQ ID NO: 186291 - DNA, 23 bp, Artificial sequence
  SiRNA target sequence
agatattcggcaaatggttttaa

SEQ ID NO: 186292 - DNA, 23 bp, Artificial sequence
  SiRNA target sequence
gatattcggcaaatggttttaaa

SEQ ID NO: 186293 - DNA, 23 bp, Artificial sequence
  SiRNA target sequence
atattcggcaaatggttttaaac

SEQ ID NO: 186294 - DNA, 23 bp, Artificial sequence
  SiRNA target sequence
tattcggcaaatggttttaaact

SEQ ID NO: 186295 - DNA, 23 bp, Artificial sequence
  SiRNA target sequence
attcggcaaatggttttaaactt

SEQ ID NO: 186296 - DNA, 23 bp, Artificial sequence
  SiRNA target sequence
ttcggcaaatggttttaaacttc

SEQ ID NO: 186297 - DNA, 23 bp, Artificial sequence
  SiRNA target sequence
tcggcaaatggttttaaacttca

SEQ ID NO: 186298 - DNA, 23 bp, Artificial sequence
  SiRNA target sequence
cggcaaatggttttaaacttcac

SEQ ID NO: 186299 - DNA, 23 bp, Artificial sequence
  SiRNA target sequence
ggcaaatggttttaaacttcaca

SEQ ID NO: 186300 - DNA, 23 bp, Artificial sequence
  SiRNA target sequence
gcaaatggttttaaacttcacag

SEQ ID NO: 186301 - DNA, 23 bp, Artificial sequence
  SiRNA target sequence
caaatggttttaaacttcacaga

SEQ ID NO: 186302 - DNA, 23 bp, Artificial sequence
  SiRNA target sequence
aaatggttttaaacttcacagat

SEQ ID NO: 186303 - DNA, 23 bp, Artificial sequence
  SiRNA target sequence
aatggttttaaacttcacagatt

SEQ ID NO: 186304 - DNA, 23 bp, Artificial sequence
  SiRNA target sequence
atggttttaaacttcacagatta

SEQ ID NO: 186305 - DNA, 23 bp, Artificial sequence
  SiRNA target sequence
tggttttaaacttcacagattac

SEQ ID NO: 186306 - DNA, 23 bp, Artificial sequence
  SiRNA target sequence
ggttttaaacttcacagattacc

SEQ ID NO: 186307 - DNA, 23 bp, Artificial sequence
  SiRNA target sequence
gttttaaacttcacagattacca

SEQ ID NO: 186308 - DNA, 23 bp, Artificial sequence
  SiRNA target sequence
ttttaaacttcacagattaccaa

SEQ ID NO: 186309 - DNA, 23 bp, Artificial sequence
  SiRNA target sequence
tttaaacttcacagattaccaat

SEQ ID NO: 186310 - DNA, 23 bp, Artificial sequence
  SiRNA target sequence
ttaaacttcacagattaccaatc

SEQ ID NO: 186311 - DNA, 23 bp, Artificial sequence
  SiRNA target sequence
taaacttcacagattaccaatcc

SEQ ID NO: 186312 - DNA, 23 bp, Artificial sequence
  SiRNA target sequence
aaacttcacagattaccaatccc

SEQ ID NO: 186313 - DNA, 23 bp, Artificial sequence
  SiRNA target sequence
aacttcacagattaccaatccct

SEQ ID NO: 186314 - DNA, 23 bp, Artificial sequence
  SiRNA target sequence
acttcacagattaccaatcccta

SEQ ID NO: 186315 - DNA, 23 bp, Artificial sequence
  SiRNA target sequence
cttcacagattaccaatccctaa

SEQ ID NO: 186316 - DNA, 23 bp, Artificial sequence
  SiRNA target sequence
ttcacagattaccaatccctaaa

SEQ ID NO: 186317 - DNA, 23 bp, Artificial sequence
  SiRNA target sequence
tcacagattaccaatccctaaat

SEQ ID NO: 186318 - DNA, 23 bp, Artificial sequence
  SiRNA target sequence
cacagattaccaatccctaaata

SEQ ID NO: 186319 - DNA, 23 bp, Artificial sequence
  SiRNA target sequence
acagattaccaatccctaaatat

SEQ ID NO: 186320 - DNA, 23 bp, Artificial sequence
  SiRNA target sequence
cagattaccaatccctaaatatg

SEQ ID NO: 186321 - DNA, 23 bp, Artificial sequence
  SiRNA target sequence
agattaccaatccctaaatatgg

SEQ ID NO: 186322 - DNA, 23 bp, Artificial sequence
  SiRNA target sequence
gattaccaatccctaaatatggt

SEQ ID NO: 186323 - DNA, 23 bp, Artificial sequence
  SiRNA target sequence
attaccaatccctaaatatggta

SEQ ID NO: 186324 - DNA, 23 bp, Artificial sequence
  SiRNA target sequence
ttaccaatccctaaatatggtaa

SEQ ID NO: 186325 - DNA, 23 bp, Artificial sequence
  SiRNA target sequence
taccaatccctaaatatggtaag

SEQ ID NO: 186326 - DNA, 23 bp, Artificial sequence
  SiRNA target sequence
accaatccctaaatatggtaagg

SEQ ID NO: 186327 - DNA, 23 bp, Artificial sequence
  SiRNA target sequence
ccaatccctaaatatggtaaggt

SEQ ID NO: 186328 - DNA, 23 bp, Artificial sequence
  SiRNA target sequence
caatccctaaatatggtaaggtt

SEQ ID NO: 186329 - DNA, 23 bp, Artificial sequence
  SiRNA target sequence
aatccctaaatatggtaaggttt

SEQ ID NO: 186330 - DNA, 23 bp, Artificial sequence
  SiRNA target sequence
atccctaaatatggtaaggtttt

SEQ ID NO: 186331 - DNA, 23 bp, Artificial sequence
  SiRNA target sequence
tccctaaatatggtaaggtttta

SEQ ID NO: 186332 - DNA, 23 bp, Artificial sequence
  SiRNA target sequence
ccctaaatatggtaaggttttag

SEQ ID NO: 186333 - DNA, 23 bp, Artificial sequence
  SiRNA target sequence
cctaaatatggtaaggttttagg

SEQ ID NO: 186334 - DNA, 23 bp, Artificial sequence
  SiRNA target sequence
ctaaatatggtaaggttttaggg

SEQ ID NO: 186335 - DNA, 23 bp, Artificial sequence
  SiRNA target sequence
taaatatggtaaggttttagggc

SEQ ID NO: 186336 - DNA, 23 bp, Artificial sequence
  SiRNA target sequence
aaatatggtaaggttttagggct

SEQ ID NO: 186337 - DNA, 23 bp, Artificial sequence
  SiRNA target sequence
aatatggtaaggttttagggcta

SEQ ID NO: 186338 - DNA, 23 bp, Artificial sequence
  SiRNA target sequence
atatggtaaggttttagggctag

SEQ ID NO: 186339 - DNA, 23 bp, Artificial sequence
  SiRNA target sequence
tatggtaaggttttagggctagt

SEQ ID NO: 186340 - DNA, 23 bp, Artificial sequence
  SiRNA target sequence
atggtaaggttttagggctagta

SEQ ID NO: 186341 - DNA, 23 bp, Artificial sequence
  SiRNA target sequence
tggtaaggttttagggctagtag

SEQ ID NO: 186342 - DNA, 23 bp, Artificial sequence
  SiRNA target sequence
ggtaaggttttagggctagtagg

SEQ ID NO: 186343 - DNA, 23 bp, Artificial sequence
  SiRNA target sequence
gtaaggttttagggctagtaggc

SEQ ID NO: 186344 - DNA, 23 bp, Artificial sequence
  SiRNA target sequence
taaggttttagggctagtaggca

SEQ ID NO: 186345 - DNA, 23 bp, Artificial sequence
  SiRNA target sequence
aaggttttagggctagtaggcac

SEQ ID NO: 186346 - DNA, 23 bp, Artificial sequence
  SiRNA target sequence
aggttttagggctagtaggcact

SEQ ID NO: 186347 - DNA, 23 bp, Artificial sequence
  SiRNA target sequence
ggttttagggctagtaggcacta

SEQ ID NO: 186348 - DNA, 23 bp, Artificial sequence
  SiRNA target sequence
gttttagggctagtaggcactaa

SEQ ID NO: 186349 - DNA, 23 bp, Artificial sequence
  SiRNA target sequence
ttttagggctagtaggcactaat

SEQ ID NO: 186350 - DNA, 23 bp, Artificial sequence
  SiRNA target sequence
tttagggctagtaggcactaatg

SEQ ID NO: 186351 - DNA, 23 bp, Artificial sequence
  SiRNA target sequence
ttagggctagtaggcactaatgg

SEQ ID NO: 186352 - DNA, 23 bp, Artificial sequence
  SiRNA target sequence
tagggctagtaggcactaatggt

SEQ ID NO: 186353 - DNA, 23 bp, Artificial sequence
  SiRNA target sequence
agggctagtaggcactaatggta

SEQ ID NO: 186354 - DNA, 23 bp, Artificial sequence
  SiRNA target sequence
gggctagtaggcactaatggtat

SEQ ID NO: 186355 - DNA, 23 bp, Artificial sequence
  SiRNA target sequence
ggctagtaggcactaatggtata

SEQ ID NO: 186356 - DNA, 23 bp, Artificial sequence
  SiRNA target sequence
gctagtaggcactaatggtatag

SEQ ID NO: 186357 - DNA, 23 bp, Artificial sequence
  SiRNA target sequence
ctagtaggcactaatggtatagg

SEQ ID NO: 186358 - DNA, 23 bp, Artificial sequence
  SiRNA target sequence
tagtaggcactaatggtatagga

SEQ ID NO: 186359 - DNA, 23 bp, Artificial sequence
  SiRNA target sequence
agtaggcactaatggtataggaa

SEQ ID NO: 186360 - DNA, 23 bp, Artificial sequence
  SiRNA target sequence
gtaggcactaatggtataggaaa

SEQ ID NO: 186361 - DNA, 23 bp, Artificial sequence
  SiRNA target sequence
taggcactaatggtataggaaaa

SEQ ID NO: 186362 - DNA, 23 bp, Artificial sequence
  SiRNA target sequence
aggcactaatggtataggaaaaa

SEQ ID NO: 186363 - DNA, 23 bp, Artificial sequence
  SiRNA target sequence
ggcactaatggtataggaaaaag

SEQ ID NO: 186364 - DNA, 23 bp, Artificial sequence
  SiRNA target sequence
gcactaatggtataggaaaaagt

SEQ ID NO: 186365 - DNA, 23 bp, Artificial sequence
  SiRNA target sequence
cactaatggtataggaaaaagta

SEQ ID NO: 186366 - DNA, 23 bp, Artificial sequence
  SiRNA target sequence
actaatggtataggaaaaagtac

SEQ ID NO: 186367 - DNA, 23 bp, Artificial sequence
  SiRNA target sequence
ctaatggtataggaaaaagtact

SEQ ID NO: 186368 - DNA, 23 bp, Artificial sequence
  SiRNA target sequence
taatggtataggaaaaagtactg

SEQ ID NO: 186369 - DNA, 23 bp, Artificial sequence
  SiRNA target sequence
aatggtataggaaaaagtactgc

SEQ ID NO: 186370 - DNA, 23 bp, Artificial sequence
  SiRNA target sequence
atggtataggaaaaagtactgca

SEQ ID NO: 186371 - DNA, 23 bp, Artificial sequence
  SiRNA target sequence
tggtataggaaaaagtactgcac

SEQ ID NO: 186372 - DNA, 23 bp, Artificial sequence
  SiRNA target sequence
ggtataggaaaaagtactgcact

SEQ ID NO: 186373 - DNA, 23 bp, Artificial sequence
  SiRNA target sequence
gtataggaaaaagtactgcactt

SEQ ID NO: 186374 - DNA, 23 bp, Artificial sequence
  SiRNA target sequence
tataggaaaaagtactgcactta

SEQ ID NO: 186375 - DNA, 23 bp, Artificial sequence
  SiRNA target sequence
ataggaaaaagtactgcacttaa

SEQ ID NO: 186376 - DNA, 23 bp, Artificial sequence
  SiRNA target sequence
taggaaaaagtactgcacttaaa

SEQ ID NO: 186377 - DNA, 23 bp, Artificial sequence
  SiRNA target sequence
aggaaaaagtactgcacttaaaa

SEQ ID NO: 186378 - DNA, 23 bp, Artificial sequence
  SiRNA target sequence
ggaaaaagtactgcacttaaaat

SEQ ID NO: 186379 - DNA, 23 bp, Artificial sequence
  SiRNA target sequence
gaaaaagtactgcacttaaaata

SEQ ID NO: 186380 - DNA, 23 bp, Artificial sequence
  SiRNA target sequence
aaaaagtactgcacttaaaatat

SEQ ID NO: 186381 - DNA, 23 bp, Artificial sequence
  SiRNA target sequence
aaaagtactgcacttaaaatatt

SEQ ID NO: 186382 - DNA, 23 bp, Artificial sequence
  SiRNA target sequence
aaagtactgcacttaaaatatta

SEQ ID NO: 186383 - DNA, 23 bp, Artificial sequence
  SiRNA target sequence
aagtactgcacttaaaatattat

SEQ ID NO: 186384 - DNA, 23 bp, Artificial sequence
  SiRNA target sequence
agtactgcacttaaaatattatc

SEQ ID NO: 186385 - DNA, 23 bp, Artificial sequence
  SiRNA target sequence
gtactgcacttaaaatattatcg

SEQ ID NO: 186386 - DNA, 23 bp, Artificial sequence
  SiRNA target sequence
tactgcacttaaaatattatcgg

SEQ ID NO: 186387 - DNA, 23 bp, Artificial sequence
  SiRNA target sequence
actgcacttaaaatattatcggg

SEQ ID NO: 186388 - DNA, 23 bp, Artificial sequence
  SiRNA target sequence
ctgcacttaaaatattatcgggc

SEQ ID NO: 186389 - DNA, 23 bp, Artificial sequence
  SiRNA target sequence
tgcacttaaaatattatcgggca

SEQ ID NO: 186390 - DNA, 23 bp, Artificial sequence
  SiRNA target sequence
gcacttaaaatattatcgggcaa

SEQ ID NO: 186391 - DNA, 23 bp, Artificial sequence
  SiRNA target sequence
cacttaaaatattatcgggcaat

SEQ ID NO: 186392 - DNA, 23 bp, Artificial sequence
  SiRNA target sequence
acttaaaatattatcgggcaatc

SEQ ID NO: 186393 - DNA, 23 bp, Artificial sequence
  SiRNA target sequence
cttaaaatattatcgggcaatct

SEQ ID NO: 186394 - DNA, 23 bp, Artificial sequence
  SiRNA target sequence
ttaaaatattatcgggcaatctt

SEQ ID NO: 186395 - DNA, 23 bp, Artificial sequence
  SiRNA target sequence
taaaatattatcgggcaatctta

SEQ ID NO: 186396 - DNA, 23 bp, Artificial sequence
  SiRNA target sequence
aaaatattatcgggcaatcttaa

SEQ ID NO: 186397 - DNA, 23 bp, Artificial sequence
  SiRNA target sequence
aaatattatcgggcaatcttaaa

SEQ ID NO: 186398 - DNA, 23 bp, Artificial sequence
  SiRNA target sequence
aatattatcgggcaatcttaaac

SEQ ID NO: 186399 - DNA, 23 bp, Artificial sequence
  SiRNA target sequence
atattatcgggcaatcttaaacc

SEQ ID NO: 186400 - DNA, 23 bp, Artificial sequence
  SiRNA target sequence
tattatcgggcaatcttaaacca

SEQ ID NO: 186401 - DNA, 23 bp, Artificial sequence
  SiRNA target sequence
attatcgggcaatcttaaaccaa

SEQ ID NO: 186402 - DNA, 23 bp, Artificial sequence
  SiRNA target sequence
ttatcgggcaatcttaaaccaaa

SEQ ID NO: 186403 - DNA, 23 bp, Artificial sequence
  SiRNA target sequence
tatcgggcaatcttaaaccaaac

SEQ ID NO: 186404 - DNA, 23 bp, Artificial sequence
  SiRNA target sequence
atcgggcaatcttaaaccaaact

SEQ ID NO: 186405 - DNA, 23 bp, Artificial sequence
  SiRNA target sequence
tcgggcaatcttaaaccaaactt

SEQ ID NO: 186406 - DNA, 23 bp, Artificial sequence
  SiRNA target sequence
cgggcaatcttaaaccaaactta

SEQ ID NO: 186407 - DNA, 23 bp, Artificial sequence
  SiRNA target sequence
gggcaatcttaaaccaaacttag

SEQ ID NO: 186408 - DNA, 23 bp, Artificial sequence
  SiRNA target sequence
ggcaatcttaaaccaaacttagg

SEQ ID NO: 186409 - DNA, 23 bp, Artificial sequence
  SiRNA target sequence
gcaatcttaaaccaaacttagga

SEQ ID NO: 186410 - DNA, 23 bp, Artificial sequence
  SiRNA target sequence
caatcttaaaccaaacttaggaa

SEQ ID NO: 186411 - DNA, 23 bp, Artificial sequence
  SiRNA target sequence
aatcttaaaccaaacttaggaaa

SEQ ID NO: 186412 - DNA, 23 bp, Artificial sequence
  SiRNA target sequence
atcttaaaccaaacttaggaaag

SEQ ID NO: 186413 - DNA, 23 bp, Artificial sequence
  SiRNA target sequence
tcttaaaccaaacttaggaaagt

SEQ ID NO: 186414 - DNA, 23 bp, Artificial sequence
  SiRNA target sequence
cttaaaccaaacttaggaaagtt

SEQ ID NO: 186415 - DNA, 23 bp, Artificial sequence
  SiRNA target sequence
ttaaaccaaacttaggaaagttc

SEQ ID NO: 186416 - DNA, 23 bp, Artificial sequence
  SiRNA target sequence
taaaccaaacttaggaaagttcg

SEQ ID NO: 186417 - DNA, 23 bp, Artificial sequence
  SiRNA target sequence
aaaccaaacttaggaaagttcga

SEQ ID NO: 186418 - DNA, 23 bp, Artificial sequence
  SiRNA target sequence
aaccaaacttaggaaagttcgac

SEQ ID NO: 186419 - DNA, 23 bp, Artificial sequence
  SiRNA target sequence
accaaacttaggaaagttcgacg

SEQ ID NO: 186420 - DNA, 23 bp, Artificial sequence
  SiRNA target sequence
ccaaacttaggaaagttcgacgt

SEQ ID NO: 186421 - DNA, 23 bp, Artificial sequence
  SiRNA target sequence
caaacttaggaaagttcgacgtt

SEQ ID NO: 186422 - DNA, 23 bp, Artificial sequence
  SiRNA target sequence
aaacttaggaaagttcgacgtta

SEQ ID NO: 186423 - DNA, 23 bp, Artificial sequence
  SiRNA target sequence
aacttaggaaagttcgacgttac

SEQ ID NO: 186424 - DNA, 23 bp, Artificial sequence
  SiRNA target sequence
acttaggaaagttcgacgttacg

SEQ ID NO: 186425 - DNA, 23 bp, Artificial sequence
  SiRNA target sequence
cttaggaaagttcgacgttacgc

SEQ ID NO: 186426 - DNA, 23 bp, Artificial sequence
  SiRNA target sequence
ttaggaaagttcgacgttacgcc

SEQ ID NO: 186427 - DNA, 23 bp, Artificial sequence
  SiRNA target sequence
taggaaagttcgacgttacgccc

SEQ ID NO: 186428 - DNA, 23 bp, Artificial sequence
  SiRNA target sequence
aggaaagttcgacgttacgcccg

SEQ ID NO: 186429 - DNA, 23 bp, Artificial sequence
  SiRNA target sequence
ggaaagttcgacgttacgcccga

SEQ ID NO: 186430 - DNA, 23 bp, Artificial sequence
  SiRNA target sequence
gaaagttcgacgttacgcccgac

SEQ ID NO: 186431 - DNA, 23 bp, Artificial sequence
  SiRNA target sequence
aaagttcgacgttacgcccgact

SEQ ID NO: 186432 - DNA, 23 bp, Artificial sequence
  SiRNA target sequence
aagttcgacgttacgcccgactg

SEQ ID NO: 186433 - DNA, 23 bp, Artificial sequence
  SiRNA target sequence
agttcgacgttacgcccgactgg

SEQ ID NO: 186434 - DNA, 23 bp, Artificial sequence
  SiRNA target sequence
gttcgacgttacgcccgactggg

SEQ ID NO: 186435 - DNA, 23 bp, Artificial sequence
  SiRNA target sequence
ttcgacgttacgcccgactgggc

SEQ ID NO: 186436 - DNA, 23 bp, Artificial sequence
  SiRNA target sequence
tcgacgttacgcccgactgggca

SEQ ID NO: 186437 - DNA, 23 bp, Artificial sequence
  SiRNA target sequence
cgacgttacgcccgactgggcag

SEQ ID NO: 186438 - DNA, 23 bp, Artificial sequence
  SiRNA target sequence
gacgttacgcccgactgggcagc

SEQ ID NO: 186439 - DNA, 23 bp, Artificial sequence
  SiRNA target sequence
acgttacgcccgactgggcagca

SEQ ID NO: 186440 - DNA, 23 bp, Artificial sequence
  SiRNA target sequence
cgttacgcccgactgggcagcaa

SEQ ID NO: 186441 - DNA, 23 bp, Artificial sequence
  SiRNA target sequence
gttacgcccgactgggcagcaat

SEQ ID NO: 186442 - DNA, 23 bp, Artificial sequence
  SiRNA target sequence
ttacgcccgactgggcagcaatt

SEQ ID NO: 186443 - DNA, 23 bp, Artificial sequence
  SiRNA target sequence
tacgcccgactgggcagcaattc

SEQ ID NO: 186444 - DNA, 23 bp, Artificial sequence
  SiRNA target sequence
acgcccgactgggcagcaattct

SEQ ID NO: 186445 - DNA, 23 bp, Artificial sequence
  SiRNA target sequence
cgcccgactgggcagcaattcta

SEQ ID NO: 186446 - DNA, 23 bp, Artificial sequence
  SiRNA target sequence
gcccgactgggcagcaattctaa

SEQ ID NO: 186447 - DNA, 23 bp, Artificial sequence
  SiRNA target sequence
cccgactgggcagcaattctaaa

SEQ ID NO: 186448 - DNA, 23 bp, Artificial sequence
  SiRNA target sequence
ccgactgggcagcaattctaaat

SEQ ID NO: 186449 - DNA, 23 bp, Artificial sequence
  SiRNA target sequence
cgactgggcagcaattctaaata

SEQ ID NO: 186450 - DNA, 23 bp, Artificial sequence
  SiRNA target sequence
gactgggcagcaattctaaataa

SEQ ID NO: 186451 - DNA, 23 bp, Artificial sequence
  SiRNA target sequence
actgggcagcaattctaaataat

SEQ ID NO: 186452 - DNA, 23 bp, Artificial sequence
  SiRNA target sequence
ctgggcagcaattctaaataatt

SEQ ID NO: 186453 - DNA, 23 bp, Artificial sequence
  SiRNA target sequence
tgggcagcaattctaaataatta

SEQ ID NO: 186454 - DNA, 23 bp, Artificial sequence
  SiRNA target sequence
gggcagcaattctaaataattat

SEQ ID NO: 186455 - DNA, 23 bp, Artificial sequence
  SiRNA target sequence
ggcagcaattctaaataattata

SEQ ID NO: 186456 - DNA, 23 bp, Artificial sequence
  SiRNA target sequence
gcagcaattctaaataattataa

SEQ ID NO: 186457 - DNA, 23 bp, Artificial sequence
  SiRNA target sequence
cagcaattctaaataattataaa

SEQ ID NO: 186458 - DNA, 23 bp, Artificial sequence
  SiRNA target sequence
agcaattctaaataattataaag

SEQ ID NO: 186459 - DNA, 23 bp, Artificial sequence
  SiRNA target sequence
gcaattctaaataattataaagg

SEQ ID NO: 186460 - DNA, 23 bp, Artificial sequence
  SiRNA target sequence
caattctaaataattataaagga

SEQ ID NO: 186461 - DNA, 23 bp, Artificial sequence
  SiRNA target sequence
aattctaaataattataaaggat

SEQ ID NO: 186462 - DNA, 23 bp, Artificial sequence
  SiRNA target sequence
attctaaataattataaaggatc

SEQ ID NO: 186463 - DNA, 23 bp, Artificial sequence
  SiRNA target sequence
ttctaaataattataaaggatct

SEQ ID NO: 186464 - DNA, 23 bp, Artificial sequence
  SiRNA target sequence
tctaaataattataaaggatctg

SEQ ID NO: 186465 - DNA, 23 bp, Artificial sequence
  SiRNA target sequence
ctaaataattataaaggatctga

SEQ ID NO: 186466 - DNA, 23 bp, Artificial sequence
  SiRNA target sequence
taaataattataaaggatctgaa

SEQ ID NO: 186467 - DNA, 23 bp, Artificial sequence
  SiRNA target sequence
aaataattataaaggatctgaac

SEQ ID NO: 186468 - DNA, 23 bp, Artificial sequence
  SiRNA target sequence
aataattataaaggatctgaact

SEQ ID NO: 186469 - DNA, 23 bp, Artificial sequence
  SiRNA target sequence
ataattataaaggatctgaactt

SEQ ID NO: 186470 - DNA, 23 bp, Artificial sequence
  SiRNA target sequence
taattataaaggatctgaacttc

SEQ ID NO: 186471 - DNA, 23 bp, Artificial sequence
  SiRNA target sequence
aattataaaggatctgaacttca

SEQ ID NO: 186472 - DNA, 23 bp, Artificial sequence
  SiRNA target sequence
attataaaggatctgaacttcat

SEQ ID NO: 186473 - DNA, 23 bp, Artificial sequence
  SiRNA target sequence
ttataaaggatctgaacttcatg

SEQ ID NO: 186474 - DNA, 23 bp, Artificial sequence
  SiRNA target sequence
tataaaggatctgaacttcatgg

SEQ ID NO: 186475 - DNA, 23 bp, Artificial sequence
  SiRNA target sequence
ataaaggatctgaacttcatgga

SEQ ID NO: 186476 - DNA, 23 bp, Artificial sequence
  SiRNA target sequence
taaaggatctgaacttcatggat

SEQ ID NO: 186477 - DNA, 23 bp, Artificial sequence
  SiRNA target sequence
aaaggatctgaacttcatggatt

SEQ ID NO: 186478 - DNA, 23 bp, Artificial sequence
  SiRNA target sequence
aaggatctgaacttcatggattt

SEQ ID NO: 186479 - DNA, 23 bp, Artificial sequence
  SiRNA target sequence
aggatctgaacttcatggatttt

SEQ ID NO: 186480 - DNA, 23 bp, Artificial sequence
  SiRNA target sequence
ggatctgaacttcatggattttt

SEQ ID NO: 186481 - DNA, 23 bp, Artificial sequence
  SiRNA target sequence
gatctgaacttcatggatttttt

SEQ ID NO: 186482 - DNA, 23 bp, Artificial sequence
  SiRNA target sequence
atctgaacttcatggatttttta

SEQ ID NO: 186483 - DNA, 23 bp, Artificial sequence
  SiRNA target sequence
tctgaacttcatggattttttac

SEQ ID NO: 186484 - DNA, 23 bp, Artificial sequence
  SiRNA target sequence
ctgaacttcatggattttttact

SEQ ID NO: 186485 - DNA, 23 bp, Artificial sequence
  SiRNA target sequence
tgaacttcatggattttttacta

SEQ ID NO: 186486 - DNA, 23 bp, Artificial sequence
  SiRNA target sequence
gaacttcatggattttttactaa

SEQ ID NO: 186487 - DNA, 23 bp, Artificial sequence
  SiRNA target sequence
aacttcatggattttttactaaa

SEQ ID NO: 186488 - DNA, 23 bp, Artificial sequence
  SiRNA target sequence
acttcatggattttttactaaaa

SEQ ID NO: 186489 - DNA, 23 bp, Artificial sequence
  SiRNA target sequence
cttcatggattttttactaaaat

SEQ ID NO: 186490 - DNA, 23 bp, Artificial sequence
  SiRNA target sequence
ttcatggattttttactaaaatt

SEQ ID NO: 186491 - DNA, 23 bp, Artificial sequence
  SiRNA target sequence
tcatggattttttactaaaattt

SEQ ID NO: 186492 - DNA, 23 bp, Artificial sequence
  SiRNA target sequence
catggattttttactaaaatttt

SEQ ID NO: 186493 - DNA, 23 bp, Artificial sequence
  SiRNA target sequence
atggattttttactaaaatttta

SEQ ID NO: 186494 - DNA, 23 bp, Artificial sequence
  SiRNA target sequence
tggattttttactaaaattttag

SEQ ID NO: 186495 - DNA, 23 bp, Artificial sequence
  SiRNA target sequence
ggattttttactaaaattttaga

SEQ ID NO: 186496 - DNA, 23 bp, Artificial sequence
  SiRNA target sequence
gattttttactaaaattttagaa

SEQ ID NO: 186497 - DNA, 23 bp, Artificial sequence
  SiRNA target sequence
attttttactaaaattttagaag

SEQ ID NO: 186498 - DNA, 23 bp, Artificial sequence
  SiRNA target sequence
ttttttactaaaattttagaagg

SEQ ID NO: 186499 - DNA, 23 bp, Artificial sequence
  SiRNA target sequence
tttttactaaaattttagaaggg

SEQ ID NO: 186500 - DNA, 23 bp, Artificial sequence
  SiRNA target sequence
ttttactaaaattttagaagggt

SEQ ID NO: 186501 - DNA, 23 bp, Artificial sequence
  SiRNA target sequence
tttactaaaattttagaagggtc

SEQ ID NO: 186502 - DNA, 23 bp, Artificial sequence
  SiRNA target sequence
ttactaaaattttagaagggtct

SEQ ID NO: 186503 - DNA, 23 bp, Artificial sequence
  SiRNA target sequence
tactaaaattttagaagggtcta

SEQ ID NO: 186504 - DNA, 23 bp, Artificial sequence
  SiRNA target sequence
actaaaattttagaagggtctat

SEQ ID NO: 186505 - DNA, 23 bp, Artificial sequence
  SiRNA target sequence
ctaaaattttagaagggtctatt

SEQ ID NO: 186506 - DNA, 23 bp, Artificial sequence
  SiRNA target sequence
taaaattttagaagggtctatta

SEQ ID NO: 186507 - DNA, 23 bp, Artificial sequence
  SiRNA target sequence
aaaattttagaagggtctattaa

SEQ ID NO: 186508 - DNA, 23 bp, Artificial sequence
  SiRNA target sequence
aaattttagaagggtctattaaa

SEQ ID NO: 186509 - DNA, 23 bp, Artificial sequence
  SiRNA target sequence
aattttagaagggtctattaaag

SEQ ID NO: 186510 - DNA, 23 bp, Artificial sequence
  SiRNA target sequence
attttagaagggtctattaaagc

SEQ ID NO: 186511 - DNA, 23 bp, Artificial sequence
  SiRNA target sequence
ttttagaagggtctattaaagct

SEQ ID NO: 186512 - DNA, 23 bp, Artificial sequence
  SiRNA target sequence
tttagaagggtctattaaagcta

SEQ ID NO: 186513 - DNA, 23 bp, Artificial sequence
  SiRNA target sequence
ttagaagggtctattaaagctat

SEQ ID NO: 186514 - DNA, 23 bp, Artificial sequence
  SiRNA target sequence
tagaagggtctattaaagctatt

SEQ ID NO: 186515 - DNA, 23 bp, Artificial sequence
  SiRNA target sequence
agaagggtctattaaagctattt

SEQ ID NO: 186516 - DNA, 23 bp, Artificial sequence
  SiRNA target sequence
gaagggtctattaaagctatttc

SEQ ID NO: 186517 - DNA, 23 bp, Artificial sequence
  SiRNA target sequence
aagggtctattaaagctatttct

SEQ ID NO: 186518 - DNA, 23 bp, Artificial sequence
  SiRNA target sequence
agggtctattaaagctatttcta

SEQ ID NO: 186519 - DNA, 23 bp, Artificial sequence
  SiRNA target sequence
gggtctattaaagctatttctaa

SEQ ID NO: 186520 - DNA, 23 bp, Artificial sequence
  SiRNA target sequence
ggtctattaaagctatttctaag

SEQ ID NO: 186521 - DNA, 23 bp, Artificial sequence
  SiRNA target sequence
gtctattaaagctatttctaaga

SEQ ID NO: 186522 - DNA, 23 bp, Artificial sequence
  SiRNA target sequence
tctattaaagctatttctaagat

SEQ ID NO: 186523 - DNA, 23 bp, Artificial sequence
  SiRNA target sequence
ctattaaagctatttctaagata

SEQ ID NO: 186524 - DNA, 23 bp, Artificial sequence
  SiRNA target sequence
tattaaagctatttctaagatac

SEQ ID NO: 186525 - DNA, 23 bp, Artificial sequence
  SiRNA target sequence
attaaagctatttctaagataca

SEQ ID NO: 186526 - DNA, 23 bp, Artificial sequence
  SiRNA target sequence
ttaaagctatttctaagatacag

SEQ ID NO: 186527 - DNA, 23 bp, Artificial sequence
  SiRNA target sequence
taaagctatttctaagatacagt

SEQ ID NO: 186528 - DNA, 23 bp, Artificial sequence
  SiRNA target sequence
aaagctatttctaagatacagta

SEQ ID NO: 186529 - DNA, 23 bp, Artificial sequence
  SiRNA target sequence
aagctatttctaagatacagtat

SEQ ID NO: 186530 - DNA, 23 bp, Artificial sequence
  SiRNA target sequence
agctatttctaagatacagtata

SEQ ID NO: 186531 - DNA, 23 bp, Artificial sequence
  SiRNA target sequence
gctatttctaagatacagtatat

SEQ ID NO: 186532 - DNA, 23 bp, Artificial sequence
  SiRNA target sequence
ctatttctaagatacagtatata

SEQ ID NO: 186533 - DNA, 23 bp, Artificial sequence
  SiRNA target sequence
tatttctaagatacagtatatag

SEQ ID NO: 186534 - DNA, 23 bp, Artificial sequence
  SiRNA target sequence
atttctaagatacagtatataga

SEQ ID NO: 186535 - DNA, 23 bp, Artificial sequence
  SiRNA target sequence
tttctaagatacagtatatagat

SEQ ID NO: 186536 - DNA, 23 bp, Artificial sequence
  SiRNA target sequence
ttctaagatacagtatatagata

SEQ ID NO: 186537 - DNA, 23 bp, Artificial sequence
  SiRNA target sequence
tctaagatacagtatatagataa

SEQ ID NO: 186538 - DNA, 23 bp, Artificial sequence
  SiRNA target sequence
ctaagatacagtatatagataaa

SEQ ID NO: 186539 - DNA, 23 bp, Artificial sequence
  SiRNA target sequence
taagatacagtatatagataaaa

SEQ ID NO: 186540 - DNA, 23 bp, Artificial sequence
  SiRNA target sequence
aagatacagtatatagataaaat

SEQ ID NO: 186541 - DNA, 23 bp, Artificial sequence
  SiRNA target sequence
agatacagtatatagataaaatg

SEQ ID NO: 186542 - DNA, 23 bp, Artificial sequence
  SiRNA target sequence
gatacagtatatagataaaatgc

SEQ ID NO: 186543 - DNA, 23 bp, Artificial sequence
  SiRNA target sequence
atacagtatatagataaaatgcc

SEQ ID NO: 186544 - DNA, 23 bp, Artificial sequence
  SiRNA target sequence
tacagtatatagataaaatgcct

SEQ ID NO: 186545 - DNA, 23 bp, Artificial sequence
  SiRNA target sequence
acagtatatagataaaatgccta

SEQ ID NO: 186546 - DNA, 23 bp, Artificial sequence
  SiRNA target sequence
cagtatatagataaaatgcctaa

SEQ ID NO: 186547 - DNA, 23 bp, Artificial sequence
  SiRNA target sequence
agtatatagataaaatgcctaaa

SEQ ID NO: 186548 - DNA, 23 bp, Artificial sequence
  SiRNA target sequence
gtatatagataaaatgcctaaat

SEQ ID NO: 186549 - DNA, 23 bp, Artificial sequence
  SiRNA target sequence
tatatagataaaatgcctaaatt

SEQ ID NO: 186550 - DNA, 23 bp, Artificial sequence
  SiRNA target sequence
atatagataaaatgcctaaattt

SEQ ID NO: 186551 - DNA, 23 bp, Artificial sequence
  SiRNA target sequence
tatagataaaatgcctaaatttt

SEQ ID NO: 186552 - DNA, 23 bp, Artificial sequence
  SiRNA target sequence
atagataaaatgcctaaattttt

SEQ ID NO: 186553 - DNA, 23 bp, Artificial sequence
  SiRNA target sequence
tagataaaatgcctaaattttta

SEQ ID NO: 186554 - DNA, 23 bp, Artificial sequence
  SiRNA target sequence
agataaaatgcctaaatttttaa

SEQ ID NO: 186555 - DNA, 23 bp, Artificial sequence
  SiRNA target sequence
gataaaatgcctaaatttttaaa

SEQ ID NO: 186556 - DNA, 23 bp, Artificial sequence
  SiRNA target sequence
ataaaatgcctaaatttttaaaa

SEQ ID NO: 186557 - DNA, 23 bp, Artificial sequence
  SiRNA target sequence
taaaatgcctaaatttttaaaag

SEQ ID NO: 186558 - DNA, 23 bp, Artificial sequence
  SiRNA target sequence
aaaatgcctaaatttttaaaagg

SEQ ID NO: 186559 - DNA, 23 bp, Artificial sequence
  SiRNA target sequence
aaatgcctaaatttttaaaagga

SEQ ID NO: 186560 - DNA, 23 bp, Artificial sequence
  SiRNA target sequence
aatgcctaaatttttaaaaggac

SEQ ID NO: 186561 - DNA, 23 bp, Artificial sequence
  SiRNA target sequence
atgcctaaatttttaaaaggacg

SEQ ID NO: 186562 - DNA, 23 bp, Artificial sequence
  SiRNA target sequence
tgcctaaatttttaaaaggacgc

SEQ ID NO: 186563 - DNA, 23 bp, Artificial sequence
  SiRNA target sequence
gcctaaatttttaaaaggacgct

SEQ ID NO: 186564 - DNA, 23 bp, Artificial sequence
  SiRNA target sequence
cctaaatttttaaaaggacgcta

SEQ ID NO: 186565 - DNA, 23 bp, Artificial sequence
  SiRNA target sequence
ctaaatttttaaaaggacgctat

SEQ ID NO: 186566 - DNA, 23 bp, Artificial sequence
  SiRNA target sequence
taaatttttaaaaggacgctata

SEQ ID NO: 186567 - DNA, 23 bp, Artificial sequence
  SiRNA target sequence
aaatttttaaaaggacgctataa

SEQ ID NO: 186568 - DNA, 23 bp, Artificial sequence
  SiRNA target sequence
aatttttaaaaggacgctataag

SEQ ID NO: 186569 - DNA, 23 bp, Artificial sequence
  SiRNA target sequence
atttttaaaaggacgctataagt

SEQ ID NO: 186570 - DNA, 23 bp, Artificial sequence
  SiRNA target sequence
tttttaaaaggacgctataagtc

SEQ ID NO: 186571 - DNA, 23 bp, Artificial sequence
  SiRNA target sequence
ttttaaaaggacgctataagtca

SEQ ID NO: 186572 - DNA, 23 bp, Artificial sequence
  SiRNA target sequence
tttaaaaggacgctataagtcag

SEQ ID NO: 186573 - DNA, 23 bp, Artificial sequence
  SiRNA target sequence
ttaaaaggacgctataagtcaga

SEQ ID NO: 186574 - DNA, 23 bp, Artificial sequence
  SiRNA target sequence
taaaaggacgctataagtcagaa

SEQ ID NO: 186575 - DNA, 23 bp, Artificial sequence
  SiRNA target sequence
aaaaggacgctataagtcagaaa

SEQ ID NO: 186576 - DNA, 23 bp, Artificial sequence
  SiRNA target sequence
aaaggacgctataagtcagaaat

SEQ ID NO: 186577 - DNA, 23 bp, Artificial sequence
  SiRNA target sequence
aaggacgctataagtcagaaatc

SEQ ID NO: 186578 - DNA, 23 bp, Artificial sequence
  SiRNA target sequence
aggacgctataagtcagaaatcg

SEQ ID NO: 186579 - DNA, 23 bp, Artificial sequence
  SiRNA target sequence
ggacgctataagtcagaaatcgc

SEQ ID NO: 186580 - DNA, 23 bp, Artificial sequence
  SiRNA target sequence
gacgctataagtcagaaatcgcc

SEQ ID NO: 186581 - DNA, 23 bp, Artificial sequence
  SiRNA target sequence
acgctataagtcagaaatcgcct

SEQ ID NO: 186582 - DNA, 23 bp, Artificial sequence
  SiRNA target sequence
cgctataagtcagaaatcgcctc

SEQ ID NO: 186583 - DNA, 23 bp, Artificial sequence
  SiRNA target sequence
gctataagtcagaaatcgcctcc

SEQ ID NO: 186584 - DNA, 23 bp, Artificial sequence
  SiRNA target sequence
ctataagtcagaaatcgcctccg

SEQ ID NO: 186585 - DNA, 23 bp, Artificial sequence
  SiRNA target sequence
tataagtcagaaatcgcctccgg

SEQ ID NO: 186586 - DNA, 23 bp, Artificial sequence
  SiRNA target sequence
ataagtcagaaatcgcctccgga

SEQ ID NO: 186587 - DNA, 23 bp, Artificial sequence
  SiRNA target sequence
taagtcagaaatcgcctccggaa

SEQ ID NO: 186588 - DNA, 23 bp, Artificial sequence
  SiRNA target sequence
aagtcagaaatcgcctccggaaa

SEQ ID NO: 186589 - DNA, 23 bp, Artificial sequence
  SiRNA target sequence
agtcagaaatcgcctccggaaaa

SEQ ID NO: 186590 - DNA, 23 bp, Artificial sequence
  SiRNA target sequence
gtcagaaatcgcctccggaaaaa

SEQ ID NO: 186591 - DNA, 23 bp, Artificial sequence
  SiRNA target sequence
tcagaaatcgcctccggaaaaat

SEQ ID NO: 186592 - DNA, 23 bp, Artificial sequence
  SiRNA target sequence
cagaaatcgcctccggaaaaatg

SEQ ID NO: 186593 - DNA, 23 bp, Artificial sequence
  SiRNA target sequence
agaaatcgcctccggaaaaatgt

SEQ ID NO: 186594 - DNA, 23 bp, Artificial sequence
  SiRNA target sequence
gaaatcgcctccggaaaaatgtt

SEQ ID NO: 186595 - DNA, 23 bp, Artificial sequence
  SiRNA target sequence
aaatcgcctccggaaaaatgttg

SEQ ID NO: 186596 - DNA, 23 bp, Artificial sequence
  SiRNA target sequence
aatcgcctccggaaaaatgttgt

SEQ ID NO: 186597 - DNA, 23 bp, Artificial sequence
  SiRNA target sequence
atcgcctccggaaaaatgttgtt

SEQ ID NO: 186598 - DNA, 23 bp, Artificial sequence
  SiRNA target sequence
tcgcctccggaaaaatgttgttt

SEQ ID NO: 186599 - DNA, 23 bp, Artificial sequence
  SiRNA target sequence
cgcctccggaaaaatgttgttta

SEQ ID NO: 186600 - DNA, 23 bp, Artificial sequence
  SiRNA target sequence
gcctccggaaaaatgttgtttac

SEQ ID NO: 186601 - DNA, 23 bp, Artificial sequence
  SiRNA target sequence
cctccggaaaaatgttgtttact

SEQ ID NO: 186602 - DNA, 23 bp, Artificial sequence
  SiRNA target sequence
ctccggaaaaatgttgtttactg

SEQ ID NO: 186603 - DNA, 23 bp, Artificial sequence
  SiRNA target sequence
tccggaaaaatgttgtttactgt

SEQ ID NO: 186604 - DNA, 23 bp, Artificial sequence
  SiRNA target sequence
ccggaaaaatgttgtttactgtt

SEQ ID NO: 186605 - DNA, 23 bp, Artificial sequence
  SiRNA target sequence
cggaaaaatgttgtttactgtta

SEQ ID NO: 186606 - DNA, 23 bp, Artificial sequence
  SiRNA target sequence
ggaaaaatgttgtttactgttaa

SEQ ID NO: 186607 - DNA, 23 bp, Artificial sequence
  SiRNA target sequence
gaaaaatgttgtttactgttaat

SEQ ID NO: 186608 - DNA, 23 bp, Artificial sequence
  SiRNA target sequence
aaaaatgttgtttactgttaatg

SEQ ID NO: 186609 - DNA, 23 bp, Artificial sequence
  SiRNA target sequence
aaaatgttgtttactgttaatga

SEQ ID NO: 186610 - DNA, 23 bp, Artificial sequence
  SiRNA target sequence
aaatgttgtttactgttaatgat

SEQ ID NO: 186611 - DNA, 23 bp, Artificial sequence
  SiRNA target sequence
aatgttgtttactgttaatgata

SEQ ID NO: 186612 - DNA, 23 bp, Artificial sequence
  SiRNA target sequence
atgttgtttactgttaatgatat

SEQ ID NO: 186613 - DNA, 23 bp, Artificial sequence
  SiRNA target sequence
tgttgtttactgttaatgatata

SEQ ID NO: 186614 - DNA, 23 bp, Artificial sequence
  SiRNA target sequence
gttgtttactgttaatgatatat

SEQ ID NO: 186615 - DNA, 23 bp, Artificial sequence
  SiRNA target sequence
ttgtttactgttaatgatatatt

SEQ ID NO: 186616 - DNA, 23 bp, Artificial sequence
  SiRNA target sequence
tgtttactgttaatgatatatta

SEQ ID NO: 186617 - DNA, 23 bp, Artificial sequence
  SiRNA target sequence
gtttactgttaatgatatattaa

SEQ ID NO: 186618 - DNA, 23 bp, Artificial sequence
  SiRNA target sequence
tttactgttaatgatatattaaa

SEQ ID NO: 186619 - DNA, 23 bp, Artificial sequence
  SiRNA target sequence
ttactgttaatgatatattaaaa

SEQ ID NO: 186620 - DNA, 23 bp, Artificial sequence
  SiRNA target sequence
tactgttaatgatatattaaaaa

SEQ ID NO: 186621 - DNA, 23 bp, Artificial sequence
  SiRNA target sequence
actgttaatgatatattaaaaaa

SEQ ID NO: 186622 - DNA, 23 bp, Artificial sequence
  SiRNA target sequence
ctgttaatgatatattaaaaaaa

SEQ ID NO: 186623 - DNA, 23 bp, Artificial sequence
  SiRNA target sequence
tgttaatgatatattaaaaaaag

SEQ ID NO: 186624 - DNA, 23 bp, Artificial sequence
  SiRNA target sequence
gttaatgatatattaaaaaaagt

SEQ ID NO: 186625 - DNA, 23 bp, Artificial sequence
  SiRNA target sequence
ttaatgatatattaaaaaaagtt

SEQ ID NO: 186626 - DNA, 23 bp, Artificial sequence
  SiRNA target sequence
taatgatatattaaaaaaagttg

SEQ ID NO: 186627 - DNA, 23 bp, Artificial sequence
  SiRNA target sequence
aatgatatattaaaaaaagttga

SEQ ID NO: 186628 - DNA, 23 bp, Artificial sequence
  SiRNA target sequence
atgatatattaaaaaaagttgat

SEQ ID NO: 186629 - DNA, 23 bp, Artificial sequence
  SiRNA target sequence
tgatatattaaaaaaagttgatg

SEQ ID NO: 186630 - DNA, 23 bp, Artificial sequence
  SiRNA target sequence
gatatattaaaaaaagttgatga

SEQ ID NO: 186631 - DNA, 23 bp, Artificial sequence
  SiRNA target sequence
atatattaaaaaaagttgatgaa

SEQ ID NO: 186632 - DNA, 23 bp, Artificial sequence
  SiRNA target sequence
tatattaaaaaaagttgatgaaa

SEQ ID NO: 186633 - DNA, 23 bp, Artificial sequence
  SiRNA target sequence
atattaaaaaaagttgatgaaaa

SEQ ID NO: 186634 - DNA, 23 bp, Artificial sequence
  SiRNA target sequence
tattaaaaaaagttgatgaaaaa

SEQ ID NO: 186635 - DNA, 23 bp, Artificial sequence
  SiRNA target sequence
attaaaaaaagttgatgaaaaaa

SEQ ID NO: 186636 - DNA, 23 bp, Artificial sequence
  SiRNA target sequence
ttaaaaaaagttgatgaaaaaaa

SEQ ID NO: 186637 - DNA, 23 bp, Artificial sequence
  SiRNA target sequence
taaaaaaagttgatgaaaaaaat

SEQ ID NO: 186638 - DNA, 23 bp, Artificial sequence
  SiRNA target sequence
aaaaaaagttgatgaaaaaaata

SEQ ID NO: 186639 - DNA, 23 bp, Artificial sequence
  SiRNA target sequence
aaaaaagttgatgaaaaaaataa

SEQ ID NO: 186640 - DNA, 23 bp, Artificial sequence
  SiRNA target sequence
aaaaagttgatgaaaaaaataaa

SEQ ID NO: 186641 - DNA, 23 bp, Artificial sequence
  SiRNA target sequence
aaaagttgatgaaaaaaataaat

SEQ ID NO: 186642 - DNA, 23 bp, Artificial sequence
  SiRNA target sequence
aaagttgatgaaaaaaataaatt

SEQ ID NO: 186643 - DNA, 23 bp, Artificial sequence
  SiRNA target sequence
aagttgatgaaaaaaataaattt

SEQ ID NO: 186644 - DNA, 23 bp, Artificial sequence
  SiRNA target sequence
agttgatgaaaaaaataaatttg

SEQ ID NO: 186645 - DNA, 23 bp, Artificial sequence
  SiRNA target sequence
gttgatgaaaaaaataaatttga

SEQ ID NO: 186646 - DNA, 23 bp, Artificial sequence
  SiRNA target sequence
ttgatgaaaaaaataaatttgac

SEQ ID NO: 186647 - DNA, 23 bp, Artificial sequence
  SiRNA target sequence
tgatgaaaaaaataaatttgact

SEQ ID NO: 186648 - DNA, 23 bp, Artificial sequence
  SiRNA target sequence
gatgaaaaaaataaatttgacta

SEQ ID NO: 186649 - DNA, 23 bp, Artificial sequence
  SiRNA target sequence
atgaaaaaaataaatttgactat

SEQ ID NO: 186650 - DNA, 23 bp, Artificial sequence
  SiRNA target sequence
tgaaaaaaataaatttgactatt

SEQ ID NO: 186651 - DNA, 23 bp, Artificial sequence
  SiRNA target sequence
gaaaaaaataaatttgactatta

SEQ ID NO: 186652 - DNA, 23 bp, Artificial sequence
  SiRNA target sequence
aaaaaaataaatttgactattac

SEQ ID NO: 186653 - DNA, 23 bp, Artificial sequence
  SiRNA target sequence
aaaaaataaatttgactattacg

SEQ ID NO: 186654 - DNA, 23 bp, Artificial sequence
  SiRNA target sequence
aaaaataaatttgactattacgt

SEQ ID NO: 186655 - DNA, 23 bp, Artificial sequence
  SiRNA target sequence
aaaataaatttgactattacgta

SEQ ID NO: 186656 - DNA, 23 bp, Artificial sequence
  SiRNA target sequence
aaataaatttgactattacgtag

SEQ ID NO: 186657 - DNA, 23 bp, Artificial sequence
  SiRNA target sequence
aataaatttgactattacgtaga

SEQ ID NO: 186658 - DNA, 23 bp, Artificial sequence
  SiRNA target sequence
ataaatttgactattacgtagat

SEQ ID NO: 186659 - DNA, 23 bp, Artificial sequence
  SiRNA target sequence
taaatttgactattacgtagata

SEQ ID NO: 186660 - DNA, 23 bp, Artificial sequence
  SiRNA target sequence
aaatttgactattacgtagataa

SEQ ID NO: 186661 - DNA, 23 bp, Artificial sequence
  SiRNA target sequence
aatttgactattacgtagataaa

SEQ ID NO: 186662 - DNA, 23 bp, Artificial sequence
  SiRNA target sequence
atttgactattacgtagataaaa

SEQ ID NO: 186663 - DNA, 23 bp, Artificial sequence
  SiRNA target sequence
tttgactattacgtagataaaat

SEQ ID NO: 186664 - DNA, 23 bp, Artificial sequence
  SiRNA target sequence
ttgactattacgtagataaaatg

SEQ ID NO: 186665 - DNA, 23 bp, Artificial sequence
  SiRNA target sequence
tgactattacgtagataaaatgg

SEQ ID NO: 186666 - DNA, 23 bp, Artificial sequence
  SiRNA target sequence
gactattacgtagataaaatggc

SEQ ID NO: 186667 - DNA, 23 bp, Artificial sequence
  SiRNA target sequence
actattacgtagataaaatggca

SEQ ID NO: 186668 - DNA, 23 bp, Artificial sequence
  SiRNA target sequence
ctattacgtagataaaatggcac

SEQ ID NO: 186669 - DNA, 23 bp, Artificial sequence
  SiRNA target sequence
tattacgtagataaaatggcact

SEQ ID NO: 186670 - DNA, 23 bp, Artificial sequence
  SiRNA target sequence
attacgtagataaaatggcactt

SEQ ID NO: 186671 - DNA, 23 bp, Artificial sequence
  SiRNA target sequence
ttacgtagataaaatggcactta

SEQ ID NO: 186672 - DNA, 23 bp, Artificial sequence
  SiRNA target sequence
tacgtagataaaatggcacttaa

SEQ ID NO: 186673 - DNA, 23 bp, Artificial sequence
  SiRNA target sequence
acgtagataaaatggcacttaaa

SEQ ID NO: 186674 - DNA, 23 bp, Artificial sequence
  SiRNA target sequence
cgtagataaaatggcacttaaaa

SEQ ID NO: 186675 - DNA, 23 bp, Artificial sequence
  SiRNA target sequence
gtagataaaatggcacttaaaaa

SEQ ID NO: 186676 - DNA, 23 bp, Artificial sequence
  SiRNA target sequence
tagataaaatggcacttaaaaat

SEQ ID NO: 186677 - DNA, 23 bp, Artificial sequence
  SiRNA target sequence
agataaaatggcacttaaaaatg

SEQ ID NO: 186678 - DNA, 23 bp, Artificial sequence
  SiRNA target sequence
gataaaatggcacttaaaaatgt

SEQ ID NO: 186679 - DNA, 23 bp, Artificial sequence
  SiRNA target sequence
ataaaatggcacttaaaaatgta

SEQ ID NO: 186680 - DNA, 23 bp, Artificial sequence
  SiRNA target sequence
taaaatggcacttaaaaatgtat

SEQ ID NO: 186681 - DNA, 23 bp, Artificial sequence
  SiRNA target sequence
aaaatggcacttaaaaatgtatt

SEQ ID NO: 186682 - DNA, 23 bp, Artificial sequence
  SiRNA target sequence
aaatggcacttaaaaatgtatta

SEQ ID NO: 186683 - DNA, 23 bp, Artificial sequence
  SiRNA target sequence
aatggcacttaaaaatgtattaa

SEQ ID NO: 186684 - DNA, 23 bp, Artificial sequence
  SiRNA target sequence
atggcacttaaaaatgtattaac

SEQ ID NO: 186685 - DNA, 23 bp, Artificial sequence
  SiRNA target sequence
tggcacttaaaaatgtattaaca

SEQ ID NO: 186686 - DNA, 23 bp, Artificial sequence
  SiRNA target sequence
ggcacttaaaaatgtattaacaa

SEQ ID NO: 186687 - DNA, 23 bp, Artificial sequence
  SiRNA target sequence
gcacttaaaaatgtattaacaag

SEQ ID NO: 186688 - DNA, 23 bp, Artificial sequence
  SiRNA target sequence
cacttaaaaatgtattaacaaga

SEQ ID NO: 186689 - DNA, 23 bp, Artificial sequence
  SiRNA target sequence
acttaaaaatgtattaacaagag

SEQ ID NO: 186690 - DNA, 23 bp, Artificial sequence
  SiRNA target sequence
cttaaaaatgtattaacaagaga

SEQ ID NO: 186691 - DNA, 23 bp, Artificial sequence
  SiRNA target sequence
ttaaaaatgtattaacaagagaa

SEQ ID NO: 186692 - DNA, 23 bp, Artificial sequence
  SiRNA target sequence
taaaaatgtattaacaagagaat

SEQ ID NO: 186693 - DNA, 23 bp, Artificial sequence
  SiRNA target sequence
aaaaatgtattaacaagagaatt

SEQ ID NO: 186694 - DNA, 23 bp, Artificial sequence
  SiRNA target sequence
aaaatgtattaacaagagaatta

SEQ ID NO: 186695 - DNA, 23 bp, Artificial sequence
  SiRNA target sequence
aaatgtattaacaagagaattag

SEQ ID NO: 186696 - DNA, 23 bp, Artificial sequence
  SiRNA target sequence
aatgtattaacaagagaattaga

SEQ ID NO: 186697 - DNA, 23 bp, Artificial sequence
  SiRNA target sequence
atgtattaacaagagaattagag

SEQ ID NO: 186698 - DNA, 23 bp, Artificial sequence
  SiRNA target sequence
tgtattaacaagagaattagagc

SEQ ID NO: 186699 - DNA, 23 bp, Artificial sequence
  SiRNA target sequence
gtattaacaagagaattagagca

SEQ ID NO: 186700 - DNA, 23 bp, Artificial sequence
  SiRNA target sequence
tattaacaagagaattagagcaa

SEQ ID NO: 186701 - DNA, 23 bp, Artificial sequence
  SiRNA target sequence
attaacaagagaattagagcaat

SEQ ID NO: 186702 - DNA, 23 bp, Artificial sequence
  SiRNA target sequence
ttaacaagagaattagagcaatt

SEQ ID NO: 186703 - DNA, 23 bp, Artificial sequence
  SiRNA target sequence
taacaagagaattagagcaatta

SEQ ID NO: 186704 - DNA, 23 bp, Artificial sequence
  SiRNA target sequence
aacaagagaattagagcaattaa

SEQ ID NO: 186705 - DNA, 23 bp, Artificial sequence
  SiRNA target sequence
acaagagaattagagcaattaag

SEQ ID NO: 186706 - DNA, 23 bp, Artificial sequence
  SiRNA target sequence
caagagaattagagcaattaagt

SEQ ID NO: 186707 - DNA, 23 bp, Artificial sequence
  SiRNA target sequence
aagagaattagagcaattaagtg

SEQ ID NO: 186708 - DNA, 23 bp, Artificial sequence
  SiRNA target sequence
agagaattagagcaattaagtgg

SEQ ID NO: 186709 - DNA, 23 bp, Artificial sequence
  SiRNA target sequence
gagaattagagcaattaagtggt

SEQ ID NO: 186710 - DNA, 23 bp, Artificial sequence
  SiRNA target sequence
agaattagagcaattaagtggtg

SEQ ID NO: 186711 - DNA, 23 bp, Artificial sequence
  SiRNA target sequence
gaattagagcaattaagtggtgg

SEQ ID NO: 186712 - DNA, 23 bp, Artificial sequence
  SiRNA target sequence
aattagagcaattaagtggtggt

SEQ ID NO: 186713 - DNA, 23 bp, Artificial sequence
  SiRNA target sequence
attagagcaattaagtggtggtg

SEQ ID NO: 186714 - DNA, 23 bp, Artificial sequence
  SiRNA target sequence
ttagagcaattaagtggtggtga

SEQ ID NO: 186715 - DNA, 23 bp, Artificial sequence
  SiRNA target sequence
tagagcaattaagtggtggtgaa

SEQ ID NO: 186716 - DNA, 23 bp, Artificial sequence
  SiRNA target sequence
agagcaattaagtggtggtgaac

SEQ ID NO: 186717 - DNA, 23 bp, Artificial sequence
  SiRNA target sequence
gagcaattaagtggtggtgaact

SEQ ID NO: 186718 - DNA, 23 bp, Artificial sequence
  SiRNA target sequence
agcaattaagtggtggtgaactt

SEQ ID NO: 186719 - DNA, 23 bp, Artificial sequence
  SiRNA target sequence
gcaattaagtggtggtgaacttc

SEQ ID NO: 186720 - DNA, 23 bp, Artificial sequence
  SiRNA target sequence
caattaagtggtggtgaacttca

SEQ ID NO: 186721 - DNA, 23 bp, Artificial sequence
  SiRNA target sequence
aattaagtggtggtgaacttcaa

SEQ ID NO: 186722 - DNA, 23 bp, Artificial sequence
  SiRNA target sequence
attaagtggtggtgaacttcaaa

SEQ ID NO: 186723 - DNA, 23 bp, Artificial sequence
  SiRNA target sequence
ttaagtggtggtgaacttcaaag

SEQ ID NO: 186724 - DNA, 23 bp, Artificial sequence
  SiRNA target sequence
taagtggtggtgaacttcaaaga

SEQ ID NO: 186725 - DNA, 23 bp, Artificial sequence
  SiRNA target sequence
aagtggtggtgaacttcaaagat

SEQ ID NO: 186726 - DNA, 23 bp, Artificial sequence
  SiRNA target sequence
agtggtggtgaacttcaaagatt

SEQ ID NO: 186727 - DNA, 23 bp, Artificial sequence
  SiRNA target sequence
gtggtggtgaacttcaaagattt

SEQ ID NO: 186728 - DNA, 23 bp, Artificial sequence
  SiRNA target sequence
tggtggtgaacttcaaagatttt

SEQ ID NO: 186729 - DNA, 23 bp, Artificial sequence
  SiRNA target sequence
ggtggtgaacttcaaagattttg

SEQ ID NO: 186730 - DNA, 23 bp, Artificial sequence
  SiRNA target sequence
gtggtgaacttcaaagattttgt

SEQ ID NO: 186731 - DNA, 23 bp, Artificial sequence
  SiRNA target sequence
tggtgaacttcaaagattttgta

SEQ ID NO: 186732 - DNA, 23 bp, Artificial sequence
  SiRNA target sequence
ggtgaacttcaaagattttgtat

SEQ ID NO: 186733 - DNA, 23 bp, Artificial sequence
  SiRNA target sequence
gtgaacttcaaagattttgtatt

SEQ ID NO: 186734 - DNA, 23 bp, Artificial sequence
  SiRNA target sequence
tgaacttcaaagattttgtattg

SEQ ID NO: 186735 - DNA, 23 bp, Artificial sequence
  SiRNA target sequence
gaacttcaaagattttgtattgc

SEQ ID NO: 186736 - DNA, 23 bp, Artificial sequence
  SiRNA target sequence
aacttcaaagattttgtattgca

SEQ ID NO: 186737 - DNA, 23 bp, Artificial sequence
  SiRNA target sequence
acttcaaagattttgtattgcat

SEQ ID NO: 186738 - DNA, 23 bp, Artificial sequence
  SiRNA target sequence
cttcaaagattttgtattgcata

SEQ ID NO: 186739 - DNA, 23 bp, Artificial sequence
  SiRNA target sequence
ttcaaagattttgtattgcatac

SEQ ID NO: 186740 - DNA, 23 bp, Artificial sequence
  SiRNA target sequence
tcaaagattttgtattgcataca

SEQ ID NO: 186741 - DNA, 23 bp, Artificial sequence
  SiRNA target sequence
caaagattttgtattgcatacac

SEQ ID NO: 186742 - DNA, 23 bp, Artificial sequence
  SiRNA target sequence
aaagattttgtattgcatacaca

SEQ ID NO: 186743 - DNA, 23 bp, Artificial sequence
  SiRNA target sequence
aagattttgtattgcatacacat

SEQ ID NO: 186744 - DNA, 23 bp, Artificial sequence
  SiRNA target sequence
agattttgtattgcatacacatg

SEQ ID NO: 186745 - DNA, 23 bp, Artificial sequence
  SiRNA target sequence
gattttgtattgcatacacatgt

SEQ ID NO: 186746 - DNA, 23 bp, Artificial sequence
  SiRNA target sequence
attttgtattgcatacacatgtt

SEQ ID NO: 186747 - DNA, 23 bp, Artificial sequence
  SiRNA target sequence
ttttgtattgcatacacatgttt

SEQ ID NO: 186748 - DNA, 23 bp, Artificial sequence
  SiRNA target sequence
tttgtattgcatacacatgttta

SEQ ID NO: 186749 - DNA, 23 bp, Artificial sequence
  SiRNA target sequence
ttgtattgcatacacatgtttac

SEQ ID NO: 186750 - DNA, 23 bp, Artificial sequence
  SiRNA target sequence
tgtattgcatacacatgtttaca

SEQ ID NO: 186751 - DNA, 23 bp, Artificial sequence
  SiRNA target sequence
gtattgcatacacatgtttacaa

SEQ ID NO: 186752 - DNA, 23 bp, Artificial sequence
  SiRNA target sequence
tattgcatacacatgtttacaag

SEQ ID NO: 186753 - DNA, 23 bp, Artificial sequence
  SiRNA target sequence
attgcatacacatgtttacaaga

SEQ ID NO: 186754 - DNA, 23 bp, Artificial sequence
  SiRNA target sequence
ttgcatacacatgtttacaagaa

SEQ ID NO: 186755 - DNA, 23 bp, Artificial sequence
  SiRNA target sequence
tgcatacacatgtttacaagaag

SEQ ID NO: 186756 - DNA, 23 bp, Artificial sequence
  SiRNA target sequence
gcatacacatgtttacaagaagg

SEQ ID NO: 186757 - DNA, 23 bp, Artificial sequence
  SiRNA target sequence
catacacatgtttacaagaagga

SEQ ID NO: 186758 - DNA, 23 bp, Artificial sequence
  SiRNA target sequence
atacacatgtttacaagaaggaa

SEQ ID NO: 186759 - DNA, 23 bp, Artificial sequence
  SiRNA target sequence
tacacatgtttacaagaaggaaa

SEQ ID NO: 186760 - DNA, 23 bp, Artificial sequence
  SiRNA target sequence
acacatgtttacaagaaggaaat

SEQ ID NO: 186761 - DNA, 23 bp, Artificial sequence
  SiRNA target sequence
cacatgtttacaagaaggaaatg

SEQ ID NO: 186762 - DNA, 23 bp, Artificial sequence
  SiRNA target sequence
acatgtttacaagaaggaaatgt

SEQ ID NO: 186763 - DNA, 23 bp, Artificial sequence
  SiRNA target sequence
catgtttacaagaaggaaatgtt

SEQ ID NO: 186764 - DNA, 23 bp, Artificial sequence
  SiRNA target sequence
atgtttacaagaaggaaatgttt

SEQ ID NO: 186765 - DNA, 23 bp, Artificial sequence
  SiRNA target sequence
tgtttacaagaaggaaatgttta

SEQ ID NO: 186766 - DNA, 23 bp, Artificial sequence
  SiRNA target sequence
gtttacaagaaggaaatgtttat

SEQ ID NO: 186767 - DNA, 23 bp, Artificial sequence
  SiRNA target sequence
tttacaagaaggaaatgtttata

SEQ ID NO: 186768 - DNA, 23 bp, Artificial sequence
  SiRNA target sequence
ttacaagaaggaaatgtttatat

SEQ ID NO: 186769 - DNA, 23 bp, Artificial sequence
  SiRNA target sequence
tacaagaaggaaatgtttatatt

SEQ ID NO: 186770 - DNA, 23 bp, Artificial sequence
  SiRNA target sequence
acaagaaggaaatgtttatattt

SEQ ID NO: 186771 - DNA, 23 bp, Artificial sequence
  SiRNA target sequence
caagaaggaaatgtttatatttt

SEQ ID NO: 186772 - DNA, 23 bp, Artificial sequence
  SiRNA target sequence
aagaaggaaatgtttatattttt

SEQ ID NO: 186773 - DNA, 23 bp, Artificial sequence
  SiRNA target sequence
agaaggaaatgtttatatttttg

SEQ ID NO: 186774 - DNA, 23 bp, Artificial sequence
  SiRNA target sequence
gaaggaaatgtttatatttttga

SEQ ID NO: 186775 - DNA, 23 bp, Artificial sequence
  SiRNA target sequence
aaggaaatgtttatatttttgat

SEQ ID NO: 186776 - DNA, 23 bp, Artificial sequence
  SiRNA target sequence
aggaaatgtttatatttttgatg

SEQ ID NO: 186777 - DNA, 23 bp, Artificial sequence
  SiRNA target sequence
ggaaatgtttatatttttgatga

SEQ ID NO: 186778 - DNA, 23 bp, Artificial sequence
  SiRNA target sequence
gaaatgtttatatttttgatgaa

SEQ ID NO: 186779 - DNA, 23 bp, Artificial sequence
  SiRNA target sequence
aaatgtttatatttttgatgaac

SEQ ID NO: 186780 - DNA, 23 bp, Artificial sequence
  SiRNA target sequence
aatgtttatatttttgatgaacc

SEQ ID NO: 186781 - DNA, 23 bp, Artificial sequence
  SiRNA target sequence
atgtttatatttttgatgaaccc

SEQ ID NO: 186782 - DNA, 23 bp, Artificial sequence
  SiRNA target sequence
tgtttatatttttgatgaaccca

SEQ ID NO: 186783 - DNA, 23 bp, Artificial sequence
  SiRNA target sequence
gtttatatttttgatgaacccac

SEQ ID NO: 186784 - DNA, 23 bp, Artificial sequence
  SiRNA target sequence
tttatatttttgatgaacccact

SEQ ID NO: 186785 - DNA, 23 bp, Artificial sequence
  SiRNA target sequence
ttatatttttgatgaacccacta

SEQ ID NO: 186786 - DNA, 23 bp, Artificial sequence
  SiRNA target sequence
tatatttttgatgaacccactag

SEQ ID NO: 186787 - DNA, 23 bp, Artificial sequence
  SiRNA target sequence
atatttttgatgaacccactagt

SEQ ID NO: 186788 - DNA, 23 bp, Artificial sequence
  SiRNA target sequence
tatttttgatgaacccactagtt

SEQ ID NO: 186789 - DNA, 23 bp, Artificial sequence
  SiRNA target sequence
atttttgatgaacccactagttt

SEQ ID NO: 186790 - DNA, 23 bp, Artificial sequence
  SiRNA target sequence
tttttgatgaacccactagtttt

SEQ ID NO: 186791 - DNA, 23 bp, Artificial sequence
  SiRNA target sequence
ttttgatgaacccactagttttt

SEQ ID NO: 186792 - DNA, 23 bp, Artificial sequence
  SiRNA target sequence
tttgatgaacccactagtttttt

SEQ ID NO: 186793 - DNA, 23 bp, Artificial sequence
  SiRNA target sequence
ttgatgaacccactagttttttg

SEQ ID NO: 186794 - DNA, 23 bp, Artificial sequence
  SiRNA target sequence
tgatgaacccactagttttttgg

SEQ ID NO: 186795 - DNA, 23 bp, Artificial sequence
  SiRNA target sequence
gatgaacccactagttttttgga

SEQ ID NO: 186796 - DNA, 23 bp, Artificial sequence
  SiRNA target sequence
atgaacccactagttttttggat

SEQ ID NO: 186797 - DNA, 23 bp, Artificial sequence
  SiRNA target sequence
tgaacccactagttttttggatg

SEQ ID NO: 186798 - DNA, 23 bp, Artificial sequence
  SiRNA target sequence
gaacccactagttttttggatgt

SEQ ID NO: 186799 - DNA, 23 bp, Artificial sequence
  SiRNA target sequence
aacccactagttttttggatgtt

SEQ ID NO: 186800 - DNA, 23 bp, Artificial sequence
  SiRNA target sequence
acccactagttttttggatgtta

SEQ ID NO: 186801 - DNA, 23 bp, Artificial sequence
  SiRNA target sequence
cccactagttttttggatgttaa

SEQ ID NO: 186802 - DNA, 23 bp, Artificial sequence
  SiRNA target sequence
ccactagttttttggatgttaag

SEQ ID NO: 186803 - DNA, 23 bp, Artificial sequence
  SiRNA target sequence
cactagttttttggatgttaagc

SEQ ID NO: 186804 - DNA, 23 bp, Artificial sequence
  SiRNA target sequence
actagttttttggatgttaagca

SEQ ID NO: 186805 - DNA, 23 bp, Artificial sequence
  SiRNA target sequence
ctagttttttggatgttaagcag

SEQ ID NO: 186806 - DNA, 23 bp, Artificial sequence
  SiRNA target sequence
tagttttttggatgttaagcagc

SEQ ID NO: 186807 - DNA, 23 bp, Artificial sequence
  SiRNA target sequence
agttttttggatgttaagcagcg

SEQ ID NO: 186808 - DNA, 23 bp, Artificial sequence
  SiRNA target sequence
gttttttggatgttaagcagcga

SEQ ID NO: 186809 - DNA, 23 bp, Artificial sequence
  SiRNA target sequence
ttttttggatgttaagcagcgac

SEQ ID NO: 186810 - DNA, 23 bp, Artificial sequence
  SiRNA target sequence
tttttggatgttaagcagcgact

SEQ ID NO: 186811 - DNA, 23 bp, Artificial sequence
  SiRNA target sequence
ttttggatgttaagcagcgacta

SEQ ID NO: 186812 - DNA, 23 bp, Artificial sequence
  SiRNA target sequence
tttggatgttaagcagcgactag

SEQ ID NO: 186813 - DNA, 23 bp, Artificial sequence
  SiRNA target sequence
ttggatgttaagcagcgactagc

SEQ ID NO: 186814 - DNA, 23 bp, Artificial sequence
  SiRNA target sequence
tggatgttaagcagcgactagca

SEQ ID NO: 186815 - DNA, 23 bp, Artificial sequence
  SiRNA target sequence
ggatgttaagcagcgactagcag

SEQ ID NO: 186816 - DNA, 23 bp, Artificial sequence
  SiRNA target sequence
gatgttaagcagcgactagcagc

SEQ ID NO: 186817 - DNA, 23 bp, Artificial sequence
  SiRNA target sequence
atgttaagcagcgactagcagct

SEQ ID NO: 186818 - DNA, 23 bp, Artificial sequence
  SiRNA target sequence
tgttaagcagcgactagcagctg

SEQ ID NO: 186819 - DNA, 23 bp, Artificial sequence
  SiRNA target sequence
gttaagcagcgactagcagctgc

SEQ ID NO: 186820 - DNA, 23 bp, Artificial sequence
  SiRNA target sequence
ttaagcagcgactagcagctgct

SEQ ID NO: 186821 - DNA, 23 bp, Artificial sequence
  SiRNA target sequence
taagcagcgactagcagctgcta

SEQ ID NO: 186822 - DNA, 23 bp, Artificial sequence
  SiRNA target sequence
aagcagcgactagcagctgctaa

SEQ ID NO: 186823 - DNA, 23 bp, Artificial sequence
  SiRNA target sequence
agcagcgactagcagctgctaag

SEQ ID NO: 186824 - DNA, 23 bp, Artificial sequence
  SiRNA target sequence
gcagcgactagcagctgctaagg

SEQ ID NO: 186825 - DNA, 23 bp, Artificial sequence
  SiRNA target sequence
cagcgactagcagctgctaagga

SEQ ID NO: 186826 - DNA, 23 bp, Artificial sequence
  SiRNA target sequence
agcgactagcagctgctaaggaa

SEQ ID NO: 186827 - DNA, 23 bp, Artificial sequence
  SiRNA target sequence
gcgactagcagctgctaaggaaa

SEQ ID NO: 186828 - DNA, 23 bp, Artificial sequence
  SiRNA target sequence
cgactagcagctgctaaggaaat

SEQ ID NO: 186829 - DNA, 23 bp, Artificial sequence
  SiRNA target sequence
gactagcagctgctaaggaaata

SEQ ID NO: 186830 - DNA, 23 bp, Artificial sequence
  SiRNA target sequence
actagcagctgctaaggaaataa

SEQ ID NO: 186831 - DNA, 23 bp, Artificial sequence
  SiRNA target sequence
ctagcagctgctaaggaaataag

SEQ ID NO: 186832 - DNA, 23 bp, Artificial sequence
  SiRNA target sequence
tagcagctgctaaggaaataaga

SEQ ID NO: 186833 - DNA, 23 bp, Artificial sequence
  SiRNA target sequence
agcagctgctaaggaaataagaa

SEQ ID NO: 186834 - DNA, 23 bp, Artificial sequence
  SiRNA target sequence
gcagctgctaaggaaataagaaa

SEQ ID NO: 186835 - DNA, 23 bp, Artificial sequence
  SiRNA target sequence
cagctgctaaggaaataagaaat

SEQ ID NO: 186836 - DNA, 23 bp, Artificial sequence
  SiRNA target sequence
agctgctaaggaaataagaaatt

SEQ ID NO: 186837 - DNA, 23 bp, Artificial sequence
  SiRNA target sequence
gctgctaaggaaataagaaattt

SEQ ID NO: 186838 - DNA, 23 bp, Artificial sequence
  SiRNA target sequence
ctgctaaggaaataagaaatttg

SEQ ID NO: 186839 - DNA, 23 bp, Artificial sequence
  SiRNA target sequence
tgctaaggaaataagaaatttgt

SEQ ID NO: 186840 - DNA, 23 bp, Artificial sequence
  SiRNA target sequence
gctaaggaaataagaaatttgtg

SEQ ID NO: 186841 - DNA, 23 bp, Artificial sequence
  SiRNA target sequence
ctaaggaaataagaaatttgtgt

SEQ ID NO: 186842 - DNA, 23 bp, Artificial sequence
  SiRNA target sequence
taaggaaataagaaatttgtgtg

SEQ ID NO: 186843 - DNA, 23 bp, Artificial sequence
  SiRNA target sequence
aaggaaataagaaatttgtgtga

SEQ ID NO: 186844 - DNA, 23 bp, Artificial sequence
  SiRNA target sequence
aggaaataagaaatttgtgtgaa

SEQ ID NO: 186845 - DNA, 23 bp, Artificial sequence
  SiRNA target sequence
ggaaataagaaatttgtgtgaag

SEQ ID NO: 186846 - DNA, 23 bp, Artificial sequence
  SiRNA target sequence
gaaataagaaatttgtgtgaaga

SEQ ID NO: 186847 - DNA, 23 bp, Artificial sequence
  SiRNA target sequence
aaataagaaatttgtgtgaagaa

SEQ ID NO: 186848 - DNA, 23 bp, Artificial sequence
  SiRNA target sequence
aataagaaatttgtgtgaagaaa

SEQ ID NO: 186849 - DNA, 23 bp, Artificial sequence
  SiRNA target sequence
ataagaaatttgtgtgaagaaaa

SEQ ID NO: 186850 - DNA, 23 bp, Artificial sequence
  SiRNA target sequence
taagaaatttgtgtgaagaaaat

SEQ ID NO: 186851 - DNA, 23 bp, Artificial sequence
  SiRNA target sequence
aagaaatttgtgtgaagaaaata

SEQ ID NO: 186852 - DNA, 23 bp, Artificial sequence
  SiRNA target sequence
agaaatttgtgtgaagaaaataa

SEQ ID NO: 186853 - DNA, 23 bp, Artificial sequence
  SiRNA target sequence
gaaatttgtgtgaagaaaataaa

SEQ ID NO: 186854 - DNA, 23 bp, Artificial sequence
  SiRNA target sequence
aaatttgtgtgaagaaaataaat

SEQ ID NO: 186855 - DNA, 23 bp, Artificial sequence
  SiRNA target sequence
aatttgtgtgaagaaaataaata

SEQ ID NO: 186856 - DNA, 23 bp, Artificial sequence
  SiRNA target sequence
atttgtgtgaagaaaataaatat

SEQ ID NO: 186857 - DNA, 23 bp, Artificial sequence
  SiRNA target sequence
tttgtgtgaagaaaataaatatg

SEQ ID NO: 186858 - DNA, 23 bp, Artificial sequence
  SiRNA target sequence
ttgtgtgaagaaaataaatatgt

SEQ ID NO: 186859 - DNA, 23 bp, Artificial sequence
  SiRNA target sequence
tgtgtgaagaaaataaatatgtt

SEQ ID NO: 186860 - DNA, 23 bp, Artificial sequence
  SiRNA target sequence
gtgtgaagaaaataaatatgttg

SEQ ID NO: 186861 - DNA, 23 bp, Artificial sequence
  SiRNA target sequence
tgtgaagaaaataaatatgttgt

SEQ ID NO: 186862 - DNA, 23 bp, Artificial sequence
  SiRNA target sequence
gtgaagaaaataaatatgttgta

SEQ ID NO: 186863 - DNA, 23 bp, Artificial sequence
  SiRNA target sequence
tgaagaaaataaatatgttgtag

SEQ ID NO: 186864 - DNA, 23 bp, Artificial sequence
  SiRNA target sequence
gaagaaaataaatatgttgtagt

SEQ ID NO: 186865 - DNA, 23 bp, Artificial sequence
  SiRNA target sequence
aagaaaataaatatgttgtagtt

SEQ ID NO: 186866 - DNA, 23 bp, Artificial sequence
  SiRNA target sequence
agaaaataaatatgttgtagttg

SEQ ID NO: 186867 - DNA, 23 bp, Artificial sequence
  SiRNA target sequence
gaaaataaatatgttgtagttgt

SEQ ID NO: 186868 - DNA, 23 bp, Artificial sequence
  SiRNA target sequence
aaaataaatatgttgtagttgtc

SEQ ID NO: 186869 - DNA, 23 bp, Artificial sequence
  SiRNA target sequence
aaataaatatgttgtagttgtcg

SEQ ID NO: 186870 - DNA, 23 bp, Artificial sequence
  SiRNA target sequence
aataaatatgttgtagttgtcga

SEQ ID NO: 186871 - DNA, 23 bp, Artificial sequence
  SiRNA target sequence
ataaatatgttgtagttgtcgaa

SEQ ID NO: 186872 - DNA, 23 bp, Artificial sequence
  SiRNA target sequence
taaatatgttgtagttgtcgaac

SEQ ID NO: 186873 - DNA, 23 bp, Artificial sequence
  SiRNA target sequence
aaatatgttgtagttgtcgaaca

SEQ ID NO: 186874 - DNA, 23 bp, Artificial sequence
  SiRNA target sequence
aatatgttgtagttgtcgaacac

SEQ ID NO: 186875 - DNA, 23 bp, Artificial sequence
  SiRNA target sequence
atatgttgtagttgtcgaacacg

SEQ ID NO: 186876 - DNA, 23 bp, Artificial sequence
  SiRNA target sequence
tatgttgtagttgtcgaacacga

SEQ ID NO: 186877 - DNA, 23 bp, Artificial sequence
  SiRNA target sequence
atgttgtagttgtcgaacacgat

SEQ ID NO: 186878 - DNA, 23 bp, Artificial sequence
  SiRNA target sequence
tgttgtagttgtcgaacacgatt

SEQ ID NO: 186879 - DNA, 23 bp, Artificial sequence
  SiRNA target sequence
gttgtagttgtcgaacacgattt

SEQ ID NO: 186880 - DNA, 23 bp, Artificial sequence
  SiRNA target sequence
ttgtagttgtcgaacacgattta

SEQ ID NO: 186881 - DNA, 23 bp, Artificial sequence
  SiRNA target sequence
tgtagttgtcgaacacgatttag

SEQ ID NO: 186882 - DNA, 23 bp, Artificial sequence
  SiRNA target sequence
gtagttgtcgaacacgatttagc

SEQ ID NO: 186883 - DNA, 23 bp, Artificial sequence
  SiRNA target sequence
tagttgtcgaacacgatttagcc

SEQ ID NO: 186884 - DNA, 23 bp, Artificial sequence
  SiRNA target sequence
agttgtcgaacacgatttagcca

SEQ ID NO: 186885 - DNA, 23 bp, Artificial sequence
  SiRNA target sequence
gttgtcgaacacgatttagccat

SEQ ID NO: 186886 - DNA, 23 bp, Artificial sequence
  SiRNA target sequence
ttgtcgaacacgatttagccatt

SEQ ID NO: 186887 - DNA, 23 bp, Artificial sequence
  SiRNA target sequence
tgtcgaacacgatttagccattt

SEQ ID NO: 186888 - DNA, 23 bp, Artificial sequence
  SiRNA target sequence
gtcgaacacgatttagccatttt

SEQ ID NO: 186889 - DNA, 23 bp, Artificial sequence
  SiRNA target sequence
tcgaacacgatttagccatttta

SEQ ID NO: 186890 - DNA, 23 bp, Artificial sequence
  SiRNA target sequence
cgaacacgatttagccattttag

SEQ ID NO: 186891 - DNA, 23 bp, Artificial sequence
  SiRNA target sequence
gaacacgatttagccattttaga

SEQ ID NO: 186892 - DNA, 23 bp, Artificial sequence
  SiRNA target sequence
aacacgatttagccattttagat

SEQ ID NO: 186893 - DNA, 23 bp, Artificial sequence
  SiRNA target sequence
acacgatttagccattttagatt

SEQ ID NO: 186894 - DNA, 23 bp, Artificial sequence
  SiRNA target sequence
cacgatttagccattttagattt

SEQ ID NO: 186895 - DNA, 23 bp, Artificial sequence
  SiRNA target sequence
acgatttagccattttagatttg

SEQ ID NO: 186896 - DNA, 23 bp, Artificial sequence
  SiRNA target sequence
cgatttagccattttagatttga

SEQ ID NO: 186897 - DNA, 23 bp, Artificial sequence
  SiRNA target sequence
gatttagccattttagatttgat

SEQ ID NO: 186898 - DNA, 23 bp, Artificial sequence
  SiRNA target sequence
atttagccattttagatttgatg

SEQ ID NO: 186899 - DNA, 23 bp, Artificial sequence
  SiRNA target sequence
tttagccattttagatttgatgt

SEQ ID NO: 186900 - DNA, 23 bp, Artificial sequence
  SiRNA target sequence
ttagccattttagatttgatgtg

SEQ ID NO: 186901 - DNA, 23 bp, Artificial sequence
  SiRNA target sequence
tagccattttagatttgatgtgt

SEQ ID NO: 186902 - DNA, 23 bp, Artificial sequence
  SiRNA target sequence
agccattttagatttgatgtgtg

SEQ ID NO: 186903 - DNA, 23 bp, Artificial sequence
  SiRNA target sequence
gccattttagatttgatgtgtga

SEQ ID NO: 186904 - DNA, 23 bp, Artificial sequence
  SiRNA target sequence
ccattttagatttgatgtgtgat

SEQ ID NO: 186905 - DNA, 23 bp, Artificial sequence
  SiRNA target sequence
cattttagatttgatgtgtgatt

SEQ ID NO: 186906 - DNA, 23 bp, Artificial sequence
  SiRNA target sequence
attttagatttgatgtgtgattt

SEQ ID NO: 186907 - DNA, 23 bp, Artificial sequence
  SiRNA target sequence
ttttagatttgatgtgtgatttt

SEQ ID NO: 186908 - DNA, 23 bp, Artificial sequence
  SiRNA target sequence
tttagatttgatgtgtgattttg

SEQ ID NO: 186909 - DNA, 23 bp, Artificial sequence
  SiRNA target sequence
ttagatttgatgtgtgattttgg

SEQ ID NO: 186910 - DNA, 23 bp, Artificial sequence
  SiRNA target sequence
tagatttgatgtgtgattttgga

SEQ ID NO: 186911 - DNA, 23 bp, Artificial sequence
  SiRNA target sequence
agatttgatgtgtgattttggat

SEQ ID NO: 186912 - DNA, 23 bp, Artificial sequence
  SiRNA target sequence
gatttgatgtgtgattttggatg

SEQ ID NO: 186913 - DNA, 23 bp, Artificial sequence
  SiRNA target sequence
atttgatgtgtgattttggatgt

SEQ ID NO: 186914 - DNA, 23 bp, Artificial sequence
  SiRNA target sequence
tttgatgtgtgattttggatgtg

SEQ ID NO: 186915 - DNA, 23 bp, Artificial sequence
  SiRNA target sequence
ttgatgtgtgattttggatgtgt

SEQ ID NO: 186916 - DNA, 23 bp, Artificial sequence
  SiRNA target sequence
tgatgtgtgattttggatgtgtt

SEQ ID NO: 186917 - DNA, 23 bp, Artificial sequence
  SiRNA target sequence
gatgtgtgattttggatgtgttc

SEQ ID NO: 186918 - DNA, 23 bp, Artificial sequence
  SiRNA target sequence
atgtgtgattttggatgtgttct

SEQ ID NO: 186919 - DNA, 23 bp, Artificial sequence
  SiRNA target sequence
tgtgtgattttggatgtgttcta

SEQ ID NO: 186920 - DNA, 23 bp, Artificial sequence
  SiRNA target sequence
gtgtgattttggatgtgttctat

SEQ ID NO: 186921 - DNA, 23 bp, Artificial sequence
  SiRNA target sequence
tgtgattttggatgtgttctata

SEQ ID NO: 186922 - DNA, 23 bp, Artificial sequence
  SiRNA target sequence
gtgattttggatgtgttctatac

SEQ ID NO: 186923 - DNA, 23 bp, Artificial sequence
  SiRNA target sequence
tgattttggatgtgttctatacg

SEQ ID NO: 186924 - DNA, 23 bp, Artificial sequence
  SiRNA target sequence
gattttggatgtgttctatacgg

SEQ ID NO: 186925 - DNA, 23 bp, Artificial sequence
  SiRNA target sequence
attttggatgtgttctatacgga

SEQ ID NO: 186926 - DNA, 23 bp, Artificial sequence
  SiRNA target sequence
ttttggatgtgttctatacggac

SEQ ID NO: 186927 - DNA, 23 bp, Artificial sequence
  SiRNA target sequence
tttggatgtgttctatacggaca

SEQ ID NO: 186928 - DNA, 23 bp, Artificial sequence
  SiRNA target sequence
ttggatgtgttctatacggacaa

SEQ ID NO: 186929 - DNA, 23 bp, Artificial sequence
  SiRNA target sequence
tggatgtgttctatacggacaat

SEQ ID NO: 186930 - DNA, 23 bp, Artificial sequence
  SiRNA target sequence
ggatgtgttctatacggacaatc

SEQ ID NO: 186931 - DNA, 23 bp, Artificial sequence
  SiRNA target sequence
gatgtgttctatacggacaatct

SEQ ID NO: 186932 - DNA, 23 bp, Artificial sequence
  SiRNA target sequence
atgtgttctatacggacaatctg

SEQ ID NO: 186933 - DNA, 23 bp, Artificial sequence
  SiRNA target sequence
tgtgttctatacggacaatctgg

SEQ ID NO: 186934 - DNA, 23 bp, Artificial sequence
  SiRNA target sequence
gtgttctatacggacaatctggg

SEQ ID NO: 186935 - DNA, 23 bp, Artificial sequence
  SiRNA target sequence
tgttctatacggacaatctgggg

SEQ ID NO: 186936 - DNA, 23 bp, Artificial sequence
  SiRNA target sequence
gttctatacggacaatctggggc

SEQ ID NO: 186937 - DNA, 23 bp, Artificial sequence
  SiRNA target sequence
ttctatacggacaatctggggca

SEQ ID NO: 186938 - DNA, 23 bp, Artificial sequence
  SiRNA target sequence
tctatacggacaatctggggcat

SEQ ID NO: 186939 - DNA, 23 bp, Artificial sequence
  SiRNA target sequence
ctatacggacaatctggggcata

SEQ ID NO: 186940 - DNA, 23 bp, Artificial sequence
  SiRNA target sequence
tatacggacaatctggggcatac

SEQ ID NO: 186941 - DNA, 23 bp, Artificial sequence
  SiRNA target sequence
atacggacaatctggggcatacg

SEQ ID NO: 186942 - DNA, 23 bp, Artificial sequence
  SiRNA target sequence
tacggacaatctggggcatacgg

SEQ ID NO: 186943 - DNA, 23 bp, Artificial sequence
  SiRNA target sequence
acggacaatctggggcatacggt

SEQ ID NO: 186944 - DNA, 23 bp, Artificial sequence
  SiRNA target sequence
cggacaatctggggcatacggtg

SEQ ID NO: 186945 - DNA, 23 bp, Artificial sequence
  SiRNA target sequence
ggacaatctggggcatacggtgt

SEQ ID NO: 186946 - DNA, 23 bp, Artificial sequence
  SiRNA target sequence
gacaatctggggcatacggtgta

SEQ ID NO: 186947 - DNA, 23 bp, Artificial sequence
  SiRNA target sequence
acaatctggggcatacggtgtaa

SEQ ID NO: 186948 - DNA, 23 bp, Artificial sequence
  SiRNA target sequence
caatctggggcatacggtgtaat

SEQ ID NO: 186949 - DNA, 23 bp, Artificial sequence
  SiRNA target sequence
aatctggggcatacggtgtaata

SEQ ID NO: 186950 - DNA, 23 bp, Artificial sequence
  SiRNA target sequence
atctggggcatacggtgtaataa

SEQ ID NO: 186951 - DNA, 23 bp, Artificial sequence
  SiRNA target sequence
tctggggcatacggtgtaataag

SEQ ID NO: 186952 - DNA, 23 bp, Artificial sequence
  SiRNA target sequence
ctggggcatacggtgtaataagc

SEQ ID NO: 186953 - DNA, 23 bp, Artificial sequence
  SiRNA target sequence
tggggcatacggtgtaataagcg

SEQ ID NO: 186954 - DNA, 23 bp, Artificial sequence
  SiRNA target sequence
ggggcatacggtgtaataagcgc

SEQ ID NO: 186955 - DNA, 23 bp, Artificial sequence
  SiRNA target sequence
gggcatacggtgtaataagcgca

SEQ ID NO: 186956 - DNA, 23 bp, Artificial sequence
  SiRNA target sequence
ggcatacggtgtaataagcgcac

SEQ ID NO: 186957 - DNA, 23 bp, Artificial sequence
  SiRNA target sequence
gcatacggtgtaataagcgcacc

SEQ ID NO: 186958 - DNA, 23 bp, Artificial sequence
  SiRNA target sequence
catacggtgtaataagcgcacca

SEQ ID NO: 186959 - DNA, 23 bp, Artificial sequence
  SiRNA target sequence
atacggtgtaataagcgcaccat

SEQ ID NO: 186960 - DNA, 23 bp, Artificial sequence
  SiRNA target sequence
tacggtgtaataagcgcaccata

SEQ ID NO: 186961 - DNA, 23 bp, Artificial sequence
  SiRNA target sequence
acggtgtaataagcgcaccatac

SEQ ID NO: 186962 - DNA, 23 bp, Artificial sequence
  SiRNA target sequence
cggtgtaataagcgcaccatacg

SEQ ID NO: 186963 - DNA, 23 bp, Artificial sequence
  SiRNA target sequence
ggtgtaataagcgcaccatacgt

SEQ ID NO: 186964 - DNA, 23 bp, Artificial sequence
  SiRNA target sequence
gtgtaataagcgcaccatacgtt

SEQ ID NO: 186965 - DNA, 23 bp, Artificial sequence
  SiRNA target sequence
tgtaataagcgcaccatacgtta

SEQ ID NO: 186966 - DNA, 23 bp, Artificial sequence
  SiRNA target sequence
gtaataagcgcaccatacgttat

SEQ ID NO: 186967 - DNA, 23 bp, Artificial sequence
  SiRNA target sequence
taataagcgcaccatacgttatt

SEQ ID NO: 186968 - DNA, 23 bp, Artificial sequence
  SiRNA target sequence
aataagcgcaccatacgttatta

SEQ ID NO: 186969 - DNA, 23 bp, Artificial sequence
  SiRNA target sequence
ataagcgcaccatacgttattaa

SEQ ID NO: 186970 - DNA, 23 bp, Artificial sequence
  SiRNA target sequence
taagcgcaccatacgttattaaa

SEQ ID NO: 186971 - DNA, 23 bp, Artificial sequence
  SiRNA target sequence
aagcgcaccatacgttattaaat

SEQ ID NO: 186972 - DNA, 23 bp, Artificial sequence
  SiRNA target sequence
agcgcaccatacgttattaaatc

SEQ ID NO: 186973 - DNA, 23 bp, Artificial sequence
  SiRNA target sequence
gcgcaccatacgttattaaatca

SEQ ID NO: 186974 - DNA, 23 bp, Artificial sequence
  SiRNA target sequence
cgcaccatacgttattaaatcag

SEQ ID NO: 186975 - DNA, 23 bp, Artificial sequence
  SiRNA target sequence
gcaccatacgttattaaatcagc

SEQ ID NO: 186976 - DNA, 23 bp, Artificial sequence
  SiRNA target sequence
caccatacgttattaaatcagca

SEQ ID NO: 186977 - DNA, 23 bp, Artificial sequence
  SiRNA target sequence
accatacgttattaaatcagcaa

SEQ ID NO: 186978 - DNA, 23 bp, Artificial sequence
  SiRNA target sequence
ccatacgttattaaatcagcaat

SEQ ID NO: 186979 - DNA, 23 bp, Artificial sequence
  SiRNA target sequence
catacgttattaaatcagcaata

SEQ ID NO: 186980 - DNA, 23 bp, Artificial sequence
  SiRNA target sequence
atacgttattaaatcagcaataa

SEQ ID NO: 186981 - DNA, 23 bp, Artificial sequence
  SiRNA target sequence
tacgttattaaatcagcaataaa

SEQ ID NO: 186982 - DNA, 23 bp, Artificial sequence
  SiRNA target sequence
acgttattaaatcagcaataaat

SEQ ID NO: 186983 - DNA, 23 bp, Artificial sequence
  SiRNA target sequence
cgttattaaatcagcaataaata

SEQ ID NO: 186984 - DNA, 23 bp, Artificial sequence
  SiRNA target sequence
gttattaaatcagcaataaatat

SEQ ID NO: 186985 - DNA, 23 bp, Artificial sequence
  SiRNA target sequence
ttattaaatcagcaataaatata

SEQ ID NO: 186986 - DNA, 23 bp, Artificial sequence
  SiRNA target sequence
tattaaatcagcaataaatatat

SEQ ID NO: 186987 - DNA, 23 bp, Artificial sequence
  SiRNA target sequence
attaaatcagcaataaatatatt

SEQ ID NO: 186988 - DNA, 23 bp, Artificial sequence
  SiRNA target sequence
ttaaatcagcaataaatatattt

SEQ ID NO: 186989 - DNA, 23 bp, Artificial sequence
  SiRNA target sequence
taaatcagcaataaatatatttc

SEQ ID NO: 186990 - DNA, 23 bp, Artificial sequence
  SiRNA target sequence
aaatcagcaataaatatatttct

SEQ ID NO: 186991 - DNA, 23 bp, Artificial sequence
  SiRNA target sequence
aatcagcaataaatatatttctt

SEQ ID NO: 186992 - DNA, 23 bp, Artificial sequence
  SiRNA target sequence
atcagcaataaatatatttcttg

SEQ ID NO: 186993 - DNA, 23 bp, Artificial sequence
  SiRNA target sequence
tcagcaataaatatatttcttga

SEQ ID NO: 186994 - DNA, 23 bp, Artificial sequence
  SiRNA target sequence
cagcaataaatatatttcttgat

SEQ ID NO: 186995 - DNA, 23 bp, Artificial sequence
  SiRNA target sequence
agcaataaatatatttcttgatg

SEQ ID NO: 186996 - DNA, 23 bp, Artificial sequence
  SiRNA target sequence
gcaataaatatatttcttgatgg

SEQ ID NO: 186997 - DNA, 23 bp, Artificial sequence
  SiRNA target sequence
caataaatatatttcttgatgga

SEQ ID NO: 186998 - DNA, 23 bp, Artificial sequence
  SiRNA target sequence
aataaatatatttcttgatggat

SEQ ID NO: 186999 - DNA, 23 bp, Artificial sequence
  SiRNA target sequence
ataaatatatttcttgatggatt

SEQ ID NO: 187000 - DNA, 23 bp, Artificial sequence
  SiRNA target sequence
taaatatatttcttgatggattt

SEQ ID NO: 187001 - DNA, 23 bp, Artificial sequence
  SiRNA target sequence
aaatatatttcttgatggatttt

SEQ ID NO: 187002 - DNA, 23 bp, Artificial sequence
  SiRNA target sequence
aatatatttcttgatggattttt

SEQ ID NO: 187003 - DNA, 23 bp, Artificial sequence
  SiRNA target sequence
atatatttcttgatggatttttg

SEQ ID NO: 187004 - DNA, 23 bp, Artificial sequence
  SiRNA target sequence
tatatttcttgatggatttttgc

SEQ ID NO: 187005 - DNA, 23 bp, Artificial sequence
  SiRNA target sequence
atatttcttgatggatttttgcc

SEQ ID NO: 187006 - DNA, 23 bp, Artificial sequence
  SiRNA target sequence
tatttcttgatggatttttgcct

SEQ ID NO: 187007 - DNA, 23 bp, Artificial sequence
  SiRNA target sequence
atttcttgatggatttttgccta

SEQ ID NO: 187008 - DNA, 23 bp, Artificial sequence
  SiRNA target sequence
tttcttgatggatttttgcctac

SEQ ID NO: 187009 - DNA, 23 bp, Artificial sequence
  SiRNA target sequence
ttcttgatggatttttgcctaca

SEQ ID NO: 187010 - DNA, 23 bp, Artificial sequence
  SiRNA target sequence
tcttgatggatttttgcctacag

SEQ ID NO: 187011 - DNA, 23 bp, Artificial sequence
  SiRNA target sequence
cttgatggatttttgcctacaga

SEQ ID NO: 187012 - DNA, 23 bp, Artificial sequence
  SiRNA target sequence
ttgatggatttttgcctacagaa

SEQ ID NO: 187013 - DNA, 23 bp, Artificial sequence
  SiRNA target sequence
tgatggatttttgcctacagaaa

SEQ ID NO: 187014 - DNA, 23 bp, Artificial sequence
  SiRNA target sequence
gatggatttttgcctacagaaaa

SEQ ID NO: 187015 - DNA, 23 bp, Artificial sequence
  SiRNA target sequence
atggatttttgcctacagaaaac

SEQ ID NO: 187016 - DNA, 23 bp, Artificial sequence
  SiRNA target sequence
tggatttttgcctacagaaaaca

SEQ ID NO: 187017 - DNA, 23 bp, Artificial sequence
  SiRNA target sequence
ggatttttgcctacagaaaacat

SEQ ID NO: 187018 - DNA, 23 bp, Artificial sequence
  SiRNA target sequence
gatttttgcctacagaaaacatg

SEQ ID NO: 187019 - DNA, 23 bp, Artificial sequence
  SiRNA target sequence
atttttgcctacagaaaacatga

SEQ ID NO: 187020 - DNA, 23 bp, Artificial sequence
  SiRNA target sequence
tttttgcctacagaaaacatgaa

SEQ ID NO: 187021 - DNA, 23 bp, Artificial sequence
  SiRNA target sequence
ttttgcctacagaaaacatgaaa

SEQ ID NO: 187022 - DNA, 23 bp, Artificial sequence
  SiRNA target sequence
tttgcctacagaaaacatgaaat

SEQ ID NO: 187023 - DNA, 23 bp, Artificial sequence
  SiRNA target sequence
ttgcctacagaaaacatgaaatt

SEQ ID NO: 187024 - DNA, 23 bp, Artificial sequence
  SiRNA target sequence
tgcctacagaaaacatgaaattt

SEQ ID NO: 187025 - DNA, 23 bp, Artificial sequence
  SiRNA target sequence
gcctacagaaaacatgaaattta

SEQ ID NO: 187026 - DNA, 23 bp, Artificial sequence
  SiRNA target sequence
cctacagaaaacatgaaatttag

SEQ ID NO: 187027 - DNA, 23 bp, Artificial sequence
  SiRNA target sequence
ctacagaaaacatgaaatttaga

SEQ ID NO: 187028 - DNA, 23 bp, Artificial sequence
  SiRNA target sequence
tacagaaaacatgaaatttagaa

SEQ ID NO: 187029 - DNA, 23 bp, Artificial sequence
  SiRNA target sequence
acagaaaacatgaaatttagaaa

SEQ ID NO: 187030 - DNA, 23 bp, Artificial sequence
  SiRNA target sequence
cagaaaacatgaaatttagaaat

SEQ ID NO: 187031 - DNA, 23 bp, Artificial sequence
  SiRNA target sequence
agaaaacatgaaatttagaaatt

SEQ ID NO: 187032 - DNA, 23 bp, Artificial sequence
  SiRNA target sequence
gaaaacatgaaatttagaaattc

SEQ ID NO: 187033 - DNA, 23 bp, Artificial sequence
  SiRNA target sequence
aaaacatgaaatttagaaattca

SEQ ID NO: 187034 - DNA, 23 bp, Artificial sequence
  SiRNA target sequence
aaacatgaaatttagaaattcag

SEQ ID NO: 187035 - DNA, 23 bp, Artificial sequence
  SiRNA target sequence
aacatgaaatttagaaattcaga

SEQ ID NO: 187036 - DNA, 23 bp, Artificial sequence
  SiRNA target sequence
acatgaaatttagaaattcagag

SEQ ID NO: 187037 - DNA, 23 bp, Artificial sequence
  SiRNA target sequence
catgaaatttagaaattcagagt

SEQ ID NO: 187038 - DNA, 23 bp, Artificial sequence
  SiRNA target sequence
atgaaatttagaaattcagagtt

SEQ ID NO: 187039 - DNA, 23 bp, Artificial sequence
  SiRNA target sequence
tgaaatttagaaattcagagtta

SEQ ID NO: 187040 - DNA, 23 bp, Artificial sequence
  SiRNA target sequence
gaaatttagaaattcagagttaa

SEQ ID NO: 187041 - DNA, 23 bp, Artificial sequence
  SiRNA target sequence
aaatttagaaattcagagttaaa

SEQ ID NO: 187042 - DNA, 23 bp, Artificial sequence
  SiRNA target sequence
aatttagaaattcagagttaaag

SEQ ID NO: 187043 - DNA, 23 bp, Artificial sequence
  SiRNA target sequence
atttagaaattcagagttaaagt

SEQ ID NO: 187044 - DNA, 23 bp, Artificial sequence
  SiRNA target sequence
tttagaaattcagagttaaagtt

SEQ ID NO: 187045 - DNA, 23 bp, Artificial sequence
  SiRNA target sequence
ttagaaattcagagttaaagttt

SEQ ID NO: 187046 - DNA, 23 bp, Artificial sequence
  SiRNA target sequence
tagaaattcagagttaaagttta

SEQ ID NO: 187047 - DNA, 23 bp, Artificial sequence
  SiRNA target sequence
agaaattcagagttaaagtttaa

SEQ ID NO: 187048 - DNA, 23 bp, Artificial sequence
  SiRNA target sequence
gaaattcagagttaaagtttaat

SEQ ID NO: 187049 - DNA, 23 bp, Artificial sequence
  SiRNA target sequence
aaattcagagttaaagtttaata

SEQ ID NO: 187050 - DNA, 23 bp, Artificial sequence
  SiRNA target sequence
aattcagagttaaagtttaatat

SEQ ID NO: 187051 - DNA, 23 bp, Artificial sequence
  SiRNA target sequence
attcagagttaaagtttaatatt

SEQ ID NO: 187052 - DNA, 23 bp, Artificial sequence
  SiRNA target sequence
ttcagagttaaagtttaatattt

SEQ ID NO: 187053 - DNA, 23 bp, Artificial sequence
  SiRNA target sequence
tcagagttaaagtttaatatttc

SEQ ID NO: 187054 - DNA, 23 bp, Artificial sequence
  SiRNA target sequence
cagagttaaagtttaatatttcg

SEQ ID NO: 187055 - DNA, 23 bp, Artificial sequence
  SiRNA target sequence
agagttaaagtttaatatttcgg

SEQ ID NO: 187056 - DNA, 23 bp, Artificial sequence
  SiRNA target sequence
gagttaaagtttaatatttcgga

SEQ ID NO: 187057 - DNA, 23 bp, Artificial sequence
  SiRNA target sequence
agttaaagtttaatatttcggaa

SEQ ID NO: 187058 - DNA, 23 bp, Artificial sequence
  SiRNA target sequence
gttaaagtttaatatttcggaaa

SEQ ID NO: 187059 - DNA, 23 bp, Artificial sequence
  SiRNA target sequence
ttaaagtttaatatttcggaaac

SEQ ID NO: 187060 - DNA, 23 bp, Artificial sequence
  SiRNA target sequence
taaagtttaatatttcggaaaca

SEQ ID NO: 187061 - DNA, 23 bp, Artificial sequence
  SiRNA target sequence
aaagtttaatatttcggaaacac

SEQ ID NO: 187062 - DNA, 23 bp, Artificial sequence
  SiRNA target sequence
aagtttaatatttcggaaacact

SEQ ID NO: 187063 - DNA, 23 bp, Artificial sequence
  SiRNA target sequence
agtttaatatttcggaaacactt

SEQ ID NO: 187064 - DNA, 23 bp, Artificial sequence
  SiRNA target sequence
gtttaatatttcggaaacacttg

SEQ ID NO: 187065 - DNA, 23 bp, Artificial sequence
  SiRNA target sequence
tttaatatttcggaaacacttga

SEQ ID NO: 187066 - DNA, 23 bp, Artificial sequence
  SiRNA target sequence
ttaatatttcggaaacacttgat

SEQ ID NO: 187067 - DNA, 23 bp, Artificial sequence
  SiRNA target sequence
taatatttcggaaacacttgata

SEQ ID NO: 187068 - DNA, 23 bp, Artificial sequence
  SiRNA target sequence
aatatttcggaaacacttgatag

SEQ ID NO: 187069 - DNA, 23 bp, Artificial sequence
  SiRNA target sequence
atatttcggaaacacttgatagt

SEQ ID NO: 187070 - DNA, 23 bp, Artificial sequence
  SiRNA target sequence
tatttcggaaacacttgatagta

SEQ ID NO: 187071 - DNA, 23 bp, Artificial sequence
  SiRNA target sequence
atttcggaaacacttgatagtat

SEQ ID NO: 187072 - DNA, 23 bp, Artificial sequence
  SiRNA target sequence
tttcggaaacacttgatagtatt

SEQ ID NO: 187073 - DNA, 23 bp, Artificial sequence
  SiRNA target sequence
ttcggaaacacttgatagtatta

SEQ ID NO: 187074 - DNA, 23 bp, Artificial sequence
  SiRNA target sequence
tcggaaacacttgatagtattat

SEQ ID NO: 187075 - DNA, 23 bp, Artificial sequence
  SiRNA target sequence
cggaaacacttgatagtattata

SEQ ID NO: 187076 - DNA, 23 bp, Artificial sequence
  SiRNA target sequence
ggaaacacttgatagtattatat

SEQ ID NO: 187077 - DNA, 23 bp, Artificial sequence
  SiRNA target sequence
gaaacacttgatagtattatatc

SEQ ID NO: 187078 - DNA, 23 bp, Artificial sequence
  SiRNA target sequence
aaacacttgatagtattatatct

SEQ ID NO: 187079 - DNA, 23 bp, Artificial sequence
  SiRNA target sequence
aacacttgatagtattatatcta

SEQ ID NO: 187080 - DNA, 23 bp, Artificial sequence
  SiRNA target sequence
acacttgatagtattatatctac

SEQ ID NO: 187081 - DNA, 23 bp, Artificial sequence
  SiRNA target sequence
cacttgatagtattatatctacc

SEQ ID NO: 187082 - DNA, 23 bp, Artificial sequence
  SiRNA target sequence
acttgatagtattatatctacca

SEQ ID NO: 187083 - DNA, 23 bp, Artificial sequence
  SiRNA target sequence
cttgatagtattatatctaccag

SEQ ID NO: 187084 - DNA, 23 bp, Artificial sequence
  SiRNA target sequence
ttgatagtattatatctaccaga

SEQ ID NO: 187085 - DNA, 23 bp, Artificial sequence
  SiRNA target sequence
tgatagtattatatctaccagag

SEQ ID NO: 187086 - DNA, 23 bp, Artificial sequence
  SiRNA target sequence
gatagtattatatctaccagaga

SEQ ID NO: 187087 - DNA, 23 bp, Artificial sequence
  SiRNA target sequence
atagtattatatctaccagagac

SEQ ID NO: 187088 - DNA, 23 bp, Artificial sequence
  SiRNA target sequence
tagtattatatctaccagagacc

SEQ ID NO: 187089 - DNA, 23 bp, Artificial sequence
  SiRNA target sequence
agtattatatctaccagagacca

SEQ ID NO: 187090 - DNA, 23 bp, Artificial sequence
  SiRNA target sequence
gtattatatctaccagagaccag

SEQ ID NO: 187091 - DNA, 23 bp, Artificial sequence
  SiRNA target sequence
tattatatctaccagagaccagt

SEQ ID NO: 187092 - DNA, 23 bp, Artificial sequence
  SiRNA target sequence
attatatctaccagagaccagta

SEQ ID NO: 187093 - DNA, 23 bp, Artificial sequence
  SiRNA target sequence
ttatatctaccagagaccagtat

SEQ ID NO: 187094 - DNA, 23 bp, Artificial sequence
  SiRNA target sequence
tatatctaccagagaccagtatc

SEQ ID NO: 187095 - DNA, 23 bp, Artificial sequence
  SiRNA target sequence
atatctaccagagaccagtatca

SEQ ID NO: 187096 - DNA, 23 bp, Artificial sequence
  SiRNA target sequence
tatctaccagagaccagtatcat

SEQ ID NO: 187097 - DNA, 23 bp, Artificial sequence
  SiRNA target sequence
atctaccagagaccagtatcatt

SEQ ID NO: 187098 - DNA, 23 bp, Artificial sequence
  SiRNA target sequence
tctaccagagaccagtatcatta

SEQ ID NO: 187099 - DNA, 23 bp, Artificial sequence
  SiRNA target sequence
ctaccagagaccagtatcattat

SEQ ID NO: 187100 - DNA, 23 bp, Artificial sequence
  SiRNA target sequence
taccagagaccagtatcattatc

SEQ ID NO: 187101 - DNA, 23 bp, Artificial sequence
  SiRNA target sequence
accagagaccagtatcattatcc

SEQ ID NO: 187102 - DNA, 23 bp, Artificial sequence
  SiRNA target sequence
ccagagaccagtatcattatccc

SEQ ID NO: 187103 - DNA, 23 bp, Artificial sequence
  SiRNA target sequence
cagagaccagtatcattatccca

SEQ ID NO: 187104 - DNA, 23 bp, Artificial sequence
  SiRNA target sequence
agagaccagtatcattatcccaa

SEQ ID NO: 187105 - DNA, 23 bp, Artificial sequence
  SiRNA target sequence
gagaccagtatcattatcccaat

SEQ ID NO: 187106 - DNA, 23 bp, Artificial sequence
  SiRNA target sequence
agaccagtatcattatcccaatt

SEQ ID NO: 187107 - DNA, 23 bp, Artificial sequence
  SiRNA target sequence
gaccagtatcattatcccaattt

SEQ ID NO: 187108 - DNA, 23 bp, Artificial sequence
  SiRNA target sequence
accagtatcattatcccaatttg

SEQ ID NO: 187109 - DNA, 23 bp, Artificial sequence
  SiRNA target sequence
ccagtatcattatcccaatttga

SEQ ID NO: 187110 - DNA, 23 bp, Artificial sequence
  SiRNA target sequence
cagtatcattatcccaatttgat

SEQ ID NO: 187111 - DNA, 23 bp, Artificial sequence
  SiRNA target sequence
agtatcattatcccaatttgata

SEQ ID NO: 187112 - DNA, 23 bp, Artificial sequence
  SiRNA target sequence
gtatcattatcccaatttgataa

SEQ ID NO: 187113 - DNA, 23 bp, Artificial sequence
  SiRNA target sequence
tatcattatcccaatttgataaa

SEQ ID NO: 187114 - DNA, 23 bp, Artificial sequence
  SiRNA target sequence
atcattatcccaatttgataaaa

SEQ ID NO: 187115 - DNA, 23 bp, Artificial sequence
  SiRNA target sequence
tcattatcccaatttgataaaaa

SEQ ID NO: 187116 - DNA, 23 bp, Artificial sequence
  SiRNA target sequence
cattatcccaatttgataaaaac

SEQ ID NO: 187117 - DNA, 23 bp, Artificial sequence
  SiRNA target sequence
attatcccaatttgataaaaaca

SEQ ID NO: 187118 - DNA, 23 bp, Artificial sequence
  SiRNA target sequence
ttatcccaatttgataaaaacat

SEQ ID NO: 187119 - DNA, 23 bp, Artificial sequence
  SiRNA target sequence
tatcccaatttgataaaaacata

SEQ ID NO: 187120 - DNA, 23 bp, Artificial sequence
  SiRNA target sequence
atcccaatttgataaaaacatat

SEQ ID NO: 187121 - DNA, 23 bp, Artificial sequence
  SiRNA target sequence
tcccaatttgataaaaacatatc

SEQ ID NO: 187122 - DNA, 23 bp, Artificial sequence
  SiRNA target sequence
cccaatttgataaaaacatatcc

SEQ ID NO: 187123 - DNA, 23 bp, Artificial sequence
  SiRNA target sequence
ccaatttgataaaaacatatcca

SEQ ID NO: 187124 - DNA, 23 bp, Artificial sequence
  SiRNA target sequence
caatttgataaaaacatatccaa

SEQ ID NO: 187125 - DNA, 23 bp, Artificial sequence
  SiRNA target sequence
aatttgataaaaacatatccaaa

SEQ ID NO: 187126 - DNA, 23 bp, Artificial sequence
  SiRNA target sequence
atttgataaaaacatatccaaat

SEQ ID NO: 187127 - DNA, 23 bp, Artificial sequence
  SiRNA target sequence
tttgataaaaacatatccaaatt

SEQ ID NO: 187128 - DNA, 23 bp, Artificial sequence
  SiRNA target sequence
ttgataaaaacatatccaaattt

SEQ ID NO: 187129 - DNA, 23 bp, Artificial sequence
  SiRNA target sequence
tgataaaaacatatccaaatttt

SEQ ID NO: 187130 - DNA, 23 bp, Artificial sequence
  SiRNA target sequence
gataaaaacatatccaaatttta

SEQ ID NO: 187131 - DNA, 23 bp, Artificial sequence
  SiRNA target sequence
ataaaaacatatccaaattttac

SEQ ID NO: 187132 - DNA, 23 bp, Artificial sequence
  SiRNA target sequence
taaaaacatatccaaattttacg

SEQ ID NO: 187133 - DNA, 23 bp, Artificial sequence
  SiRNA target sequence
aaaaacatatccaaattttacgc

SEQ ID NO: 187134 - DNA, 23 bp, Artificial sequence
  SiRNA target sequence
aaaacatatccaaattttacgct

SEQ ID NO: 187135 - DNA, 23 bp, Artificial sequence
  SiRNA target sequence
aaacatatccaaattttacgctt

SEQ ID NO: 187136 - DNA, 23 bp, Artificial sequence
  SiRNA target sequence
aacatatccaaattttacgctta

SEQ ID NO: 187137 - DNA, 23 bp, Artificial sequence
  SiRNA target sequence
acatatccaaattttacgcttaa

SEQ ID NO: 187138 - DNA, 23 bp, Artificial sequence
  SiRNA target sequence
catatccaaattttacgcttaaa

SEQ ID NO: 187139 - DNA, 23 bp, Artificial sequence
  SiRNA target sequence
atatccaaattttacgcttaaag

SEQ ID NO: 187140 - DNA, 23 bp, Artificial sequence
  SiRNA target sequence
tatccaaattttacgcttaaagt

SEQ ID NO: 187141 - DNA, 23 bp, Artificial sequence
  SiRNA target sequence
atccaaattttacgcttaaagtt

SEQ ID NO: 187142 - DNA, 23 bp, Artificial sequence
  SiRNA target sequence
tccaaattttacgcttaaagttg

SEQ ID NO: 187143 - DNA, 23 bp, Artificial sequence
  SiRNA target sequence
ccaaattttacgcttaaagttga

SEQ ID NO: 187144 - DNA, 23 bp, Artificial sequence
  SiRNA target sequence
caaattttacgcttaaagttgaa

SEQ ID NO: 187145 - DNA, 23 bp, Artificial sequence
  SiRNA target sequence
aaattttacgcttaaagttgaag

SEQ ID NO: 187146 - DNA, 23 bp, Artificial sequence
  SiRNA target sequence
aattttacgcttaaagttgaagg

SEQ ID NO: 187147 - DNA, 23 bp, Artificial sequence
  SiRNA target sequence
attttacgcttaaagttgaaggc

SEQ ID NO: 187148 - DNA, 23 bp, Artificial sequence
  SiRNA target sequence
ttttacgcttaaagttgaaggcg

SEQ ID NO: 187149 - DNA, 23 bp, Artificial sequence
  SiRNA target sequence
tttacgcttaaagttgaaggcgg

SEQ ID NO: 187150 - DNA, 23 bp, Artificial sequence
  SiRNA target sequence
ttacgcttaaagttgaaggcggt

SEQ ID NO: 187151 - DNA, 23 bp, Artificial sequence
  SiRNA target sequence
tacgcttaaagttgaaggcggta

SEQ ID NO: 187152 - DNA, 23 bp, Artificial sequence
  SiRNA target sequence
acgcttaaagttgaaggcggtaa

SEQ ID NO: 187153 - DNA, 23 bp, Artificial sequence
  SiRNA target sequence
cgcttaaagttgaaggcggtaac

SEQ ID NO: 187154 - DNA, 23 bp, Artificial sequence
  SiRNA target sequence
gcttaaagttgaaggcggtaact

SEQ ID NO: 187155 - DNA, 23 bp, Artificial sequence
  SiRNA target sequence
cttaaagttgaaggcggtaactt

SEQ ID NO: 187156 - DNA, 23 bp, Artificial sequence
  SiRNA target sequence
ttaaagttgaaggcggtaacttt

SEQ ID NO: 187157 - DNA, 23 bp, Artificial sequence
  SiRNA target sequence
taaagttgaaggcggtaactttt

SEQ ID NO: 187158 - DNA, 23 bp, Artificial sequence
  SiRNA target sequence
aaagttgaaggcggtaacttttc

SEQ ID NO: 187159 - DNA, 23 bp, Artificial sequence
  SiRNA target sequence
aagttgaaggcggtaacttttca

SEQ ID NO: 187160 - DNA, 23 bp, Artificial sequence
  SiRNA target sequence
agttgaaggcggtaacttttcag

SEQ ID NO: 187161 - DNA, 23 bp, Artificial sequence
  SiRNA target sequence
gttgaaggcggtaacttttcaga

SEQ ID NO: 187162 - DNA, 23 bp, Artificial sequence
  SiRNA target sequence
ttgaaggcggtaacttttcagat

SEQ ID NO: 187163 - DNA, 23 bp, Artificial sequence
  SiRNA target sequence
tgaaggcggtaacttttcagatt

SEQ ID NO: 187164 - DNA, 23 bp, Artificial sequence
  SiRNA target sequence
gaaggcggtaacttttcagattc

SEQ ID NO: 187165 - DNA, 23 bp, Artificial sequence
  SiRNA target sequence
aaggcggtaacttttcagattct

SEQ ID NO: 187166 - DNA, 23 bp, Artificial sequence
  SiRNA target sequence
aggcggtaacttttcagattctg

SEQ ID NO: 187167 - DNA, 23 bp, Artificial sequence
  SiRNA target sequence
ggcggtaacttttcagattctga

SEQ ID NO: 187168 - DNA, 23 bp, Artificial sequence
  SiRNA target sequence
gcggtaacttttcagattctgaa

SEQ ID NO: 187169 - DNA, 23 bp, Artificial sequence
  SiRNA target sequence
cggtaacttttcagattctgaaa

SEQ ID NO: 187170 - DNA, 23 bp, Artificial sequence
  SiRNA target sequence
ggtaacttttcagattctgaaat

SEQ ID NO: 187171 - DNA, 23 bp, Artificial sequence
  SiRNA target sequence
gtaacttttcagattctgaaatt

SEQ ID NO: 187172 - DNA, 23 bp, Artificial sequence
  SiRNA target sequence
taacttttcagattctgaaattg

SEQ ID NO: 187173 - DNA, 23 bp, Artificial sequence
  SiRNA target sequence
aacttttcagattctgaaattgt

SEQ ID NO: 187174 - DNA, 23 bp, Artificial sequence
  SiRNA target sequence
acttttcagattctgaaattgtt

SEQ ID NO: 187175 - DNA, 23 bp, Artificial sequence
  SiRNA target sequence
cttttcagattctgaaattgttg

SEQ ID NO: 187176 - DNA, 23 bp, Artificial sequence
  SiRNA target sequence
ttttcagattctgaaattgttgt

SEQ ID NO: 187177 - DNA, 23 bp, Artificial sequence
  SiRNA target sequence
tttcagattctgaaattgttgta

SEQ ID NO: 187178 - DNA, 23 bp, Artificial sequence
  SiRNA target sequence
ttcagattctgaaattgttgtat

SEQ ID NO: 187179 - DNA, 23 bp, Artificial sequence
  SiRNA target sequence
tcagattctgaaattgttgtatt

SEQ ID NO: 187180 - DNA, 23 bp, Artificial sequence
  SiRNA target sequence
cagattctgaaattgttgtattt

SEQ ID NO: 187181 - DNA, 23 bp, Artificial sequence
  SiRNA target sequence
agattctgaaattgttgtatttc

SEQ ID NO: 187182 - DNA, 23 bp, Artificial sequence
  SiRNA target sequence
gattctgaaattgttgtatttct

SEQ ID NO: 187183 - DNA, 23 bp, Artificial sequence
  SiRNA target sequence
attctgaaattgttgtatttctt

SEQ ID NO: 187184 - DNA, 23 bp, Artificial sequence
  SiRNA target sequence
ttctgaaattgttgtatttcttg

SEQ ID NO: 187185 - DNA, 23 bp, Artificial sequence
  SiRNA target sequence
tctgaaattgttgtatttcttgg

SEQ ID NO: 187186 - DNA, 23 bp, Artificial sequence
  SiRNA target sequence
ctgaaattgttgtatttcttggt

SEQ ID NO: 187187 - DNA, 23 bp, Artificial sequence
  SiRNA target sequence
tgaaattgttgtatttcttggtg

SEQ ID NO: 187188 - DNA, 23 bp, Artificial sequence
  SiRNA target sequence
gaaattgttgtatttcttggtga

SEQ ID NO: 187189 - DNA, 23 bp, Artificial sequence
  SiRNA target sequence
aaattgttgtatttcttggtgaa

SEQ ID NO: 187190 - DNA, 23 bp, Artificial sequence
  SiRNA target sequence
aattgttgtatttcttggtgaaa

SEQ ID NO: 187191 - DNA, 23 bp, Artificial sequence
  SiRNA target sequence
attgttgtatttcttggtgaaaa

SEQ ID NO: 187192 - DNA, 23 bp, Artificial sequence
  SiRNA target sequence
ttgttgtatttcttggtgaaaat

SEQ ID NO: 187193 - DNA, 23 bp, Artificial sequence
  SiRNA target sequence
tgttgtatttcttggtgaaaatg

SEQ ID NO: 187194 - DNA, 23 bp, Artificial sequence
  SiRNA target sequence
gttgtatttcttggtgaaaatgg

SEQ ID NO: 187195 - DNA, 23 bp, Artificial sequence
  SiRNA target sequence
ttgtatttcttggtgaaaatgga

SEQ ID NO: 187196 - DNA, 23 bp, Artificial sequence
  SiRNA target sequence
tgtatttcttggtgaaaatggaa

SEQ ID NO: 187197 - DNA, 23 bp, Artificial sequence
  SiRNA target sequence
gtatttcttggtgaaaatggaat

SEQ ID NO: 187198 - DNA, 23 bp, Artificial sequence
  SiRNA target sequence
tatttcttggtgaaaatggaatg

SEQ ID NO: 187199 - DNA, 23 bp, Artificial sequence
  SiRNA target sequence
atttcttggtgaaaatggaatgg

SEQ ID NO: 187200 - DNA, 23 bp, Artificial sequence
  SiRNA target sequence
tttcttggtgaaaatggaatggg

SEQ ID NO: 187201 - DNA, 23 bp, Artificial sequence
  SiRNA target sequence
ttcttggtgaaaatggaatgggc

SEQ ID NO: 187202 - DNA, 23 bp, Artificial sequence
  SiRNA target sequence
tcttggtgaaaatggaatgggca

SEQ ID NO: 187203 - DNA, 23 bp, Artificial sequence
  SiRNA target sequence
cttggtgaaaatggaatgggcaa

SEQ ID NO: 187204 - DNA, 23 bp, Artificial sequence
  SiRNA target sequence
ttggtgaaaatggaatgggcaaa

SEQ ID NO: 187205 - DNA, 23 bp, Artificial sequence
  SiRNA target sequence
tggtgaaaatggaatgggcaaaa

SEQ ID NO: 187206 - DNA, 23 bp, Artificial sequence
  SiRNA target sequence
ggtgaaaatggaatgggcaaaac

SEQ ID NO: 187207 - DNA, 23 bp, Artificial sequence
  SiRNA target sequence
gtgaaaatggaatgggcaaaact

SEQ ID NO: 187208 - DNA, 23 bp, Artificial sequence
  SiRNA target sequence
tgaaaatggaatgggcaaaacta

SEQ ID NO: 187209 - DNA, 23 bp, Artificial sequence
  SiRNA target sequence
gaaaatggaatgggcaaaactac

SEQ ID NO: 187210 - DNA, 23 bp, Artificial sequence
  SiRNA target sequence
aaaatggaatgggcaaaactact

SEQ ID NO: 187211 - DNA, 23 bp, Artificial sequence
  SiRNA target sequence
aaatggaatgggcaaaactactt

SEQ ID NO: 187212 - DNA, 23 bp, Artificial sequence
  SiRNA target sequence
aatggaatgggcaaaactacttt

SEQ ID NO: 187213 - DNA, 23 bp, Artificial sequence
  SiRNA target sequence
atggaatgggcaaaactacttta

SEQ ID NO: 187214 - DNA, 23 bp, Artificial sequence
  SiRNA target sequence
tggaatgggcaaaactactttag

SEQ ID NO: 187215 - DNA, 23 bp, Artificial sequence
  SiRNA target sequence
ggaatgggcaaaactactttagt

SEQ ID NO: 187216 - DNA, 23 bp, Artificial sequence
  SiRNA target sequence
gaatgggcaaaactactttagta

SEQ ID NO: 187217 - DNA, 23 bp, Artificial sequence
  SiRNA target sequence
aatgggcaaaactactttagtag

SEQ ID NO: 187218 - DNA, 23 bp, Artificial sequence
  SiRNA target sequence
atgggcaaaactactttagtagg

SEQ ID NO: 187219 - DNA, 23 bp, Artificial sequence
  SiRNA target sequence
tgggcaaaactactttagtaggt

SEQ ID NO: 187220 - DNA, 23 bp, Artificial sequence
  SiRNA target sequence
gggcaaaactactttagtaggtt

SEQ ID NO: 187221 - DNA, 23 bp, Artificial sequence
  SiRNA target sequence
ggcaaaactactttagtaggttt

SEQ ID NO: 187222 - DNA, 23 bp, Artificial sequence
  SiRNA target sequence
gcaaaactactttagtaggtttg

SEQ ID NO: 187223 - DNA, 23 bp, Artificial sequence
  SiRNA target sequence
caaaactactttagtaggtttga

SEQ ID NO: 187224 - DNA, 23 bp, Artificial sequence
  SiRNA target sequence
aaaactactttagtaggtttgat

SEQ ID NO: 187225 - DNA, 23 bp, Artificial sequence
  SiRNA target sequence
aaactactttagtaggtttgatt

SEQ ID NO: 187226 - DNA, 23 bp, Artificial sequence
  SiRNA target sequence
aactactttagtaggtttgattt

SEQ ID NO: 187227 - DNA, 23 bp, Artificial sequence
  SiRNA target sequence
actactttagtaggtttgatttc

SEQ ID NO: 187228 - DNA, 23 bp, Artificial sequence
  SiRNA target sequence
ctactttagtaggtttgatttcg

SEQ ID NO: 187229 - DNA, 23 bp, Artificial sequence
  SiRNA target sequence
tactttagtaggtttgatttcgg

SEQ ID NO: 187230 - DNA, 23 bp, Artificial sequence
  SiRNA target sequence
actttagtaggtttgatttcggg

SEQ ID NO: 187231 - DNA, 23 bp, Artificial sequence
  SiRNA target sequence
ctttagtaggtttgatttcgggg

SEQ ID NO: 187232 - DNA, 23 bp, Artificial sequence
  SiRNA target sequence
tttagtaggtttgatttcggggt

SEQ ID NO: 187233 - DNA, 23 bp, Artificial sequence
  SiRNA target sequence
ttagtaggtttgatttcggggtt

SEQ ID NO: 187234 - DNA, 23 bp, Artificial sequence
  SiRNA target sequence
tagtaggtttgatttcggggtta

SEQ ID NO: 187235 - DNA, 23 bp, Artificial sequence
  SiRNA target sequence
agtaggtttgatttcggggttaa

SEQ ID NO: 187236 - DNA, 23 bp, Artificial sequence
  SiRNA target sequence
gtaggtttgatttcggggttaat

SEQ ID NO: 187237 - DNA, 23 bp, Artificial sequence
  SiRNA target sequence
taggtttgatttcggggttaatt

SEQ ID NO: 187238 - DNA, 23 bp, Artificial sequence
  SiRNA target sequence
aggtttgatttcggggttaatta

SEQ ID NO: 187239 - DNA, 23 bp, Artificial sequence
  SiRNA target sequence
ggtttgatttcggggttaattaa

SEQ ID NO: 187240 - DNA, 23 bp, Artificial sequence
  SiRNA target sequence
gtttgatttcggggttaattaaa

SEQ ID NO: 187241 - DNA, 23 bp, Artificial sequence
  SiRNA target sequence
tttgatttcggggttaattaaag

SEQ ID NO: 187242 - DNA, 23 bp, Artificial sequence
  SiRNA target sequence
ttgatttcggggttaattaaaga

SEQ ID NO: 187243 - DNA, 23 bp, Artificial sequence
  SiRNA target sequence
tgatttcggggttaattaaagat

SEQ ID NO: 187244 - DNA, 23 bp, Artificial sequence
  SiRNA target sequence
gatttcggggttaattaaagatg

SEQ ID NO: 187245 - DNA, 23 bp, Artificial sequence
  SiRNA target sequence
atttcggggttaattaaagatga

SEQ ID NO: 187246 - DNA, 23 bp, Artificial sequence
  SiRNA target sequence
tttcggggttaattaaagatgat

SEQ ID NO: 187247 - DNA, 23 bp, Artificial sequence
  SiRNA target sequence
ttcggggttaattaaagatgata

SEQ ID NO: 187248 - DNA, 23 bp, Artificial sequence
  SiRNA target sequence
tcggggttaattaaagatgataa

SEQ ID NO: 187249 - DNA, 23 bp, Artificial sequence
  SiRNA target sequence
cggggttaattaaagatgataac

SEQ ID NO: 187250 - DNA, 23 bp, Artificial sequence
  SiRNA target sequence
ggggttaattaaagatgataacg

SEQ ID NO: 187251 - DNA, 23 bp, Artificial sequence
  SiRNA target sequence
gggttaattaaagatgataacgg

SEQ ID NO: 187252 - DNA, 23 bp, Artificial sequence
  SiRNA target sequence
ggttaattaaagatgataacggg

SEQ ID NO: 187253 - DNA, 23 bp, Artificial sequence
  SiRNA target sequence
gttaattaaagatgataacgggg

SEQ ID NO: 187254 - DNA, 23 bp, Artificial sequence
  SiRNA target sequence
ttaattaaagatgataacgggga

SEQ ID NO: 187255 - DNA, 23 bp, Artificial sequence
  SiRNA target sequence
taattaaagatgataacggggaa

SEQ ID NO: 187256 - DNA, 23 bp, Artificial sequence
  SiRNA target sequence
aattaaagatgataacggggaag

SEQ ID NO: 187257 - DNA, 23 bp, Artificial sequence
  SiRNA target sequence
attaaagatgataacggggaaga

SEQ ID NO: 187258 - DNA, 23 bp, Artificial sequence
  SiRNA target sequence
ttaaagatgataacggggaagag

SEQ ID NO: 187259 - DNA, 23 bp, Artificial sequence
  SiRNA target sequence
taaagatgataacggggaagagt

SEQ ID NO: 187260 - DNA, 23 bp, Artificial sequence
  SiRNA target sequence
aaagatgataacggggaagagtt

SEQ ID NO: 187261 - DNA, 23 bp, Artificial sequence
  SiRNA target sequence
aagatgataacggggaagagttc

SEQ ID NO: 187262 - DNA, 23 bp, Artificial sequence
  SiRNA target sequence
agatgataacggggaagagttcg

SEQ ID NO: 187263 - DNA, 23 bp, Artificial sequence
  SiRNA target sequence
gatgataacggggaagagttcgg

SEQ ID NO: 187264 - DNA, 23 bp, Artificial sequence
  SiRNA target sequence
atgataacggggaagagttcggt

SEQ ID NO: 187265 - DNA, 23 bp, Artificial sequence
  SiRNA target sequence
tgataacggggaagagttcggtt

SEQ ID NO: 187266 - DNA, 23 bp, Artificial sequence
  SiRNA target sequence
gataacggggaagagttcggttt

SEQ ID NO: 187267 - DNA, 23 bp, Artificial sequence
  SiRNA target sequence
ataacggggaagagttcggtttg

SEQ ID NO: 187268 - DNA, 23 bp, Artificial sequence
  SiRNA target sequence
taacggggaagagttcggtttgt

SEQ ID NO: 187269 - DNA, 23 bp, Artificial sequence
  SiRNA target sequence
aacggggaagagttcggtttgtt

SEQ ID NO: 187270 - DNA, 23 bp, Artificial sequence
  SiRNA target sequence
acggggaagagttcggtttgttg

SEQ ID NO: 187271 - DNA, 23 bp, Artificial sequence
  SiRNA target sequence
cggggaagagttcggtttgttgt

SEQ ID NO: 187272 - DNA, 23 bp, Artificial sequence
  SiRNA target sequence
ggggaagagttcggtttgttgtc

SEQ ID NO: 187273 - DNA, 23 bp, Artificial sequence
  SiRNA target sequence
gggaagagttcggtttgttgtca

SEQ ID NO: 187274 - DNA, 23 bp, Artificial sequence
  SiRNA target sequence
ggaagagttcggtttgttgtcat

SEQ ID NO: 187275 - DNA, 23 bp, Artificial sequence
  SiRNA target sequence
gaagagttcggtttgttgtcata

SEQ ID NO: 187276 - DNA, 23 bp, Artificial sequence
  SiRNA target sequence
aagagttcggtttgttgtcatat

SEQ ID NO: 187277 - DNA, 23 bp, Artificial sequence
  SiRNA target sequence
agagttcggtttgttgtcatata

SEQ ID NO: 187278 - DNA, 23 bp, Artificial sequence
  SiRNA target sequence
gagttcggtttgttgtcatatag

SEQ ID NO: 187279 - DNA, 23 bp, Artificial sequence
  SiRNA target sequence
agttcggtttgttgtcatatagt

SEQ ID NO: 187280 - DNA, 23 bp, Artificial sequence
  SiRNA target sequence
gttcggtttgttgtcatatagtc

SEQ ID NO: 187281 - DNA, 23 bp, Artificial sequence
  SiRNA target sequence
ttcggtttgttgtcatatagtct

SEQ ID NO: 187282 - DNA, 23 bp, Artificial sequence
  SiRNA target sequence
tcggtttgttgtcatatagtctt

SEQ ID NO: 187283 - DNA, 23 bp, Artificial sequence
  SiRNA target sequence
cggtttgttgtcatatagtctta

SEQ ID NO: 187284 - DNA, 23 bp, Artificial sequence
  SiRNA target sequence
ggtttgttgtcatatagtcttaa

SEQ ID NO: 187285 - DNA, 23 bp, Artificial sequence
  SiRNA target sequence
gtttgttgtcatatagtcttaaa

SEQ ID NO: 187286 - DNA, 23 bp, Artificial sequence
  SiRNA target sequence
tttgttgtcatatagtcttaaac

SEQ ID NO: 187287 - DNA, 23 bp, Artificial sequence
  SiRNA target sequence
ttgttgtcatatagtcttaaacc

SEQ ID NO: 187288 - DNA, 23 bp, Artificial sequence
  SiRNA target sequence
tgttgtcatatagtcttaaaccg

SEQ ID NO: 187289 - DNA, 23 bp, Artificial sequence
  SiRNA target sequence
gttgtcatatagtcttaaaccgc

SEQ ID NO: 187290 - DNA, 23 bp, Artificial sequence
  SiRNA target sequence
ttgtcatatagtcttaaaccgca

SEQ ID NO: 187291 - DNA, 23 bp, Artificial sequence
  SiRNA target sequence
tgtcatatagtcttaaaccgcaa

SEQ ID NO: 187292 - DNA, 23 bp, Artificial sequence
  SiRNA target sequence
gtcatatagtcttaaaccgcaaa

SEQ ID NO: 187293 - DNA, 23 bp, Artificial sequence
  SiRNA target sequence
tcatatagtcttaaaccgcaaaa

SEQ ID NO: 187294 - DNA, 23 bp, Artificial sequence
  SiRNA target sequence
catatagtcttaaaccgcaaaaa

SEQ ID NO: 187295 - DNA, 23 bp, Artificial sequence
  SiRNA target sequence
atatagtcttaaaccgcaaaaaa

SEQ ID NO: 187296 - DNA, 23 bp, Artificial sequence
  SiRNA target sequence
tatagtcttaaaccgcaaaaaat

SEQ ID NO: 187297 - DNA, 23 bp, Artificial sequence
  SiRNA target sequence
atagtcttaaaccgcaaaaaatc

SEQ ID NO: 187298 - DNA, 23 bp, Artificial sequence
  SiRNA target sequence
tagtcttaaaccgcaaaaaatca

SEQ ID NO: 187299 - DNA, 23 bp, Artificial sequence
  SiRNA target sequence
agtcttaaaccgcaaaaaatcat

SEQ ID NO: 187300 - DNA, 23 bp, Artificial sequence
  SiRNA target sequence
gtcttaaaccgcaaaaaatcata

SEQ ID NO: 187301 - DNA, 23 bp, Artificial sequence
  SiRNA target sequence
tcttaaaccgcaaaaaatcatac

SEQ ID NO: 187302 - DNA, 23 bp, Artificial sequence
  SiRNA target sequence
cttaaaccgcaaaaaatcatacc

SEQ ID NO: 187303 - DNA, 23 bp, Artificial sequence
  SiRNA target sequence
ttaaaccgcaaaaaatcataccg

SEQ ID NO: 187304 - DNA, 23 bp, Artificial sequence
  SiRNA target sequence
taaaccgcaaaaaatcataccga

SEQ ID NO: 187305 - DNA, 23 bp, Artificial sequence
  SiRNA target sequence
aaaccgcaaaaaatcataccgaa

SEQ ID NO: 187306 - DNA, 23 bp, Artificial sequence
  SiRNA target sequence
aaccgcaaaaaatcataccgaaa

SEQ ID NO: 187307 - DNA, 23 bp, Artificial sequence
  SiRNA target sequence
accgcaaaaaatcataccgaaat

SEQ ID NO: 187308 - DNA, 23 bp, Artificial sequence
  SiRNA target sequence
ccgcaaaaaatcataccgaaata

SEQ ID NO: 187309 - DNA, 23 bp, Artificial sequence
  SiRNA target sequence
cgcaaaaaatcataccgaaatac

SEQ ID NO: 187310 - DNA, 23 bp, Artificial sequence
  SiRNA target sequence
gcaaaaaatcataccgaaataca

SEQ ID NO: 187311 - DNA, 23 bp, Artificial sequence
  SiRNA target sequence
caaaaaatcataccgaaatacaa

SEQ ID NO: 187312 - DNA, 23 bp, Artificial sequence
  SiRNA target sequence
aaaaaatcataccgaaatacaaa

SEQ ID NO: 187313 - DNA, 23 bp, Artificial sequence
  SiRNA target sequence
aaaaatcataccgaaatacaaag

SEQ ID NO: 187314 - DNA, 23 bp, Artificial sequence
  SiRNA target sequence
aaaatcataccgaaatacaaagg

SEQ ID NO: 187315 - DNA, 23 bp, Artificial sequence
  SiRNA target sequence
aaatcataccgaaatacaaagga

SEQ ID NO: 187316 - DNA, 23 bp, Artificial sequence
  SiRNA target sequence
aatcataccgaaatacaaaggaa

SEQ ID NO: 187317 - DNA, 23 bp, Artificial sequence
  SiRNA target sequence
atcataccgaaatacaaaggaac

SEQ ID NO: 187318 - DNA, 23 bp, Artificial sequence
  SiRNA target sequence
tcataccgaaatacaaaggaaca

SEQ ID NO: 187319 - DNA, 23 bp, Artificial sequence
  SiRNA target sequence
cataccgaaatacaaaggaacag

SEQ ID NO: 187320 - DNA, 23 bp, Artificial sequence
  SiRNA target sequence
ataccgaaatacaaaggaacagt

SEQ ID NO: 187321 - DNA, 23 bp, Artificial sequence
  SiRNA target sequence
taccgaaatacaaaggaacagtt

SEQ ID NO: 187322 - DNA, 23 bp, Artificial sequence
  SiRNA target sequence
accgaaatacaaaggaacagtta

SEQ ID NO: 187323 - DNA, 23 bp, Artificial sequence
  SiRNA target sequence
ccgaaatacaaaggaacagttag

SEQ ID NO: 187324 - DNA, 23 bp, Artificial sequence
  SiRNA target sequence
cgaaatacaaaggaacagttaga

SEQ ID NO: 187325 - DNA, 23 bp, Artificial sequence
  SiRNA target sequence
gaaatacaaaggaacagttagag

SEQ ID NO: 187326 - DNA, 23 bp, Artificial sequence
  SiRNA target sequence
aaatacaaaggaacagttagaga

SEQ ID NO: 187327 - DNA, 23 bp, Artificial sequence
  SiRNA target sequence
aatacaaaggaacagttagagat

SEQ ID NO: 187328 - DNA, 23 bp, Artificial sequence
  SiRNA target sequence
atacaaaggaacagttagagatc

SEQ ID NO: 187329 - DNA, 23 bp, Artificial sequence
  SiRNA target sequence
tacaaaggaacagttagagatct

SEQ ID NO: 187330 - DNA, 23 bp, Artificial sequence
  SiRNA target sequence
acaaaggaacagttagagatctt

SEQ ID NO: 187331 - DNA, 23 bp, Artificial sequence
  SiRNA target sequence
caaaggaacagttagagatcttt

SEQ ID NO: 187332 - DNA, 23 bp, Artificial sequence
  SiRNA target sequence
aaaggaacagttagagatctttt

SEQ ID NO: 187333 - DNA, 23 bp, Artificial sequence
  SiRNA target sequence
aaggaacagttagagatcttttt

SEQ ID NO: 187334 - DNA, 23 bp, Artificial sequence
  SiRNA target sequence
aggaacagttagagatcttttta

SEQ ID NO: 187335 - DNA, 23 bp, Artificial sequence
  SiRNA target sequence
ggaacagttagagatctttttat

SEQ ID NO: 187336 - DNA, 23 bp, Artificial sequence
  SiRNA target sequence
gaacagttagagatctttttatg

SEQ ID NO: 187337 - DNA, 23 bp, Artificial sequence
  SiRNA target sequence
aacagttagagatctttttatgt

SEQ ID NO: 187338 - DNA, 23 bp, Artificial sequence
  SiRNA target sequence
acagttagagatctttttatgtc

SEQ ID NO: 187339 - DNA, 23 bp, Artificial sequence
  SiRNA target sequence
cagttagagatctttttatgtca

SEQ ID NO: 187340 - DNA, 23 bp, Artificial sequence
  SiRNA target sequence
agttagagatctttttatgtcaa

SEQ ID NO: 187341 - DNA, 23 bp, Artificial sequence
  SiRNA target sequence
gttagagatctttttatgtcaaa

SEQ ID NO: 187342 - DNA, 23 bp, Artificial sequence
  SiRNA target sequence
ttagagatctttttatgtcaaaa

SEQ ID NO: 187343 - DNA, 23 bp, Artificial sequence
  SiRNA target sequence
tagagatctttttatgtcaaaaa

SEQ ID NO: 187344 - DNA, 23 bp, Artificial sequence
  SiRNA target sequence
agagatctttttatgtcaaaaat

SEQ ID NO: 187345 - DNA, 23 bp, Artificial sequence
  SiRNA target sequence
gagatctttttatgtcaaaaatt

SEQ ID NO: 187346 - DNA, 23 bp, Artificial sequence
  SiRNA target sequence
agatctttttatgtcaaaaattc

SEQ ID NO: 187347 - DNA, 23 bp, Artificial sequence
  SiRNA target sequence
gatctttttatgtcaaaaattcg

SEQ ID NO: 187348 - DNA, 23 bp, Artificial sequence
  SiRNA target sequence
atctttttatgtcaaaaattcgt

SEQ ID NO: 187349 - DNA, 23 bp, Artificial sequence
  SiRNA target sequence
tctttttatgtcaaaaattcgtt

SEQ ID NO: 187350 - DNA, 23 bp, Artificial sequence
  SiRNA target sequence
ctttttatgtcaaaaattcgttc

SEQ ID NO: 187351 - DNA, 23 bp, Artificial sequence
  SiRNA target sequence
tttttatgtcaaaaattcgttct

SEQ ID NO: 187352 - DNA, 23 bp, Artificial sequence
  SiRNA target sequence
ttttatgtcaaaaattcgttctt

SEQ ID NO: 187353 - DNA, 23 bp, Artificial sequence
  SiRNA target sequence
tttatgtcaaaaattcgttcttc

SEQ ID NO: 187354 - DNA, 23 bp, Artificial sequence
  SiRNA target sequence
ttatgtcaaaaattcgttcttcc

SEQ ID NO: 187355 - DNA, 23 bp, Artificial sequence
  SiRNA target sequence
tatgtcaaaaattcgttcttcct

SEQ ID NO: 187356 - DNA, 23 bp, Artificial sequence
  SiRNA target sequence
atgtcaaaaattcgttcttcctt

SEQ ID NO: 187357 - DNA, 23 bp, Artificial sequence
  SiRNA target sequence
tgtcaaaaattcgttcttccttt

SEQ ID NO: 187358 - DNA, 23 bp, Artificial sequence
  SiRNA target sequence
gtcaaaaattcgttcttcctttt

SEQ ID NO: 187359 - DNA, 23 bp, Artificial sequence
  SiRNA target sequence
tcaaaaattcgttcttccttttt

SEQ ID NO: 187360 - DNA, 23 bp, Artificial sequence
  SiRNA target sequence
caaaaattcgttcttccttttta

SEQ ID NO: 187361 - DNA, 23 bp, Artificial sequence
  SiRNA target sequence
aaaaattcgttcttcctttttag

SEQ ID NO: 187362 - DNA, 23 bp, Artificial sequence
  SiRNA target sequence
aaaattcgttcttcctttttaga

SEQ ID NO: 187363 - DNA, 23 bp, Artificial sequence
  SiRNA target sequence
aaattcgttcttcctttttagac

SEQ ID NO: 187364 - DNA, 23 bp, Artificial sequence
  SiRNA target sequence
aattcgttcttcctttttagacg

SEQ ID NO: 187365 - DNA, 23 bp, Artificial sequence
  SiRNA target sequence
attcgttcttcctttttagacgc

SEQ ID NO: 187366 - DNA, 23 bp, Artificial sequence
  SiRNA target sequence
ttcgttcttcctttttagacgct

SEQ ID NO: 187367 - DNA, 23 bp, Artificial sequence
  SiRNA target sequence
tcgttcttcctttttagacgcta

SEQ ID NO: 187368 - DNA, 23 bp, Artificial sequence
  SiRNA target sequence
cgttcttcctttttagacgctaa

SEQ ID NO: 187369 - DNA, 23 bp, Artificial sequence
  SiRNA target sequence
gttcttcctttttagacgctaat

SEQ ID NO: 187370 - DNA, 23 bp, Artificial sequence
  SiRNA target sequence
ttcttcctttttagacgctaatt

SEQ ID NO: 187371 - DNA, 23 bp, Artificial sequence
  SiRNA target sequence
tcttcctttttagacgctaattt

SEQ ID NO: 187372 - DNA, 23 bp, Artificial sequence
  SiRNA target sequence
cttcctttttagacgctaatttt

SEQ ID NO: 187373 - DNA, 23 bp, Artificial sequence
  SiRNA target sequence
ttcctttttagacgctaattttg

SEQ ID NO: 187374 - DNA, 23 bp, Artificial sequence
  SiRNA target sequence
tcctttttagacgctaattttgt

SEQ ID NO: 187375 - DNA, 23 bp, Artificial sequence
  SiRNA target sequence
cctttttagacgctaattttgtt

SEQ ID NO: 187376 - DNA, 23 bp, Artificial sequence
  SiRNA target sequence
ctttttagacgctaattttgtta

SEQ ID NO: 187377 - DNA, 23 bp, Artificial sequence
  SiRNA target sequence
tttttagacgctaattttgttaa

SEQ ID NO: 187378 - DNA, 23 bp, Artificial sequence
  SiRNA target sequence
ttttagacgctaattttgttaat

SEQ ID NO: 187379 - DNA, 23 bp, Artificial sequence
  SiRNA target sequence
tttagacgctaattttgttaatg

SEQ ID NO: 187380 - DNA, 23 bp, Artificial sequence
  SiRNA target sequence
ttagacgctaattttgttaatga

SEQ ID NO: 187381 - DNA, 23 bp, Artificial sequence
  SiRNA target sequence
tagacgctaattttgttaatgaa

SEQ ID NO: 187382 - DNA, 23 bp, Artificial sequence
  SiRNA target sequence
agacgctaattttgttaatgaag

SEQ ID NO: 187383 - DNA, 23 bp, Artificial sequence
  SiRNA target sequence
gacgctaattttgttaatgaagc

SEQ ID NO: 187384 - DNA, 23 bp, Artificial sequence
  SiRNA target sequence
acgctaattttgttaatgaagct

SEQ ID NO: 187385 - DNA, 23 bp, Artificial sequence
  SiRNA target sequence
cgctaattttgttaatgaagcta

SEQ ID NO: 187386 - DNA, 23 bp, Artificial sequence
  SiRNA target sequence
gctaattttgttaatgaagctat

SEQ ID NO: 187387 - DNA, 23 bp, Artificial sequence
  SiRNA target sequence
ctaattttgttaatgaagctatt

SEQ ID NO: 187388 - DNA, 23 bp, Artificial sequence
  SiRNA target sequence
taattttgttaatgaagctatta

SEQ ID NO: 187389 - DNA, 23 bp, Artificial sequence
  SiRNA target sequence
aattttgttaatgaagctattaa

SEQ ID NO: 187390 - DNA, 23 bp, Artificial sequence
  SiRNA target sequence
attttgttaatgaagctattaaa

SEQ ID NO: 187391 - DNA, 23 bp, Artificial sequence
  SiRNA target sequence
ttttgttaatgaagctattaaac

SEQ ID NO: 187392 - DNA, 23 bp, Artificial sequence
  SiRNA target sequence
tttgttaatgaagctattaaacc

SEQ ID NO: 187393 - DNA, 23 bp, Artificial sequence
  SiRNA target sequence
ttgttaatgaagctattaaacct

SEQ ID NO: 187394 - DNA, 23 bp, Artificial sequence
  SiRNA target sequence
tgttaatgaagctattaaacctt

SEQ ID NO: 187395 - DNA, 23 bp, Artificial sequence
  SiRNA target sequence
gttaatgaagctattaaaccttt

SEQ ID NO: 187396 - DNA, 23 bp, Artificial sequence
  SiRNA target sequence
ttaatgaagctattaaaccttta

SEQ ID NO: 187397 - DNA, 23 bp, Artificial sequence
  SiRNA target sequence
taatgaagctattaaacctttag

SEQ ID NO: 187398 - DNA, 23 bp, Artificial sequence
  SiRNA target sequence
aatgaagctattaaacctttaga

SEQ ID NO: 187399 - DNA, 23 bp, Artificial sequence
  SiRNA target sequence
atgaagctattaaacctttagat

SEQ ID NO: 187400 - DNA, 23 bp, Artificial sequence
  SiRNA target sequence
tgaagctattaaacctttagata

SEQ ID NO: 187401 - DNA, 23 bp, Artificial sequence
  SiRNA target sequence
gaagctattaaacctttagatat

SEQ ID NO: 187402 - DNA, 23 bp, Artificial sequence
  SiRNA target sequence
aagctattaaacctttagatatt

SEQ ID NO: 187403 - DNA, 23 bp, Artificial sequence
  SiRNA target sequence
agctattaaacctttagatattc

SEQ ID NO: 187404 - DNA, 23 bp, Artificial sequence
  SiRNA target sequence
gctattaaacctttagatattca

SEQ ID NO: 187405 - DNA, 23 bp, Artificial sequence
  SiRNA target sequence
ctattaaacctttagatattcat

SEQ ID NO: 187406 - DNA, 23 bp, Artificial sequence
  SiRNA target sequence
tattaaacctttagatattcatc

SEQ ID NO: 187407 - DNA, 23 bp, Artificial sequence
  SiRNA target sequence
attaaacctttagatattcatca

SEQ ID NO: 187408 - DNA, 23 bp, Artificial sequence
  SiRNA target sequence
ttaaacctttagatattcatcat

SEQ ID NO: 187409 - DNA, 23 bp, Artificial sequence
  SiRNA target sequence
taaacctttagatattcatcatt

SEQ ID NO: 187410 - DNA, 23 bp, Artificial sequence
  SiRNA target sequence
aaacctttagatattcatcattt

SEQ ID NO: 187411 - DNA, 23 bp, Artificial sequence
  SiRNA target sequence
aacctttagatattcatcattta

SEQ ID NO: 187412 - DNA, 23 bp, Artificial sequence
  SiRNA target sequence
acctttagatattcatcatttat

SEQ ID NO: 187413 - DNA, 23 bp, Artificial sequence
  SiRNA target sequence
cctttagatattcatcatttata

SEQ ID NO: 187414 - DNA, 23 bp, Artificial sequence
  SiRNA target sequence
ctttagatattcatcatttatac

SEQ ID NO: 187415 - DNA, 23 bp, Artificial sequence
  SiRNA target sequence
tttagatattcatcatttatacg

SEQ ID NO: 187416 - DNA, 23 bp, Artificial sequence
  SiRNA target sequence
ttagatattcatcatttatacga

SEQ ID NO: 187417 - DNA, 23 bp, Artificial sequence
  SiRNA target sequence
tagatattcatcatttatacgac

SEQ ID NO: 187418 - DNA, 23 bp, Artificial sequence
  SiRNA target sequence
agatattcatcatttatacgacc

SEQ ID NO: 187419 - DNA, 23 bp, Artificial sequence
  SiRNA target sequence
gatattcatcatttatacgacca

SEQ ID NO: 187420 - DNA, 23 bp, Artificial sequence
  SiRNA target sequence
atattcatcatttatacgaccaa

SEQ ID NO: 187421 - DNA, 23 bp, Artificial sequence
  SiRNA target sequence
tattcatcatttatacgaccaac

SEQ ID NO: 187422 - DNA, 23 bp, Artificial sequence
  SiRNA target sequence
attcatcatttatacgaccaact

SEQ ID NO: 187423 - DNA, 23 bp, Artificial sequence
  SiRNA target sequence
ttcatcatttatacgaccaactt

SEQ ID NO: 187424 - DNA, 23 bp, Artificial sequence
  SiRNA target sequence
tcatcatttatacgaccaacttg

SEQ ID NO: 187425 - DNA, 23 bp, Artificial sequence
  SiRNA target sequence
catcatttatacgaccaacttgt

SEQ ID NO: 187426 - DNA, 23 bp, Artificial sequence
  SiRNA target sequence
atcatttatacgaccaacttgta

SEQ ID NO: 187427 - DNA, 23 bp, Artificial sequence
  SiRNA target sequence
tcatttatacgaccaacttgtag

SEQ ID NO: 187428 - DNA, 23 bp, Artificial sequence
  SiRNA target sequence
catttatacgaccaacttgtaga

SEQ ID NO: 187429 - DNA, 23 bp, Artificial sequence
  SiRNA target sequence
atttatacgaccaacttgtagaa

SEQ ID NO: 187430 - DNA, 23 bp, Artificial sequence
  SiRNA target sequence
tttatacgaccaacttgtagaaa

SEQ ID NO: 187431 - DNA, 23 bp, Artificial sequence
  SiRNA target sequence
ttatacgaccaacttgtagaaaa

SEQ ID NO: 187432 - DNA, 23 bp, Artificial sequence
  SiRNA target sequence
tatacgaccaacttgtagaaaac

SEQ ID NO: 187433 - DNA, 23 bp, Artificial sequence
  SiRNA target sequence
atacgaccaacttgtagaaaact

SEQ ID NO: 187434 - DNA, 23 bp, Artificial sequence
  SiRNA target sequence
tacgaccaacttgtagaaaactt

SEQ ID NO: 187435 - DNA, 23 bp, Artificial sequence
  SiRNA target sequence
acgaccaacttgtagaaaacttg

SEQ ID NO: 187436 - DNA, 23 bp, Artificial sequence
  SiRNA target sequence
cgaccaacttgtagaaaacttga

SEQ ID NO: 187437 - DNA, 23 bp, Artificial sequence
  SiRNA target sequence
gaccaacttgtagaaaacttgag

SEQ ID NO: 187438 - DNA, 23 bp, Artificial sequence
  SiRNA target sequence
accaacttgtagaaaacttgagt

SEQ ID NO: 187439 - DNA, 23 bp, Artificial sequence
  SiRNA target sequence
ccaacttgtagaaaacttgagtg

SEQ ID NO: 187440 - DNA, 23 bp, Artificial sequence
  SiRNA target sequence
caacttgtagaaaacttgagtgg

SEQ ID NO: 187441 - DNA, 23 bp, Artificial sequence
  SiRNA target sequence
aacttgtagaaaacttgagtggt

SEQ ID NO: 187442 - DNA, 23 bp, Artificial sequence
  SiRNA target sequence
acttgtagaaaacttgagtggtg

SEQ ID NO: 187443 - DNA, 23 bp, Artificial sequence
  SiRNA target sequence
cttgtagaaaacttgagtggtgg

SEQ ID NO: 187444 - DNA, 23 bp, Artificial sequence
  SiRNA target sequence
ttgtagaaaacttgagtggtgga

SEQ ID NO: 187445 - DNA, 23 bp, Artificial sequence
  SiRNA target sequence
tgtagaaaacttgagtggtggag

SEQ ID NO: 187446 - DNA, 23 bp, Artificial sequence
  SiRNA target sequence
gtagaaaacttgagtggtggaga

SEQ ID NO: 187447 - DNA, 23 bp, Artificial sequence
  SiRNA target sequence
tagaaaacttgagtggtggagaa

SEQ ID NO: 187448 - DNA, 23 bp, Artificial sequence
  SiRNA target sequence
agaaaacttgagtggtggagaat

SEQ ID NO: 187449 - DNA, 23 bp, Artificial sequence
  SiRNA target sequence
gaaaacttgagtggtggagaatt

SEQ ID NO: 187450 - DNA, 23 bp, Artificial sequence
  SiRNA target sequence
aaaacttgagtggtggagaatta

SEQ ID NO: 187451 - DNA, 23 bp, Artificial sequence
  SiRNA target sequence
aaacttgagtggtggagaattac

SEQ ID NO: 187452 - DNA, 23 bp, Artificial sequence
  SiRNA target sequence
aacttgagtggtggagaattaca

SEQ ID NO: 187453 - DNA, 23 bp, Artificial sequence
  SiRNA target sequence
acttgagtggtggagaattacaa

SEQ ID NO: 187454 - DNA, 23 bp, Artificial sequence
  SiRNA target sequence
cttgagtggtggagaattacaaa

SEQ ID NO: 187455 - DNA, 23 bp, Artificial sequence
  SiRNA target sequence
ttgagtggtggagaattacaaag

SEQ ID NO: 187456 - DNA, 23 bp, Artificial sequence
  SiRNA target sequence
tgagtggtggagaattacaaaga

SEQ ID NO: 187457 - DNA, 23 bp, Artificial sequence
  SiRNA target sequence
gagtggtggagaattacaaagaa

SEQ ID NO: 187458 - DNA, 23 bp, Artificial sequence
  SiRNA target sequence
agtggtggagaattacaaagaat

SEQ ID NO: 187459 - DNA, 23 bp, Artificial sequence
  SiRNA target sequence
gtggtggagaattacaaagaatt

SEQ ID NO: 187460 - DNA, 23 bp, Artificial sequence
  SiRNA target sequence
tggtggagaattacaaagaattg

SEQ ID NO: 187461 - DNA, 23 bp, Artificial sequence
  SiRNA target sequence
ggtggagaattacaaagaattgc

SEQ ID NO: 187462 - DNA, 23 bp, Artificial sequence
  SiRNA target sequence
gtggagaattacaaagaattgca

SEQ ID NO: 187463 - DNA, 23 bp, Artificial sequence
  SiRNA target sequence
tggagaattacaaagaattgcaa

SEQ ID NO: 187464 - DNA, 23 bp, Artificial sequence
  SiRNA target sequence
ggagaattacaaagaattgcaat

SEQ ID NO: 187465 - DNA, 23 bp, Artificial sequence
  SiRNA target sequence
gagaattacaaagaattgcaata

SEQ ID NO: 187466 - DNA, 23 bp, Artificial sequence
  SiRNA target sequence
agaattacaaagaattgcaataa

SEQ ID NO: 187467 - DNA, 23 bp, Artificial sequence
  SiRNA target sequence
gaattacaaagaattgcaataat

SEQ ID NO: 187468 - DNA, 23 bp, Artificial sequence
  SiRNA target sequence
aattacaaagaattgcaataata

SEQ ID NO: 187469 - DNA, 23 bp, Artificial sequence
  SiRNA target sequence
attacaaagaattgcaataataa

SEQ ID NO: 187470 - DNA, 23 bp, Artificial sequence
  SiRNA target sequence
ttacaaagaattgcaataataat

SEQ ID NO: 187471 - DNA, 23 bp, Artificial sequence
  SiRNA target sequence
tacaaagaattgcaataataata

SEQ ID NO: 187472 - DNA, 23 bp, Artificial sequence
  SiRNA target sequence
acaaagaattgcaataataatat

SEQ ID NO: 187473 - DNA, 23 bp, Artificial sequence
  SiRNA target sequence
caaagaattgcaataataatatg

SEQ ID NO: 187474 - DNA, 23 bp, Artificial sequence
  SiRNA target sequence
aaagaattgcaataataatatgt

SEQ ID NO: 187475 - DNA, 23 bp, Artificial sequence
  SiRNA target sequence
aagaattgcaataataatatgtt

SEQ ID NO: 187476 - DNA, 23 bp, Artificial sequence
  SiRNA target sequence
agaattgcaataataatatgttt

SEQ ID NO: 187477 - DNA, 23 bp, Artificial sequence
  SiRNA target sequence
gaattgcaataataatatgttta

SEQ ID NO: 187478 - DNA, 23 bp, Artificial sequence
  SiRNA target sequence
aattgcaataataatatgtttag

SEQ ID NO: 187479 - DNA, 23 bp, Artificial sequence
  SiRNA target sequence
attgcaataataatatgtttagg

SEQ ID NO: 187480 - DNA, 23 bp, Artificial sequence
  SiRNA target sequence
ttgcaataataatatgtttagga

SEQ ID NO: 187481 - DNA, 23 bp, Artificial sequence
  SiRNA target sequence
tgcaataataatatgtttaggaa

SEQ ID NO: 187482 - DNA, 23 bp, Artificial sequence
  SiRNA target sequence
gcaataataatatgtttaggaaa

SEQ ID NO: 187483 - DNA, 23 bp, Artificial sequence
  SiRNA target sequence
caataataatatgtttaggaaaa

SEQ ID NO: 187484 - DNA, 23 bp, Artificial sequence
  SiRNA target sequence
aataataatatgtttaggaaaag

SEQ ID NO: 187485 - DNA, 23 bp, Artificial sequence
  SiRNA target sequence
ataataatatgtttaggaaaaga

SEQ ID NO: 187486 - DNA, 23 bp, Artificial sequence
  SiRNA target sequence
taataatatgtttaggaaaagat

SEQ ID NO: 187487 - DNA, 23 bp, Artificial sequence
  SiRNA target sequence
aataatatgtttaggaaaagatg

SEQ ID NO: 187488 - DNA, 23 bp, Artificial sequence
  SiRNA target sequence
ataatatgtttaggaaaagatgc

SEQ ID NO: 187489 - DNA, 23 bp, Artificial sequence
  SiRNA target sequence
taatatgtttaggaaaagatgct

SEQ ID NO: 187490 - DNA, 23 bp, Artificial sequence
  SiRNA target sequence
aatatgtttaggaaaagatgcta

SEQ ID NO: 187491 - DNA, 23 bp, Artificial sequence
  SiRNA target sequence
atatgtttaggaaaagatgctaa

SEQ ID NO: 187492 - DNA, 23 bp, Artificial sequence
  SiRNA target sequence
tatgtttaggaaaagatgctaac

SEQ ID NO: 187493 - DNA, 23 bp, Artificial sequence
  SiRNA target sequence
atgtttaggaaaagatgctaacc

SEQ ID NO: 187494 - DNA, 23 bp, Artificial sequence
  SiRNA target sequence
tgtttaggaaaagatgctaacct

SEQ ID NO: 187495 - DNA, 23 bp, Artificial sequence
  SiRNA target sequence
gtttaggaaaagatgctaacctt

SEQ ID NO: 187496 - DNA, 23 bp, Artificial sequence
  SiRNA target sequence
tttaggaaaagatgctaaccttt

SEQ ID NO: 187497 - DNA, 23 bp, Artificial sequence
  SiRNA target sequence
ttaggaaaagatgctaaccttta

SEQ ID NO: 187498 - DNA, 23 bp, Artificial sequence
  SiRNA target sequence
taggaaaagatgctaacctttat

SEQ ID NO: 187499 - DNA, 23 bp, Artificial sequence
  SiRNA target sequence
aggaaaagatgctaacctttatt

SEQ ID NO: 187500 - DNA, 23 bp, Artificial sequence
  SiRNA target sequence
ggaaaagatgctaacctttattt

SEQ ID NO: 187501 - DNA, 23 bp, Artificial sequence
  SiRNA target sequence
gaaaagatgctaacctttattta

SEQ ID NO: 187502 - DNA, 23 bp, Artificial sequence
  SiRNA target sequence
aaaagatgctaacctttatttat

SEQ ID NO: 187503 - DNA, 23 bp, Artificial sequence
  SiRNA target sequence
aaagatgctaacctttatttatt

SEQ ID NO: 187504 - DNA, 23 bp, Artificial sequence
  SiRNA target sequence
aagatgctaacctttatttatta

SEQ ID NO: 187505 - DNA, 23 bp, Artificial sequence
  SiRNA target sequence
agatgctaacctttatttattag

SEQ ID NO: 187506 - DNA, 23 bp, Artificial sequence
  SiRNA target sequence
gatgctaacctttatttattaga

SEQ ID NO: 187507 - DNA, 23 bp, Artificial sequence
  SiRNA target sequence
atgctaacctttatttattagat

SEQ ID NO: 187508 - DNA, 23 bp, Artificial sequence
  SiRNA target sequence
tgctaacctttatttattagatg

SEQ ID NO: 187509 - DNA, 23 bp, Artificial sequence
  SiRNA target sequence
gctaacctttatttattagatga

SEQ ID NO: 187510 - DNA, 23 bp, Artificial sequence
  SiRNA target sequence
ctaacctttatttattagatgaa

SEQ ID NO: 187511 - DNA, 23 bp, Artificial sequence
  SiRNA target sequence
taacctttatttattagatgaac

SEQ ID NO: 187512 - DNA, 23 bp, Artificial sequence
  SiRNA target sequence
aacctttatttattagatgaacc

SEQ ID NO: 187513 - DNA, 23 bp, Artificial sequence
  SiRNA target sequence
acctttatttattagatgaacct

SEQ ID NO: 187514 - DNA, 23 bp, Artificial sequence
  SiRNA target sequence
cctttatttattagatgaacctt

SEQ ID NO: 187515 - DNA, 23 bp, Artificial sequence
  SiRNA target sequence
ctttatttattagatgaaccttc

SEQ ID NO: 187516 - DNA, 23 bp, Artificial sequence
  SiRNA target sequence
tttatttattagatgaaccttct

SEQ ID NO: 187517 - DNA, 23 bp, Artificial sequence
  SiRNA target sequence
ttatttattagatgaaccttctg

SEQ ID NO: 187518 - DNA, 23 bp, Artificial sequence
  SiRNA target sequence
tatttattagatgaaccttctgc

SEQ ID NO: 187519 - DNA, 23 bp, Artificial sequence
  SiRNA target sequence
atttattagatgaaccttctgcg

SEQ ID NO: 187520 - DNA, 23 bp, Artificial sequence
  SiRNA target sequence
tttattagatgaaccttctgcgt

SEQ ID NO: 187521 - DNA, 23 bp, Artificial sequence
  SiRNA target sequence
ttattagatgaaccttctgcgta

SEQ ID NO: 187522 - DNA, 23 bp, Artificial sequence
  SiRNA target sequence
tattagatgaaccttctgcgtat

SEQ ID NO: 187523 - DNA, 23 bp, Artificial sequence
  SiRNA target sequence
attagatgaaccttctgcgtatc

SEQ ID NO: 187524 - DNA, 23 bp, Artificial sequence
  SiRNA target sequence
ttagatgaaccttctgcgtatct

SEQ ID NO: 187525 - DNA, 23 bp, Artificial sequence
  SiRNA target sequence
tagatgaaccttctgcgtatcta

SEQ ID NO: 187526 - DNA, 23 bp, Artificial sequence
  SiRNA target sequence
agatgaaccttctgcgtatctag

SEQ ID NO: 187527 - DNA, 23 bp, Artificial sequence
  SiRNA target sequence
gatgaaccttctgcgtatctaga

SEQ ID NO: 187528 - DNA, 23 bp, Artificial sequence
  SiRNA target sequence
atgaaccttctgcgtatctagat

SEQ ID NO: 187529 - DNA, 23 bp, Artificial sequence
  SiRNA target sequence
tgaaccttctgcgtatctagatt

SEQ ID NO: 187530 - DNA, 23 bp, Artificial sequence
  SiRNA target sequence
gaaccttctgcgtatctagattc

SEQ ID NO: 187531 - DNA, 23 bp, Artificial sequence
  SiRNA target sequence
aaccttctgcgtatctagattca

SEQ ID NO: 187532 - DNA, 23 bp, Artificial sequence
  SiRNA target sequence
accttctgcgtatctagattcag

SEQ ID NO: 187533 - DNA, 23 bp, Artificial sequence
  SiRNA target sequence
ccttctgcgtatctagattcaga

SEQ ID NO: 187534 - DNA, 23 bp, Artificial sequence
  SiRNA target sequence
cttctgcgtatctagattcagat

SEQ ID NO: 187535 - DNA, 23 bp, Artificial sequence
  SiRNA target sequence
ttctgcgtatctagattcagatc

SEQ ID NO: 187536 - DNA, 23 bp, Artificial sequence
  SiRNA target sequence
tctgcgtatctagattcagatca

SEQ ID NO: 187537 - DNA, 23 bp, Artificial sequence
  SiRNA target sequence
ctgcgtatctagattcagatcag

SEQ ID NO: 187538 - DNA, 23 bp, Artificial sequence
  SiRNA target sequence
tgcgtatctagattcagatcaga

SEQ ID NO: 187539 - DNA, 23 bp, Artificial sequence
  SiRNA target sequence
gcgtatctagattcagatcagag

SEQ ID NO: 187540 - DNA, 23 bp, Artificial sequence
  SiRNA target sequence
cgtatctagattcagatcagaga

SEQ ID NO: 187541 - DNA, 23 bp, Artificial sequence
  SiRNA target sequence
gtatctagattcagatcagagaa

SEQ ID NO: 187542 - DNA, 23 bp, Artificial sequence
  SiRNA target sequence
tatctagattcagatcagagaat

SEQ ID NO: 187543 - DNA, 23 bp, Artificial sequence
  SiRNA target sequence
atctagattcagatcagagaata

SEQ ID NO: 187544 - DNA, 23 bp, Artificial sequence
  SiRNA target sequence
tctagattcagatcagagaatag

SEQ ID NO: 187545 - DNA, 23 bp, Artificial sequence
  SiRNA target sequence
ctagattcagatcagagaatagc

SEQ ID NO: 187546 - DNA, 23 bp, Artificial sequence
  SiRNA target sequence
tagattcagatcagagaatagcg

SEQ ID NO: 187547 - DNA, 23 bp, Artificial sequence
  SiRNA target sequence
agattcagatcagagaatagcga

SEQ ID NO: 187548 - DNA, 23 bp, Artificial sequence
  SiRNA target sequence
gattcagatcagagaatagcgat

SEQ ID NO: 187549 - DNA, 23 bp, Artificial sequence
  SiRNA target sequence
attcagatcagagaatagcgatt

SEQ ID NO: 187550 - DNA, 23 bp, Artificial sequence
  SiRNA target sequence
ttcagatcagagaatagcgattt

SEQ ID NO: 187551 - DNA, 23 bp, Artificial sequence
  SiRNA target sequence
tcagatcagagaatagcgatttc

SEQ ID NO: 187552 - DNA, 23 bp, Artificial sequence
  SiRNA target sequence
cagatcagagaatagcgatttca

SEQ ID NO: 187553 - DNA, 23 bp, Artificial sequence
  SiRNA target sequence
agatcagagaatagcgatttcaa

SEQ ID NO: 187554 - DNA, 23 bp, Artificial sequence
  SiRNA target sequence
gatcagagaatagcgatttcaaa

SEQ ID NO: 187555 - DNA, 23 bp, Artificial sequence
  SiRNA target sequence
atcagagaatagcgatttcaaaa

SEQ ID NO: 187556 - DNA, 23 bp, Artificial sequence
  SiRNA target sequence
tcagagaatagcgatttcaaaag

SEQ ID NO: 187557 - DNA, 23 bp, Artificial sequence
  SiRNA target sequence
cagagaatagcgatttcaaaagt

SEQ ID NO: 187558 - DNA, 23 bp, Artificial sequence
  SiRNA target sequence
agagaatagcgatttcaaaagtt

SEQ ID NO: 187559 - DNA, 23 bp, Artificial sequence
  SiRNA target sequence
gagaatagcgatttcaaaagtta

SEQ ID NO: 187560 - DNA, 23 bp, Artificial sequence
  SiRNA target sequence
agaatagcgatttcaaaagttat

SEQ ID NO: 187561 - DNA, 23 bp, Artificial sequence
  SiRNA target sequence
gaatagcgatttcaaaagttata

SEQ ID NO: 187562 - DNA, 23 bp, Artificial sequence
  SiRNA target sequence
aatagcgatttcaaaagttataa

SEQ ID NO: 187563 - DNA, 23 bp, Artificial sequence
  SiRNA target sequence
atagcgatttcaaaagttataaa

SEQ ID NO: 187564 - DNA, 23 bp, Artificial sequence
  SiRNA target sequence
tagcgatttcaaaagttataaaa

SEQ ID NO: 187565 - DNA, 23 bp, Artificial sequence
  SiRNA target sequence
agcgatttcaaaagttataaaaa

SEQ ID NO: 187566 - DNA, 23 bp, Artificial sequence
  SiRNA target sequence
gcgatttcaaaagttataaaaag

SEQ ID NO: 187567 - DNA, 23 bp, Artificial sequence
  SiRNA target sequence
cgatttcaaaagttataaaaagg

SEQ ID NO: 187568 - DNA, 23 bp, Artificial sequence
  SiRNA target sequence
gatttcaaaagttataaaaaggt

SEQ ID NO: 187569 - DNA, 23 bp, Artificial sequence
  SiRNA target sequence
atttcaaaagttataaaaaggtt

SEQ ID NO: 187570 - DNA, 23 bp, Artificial sequence
  SiRNA target sequence
tttcaaaagttataaaaaggttt

SEQ ID NO: 187571 - DNA, 23 bp, Artificial sequence
  SiRNA target sequence
ttcaaaagttataaaaaggttta

SEQ ID NO: 187572 - DNA, 23 bp, Artificial sequence
  SiRNA target sequence
tcaaaagttataaaaaggtttat

SEQ ID NO: 187573 - DNA, 23 bp, Artificial sequence
  SiRNA target sequence
caaaagttataaaaaggtttatt

SEQ ID NO: 187574 - DNA, 23 bp, Artificial sequence
  SiRNA target sequence
aaaagttataaaaaggtttattt

SEQ ID NO: 187575 - DNA, 23 bp, Artificial sequence
  SiRNA target sequence
aaagttataaaaaggtttattta

SEQ ID NO: 187576 - DNA, 23 bp, Artificial sequence
  SiRNA target sequence
aagttataaaaaggtttatttat

SEQ ID NO: 187577 - DNA, 23 bp, Artificial sequence
  SiRNA target sequence
agttataaaaaggtttatttatg

SEQ ID NO: 187578 - DNA, 23 bp, Artificial sequence
  SiRNA target sequence
gttataaaaaggtttatttatgg

SEQ ID NO: 187579 - DNA, 23 bp, Artificial sequence
  SiRNA target sequence
ttataaaaaggtttatttatggg

SEQ ID NO: 187580 - DNA, 23 bp, Artificial sequence
  SiRNA target sequence
tataaaaaggtttatttatggga

SEQ ID NO: 187581 - DNA, 23 bp, Artificial sequence
  SiRNA target sequence
ataaaaaggtttatttatgggaa

SEQ ID NO: 187582 - DNA, 23 bp, Artificial sequence
  SiRNA target sequence
taaaaaggtttatttatgggaag

SEQ ID NO: 187583 - DNA, 23 bp, Artificial sequence
  SiRNA target sequence
aaaaaggtttatttatgggaaga

SEQ ID NO: 187584 - DNA, 23 bp, Artificial sequence
  SiRNA target sequence
aaaaggtttatttatgggaagaa

SEQ ID NO: 187585 - DNA, 23 bp, Artificial sequence
  SiRNA target sequence
aaaggtttatttatgggaagaag

SEQ ID NO: 187586 - DNA, 23 bp, Artificial sequence
  SiRNA target sequence
aaggtttatttatgggaagaagc

SEQ ID NO: 187587 - DNA, 23 bp, Artificial sequence
  SiRNA target sequence
aggtttatttatgggaagaagcg

SEQ ID NO: 187588 - DNA, 23 bp, Artificial sequence
  SiRNA target sequence
ggtttatttatgggaagaagcga

SEQ ID NO: 187589 - DNA, 23 bp, Artificial sequence
  SiRNA target sequence
gtttatttatgggaagaagcgaa

SEQ ID NO: 187590 - DNA, 23 bp, Artificial sequence
  SiRNA target sequence
tttatttatgggaagaagcgaac

SEQ ID NO: 187591 - DNA, 23 bp, Artificial sequence
  SiRNA target sequence
ttatttatgggaagaagcgaaca

SEQ ID NO: 187592 - DNA, 23 bp, Artificial sequence
  SiRNA target sequence
tatttatgggaagaagcgaacag

SEQ ID NO: 187593 - DNA, 23 bp, Artificial sequence
  SiRNA target sequence
atttatgggaagaagcgaacagc

SEQ ID NO: 187594 - DNA, 23 bp, Artificial sequence
  SiRNA target sequence
tttatgggaagaagcgaacagcc

SEQ ID NO: 187595 - DNA, 23 bp, Artificial sequence
  SiRNA target sequence
ttatgggaagaagcgaacagcct

SEQ ID NO: 187596 - DNA, 23 bp, Artificial sequence
  SiRNA target sequence
tatgggaagaagcgaacagcctt

SEQ ID NO: 187597 - DNA, 23 bp, Artificial sequence
  SiRNA target sequence
atgggaagaagcgaacagccttt

SEQ ID NO: 187598 - DNA, 23 bp, Artificial sequence
  SiRNA target sequence
tgggaagaagcgaacagcctttg

SEQ ID NO: 187599 - DNA, 23 bp, Artificial sequence
  SiRNA target sequence
gggaagaagcgaacagcctttgt

SEQ ID NO: 187600 - DNA, 23 bp, Artificial sequence
  SiRNA target sequence
ggaagaagcgaacagcctttgtg

SEQ ID NO: 187601 - DNA, 23 bp, Artificial sequence
  SiRNA target sequence
gaagaagcgaacagcctttgtgg

SEQ ID NO: 187602 - DNA, 23 bp, Artificial sequence
  SiRNA target sequence
aagaagcgaacagcctttgtggt

SEQ ID NO: 187603 - DNA, 23 bp, Artificial sequence
  SiRNA target sequence
agaagcgaacagcctttgtggtt

SEQ ID NO: 187604 - DNA, 23 bp, Artificial sequence
  SiRNA target sequence
gaagcgaacagcctttgtggttg

SEQ ID NO: 187605 - DNA, 23 bp, Artificial sequence
  SiRNA target sequence
aagcgaacagcctttgtggttga

SEQ ID NO: 187606 - DNA, 23 bp, Artificial sequence
  SiRNA target sequence
agcgaacagcctttgtggttgaa

SEQ ID NO: 187607 - DNA, 23 bp, Artificial sequence
  SiRNA target sequence
gcgaacagcctttgtggttgaac

SEQ ID NO: 187608 - DNA, 23 bp, Artificial sequence
  SiRNA target sequence
cgaacagcctttgtggttgaaca

SEQ ID NO: 187609 - DNA, 23 bp, Artificial sequence
  SiRNA target sequence
gaacagcctttgtggttgaacat

SEQ ID NO: 187610 - DNA, 23 bp, Artificial sequence
  SiRNA target sequence
aacagcctttgtggttgaacatg

SEQ ID NO: 187611 - DNA, 23 bp, Artificial sequence
  SiRNA target sequence
acagcctttgtggttgaacatga

SEQ ID NO: 187612 - DNA, 23 bp, Artificial sequence
  SiRNA target sequence
cagcctttgtggttgaacatgat

SEQ ID NO: 187613 - DNA, 23 bp, Artificial sequence
  SiRNA target sequence
agcctttgtggttgaacatgatt

SEQ ID NO: 187614 - DNA, 23 bp, Artificial sequence
  SiRNA target sequence
gcctttgtggttgaacatgattt

SEQ ID NO: 187615 - DNA, 23 bp, Artificial sequence
  SiRNA target sequence
cctttgtggttgaacatgattta

SEQ ID NO: 187616 - DNA, 23 bp, Artificial sequence
  SiRNA target sequence
ctttgtggttgaacatgatttaa

SEQ ID NO: 187617 - DNA, 23 bp, Artificial sequence
  SiRNA target sequence
tttgtggttgaacatgatttaat

SEQ ID NO: 187618 - DNA, 23 bp, Artificial sequence
  SiRNA target sequence
ttgtggttgaacatgatttaatt

SEQ ID NO: 187619 - DNA, 23 bp, Artificial sequence
  SiRNA target sequence
tgtggttgaacatgatttaattg

SEQ ID NO: 187620 - DNA, 23 bp, Artificial sequence
  SiRNA target sequence
gtggttgaacatgatttaattgt

SEQ ID NO: 187621 - DNA, 23 bp, Artificial sequence
  SiRNA target sequence
tggttgaacatgatttaattgta

SEQ ID NO: 187622 - DNA, 23 bp, Artificial sequence
  SiRNA target sequence
ggttgaacatgatttaattgtag

SEQ ID NO: 187623 - DNA, 23 bp, Artificial sequence
  SiRNA target sequence
gttgaacatgatttaattgtagg

SEQ ID NO: 187624 - DNA, 23 bp, Artificial sequence
  SiRNA target sequence
ttgaacatgatttaattgtaggt

SEQ ID NO: 187625 - DNA, 23 bp, Artificial sequence
  SiRNA target sequence
tgaacatgatttaattgtaggta

SEQ ID NO: 187626 - DNA, 23 bp, Artificial sequence
  SiRNA target sequence
gaacatgatttaattgtaggtac

SEQ ID NO: 187627 - DNA, 23 bp, Artificial sequence
  SiRNA target sequence
aacatgatttaattgtaggtaca

SEQ ID NO: 187628 - DNA, 23 bp, Artificial sequence
  SiRNA target sequence
acatgatttaattgtaggtacat

SEQ ID NO: 187629 - DNA, 23 bp, Artificial sequence
  SiRNA target sequence
catgatttaattgtaggtacata

SEQ ID NO: 187630 - DNA, 23 bp, Artificial sequence
  SiRNA target sequence
atgatttaattgtaggtacatat

SEQ ID NO: 187631 - DNA, 23 bp, Artificial sequence
  SiRNA target sequence
tgatttaattgtaggtacatatt

SEQ ID NO: 187632 - DNA, 23 bp, Artificial sequence
  SiRNA target sequence
gatttaattgtaggtacatattt

SEQ ID NO: 187633 - DNA, 23 bp, Artificial sequence
  SiRNA target sequence
atttaattgtaggtacatatttg

SEQ ID NO: 187634 - DNA, 23 bp, Artificial sequence
  SiRNA target sequence
tttaattgtaggtacatatttgg

SEQ ID NO: 187635 - DNA, 23 bp, Artificial sequence
  SiRNA target sequence
ttaattgtaggtacatatttggc

SEQ ID NO: 187636 - DNA, 23 bp, Artificial sequence
  SiRNA target sequence
taattgtaggtacatatttggct

SEQ ID NO: 187637 - DNA, 23 bp, Artificial sequence
  SiRNA target sequence
aattgtaggtacatatttggctg

SEQ ID NO: 187638 - DNA, 23 bp, Artificial sequence
  SiRNA target sequence
attgtaggtacatatttggctga

SEQ ID NO: 187639 - DNA, 23 bp, Artificial sequence
  SiRNA target sequence
ttgtaggtacatatttggctgat

SEQ ID NO: 187640 - DNA, 23 bp, Artificial sequence
  SiRNA target sequence
tgtaggtacatatttggctgata

SEQ ID NO: 187641 - DNA, 23 bp, Artificial sequence
  SiRNA target sequence
gtaggtacatatttggctgataa

SEQ ID NO: 187642 - DNA, 23 bp, Artificial sequence
  SiRNA target sequence
taggtacatatttggctgataaa

SEQ ID NO: 187643 - DNA, 23 bp, Artificial sequence
  SiRNA target sequence
aggtacatatttggctgataaag

SEQ ID NO: 187644 - DNA, 23 bp, Artificial sequence
  SiRNA target sequence
ggtacatatttggctgataaagt

SEQ ID NO: 187645 - DNA, 23 bp, Artificial sequence
  SiRNA target sequence
gtacatatttggctgataaagtt

SEQ ID NO: 187646 - DNA, 23 bp, Artificial sequence
  SiRNA target sequence
tacatatttggctgataaagttg

SEQ ID NO: 187647 - DNA, 23 bp, Artificial sequence
  SiRNA target sequence
acatatttggctgataaagttgt

SEQ ID NO: 187648 - DNA, 23 bp, Artificial sequence
  SiRNA target sequence
catatttggctgataaagttgtt

SEQ ID NO: 187649 - DNA, 23 bp, Artificial sequence
  SiRNA target sequence
atatttggctgataaagttgttg

SEQ ID NO: 187650 - DNA, 23 bp, Artificial sequence
  SiRNA target sequence
tatttggctgataaagttgttgt

SEQ ID NO: 187651 - DNA, 23 bp, Artificial sequence
  SiRNA target sequence
atttggctgataaagttgttgtt

SEQ ID NO: 187652 - DNA, 23 bp, Artificial sequence
  SiRNA target sequence
tttggctgataaagttgttgttt

SEQ ID NO: 187653 - DNA, 23 bp, Artificial sequence
  SiRNA target sequence
ttggctgataaagttgttgtttt

SEQ ID NO: 187654 - DNA, 23 bp, Artificial sequence
  SiRNA target sequence
tggctgataaagttgttgttttt

SEQ ID NO: 187655 - DNA, 23 bp, Artificial sequence
  SiRNA target sequence
ggctgataaagttgttgtttttg

SEQ ID NO: 187656 - DNA, 23 bp, Artificial sequence
  SiRNA target sequence
gctgataaagttgttgtttttga

SEQ ID NO: 187657 - DNA, 23 bp, Artificial sequence
  SiRNA target sequence
ctgataaagttgttgtttttgag

SEQ ID NO: 187658 - DNA, 23 bp, Artificial sequence
  SiRNA target sequence
tgataaagttgttgtttttgagg

SEQ ID NO: 187659 - DNA, 23 bp, Artificial sequence
  SiRNA target sequence
gataaagttgttgtttttgaggg

SEQ ID NO: 187660 - DNA, 23 bp, Artificial sequence
  SiRNA target sequence
ataaagttgttgtttttgaggga

SEQ ID NO: 187661 - DNA, 23 bp, Artificial sequence
  SiRNA target sequence
taaagttgttgtttttgagggaa

SEQ ID NO: 187662 - DNA, 23 bp, Artificial sequence
  SiRNA target sequence
aaagttgttgtttttgagggaag

SEQ ID NO: 187663 - DNA, 23 bp, Artificial sequence
  SiRNA target sequence
aagttgttgtttttgagggaagc

SEQ ID NO: 187664 - DNA, 23 bp, Artificial sequence
  SiRNA target sequence
agttgttgtttttgagggaagcc

SEQ ID NO: 187665 - DNA, 23 bp, Artificial sequence
  SiRNA target sequence
gttgttgtttttgagggaagccc

SEQ ID NO: 187666 - DNA, 23 bp, Artificial sequence
  SiRNA target sequence
ttgttgtttttgagggaagccct

SEQ ID NO: 187667 - DNA, 23 bp, Artificial sequence
  SiRNA target sequence
tgttgtttttgagggaagcccta

SEQ ID NO: 187668 - DNA, 23 bp, Artificial sequence
  SiRNA target sequence
gttgtttttgagggaagccctag

SEQ ID NO: 187669 - DNA, 23 bp, Artificial sequence
  SiRNA target sequence
ttgtttttgagggaagccctagt

SEQ ID NO: 187670 - DNA, 23 bp, Artificial sequence
  SiRNA target sequence
tgtttttgagggaagccctagtg

SEQ ID NO: 187671 - DNA, 23 bp, Artificial sequence
  SiRNA target sequence
gtttttgagggaagccctagtgt

SEQ ID NO: 187672 - DNA, 23 bp, Artificial sequence
  SiRNA target sequence
tttttgagggaagccctagtgtt

SEQ ID NO: 187673 - DNA, 23 bp, Artificial sequence
  SiRNA target sequence
ttttgagggaagccctagtgttc

SEQ ID NO: 187674 - DNA, 23 bp, Artificial sequence
  SiRNA target sequence
tttgagggaagccctagtgttca

SEQ ID NO: 187675 - DNA, 23 bp, Artificial sequence
  SiRNA target sequence
ttgagggaagccctagtgttcat

SEQ ID NO: 187676 - DNA, 23 bp, Artificial sequence
  SiRNA target sequence
tgagggaagccctagtgttcata

SEQ ID NO: 187677 - DNA, 23 bp, Artificial sequence
  SiRNA target sequence
gagggaagccctagtgttcatag

SEQ ID NO: 187678 - DNA, 23 bp, Artificial sequence
  SiRNA target sequence
agggaagccctagtgttcatagc

SEQ ID NO: 187679 - DNA, 23 bp, Artificial sequence
  SiRNA target sequence
gggaagccctagtgttcatagca

SEQ ID NO: 187680 - DNA, 23 bp, Artificial sequence
  SiRNA target sequence
ggaagccctagtgttcatagcac

SEQ ID NO: 187681 - DNA, 23 bp, Artificial sequence
  SiRNA target sequence
gaagccctagtgttcatagcact

SEQ ID NO: 187682 - DNA, 23 bp, Artificial sequence
  SiRNA target sequence
aagccctagtgttcatagcactg

SEQ ID NO: 187683 - DNA, 23 bp, Artificial sequence
  SiRNA target sequence
agccctagtgttcatagcactgc

SEQ ID NO: 187684 - DNA, 23 bp, Artificial sequence
  SiRNA target sequence
gccctagtgttcatagcactgct

SEQ ID NO: 187685 - DNA, 23 bp, Artificial sequence
  SiRNA target sequence
ccctagtgttcatagcactgctc

SEQ ID NO: 187686 - DNA, 23 bp, Artificial sequence
  SiRNA target sequence
cctagtgttcatagcactgctca

SEQ ID NO: 187687 - DNA, 23 bp, Artificial sequence
  SiRNA target sequence
ctagtgttcatagcactgctcat

SEQ ID NO: 187688 - DNA, 23 bp, Artificial sequence
  SiRNA target sequence
tagtgttcatagcactgctcata

SEQ ID NO: 187689 - DNA, 23 bp, Artificial sequence
  SiRNA target sequence
agtgttcatagcactgctcataa

SEQ ID NO: 187690 - DNA, 23 bp, Artificial sequence
  SiRNA target sequence
gtgttcatagcactgctcataaa

SEQ ID NO: 187691 - DNA, 23 bp, Artificial sequence
  SiRNA target sequence
tgttcatagcactgctcataaac

SEQ ID NO: 187692 - DNA, 23 bp, Artificial sequence
  SiRNA target sequence
gttcatagcactgctcataaacc

SEQ ID NO: 187693 - DNA, 23 bp, Artificial sequence
  SiRNA target sequence
ttcatagcactgctcataaaccg

SEQ ID NO: 187694 - DNA, 23 bp, Artificial sequence
  SiRNA target sequence
tcatagcactgctcataaaccga

SEQ ID NO: 187695 - DNA, 23 bp, Artificial sequence
  SiRNA target sequence
catagcactgctcataaaccgat

SEQ ID NO: 187696 - DNA, 23 bp, Artificial sequence
  SiRNA target sequence
atagcactgctcataaaccgatg

SEQ ID NO: 187697 - DNA, 23 bp, Artificial sequence
  SiRNA target sequence
tagcactgctcataaaccgatgg

SEQ ID NO: 187698 - DNA, 23 bp, Artificial sequence
  SiRNA target sequence
agcactgctcataaaccgatgga

SEQ ID NO: 187699 - DNA, 23 bp, Artificial sequence
  SiRNA target sequence
gcactgctcataaaccgatggat

SEQ ID NO: 187700 - DNA, 23 bp, Artificial sequence
  SiRNA target sequence
cactgctcataaaccgatggatt

SEQ ID NO: 187701 - DNA, 23 bp, Artificial sequence
  SiRNA target sequence
actgctcataaaccgatggattt

SEQ ID NO: 187702 - DNA, 23 bp, Artificial sequence
  SiRNA target sequence
ctgctcataaaccgatggatttg

SEQ ID NO: 187703 - DNA, 23 bp, Artificial sequence
  SiRNA target sequence
tgctcataaaccgatggatttgc

SEQ ID NO: 187704 - DNA, 23 bp, Artificial sequence
  SiRNA target sequence
gctcataaaccgatggatttgca

SEQ ID NO: 187705 - DNA, 23 bp, Artificial sequence
  SiRNA target sequence
ctcataaaccgatggatttgcat

SEQ ID NO: 187706 - DNA, 23 bp, Artificial sequence
  SiRNA target sequence
tcataaaccgatggatttgcata

SEQ ID NO: 187707 - DNA, 23 bp, Artificial sequence
  SiRNA target sequence
cataaaccgatggatttgcatag

SEQ ID NO: 187708 - DNA, 23 bp, Artificial sequence
  SiRNA target sequence
ataaaccgatggatttgcatagt

SEQ ID NO: 187709 - DNA, 23 bp, Artificial sequence
  SiRNA target sequence
taaaccgatggatttgcatagtg

SEQ ID NO: 187710 - DNA, 23 bp, Artificial sequence
  SiRNA target sequence
aaaccgatggatttgcatagtgg

SEQ ID NO: 187711 - DNA, 23 bp, Artificial sequence
  SiRNA target sequence
aaccgatggatttgcatagtgga

SEQ ID NO: 187712 - DNA, 23 bp, Artificial sequence
  SiRNA target sequence
accgatggatttgcatagtggaa

SEQ ID NO: 187713 - DNA, 23 bp, Artificial sequence
  SiRNA target sequence
ccgatggatttgcatagtggaat

SEQ ID NO: 187714 - DNA, 23 bp, Artificial sequence
  SiRNA target sequence
cgatggatttgcatagtggaatg

SEQ ID NO: 187715 - DNA, 23 bp, Artificial sequence
  SiRNA target sequence
gatggatttgcatagtggaatga

SEQ ID NO: 187716 - DNA, 23 bp, Artificial sequence
  SiRNA target sequence
atggatttgcatagtggaatgaa

SEQ ID NO: 187717 - DNA, 23 bp, Artificial sequence
  SiRNA target sequence
tggatttgcatagtggaatgaat

SEQ ID NO: 187718 - DNA, 23 bp, Artificial sequence
  SiRNA target sequence
ggatttgcatagtggaatgaata

SEQ ID NO: 187719 - DNA, 23 bp, Artificial sequence
  SiRNA target sequence
gatttgcatagtggaatgaatat

SEQ ID NO: 187720 - DNA, 23 bp, Artificial sequence
  SiRNA target sequence
atttgcatagtggaatgaatatt

SEQ ID NO: 187721 - DNA, 23 bp, Artificial sequence
  SiRNA target sequence
tttgcatagtggaatgaatattt

SEQ ID NO: 187722 - DNA, 23 bp, Artificial sequence
  SiRNA target sequence
ttgcatagtggaatgaatatttt

SEQ ID NO: 187723 - DNA, 23 bp, Artificial sequence
  SiRNA target sequence
tgcatagtggaatgaatattttt

SEQ ID NO: 187724 - DNA, 23 bp, Artificial sequence
  SiRNA target sequence
gcatagtggaatgaatatttttt

SEQ ID NO: 187725 - DNA, 23 bp, Artificial sequence
  SiRNA target sequence
catagtggaatgaatattttttt

SEQ ID NO: 187726 - DNA, 23 bp, Artificial sequence
  SiRNA target sequence
atagtggaatgaatattttttta

SEQ ID NO: 187727 - DNA, 23 bp, Artificial sequence
  SiRNA target sequence
tagtggaatgaatatttttttaa

SEQ ID NO: 187728 - DNA, 23 bp, Artificial sequence
  SiRNA target sequence
agtggaatgaatatttttttaaa

SEQ ID NO: 187729 - DNA, 23 bp, Artificial sequence
  SiRNA target sequence
gtggaatgaatatttttttaaag

SEQ ID NO: 187730 - DNA, 23 bp, Artificial sequence
  SiRNA target sequence
tggaatgaatatttttttaaaga

SEQ ID NO: 187731 - DNA, 23 bp, Artificial sequence
  SiRNA target sequence
ggaatgaatatttttttaaagaa

SEQ ID NO: 187732 - DNA, 23 bp, Artificial sequence
  SiRNA target sequence
gaatgaatatttttttaaagaat

SEQ ID NO: 187733 - DNA, 23 bp, Artificial sequence
  SiRNA target sequence
aatgaatatttttttaaagaatc

SEQ ID NO: 187734 - DNA, 23 bp, Artificial sequence
  SiRNA target sequence
atgaatatttttttaaagaatct

SEQ ID NO: 187735 - DNA, 23 bp, Artificial sequence
  SiRNA target sequence
tgaatatttttttaaagaatctt

SEQ ID NO: 187736 - DNA, 23 bp, Artificial sequence
  SiRNA target sequence
gaatatttttttaaagaatcttg

SEQ ID NO: 187737 - DNA, 23 bp, Artificial sequence
  SiRNA target sequence
aatatttttttaaagaatcttga

SEQ ID NO: 187738 - DNA, 23 bp, Artificial sequence
  SiRNA target sequence
atatttttttaaagaatcttgat

SEQ ID NO: 187739 - DNA, 23 bp, Artificial sequence
  SiRNA target sequence
tatttttttaaagaatcttgata

SEQ ID NO: 187740 - DNA, 23 bp, Artificial sequence
  SiRNA target sequence
atttttttaaagaatcttgatat

SEQ ID NO: 187741 - DNA, 23 bp, Artificial sequence
  SiRNA target sequence
tttttttaaagaatcttgatatt

SEQ ID NO: 187742 - DNA, 23 bp, Artificial sequence
  SiRNA target sequence
ttttttaaagaatcttgatatta

SEQ ID NO: 187743 - DNA, 23 bp, Artificial sequence
  SiRNA target sequence
tttttaaagaatcttgatattac

SEQ ID NO: 187744 - DNA, 23 bp, Artificial sequence
  SiRNA target sequence
ttttaaagaatcttgatattact

SEQ ID NO: 187745 - DNA, 23 bp, Artificial sequence
  SiRNA target sequence
tttaaagaatcttgatattactt

SEQ ID NO: 187746 - DNA, 23 bp, Artificial sequence
  SiRNA target sequence
ttaaagaatcttgatattacttt

SEQ ID NO: 187747 - DNA, 23 bp, Artificial sequence
  SiRNA target sequence
taaagaatcttgatattactttt

SEQ ID NO: 187748 - DNA, 23 bp, Artificial sequence
  SiRNA target sequence
aaagaatcttgatattactttta

SEQ ID NO: 187749 - DNA, 23 bp, Artificial sequence
  SiRNA target sequence
aagaatcttgatattacttttag

SEQ ID NO: 187750 - DNA, 23 bp, Artificial sequence
  SiRNA target sequence
agaatcttgatattacttttaga

SEQ ID NO: 187751 - DNA, 23 bp, Artificial sequence
  SiRNA target sequence
gaatcttgatattacttttagaa

SEQ ID NO: 187752 - DNA, 23 bp, Artificial sequence
  SiRNA target sequence
aatcttgatattacttttagaag

SEQ ID NO: 187753 - DNA, 23 bp, Artificial sequence
  SiRNA target sequence
atcttgatattacttttagaaga

SEQ ID NO: 187754 - DNA, 23 bp, Artificial sequence
  SiRNA target sequence
tcttgatattacttttagaagag

SEQ ID NO: 187755 - DNA, 23 bp, Artificial sequence
  SiRNA target sequence
cttgatattacttttagaagaga

SEQ ID NO: 187756 - DNA, 23 bp, Artificial sequence
  SiRNA target sequence
ttgatattacttttagaagagac

SEQ ID NO: 187757 - DNA, 23 bp, Artificial sequence
  SiRNA target sequence
tgatattacttttagaagagact

SEQ ID NO: 187758 - DNA, 23 bp, Artificial sequence
  SiRNA target sequence
gatattacttttagaagagactc

SEQ ID NO: 187759 - DNA, 23 bp, Artificial sequence
  SiRNA target sequence
atattacttttagaagagactct

SEQ ID NO: 187760 - DNA, 23 bp, Artificial sequence
  SiRNA target sequence
tattacttttagaagagactctt

SEQ ID NO: 187761 - DNA, 23 bp, Artificial sequence
  SiRNA target sequence
attacttttagaagagactcttc

SEQ ID NO: 187762 - DNA, 23 bp, Artificial sequence
  SiRNA target sequence
ttacttttagaagagactcttcc

SEQ ID NO: 187763 - DNA, 23 bp, Artificial sequence
  SiRNA target sequence
tacttttagaagagactcttcca

SEQ ID NO: 187764 - DNA, 23 bp, Artificial sequence
  SiRNA target sequence
acttttagaagagactcttccaa

SEQ ID NO: 187765 - DNA, 23 bp, Artificial sequence
  SiRNA target sequence
cttttagaagagactcttccaat

SEQ ID NO: 187766 - DNA, 23 bp, Artificial sequence
  SiRNA target sequence
ttttagaagagactcttccaatt

SEQ ID NO: 187767 - DNA, 23 bp, Artificial sequence
  SiRNA target sequence
tttagaagagactcttccaattt

SEQ ID NO: 187768 - DNA, 23 bp, Artificial sequence
  SiRNA target sequence
ttagaagagactcttccaatttt

SEQ ID NO: 187769 - DNA, 23 bp, Artificial sequence
  SiRNA target sequence
tagaagagactcttccaatttta

SEQ ID NO: 187770 - DNA, 23 bp, Artificial sequence
  SiRNA target sequence
agaagagactcttccaattttag

SEQ ID NO: 187771 - DNA, 23 bp, Artificial sequence
  SiRNA target sequence
gaagagactcttccaattttaga

SEQ ID NO: 187772 - DNA, 23 bp, Artificial sequence
  SiRNA target sequence
aagagactcttccaattttagac

SEQ ID NO: 187773 - DNA, 23 bp, Artificial sequence
  SiRNA target sequence
agagactcttccaattttagacc

SEQ ID NO: 187774 - DNA, 23 bp, Artificial sequence
  SiRNA target sequence
gagactcttccaattttagacca

SEQ ID NO: 187775 - DNA, 23 bp, Artificial sequence
  SiRNA target sequence
agactcttccaattttagaccaa

SEQ ID NO: 187776 - DNA, 23 bp, Artificial sequence
  SiRNA target sequence
gactcttccaattttagaccaag

SEQ ID NO: 187777 - DNA, 23 bp, Artificial sequence
  SiRNA target sequence
actcttccaattttagaccaaga

SEQ ID NO: 187778 - DNA, 23 bp, Artificial sequence
  SiRNA target sequence
ctcttccaattttagaccaagag

SEQ ID NO: 187779 - DNA, 23 bp, Artificial sequence
  SiRNA target sequence
tcttccaattttagaccaagagt

SEQ ID NO: 187780 - DNA, 23 bp, Artificial sequence
  SiRNA target sequence
cttccaattttagaccaagagtt

SEQ ID NO: 187781 - DNA, 23 bp, Artificial sequence
  SiRNA target sequence
ttccaattttagaccaagagtta

SEQ ID NO: 187782 - DNA, 23 bp, Artificial sequence
  SiRNA target sequence
tccaattttagaccaagagttaa

SEQ ID NO: 187783 - DNA, 23 bp, Artificial sequence
  SiRNA target sequence
ccaattttagaccaagagttaat

SEQ ID NO: 187784 - DNA, 23 bp, Artificial sequence
  SiRNA target sequence
caattttagaccaagagttaata

SEQ ID NO: 187785 - DNA, 23 bp, Artificial sequence
  SiRNA target sequence
aattttagaccaagagttaataa

SEQ ID NO: 187786 - DNA, 23 bp, Artificial sequence
  SiRNA target sequence
attttagaccaagagttaataag

SEQ ID NO: 187787 - DNA, 23 bp, Artificial sequence
  SiRNA target sequence
ttttagaccaagagttaataagc

SEQ ID NO: 187788 - DNA, 23 bp, Artificial sequence
  SiRNA target sequence
tttagaccaagagttaataagcc

SEQ ID NO: 187789 - DNA, 23 bp, Artificial sequence
  SiRNA target sequence
ttagaccaagagttaataagccg

SEQ ID NO: 187790 - DNA, 23 bp, Artificial sequence
  SiRNA target sequence
tagaccaagagttaataagccga

SEQ ID NO: 187791 - DNA, 23 bp, Artificial sequence
  SiRNA target sequence
agaccaagagttaataagccgaa

SEQ ID NO: 187792 - DNA, 23 bp, Artificial sequence
  SiRNA target sequence
gaccaagagttaataagccgaat

SEQ ID NO: 187793 - DNA, 23 bp, Artificial sequence
  SiRNA target sequence
accaagagttaataagccgaatt

SEQ ID NO: 187794 - DNA, 23 bp, Artificial sequence
  SiRNA target sequence
ccaagagttaataagccgaattc

SEQ ID NO: 187795 - DNA, 23 bp, Artificial sequence
  SiRNA target sequence
caagagttaataagccgaattcc

SEQ ID NO: 187796 - DNA, 23 bp, Artificial sequence
  SiRNA target sequence
aagagttaataagccgaattccg

SEQ ID NO: 187797 - DNA, 23 bp, Artificial sequence
  SiRNA target sequence
agagttaataagccgaattccgc

SEQ ID NO: 187798 - DNA, 23 bp, Artificial sequence
  SiRNA target sequence
gagttaataagccgaattccgca

SEQ ID NO: 187799 - DNA, 23 bp, Artificial sequence
  SiRNA target sequence
agttaataagccgaattccgcaa

SEQ ID NO: 187800 - DNA, 23 bp, Artificial sequence
  SiRNA target sequence
gttaataagccgaattccgcaaa

SEQ ID NO: 187801 - DNA, 23 bp, Artificial sequence
  SiRNA target sequence
ttaataagccgaattccgcaaaa

SEQ ID NO: 187802 - DNA, 23 bp, Artificial sequence
  SiRNA target sequence
taataagccgaattccgcaaaag

SEQ ID NO: 187803 - DNA, 23 bp, Artificial sequence
  SiRNA target sequence
aataagccgaattccgcaaaaga

SEQ ID NO: 187804 - DNA, 23 bp, Artificial sequence
  SiRNA target sequence
ataagccgaattccgcaaaagac

SEQ ID NO: 187805 - DNA, 23 bp, Artificial sequence
  SiRNA target sequence
taagccgaattccgcaaaagaca

SEQ ID NO: 187806 - DNA, 23 bp, Artificial sequence
  SiRNA target sequence
aagccgaattccgcaaaagacag

SEQ ID NO: 187807 - DNA, 23 bp, Artificial sequence
  SiRNA target sequence
agccgaattccgcaaaagacaga

SEQ ID NO: 187808 - DNA, 23 bp, Artificial sequence
  SiRNA target sequence
gccgaattccgcaaaagacagaa

SEQ ID NO: 187809 - DNA, 23 bp, Artificial sequence
  SiRNA target sequence
ccgaattccgcaaaagacagaac

SEQ ID NO: 187810 - DNA, 23 bp, Artificial sequence
  SiRNA target sequence
cgaattccgcaaaagacagaact

SEQ ID NO: 187811 - DNA, 23 bp, Artificial sequence
  SiRNA target sequence
gaattccgcaaaagacagaactc

SEQ ID NO: 187812 - DNA, 23 bp, Artificial sequence
  SiRNA target sequence
aattccgcaaaagacagaactca

SEQ ID NO: 187813 - DNA, 23 bp, Artificial sequence
  SiRNA target sequence
attccgcaaaagacagaactcag

SEQ ID NO: 187814 - DNA, 23 bp, Artificial sequence
  SiRNA target sequence
ttccgcaaaagacagaactcaga

SEQ ID NO: 187815 - DNA, 23 bp, Artificial sequence
  SiRNA target sequence
tccgcaaaagacagaactcagaa

SEQ ID NO: 187816 - DNA, 23 bp, Artificial sequence
  SiRNA target sequence
ccgcaaaagacagaactcagaaa

SEQ ID NO: 187817 - DNA, 23 bp, Artificial sequence
  SiRNA target sequence
cgcaaaagacagaactcagaaag

SEQ ID NO: 187818 - DNA, 23 bp, Artificial sequence
  SiRNA target sequence
gcaaaagacagaactcagaaaga

SEQ ID NO: 187819 - DNA, 23 bp, Artificial sequence
  SiRNA target sequence
caaaagacagaactcagaaagaa

SEQ ID NO: 187820 - DNA, 23 bp, Artificial sequence
  SiRNA target sequence
aaaagacagaactcagaaagaag

SEQ ID NO: 187821 - DNA, 23 bp, Artificial sequence
  SiRNA target sequence
aaagacagaactcagaaagaaga

SEQ ID NO: 187822 - DNA, 23 bp, Artificial sequence
  SiRNA target sequence
aagacagaactcagaaagaagag

SEQ ID NO: 187823 - DNA, 23 bp, Artificial sequence
  SiRNA target sequence
agacagaactcagaaagaagaga

SEQ ID NO: 187824 - DNA, 23 bp, Artificial sequence
  SiRNA target sequence
gacagaactcagaaagaagagaa

SEQ ID NO: 187825 - DNA, 23 bp, Artificial sequence
  SiRNA target sequence
acagaactcagaaagaagagaat

SEQ ID NO: 187826 - DNA, 23 bp, Artificial sequence
  SiRNA target sequence
cagaactcagaaagaagagaata

SEQ ID NO: 187827 - DNA, 23 bp, Artificial sequence
  SiRNA target sequence
agaactcagaaagaagagaataa

SEQ ID NO: 187828 - DNA, 23 bp, Artificial sequence
  SiRNA target sequence
gaactcagaaagaagagaataaa

SEQ ID NO: 187829 - DNA, 23 bp, Artificial sequence
  SiRNA target sequence
aactcagaaagaagagaataaat

SEQ ID NO: 187830 - DNA, 23 bp, Artificial sequence
  SiRNA target sequence
actcagaaagaagagaataaata

SEQ ID NO: 187831 - DNA, 23 bp, Artificial sequence
  SiRNA target sequence
ctcagaaagaagagaataaatat

SEQ ID NO: 187832 - DNA, 23 bp, Artificial sequence
  SiRNA target sequence
tcagaaagaagagaataaatatt

SEQ ID NO: 187833 - DNA, 23 bp, Artificial sequence
  SiRNA target sequence
cagaaagaagagaataaatattt

SEQ ID NO: 187834 - DNA, 23 bp, Artificial sequence
  SiRNA target sequence
agaaagaagagaataaatatttt

SEQ ID NO: 187835 - DNA, 23 bp, Artificial sequence
  SiRNA target sequence
gaaagaagagaataaatattttt

SEQ ID NO: 187836 - DNA, 23 bp, Artificial sequence
  SiRNA target sequence
aaagaagagaataaatatttttt

SEQ ID NO: 187837 - DNA, 23 bp, Artificial sequence
  SiRNA target sequence
aagaagagaataaatattttttt

SEQ ID NO: 187838 - DNA, 23 bp, Artificial sequence
  SiRNA target sequence
agaagagaataaatatttttttt

SEQ ID NO: 187839 - DNA, 23 bp, Artificial sequence
  SiRNA target sequence
gaagagaataaatattttttttg

SEQ ID NO: 187840 - DNA, 23 bp, Artificial sequence
  SiRNA target sequence
aagagaataaatattttttttga

SEQ ID NO: 187841 - DNA, 24 bp, Artificial sequence
  SiRNA target sequence
atggccaagaatgaatctaataaa

SEQ ID NO: 187842 - DNA, 24 bp, Artificial sequence
  SiRNA target sequence
tggccaagaatgaatctaataaaa

SEQ ID NO: 187843 - DNA, 24 bp, Artificial sequence
  SiRNA target sequence
ggccaagaatgaatctaataaaat

SEQ ID NO: 187844 - DNA, 24 bp, Artificial sequence
  SiRNA target sequence
gccaagaatgaatctaataaaata

SEQ ID NO: 187845 - DNA, 24 bp, Artificial sequence
  SiRNA target sequence
ccaagaatgaatctaataaaataa

SEQ ID NO: 187846 - DNA, 24 bp, Artificial sequence
  SiRNA target sequence
caagaatgaatctaataaaataac

SEQ ID NO: 187847 - DNA, 24 bp, Artificial sequence
  SiRNA target sequence
aagaatgaatctaataaaataacg

SEQ ID NO: 187848 - DNA, 24 bp, Artificial sequence
  SiRNA target sequence
agaatgaatctaataaaataacga

SEQ ID NO: 187849 - DNA, 24 bp, Artificial sequence
  SiRNA target sequence
gaatgaatctaataaaataacgag

SEQ ID NO: 187850 - DNA, 24 bp, Artificial sequence
  SiRNA target sequence
aatgaatctaataaaataacgaga

SEQ ID NO: 187851 - DNA, 24 bp, Artificial sequence
  SiRNA target sequence
atgaatctaataaaataacgagac

SEQ ID NO: 187852 - DNA, 24 bp, Artificial sequence
  SiRNA target sequence
tgaatctaataaaataacgagact

SEQ ID NO: 187853 - DNA, 24 bp, Artificial sequence
  SiRNA target sequence
gaatctaataaaataacgagactg

SEQ ID NO: 187854 - DNA, 24 bp, Artificial sequence
  SiRNA target sequence
aatctaataaaataacgagactgg

SEQ ID NO: 187855 - DNA, 24 bp, Artificial sequence
  SiRNA target sequence
atctaataaaataacgagactggc

SEQ ID NO: 187856 - DNA, 24 bp, Artificial sequence
  SiRNA target sequence
tctaataaaataacgagactggca

SEQ ID NO: 187857 - DNA, 24 bp, Artificial sequence
  SiRNA target sequence
ctaataaaataacgagactggcaa

SEQ ID NO: 187858 - DNA, 24 bp, Artificial sequence
  SiRNA target sequence
taataaaataacgagactggcaat

SEQ ID NO: 187859 - DNA, 24 bp, Artificial sequence
  SiRNA target sequence
aataaaataacgagactggcaatt

SEQ ID NO: 187860 - DNA, 24 bp, Artificial sequence
  SiRNA target sequence
ataaaataacgagactggcaattg

SEQ ID NO: 187861 - DNA, 24 bp, Artificial sequence
  SiRNA target sequence
taaaataacgagactggcaattgt

SEQ ID NO: 187862 - DNA, 24 bp, Artificial sequence
  SiRNA target sequence
aaaataacgagactggcaattgtt

SEQ ID NO: 187863 - DNA, 24 bp, Artificial sequence
  SiRNA target sequence
aaataacgagactggcaattgtta

SEQ ID NO: 187864 - DNA, 24 bp, Artificial sequence
  SiRNA target sequence
aataacgagactggcaattgttaa

SEQ ID NO: 187865 - DNA, 24 bp, Artificial sequence
  SiRNA target sequence
ataacgagactggcaattgttaat

SEQ ID NO: 187866 - DNA, 24 bp, Artificial sequence
  SiRNA target sequence
taacgagactggcaattgttaatt

SEQ ID NO: 187867 - DNA, 24 bp, Artificial sequence
  SiRNA target sequence
aacgagactggcaattgttaatta

SEQ ID NO: 187868 - DNA, 24 bp, Artificial sequence
  SiRNA target sequence
acgagactggcaattgttaattat

SEQ ID NO: 187869 - DNA, 24 bp, Artificial sequence
  SiRNA target sequence
cgagactggcaattgttaattatg

SEQ ID NO: 187870 - DNA, 24 bp, Artificial sequence
  SiRNA target sequence
gagactggcaattgttaattatga

SEQ ID NO: 187871 - DNA, 24 bp, Artificial sequence
  SiRNA target sequence
agactggcaattgttaattatgaa

SEQ ID NO: 187872 - DNA, 24 bp, Artificial sequence
  SiRNA target sequence
gactggcaattgttaattatgaac

SEQ ID NO: 187873 - DNA, 24 bp, Artificial sequence
  SiRNA target sequence
actggcaattgttaattatgaact

SEQ ID NO: 187874 - DNA, 24 bp, Artificial sequence
  SiRNA target sequence
ctggcaattgttaattatgaacta

SEQ ID NO: 187875 - DNA, 24 bp, Artificial sequence
  SiRNA target sequence
tggcaattgttaattatgaactat

SEQ ID NO: 187876 - DNA, 24 bp, Artificial sequence
  SiRNA target sequence
ggcaattgttaattatgaactatg

SEQ ID NO: 187877 - DNA, 24 bp, Artificial sequence
  SiRNA target sequence
gcaattgttaattatgaactatgt

SEQ ID NO: 187878 - DNA, 24 bp, Artificial sequence
  SiRNA target sequence
caattgttaattatgaactatgta

SEQ ID NO: 187879 - DNA, 24 bp, Artificial sequence
  SiRNA target sequence
aattgttaattatgaactatgtaa

SEQ ID NO: 187880 - DNA, 24 bp, Artificial sequence
  SiRNA target sequence
attgttaattatgaactatgtaaa

SEQ ID NO: 187881 - DNA, 24 bp, Artificial sequence
  SiRNA target sequence
ttgttaattatgaactatgtaaac

SEQ ID NO: 187882 - DNA, 24 bp, Artificial sequence
  SiRNA target sequence
tgttaattatgaactatgtaaacc

SEQ ID NO: 187883 - DNA, 24 bp, Artificial sequence
  SiRNA target sequence
gttaattatgaactatgtaaaccg

SEQ ID NO: 187884 - DNA, 24 bp, Artificial sequence
  SiRNA target sequence
ttaattatgaactatgtaaaccga

SEQ ID NO: 187885 - DNA, 24 bp, Artificial sequence
  SiRNA target sequence
taattatgaactatgtaaaccgaa

SEQ ID NO: 187886 - DNA, 24 bp, Artificial sequence
  SiRNA target sequence
aattatgaactatgtaaaccgaag

SEQ ID NO: 187887 - DNA, 24 bp, Artificial sequence
  SiRNA target sequence
attatgaactatgtaaaccgaagg

SEQ ID NO: 187888 - DNA, 24 bp, Artificial sequence
  SiRNA target sequence
ttatgaactatgtaaaccgaagga

SEQ ID NO: 187889 - DNA, 24 bp, Artificial sequence
  SiRNA target sequence
tatgaactatgtaaaccgaaggaa

SEQ ID NO: 187890 - DNA, 24 bp, Artificial sequence
  SiRNA target sequence
atgaactatgtaaaccgaaggaat

SEQ ID NO: 187891 - DNA, 24 bp, Artificial sequence
  SiRNA target sequence
tgaactatgtaaaccgaaggaatg

SEQ ID NO: 187892 - DNA, 24 bp, Artificial sequence
  SiRNA target sequence
gaactatgtaaaccgaaggaatgt

SEQ ID NO: 187893 - DNA, 24 bp, Artificial sequence
  SiRNA target sequence
aactatgtaaaccgaaggaatgta

SEQ ID NO: 187894 - DNA, 24 bp, Artificial sequence
  SiRNA target sequence
actatgtaaaccgaaggaatgtat

SEQ ID NO: 187895 - DNA, 24 bp, Artificial sequence
  SiRNA target sequence
ctatgtaaaccgaaggaatgtatg

SEQ ID NO: 187896 - DNA, 24 bp, Artificial sequence
  SiRNA target sequence
tatgtaaaccgaaggaatgtatgt

SEQ ID NO: 187897 - DNA, 24 bp, Artificial sequence
  SiRNA target sequence
atgtaaaccgaaggaatgtatgtc

SEQ ID NO: 187898 - DNA, 24 bp, Artificial sequence
  SiRNA target sequence
tgtaaaccgaaggaatgtatgtca

SEQ ID NO: 187899 - DNA, 24 bp, Artificial sequence
  SiRNA target sequence
gtaaaccgaaggaatgtatgtcag

SEQ ID NO: 187900 - DNA, 24 bp, Artificial sequence
  SiRNA target sequence
taaaccgaaggaatgtatgtcaga

SEQ ID NO: 187901 - DNA, 24 bp, Artificial sequence
  SiRNA target sequence
aaaccgaaggaatgtatgtcagaa

SEQ ID NO: 187902 - DNA, 24 bp, Artificial sequence
  SiRNA target sequence
aaccgaaggaatgtatgtcagaat

SEQ ID NO: 187903 - DNA, 24 bp, Artificial sequence
  SiRNA target sequence
accgaaggaatgtatgtcagaatg

SEQ ID NO: 187904 - DNA, 24 bp, Artificial sequence
  SiRNA target sequence
ccgaaggaatgtatgtcagaatgt

SEQ ID NO: 187905 - DNA, 24 bp, Artificial sequence
  SiRNA target sequence
cgaaggaatgtatgtcagaatgta

SEQ ID NO: 187906 - DNA, 24 bp, Artificial sequence
  SiRNA target sequence
gaaggaatgtatgtcagaatgtaa

SEQ ID NO: 187907 - DNA, 24 bp, Artificial sequence
  SiRNA target sequence
aaggaatgtatgtcagaatgtaaa

SEQ ID NO: 187908 - DNA, 24 bp, Artificial sequence
  SiRNA target sequence
aggaatgtatgtcagaatgtaaaa

SEQ ID NO: 187909 - DNA, 24 bp, Artificial sequence
  SiRNA target sequence
ggaatgtatgtcagaatgtaaaaa

SEQ ID NO: 187910 - DNA, 24 bp, Artificial sequence
  SiRNA target sequence
gaatgtatgtcagaatgtaaaaag

SEQ ID NO: 187911 - DNA, 24 bp, Artificial sequence
  SiRNA target sequence
aatgtatgtcagaatgtaaaaagg

SEQ ID NO: 187912 - DNA, 24 bp, Artificial sequence
  SiRNA target sequence
atgtatgtcagaatgtaaaaaggc

SEQ ID NO: 187913 - DNA, 24 bp, Artificial sequence
  SiRNA target sequence
tgtatgtcagaatgtaaaaaggcg

SEQ ID NO: 187914 - DNA, 24 bp, Artificial sequence
  SiRNA target sequence
gtatgtcagaatgtaaaaaggcgt

SEQ ID NO: 187915 - DNA, 24 bp, Artificial sequence
  SiRNA target sequence
tatgtcagaatgtaaaaaggcgtg

SEQ ID NO: 187916 - DNA, 24 bp, Artificial sequence
  SiRNA target sequence
atgtcagaatgtaaaaaggcgtgt

SEQ ID NO: 187917 - DNA, 24 bp, Artificial sequence
  SiRNA target sequence
tgtcagaatgtaaaaaggcgtgtc

SEQ ID NO: 187918 - DNA, 24 bp, Artificial sequence
  SiRNA target sequence
gtcagaatgtaaaaaggcgtgtcc

SEQ ID NO: 187919 - DNA, 24 bp, Artificial sequence
  SiRNA target sequence
tcagaatgtaaaaaggcgtgtcct

SEQ ID NO: 187920 - DNA, 24 bp, Artificial sequence
  SiRNA target sequence
cagaatgtaaaaaggcgtgtcctg

SEQ ID NO: 187921 - DNA, 24 bp, Artificial sequence
  SiRNA target sequence
agaatgtaaaaaggcgtgtcctgt

SEQ ID NO: 187922 - DNA, 24 bp, Artificial sequence
  SiRNA target sequence
gaatgtaaaaaggcgtgtcctgtt

SEQ ID NO: 187923 - DNA, 24 bp, Artificial sequence
  SiRNA target sequence
aatgtaaaaaggcgtgtcctgtta

SEQ ID NO: 187924 - DNA, 24 bp, Artificial sequence
  SiRNA target sequence
atgtaaaaaggcgtgtcctgttaa

SEQ ID NO: 187925 - DNA, 24 bp, Artificial sequence
  SiRNA target sequence
tgtaaaaaggcgtgtcctgttaat

SEQ ID NO: 187926 - DNA, 24 bp, Artificial sequence
  SiRNA target sequence
gtaaaaaggcgtgtcctgttaata

SEQ ID NO: 187927 - DNA, 24 bp, Artificial sequence
  SiRNA target sequence
taaaaaggcgtgtcctgttaataa

SEQ ID NO: 187928 - DNA, 24 bp, Artificial sequence
  SiRNA target sequence
aaaaaggcgtgtcctgttaataaa

SEQ ID NO: 187929 - DNA, 24 bp, Artificial sequence
  SiRNA target sequence
aaaaggcgtgtcctgttaataaaa

SEQ ID NO: 187930 - DNA, 24 bp, Artificial sequence
  SiRNA target sequence
aaaggcgtgtcctgttaataaaac

SEQ ID NO: 187931 - DNA, 24 bp, Artificial sequence
  SiRNA target sequence
aaggcgtgtcctgttaataaaaca

SEQ ID NO: 187932 - DNA, 24 bp, Artificial sequence
  SiRNA target sequence
aggcgtgtcctgttaataaaacag

SEQ ID NO: 187933 - DNA, 24 bp, Artificial sequence
  SiRNA target sequence
ggcgtgtcctgttaataaaacagg

SEQ ID NO: 187934 - DNA, 24 bp, Artificial sequence
  SiRNA target sequence
gcgtgtcctgttaataaaacagga

SEQ ID NO: 187935 - DNA, 24 bp, Artificial sequence
  SiRNA target sequence
cgtgtcctgttaataaaacaggaa

SEQ ID NO: 187936 - DNA, 24 bp, Artificial sequence
  SiRNA target sequence
gtgtcctgttaataaaacaggaaa

SEQ ID NO: 187937 - DNA, 24 bp, Artificial sequence
  SiRNA target sequence
tgtcctgttaataaaacaggaaag

SEQ ID NO: 187938 - DNA, 24 bp, Artificial sequence
  SiRNA target sequence
gtcctgttaataaaacaggaaagg

SEQ ID NO: 187939 - DNA, 24 bp, Artificial sequence
  SiRNA target sequence
tcctgttaataaaacaggaaagga

SEQ ID NO: 187940 - DNA, 24 bp, Artificial sequence
  SiRNA target sequence
cctgttaataaaacaggaaaggag

SEQ ID NO: 187941 - DNA, 24 bp, Artificial sequence
  SiRNA target sequence
ctgttaataaaacaggaaaggagt

SEQ ID NO: 187942 - DNA, 24 bp, Artificial sequence
  SiRNA target sequence
tgttaataaaacaggaaaggagtg

SEQ ID NO: 187943 - DNA, 24 bp, Artificial sequence
  SiRNA target sequence
gttaataaaacaggaaaggagtgt

SEQ ID NO: 187944 - DNA, 24 bp, Artificial sequence
  SiRNA target sequence
ttaataaaacaggaaaggagtgta

SEQ ID NO: 187945 - DNA, 24 bp, Artificial sequence
  SiRNA target sequence
taataaaacaggaaaggagtgtat

SEQ ID NO: 187946 - DNA, 24 bp, Artificial sequence
  SiRNA target sequence
aataaaacaggaaaggagtgtatt

SEQ ID NO: 187947 - DNA, 24 bp, Artificial sequence
  SiRNA target sequence
ataaaacaggaaaggagtgtatta

SEQ ID NO: 187948 - DNA, 24 bp, Artificial sequence
  SiRNA target sequence
taaaacaggaaaggagtgtattac

SEQ ID NO: 187949 - DNA, 24 bp, Artificial sequence
  SiRNA target sequence
aaaacaggaaaggagtgtattaca

SEQ ID NO: 187950 - DNA, 24 bp, Artificial sequence
  SiRNA target sequence
aaacaggaaaggagtgtattacaa

SEQ ID NO: 187951 - DNA, 24 bp, Artificial sequence
  SiRNA target sequence
aacaggaaaggagtgtattacaat

SEQ ID NO: 187952 - DNA, 24 bp, Artificial sequence
  SiRNA target sequence
acaggaaaggagtgtattacaatt

SEQ ID NO: 187953 - DNA, 24 bp, Artificial sequence
  SiRNA target sequence
caggaaaggagtgtattacaattg

SEQ ID NO: 187954 - DNA, 24 bp, Artificial sequence
  SiRNA target sequence
aggaaaggagtgtattacaattga

SEQ ID NO: 187955 - DNA, 24 bp, Artificial sequence
  SiRNA target sequence
ggaaaggagtgtattacaattgat

SEQ ID NO: 187956 - DNA, 24 bp, Artificial sequence
  SiRNA target sequence
gaaaggagtgtattacaattgata

SEQ ID NO: 187957 - DNA, 24 bp, Artificial sequence
  SiRNA target sequence
aaaggagtgtattacaattgatac

SEQ ID NO: 187958 - DNA, 24 bp, Artificial sequence
  SiRNA target sequence
aaggagtgtattacaattgatact

SEQ ID NO: 187959 - DNA, 24 bp, Artificial sequence
  SiRNA target sequence
aggagtgtattacaattgatacta

SEQ ID NO: 187960 - DNA, 24 bp, Artificial sequence
  SiRNA target sequence
ggagtgtattacaattgatactaa

SEQ ID NO: 187961 - DNA, 24 bp, Artificial sequence
  SiRNA target sequence
gagtgtattacaattgatactaaa

SEQ ID NO: 187962 - DNA, 24 bp, Artificial sequence
  SiRNA target sequence
agtgtattacaattgatactaaat

SEQ ID NO: 187963 - DNA, 24 bp, Artificial sequence
  SiRNA target sequence
gtgtattacaattgatactaaatc

SEQ ID NO: 187964 - DNA, 24 bp, Artificial sequence
  SiRNA target sequence
tgtattacaattgatactaaatca

SEQ ID NO: 187965 - DNA, 24 bp, Artificial sequence
  SiRNA target sequence
gtattacaattgatactaaatcac

SEQ ID NO: 187966 - DNA, 24 bp, Artificial sequence
  SiRNA target sequence
tattacaattgatactaaatcaca

SEQ ID NO: 187967 - DNA, 24 bp, Artificial sequence
  SiRNA target sequence
attacaattgatactaaatcacat

SEQ ID NO: 187968 - DNA, 24 bp, Artificial sequence
  SiRNA target sequence
ttacaattgatactaaatcacata

SEQ ID NO: 187969 - DNA, 24 bp, Artificial sequence
  SiRNA target sequence
tacaattgatactaaatcacatat

SEQ ID NO: 187970 - DNA, 24 bp, Artificial sequence
  SiRNA target sequence
acaattgatactaaatcacatatc

SEQ ID NO: 187971 - DNA, 24 bp, Artificial sequence
  SiRNA target sequence
caattgatactaaatcacatatct

SEQ ID NO: 187972 - DNA, 24 bp, Artificial sequence
  SiRNA target sequence
aattgatactaaatcacatatctc

SEQ ID NO: 187973 - DNA, 24 bp, Artificial sequence
  SiRNA target sequence
attgatactaaatcacatatctca

SEQ ID NO: 187974 - DNA, 24 bp, Artificial sequence
  SiRNA target sequence
ttgatactaaatcacatatctcag

SEQ ID NO: 187975 - DNA, 24 bp, Artificial sequence
  SiRNA target sequence
tgatactaaatcacatatctcaga

SEQ ID NO: 187976 - DNA, 24 bp, Artificial sequence
  SiRNA target sequence
gatactaaatcacatatctcagaa

SEQ ID NO: 187977 - DNA, 24 bp, Artificial sequence
  SiRNA target sequence
atactaaatcacatatctcagaaa

SEQ ID NO: 187978 - DNA, 24 bp, Artificial sequence
  SiRNA target sequence
tactaaatcacatatctcagaaat

SEQ ID NO: 187979 - DNA, 24 bp, Artificial sequence
  SiRNA target sequence
actaaatcacatatctcagaaatt

SEQ ID NO: 187980 - DNA, 24 bp, Artificial sequence
  SiRNA target sequence
ctaaatcacatatctcagaaattc

SEQ ID NO: 187981 - DNA, 24 bp, Artificial sequence
  SiRNA target sequence
taaatcacatatctcagaaattct

SEQ ID NO: 187982 - DNA, 24 bp, Artificial sequence
  SiRNA target sequence
aaatcacatatctcagaaattctg

SEQ ID NO: 187983 - DNA, 24 bp, Artificial sequence
  SiRNA target sequence
aatcacatatctcagaaattctgt

SEQ ID NO: 187984 - DNA, 24 bp, Artificial sequence
  SiRNA target sequence
atcacatatctcagaaattctgtg

SEQ ID NO: 187985 - DNA, 24 bp, Artificial sequence
  SiRNA target sequence
tcacatatctcagaaattctgtgt

SEQ ID NO: 187986 - DNA, 24 bp, Artificial sequence
  SiRNA target sequence
cacatatctcagaaattctgtgta

SEQ ID NO: 187987 - DNA, 24 bp, Artificial sequence
  SiRNA target sequence
acatatctcagaaattctgtgtat

SEQ ID NO: 187988 - DNA, 24 bp, Artificial sequence
  SiRNA target sequence
catatctcagaaattctgtgtata

SEQ ID NO: 187989 - DNA, 24 bp, Artificial sequence
  SiRNA target sequence
atatctcagaaattctgtgtatag

SEQ ID NO: 187990 - DNA, 24 bp, Artificial sequence
  SiRNA target sequence
tatctcagaaattctgtgtatagg

SEQ ID NO: 187991 - DNA, 24 bp, Artificial sequence
  SiRNA target sequence
atctcagaaattctgtgtatagga

SEQ ID NO: 187992 - DNA, 24 bp, Artificial sequence
  SiRNA target sequence
tctcagaaattctgtgtataggat

SEQ ID NO: 187993 - DNA, 24 bp, Artificial sequence
  SiRNA target sequence
ctcagaaattctgtgtataggatg

SEQ ID NO: 187994 - DNA, 24 bp, Artificial sequence
  SiRNA target sequence
tcagaaattctgtgtataggatgt

SEQ ID NO: 187995 - DNA, 24 bp, Artificial sequence
  SiRNA target sequence
cagaaattctgtgtataggatgtt

SEQ ID NO: 187996 - DNA, 24 bp, Artificial sequence
  SiRNA target sequence
agaaattctgtgtataggatgttc

SEQ ID NO: 187997 - DNA, 24 bp, Artificial sequence
  SiRNA target sequence
gaaattctgtgtataggatgttct

SEQ ID NO: 187998 - DNA, 24 bp, Artificial sequence
  SiRNA target sequence
aaattctgtgtataggatgttctg

SEQ ID NO: 187999 - DNA, 24 bp, Artificial sequence
  SiRNA target sequence
aattctgtgtataggatgttctgc

SEQ ID NO: 188000 - DNA, 24 bp, Artificial sequence
  SiRNA target sequence
attctgtgtataggatgttctgcg

SEQ ID NO: 188001 - DNA, 24 bp, Artificial sequence
  SiRNA target sequence
ttctgtgtataggatgttctgcgt

SEQ ID NO: 188002 - DNA, 24 bp, Artificial sequence
  SiRNA target sequence
tctgtgtataggatgttctgcgtg

SEQ ID NO: 188003 - DNA, 24 bp, Artificial sequence
  SiRNA target sequence
ctgtgtataggatgttctgcgtgt

SEQ ID NO: 188004 - DNA, 24 bp, Artificial sequence
  SiRNA target sequence
tgtgtataggatgttctgcgtgtc

SEQ ID NO: 188005 - DNA, 24 bp, Artificial sequence
  SiRNA target sequence
gtgtataggatgttctgcgtgtca

SEQ ID NO: 188006 - DNA, 24 bp, Artificial sequence
  SiRNA target sequence
tgtataggatgttctgcgtgtcaa

SEQ ID NO: 188007 - DNA, 24 bp, Artificial sequence
  SiRNA target sequence
gtataggatgttctgcgtgtcaaa

SEQ ID NO: 188008 - DNA, 24 bp, Artificial sequence
  SiRNA target sequence
tataggatgttctgcgtgtcaaaa

SEQ ID NO: 188009 - DNA, 24 bp, Artificial sequence
  SiRNA target sequence
ataggatgttctgcgtgtcaaaag

SEQ ID NO: 188010 - DNA, 24 bp, Artificial sequence
  SiRNA target sequence
taggatgttctgcgtgtcaaaaga

SEQ ID NO: 188011 - DNA, 24 bp, Artificial sequence
  SiRNA target sequence
aggatgttctgcgtgtcaaaagaa

SEQ ID NO: 188012 - DNA, 24 bp, Artificial sequence
  SiRNA target sequence
ggatgttctgcgtgtcaaaagaaa

SEQ ID NO: 188013 - DNA, 24 bp, Artificial sequence
  SiRNA target sequence
gatgttctgcgtgtcaaaagaaat

SEQ ID NO: 188014 - DNA, 24 bp, Artificial sequence
  SiRNA target sequence
atgttctgcgtgtcaaaagaaatg

SEQ ID NO: 188015 - DNA, 24 bp, Artificial sequence
  SiRNA target sequence
tgttctgcgtgtcaaaagaaatgt

SEQ ID NO: 188016 - DNA, 24 bp, Artificial sequence
  SiRNA target sequence
gttctgcgtgtcaaaagaaatgtc

SEQ ID NO: 188017 - DNA, 24 bp, Artificial sequence
  SiRNA target sequence
ttctgcgtgtcaaaagaaatgtcc

SEQ ID NO: 188018 - DNA, 24 bp, Artificial sequence
  SiRNA target sequence
tctgcgtgtcaaaagaaatgtcct

SEQ ID NO: 188019 - DNA, 24 bp, Artificial sequence
  SiRNA target sequence
ctgcgtgtcaaaagaaatgtcctt

SEQ ID NO: 188020 - DNA, 24 bp, Artificial sequence
  SiRNA target sequence
tgcgtgtcaaaagaaatgtccttt

SEQ ID NO: 188021 - DNA, 24 bp, Artificial sequence
  SiRNA target sequence
gcgtgtcaaaagaaatgtcctttt

SEQ ID NO: 188022 - DNA, 24 bp, Artificial sequence
  SiRNA target sequence
cgtgtcaaaagaaatgtcctttta

SEQ ID NO: 188023 - DNA, 24 bp, Artificial sequence
  SiRNA target sequence
gtgtcaaaagaaatgtccttttaa

SEQ ID NO: 188024 - DNA, 24 bp, Artificial sequence
  SiRNA target sequence
tgtcaaaagaaatgtccttttaag

SEQ ID NO: 188025 - DNA, 24 bp, Artificial sequence
  SiRNA target sequence
gtcaaaagaaatgtccttttaagg

SEQ ID NO: 188026 - DNA, 24 bp, Artificial sequence
  SiRNA target sequence
tcaaaagaaatgtccttttaaggc

SEQ ID NO: 188027 - DNA, 24 bp, Artificial sequence
  SiRNA target sequence
caaaagaaatgtccttttaaggcg

SEQ ID NO: 188028 - DNA, 24 bp, Artificial sequence
  SiRNA target sequence
aaaagaaatgtccttttaaggcga

SEQ ID NO: 188029 - DNA, 24 bp, Artificial sequence
  SiRNA target sequence
aaagaaatgtccttttaaggcgat

SEQ ID NO: 188030 - DNA, 24 bp, Artificial sequence
  SiRNA target sequence
aagaaatgtccttttaaggcgatt

SEQ ID NO: 188031 - DNA, 24 bp, Artificial sequence
  SiRNA target sequence
agaaatgtccttttaaggcgatta

SEQ ID NO: 188032 - DNA, 24 bp, Artificial sequence
  SiRNA target sequence
gaaatgtccttttaaggcgattac

SEQ ID NO: 188033 - DNA, 24 bp, Artificial sequence
  SiRNA target sequence
aaatgtccttttaaggcgattaca

SEQ ID NO: 188034 - DNA, 24 bp, Artificial sequence
  SiRNA target sequence
aatgtccttttaaggcgattacaa

SEQ ID NO: 188035 - DNA, 24 bp, Artificial sequence
  SiRNA target sequence
atgtccttttaaggcgattacaat

SEQ ID NO: 188036 - DNA, 24 bp, Artificial sequence
  SiRNA target sequence
tgtccttttaaggcgattacaatt

SEQ ID NO: 188037 - DNA, 24 bp, Artificial sequence
  SiRNA target sequence
gtccttttaaggcgattacaattg

SEQ ID NO: 188038 - DNA, 24 bp, Artificial sequence
  SiRNA target sequence
tccttttaaggcgattacaattgt

SEQ ID NO: 188039 - DNA, 24 bp, Artificial sequence
  SiRNA target sequence
ccttttaaggcgattacaattgta

SEQ ID NO: 188040 - DNA, 24 bp, Artificial sequence
  SiRNA target sequence
cttttaaggcgattacaattgtaa

SEQ ID NO: 188041 - DNA, 24 bp, Artificial sequence
  SiRNA target sequence
ttttaaggcgattacaattgtaaa

SEQ ID NO: 188042 - DNA, 24 bp, Artificial sequence
  SiRNA target sequence
tttaaggcgattacaattgtaaat

SEQ ID NO: 188043 - DNA, 24 bp, Artificial sequence
  SiRNA target sequence
ttaaggcgattacaattgtaaatt

SEQ ID NO: 188044 - DNA, 24 bp, Artificial sequence
  SiRNA target sequence
taaggcgattacaattgtaaattt

SEQ ID NO: 188045 - DNA, 24 bp, Artificial sequence
  SiRNA target sequence
aaggcgattacaattgtaaattta

SEQ ID NO: 188046 - DNA, 24 bp, Artificial sequence
  SiRNA target sequence
aggcgattacaattgtaaatttac

SEQ ID NO: 188047 - DNA, 24 bp, Artificial sequence
  SiRNA target sequence
ggcgattacaattgtaaatttacc

SEQ ID NO: 188048 - DNA, 24 bp, Artificial sequence
  SiRNA target sequence
gcgattacaattgtaaatttacct

SEQ ID NO: 188049 - DNA, 24 bp, Artificial sequence
  SiRNA target sequence
cgattacaattgtaaatttaccta

SEQ ID NO: 188050 - DNA, 24 bp, Artificial sequence
  SiRNA target sequence
gattacaattgtaaatttacctac

SEQ ID NO: 188051 - DNA, 24 bp, Artificial sequence
  SiRNA target sequence
attacaattgtaaatttacctaca

SEQ ID NO: 188052 - DNA, 24 bp, Artificial sequence
  SiRNA target sequence
ttacaattgtaaatttacctacaa

SEQ ID NO: 188053 - DNA, 24 bp, Artificial sequence
  SiRNA target sequence
tacaattgtaaatttacctacaaa

SEQ ID NO: 188054 - DNA, 24 bp, Artificial sequence
  SiRNA target sequence
acaattgtaaatttacctacaaat

SEQ ID NO: 188055 - DNA, 24 bp, Artificial sequence
  SiRNA target sequence
caattgtaaatttacctacaaatc

SEQ ID NO: 188056 - DNA, 24 bp, Artificial sequence
  SiRNA target sequence
aattgtaaatttacctacaaatct

SEQ ID NO: 188057 - DNA, 24 bp, Artificial sequence
  SiRNA target sequence
attgtaaatttacctacaaatcta

SEQ ID NO: 188058 - DNA, 24 bp, Artificial sequence
  SiRNA target sequence
ttgtaaatttacctacaaatctag

SEQ ID NO: 188059 - DNA, 24 bp, Artificial sequence
  SiRNA target sequence
tgtaaatttacctacaaatctaga

SEQ ID NO: 188060 - DNA, 24 bp, Artificial sequence
  SiRNA target sequence
gtaaatttacctacaaatctagat

SEQ ID NO: 188061 - DNA, 24 bp, Artificial sequence
  SiRNA target sequence
taaatttacctacaaatctagata

SEQ ID NO: 188062 - DNA, 24 bp, Artificial sequence
  SiRNA target sequence
aaatttacctacaaatctagataa

SEQ ID NO: 188063 - DNA, 24 bp, Artificial sequence
  SiRNA target sequence
aatttacctacaaatctagataaa

SEQ ID NO: 188064 - DNA, 24 bp, Artificial sequence
  SiRNA target sequence
atttacctacaaatctagataaag

SEQ ID NO: 188065 - DNA, 24 bp, Artificial sequence
  SiRNA target sequence
tttacctacaaatctagataaaga

SEQ ID NO: 188066 - DNA, 24 bp, Artificial sequence
  SiRNA target sequence
ttacctacaaatctagataaagac

SEQ ID NO: 188067 - DNA, 24 bp, Artificial sequence
  SiRNA target sequence
tacctacaaatctagataaagaca

SEQ ID NO: 188068 - DNA, 24 bp, Artificial sequence
  SiRNA target sequence
acctacaaatctagataaagacat

SEQ ID NO: 188069 - DNA, 24 bp, Artificial sequence
  SiRNA target sequence
cctacaaatctagataaagacatt

SEQ ID NO: 188070 - DNA, 24 bp, Artificial sequence
  SiRNA target sequence
ctacaaatctagataaagacattt

SEQ ID NO: 188071 - DNA, 24 bp, Artificial sequence
  SiRNA target sequence
tacaaatctagataaagacatttc

SEQ ID NO: 188072 - DNA, 24 bp, Artificial sequence
  SiRNA target sequence
acaaatctagataaagacatttca

SEQ ID NO: 188073 - DNA, 24 bp, Artificial sequence
  SiRNA target sequence
caaatctagataaagacatttcac

SEQ ID NO: 188074 - DNA, 24 bp, Artificial sequence
  SiRNA target sequence
aaatctagataaagacatttcaca

SEQ ID NO: 188075 - DNA, 24 bp, Artificial sequence
  SiRNA target sequence
aatctagataaagacatttcacat

SEQ ID NO: 188076 - DNA, 24 bp, Artificial sequence
  SiRNA target sequence
atctagataaagacatttcacata

SEQ ID NO: 188077 - DNA, 24 bp, Artificial sequence
  SiRNA target sequence
tctagataaagacatttcacatag

SEQ ID NO: 188078 - DNA, 24 bp, Artificial sequence
  SiRNA target sequence
ctagataaagacatttcacataga

SEQ ID NO: 188079 - DNA, 24 bp, Artificial sequence
  SiRNA target sequence
tagataaagacatttcacatagat

SEQ ID NO: 188080 - DNA, 24 bp, Artificial sequence
  SiRNA target sequence
agataaagacatttcacatagata

SEQ ID NO: 188081 - DNA, 24 bp, Artificial sequence
  SiRNA target sequence
gataaagacatttcacatagatat

SEQ ID NO: 188082 - DNA, 24 bp, Artificial sequence
  SiRNA target sequence
ataaagacatttcacatagatatt

SEQ ID NO: 188083 - DNA, 24 bp, Artificial sequence
  SiRNA target sequence
taaagacatttcacatagatattc

SEQ ID NO: 188084 - DNA, 24 bp, Artificial sequence
  SiRNA target sequence
aaagacatttcacatagatattcg

SEQ ID NO: 188085 - DNA, 24 bp, Artificial sequence
  SiRNA target sequence
aagacatttcacatagatattcgg

SEQ ID NO: 188086 - DNA, 24 bp, Artificial sequence
  SiRNA target sequence
agacatttcacatagatattcggc

SEQ ID NO: 188087 - DNA, 24 bp, Artificial sequence
  SiRNA target sequence
gacatttcacatagatattcggca

SEQ ID NO: 188088 - DNA, 24 bp, Artificial sequence
  SiRNA target sequence
acatttcacatagatattcggcaa

SEQ ID NO: 188089 - DNA, 24 bp, Artificial sequence
  SiRNA target sequence
catttcacatagatattcggcaaa

SEQ ID NO: 188090 - DNA, 24 bp, Artificial sequence
  SiRNA target sequence
atttcacatagatattcggcaaat

SEQ ID NO: 188091 - DNA, 24 bp, Artificial sequence
  SiRNA target sequence
tttcacatagatattcggcaaatg

SEQ ID NO: 188092 - DNA, 24 bp, Artificial sequence
  SiRNA target sequence
ttcacatagatattcggcaaatgg

SEQ ID NO: 188093 - DNA, 24 bp, Artificial sequence
  SiRNA target sequence
tcacatagatattcggcaaatggt

SEQ ID NO: 188094 - DNA, 24 bp, Artificial sequence
  SiRNA target sequence
cacatagatattcggcaaatggtt

SEQ ID NO: 188095 - DNA, 24 bp, Artificial sequence
  SiRNA target sequence
acatagatattcggcaaatggttt

SEQ ID NO: 188096 - DNA, 24 bp, Artificial sequence
  SiRNA target sequence
catagatattcggcaaatggtttt

SEQ ID NO: 188097 - DNA, 24 bp, Artificial sequence
  SiRNA target sequence
atagatattcggcaaatggtttta

SEQ ID NO: 188098 - DNA, 24 bp, Artificial sequence
  SiRNA target sequence
tagatattcggcaaatggttttaa

SEQ ID NO: 188099 - DNA, 24 bp, Artificial sequence
  SiRNA target sequence
agatattcggcaaatggttttaaa

SEQ ID NO: 188100 - DNA, 24 bp, Artificial sequence
  SiRNA target sequence
gatattcggcaaatggttttaaac

SEQ ID NO: 188101 - DNA, 24 bp, Artificial sequence
  SiRNA target sequence
atattcggcaaatggttttaaact

SEQ ID NO: 188102 - DNA, 24 bp, Artificial sequence
  SiRNA target sequence
tattcggcaaatggttttaaactt

SEQ ID NO: 188103 - DNA, 24 bp, Artificial sequence
  SiRNA target sequence
attcggcaaatggttttaaacttc

SEQ ID NO: 188104 - DNA, 24 bp, Artificial sequence
  SiRNA target sequence
ttcggcaaatggttttaaacttca

SEQ ID NO: 188105 - DNA, 24 bp, Artificial sequence
  SiRNA target sequence
tcggcaaatggttttaaacttcac

SEQ ID NO: 188106 - DNA, 24 bp, Artificial sequence
  SiRNA target sequence
cggcaaatggttttaaacttcaca

SEQ ID NO: 188107 - DNA, 24 bp, Artificial sequence
  SiRNA target sequence
ggcaaatggttttaaacttcacag

SEQ ID NO: 188108 - DNA, 24 bp, Artificial sequence
  SiRNA target sequence
gcaaatggttttaaacttcacaga

SEQ ID NO: 188109 - DNA, 24 bp, Artificial sequence
  SiRNA target sequence
caaatggttttaaacttcacagat

SEQ ID NO: 188110 - DNA, 24 bp, Artificial sequence
  SiRNA target sequence
aaatggttttaaacttcacagatt

SEQ ID NO: 188111 - DNA, 24 bp, Artificial sequence
  SiRNA target sequence
aatggttttaaacttcacagatta

SEQ ID NO: 188112 - DNA, 24 bp, Artificial sequence
  SiRNA target sequence
atggttttaaacttcacagattac

SEQ ID NO: 188113 - DNA, 24 bp, Artificial sequence
  SiRNA target sequence
tggttttaaacttcacagattacc

SEQ ID NO: 188114 - DNA, 24 bp, Artificial sequence
  SiRNA target sequence
ggttttaaacttcacagattacca

SEQ ID NO: 188115 - DNA, 24 bp, Artificial sequence
  SiRNA target sequence
gttttaaacttcacagattaccaa

SEQ ID NO: 188116 - DNA, 24 bp, Artificial sequence
  SiRNA target sequence
ttttaaacttcacagattaccaat

SEQ ID NO: 188117 - DNA, 24 bp, Artificial sequence
  SiRNA target sequence
tttaaacttcacagattaccaatc

SEQ ID NO: 188118 - DNA, 24 bp, Artificial sequence
  SiRNA target sequence
ttaaacttcacagattaccaatcc

SEQ ID NO: 188119 - DNA, 24 bp, Artificial sequence
  SiRNA target sequence
taaacttcacagattaccaatccc

SEQ ID NO: 188120 - DNA, 24 bp, Artificial sequence
  SiRNA target sequence
aaacttcacagattaccaatccct

SEQ ID NO: 188121 - DNA, 24 bp, Artificial sequence
  SiRNA target sequence
aacttcacagattaccaatcccta

SEQ ID NO: 188122 - DNA, 24 bp, Artificial sequence
  SiRNA target sequence
acttcacagattaccaatccctaa

SEQ ID NO: 188123 - DNA, 24 bp, Artificial sequence
  SiRNA target sequence
cttcacagattaccaatccctaaa

SEQ ID NO: 188124 - DNA, 24 bp, Artificial sequence
  SiRNA target sequence
ttcacagattaccaatccctaaat

SEQ ID NO: 188125 - DNA, 24 bp, Artificial sequence
  SiRNA target sequence
tcacagattaccaatccctaaata

SEQ ID NO: 188126 - DNA, 24 bp, Artificial sequence
  SiRNA target sequence
cacagattaccaatccctaaatat

SEQ ID NO: 188127 - DNA, 24 bp, Artificial sequence
  SiRNA target sequence
acagattaccaatccctaaatatg

SEQ ID NO: 188128 - DNA, 24 bp, Artificial sequence
  SiRNA target sequence
cagattaccaatccctaaatatgg

SEQ ID NO: 188129 - DNA, 24 bp, Artificial sequence
  SiRNA target sequence
agattaccaatccctaaatatggt

SEQ ID NO: 188130 - DNA, 24 bp, Artificial sequence
  SiRNA target sequence
gattaccaatccctaaatatggta

SEQ ID NO: 188131 - DNA, 24 bp, Artificial sequence
  SiRNA target sequence
attaccaatccctaaatatggtaa

SEQ ID NO: 188132 - DNA, 24 bp, Artificial sequence
  SiRNA target sequence
ttaccaatccctaaatatggtaag

SEQ ID NO: 188133 - DNA, 24 bp, Artificial sequence
  SiRNA target sequence
taccaatccctaaatatggtaagg

SEQ ID NO: 188134 - DNA, 24 bp, Artificial sequence
  SiRNA target sequence
accaatccctaaatatggtaaggt

SEQ ID NO: 188135 - DNA, 24 bp, Artificial sequence
  SiRNA target sequence
ccaatccctaaatatggtaaggtt

SEQ ID NO: 188136 - DNA, 24 bp, Artificial sequence
  SiRNA target sequence
caatccctaaatatggtaaggttt

SEQ ID NO: 188137 - DNA, 24 bp, Artificial sequence
  SiRNA target sequence
aatccctaaatatggtaaggtttt

SEQ ID NO: 188138 - DNA, 24 bp, Artificial sequence
  SiRNA target sequence
atccctaaatatggtaaggtttta

SEQ ID NO: 188139 - DNA, 24 bp, Artificial sequence
  SiRNA target sequence
tccctaaatatggtaaggttttag

SEQ ID NO: 188140 - DNA, 24 bp, Artificial sequence
  SiRNA target sequence
ccctaaatatggtaaggttttagg

SEQ ID NO: 188141 - DNA, 24 bp, Artificial sequence
  SiRNA target sequence
cctaaatatggtaaggttttaggg

SEQ ID NO: 188142 - DNA, 24 bp, Artificial sequence
  SiRNA target sequence
ctaaatatggtaaggttttagggc

SEQ ID NO: 188143 - DNA, 24 bp, Artificial sequence
  SiRNA target sequence
taaatatggtaaggttttagggct

SEQ ID NO: 188144 - DNA, 24 bp, Artificial sequence
  SiRNA target sequence
aaatatggtaaggttttagggcta

SEQ ID NO: 188145 - DNA, 24 bp, Artificial sequence
  SiRNA target sequence
aatatggtaaggttttagggctag

SEQ ID NO: 188146 - DNA, 24 bp, Artificial sequence
  SiRNA target sequence
atatggtaaggttttagggctagt

SEQ ID NO: 188147 - DNA, 24 bp, Artificial sequence
  SiRNA target sequence
tatggtaaggttttagggctagta

SEQ ID NO: 188148 - DNA, 24 bp, Artificial sequence
  SiRNA target sequence
atggtaaggttttagggctagtag

SEQ ID NO: 188149 - DNA, 24 bp, Artificial sequence
  SiRNA target sequence
tggtaaggttttagggctagtagg

SEQ ID NO: 188150 - DNA, 24 bp, Artificial sequence
  SiRNA target sequence
ggtaaggttttagggctagtaggc

SEQ ID NO: 188151 - DNA, 24 bp, Artificial sequence
  SiRNA target sequence
gtaaggttttagggctagtaggca

SEQ ID NO: 188152 - DNA, 24 bp, Artificial sequence
  SiRNA target sequence
taaggttttagggctagtaggcac

SEQ ID NO: 188153 - DNA, 24 bp, Artificial sequence
  SiRNA target sequence
aaggttttagggctagtaggcact

SEQ ID NO: 188154 - DNA, 24 bp, Artificial sequence
  SiRNA target sequence
aggttttagggctagtaggcacta

SEQ ID NO: 188155 - DNA, 24 bp, Artificial sequence
  SiRNA target sequence
ggttttagggctagtaggcactaa

SEQ ID NO: 188156 - DNA, 24 bp, Artificial sequence
  SiRNA target sequence
gttttagggctagtaggcactaat

SEQ ID NO: 188157 - DNA, 24 bp, Artificial sequence
  SiRNA target sequence
ttttagggctagtaggcactaatg

SEQ ID NO: 188158 - DNA, 24 bp, Artificial sequence
  SiRNA target sequence
tttagggctagtaggcactaatgg

SEQ ID NO: 188159 - DNA, 24 bp, Artificial sequence
  SiRNA target sequence
ttagggctagtaggcactaatggt

SEQ ID NO: 188160 - DNA, 24 bp, Artificial sequence
  SiRNA target sequence
tagggctagtaggcactaatggta

SEQ ID NO: 188161 - DNA, 24 bp, Artificial sequence
  SiRNA target sequence
agggctagtaggcactaatggtat

SEQ ID NO: 188162 - DNA, 24 bp, Artificial sequence
  SiRNA target sequence
gggctagtaggcactaatggtata

SEQ ID NO: 188163 - DNA, 24 bp, Artificial sequence
  SiRNA target sequence
ggctagtaggcactaatggtatag

SEQ ID NO: 188164 - DNA, 24 bp, Artificial sequence
  SiRNA target sequence
gctagtaggcactaatggtatagg

SEQ ID NO: 188165 - DNA, 24 bp, Artificial sequence
  SiRNA target sequence
ctagtaggcactaatggtatagga

SEQ ID NO: 188166 - DNA, 24 bp, Artificial sequence
  SiRNA target sequence
tagtaggcactaatggtataggaa

SEQ ID NO: 188167 - DNA, 24 bp, Artificial sequence
  SiRNA target sequence
agtaggcactaatggtataggaaa

SEQ ID NO: 188168 - DNA, 24 bp, Artificial sequence
  SiRNA target sequence
gtaggcactaatggtataggaaaa

SEQ ID NO: 188169 - DNA, 24 bp, Artificial sequence
  SiRNA target sequence
taggcactaatggtataggaaaaa

SEQ ID NO: 188170 - DNA, 24 bp, Artificial sequence
  SiRNA target sequence
aggcactaatggtataggaaaaag

SEQ ID NO: 188171 - DNA, 24 bp, Artificial sequence
  SiRNA target sequence
ggcactaatggtataggaaaaagt

SEQ ID NO: 188172 - DNA, 24 bp, Artificial sequence
  SiRNA target sequence
gcactaatggtataggaaaaagta

SEQ ID NO: 188173 - DNA, 24 bp, Artificial sequence
  SiRNA target sequence
cactaatggtataggaaaaagtac

SEQ ID NO: 188174 - DNA, 24 bp, Artificial sequence
  SiRNA target sequence
actaatggtataggaaaaagtact

SEQ ID NO: 188175 - DNA, 24 bp, Artificial sequence
  SiRNA target sequence
ctaatggtataggaaaaagtactg

SEQ ID NO: 188176 - DNA, 24 bp, Artificial sequence
  SiRNA target sequence
taatggtataggaaaaagtactgc

SEQ ID NO: 188177 - DNA, 24 bp, Artificial sequence
  SiRNA target sequence
aatggtataggaaaaagtactgca

SEQ ID NO: 188178 - DNA, 24 bp, Artificial sequence
  SiRNA target sequence
atggtataggaaaaagtactgcac

SEQ ID NO: 188179 - DNA, 24 bp, Artificial sequence
  SiRNA target sequence
tggtataggaaaaagtactgcact

SEQ ID NO: 188180 - DNA, 24 bp, Artificial sequence
  SiRNA target sequence
ggtataggaaaaagtactgcactt

SEQ ID NO: 188181 - DNA, 24 bp, Artificial sequence
  SiRNA target sequence
gtataggaaaaagtactgcactta

SEQ ID NO: 188182 - DNA, 24 bp, Artificial sequence
  SiRNA target sequence
tataggaaaaagtactgcacttaa

SEQ ID NO: 188183 - DNA, 24 bp, Artificial sequence
  SiRNA target sequence
ataggaaaaagtactgcacttaaa

SEQ ID NO: 188184 - DNA, 24 bp, Artificial sequence
  SiRNA target sequence
taggaaaaagtactgcacttaaaa

SEQ ID NO: 188185 - DNA, 24 bp, Artificial sequence
  SiRNA target sequence
aggaaaaagtactgcacttaaaat

SEQ ID NO: 188186 - DNA, 24 bp, Artificial sequence
  SiRNA target sequence
ggaaaaagtactgcacttaaaata

SEQ ID NO: 188187 - DNA, 24 bp, Artificial sequence
  SiRNA target sequence
gaaaaagtactgcacttaaaatat

SEQ ID NO: 188188 - DNA, 24 bp, Artificial sequence
  SiRNA target sequence
aaaaagtactgcacttaaaatatt

SEQ ID NO: 188189 - DNA, 24 bp, Artificial sequence
  SiRNA target sequence
aaaagtactgcacttaaaatatta

SEQ ID NO: 188190 - DNA, 24 bp, Artificial sequence
  SiRNA target sequence
aaagtactgcacttaaaatattat

SEQ ID NO: 188191 - DNA, 24 bp, Artificial sequence
  SiRNA target sequence
aagtactgcacttaaaatattatc

SEQ ID NO: 188192 - DNA, 24 bp, Artificial sequence
  SiRNA target sequence
agtactgcacttaaaatattatcg

SEQ ID NO: 188193 - DNA, 24 bp, Artificial sequence
  SiRNA target sequence
gtactgcacttaaaatattatcgg

SEQ ID NO: 188194 - DNA, 24 bp, Artificial sequence
  SiRNA target sequence
tactgcacttaaaatattatcggg

SEQ ID NO: 188195 - DNA, 24 bp, Artificial sequence
  SiRNA target sequence
actgcacttaaaatattatcgggc

SEQ ID NO: 188196 - DNA, 24 bp, Artificial sequence
  SiRNA target sequence
ctgcacttaaaatattatcgggca

SEQ ID NO: 188197 - DNA, 24 bp, Artificial sequence
  SiRNA target sequence
tgcacttaaaatattatcgggcaa

SEQ ID NO: 188198 - DNA, 24 bp, Artificial sequence
  SiRNA target sequence
gcacttaaaatattatcgggcaat

SEQ ID NO: 188199 - DNA, 24 bp, Artificial sequence
  SiRNA target sequence
cacttaaaatattatcgggcaatc

SEQ ID NO: 188200 - DNA, 24 bp, Artificial sequence
  SiRNA target sequence
acttaaaatattatcgggcaatct

SEQ ID NO: 188201 - DNA, 24 bp, Artificial sequence
  SiRNA target sequence
cttaaaatattatcgggcaatctt

SEQ ID NO: 188202 - DNA, 24 bp, Artificial sequence
  SiRNA target sequence
ttaaaatattatcgggcaatctta

SEQ ID NO: 188203 - DNA, 24 bp, Artificial sequence
  SiRNA target sequence
taaaatattatcgggcaatcttaa

SEQ ID NO: 188204 - DNA, 24 bp, Artificial sequence
  SiRNA target sequence
aaaatattatcgggcaatcttaaa

SEQ ID NO: 188205 - DNA, 24 bp, Artificial sequence
  SiRNA target sequence
aaatattatcgggcaatcttaaac

SEQ ID NO: 188206 - DNA, 24 bp, Artificial sequence
  SiRNA target sequence
aatattatcgggcaatcttaaacc

SEQ ID NO: 188207 - DNA, 24 bp, Artificial sequence
  SiRNA target sequence
atattatcgggcaatcttaaacca

SEQ ID NO: 188208 - DNA, 24 bp, Artificial sequence
  SiRNA target sequence
tattatcgggcaatcttaaaccaa

SEQ ID NO: 188209 - DNA, 24 bp, Artificial sequence
  SiRNA target sequence
attatcgggcaatcttaaaccaaa

SEQ ID NO: 188210 - DNA, 24 bp, Artificial sequence
  SiRNA target sequence
ttatcgggcaatcttaaaccaaac

SEQ ID NO: 188211 - DNA, 24 bp, Artificial sequence
  SiRNA target sequence
tatcgggcaatcttaaaccaaact

SEQ ID NO: 188212 - DNA, 24 bp, Artificial sequence
  SiRNA target sequence
atcgggcaatcttaaaccaaactt

SEQ ID NO: 188213 - DNA, 24 bp, Artificial sequence
  SiRNA target sequence
tcgggcaatcttaaaccaaactta

SEQ ID NO: 188214 - DNA, 24 bp, Artificial sequence
  SiRNA target sequence
cgggcaatcttaaaccaaacttag

SEQ ID NO: 188215 - DNA, 24 bp, Artificial sequence
  SiRNA target sequence
gggcaatcttaaaccaaacttagg

SEQ ID NO: 188216 - DNA, 24 bp, Artificial sequence
  SiRNA target sequence
ggcaatcttaaaccaaacttagga

SEQ ID NO: 188217 - DNA, 24 bp, Artificial sequence
  SiRNA target sequence
gcaatcttaaaccaaacttaggaa

SEQ ID NO: 188218 - DNA, 24 bp, Artificial sequence
  SiRNA target sequence
caatcttaaaccaaacttaggaaa

SEQ ID NO: 188219 - DNA, 24 bp, Artificial sequence
  SiRNA target sequence
aatcttaaaccaaacttaggaaag

SEQ ID NO: 188220 - DNA, 24 bp, Artificial sequence
  SiRNA target sequence
atcttaaaccaaacttaggaaagt

SEQ ID NO: 188221 - DNA, 24 bp, Artificial sequence
  SiRNA target sequence
tcttaaaccaaacttaggaaagtt

SEQ ID NO: 188222 - DNA, 24 bp, Artificial sequence
  SiRNA target sequence
cttaaaccaaacttaggaaagttc

SEQ ID NO: 188223 - DNA, 24 bp, Artificial sequence
  SiRNA target sequence
ttaaaccaaacttaggaaagttcg

SEQ ID NO: 188224 - DNA, 24 bp, Artificial sequence
  SiRNA target sequence
taaaccaaacttaggaaagttcga

SEQ ID NO: 188225 - DNA, 24 bp, Artificial sequence
  SiRNA target sequence
aaaccaaacttaggaaagttcgac

SEQ ID NO: 188226 - DNA, 24 bp, Artificial sequence
  SiRNA target sequence
aaccaaacttaggaaagttcgacg

SEQ ID NO: 188227 - DNA, 24 bp, Artificial sequence
  SiRNA target sequence
accaaacttaggaaagttcgacgt

SEQ ID NO: 188228 - DNA, 24 bp, Artificial sequence
  SiRNA target sequence
ccaaacttaggaaagttcgacgtt

SEQ ID NO: 188229 - DNA, 24 bp, Artificial sequence
  SiRNA target sequence
caaacttaggaaagttcgacgtta

SEQ ID NO: 188230 - DNA, 24 bp, Artificial sequence
  SiRNA target sequence
aaacttaggaaagttcgacgttac

SEQ ID NO: 188231 - DNA, 24 bp, Artificial sequence
  SiRNA target sequence
aacttaggaaagttcgacgttacg

SEQ ID NO: 188232 - DNA, 24 bp, Artificial sequence
  SiRNA target sequence
acttaggaaagttcgacgttacgc

SEQ ID NO: 188233 - DNA, 24 bp, Artificial sequence
  SiRNA target sequence
cttaggaaagttcgacgttacgcc

SEQ ID NO: 188234 - DNA, 24 bp, Artificial sequence
  SiRNA target sequence
ttaggaaagttcgacgttacgccc

SEQ ID NO: 188235 - DNA, 24 bp, Artificial sequence
  SiRNA target sequence
taggaaagttcgacgttacgcccg

SEQ ID NO: 188236 - DNA, 24 bp, Artificial sequence
  SiRNA target sequence
aggaaagttcgacgttacgcccga

SEQ ID NO: 188237 - DNA, 24 bp, Artificial sequence
  SiRNA target sequence
ggaaagttcgacgttacgcccgac

SEQ ID NO: 188238 - DNA, 24 bp, Artificial sequence
  SiRNA target sequence
gaaagttcgacgttacgcccgact

SEQ ID NO: 188239 - DNA, 24 bp, Artificial sequence
  SiRNA target sequence
aaagttcgacgttacgcccgactg

SEQ ID NO: 188240 - DNA, 24 bp, Artificial sequence
  SiRNA target sequence
aagttcgacgttacgcccgactgg

SEQ ID NO: 188241 - DNA, 24 bp, Artificial sequence
  SiRNA target sequence
agttcgacgttacgcccgactggg

SEQ ID NO: 188242 - DNA, 24 bp, Artificial sequence
  SiRNA target sequence
gttcgacgttacgcccgactgggc

SEQ ID NO: 188243 - DNA, 24 bp, Artificial sequence
  SiRNA target sequence
ttcgacgttacgcccgactgggca

SEQ ID NO: 188244 - DNA, 24 bp, Artificial sequence
  SiRNA target sequence
tcgacgttacgcccgactgggcag

SEQ ID NO: 188245 - DNA, 24 bp, Artificial sequence
  SiRNA target sequence
cgacgttacgcccgactgggcagc

SEQ ID NO: 188246 - DNA, 24 bp, Artificial sequence
  SiRNA target sequence
gacgttacgcccgactgggcagca

SEQ ID NO: 188247 - DNA, 24 bp, Artificial sequence
  SiRNA target sequence
acgttacgcccgactgggcagcaa

SEQ ID NO: 188248 - DNA, 24 bp, Artificial sequence
  SiRNA target sequence
cgttacgcccgactgggcagcaat

SEQ ID NO: 188249 - DNA, 24 bp, Artificial sequence
  SiRNA target sequence
gttacgcccgactgggcagcaatt

SEQ ID NO: 188250 - DNA, 24 bp, Artificial sequence
  SiRNA target sequence
ttacgcccgactgggcagcaattc

SEQ ID NO: 188251 - DNA, 24 bp, Artificial sequence
  SiRNA target sequence
tacgcccgactgggcagcaattct

SEQ ID NO: 188252 - DNA, 24 bp, Artificial sequence
  SiRNA target sequence
acgcccgactgggcagcaattcta

SEQ ID NO: 188253 - DNA, 24 bp, Artificial sequence
  SiRNA target sequence
cgcccgactgggcagcaattctaa

SEQ ID NO: 188254 - DNA, 24 bp, Artificial sequence
  SiRNA target sequence
gcccgactgggcagcaattctaaa

SEQ ID NO: 188255 - DNA, 24 bp, Artificial sequence
  SiRNA target sequence
cccgactgggcagcaattctaaat

SEQ ID NO: 188256 - DNA, 24 bp, Artificial sequence
  SiRNA target sequence
ccgactgggcagcaattctaaata

SEQ ID NO: 188257 - DNA, 24 bp, Artificial sequence
  SiRNA target sequence
cgactgggcagcaattctaaataa

SEQ ID NO: 188258 - DNA, 24 bp, Artificial sequence
  SiRNA target sequence
gactgggcagcaattctaaataat

SEQ ID NO: 188259 - DNA, 24 bp, Artificial sequence
  SiRNA target sequence
actgggcagcaattctaaataatt

SEQ ID NO: 188260 - DNA, 24 bp, Artificial sequence
  SiRNA target sequence
ctgggcagcaattctaaataatta

SEQ ID NO: 188261 - DNA, 24 bp, Artificial sequence
  SiRNA target sequence
tgggcagcaattctaaataattat

SEQ ID NO: 188262 - DNA, 24 bp, Artificial sequence
  SiRNA target sequence
gggcagcaattctaaataattata

SEQ ID NO: 188263 - DNA, 24 bp, Artificial sequence
  SiRNA target sequence
ggcagcaattctaaataattataa

SEQ ID NO: 188264 - DNA, 24 bp, Artificial sequence
  SiRNA target sequence
gcagcaattctaaataattataaa

SEQ ID NO: 188265 - DNA, 24 bp, Artificial sequence
  SiRNA target sequence
cagcaattctaaataattataaag

SEQ ID NO: 188266 - DNA, 24 bp, Artificial sequence
  SiRNA target sequence
agcaattctaaataattataaagg

SEQ ID NO: 188267 - DNA, 24 bp, Artificial sequence
  SiRNA target sequence
gcaattctaaataattataaagga

SEQ ID NO: 188268 - DNA, 24 bp, Artificial sequence
  SiRNA target sequence
caattctaaataattataaaggat

SEQ ID NO: 188269 - DNA, 24 bp, Artificial sequence
  SiRNA target sequence
aattctaaataattataaaggatc

SEQ ID NO: 188270 - DNA, 24 bp, Artificial sequence
  SiRNA target sequence
attctaaataattataaaggatct

SEQ ID NO: 188271 - DNA, 24 bp, Artificial sequence
  SiRNA target sequence
ttctaaataattataaaggatctg

SEQ ID NO: 188272 - DNA, 24 bp, Artificial sequence
  SiRNA target sequence
tctaaataattataaaggatctga

SEQ ID NO: 188273 - DNA, 24 bp, Artificial sequence
  SiRNA target sequence
ctaaataattataaaggatctgaa

SEQ ID NO: 188274 - DNA, 24 bp, Artificial sequence
  SiRNA target sequence
taaataattataaaggatctgaac

SEQ ID NO: 188275 - DNA, 24 bp, Artificial sequence
  SiRNA target sequence
aaataattataaaggatctgaact

SEQ ID NO: 188276 - DNA, 24 bp, Artificial sequence
  SiRNA target sequence
aataattataaaggatctgaactt

SEQ ID NO: 188277 - DNA, 24 bp, Artificial sequence
  SiRNA target sequence
ataattataaaggatctgaacttc

SEQ ID NO: 188278 - DNA, 24 bp, Artificial sequence
  SiRNA target sequence
taattataaaggatctgaacttca

SEQ ID NO: 188279 - DNA, 24 bp, Artificial sequence
  SiRNA target sequence
aattataaaggatctgaacttcat

SEQ ID NO: 188280 - DNA, 24 bp, Artificial sequence
  SiRNA target sequence
attataaaggatctgaacttcatg

SEQ ID NO: 188281 - DNA, 24 bp, Artificial sequence
  SiRNA target sequence
ttataaaggatctgaacttcatgg

SEQ ID NO: 188282 - DNA, 24 bp, Artificial sequence
  SiRNA target sequence
tataaaggatctgaacttcatgga

SEQ ID NO: 188283 - DNA, 24 bp, Artificial sequence
  SiRNA target sequence
ataaaggatctgaacttcatggat

SEQ ID NO: 188284 - DNA, 24 bp, Artificial sequence
  SiRNA target sequence
taaaggatctgaacttcatggatt

SEQ ID NO: 188285 - DNA, 24 bp, Artificial sequence
  SiRNA target sequence
aaaggatctgaacttcatggattt

SEQ ID NO: 188286 - DNA, 24 bp, Artificial sequence
  SiRNA target sequence
aaggatctgaacttcatggatttt

SEQ ID NO: 188287 - DNA, 24 bp, Artificial sequence
  SiRNA target sequence
aggatctgaacttcatggattttt

SEQ ID NO: 188288 - DNA, 24 bp, Artificial sequence
  SiRNA target sequence
ggatctgaacttcatggatttttt

SEQ ID NO: 188289 - DNA, 24 bp, Artificial sequence
  SiRNA target sequence
gatctgaacttcatggatttttta

SEQ ID NO: 188290 - DNA, 24 bp, Artificial sequence
  SiRNA target sequence
atctgaacttcatggattttttac

SEQ ID NO: 188291 - DNA, 24 bp, Artificial sequence
  SiRNA target sequence
tctgaacttcatggattttttact

SEQ ID NO: 188292 - DNA, 24 bp, Artificial sequence
  SiRNA target sequence
ctgaacttcatggattttttacta

SEQ ID NO: 188293 - DNA, 24 bp, Artificial sequence
  SiRNA target sequence
tgaacttcatggattttttactaa

SEQ ID NO: 188294 - DNA, 24 bp, Artificial sequence
  SiRNA target sequence
gaacttcatggattttttactaaa

SEQ ID NO: 188295 - DNA, 24 bp, Artificial sequence
  SiRNA target sequence
aacttcatggattttttactaaaa

SEQ ID NO: 188296 - DNA, 24 bp, Artificial sequence
  SiRNA target sequence
acttcatggattttttactaaaat

SEQ ID NO: 188297 - DNA, 24 bp, Artificial sequence
  SiRNA target sequence
cttcatggattttttactaaaatt

SEQ ID NO: 188298 - DNA, 24 bp, Artificial sequence
  SiRNA target sequence
ttcatggattttttactaaaattt

SEQ ID NO: 188299 - DNA, 24 bp, Artificial sequence
  SiRNA target sequence
tcatggattttttactaaaatttt

SEQ ID NO: 188300 - DNA, 24 bp, Artificial sequence
  SiRNA target sequence
catggattttttactaaaatttta

SEQ ID NO: 188301 - DNA, 24 bp, Artificial sequence
  SiRNA target sequence
atggattttttactaaaattttag

SEQ ID NO: 188302 - DNA, 24 bp, Artificial sequence
  SiRNA target sequence
tggattttttactaaaattttaga

SEQ ID NO: 188303 - DNA, 24 bp, Artificial sequence
  SiRNA target sequence
ggattttttactaaaattttagaa

SEQ ID NO: 188304 - DNA, 24 bp, Artificial sequence
  SiRNA target sequence
gattttttactaaaattttagaag

SEQ ID NO: 188305 - DNA, 24 bp, Artificial sequence
  SiRNA target sequence
attttttactaaaattttagaagg

SEQ ID NO: 188306 - DNA, 24 bp, Artificial sequence
  SiRNA target sequence
ttttttactaaaattttagaaggg

SEQ ID NO: 188307 - DNA, 24 bp, Artificial sequence
  SiRNA target sequence
tttttactaaaattttagaagggt

SEQ ID NO: 188308 - DNA, 24 bp, Artificial sequence
  SiRNA target sequence
ttttactaaaattttagaagggtc

SEQ ID NO: 188309 - DNA, 24 bp, Artificial sequence
  SiRNA target sequence
tttactaaaattttagaagggtct

SEQ ID NO: 188310 - DNA, 24 bp, Artificial sequence
  SiRNA target sequence
ttactaaaattttagaagggtcta

SEQ ID NO: 188311 - DNA, 24 bp, Artificial sequence
  SiRNA target sequence
tactaaaattttagaagggtctat

SEQ ID NO: 188312 - DNA, 24 bp, Artificial sequence
  SiRNA target sequence
actaaaattttagaagggtctatt

SEQ ID NO: 188313 - DNA, 24 bp, Artificial sequence
  SiRNA target sequence
ctaaaattttagaagggtctatta

SEQ ID NO: 188314 - DNA, 24 bp, Artificial sequence
  SiRNA target sequence
taaaattttagaagggtctattaa

SEQ ID NO: 188315 - DNA, 24 bp, Artificial sequence
  SiRNA target sequence
aaaattttagaagggtctattaaa

SEQ ID NO: 188316 - DNA, 24 bp, Artificial sequence
  SiRNA target sequence
aaattttagaagggtctattaaag

SEQ ID NO: 188317 - DNA, 24 bp, Artificial sequence
  SiRNA target sequence
aattttagaagggtctattaaagc

SEQ ID NO: 188318 - DNA, 24 bp, Artificial sequence
  SiRNA target sequence
attttagaagggtctattaaagct

SEQ ID NO: 188319 - DNA, 24 bp, Artificial sequence
  SiRNA target sequence
ttttagaagggtctattaaagcta

SEQ ID NO: 188320 - DNA, 24 bp, Artificial sequence
  SiRNA target sequence
tttagaagggtctattaaagctat

SEQ ID NO: 188321 - DNA, 24 bp, Artificial sequence
  SiRNA target sequence
ttagaagggtctattaaagctatt

SEQ ID NO: 188322 - DNA, 24 bp, Artificial sequence
  SiRNA target sequence
tagaagggtctattaaagctattt

SEQ ID NO: 188323 - DNA, 24 bp, Artificial sequence
  SiRNA target sequence
agaagggtctattaaagctatttc

SEQ ID NO: 188324 - DNA, 24 bp, Artificial sequence
  SiRNA target sequence
gaagggtctattaaagctatttct

SEQ ID NO: 188325 - DNA, 24 bp, Artificial sequence
  SiRNA target sequence
aagggtctattaaagctatttcta

SEQ ID NO: 188326 - DNA, 24 bp, Artificial sequence
  SiRNA target sequence
agggtctattaaagctatttctaa

SEQ ID NO: 188327 - DNA, 24 bp, Artificial sequence
  SiRNA target sequence
gggtctattaaagctatttctaag

SEQ ID NO: 188328 - DNA, 24 bp, Artificial sequence
  SiRNA target sequence
ggtctattaaagctatttctaaga

SEQ ID NO: 188329 - DNA, 24 bp, Artificial sequence
  SiRNA target sequence
gtctattaaagctatttctaagat

SEQ ID NO: 188330 - DNA, 24 bp, Artificial sequence
  SiRNA target sequence
tctattaaagctatttctaagata

SEQ ID NO: 188331 - DNA, 24 bp, Artificial sequence
  SiRNA target sequence
ctattaaagctatttctaagatac

SEQ ID NO: 188332 - DNA, 24 bp, Artificial sequence
  SiRNA target sequence
tattaaagctatttctaagataca

SEQ ID NO: 188333 - DNA, 24 bp, Artificial sequence
  SiRNA target sequence
attaaagctatttctaagatacag

SEQ ID NO: 188334 - DNA, 24 bp, Artificial sequence
  SiRNA target sequence
ttaaagctatttctaagatacagt

SEQ ID NO: 188335 - DNA, 24 bp, Artificial sequence
  SiRNA target sequence
taaagctatttctaagatacagta

SEQ ID NO: 188336 - DNA, 24 bp, Artificial sequence
  SiRNA target sequence
aaagctatttctaagatacagtat

SEQ ID NO: 188337 - DNA, 24 bp, Artificial sequence
  SiRNA target sequence
aagctatttctaagatacagtata

SEQ ID NO: 188338 - DNA, 24 bp, Artificial sequence
  SiRNA target sequence
agctatttctaagatacagtatat

SEQ ID NO: 188339 - DNA, 24 bp, Artificial sequence
  SiRNA target sequence
gctatttctaagatacagtatata

SEQ ID NO: 188340 - DNA, 24 bp, Artificial sequence
  SiRNA target sequence
ctatttctaagatacagtatatag

SEQ ID NO: 188341 - DNA, 24 bp, Artificial sequence
  SiRNA target sequence
tatttctaagatacagtatataga

SEQ ID NO: 188342 - DNA, 24 bp, Artificial sequence
  SiRNA target sequence
atttctaagatacagtatatagat

SEQ ID NO: 188343 - DNA, 24 bp, Artificial sequence
  SiRNA target sequence
tttctaagatacagtatatagata

SEQ ID NO: 188344 - DNA, 24 bp, Artificial sequence
  SiRNA target sequence
ttctaagatacagtatatagataa

SEQ ID NO: 188345 - DNA, 24 bp, Artificial sequence
  SiRNA target sequence
tctaagatacagtatatagataaa

SEQ ID NO: 188346 - DNA, 24 bp, Artificial sequence
  SiRNA target sequence
ctaagatacagtatatagataaaa

SEQ ID NO: 188347 - DNA, 24 bp, Artificial sequence
  SiRNA target sequence
taagatacagtatatagataaaat

SEQ ID NO: 188348 - DNA, 24 bp, Artificial sequence
  SiRNA target sequence
aagatacagtatatagataaaatg

SEQ ID NO: 188349 - DNA, 24 bp, Artificial sequence
  SiRNA target sequence
agatacagtatatagataaaatgc

SEQ ID NO: 188350 - DNA, 24 bp, Artificial sequence
  SiRNA target sequence
gatacagtatatagataaaatgcc

SEQ ID NO: 188351 - DNA, 24 bp, Artificial sequence
  SiRNA target sequence
atacagtatatagataaaatgcct

SEQ ID NO: 188352 - DNA, 24 bp, Artificial sequence
  SiRNA target sequence
tacagtatatagataaaatgccta

SEQ ID NO: 188353 - DNA, 24 bp, Artificial sequence
  SiRNA target sequence
acagtatatagataaaatgcctaa

SEQ ID NO: 188354 - DNA, 24 bp, Artificial sequence
  SiRNA target sequence
cagtatatagataaaatgcctaaa

SEQ ID NO: 188355 - DNA, 24 bp, Artificial sequence
  SiRNA target sequence
agtatatagataaaatgcctaaat

SEQ ID NO: 188356 - DNA, 24 bp, Artificial sequence
  SiRNA target sequence
gtatatagataaaatgcctaaatt

SEQ ID NO: 188357 - DNA, 24 bp, Artificial sequence
  SiRNA target sequence
tatatagataaaatgcctaaattt

SEQ ID NO: 188358 - DNA, 24 bp, Artificial sequence
  SiRNA target sequence
atatagataaaatgcctaaatttt

SEQ ID NO: 188359 - DNA, 24 bp, Artificial sequence
  SiRNA target sequence
tatagataaaatgcctaaattttt

SEQ ID NO: 188360 - DNA, 24 bp, Artificial sequence
  SiRNA target sequence
atagataaaatgcctaaattttta

SEQ ID NO: 188361 - DNA, 24 bp, Artificial sequence
  SiRNA target sequence
tagataaaatgcctaaatttttaa

SEQ ID NO: 188362 - DNA, 24 bp, Artificial sequence
  SiRNA target sequence
agataaaatgcctaaatttttaaa

SEQ ID NO: 188363 - DNA, 24 bp, Artificial sequence
  SiRNA target sequence
gataaaatgcctaaatttttaaaa

SEQ ID NO: 188364 - DNA, 24 bp, Artificial sequence
  SiRNA target sequence
ataaaatgcctaaatttttaaaag

SEQ ID NO: 188365 - DNA, 24 bp, Artificial sequence
  SiRNA target sequence
taaaatgcctaaatttttaaaagg

SEQ ID NO: 188366 - DNA, 24 bp, Artificial sequence
  SiRNA target sequence
aaaatgcctaaatttttaaaagga

SEQ ID NO: 188367 - DNA, 24 bp, Artificial sequence
  SiRNA target sequence
aaatgcctaaatttttaaaaggac

SEQ ID NO: 188368 - DNA, 24 bp, Artificial sequence
  SiRNA target sequence
aatgcctaaatttttaaaaggacg

SEQ ID NO: 188369 - DNA, 24 bp, Artificial sequence
  SiRNA target sequence
atgcctaaatttttaaaaggacgc

SEQ ID NO: 188370 - DNA, 24 bp, Artificial sequence
  SiRNA target sequence
tgcctaaatttttaaaaggacgct

SEQ ID NO: 188371 - DNA, 24 bp, Artificial sequence
  SiRNA target sequence
gcctaaatttttaaaaggacgcta

SEQ ID NO: 188372 - DNA, 24 bp, Artificial sequence
  SiRNA target sequence
cctaaatttttaaaaggacgctat

SEQ ID NO: 188373 - DNA, 24 bp, Artificial sequence
  SiRNA target sequence
ctaaatttttaaaaggacgctata

SEQ ID NO: 188374 - DNA, 24 bp, Artificial sequence
  SiRNA target sequence
taaatttttaaaaggacgctataa

SEQ ID NO: 188375 - DNA, 24 bp, Artificial sequence
  SiRNA target sequence
aaatttttaaaaggacgctataag

SEQ ID NO: 188376 - DNA, 24 bp, Artificial sequence
  SiRNA target sequence
aatttttaaaaggacgctataagt

SEQ ID NO: 188377 - DNA, 24 bp, Artificial sequence
  SiRNA target sequence
atttttaaaaggacgctataagtc

SEQ ID NO: 188378 - DNA, 24 bp, Artificial sequence
  SiRNA target sequence
tttttaaaaggacgctataagtca

SEQ ID NO: 188379 - DNA, 24 bp, Artificial sequence
  SiRNA target sequence
ttttaaaaggacgctataagtcag

SEQ ID NO: 188380 - DNA, 24 bp, Artificial sequence
  SiRNA target sequence
tttaaaaggacgctataagtcaga

SEQ ID NO: 188381 - DNA, 24 bp, Artificial sequence
  SiRNA target sequence
ttaaaaggacgctataagtcagaa

SEQ ID NO: 188382 - DNA, 24 bp, Artificial sequence
  SiRNA target sequence
taaaaggacgctataagtcagaaa

SEQ ID NO: 188383 - DNA, 24 bp, Artificial sequence
  SiRNA target sequence
aaaaggacgctataagtcagaaat

SEQ ID NO: 188384 - DNA, 24 bp, Artificial sequence
  SiRNA target sequence
aaaggacgctataagtcagaaatc

SEQ ID NO: 188385 - DNA, 24 bp, Artificial sequence
  SiRNA target sequence
aaggacgctataagtcagaaatcg

SEQ ID NO: 188386 - DNA, 24 bp, Artificial sequence
  SiRNA target sequence
aggacgctataagtcagaaatcgc

SEQ ID NO: 188387 - DNA, 24 bp, Artificial sequence
  SiRNA target sequence
ggacgctataagtcagaaatcgcc

SEQ ID NO: 188388 - DNA, 24 bp, Artificial sequence
  SiRNA target sequence
gacgctataagtcagaaatcgcct

SEQ ID NO: 188389 - DNA, 24 bp, Artificial sequence
  SiRNA target sequence
acgctataagtcagaaatcgcctc

SEQ ID NO: 188390 - DNA, 24 bp, Artificial sequence
  SiRNA target sequence
cgctataagtcagaaatcgcctcc

SEQ ID NO: 188391 - DNA, 24 bp, Artificial sequence
  SiRNA target sequence
gctataagtcagaaatcgcctccg

SEQ ID NO: 188392 - DNA, 24 bp, Artificial sequence
  SiRNA target sequence
ctataagtcagaaatcgcctccgg

SEQ ID NO: 188393 - DNA, 24 bp, Artificial sequence
  SiRNA target sequence
tataagtcagaaatcgcctccgga

SEQ ID NO: 188394 - DNA, 24 bp, Artificial sequence
  SiRNA target sequence
ataagtcagaaatcgcctccggaa

SEQ ID NO: 188395 - DNA, 24 bp, Artificial sequence
  SiRNA target sequence
taagtcagaaatcgcctccggaaa

SEQ ID NO: 188396 - DNA, 24 bp, Artificial sequence
  SiRNA target sequence
aagtcagaaatcgcctccggaaaa

SEQ ID NO: 188397 - DNA, 24 bp, Artificial sequence
  SiRNA target sequence
agtcagaaatcgcctccggaaaaa

SEQ ID NO: 188398 - DNA, 24 bp, Artificial sequence
  SiRNA target sequence
gtcagaaatcgcctccggaaaaat

SEQ ID NO: 188399 - DNA, 24 bp, Artificial sequence
  SiRNA target sequence
tcagaaatcgcctccggaaaaatg

SEQ ID NO: 188400 - DNA, 24 bp, Artificial sequence
  SiRNA target sequence
cagaaatcgcctccggaaaaatgt

SEQ ID NO: 188401 - DNA, 24 bp, Artificial sequence
  SiRNA target sequence
agaaatcgcctccggaaaaatgtt

SEQ ID NO: 188402 - DNA, 24 bp, Artificial sequence
  SiRNA target sequence
gaaatcgcctccggaaaaatgttg

SEQ ID NO: 188403 - DNA, 24 bp, Artificial sequence
  SiRNA target sequence
aaatcgcctccggaaaaatgttgt

SEQ ID NO: 188404 - DNA, 24 bp, Artificial sequence
  SiRNA target sequence
aatcgcctccggaaaaatgttgtt

SEQ ID NO: 188405 - DNA, 24 bp, Artificial sequence
  SiRNA target sequence
atcgcctccggaaaaatgttgttt

SEQ ID NO: 188406 - DNA, 24 bp, Artificial sequence
  SiRNA target sequence
tcgcctccggaaaaatgttgttta

SEQ ID NO: 188407 - DNA, 24 bp, Artificial sequence
  SiRNA target sequence
cgcctccggaaaaatgttgtttac

SEQ ID NO: 188408 - DNA, 24 bp, Artificial sequence
  SiRNA target sequence
gcctccggaaaaatgttgtttact

SEQ ID NO: 188409 - DNA, 24 bp, Artificial sequence
  SiRNA target sequence
cctccggaaaaatgttgtttactg

SEQ ID NO: 188410 - DNA, 24 bp, Artificial sequence
  SiRNA target sequence
ctccggaaaaatgttgtttactgt

SEQ ID NO: 188411 - DNA, 24 bp, Artificial sequence
  SiRNA target sequence
tccggaaaaatgttgtttactgtt

SEQ ID NO: 188412 - DNA, 24 bp, Artificial sequence
  SiRNA target sequence
ccggaaaaatgttgtttactgtta

SEQ ID NO: 188413 - DNA, 24 bp, Artificial sequence
  SiRNA target sequence
cggaaaaatgttgtttactgttaa

SEQ ID NO: 188414 - DNA, 24 bp, Artificial sequence
  SiRNA target sequence
ggaaaaatgttgtttactgttaat

SEQ ID NO: 188415 - DNA, 24 bp, Artificial sequence
  SiRNA target sequence
gaaaaatgttgtttactgttaatg

SEQ ID NO: 188416 - DNA, 24 bp, Artificial sequence
  SiRNA target sequence
aaaaatgttgtttactgttaatga

SEQ ID NO: 188417 - DNA, 24 bp, Artificial sequence
  SiRNA target sequence
aaaatgttgtttactgttaatgat

SEQ ID NO: 188418 - DNA, 24 bp, Artificial sequence
  SiRNA target sequence
aaatgttgtttactgttaatgata

SEQ ID NO: 188419 - DNA, 24 bp, Artificial sequence
  SiRNA target sequence
aatgttgtttactgttaatgatat

SEQ ID NO: 188420 - DNA, 24 bp, Artificial sequence
  SiRNA target sequence
atgttgtttactgttaatgatata

SEQ ID NO: 188421 - DNA, 24 bp, Artificial sequence
  SiRNA target sequence
tgttgtttactgttaatgatatat

SEQ ID NO: 188422 - DNA, 24 bp, Artificial sequence
  SiRNA target sequence
gttgtttactgttaatgatatatt

SEQ ID NO: 188423 - DNA, 24 bp, Artificial sequence
  SiRNA target sequence
ttgtttactgttaatgatatatta

SEQ ID NO: 188424 - DNA, 24 bp, Artificial sequence
  SiRNA target sequence
tgtttactgttaatgatatattaa

SEQ ID NO: 188425 - DNA, 24 bp, Artificial sequence
  SiRNA target sequence
gtttactgttaatgatatattaaa

SEQ ID NO: 188426 - DNA, 24 bp, Artificial sequence
  SiRNA target sequence
tttactgttaatgatatattaaaa

SEQ ID NO: 188427 - DNA, 24 bp, Artificial sequence
  SiRNA target sequence
ttactgttaatgatatattaaaaa

SEQ ID NO: 188428 - DNA, 24 bp, Artificial sequence
  SiRNA target sequence
tactgttaatgatatattaaaaaa

SEQ ID NO: 188429 - DNA, 24 bp, Artificial sequence
  SiRNA target sequence
actgttaatgatatattaaaaaaa

SEQ ID NO: 188430 - DNA, 24 bp, Artificial sequence
  SiRNA target sequence
ctgttaatgatatattaaaaaaag

SEQ ID NO: 188431 - DNA, 24 bp, Artificial sequence
  SiRNA target sequence
tgttaatgatatattaaaaaaagt

SEQ ID NO: 188432 - DNA, 24 bp, Artificial sequence
  SiRNA target sequence
gttaatgatatattaaaaaaagtt

SEQ ID NO: 188433 - DNA, 24 bp, Artificial sequence
  SiRNA target sequence
ttaatgatatattaaaaaaagttg

SEQ ID NO: 188434 - DNA, 24 bp, Artificial sequence
  SiRNA target sequence
taatgatatattaaaaaaagttga

SEQ ID NO: 188435 - DNA, 24 bp, Artificial sequence
  SiRNA target sequence
aatgatatattaaaaaaagttgat

SEQ ID NO: 188436 - DNA, 24 bp, Artificial sequence
  SiRNA target sequence
atgatatattaaaaaaagttgatg

SEQ ID NO: 188437 - DNA, 24 bp, Artificial sequence
  SiRNA target sequence
tgatatattaaaaaaagttgatga

SEQ ID NO: 188438 - DNA, 24 bp, Artificial sequence
  SiRNA target sequence
gatatattaaaaaaagttgatgaa

SEQ ID NO: 188439 - DNA, 24 bp, Artificial sequence
  SiRNA target sequence
atatattaaaaaaagttgatgaaa

SEQ ID NO: 188440 - DNA, 24 bp, Artificial sequence
  SiRNA target sequence
tatattaaaaaaagttgatgaaaa

SEQ ID NO: 188441 - DNA, 24 bp, Artificial sequence
  SiRNA target sequence
atattaaaaaaagttgatgaaaaa

SEQ ID NO: 188442 - DNA, 24 bp, Artificial sequence
  SiRNA target sequence
tattaaaaaaagttgatgaaaaaa

SEQ ID NO: 188443 - DNA, 24 bp, Artificial sequence
  SiRNA target sequence
attaaaaaaagttgatgaaaaaaa

SEQ ID NO: 188444 - DNA, 24 bp, Artificial sequence
  SiRNA target sequence
ttaaaaaaagttgatgaaaaaaat

SEQ ID NO: 188445 - DNA, 24 bp, Artificial sequence
  SiRNA target sequence
taaaaaaagttgatgaaaaaaata

SEQ ID NO: 188446 - DNA, 24 bp, Artificial sequence
  SiRNA target sequence
aaaaaaagttgatgaaaaaaataa

SEQ ID NO: 188447 - DNA, 24 bp, Artificial sequence
  SiRNA target sequence
aaaaaagttgatgaaaaaaataaa

SEQ ID NO: 188448 - DNA, 24 bp, Artificial sequence
  SiRNA target sequence
aaaaagttgatgaaaaaaataaat

SEQ ID NO: 188449 - DNA, 24 bp, Artificial sequence
  SiRNA target sequence
aaaagttgatgaaaaaaataaatt

SEQ ID NO: 188450 - DNA, 24 bp, Artificial sequence
  SiRNA target sequence
aaagttgatgaaaaaaataaattt

SEQ ID NO: 188451 - DNA, 24 bp, Artificial sequence
  SiRNA target sequence
aagttgatgaaaaaaataaatttg

SEQ ID NO: 188452 - DNA, 24 bp, Artificial sequence
  SiRNA target sequence
agttgatgaaaaaaataaatttga

SEQ ID NO: 188453 - DNA, 24 bp, Artificial sequence
  SiRNA target sequence
gttgatgaaaaaaataaatttgac

SEQ ID NO: 188454 - DNA, 24 bp, Artificial sequence
  SiRNA target sequence
ttgatgaaaaaaataaatttgact

SEQ ID NO: 188455 - DNA, 24 bp, Artificial sequence
  SiRNA target sequence
tgatgaaaaaaataaatttgacta

SEQ ID NO: 188456 - DNA, 24 bp, Artificial sequence
  SiRNA target sequence
gatgaaaaaaataaatttgactat

SEQ ID NO: 188457 - DNA, 24 bp, Artificial sequence
  SiRNA target sequence
atgaaaaaaataaatttgactatt

SEQ ID NO: 188458 - DNA, 24 bp, Artificial sequence
  SiRNA target sequence
tgaaaaaaataaatttgactatta

SEQ ID NO: 188459 - DNA, 24 bp, Artificial sequence
  SiRNA target sequence
gaaaaaaataaatttgactattac

SEQ ID NO: 188460 - DNA, 24 bp, Artificial sequence
  SiRNA target sequence
aaaaaaataaatttgactattacg

SEQ ID NO: 188461 - DNA, 24 bp, Artificial sequence
  SiRNA target sequence
aaaaaataaatttgactattacgt

SEQ ID NO: 188462 - DNA, 24 bp, Artificial sequence
  SiRNA target sequence
aaaaataaatttgactattacgta

SEQ ID NO: 188463 - DNA, 24 bp, Artificial sequence
  SiRNA target sequence
aaaataaatttgactattacgtag

SEQ ID NO: 188464 - DNA, 24 bp, Artificial sequence
  SiRNA target sequence
aaataaatttgactattacgtaga

SEQ ID NO: 188465 - DNA, 24 bp, Artificial sequence
  SiRNA target sequence
aataaatttgactattacgtagat

SEQ ID NO: 188466 - DNA, 24 bp, Artificial sequence
  SiRNA target sequence
ataaatttgactattacgtagata

SEQ ID NO: 188467 - DNA, 24 bp, Artificial sequence
  SiRNA target sequence
taaatttgactattacgtagataa

SEQ ID NO: 188468 - DNA, 24 bp, Artificial sequence
  SiRNA target sequence
aaatttgactattacgtagataaa

SEQ ID NO: 188469 - DNA, 24 bp, Artificial sequence
  SiRNA target sequence
aatttgactattacgtagataaaa

SEQ ID NO: 188470 - DNA, 24 bp, Artificial sequence
  SiRNA target sequence
atttgactattacgtagataaaat

SEQ ID NO: 188471 - DNA, 24 bp, Artificial sequence
  SiRNA target sequence
tttgactattacgtagataaaatg

SEQ ID NO: 188472 - DNA, 24 bp, Artificial sequence
  SiRNA target sequence
ttgactattacgtagataaaatgg

SEQ ID NO: 188473 - DNA, 24 bp, Artificial sequence
  SiRNA target sequence
tgactattacgtagataaaatggc

SEQ ID NO: 188474 - DNA, 24 bp, Artificial sequence
  SiRNA target sequence
gactattacgtagataaaatggca

SEQ ID NO: 188475 - DNA, 24 bp, Artificial sequence
  SiRNA target sequence
actattacgtagataaaatggcac

SEQ ID NO: 188476 - DNA, 24 bp, Artificial sequence
  SiRNA target sequence
ctattacgtagataaaatggcact

SEQ ID NO: 188477 - DNA, 24 bp, Artificial sequence
  SiRNA target sequence
tattacgtagataaaatggcactt

SEQ ID NO: 188478 - DNA, 24 bp, Artificial sequence
  SiRNA target sequence
attacgtagataaaatggcactta

SEQ ID NO: 188479 - DNA, 24 bp, Artificial sequence
  SiRNA target sequence
ttacgtagataaaatggcacttaa

SEQ ID NO: 188480 - DNA, 24 bp, Artificial sequence
  SiRNA target sequence
tacgtagataaaatggcacttaaa

SEQ ID NO: 188481 - DNA, 24 bp, Artificial sequence
  SiRNA target sequence
acgtagataaaatggcacttaaaa

SEQ ID NO: 188482 - DNA, 24 bp, Artificial sequence
  SiRNA target sequence
cgtagataaaatggcacttaaaaa

SEQ ID NO: 188483 - DNA, 24 bp, Artificial sequence
  SiRNA target sequence
gtagataaaatggcacttaaaaat

SEQ ID NO: 188484 - DNA, 24 bp, Artificial sequence
  SiRNA target sequence
tagataaaatggcacttaaaaatg

SEQ ID NO: 188485 - DNA, 24 bp, Artificial sequence
  SiRNA target sequence
agataaaatggcacttaaaaatgt

SEQ ID NO: 188486 - DNA, 24 bp, Artificial sequence
  SiRNA target sequence
gataaaatggcacttaaaaatgta

SEQ ID NO: 188487 - DNA, 24 bp, Artificial sequence
  SiRNA target sequence
ataaaatggcacttaaaaatgtat

SEQ ID NO: 188488 - DNA, 24 bp, Artificial sequence
  SiRNA target sequence
taaaatggcacttaaaaatgtatt

SEQ ID NO: 188489 - DNA, 24 bp, Artificial sequence
  SiRNA target sequence
aaaatggcacttaaaaatgtatta

SEQ ID NO: 188490 - DNA, 24 bp, Artificial sequence
  SiRNA target sequence
aaatggcacttaaaaatgtattaa

SEQ ID NO: 188491 - DNA, 24 bp, Artificial sequence
  SiRNA target sequence
aatggcacttaaaaatgtattaac

SEQ ID NO: 188492 - DNA, 24 bp, Artificial sequence
  SiRNA target sequence
atggcacttaaaaatgtattaaca

SEQ ID NO: 188493 - DNA, 24 bp, Artificial sequence
  SiRNA target sequence
tggcacttaaaaatgtattaacaa

SEQ ID NO: 188494 - DNA, 24 bp, Artificial sequence
  SiRNA target sequence
ggcacttaaaaatgtattaacaag

SEQ ID NO: 188495 - DNA, 24 bp, Artificial sequence
  SiRNA target sequence
gcacttaaaaatgtattaacaaga

SEQ ID NO: 188496 - DNA, 24 bp, Artificial sequence
  SiRNA target sequence
cacttaaaaatgtattaacaagag

SEQ ID NO: 188497 - DNA, 24 bp, Artificial sequence
  SiRNA target sequence
acttaaaaatgtattaacaagaga

SEQ ID NO: 188498 - DNA, 24 bp, Artificial sequence
  SiRNA target sequence
cttaaaaatgtattaacaagagaa

SEQ ID NO: 188499 - DNA, 24 bp, Artificial sequence
  SiRNA target sequence
ttaaaaatgtattaacaagagaat

SEQ ID NO: 188500 - DNA, 24 bp, Artificial sequence
  SiRNA target sequence
taaaaatgtattaacaagagaatt

SEQ ID NO: 188501 - DNA, 24 bp, Artificial sequence
  SiRNA target sequence
aaaaatgtattaacaagagaatta

SEQ ID NO: 188502 - DNA, 24 bp, Artificial sequence
  SiRNA target sequence
aaaatgtattaacaagagaattag

SEQ ID NO: 188503 - DNA, 24 bp, Artificial sequence
  SiRNA target sequence
aaatgtattaacaagagaattaga

SEQ ID NO: 188504 - DNA, 24 bp, Artificial sequence
  SiRNA target sequence
aatgtattaacaagagaattagag

SEQ ID NO: 188505 - DNA, 24 bp, Artificial sequence
  SiRNA target sequence
atgtattaacaagagaattagagc

SEQ ID NO: 188506 - DNA, 24 bp, Artificial sequence
  SiRNA target sequence
tgtattaacaagagaattagagca

SEQ ID NO: 188507 - DNA, 24 bp, Artificial sequence
  SiRNA target sequence
gtattaacaagagaattagagcaa

SEQ ID NO: 188508 - DNA, 24 bp, Artificial sequence
  SiRNA target sequence
tattaacaagagaattagagcaat

SEQ ID NO: 188509 - DNA, 24 bp, Artificial sequence
  SiRNA target sequence
attaacaagagaattagagcaatt

SEQ ID NO: 188510 - DNA, 24 bp, Artificial sequence
  SiRNA target sequence
ttaacaagagaattagagcaatta

SEQ ID NO: 188511 - DNA, 24 bp, Artificial sequence
  SiRNA target sequence
taacaagagaattagagcaattaa

SEQ ID NO: 188512 - DNA, 24 bp, Artificial sequence
  SiRNA target sequence
aacaagagaattagagcaattaag

SEQ ID NO: 188513 - DNA, 24 bp, Artificial sequence
  SiRNA target sequence
acaagagaattagagcaattaagt

SEQ ID NO: 188514 - DNA, 24 bp, Artificial sequence
  SiRNA target sequence
caagagaattagagcaattaagtg

SEQ ID NO: 188515 - DNA, 24 bp, Artificial sequence
  SiRNA target sequence
aagagaattagagcaattaagtgg

SEQ ID NO: 188516 - DNA, 24 bp, Artificial sequence
  SiRNA target sequence
agagaattagagcaattaagtggt

SEQ ID NO: 188517 - DNA, 24 bp, Artificial sequence
  SiRNA target sequence
gagaattagagcaattaagtggtg

SEQ ID NO: 188518 - DNA, 24 bp, Artificial sequence
  SiRNA target sequence
agaattagagcaattaagtggtgg

SEQ ID NO: 188519 - DNA, 24 bp, Artificial sequence
  SiRNA target sequence
gaattagagcaattaagtggtggt

SEQ ID NO: 188520 - DNA, 24 bp, Artificial sequence
  SiRNA target sequence
aattagagcaattaagtggtggtg

SEQ ID NO: 188521 - DNA, 24 bp, Artificial sequence
  SiRNA target sequence
attagagcaattaagtggtggtga

SEQ ID NO: 188522 - DNA, 24 bp, Artificial sequence
  SiRNA target sequence
ttagagcaattaagtggtggtgaa

SEQ ID NO: 188523 - DNA, 24 bp, Artificial sequence
  SiRNA target sequence
tagagcaattaagtggtggtgaac

SEQ ID NO: 188524 - DNA, 24 bp, Artificial sequence
  SiRNA target sequence
agagcaattaagtggtggtgaact

SEQ ID NO: 188525 - DNA, 24 bp, Artificial sequence
  SiRNA target sequence
gagcaattaagtggtggtgaactt

SEQ ID NO: 188526 - DNA, 24 bp, Artificial sequence
  SiRNA target sequence
agcaattaagtggtggtgaacttc

SEQ ID NO: 188527 - DNA, 24 bp, Artificial sequence
  SiRNA target sequence
gcaattaagtggtggtgaacttca

SEQ ID NO: 188528 - DNA, 24 bp, Artificial sequence
  SiRNA target sequence
caattaagtggtggtgaacttcaa

SEQ ID NO: 188529 - DNA, 24 bp, Artificial sequence
  SiRNA target sequence
aattaagtggtggtgaacttcaaa

SEQ ID NO: 188530 - DNA, 24 bp, Artificial sequence
  SiRNA target sequence
attaagtggtggtgaacttcaaag

SEQ ID NO: 188531 - DNA, 24 bp, Artificial sequence
  SiRNA target sequence
ttaagtggtggtgaacttcaaaga

SEQ ID NO: 188532 - DNA, 24 bp, Artificial sequence
  SiRNA target sequence
taagtggtggtgaacttcaaagat

SEQ ID NO: 188533 - DNA, 24 bp, Artificial sequence
  SiRNA target sequence
aagtggtggtgaacttcaaagatt

SEQ ID NO: 188534 - DNA, 24 bp, Artificial sequence
  SiRNA target sequence
agtggtggtgaacttcaaagattt

SEQ ID NO: 188535 - DNA, 24 bp, Artificial sequence
  SiRNA target sequence
gtggtggtgaacttcaaagatttt

SEQ ID NO: 188536 - DNA, 24 bp, Artificial sequence
  SiRNA target sequence
tggtggtgaacttcaaagattttg

SEQ ID NO: 188537 - DNA, 24 bp, Artificial sequence
  SiRNA target sequence
ggtggtgaacttcaaagattttgt

SEQ ID NO: 188538 - DNA, 24 bp, Artificial sequence
  SiRNA target sequence
gtggtgaacttcaaagattttgta

SEQ ID NO: 188539 - DNA, 24 bp, Artificial sequence
  SiRNA target sequence
tggtgaacttcaaagattttgtat

SEQ ID NO: 188540 - DNA, 24 bp, Artificial sequence
  SiRNA target sequence
ggtgaacttcaaagattttgtatt

SEQ ID NO: 188541 - DNA, 24 bp, Artificial sequence
  SiRNA target sequence
gtgaacttcaaagattttgtattg

SEQ ID NO: 188542 - DNA, 24 bp, Artificial sequence
  SiRNA target sequence
tgaacttcaaagattttgtattgc

SEQ ID NO: 188543 - DNA, 24 bp, Artificial sequence
  SiRNA target sequence
gaacttcaaagattttgtattgca

SEQ ID NO: 188544 - DNA, 24 bp, Artificial sequence
  SiRNA target sequence
aacttcaaagattttgtattgcat

SEQ ID NO: 188545 - DNA, 24 bp, Artificial sequence
  SiRNA target sequence
acttcaaagattttgtattgcata

SEQ ID NO: 188546 - DNA, 24 bp, Artificial sequence
  SiRNA target sequence
cttcaaagattttgtattgcatac

SEQ ID NO: 188547 - DNA, 24 bp, Artificial sequence
  SiRNA target sequence
ttcaaagattttgtattgcataca

SEQ ID NO: 188548 - DNA, 24 bp, Artificial sequence
  SiRNA target sequence
tcaaagattttgtattgcatacac

SEQ ID NO: 188549 - DNA, 24 bp, Artificial sequence
  SiRNA target sequence
caaagattttgtattgcatacaca

SEQ ID NO: 188550 - DNA, 24 bp, Artificial sequence
  SiRNA target sequence
aaagattttgtattgcatacacat

SEQ ID NO: 188551 - DNA, 24 bp, Artificial sequence
  SiRNA target sequence
aagattttgtattgcatacacatg

SEQ ID NO: 188552 - DNA, 24 bp, Artificial sequence
  SiRNA target sequence
agattttgtattgcatacacatgt

SEQ ID NO: 188553 - DNA, 24 bp, Artificial sequence
  SiRNA target sequence
gattttgtattgcatacacatgtt

SEQ ID NO: 188554 - DNA, 24 bp, Artificial sequence
  SiRNA target sequence
attttgtattgcatacacatgttt

SEQ ID NO: 188555 - DNA, 24 bp, Artificial sequence
  SiRNA target sequence
ttttgtattgcatacacatgttta

SEQ ID NO: 188556 - DNA, 24 bp, Artificial sequence
  SiRNA target sequence
tttgtattgcatacacatgtttac

SEQ ID NO: 188557 - DNA, 24 bp, Artificial sequence
  SiRNA target sequence
ttgtattgcatacacatgtttaca

SEQ ID NO: 188558 - DNA, 24 bp, Artificial sequence
  SiRNA target sequence
tgtattgcatacacatgtttacaa

SEQ ID NO: 188559 - DNA, 24 bp, Artificial sequence
  SiRNA target sequence
gtattgcatacacatgtttacaag

SEQ ID NO: 188560 - DNA, 24 bp, Artificial sequence
  SiRNA target sequence
tattgcatacacatgtttacaaga

SEQ ID NO: 188561 - DNA, 24 bp, Artificial sequence
  SiRNA target sequence
attgcatacacatgtttacaagaa

SEQ ID NO: 188562 - DNA, 24 bp, Artificial sequence
  SiRNA target sequence
ttgcatacacatgtttacaagaag

SEQ ID NO: 188563 - DNA, 24 bp, Artificial sequence
  SiRNA target sequence
tgcatacacatgtttacaagaagg

SEQ ID NO: 188564 - DNA, 24 bp, Artificial sequence
  SiRNA target sequence
gcatacacatgtttacaagaagga

SEQ ID NO: 188565 - DNA, 24 bp, Artificial sequence
  SiRNA target sequence
catacacatgtttacaagaaggaa

SEQ ID NO: 188566 - DNA, 24 bp, Artificial sequence
  SiRNA target sequence
atacacatgtttacaagaaggaaa

SEQ ID NO: 188567 - DNA, 24 bp, Artificial sequence
  SiRNA target sequence
tacacatgtttacaagaaggaaat

SEQ ID NO: 188568 - DNA, 24 bp, Artificial sequence
  SiRNA target sequence
acacatgtttacaagaaggaaatg

SEQ ID NO: 188569 - DNA, 24 bp, Artificial sequence
  SiRNA target sequence
cacatgtttacaagaaggaaatgt

SEQ ID NO: 188570 - DNA, 24 bp, Artificial sequence
  SiRNA target sequence
acatgtttacaagaaggaaatgtt

SEQ ID NO: 188571 - DNA, 24 bp, Artificial sequence
  SiRNA target sequence
catgtttacaagaaggaaatgttt

SEQ ID NO: 188572 - DNA, 24 bp, Artificial sequence
  SiRNA target sequence
atgtttacaagaaggaaatgttta

SEQ ID NO: 188573 - DNA, 24 bp, Artificial sequence
  SiRNA target sequence
tgtttacaagaaggaaatgtttat

SEQ ID NO: 188574 - DNA, 24 bp, Artificial sequence
  SiRNA target sequence
gtttacaagaaggaaatgtttata

SEQ ID NO: 188575 - DNA, 24 bp, Artificial sequence
  SiRNA target sequence
tttacaagaaggaaatgtttatat

SEQ ID NO: 188576 - DNA, 24 bp, Artificial sequence
  SiRNA target sequence
ttacaagaaggaaatgtttatatt

SEQ ID NO: 188577 - DNA, 24 bp, Artificial sequence
  SiRNA target sequence
tacaagaaggaaatgtttatattt

SEQ ID NO: 188578 - DNA, 24 bp, Artificial sequence
  SiRNA target sequence
acaagaaggaaatgtttatatttt

SEQ ID NO: 188579 - DNA, 24 bp, Artificial sequence
  SiRNA target sequence
caagaaggaaatgtttatattttt

SEQ ID NO: 188580 - DNA, 24 bp, Artificial sequence
  SiRNA target sequence
aagaaggaaatgtttatatttttg

SEQ ID NO: 188581 - DNA, 24 bp, Artificial sequence
  SiRNA target sequence
agaaggaaatgtttatatttttga

SEQ ID NO: 188582 - DNA, 24 bp, Artificial sequence
  SiRNA target sequence
gaaggaaatgtttatatttttgat

SEQ ID NO: 188583 - DNA, 24 bp, Artificial sequence
  SiRNA target sequence
aaggaaatgtttatatttttgatg

SEQ ID NO: 188584 - DNA, 24 bp, Artificial sequence
  SiRNA target sequence
aggaaatgtttatatttttgatga

SEQ ID NO: 188585 - DNA, 24 bp, Artificial sequence
  SiRNA target sequence
ggaaatgtttatatttttgatgaa

SEQ ID NO: 188586 - DNA, 24 bp, Artificial sequence
  SiRNA target sequence
gaaatgtttatatttttgatgaac

SEQ ID NO: 188587 - DNA, 24 bp, Artificial sequence
  SiRNA target sequence
aaatgtttatatttttgatgaacc

SEQ ID NO: 188588 - DNA, 24 bp, Artificial sequence
  SiRNA target sequence
aatgtttatatttttgatgaaccc

SEQ ID NO: 188589 - DNA, 24 bp, Artificial sequence
  SiRNA target sequence
atgtttatatttttgatgaaccca

SEQ ID NO: 188590 - DNA, 24 bp, Artificial sequence
  SiRNA target sequence
tgtttatatttttgatgaacccac

SEQ ID NO: 188591 - DNA, 24 bp, Artificial sequence
  SiRNA target sequence
gtttatatttttgatgaacccact

SEQ ID NO: 188592 - DNA, 24 bp, Artificial sequence
  SiRNA target sequence
tttatatttttgatgaacccacta

SEQ ID NO: 188593 - DNA, 24 bp, Artificial sequence
  SiRNA target sequence
ttatatttttgatgaacccactag

SEQ ID NO: 188594 - DNA, 24 bp, Artificial sequence
  SiRNA target sequence
tatatttttgatgaacccactagt

SEQ ID NO: 188595 - DNA, 24 bp, Artificial sequence
  SiRNA target sequence
atatttttgatgaacccactagtt

SEQ ID NO: 188596 - DNA, 24 bp, Artificial sequence
  SiRNA target sequence
tatttttgatgaacccactagttt

SEQ ID NO: 188597 - DNA, 24 bp, Artificial sequence
  SiRNA target sequence
atttttgatgaacccactagtttt

SEQ ID NO: 188598 - DNA, 24 bp, Artificial sequence
  SiRNA target sequence
tttttgatgaacccactagttttt

SEQ ID NO: 188599 - DNA, 24 bp, Artificial sequence
  SiRNA target sequence
ttttgatgaacccactagtttttt

SEQ ID NO: 188600 - DNA, 24 bp, Artificial sequence
  SiRNA target sequence
tttgatgaacccactagttttttg

SEQ ID NO: 188601 - DNA, 24 bp, Artificial sequence
  SiRNA target sequence
ttgatgaacccactagttttttgg

SEQ ID NO: 188602 - DNA, 24 bp, Artificial sequence
  SiRNA target sequence
tgatgaacccactagttttttgga

SEQ ID NO: 188603 - DNA, 24 bp, Artificial sequence
  SiRNA target sequence
gatgaacccactagttttttggat

SEQ ID NO: 188604 - DNA, 24 bp, Artificial sequence
  SiRNA target sequence
atgaacccactagttttttggatg

SEQ ID NO: 188605 - DNA, 24 bp, Artificial sequence
  SiRNA target sequence
tgaacccactagttttttggatgt

SEQ ID NO: 188606 - DNA, 24 bp, Artificial sequence
  SiRNA target sequence
gaacccactagttttttggatgtt

SEQ ID NO: 188607 - DNA, 24 bp, Artificial sequence
  SiRNA target sequence
aacccactagttttttggatgtta

SEQ ID NO: 188608 - DNA, 24 bp, Artificial sequence
  SiRNA target sequence
acccactagttttttggatgttaa

SEQ ID NO: 188609 - DNA, 24 bp, Artificial sequence
  SiRNA target sequence
cccactagttttttggatgttaag

SEQ ID NO: 188610 - DNA, 24 bp, Artificial sequence
  SiRNA target sequence
ccactagttttttggatgttaagc

SEQ ID NO: 188611 - DNA, 24 bp, Artificial sequence
  SiRNA target sequence
cactagttttttggatgttaagca

SEQ ID NO: 188612 - DNA, 24 bp, Artificial sequence
  SiRNA target sequence
actagttttttggatgttaagcag

SEQ ID NO: 188613 - DNA, 24 bp, Artificial sequence
  SiRNA target sequence
ctagttttttggatgttaagcagc

SEQ ID NO: 188614 - DNA, 24 bp, Artificial sequence
  SiRNA target sequence
tagttttttggatgttaagcagcg

SEQ ID NO: 188615 - DNA, 24 bp, Artificial sequence
  SiRNA target sequence
agttttttggatgttaagcagcga

SEQ ID NO: 188616 - DNA, 24 bp, Artificial sequence
  SiRNA target sequence
gttttttggatgttaagcagcgac

SEQ ID NO: 188617 - DNA, 24 bp, Artificial sequence
  SiRNA target sequence
ttttttggatgttaagcagcgact

SEQ ID NO: 188618 - DNA, 24 bp, Artificial sequence
  SiRNA target sequence
tttttggatgttaagcagcgacta

SEQ ID NO: 188619 - DNA, 24 bp, Artificial sequence
  SiRNA target sequence
ttttggatgttaagcagcgactag

SEQ ID NO: 188620 - DNA, 24 bp, Artificial sequence
  SiRNA target sequence
tttggatgttaagcagcgactagc

SEQ ID NO: 188621 - DNA, 24 bp, Artificial sequence
  SiRNA target sequence
ttggatgttaagcagcgactagca

SEQ ID NO: 188622 - DNA, 24 bp, Artificial sequence
  SiRNA target sequence
tggatgttaagcagcgactagcag

SEQ ID NO: 188623 - DNA, 24 bp, Artificial sequence
  SiRNA target sequence
ggatgttaagcagcgactagcagc

SEQ ID NO: 188624 - DNA, 24 bp, Artificial sequence
  SiRNA target sequence
gatgttaagcagcgactagcagct

SEQ ID NO: 188625 - DNA, 24 bp, Artificial sequence
  SiRNA target sequence
atgttaagcagcgactagcagctg

SEQ ID NO: 188626 - DNA, 24 bp, Artificial sequence
  SiRNA target sequence
tgttaagcagcgactagcagctgc

SEQ ID NO: 188627 - DNA, 24 bp, Artificial sequence
  SiRNA target sequence
gttaagcagcgactagcagctgct

SEQ ID NO: 188628 - DNA, 24 bp, Artificial sequence
  SiRNA target sequence
ttaagcagcgactagcagctgcta

SEQ ID NO: 188629 - DNA, 24 bp, Artificial sequence
  SiRNA target sequence
taagcagcgactagcagctgctaa

SEQ ID NO: 188630 - DNA, 24 bp, Artificial sequence
  SiRNA target sequence
aagcagcgactagcagctgctaag

SEQ ID NO: 188631 - DNA, 24 bp, Artificial sequence
  SiRNA target sequence
agcagcgactagcagctgctaagg

SEQ ID NO: 188632 - DNA, 24 bp, Artificial sequence
  SiRNA target sequence
gcagcgactagcagctgctaagga

SEQ ID NO: 188633 - DNA, 24 bp, Artificial sequence
  SiRNA target sequence
cagcgactagcagctgctaaggaa

SEQ ID NO: 188634 - DNA, 24 bp, Artificial sequence
  SiRNA target sequence
agcgactagcagctgctaaggaaa

SEQ ID NO: 188635 - DNA, 24 bp, Artificial sequence
  SiRNA target sequence
gcgactagcagctgctaaggaaat

SEQ ID NO: 188636 - DNA, 24 bp, Artificial sequence
  SiRNA target sequence
cgactagcagctgctaaggaaata

SEQ ID NO: 188637 - DNA, 24 bp, Artificial sequence
  SiRNA target sequence
gactagcagctgctaaggaaataa

SEQ ID NO: 188638 - DNA, 24 bp, Artificial sequence
  SiRNA target sequence
actagcagctgctaaggaaataag

SEQ ID NO: 188639 - DNA, 24 bp, Artificial sequence
  SiRNA target sequence
ctagcagctgctaaggaaataaga

SEQ ID NO: 188640 - DNA, 24 bp, Artificial sequence
  SiRNA target sequence
tagcagctgctaaggaaataagaa

SEQ ID NO: 188641 - DNA, 24 bp, Artificial sequence
  SiRNA target sequence
agcagctgctaaggaaataagaaa

SEQ ID NO: 188642 - DNA, 24 bp, Artificial sequence
  SiRNA target sequence
gcagctgctaaggaaataagaaat

SEQ ID NO: 188643 - DNA, 24 bp, Artificial sequence
  SiRNA target sequence
cagctgctaaggaaataagaaatt

SEQ ID NO: 188644 - DNA, 24 bp, Artificial sequence
  SiRNA target sequence
agctgctaaggaaataagaaattt

SEQ ID NO: 188645 - DNA, 24 bp, Artificial sequence
  SiRNA target sequence
gctgctaaggaaataagaaatttg

SEQ ID NO: 188646 - DNA, 24 bp, Artificial sequence
  SiRNA target sequence
ctgctaaggaaataagaaatttgt

SEQ ID NO: 188647 - DNA, 24 bp, Artificial sequence
  SiRNA target sequence
tgctaaggaaataagaaatttgtg

SEQ ID NO: 188648 - DNA, 24 bp, Artificial sequence
  SiRNA target sequence
gctaaggaaataagaaatttgtgt

SEQ ID NO: 188649 - DNA, 24 bp, Artificial sequence
  SiRNA target sequence
ctaaggaaataagaaatttgtgtg

SEQ ID NO: 188650 - DNA, 24 bp, Artificial sequence
  SiRNA target sequence
taaggaaataagaaatttgtgtga

SEQ ID NO: 188651 - DNA, 24 bp, Artificial sequence
  SiRNA target sequence
aaggaaataagaaatttgtgtgaa

SEQ ID NO: 188652 - DNA, 24 bp, Artificial sequence
  SiRNA target sequence
aggaaataagaaatttgtgtgaag

SEQ ID NO: 188653 - DNA, 24 bp, Artificial sequence
  SiRNA target sequence
ggaaataagaaatttgtgtgaaga

SEQ ID NO: 188654 - DNA, 24 bp, Artificial sequence
  SiRNA target sequence
gaaataagaaatttgtgtgaagaa

SEQ ID NO: 188655 - DNA, 24 bp, Artificial sequence
  SiRNA target sequence
aaataagaaatttgtgtgaagaaa

SEQ ID NO: 188656 - DNA, 24 bp, Artificial sequence
  SiRNA target sequence
aataagaaatttgtgtgaagaaaa

SEQ ID NO: 188657 - DNA, 24 bp, Artificial sequence
  SiRNA target sequence
ataagaaatttgtgtgaagaaaat

SEQ ID NO: 188658 - DNA, 24 bp, Artificial sequence
  SiRNA target sequence
taagaaatttgtgtgaagaaaata

SEQ ID NO: 188659 - DNA, 24 bp, Artificial sequence
  SiRNA target sequence
aagaaatttgtgtgaagaaaataa

SEQ ID NO: 188660 - DNA, 24 bp, Artificial sequence
  SiRNA target sequence
agaaatttgtgtgaagaaaataaa

SEQ ID NO: 188661 - DNA, 24 bp, Artificial sequence
  SiRNA target sequence
gaaatttgtgtgaagaaaataaat

SEQ ID NO: 188662 - DNA, 24 bp, Artificial sequence
  SiRNA target sequence
aaatttgtgtgaagaaaataaata

SEQ ID NO: 188663 - DNA, 24 bp, Artificial sequence
  SiRNA target sequence
aatttgtgtgaagaaaataaatat

SEQ ID NO: 188664 - DNA, 24 bp, Artificial sequence
  SiRNA target sequence
atttgtgtgaagaaaataaatatg

SEQ ID NO: 188665 - DNA, 24 bp, Artificial sequence
  SiRNA target sequence
tttgtgtgaagaaaataaatatgt

SEQ ID NO: 188666 - DNA, 24 bp, Artificial sequence
  SiRNA target sequence
ttgtgtgaagaaaataaatatgtt

SEQ ID NO: 188667 - DNA, 24 bp, Artificial sequence
  SiRNA target sequence
tgtgtgaagaaaataaatatgttg

SEQ ID NO: 188668 - DNA, 24 bp, Artificial sequence
  SiRNA target sequence
gtgtgaagaaaataaatatgttgt

SEQ ID NO: 188669 - DNA, 24 bp, Artificial sequence
  SiRNA target sequence
tgtgaagaaaataaatatgttgta

SEQ ID NO: 188670 - DNA, 24 bp, Artificial sequence
  SiRNA target sequence
gtgaagaaaataaatatgttgtag

SEQ ID NO: 188671 - DNA, 24 bp, Artificial sequence
  SiRNA target sequence
tgaagaaaataaatatgttgtagt

SEQ ID NO: 188672 - DNA, 24 bp, Artificial sequence
  SiRNA target sequence
gaagaaaataaatatgttgtagtt

SEQ ID NO: 188673 - DNA, 24 bp, Artificial sequence
  SiRNA target sequence
aagaaaataaatatgttgtagttg

SEQ ID NO: 188674 - DNA, 24 bp, Artificial sequence
  SiRNA target sequence
agaaaataaatatgttgtagttgt

SEQ ID NO: 188675 - DNA, 24 bp, Artificial sequence
  SiRNA target sequence
gaaaataaatatgttgtagttgtc

SEQ ID NO: 188676 - DNA, 24 bp, Artificial sequence
  SiRNA target sequence
aaaataaatatgttgtagttgtcg

SEQ ID NO: 188677 - DNA, 24 bp, Artificial sequence
  SiRNA target sequence
aaataaatatgttgtagttgtcga

SEQ ID NO: 188678 - DNA, 24 bp, Artificial sequence
  SiRNA target sequence
aataaatatgttgtagttgtcgaa

SEQ ID NO: 188679 - DNA, 24 bp, Artificial sequence
  SiRNA target sequence
ataaatatgttgtagttgtcgaac

SEQ ID NO: 188680 - DNA, 24 bp, Artificial sequence
  SiRNA target sequence
taaatatgttgtagttgtcgaaca

SEQ ID NO: 188681 - DNA, 24 bp, Artificial sequence
  SiRNA target sequence
aaatatgttgtagttgtcgaacac

SEQ ID NO: 188682 - DNA, 24 bp, Artificial sequence
  SiRNA target sequence
aatatgttgtagttgtcgaacacg

SEQ ID NO: 188683 - DNA, 24 bp, Artificial sequence
  SiRNA target sequence
atatgttgtagttgtcgaacacga

SEQ ID NO: 188684 - DNA, 24 bp, Artificial sequence
  SiRNA target sequence
tatgttgtagttgtcgaacacgat

SEQ ID NO: 188685 - DNA, 24 bp, Artificial sequence
  SiRNA target sequence
atgttgtagttgtcgaacacgatt

SEQ ID NO: 188686 - DNA, 24 bp, Artificial sequence
  SiRNA target sequence
tgttgtagttgtcgaacacgattt

SEQ ID NO: 188687 - DNA, 24 bp, Artificial sequence
  SiRNA target sequence
gttgtagttgtcgaacacgattta

SEQ ID NO: 188688 - DNA, 24 bp, Artificial sequence
  SiRNA target sequence
ttgtagttgtcgaacacgatttag

SEQ ID NO: 188689 - DNA, 24 bp, Artificial sequence
  SiRNA target sequence
tgtagttgtcgaacacgatttagc

SEQ ID NO: 188690 - DNA, 24 bp, Artificial sequence
  SiRNA target sequence
gtagttgtcgaacacgatttagcc

SEQ ID NO: 188691 - DNA, 24 bp, Artificial sequence
  SiRNA target sequence
tagttgtcgaacacgatttagcca

SEQ ID NO: 188692 - DNA, 24 bp, Artificial sequence
  SiRNA target sequence
agttgtcgaacacgatttagccat

SEQ ID NO: 188693 - DNA, 24 bp, Artificial sequence
  SiRNA target sequence
gttgtcgaacacgatttagccatt

SEQ ID NO: 188694 - DNA, 24 bp, Artificial sequence
  SiRNA target sequence
ttgtcgaacacgatttagccattt

SEQ ID NO: 188695 - DNA, 24 bp, Artificial sequence
  SiRNA target sequence
tgtcgaacacgatttagccatttt

SEQ ID NO: 188696 - DNA, 24 bp, Artificial sequence
  SiRNA target sequence
gtcgaacacgatttagccatttta

SEQ ID NO: 188697 - DNA, 24 bp, Artificial sequence
  SiRNA target sequence
tcgaacacgatttagccattttag

SEQ ID NO: 188698 - DNA, 24 bp, Artificial sequence
  SiRNA target sequence
cgaacacgatttagccattttaga

SEQ ID NO: 188699 - DNA, 24 bp, Artificial sequence
  SiRNA target sequence
gaacacgatttagccattttagat

SEQ ID NO: 188700 - DNA, 24 bp, Artificial sequence
  SiRNA target sequence
aacacgatttagccattttagatt

SEQ ID NO: 188701 - DNA, 24 bp, Artificial sequence
  SiRNA target sequence
acacgatttagccattttagattt

SEQ ID NO: 188702 - DNA, 24 bp, Artificial sequence
  SiRNA target sequence
cacgatttagccattttagatttg

SEQ ID NO: 188703 - DNA, 24 bp, Artificial sequence
  SiRNA target sequence
acgatttagccattttagatttga

SEQ ID NO: 188704 - DNA, 24 bp, Artificial sequence
  SiRNA target sequence
cgatttagccattttagatttgat

SEQ ID NO: 188705 - DNA, 24 bp, Artificial sequence
  SiRNA target sequence
gatttagccattttagatttgatg

SEQ ID NO: 188706 - DNA, 24 bp, Artificial sequence
  SiRNA target sequence
atttagccattttagatttgatgt

SEQ ID NO: 188707 - DNA, 24 bp, Artificial sequence
  SiRNA target sequence
tttagccattttagatttgatgtg

SEQ ID NO: 188708 - DNA, 24 bp, Artificial sequence
  SiRNA target sequence
ttagccattttagatttgatgtgt

SEQ ID NO: 188709 - DNA, 24 bp, Artificial sequence
  SiRNA target sequence
tagccattttagatttgatgtgtg

SEQ ID NO: 188710 - DNA, 24 bp, Artificial sequence
  SiRNA target sequence
agccattttagatttgatgtgtga

SEQ ID NO: 188711 - DNA, 24 bp, Artificial sequence
  SiRNA target sequence
gccattttagatttgatgtgtgat

SEQ ID NO: 188712 - DNA, 24 bp, Artificial sequence
  SiRNA target sequence
ccattttagatttgatgtgtgatt

SEQ ID NO: 188713 - DNA, 24 bp, Artificial sequence
  SiRNA target sequence
cattttagatttgatgtgtgattt

SEQ ID NO: 188714 - DNA, 24 bp, Artificial sequence
  SiRNA target sequence
attttagatttgatgtgtgatttt

SEQ ID NO: 188715 - DNA, 24 bp, Artificial sequence
  SiRNA target sequence
ttttagatttgatgtgtgattttg

SEQ ID NO: 188716 - DNA, 24 bp, Artificial sequence
  SiRNA target sequence
tttagatttgatgtgtgattttgg

SEQ ID NO: 188717 - DNA, 24 bp, Artificial sequence
  SiRNA target sequence
ttagatttgatgtgtgattttgga

SEQ ID NO: 188718 - DNA, 24 bp, Artificial sequence
  SiRNA target sequence
tagatttgatgtgtgattttggat

SEQ ID NO: 188719 - DNA, 24 bp, Artificial sequence
  SiRNA target sequence
agatttgatgtgtgattttggatg

SEQ ID NO: 188720 - DNA, 24 bp, Artificial sequence
  SiRNA target sequence
gatttgatgtgtgattttggatgt

SEQ ID NO: 188721 - DNA, 24 bp, Artificial sequence
  SiRNA target sequence
atttgatgtgtgattttggatgtg

SEQ ID NO: 188722 - DNA, 24 bp, Artificial sequence
  SiRNA target sequence
tttgatgtgtgattttggatgtgt

SEQ ID NO: 188723 - DNA, 24 bp, Artificial sequence
  SiRNA target sequence
ttgatgtgtgattttggatgtgtt

SEQ ID NO: 188724 - DNA, 24 bp, Artificial sequence
  SiRNA target sequence
tgatgtgtgattttggatgtgttc

SEQ ID NO: 188725 - DNA, 24 bp, Artificial sequence
  SiRNA target sequence
gatgtgtgattttggatgtgttct

SEQ ID NO: 188726 - DNA, 24 bp, Artificial sequence
  SiRNA target sequence
atgtgtgattttggatgtgttcta

SEQ ID NO: 188727 - DNA, 24 bp, Artificial sequence
  SiRNA target sequence
tgtgtgattttggatgtgttctat

SEQ ID NO: 188728 - DNA, 24 bp, Artificial sequence
  SiRNA target sequence
gtgtgattttggatgtgttctata

SEQ ID NO: 188729 - DNA, 24 bp, Artificial sequence
  SiRNA target sequence
tgtgattttggatgtgttctatac

SEQ ID NO: 188730 - DNA, 24 bp, Artificial sequence
  SiRNA target sequence
gtgattttggatgtgttctatacg

SEQ ID NO: 188731 - DNA, 24 bp, Artificial sequence
  SiRNA target sequence
tgattttggatgtgttctatacgg

SEQ ID NO: 188732 - DNA, 24 bp, Artificial sequence
  SiRNA target sequence
gattttggatgtgttctatacgga

SEQ ID NO: 188733 - DNA, 24 bp, Artificial sequence
  SiRNA target sequence
attttggatgtgttctatacggac

SEQ ID NO: 188734 - DNA, 24 bp, Artificial sequence
  SiRNA target sequence
ttttggatgtgttctatacggaca

SEQ ID NO: 188735 - DNA, 24 bp, Artificial sequence
  SiRNA target sequence
tttggatgtgttctatacggacaa

SEQ ID NO: 188736 - DNA, 24 bp, Artificial sequence
  SiRNA target sequence
ttggatgtgttctatacggacaat

SEQ ID NO: 188737 - DNA, 24 bp, Artificial sequence
  SiRNA target sequence
tggatgtgttctatacggacaatc

SEQ ID NO: 188738 - DNA, 24 bp, Artificial sequence
  SiRNA target sequence
ggatgtgttctatacggacaatct

SEQ ID NO: 188739 - DNA, 24 bp, Artificial sequence
  SiRNA target sequence
gatgtgttctatacggacaatctg

SEQ ID NO: 188740 - DNA, 24 bp, Artificial sequence
  SiRNA target sequence
atgtgttctatacggacaatctgg

SEQ ID NO: 188741 - DNA, 24 bp, Artificial sequence
  SiRNA target sequence
tgtgttctatacggacaatctggg

SEQ ID NO: 188742 - DNA, 24 bp, Artificial sequence
  SiRNA target sequence
gtgttctatacggacaatctgggg

SEQ ID NO: 188743 - DNA, 24 bp, Artificial sequence
  SiRNA target sequence
tgttctatacggacaatctggggc

SEQ ID NO: 188744 - DNA, 24 bp, Artificial sequence
  SiRNA target sequence
gttctatacggacaatctggggca

SEQ ID NO: 188745 - DNA, 24 bp, Artificial sequence
  SiRNA target sequence
ttctatacggacaatctggggcat

SEQ ID NO: 188746 - DNA, 24 bp, Artificial sequence
  SiRNA target sequence
tctatacggacaatctggggcata

SEQ ID NO: 188747 - DNA, 24 bp, Artificial sequence
  SiRNA target sequence
ctatacggacaatctggggcatac

SEQ ID NO: 188748 - DNA, 24 bp, Artificial sequence
  SiRNA target sequence
tatacggacaatctggggcatacg

SEQ ID NO: 188749 - DNA, 24 bp, Artificial sequence
  SiRNA target sequence
atacggacaatctggggcatacgg

SEQ ID NO: 188750 - DNA, 24 bp, Artificial sequence
  SiRNA target sequence
tacggacaatctggggcatacggt

SEQ ID NO: 188751 - DNA, 24 bp, Artificial sequence
  SiRNA target sequence
acggacaatctggggcatacggtg

SEQ ID NO: 188752 - DNA, 24 bp, Artificial sequence
  SiRNA target sequence
cggacaatctggggcatacggtgt

SEQ ID NO: 188753 - DNA, 24 bp, Artificial sequence
  SiRNA target sequence
ggacaatctggggcatacggtgta

SEQ ID NO: 188754 - DNA, 24 bp, Artificial sequence
  SiRNA target sequence
gacaatctggggcatacggtgtaa

SEQ ID NO: 188755 - DNA, 24 bp, Artificial sequence
  SiRNA target sequence
acaatctggggcatacggtgtaat

SEQ ID NO: 188756 - DNA, 24 bp, Artificial sequence
  SiRNA target sequence
caatctggggcatacggtgtaata

SEQ ID NO: 188757 - DNA, 24 bp, Artificial sequence
  SiRNA target sequence
aatctggggcatacggtgtaataa

SEQ ID NO: 188758 - DNA, 24 bp, Artificial sequence
  SiRNA target sequence
atctggggcatacggtgtaataag

SEQ ID NO: 188759 - DNA, 24 bp, Artificial sequence
  SiRNA target sequence
tctggggcatacggtgtaataagc

SEQ ID NO: 188760 - DNA, 24 bp, Artificial sequence
  SiRNA target sequence
ctggggcatacggtgtaataagcg

SEQ ID NO: 188761 - DNA, 24 bp, Artificial sequence
  SiRNA target sequence
tggggcatacggtgtaataagcgc

SEQ ID NO: 188762 - DNA, 24 bp, Artificial sequence
  SiRNA target sequence
ggggcatacggtgtaataagcgca

SEQ ID NO: 188763 - DNA, 24 bp, Artificial sequence
  SiRNA target sequence
gggcatacggtgtaataagcgcac

SEQ ID NO: 188764 - DNA, 24 bp, Artificial sequence
  SiRNA target sequence
ggcatacggtgtaataagcgcacc

SEQ ID NO: 188765 - DNA, 24 bp, Artificial sequence
  SiRNA target sequence
gcatacggtgtaataagcgcacca

SEQ ID NO: 188766 - DNA, 24 bp, Artificial sequence
  SiRNA target sequence
catacggtgtaataagcgcaccat

SEQ ID NO: 188767 - DNA, 24 bp, Artificial sequence
  SiRNA target sequence
atacggtgtaataagcgcaccata

SEQ ID NO: 188768 - DNA, 24 bp, Artificial sequence
  SiRNA target sequence
tacggtgtaataagcgcaccatac

SEQ ID NO: 188769 - DNA, 24 bp, Artificial sequence
  SiRNA target sequence
acggtgtaataagcgcaccatacg

SEQ ID NO: 188770 - DNA, 24 bp, Artificial sequence
  SiRNA target sequence
cggtgtaataagcgcaccatacgt

SEQ ID NO: 188771 - DNA, 24 bp, Artificial sequence
  SiRNA target sequence
ggtgtaataagcgcaccatacgtt

SEQ ID NO: 188772 - DNA, 24 bp, Artificial sequence
  SiRNA target sequence
gtgtaataagcgcaccatacgtta

SEQ ID NO: 188773 - DNA, 24 bp, Artificial sequence
  SiRNA target sequence
tgtaataagcgcaccatacgttat

SEQ ID NO: 188774 - DNA, 24 bp, Artificial sequence
  SiRNA target sequence
gtaataagcgcaccatacgttatt

SEQ ID NO: 188775 - DNA, 24 bp, Artificial sequence
  SiRNA target sequence
taataagcgcaccatacgttatta

SEQ ID NO: 188776 - DNA, 24 bp, Artificial sequence
  SiRNA target sequence
aataagcgcaccatacgttattaa

SEQ ID NO: 188777 - DNA, 24 bp, Artificial sequence
  SiRNA target sequence
ataagcgcaccatacgttattaaa

SEQ ID NO: 188778 - DNA, 24 bp, Artificial sequence
  SiRNA target sequence
taagcgcaccatacgttattaaat

SEQ ID NO: 188779 - DNA, 24 bp, Artificial sequence
  SiRNA target sequence
aagcgcaccatacgttattaaatc

SEQ ID NO: 188780 - DNA, 24 bp, Artificial sequence
  SiRNA target sequence
agcgcaccatacgttattaaatca

SEQ ID NO: 188781 - DNA, 24 bp, Artificial sequence
  SiRNA target sequence
gcgcaccatacgttattaaatcag

SEQ ID NO: 188782 - DNA, 24 bp, Artificial sequence
  SiRNA target sequence
cgcaccatacgttattaaatcagc

SEQ ID NO: 188783 - DNA, 24 bp, Artificial sequence
  SiRNA target sequence
gcaccatacgttattaaatcagca

SEQ ID NO: 188784 - DNA, 24 bp, Artificial sequence
  SiRNA target sequence
caccatacgttattaaatcagcaa

SEQ ID NO: 188785 - DNA, 24 bp, Artificial sequence
  SiRNA target sequence
accatacgttattaaatcagcaat

SEQ ID NO: 188786 - DNA, 24 bp, Artificial sequence
  SiRNA target sequence
ccatacgttattaaatcagcaata

SEQ ID NO: 188787 - DNA, 24 bp, Artificial sequence
  SiRNA target sequence
catacgttattaaatcagcaataa

SEQ ID NO: 188788 - DNA, 24 bp, Artificial sequence
  SiRNA target sequence
atacgttattaaatcagcaataaa

SEQ ID NO: 188789 - DNA, 24 bp, Artificial sequence
  SiRNA target sequence
tacgttattaaatcagcaataaat

SEQ ID NO: 188790 - DNA, 24 bp, Artificial sequence
  SiRNA target sequence
acgttattaaatcagcaataaata

SEQ ID NO: 188791 - DNA, 24 bp, Artificial sequence
  SiRNA target sequence
cgttattaaatcagcaataaatat

SEQ ID NO: 188792 - DNA, 24 bp, Artificial sequence
  SiRNA target sequence
gttattaaatcagcaataaatata

SEQ ID NO: 188793 - DNA, 24 bp, Artificial sequence
  SiRNA target sequence
ttattaaatcagcaataaatatat

SEQ ID NO: 188794 - DNA, 24 bp, Artificial sequence
  SiRNA target sequence
tattaaatcagcaataaatatatt

SEQ ID NO: 188795 - DNA, 24 bp, Artificial sequence
  SiRNA target sequence
attaaatcagcaataaatatattt

SEQ ID NO: 188796 - DNA, 24 bp, Artificial sequence
  SiRNA target sequence
ttaaatcagcaataaatatatttc

SEQ ID NO: 188797 - DNA, 24 bp, Artificial sequence
  SiRNA target sequence
taaatcagcaataaatatatttct

SEQ ID NO: 188798 - DNA, 24 bp, Artificial sequence
  SiRNA target sequence
aaatcagcaataaatatatttctt

SEQ ID NO: 188799 - DNA, 24 bp, Artificial sequence
  SiRNA target sequence
aatcagcaataaatatatttcttg

SEQ ID NO: 188800 - DNA, 24 bp, Artificial sequence
  SiRNA target sequence
atcagcaataaatatatttcttga

SEQ ID NO: 188801 - DNA, 24 bp, Artificial sequence
  SiRNA target sequence
tcagcaataaatatatttcttgat

SEQ ID NO: 188802 - DNA, 24 bp, Artificial sequence
  SiRNA target sequence
cagcaataaatatatttcttgatg

SEQ ID NO: 188803 - DNA, 24 bp, Artificial sequence
  SiRNA target sequence
agcaataaatatatttcttgatgg

SEQ ID NO: 188804 - DNA, 24 bp, Artificial sequence
  SiRNA target sequence
gcaataaatatatttcttgatgga

SEQ ID NO: 188805 - DNA, 24 bp, Artificial sequence
  SiRNA target sequence
caataaatatatttcttgatggat

SEQ ID NO: 188806 - DNA, 24 bp, Artificial sequence
  SiRNA target sequence
aataaatatatttcttgatggatt

SEQ ID NO: 188807 - DNA, 24 bp, Artificial sequence
  SiRNA target sequence
ataaatatatttcttgatggattt

SEQ ID NO: 188808 - DNA, 24 bp, Artificial sequence
  SiRNA target sequence
taaatatatttcttgatggatttt

SEQ ID NO: 188809 - DNA, 24 bp, Artificial sequence
  SiRNA target sequence
aaatatatttcttgatggattttt

SEQ ID NO: 188810 - DNA, 24 bp, Artificial sequence
  SiRNA target sequence
aatatatttcttgatggatttttg

SEQ ID NO: 188811 - DNA, 24 bp, Artificial sequence
  SiRNA target sequence
atatatttcttgatggatttttgc

SEQ ID NO: 188812 - DNA, 24 bp, Artificial sequence
  SiRNA target sequence
tatatttcttgatggatttttgcc

SEQ ID NO: 188813 - DNA, 24 bp, Artificial sequence
  SiRNA target sequence
atatttcttgatggatttttgcct

SEQ ID NO: 188814 - DNA, 24 bp, Artificial sequence
  SiRNA target sequence
tatttcttgatggatttttgccta

SEQ ID NO: 188815 - DNA, 24 bp, Artificial sequence
  SiRNA target sequence
atttcttgatggatttttgcctac

SEQ ID NO: 188816 - DNA, 24 bp, Artificial sequence
  SiRNA target sequence
tttcttgatggatttttgcctaca

SEQ ID NO: 188817 - DNA, 24 bp, Artificial sequence
  SiRNA target sequence
ttcttgatggatttttgcctacag

SEQ ID NO: 188818 - DNA, 24 bp, Artificial sequence
  SiRNA target sequence
tcttgatggatttttgcctacaga

SEQ ID NO: 188819 - DNA, 24 bp, Artificial sequence
  SiRNA target sequence
cttgatggatttttgcctacagaa

SEQ ID NO: 188820 - DNA, 24 bp, Artificial sequence
  SiRNA target sequence
ttgatggatttttgcctacagaaa

SEQ ID NO: 188821 - DNA, 24 bp, Artificial sequence
  SiRNA target sequence
tgatggatttttgcctacagaaaa

SEQ ID NO: 188822 - DNA, 24 bp, Artificial sequence
  SiRNA target sequence
gatggatttttgcctacagaaaac

SEQ ID NO: 188823 - DNA, 24 bp, Artificial sequence
  SiRNA target sequence
atggatttttgcctacagaaaaca

SEQ ID NO: 188824 - DNA, 24 bp, Artificial sequence
  SiRNA target sequence
tggatttttgcctacagaaaacat

SEQ ID NO: 188825 - DNA, 24 bp, Artificial sequence
  SiRNA target sequence
ggatttttgcctacagaaaacatg

SEQ ID NO: 188826 - DNA, 24 bp, Artificial sequence
  SiRNA target sequence
gatttttgcctacagaaaacatga

SEQ ID NO: 188827 - DNA, 24 bp, Artificial sequence
  SiRNA target sequence
atttttgcctacagaaaacatgaa

SEQ ID NO: 188828 - DNA, 24 bp, Artificial sequence
  SiRNA target sequence
tttttgcctacagaaaacatgaaa

SEQ ID NO: 188829 - DNA, 24 bp, Artificial sequence
  SiRNA target sequence
ttttgcctacagaaaacatgaaat

SEQ ID NO: 188830 - DNA, 24 bp, Artificial sequence
  SiRNA target sequence
tttgcctacagaaaacatgaaatt

SEQ ID NO: 188831 - DNA, 24 bp, Artificial sequence
  SiRNA target sequence
ttgcctacagaaaacatgaaattt

SEQ ID NO: 188832 - DNA, 24 bp, Artificial sequence
  SiRNA target sequence
tgcctacagaaaacatgaaattta

SEQ ID NO: 188833 - DNA, 24 bp, Artificial sequence
  SiRNA target sequence
gcctacagaaaacatgaaatttag

SEQ ID NO: 188834 - DNA, 24 bp, Artificial sequence
  SiRNA target sequence
cctacagaaaacatgaaatttaga

SEQ ID NO: 188835 - DNA, 24 bp, Artificial sequence
  SiRNA target sequence
ctacagaaaacatgaaatttagaa

SEQ ID NO: 188836 - DNA, 24 bp, Artificial sequence
  SiRNA target sequence
tacagaaaacatgaaatttagaaa

SEQ ID NO: 188837 - DNA, 24 bp, Artificial sequence
  SiRNA target sequence
acagaaaacatgaaatttagaaat

SEQ ID NO: 188838 - DNA, 24 bp, Artificial sequence
  SiRNA target sequence
cagaaaacatgaaatttagaaatt

SEQ ID NO: 188839 - DNA, 24 bp, Artificial sequence
  SiRNA target sequence
agaaaacatgaaatttagaaattc

SEQ ID NO: 188840 - DNA, 24 bp, Artificial sequence
  SiRNA target sequence
gaaaacatgaaatttagaaattca

SEQ ID NO: 188841 - DNA, 24 bp, Artificial sequence
  SiRNA target sequence
aaaacatgaaatttagaaattcag

SEQ ID NO: 188842 - DNA, 24 bp, Artificial sequence
  SiRNA target sequence
aaacatgaaatttagaaattcaga

SEQ ID NO: 188843 - DNA, 24 bp, Artificial sequence
  SiRNA target sequence
aacatgaaatttagaaattcagag

SEQ ID NO: 188844 - DNA, 24 bp, Artificial sequence
  SiRNA target sequence
acatgaaatttagaaattcagagt

SEQ ID NO: 188845 - DNA, 24 bp, Artificial sequence
  SiRNA target sequence
catgaaatttagaaattcagagtt

SEQ ID NO: 188846 - DNA, 24 bp, Artificial sequence
  SiRNA target sequence
atgaaatttagaaattcagagtta

SEQ ID NO: 188847 - DNA, 24 bp, Artificial sequence
  SiRNA target sequence
tgaaatttagaaattcagagttaa

SEQ ID NO: 188848 - DNA, 24 bp, Artificial sequence
  SiRNA target sequence
gaaatttagaaattcagagttaaa

SEQ ID NO: 188849 - DNA, 24 bp, Artificial sequence
  SiRNA target sequence
aaatttagaaattcagagttaaag

SEQ ID NO: 188850 - DNA, 24 bp, Artificial sequence
  SiRNA target sequence
aatttagaaattcagagttaaagt

SEQ ID NO: 188851 - DNA, 24 bp, Artificial sequence
  SiRNA target sequence
atttagaaattcagagttaaagtt

SEQ ID NO: 188852 - DNA, 24 bp, Artificial sequence
  SiRNA target sequence
tttagaaattcagagttaaagttt

SEQ ID NO: 188853 - DNA, 24 bp, Artificial sequence
  SiRNA target sequence
ttagaaattcagagttaaagttta

SEQ ID NO: 188854 - DNA, 24 bp, Artificial sequence
  SiRNA target sequence
tagaaattcagagttaaagtttaa

SEQ ID NO: 188855 - DNA, 24 bp, Artificial sequence
  SiRNA target sequence
agaaattcagagttaaagtttaat

SEQ ID NO: 188856 - DNA, 24 bp, Artificial sequence
  SiRNA target sequence
gaaattcagagttaaagtttaata

SEQ ID NO: 188857 - DNA, 24 bp, Artificial sequence
  SiRNA target sequence
aaattcagagttaaagtttaatat

SEQ ID NO: 188858 - DNA, 24 bp, Artificial sequence
  SiRNA target sequence
aattcagagttaaagtttaatatt

SEQ ID NO: 188859 - DNA, 24 bp, Artificial sequence
  SiRNA target sequence
attcagagttaaagtttaatattt

SEQ ID NO: 188860 - DNA, 24 bp, Artificial sequence
  SiRNA target sequence
ttcagagttaaagtttaatatttc

SEQ ID NO: 188861 - DNA, 24 bp, Artificial sequence
  SiRNA target sequence
tcagagttaaagtttaatatttcg

SEQ ID NO: 188862 - DNA, 24 bp, Artificial sequence
  SiRNA target sequence
cagagttaaagtttaatatttcgg

SEQ ID NO: 188863 - DNA, 24 bp, Artificial sequence
  SiRNA target sequence
agagttaaagtttaatatttcgga

SEQ ID NO: 188864 - DNA, 24 bp, Artificial sequence
  SiRNA target sequence
gagttaaagtttaatatttcggaa

SEQ ID NO: 188865 - DNA, 24 bp, Artificial sequence
  SiRNA target sequence
agttaaagtttaatatttcggaaa

SEQ ID NO: 188866 - DNA, 24 bp, Artificial sequence
  SiRNA target sequence
gttaaagtttaatatttcggaaac

SEQ ID NO: 188867 - DNA, 24 bp, Artificial sequence
  SiRNA target sequence
ttaaagtttaatatttcggaaaca

SEQ ID NO: 188868 - DNA, 24 bp, Artificial sequence
  SiRNA target sequence
taaagtttaatatttcggaaacac

SEQ ID NO: 188869 - DNA, 24 bp, Artificial sequence
  SiRNA target sequence
aaagtttaatatttcggaaacact

SEQ ID NO: 188870 - DNA, 24 bp, Artificial sequence
  SiRNA target sequence
aagtttaatatttcggaaacactt

SEQ ID NO: 188871 - DNA, 24 bp, Artificial sequence
  SiRNA target sequence
agtttaatatttcggaaacacttg

SEQ ID NO: 188872 - DNA, 24 bp, Artificial sequence
  SiRNA target sequence
gtttaatatttcggaaacacttga

SEQ ID NO: 188873 - DNA, 24 bp, Artificial sequence
  SiRNA target sequence
tttaatatttcggaaacacttgat

SEQ ID NO: 188874 - DNA, 24 bp, Artificial sequence
  SiRNA target sequence
ttaatatttcggaaacacttgata

SEQ ID NO: 188875 - DNA, 24 bp, Artificial sequence
  SiRNA target sequence
taatatttcggaaacacttgatag

SEQ ID NO: 188876 - DNA, 24 bp, Artificial sequence
  SiRNA target sequence
aatatttcggaaacacttgatagt

SEQ ID NO: 188877 - DNA, 24 bp, Artificial sequence
  SiRNA target sequence
atatttcggaaacacttgatagta

SEQ ID NO: 188878 - DNA, 24 bp, Artificial sequence
  SiRNA target sequence
tatttcggaaacacttgatagtat

SEQ ID NO: 188879 - DNA, 24 bp, Artificial sequence
  SiRNA target sequence
atttcggaaacacttgatagtatt

SEQ ID NO: 188880 - DNA, 24 bp, Artificial sequence
  SiRNA target sequence
tttcggaaacacttgatagtatta

SEQ ID NO: 188881 - DNA, 24 bp, Artificial sequence
  SiRNA target sequence
ttcggaaacacttgatagtattat

SEQ ID NO: 188882 - DNA, 24 bp, Artificial sequence
  SiRNA target sequence
tcggaaacacttgatagtattata

SEQ ID NO: 188883 - DNA, 24 bp, Artificial sequence
  SiRNA target sequence
cggaaacacttgatagtattatat

SEQ ID NO: 188884 - DNA, 24 bp, Artificial sequence
  SiRNA target sequence
ggaaacacttgatagtattatatc

SEQ ID NO: 188885 - DNA, 24 bp, Artificial sequence
  SiRNA target sequence
gaaacacttgatagtattatatct

SEQ ID NO: 188886 - DNA, 24 bp, Artificial sequence
  SiRNA target sequence
aaacacttgatagtattatatcta

SEQ ID NO: 188887 - DNA, 24 bp, Artificial sequence
  SiRNA target sequence
aacacttgatagtattatatctac

SEQ ID NO: 188888 - DNA, 24 bp, Artificial sequence
  SiRNA target sequence
acacttgatagtattatatctacc

SEQ ID NO: 188889 - DNA, 24 bp, Artificial sequence
  SiRNA target sequence
cacttgatagtattatatctacca

SEQ ID NO: 188890 - DNA, 24 bp, Artificial sequence
  SiRNA target sequence
acttgatagtattatatctaccag

SEQ ID NO: 188891 - DNA, 24 bp, Artificial sequence
  SiRNA target sequence
cttgatagtattatatctaccaga

SEQ ID NO: 188892 - DNA, 24 bp, Artificial sequence
  SiRNA target sequence
ttgatagtattatatctaccagag

SEQ ID NO: 188893 - DNA, 24 bp, Artificial sequence
  SiRNA target sequence
tgatagtattatatctaccagaga

SEQ ID NO: 188894 - DNA, 24 bp, Artificial sequence
  SiRNA target sequence
gatagtattatatctaccagagac

SEQ ID NO: 188895 - DNA, 24 bp, Artificial sequence
  SiRNA target sequence
atagtattatatctaccagagacc

SEQ ID NO: 188896 - DNA, 24 bp, Artificial sequence
  SiRNA target sequence
tagtattatatctaccagagacca

SEQ ID NO: 188897 - DNA, 24 bp, Artificial sequence
  SiRNA target sequence
agtattatatctaccagagaccag

SEQ ID NO: 188898 - DNA, 24 bp, Artificial sequence
  SiRNA target sequence
gtattatatctaccagagaccagt

SEQ ID NO: 188899 - DNA, 24 bp, Artificial sequence
  SiRNA target sequence
tattatatctaccagagaccagta

SEQ ID NO: 188900 - DNA, 24 bp, Artificial sequence
  SiRNA target sequence
attatatctaccagagaccagtat

SEQ ID NO: 188901 - DNA, 24 bp, Artificial sequence
  SiRNA target sequence
ttatatctaccagagaccagtatc

SEQ ID NO: 188902 - DNA, 24 bp, Artificial sequence
  SiRNA target sequence
tatatctaccagagaccagtatca

SEQ ID NO: 188903 - DNA, 24 bp, Artificial sequence
  SiRNA target sequence
atatctaccagagaccagtatcat

SEQ ID NO: 188904 - DNA, 24 bp, Artificial sequence
  SiRNA target sequence
tatctaccagagaccagtatcatt

SEQ ID NO: 188905 - DNA, 24 bp, Artificial sequence
  SiRNA target sequence
atctaccagagaccagtatcatta

SEQ ID NO: 188906 - DNA, 24 bp, Artificial sequence
  SiRNA target sequence
tctaccagagaccagtatcattat

SEQ ID NO: 188907 - DNA, 24 bp, Artificial sequence
  SiRNA target sequence
ctaccagagaccagtatcattatc

SEQ ID NO: 188908 - DNA, 24 bp, Artificial sequence
  SiRNA target sequence
taccagagaccagtatcattatcc

SEQ ID NO: 188909 - DNA, 24 bp, Artificial sequence
  SiRNA target sequence
accagagaccagtatcattatccc

SEQ ID NO: 188910 - DNA, 24 bp, Artificial sequence
  SiRNA target sequence
ccagagaccagtatcattatccca

SEQ ID NO: 188911 - DNA, 24 bp, Artificial sequence
  SiRNA target sequence
cagagaccagtatcattatcccaa

SEQ ID NO: 188912 - DNA, 24 bp, Artificial sequence
  SiRNA target sequence
agagaccagtatcattatcccaat

SEQ ID NO: 188913 - DNA, 24 bp, Artificial sequence
  SiRNA target sequence
gagaccagtatcattatcccaatt

SEQ ID NO: 188914 - DNA, 24 bp, Artificial sequence
  SiRNA target sequence
agaccagtatcattatcccaattt

SEQ ID NO: 188915 - DNA, 24 bp, Artificial sequence
  SiRNA target sequence
gaccagtatcattatcccaatttg

SEQ ID NO: 188916 - DNA, 24 bp, Artificial sequence
  SiRNA target sequence
accagtatcattatcccaatttga

SEQ ID NO: 188917 - DNA, 24 bp, Artificial sequence
  SiRNA target sequence
ccagtatcattatcccaatttgat

SEQ ID NO: 188918 - DNA, 24 bp, Artificial sequence
  SiRNA target sequence
cagtatcattatcccaatttgata

SEQ ID NO: 188919 - DNA, 24 bp, Artificial sequence
  SiRNA target sequence
agtatcattatcccaatttgataa

SEQ ID NO: 188920 - DNA, 24 bp, Artificial sequence
  SiRNA target sequence
gtatcattatcccaatttgataaa

SEQ ID NO: 188921 - DNA, 24 bp, Artificial sequence
  SiRNA target sequence
tatcattatcccaatttgataaaa

SEQ ID NO: 188922 - DNA, 24 bp, Artificial sequence
  SiRNA target sequence
atcattatcccaatttgataaaaa

SEQ ID NO: 188923 - DNA, 24 bp, Artificial sequence
  SiRNA target sequence
tcattatcccaatttgataaaaac

SEQ ID NO: 188924 - DNA, 24 bp, Artificial sequence
  SiRNA target sequence
cattatcccaatttgataaaaaca

SEQ ID NO: 188925 - DNA, 24 bp, Artificial sequence
  SiRNA target sequence
attatcccaatttgataaaaacat

SEQ ID NO: 188926 - DNA, 24 bp, Artificial sequence
  SiRNA target sequence
ttatcccaatttgataaaaacata

SEQ ID NO: 188927 - DNA, 24 bp, Artificial sequence
  SiRNA target sequence
tatcccaatttgataaaaacatat

SEQ ID NO: 188928 - DNA, 24 bp, Artificial sequence
  SiRNA target sequence
atcccaatttgataaaaacatatc

SEQ ID NO: 188929 - DNA, 24 bp, Artificial sequence
  SiRNA target sequence
tcccaatttgataaaaacatatcc

SEQ ID NO: 188930 - DNA, 24 bp, Artificial sequence
  SiRNA target sequence
cccaatttgataaaaacatatcca

SEQ ID NO: 188931 - DNA, 24 bp, Artificial sequence
  SiRNA target sequence
ccaatttgataaaaacatatccaa

SEQ ID NO: 188932 - DNA, 24 bp, Artificial sequence
  SiRNA target sequence
caatttgataaaaacatatccaaa

SEQ ID NO: 188933 - DNA, 24 bp, Artificial sequence
  SiRNA target sequence
aatttgataaaaacatatccaaat

SEQ ID NO: 188934 - DNA, 24 bp, Artificial sequence
  SiRNA target sequence
atttgataaaaacatatccaaatt

SEQ ID NO: 188935 - DNA, 24 bp, Artificial sequence
  SiRNA target sequence
tttgataaaaacatatccaaattt

SEQ ID NO: 188936 - DNA, 24 bp, Artificial sequence
  SiRNA target sequence
ttgataaaaacatatccaaatttt

SEQ ID NO: 188937 - DNA, 24 bp, Artificial sequence
  SiRNA target sequence
tgataaaaacatatccaaatttta

SEQ ID NO: 188938 - DNA, 24 bp, Artificial sequence
  SiRNA target sequence
gataaaaacatatccaaattttac

SEQ ID NO: 188939 - DNA, 24 bp, Artificial sequence
  SiRNA target sequence
ataaaaacatatccaaattttacg

SEQ ID NO: 188940 - DNA, 24 bp, Artificial sequence
  SiRNA target sequence
taaaaacatatccaaattttacgc

SEQ ID NO: 188941 - DNA, 24 bp, Artificial sequence
  SiRNA target sequence
aaaaacatatccaaattttacgct

SEQ ID NO: 188942 - DNA, 24 bp, Artificial sequence
  SiRNA target sequence
aaaacatatccaaattttacgctt

SEQ ID NO: 188943 - DNA, 24 bp, Artificial sequence
  SiRNA target sequence
aaacatatccaaattttacgctta

SEQ ID NO: 188944 - DNA, 24 bp, Artificial sequence
  SiRNA target sequence
aacatatccaaattttacgcttaa

SEQ ID NO: 188945 - DNA, 24 bp, Artificial sequence
  SiRNA target sequence
acatatccaaattttacgcttaaa

SEQ ID NO: 188946 - DNA, 24 bp, Artificial sequence
  SiRNA target sequence
catatccaaattttacgcttaaag

SEQ ID NO: 188947 - DNA, 24 bp, Artificial sequence
  SiRNA target sequence
atatccaaattttacgcttaaagt

SEQ ID NO: 188948 - DNA, 24 bp, Artificial sequence
  SiRNA target sequence
tatccaaattttacgcttaaagtt

SEQ ID NO: 188949 - DNA, 24 bp, Artificial sequence
  SiRNA target sequence
atccaaattttacgcttaaagttg

SEQ ID NO: 188950 - DNA, 24 bp, Artificial sequence
  SiRNA target sequence
tccaaattttacgcttaaagttga

SEQ ID NO: 188951 - DNA, 24 bp, Artificial sequence
  SiRNA target sequence
ccaaattttacgcttaaagttgaa

SEQ ID NO: 188952 - DNA, 24 bp, Artificial sequence
  SiRNA target sequence
caaattttacgcttaaagttgaag

SEQ ID NO: 188953 - DNA, 24 bp, Artificial sequence
  SiRNA target sequence
aaattttacgcttaaagttgaagg

SEQ ID NO: 188954 - DNA, 24 bp, Artificial sequence
  SiRNA target sequence
aattttacgcttaaagttgaaggc

SEQ ID NO: 188955 - DNA, 24 bp, Artificial sequence
  SiRNA target sequence
attttacgcttaaagttgaaggcg

SEQ ID NO: 188956 - DNA, 24 bp, Artificial sequence
  SiRNA target sequence
ttttacgcttaaagttgaaggcgg

SEQ ID NO: 188957 - DNA, 24 bp, Artificial sequence
  SiRNA target sequence
tttacgcttaaagttgaaggcggt

SEQ ID NO: 188958 - DNA, 24 bp, Artificial sequence
  SiRNA target sequence
ttacgcttaaagttgaaggcggta

SEQ ID NO: 188959 - DNA, 24 bp, Artificial sequence
  SiRNA target sequence
tacgcttaaagttgaaggcggtaa

SEQ ID NO: 188960 - DNA, 24 bp, Artificial sequence
  SiRNA target sequence
acgcttaaagttgaaggcggtaac

SEQ ID NO: 188961 - DNA, 24 bp, Artificial sequence
  SiRNA target sequence
cgcttaaagttgaaggcggtaact

SEQ ID NO: 188962 - DNA, 24 bp, Artificial sequence
  SiRNA target sequence
gcttaaagttgaaggcggtaactt

SEQ ID NO: 188963 - DNA, 24 bp, Artificial sequence
  SiRNA target sequence
cttaaagttgaaggcggtaacttt

SEQ ID NO: 188964 - DNA, 24 bp, Artificial sequence
  SiRNA target sequence
ttaaagttgaaggcggtaactttt

SEQ ID NO: 188965 - DNA, 24 bp, Artificial sequence
  SiRNA target sequence
taaagttgaaggcggtaacttttc

SEQ ID NO: 188966 - DNA, 24 bp, Artificial sequence
  SiRNA target sequence
aaagttgaaggcggtaacttttca

SEQ ID NO: 188967 - DNA, 24 bp, Artificial sequence
  SiRNA target sequence
aagttgaaggcggtaacttttcag

SEQ ID NO: 188968 - DNA, 24 bp, Artificial sequence
  SiRNA target sequence
agttgaaggcggtaacttttcaga

SEQ ID NO: 188969 - DNA, 24 bp, Artificial sequence
  SiRNA target sequence
gttgaaggcggtaacttttcagat

SEQ ID NO: 188970 - DNA, 24 bp, Artificial sequence
  SiRNA target sequence
ttgaaggcggtaacttttcagatt

SEQ ID NO: 188971 - DNA, 24 bp, Artificial sequence
  SiRNA target sequence
tgaaggcggtaacttttcagattc

SEQ ID NO: 188972 - DNA, 24 bp, Artificial sequence
  SiRNA target sequence
gaaggcggtaacttttcagattct

SEQ ID NO: 188973 - DNA, 24 bp, Artificial sequence
  SiRNA target sequence
aaggcggtaacttttcagattctg

SEQ ID NO: 188974 - DNA, 24 bp, Artificial sequence
  SiRNA target sequence
aggcggtaacttttcagattctga

SEQ ID NO: 188975 - DNA, 24 bp, Artificial sequence
  SiRNA target sequence
ggcggtaacttttcagattctgaa

SEQ ID NO: 188976 - DNA, 24 bp, Artificial sequence
  SiRNA target sequence
gcggtaacttttcagattctgaaa

SEQ ID NO: 188977 - DNA, 24 bp, Artificial sequence
  SiRNA target sequence
cggtaacttttcagattctgaaat

SEQ ID NO: 188978 - DNA, 24 bp, Artificial sequence
  SiRNA target sequence
ggtaacttttcagattctgaaatt

SEQ ID NO: 188979 - DNA, 24 bp, Artificial sequence
  SiRNA target sequence
gtaacttttcagattctgaaattg

SEQ ID NO: 188980 - DNA, 24 bp, Artificial sequence
  SiRNA target sequence
taacttttcagattctgaaattgt

SEQ ID NO: 188981 - DNA, 24 bp, Artificial sequence
  SiRNA target sequence
aacttttcagattctgaaattgtt

SEQ ID NO: 188982 - DNA, 24 bp, Artificial sequence
  SiRNA target sequence
acttttcagattctgaaattgttg

SEQ ID NO: 188983 - DNA, 24 bp, Artificial sequence
  SiRNA target sequence
cttttcagattctgaaattgttgt

SEQ ID NO: 188984 - DNA, 24 bp, Artificial sequence
  SiRNA target sequence
ttttcagattctgaaattgttgta

SEQ ID NO: 188985 - DNA, 24 bp, Artificial sequence
  SiRNA target sequence
tttcagattctgaaattgttgtat

SEQ ID NO: 188986 - DNA, 24 bp, Artificial sequence
  SiRNA target sequence
ttcagattctgaaattgttgtatt

SEQ ID NO: 188987 - DNA, 24 bp, Artificial sequence
  SiRNA target sequence
tcagattctgaaattgttgtattt

SEQ ID NO: 188988 - DNA, 24 bp, Artificial sequence
  SiRNA target sequence
cagattctgaaattgttgtatttc

SEQ ID NO: 188989 - DNA, 24 bp, Artificial sequence
  SiRNA target sequence
agattctgaaattgttgtatttct

SEQ ID NO: 188990 - DNA, 24 bp, Artificial sequence
  SiRNA target sequence
gattctgaaattgttgtatttctt

SEQ ID NO: 188991 - DNA, 24 bp, Artificial sequence
  SiRNA target sequence
attctgaaattgttgtatttcttg

SEQ ID NO: 188992 - DNA, 24 bp, Artificial sequence
  SiRNA target sequence
ttctgaaattgttgtatttcttgg

SEQ ID NO: 188993 - DNA, 24 bp, Artificial sequence
  SiRNA target sequence
tctgaaattgttgtatttcttggt

SEQ ID NO: 188994 - DNA, 24 bp, Artificial sequence
  SiRNA target sequence
ctgaaattgttgtatttcttggtg

SEQ ID NO: 188995 - DNA, 24 bp, Artificial sequence
  SiRNA target sequence
tgaaattgttgtatttcttggtga

SEQ ID NO: 188996 - DNA, 24 bp, Artificial sequence
  SiRNA target sequence
gaaattgttgtatttcttggtgaa

SEQ ID NO: 188997 - DNA, 24 bp, Artificial sequence
  SiRNA target sequence
aaattgttgtatttcttggtgaaa

SEQ ID NO: 188998 - DNA, 24 bp, Artificial sequence
  SiRNA target sequence
aattgttgtatttcttggtgaaaa

SEQ ID NO: 188999 - DNA, 24 bp, Artificial sequence
  SiRNA target sequence
attgttgtatttcttggtgaaaat

SEQ ID NO: 189000 - DNA, 24 bp, Artificial sequence
  SiRNA target sequence
ttgttgtatttcttggtgaaaatg

SEQ ID NO: 189001 - DNA, 24 bp, Artificial sequence
  SiRNA target sequence
tgttgtatttcttggtgaaaatgg

SEQ ID NO: 189002 - DNA, 24 bp, Artificial sequence
  SiRNA target sequence
gttgtatttcttggtgaaaatgga

SEQ ID NO: 189003 - DNA, 24 bp, Artificial sequence
  SiRNA target sequence
ttgtatttcttggtgaaaatggaa

SEQ ID NO: 189004 - DNA, 24 bp, Artificial sequence
  SiRNA target sequence
tgtatttcttggtgaaaatggaat

SEQ ID NO: 189005 - DNA, 24 bp, Artificial sequence
  SiRNA target sequence
gtatttcttggtgaaaatggaatg

SEQ ID NO: 189006 - DNA, 24 bp, Artificial sequence
  SiRNA target sequence
tatttcttggtgaaaatggaatgg

SEQ ID NO: 189007 - DNA, 24 bp, Artificial sequence
  SiRNA target sequence
atttcttggtgaaaatggaatggg

SEQ ID NO: 189008 - DNA, 24 bp, Artificial sequence
  SiRNA target sequence
tttcttggtgaaaatggaatgggc

SEQ ID NO: 189009 - DNA, 24 bp, Artificial sequence
  SiRNA target sequence
ttcttggtgaaaatggaatgggca

SEQ ID NO: 189010 - DNA, 24 bp, Artificial sequence
  SiRNA target sequence
tcttggtgaaaatggaatgggcaa

SEQ ID NO: 189011 - DNA, 24 bp, Artificial sequence
  SiRNA target sequence
cttggtgaaaatggaatgggcaaa

SEQ ID NO: 189012 - DNA, 24 bp, Artificial sequence
  SiRNA target sequence
ttggtgaaaatggaatgggcaaaa

SEQ ID NO: 189013 - DNA, 24 bp, Artificial sequence
  SiRNA target sequence
tggtgaaaatggaatgggcaaaac

SEQ ID NO: 189014 - DNA, 24 bp, Artificial sequence
  SiRNA target sequence
ggtgaaaatggaatgggcaaaact

SEQ ID NO: 189015 - DNA, 24 bp, Artificial sequence
  SiRNA target sequence
gtgaaaatggaatgggcaaaacta

SEQ ID NO: 189016 - DNA, 24 bp, Artificial sequence
  SiRNA target sequence
tgaaaatggaatgggcaaaactac

SEQ ID NO: 189017 - DNA, 24 bp, Artificial sequence
  SiRNA target sequence
gaaaatggaatgggcaaaactact

SEQ ID NO: 189018 - DNA, 24 bp, Artificial sequence
  SiRNA target sequence
aaaatggaatgggcaaaactactt

SEQ ID NO: 189019 - DNA, 24 bp, Artificial sequence
  SiRNA target sequence
aaatggaatgggcaaaactacttt

SEQ ID NO: 189020 - DNA, 24 bp, Artificial sequence
  SiRNA target sequence
aatggaatgggcaaaactacttta

SEQ ID NO: 189021 - DNA, 24 bp, Artificial sequence
  SiRNA target sequence
atggaatgggcaaaactactttag

SEQ ID NO: 189022 - DNA, 24 bp, Artificial sequence
  SiRNA target sequence
tggaatgggcaaaactactttagt

SEQ ID NO: 189023 - DNA, 24 bp, Artificial sequence
  SiRNA target sequence
ggaatgggcaaaactactttagta

SEQ ID NO: 189024 - DNA, 24 bp, Artificial sequence
  SiRNA target sequence
gaatgggcaaaactactttagtag

SEQ ID NO: 189025 - DNA, 24 bp, Artificial sequence
  SiRNA target sequence
aatgggcaaaactactttagtagg

SEQ ID NO: 189026 - DNA, 24 bp, Artificial sequence
  SiRNA target sequence
atgggcaaaactactttagtaggt

SEQ ID NO: 189027 - DNA, 24 bp, Artificial sequence
  SiRNA target sequence
tgggcaaaactactttagtaggtt

SEQ ID NO: 189028 - DNA, 24 bp, Artificial sequence
  SiRNA target sequence
gggcaaaactactttagtaggttt

SEQ ID NO: 189029 - DNA, 24 bp, Artificial sequence
  SiRNA target sequence
ggcaaaactactttagtaggtttg

SEQ ID NO: 189030 - DNA, 24 bp, Artificial sequence
  SiRNA target sequence
gcaaaactactttagtaggtttga

SEQ ID NO: 189031 - DNA, 24 bp, Artificial sequence
  SiRNA target sequence
caaaactactttagtaggtttgat

SEQ ID NO: 189032 - DNA, 24 bp, Artificial sequence
  SiRNA target sequence
aaaactactttagtaggtttgatt

SEQ ID NO: 189033 - DNA, 24 bp, Artificial sequence
  SiRNA target sequence
aaactactttagtaggtttgattt

SEQ ID NO: 189034 - DNA, 24 bp, Artificial sequence
  SiRNA target sequence
aactactttagtaggtttgatttc

SEQ ID NO: 189035 - DNA, 24 bp, Artificial sequence
  SiRNA target sequence
actactttagtaggtttgatttcg

SEQ ID NO: 189036 - DNA, 24 bp, Artificial sequence
  SiRNA target sequence
ctactttagtaggtttgatttcgg

SEQ ID NO: 189037 - DNA, 24 bp, Artificial sequence
  SiRNA target sequence
tactttagtaggtttgatttcggg

SEQ ID NO: 189038 - DNA, 24 bp, Artificial sequence
  SiRNA target sequence
actttagtaggtttgatttcgggg

SEQ ID NO: 189039 - DNA, 24 bp, Artificial sequence
  SiRNA target sequence
ctttagtaggtttgatttcggggt

SEQ ID NO: 189040 - DNA, 24 bp, Artificial sequence
  SiRNA target sequence
tttagtaggtttgatttcggggtt

SEQ ID NO: 189041 - DNA, 24 bp, Artificial sequence
  SiRNA target sequence
ttagtaggtttgatttcggggtta

SEQ ID NO: 189042 - DNA, 24 bp, Artificial sequence
  SiRNA target sequence
tagtaggtttgatttcggggttaa

SEQ ID NO: 189043 - DNA, 24 bp, Artificial sequence
  SiRNA target sequence
agtaggtttgatttcggggttaat

SEQ ID NO: 189044 - DNA, 24 bp, Artificial sequence
  SiRNA target sequence
gtaggtttgatttcggggttaatt

SEQ ID NO: 189045 - DNA, 24 bp, Artificial sequence
  SiRNA target sequence
taggtttgatttcggggttaatta

SEQ ID NO: 189046 - DNA, 24 bp, Artificial sequence
  SiRNA target sequence
aggtttgatttcggggttaattaa

SEQ ID NO: 189047 - DNA, 24 bp, Artificial sequence
  SiRNA target sequence
ggtttgatttcggggttaattaaa

SEQ ID NO: 189048 - DNA, 24 bp, Artificial sequence
  SiRNA target sequence
gtttgatttcggggttaattaaag

SEQ ID NO: 189049 - DNA, 24 bp, Artificial sequence
  SiRNA target sequence
tttgatttcggggttaattaaaga

SEQ ID NO: 189050 - DNA, 24 bp, Artificial sequence
  SiRNA target sequence
ttgatttcggggttaattaaagat

SEQ ID NO: 189051 - DNA, 24 bp, Artificial sequence
  SiRNA target sequence
tgatttcggggttaattaaagatg

SEQ ID NO: 189052 - DNA, 24 bp, Artificial sequence
  SiRNA target sequence
gatttcggggttaattaaagatga

SEQ ID NO: 189053 - DNA, 24 bp, Artificial sequence
  SiRNA target sequence
atttcggggttaattaaagatgat

SEQ ID NO: 189054 - DNA, 24 bp, Artificial sequence
  SiRNA target sequence
tttcggggttaattaaagatgata

SEQ ID NO: 189055 - DNA, 24 bp, Artificial sequence
  SiRNA target sequence
ttcggggttaattaaagatgataa

SEQ ID NO: 189056 - DNA, 24 bp, Artificial sequence
  SiRNA target sequence
tcggggttaattaaagatgataac

SEQ ID NO: 189057 - DNA, 24 bp, Artificial sequence
  SiRNA target sequence
cggggttaattaaagatgataacg

SEQ ID NO: 189058 - DNA, 24 bp, Artificial sequence
  SiRNA target sequence
ggggttaattaaagatgataacgg

SEQ ID NO: 189059 - DNA, 24 bp, Artificial sequence
  SiRNA target sequence
gggttaattaaagatgataacggg

SEQ ID NO: 189060 - DNA, 24 bp, Artificial sequence
  SiRNA target sequence
ggttaattaaagatgataacgggg

SEQ ID NO: 189061 - DNA, 24 bp, Artificial sequence
  SiRNA target sequence
gttaattaaagatgataacgggga

SEQ ID NO: 189062 - DNA, 24 bp, Artificial sequence
  SiRNA target sequence
ttaattaaagatgataacggggaa

SEQ ID NO: 189063 - DNA, 24 bp, Artificial sequence
  SiRNA target sequence
taattaaagatgataacggggaag

SEQ ID NO: 189064 - DNA, 24 bp, Artificial sequence
  SiRNA target sequence
aattaaagatgataacggggaaga

SEQ ID NO: 189065 - DNA, 24 bp, Artificial sequence
  SiRNA target sequence
attaaagatgataacggggaagag

SEQ ID NO: 189066 - DNA, 24 bp, Artificial sequence
  SiRNA target sequence
ttaaagatgataacggggaagagt

SEQ ID NO: 189067 - DNA, 24 bp, Artificial sequence
  SiRNA target sequence
taaagatgataacggggaagagtt

SEQ ID NO: 189068 - DNA, 24 bp, Artificial sequence
  SiRNA target sequence
aaagatgataacggggaagagttc

SEQ ID NO: 189069 - DNA, 24 bp, Artificial sequence
  SiRNA target sequence
aagatgataacggggaagagttcg

SEQ ID NO: 189070 - DNA, 24 bp, Artificial sequence
  SiRNA target sequence
agatgataacggggaagagttcgg

SEQ ID NO: 189071 - DNA, 24 bp, Artificial sequence
  SiRNA target sequence
gatgataacggggaagagttcggt

SEQ ID NO: 189072 - DNA, 24 bp, Artificial sequence
  SiRNA target sequence
atgataacggggaagagttcggtt

SEQ ID NO: 189073 - DNA, 24 bp, Artificial sequence
  SiRNA target sequence
tgataacggggaagagttcggttt

SEQ ID NO: 189074 - DNA, 24 bp, Artificial sequence
  SiRNA target sequence
gataacggggaagagttcggtttg

SEQ ID NO: 189075 - DNA, 24 bp, Artificial sequence
  SiRNA target sequence
ataacggggaagagttcggtttgt

SEQ ID NO: 189076 - DNA, 24 bp, Artificial sequence
  SiRNA target sequence
taacggggaagagttcggtttgtt

SEQ ID NO: 189077 - DNA, 24 bp, Artificial sequence
  SiRNA target sequence
aacggggaagagttcggtttgttg

SEQ ID NO: 189078 - DNA, 24 bp, Artificial sequence
  SiRNA target sequence
acggggaagagttcggtttgttgt

SEQ ID NO: 189079 - DNA, 24 bp, Artificial sequence
  SiRNA target sequence
cggggaagagttcggtttgttgtc

SEQ ID NO: 189080 - DNA, 24 bp, Artificial sequence
  SiRNA target sequence
ggggaagagttcggtttgttgtca

SEQ ID NO: 189081 - DNA, 24 bp, Artificial sequence
  SiRNA target sequence
gggaagagttcggtttgttgtcat

SEQ ID NO: 189082 - DNA, 24 bp, Artificial sequence
  SiRNA target sequence
ggaagagttcggtttgttgtcata

SEQ ID NO: 189083 - DNA, 24 bp, Artificial sequence
  SiRNA target sequence
gaagagttcggtttgttgtcatat

SEQ ID NO: 189084 - DNA, 24 bp, Artificial sequence
  SiRNA target sequence
aagagttcggtttgttgtcatata

SEQ ID NO: 189085 - DNA, 24 bp, Artificial sequence
  SiRNA target sequence
agagttcggtttgttgtcatatag

SEQ ID NO: 189086 - DNA, 24 bp, Artificial sequence
  SiRNA target sequence
gagttcggtttgttgtcatatagt

SEQ ID NO: 189087 - DNA, 24 bp, Artificial sequence
  SiRNA target sequence
agttcggtttgttgtcatatagtc

SEQ ID NO: 189088 - DNA, 24 bp, Artificial sequence
  SiRNA target sequence
gttcggtttgttgtcatatagtct

SEQ ID NO: 189089 - DNA, 24 bp, Artificial sequence
  SiRNA target sequence
ttcggtttgttgtcatatagtctt

SEQ ID NO: 189090 - DNA, 24 bp, Artificial sequence
  SiRNA target sequence
tcggtttgttgtcatatagtctta

SEQ ID NO: 189091 - DNA, 24 bp, Artificial sequence
  SiRNA target sequence
cggtttgttgtcatatagtcttaa

SEQ ID NO: 189092 - DNA, 24 bp, Artificial sequence
  SiRNA target sequence
ggtttgttgtcatatagtcttaaa

SEQ ID NO: 189093 - DNA, 24 bp, Artificial sequence
  SiRNA target sequence
gtttgttgtcatatagtcttaaac

SEQ ID NO: 189094 - DNA, 24 bp, Artificial sequence
  SiRNA target sequence
tttgttgtcatatagtcttaaacc

SEQ ID NO: 189095 - DNA, 24 bp, Artificial sequence
  SiRNA target sequence
ttgttgtcatatagtcttaaaccg

SEQ ID NO: 189096 - DNA, 24 bp, Artificial sequence
  SiRNA target sequence
tgttgtcatatagtcttaaaccgc

SEQ ID NO: 189097 - DNA, 24 bp, Artificial sequence
  SiRNA target sequence
gttgtcatatagtcttaaaccgca

SEQ ID NO: 189098 - DNA, 24 bp, Artificial sequence
  SiRNA target sequence
ttgtcatatagtcttaaaccgcaa

SEQ ID NO: 189099 - DNA, 24 bp, Artificial sequence
  SiRNA target sequence
tgtcatatagtcttaaaccgcaaa

SEQ ID NO: 189100 - DNA, 24 bp, Artificial sequence
  SiRNA target sequence
gtcatatagtcttaaaccgcaaaa

SEQ ID NO: 189101 - DNA, 24 bp, Artificial sequence
  SiRNA target sequence
tcatatagtcttaaaccgcaaaaa

SEQ ID NO: 189102 - DNA, 24 bp, Artificial sequence
  SiRNA target sequence
catatagtcttaaaccgcaaaaaa

SEQ ID NO: 189103 - DNA, 24 bp, Artificial sequence
  SiRNA target sequence
atatagtcttaaaccgcaaaaaat

SEQ ID NO: 189104 - DNA, 24 bp, Artificial sequence
  SiRNA target sequence
tatagtcttaaaccgcaaaaaatc

SEQ ID NO: 189105 - DNA, 24 bp, Artificial sequence
  SiRNA target sequence
atagtcttaaaccgcaaaaaatca

SEQ ID NO: 189106 - DNA, 24 bp, Artificial sequence
  SiRNA target sequence
tagtcttaaaccgcaaaaaatcat

SEQ ID NO: 189107 - DNA, 24 bp, Artificial sequence
  SiRNA target sequence
agtcttaaaccgcaaaaaatcata

SEQ ID NO: 189108 - DNA, 24 bp, Artificial sequence
  SiRNA target sequence
gtcttaaaccgcaaaaaatcatac

SEQ ID NO: 189109 - DNA, 24 bp, Artificial sequence
  SiRNA target sequence
tcttaaaccgcaaaaaatcatacc

SEQ ID NO: 189110 - DNA, 24 bp, Artificial sequence
  SiRNA target sequence
cttaaaccgcaaaaaatcataccg

SEQ ID NO: 189111 - DNA, 24 bp, Artificial sequence
  SiRNA target sequence
ttaaaccgcaaaaaatcataccga

SEQ ID NO: 189112 - DNA, 24 bp, Artificial sequence
  SiRNA target sequence
taaaccgcaaaaaatcataccgaa

SEQ ID NO: 189113 - DNA, 24 bp, Artificial sequence
  SiRNA target sequence
aaaccgcaaaaaatcataccgaaa

SEQ ID NO: 189114 - DNA, 24 bp, Artificial sequence
  SiRNA target sequence
aaccgcaaaaaatcataccgaaat

SEQ ID NO: 189115 - DNA, 24 bp, Artificial sequence
  SiRNA target sequence
accgcaaaaaatcataccgaaata

SEQ ID NO: 189116 - DNA, 24 bp, Artificial sequence
  SiRNA target sequence
ccgcaaaaaatcataccgaaatac

SEQ ID NO: 189117 - DNA, 24 bp, Artificial sequence
  SiRNA target sequence
cgcaaaaaatcataccgaaataca

SEQ ID NO: 189118 - DNA, 24 bp, Artificial sequence
  SiRNA target sequence
gcaaaaaatcataccgaaatacaa

SEQ ID NO: 189119 - DNA, 24 bp, Artificial sequence
  SiRNA target sequence
caaaaaatcataccgaaatacaaa

SEQ ID NO: 189120 - DNA, 24 bp, Artificial sequence
  SiRNA target sequence
aaaaaatcataccgaaatacaaag

SEQ ID NO: 189121 - DNA, 24 bp, Artificial sequence
  SiRNA target sequence
aaaaatcataccgaaatacaaagg

SEQ ID NO: 189122 - DNA, 24 bp, Artificial sequence
  SiRNA target sequence
aaaatcataccgaaatacaaagga

SEQ ID NO: 189123 - DNA, 24 bp, Artificial sequence
  SiRNA target sequence
aaatcataccgaaatacaaaggaa

SEQ ID NO: 189124 - DNA, 24 bp, Artificial sequence
  SiRNA target sequence
aatcataccgaaatacaaaggaac

SEQ ID NO: 189125 - DNA, 24 bp, Artificial sequence
  SiRNA target sequence
atcataccgaaatacaaaggaaca

SEQ ID NO: 189126 - DNA, 24 bp, Artificial sequence
  SiRNA target sequence
tcataccgaaatacaaaggaacag

SEQ ID NO: 189127 - DNA, 24 bp, Artificial sequence
  SiRNA target sequence
cataccgaaatacaaaggaacagt

SEQ ID NO: 189128 - DNA, 24 bp, Artificial sequence
  SiRNA target sequence
ataccgaaatacaaaggaacagtt

SEQ ID NO: 189129 - DNA, 24 bp, Artificial sequence
  SiRNA target sequence
taccgaaatacaaaggaacagtta

SEQ ID NO: 189130 - DNA, 24 bp, Artificial sequence
  SiRNA target sequence
accgaaatacaaaggaacagttag

SEQ ID NO: 189131 - DNA, 24 bp, Artificial sequence
  SiRNA target sequence
ccgaaatacaaaggaacagttaga

SEQ ID NO: 189132 - DNA, 24 bp, Artificial sequence
  SiRNA target sequence
cgaaatacaaaggaacagttagag

SEQ ID NO: 189133 - DNA, 24 bp, Artificial sequence
  SiRNA target sequence
gaaatacaaaggaacagttagaga

SEQ ID NO: 189134 - DNA, 24 bp, Artificial sequence
  SiRNA target sequence
aaatacaaaggaacagttagagat

SEQ ID NO: 189135 - DNA, 24 bp, Artificial sequence
  SiRNA target sequence
aatacaaaggaacagttagagatc

SEQ ID NO: 189136 - DNA, 24 bp, Artificial sequence
  SiRNA target sequence
atacaaaggaacagttagagatct

SEQ ID NO: 189137 - DNA, 24 bp, Artificial sequence
  SiRNA target sequence
tacaaaggaacagttagagatctt

SEQ ID NO: 189138 - DNA, 24 bp, Artificial sequence
  SiRNA target sequence
acaaaggaacagttagagatcttt

SEQ ID NO: 189139 - DNA, 24 bp, Artificial sequence
  SiRNA target sequence
caaaggaacagttagagatctttt

SEQ ID NO: 189140 - DNA, 24 bp, Artificial sequence
  SiRNA target sequence
aaaggaacagttagagatcttttt

SEQ ID NO: 189141 - DNA, 24 bp, Artificial sequence
  SiRNA target sequence
aaggaacagttagagatcttttta

SEQ ID NO: 189142 - DNA, 24 bp, Artificial sequence
  SiRNA target sequence
aggaacagttagagatctttttat

SEQ ID NO: 189143 - DNA, 24 bp, Artificial sequence
  SiRNA target sequence
ggaacagttagagatctttttatg

SEQ ID NO: 189144 - DNA, 24 bp, Artificial sequence
  SiRNA target sequence
gaacagttagagatctttttatgt

SEQ ID NO: 189145 - DNA, 24 bp, Artificial sequence
  SiRNA target sequence
aacagttagagatctttttatgtc

SEQ ID NO: 189146 - DNA, 24 bp, Artificial sequence
  SiRNA target sequence
acagttagagatctttttatgtca

SEQ ID NO: 189147 - DNA, 24 bp, Artificial sequence
  SiRNA target sequence
cagttagagatctttttatgtcaa

SEQ ID NO: 189148 - DNA, 24 bp, Artificial sequence
  SiRNA target sequence
agttagagatctttttatgtcaaa

SEQ ID NO: 189149 - DNA, 24 bp, Artificial sequence
  SiRNA target sequence
gttagagatctttttatgtcaaaa

SEQ ID NO: 189150 - DNA, 24 bp, Artificial sequence
  SiRNA target sequence
ttagagatctttttatgtcaaaaa

SEQ ID NO: 189151 - DNA, 24 bp, Artificial sequence
  SiRNA target sequence
tagagatctttttatgtcaaaaat

SEQ ID NO: 189152 - DNA, 24 bp, Artificial sequence
  SiRNA target sequence
agagatctttttatgtcaaaaatt

SEQ ID NO: 189153 - DNA, 24 bp, Artificial sequence
  SiRNA target sequence
gagatctttttatgtcaaaaattc

SEQ ID NO: 189154 - DNA, 24 bp, Artificial sequence
  SiRNA target sequence
agatctttttatgtcaaaaattcg

SEQ ID NO: 189155 - DNA, 24 bp, Artificial sequence
  SiRNA target sequence
gatctttttatgtcaaaaattcgt

SEQ ID NO: 189156 - DNA, 24 bp, Artificial sequence
  SiRNA target sequence
atctttttatgtcaaaaattcgtt

SEQ ID NO: 189157 - DNA, 24 bp, Artificial sequence
  SiRNA target sequence
tctttttatgtcaaaaattcgttc

SEQ ID NO: 189158 - DNA, 24 bp, Artificial sequence
  SiRNA target sequence
ctttttatgtcaaaaattcgttct

SEQ ID NO: 189159 - DNA, 24 bp, Artificial sequence
  SiRNA target sequence
tttttatgtcaaaaattcgttctt

SEQ ID NO: 189160 - DNA, 24 bp, Artificial sequence
  SiRNA target sequence
ttttatgtcaaaaattcgttcttc

SEQ ID NO: 189161 - DNA, 24 bp, Artificial sequence
  SiRNA target sequence
tttatgtcaaaaattcgttcttcc

SEQ ID NO: 189162 - DNA, 24 bp, Artificial sequence
  SiRNA target sequence
ttatgtcaaaaattcgttcttcct

SEQ ID NO: 189163 - DNA, 24 bp, Artificial sequence
  SiRNA target sequence
tatgtcaaaaattcgttcttcctt

SEQ ID NO: 189164 - DNA, 24 bp, Artificial sequence
  SiRNA target sequence
atgtcaaaaattcgttcttccttt

SEQ ID NO: 189165 - DNA, 24 bp, Artificial sequence
  SiRNA target sequence
tgtcaaaaattcgttcttcctttt

SEQ ID NO: 189166 - DNA, 24 bp, Artificial sequence
  SiRNA target sequence
gtcaaaaattcgttcttccttttt

SEQ ID NO: 189167 - DNA, 24 bp, Artificial sequence
  SiRNA target sequence
tcaaaaattcgttcttccttttta

SEQ ID NO: 189168 - DNA, 24 bp, Artificial sequence
  SiRNA target sequence
caaaaattcgttcttcctttttag

SEQ ID NO: 189169 - DNA, 24 bp, Artificial sequence
  SiRNA target sequence
aaaaattcgttcttcctttttaga

SEQ ID NO: 189170 - DNA, 24 bp, Artificial sequence
  SiRNA target sequence
aaaattcgttcttcctttttagac

SEQ ID NO: 189171 - DNA, 24 bp, Artificial sequence
  SiRNA target sequence
aaattcgttcttcctttttagacg

SEQ ID NO: 189172 - DNA, 24 bp, Artificial sequence
  SiRNA target sequence
aattcgttcttcctttttagacgc

SEQ ID NO: 189173 - DNA, 24 bp, Artificial sequence
  SiRNA target sequence
attcgttcttcctttttagacgct

SEQ ID NO: 189174 - DNA, 24 bp, Artificial sequence
  SiRNA target sequence
ttcgttcttcctttttagacgcta

SEQ ID NO: 189175 - DNA, 24 bp, Artificial sequence
  SiRNA target sequence
tcgttcttcctttttagacgctaa

SEQ ID NO: 189176 - DNA, 24 bp, Artificial sequence
  SiRNA target sequence
cgttcttcctttttagacgctaat

SEQ ID NO: 189177 - DNA, 24 bp, Artificial sequence
  SiRNA target sequence
gttcttcctttttagacgctaatt

SEQ ID NO: 189178 - DNA, 24 bp, Artificial sequence
  SiRNA target sequence
ttcttcctttttagacgctaattt

SEQ ID NO: 189179 - DNA, 24 bp, Artificial sequence
  SiRNA target sequence
tcttcctttttagacgctaatttt

SEQ ID NO: 189180 - DNA, 24 bp, Artificial sequence
  SiRNA target sequence
cttcctttttagacgctaattttg

SEQ ID NO: 189181 - DNA, 24 bp, Artificial sequence
  SiRNA target sequence
ttcctttttagacgctaattttgt

SEQ ID NO: 189182 - DNA, 24 bp, Artificial sequence
  SiRNA target sequence
tcctttttagacgctaattttgtt

SEQ ID NO: 189183 - DNA, 24 bp, Artificial sequence
  SiRNA target sequence
cctttttagacgctaattttgtta

SEQ ID NO: 189184 - DNA, 24 bp, Artificial sequence
  SiRNA target sequence
ctttttagacgctaattttgttaa

SEQ ID NO: 189185 - DNA, 24 bp, Artificial sequence
  SiRNA target sequence
tttttagacgctaattttgttaat

SEQ ID NO: 189186 - DNA, 24 bp, Artificial sequence
  SiRNA target sequence
ttttagacgctaattttgttaatg

SEQ ID NO: 189187 - DNA, 24 bp, Artificial sequence
  SiRNA target sequence
tttagacgctaattttgttaatga

SEQ ID NO: 189188 - DNA, 24 bp, Artificial sequence
  SiRNA target sequence
ttagacgctaattttgttaatgaa

SEQ ID NO: 189189 - DNA, 24 bp, Artificial sequence
  SiRNA target sequence
tagacgctaattttgttaatgaag

SEQ ID NO: 189190 - DNA, 24 bp, Artificial sequence
  SiRNA target sequence
agacgctaattttgttaatgaagc

SEQ ID NO: 189191 - DNA, 24 bp, Artificial sequence
  SiRNA target sequence
gacgctaattttgttaatgaagct

SEQ ID NO: 189192 - DNA, 24 bp, Artificial sequence
  SiRNA target sequence
acgctaattttgttaatgaagcta

SEQ ID NO: 189193 - DNA, 24 bp, Artificial sequence
  SiRNA target sequence
cgctaattttgttaatgaagctat

SEQ ID NO: 189194 - DNA, 24 bp, Artificial sequence
  SiRNA target sequence
gctaattttgttaatgaagctatt

SEQ ID NO: 189195 - DNA, 24 bp, Artificial sequence
  SiRNA target sequence
ctaattttgttaatgaagctatta

SEQ ID NO: 189196 - DNA, 24 bp, Artificial sequence
  SiRNA target sequence
taattttgttaatgaagctattaa

SEQ ID NO: 189197 - DNA, 24 bp, Artificial sequence
  SiRNA target sequence
aattttgttaatgaagctattaaa

SEQ ID NO: 189198 - DNA, 24 bp, Artificial sequence
  SiRNA target sequence
attttgttaatgaagctattaaac

SEQ ID NO: 189199 - DNA, 24 bp, Artificial sequence
  SiRNA target sequence
ttttgttaatgaagctattaaacc

SEQ ID NO: 189200 - DNA, 24 bp, Artificial sequence
  SiRNA target sequence
tttgttaatgaagctattaaacct

SEQ ID NO: 189201 - DNA, 24 bp, Artificial sequence
  SiRNA target sequence
ttgttaatgaagctattaaacctt

SEQ ID NO: 189202 - DNA, 24 bp, Artificial sequence
  SiRNA target sequence
tgttaatgaagctattaaaccttt

SEQ ID NO: 189203 - DNA, 24 bp, Artificial sequence
  SiRNA target sequence
gttaatgaagctattaaaccttta

SEQ ID NO: 189204 - DNA, 24 bp, Artificial sequence
  SiRNA target sequence
ttaatgaagctattaaacctttag

SEQ ID NO: 189205 - DNA, 24 bp, Artificial sequence
  SiRNA target sequence
taatgaagctattaaacctttaga

SEQ ID NO: 189206 - DNA, 24 bp, Artificial sequence
  SiRNA target sequence
aatgaagctattaaacctttagat

SEQ ID NO: 189207 - DNA, 24 bp, Artificial sequence
  SiRNA target sequence
atgaagctattaaacctttagata

SEQ ID NO: 189208 - DNA, 24 bp, Artificial sequence
  SiRNA target sequence
tgaagctattaaacctttagatat

SEQ ID NO: 189209 - DNA, 24 bp, Artificial sequence
  SiRNA target sequence
gaagctattaaacctttagatatt

SEQ ID NO: 189210 - DNA, 24 bp, Artificial sequence
  SiRNA target sequence
aagctattaaacctttagatattc

SEQ ID NO: 189211 - DNA, 24 bp, Artificial sequence
  SiRNA target sequence
agctattaaacctttagatattca

SEQ ID NO: 189212 - DNA, 24 bp, Artificial sequence
  SiRNA target sequence
gctattaaacctttagatattcat

SEQ ID NO: 189213 - DNA, 24 bp, Artificial sequence
  SiRNA target sequence
ctattaaacctttagatattcatc

SEQ ID NO: 189214 - DNA, 24 bp, Artificial sequence
  SiRNA target sequence
tattaaacctttagatattcatca

SEQ ID NO: 189215 - DNA, 24 bp, Artificial sequence
  SiRNA target sequence
attaaacctttagatattcatcat

SEQ ID NO: 189216 - DNA, 24 bp, Artificial sequence
  SiRNA target sequence
ttaaacctttagatattcatcatt

SEQ ID NO: 189217 - DNA, 24 bp, Artificial sequence
  SiRNA target sequence
taaacctttagatattcatcattt

SEQ ID NO: 189218 - DNA, 24 bp, Artificial sequence
  SiRNA target sequence
aaacctttagatattcatcattta

SEQ ID NO: 189219 - DNA, 24 bp, Artificial sequence
  SiRNA target sequence
aacctttagatattcatcatttat

SEQ ID NO: 189220 - DNA, 24 bp, Artificial sequence
  SiRNA target sequence
acctttagatattcatcatttata

SEQ ID NO: 189221 - DNA, 24 bp, Artificial sequence
  SiRNA target sequence
cctttagatattcatcatttatac

SEQ ID NO: 189222 - DNA, 24 bp, Artificial sequence
  SiRNA target sequence
ctttagatattcatcatttatacg

SEQ ID NO: 189223 - DNA, 24 bp, Artificial sequence
  SiRNA target sequence
tttagatattcatcatttatacga

SEQ ID NO: 189224 - DNA, 24 bp, Artificial sequence
  SiRNA target sequence
ttagatattcatcatttatacgac

SEQ ID NO: 189225 - DNA, 24 bp, Artificial sequence
  SiRNA target sequence
tagatattcatcatttatacgacc

SEQ ID NO: 189226 - DNA, 24 bp, Artificial sequence
  SiRNA target sequence
agatattcatcatttatacgacca

SEQ ID NO: 189227 - DNA, 24 bp, Artificial sequence
  SiRNA target sequence
gatattcatcatttatacgaccaa

SEQ ID NO: 189228 - DNA, 24 bp, Artificial sequence
  SiRNA target sequence
atattcatcatttatacgaccaac

SEQ ID NO: 189229 - DNA, 24 bp, Artificial sequence
  SiRNA target sequence
tattcatcatttatacgaccaact

SEQ ID NO: 189230 - DNA, 24 bp, Artificial sequence
  SiRNA target sequence
attcatcatttatacgaccaactt

SEQ ID NO: 189231 - DNA, 24 bp, Artificial sequence
  SiRNA target sequence
ttcatcatttatacgaccaacttg

SEQ ID NO: 189232 - DNA, 24 bp, Artificial sequence
  SiRNA target sequence
tcatcatttatacgaccaacttgt

SEQ ID NO: 189233 - DNA, 24 bp, Artificial sequence
  SiRNA target sequence
catcatttatacgaccaacttgta

SEQ ID NO: 189234 - DNA, 24 bp, Artificial sequence
  SiRNA target sequence
atcatttatacgaccaacttgtag

SEQ ID NO: 189235 - DNA, 24 bp, Artificial sequence
  SiRNA target sequence
tcatttatacgaccaacttgtaga

SEQ ID NO: 189236 - DNA, 24 bp, Artificial sequence
  SiRNA target sequence
catttatacgaccaacttgtagaa

SEQ ID NO: 189237 - DNA, 24 bp, Artificial sequence
  SiRNA target sequence
atttatacgaccaacttgtagaaa

SEQ ID NO: 189238 - DNA, 24 bp, Artificial sequence
  SiRNA target sequence
tttatacgaccaacttgtagaaaa

SEQ ID NO: 189239 - DNA, 24 bp, Artificial sequence
  SiRNA target sequence
ttatacgaccaacttgtagaaaac

SEQ ID NO: 189240 - DNA, 24 bp, Artificial sequence
  SiRNA target sequence
tatacgaccaacttgtagaaaact

SEQ ID NO: 189241 - DNA, 24 bp, Artificial sequence
  SiRNA target sequence
atacgaccaacttgtagaaaactt

SEQ ID NO: 189242 - DNA, 24 bp, Artificial sequence
  SiRNA target sequence
tacgaccaacttgtagaaaacttg

SEQ ID NO: 189243 - DNA, 24 bp, Artificial sequence
  SiRNA target sequence
acgaccaacttgtagaaaacttga

SEQ ID NO: 189244 - DNA, 24 bp, Artificial sequence
  SiRNA target sequence
cgaccaacttgtagaaaacttgag

SEQ ID NO: 189245 - DNA, 24 bp, Artificial sequence
  SiRNA target sequence
gaccaacttgtagaaaacttgagt

SEQ ID NO: 189246 - DNA, 24 bp, Artificial sequence
  SiRNA target sequence
accaacttgtagaaaacttgagtg

SEQ ID NO: 189247 - DNA, 24 bp, Artificial sequence
  SiRNA target sequence
ccaacttgtagaaaacttgagtgg

SEQ ID NO: 189248 - DNA, 24 bp, Artificial sequence
  SiRNA target sequence
caacttgtagaaaacttgagtggt

SEQ ID NO: 189249 - DNA, 24 bp, Artificial sequence
  SiRNA target sequence
aacttgtagaaaacttgagtggtg

SEQ ID NO: 189250 - DNA, 24 bp, Artificial sequence
  SiRNA target sequence
acttgtagaaaacttgagtggtgg

SEQ ID NO: 189251 - DNA, 24 bp, Artificial sequence
  SiRNA target sequence
cttgtagaaaacttgagtggtgga

SEQ ID NO: 189252 - DNA, 24 bp, Artificial sequence
  SiRNA target sequence
ttgtagaaaacttgagtggtggag

SEQ ID NO: 189253 - DNA, 24 bp, Artificial sequence
  SiRNA target sequence
tgtagaaaacttgagtggtggaga

SEQ ID NO: 189254 - DNA, 24 bp, Artificial sequence
  SiRNA target sequence
gtagaaaacttgagtggtggagaa

SEQ ID NO: 189255 - DNA, 24 bp, Artificial sequence
  SiRNA target sequence
tagaaaacttgagtggtggagaat

SEQ ID NO: 189256 - DNA, 24 bp, Artificial sequence
  SiRNA target sequence
agaaaacttgagtggtggagaatt

SEQ ID NO: 189257 - DNA, 24 bp, Artificial sequence
  SiRNA target sequence
gaaaacttgagtggtggagaatta

SEQ ID NO: 189258 - DNA, 24 bp, Artificial sequence
  SiRNA target sequence
aaaacttgagtggtggagaattac

SEQ ID NO: 189259 - DNA, 24 bp, Artificial sequence
  SiRNA target sequence
aaacttgagtggtggagaattaca

SEQ ID NO: 189260 - DNA, 24 bp, Artificial sequence
  SiRNA target sequence
aacttgagtggtggagaattacaa

SEQ ID NO: 189261 - DNA, 24 bp, Artificial sequence
  SiRNA target sequence
acttgagtggtggagaattacaaa

SEQ ID NO: 189262 - DNA, 24 bp, Artificial sequence
  SiRNA target sequence
cttgagtggtggagaattacaaag

SEQ ID NO: 189263 - DNA, 24 bp, Artificial sequence
  SiRNA target sequence
ttgagtggtggagaattacaaaga

SEQ ID NO: 189264 - DNA, 24 bp, Artificial sequence
  SiRNA target sequence
tgagtggtggagaattacaaagaa

SEQ ID NO: 189265 - DNA, 24 bp, Artificial sequence
  SiRNA target sequence
gagtggtggagaattacaaagaat

SEQ ID NO: 189266 - DNA, 24 bp, Artificial sequence
  SiRNA target sequence
agtggtggagaattacaaagaatt

SEQ ID NO: 189267 - DNA, 24 bp, Artificial sequence
  SiRNA target sequence
gtggtggagaattacaaagaattg

SEQ ID NO: 189268 - DNA, 24 bp, Artificial sequence
  SiRNA target sequence
tggtggagaattacaaagaattgc

SEQ ID NO: 189269 - DNA, 24 bp, Artificial sequence
  SiRNA target sequence
ggtggagaattacaaagaattgca

SEQ ID NO: 189270 - DNA, 24 bp, Artificial sequence
  SiRNA target sequence
gtggagaattacaaagaattgcaa

SEQ ID NO: 189271 - DNA, 24 bp, Artificial sequence
  SiRNA target sequence
tggagaattacaaagaattgcaat

SEQ ID NO: 189272 - DNA, 24 bp, Artificial sequence
  SiRNA target sequence
ggagaattacaaagaattgcaata

SEQ ID NO: 189273 - DNA, 24 bp, Artificial sequence
  SiRNA target sequence
gagaattacaaagaattgcaataa

SEQ ID NO: 189274 - DNA, 24 bp, Artificial sequence
  SiRNA target sequence
agaattacaaagaattgcaataat

SEQ ID NO: 189275 - DNA, 24 bp, Artificial sequence
  SiRNA target sequence
gaattacaaagaattgcaataata

SEQ ID NO: 189276 - DNA, 24 bp, Artificial sequence
  SiRNA target sequence
aattacaaagaattgcaataataa

SEQ ID NO: 189277 - DNA, 24 bp, Artificial sequence
  SiRNA target sequence
attacaaagaattgcaataataat

SEQ ID NO: 189278 - DNA, 24 bp, Artificial sequence
  SiRNA target sequence
ttacaaagaattgcaataataata

SEQ ID NO: 189279 - DNA, 24 bp, Artificial sequence
  SiRNA target sequence
tacaaagaattgcaataataatat

SEQ ID NO: 189280 - DNA, 24 bp, Artificial sequence
  SiRNA target sequence
acaaagaattgcaataataatatg

SEQ ID NO: 189281 - DNA, 24 bp, Artificial sequence
  SiRNA target sequence
caaagaattgcaataataatatgt

SEQ ID NO: 189282 - DNA, 24 bp, Artificial sequence
  SiRNA target sequence
aaagaattgcaataataatatgtt

SEQ ID NO: 189283 - DNA, 24 bp, Artificial sequence
  SiRNA target sequence
aagaattgcaataataatatgttt

SEQ ID NO: 189284 - DNA, 24 bp, Artificial sequence
  SiRNA target sequence
agaattgcaataataatatgttta

SEQ ID NO: 189285 - DNA, 24 bp, Artificial sequence
  SiRNA target sequence
gaattgcaataataatatgtttag

SEQ ID NO: 189286 - DNA, 24 bp, Artificial sequence
  SiRNA target sequence
aattgcaataataatatgtttagg

SEQ ID NO: 189287 - DNA, 24 bp, Artificial sequence
  SiRNA target sequence
attgcaataataatatgtttagga

SEQ ID NO: 189288 - DNA, 24 bp, Artificial sequence
  SiRNA target sequence
ttgcaataataatatgtttaggaa

SEQ ID NO: 189289 - DNA, 24 bp, Artificial sequence
  SiRNA target sequence
tgcaataataatatgtttaggaaa

SEQ ID NO: 189290 - DNA, 24 bp, Artificial sequence
  SiRNA target sequence
gcaataataatatgtttaggaaaa

SEQ ID NO: 189291 - DNA, 24 bp, Artificial sequence
  SiRNA target sequence
caataataatatgtttaggaaaag

SEQ ID NO: 189292 - DNA, 24 bp, Artificial sequence
  SiRNA target sequence
aataataatatgtttaggaaaaga

SEQ ID NO: 189293 - DNA, 24 bp, Artificial sequence
  SiRNA target sequence
ataataatatgtttaggaaaagat

SEQ ID NO: 189294 - DNA, 24 bp, Artificial sequence
  SiRNA target sequence
taataatatgtttaggaaaagatg

SEQ ID NO: 189295 - DNA, 24 bp, Artificial sequence
  SiRNA target sequence
aataatatgtttaggaaaagatgc

SEQ ID NO: 189296 - DNA, 24 bp, Artificial sequence
  SiRNA target sequence
ataatatgtttaggaaaagatgct

SEQ ID NO: 189297 - DNA, 24 bp, Artificial sequence
  SiRNA target sequence
taatatgtttaggaaaagatgcta

SEQ ID NO: 189298 - DNA, 24 bp, Artificial sequence
  SiRNA target sequence
aatatgtttaggaaaagatgctaa

SEQ ID NO: 189299 - DNA, 24 bp, Artificial sequence
  SiRNA target sequence
atatgtttaggaaaagatgctaac

SEQ ID NO: 189300 - DNA, 24 bp, Artificial sequence
  SiRNA target sequence
tatgtttaggaaaagatgctaacc

SEQ ID NO: 189301 - DNA, 24 bp, Artificial sequence
  SiRNA target sequence
atgtttaggaaaagatgctaacct

SEQ ID NO: 189302 - DNA, 24 bp, Artificial sequence
  SiRNA target sequence
tgtttaggaaaagatgctaacctt

SEQ ID NO: 189303 - DNA, 24 bp, Artificial sequence
  SiRNA target sequence
gtttaggaaaagatgctaaccttt

SEQ ID NO: 189304 - DNA, 24 bp, Artificial sequence
  SiRNA target sequence
tttaggaaaagatgctaaccttta

SEQ ID NO: 189305 - DNA, 24 bp, Artificial sequence
  SiRNA target sequence
ttaggaaaagatgctaacctttat

SEQ ID NO: 189306 - DNA, 24 bp, Artificial sequence
  SiRNA target sequence
taggaaaagatgctaacctttatt

SEQ ID NO: 189307 - DNA, 24 bp, Artificial sequence
  SiRNA target sequence
aggaaaagatgctaacctttattt

SEQ ID NO: 189308 - DNA, 24 bp, Artificial sequence
  SiRNA target sequence
ggaaaagatgctaacctttattta

SEQ ID NO: 189309 - DNA, 24 bp, Artificial sequence
  SiRNA target sequence
gaaaagatgctaacctttatttat

SEQ ID NO: 189310 - DNA, 24 bp, Artificial sequence
  SiRNA target sequence
aaaagatgctaacctttatttatt

SEQ ID NO: 189311 - DNA, 24 bp, Artificial sequence
  SiRNA target sequence
aaagatgctaacctttatttatta

SEQ ID NO: 189312 - DNA, 24 bp, Artificial sequence
  SiRNA target sequence
aagatgctaacctttatttattag

SEQ ID NO: 189313 - DNA, 24 bp, Artificial sequence
  SiRNA target sequence
agatgctaacctttatttattaga

SEQ ID NO: 189314 - DNA, 24 bp, Artificial sequence
  SiRNA target sequence
gatgctaacctttatttattagat

SEQ ID NO: 189315 - DNA, 24 bp, Artificial sequence
  SiRNA target sequence
atgctaacctttatttattagatg

SEQ ID NO: 189316 - DNA, 24 bp, Artificial sequence
  SiRNA target sequence
tgctaacctttatttattagatga

SEQ ID NO: 189317 - DNA, 24 bp, Artificial sequence
  SiRNA target sequence
gctaacctttatttattagatgaa

SEQ ID NO: 189318 - DNA, 24 bp, Artificial sequence
  SiRNA target sequence
ctaacctttatttattagatgaac

SEQ ID NO: 189319 - DNA, 24 bp, Artificial sequence
  SiRNA target sequence
taacctttatttattagatgaacc

SEQ ID NO: 189320 - DNA, 24 bp, Artificial sequence
  SiRNA target sequence
aacctttatttattagatgaacct

SEQ ID NO: 189321 - DNA, 24 bp, Artificial sequence
  SiRNA target sequence
acctttatttattagatgaacctt

SEQ ID NO: 189322 - DNA, 24 bp, Artificial sequence
  SiRNA target sequence
cctttatttattagatgaaccttc

SEQ ID NO: 189323 - DNA, 24 bp, Artificial sequence
  SiRNA target sequence
ctttatttattagatgaaccttct

SEQ ID NO: 189324 - DNA, 24 bp, Artificial sequence
  SiRNA target sequence
tttatttattagatgaaccttctg

SEQ ID NO: 189325 - DNA, 24 bp, Artificial sequence
  SiRNA target sequence
ttatttattagatgaaccttctgc

SEQ ID NO: 189326 - DNA, 24 bp, Artificial sequence
  SiRNA target sequence
tatttattagatgaaccttctgcg

SEQ ID NO: 189327 - DNA, 24 bp, Artificial sequence
  SiRNA target sequence
atttattagatgaaccttctgcgt

SEQ ID NO: 189328 - DNA, 24 bp, Artificial sequence
  SiRNA target sequence
tttattagatgaaccttctgcgta

SEQ ID NO: 189329 - DNA, 24 bp, Artificial sequence
  SiRNA target sequence
ttattagatgaaccttctgcgtat

SEQ ID NO: 189330 - DNA, 24 bp, Artificial sequence
  SiRNA target sequence
tattagatgaaccttctgcgtatc

SEQ ID NO: 189331 - DNA, 24 bp, Artificial sequence
  SiRNA target sequence
attagatgaaccttctgcgtatct

SEQ ID NO: 189332 - DNA, 24 bp, Artificial sequence
  SiRNA target sequence
ttagatgaaccttctgcgtatcta

SEQ ID NO: 189333 - DNA, 24 bp, Artificial sequence
  SiRNA target sequence
tagatgaaccttctgcgtatctag

SEQ ID NO: 189334 - DNA, 24 bp, Artificial sequence
  SiRNA target sequence
agatgaaccttctgcgtatctaga

SEQ ID NO: 189335 - DNA, 24 bp, Artificial sequence
  SiRNA target sequence
gatgaaccttctgcgtatctagat

SEQ ID NO: 189336 - DNA, 24 bp, Artificial sequence
  SiRNA target sequence
atgaaccttctgcgtatctagatt

SEQ ID NO: 189337 - DNA, 24 bp, Artificial sequence
  SiRNA target sequence
tgaaccttctgcgtatctagattc

SEQ ID NO: 189338 - DNA, 24 bp, Artificial sequence
  SiRNA target sequence
gaaccttctgcgtatctagattca

SEQ ID NO: 189339 - DNA, 24 bp, Artificial sequence
  SiRNA target sequence
aaccttctgcgtatctagattcag

SEQ ID NO: 189340 - DNA, 24 bp, Artificial sequence
  SiRNA target sequence
accttctgcgtatctagattcaga

SEQ ID NO: 189341 - DNA, 24 bp, Artificial sequence
  SiRNA target sequence
ccttctgcgtatctagattcagat

SEQ ID NO: 189342 - DNA, 24 bp, Artificial sequence
  SiRNA target sequence
cttctgcgtatctagattcagatc

SEQ ID NO: 189343 - DNA, 24 bp, Artificial sequence
  SiRNA target sequence
ttctgcgtatctagattcagatca

SEQ ID NO: 189344 - DNA, 24 bp, Artificial sequence
  SiRNA target sequence
tctgcgtatctagattcagatcag

SEQ ID NO: 189345 - DNA, 24 bp, Artificial sequence
  SiRNA target sequence
ctgcgtatctagattcagatcaga

SEQ ID NO: 189346 - DNA, 24 bp, Artificial sequence
  SiRNA target sequence
tgcgtatctagattcagatcagag

SEQ ID NO: 189347 - DNA, 24 bp, Artificial sequence
  SiRNA target sequence
gcgtatctagattcagatcagaga

SEQ ID NO: 189348 - DNA, 24 bp, Artificial sequence
  SiRNA target sequence
cgtatctagattcagatcagagaa

SEQ ID NO: 189349 - DNA, 24 bp, Artificial sequence
  SiRNA target sequence
gtatctagattcagatcagagaat

SEQ ID NO: 189350 - DNA, 24 bp, Artificial sequence
  SiRNA target sequence
tatctagattcagatcagagaata

SEQ ID NO: 189351 - DNA, 24 bp, Artificial sequence
  SiRNA target sequence
atctagattcagatcagagaatag

SEQ ID NO: 189352 - DNA, 24 bp, Artificial sequence
  SiRNA target sequence
tctagattcagatcagagaatagc

SEQ ID NO: 189353 - DNA, 24 bp, Artificial sequence
  SiRNA target sequence
ctagattcagatcagagaatagcg

SEQ ID NO: 189354 - DNA, 24 bp, Artificial sequence
  SiRNA target sequence
tagattcagatcagagaatagcga

SEQ ID NO: 189355 - DNA, 24 bp, Artificial sequence
  SiRNA target sequence
agattcagatcagagaatagcgat

SEQ ID NO: 189356 - DNA, 24 bp, Artificial sequence
  SiRNA target sequence
gattcagatcagagaatagcgatt

SEQ ID NO: 189357 - DNA, 24 bp, Artificial sequence
  SiRNA target sequence
attcagatcagagaatagcgattt

SEQ ID NO: 189358 - DNA, 24 bp, Artificial sequence
  SiRNA target sequence
ttcagatcagagaatagcgatttc

SEQ ID NO: 189359 - DNA, 24 bp, Artificial sequence
  SiRNA target sequence
tcagatcagagaatagcgatttca

SEQ ID NO: 189360 - DNA, 24 bp, Artificial sequence
  SiRNA target sequence
cagatcagagaatagcgatttcaa

SEQ ID NO: 189361 - DNA, 24 bp, Artificial sequence
  SiRNA target sequence
agatcagagaatagcgatttcaaa

SEQ ID NO: 189362 - DNA, 24 bp, Artificial sequence
  SiRNA target sequence
gatcagagaatagcgatttcaaaa

SEQ ID NO: 189363 - DNA, 24 bp, Artificial sequence
  SiRNA target sequence
atcagagaatagcgatttcaaaag

SEQ ID NO: 189364 - DNA, 24 bp, Artificial sequence
  SiRNA target sequence
tcagagaatagcgatttcaaaagt

SEQ ID NO: 189365 - DNA, 24 bp, Artificial sequence
  SiRNA target sequence
cagagaatagcgatttcaaaagtt

SEQ ID NO: 189366 - DNA, 24 bp, Artificial sequence
  SiRNA target sequence
agagaatagcgatttcaaaagtta

SEQ ID NO: 189367 - DNA, 24 bp, Artificial sequence
  SiRNA target sequence
gagaatagcgatttcaaaagttat

SEQ ID NO: 189368 - DNA, 24 bp, Artificial sequence
  SiRNA target sequence
agaatagcgatttcaaaagttata

SEQ ID NO: 189369 - DNA, 24 bp, Artificial sequence
  SiRNA target sequence
gaatagcgatttcaaaagttataa

SEQ ID NO: 189370 - DNA, 24 bp, Artificial sequence
  SiRNA target sequence
aatagcgatttcaaaagttataaa

SEQ ID NO: 189371 - DNA, 24 bp, Artificial sequence
  SiRNA target sequence
atagcgatttcaaaagttataaaa

SEQ ID NO: 189372 - DNA, 24 bp, Artificial sequence
  SiRNA target sequence
tagcgatttcaaaagttataaaaa

SEQ ID NO: 189373 - DNA, 24 bp, Artificial sequence
  SiRNA target sequence
agcgatttcaaaagttataaaaag

SEQ ID NO: 189374 - DNA, 24 bp, Artificial sequence
  SiRNA target sequence
gcgatttcaaaagttataaaaagg

SEQ ID NO: 189375 - DNA, 24 bp, Artificial sequence
  SiRNA target sequence
cgatttcaaaagttataaaaaggt

SEQ ID NO: 189376 - DNA, 24 bp, Artificial sequence
  SiRNA target sequence
gatttcaaaagttataaaaaggtt

SEQ ID NO: 189377 - DNA, 24 bp, Artificial sequence
  SiRNA target sequence
atttcaaaagttataaaaaggttt

SEQ ID NO: 189378 - DNA, 24 bp, Artificial sequence
  SiRNA target sequence
tttcaaaagttataaaaaggttta

SEQ ID NO: 189379 - DNA, 24 bp, Artificial sequence
  SiRNA target sequence
ttcaaaagttataaaaaggtttat

SEQ ID NO: 189380 - DNA, 24 bp, Artificial sequence
  SiRNA target sequence
tcaaaagttataaaaaggtttatt

SEQ ID NO: 189381 - DNA, 24 bp, Artificial sequence
  SiRNA target sequence
caaaagttataaaaaggtttattt

SEQ ID NO: 189382 - DNA, 24 bp, Artificial sequence
  SiRNA target sequence
aaaagttataaaaaggtttattta

SEQ ID NO: 189383 - DNA, 24 bp, Artificial sequence
  SiRNA target sequence
aaagttataaaaaggtttatttat

SEQ ID NO: 189384 - DNA, 24 bp, Artificial sequence
  SiRNA target sequence
aagttataaaaaggtttatttatg

SEQ ID NO: 189385 - DNA, 24 bp, Artificial sequence
  SiRNA target sequence
agttataaaaaggtttatttatgg

SEQ ID NO: 189386 - DNA, 24 bp, Artificial sequence
  SiRNA target sequence
gttataaaaaggtttatttatggg

SEQ ID NO: 189387 - DNA, 24 bp, Artificial sequence
  SiRNA target sequence
ttataaaaaggtttatttatggga

SEQ ID NO: 189388 - DNA, 24 bp, Artificial sequence
  SiRNA target sequence
tataaaaaggtttatttatgggaa

SEQ ID NO: 189389 - DNA, 24 bp, Artificial sequence
  SiRNA target sequence
ataaaaaggtttatttatgggaag

SEQ ID NO: 189390 - DNA, 24 bp, Artificial sequence
  SiRNA target sequence
taaaaaggtttatttatgggaaga

SEQ ID NO: 189391 - DNA, 24 bp, Artificial sequence
  SiRNA target sequence
aaaaaggtttatttatgggaagaa

SEQ ID NO: 189392 - DNA, 24 bp, Artificial sequence
  SiRNA target sequence
aaaaggtttatttatgggaagaag

SEQ ID NO: 189393 - DNA, 24 bp, Artificial sequence
  SiRNA target sequence
aaaggtttatttatgggaagaagc

SEQ ID NO: 189394 - DNA, 24 bp, Artificial sequence
  SiRNA target sequence
aaggtttatttatgggaagaagcg

SEQ ID NO: 189395 - DNA, 24 bp, Artificial sequence
  SiRNA target sequence
aggtttatttatgggaagaagcga

SEQ ID NO: 189396 - DNA, 24 bp, Artificial sequence
  SiRNA target sequence
ggtttatttatgggaagaagcgaa

SEQ ID NO: 189397 - DNA, 24 bp, Artificial sequence
  SiRNA target sequence
gtttatttatgggaagaagcgaac

SEQ ID NO: 189398 - DNA, 24 bp, Artificial sequence
  SiRNA target sequence
tttatttatgggaagaagcgaaca

SEQ ID NO: 189399 - DNA, 24 bp, Artificial sequence
  SiRNA target sequence
ttatttatgggaagaagcgaacag

SEQ ID NO: 189400 - DNA, 24 bp, Artificial sequence
  SiRNA target sequence
tatttatgggaagaagcgaacagc

SEQ ID NO: 189401 - DNA, 24 bp, Artificial sequence
  SiRNA target sequence
atttatgggaagaagcgaacagcc

SEQ ID NO: 189402 - DNA, 24 bp, Artificial sequence
  SiRNA target sequence
tttatgggaagaagcgaacagcct

SEQ ID NO: 189403 - DNA, 24 bp, Artificial sequence
  SiRNA target sequence
ttatgggaagaagcgaacagcctt

SEQ ID NO: 189404 - DNA, 24 bp, Artificial sequence
  SiRNA target sequence
tatgggaagaagcgaacagccttt

SEQ ID NO: 189405 - DNA, 24 bp, Artificial sequence
  SiRNA target sequence
atgggaagaagcgaacagcctttg

SEQ ID NO: 189406 - DNA, 24 bp, Artificial sequence
  SiRNA target sequence
tgggaagaagcgaacagcctttgt

SEQ ID NO: 189407 - DNA, 24 bp, Artificial sequence
  SiRNA target sequence
gggaagaagcgaacagcctttgtg

SEQ ID NO: 189408 - DNA, 24 bp, Artificial sequence
  SiRNA target sequence
ggaagaagcgaacagcctttgtgg

SEQ ID NO: 189409 - DNA, 24 bp, Artificial sequence
  SiRNA target sequence
gaagaagcgaacagcctttgtggt

SEQ ID NO: 189410 - DNA, 24 bp, Artificial sequence
  SiRNA target sequence
aagaagcgaacagcctttgtggtt

SEQ ID NO: 189411 - DNA, 24 bp, Artificial sequence
  SiRNA target sequence
agaagcgaacagcctttgtggttg

SEQ ID NO: 189412 - DNA, 24 bp, Artificial sequence
  SiRNA target sequence
gaagcgaacagcctttgtggttga

SEQ ID NO: 189413 - DNA, 24 bp, Artificial sequence
  SiRNA target sequence
aagcgaacagcctttgtggttgaa

SEQ ID NO: 189414 - DNA, 24 bp, Artificial sequence
  SiRNA target sequence
agcgaacagcctttgtggttgaac

SEQ ID NO: 189415 - DNA, 24 bp, Artificial sequence
  SiRNA target sequence
gcgaacagcctttgtggttgaaca

SEQ ID NO: 189416 - DNA, 24 bp, Artificial sequence
  SiRNA target sequence
cgaacagcctttgtggttgaacat

SEQ ID NO: 189417 - DNA, 24 bp, Artificial sequence
  SiRNA target sequence
gaacagcctttgtggttgaacatg

SEQ ID NO: 189418 - DNA, 24 bp, Artificial sequence
  SiRNA target sequence
aacagcctttgtggttgaacatga

SEQ ID NO: 189419 - DNA, 24 bp, Artificial sequence
  SiRNA target sequence
acagcctttgtggttgaacatgat

SEQ ID NO: 189420 - DNA, 24 bp, Artificial sequence
  SiRNA target sequence
cagcctttgtggttgaacatgatt

SEQ ID NO: 189421 - DNA, 24 bp, Artificial sequence
  SiRNA target sequence
agcctttgtggttgaacatgattt

SEQ ID NO: 189422 - DNA, 24 bp, Artificial sequence
  SiRNA target sequence
gcctttgtggttgaacatgattta

SEQ ID NO: 189423 - DNA, 24 bp, Artificial sequence
  SiRNA target sequence
cctttgtggttgaacatgatttaa

SEQ ID NO: 189424 - DNA, 24 bp, Artificial sequence
  SiRNA target sequence
ctttgtggttgaacatgatttaat

SEQ ID NO: 189425 - DNA, 24 bp, Artificial sequence
  SiRNA target sequence
tttgtggttgaacatgatttaatt

SEQ ID NO: 189426 - DNA, 24 bp, Artificial sequence
  SiRNA target sequence
ttgtggttgaacatgatttaattg

SEQ ID NO: 189427 - DNA, 24 bp, Artificial sequence
  SiRNA target sequence
tgtggttgaacatgatttaattgt

SEQ ID NO: 189428 - DNA, 24 bp, Artificial sequence
  SiRNA target sequence
gtggttgaacatgatttaattgta

SEQ ID NO: 189429 - DNA, 24 bp, Artificial sequence
  SiRNA target sequence
tggttgaacatgatttaattgtag

SEQ ID NO: 189430 - DNA, 24 bp, Artificial sequence
  SiRNA target sequence
ggttgaacatgatttaattgtagg

SEQ ID NO: 189431 - DNA, 24 bp, Artificial sequence
  SiRNA target sequence
gttgaacatgatttaattgtaggt

SEQ ID NO: 189432 - DNA, 24 bp, Artificial sequence
  SiRNA target sequence
ttgaacatgatttaattgtaggta

SEQ ID NO: 189433 - DNA, 24 bp, Artificial sequence
  SiRNA target sequence
tgaacatgatttaattgtaggtac

SEQ ID NO: 189434 - DNA, 24 bp, Artificial sequence
  SiRNA target sequence
gaacatgatttaattgtaggtaca

SEQ ID NO: 189435 - DNA, 24 bp, Artificial sequence
  SiRNA target sequence
aacatgatttaattgtaggtacat

SEQ ID NO: 189436 - DNA, 24 bp, Artificial sequence
  SiRNA target sequence
acatgatttaattgtaggtacata

SEQ ID NO: 189437 - DNA, 24 bp, Artificial sequence
  SiRNA target sequence
catgatttaattgtaggtacatat

SEQ ID NO: 189438 - DNA, 24 bp, Artificial sequence
  SiRNA target sequence
atgatttaattgtaggtacatatt

SEQ ID NO: 189439 - DNA, 24 bp, Artificial sequence
  SiRNA target sequence
tgatttaattgtaggtacatattt

SEQ ID NO: 189440 - DNA, 24 bp, Artificial sequence
  SiRNA target sequence
gatttaattgtaggtacatatttg

SEQ ID NO: 189441 - DNA, 24 bp, Artificial sequence
  SiRNA target sequence
atttaattgtaggtacatatttgg

SEQ ID NO: 189442 - DNA, 24 bp, Artificial sequence
  SiRNA target sequence
tttaattgtaggtacatatttggc

SEQ ID NO: 189443 - DNA, 24 bp, Artificial sequence
  SiRNA target sequence
ttaattgtaggtacatatttggct

SEQ ID NO: 189444 - DNA, 24 bp, Artificial sequence
  SiRNA target sequence
taattgtaggtacatatttggctg

SEQ ID NO: 189445 - DNA, 24 bp, Artificial sequence
  SiRNA target sequence
aattgtaggtacatatttggctga

SEQ ID NO: 189446 - DNA, 24 bp, Artificial sequence
  SiRNA target sequence
attgtaggtacatatttggctgat

SEQ ID NO: 189447 - DNA, 24 bp, Artificial sequence
  SiRNA target sequence
ttgtaggtacatatttggctgata

SEQ ID NO: 189448 - DNA, 24 bp, Artificial sequence
  SiRNA target sequence
tgtaggtacatatttggctgataa

SEQ ID NO: 189449 - DNA, 24 bp, Artificial sequence
  SiRNA target sequence
gtaggtacatatttggctgataaa

SEQ ID NO: 189450 - DNA, 24 bp, Artificial sequence
  SiRNA target sequence
taggtacatatttggctgataaag

SEQ ID NO: 189451 - DNA, 24 bp, Artificial sequence
  SiRNA target sequence
aggtacatatttggctgataaagt

SEQ ID NO: 189452 - DNA, 24 bp, Artificial sequence
  SiRNA target sequence
ggtacatatttggctgataaagtt

SEQ ID NO: 189453 - DNA, 24 bp, Artificial sequence
  SiRNA target sequence
gtacatatttggctgataaagttg

SEQ ID NO: 189454 - DNA, 24 bp, Artificial sequence
  SiRNA target sequence
tacatatttggctgataaagttgt

SEQ ID NO: 189455 - DNA, 24 bp, Artificial sequence
  SiRNA target sequence
acatatttggctgataaagttgtt

SEQ ID NO: 189456 - DNA, 24 bp, Artificial sequence
  SiRNA target sequence
catatttggctgataaagttgttg

SEQ ID NO: 189457 - DNA, 24 bp, Artificial sequence
  SiRNA target sequence
atatttggctgataaagttgttgt

SEQ ID NO: 189458 - DNA, 24 bp, Artificial sequence
  SiRNA target sequence
tatttggctgataaagttgttgtt

SEQ ID NO: 189459 - DNA, 24 bp, Artificial sequence
  SiRNA target sequence
atttggctgataaagttgttgttt

SEQ ID NO: 189460 - DNA, 24 bp, Artificial sequence
  SiRNA target sequence
tttggctgataaagttgttgtttt

SEQ ID NO: 189461 - DNA, 24 bp, Artificial sequence
  SiRNA target sequence
ttggctgataaagttgttgttttt

SEQ ID NO: 189462 - DNA, 24 bp, Artificial sequence
  SiRNA target sequence
tggctgataaagttgttgtttttg

SEQ ID NO: 189463 - DNA, 24 bp, Artificial sequence
  SiRNA target sequence
ggctgataaagttgttgtttttga

SEQ ID NO: 189464 - DNA, 24 bp, Artificial sequence
  SiRNA target sequence
gctgataaagttgttgtttttgag

SEQ ID NO: 189465 - DNA, 24 bp, Artificial sequence
  SiRNA target sequence
ctgataaagttgttgtttttgagg

SEQ ID NO: 189466 - DNA, 24 bp, Artificial sequence
  SiRNA target sequence
tgataaagttgttgtttttgaggg

SEQ ID NO: 189467 - DNA, 24 bp, Artificial sequence
  SiRNA target sequence
gataaagttgttgtttttgaggga

SEQ ID NO: 189468 - DNA, 24 bp, Artificial sequence
  SiRNA target sequence
ataaagttgttgtttttgagggaa

SEQ ID NO: 189469 - DNA, 24 bp, Artificial sequence
  SiRNA target sequence
taaagttgttgtttttgagggaag

SEQ ID NO: 189470 - DNA, 24 bp, Artificial sequence
  SiRNA target sequence
aaagttgttgtttttgagggaagc

SEQ ID NO: 189471 - DNA, 24 bp, Artificial sequence
  SiRNA target sequence
aagttgttgtttttgagggaagcc

SEQ ID NO: 189472 - DNA, 24 bp, Artificial sequence
  SiRNA target sequence
agttgttgtttttgagggaagccc

SEQ ID NO: 189473 - DNA, 24 bp, Artificial sequence
  SiRNA target sequence
gttgttgtttttgagggaagccct

SEQ ID NO: 189474 - DNA, 24 bp, Artificial sequence
  SiRNA target sequence
ttgttgtttttgagggaagcccta

SEQ ID NO: 189475 - DNA, 24 bp, Artificial sequence
  SiRNA target sequence
tgttgtttttgagggaagccctag

SEQ ID NO: 189476 - DNA, 24 bp, Artificial sequence
  SiRNA target sequence
gttgtttttgagggaagccctagt

SEQ ID NO: 189477 - DNA, 24 bp, Artificial sequence
  SiRNA target sequence
ttgtttttgagggaagccctagtg

SEQ ID NO: 189478 - DNA, 24 bp, Artificial sequence
  SiRNA target sequence
tgtttttgagggaagccctagtgt

SEQ ID NO: 189479 - DNA, 24 bp, Artificial sequence
  SiRNA target sequence
gtttttgagggaagccctagtgtt

SEQ ID NO: 189480 - DNA, 24 bp, Artificial sequence
  SiRNA target sequence
tttttgagggaagccctagtgttc

SEQ ID NO: 189481 - DNA, 24 bp, Artificial sequence
  SiRNA target sequence
ttttgagggaagccctagtgttca

SEQ ID NO: 189482 - DNA, 24 bp, Artificial sequence
  SiRNA target sequence
tttgagggaagccctagtgttcat

SEQ ID NO: 189483 - DNA, 24 bp, Artificial sequence
  SiRNA target sequence
ttgagggaagccctagtgttcata

SEQ ID NO: 189484 - DNA, 24 bp, Artificial sequence
  SiRNA target sequence
tgagggaagccctagtgttcatag

SEQ ID NO: 189485 - DNA, 24 bp, Artificial sequence
  SiRNA target sequence
gagggaagccctagtgttcatagc

SEQ ID NO: 189486 - DNA, 24 bp, Artificial sequence
  SiRNA target sequence
agggaagccctagtgttcatagca

SEQ ID NO: 189487 - DNA, 24 bp, Artificial sequence
  SiRNA target sequence
gggaagccctagtgttcatagcac

SEQ ID NO: 189488 - DNA, 24 bp, Artificial sequence
  SiRNA target sequence
ggaagccctagtgttcatagcact

SEQ ID NO: 189489 - DNA, 24 bp, Artificial sequence
  SiRNA target sequence
gaagccctagtgttcatagcactg

SEQ ID NO: 189490 - DNA, 24 bp, Artificial sequence
  SiRNA target sequence
aagccctagtgttcatagcactgc

SEQ ID NO: 189491 - DNA, 24 bp, Artificial sequence
  SiRNA target sequence
agccctagtgttcatagcactgct

SEQ ID NO: 189492 - DNA, 24 bp, Artificial sequence
  SiRNA target sequence
gccctagtgttcatagcactgctc

SEQ ID NO: 189493 - DNA, 24 bp, Artificial sequence
  SiRNA target sequence
ccctagtgttcatagcactgctca

SEQ ID NO: 189494 - DNA, 24 bp, Artificial sequence
  SiRNA target sequence
cctagtgttcatagcactgctcat

SEQ ID NO: 189495 - DNA, 24 bp, Artificial sequence
  SiRNA target sequence
ctagtgttcatagcactgctcata

SEQ ID NO: 189496 - DNA, 24 bp, Artificial sequence
  SiRNA target sequence
tagtgttcatagcactgctcataa

SEQ ID NO: 189497 - DNA, 24 bp, Artificial sequence
  SiRNA target sequence
agtgttcatagcactgctcataaa

SEQ ID NO: 189498 - DNA, 24 bp, Artificial sequence
  SiRNA target sequence
gtgttcatagcactgctcataaac

SEQ ID NO: 189499 - DNA, 24 bp, Artificial sequence
  SiRNA target sequence
tgttcatagcactgctcataaacc

SEQ ID NO: 189500 - DNA, 24 bp, Artificial sequence
  SiRNA target sequence
gttcatagcactgctcataaaccg

SEQ ID NO: 189501 - DNA, 24 bp, Artificial sequence
  SiRNA target sequence
ttcatagcactgctcataaaccga

SEQ ID NO: 189502 - DNA, 24 bp, Artificial sequence
  SiRNA target sequence
tcatagcactgctcataaaccgat

SEQ ID NO: 189503 - DNA, 24 bp, Artificial sequence
  SiRNA target sequence
catagcactgctcataaaccgatg

SEQ ID NO: 189504 - DNA, 24 bp, Artificial sequence
  SiRNA target sequence
atagcactgctcataaaccgatgg

SEQ ID NO: 189505 - DNA, 24 bp, Artificial sequence
  SiRNA target sequence
tagcactgctcataaaccgatgga

SEQ ID NO: 189506 - DNA, 24 bp, Artificial sequence
  SiRNA target sequence
agcactgctcataaaccgatggat

SEQ ID NO: 189507 - DNA, 24 bp, Artificial sequence
  SiRNA target sequence
gcactgctcataaaccgatggatt

SEQ ID NO: 189508 - DNA, 24 bp, Artificial sequence
  SiRNA target sequence
cactgctcataaaccgatggattt

SEQ ID NO: 189509 - DNA, 24 bp, Artificial sequence
  SiRNA target sequence
actgctcataaaccgatggatttg

SEQ ID NO: 189510 - DNA, 24 bp, Artificial sequence
  SiRNA target sequence
ctgctcataaaccgatggatttgc

SEQ ID NO: 189511 - DNA, 24 bp, Artificial sequence
  SiRNA target sequence
tgctcataaaccgatggatttgca

SEQ ID NO: 189512 - DNA, 24 bp, Artificial sequence
  SiRNA target sequence
gctcataaaccgatggatttgcat

SEQ ID NO: 189513 - DNA, 24 bp, Artificial sequence
  SiRNA target sequence
ctcataaaccgatggatttgcata

SEQ ID NO: 189514 - DNA, 24 bp, Artificial sequence
  SiRNA target sequence
tcataaaccgatggatttgcatag

SEQ ID NO: 189515 - DNA, 24 bp, Artificial sequence
  SiRNA target sequence
cataaaccgatggatttgcatagt

SEQ ID NO: 189516 - DNA, 24 bp, Artificial sequence
  SiRNA target sequence
ataaaccgatggatttgcatagtg

SEQ ID NO: 189517 - DNA, 24 bp, Artificial sequence
  SiRNA target sequence
taaaccgatggatttgcatagtgg

SEQ ID NO: 189518 - DNA, 24 bp, Artificial sequence
  SiRNA target sequence
aaaccgatggatttgcatagtgga

SEQ ID NO: 189519 - DNA, 24 bp, Artificial sequence
  SiRNA target sequence
aaccgatggatttgcatagtggaa

SEQ ID NO: 189520 - DNA, 24 bp, Artificial sequence
  SiRNA target sequence
accgatggatttgcatagtggaat

SEQ ID NO: 189521 - DNA, 24 bp, Artificial sequence
  SiRNA target sequence
ccgatggatttgcatagtggaatg

SEQ ID NO: 189522 - DNA, 24 bp, Artificial sequence
  SiRNA target sequence
cgatggatttgcatagtggaatga

SEQ ID NO: 189523 - DNA, 24 bp, Artificial sequence
  SiRNA target sequence
gatggatttgcatagtggaatgaa

SEQ ID NO: 189524 - DNA, 24 bp, Artificial sequence
  SiRNA target sequence
atggatttgcatagtggaatgaat

SEQ ID NO: 189525 - DNA, 24 bp, Artificial sequence
  SiRNA target sequence
tggatttgcatagtggaatgaata

SEQ ID NO: 189526 - DNA, 24 bp, Artificial sequence
  SiRNA target sequence
ggatttgcatagtggaatgaatat

SEQ ID NO: 189527 - DNA, 24 bp, Artificial sequence
  SiRNA target sequence
gatttgcatagtggaatgaatatt

SEQ ID NO: 189528 - DNA, 24 bp, Artificial sequence
  SiRNA target sequence
atttgcatagtggaatgaatattt

SEQ ID NO: 189529 - DNA, 24 bp, Artificial sequence
  SiRNA target sequence
tttgcatagtggaatgaatatttt

SEQ ID NO: 189530 - DNA, 24 bp, Artificial sequence
  SiRNA target sequence
ttgcatagtggaatgaatattttt

SEQ ID NO: 189531 - DNA, 24 bp, Artificial sequence
  SiRNA target sequence
tgcatagtggaatgaatatttttt

SEQ ID NO: 189532 - DNA, 24 bp, Artificial sequence
  SiRNA target sequence
gcatagtggaatgaatattttttt

SEQ ID NO: 189533 - DNA, 24 bp, Artificial sequence
  SiRNA target sequence
catagtggaatgaatattttttta

SEQ ID NO: 189534 - DNA, 24 bp, Artificial sequence
  SiRNA target sequence
atagtggaatgaatatttttttaa

SEQ ID NO: 189535 - DNA, 24 bp, Artificial sequence
  SiRNA target sequence
tagtggaatgaatatttttttaaa

SEQ ID NO: 189536 - DNA, 24 bp, Artificial sequence
  SiRNA target sequence
agtggaatgaatatttttttaaag

SEQ ID NO: 189537 - DNA, 24 bp, Artificial sequence
  SiRNA target sequence
gtggaatgaatatttttttaaaga

SEQ ID NO: 189538 - DNA, 24 bp, Artificial sequence
  SiRNA target sequence
tggaatgaatatttttttaaagaa

SEQ ID NO: 189539 - DNA, 24 bp, Artificial sequence
  SiRNA target sequence
ggaatgaatatttttttaaagaat

SEQ ID NO: 189540 - DNA, 24 bp, Artificial sequence
  SiRNA target sequence
gaatgaatatttttttaaagaatc

SEQ ID NO: 189541 - DNA, 24 bp, Artificial sequence
  SiRNA target sequence
aatgaatatttttttaaagaatct

SEQ ID NO: 189542 - DNA, 24 bp, Artificial sequence
  SiRNA target sequence
atgaatatttttttaaagaatctt

SEQ ID NO: 189543 - DNA, 24 bp, Artificial sequence
  SiRNA target sequence
tgaatatttttttaaagaatcttg

SEQ ID NO: 189544 - DNA, 24 bp, Artificial sequence
  SiRNA target sequence
gaatatttttttaaagaatcttga

SEQ ID NO: 189545 - DNA, 24 bp, Artificial sequence
  SiRNA target sequence
aatatttttttaaagaatcttgat

SEQ ID NO: 189546 - DNA, 24 bp, Artificial sequence
  SiRNA target sequence
atatttttttaaagaatcttgata

SEQ ID NO: 189547 - DNA, 24 bp, Artificial sequence
  SiRNA target sequence
tatttttttaaagaatcttgatat

SEQ ID NO: 189548 - DNA, 24 bp, Artificial sequence
  SiRNA target sequence
atttttttaaagaatcttgatatt

SEQ ID NO: 189549 - DNA, 24 bp, Artificial sequence
  SiRNA target sequence
tttttttaaagaatcttgatatta

SEQ ID NO: 189550 - DNA, 24 bp, Artificial sequence
  SiRNA target sequence
ttttttaaagaatcttgatattac

SEQ ID NO: 189551 - DNA, 24 bp, Artificial sequence
  SiRNA target sequence
tttttaaagaatcttgatattact

SEQ ID NO: 189552 - DNA, 24 bp, Artificial sequence
  SiRNA target sequence
ttttaaagaatcttgatattactt

SEQ ID NO: 189553 - DNA, 24 bp, Artificial sequence
  SiRNA target sequence
tttaaagaatcttgatattacttt

SEQ ID NO: 189554 - DNA, 24 bp, Artificial sequence
  SiRNA target sequence
ttaaagaatcttgatattactttt

SEQ ID NO: 189555 - DNA, 24 bp, Artificial sequence
  SiRNA target sequence
taaagaatcttgatattactttta

SEQ ID NO: 189556 - DNA, 24 bp, Artificial sequence
  SiRNA target sequence
aaagaatcttgatattacttttag

SEQ ID NO: 189557 - DNA, 24 bp, Artificial sequence
  SiRNA target sequence
aagaatcttgatattacttttaga

SEQ ID NO: 189558 - DNA, 24 bp, Artificial sequence
  SiRNA target sequence
agaatcttgatattacttttagaa

SEQ ID NO: 189559 - DNA, 24 bp, Artificial sequence
  SiRNA target sequence
gaatcttgatattacttttagaag

SEQ ID NO: 189560 - DNA, 24 bp, Artificial sequence
  SiRNA target sequence
aatcttgatattacttttagaaga

SEQ ID NO: 189561 - DNA, 24 bp, Artificial sequence
  SiRNA target sequence
atcttgatattacttttagaagag

SEQ ID NO: 189562 - DNA, 24 bp, Artificial sequence
  SiRNA target sequence
tcttgatattacttttagaagaga

SEQ ID NO: 189563 - DNA, 24 bp, Artificial sequence
  SiRNA target sequence
cttgatattacttttagaagagac

SEQ ID NO: 189564 - DNA, 24 bp, Artificial sequence
  SiRNA target sequence
ttgatattacttttagaagagact

SEQ ID NO: 189565 - DNA, 24 bp, Artificial sequence
  SiRNA target sequence
tgatattacttttagaagagactc

SEQ ID NO: 189566 - DNA, 24 bp, Artificial sequence
  SiRNA target sequence
gatattacttttagaagagactct

SEQ ID NO: 189567 - DNA, 24 bp, Artificial sequence
  SiRNA target sequence
atattacttttagaagagactctt

SEQ ID NO: 189568 - DNA, 24 bp, Artificial sequence
  SiRNA target sequence
tattacttttagaagagactcttc

SEQ ID NO: 189569 - DNA, 24 bp, Artificial sequence
  SiRNA target sequence
attacttttagaagagactcttcc

SEQ ID NO: 189570 - DNA, 24 bp, Artificial sequence
  SiRNA target sequence
ttacttttagaagagactcttcca

SEQ ID NO: 189571 - DNA, 24 bp, Artificial sequence
  SiRNA target sequence
tacttttagaagagactcttccaa

SEQ ID NO: 189572 - DNA, 24 bp, Artificial sequence
  SiRNA target sequence
acttttagaagagactcttccaat

SEQ ID NO: 189573 - DNA, 24 bp, Artificial sequence
  SiRNA target sequence
cttttagaagagactcttccaatt

SEQ ID NO: 189574 - DNA, 24 bp, Artificial sequence
  SiRNA target sequence
ttttagaagagactcttccaattt

SEQ ID NO: 189575 - DNA, 24 bp, Artificial sequence
  SiRNA target sequence
tttagaagagactcttccaatttt

SEQ ID NO: 189576 - DNA, 24 bp, Artificial sequence
  SiRNA target sequence
ttagaagagactcttccaatttta

SEQ ID NO: 189577 - DNA, 24 bp, Artificial sequence
  SiRNA target sequence
tagaagagactcttccaattttag

SEQ ID NO: 189578 - DNA, 24 bp, Artificial sequence
  SiRNA target sequence
agaagagactcttccaattttaga

SEQ ID NO: 189579 - DNA, 24 bp, Artificial sequence
  SiRNA target sequence
gaagagactcttccaattttagac

SEQ ID NO: 189580 - DNA, 24 bp, Artificial sequence
  SiRNA target sequence
aagagactcttccaattttagacc

SEQ ID NO: 189581 - DNA, 24 bp, Artificial sequence
  SiRNA target sequence
agagactcttccaattttagacca

SEQ ID NO: 189582 - DNA, 24 bp, Artificial sequence
  SiRNA target sequence
gagactcttccaattttagaccaa

SEQ ID NO: 189583 - DNA, 24 bp, Artificial sequence
  SiRNA target sequence
agactcttccaattttagaccaag

SEQ ID NO: 189584 - DNA, 24 bp, Artificial sequence
  SiRNA target sequence
gactcttccaattttagaccaaga

SEQ ID NO: 189585 - DNA, 24 bp, Artificial sequence
  SiRNA target sequence
actcttccaattttagaccaagag

SEQ ID NO: 189586 - DNA, 24 bp, Artificial sequence
  SiRNA target sequence
ctcttccaattttagaccaagagt

SEQ ID NO: 189587 - DNA, 24 bp, Artificial sequence
  SiRNA target sequence
tcttccaattttagaccaagagtt

SEQ ID NO: 189588 - DNA, 24 bp, Artificial sequence
  SiRNA target sequence
cttccaattttagaccaagagtta

SEQ ID NO: 189589 - DNA, 24 bp, Artificial sequence
  SiRNA target sequence
ttccaattttagaccaagagttaa

SEQ ID NO: 189590 - DNA, 24 bp, Artificial sequence
  SiRNA target sequence
tccaattttagaccaagagttaat

SEQ ID NO: 189591 - DNA, 24 bp, Artificial sequence
  SiRNA target sequence
ccaattttagaccaagagttaata

SEQ ID NO: 189592 - DNA, 24 bp, Artificial sequence
  SiRNA target sequence
caattttagaccaagagttaataa

SEQ ID NO: 189593 - DNA, 24 bp, Artificial sequence
  SiRNA target sequence
aattttagaccaagagttaataag

SEQ ID NO: 189594 - DNA, 24 bp, Artificial sequence
  SiRNA target sequence
attttagaccaagagttaataagc

SEQ ID NO: 189595 - DNA, 24 bp, Artificial sequence
  SiRNA target sequence
ttttagaccaagagttaataagcc

SEQ ID NO: 189596 - DNA, 24 bp, Artificial sequence
  SiRNA target sequence
tttagaccaagagttaataagccg

SEQ ID NO: 189597 - DNA, 24 bp, Artificial sequence
  SiRNA target sequence
ttagaccaagagttaataagccga

SEQ ID NO: 189598 - DNA, 24 bp, Artificial sequence
  SiRNA target sequence
tagaccaagagttaataagccgaa

SEQ ID NO: 189599 - DNA, 24 bp, Artificial sequence
  SiRNA target sequence
agaccaagagttaataagccgaat

SEQ ID NO: 189600 - DNA, 24 bp, Artificial sequence
  SiRNA target sequence
gaccaagagttaataagccgaatt

SEQ ID NO: 189601 - DNA, 24 bp, Artificial sequence
  SiRNA target sequence
accaagagttaataagccgaattc

SEQ ID NO: 189602 - DNA, 24 bp, Artificial sequence
  SiRNA target sequence
ccaagagttaataagccgaattcc

SEQ ID NO: 189603 - DNA, 24 bp, Artificial sequence
  SiRNA target sequence
caagagttaataagccgaattccg

SEQ ID NO: 189604 - DNA, 24 bp, Artificial sequence
  SiRNA target sequence
aagagttaataagccgaattccgc

SEQ ID NO: 189605 - DNA, 24 bp, Artificial sequence
  SiRNA target sequence
agagttaataagccgaattccgca

SEQ ID NO: 189606 - DNA, 24 bp, Artificial sequence
  SiRNA target sequence
gagttaataagccgaattccgcaa

SEQ ID NO: 189607 - DNA, 24 bp, Artificial sequence
  SiRNA target sequence
agttaataagccgaattccgcaaa

SEQ ID NO: 189608 - DNA, 24 bp, Artificial sequence
  SiRNA target sequence
gttaataagccgaattccgcaaaa

SEQ ID NO: 189609 - DNA, 24 bp, Artificial sequence
  SiRNA target sequence
ttaataagccgaattccgcaaaag

SEQ ID NO: 189610 - DNA, 24 bp, Artificial sequence
  SiRNA target sequence
taataagccgaattccgcaaaaga

SEQ ID NO: 189611 - DNA, 24 bp, Artificial sequence
  SiRNA target sequence
aataagccgaattccgcaaaagac

SEQ ID NO: 189612 - DNA, 24 bp, Artificial sequence
  SiRNA target sequence
ataagccgaattccgcaaaagaca

SEQ ID NO: 189613 - DNA, 24 bp, Artificial sequence
  SiRNA target sequence
taagccgaattccgcaaaagacag

SEQ ID NO: 189614 - DNA, 24 bp, Artificial sequence
  SiRNA target sequence
aagccgaattccgcaaaagacaga

SEQ ID NO: 189615 - DNA, 24 bp, Artificial sequence
  SiRNA target sequence
agccgaattccgcaaaagacagaa

SEQ ID NO: 189616 - DNA, 24 bp, Artificial sequence
  SiRNA target sequence
gccgaattccgcaaaagacagaac

SEQ ID NO: 189617 - DNA, 24 bp, Artificial sequence
  SiRNA target sequence
ccgaattccgcaaaagacagaact

SEQ ID NO: 189618 - DNA, 24 bp, Artificial sequence
  SiRNA target sequence
cgaattccgcaaaagacagaactc

SEQ ID NO: 189619 - DNA, 24 bp, Artificial sequence
  SiRNA target sequence
gaattccgcaaaagacagaactca

SEQ ID NO: 189620 - DNA, 24 bp, Artificial sequence
  SiRNA target sequence
aattccgcaaaagacagaactcag

SEQ ID NO: 189621 - DNA, 24 bp, Artificial sequence
  SiRNA target sequence
attccgcaaaagacagaactcaga

SEQ ID NO: 189622 - DNA, 24 bp, Artificial sequence
  SiRNA target sequence
ttccgcaaaagacagaactcagaa

SEQ ID NO: 189623 - DNA, 24 bp, Artificial sequence
  SiRNA target sequence
tccgcaaaagacagaactcagaaa

SEQ ID NO: 189624 - DNA, 24 bp, Artificial sequence
  SiRNA target sequence
ccgcaaaagacagaactcagaaag

SEQ ID NO: 189625 - DNA, 24 bp, Artificial sequence
  SiRNA target sequence
cgcaaaagacagaactcagaaaga

SEQ ID NO: 189626 - DNA, 24 bp, Artificial sequence
  SiRNA target sequence
gcaaaagacagaactcagaaagaa

SEQ ID NO: 189627 - DNA, 24 bp, Artificial sequence
  SiRNA target sequence
caaaagacagaactcagaaagaag

SEQ ID NO: 189628 - DNA, 24 bp, Artificial sequence
  SiRNA target sequence
aaaagacagaactcagaaagaaga

SEQ ID NO: 189629 - DNA, 24 bp, Artificial sequence
  SiRNA target sequence
aaagacagaactcagaaagaagag

SEQ ID NO: 189630 - DNA, 24 bp, Artificial sequence
  SiRNA target sequence
aagacagaactcagaaagaagaga

SEQ ID NO: 189631 - DNA, 24 bp, Artificial sequence
  SiRNA target sequence
agacagaactcagaaagaagagaa

SEQ ID NO: 189632 - DNA, 24 bp, Artificial sequence
  SiRNA target sequence
gacagaactcagaaagaagagaat

SEQ ID NO: 189633 - DNA, 24 bp, Artificial sequence
  SiRNA target sequence
acagaactcagaaagaagagaata

SEQ ID NO: 189634 - DNA, 24 bp, Artificial sequence
  SiRNA target sequence
cagaactcagaaagaagagaataa

SEQ ID NO: 189635 - DNA, 24 bp, Artificial sequence
  SiRNA target sequence
agaactcagaaagaagagaataaa

SEQ ID NO: 189636 - DNA, 24 bp, Artificial sequence
  SiRNA target sequence
gaactcagaaagaagagaataaat

SEQ ID NO: 189637 - DNA, 24 bp, Artificial sequence
  SiRNA target sequence
aactcagaaagaagagaataaata

SEQ ID NO: 189638 - DNA, 24 bp, Artificial sequence
  SiRNA target sequence
actcagaaagaagagaataaatat

SEQ ID NO: 189639 - DNA, 24 bp, Artificial sequence
  SiRNA target sequence
ctcagaaagaagagaataaatatt

SEQ ID NO: 189640 - DNA, 24 bp, Artificial sequence
  SiRNA target sequence
tcagaaagaagagaataaatattt

SEQ ID NO: 189641 - DNA, 24 bp, Artificial sequence
  SiRNA target sequence
cagaaagaagagaataaatatttt

SEQ ID NO: 189642 - DNA, 24 bp, Artificial sequence
  SiRNA target sequence
agaaagaagagaataaatattttt

SEQ ID NO: 189643 - DNA, 24 bp, Artificial sequence
  SiRNA target sequence
gaaagaagagaataaatatttttt

SEQ ID NO: 189644 - DNA, 24 bp, Artificial sequence
  SiRNA target sequence
aaagaagagaataaatattttttt

SEQ ID NO: 189645 - DNA, 24 bp, Artificial sequence
  SiRNA target sequence
aagaagagaataaatatttttttt

SEQ ID NO: 189646 - DNA, 24 bp, Artificial sequence
  SiRNA target sequence
agaagagaataaatattttttttg

SEQ ID NO: 189647 - DNA, 24 bp, Artificial sequence
  SiRNA target sequence
gaagagaataaatattttttttga

SEQ ID NO: 189648 - DNA, 25 bp, Artificial sequence
  SiRNA target sequence
atggccaagaatgaatctaataaaa

SEQ ID NO: 189649 - DNA, 25 bp, Artificial sequence
  SiRNA target sequence
tggccaagaatgaatctaataaaat

SEQ ID NO: 189650 - DNA, 25 bp, Artificial sequence
  SiRNA target sequence
ggccaagaatgaatctaataaaata

SEQ ID NO: 189651 - DNA, 25 bp, Artificial sequence
  SiRNA target sequence
gccaagaatgaatctaataaaataa

SEQ ID NO: 189652 - DNA, 25 bp, Artificial sequence
  SiRNA target sequence
ccaagaatgaatctaataaaataac

SEQ ID NO: 189653 - DNA, 25 bp, Artificial sequence
  SiRNA target sequence
caagaatgaatctaataaaataacg

SEQ ID NO: 189654 - DNA, 25 bp, Artificial sequence
  SiRNA target sequence
aagaatgaatctaataaaataacga

SEQ ID NO: 189655 - DNA, 25 bp, Artificial sequence
  SiRNA target sequence
agaatgaatctaataaaataacgag

SEQ ID NO: 189656 - DNA, 25 bp, Artificial sequence
  SiRNA target sequence
gaatgaatctaataaaataacgaga

SEQ ID NO: 189657 - DNA, 25 bp, Artificial sequence
  SiRNA target sequence
aatgaatctaataaaataacgagac

SEQ ID NO: 189658 - DNA, 25 bp, Artificial sequence
  SiRNA target sequence
atgaatctaataaaataacgagact

SEQ ID NO: 189659 - DNA, 25 bp, Artificial sequence
  SiRNA target sequence
tgaatctaataaaataacgagactg

SEQ ID NO: 189660 - DNA, 25 bp, Artificial sequence
  SiRNA target sequence
gaatctaataaaataacgagactgg

SEQ ID NO: 189661 - DNA, 25 bp, Artificial sequence
  SiRNA target sequence
aatctaataaaataacgagactggc

SEQ ID NO: 189662 - DNA, 25 bp, Artificial sequence
  SiRNA target sequence
atctaataaaataacgagactggca

SEQ ID NO: 189663 - DNA, 25 bp, Artificial sequence
  SiRNA target sequence
tctaataaaataacgagactggcaa

SEQ ID NO: 189664 - DNA, 25 bp, Artificial sequence
  SiRNA target sequence
ctaataaaataacgagactggcaat

SEQ ID NO: 189665 - DNA, 25 bp, Artificial sequence
  SiRNA target sequence
taataaaataacgagactggcaatt

SEQ ID NO: 189666 - DNA, 25 bp, Artificial sequence
  SiRNA target sequence
aataaaataacgagactggcaattg

SEQ ID NO: 189667 - DNA, 25 bp, Artificial sequence
  SiRNA target sequence
ataaaataacgagactggcaattgt

SEQ ID NO: 189668 - DNA, 25 bp, Artificial sequence
  SiRNA target sequence
taaaataacgagactggcaattgtt

SEQ ID NO: 189669 - DNA, 25 bp, Artificial sequence
  SiRNA target sequence
aaaataacgagactggcaattgtta

SEQ ID NO: 189670 - DNA, 25 bp, Artificial sequence
  SiRNA target sequence
aaataacgagactggcaattgttaa

SEQ ID NO: 189671 - DNA, 25 bp, Artificial sequence
  SiRNA target sequence
aataacgagactggcaattgttaat

SEQ ID NO: 189672 - DNA, 25 bp, Artificial sequence
  SiRNA target sequence
ataacgagactggcaattgttaatt

SEQ ID NO: 189673 - DNA, 25 bp, Artificial sequence
  SiRNA target sequence
taacgagactggcaattgttaatta

SEQ ID NO: 189674 - DNA, 25 bp, Artificial sequence
  SiRNA target sequence
aacgagactggcaattgttaattat

SEQ ID NO: 189675 - DNA, 25 bp, Artificial sequence
  SiRNA target sequence
acgagactggcaattgttaattatg

SEQ ID NO: 189676 - DNA, 25 bp, Artificial sequence
  SiRNA target sequence
cgagactggcaattgttaattatga

SEQ ID NO: 189677 - DNA, 25 bp, Artificial sequence
  SiRNA target sequence
gagactggcaattgttaattatgaa

SEQ ID NO: 189678 - DNA, 25 bp, Artificial sequence
  SiRNA target sequence
agactggcaattgttaattatgaac

SEQ ID NO: 189679 - DNA, 25 bp, Artificial sequence
  SiRNA target sequence
gactggcaattgttaattatgaact

SEQ ID NO: 189680 - DNA, 25 bp, Artificial sequence
  SiRNA target sequence
actggcaattgttaattatgaacta

SEQ ID NO: 189681 - DNA, 25 bp, Artificial sequence
  SiRNA target sequence
ctggcaattgttaattatgaactat

SEQ ID NO: 189682 - DNA, 25 bp, Artificial sequence
  SiRNA target sequence
tggcaattgttaattatgaactatg

SEQ ID NO: 189683 - DNA, 25 bp, Artificial sequence
  SiRNA target sequence
ggcaattgttaattatgaactatgt

SEQ ID NO: 189684 - DNA, 25 bp, Artificial sequence
  SiRNA target sequence
gcaattgttaattatgaactatgta

SEQ ID NO: 189685 - DNA, 25 bp, Artificial sequence
  SiRNA target sequence
caattgttaattatgaactatgtaa

SEQ ID NO: 189686 - DNA, 25 bp, Artificial sequence
  SiRNA target sequence
aattgttaattatgaactatgtaaa

SEQ ID NO: 189687 - DNA, 25 bp, Artificial sequence
  SiRNA target sequence
attgttaattatgaactatgtaaac

SEQ ID NO: 189688 - DNA, 25 bp, Artificial sequence
  SiRNA target sequence
ttgttaattatgaactatgtaaacc

SEQ ID NO: 189689 - DNA, 25 bp, Artificial sequence
  SiRNA target sequence
tgttaattatgaactatgtaaaccg

SEQ ID NO: 189690 - DNA, 25 bp, Artificial sequence
  SiRNA target sequence
gttaattatgaactatgtaaaccga

SEQ ID NO: 189691 - DNA, 25 bp, Artificial sequence
  SiRNA target sequence
ttaattatgaactatgtaaaccgaa

SEQ ID NO: 189692 - DNA, 25 bp, Artificial sequence
  SiRNA target sequence
taattatgaactatgtaaaccgaag

SEQ ID NO: 189693 - DNA, 25 bp, Artificial sequence
  SiRNA target sequence
aattatgaactatgtaaaccgaagg

SEQ ID NO: 189694 - DNA, 25 bp, Artificial sequence
  SiRNA target sequence
attatgaactatgtaaaccgaagga

SEQ ID NO: 189695 - DNA, 25 bp, Artificial sequence
  SiRNA target sequence
ttatgaactatgtaaaccgaaggaa

SEQ ID NO: 189696 - DNA, 25 bp, Artificial sequence
  SiRNA target sequence
tatgaactatgtaaaccgaaggaat

SEQ ID NO: 189697 - DNA, 25 bp, Artificial sequence
  SiRNA target sequence
atgaactatgtaaaccgaaggaatg

SEQ ID NO: 189698 - DNA, 25 bp, Artificial sequence
  SiRNA target sequence
tgaactatgtaaaccgaaggaatgt

SEQ ID NO: 189699 - DNA, 25 bp, Artificial sequence
  SiRNA target sequence
gaactatgtaaaccgaaggaatgta

SEQ ID NO: 189700 - DNA, 25 bp, Artificial sequence
  SiRNA target sequence
aactatgtaaaccgaaggaatgtat

SEQ ID NO: 189701 - DNA, 25 bp, Artificial sequence
  SiRNA target sequence
actatgtaaaccgaaggaatgtatg

SEQ ID NO: 189702 - DNA, 25 bp, Artificial sequence
  SiRNA target sequence
ctatgtaaaccgaaggaatgtatgt

SEQ ID NO: 189703 - DNA, 25 bp, Artificial sequence
  SiRNA target sequence
tatgtaaaccgaaggaatgtatgtc

SEQ ID NO: 189704 - DNA, 25 bp, Artificial sequence
  SiRNA target sequence
atgtaaaccgaaggaatgtatgtca

SEQ ID NO: 189705 - DNA, 25 bp, Artificial sequence
  SiRNA target sequence
tgtaaaccgaaggaatgtatgtcag

SEQ ID NO: 189706 - DNA, 25 bp, Artificial sequence
  SiRNA target sequence
gtaaaccgaaggaatgtatgtcaga

SEQ ID NO: 189707 - DNA, 25 bp, Artificial sequence
  SiRNA target sequence
taaaccgaaggaatgtatgtcagaa

SEQ ID NO: 189708 - DNA, 25 bp, Artificial sequence
  SiRNA target sequence
aaaccgaaggaatgtatgtcagaat

SEQ ID NO: 189709 - DNA, 25 bp, Artificial sequence
  SiRNA target sequence
aaccgaaggaatgtatgtcagaatg

SEQ ID NO: 189710 - DNA, 25 bp, Artificial sequence
  SiRNA target sequence
accgaaggaatgtatgtcagaatgt

SEQ ID NO: 189711 - DNA, 25 bp, Artificial sequence
  SiRNA target sequence
ccgaaggaatgtatgtcagaatgta

SEQ ID NO: 189712 - DNA, 25 bp, Artificial sequence
  SiRNA target sequence
cgaaggaatgtatgtcagaatgtaa

SEQ ID NO: 189713 - DNA, 25 bp, Artificial sequence
  SiRNA target sequence
gaaggaatgtatgtcagaatgtaaa

SEQ ID NO: 189714 - DNA, 25 bp, Artificial sequence
  SiRNA target sequence
aaggaatgtatgtcagaatgtaaaa

SEQ ID NO: 189715 - DNA, 25 bp, Artificial sequence
  SiRNA target sequence
aggaatgtatgtcagaatgtaaaaa

SEQ ID NO: 189716 - DNA, 25 bp, Artificial sequence
  SiRNA target sequence
ggaatgtatgtcagaatgtaaaaag

SEQ ID NO: 189717 - DNA, 25 bp, Artificial sequence
  SiRNA target sequence
gaatgtatgtcagaatgtaaaaagg

SEQ ID NO: 189718 - DNA, 25 bp, Artificial sequence
  SiRNA target sequence
aatgtatgtcagaatgtaaaaaggc

SEQ ID NO: 189719 - DNA, 25 bp, Artificial sequence
  SiRNA target sequence
atgtatgtcagaatgtaaaaaggcg

SEQ ID NO: 189720 - DNA, 25 bp, Artificial sequence
  SiRNA target sequence
tgtatgtcagaatgtaaaaaggcgt

SEQ ID NO: 189721 - DNA, 25 bp, Artificial sequence
  SiRNA target sequence
gtatgtcagaatgtaaaaaggcgtg

SEQ ID NO: 189722 - DNA, 25 bp, Artificial sequence
  SiRNA target sequence
tatgtcagaatgtaaaaaggcgtgt

SEQ ID NO: 189723 - DNA, 25 bp, Artificial sequence
  SiRNA target sequence
atgtcagaatgtaaaaaggcgtgtc

SEQ ID NO: 189724 - DNA, 25 bp, Artificial sequence
  SiRNA target sequence
tgtcagaatgtaaaaaggcgtgtcc

SEQ ID NO: 189725 - DNA, 25 bp, Artificial sequence
  SiRNA target sequence
gtcagaatgtaaaaaggcgtgtcct

SEQ ID NO: 189726 - DNA, 25 bp, Artificial sequence
  SiRNA target sequence
tcagaatgtaaaaaggcgtgtcctg

SEQ ID NO: 189727 - DNA, 25 bp, Artificial sequence
  SiRNA target sequence
cagaatgtaaaaaggcgtgtcctgt

SEQ ID NO: 189728 - DNA, 25 bp, Artificial sequence
  SiRNA target sequence
agaatgtaaaaaggcgtgtcctgtt

SEQ ID NO: 189729 - DNA, 25 bp, Artificial sequence
  SiRNA target sequence
gaatgtaaaaaggcgtgtcctgtta

SEQ ID NO: 189730 - DNA, 25 bp, Artificial sequence
  SiRNA target sequence
aatgtaaaaaggcgtgtcctgttaa

SEQ ID NO: 189731 - DNA, 25 bp, Artificial sequence
  SiRNA target sequence
atgtaaaaaggcgtgtcctgttaat

SEQ ID NO: 189732 - DNA, 25 bp, Artificial sequence
  SiRNA target sequence
tgtaaaaaggcgtgtcctgttaata

SEQ ID NO: 189733 - DNA, 25 bp, Artificial sequence
  SiRNA target sequence
gtaaaaaggcgtgtcctgttaataa

SEQ ID NO: 189734 - DNA, 25 bp, Artificial sequence
  SiRNA target sequence
taaaaaggcgtgtcctgttaataaa

SEQ ID NO: 189735 - DNA, 25 bp, Artificial sequence
  SiRNA target sequence
aaaaaggcgtgtcctgttaataaaa

SEQ ID NO: 189736 - DNA, 25 bp, Artificial sequence
  SiRNA target sequence
aaaaggcgtgtcctgttaataaaac

SEQ ID NO: 189737 - DNA, 25 bp, Artificial sequence
  SiRNA target sequence
aaaggcgtgtcctgttaataaaaca

SEQ ID NO: 189738 - DNA, 25 bp, Artificial sequence
  SiRNA target sequence
aaggcgtgtcctgttaataaaacag

SEQ ID NO: 189739 - DNA, 25 bp, Artificial sequence
  SiRNA target sequence
aggcgtgtcctgttaataaaacagg

SEQ ID NO: 189740 - DNA, 25 bp, Artificial sequence
  SiRNA target sequence
ggcgtgtcctgttaataaaacagga

SEQ ID NO: 189741 - DNA, 25 bp, Artificial sequence
  SiRNA target sequence
gcgtgtcctgttaataaaacaggaa

SEQ ID NO: 189742 - DNA, 25 bp, Artificial sequence
  SiRNA target sequence
cgtgtcctgttaataaaacaggaaa

SEQ ID NO: 189743 - DNA, 25 bp, Artificial sequence
  SiRNA target sequence
gtgtcctgttaataaaacaggaaag

SEQ ID NO: 189744 - DNA, 25 bp, Artificial sequence
  SiRNA target sequence
tgtcctgttaataaaacaggaaagg

SEQ ID NO: 189745 - DNA, 25 bp, Artificial sequence
  SiRNA target sequence
gtcctgttaataaaacaggaaagga

SEQ ID NO: 189746 - DNA, 25 bp, Artificial sequence
  SiRNA target sequence
tcctgttaataaaacaggaaaggag

SEQ ID NO: 189747 - DNA, 25 bp, Artificial sequence
  SiRNA target sequence
cctgttaataaaacaggaaaggagt

SEQ ID NO: 189748 - DNA, 25 bp, Artificial sequence
  SiRNA target sequence
ctgttaataaaacaggaaaggagtg

SEQ ID NO: 189749 - DNA, 25 bp, Artificial sequence
  SiRNA target sequence
tgttaataaaacaggaaaggagtgt

SEQ ID NO: 189750 - DNA, 25 bp, Artificial sequence
  SiRNA target sequence
gttaataaaacaggaaaggagtgta

SEQ ID NO: 189751 - DNA, 25 bp, Artificial sequence
  SiRNA target sequence
ttaataaaacaggaaaggagtgtat

SEQ ID NO: 189752 - DNA, 25 bp, Artificial sequence
  SiRNA target sequence
taataaaacaggaaaggagtgtatt

SEQ ID NO: 189753 - DNA, 25 bp, Artificial sequence
  SiRNA target sequence
aataaaacaggaaaggagtgtatta

SEQ ID NO: 189754 - DNA, 25 bp, Artificial sequence
  SiRNA target sequence
ataaaacaggaaaggagtgtattac

SEQ ID NO: 189755 - DNA, 25 bp, Artificial sequence
  SiRNA target sequence
taaaacaggaaaggagtgtattaca

SEQ ID NO: 189756 - DNA, 25 bp, Artificial sequence
  SiRNA target sequence
aaaacaggaaaggagtgtattacaa

SEQ ID NO: 189757 - DNA, 25 bp, Artificial sequence
  SiRNA target sequence
aaacaggaaaggagtgtattacaat

SEQ ID NO: 189758 - DNA, 25 bp, Artificial sequence
  SiRNA target sequence
aacaggaaaggagtgtattacaatt

SEQ ID NO: 189759 - DNA, 25 bp, Artificial sequence
  SiRNA target sequence
acaggaaaggagtgtattacaattg

SEQ ID NO: 189760 - DNA, 25 bp, Artificial sequence
  SiRNA target sequence
caggaaaggagtgtattacaattga

SEQ ID NO: 189761 - DNA, 25 bp, Artificial sequence
  SiRNA target sequence
aggaaaggagtgtattacaattgat

SEQ ID NO: 189762 - DNA, 25 bp, Artificial sequence
  SiRNA target sequence
ggaaaggagtgtattacaattgata

SEQ ID NO: 189763 - DNA, 25 bp, Artificial sequence
  SiRNA target sequence
gaaaggagtgtattacaattgatac

SEQ ID NO: 189764 - DNA, 25 bp, Artificial sequence
  SiRNA target sequence
aaaggagtgtattacaattgatact

SEQ ID NO: 189765 - DNA, 25 bp, Artificial sequence
  SiRNA target sequence
aaggagtgtattacaattgatacta

SEQ ID NO: 189766 - DNA, 25 bp, Artificial sequence
  SiRNA target sequence
aggagtgtattacaattgatactaa

SEQ ID NO: 189767 - DNA, 25 bp, Artificial sequence
  SiRNA target sequence
ggagtgtattacaattgatactaaa

SEQ ID NO: 189768 - DNA, 25 bp, Artificial sequence
  SiRNA target sequence
gagtgtattacaattgatactaaat

SEQ ID NO: 189769 - DNA, 25 bp, Artificial sequence
  SiRNA target sequence
agtgtattacaattgatactaaatc

SEQ ID NO: 189770 - DNA, 25 bp, Artificial sequence
  SiRNA target sequence
gtgtattacaattgatactaaatca

SEQ ID NO: 189771 - DNA, 25 bp, Artificial sequence
  SiRNA target sequence
tgtattacaattgatactaaatcac

SEQ ID NO: 189772 - DNA, 25 bp, Artificial sequence
  SiRNA target sequence
gtattacaattgatactaaatcaca

SEQ ID NO: 189773 - DNA, 25 bp, Artificial sequence
  SiRNA target sequence
tattacaattgatactaaatcacat

SEQ ID NO: 189774 - DNA, 25 bp, Artificial sequence
  SiRNA target sequence
attacaattgatactaaatcacata

SEQ ID NO: 189775 - DNA, 25 bp, Artificial sequence
  SiRNA target sequence
ttacaattgatactaaatcacatat

SEQ ID NO: 189776 - DNA, 25 bp, Artificial sequence
  SiRNA target sequence
tacaattgatactaaatcacatatc

SEQ ID NO: 189777 - DNA, 25 bp, Artificial sequence
  SiRNA target sequence
acaattgatactaaatcacatatct

SEQ ID NO: 189778 - DNA, 25 bp, Artificial sequence
  SiRNA target sequence
caattgatactaaatcacatatctc

SEQ ID NO: 189779 - DNA, 25 bp, Artificial sequence
  SiRNA target sequence
aattgatactaaatcacatatctca

SEQ ID NO: 189780 - DNA, 25 bp, Artificial sequence
  SiRNA target sequence
attgatactaaatcacatatctcag

SEQ ID NO: 189781 - DNA, 25 bp, Artificial sequence
  SiRNA target sequence
ttgatactaaatcacatatctcaga

SEQ ID NO: 189782 - DNA, 25 bp, Artificial sequence
  SiRNA target sequence
tgatactaaatcacatatctcagaa

SEQ ID NO: 189783 - DNA, 25 bp, Artificial sequence
  SiRNA target sequence
gatactaaatcacatatctcagaaa

SEQ ID NO: 189784 - DNA, 25 bp, Artificial sequence
  SiRNA target sequence
atactaaatcacatatctcagaaat

SEQ ID NO: 189785 - DNA, 25 bp, Artificial sequence
  SiRNA target sequence
tactaaatcacatatctcagaaatt

SEQ ID NO: 189786 - DNA, 25 bp, Artificial sequence
  SiRNA target sequence
actaaatcacatatctcagaaattc

SEQ ID NO: 189787 - DNA, 25 bp, Artificial sequence
  SiRNA target sequence
ctaaatcacatatctcagaaattct

SEQ ID NO: 189788 - DNA, 25 bp, Artificial sequence
  SiRNA target sequence
taaatcacatatctcagaaattctg

SEQ ID NO: 189789 - DNA, 25 bp, Artificial sequence
  SiRNA target sequence
aaatcacatatctcagaaattctgt

SEQ ID NO: 189790 - DNA, 25 bp, Artificial sequence
  SiRNA target sequence
aatcacatatctcagaaattctgtg

SEQ ID NO: 189791 - DNA, 25 bp, Artificial sequence
  SiRNA target sequence
atcacatatctcagaaattctgtgt

SEQ ID NO: 189792 - DNA, 25 bp, Artificial sequence
  SiRNA target sequence
tcacatatctcagaaattctgtgta

SEQ ID NO: 189793 - DNA, 25 bp, Artificial sequence
  SiRNA target sequence
cacatatctcagaaattctgtgtat

SEQ ID NO: 189794 - DNA, 25 bp, Artificial sequence
  SiRNA target sequence
acatatctcagaaattctgtgtata

SEQ ID NO: 189795 - DNA, 25 bp, Artificial sequence
  SiRNA target sequence
catatctcagaaattctgtgtatag

SEQ ID NO: 189796 - DNA, 25 bp, Artificial sequence
  SiRNA target sequence
atatctcagaaattctgtgtatagg

SEQ ID NO: 189797 - DNA, 25 bp, Artificial sequence
  SiRNA target sequence
tatctcagaaattctgtgtatagga

SEQ ID NO: 189798 - DNA, 25 bp, Artificial sequence
  SiRNA target sequence
atctcagaaattctgtgtataggat

SEQ ID NO: 189799 - DNA, 25 bp, Artificial sequence
  SiRNA target sequence
tctcagaaattctgtgtataggatg

SEQ ID NO: 189800 - DNA, 25 bp, Artificial sequence
  SiRNA target sequence
ctcagaaattctgtgtataggatgt

SEQ ID NO: 189801 - DNA, 25 bp, Artificial sequence
  SiRNA target sequence
tcagaaattctgtgtataggatgtt

SEQ ID NO: 189802 - DNA, 25 bp, Artificial sequence
  SiRNA target sequence
cagaaattctgtgtataggatgttc

SEQ ID NO: 189803 - DNA, 25 bp, Artificial sequence
  SiRNA target sequence
agaaattctgtgtataggatgttct

SEQ ID NO: 189804 - DNA, 25 bp, Artificial sequence
  SiRNA target sequence
gaaattctgtgtataggatgttctg

SEQ ID NO: 189805 - DNA, 25 bp, Artificial sequence
  SiRNA target sequence
aaattctgtgtataggatgttctgc

SEQ ID NO: 189806 - DNA, 25 bp, Artificial sequence
  SiRNA target sequence
aattctgtgtataggatgttctgcg

SEQ ID NO: 189807 - DNA, 25 bp, Artificial sequence
  SiRNA target sequence
attctgtgtataggatgttctgcgt

SEQ ID NO: 189808 - DNA, 25 bp, Artificial sequence
  SiRNA target sequence
ttctgtgtataggatgttctgcgtg

SEQ ID NO: 189809 - DNA, 25 bp, Artificial sequence
  SiRNA target sequence
tctgtgtataggatgttctgcgtgt

SEQ ID NO: 189810 - DNA, 25 bp, Artificial sequence
  SiRNA target sequence
ctgtgtataggatgttctgcgtgtc

SEQ ID NO: 189811 - DNA, 25 bp, Artificial sequence
  SiRNA target sequence
tgtgtataggatgttctgcgtgtca

SEQ ID NO: 189812 - DNA, 25 bp, Artificial sequence
  SiRNA target sequence
gtgtataggatgttctgcgtgtcaa

SEQ ID NO: 189813 - DNA, 25 bp, Artificial sequence
  SiRNA target sequence
tgtataggatgttctgcgtgtcaaa

SEQ ID NO: 189814 - DNA, 25 bp, Artificial sequence
  SiRNA target sequence
gtataggatgttctgcgtgtcaaaa

SEQ ID NO: 189815 - DNA, 25 bp, Artificial sequence
  SiRNA target sequence
tataggatgttctgcgtgtcaaaag

SEQ ID NO: 189816 - DNA, 25 bp, Artificial sequence
  SiRNA target sequence
ataggatgttctgcgtgtcaaaaga

SEQ ID NO: 189817 - DNA, 25 bp, Artificial sequence
  SiRNA target sequence
taggatgttctgcgtgtcaaaagaa

SEQ ID NO: 189818 - DNA, 25 bp, Artificial sequence
  SiRNA target sequence
aggatgttctgcgtgtcaaaagaaa

SEQ ID NO: 189819 - DNA, 25 bp, Artificial sequence
  SiRNA target sequence
ggatgttctgcgtgtcaaaagaaat

SEQ ID NO: 189820 - DNA, 25 bp, Artificial sequence
  SiRNA target sequence
gatgttctgcgtgtcaaaagaaatg

SEQ ID NO: 189821 - DNA, 25 bp, Artificial sequence
  SiRNA target sequence
atgttctgcgtgtcaaaagaaatgt

SEQ ID NO: 189822 - DNA, 25 bp, Artificial sequence
  SiRNA target sequence
tgttctgcgtgtcaaaagaaatgtc

SEQ ID NO: 189823 - DNA, 25 bp, Artificial sequence
  SiRNA target sequence
gttctgcgtgtcaaaagaaatgtcc

SEQ ID NO: 189824 - DNA, 25 bp, Artificial sequence
  SiRNA target sequence
ttctgcgtgtcaaaagaaatgtcct

SEQ ID NO: 189825 - DNA, 25 bp, Artificial sequence
  SiRNA target sequence
tctgcgtgtcaaaagaaatgtcctt

SEQ ID NO: 189826 - DNA, 25 bp, Artificial sequence
  SiRNA target sequence
ctgcgtgtcaaaagaaatgtccttt

SEQ ID NO: 189827 - DNA, 25 bp, Artificial sequence
  SiRNA target sequence
tgcgtgtcaaaagaaatgtcctttt

SEQ ID NO: 189828 - DNA, 25 bp, Artificial sequence
  SiRNA target sequence
gcgtgtcaaaagaaatgtcctttta

SEQ ID NO: 189829 - DNA, 25 bp, Artificial sequence
  SiRNA target sequence
cgtgtcaaaagaaatgtccttttaa

SEQ ID NO: 189830 - DNA, 25 bp, Artificial sequence
  SiRNA target sequence
gtgtcaaaagaaatgtccttttaag

SEQ ID NO: 189831 - DNA, 25 bp, Artificial sequence
  SiRNA target sequence
tgtcaaaagaaatgtccttttaagg

SEQ ID NO: 189832 - DNA, 25 bp, Artificial sequence
  SiRNA target sequence
gtcaaaagaaatgtccttttaaggc

SEQ ID NO: 189833 - DNA, 25 bp, Artificial sequence
  SiRNA target sequence
tcaaaagaaatgtccttttaaggcg

SEQ ID NO: 189834 - DNA, 25 bp, Artificial sequence
  SiRNA target sequence
caaaagaaatgtccttttaaggcga

SEQ ID NO: 189835 - DNA, 25 bp, Artificial sequence
  SiRNA target sequence
aaaagaaatgtccttttaaggcgat

SEQ ID NO: 189836 - DNA, 25 bp, Artificial sequence
  SiRNA target sequence
aaagaaatgtccttttaaggcgatt

SEQ ID NO: 189837 - DNA, 25 bp, Artificial sequence
  SiRNA target sequence
aagaaatgtccttttaaggcgatta

SEQ ID NO: 189838 - DNA, 25 bp, Artificial sequence
  SiRNA target sequence
agaaatgtccttttaaggcgattac

SEQ ID NO: 189839 - DNA, 25 bp, Artificial sequence
  SiRNA target sequence
gaaatgtccttttaaggcgattaca

SEQ ID NO: 189840 - DNA, 25 bp, Artificial sequence
  SiRNA target sequence
aaatgtccttttaaggcgattacaa

SEQ ID NO: 189841 - DNA, 25 bp, Artificial sequence
  SiRNA target sequence
aatgtccttttaaggcgattacaat

SEQ ID NO: 189842 - DNA, 25 bp, Artificial sequence
  SiRNA target sequence
atgtccttttaaggcgattacaatt

SEQ ID NO: 189843 - DNA, 25 bp, Artificial sequence
  SiRNA target sequence
tgtccttttaaggcgattacaattg

SEQ ID NO: 189844 - DNA, 25 bp, Artificial sequence
  SiRNA target sequence
gtccttttaaggcgattacaattgt

SEQ ID NO: 189845 - DNA, 25 bp, Artificial sequence
  SiRNA target sequence
tccttttaaggcgattacaattgta

SEQ ID NO: 189846 - DNA, 25 bp, Artificial sequence
  SiRNA target sequence
ccttttaaggcgattacaattgtaa

SEQ ID NO: 189847 - DNA, 25 bp, Artificial sequence
  SiRNA target sequence
cttttaaggcgattacaattgtaaa

SEQ ID NO: 189848 - DNA, 25 bp, Artificial sequence
  SiRNA target sequence
ttttaaggcgattacaattgtaaat

SEQ ID NO: 189849 - DNA, 25 bp, Artificial sequence
  SiRNA target sequence
tttaaggcgattacaattgtaaatt

SEQ ID NO: 189850 - DNA, 25 bp, Artificial sequence
  SiRNA target sequence
ttaaggcgattacaattgtaaattt

SEQ ID NO: 189851 - DNA, 25 bp, Artificial sequence
  SiRNA target sequence
taaggcgattacaattgtaaattta

SEQ ID NO: 189852 - DNA, 25 bp, Artificial sequence
  SiRNA target sequence
aaggcgattacaattgtaaatttac

SEQ ID NO: 189853 - DNA, 25 bp, Artificial sequence
  SiRNA target sequence
aggcgattacaattgtaaatttacc

SEQ ID NO: 189854 - DNA, 25 bp, Artificial sequence
  SiRNA target sequence
ggcgattacaattgtaaatttacct

SEQ ID NO: 189855 - DNA, 25 bp, Artificial sequence
  SiRNA target sequence
gcgattacaattgtaaatttaccta

SEQ ID NO: 189856 - DNA, 25 bp, Artificial sequence
  SiRNA target sequence
cgattacaattgtaaatttacctac

SEQ ID NO: 189857 - DNA, 25 bp, Artificial sequence
  SiRNA target sequence
gattacaattgtaaatttacctaca

SEQ ID NO: 189858 - DNA, 25 bp, Artificial sequence
  SiRNA target sequence
attacaattgtaaatttacctacaa

SEQ ID NO: 189859 - DNA, 25 bp, Artificial sequence
  SiRNA target sequence
ttacaattgtaaatttacctacaaa

SEQ ID NO: 189860 - DNA, 25 bp, Artificial sequence
  SiRNA target sequence
tacaattgtaaatttacctacaaat

SEQ ID NO: 189861 - DNA, 25 bp, Artificial sequence
  SiRNA target sequence
acaattgtaaatttacctacaaatc

SEQ ID NO: 189862 - DNA, 25 bp, Artificial sequence
  SiRNA target sequence
caattgtaaatttacctacaaatct

SEQ ID NO: 189863 - DNA, 25 bp, Artificial sequence
  SiRNA target sequence
aattgtaaatttacctacaaatcta

SEQ ID NO: 189864 - DNA, 25 bp, Artificial sequence
  SiRNA target sequence
attgtaaatttacctacaaatctag

SEQ ID NO: 189865 - DNA, 25 bp, Artificial sequence
  SiRNA target sequence
ttgtaaatttacctacaaatctaga

SEQ ID NO: 189866 - DNA, 25 bp, Artificial sequence
  SiRNA target sequence
tgtaaatttacctacaaatctagat

SEQ ID NO: 189867 - DNA, 25 bp, Artificial sequence
  SiRNA target sequence
gtaaatttacctacaaatctagata

SEQ ID NO: 189868 - DNA, 25 bp, Artificial sequence
  SiRNA target sequence
taaatttacctacaaatctagataa

SEQ ID NO: 189869 - DNA, 25 bp, Artificial sequence
  SiRNA target sequence
aaatttacctacaaatctagataaa

SEQ ID NO: 189870 - DNA, 25 bp, Artificial sequence
  SiRNA target sequence
aatttacctacaaatctagataaag

SEQ ID NO: 189871 - DNA, 25 bp, Artificial sequence
  SiRNA target sequence
atttacctacaaatctagataaaga

SEQ ID NO: 189872 - DNA, 25 bp, Artificial sequence
  SiRNA target sequence
tttacctacaaatctagataaagac

SEQ ID NO: 189873 - DNA, 25 bp, Artificial sequence
  SiRNA target sequence
ttacctacaaatctagataaagaca

SEQ ID NO: 189874 - DNA, 25 bp, Artificial sequence
  SiRNA target sequence
tacctacaaatctagataaagacat

SEQ ID NO: 189875 - DNA, 25 bp, Artificial sequence
  SiRNA target sequence
acctacaaatctagataaagacatt

SEQ ID NO: 189876 - DNA, 25 bp, Artificial sequence
  SiRNA target sequence
cctacaaatctagataaagacattt

SEQ ID NO: 189877 - DNA, 25 bp, Artificial sequence
  SiRNA target sequence
ctacaaatctagataaagacatttc

SEQ ID NO: 189878 - DNA, 25 bp, Artificial sequence
  SiRNA target sequence
tacaaatctagataaagacatttca

SEQ ID NO: 189879 - DNA, 25 bp, Artificial sequence
  SiRNA target sequence
acaaatctagataaagacatttcac

SEQ ID NO: 189880 - DNA, 25 bp, Artificial sequence
  SiRNA target sequence
caaatctagataaagacatttcaca

SEQ ID NO: 189881 - DNA, 25 bp, Artificial sequence
  SiRNA target sequence
aaatctagataaagacatttcacat

SEQ ID NO: 189882 - DNA, 25 bp, Artificial sequence
  SiRNA target sequence
aatctagataaagacatttcacata

SEQ ID NO: 189883 - DNA, 25 bp, Artificial sequence
  SiRNA target sequence
atctagataaagacatttcacatag

SEQ ID NO: 189884 - DNA, 25 bp, Artificial sequence
  SiRNA target sequence
tctagataaagacatttcacataga

SEQ ID NO: 189885 - DNA, 25 bp, Artificial sequence
  SiRNA target sequence
ctagataaagacatttcacatagat

SEQ ID NO: 189886 - DNA, 25 bp, Artificial sequence
  SiRNA target sequence
tagataaagacatttcacatagata

SEQ ID NO: 189887 - DNA, 25 bp, Artificial sequence
  SiRNA target sequence
agataaagacatttcacatagatat

SEQ ID NO: 189888 - DNA, 25 bp, Artificial sequence
  SiRNA target sequence
gataaagacatttcacatagatatt

SEQ ID NO: 189889 - DNA, 25 bp, Artificial sequence
  SiRNA target sequence
ataaagacatttcacatagatattc

SEQ ID NO: 189890 - DNA, 25 bp, Artificial sequence
  SiRNA target sequence
taaagacatttcacatagatattcg

SEQ ID NO: 189891 - DNA, 25 bp, Artificial sequence
  SiRNA target sequence
aaagacatttcacatagatattcgg

SEQ ID NO: 189892 - DNA, 25 bp, Artificial sequence
  SiRNA target sequence
aagacatttcacatagatattcggc

SEQ ID NO: 189893 - DNA, 25 bp, Artificial sequence
  SiRNA target sequence
agacatttcacatagatattcggca

SEQ ID NO: 189894 - DNA, 25 bp, Artificial sequence
  SiRNA target sequence
gacatttcacatagatattcggcaa

SEQ ID NO: 189895 - DNA, 25 bp, Artificial sequence
  SiRNA target sequence
acatttcacatagatattcggcaaa

SEQ ID NO: 189896 - DNA, 25 bp, Artificial sequence
  SiRNA target sequence
catttcacatagatattcggcaaat

SEQ ID NO: 189897 - DNA, 25 bp, Artificial sequence
  SiRNA target sequence
atttcacatagatattcggcaaatg

SEQ ID NO: 189898 - DNA, 25 bp, Artificial sequence
  SiRNA target sequence
tttcacatagatattcggcaaatgg

SEQ ID NO: 189899 - DNA, 25 bp, Artificial sequence
  SiRNA target sequence
ttcacatagatattcggcaaatggt

SEQ ID NO: 189900 - DNA, 25 bp, Artificial sequence
  SiRNA target sequence
tcacatagatattcggcaaatggtt

SEQ ID NO: 189901 - DNA, 25 bp, Artificial sequence
  SiRNA target sequence
cacatagatattcggcaaatggttt

SEQ ID NO: 189902 - DNA, 25 bp, Artificial sequence
  SiRNA target sequence
acatagatattcggcaaatggtttt

SEQ ID NO: 189903 - DNA, 25 bp, Artificial sequence
  SiRNA target sequence
catagatattcggcaaatggtttta

SEQ ID NO: 189904 - DNA, 25 bp, Artificial sequence
  SiRNA target sequence
atagatattcggcaaatggttttaa

SEQ ID NO: 189905 - DNA, 25 bp, Artificial sequence
  SiRNA target sequence
tagatattcggcaaatggttttaaa

SEQ ID NO: 189906 - DNA, 25 bp, Artificial sequence
  SiRNA target sequence
agatattcggcaaatggttttaaac

SEQ ID NO: 189907 - DNA, 25 bp, Artificial sequence
  SiRNA target sequence
gatattcggcaaatggttttaaact

SEQ ID NO: 189908 - DNA, 25 bp, Artificial sequence
  SiRNA target sequence
atattcggcaaatggttttaaactt

SEQ ID NO: 189909 - DNA, 25 bp, Artificial sequence
  SiRNA target sequence
tattcggcaaatggttttaaacttc

SEQ ID NO: 189910 - DNA, 25 bp, Artificial sequence
  SiRNA target sequence
attcggcaaatggttttaaacttca

SEQ ID NO: 189911 - DNA, 25 bp, Artificial sequence
  SiRNA target sequence
ttcggcaaatggttttaaacttcac

SEQ ID NO: 189912 - DNA, 25 bp, Artificial sequence
  SiRNA target sequence
tcggcaaatggttttaaacttcaca

SEQ ID NO: 189913 - DNA, 25 bp, Artificial sequence
  SiRNA target sequence
cggcaaatggttttaaacttcacag

SEQ ID NO: 189914 - DNA, 25 bp, Artificial sequence
  SiRNA target sequence
ggcaaatggttttaaacttcacaga

SEQ ID NO: 189915 - DNA, 25 bp, Artificial sequence
  SiRNA target sequence
gcaaatggttttaaacttcacagat

SEQ ID NO: 189916 - DNA, 25 bp, Artificial sequence
  SiRNA target sequence
caaatggttttaaacttcacagatt

SEQ ID NO: 189917 - DNA, 25 bp, Artificial sequence
  SiRNA target sequence
aaatggttttaaacttcacagatta

SEQ ID NO: 189918 - DNA, 25 bp, Artificial sequence
  SiRNA target sequence
aatggttttaaacttcacagattac

SEQ ID NO: 189919 - DNA, 25 bp, Artificial sequence
  SiRNA target sequence
atggttttaaacttcacagattacc

SEQ ID NO: 189920 - DNA, 25 bp, Artificial sequence
  SiRNA target sequence
tggttttaaacttcacagattacca

SEQ ID NO: 189921 - DNA, 25 bp, Artificial sequence
  SiRNA target sequence
ggttttaaacttcacagattaccaa

SEQ ID NO: 189922 - DNA, 25 bp, Artificial sequence
  SiRNA target sequence
gttttaaacttcacagattaccaat

SEQ ID NO: 189923 - DNA, 25 bp, Artificial sequence
  SiRNA target sequence
ttttaaacttcacagattaccaatc

SEQ ID NO: 189924 - DNA, 25 bp, Artificial sequence
  SiRNA target sequence
tttaaacttcacagattaccaatcc

SEQ ID NO: 189925 - DNA, 25 bp, Artificial sequence
  SiRNA target sequence
ttaaacttcacagattaccaatccc

SEQ ID NO: 189926 - DNA, 25 bp, Artificial sequence
  SiRNA target sequence
taaacttcacagattaccaatccct

SEQ ID NO: 189927 - DNA, 25 bp, Artificial sequence
  SiRNA target sequence
aaacttcacagattaccaatcccta

SEQ ID NO: 189928 - DNA, 25 bp, Artificial sequence
  SiRNA target sequence
aacttcacagattaccaatccctaa

SEQ ID NO: 189929 - DNA, 25 bp, Artificial sequence
  SiRNA target sequence
acttcacagattaccaatccctaaa

SEQ ID NO: 189930 - DNA, 25 bp, Artificial sequence
  SiRNA target sequence
cttcacagattaccaatccctaaat

SEQ ID NO: 189931 - DNA, 25 bp, Artificial sequence
  SiRNA target sequence
ttcacagattaccaatccctaaata

SEQ ID NO: 189932 - DNA, 25 bp, Artificial sequence
  SiRNA target sequence
tcacagattaccaatccctaaatat

SEQ ID NO: 189933 - DNA, 25 bp, Artificial sequence
  SiRNA target sequence
cacagattaccaatccctaaatatg

SEQ ID NO: 189934 - DNA, 25 bp, Artificial sequence
  SiRNA target sequence
acagattaccaatccctaaatatgg

SEQ ID NO: 189935 - DNA, 25 bp, Artificial sequence
  SiRNA target sequence
cagattaccaatccctaaatatggt

SEQ ID NO: 189936 - DNA, 25 bp, Artificial sequence
  SiRNA target sequence
agattaccaatccctaaatatggta

SEQ ID NO: 189937 - DNA, 25 bp, Artificial sequence
  SiRNA target sequence
gattaccaatccctaaatatggtaa

SEQ ID NO: 189938 - DNA, 25 bp, Artificial sequence
  SiRNA target sequence
attaccaatccctaaatatggtaag

SEQ ID NO: 189939 - DNA, 25 bp, Artificial sequence
  SiRNA target sequence
ttaccaatccctaaatatggtaagg

SEQ ID NO: 189940 - DNA, 25 bp, Artificial sequence
  SiRNA target sequence
taccaatccctaaatatggtaaggt

SEQ ID NO: 189941 - DNA, 25 bp, Artificial sequence
  SiRNA target sequence
accaatccctaaatatggtaaggtt

SEQ ID NO: 189942 - DNA, 25 bp, Artificial sequence
  SiRNA target sequence
ccaatccctaaatatggtaaggttt

SEQ ID NO: 189943 - DNA, 25 bp, Artificial sequence
  SiRNA target sequence
caatccctaaatatggtaaggtttt

SEQ ID NO: 189944 - DNA, 25 bp, Artificial sequence
  SiRNA target sequence
aatccctaaatatggtaaggtttta

SEQ ID NO: 189945 - DNA, 25 bp, Artificial sequence
  SiRNA target sequence
atccctaaatatggtaaggttttag

SEQ ID NO: 189946 - DNA, 25 bp, Artificial sequence
  SiRNA target sequence
tccctaaatatggtaaggttttagg

SEQ ID NO: 189947 - DNA, 25 bp, Artificial sequence
  SiRNA target sequence
ccctaaatatggtaaggttttaggg

SEQ ID NO: 189948 - DNA, 25 bp, Artificial sequence
  SiRNA target sequence
cctaaatatggtaaggttttagggc

SEQ ID NO: 189949 - DNA, 25 bp, Artificial sequence
  SiRNA target sequence
ctaaatatggtaaggttttagggct

SEQ ID NO: 189950 - DNA, 25 bp, Artificial sequence
  SiRNA target sequence
taaatatggtaaggttttagggcta

SEQ ID NO: 189951 - DNA, 25 bp, Artificial sequence
  SiRNA target sequence
aaatatggtaaggttttagggctag

SEQ ID NO: 189952 - DNA, 25 bp, Artificial sequence
  SiRNA target sequence
aatatggtaaggttttagggctagt

SEQ ID NO: 189953 - DNA, 25 bp, Artificial sequence
  SiRNA target sequence
atatggtaaggttttagggctagta

SEQ ID NO: 189954 - DNA, 25 bp, Artificial sequence
  SiRNA target sequence
tatggtaaggttttagggctagtag

SEQ ID NO: 189955 - DNA, 25 bp, Artificial sequence
  SiRNA target sequence
atggtaaggttttagggctagtagg

SEQ ID NO: 189956 - DNA, 25 bp, Artificial sequence
  SiRNA target sequence
tggtaaggttttagggctagtaggc

SEQ ID NO: 189957 - DNA, 25 bp, Artificial sequence
  SiRNA target sequence
ggtaaggttttagggctagtaggca

SEQ ID NO: 189958 - DNA, 25 bp, Artificial sequence
  SiRNA target sequence
gtaaggttttagggctagtaggcac

SEQ ID NO: 189959 - DNA, 25 bp, Artificial sequence
  SiRNA target sequence
taaggttttagggctagtaggcact

SEQ ID NO: 189960 - DNA, 25 bp, Artificial sequence
  SiRNA target sequence
aaggttttagggctagtaggcacta

SEQ ID NO: 189961 - DNA, 25 bp, Artificial sequence
  SiRNA target sequence
aggttttagggctagtaggcactaa

SEQ ID NO: 189962 - DNA, 25 bp, Artificial sequence
  SiRNA target sequence
ggttttagggctagtaggcactaat

SEQ ID NO: 189963 - DNA, 25 bp, Artificial sequence
  SiRNA target sequence
gttttagggctagtaggcactaatg

SEQ ID NO: 189964 - DNA, 25 bp, Artificial sequence
  SiRNA target sequence
ttttagggctagtaggcactaatgg

SEQ ID NO: 189965 - DNA, 25 bp, Artificial sequence
  SiRNA target sequence
tttagggctagtaggcactaatggt

SEQ ID NO: 189966 - DNA, 25 bp, Artificial sequence
  SiRNA target sequence
ttagggctagtaggcactaatggta

SEQ ID NO: 189967 - DNA, 25 bp, Artificial sequence
  SiRNA target sequence
tagggctagtaggcactaatggtat

SEQ ID NO: 189968 - DNA, 25 bp, Artificial sequence
  SiRNA target sequence
agggctagtaggcactaatggtata

SEQ ID NO: 189969 - DNA, 25 bp, Artificial sequence
  SiRNA target sequence
gggctagtaggcactaatggtatag

SEQ ID NO: 189970 - DNA, 25 bp, Artificial sequence
  SiRNA target sequence
ggctagtaggcactaatggtatagg

SEQ ID NO: 189971 - DNA, 25 bp, Artificial sequence
  SiRNA target sequence
gctagtaggcactaatggtatagga

SEQ ID NO: 189972 - DNA, 25 bp, Artificial sequence
  SiRNA target sequence
ctagtaggcactaatggtataggaa

SEQ ID NO: 189973 - DNA, 25 bp, Artificial sequence
  SiRNA target sequence
tagtaggcactaatggtataggaaa

SEQ ID NO: 189974 - DNA, 25 bp, Artificial sequence
  SiRNA target sequence
agtaggcactaatggtataggaaaa

SEQ ID NO: 189975 - DNA, 25 bp, Artificial sequence
  SiRNA target sequence
gtaggcactaatggtataggaaaaa

SEQ ID NO: 189976 - DNA, 25 bp, Artificial sequence
  SiRNA target sequence
taggcactaatggtataggaaaaag

SEQ ID NO: 189977 - DNA, 25 bp, Artificial sequence
  SiRNA target sequence
aggcactaatggtataggaaaaagt

SEQ ID NO: 189978 - DNA, 25 bp, Artificial sequence
  SiRNA target sequence
ggcactaatggtataggaaaaagta

SEQ ID NO: 189979 - DNA, 25 bp, Artificial sequence
  SiRNA target sequence
gcactaatggtataggaaaaagtac

SEQ ID NO: 189980 - DNA, 25 bp, Artificial sequence
  SiRNA target sequence
cactaatggtataggaaaaagtact

SEQ ID NO: 189981 - DNA, 25 bp, Artificial sequence
  SiRNA target sequence
actaatggtataggaaaaagtactg

SEQ ID NO: 189982 - DNA, 25 bp, Artificial sequence
  SiRNA target sequence
ctaatggtataggaaaaagtactgc

SEQ ID NO: 189983 - DNA, 25 bp, Artificial sequence
  SiRNA target sequence
taatggtataggaaaaagtactgca

SEQ ID NO: 189984 - DNA, 25 bp, Artificial sequence
  SiRNA target sequence
aatggtataggaaaaagtactgcac

SEQ ID NO: 189985 - DNA, 25 bp, Artificial sequence
  SiRNA target sequence
atggtataggaaaaagtactgcact

SEQ ID NO: 189986 - DNA, 25 bp, Artificial sequence
  SiRNA target sequence
tggtataggaaaaagtactgcactt

SEQ ID NO: 189987 - DNA, 25 bp, Artificial sequence
  SiRNA target sequence
ggtataggaaaaagtactgcactta

SEQ ID NO: 189988 - DNA, 25 bp, Artificial sequence
  SiRNA target sequence
gtataggaaaaagtactgcacttaa

SEQ ID NO: 189989 - DNA, 25 bp, Artificial sequence
  SiRNA target sequence
tataggaaaaagtactgcacttaaa

SEQ ID NO: 189990 - DNA, 25 bp, Artificial sequence
  SiRNA target sequence
ataggaaaaagtactgcacttaaaa

SEQ ID NO: 189991 - DNA, 25 bp, Artificial sequence
  SiRNA target sequence
taggaaaaagtactgcacttaaaat

SEQ ID NO: 189992 - DNA, 25 bp, Artificial sequence
  SiRNA target sequence
aggaaaaagtactgcacttaaaata

SEQ ID NO: 189993 - DNA, 25 bp, Artificial sequence
  SiRNA target sequence
ggaaaaagtactgcacttaaaatat

SEQ ID NO: 189994 - DNA, 25 bp, Artificial sequence
  SiRNA target sequence
gaaaaagtactgcacttaaaatatt

SEQ ID NO: 189995 - DNA, 25 bp, Artificial sequence
  SiRNA target sequence
aaaaagtactgcacttaaaatatta

SEQ ID NO: 189996 - DNA, 25 bp, Artificial sequence
  SiRNA target sequence
aaaagtactgcacttaaaatattat

SEQ ID NO: 189997 - DNA, 25 bp, Artificial sequence
  SiRNA target sequence
aaagtactgcacttaaaatattatc

SEQ ID NO: 189998 - DNA, 25 bp, Artificial sequence
  SiRNA target sequence
aagtactgcacttaaaatattatcg

SEQ ID NO: 189999 - DNA, 25 bp, Artificial sequence
  SiRNA target sequence
agtactgcacttaaaatattatcgg

SEQ ID NO: 190000 - DNA, 25 bp, Artificial sequence
  SiRNA target sequence
gtactgcacttaaaatattatcggg

SEQ ID NO: 190001 - DNA, 25 bp, Artificial sequence
  SiRNA target sequence
tactgcacttaaaatattatcgggc

SEQ ID NO: 190002 - DNA, 25 bp, Artificial sequence
  SiRNA target sequence
actgcacttaaaatattatcgggca

SEQ ID NO: 190003 - DNA, 25 bp, Artificial sequence
  SiRNA target sequence
ctgcacttaaaatattatcgggcaa

SEQ ID NO: 190004 - DNA, 25 bp, Artificial sequence
  SiRNA target sequence
tgcacttaaaatattatcgggcaat

SEQ ID NO: 190005 - DNA, 25 bp, Artificial sequence
  SiRNA target sequence
gcacttaaaatattatcgggcaatc

SEQ ID NO: 190006 - DNA, 25 bp, Artificial sequence
  SiRNA target sequence
cacttaaaatattatcgggcaatct

SEQ ID NO: 190007 - DNA, 25 bp, Artificial sequence
  SiRNA target sequence
acttaaaatattatcgggcaatctt

SEQ ID NO: 190008 - DNA, 25 bp, Artificial sequence
  SiRNA target sequence
cttaaaatattatcgggcaatctta

SEQ ID NO: 190009 - DNA, 25 bp, Artificial sequence
  SiRNA target sequence
ttaaaatattatcgggcaatcttaa

SEQ ID NO: 190010 - DNA, 25 bp, Artificial sequence
  SiRNA target sequence
taaaatattatcgggcaatcttaaa

SEQ ID NO: 190011 - DNA, 25 bp, Artificial sequence
  SiRNA target sequence
aaaatattatcgggcaatcttaaac

SEQ ID NO: 190012 - DNA, 25 bp, Artificial sequence
  SiRNA target sequence
aaatattatcgggcaatcttaaacc

SEQ ID NO: 190013 - DNA, 25 bp, Artificial sequence
  SiRNA target sequence
aatattatcgggcaatcttaaacca

SEQ ID NO: 190014 - DNA, 25 bp, Artificial sequence
  SiRNA target sequence
atattatcgggcaatcttaaaccaa

SEQ ID NO: 190015 - DNA, 25 bp, Artificial sequence
  SiRNA target sequence
tattatcgggcaatcttaaaccaaa

SEQ ID NO: 190016 - DNA, 25 bp, Artificial sequence
  SiRNA target sequence
attatcgggcaatcttaaaccaaac

SEQ ID NO: 190017 - DNA, 25 bp, Artificial sequence
  SiRNA target sequence
ttatcgggcaatcttaaaccaaact

SEQ ID NO: 190018 - DNA, 25 bp, Artificial sequence
  SiRNA target sequence
tatcgggcaatcttaaaccaaactt

SEQ ID NO: 190019 - DNA, 25 bp, Artificial sequence
  SiRNA target sequence
atcgggcaatcttaaaccaaactta

SEQ ID NO: 190020 - DNA, 25 bp, Artificial sequence
  SiRNA target sequence
tcgggcaatcttaaaccaaacttag

SEQ ID NO: 190021 - DNA, 25 bp, Artificial sequence
  SiRNA target sequence
cgggcaatcttaaaccaaacttagg

SEQ ID NO: 190022 - DNA, 25 bp, Artificial sequence
  SiRNA target sequence
gggcaatcttaaaccaaacttagga

SEQ ID NO: 190023 - DNA, 25 bp, Artificial sequence
  SiRNA target sequence
ggcaatcttaaaccaaacttaggaa

SEQ ID NO: 190024 - DNA, 25 bp, Artificial sequence
  SiRNA target sequence
gcaatcttaaaccaaacttaggaaa

SEQ ID NO: 190025 - DNA, 25 bp, Artificial sequence
  SiRNA target sequence
caatcttaaaccaaacttaggaaag

SEQ ID NO: 190026 - DNA, 25 bp, Artificial sequence
  SiRNA target sequence
aatcttaaaccaaacttaggaaagt

SEQ ID NO: 190027 - DNA, 25 bp, Artificial sequence
  SiRNA target sequence
atcttaaaccaaacttaggaaagtt

SEQ ID NO: 190028 - DNA, 25 bp, Artificial sequence
  SiRNA target sequence
tcttaaaccaaacttaggaaagttc

SEQ ID NO: 190029 - DNA, 25 bp, Artificial sequence
  SiRNA target sequence
cttaaaccaaacttaggaaagttcg

SEQ ID NO: 190030 - DNA, 25 bp, Artificial sequence
  SiRNA target sequence
ttaaaccaaacttaggaaagttcga

SEQ ID NO: 190031 - DNA, 25 bp, Artificial sequence
  SiRNA target sequence
taaaccaaacttaggaaagttcgac

SEQ ID NO: 190032 - DNA, 25 bp, Artificial sequence
  SiRNA target sequence
aaaccaaacttaggaaagttcgacg

SEQ ID NO: 190033 - DNA, 25 bp, Artificial sequence
  SiRNA target sequence
aaccaaacttaggaaagttcgacgt

SEQ ID NO: 190034 - DNA, 25 bp, Artificial sequence
  SiRNA target sequence
accaaacttaggaaagttcgacgtt

SEQ ID NO: 190035 - DNA, 25 bp, Artificial sequence
  SiRNA target sequence
ccaaacttaggaaagttcgacgtta

SEQ ID NO: 190036 - DNA, 25 bp, Artificial sequence
  SiRNA target sequence
caaacttaggaaagttcgacgttac

SEQ ID NO: 190037 - DNA, 25 bp, Artificial sequence
  SiRNA target sequence
aaacttaggaaagttcgacgttacg

SEQ ID NO: 190038 - DNA, 25 bp, Artificial sequence
  SiRNA target sequence
aacttaggaaagttcgacgttacgc

SEQ ID NO: 190039 - DNA, 25 bp, Artificial sequence
  SiRNA target sequence
acttaggaaagttcgacgttacgcc

SEQ ID NO: 190040 - DNA, 25 bp, Artificial sequence
  SiRNA target sequence
cttaggaaagttcgacgttacgccc

SEQ ID NO: 190041 - DNA, 25 bp, Artificial sequence
  SiRNA target sequence
ttaggaaagttcgacgttacgcccg

SEQ ID NO: 190042 - DNA, 25 bp, Artificial sequence
  SiRNA target sequence
taggaaagttcgacgttacgcccga

SEQ ID NO: 190043 - DNA, 25 bp, Artificial sequence
  SiRNA target sequence
aggaaagttcgacgttacgcccgac

SEQ ID NO: 190044 - DNA, 25 bp, Artificial sequence
  SiRNA target sequence
ggaaagttcgacgttacgcccgact

SEQ ID NO: 190045 - DNA, 25 bp, Artificial sequence
  SiRNA target sequence
gaaagttcgacgttacgcccgactg

SEQ ID NO: 190046 - DNA, 25 bp, Artificial sequence
  SiRNA target sequence
aaagttcgacgttacgcccgactgg

SEQ ID NO: 190047 - DNA, 25 bp, Artificial sequence
  SiRNA target sequence
aagttcgacgttacgcccgactggg

SEQ ID NO: 190048 - DNA, 25 bp, Artificial sequence
  SiRNA target sequence
agttcgacgttacgcccgactgggc

SEQ ID NO: 190049 - DNA, 25 bp, Artificial sequence
  SiRNA target sequence
gttcgacgttacgcccgactgggca

SEQ ID NO: 190050 - DNA, 25 bp, Artificial sequence
  SiRNA target sequence
ttcgacgttacgcccgactgggcag

SEQ ID NO: 190051 - DNA, 25 bp, Artificial sequence
  SiRNA target sequence
tcgacgttacgcccgactgggcagc

SEQ ID NO: 190052 - DNA, 25 bp, Artificial sequence
  SiRNA target sequence
cgacgttacgcccgactgggcagca

SEQ ID NO: 190053 - DNA, 25 bp, Artificial sequence
  SiRNA target sequence
gacgttacgcccgactgggcagcaa

SEQ ID NO: 190054 - DNA, 25 bp, Artificial sequence
  SiRNA target sequence
acgttacgcccgactgggcagcaat

SEQ ID NO: 190055 - DNA, 25 bp, Artificial sequence
  SiRNA target sequence
cgttacgcccgactgggcagcaatt

SEQ ID NO: 190056 - DNA, 25 bp, Artificial sequence
  SiRNA target sequence
gttacgcccgactgggcagcaattc

SEQ ID NO: 190057 - DNA, 25 bp, Artificial sequence
  SiRNA target sequence
ttacgcccgactgggcagcaattct

SEQ ID NO: 190058 - DNA, 25 bp, Artificial sequence
  SiRNA target sequence
tacgcccgactgggcagcaattcta

SEQ ID NO: 190059 - DNA, 25 bp, Artificial sequence
  SiRNA target sequence
acgcccgactgggcagcaattctaa

SEQ ID NO: 190060 - DNA, 25 bp, Artificial sequence
  SiRNA target sequence
cgcccgactgggcagcaattctaaa

SEQ ID NO: 190061 - DNA, 25 bp, Artificial sequence
  SiRNA target sequence
gcccgactgggcagcaattctaaat

SEQ ID NO: 190062 - DNA, 25 bp, Artificial sequence
  SiRNA target sequence
cccgactgggcagcaattctaaata

SEQ ID NO: 190063 - DNA, 25 bp, Artificial sequence
  SiRNA target sequence
ccgactgggcagcaattctaaataa

SEQ ID NO: 190064 - DNA, 25 bp, Artificial sequence
  SiRNA target sequence
cgactgggcagcaattctaaataat

SEQ ID NO: 190065 - DNA, 25 bp, Artificial sequence
  SiRNA target sequence
gactgggcagcaattctaaataatt

SEQ ID NO: 190066 - DNA, 25 bp, Artificial sequence
  SiRNA target sequence
actgggcagcaattctaaataatta

SEQ ID NO: 190067 - DNA, 25 bp, Artificial sequence
  SiRNA target sequence
ctgggcagcaattctaaataattat

SEQ ID NO: 190068 - DNA, 25 bp, Artificial sequence
  SiRNA target sequence
tgggcagcaattctaaataattata

SEQ ID NO: 190069 - DNA, 25 bp, Artificial sequence
  SiRNA target sequence
gggcagcaattctaaataattataa

SEQ ID NO: 190070 - DNA, 25 bp, Artificial sequence
  SiRNA target sequence
ggcagcaattctaaataattataaa

SEQ ID NO: 190071 - DNA, 25 bp, Artificial sequence
  SiRNA target sequence
gcagcaattctaaataattataaag

SEQ ID NO: 190072 - DNA, 25 bp, Artificial sequence
  SiRNA target sequence
cagcaattctaaataattataaagg

SEQ ID NO: 190073 - DNA, 25 bp, Artificial sequence
  SiRNA target sequence
agcaattctaaataattataaagga

SEQ ID NO: 190074 - DNA, 25 bp, Artificial sequence
  SiRNA target sequence
gcaattctaaataattataaaggat

SEQ ID NO: 190075 - DNA, 25 bp, Artificial sequence
  SiRNA target sequence
caattctaaataattataaaggatc

SEQ ID NO: 190076 - DNA, 25 bp, Artificial sequence
  SiRNA target sequence
aattctaaataattataaaggatct

SEQ ID NO: 190077 - DNA, 25 bp, Artificial sequence
  SiRNA target sequence
attctaaataattataaaggatctg

SEQ ID NO: 190078 - DNA, 25 bp, Artificial sequence
  SiRNA target sequence
ttctaaataattataaaggatctga

SEQ ID NO: 190079 - DNA, 25 bp, Artificial sequence
  SiRNA target sequence
tctaaataattataaaggatctgaa

SEQ ID NO: 190080 - DNA, 25 bp, Artificial sequence
  SiRNA target sequence
ctaaataattataaaggatctgaac

SEQ ID NO: 190081 - DNA, 25 bp, Artificial sequence
  SiRNA target sequence
taaataattataaaggatctgaact

SEQ ID NO: 190082 - DNA, 25 bp, Artificial sequence
  SiRNA target sequence
aaataattataaaggatctgaactt

SEQ ID NO: 190083 - DNA, 25 bp, Artificial sequence
  SiRNA target sequence
aataattataaaggatctgaacttc

SEQ ID NO: 190084 - DNA, 25 bp, Artificial sequence
  SiRNA target sequence
ataattataaaggatctgaacttca

SEQ ID NO: 190085 - DNA, 25 bp, Artificial sequence
  SiRNA target sequence
taattataaaggatctgaacttcat

SEQ ID NO: 190086 - DNA, 25 bp, Artificial sequence
  SiRNA target sequence
aattataaaggatctgaacttcatg

SEQ ID NO: 190087 - DNA, 25 bp, Artificial sequence
  SiRNA target sequence
attataaaggatctgaacttcatgg

SEQ ID NO: 190088 - DNA, 25 bp, Artificial sequence
  SiRNA target sequence
ttataaaggatctgaacttcatgga

SEQ ID NO: 190089 - DNA, 25 bp, Artificial sequence
  SiRNA target sequence
tataaaggatctgaacttcatggat

SEQ ID NO: 190090 - DNA, 25 bp, Artificial sequence
  SiRNA target sequence
ataaaggatctgaacttcatggatt

SEQ ID NO: 190091 - DNA, 25 bp, Artificial sequence
  SiRNA target sequence
taaaggatctgaacttcatggattt

SEQ ID NO: 190092 - DNA, 25 bp, Artificial sequence
  SiRNA target sequence
aaaggatctgaacttcatggatttt

SEQ ID NO: 190093 - DNA, 25 bp, Artificial sequence
  SiRNA target sequence
aaggatctgaacttcatggattttt

SEQ ID NO: 190094 - DNA, 25 bp, Artificial sequence
  SiRNA target sequence
aggatctgaacttcatggatttttt

SEQ ID NO: 190095 - DNA, 25 bp, Artificial sequence
  SiRNA target sequence
ggatctgaacttcatggatttttta

SEQ ID NO: 190096 - DNA, 25 bp, Artificial sequence
  SiRNA target sequence
gatctgaacttcatggattttttac

SEQ ID NO: 190097 - DNA, 25 bp, Artificial sequence
  SiRNA target sequence
atctgaacttcatggattttttact

SEQ ID NO: 190098 - DNA, 25 bp, Artificial sequence
  SiRNA target sequence
tctgaacttcatggattttttacta

SEQ ID NO: 190099 - DNA, 25 bp, Artificial sequence
  SiRNA target sequence
ctgaacttcatggattttttactaa

SEQ ID NO: 190100 - DNA, 25 bp, Artificial sequence
  SiRNA target sequence
tgaacttcatggattttttactaaa

SEQ ID NO: 190101 - DNA, 25 bp, Artificial sequence
  SiRNA target sequence
gaacttcatggattttttactaaaa

SEQ ID NO: 190102 - DNA, 25 bp, Artificial sequence
  SiRNA target sequence
aacttcatggattttttactaaaat

SEQ ID NO: 190103 - DNA, 25 bp, Artificial sequence
  SiRNA target sequence
acttcatggattttttactaaaatt

SEQ ID NO: 190104 - DNA, 25 bp, Artificial sequence
  SiRNA target sequence
cttcatggattttttactaaaattt

SEQ ID NO: 190105 - DNA, 25 bp, Artificial sequence
  SiRNA target sequence
ttcatggattttttactaaaatttt

SEQ ID NO: 190106 - DNA, 25 bp, Artificial sequence
  SiRNA target sequence
tcatggattttttactaaaatttta

SEQ ID NO: 190107 - DNA, 25 bp, Artificial sequence
  SiRNA target sequence
catggattttttactaaaattttag

SEQ ID NO: 190108 - DNA, 25 bp, Artificial sequence
  SiRNA target sequence
atggattttttactaaaattttaga

SEQ ID NO: 190109 - DNA, 25 bp, Artificial sequence
  SiRNA target sequence
tggattttttactaaaattttagaa

SEQ ID NO: 190110 - DNA, 25 bp, Artificial sequence
  SiRNA target sequence
ggattttttactaaaattttagaag

SEQ ID NO: 190111 - DNA, 25 bp, Artificial sequence
  SiRNA target sequence
gattttttactaaaattttagaagg

SEQ ID NO: 190112 - DNA, 25 bp, Artificial sequence
  SiRNA target sequence
attttttactaaaattttagaaggg

SEQ ID NO: 190113 - DNA, 25 bp, Artificial sequence
  SiRNA target sequence
ttttttactaaaattttagaagggt

SEQ ID NO: 190114 - DNA, 25 bp, Artificial sequence
  SiRNA target sequence
tttttactaaaattttagaagggtc

SEQ ID NO: 190115 - DNA, 25 bp, Artificial sequence
  SiRNA target sequence
ttttactaaaattttagaagggtct

SEQ ID NO: 190116 - DNA, 25 bp, Artificial sequence
  SiRNA target sequence
tttactaaaattttagaagggtcta

SEQ ID NO: 190117 - DNA, 25 bp, Artificial sequence
  SiRNA target sequence
ttactaaaattttagaagggtctat

SEQ ID NO: 190118 - DNA, 25 bp, Artificial sequence
  SiRNA target sequence
tactaaaattttagaagggtctatt

SEQ ID NO: 190119 - DNA, 25 bp, Artificial sequence
  SiRNA target sequence
actaaaattttagaagggtctatta

SEQ ID NO: 190120 - DNA, 25 bp, Artificial sequence
  SiRNA target sequence
ctaaaattttagaagggtctattaa

SEQ ID NO: 190121 - DNA, 25 bp, Artificial sequence
  SiRNA target sequence
taaaattttagaagggtctattaaa

SEQ ID NO: 190122 - DNA, 25 bp, Artificial sequence
  SiRNA target sequence
aaaattttagaagggtctattaaag

SEQ ID NO: 190123 - DNA, 25 bp, Artificial sequence
  SiRNA target sequence
aaattttagaagggtctattaaagc

SEQ ID NO: 190124 - DNA, 25 bp, Artificial sequence
  SiRNA target sequence
aattttagaagggtctattaaagct

SEQ ID NO: 190125 - DNA, 25 bp, Artificial sequence
  SiRNA target sequence
attttagaagggtctattaaagcta

SEQ ID NO: 190126 - DNA, 25 bp, Artificial sequence
  SiRNA target sequence
ttttagaagggtctattaaagctat

SEQ ID NO: 190127 - DNA, 25 bp, Artificial sequence
  SiRNA target sequence
tttagaagggtctattaaagctatt

SEQ ID NO: 190128 - DNA, 25 bp, Artificial sequence
  SiRNA target sequence
ttagaagggtctattaaagctattt

SEQ ID NO: 190129 - DNA, 25 bp, Artificial sequence
  SiRNA target sequence
tagaagggtctattaaagctatttc

SEQ ID NO: 190130 - DNA, 25 bp, Artificial sequence
  SiRNA target sequence
agaagggtctattaaagctatttct

SEQ ID NO: 190131 - DNA, 25 bp, Artificial sequence
  SiRNA target sequence
gaagggtctattaaagctatttcta

SEQ ID NO: 190132 - DNA, 25 bp, Artificial sequence
  SiRNA target sequence
aagggtctattaaagctatttctaa

SEQ ID NO: 190133 - DNA, 25 bp, Artificial sequence
  SiRNA target sequence
agggtctattaaagctatttctaag

SEQ ID NO: 190134 - DNA, 25 bp, Artificial sequence
  SiRNA target sequence
gggtctattaaagctatttctaaga

SEQ ID NO: 190135 - DNA, 25 bp, Artificial sequence
  SiRNA target sequence
ggtctattaaagctatttctaagat

SEQ ID NO: 190136 - DNA, 25 bp, Artificial sequence
  SiRNA target sequence
gtctattaaagctatttctaagata

SEQ ID NO: 190137 - DNA, 25 bp, Artificial sequence
  SiRNA target sequence
tctattaaagctatttctaagatac

SEQ ID NO: 190138 - DNA, 25 bp, Artificial sequence
  SiRNA target sequence
ctattaaagctatttctaagataca

SEQ ID NO: 190139 - DNA, 25 bp, Artificial sequence
  SiRNA target sequence
tattaaagctatttctaagatacag

SEQ ID NO: 190140 - DNA, 25 bp, Artificial sequence
  SiRNA target sequence
attaaagctatttctaagatacagt

SEQ ID NO: 190141 - DNA, 25 bp, Artificial sequence
  SiRNA target sequence
ttaaagctatttctaagatacagta

SEQ ID NO: 190142 - DNA, 25 bp, Artificial sequence
  SiRNA target sequence
taaagctatttctaagatacagtat

SEQ ID NO: 190143 - DNA, 25 bp, Artificial sequence
  SiRNA target sequence
aaagctatttctaagatacagtata

SEQ ID NO: 190144 - DNA, 25 bp, Artificial sequence
  SiRNA target sequence
aagctatttctaagatacagtatat

SEQ ID NO: 190145 - DNA, 25 bp, Artificial sequence
  SiRNA target sequence
agctatttctaagatacagtatata

SEQ ID NO: 190146 - DNA, 25 bp, Artificial sequence
  SiRNA target sequence
gctatttctaagatacagtatatag

SEQ ID NO: 190147 - DNA, 25 bp, Artificial sequence
  SiRNA target sequence
ctatttctaagatacagtatataga

SEQ ID NO: 190148 - DNA, 25 bp, Artificial sequence
  SiRNA target sequence
tatttctaagatacagtatatagat

SEQ ID NO: 190149 - DNA, 25 bp, Artificial sequence
  SiRNA target sequence
atttctaagatacagtatatagata

SEQ ID NO: 190150 - DNA, 25 bp, Artificial sequence
  SiRNA target sequence
tttctaagatacagtatatagataa

SEQ ID NO: 190151 - DNA, 25 bp, Artificial sequence
  SiRNA target sequence
ttctaagatacagtatatagataaa

SEQ ID NO: 190152 - DNA, 25 bp, Artificial sequence
  SiRNA target sequence
tctaagatacagtatatagataaaa

SEQ ID NO: 190153 - DNA, 25 bp, Artificial sequence
  SiRNA target sequence
ctaagatacagtatatagataaaat

SEQ ID NO: 190154 - DNA, 25 bp, Artificial sequence
  SiRNA target sequence
taagatacagtatatagataaaatg

SEQ ID NO: 190155 - DNA, 25 bp, Artificial sequence
  SiRNA target sequence
aagatacagtatatagataaaatgc

SEQ ID NO: 190156 - DNA, 25 bp, Artificial sequence
  SiRNA target sequence
agatacagtatatagataaaatgcc

SEQ ID NO: 190157 - DNA, 25 bp, Artificial sequence
  SiRNA target sequence
gatacagtatatagataaaatgcct

SEQ ID NO: 190158 - DNA, 25 bp, Artificial sequence
  SiRNA target sequence
atacagtatatagataaaatgccta

SEQ ID NO: 190159 - DNA, 25 bp, Artificial sequence
  SiRNA target sequence
tacagtatatagataaaatgcctaa

SEQ ID NO: 190160 - DNA, 25 bp, Artificial sequence
  SiRNA target sequence
acagtatatagataaaatgcctaaa

SEQ ID NO: 190161 - DNA, 25 bp, Artificial sequence
  SiRNA target sequence
cagtatatagataaaatgcctaaat

SEQ ID NO: 190162 - DNA, 25 bp, Artificial sequence
  SiRNA target sequence
agtatatagataaaatgcctaaatt

SEQ ID NO: 190163 - DNA, 25 bp, Artificial sequence
  SiRNA target sequence
gtatatagataaaatgcctaaattt

SEQ ID NO: 190164 - DNA, 25 bp, Artificial sequence
  SiRNA target sequence
tatatagataaaatgcctaaatttt

SEQ ID NO: 190165 - DNA, 25 bp, Artificial sequence
  SiRNA target sequence
atatagataaaatgcctaaattttt

SEQ ID NO: 190166 - DNA, 25 bp, Artificial sequence
  SiRNA target sequence
tatagataaaatgcctaaattttta

SEQ ID NO: 190167 - DNA, 25 bp, Artificial sequence
  SiRNA target sequence
atagataaaatgcctaaatttttaa

SEQ ID NO: 190168 - DNA, 25 bp, Artificial sequence
  SiRNA target sequence
tagataaaatgcctaaatttttaaa

SEQ ID NO: 190169 - DNA, 25 bp, Artificial sequence
  SiRNA target sequence
agataaaatgcctaaatttttaaaa

SEQ ID NO: 190170 - DNA, 25 bp, Artificial sequence
  SiRNA target sequence
gataaaatgcctaaatttttaaaag

SEQ ID NO: 190171 - DNA, 25 bp, Artificial sequence
  SiRNA target sequence
ataaaatgcctaaatttttaaaagg

SEQ ID NO: 190172 - DNA, 25 bp, Artificial sequence
  SiRNA target sequence
taaaatgcctaaatttttaaaagga

SEQ ID NO: 190173 - DNA, 25 bp, Artificial sequence
  SiRNA target sequence
aaaatgcctaaatttttaaaaggac

SEQ ID NO: 190174 - DNA, 25 bp, Artificial sequence
  SiRNA target sequence
aaatgcctaaatttttaaaaggacg

SEQ ID NO: 190175 - DNA, 25 bp, Artificial sequence
  SiRNA target sequence
aatgcctaaatttttaaaaggacgc

SEQ ID NO: 190176 - DNA, 25 bp, Artificial sequence
  SiRNA target sequence
atgcctaaatttttaaaaggacgct

SEQ ID NO: 190177 - DNA, 25 bp, Artificial sequence
  SiRNA target sequence
tgcctaaatttttaaaaggacgcta

SEQ ID NO: 190178 - DNA, 25 bp, Artificial sequence
  SiRNA target sequence
gcctaaatttttaaaaggacgctat

SEQ ID NO: 190179 - DNA, 25 bp, Artificial sequence
  SiRNA target sequence
cctaaatttttaaaaggacgctata

SEQ ID NO: 190180 - DNA, 25 bp, Artificial sequence
  SiRNA target sequence
ctaaatttttaaaaggacgctataa

SEQ ID NO: 190181 - DNA, 25 bp, Artificial sequence
  SiRNA target sequence
taaatttttaaaaggacgctataag

SEQ ID NO: 190182 - DNA, 25 bp, Artificial sequence
  SiRNA target sequence
aaatttttaaaaggacgctataagt

SEQ ID NO: 190183 - DNA, 25 bp, Artificial sequence
  SiRNA target sequence
aatttttaaaaggacgctataagtc

SEQ ID NO: 190184 - DNA, 25 bp, Artificial sequence
  SiRNA target sequence
atttttaaaaggacgctataagtca

SEQ ID NO: 190185 - DNA, 25 bp, Artificial sequence
  SiRNA target sequence
tttttaaaaggacgctataagtcag

SEQ ID NO: 190186 - DNA, 25 bp, Artificial sequence
  SiRNA target sequence
ttttaaaaggacgctataagtcaga

SEQ ID NO: 190187 - DNA, 25 bp, Artificial sequence
  SiRNA target sequence
tttaaaaggacgctataagtcagaa

SEQ ID NO: 190188 - DNA, 25 bp, Artificial sequence
  SiRNA target sequence
ttaaaaggacgctataagtcagaaa

SEQ ID NO: 190189 - DNA, 25 bp, Artificial sequence
  SiRNA target sequence
taaaaggacgctataagtcagaaat

SEQ ID NO: 190190 - DNA, 25 bp, Artificial sequence
  SiRNA target sequence
aaaaggacgctataagtcagaaatc

SEQ ID NO: 190191 - DNA, 25 bp, Artificial sequence
  SiRNA target sequence
aaaggacgctataagtcagaaatcg

SEQ ID NO: 190192 - DNA, 25 bp, Artificial sequence
  SiRNA target sequence
aaggacgctataagtcagaaatcgc

SEQ ID NO: 190193 - DNA, 25 bp, Artificial sequence
  SiRNA target sequence
aggacgctataagtcagaaatcgcc

SEQ ID NO: 190194 - DNA, 25 bp, Artificial sequence
  SiRNA target sequence
ggacgctataagtcagaaatcgcct

SEQ ID NO: 190195 - DNA, 25 bp, Artificial sequence
  SiRNA target sequence
gacgctataagtcagaaatcgcctc

SEQ ID NO: 190196 - DNA, 25 bp, Artificial sequence
  SiRNA target sequence
acgctataagtcagaaatcgcctcc

SEQ ID NO: 190197 - DNA, 25 bp, Artificial sequence
  SiRNA target sequence
cgctataagtcagaaatcgcctccg

SEQ ID NO: 190198 - DNA, 25 bp, Artificial sequence
  SiRNA target sequence
gctataagtcagaaatcgcctccgg

SEQ ID NO: 190199 - DNA, 25 bp, Artificial sequence
  SiRNA target sequence
ctataagtcagaaatcgcctccgga

SEQ ID NO: 190200 - DNA, 25 bp, Artificial sequence
  SiRNA target sequence
tataagtcagaaatcgcctccggaa

SEQ ID NO: 190201 - DNA, 25 bp, Artificial sequence
  SiRNA target sequence
ataagtcagaaatcgcctccggaaa

SEQ ID NO: 190202 - DNA, 25 bp, Artificial sequence
  SiRNA target sequence
taagtcagaaatcgcctccggaaaa

SEQ ID NO: 190203 - DNA, 25 bp, Artificial sequence
  SiRNA target sequence
aagtcagaaatcgcctccggaaaaa

SEQ ID NO: 190204 - DNA, 25 bp, Artificial sequence
  SiRNA target sequence
agtcagaaatcgcctccggaaaaat

SEQ ID NO: 190205 - DNA, 25 bp, Artificial sequence
  SiRNA target sequence
gtcagaaatcgcctccggaaaaatg

SEQ ID NO: 190206 - DNA, 25 bp, Artificial sequence
  SiRNA target sequence
tcagaaatcgcctccggaaaaatgt

SEQ ID NO: 190207 - DNA, 25 bp, Artificial sequence
  SiRNA target sequence
cagaaatcgcctccggaaaaatgtt

SEQ ID NO: 190208 - DNA, 25 bp, Artificial sequence
  SiRNA target sequence
agaaatcgcctccggaaaaatgttg

SEQ ID NO: 190209 - DNA, 25 bp, Artificial sequence
  SiRNA target sequence
gaaatcgcctccggaaaaatgttgt

SEQ ID NO: 190210 - DNA, 25 bp, Artificial sequence
  SiRNA target sequence
aaatcgcctccggaaaaatgttgtt

SEQ ID NO: 190211 - DNA, 25 bp, Artificial sequence
  SiRNA target sequence
aatcgcctccggaaaaatgttgttt

SEQ ID NO: 190212 - DNA, 25 bp, Artificial sequence
  SiRNA target sequence
atcgcctccggaaaaatgttgttta

SEQ ID NO: 190213 - DNA, 25 bp, Artificial sequence
  SiRNA target sequence
tcgcctccggaaaaatgttgtttac

SEQ ID NO: 190214 - DNA, 25 bp, Artificial sequence
  SiRNA target sequence
cgcctccggaaaaatgttgtttact

SEQ ID NO: 190215 - DNA, 25 bp, Artificial sequence
  SiRNA target sequence
gcctccggaaaaatgttgtttactg

SEQ ID NO: 190216 - DNA, 25 bp, Artificial sequence
  SiRNA target sequence
cctccggaaaaatgttgtttactgt

SEQ ID NO: 190217 - DNA, 25 bp, Artificial sequence
  SiRNA target sequence
ctccggaaaaatgttgtttactgtt

SEQ ID NO: 190218 - DNA, 25 bp, Artificial sequence
  SiRNA target sequence
tccggaaaaatgttgtttactgtta

SEQ ID NO: 190219 - DNA, 25 bp, Artificial sequence
  SiRNA target sequence
ccggaaaaatgttgtttactgttaa

SEQ ID NO: 190220 - DNA, 25 bp, Artificial sequence
  SiRNA target sequence
cggaaaaatgttgtttactgttaat

SEQ ID NO: 190221 - DNA, 25 bp, Artificial sequence
  SiRNA target sequence
ggaaaaatgttgtttactgttaatg

SEQ ID NO: 190222 - DNA, 25 bp, Artificial sequence
  SiRNA target sequence
gaaaaatgttgtttactgttaatga

SEQ ID NO: 190223 - DNA, 25 bp, Artificial sequence
  SiRNA target sequence
aaaaatgttgtttactgttaatgat

SEQ ID NO: 190224 - DNA, 25 bp, Artificial sequence
  SiRNA target sequence
aaaatgttgtttactgttaatgata

SEQ ID NO: 190225 - DNA, 25 bp, Artificial sequence
  SiRNA target sequence
aaatgttgtttactgttaatgatat

SEQ ID NO: 190226 - DNA, 25 bp, Artificial sequence
  SiRNA target sequence
aatgttgtttactgttaatgatata

SEQ ID NO: 190227 - DNA, 25 bp, Artificial sequence
  SiRNA target sequence
atgttgtttactgttaatgatatat

SEQ ID NO: 190228 - DNA, 25 bp, Artificial sequence
  SiRNA target sequence
tgttgtttactgttaatgatatatt

SEQ ID NO: 190229 - DNA, 25 bp, Artificial sequence
  SiRNA target sequence
gttgtttactgttaatgatatatta

SEQ ID NO: 190230 - DNA, 25 bp, Artificial sequence
  SiRNA target sequence
ttgtttactgttaatgatatattaa

SEQ ID NO: 190231 - DNA, 25 bp, Artificial sequence
  SiRNA target sequence
tgtttactgttaatgatatattaaa

SEQ ID NO: 190232 - DNA, 25 bp, Artificial sequence
  SiRNA target sequence
gtttactgttaatgatatattaaaa

SEQ ID NO: 190233 - DNA, 25 bp, Artificial sequence
  SiRNA target sequence
tttactgttaatgatatattaaaaa

SEQ ID NO: 190234 - DNA, 25 bp, Artificial sequence
  SiRNA target sequence
ttactgttaatgatatattaaaaaa

SEQ ID NO: 190235 - DNA, 25 bp, Artificial sequence
  SiRNA target sequence
tactgttaatgatatattaaaaaaa

SEQ ID NO: 190236 - DNA, 25 bp, Artificial sequence
  SiRNA target sequence
actgttaatgatatattaaaaaaag

SEQ ID NO: 190237 - DNA, 25 bp, Artificial sequence
  SiRNA target sequence
ctgttaatgatatattaaaaaaagt

SEQ ID NO: 190238 - DNA, 25 bp, Artificial sequence
  SiRNA target sequence
tgttaatgatatattaaaaaaagtt

SEQ ID NO: 190239 - DNA, 25 bp, Artificial sequence
  SiRNA target sequence
gttaatgatatattaaaaaaagttg

SEQ ID NO: 190240 - DNA, 25 bp, Artificial sequence
  SiRNA target sequence
ttaatgatatattaaaaaaagttga

SEQ ID NO: 190241 - DNA, 25 bp, Artificial sequence
  SiRNA target sequence
taatgatatattaaaaaaagttgat

SEQ ID NO: 190242 - DNA, 25 bp, Artificial sequence
  SiRNA target sequence
aatgatatattaaaaaaagttgatg

SEQ ID NO: 190243 - DNA, 25 bp, Artificial sequence
  SiRNA target sequence
atgatatattaaaaaaagttgatga

SEQ ID NO: 190244 - DNA, 25 bp, Artificial sequence
  SiRNA target sequence
tgatatattaaaaaaagttgatgaa

SEQ ID NO: 190245 - DNA, 25 bp, Artificial sequence
  SiRNA target sequence
gatatattaaaaaaagttgatgaaa

SEQ ID NO: 190246 - DNA, 25 bp, Artificial sequence
  SiRNA target sequence
atatattaaaaaaagttgatgaaaa

SEQ ID NO: 190247 - DNA, 25 bp, Artificial sequence
  SiRNA target sequence
tatattaaaaaaagttgatgaaaaa

SEQ ID NO: 190248 - DNA, 25 bp, Artificial sequence
  SiRNA target sequence
atattaaaaaaagttgatgaaaaaa

SEQ ID NO: 190249 - DNA, 25 bp, Artificial sequence
  SiRNA target sequence
tattaaaaaaagttgatgaaaaaaa

SEQ ID NO: 190250 - DNA, 25 bp, Artificial sequence
  SiRNA target sequence
attaaaaaaagttgatgaaaaaaat

SEQ ID NO: 190251 - DNA, 25 bp, Artificial sequence
  SiRNA target sequence
ttaaaaaaagttgatgaaaaaaata

SEQ ID NO: 190252 - DNA, 25 bp, Artificial sequence
  SiRNA target sequence
taaaaaaagttgatgaaaaaaataa

SEQ ID NO: 190253 - DNA, 25 bp, Artificial sequence
  SiRNA target sequence
aaaaaaagttgatgaaaaaaataaa

SEQ ID NO: 190254 - DNA, 25 bp, Artificial sequence
  SiRNA target sequence
aaaaaagttgatgaaaaaaataaat

SEQ ID NO: 190255 - DNA, 25 bp, Artificial sequence
  SiRNA target sequence
aaaaagttgatgaaaaaaataaatt

SEQ ID NO: 190256 - DNA, 25 bp, Artificial sequence
  SiRNA target sequence
aaaagttgatgaaaaaaataaattt

SEQ ID NO: 190257 - DNA, 25 bp, Artificial sequence
  SiRNA target sequence
aaagttgatgaaaaaaataaatttg

SEQ ID NO: 190258 - DNA, 25 bp, Artificial sequence
  SiRNA target sequence
aagttgatgaaaaaaataaatttga

SEQ ID NO: 190259 - DNA, 25 bp, Artificial sequence
  SiRNA target sequence
agttgatgaaaaaaataaatttgac

SEQ ID NO: 190260 - DNA, 25 bp, Artificial sequence
  SiRNA target sequence
gttgatgaaaaaaataaatttgact

SEQ ID NO: 190261 - DNA, 25 bp, Artificial sequence
  SiRNA target sequence
ttgatgaaaaaaataaatttgacta

SEQ ID NO: 190262 - DNA, 25 bp, Artificial sequence
  SiRNA target sequence
tgatgaaaaaaataaatttgactat

SEQ ID NO: 190263 - DNA, 25 bp, Artificial sequence
  SiRNA target sequence
gatgaaaaaaataaatttgactatt

SEQ ID NO: 190264 - DNA, 25 bp, Artificial sequence
  SiRNA target sequence
atgaaaaaaataaatttgactatta

SEQ ID NO: 190265 - DNA, 25 bp, Artificial sequence
  SiRNA target sequence
tgaaaaaaataaatttgactattac

SEQ ID NO: 190266 - DNA, 25 bp, Artificial sequence
  SiRNA target sequence
gaaaaaaataaatttgactattacg

SEQ ID NO: 190267 - DNA, 25 bp, Artificial sequence
  SiRNA target sequence
aaaaaaataaatttgactattacgt

SEQ ID NO: 190268 - DNA, 25 bp, Artificial sequence
  SiRNA target sequence
aaaaaataaatttgactattacgta

SEQ ID NO: 190269 - DNA, 25 bp, Artificial sequence
  SiRNA target sequence
aaaaataaatttgactattacgtag

SEQ ID NO: 190270 - DNA, 25 bp, Artificial sequence
  SiRNA target sequence
aaaataaatttgactattacgtaga

SEQ ID NO: 190271 - DNA, 25 bp, Artificial sequence
  SiRNA target sequence
aaataaatttgactattacgtagat

SEQ ID NO: 190272 - DNA, 25 bp, Artificial sequence
  SiRNA target sequence
aataaatttgactattacgtagata

SEQ ID NO: 190273 - DNA, 25 bp, Artificial sequence
  SiRNA target sequence
ataaatttgactattacgtagataa

SEQ ID NO: 190274 - DNA, 25 bp, Artificial sequence
  SiRNA target sequence
taaatttgactattacgtagataaa

SEQ ID NO: 190275 - DNA, 25 bp, Artificial sequence
  SiRNA target sequence
aaatttgactattacgtagataaaa

SEQ ID NO: 190276 - DNA, 25 bp, Artificial sequence
  SiRNA target sequence
aatttgactattacgtagataaaat

SEQ ID NO: 190277 - DNA, 25 bp, Artificial sequence
  SiRNA target sequence
atttgactattacgtagataaaatg

SEQ ID NO: 190278 - DNA, 25 bp, Artificial sequence
  SiRNA target sequence
tttgactattacgtagataaaatgg

SEQ ID NO: 190279 - DNA, 25 bp, Artificial sequence
  SiRNA target sequence
ttgactattacgtagataaaatggc

SEQ ID NO: 190280 - DNA, 25 bp, Artificial sequence
  SiRNA target sequence
tgactattacgtagataaaatggca

SEQ ID NO: 190281 - DNA, 25 bp, Artificial sequence
  SiRNA target sequence
gactattacgtagataaaatggcac

SEQ ID NO: 190282 - DNA, 25 bp, Artificial sequence
  SiRNA target sequence
actattacgtagataaaatggcact

SEQ ID NO: 190283 - DNA, 25 bp, Artificial sequence
  SiRNA target sequence
ctattacgtagataaaatggcactt

SEQ ID NO: 190284 - DNA, 25 bp, Artificial sequence
  SiRNA target sequence
tattacgtagataaaatggcactta

SEQ ID NO: 190285 - DNA, 25 bp, Artificial sequence
  SiRNA target sequence
attacgtagataaaatggcacttaa

SEQ ID NO: 190286 - DNA, 25 bp, Artificial sequence
  SiRNA target sequence
ttacgtagataaaatggcacttaaa

SEQ ID NO: 190287 - DNA, 25 bp, Artificial sequence
  SiRNA target sequence
tacgtagataaaatggcacttaaaa

SEQ ID NO: 190288 - DNA, 25 bp, Artificial sequence
  SiRNA target sequence
acgtagataaaatggcacttaaaaa

SEQ ID NO: 190289 - DNA, 25 bp, Artificial sequence
  SiRNA target sequence
cgtagataaaatggcacttaaaaat

SEQ ID NO: 190290 - DNA, 25 bp, Artificial sequence
  SiRNA target sequence
gtagataaaatggcacttaaaaatg

SEQ ID NO: 190291 - DNA, 25 bp, Artificial sequence
  SiRNA target sequence
tagataaaatggcacttaaaaatgt

SEQ ID NO: 190292 - DNA, 25 bp, Artificial sequence
  SiRNA target sequence
agataaaatggcacttaaaaatgta

SEQ ID NO: 190293 - DNA, 25 bp, Artificial sequence
  SiRNA target sequence
gataaaatggcacttaaaaatgtat

SEQ ID NO: 190294 - DNA, 25 bp, Artificial sequence
  SiRNA target sequence
ataaaatggcacttaaaaatgtatt

SEQ ID NO: 190295 - DNA, 25 bp, Artificial sequence
  SiRNA target sequence
taaaatggcacttaaaaatgtatta

SEQ ID NO: 190296 - DNA, 25 bp, Artificial sequence
  SiRNA target sequence
aaaatggcacttaaaaatgtattaa

SEQ ID NO: 190297 - DNA, 25 bp, Artificial sequence
  SiRNA target sequence
aaatggcacttaaaaatgtattaac

SEQ ID NO: 190298 - DNA, 25 bp, Artificial sequence
  SiRNA target sequence
aatggcacttaaaaatgtattaaca

SEQ ID NO: 190299 - DNA, 25 bp, Artificial sequence
  SiRNA target sequence
atggcacttaaaaatgtattaacaa

SEQ ID NO: 190300 - DNA, 25 bp, Artificial sequence
  SiRNA target sequence
tggcacttaaaaatgtattaacaag

SEQ ID NO: 190301 - DNA, 25 bp, Artificial sequence
  SiRNA target sequence
ggcacttaaaaatgtattaacaaga

SEQ ID NO: 190302 - DNA, 25 bp, Artificial sequence
  SiRNA target sequence
gcacttaaaaatgtattaacaagag

SEQ ID NO: 190303 - DNA, 25 bp, Artificial sequence
  SiRNA target sequence
cacttaaaaatgtattaacaagaga

SEQ ID NO: 190304 - DNA, 25 bp, Artificial sequence
  SiRNA target sequence
acttaaaaatgtattaacaagagaa

SEQ ID NO: 190305 - DNA, 25 bp, Artificial sequence
  SiRNA target sequence
cttaaaaatgtattaacaagagaat

SEQ ID NO: 190306 - DNA, 25 bp, Artificial sequence
  SiRNA target sequence
ttaaaaatgtattaacaagagaatt

SEQ ID NO: 190307 - DNA, 25 bp, Artificial sequence
  SiRNA target sequence
taaaaatgtattaacaagagaatta

SEQ ID NO: 190308 - DNA, 25 bp, Artificial sequence
  SiRNA target sequence
aaaaatgtattaacaagagaattag

SEQ ID NO: 190309 - DNA, 25 bp, Artificial sequence
  SiRNA target sequence
aaaatgtattaacaagagaattaga

SEQ ID NO: 190310 - DNA, 25 bp, Artificial sequence
  SiRNA target sequence
aaatgtattaacaagagaattagag

SEQ ID NO: 190311 - DNA, 25 bp, Artificial sequence
  SiRNA target sequence
aatgtattaacaagagaattagagc

SEQ ID NO: 190312 - DNA, 25 bp, Artificial sequence
  SiRNA target sequence
atgtattaacaagagaattagagca

SEQ ID NO: 190313 - DNA, 25 bp, Artificial sequence
  SiRNA target sequence
tgtattaacaagagaattagagcaa

SEQ ID NO: 190314 - DNA, 25 bp, Artificial sequence
  SiRNA target sequence
gtattaacaagagaattagagcaat

SEQ ID NO: 190315 - DNA, 25 bp, Artificial sequence
  SiRNA target sequence
tattaacaagagaattagagcaatt

SEQ ID NO: 190316 - DNA, 25 bp, Artificial sequence
  SiRNA target sequence
attaacaagagaattagagcaatta

SEQ ID NO: 190317 - DNA, 25 bp, Artificial sequence
  SiRNA target sequence
ttaacaagagaattagagcaattaa

SEQ ID NO: 190318 - DNA, 25 bp, Artificial sequence
  SiRNA target sequence
taacaagagaattagagcaattaag

SEQ ID NO: 190319 - DNA, 25 bp, Artificial sequence
  SiRNA target sequence
aacaagagaattagagcaattaagt

SEQ ID NO: 190320 - DNA, 25 bp, Artificial sequence
  SiRNA target sequence
acaagagaattagagcaattaagtg

SEQ ID NO: 190321 - DNA, 25 bp, Artificial sequence
  SiRNA target sequence
caagagaattagagcaattaagtgg

SEQ ID NO: 190322 - DNA, 25 bp, Artificial sequence
  SiRNA target sequence
aagagaattagagcaattaagtggt

SEQ ID NO: 190323 - DNA, 25 bp, Artificial sequence
  SiRNA target sequence
agagaattagagcaattaagtggtg

SEQ ID NO: 190324 - DNA, 25 bp, Artificial sequence
  SiRNA target sequence
gagaattagagcaattaagtggtgg

SEQ ID NO: 190325 - DNA, 25 bp, Artificial sequence
  SiRNA target sequence
agaattagagcaattaagtggtggt

SEQ ID NO: 190326 - DNA, 25 bp, Artificial sequence
  SiRNA target sequence
gaattagagcaattaagtggtggtg

SEQ ID NO: 190327 - DNA, 25 bp, Artificial sequence
  SiRNA target sequence
aattagagcaattaagtggtggtga

SEQ ID NO: 190328 - DNA, 25 bp, Artificial sequence
  SiRNA target sequence
attagagcaattaagtggtggtgaa

SEQ ID NO: 190329 - DNA, 25 bp, Artificial sequence
  SiRNA target sequence
ttagagcaattaagtggtggtgaac

SEQ ID NO: 190330 - DNA, 25 bp, Artificial sequence
  SiRNA target sequence
tagagcaattaagtggtggtgaact

SEQ ID NO: 190331 - DNA, 25 bp, Artificial sequence
  SiRNA target sequence
agagcaattaagtggtggtgaactt

SEQ ID NO: 190332 - DNA, 25 bp, Artificial sequence
  SiRNA target sequence
gagcaattaagtggtggtgaacttc

SEQ ID NO: 190333 - DNA, 25 bp, Artificial sequence
  SiRNA target sequence
agcaattaagtggtggtgaacttca

SEQ ID NO: 190334 - DNA, 25 bp, Artificial sequence
  SiRNA target sequence
gcaattaagtggtggtgaacttcaa

SEQ ID NO: 190335 - DNA, 25 bp, Artificial sequence
  SiRNA target sequence
caattaagtggtggtgaacttcaaa

SEQ ID NO: 190336 - DNA, 25 bp, Artificial sequence
  SiRNA target sequence
aattaagtggtggtgaacttcaaag

SEQ ID NO: 190337 - DNA, 25 bp, Artificial sequence
  SiRNA target sequence
attaagtggtggtgaacttcaaaga

SEQ ID NO: 190338 - DNA, 25 bp, Artificial sequence
  SiRNA target sequence
ttaagtggtggtgaacttcaaagat

SEQ ID NO: 190339 - DNA, 25 bp, Artificial sequence
  SiRNA target sequence
taagtggtggtgaacttcaaagatt

SEQ ID NO: 190340 - DNA, 25 bp, Artificial sequence
  SiRNA target sequence
aagtggtggtgaacttcaaagattt

SEQ ID NO: 190341 - DNA, 25 bp, Artificial sequence
  SiRNA target sequence
agtggtggtgaacttcaaagatttt

SEQ ID NO: 190342 - DNA, 25 bp, Artificial sequence
  SiRNA target sequence
gtggtggtgaacttcaaagattttg

SEQ ID NO: 190343 - DNA, 25 bp, Artificial sequence
  SiRNA target sequence
tggtggtgaacttcaaagattttgt

SEQ ID NO: 190344 - DNA, 25 bp, Artificial sequence
  SiRNA target sequence
ggtggtgaacttcaaagattttgta

SEQ ID NO: 190345 - DNA, 25 bp, Artificial sequence
  SiRNA target sequence
gtggtgaacttcaaagattttgtat

SEQ ID NO: 190346 - DNA, 25 bp, Artificial sequence
  SiRNA target sequence
tggtgaacttcaaagattttgtatt

SEQ ID NO: 190347 - DNA, 25 bp, Artificial sequence
  SiRNA target sequence
ggtgaacttcaaagattttgtattg

SEQ ID NO: 190348 - DNA, 25 bp, Artificial sequence
  SiRNA target sequence
gtgaacttcaaagattttgtattgc

SEQ ID NO: 190349 - DNA, 25 bp, Artificial sequence
  SiRNA target sequence
tgaacttcaaagattttgtattgca

SEQ ID NO: 190350 - DNA, 25 bp, Artificial sequence
  SiRNA target sequence
gaacttcaaagattttgtattgcat

SEQ ID NO: 190351 - DNA, 25 bp, Artificial sequence
  SiRNA target sequence
aacttcaaagattttgtattgcata

SEQ ID NO: 190352 - DNA, 25 bp, Artificial sequence
  SiRNA target sequence
acttcaaagattttgtattgcatac

SEQ ID NO: 190353 - DNA, 25 bp, Artificial sequence
  SiRNA target sequence
cttcaaagattttgtattgcataca

SEQ ID NO: 190354 - DNA, 25 bp, Artificial sequence
  SiRNA target sequence
ttcaaagattttgtattgcatacac

SEQ ID NO: 190355 - DNA, 25 bp, Artificial sequence
  SiRNA target sequence
tcaaagattttgtattgcatacaca

SEQ ID NO: 190356 - DNA, 25 bp, Artificial sequence
  SiRNA target sequence
caaagattttgtattgcatacacat

SEQ ID NO: 190357 - DNA, 25 bp, Artificial sequence
  SiRNA target sequence
aaagattttgtattgcatacacatg

SEQ ID NO: 190358 - DNA, 25 bp, Artificial sequence
  SiRNA target sequence
aagattttgtattgcatacacatgt

SEQ ID NO: 190359 - DNA, 25 bp, Artificial sequence
  SiRNA target sequence
agattttgtattgcatacacatgtt

SEQ ID NO: 190360 - DNA, 25 bp, Artificial sequence
  SiRNA target sequence
gattttgtattgcatacacatgttt

SEQ ID NO: 190361 - DNA, 25 bp, Artificial sequence
  SiRNA target sequence
attttgtattgcatacacatgttta

SEQ ID NO: 190362 - DNA, 25 bp, Artificial sequence
  SiRNA target sequence
ttttgtattgcatacacatgtttac

SEQ ID NO: 190363 - DNA, 25 bp, Artificial sequence
  SiRNA target sequence
tttgtattgcatacacatgtttaca

SEQ ID NO: 190364 - DNA, 25 bp, Artificial sequence
  SiRNA target sequence
ttgtattgcatacacatgtttacaa

SEQ ID NO: 190365 - DNA, 25 bp, Artificial sequence
  SiRNA target sequence
tgtattgcatacacatgtttacaag

SEQ ID NO: 190366 - DNA, 25 bp, Artificial sequence
  SiRNA target sequence
gtattgcatacacatgtttacaaga

SEQ ID NO: 190367 - DNA, 25 bp, Artificial sequence
  SiRNA target sequence
tattgcatacacatgtttacaagaa

SEQ ID NO: 190368 - DNA, 25 bp, Artificial sequence
  SiRNA target sequence
attgcatacacatgtttacaagaag

SEQ ID NO: 190369 - DNA, 25 bp, Artificial sequence
  SiRNA target sequence
ttgcatacacatgtttacaagaagg

SEQ ID NO: 190370 - DNA, 25 bp, Artificial sequence
  SiRNA target sequence
tgcatacacatgtttacaagaagga

SEQ ID NO: 190371 - DNA, 25 bp, Artificial sequence
  SiRNA target sequence
gcatacacatgtttacaagaaggaa

SEQ ID NO: 190372 - DNA, 25 bp, Artificial sequence
  SiRNA target sequence
catacacatgtttacaagaaggaaa

SEQ ID NO: 190373 - DNA, 25 bp, Artificial sequence
  SiRNA target sequence
atacacatgtttacaagaaggaaat

SEQ ID NO: 190374 - DNA, 25 bp, Artificial sequence
  SiRNA target sequence
tacacatgtttacaagaaggaaatg

SEQ ID NO: 190375 - DNA, 25 bp, Artificial sequence
  SiRNA target sequence
acacatgtttacaagaaggaaatgt

SEQ ID NO: 190376 - DNA, 25 bp, Artificial sequence
  SiRNA target sequence
cacatgtttacaagaaggaaatgtt

SEQ ID NO: 190377 - DNA, 25 bp, Artificial sequence
  SiRNA target sequence
acatgtttacaagaaggaaatgttt

SEQ ID NO: 190378 - DNA, 25 bp, Artificial sequence
  SiRNA target sequence
catgtttacaagaaggaaatgttta

SEQ ID NO: 190379 - DNA, 25 bp, Artificial sequence
  SiRNA target sequence
atgtttacaagaaggaaatgtttat

SEQ ID NO: 190380 - DNA, 25 bp, Artificial sequence
  SiRNA target sequence
tgtttacaagaaggaaatgtttata

SEQ ID NO: 190381 - DNA, 25 bp, Artificial sequence
  SiRNA target sequence
gtttacaagaaggaaatgtttatat

SEQ ID NO: 190382 - DNA, 25 bp, Artificial sequence
  SiRNA target sequence
tttacaagaaggaaatgtttatatt

SEQ ID NO: 190383 - DNA, 25 bp, Artificial sequence
  SiRNA target sequence
ttacaagaaggaaatgtttatattt

SEQ ID NO: 190384 - DNA, 25 bp, Artificial sequence
  SiRNA target sequence
tacaagaaggaaatgtttatatttt

SEQ ID NO: 190385 - DNA, 25 bp, Artificial sequence
  SiRNA target sequence
acaagaaggaaatgtttatattttt

SEQ ID NO: 190386 - DNA, 25 bp, Artificial sequence
  SiRNA target sequence
caagaaggaaatgtttatatttttg

SEQ ID NO: 190387 - DNA, 25 bp, Artificial sequence
  SiRNA target sequence
aagaaggaaatgtttatatttttga

SEQ ID NO: 190388 - DNA, 25 bp, Artificial sequence
  SiRNA target sequence
agaaggaaatgtttatatttttgat

SEQ ID NO: 190389 - DNA, 25 bp, Artificial sequence
  SiRNA target sequence
gaaggaaatgtttatatttttgatg

SEQ ID NO: 190390 - DNA, 25 bp, Artificial sequence
  SiRNA target sequence
aaggaaatgtttatatttttgatga

SEQ ID NO: 190391 - DNA, 25 bp, Artificial sequence
  SiRNA target sequence
aggaaatgtttatatttttgatgaa

SEQ ID NO: 190392 - DNA, 25 bp, Artificial sequence
  SiRNA target sequence
ggaaatgtttatatttttgatgaac

SEQ ID NO: 190393 - DNA, 25 bp, Artificial sequence
  SiRNA target sequence
gaaatgtttatatttttgatgaacc

SEQ ID NO: 190394 - DNA, 25 bp, Artificial sequence
  SiRNA target sequence
aaatgtttatatttttgatgaaccc

SEQ ID NO: 190395 - DNA, 25 bp, Artificial sequence
  SiRNA target sequence
aatgtttatatttttgatgaaccca

SEQ ID NO: 190396 - DNA, 25 bp, Artificial sequence
  SiRNA target sequence
atgtttatatttttgatgaacccac

SEQ ID NO: 190397 - DNA, 25 bp, Artificial sequence
  SiRNA target sequence
tgtttatatttttgatgaacccact

SEQ ID NO: 190398 - DNA, 25 bp, Artificial sequence
  SiRNA target sequence
gtttatatttttgatgaacccacta

SEQ ID NO: 190399 - DNA, 25 bp, Artificial sequence
  SiRNA target sequence
tttatatttttgatgaacccactag

SEQ ID NO: 190400 - DNA, 25 bp, Artificial sequence
  SiRNA target sequence
ttatatttttgatgaacccactagt

SEQ ID NO: 190401 - DNA, 25 bp, Artificial sequence
  SiRNA target sequence
tatatttttgatgaacccactagtt

SEQ ID NO: 190402 - DNA, 25 bp, Artificial sequence
  SiRNA target sequence
atatttttgatgaacccactagttt

SEQ ID NO: 190403 - DNA, 25 bp, Artificial sequence
  SiRNA target sequence
tatttttgatgaacccactagtttt

SEQ ID NO: 190404 - DNA, 25 bp, Artificial sequence
  SiRNA target sequence
atttttgatgaacccactagttttt

SEQ ID NO: 190405 - DNA, 25 bp, Artificial sequence
  SiRNA target sequence
tttttgatgaacccactagtttttt

SEQ ID NO: 190406 - DNA, 25 bp, Artificial sequence
  SiRNA target sequence
ttttgatgaacccactagttttttg

SEQ ID NO: 190407 - DNA, 25 bp, Artificial sequence
  SiRNA target sequence
tttgatgaacccactagttttttgg

SEQ ID NO: 190408 - DNA, 25 bp, Artificial sequence
  SiRNA target sequence
ttgatgaacccactagttttttgga

SEQ ID NO: 190409 - DNA, 25 bp, Artificial sequence
  SiRNA target sequence
tgatgaacccactagttttttggat

SEQ ID NO: 190410 - DNA, 25 bp, Artificial sequence
  SiRNA target sequence
gatgaacccactagttttttggatg

SEQ ID NO: 190411 - DNA, 25 bp, Artificial sequence
  SiRNA target sequence
atgaacccactagttttttggatgt

SEQ ID NO: 190412 - DNA, 25 bp, Artificial sequence
  SiRNA target sequence
tgaacccactagttttttggatgtt

SEQ ID NO: 190413 - DNA, 25 bp, Artificial sequence
  SiRNA target sequence
gaacccactagttttttggatgtta

SEQ ID NO: 190414 - DNA, 25 bp, Artificial sequence
  SiRNA target sequence
aacccactagttttttggatgttaa

SEQ ID NO: 190415 - DNA, 25 bp, Artificial sequence
  SiRNA target sequence
acccactagttttttggatgttaag

SEQ ID NO: 190416 - DNA, 25 bp, Artificial sequence
  SiRNA target sequence
cccactagttttttggatgttaagc

SEQ ID NO: 190417 - DNA, 25 bp, Artificial sequence
  SiRNA target sequence
ccactagttttttggatgttaagca

SEQ ID NO: 190418 - DNA, 25 bp, Artificial sequence
  SiRNA target sequence
cactagttttttggatgttaagcag

SEQ ID NO: 190419 - DNA, 25 bp, Artificial sequence
  SiRNA target sequence
actagttttttggatgttaagcagc

SEQ ID NO: 190420 - DNA, 25 bp, Artificial sequence
  SiRNA target sequence
ctagttttttggatgttaagcagcg

SEQ ID NO: 190421 - DNA, 25 bp, Artificial sequence
  SiRNA target sequence
tagttttttggatgttaagcagcga

SEQ ID NO: 190422 - DNA, 25 bp, Artificial sequence
  SiRNA target sequence
agttttttggatgttaagcagcgac

SEQ ID NO: 190423 - DNA, 25 bp, Artificial sequence
  SiRNA target sequence
gttttttggatgttaagcagcgact

SEQ ID NO: 190424 - DNA, 25 bp, Artificial sequence
  SiRNA target sequence
ttttttggatgttaagcagcgacta

SEQ ID NO: 190425 - DNA, 25 bp, Artificial sequence
  SiRNA target sequence
tttttggatgttaagcagcgactag

SEQ ID NO: 190426 - DNA, 25 bp, Artificial sequence
  SiRNA target sequence
ttttggatgttaagcagcgactagc

SEQ ID NO: 190427 - DNA, 25 bp, Artificial sequence
  SiRNA target sequence
tttggatgttaagcagcgactagca

SEQ ID NO: 190428 - DNA, 25 bp, Artificial sequence
  SiRNA target sequence
ttggatgttaagcagcgactagcag

SEQ ID NO: 190429 - DNA, 25 bp, Artificial sequence
  SiRNA target sequence
tggatgttaagcagcgactagcagc

SEQ ID NO: 190430 - DNA, 25 bp, Artificial sequence
  SiRNA target sequence
ggatgttaagcagcgactagcagct

SEQ ID NO: 190431 - DNA, 25 bp, Artificial sequence
  SiRNA target sequence
gatgttaagcagcgactagcagctg

SEQ ID NO: 190432 - DNA, 25 bp, Artificial sequence
  SiRNA target sequence
atgttaagcagcgactagcagctgc

SEQ ID NO: 190433 - DNA, 25 bp, Artificial sequence
  SiRNA target sequence
tgttaagcagcgactagcagctgct

SEQ ID NO: 190434 - DNA, 25 bp, Artificial sequence
  SiRNA target sequence
gttaagcagcgactagcagctgcta

SEQ ID NO: 190435 - DNA, 25 bp, Artificial sequence
  SiRNA target sequence
ttaagcagcgactagcagctgctaa

SEQ ID NO: 190436 - DNA, 25 bp, Artificial sequence
  SiRNA target sequence
taagcagcgactagcagctgctaag

SEQ ID NO: 190437 - DNA, 25 bp, Artificial sequence
  SiRNA target sequence
aagcagcgactagcagctgctaagg

SEQ ID NO: 190438 - DNA, 25 bp, Artificial sequence
  SiRNA target sequence
agcagcgactagcagctgctaagga

SEQ ID NO: 190439 - DNA, 25 bp, Artificial sequence
  SiRNA target sequence
gcagcgactagcagctgctaaggaa

SEQ ID NO: 190440 - DNA, 25 bp, Artificial sequence
  SiRNA target sequence
cagcgactagcagctgctaaggaaa

SEQ ID NO: 190441 - DNA, 25 bp, Artificial sequence
  SiRNA target sequence
agcgactagcagctgctaaggaaat

SEQ ID NO: 190442 - DNA, 25 bp, Artificial sequence
  SiRNA target sequence
gcgactagcagctgctaaggaaata

SEQ ID NO: 190443 - DNA, 25 bp, Artificial sequence
  SiRNA target sequence
cgactagcagctgctaaggaaataa

SEQ ID NO: 190444 - DNA, 25 bp, Artificial sequence
  SiRNA target sequence
gactagcagctgctaaggaaataag

SEQ ID NO: 190445 - DNA, 25 bp, Artificial sequence
  SiRNA target sequence
actagcagctgctaaggaaataaga

SEQ ID NO: 190446 - DNA, 25 bp, Artificial sequence
  SiRNA target sequence
ctagcagctgctaaggaaataagaa

SEQ ID NO: 190447 - DNA, 25 bp, Artificial sequence
  SiRNA target sequence
tagcagctgctaaggaaataagaaa

SEQ ID NO: 190448 - DNA, 25 bp, Artificial sequence
  SiRNA target sequence
agcagctgctaaggaaataagaaat

SEQ ID NO: 190449 - DNA, 25 bp, Artificial sequence
  SiRNA target sequence
gcagctgctaaggaaataagaaatt

SEQ ID NO: 190450 - DNA, 25 bp, Artificial sequence
  SiRNA target sequence
cagctgctaaggaaataagaaattt

SEQ ID NO: 190451 - DNA, 25 bp, Artificial sequence
  SiRNA target sequence
agctgctaaggaaataagaaatttg

SEQ ID NO: 190452 - DNA, 25 bp, Artificial sequence
  SiRNA target sequence
gctgctaaggaaataagaaatttgt

SEQ ID NO: 190453 - DNA, 25 bp, Artificial sequence
  SiRNA target sequence
ctgctaaggaaataagaaatttgtg

SEQ ID NO: 190454 - DNA, 25 bp, Artificial sequence
  SiRNA target sequence
tgctaaggaaataagaaatttgtgt

SEQ ID NO: 190455 - DNA, 25 bp, Artificial sequence
  SiRNA target sequence
gctaaggaaataagaaatttgtgtg

SEQ ID NO: 190456 - DNA, 25 bp, Artificial sequence
  SiRNA target sequence
ctaaggaaataagaaatttgtgtga

SEQ ID NO: 190457 - DNA, 25 bp, Artificial sequence
  SiRNA target sequence
taaggaaataagaaatttgtgtgaa

SEQ ID NO: 190458 - DNA, 25 bp, Artificial sequence
  SiRNA target sequence
aaggaaataagaaatttgtgtgaag

SEQ ID NO: 190459 - DNA, 25 bp, Artificial sequence
  SiRNA target sequence
aggaaataagaaatttgtgtgaaga

SEQ ID NO: 190460 - DNA, 25 bp, Artificial sequence
  SiRNA target sequence
ggaaataagaaatttgtgtgaagaa

SEQ ID NO: 190461 - DNA, 25 bp, Artificial sequence
  SiRNA target sequence
gaaataagaaatttgtgtgaagaaa

SEQ ID NO: 190462 - DNA, 25 bp, Artificial sequence
  SiRNA target sequence
aaataagaaatttgtgtgaagaaaa

SEQ ID NO: 190463 - DNA, 25 bp, Artificial sequence
  SiRNA target sequence
aataagaaatttgtgtgaagaaaat

SEQ ID NO: 190464 - DNA, 25 bp, Artificial sequence
  SiRNA target sequence
ataagaaatttgtgtgaagaaaata

SEQ ID NO: 190465 - DNA, 25 bp, Artificial sequence
  SiRNA target sequence
taagaaatttgtgtgaagaaaataa

SEQ ID NO: 190466 - DNA, 25 bp, Artificial sequence
  SiRNA target sequence
aagaaatttgtgtgaagaaaataaa

SEQ ID NO: 190467 - DNA, 25 bp, Artificial sequence
  SiRNA target sequence
agaaatttgtgtgaagaaaataaat

SEQ ID NO: 190468 - DNA, 25 bp, Artificial sequence
  SiRNA target sequence
gaaatttgtgtgaagaaaataaata

SEQ ID NO: 190469 - DNA, 25 bp, Artificial sequence
  SiRNA target sequence
aaatttgtgtgaagaaaataaatat

SEQ ID NO: 190470 - DNA, 25 bp, Artificial sequence
  SiRNA target sequence
aatttgtgtgaagaaaataaatatg

SEQ ID NO: 190471 - DNA, 25 bp, Artificial sequence
  SiRNA target sequence
atttgtgtgaagaaaataaatatgt

SEQ ID NO: 190472 - DNA, 25 bp, Artificial sequence
  SiRNA target sequence
tttgtgtgaagaaaataaatatgtt

SEQ ID NO: 190473 - DNA, 25 bp, Artificial sequence
  SiRNA target sequence
ttgtgtgaagaaaataaatatgttg

SEQ ID NO: 190474 - DNA, 25 bp, Artificial sequence
  SiRNA target sequence
tgtgtgaagaaaataaatatgttgt

SEQ ID NO: 190475 - DNA, 25 bp, Artificial sequence
  SiRNA target sequence
gtgtgaagaaaataaatatgttgta

SEQ ID NO: 190476 - DNA, 25 bp, Artificial sequence
  SiRNA target sequence
tgtgaagaaaataaatatgttgtag

SEQ ID NO: 190477 - DNA, 25 bp, Artificial sequence
  SiRNA target sequence
gtgaagaaaataaatatgttgtagt

SEQ ID NO: 190478 - DNA, 25 bp, Artificial sequence
  SiRNA target sequence
tgaagaaaataaatatgttgtagtt

SEQ ID NO: 190479 - DNA, 25 bp, Artificial sequence
  SiRNA target sequence
gaagaaaataaatatgttgtagttg

SEQ ID NO: 190480 - DNA, 25 bp, Artificial sequence
  SiRNA target sequence
aagaaaataaatatgttgtagttgt

SEQ ID NO: 190481 - DNA, 25 bp, Artificial sequence
  SiRNA target sequence
agaaaataaatatgttgtagttgtc

SEQ ID NO: 190482 - DNA, 25 bp, Artificial sequence
  SiRNA target sequence
gaaaataaatatgttgtagttgtcg

SEQ ID NO: 190483 - DNA, 25 bp, Artificial sequence
  SiRNA target sequence
aaaataaatatgttgtagttgtcga

SEQ ID NO: 190484 - DNA, 25 bp, Artificial sequence
  SiRNA target sequence
aaataaatatgttgtagttgtcgaa

SEQ ID NO: 190485 - DNA, 25 bp, Artificial sequence
  SiRNA target sequence
aataaatatgttgtagttgtcgaac

SEQ ID NO: 190486 - DNA, 25 bp, Artificial sequence
  SiRNA target sequence
ataaatatgttgtagttgtcgaaca

SEQ ID NO: 190487 - DNA, 25 bp, Artificial sequence
  SiRNA target sequence
taaatatgttgtagttgtcgaacac

SEQ ID NO: 190488 - DNA, 25 bp, Artificial sequence
  SiRNA target sequence
aaatatgttgtagttgtcgaacacg

SEQ ID NO: 190489 - DNA, 25 bp, Artificial sequence
  SiRNA target sequence
aatatgttgtagttgtcgaacacga

SEQ ID NO: 190490 - DNA, 25 bp, Artificial sequence
  SiRNA target sequence
atatgttgtagttgtcgaacacgat

SEQ ID NO: 190491 - DNA, 25 bp, Artificial sequence
  SiRNA target sequence
tatgttgtagttgtcgaacacgatt

SEQ ID NO: 190492 - DNA, 25 bp, Artificial sequence
  SiRNA target sequence
atgttgtagttgtcgaacacgattt

SEQ ID NO: 190493 - DNA, 25 bp, Artificial sequence
  SiRNA target sequence
tgttgtagttgtcgaacacgattta

SEQ ID NO: 190494 - DNA, 25 bp, Artificial sequence
  SiRNA target sequence
gttgtagttgtcgaacacgatttag

SEQ ID NO: 190495 - DNA, 25 bp, Artificial sequence
  SiRNA target sequence
ttgtagttgtcgaacacgatttagc

SEQ ID NO: 190496 - DNA, 25 bp, Artificial sequence
  SiRNA target sequence
tgtagttgtcgaacacgatttagcc

SEQ ID NO: 190497 - DNA, 25 bp, Artificial sequence
  SiRNA target sequence
gtagttgtcgaacacgatttagcca

SEQ ID NO: 190498 - DNA, 25 bp, Artificial sequence
  SiRNA target sequence
tagttgtcgaacacgatttagccat

SEQ ID NO: 190499 - DNA, 25 bp, Artificial sequence
  SiRNA target sequence
agttgtcgaacacgatttagccatt

SEQ ID NO: 190500 - DNA, 25 bp, Artificial sequence
  SiRNA target sequence
gttgtcgaacacgatttagccattt

SEQ ID NO: 190501 - DNA, 25 bp, Artificial sequence
  SiRNA target sequence
ttgtcgaacacgatttagccatttt

SEQ ID NO: 190502 - DNA, 25 bp, Artificial sequence
  SiRNA target sequence
tgtcgaacacgatttagccatttta

SEQ ID NO: 190503 - DNA, 25 bp, Artificial sequence
  SiRNA target sequence
gtcgaacacgatttagccattttag

SEQ ID NO: 190504 - DNA, 25 bp, Artificial sequence
  SiRNA target sequence
tcgaacacgatttagccattttaga

SEQ ID NO: 190505 - DNA, 25 bp, Artificial sequence
  SiRNA target sequence
cgaacacgatttagccattttagat

SEQ ID NO: 190506 - DNA, 25 bp, Artificial sequence
  SiRNA target sequence
gaacacgatttagccattttagatt

SEQ ID NO: 190507 - DNA, 25 bp, Artificial sequence
  SiRNA target sequence
aacacgatttagccattttagattt

SEQ ID NO: 190508 - DNA, 25 bp, Artificial sequence
  SiRNA target sequence
acacgatttagccattttagatttg

SEQ ID NO: 190509 - DNA, 25 bp, Artificial sequence
  SiRNA target sequence
cacgatttagccattttagatttga

SEQ ID NO: 190510 - DNA, 25 bp, Artificial sequence
  SiRNA target sequence
acgatttagccattttagatttgat

SEQ ID NO: 190511 - DNA, 25 bp, Artificial sequence
  SiRNA target sequence
cgatttagccattttagatttgatg

SEQ ID NO: 190512 - DNA, 25 bp, Artificial sequence
  SiRNA target sequence
gatttagccattttagatttgatgt

SEQ ID NO: 190513 - DNA, 25 bp, Artificial sequence
  SiRNA target sequence
atttagccattttagatttgatgtg

SEQ ID NO: 190514 - DNA, 25 bp, Artificial sequence
  SiRNA target sequence
tttagccattttagatttgatgtgt

SEQ ID NO: 190515 - DNA, 25 bp, Artificial sequence
  SiRNA target sequence
ttagccattttagatttgatgtgtg

SEQ ID NO: 190516 - DNA, 25 bp, Artificial sequence
  SiRNA target sequence
tagccattttagatttgatgtgtga

SEQ ID NO: 190517 - DNA, 25 bp, Artificial sequence
  SiRNA target sequence
agccattttagatttgatgtgtgat

SEQ ID NO: 190518 - DNA, 25 bp, Artificial sequence
  SiRNA target sequence
gccattttagatttgatgtgtgatt

SEQ ID NO: 190519 - DNA, 25 bp, Artificial sequence
  SiRNA target sequence
ccattttagatttgatgtgtgattt

SEQ ID NO: 190520 - DNA, 25 bp, Artificial sequence
  SiRNA target sequence
cattttagatttgatgtgtgatttt

SEQ ID NO: 190521 - DNA, 25 bp, Artificial sequence
  SiRNA target sequence
attttagatttgatgtgtgattttg

SEQ ID NO: 190522 - DNA, 25 bp, Artificial sequence
  SiRNA target sequence
ttttagatttgatgtgtgattttgg

SEQ ID NO: 190523 - DNA, 25 bp, Artificial sequence
  SiRNA target sequence
tttagatttgatgtgtgattttgga

SEQ ID NO: 190524 - DNA, 25 bp, Artificial sequence
  SiRNA target sequence
ttagatttgatgtgtgattttggat

SEQ ID NO: 190525 - DNA, 25 bp, Artificial sequence
  SiRNA target sequence
tagatttgatgtgtgattttggatg

SEQ ID NO: 190526 - DNA, 25 bp, Artificial sequence
  SiRNA target sequence
agatttgatgtgtgattttggatgt

SEQ ID NO: 190527 - DNA, 25 bp, Artificial sequence
  SiRNA target sequence
gatttgatgtgtgattttggatgtg

SEQ ID NO: 190528 - DNA, 25 bp, Artificial sequence
  SiRNA target sequence
atttgatgtgtgattttggatgtgt

SEQ ID NO: 190529 - DNA, 25 bp, Artificial sequence
  SiRNA target sequence
tttgatgtgtgattttggatgtgtt

SEQ ID NO: 190530 - DNA, 25 bp, Artificial sequence
  SiRNA target sequence
ttgatgtgtgattttggatgtgttc

SEQ ID NO: 190531 - DNA, 25 bp, Artificial sequence
  SiRNA target sequence
tgatgtgtgattttggatgtgttct

SEQ ID NO: 190532 - DNA, 25 bp, Artificial sequence
  SiRNA target sequence
gatgtgtgattttggatgtgttcta

SEQ ID NO: 190533 - DNA, 25 bp, Artificial sequence
  SiRNA target sequence
atgtgtgattttggatgtgttctat

SEQ ID NO: 190534 - DNA, 25 bp, Artificial sequence
  SiRNA target sequence
tgtgtgattttggatgtgttctata

SEQ ID NO: 190535 - DNA, 25 bp, Artificial sequence
  SiRNA target sequence
gtgtgattttggatgtgttctatac

SEQ ID NO: 190536 - DNA, 25 bp, Artificial sequence
  SiRNA target sequence
tgtgattttggatgtgttctatacg

SEQ ID NO: 190537 - DNA, 25 bp, Artificial sequence
  SiRNA target sequence
gtgattttggatgtgttctatacgg

SEQ ID NO: 190538 - DNA, 25 bp, Artificial sequence
  SiRNA target sequence
tgattttggatgtgttctatacgga

SEQ ID NO: 190539 - DNA, 25 bp, Artificial sequence
  SiRNA target sequence
gattttggatgtgttctatacggac

SEQ ID NO: 190540 - DNA, 25 bp, Artificial sequence
  SiRNA target sequence
attttggatgtgttctatacggaca

SEQ ID NO: 190541 - DNA, 25 bp, Artificial sequence
  SiRNA target sequence
ttttggatgtgttctatacggacaa

SEQ ID NO: 190542 - DNA, 25 bp, Artificial sequence
  SiRNA target sequence
tttggatgtgttctatacggacaat

SEQ ID NO: 190543 - DNA, 25 bp, Artificial sequence
  SiRNA target sequence
ttggatgtgttctatacggacaatc

SEQ ID NO: 190544 - DNA, 25 bp, Artificial sequence
  SiRNA target sequence
tggatgtgttctatacggacaatct

SEQ ID NO: 190545 - DNA, 25 bp, Artificial sequence
  SiRNA target sequence
ggatgtgttctatacggacaatctg

SEQ ID NO: 190546 - DNA, 25 bp, Artificial sequence
  SiRNA target sequence
gatgtgttctatacggacaatctgg

SEQ ID NO: 190547 - DNA, 25 bp, Artificial sequence
  SiRNA target sequence
atgtgttctatacggacaatctggg

SEQ ID NO: 190548 - DNA, 25 bp, Artificial sequence
  SiRNA target sequence
tgtgttctatacggacaatctgggg

SEQ ID NO: 190549 - DNA, 25 bp, Artificial sequence
  SiRNA target sequence
gtgttctatacggacaatctggggc

SEQ ID NO: 190550 - DNA, 25 bp, Artificial sequence
  SiRNA target sequence
tgttctatacggacaatctggggca

SEQ ID NO: 190551 - DNA, 25 bp, Artificial sequence
  SiRNA target sequence
gttctatacggacaatctggggcat

SEQ ID NO: 190552 - DNA, 25 bp, Artificial sequence
  SiRNA target sequence
ttctatacggacaatctggggcata

SEQ ID NO: 190553 - DNA, 25 bp, Artificial sequence
  SiRNA target sequence
tctatacggacaatctggggcatac

SEQ ID NO: 190554 - DNA, 25 bp, Artificial sequence
  SiRNA target sequence
ctatacggacaatctggggcatacg

SEQ ID NO: 190555 - DNA, 25 bp, Artificial sequence
  SiRNA target sequence
tatacggacaatctggggcatacgg

SEQ ID NO: 190556 - DNA, 25 bp, Artificial sequence
  SiRNA target sequence
atacggacaatctggggcatacggt

SEQ ID NO: 190557 - DNA, 25 bp, Artificial sequence
  SiRNA target sequence
tacggacaatctggggcatacggtg

SEQ ID NO: 190558 - DNA, 25 bp, Artificial sequence
  SiRNA target sequence
acggacaatctggggcatacggtgt

SEQ ID NO: 190559 - DNA, 25 bp, Artificial sequence
  SiRNA target sequence
cggacaatctggggcatacggtgta

SEQ ID NO: 190560 - DNA, 25 bp, Artificial sequence
  SiRNA target sequence
ggacaatctggggcatacggtgtaa

SEQ ID NO: 190561 - DNA, 25 bp, Artificial sequence
  SiRNA target sequence
gacaatctggggcatacggtgtaat

SEQ ID NO: 190562 - DNA, 25 bp, Artificial sequence
  SiRNA target sequence
acaatctggggcatacggtgtaata

SEQ ID NO: 190563 - DNA, 25 bp, Artificial sequence
  SiRNA target sequence
caatctggggcatacggtgtaataa

SEQ ID NO: 190564 - DNA, 25 bp, Artificial sequence
  SiRNA target sequence
aatctggggcatacggtgtaataag

SEQ ID NO: 190565 - DNA, 25 bp, Artificial sequence
  SiRNA target sequence
atctggggcatacggtgtaataagc

SEQ ID NO: 190566 - DNA, 25 bp, Artificial sequence
  SiRNA target sequence
tctggggcatacggtgtaataagcg

SEQ ID NO: 190567 - DNA, 25 bp, Artificial sequence
  SiRNA target sequence
ctggggcatacggtgtaataagcgc

SEQ ID NO: 190568 - DNA, 25 bp, Artificial sequence
  SiRNA target sequence
tggggcatacggtgtaataagcgca

SEQ ID NO: 190569 - DNA, 25 bp, Artificial sequence
  SiRNA target sequence
ggggcatacggtgtaataagcgcac

SEQ ID NO: 190570 - DNA, 25 bp, Artificial sequence
  SiRNA target sequence
gggcatacggtgtaataagcgcacc

SEQ ID NO: 190571 - DNA, 25 bp, Artificial sequence
  SiRNA target sequence
ggcatacggtgtaataagcgcacca

SEQ ID NO: 190572 - DNA, 25 bp, Artificial sequence
  SiRNA target sequence
gcatacggtgtaataagcgcaccat

SEQ ID NO: 190573 - DNA, 25 bp, Artificial sequence
  SiRNA target sequence
catacggtgtaataagcgcaccata

SEQ ID NO: 190574 - DNA, 25 bp, Artificial sequence
  SiRNA target sequence
atacggtgtaataagcgcaccatac

SEQ ID NO: 190575 - DNA, 25 bp, Artificial sequence
  SiRNA target sequence
tacggtgtaataagcgcaccatacg

SEQ ID NO: 190576 - DNA, 25 bp, Artificial sequence
  SiRNA target sequence
acggtgtaataagcgcaccatacgt

SEQ ID NO: 190577 - DNA, 25 bp, Artificial sequence
  SiRNA target sequence
cggtgtaataagcgcaccatacgtt

SEQ ID NO: 190578 - DNA, 25 bp, Artificial sequence
  SiRNA target sequence
ggtgtaataagcgcaccatacgtta

SEQ ID NO: 190579 - DNA, 25 bp, Artificial sequence
  SiRNA target sequence
gtgtaataagcgcaccatacgttat

SEQ ID NO: 190580 - DNA, 25 bp, Artificial sequence
  SiRNA target sequence
tgtaataagcgcaccatacgttatt

SEQ ID NO: 190581 - DNA, 25 bp, Artificial sequence
  SiRNA target sequence
gtaataagcgcaccatacgttatta

SEQ ID NO: 190582 - DNA, 25 bp, Artificial sequence
  SiRNA target sequence
taataagcgcaccatacgttattaa

SEQ ID NO: 190583 - DNA, 25 bp, Artificial sequence
  SiRNA target sequence
aataagcgcaccatacgttattaaa

SEQ ID NO: 190584 - DNA, 25 bp, Artificial sequence
  SiRNA target sequence
ataagcgcaccatacgttattaaat

SEQ ID NO: 190585 - DNA, 25 bp, Artificial sequence
  SiRNA target sequence
taagcgcaccatacgttattaaatc

SEQ ID NO: 190586 - DNA, 25 bp, Artificial sequence
  SiRNA target sequence
aagcgcaccatacgttattaaatca

SEQ ID NO: 190587 - DNA, 25 bp, Artificial sequence
  SiRNA target sequence
agcgcaccatacgttattaaatcag

SEQ ID NO: 190588 - DNA, 25 bp, Artificial sequence
  SiRNA target sequence
gcgcaccatacgttattaaatcagc

SEQ ID NO: 190589 - DNA, 25 bp, Artificial sequence
  SiRNA target sequence
cgcaccatacgttattaaatcagca

SEQ ID NO: 190590 - DNA, 25 bp, Artificial sequence
  SiRNA target sequence
gcaccatacgttattaaatcagcaa

SEQ ID NO: 190591 - DNA, 25 bp, Artificial sequence
  SiRNA target sequence
caccatacgttattaaatcagcaat

SEQ ID NO: 190592 - DNA, 25 bp, Artificial sequence
  SiRNA target sequence
accatacgttattaaatcagcaata

SEQ ID NO: 190593 - DNA, 25 bp, Artificial sequence
  SiRNA target sequence
ccatacgttattaaatcagcaataa

SEQ ID NO: 190594 - DNA, 25 bp, Artificial sequence
  SiRNA target sequence
catacgttattaaatcagcaataaa

SEQ ID NO: 190595 - DNA, 25 bp, Artificial sequence
  SiRNA target sequence
atacgttattaaatcagcaataaat

SEQ ID NO: 190596 - DNA, 25 bp, Artificial sequence
  SiRNA target sequence
tacgttattaaatcagcaataaata

SEQ ID NO: 190597 - DNA, 25 bp, Artificial sequence
  SiRNA target sequence
acgttattaaatcagcaataaatat

SEQ ID NO: 190598 - DNA, 25 bp, Artificial sequence
  SiRNA target sequence
cgttattaaatcagcaataaatata

SEQ ID NO: 190599 - DNA, 25 bp, Artificial sequence
  SiRNA target sequence
gttattaaatcagcaataaatatat

SEQ ID NO: 190600 - DNA, 25 bp, Artificial sequence
  SiRNA target sequence
ttattaaatcagcaataaatatatt

SEQ ID NO: 190601 - DNA, 25 bp, Artificial sequence
  SiRNA target sequence
tattaaatcagcaataaatatattt

SEQ ID NO: 190602 - DNA, 25 bp, Artificial sequence
  SiRNA target sequence
attaaatcagcaataaatatatttc

SEQ ID NO: 190603 - DNA, 25 bp, Artificial sequence
  SiRNA target sequence
ttaaatcagcaataaatatatttct

SEQ ID NO: 190604 - DNA, 25 bp, Artificial sequence
  SiRNA target sequence
taaatcagcaataaatatatttctt

SEQ ID NO: 190605 - DNA, 25 bp, Artificial sequence
  SiRNA target sequence
aaatcagcaataaatatatttcttg

SEQ ID NO: 190606 - DNA, 25 bp, Artificial sequence
  SiRNA target sequence
aatcagcaataaatatatttcttga

SEQ ID NO: 190607 - DNA, 25 bp, Artificial sequence
  SiRNA target sequence
atcagcaataaatatatttcttgat

SEQ ID NO: 190608 - DNA, 25 bp, Artificial sequence
  SiRNA target sequence
tcagcaataaatatatttcttgatg

SEQ ID NO: 190609 - DNA, 25 bp, Artificial sequence
  SiRNA target sequence
cagcaataaatatatttcttgatgg

SEQ ID NO: 190610 - DNA, 25 bp, Artificial sequence
  SiRNA target sequence
agcaataaatatatttcttgatgga

SEQ ID NO: 190611 - DNA, 25 bp, Artificial sequence
  SiRNA target sequence
gcaataaatatatttcttgatggat

SEQ ID NO: 190612 - DNA, 25 bp, Artificial sequence
  SiRNA target sequence
caataaatatatttcttgatggatt

SEQ ID NO: 190613 - DNA, 25 bp, Artificial sequence
  SiRNA target sequence
aataaatatatttcttgatggattt

SEQ ID NO: 190614 - DNA, 25 bp, Artificial sequence
  SiRNA target sequence
ataaatatatttcttgatggatttt

SEQ ID NO: 190615 - DNA, 25 bp, Artificial sequence
  SiRNA target sequence
taaatatatttcttgatggattttt

SEQ ID NO: 190616 - DNA, 25 bp, Artificial sequence
  SiRNA target sequence
aaatatatttcttgatggatttttg

SEQ ID NO: 190617 - DNA, 25 bp, Artificial sequence
  SiRNA target sequence
aatatatttcttgatggatttttgc

SEQ ID NO: 190618 - DNA, 25 bp, Artificial sequence
  SiRNA target sequence
atatatttcttgatggatttttgcc

SEQ ID NO: 190619 - DNA, 25 bp, Artificial sequence
  SiRNA target sequence
tatatttcttgatggatttttgcct

SEQ ID NO: 190620 - DNA, 25 bp, Artificial sequence
  SiRNA target sequence
atatttcttgatggatttttgccta

SEQ ID NO: 190621 - DNA, 25 bp, Artificial sequence
  SiRNA target sequence
tatttcttgatggatttttgcctac

SEQ ID NO: 190622 - DNA, 25 bp, Artificial sequence
  SiRNA target sequence
atttcttgatggatttttgcctaca

SEQ ID NO: 190623 - DNA, 25 bp, Artificial sequence
  SiRNA target sequence
tttcttgatggatttttgcctacag

SEQ ID NO: 190624 - DNA, 25 bp, Artificial sequence
  SiRNA target sequence
ttcttgatggatttttgcctacaga

SEQ ID NO: 190625 - DNA, 25 bp, Artificial sequence
  SiRNA target sequence
tcttgatggatttttgcctacagaa

SEQ ID NO: 190626 - DNA, 25 bp, Artificial sequence
  SiRNA target sequence
cttgatggatttttgcctacagaaa

SEQ ID NO: 190627 - DNA, 25 bp, Artificial sequence
  SiRNA target sequence
ttgatggatttttgcctacagaaaa

SEQ ID NO: 190628 - DNA, 25 bp, Artificial sequence
  SiRNA target sequence
tgatggatttttgcctacagaaaac

SEQ ID NO: 190629 - DNA, 25 bp, Artificial sequence
  SiRNA target sequence
gatggatttttgcctacagaaaaca

SEQ ID NO: 190630 - DNA, 25 bp, Artificial sequence
  SiRNA target sequence
atggatttttgcctacagaaaacat

SEQ ID NO: 190631 - DNA, 25 bp, Artificial sequence
  SiRNA target sequence
tggatttttgcctacagaaaacatg

SEQ ID NO: 190632 - DNA, 25 bp, Artificial sequence
  SiRNA target sequence
ggatttttgcctacagaaaacatga

SEQ ID NO: 190633 - DNA, 25 bp, Artificial sequence
  SiRNA target sequence
gatttttgcctacagaaaacatgaa

SEQ ID NO: 190634 - DNA, 25 bp, Artificial sequence
  SiRNA target sequence
atttttgcctacagaaaacatgaaa

SEQ ID NO: 190635 - DNA, 25 bp, Artificial sequence
  SiRNA target sequence
tttttgcctacagaaaacatgaaat

SEQ ID NO: 190636 - DNA, 25 bp, Artificial sequence
  SiRNA target sequence
ttttgcctacagaaaacatgaaatt

SEQ ID NO: 190637 - DNA, 25 bp, Artificial sequence
  SiRNA target sequence
tttgcctacagaaaacatgaaattt

SEQ ID NO: 190638 - DNA, 25 bp, Artificial sequence
  SiRNA target sequence
ttgcctacagaaaacatgaaattta

SEQ ID NO: 190639 - DNA, 25 bp, Artificial sequence
  SiRNA target sequence
tgcctacagaaaacatgaaatttag

SEQ ID NO: 190640 - DNA, 25 bp, Artificial sequence
  SiRNA target sequence
gcctacagaaaacatgaaatttaga

SEQ ID NO: 190641 - DNA, 25 bp, Artificial sequence
  SiRNA target sequence
cctacagaaaacatgaaatttagaa

SEQ ID NO: 190642 - DNA, 25 bp, Artificial sequence
  SiRNA target sequence
ctacagaaaacatgaaatttagaaa

SEQ ID NO: 190643 - DNA, 25 bp, Artificial sequence
  SiRNA target sequence
tacagaaaacatgaaatttagaaat

SEQ ID NO: 190644 - DNA, 25 bp, Artificial sequence
  SiRNA target sequence
acagaaaacatgaaatttagaaatt

SEQ ID NO: 190645 - DNA, 25 bp, Artificial sequence
  SiRNA target sequence
cagaaaacatgaaatttagaaattc

SEQ ID NO: 190646 - DNA, 25 bp, Artificial sequence
  SiRNA target sequence
agaaaacatgaaatttagaaattca

SEQ ID NO: 190647 - DNA, 25 bp, Artificial sequence
  SiRNA target sequence
gaaaacatgaaatttagaaattcag

SEQ ID NO: 190648 - DNA, 25 bp, Artificial sequence
  SiRNA target sequence
aaaacatgaaatttagaaattcaga

SEQ ID NO: 190649 - DNA, 25 bp, Artificial sequence
  SiRNA target sequence
aaacatgaaatttagaaattcagag

SEQ ID NO: 190650 - DNA, 25 bp, Artificial sequence
  SiRNA target sequence
aacatgaaatttagaaattcagagt

SEQ ID NO: 190651 - DNA, 25 bp, Artificial sequence
  SiRNA target sequence
acatgaaatttagaaattcagagtt

SEQ ID NO: 190652 - DNA, 25 bp, Artificial sequence
  SiRNA target sequence
catgaaatttagaaattcagagtta

SEQ ID NO: 190653 - DNA, 25 bp, Artificial sequence
  SiRNA target sequence
atgaaatttagaaattcagagttaa

SEQ ID NO: 190654 - DNA, 25 bp, Artificial sequence
  SiRNA target sequence
tgaaatttagaaattcagagttaaa

SEQ ID NO: 190655 - DNA, 25 bp, Artificial sequence
  SiRNA target sequence
gaaatttagaaattcagagttaaag

SEQ ID NO: 190656 - DNA, 25 bp, Artificial sequence
  SiRNA target sequence
aaatttagaaattcagagttaaagt

SEQ ID NO: 190657 - DNA, 25 bp, Artificial sequence
  SiRNA target sequence
aatttagaaattcagagttaaagtt

SEQ ID NO: 190658 - DNA, 25 bp, Artificial sequence
  SiRNA target sequence
atttagaaattcagagttaaagttt

SEQ ID NO: 190659 - DNA, 25 bp, Artificial sequence
  SiRNA target sequence
tttagaaattcagagttaaagttta

SEQ ID NO: 190660 - DNA, 25 bp, Artificial sequence
  SiRNA target sequence
ttagaaattcagagttaaagtttaa

SEQ ID NO: 190661 - DNA, 25 bp, Artificial sequence
  SiRNA target sequence
tagaaattcagagttaaagtttaat

SEQ ID NO: 190662 - DNA, 25 bp, Artificial sequence
  SiRNA target sequence
agaaattcagagttaaagtttaata

SEQ ID NO: 190663 - DNA, 25 bp, Artificial sequence
  SiRNA target sequence
gaaattcagagttaaagtttaatat

SEQ ID NO: 190664 - DNA, 25 bp, Artificial sequence
  SiRNA target sequence
aaattcagagttaaagtttaatatt

SEQ ID NO: 190665 - DNA, 25 bp, Artificial sequence
  SiRNA target sequence
aattcagagttaaagtttaatattt

SEQ ID NO: 190666 - DNA, 25 bp, Artificial sequence
  SiRNA target sequence
attcagagttaaagtttaatatttc

SEQ ID NO: 190667 - DNA, 25 bp, Artificial sequence
  SiRNA target sequence
ttcagagttaaagtttaatatttcg

SEQ ID NO: 190668 - DNA, 25 bp, Artificial sequence
  SiRNA target sequence
tcagagttaaagtttaatatttcgg

SEQ ID NO: 190669 - DNA, 25 bp, Artificial sequence
  SiRNA target sequence
cagagttaaagtttaatatttcgga

SEQ ID NO: 190670 - DNA, 25 bp, Artificial sequence
  SiRNA target sequence
agagttaaagtttaatatttcggaa

SEQ ID NO: 190671 - DNA, 25 bp, Artificial sequence
  SiRNA target sequence
gagttaaagtttaatatttcggaaa

SEQ ID NO: 190672 - DNA, 25 bp, Artificial sequence
  SiRNA target sequence
agttaaagtttaatatttcggaaac

SEQ ID NO: 190673 - DNA, 25 bp, Artificial sequence
  SiRNA target sequence
gttaaagtttaatatttcggaaaca

SEQ ID NO: 190674 - DNA, 25 bp, Artificial sequence
  SiRNA target sequence
ttaaagtttaatatttcggaaacac

SEQ ID NO: 190675 - DNA, 25 bp, Artificial sequence
  SiRNA target sequence
taaagtttaatatttcggaaacact

SEQ ID NO: 190676 - DNA, 25 bp, Artificial sequence
  SiRNA target sequence
aaagtttaatatttcggaaacactt

SEQ ID NO: 190677 - DNA, 25 bp, Artificial sequence
  SiRNA target sequence
aagtttaatatttcggaaacacttg

SEQ ID NO: 190678 - DNA, 25 bp, Artificial sequence
  SiRNA target sequence
agtttaatatttcggaaacacttga

SEQ ID NO: 190679 - DNA, 25 bp, Artificial sequence
  SiRNA target sequence
gtttaatatttcggaaacacttgat

SEQ ID NO: 190680 - DNA, 25 bp, Artificial sequence
  SiRNA target sequence
tttaatatttcggaaacacttgata

SEQ ID NO: 190681 - DNA, 25 bp, Artificial sequence
  SiRNA target sequence
ttaatatttcggaaacacttgatag

SEQ ID NO: 190682 - DNA, 25 bp, Artificial sequence
  SiRNA target sequence
taatatttcggaaacacttgatagt

SEQ ID NO: 190683 - DNA, 25 bp, Artificial sequence
  SiRNA target sequence
aatatttcggaaacacttgatagta

SEQ ID NO: 190684 - DNA, 25 bp, Artificial sequence
  SiRNA target sequence
atatttcggaaacacttgatagtat

SEQ ID NO: 190685 - DNA, 25 bp, Artificial sequence
  SiRNA target sequence
tatttcggaaacacttgatagtatt

SEQ ID NO: 190686 - DNA, 25 bp, Artificial sequence
  SiRNA target sequence
atttcggaaacacttgatagtatta

SEQ ID NO: 190687 - DNA, 25 bp, Artificial sequence
  SiRNA target sequence
tttcggaaacacttgatagtattat

SEQ ID NO: 190688 - DNA, 25 bp, Artificial sequence
  SiRNA target sequence
ttcggaaacacttgatagtattata

SEQ ID NO: 190689 - DNA, 25 bp, Artificial sequence
  SiRNA target sequence
tcggaaacacttgatagtattatat

SEQ ID NO: 190690 - DNA, 25 bp, Artificial sequence
  SiRNA target sequence
cggaaacacttgatagtattatatc

SEQ ID NO: 190691 - DNA, 25 bp, Artificial sequence
  SiRNA target sequence
ggaaacacttgatagtattatatct

SEQ ID NO: 190692 - DNA, 25 bp, Artificial sequence
  SiRNA target sequence
gaaacacttgatagtattatatcta

SEQ ID NO: 190693 - DNA, 25 bp, Artificial sequence
  SiRNA target sequence
aaacacttgatagtattatatctac

SEQ ID NO: 190694 - DNA, 25 bp, Artificial sequence
  SiRNA target sequence
aacacttgatagtattatatctacc

SEQ ID NO: 190695 - DNA, 25 bp, Artificial sequence
  SiRNA target sequence
acacttgatagtattatatctacca

SEQ ID NO: 190696 - DNA, 25 bp, Artificial sequence
  SiRNA target sequence
cacttgatagtattatatctaccag

SEQ ID NO: 190697 - DNA, 25 bp, Artificial sequence
  SiRNA target sequence
acttgatagtattatatctaccaga

SEQ ID NO: 190698 - DNA, 25 bp, Artificial sequence
  SiRNA target sequence
cttgatagtattatatctaccagag

SEQ ID NO: 190699 - DNA, 25 bp, Artificial sequence
  SiRNA target sequence
ttgatagtattatatctaccagaga

SEQ ID NO: 190700 - DNA, 25 bp, Artificial sequence
  SiRNA target sequence
tgatagtattatatctaccagagac

SEQ ID NO: 190701 - DNA, 25 bp, Artificial sequence
  SiRNA target sequence
gatagtattatatctaccagagacc

SEQ ID NO: 190702 - DNA, 25 bp, Artificial sequence
  SiRNA target sequence
atagtattatatctaccagagacca

SEQ ID NO: 190703 - DNA, 25 bp, Artificial sequence
  SiRNA target sequence
tagtattatatctaccagagaccag

SEQ ID NO: 190704 - DNA, 25 bp, Artificial sequence
  SiRNA target sequence
agtattatatctaccagagaccagt

SEQ ID NO: 190705 - DNA, 25 bp, Artificial sequence
  SiRNA target sequence
gtattatatctaccagagaccagta

SEQ ID NO: 190706 - DNA, 25 bp, Artificial sequence
  SiRNA target sequence
tattatatctaccagagaccagtat

SEQ ID NO: 190707 - DNA, 25 bp, Artificial sequence
  SiRNA target sequence
attatatctaccagagaccagtatc

SEQ ID NO: 190708 - DNA, 25 bp, Artificial sequence
  SiRNA target sequence
ttatatctaccagagaccagtatca

SEQ ID NO: 190709 - DNA, 25 bp, Artificial sequence
  SiRNA target sequence
tatatctaccagagaccagtatcat

SEQ ID NO: 190710 - DNA, 25 bp, Artificial sequence
  SiRNA target sequence
atatctaccagagaccagtatcatt

SEQ ID NO: 190711 - DNA, 25 bp, Artificial sequence
  SiRNA target sequence
tatctaccagagaccagtatcatta

SEQ ID NO: 190712 - DNA, 25 bp, Artificial sequence
  SiRNA target sequence
atctaccagagaccagtatcattat

SEQ ID NO: 190713 - DNA, 25 bp, Artificial sequence
  SiRNA target sequence
tctaccagagaccagtatcattatc

SEQ ID NO: 190714 - DNA, 25 bp, Artificial sequence
  SiRNA target sequence
ctaccagagaccagtatcattatcc

SEQ ID NO: 190715 - DNA, 25 bp, Artificial sequence
  SiRNA target sequence
taccagagaccagtatcattatccc

SEQ ID NO: 190716 - DNA, 25 bp, Artificial sequence
  SiRNA target sequence
accagagaccagtatcattatccca

SEQ ID NO: 190717 - DNA, 25 bp, Artificial sequence
  SiRNA target sequence
ccagagaccagtatcattatcccaa

SEQ ID NO: 190718 - DNA, 25 bp, Artificial sequence
  SiRNA target sequence
cagagaccagtatcattatcccaat

SEQ ID NO: 190719 - DNA, 25 bp, Artificial sequence
  SiRNA target sequence
agagaccagtatcattatcccaatt

SEQ ID NO: 190720 - DNA, 25 bp, Artificial sequence
  SiRNA target sequence
gagaccagtatcattatcccaattt

SEQ ID NO: 190721 - DNA, 25 bp, Artificial sequence
  SiRNA target sequence
agaccagtatcattatcccaatttg

SEQ ID NO: 190722 - DNA, 25 bp, Artificial sequence
  SiRNA target sequence
gaccagtatcattatcccaatttga

SEQ ID NO: 190723 - DNA, 25 bp, Artificial sequence
  SiRNA target sequence
accagtatcattatcccaatttgat

SEQ ID NO: 190724 - DNA, 25 bp, Artificial sequence
  SiRNA target sequence
ccagtatcattatcccaatttgata

SEQ ID NO: 190725 - DNA, 25 bp, Artificial sequence
  SiRNA target sequence
cagtatcattatcccaatttgataa

SEQ ID NO: 190726 - DNA, 25 bp, Artificial sequence
  SiRNA target sequence
agtatcattatcccaatttgataaa

SEQ ID NO: 190727 - DNA, 25 bp, Artificial sequence
  SiRNA target sequence
gtatcattatcccaatttgataaaa

SEQ ID NO: 190728 - DNA, 25 bp, Artificial sequence
  SiRNA target sequence
tatcattatcccaatttgataaaaa

SEQ ID NO: 190729 - DNA, 25 bp, Artificial sequence
  SiRNA target sequence
atcattatcccaatttgataaaaac

SEQ ID NO: 190730 - DNA, 25 bp, Artificial sequence
  SiRNA target sequence
tcattatcccaatttgataaaaaca

SEQ ID NO: 190731 - DNA, 25 bp, Artificial sequence
  SiRNA target sequence
cattatcccaatttgataaaaacat

SEQ ID NO: 190732 - DNA, 25 bp, Artificial sequence
  SiRNA target sequence
attatcccaatttgataaaaacata

SEQ ID NO: 190733 - DNA, 25 bp, Artificial sequence
  SiRNA target sequence
ttatcccaatttgataaaaacatat

SEQ ID NO: 190734 - DNA, 25 bp, Artificial sequence
  SiRNA target sequence
tatcccaatttgataaaaacatatc

SEQ ID NO: 190735 - DNA, 25 bp, Artificial sequence
  SiRNA target sequence
atcccaatttgataaaaacatatcc

SEQ ID NO: 190736 - DNA, 25 bp, Artificial sequence
  SiRNA target sequence
tcccaatttgataaaaacatatcca

SEQ ID NO: 190737 - DNA, 25 bp, Artificial sequence
  SiRNA target sequence
cccaatttgataaaaacatatccaa

SEQ ID NO: 190738 - DNA, 25 bp, Artificial sequence
  SiRNA target sequence
ccaatttgataaaaacatatccaaa

SEQ ID NO: 190739 - DNA, 25 bp, Artificial sequence
  SiRNA target sequence
caatttgataaaaacatatccaaat

SEQ ID NO: 190740 - DNA, 25 bp, Artificial sequence
  SiRNA target sequence
aatttgataaaaacatatccaaatt

SEQ ID NO: 190741 - DNA, 25 bp, Artificial sequence
  SiRNA target sequence
atttgataaaaacatatccaaattt

SEQ ID NO: 190742 - DNA, 25 bp, Artificial sequence
  SiRNA target sequence
tttgataaaaacatatccaaatttt

SEQ ID NO: 190743 - DNA, 25 bp, Artificial sequence
  SiRNA target sequence
ttgataaaaacatatccaaatttta

SEQ ID NO: 190744 - DNA, 25 bp, Artificial sequence
  SiRNA target sequence
tgataaaaacatatccaaattttac

SEQ ID NO: 190745 - DNA, 25 bp, Artificial sequence
  SiRNA target sequence
gataaaaacatatccaaattttacg

SEQ ID NO: 190746 - DNA, 25 bp, Artificial sequence
  SiRNA target sequence
ataaaaacatatccaaattttacgc

SEQ ID NO: 190747 - DNA, 25 bp, Artificial sequence
  SiRNA target sequence
taaaaacatatccaaattttacgct

SEQ ID NO: 190748 - DNA, 25 bp, Artificial sequence
  SiRNA target sequence
aaaaacatatccaaattttacgctt

SEQ ID NO: 190749 - DNA, 25 bp, Artificial sequence
  SiRNA target sequence
aaaacatatccaaattttacgctta

SEQ ID NO: 190750 - DNA, 25 bp, Artificial sequence
  SiRNA target sequence
aaacatatccaaattttacgcttaa

SEQ ID NO: 190751 - DNA, 25 bp, Artificial sequence
  SiRNA target sequence
aacatatccaaattttacgcttaaa

SEQ ID NO: 190752 - DNA, 25 bp, Artificial sequence
  SiRNA target sequence
acatatccaaattttacgcttaaag

SEQ ID NO: 190753 - DNA, 25 bp, Artificial sequence
  SiRNA target sequence
catatccaaattttacgcttaaagt

SEQ ID NO: 190754 - DNA, 25 bp, Artificial sequence
  SiRNA target sequence
atatccaaattttacgcttaaagtt

SEQ ID NO: 190755 - DNA, 25 bp, Artificial sequence
  SiRNA target sequence
tatccaaattttacgcttaaagttg

SEQ ID NO: 190756 - DNA, 25 bp, Artificial sequence
  SiRNA target sequence
atccaaattttacgcttaaagttga

SEQ ID NO: 190757 - DNA, 25 bp, Artificial sequence
  SiRNA target sequence
tccaaattttacgcttaaagttgaa

SEQ ID NO: 190758 - DNA, 25 bp, Artificial sequence
  SiRNA target sequence
ccaaattttacgcttaaagttgaag

SEQ ID NO: 190759 - DNA, 25 bp, Artificial sequence
  SiRNA target sequence
caaattttacgcttaaagttgaagg

SEQ ID NO: 190760 - DNA, 25 bp, Artificial sequence
  SiRNA target sequence
aaattttacgcttaaagttgaaggc

SEQ ID NO: 190761 - DNA, 25 bp, Artificial sequence
  SiRNA target sequence
aattttacgcttaaagttgaaggcg

SEQ ID NO: 190762 - DNA, 25 bp, Artificial sequence
  SiRNA target sequence
attttacgcttaaagttgaaggcgg

SEQ ID NO: 190763 - DNA, 25 bp, Artificial sequence
  SiRNA target sequence
ttttacgcttaaagttgaaggcggt

SEQ ID NO: 190764 - DNA, 25 bp, Artificial sequence
  SiRNA target sequence
tttacgcttaaagttgaaggcggta

SEQ ID NO: 190765 - DNA, 25 bp, Artificial sequence
  SiRNA target sequence
ttacgcttaaagttgaaggcggtaa

SEQ ID NO: 190766 - DNA, 25 bp, Artificial sequence
  SiRNA target sequence
tacgcttaaagttgaaggcggtaac

SEQ ID NO: 190767 - DNA, 25 bp, Artificial sequence
  SiRNA target sequence
acgcttaaagttgaaggcggtaact

SEQ ID NO: 190768 - DNA, 25 bp, Artificial sequence
  SiRNA target sequence
cgcttaaagttgaaggcggtaactt

SEQ ID NO: 190769 - DNA, 25 bp, Artificial sequence
  SiRNA target sequence
gcttaaagttgaaggcggtaacttt

SEQ ID NO: 190770 - DNA, 25 bp, Artificial sequence
  SiRNA target sequence
cttaaagttgaaggcggtaactttt

SEQ ID NO: 190771 - DNA, 25 bp, Artificial sequence
  SiRNA target sequence
ttaaagttgaaggcggtaacttttc

SEQ ID NO: 190772 - DNA, 25 bp, Artificial sequence
  SiRNA target sequence
taaagttgaaggcggtaacttttca

SEQ ID NO: 190773 - DNA, 25 bp, Artificial sequence
  SiRNA target sequence
aaagttgaaggcggtaacttttcag

SEQ ID NO: 190774 - DNA, 25 bp, Artificial sequence
  SiRNA target sequence
aagttgaaggcggtaacttttcaga

SEQ ID NO: 190775 - DNA, 25 bp, Artificial sequence
  SiRNA target sequence
agttgaaggcggtaacttttcagat

SEQ ID NO: 190776 - DNA, 25 bp, Artificial sequence
  SiRNA target sequence
gttgaaggcggtaacttttcagatt

SEQ ID NO: 190777 - DNA, 25 bp, Artificial sequence
  SiRNA target sequence
ttgaaggcggtaacttttcagattc

SEQ ID NO: 190778 - DNA, 25 bp, Artificial sequence
  SiRNA target sequence
tgaaggcggtaacttttcagattct

SEQ ID NO: 190779 - DNA, 25 bp, Artificial sequence
  SiRNA target sequence
gaaggcggtaacttttcagattctg

SEQ ID NO: 190780 - DNA, 25 bp, Artificial sequence
  SiRNA target sequence
aaggcggtaacttttcagattctga

SEQ ID NO: 190781 - DNA, 25 bp, Artificial sequence
  SiRNA target sequence
aggcggtaacttttcagattctgaa

SEQ ID NO: 190782 - DNA, 25 bp, Artificial sequence
  SiRNA target sequence
ggcggtaacttttcagattctgaaa

SEQ ID NO: 190783 - DNA, 25 bp, Artificial sequence
  SiRNA target sequence
gcggtaacttttcagattctgaaat

SEQ ID NO: 190784 - DNA, 25 bp, Artificial sequence
  SiRNA target sequence
cggtaacttttcagattctgaaatt

SEQ ID NO: 190785 - DNA, 25 bp, Artificial sequence
  SiRNA target sequence
ggtaacttttcagattctgaaattg

SEQ ID NO: 190786 - DNA, 25 bp, Artificial sequence
  SiRNA target sequence
gtaacttttcagattctgaaattgt

SEQ ID NO: 190787 - DNA, 25 bp, Artificial sequence
  SiRNA target sequence
taacttttcagattctgaaattgtt

SEQ ID NO: 190788 - DNA, 25 bp, Artificial sequence
  SiRNA target sequence
aacttttcagattctgaaattgttg

SEQ ID NO: 190789 - DNA, 25 bp, Artificial sequence
  SiRNA target sequence
acttttcagattctgaaattgttgt

SEQ ID NO: 190790 - DNA, 25 bp, Artificial sequence
  SiRNA target sequence
cttttcagattctgaaattgttgta

SEQ ID NO: 190791 - DNA, 25 bp, Artificial sequence
  SiRNA target sequence
ttttcagattctgaaattgttgtat

SEQ ID NO: 190792 - DNA, 25 bp, Artificial sequence
  SiRNA target sequence
tttcagattctgaaattgttgtatt

SEQ ID NO: 190793 - DNA, 25 bp, Artificial sequence
  SiRNA target sequence
ttcagattctgaaattgttgtattt

SEQ ID NO: 190794 - DNA, 25 bp, Artificial sequence
  SiRNA target sequence
tcagattctgaaattgttgtatttc

SEQ ID NO: 190795 - DNA, 25 bp, Artificial sequence
  SiRNA target sequence
cagattctgaaattgttgtatttct

SEQ ID NO: 190796 - DNA, 25 bp, Artificial sequence
  SiRNA target sequence
agattctgaaattgttgtatttctt

SEQ ID NO: 190797 - DNA, 25 bp, Artificial sequence
  SiRNA target sequence
gattctgaaattgttgtatttcttg

SEQ ID NO: 190798 - DNA, 25 bp, Artificial sequence
  SiRNA target sequence
attctgaaattgttgtatttcttgg

SEQ ID NO: 190799 - DNA, 25 bp, Artificial sequence
  SiRNA target sequence
ttctgaaattgttgtatttcttggt

SEQ ID NO: 190800 - DNA, 25 bp, Artificial sequence
  SiRNA target sequence
tctgaaattgttgtatttcttggtg

SEQ ID NO: 190801 - DNA, 25 bp, Artificial sequence
  SiRNA target sequence
ctgaaattgttgtatttcttggtga

SEQ ID NO: 190802 - DNA, 25 bp, Artificial sequence
  SiRNA target sequence
tgaaattgttgtatttcttggtgaa

SEQ ID NO: 190803 - DNA, 25 bp, Artificial sequence
  SiRNA target sequence
gaaattgttgtatttcttggtgaaa

SEQ ID NO: 190804 - DNA, 25 bp, Artificial sequence
  SiRNA target sequence
aaattgttgtatttcttggtgaaaa

SEQ ID NO: 190805 - DNA, 25 bp, Artificial sequence
  SiRNA target sequence
aattgttgtatttcttggtgaaaat

SEQ ID NO: 190806 - DNA, 25 bp, Artificial sequence
  SiRNA target sequence
attgttgtatttcttggtgaaaatg

SEQ ID NO: 190807 - DNA, 25 bp, Artificial sequence
  SiRNA target sequence
ttgttgtatttcttggtgaaaatgg

SEQ ID NO: 190808 - DNA, 25 bp, Artificial sequence
  SiRNA target sequence
tgttgtatttcttggtgaaaatgga

SEQ ID NO: 190809 - DNA, 25 bp, Artificial sequence
  SiRNA target sequence
gttgtatttcttggtgaaaatggaa

SEQ ID NO: 190810 - DNA, 25 bp, Artificial sequence
  SiRNA target sequence
ttgtatttcttggtgaaaatggaat

SEQ ID NO: 190811 - DNA, 25 bp, Artificial sequence
  SiRNA target sequence
tgtatttcttggtgaaaatggaatg

SEQ ID NO: 190812 - DNA, 25 bp, Artificial sequence
  SiRNA target sequence
gtatttcttggtgaaaatggaatgg

SEQ ID NO: 190813 - DNA, 25 bp, Artificial sequence
  SiRNA target sequence
tatttcttggtgaaaatggaatggg

SEQ ID NO: 190814 - DNA, 25 bp, Artificial sequence
  SiRNA target sequence
atttcttggtgaaaatggaatgggc

SEQ ID NO: 190815 - DNA, 25 bp, Artificial sequence
  SiRNA target sequence
tttcttggtgaaaatggaatgggca

SEQ ID NO: 190816 - DNA, 25 bp, Artificial sequence
  SiRNA target sequence
ttcttggtgaaaatggaatgggcaa

SEQ ID NO: 190817 - DNA, 25 bp, Artificial sequence
  SiRNA target sequence
tcttggtgaaaatggaatgggcaaa

SEQ ID NO: 190818 - DNA, 25 bp, Artificial sequence
  SiRNA target sequence
cttggtgaaaatggaatgggcaaaa

SEQ ID NO: 190819 - DNA, 25 bp, Artificial sequence
  SiRNA target sequence
ttggtgaaaatggaatgggcaaaac

SEQ ID NO: 190820 - DNA, 25 bp, Artificial sequence
  SiRNA target sequence
tggtgaaaatggaatgggcaaaact

SEQ ID NO: 190821 - DNA, 25 bp, Artificial sequence
  SiRNA target sequence
ggtgaaaatggaatgggcaaaacta

SEQ ID NO: 190822 - DNA, 25 bp, Artificial sequence
  SiRNA target sequence
gtgaaaatggaatgggcaaaactac

SEQ ID NO: 190823 - DNA, 25 bp, Artificial sequence
  SiRNA target sequence
tgaaaatggaatgggcaaaactact

SEQ ID NO: 190824 - DNA, 25 bp, Artificial sequence
  SiRNA target sequence
gaaaatggaatgggcaaaactactt

SEQ ID NO: 190825 - DNA, 25 bp, Artificial sequence
  SiRNA target sequence
aaaatggaatgggcaaaactacttt

SEQ ID NO: 190826 - DNA, 25 bp, Artificial sequence
  SiRNA target sequence
aaatggaatgggcaaaactacttta

SEQ ID NO: 190827 - DNA, 25 bp, Artificial sequence
  SiRNA target sequence
aatggaatgggcaaaactactttag

SEQ ID NO: 190828 - DNA, 25 bp, Artificial sequence
  SiRNA target sequence
atggaatgggcaaaactactttagt

SEQ ID NO: 190829 - DNA, 25 bp, Artificial sequence
  SiRNA target sequence
tggaatgggcaaaactactttagta

SEQ ID NO: 190830 - DNA, 25 bp, Artificial sequence
  SiRNA target sequence
ggaatgggcaaaactactttagtag

SEQ ID NO: 190831 - DNA, 25 bp, Artificial sequence
  SiRNA target sequence
gaatgggcaaaactactttagtagg

SEQ ID NO: 190832 - DNA, 25 bp, Artificial sequence
  SiRNA target sequence
aatgggcaaaactactttagtaggt

SEQ ID NO: 190833 - DNA, 25 bp, Artificial sequence
  SiRNA target sequence
atgggcaaaactactttagtaggtt

SEQ ID NO: 190834 - DNA, 25 bp, Artificial sequence
  SiRNA target sequence
tgggcaaaactactttagtaggttt

SEQ ID NO: 190835 - DNA, 25 bp, Artificial sequence
  SiRNA target sequence
gggcaaaactactttagtaggtttg

SEQ ID NO: 190836 - DNA, 25 bp, Artificial sequence
  SiRNA target sequence
ggcaaaactactttagtaggtttga

SEQ ID NO: 190837 - DNA, 25 bp, Artificial sequence
  SiRNA target sequence
gcaaaactactttagtaggtttgat

SEQ ID NO: 190838 - DNA, 25 bp, Artificial sequence
  SiRNA target sequence
caaaactactttagtaggtttgatt

SEQ ID NO: 190839 - DNA, 25 bp, Artificial sequence
  SiRNA target sequence
aaaactactttagtaggtttgattt

SEQ ID NO: 190840 - DNA, 25 bp, Artificial sequence
  SiRNA target sequence
aaactactttagtaggtttgatttc

SEQ ID NO: 190841 - DNA, 25 bp, Artificial sequence
  SiRNA target sequence
aactactttagtaggtttgatttcg

SEQ ID NO: 190842 - DNA, 25 bp, Artificial sequence
  SiRNA target sequence
actactttagtaggtttgatttcgg

SEQ ID NO: 190843 - DNA, 25 bp, Artificial sequence
  SiRNA target sequence
ctactttagtaggtttgatttcggg

SEQ ID NO: 190844 - DNA, 25 bp, Artificial sequence
  SiRNA target sequence
tactttagtaggtttgatttcgggg

SEQ ID NO: 190845 - DNA, 25 bp, Artificial sequence
  SiRNA target sequence
actttagtaggtttgatttcggggt

SEQ ID NO: 190846 - DNA, 25 bp, Artificial sequence
  SiRNA target sequence
ctttagtaggtttgatttcggggtt

SEQ ID NO: 190847 - DNA, 25 bp, Artificial sequence
  SiRNA target sequence
tttagtaggtttgatttcggggtta

SEQ ID NO: 190848 - DNA, 25 bp, Artificial sequence
  SiRNA target sequence
ttagtaggtttgatttcggggttaa

SEQ ID NO: 190849 - DNA, 25 bp, Artificial sequence
  SiRNA target sequence
tagtaggtttgatttcggggttaat

SEQ ID NO: 190850 - DNA, 25 bp, Artificial sequence
  SiRNA target sequence
agtaggtttgatttcggggttaatt

SEQ ID NO: 190851 - DNA, 25 bp, Artificial sequence
  SiRNA target sequence
gtaggtttgatttcggggttaatta

SEQ ID NO: 190852 - DNA, 25 bp, Artificial sequence
  SiRNA target sequence
taggtttgatttcggggttaattaa

SEQ ID NO: 190853 - DNA, 25 bp, Artificial sequence
  SiRNA target sequence
aggtttgatttcggggttaattaaa

SEQ ID NO: 190854 - DNA, 25 bp, Artificial sequence
  SiRNA target sequence
ggtttgatttcggggttaattaaag

SEQ ID NO: 190855 - DNA, 25 bp, Artificial sequence
  SiRNA target sequence
gtttgatttcggggttaattaaaga

SEQ ID NO: 190856 - DNA, 25 bp, Artificial sequence
  SiRNA target sequence
tttgatttcggggttaattaaagat

SEQ ID NO: 190857 - DNA, 25 bp, Artificial sequence
  SiRNA target sequence
ttgatttcggggttaattaaagatg

SEQ ID NO: 190858 - DNA, 25 bp, Artificial sequence
  SiRNA target sequence
tgatttcggggttaattaaagatga

SEQ ID NO: 190859 - DNA, 25 bp, Artificial sequence
  SiRNA target sequence
gatttcggggttaattaaagatgat

SEQ ID NO: 190860 - DNA, 25 bp, Artificial sequence
  SiRNA target sequence
atttcggggttaattaaagatgata

SEQ ID NO: 190861 - DNA, 25 bp, Artificial sequence
  SiRNA target sequence
tttcggggttaattaaagatgataa

SEQ ID NO: 190862 - DNA, 25 bp, Artificial sequence
  SiRNA target sequence
ttcggggttaattaaagatgataac

SEQ ID NO: 190863 - DNA, 25 bp, Artificial sequence
  SiRNA target sequence
tcggggttaattaaagatgataacg

SEQ ID NO: 190864 - DNA, 25 bp, Artificial sequence
  SiRNA target sequence
cggggttaattaaagatgataacgg

SEQ ID NO: 190865 - DNA, 25 bp, Artificial sequence
  SiRNA target sequence
ggggttaattaaagatgataacggg

SEQ ID NO: 190866 - DNA, 25 bp, Artificial sequence
  SiRNA target sequence
gggttaattaaagatgataacgggg

SEQ ID NO: 190867 - DNA, 25 bp, Artificial sequence
  SiRNA target sequence
ggttaattaaagatgataacgggga

SEQ ID NO: 190868 - DNA, 25 bp, Artificial sequence
  SiRNA target sequence
gttaattaaagatgataacggggaa

SEQ ID NO: 190869 - DNA, 25 bp, Artificial sequence
  SiRNA target sequence
ttaattaaagatgataacggggaag

SEQ ID NO: 190870 - DNA, 25 bp, Artificial sequence
  SiRNA target sequence
taattaaagatgataacggggaaga

SEQ ID NO: 190871 - DNA, 25 bp, Artificial sequence
  SiRNA target sequence
aattaaagatgataacggggaagag

SEQ ID NO: 190872 - DNA, 25 bp, Artificial sequence
  SiRNA target sequence
attaaagatgataacggggaagagt

SEQ ID NO: 190873 - DNA, 25 bp, Artificial sequence
  SiRNA target sequence
ttaaagatgataacggggaagagtt

SEQ ID NO: 190874 - DNA, 25 bp, Artificial sequence
  SiRNA target sequence
taaagatgataacggggaagagttc

SEQ ID NO: 190875 - DNA, 25 bp, Artificial sequence
  SiRNA target sequence
aaagatgataacggggaagagttcg

SEQ ID NO: 190876 - DNA, 25 bp, Artificial sequence
  SiRNA target sequence
aagatgataacggggaagagttcgg

SEQ ID NO: 190877 - DNA, 25 bp, Artificial sequence
  SiRNA target sequence
agatgataacggggaagagttcggt

SEQ ID NO: 190878 - DNA, 25 bp, Artificial sequence
  SiRNA target sequence
gatgataacggggaagagttcggtt

SEQ ID NO: 190879 - DNA, 25 bp, Artificial sequence
  SiRNA target sequence
atgataacggggaagagttcggttt

SEQ ID NO: 190880 - DNA, 25 bp, Artificial sequence
  SiRNA target sequence
tgataacggggaagagttcggtttg

SEQ ID NO: 190881 - DNA, 25 bp, Artificial sequence
  SiRNA target sequence
gataacggggaagagttcggtttgt

SEQ ID NO: 190882 - DNA, 25 bp, Artificial sequence
  SiRNA target sequence
ataacggggaagagttcggtttgtt

SEQ ID NO: 190883 - DNA, 25 bp, Artificial sequence
  SiRNA target sequence
taacggggaagagttcggtttgttg

SEQ ID NO: 190884 - DNA, 25 bp, Artificial sequence
  SiRNA target sequence
aacggggaagagttcggtttgttgt

SEQ ID NO: 190885 - DNA, 25 bp, Artificial sequence
  SiRNA target sequence
acggggaagagttcggtttgttgtc

SEQ ID NO: 190886 - DNA, 25 bp, Artificial sequence
  SiRNA target sequence
cggggaagagttcggtttgttgtca

SEQ ID NO: 190887 - DNA, 25 bp, Artificial sequence
  SiRNA target sequence
ggggaagagttcggtttgttgtcat

SEQ ID NO: 190888 - DNA, 25 bp, Artificial sequence
  SiRNA target sequence
gggaagagttcggtttgttgtcata

SEQ ID NO: 190889 - DNA, 25 bp, Artificial sequence
  SiRNA target sequence
ggaagagttcggtttgttgtcatat

SEQ ID NO: 190890 - DNA, 25 bp, Artificial sequence
  SiRNA target sequence
gaagagttcggtttgttgtcatata

SEQ ID NO: 190891 - DNA, 25 bp, Artificial sequence
  SiRNA target sequence
aagagttcggtttgttgtcatatag

SEQ ID NO: 190892 - DNA, 25 bp, Artificial sequence
  SiRNA target sequence
agagttcggtttgttgtcatatagt

SEQ ID NO: 190893 - DNA, 25 bp, Artificial sequence
  SiRNA target sequence
gagttcggtttgttgtcatatagtc

SEQ ID NO: 190894 - DNA, 25 bp, Artificial sequence
  SiRNA target sequence
agttcggtttgttgtcatatagtct

SEQ ID NO: 190895 - DNA, 25 bp, Artificial sequence
  SiRNA target sequence
gttcggtttgttgtcatatagtctt

SEQ ID NO: 190896 - DNA, 25 bp, Artificial sequence
  SiRNA target sequence
ttcggtttgttgtcatatagtctta

SEQ ID NO: 190897 - DNA, 25 bp, Artificial sequence
  SiRNA target sequence
tcggtttgttgtcatatagtcttaa

SEQ ID NO: 190898 - DNA, 25 bp, Artificial sequence
  SiRNA target sequence
cggtttgttgtcatatagtcttaaa

SEQ ID NO: 190899 - DNA, 25 bp, Artificial sequence
  SiRNA target sequence
ggtttgttgtcatatagtcttaaac

SEQ ID NO: 190900 - DNA, 25 bp, Artificial sequence
  SiRNA target sequence
gtttgttgtcatatagtcttaaacc

SEQ ID NO: 190901 - DNA, 25 bp, Artificial sequence
  SiRNA target sequence
tttgttgtcatatagtcttaaaccg

SEQ ID NO: 190902 - DNA, 25 bp, Artificial sequence
  SiRNA target sequence
ttgttgtcatatagtcttaaaccgc

SEQ ID NO: 190903 - DNA, 25 bp, Artificial sequence
  SiRNA target sequence
tgttgtcatatagtcttaaaccgca

SEQ ID NO: 190904 - DNA, 25 bp, Artificial sequence
  SiRNA target sequence
gttgtcatatagtcttaaaccgcaa

SEQ ID NO: 190905 - DNA, 25 bp, Artificial sequence
  SiRNA target sequence
ttgtcatatagtcttaaaccgcaaa

SEQ ID NO: 190906 - DNA, 25 bp, Artificial sequence
  SiRNA target sequence
tgtcatatagtcttaaaccgcaaaa

SEQ ID NO: 190907 - DNA, 25 bp, Artificial sequence
  SiRNA target sequence
gtcatatagtcttaaaccgcaaaaa

SEQ ID NO: 190908 - DNA, 25 bp, Artificial sequence
  SiRNA target sequence
tcatatagtcttaaaccgcaaaaaa

SEQ ID NO: 190909 - DNA, 25 bp, Artificial sequence
  SiRNA target sequence
catatagtcttaaaccgcaaaaaat

SEQ ID NO: 190910 - DNA, 25 bp, Artificial sequence
  SiRNA target sequence
atatagtcttaaaccgcaaaaaatc

SEQ ID NO: 190911 - DNA, 25 bp, Artificial sequence
  SiRNA target sequence
tatagtcttaaaccgcaaaaaatca

SEQ ID NO: 190912 - DNA, 25 bp, Artificial sequence
  SiRNA target sequence
atagtcttaaaccgcaaaaaatcat

SEQ ID NO: 190913 - DNA, 25 bp, Artificial sequence
  SiRNA target sequence
tagtcttaaaccgcaaaaaatcata

SEQ ID NO: 190914 - DNA, 25 bp, Artificial sequence
  SiRNA target sequence
agtcttaaaccgcaaaaaatcatac

SEQ ID NO: 190915 - DNA, 25 bp, Artificial sequence
  SiRNA target sequence
gtcttaaaccgcaaaaaatcatacc

SEQ ID NO: 190916 - DNA, 25 bp, Artificial sequence
  SiRNA target sequence
tcttaaaccgcaaaaaatcataccg

SEQ ID NO: 190917 - DNA, 25 bp, Artificial sequence
  SiRNA target sequence
cttaaaccgcaaaaaatcataccga

SEQ ID NO: 190918 - DNA, 25 bp, Artificial sequence
  SiRNA target sequence
ttaaaccgcaaaaaatcataccgaa

SEQ ID NO: 190919 - DNA, 25 bp, Artificial sequence
  SiRNA target sequence
taaaccgcaaaaaatcataccgaaa

SEQ ID NO: 190920 - DNA, 25 bp, Artificial sequence
  SiRNA target sequence
aaaccgcaaaaaatcataccgaaat

SEQ ID NO: 190921 - DNA, 25 bp, Artificial sequence
  SiRNA target sequence
aaccgcaaaaaatcataccgaaata

SEQ ID NO: 190922 - DNA, 25 bp, Artificial sequence
  SiRNA target sequence
accgcaaaaaatcataccgaaatac

SEQ ID NO: 190923 - DNA, 25 bp, Artificial sequence
  SiRNA target sequence
ccgcaaaaaatcataccgaaataca

SEQ ID NO: 190924 - DNA, 25 bp, Artificial sequence
  SiRNA target sequence
cgcaaaaaatcataccgaaatacaa

SEQ ID NO: 190925 - DNA, 25 bp, Artificial sequence
  SiRNA target sequence
gcaaaaaatcataccgaaatacaaa

SEQ ID NO: 190926 - DNA, 25 bp, Artificial sequence
  SiRNA target sequence
caaaaaatcataccgaaatacaaag

SEQ ID NO: 190927 - DNA, 25 bp, Artificial sequence
  SiRNA target sequence
aaaaaatcataccgaaatacaaagg

SEQ ID NO: 190928 - DNA, 25 bp, Artificial sequence
  SiRNA target sequence
aaaaatcataccgaaatacaaagga

SEQ ID NO: 190929 - DNA, 25 bp, Artificial sequence
  SiRNA target sequence
aaaatcataccgaaatacaaaggaa

SEQ ID NO: 190930 - DNA, 25 bp, Artificial sequence
  SiRNA target sequence
aaatcataccgaaatacaaaggaac

SEQ ID NO: 190931 - DNA, 25 bp, Artificial sequence
  SiRNA target sequence
aatcataccgaaatacaaaggaaca

SEQ ID NO: 190932 - DNA, 25 bp, Artificial sequence
  SiRNA target sequence
atcataccgaaatacaaaggaacag

SEQ ID NO: 190933 - DNA, 25 bp, Artificial sequence
  SiRNA target sequence
tcataccgaaatacaaaggaacagt

SEQ ID NO: 190934 - DNA, 25 bp, Artificial sequence
  SiRNA target sequence
cataccgaaatacaaaggaacagtt

SEQ ID NO: 190935 - DNA, 25 bp, Artificial sequence
  SiRNA target sequence
ataccgaaatacaaaggaacagtta

SEQ ID NO: 190936 - DNA, 25 bp, Artificial sequence
  SiRNA target sequence
taccgaaatacaaaggaacagttag

SEQ ID NO: 190937 - DNA, 25 bp, Artificial sequence
  SiRNA target sequence
accgaaatacaaaggaacagttaga

SEQ ID NO: 190938 - DNA, 25 bp, Artificial sequence
  SiRNA target sequence
ccgaaatacaaaggaacagttagag

SEQ ID NO: 190939 - DNA, 25 bp, Artificial sequence
  SiRNA target sequence
cgaaatacaaaggaacagttagaga

SEQ ID NO: 190940 - DNA, 25 bp, Artificial sequence
  SiRNA target sequence
gaaatacaaaggaacagttagagat

SEQ ID NO: 190941 - DNA, 25 bp, Artificial sequence
  SiRNA target sequence
aaatacaaaggaacagttagagatc

SEQ ID NO: 190942 - DNA, 25 bp, Artificial sequence
  SiRNA target sequence
aatacaaaggaacagttagagatct

SEQ ID NO: 190943 - DNA, 25 bp, Artificial sequence
  SiRNA target sequence
atacaaaggaacagttagagatctt

SEQ ID NO: 190944 - DNA, 25 bp, Artificial sequence
  SiRNA target sequence
tacaaaggaacagttagagatcttt

SEQ ID NO: 190945 - DNA, 25 bp, Artificial sequence
  SiRNA target sequence
acaaaggaacagttagagatctttt

SEQ ID NO: 190946 - DNA, 25 bp, Artificial sequence
  SiRNA target sequence
caaaggaacagttagagatcttttt

SEQ ID NO: 190947 - DNA, 25 bp, Artificial sequence
  SiRNA target sequence
aaaggaacagttagagatcttttta

SEQ ID NO: 190948 - DNA, 25 bp, Artificial sequence
  SiRNA target sequence
aaggaacagttagagatctttttat

SEQ ID NO: 190949 - DNA, 25 bp, Artificial sequence
  SiRNA target sequence
aggaacagttagagatctttttatg

SEQ ID NO: 190950 - DNA, 25 bp, Artificial sequence
  SiRNA target sequence
ggaacagttagagatctttttatgt

SEQ ID NO: 190951 - DNA, 25 bp, Artificial sequence
  SiRNA target sequence
gaacagttagagatctttttatgtc

SEQ ID NO: 190952 - DNA, 25 bp, Artificial sequence
  SiRNA target sequence
aacagttagagatctttttatgtca

SEQ ID NO: 190953 - DNA, 25 bp, Artificial sequence
  SiRNA target sequence
acagttagagatctttttatgtcaa

SEQ ID NO: 190954 - DNA, 25 bp, Artificial sequence
  SiRNA target sequence
cagttagagatctttttatgtcaaa

SEQ ID NO: 190955 - DNA, 25 bp, Artificial sequence
  SiRNA target sequence
agttagagatctttttatgtcaaaa

SEQ ID NO: 190956 - DNA, 25 bp, Artificial sequence
  SiRNA target sequence
gttagagatctttttatgtcaaaaa

SEQ ID NO: 190957 - DNA, 25 bp, Artificial sequence
  SiRNA target sequence
ttagagatctttttatgtcaaaaat

SEQ ID NO: 190958 - DNA, 25 bp, Artificial sequence
  SiRNA target sequence
tagagatctttttatgtcaaaaatt

SEQ ID NO: 190959 - DNA, 25 bp, Artificial sequence
  SiRNA target sequence
agagatctttttatgtcaaaaattc

SEQ ID NO: 190960 - DNA, 25 bp, Artificial sequence
  SiRNA target sequence
gagatctttttatgtcaaaaattcg

SEQ ID NO: 190961 - DNA, 25 bp, Artificial sequence
  SiRNA target sequence
agatctttttatgtcaaaaattcgt

SEQ ID NO: 190962 - DNA, 25 bp, Artificial sequence
  SiRNA target sequence
gatctttttatgtcaaaaattcgtt

SEQ ID NO: 190963 - DNA, 25 bp, Artificial sequence
  SiRNA target sequence
atctttttatgtcaaaaattcgttc

SEQ ID NO: 190964 - DNA, 25 bp, Artificial sequence
  SiRNA target sequence
tctttttatgtcaaaaattcgttct

SEQ ID NO: 190965 - DNA, 25 bp, Artificial sequence
  SiRNA target sequence
ctttttatgtcaaaaattcgttctt

SEQ ID NO: 190966 - DNA, 25 bp, Artificial sequence
  SiRNA target sequence
tttttatgtcaaaaattcgttcttc

SEQ ID NO: 190967 - DNA, 25 bp, Artificial sequence
  SiRNA target sequence
ttttatgtcaaaaattcgttcttcc

SEQ ID NO: 190968 - DNA, 25 bp, Artificial sequence
  SiRNA target sequence
tttatgtcaaaaattcgttcttcct

SEQ ID NO: 190969 - DNA, 25 bp, Artificial sequence
  SiRNA target sequence
ttatgtcaaaaattcgttcttcctt

SEQ ID NO: 190970 - DNA, 25 bp, Artificial sequence
  SiRNA target sequence
tatgtcaaaaattcgttcttccttt

SEQ ID NO: 190971 - DNA, 25 bp, Artificial sequence
  SiRNA target sequence
atgtcaaaaattcgttcttcctttt

SEQ ID NO: 190972 - DNA, 25 bp, Artificial sequence
  SiRNA target sequence
tgtcaaaaattcgttcttccttttt

SEQ ID NO: 190973 - DNA, 25 bp, Artificial sequence
  SiRNA target sequence
gtcaaaaattcgttcttccttttta

SEQ ID NO: 190974 - DNA, 25 bp, Artificial sequence
  SiRNA target sequence
tcaaaaattcgttcttcctttttag

SEQ ID NO: 190975 - DNA, 25 bp, Artificial sequence
  SiRNA target sequence
caaaaattcgttcttcctttttaga

SEQ ID NO: 190976 - DNA, 25 bp, Artificial sequence
  SiRNA target sequence
aaaaattcgttcttcctttttagac

SEQ ID NO: 190977 - DNA, 25 bp, Artificial sequence
  SiRNA target sequence
aaaattcgttcttcctttttagacg

SEQ ID NO: 190978 - DNA, 25 bp, Artificial sequence
  SiRNA target sequence
aaattcgttcttcctttttagacgc

SEQ ID NO: 190979 - DNA, 25 bp, Artificial sequence
  SiRNA target sequence
aattcgttcttcctttttagacgct

SEQ ID NO: 190980 - DNA, 25 bp, Artificial sequence
  SiRNA target sequence
attcgttcttcctttttagacgcta

SEQ ID NO: 190981 - DNA, 25 bp, Artificial sequence
  SiRNA target sequence
ttcgttcttcctttttagacgctaa

SEQ ID NO: 190982 - DNA, 25 bp, Artificial sequence
  SiRNA target sequence
tcgttcttcctttttagacgctaat

SEQ ID NO: 190983 - DNA, 25 bp, Artificial sequence
  SiRNA target sequence
cgttcttcctttttagacgctaatt

SEQ ID NO: 190984 - DNA, 25 bp, Artificial sequence
  SiRNA target sequence
gttcttcctttttagacgctaattt

SEQ ID NO: 190985 - DNA, 25 bp, Artificial sequence
  SiRNA target sequence
ttcttcctttttagacgctaatttt

SEQ ID NO: 190986 - DNA, 25 bp, Artificial sequence
  SiRNA target sequence
tcttcctttttagacgctaattttg

SEQ ID NO: 190987 - DNA, 25 bp, Artificial sequence
  SiRNA target sequence
cttcctttttagacgctaattttgt

SEQ ID NO: 190988 - DNA, 25 bp, Artificial sequence
  SiRNA target sequence
ttcctttttagacgctaattttgtt

SEQ ID NO: 190989 - DNA, 25 bp, Artificial sequence
  SiRNA target sequence
tcctttttagacgctaattttgtta

SEQ ID NO: 190990 - DNA, 25 bp, Artificial sequence
  SiRNA target sequence
cctttttagacgctaattttgttaa

SEQ ID NO: 190991 - DNA, 25 bp, Artificial sequence
  SiRNA target sequence
ctttttagacgctaattttgttaat

SEQ ID NO: 190992 - DNA, 25 bp, Artificial sequence
  SiRNA target sequence
tttttagacgctaattttgttaatg

SEQ ID NO: 190993 - DNA, 25 bp, Artificial sequence
  SiRNA target sequence
ttttagacgctaattttgttaatga

SEQ ID NO: 190994 - DNA, 25 bp, Artificial sequence
  SiRNA target sequence
tttagacgctaattttgttaatgaa

SEQ ID NO: 190995 - DNA, 25 bp, Artificial sequence
  SiRNA target sequence
ttagacgctaattttgttaatgaag

SEQ ID NO: 190996 - DNA, 25 bp, Artificial sequence
  SiRNA target sequence
tagacgctaattttgttaatgaagc

SEQ ID NO: 190997 - DNA, 25 bp, Artificial sequence
  SiRNA target sequence
agacgctaattttgttaatgaagct

SEQ ID NO: 190998 - DNA, 25 bp, Artificial sequence
  SiRNA target sequence
gacgctaattttgttaatgaagcta

SEQ ID NO: 190999 - DNA, 25 bp, Artificial sequence
  SiRNA target sequence
acgctaattttgttaatgaagctat

SEQ ID NO: 191000 - DNA, 25 bp, Artificial sequence
  SiRNA target sequence
cgctaattttgttaatgaagctatt

SEQ ID NO: 191001 - DNA, 25 bp, Artificial sequence
  SiRNA target sequence
gctaattttgttaatgaagctatta

SEQ ID NO: 191002 - DNA, 25 bp, Artificial sequence
  SiRNA target sequence
ctaattttgttaatgaagctattaa

SEQ ID NO: 191003 - DNA, 25 bp, Artificial sequence
  SiRNA target sequence
taattttgttaatgaagctattaaa

SEQ ID NO: 191004 - DNA, 25 bp, Artificial sequence
  SiRNA target sequence
aattttgttaatgaagctattaaac

SEQ ID NO: 191005 - DNA, 25 bp, Artificial sequence
  SiRNA target sequence
attttgttaatgaagctattaaacc

SEQ ID NO: 191006 - DNA, 25 bp, Artificial sequence
  SiRNA target sequence
ttttgttaatgaagctattaaacct

SEQ ID NO: 191007 - DNA, 25 bp, Artificial sequence
  SiRNA target sequence
tttgttaatgaagctattaaacctt

SEQ ID NO: 191008 - DNA, 25 bp, Artificial sequence
  SiRNA target sequence
ttgttaatgaagctattaaaccttt

SEQ ID NO: 191009 - DNA, 25 bp, Artificial sequence
  SiRNA target sequence
tgttaatgaagctattaaaccttta

SEQ ID NO: 191010 - DNA, 25 bp, Artificial sequence
  SiRNA target sequence
gttaatgaagctattaaacctttag

SEQ ID NO: 191011 - DNA, 25 bp, Artificial sequence
  SiRNA target sequence
ttaatgaagctattaaacctttaga

SEQ ID NO: 191012 - DNA, 25 bp, Artificial sequence
  SiRNA target sequence
taatgaagctattaaacctttagat

SEQ ID NO: 191013 - DNA, 25 bp, Artificial sequence
  SiRNA target sequence
aatgaagctattaaacctttagata

SEQ ID NO: 191014 - DNA, 25 bp, Artificial sequence
  SiRNA target sequence
atgaagctattaaacctttagatat

SEQ ID NO: 191015 - DNA, 25 bp, Artificial sequence
  SiRNA target sequence
tgaagctattaaacctttagatatt

SEQ ID NO: 191016 - DNA, 25 bp, Artificial sequence
  SiRNA target sequence
gaagctattaaacctttagatattc

SEQ ID NO: 191017 - DNA, 25 bp, Artificial sequence
  SiRNA target sequence
aagctattaaacctttagatattca

SEQ ID NO: 191018 - DNA, 25 bp, Artificial sequence
  SiRNA target sequence
agctattaaacctttagatattcat

SEQ ID NO: 191019 - DNA, 25 bp, Artificial sequence
  SiRNA target sequence
gctattaaacctttagatattcatc

SEQ ID NO: 191020 - DNA, 25 bp, Artificial sequence
  SiRNA target sequence
ctattaaacctttagatattcatca

SEQ ID NO: 191021 - DNA, 25 bp, Artificial sequence
  SiRNA target sequence
tattaaacctttagatattcatcat

SEQ ID NO: 191022 - DNA, 25 bp, Artificial sequence
  SiRNA target sequence
attaaacctttagatattcatcatt

SEQ ID NO: 191023 - DNA, 25 bp, Artificial sequence
  SiRNA target sequence
ttaaacctttagatattcatcattt

SEQ ID NO: 191024 - DNA, 25 bp, Artificial sequence
  SiRNA target sequence
taaacctttagatattcatcattta

SEQ ID NO: 191025 - DNA, 25 bp, Artificial sequence
  SiRNA target sequence
aaacctttagatattcatcatttat

SEQ ID NO: 191026 - DNA, 25 bp, Artificial sequence
  SiRNA target sequence
aacctttagatattcatcatttata

SEQ ID NO: 191027 - DNA, 25 bp, Artificial sequence
  SiRNA target sequence
acctttagatattcatcatttatac

SEQ ID NO: 191028 - DNA, 25 bp, Artificial sequence
  SiRNA target sequence
cctttagatattcatcatttatacg

SEQ ID NO: 191029 - DNA, 25 bp, Artificial sequence
  SiRNA target sequence
ctttagatattcatcatttatacga

SEQ ID NO: 191030 - DNA, 25 bp, Artificial sequence
  SiRNA target sequence
tttagatattcatcatttatacgac

SEQ ID NO: 191031 - DNA, 25 bp, Artificial sequence
  SiRNA target sequence
ttagatattcatcatttatacgacc

SEQ ID NO: 191032 - DNA, 25 bp, Artificial sequence
  SiRNA target sequence
tagatattcatcatttatacgacca

SEQ ID NO: 191033 - DNA, 25 bp, Artificial sequence
  SiRNA target sequence
agatattcatcatttatacgaccaa

SEQ ID NO: 191034 - DNA, 25 bp, Artificial sequence
  SiRNA target sequence
gatattcatcatttatacgaccaac

SEQ ID NO: 191035 - DNA, 25 bp, Artificial sequence
  SiRNA target sequence
atattcatcatttatacgaccaact

SEQ ID NO: 191036 - DNA, 25 bp, Artificial sequence
  SiRNA target sequence
tattcatcatttatacgaccaactt

SEQ ID NO: 191037 - DNA, 25 bp, Artificial sequence
  SiRNA target sequence
attcatcatttatacgaccaacttg

SEQ ID NO: 191038 - DNA, 25 bp, Artificial sequence
  SiRNA target sequence
ttcatcatttatacgaccaacttgt

SEQ ID NO: 191039 - DNA, 25 bp, Artificial sequence
  SiRNA target sequence
tcatcatttatacgaccaacttgta

SEQ ID NO: 191040 - DNA, 25 bp, Artificial sequence
  SiRNA target sequence
catcatttatacgaccaacttgtag

SEQ ID NO: 191041 - DNA, 25 bp, Artificial sequence
  SiRNA target sequence
atcatttatacgaccaacttgtaga

SEQ ID NO: 191042 - DNA, 25 bp, Artificial sequence
  SiRNA target sequence
tcatttatacgaccaacttgtagaa

SEQ ID NO: 191043 - DNA, 25 bp, Artificial sequence
  SiRNA target sequence
catttatacgaccaacttgtagaaa

SEQ ID NO: 191044 - DNA, 25 bp, Artificial sequence
  SiRNA target sequence
atttatacgaccaacttgtagaaaa

SEQ ID NO: 191045 - DNA, 25 bp, Artificial sequence
  SiRNA target sequence
tttatacgaccaacttgtagaaaac

SEQ ID NO: 191046 - DNA, 25 bp, Artificial sequence
  SiRNA target sequence
ttatacgaccaacttgtagaaaact

SEQ ID NO: 191047 - DNA, 25 bp, Artificial sequence
  SiRNA target sequence
tatacgaccaacttgtagaaaactt

SEQ ID NO: 191048 - DNA, 25 bp, Artificial sequence
  SiRNA target sequence
atacgaccaacttgtagaaaacttg

SEQ ID NO: 191049 - DNA, 25 bp, Artificial sequence
  SiRNA target sequence
tacgaccaacttgtagaaaacttga

SEQ ID NO: 191050 - DNA, 25 bp, Artificial sequence
  SiRNA target sequence
acgaccaacttgtagaaaacttgag

SEQ ID NO: 191051 - DNA, 25 bp, Artificial sequence
  SiRNA target sequence
cgaccaacttgtagaaaacttgagt

SEQ ID NO: 191052 - DNA, 25 bp, Artificial sequence
  SiRNA target sequence
gaccaacttgtagaaaacttgagtg

SEQ ID NO: 191053 - DNA, 25 bp, Artificial sequence
  SiRNA target sequence
accaacttgtagaaaacttgagtgg

SEQ ID NO: 191054 - DNA, 25 bp, Artificial sequence
  SiRNA target sequence
ccaacttgtagaaaacttgagtggt

SEQ ID NO: 191055 - DNA, 25 bp, Artificial sequence
  SiRNA target sequence
caacttgtagaaaacttgagtggtg

SEQ ID NO: 191056 - DNA, 25 bp, Artificial sequence
  SiRNA target sequence
aacttgtagaaaacttgagtggtgg

SEQ ID NO: 191057 - DNA, 25 bp, Artificial sequence
  SiRNA target sequence
acttgtagaaaacttgagtggtgga

SEQ ID NO: 191058 - DNA, 25 bp, Artificial sequence
  SiRNA target sequence
cttgtagaaaacttgagtggtggag

SEQ ID NO: 191059 - DNA, 25 bp, Artificial sequence
  SiRNA target sequence
ttgtagaaaacttgagtggtggaga

SEQ ID NO: 191060 - DNA, 25 bp, Artificial sequence
  SiRNA target sequence
tgtagaaaacttgagtggtggagaa

SEQ ID NO: 191061 - DNA, 25 bp, Artificial sequence
  SiRNA target sequence
gtagaaaacttgagtggtggagaat

SEQ ID NO: 191062 - DNA, 25 bp, Artificial sequence
  SiRNA target sequence
tagaaaacttgagtggtggagaatt

SEQ ID NO: 191063 - DNA, 25 bp, Artificial sequence
  SiRNA target sequence
agaaaacttgagtggtggagaatta

SEQ ID NO: 191064 - DNA, 25 bp, Artificial sequence
  SiRNA target sequence
gaaaacttgagtggtggagaattac

SEQ ID NO: 191065 - DNA, 25 bp, Artificial sequence
  SiRNA target sequence
aaaacttgagtggtggagaattaca

SEQ ID NO: 191066 - DNA, 25 bp, Artificial sequence
  SiRNA target sequence
aaacttgagtggtggagaattacaa

SEQ ID NO: 191067 - DNA, 25 bp, Artificial sequence
  SiRNA target sequence
aacttgagtggtggagaattacaaa

SEQ ID NO: 191068 - DNA, 25 bp, Artificial sequence
  SiRNA target sequence
acttgagtggtggagaattacaaag

SEQ ID NO: 191069 - DNA, 25 bp, Artificial sequence
  SiRNA target sequence
cttgagtggtggagaattacaaaga

SEQ ID NO: 191070 - DNA, 25 bp, Artificial sequence
  SiRNA target sequence
ttgagtggtggagaattacaaagaa

SEQ ID NO: 191071 - DNA, 25 bp, Artificial sequence
  SiRNA target sequence
tgagtggtggagaattacaaagaat

SEQ ID NO: 191072 - DNA, 25 bp, Artificial sequence
  SiRNA target sequence
gagtggtggagaattacaaagaatt

SEQ ID NO: 191073 - DNA, 25 bp, Artificial sequence
  SiRNA target sequence
agtggtggagaattacaaagaattg

SEQ ID NO: 191074 - DNA, 25 bp, Artificial sequence
  SiRNA target sequence
gtggtggagaattacaaagaattgc

SEQ ID NO: 191075 - DNA, 25 bp, Artificial sequence
  SiRNA target sequence
tggtggagaattacaaagaattgca

SEQ ID NO: 191076 - DNA, 25 bp, Artificial sequence
  SiRNA target sequence
ggtggagaattacaaagaattgcaa

SEQ ID NO: 191077 - DNA, 25 bp, Artificial sequence
  SiRNA target sequence
gtggagaattacaaagaattgcaat

SEQ ID NO: 191078 - DNA, 25 bp, Artificial sequence
  SiRNA target sequence
tggagaattacaaagaattgcaata

SEQ ID NO: 191079 - DNA, 25 bp, Artificial sequence
  SiRNA target sequence
ggagaattacaaagaattgcaataa

SEQ ID NO: 191080 - DNA, 25 bp, Artificial sequence
  SiRNA target sequence
gagaattacaaagaattgcaataat

SEQ ID NO: 191081 - DNA, 25 bp, Artificial sequence
  SiRNA target sequence
agaattacaaagaattgcaataata

SEQ ID NO: 191082 - DNA, 25 bp, Artificial sequence
  SiRNA target sequence
gaattacaaagaattgcaataataa

SEQ ID NO: 191083 - DNA, 25 bp, Artificial sequence
  SiRNA target sequence
aattacaaagaattgcaataataat

SEQ ID NO: 191084 - DNA, 25 bp, Artificial sequence
  SiRNA target sequence
attacaaagaattgcaataataata

SEQ ID NO: 191085 - DNA, 25 bp, Artificial sequence
  SiRNA target sequence
ttacaaagaattgcaataataatat

SEQ ID NO: 191086 - DNA, 25 bp, Artificial sequence
  SiRNA target sequence
tacaaagaattgcaataataatatg

SEQ ID NO: 191087 - DNA, 25 bp, Artificial sequence
  SiRNA target sequence
acaaagaattgcaataataatatgt

SEQ ID NO: 191088 - DNA, 25 bp, Artificial sequence
  SiRNA target sequence
caaagaattgcaataataatatgtt

SEQ ID NO: 191089 - DNA, 25 bp, Artificial sequence
  SiRNA target sequence
aaagaattgcaataataatatgttt

SEQ ID NO: 191090 - DNA, 25 bp, Artificial sequence
  SiRNA target sequence
aagaattgcaataataatatgttta

SEQ ID NO: 191091 - DNA, 25 bp, Artificial sequence
  SiRNA target sequence
agaattgcaataataatatgtttag

SEQ ID NO: 191092 - DNA, 25 bp, Artificial sequence
  SiRNA target sequence
gaattgcaataataatatgtttagg

SEQ ID NO: 191093 - DNA, 25 bp, Artificial sequence
  SiRNA target sequence
aattgcaataataatatgtttagga

SEQ ID NO: 191094 - DNA, 25 bp, Artificial sequence
  SiRNA target sequence
attgcaataataatatgtttaggaa

SEQ ID NO: 191095 - DNA, 25 bp, Artificial sequence
  SiRNA target sequence
ttgcaataataatatgtttaggaaa

SEQ ID NO: 191096 - DNA, 25 bp, Artificial sequence
  SiRNA target sequence
tgcaataataatatgtttaggaaaa

SEQ ID NO: 191097 - DNA, 25 bp, Artificial sequence
  SiRNA target sequence
gcaataataatatgtttaggaaaag

SEQ ID NO: 191098 - DNA, 25 bp, Artificial sequence
  SiRNA target sequence
caataataatatgtttaggaaaaga

SEQ ID NO: 191099 - DNA, 25 bp, Artificial sequence
  SiRNA target sequence
aataataatatgtttaggaaaagat

SEQ ID NO: 191100 - DNA, 25 bp, Artificial sequence
  SiRNA target sequence
ataataatatgtttaggaaaagatg

SEQ ID NO: 191101 - DNA, 25 bp, Artificial sequence
  SiRNA target sequence
taataatatgtttaggaaaagatgc

SEQ ID NO: 191102 - DNA, 25 bp, Artificial sequence
  SiRNA target sequence
aataatatgtttaggaaaagatgct

SEQ ID NO: 191103 - DNA, 25 bp, Artificial sequence
  SiRNA target sequence
ataatatgtttaggaaaagatgcta

SEQ ID NO: 191104 - DNA, 25 bp, Artificial sequence
  SiRNA target sequence
taatatgtttaggaaaagatgctaa

SEQ ID NO: 191105 - DNA, 25 bp, Artificial sequence
  SiRNA target sequence
aatatgtttaggaaaagatgctaac

SEQ ID NO: 191106 - DNA, 25 bp, Artificial sequence
  SiRNA target sequence
atatgtttaggaaaagatgctaacc

SEQ ID NO: 191107 - DNA, 25 bp, Artificial sequence
  SiRNA target sequence
tatgtttaggaaaagatgctaacct

SEQ ID NO: 191108 - DNA, 25 bp, Artificial sequence
  SiRNA target sequence
atgtttaggaaaagatgctaacctt

SEQ ID NO: 191109 - DNA, 25 bp, Artificial sequence
  SiRNA target sequence
tgtttaggaaaagatgctaaccttt

SEQ ID NO: 191110 - DNA, 25 bp, Artificial sequence
  SiRNA target sequence
gtttaggaaaagatgctaaccttta

SEQ ID NO: 191111 - DNA, 25 bp, Artificial sequence
  SiRNA target sequence
tttaggaaaagatgctaacctttat

SEQ ID NO: 191112 - DNA, 25 bp, Artificial sequence
  SiRNA target sequence
ttaggaaaagatgctaacctttatt

SEQ ID NO: 191113 - DNA, 25 bp, Artificial sequence
  SiRNA target sequence
taggaaaagatgctaacctttattt

SEQ ID NO: 191114 - DNA, 25 bp, Artificial sequence
  SiRNA target sequence
aggaaaagatgctaacctttattta

SEQ ID NO: 191115 - DNA, 25 bp, Artificial sequence
  SiRNA target sequence
ggaaaagatgctaacctttatttat

SEQ ID NO: 191116 - DNA, 25 bp, Artificial sequence
  SiRNA target sequence
gaaaagatgctaacctttatttatt

SEQ ID NO: 191117 - DNA, 25 bp, Artificial sequence
  SiRNA target sequence
aaaagatgctaacctttatttatta

SEQ ID NO: 191118 - DNA, 25 bp, Artificial sequence
  SiRNA target sequence
aaagatgctaacctttatttattag

SEQ ID NO: 191119 - DNA, 25 bp, Artificial sequence
  SiRNA target sequence
aagatgctaacctttatttattaga

SEQ ID NO: 191120 - DNA, 25 bp, Artificial sequence
  SiRNA target sequence
agatgctaacctttatttattagat

SEQ ID NO: 191121 - DNA, 25 bp, Artificial sequence
  SiRNA target sequence
gatgctaacctttatttattagatg

SEQ ID NO: 191122 - DNA, 25 bp, Artificial sequence
  SiRNA target sequence
atgctaacctttatttattagatga

SEQ ID NO: 191123 - DNA, 25 bp, Artificial sequence
  SiRNA target sequence
tgctaacctttatttattagatgaa

SEQ ID NO: 191124 - DNA, 25 bp, Artificial sequence
  SiRNA target sequence
gctaacctttatttattagatgaac

SEQ ID NO: 191125 - DNA, 25 bp, Artificial sequence
  SiRNA target sequence
ctaacctttatttattagatgaacc

SEQ ID NO: 191126 - DNA, 25 bp, Artificial sequence
  SiRNA target sequence
taacctttatttattagatgaacct

SEQ ID NO: 191127 - DNA, 25 bp, Artificial sequence
  SiRNA target sequence
aacctttatttattagatgaacctt

SEQ ID NO: 191128 - DNA, 25 bp, Artificial sequence
  SiRNA target sequence
acctttatttattagatgaaccttc

SEQ ID NO: 191129 - DNA, 25 bp, Artificial sequence
  SiRNA target sequence
cctttatttattagatgaaccttct

SEQ ID NO: 191130 - DNA, 25 bp, Artificial sequence
  SiRNA target sequence
ctttatttattagatgaaccttctg

SEQ ID NO: 191131 - DNA, 25 bp, Artificial sequence
  SiRNA target sequence
tttatttattagatgaaccttctgc

SEQ ID NO: 191132 - DNA, 25 bp, Artificial sequence
  SiRNA target sequence
ttatttattagatgaaccttctgcg

SEQ ID NO: 191133 - DNA, 25 bp, Artificial sequence
  SiRNA target sequence
tatttattagatgaaccttctgcgt

SEQ ID NO: 191134 - DNA, 25 bp, Artificial sequence
  SiRNA target sequence
atttattagatgaaccttctgcgta

SEQ ID NO: 191135 - DNA, 25 bp, Artificial sequence
  SiRNA target sequence
tttattagatgaaccttctgcgtat

SEQ ID NO: 191136 - DNA, 25 bp, Artificial sequence
  SiRNA target sequence
ttattagatgaaccttctgcgtatc

SEQ ID NO: 191137 - DNA, 25 bp, Artificial sequence
  SiRNA target sequence
tattagatgaaccttctgcgtatct

SEQ ID NO: 191138 - DNA, 25 bp, Artificial sequence
  SiRNA target sequence
attagatgaaccttctgcgtatcta

SEQ ID NO: 191139 - DNA, 25 bp, Artificial sequence
  SiRNA target sequence
ttagatgaaccttctgcgtatctag

SEQ ID NO: 191140 - DNA, 25 bp, Artificial sequence
  SiRNA target sequence
tagatgaaccttctgcgtatctaga

SEQ ID NO: 191141 - DNA, 25 bp, Artificial sequence
  SiRNA target sequence
agatgaaccttctgcgtatctagat

SEQ ID NO: 191142 - DNA, 25 bp, Artificial sequence
  SiRNA target sequence
gatgaaccttctgcgtatctagatt

SEQ ID NO: 191143 - DNA, 25 bp, Artificial sequence
  SiRNA target sequence
atgaaccttctgcgtatctagattc

SEQ ID NO: 191144 - DNA, 25 bp, Artificial sequence
  SiRNA target sequence
tgaaccttctgcgtatctagattca

SEQ ID NO: 191145 - DNA, 25 bp, Artificial sequence
  SiRNA target sequence
gaaccttctgcgtatctagattcag

SEQ ID NO: 191146 - DNA, 25 bp, Artificial sequence
  SiRNA target sequence
aaccttctgcgtatctagattcaga

SEQ ID NO: 191147 - DNA, 25 bp, Artificial sequence
  SiRNA target sequence
accttctgcgtatctagattcagat

SEQ ID NO: 191148 - DNA, 25 bp, Artificial sequence
  SiRNA target sequence
ccttctgcgtatctagattcagatc

SEQ ID NO: 191149 - DNA, 25 bp, Artificial sequence
  SiRNA target sequence
cttctgcgtatctagattcagatca

SEQ ID NO: 191150 - DNA, 25 bp, Artificial sequence
  SiRNA target sequence
ttctgcgtatctagattcagatcag

SEQ ID NO: 191151 - DNA, 25 bp, Artificial sequence
  SiRNA target sequence
tctgcgtatctagattcagatcaga

SEQ ID NO: 191152 - DNA, 25 bp, Artificial sequence
  SiRNA target sequence
ctgcgtatctagattcagatcagag

SEQ ID NO: 191153 - DNA, 25 bp, Artificial sequence
  SiRNA target sequence
tgcgtatctagattcagatcagaga

SEQ ID NO: 191154 - DNA, 25 bp, Artificial sequence
  SiRNA target sequence
gcgtatctagattcagatcagagaa

SEQ ID NO: 191155 - DNA, 25 bp, Artificial sequence
  SiRNA target sequence
cgtatctagattcagatcagagaat

SEQ ID NO: 191156 - DNA, 25 bp, Artificial sequence
  SiRNA target sequence
gtatctagattcagatcagagaata

SEQ ID NO: 191157 - DNA, 25 bp, Artificial sequence
  SiRNA target sequence
tatctagattcagatcagagaatag

SEQ ID NO: 191158 - DNA, 25 bp, Artificial sequence
  SiRNA target sequence
atctagattcagatcagagaatagc

SEQ ID NO: 191159 - DNA, 25 bp, Artificial sequence
  SiRNA target sequence
tctagattcagatcagagaatagcg

SEQ ID NO: 191160 - DNA, 25 bp, Artificial sequence
  SiRNA target sequence
ctagattcagatcagagaatagcga

SEQ ID NO: 191161 - DNA, 25 bp, Artificial sequence
  SiRNA target sequence
tagattcagatcagagaatagcgat

SEQ ID NO: 191162 - DNA, 25 bp, Artificial sequence
  SiRNA target sequence
agattcagatcagagaatagcgatt

SEQ ID NO: 191163 - DNA, 25 bp, Artificial sequence
  SiRNA target sequence
gattcagatcagagaatagcgattt

SEQ ID NO: 191164 - DNA, 25 bp, Artificial sequence
  SiRNA target sequence
attcagatcagagaatagcgatttc

SEQ ID NO: 191165 - DNA, 25 bp, Artificial sequence
  SiRNA target sequence
ttcagatcagagaatagcgatttca

SEQ ID NO: 191166 - DNA, 25 bp, Artificial sequence
  SiRNA target sequence
tcagatcagagaatagcgatttcaa

SEQ ID NO: 191167 - DNA, 25 bp, Artificial sequence
  SiRNA target sequence
cagatcagagaatagcgatttcaaa

SEQ ID NO: 191168 - DNA, 25 bp, Artificial sequence
  SiRNA target sequence
agatcagagaatagcgatttcaaaa

SEQ ID NO: 191169 - DNA, 25 bp, Artificial sequence
  SiRNA target sequence
gatcagagaatagcgatttcaaaag

SEQ ID NO: 191170 - DNA, 25 bp, Artificial sequence
  SiRNA target sequence
atcagagaatagcgatttcaaaagt

SEQ ID NO: 191171 - DNA, 25 bp, Artificial sequence
  SiRNA target sequence
tcagagaatagcgatttcaaaagtt

SEQ ID NO: 191172 - DNA, 25 bp, Artificial sequence
  SiRNA target sequence
cagagaatagcgatttcaaaagtta

SEQ ID NO: 191173 - DNA, 25 bp, Artificial sequence
  SiRNA target sequence
agagaatagcgatttcaaaagttat

SEQ ID NO: 191174 - DNA, 25 bp, Artificial sequence
  SiRNA target sequence
gagaatagcgatttcaaaagttata

SEQ ID NO: 191175 - DNA, 25 bp, Artificial sequence
  SiRNA target sequence
agaatagcgatttcaaaagttataa

SEQ ID NO: 191176 - DNA, 25 bp, Artificial sequence
  SiRNA target sequence
gaatagcgatttcaaaagttataaa

SEQ ID NO: 191177 - DNA, 25 bp, Artificial sequence
  SiRNA target sequence
aatagcgatttcaaaagttataaaa

SEQ ID NO: 191178 - DNA, 25 bp, Artificial sequence
  SiRNA target sequence
atagcgatttcaaaagttataaaaa

SEQ ID NO: 191179 - DNA, 25 bp, Artificial sequence
  SiRNA target sequence
tagcgatttcaaaagttataaaaag

SEQ ID NO: 191180 - DNA, 25 bp, Artificial sequence
  SiRNA target sequence
agcgatttcaaaagttataaaaagg

SEQ ID NO: 191181 - DNA, 25 bp, Artificial sequence
  SiRNA target sequence
gcgatttcaaaagttataaaaaggt

SEQ ID NO: 191182 - DNA, 25 bp, Artificial sequence
  SiRNA target sequence
cgatttcaaaagttataaaaaggtt

SEQ ID NO: 191183 - DNA, 25 bp, Artificial sequence
  SiRNA target sequence
gatttcaaaagttataaaaaggttt

SEQ ID NO: 191184 - DNA, 25 bp, Artificial sequence
  SiRNA target sequence
atttcaaaagttataaaaaggttta

SEQ ID NO: 191185 - DNA, 25 bp, Artificial sequence
  SiRNA target sequence
tttcaaaagttataaaaaggtttat

SEQ ID NO: 191186 - DNA, 25 bp, Artificial sequence
  SiRNA target sequence
ttcaaaagttataaaaaggtttatt

SEQ ID NO: 191187 - DNA, 25 bp, Artificial sequence
  SiRNA target sequence
tcaaaagttataaaaaggtttattt

SEQ ID NO: 191188 - DNA, 25 bp, Artificial sequence
  SiRNA target sequence
caaaagttataaaaaggtttattta

SEQ ID NO: 191189 - DNA, 25 bp, Artificial sequence
  SiRNA target sequence
aaaagttataaaaaggtttatttat

SEQ ID NO: 191190 - DNA, 25 bp, Artificial sequence
  SiRNA target sequence
aaagttataaaaaggtttatttatg

SEQ ID NO: 191191 - DNA, 25 bp, Artificial sequence
  SiRNA target sequence
aagttataaaaaggtttatttatgg

SEQ ID NO: 191192 - DNA, 25 bp, Artificial sequence
  SiRNA target sequence
agttataaaaaggtttatttatggg

SEQ ID NO: 191193 - DNA, 25 bp, Artificial sequence
  SiRNA target sequence
gttataaaaaggtttatttatggga

SEQ ID NO: 191194 - DNA, 25 bp, Artificial sequence
  SiRNA target sequence
ttataaaaaggtttatttatgggaa

SEQ ID NO: 191195 - DNA, 25 bp, Artificial sequence
  SiRNA target sequence
tataaaaaggtttatttatgggaag

SEQ ID NO: 191196 - DNA, 25 bp, Artificial sequence
  SiRNA target sequence
ataaaaaggtttatttatgggaaga

SEQ ID NO: 191197 - DNA, 25 bp, Artificial sequence
  SiRNA target sequence
taaaaaggtttatttatgggaagaa

SEQ ID NO: 191198 - DNA, 25 bp, Artificial sequence
  SiRNA target sequence
aaaaaggtttatttatgggaagaag

SEQ ID NO: 191199 - DNA, 25 bp, Artificial sequence
  SiRNA target sequence
aaaaggtttatttatgggaagaagc

SEQ ID NO: 191200 - DNA, 25 bp, Artificial sequence
  SiRNA target sequence
aaaggtttatttatgggaagaagcg

SEQ ID NO: 191201 - DNA, 25 bp, Artificial sequence
  SiRNA target sequence
aaggtttatttatgggaagaagcga

SEQ ID NO: 191202 - DNA, 25 bp, Artificial sequence
  SiRNA target sequence
aggtttatttatgggaagaagcgaa

SEQ ID NO: 191203 - DNA, 25 bp, Artificial sequence
  SiRNA target sequence
ggtttatttatgggaagaagcgaac

SEQ ID NO: 191204 - DNA, 25 bp, Artificial sequence
  SiRNA target sequence
gtttatttatgggaagaagcgaaca

SEQ ID NO: 191205 - DNA, 25 bp, Artificial sequence
  SiRNA target sequence
tttatttatgggaagaagcgaacag

SEQ ID NO: 191206 - DNA, 25 bp, Artificial sequence
  SiRNA target sequence
ttatttatgggaagaagcgaacagc

SEQ ID NO: 191207 - DNA, 25 bp, Artificial sequence
  SiRNA target sequence
tatttatgggaagaagcgaacagcc

SEQ ID NO: 191208 - DNA, 25 bp, Artificial sequence
  SiRNA target sequence
atttatgggaagaagcgaacagcct

SEQ ID NO: 191209 - DNA, 25 bp, Artificial sequence
  SiRNA target sequence
tttatgggaagaagcgaacagcctt

SEQ ID NO: 191210 - DNA, 25 bp, Artificial sequence
  SiRNA target sequence
ttatgggaagaagcgaacagccttt

SEQ ID NO: 191211 - DNA, 25 bp, Artificial sequence
  SiRNA target sequence
tatgggaagaagcgaacagcctttg

SEQ ID NO: 191212 - DNA, 25 bp, Artificial sequence
  SiRNA target sequence
atgggaagaagcgaacagcctttgt

SEQ ID NO: 191213 - DNA, 25 bp, Artificial sequence
  SiRNA target sequence
tgggaagaagcgaacagcctttgtg

SEQ ID NO: 191214 - DNA, 25 bp, Artificial sequence
  SiRNA target sequence
gggaagaagcgaacagcctttgtgg

SEQ ID NO: 191215 - DNA, 25 bp, Artificial sequence
  SiRNA target sequence
ggaagaagcgaacagcctttgtggt

SEQ ID NO: 191216 - DNA, 25 bp, Artificial sequence
  SiRNA target sequence
gaagaagcgaacagcctttgtggtt

SEQ ID NO: 191217 - DNA, 25 bp, Artificial sequence
  SiRNA target sequence
aagaagcgaacagcctttgtggttg

SEQ ID NO: 191218 - DNA, 25 bp, Artificial sequence
  SiRNA target sequence
agaagcgaacagcctttgtggttga

SEQ ID NO: 191219 - DNA, 25 bp, Artificial sequence
  SiRNA target sequence
gaagcgaacagcctttgtggttgaa

SEQ ID NO: 191220 - DNA, 25 bp, Artificial sequence
  SiRNA target sequence
aagcgaacagcctttgtggttgaac

SEQ ID NO: 191221 - DNA, 25 bp, Artificial sequence
  SiRNA target sequence
agcgaacagcctttgtggttgaaca

SEQ ID NO: 191222 - DNA, 25 bp, Artificial sequence
  SiRNA target sequence
gcgaacagcctttgtggttgaacat

SEQ ID NO: 191223 - DNA, 25 bp, Artificial sequence
  SiRNA target sequence
cgaacagcctttgtggttgaacatg

SEQ ID NO: 191224 - DNA, 25 bp, Artificial sequence
  SiRNA target sequence
gaacagcctttgtggttgaacatga

SEQ ID NO: 191225 - DNA, 25 bp, Artificial sequence
  SiRNA target sequence
aacagcctttgtggttgaacatgat

SEQ ID NO: 191226 - DNA, 25 bp, Artificial sequence
  SiRNA target sequence
acagcctttgtggttgaacatgatt

SEQ ID NO: 191227 - DNA, 25 bp, Artificial sequence
  SiRNA target sequence
cagcctttgtggttgaacatgattt

SEQ ID NO: 191228 - DNA, 25 bp, Artificial sequence
  SiRNA target sequence
agcctttgtggttgaacatgattta

SEQ ID NO: 191229 - DNA, 25 bp, Artificial sequence
  SiRNA target sequence
gcctttgtggttgaacatgatttaa

SEQ ID NO: 191230 - DNA, 25 bp, Artificial sequence
  SiRNA target sequence
cctttgtggttgaacatgatttaat

SEQ ID NO: 191231 - DNA, 25 bp, Artificial sequence
  SiRNA target sequence
ctttgtggttgaacatgatttaatt

SEQ ID NO: 191232 - DNA, 25 bp, Artificial sequence
  SiRNA target sequence
tttgtggttgaacatgatttaattg

SEQ ID NO: 191233 - DNA, 25 bp, Artificial sequence
  SiRNA target sequence
ttgtggttgaacatgatttaattgt

SEQ ID NO: 191234 - DNA, 25 bp, Artificial sequence
  SiRNA target sequence
tgtggttgaacatgatttaattgta

SEQ ID NO: 191235 - DNA, 25 bp, Artificial sequence
  SiRNA target sequence
gtggttgaacatgatttaattgtag

SEQ ID NO: 191236 - DNA, 25 bp, Artificial sequence
  SiRNA target sequence
tggttgaacatgatttaattgtagg

SEQ ID NO: 191237 - DNA, 25 bp, Artificial sequence
  SiRNA target sequence
ggttgaacatgatttaattgtaggt

SEQ ID NO: 191238 - DNA, 25 bp, Artificial sequence
  SiRNA target sequence
gttgaacatgatttaattgtaggta

SEQ ID NO: 191239 - DNA, 25 bp, Artificial sequence
  SiRNA target sequence
ttgaacatgatttaattgtaggtac

SEQ ID NO: 191240 - DNA, 25 bp, Artificial sequence
  SiRNA target sequence
tgaacatgatttaattgtaggtaca

SEQ ID NO: 191241 - DNA, 25 bp, Artificial sequence
  SiRNA target sequence
gaacatgatttaattgtaggtacat

SEQ ID NO: 191242 - DNA, 25 bp, Artificial sequence
  SiRNA target sequence
aacatgatttaattgtaggtacata

SEQ ID NO: 191243 - DNA, 25 bp, Artificial sequence
  SiRNA target sequence
acatgatttaattgtaggtacatat

SEQ ID NO: 191244 - DNA, 25 bp, Artificial sequence
  SiRNA target sequence
catgatttaattgtaggtacatatt

SEQ ID NO: 191245 - DNA, 25 bp, Artificial sequence
  SiRNA target sequence
atgatttaattgtaggtacatattt

SEQ ID NO: 191246 - DNA, 25 bp, Artificial sequence
  SiRNA target sequence
tgatttaattgtaggtacatatttg

SEQ ID NO: 191247 - DNA, 25 bp, Artificial sequence
  SiRNA target sequence
gatttaattgtaggtacatatttgg

SEQ ID NO: 191248 - DNA, 25 bp, Artificial sequence
  SiRNA target sequence
atttaattgtaggtacatatttggc

SEQ ID NO: 191249 - DNA, 25 bp, Artificial sequence
  SiRNA target sequence
tttaattgtaggtacatatttggct

SEQ ID NO: 191250 - DNA, 25 bp, Artificial sequence
  SiRNA target sequence
ttaattgtaggtacatatttggctg

SEQ ID NO: 191251 - DNA, 25 bp, Artificial sequence
  SiRNA target sequence
taattgtaggtacatatttggctga

SEQ ID NO: 191252 - DNA, 25 bp, Artificial sequence
  SiRNA target sequence
aattgtaggtacatatttggctgat

SEQ ID NO: 191253 - DNA, 25 bp, Artificial sequence
  SiRNA target sequence
attgtaggtacatatttggctgata

SEQ ID NO: 191254 - DNA, 25 bp, Artificial sequence
  SiRNA target sequence
ttgtaggtacatatttggctgataa

SEQ ID NO: 191255 - DNA, 25 bp, Artificial sequence
  SiRNA target sequence
tgtaggtacatatttggctgataaa

SEQ ID NO: 191256 - DNA, 25 bp, Artificial sequence
  SiRNA target sequence
gtaggtacatatttggctgataaag

SEQ ID NO: 191257 - DNA, 25 bp, Artificial sequence
  SiRNA target sequence
taggtacatatttggctgataaagt

SEQ ID NO: 191258 - DNA, 25 bp, Artificial sequence
  SiRNA target sequence
aggtacatatttggctgataaagtt

SEQ ID NO: 191259 - DNA, 25 bp, Artificial sequence
  SiRNA target sequence
ggtacatatttggctgataaagttg

SEQ ID NO: 191260 - DNA, 25 bp, Artificial sequence
  SiRNA target sequence
gtacatatttggctgataaagttgt

SEQ ID NO: 191261 - DNA, 25 bp, Artificial sequence
  SiRNA target sequence
tacatatttggctgataaagttgtt

SEQ ID NO: 191262 - DNA, 25 bp, Artificial sequence
  SiRNA target sequence
acatatttggctgataaagttgttg

SEQ ID NO: 191263 - DNA, 25 bp, Artificial sequence
  SiRNA target sequence
catatttggctgataaagttgttgt

SEQ ID NO: 191264 - DNA, 25 bp, Artificial sequence
  SiRNA target sequence
atatttggctgataaagttgttgtt

SEQ ID NO: 191265 - DNA, 25 bp, Artificial sequence
  SiRNA target sequence
tatttggctgataaagttgttgttt

SEQ ID NO: 191266 - DNA, 25 bp, Artificial sequence
  SiRNA target sequence
atttggctgataaagttgttgtttt

SEQ ID NO: 191267 - DNA, 25 bp, Artificial sequence
  SiRNA target sequence
tttggctgataaagttgttgttttt

SEQ ID NO: 191268 - DNA, 25 bp, Artificial sequence
  SiRNA target sequence
ttggctgataaagttgttgtttttg

SEQ ID NO: 191269 - DNA, 25 bp, Artificial sequence
  SiRNA target sequence
tggctgataaagttgttgtttttga

SEQ ID NO: 191270 - DNA, 25 bp, Artificial sequence
  SiRNA target sequence
ggctgataaagttgttgtttttgag

SEQ ID NO: 191271 - DNA, 25 bp, Artificial sequence
  SiRNA target sequence
gctgataaagttgttgtttttgagg

SEQ ID NO: 191272 - DNA, 25 bp, Artificial sequence
  SiRNA target sequence
ctgataaagttgttgtttttgaggg

SEQ ID NO: 191273 - DNA, 25 bp, Artificial sequence
  SiRNA target sequence
tgataaagttgttgtttttgaggga

SEQ ID NO: 191274 - DNA, 25 bp, Artificial sequence
  SiRNA target sequence
gataaagttgttgtttttgagggaa

SEQ ID NO: 191275 - DNA, 25 bp, Artificial sequence
  SiRNA target sequence
ataaagttgttgtttttgagggaag

SEQ ID NO: 191276 - DNA, 25 bp, Artificial sequence
  SiRNA target sequence
taaagttgttgtttttgagggaagc

SEQ ID NO: 191277 - DNA, 25 bp, Artificial sequence
  SiRNA target sequence
aaagttgttgtttttgagggaagcc

SEQ ID NO: 191278 - DNA, 25 bp, Artificial sequence
  SiRNA target sequence
aagttgttgtttttgagggaagccc

SEQ ID NO: 191279 - DNA, 25 bp, Artificial sequence
  SiRNA target sequence
agttgttgtttttgagggaagccct

SEQ ID NO: 191280 - DNA, 25 bp, Artificial sequence
  SiRNA target sequence
gttgttgtttttgagggaagcccta

SEQ ID NO: 191281 - DNA, 25 bp, Artificial sequence
  SiRNA target sequence
ttgttgtttttgagggaagccctag

SEQ ID NO: 191282 - DNA, 25 bp, Artificial sequence
  SiRNA target sequence
tgttgtttttgagggaagccctagt

SEQ ID NO: 191283 - DNA, 25 bp, Artificial sequence
  SiRNA target sequence
gttgtttttgagggaagccctagtg

SEQ ID NO: 191284 - DNA, 25 bp, Artificial sequence
  SiRNA target sequence
ttgtttttgagggaagccctagtgt

SEQ ID NO: 191285 - DNA, 25 bp, Artificial sequence
  SiRNA target sequence
tgtttttgagggaagccctagtgtt

SEQ ID NO: 191286 - DNA, 25 bp, Artificial sequence
  SiRNA target sequence
gtttttgagggaagccctagtgttc

SEQ ID NO: 191287 - DNA, 25 bp, Artificial sequence
  SiRNA target sequence
tttttgagggaagccctagtgttca

SEQ ID NO: 191288 - DNA, 25 bp, Artificial sequence
  SiRNA target sequence
ttttgagggaagccctagtgttcat

SEQ ID NO: 191289 - DNA, 25 bp, Artificial sequence
  SiRNA target sequence
tttgagggaagccctagtgttcata

SEQ ID NO: 191290 - DNA, 25 bp, Artificial sequence
  SiRNA target sequence
ttgagggaagccctagtgttcatag

SEQ ID NO: 191291 - DNA, 25 bp, Artificial sequence
  SiRNA target sequence
tgagggaagccctagtgttcatagc

SEQ ID NO: 191292 - DNA, 25 bp, Artificial sequence
  SiRNA target sequence
gagggaagccctagtgttcatagca

SEQ ID NO: 191293 - DNA, 25 bp, Artificial sequence
  SiRNA target sequence
agggaagccctagtgttcatagcac

SEQ ID NO: 191294 - DNA, 25 bp, Artificial sequence
  SiRNA target sequence
gggaagccctagtgttcatagcact

SEQ ID NO: 191295 - DNA, 25 bp, Artificial sequence
  SiRNA target sequence
ggaagccctagtgttcatagcactg

SEQ ID NO: 191296 - DNA, 25 bp, Artificial sequence
  SiRNA target sequence
gaagccctagtgttcatagcactgc

SEQ ID NO: 191297 - DNA, 25 bp, Artificial sequence
  SiRNA target sequence
aagccctagtgttcatagcactgct

SEQ ID NO: 191298 - DNA, 25 bp, Artificial sequence
  SiRNA target sequence
agccctagtgttcatagcactgctc

SEQ ID NO: 191299 - DNA, 25 bp, Artificial sequence
  SiRNA target sequence
gccctagtgttcatagcactgctca

SEQ ID NO: 191300 - DNA, 25 bp, Artificial sequence
  SiRNA target sequence
ccctagtgttcatagcactgctcat

SEQ ID NO: 191301 - DNA, 25 bp, Artificial sequence
  SiRNA target sequence
cctagtgttcatagcactgctcata

SEQ ID NO: 191302 - DNA, 25 bp, Artificial sequence
  SiRNA target sequence
ctagtgttcatagcactgctcataa

SEQ ID NO: 191303 - DNA, 25 bp, Artificial sequence
  SiRNA target sequence
tagtgttcatagcactgctcataaa

SEQ ID NO: 191304 - DNA, 25 bp, Artificial sequence
  SiRNA target sequence
agtgttcatagcactgctcataaac

SEQ ID NO: 191305 - DNA, 25 bp, Artificial sequence
  SiRNA target sequence
gtgttcatagcactgctcataaacc

SEQ ID NO: 191306 - DNA, 25 bp, Artificial sequence
  SiRNA target sequence
tgttcatagcactgctcataaaccg

SEQ ID NO: 191307 - DNA, 25 bp, Artificial sequence
  SiRNA target sequence
gttcatagcactgctcataaaccga

SEQ ID NO: 191308 - DNA, 25 bp, Artificial sequence
  SiRNA target sequence
ttcatagcactgctcataaaccgat

SEQ ID NO: 191309 - DNA, 25 bp, Artificial sequence
  SiRNA target sequence
tcatagcactgctcataaaccgatg

SEQ ID NO: 191310 - DNA, 25 bp, Artificial sequence
  SiRNA target sequence
catagcactgctcataaaccgatgg

SEQ ID NO: 191311 - DNA, 25 bp, Artificial sequence
  SiRNA target sequence
atagcactgctcataaaccgatgga

SEQ ID NO: 191312 - DNA, 25 bp, Artificial sequence
  SiRNA target sequence
tagcactgctcataaaccgatggat

SEQ ID NO: 191313 - DNA, 25 bp, Artificial sequence
  SiRNA target sequence
agcactgctcataaaccgatggatt

SEQ ID NO: 191314 - DNA, 25 bp, Artificial sequence
  SiRNA target sequence
gcactgctcataaaccgatggattt

SEQ ID NO: 191315 - DNA, 25 bp, Artificial sequence
  SiRNA target sequence
cactgctcataaaccgatggatttg

SEQ ID NO: 191316 - DNA, 25 bp, Artificial sequence
  SiRNA target sequence
actgctcataaaccgatggatttgc

SEQ ID NO: 191317 - DNA, 25 bp, Artificial sequence
  SiRNA target sequence
ctgctcataaaccgatggatttgca

SEQ ID NO: 191318 - DNA, 25 bp, Artificial sequence
  SiRNA target sequence
tgctcataaaccgatggatttgcat

SEQ ID NO: 191319 - DNA, 25 bp, Artificial sequence
  SiRNA target sequence
gctcataaaccgatggatttgcata

SEQ ID NO: 191320 - DNA, 25 bp, Artificial sequence
  SiRNA target sequence
ctcataaaccgatggatttgcatag

SEQ ID NO: 191321 - DNA, 25 bp, Artificial sequence
  SiRNA target sequence
tcataaaccgatggatttgcatagt

SEQ ID NO: 191322 - DNA, 25 bp, Artificial sequence
  SiRNA target sequence
cataaaccgatggatttgcatagtg

SEQ ID NO: 191323 - DNA, 25 bp, Artificial sequence
  SiRNA target sequence
ataaaccgatggatttgcatagtgg

SEQ ID NO: 191324 - DNA, 25 bp, Artificial sequence
  SiRNA target sequence
taaaccgatggatttgcatagtgga

SEQ ID NO: 191325 - DNA, 25 bp, Artificial sequence
  SiRNA target sequence
aaaccgatggatttgcatagtggaa

SEQ ID NO: 191326 - DNA, 25 bp, Artificial sequence
  SiRNA target sequence
aaccgatggatttgcatagtggaat

SEQ ID NO: 191327 - DNA, 25 bp, Artificial sequence
  SiRNA target sequence
accgatggatttgcatagtggaatg

SEQ ID NO: 191328 - DNA, 25 bp, Artificial sequence
  SiRNA target sequence
ccgatggatttgcatagtggaatga

SEQ ID NO: 191329 - DNA, 25 bp, Artificial sequence
  SiRNA target sequence
cgatggatttgcatagtggaatgaa

SEQ ID NO: 191330 - DNA, 25 bp, Artificial sequence
  SiRNA target sequence
gatggatttgcatagtggaatgaat

SEQ ID NO: 191331 - DNA, 25 bp, Artificial sequence
  SiRNA target sequence
atggatttgcatagtggaatgaata

SEQ ID NO: 191332 - DNA, 25 bp, Artificial sequence
  SiRNA target sequence
tggatttgcatagtggaatgaatat

SEQ ID NO: 191333 - DNA, 25 bp, Artificial sequence
  SiRNA target sequence
ggatttgcatagtggaatgaatatt

SEQ ID NO: 191334 - DNA, 25 bp, Artificial sequence
  SiRNA target sequence
gatttgcatagtggaatgaatattt

SEQ ID NO: 191335 - DNA, 25 bp, Artificial sequence
  SiRNA target sequence
atttgcatagtggaatgaatatttt

SEQ ID NO: 191336 - DNA, 25 bp, Artificial sequence
  SiRNA target sequence
tttgcatagtggaatgaatattttt

SEQ ID NO: 191337 - DNA, 25 bp, Artificial sequence
  SiRNA target sequence
ttgcatagtggaatgaatatttttt

SEQ ID NO: 191338 - DNA, 25 bp, Artificial sequence
  SiRNA target sequence
tgcatagtggaatgaatattttttt

SEQ ID NO: 191339 - DNA, 25 bp, Artificial sequence
  SiRNA target sequence
gcatagtggaatgaatattttttta

SEQ ID NO: 191340 - DNA, 25 bp, Artificial sequence
  SiRNA target sequence
catagtggaatgaatatttttttaa

SEQ ID NO: 191341 - DNA, 25 bp, Artificial sequence
  SiRNA target sequence
atagtggaatgaatatttttttaaa

SEQ ID NO: 191342 - DNA, 25 bp, Artificial sequence
  SiRNA target sequence
tagtggaatgaatatttttttaaag

SEQ ID NO: 191343 - DNA, 25 bp, Artificial sequence
  SiRNA target sequence
agtggaatgaatatttttttaaaga

SEQ ID NO: 191344 - DNA, 25 bp, Artificial sequence
  SiRNA target sequence
gtggaatgaatatttttttaaagaa

SEQ ID NO: 191345 - DNA, 25 bp, Artificial sequence
  SiRNA target sequence
tggaatgaatatttttttaaagaat

SEQ ID NO: 191346 - DNA, 25 bp, Artificial sequence
  SiRNA target sequence
ggaatgaatatttttttaaagaatc

SEQ ID NO: 191347 - DNA, 25 bp, Artificial sequence
  SiRNA target sequence
gaatgaatatttttttaaagaatct

SEQ ID NO: 191348 - DNA, 25 bp, Artificial sequence
  SiRNA target sequence
aatgaatatttttttaaagaatctt

SEQ ID NO: 191349 - DNA, 25 bp, Artificial sequence
  SiRNA target sequence
atgaatatttttttaaagaatcttg

SEQ ID NO: 191350 - DNA, 25 bp, Artificial sequence
  SiRNA target sequence
tgaatatttttttaaagaatcttga

SEQ ID NO: 191351 - DNA, 25 bp, Artificial sequence
  SiRNA target sequence
gaatatttttttaaagaatcttgat

SEQ ID NO: 191352 - DNA, 25 bp, Artificial sequence
  SiRNA target sequence
aatatttttttaaagaatcttgata

SEQ ID NO: 191353 - DNA, 25 bp, Artificial sequence
  SiRNA target sequence
atatttttttaaagaatcttgatat

SEQ ID NO: 191354 - DNA, 25 bp, Artificial sequence
  SiRNA target sequence
tatttttttaaagaatcttgatatt

SEQ ID NO: 191355 - DNA, 25 bp, Artificial sequence
  SiRNA target sequence
atttttttaaagaatcttgatatta

SEQ ID NO: 191356 - DNA, 25 bp, Artificial sequence
  SiRNA target sequence
tttttttaaagaatcttgatattac

SEQ ID NO: 191357 - DNA, 25 bp, Artificial sequence
  SiRNA target sequence
ttttttaaagaatcttgatattact

SEQ ID NO: 191358 - DNA, 25 bp, Artificial sequence
  SiRNA target sequence
tttttaaagaatcttgatattactt

SEQ ID NO: 191359 - DNA, 25 bp, Artificial sequence
  SiRNA target sequence
ttttaaagaatcttgatattacttt

SEQ ID NO: 191360 - DNA, 25 bp, Artificial sequence
  SiRNA target sequence
tttaaagaatcttgatattactttt

SEQ ID NO: 191361 - DNA, 25 bp, Artificial sequence
  SiRNA target sequence
ttaaagaatcttgatattactttta

SEQ ID NO: 191362 - DNA, 25 bp, Artificial sequence
  SiRNA target sequence
taaagaatcttgatattacttttag

SEQ ID NO: 191363 - DNA, 25 bp, Artificial sequence
  SiRNA target sequence
aaagaatcttgatattacttttaga

SEQ ID NO: 191364 - DNA, 25 bp, Artificial sequence
  SiRNA target sequence
aagaatcttgatattacttttagaa

SEQ ID NO: 191365 - DNA, 25 bp, Artificial sequence
  SiRNA target sequence
agaatcttgatattacttttagaag

SEQ ID NO: 191366 - DNA, 25 bp, Artificial sequence
  SiRNA target sequence
gaatcttgatattacttttagaaga

SEQ ID NO: 191367 - DNA, 25 bp, Artificial sequence
  SiRNA target sequence
aatcttgatattacttttagaagag

SEQ ID NO: 191368 - DNA, 25 bp, Artificial sequence
  SiRNA target sequence
atcttgatattacttttagaagaga

SEQ ID NO: 191369 - DNA, 25 bp, Artificial sequence
  SiRNA target sequence
tcttgatattacttttagaagagac

SEQ ID NO: 191370 - DNA, 25 bp, Artificial sequence
  SiRNA target sequence
cttgatattacttttagaagagact

SEQ ID NO: 191371 - DNA, 25 bp, Artificial sequence
  SiRNA target sequence
ttgatattacttttagaagagactc

SEQ ID NO: 191372 - DNA, 25 bp, Artificial sequence
  SiRNA target sequence
tgatattacttttagaagagactct

SEQ ID NO: 191373 - DNA, 25 bp, Artificial sequence
  SiRNA target sequence
gatattacttttagaagagactctt

SEQ ID NO: 191374 - DNA, 25 bp, Artificial sequence
  SiRNA target sequence
atattacttttagaagagactcttc

SEQ ID NO: 191375 - DNA, 25 bp, Artificial sequence
  SiRNA target sequence
tattacttttagaagagactcttcc

SEQ ID NO: 191376 - DNA, 25 bp, Artificial sequence
  SiRNA target sequence
attacttttagaagagactcttcca

SEQ ID NO: 191377 - DNA, 25 bp, Artificial sequence
  SiRNA target sequence
ttacttttagaagagactcttccaa

SEQ ID NO: 191378 - DNA, 25 bp, Artificial sequence
  SiRNA target sequence
tacttttagaagagactcttccaat

SEQ ID NO: 191379 - DNA, 25 bp, Artificial sequence
  SiRNA target sequence
acttttagaagagactcttccaatt

SEQ ID NO: 191380 - DNA, 25 bp, Artificial sequence
  SiRNA target sequence
cttttagaagagactcttccaattt

SEQ ID NO: 191381 - DNA, 25 bp, Artificial sequence
  SiRNA target sequence
ttttagaagagactcttccaatttt

SEQ ID NO: 191382 - DNA, 25 bp, Artificial sequence
  SiRNA target sequence
tttagaagagactcttccaatttta

SEQ ID NO: 191383 - DNA, 25 bp, Artificial sequence
  SiRNA target sequence
ttagaagagactcttccaattttag

SEQ ID NO: 191384 - DNA, 25 bp, Artificial sequence
  SiRNA target sequence
tagaagagactcttccaattttaga

SEQ ID NO: 191385 - DNA, 25 bp, Artificial sequence
  SiRNA target sequence
agaagagactcttccaattttagac

SEQ ID NO: 191386 - DNA, 25 bp, Artificial sequence
  SiRNA target sequence
gaagagactcttccaattttagacc

SEQ ID NO: 191387 - DNA, 25 bp, Artificial sequence
  SiRNA target sequence
aagagactcttccaattttagacca

SEQ ID NO: 191388 - DNA, 25 bp, Artificial sequence
  SiRNA target sequence
agagactcttccaattttagaccaa

SEQ ID NO: 191389 - DNA, 25 bp, Artificial sequence
  SiRNA target sequence
gagactcttccaattttagaccaag

SEQ ID NO: 191390 - DNA, 25 bp, Artificial sequence
  SiRNA target sequence
agactcttccaattttagaccaaga

SEQ ID NO: 191391 - DNA, 25 bp, Artificial sequence
  SiRNA target sequence
gactcttccaattttagaccaagag

SEQ ID NO: 191392 - DNA, 25 bp, Artificial sequence
  SiRNA target sequence
actcttccaattttagaccaagagt

SEQ ID NO: 191393 - DNA, 25 bp, Artificial sequence
  SiRNA target sequence
ctcttccaattttagaccaagagtt

SEQ ID NO: 191394 - DNA, 25 bp, Artificial sequence
  SiRNA target sequence
tcttccaattttagaccaagagtta

SEQ ID NO: 191395 - DNA, 25 bp, Artificial sequence
  SiRNA target sequence
cttccaattttagaccaagagttaa

SEQ ID NO: 191396 - DNA, 25 bp, Artificial sequence
  SiRNA target sequence
ttccaattttagaccaagagttaat

SEQ ID NO: 191397 - DNA, 25 bp, Artificial sequence
  SiRNA target sequence
tccaattttagaccaagagttaata

SEQ ID NO: 191398 - DNA, 25 bp, Artificial sequence
  SiRNA target sequence
ccaattttagaccaagagttaataa

SEQ ID NO: 191399 - DNA, 25 bp, Artificial sequence
  SiRNA target sequence
caattttagaccaagagttaataag

SEQ ID NO: 191400 - DNA, 25 bp, Artificial sequence
  SiRNA target sequence
aattttagaccaagagttaataagc

SEQ ID NO: 191401 - DNA, 25 bp, Artificial sequence
  SiRNA target sequence
attttagaccaagagttaataagcc

SEQ ID NO: 191402 - DNA, 25 bp, Artificial sequence
  SiRNA target sequence
ttttagaccaagagttaataagccg

SEQ ID NO: 191403 - DNA, 25 bp, Artificial sequence
  SiRNA target sequence
tttagaccaagagttaataagccga

SEQ ID NO: 191404 - DNA, 25 bp, Artificial sequence
  SiRNA target sequence
ttagaccaagagttaataagccgaa

SEQ ID NO: 191405 - DNA, 25 bp, Artificial sequence
  SiRNA target sequence
tagaccaagagttaataagccgaat

SEQ ID NO: 191406 - DNA, 25 bp, Artificial sequence
  SiRNA target sequence
agaccaagagttaataagccgaatt

SEQ ID NO: 191407 - DNA, 25 bp, Artificial sequence
  SiRNA target sequence
gaccaagagttaataagccgaattc

SEQ ID NO: 191408 - DNA, 25 bp, Artificial sequence
  SiRNA target sequence
accaagagttaataagccgaattcc

SEQ ID NO: 191409 - DNA, 25 bp, Artificial sequence
  SiRNA target sequence
ccaagagttaataagccgaattccg

SEQ ID NO: 191410 - DNA, 25 bp, Artificial sequence
  SiRNA target sequence
caagagttaataagccgaattccgc

SEQ ID NO: 191411 - DNA, 25 bp, Artificial sequence
  SiRNA target sequence
aagagttaataagccgaattccgca

SEQ ID NO: 191412 - DNA, 25 bp, Artificial sequence
  SiRNA target sequence
agagttaataagccgaattccgcaa

SEQ ID NO: 191413 - DNA, 25 bp, Artificial sequence
  SiRNA target sequence
gagttaataagccgaattccgcaaa

SEQ ID NO: 191414 - DNA, 25 bp, Artificial sequence
  SiRNA target sequence
agttaataagccgaattccgcaaaa

SEQ ID NO: 191415 - DNA, 25 bp, Artificial sequence
  SiRNA target sequence
gttaataagccgaattccgcaaaag

SEQ ID NO: 191416 - DNA, 25 bp, Artificial sequence
  SiRNA target sequence
ttaataagccgaattccgcaaaaga

SEQ ID NO: 191417 - DNA, 25 bp, Artificial sequence
  SiRNA target sequence
taataagccgaattccgcaaaagac

SEQ ID NO: 191418 - DNA, 25 bp, Artificial sequence
  SiRNA target sequence
aataagccgaattccgcaaaagaca

SEQ ID NO: 191419 - DNA, 25 bp, Artificial sequence
  SiRNA target sequence
ataagccgaattccgcaaaagacag

SEQ ID NO: 191420 - DNA, 25 bp, Artificial sequence
  SiRNA target sequence
taagccgaattccgcaaaagacaga

SEQ ID NO: 191421 - DNA, 25 bp, Artificial sequence
  SiRNA target sequence
aagccgaattccgcaaaagacagaa

SEQ ID NO: 191422 - DNA, 25 bp, Artificial sequence
  SiRNA target sequence
agccgaattccgcaaaagacagaac

SEQ ID NO: 191423 - DNA, 25 bp, Artificial sequence
  SiRNA target sequence
gccgaattccgcaaaagacagaact

SEQ ID NO: 191424 - DNA, 25 bp, Artificial sequence
  SiRNA target sequence
ccgaattccgcaaaagacagaactc

SEQ ID NO: 191425 - DNA, 25 bp, Artificial sequence
  SiRNA target sequence
cgaattccgcaaaagacagaactca

SEQ ID NO: 191426 - DNA, 25 bp, Artificial sequence
  SiRNA target sequence
gaattccgcaaaagacagaactcag

SEQ ID NO: 191427 - DNA, 25 bp, Artificial sequence
  SiRNA target sequence
aattccgcaaaagacagaactcaga

SEQ ID NO: 191428 - DNA, 25 bp, Artificial sequence
  SiRNA target sequence
attccgcaaaagacagaactcagaa

SEQ ID NO: 191429 - DNA, 25 bp, Artificial sequence
  SiRNA target sequence
ttccgcaaaagacagaactcagaaa

SEQ ID NO: 191430 - DNA, 25 bp, Artificial sequence
  SiRNA target sequence
tccgcaaaagacagaactcagaaag

SEQ ID NO: 191431 - DNA, 25 bp, Artificial sequence
  SiRNA target sequence
ccgcaaaagacagaactcagaaaga

SEQ ID NO: 191432 - DNA, 25 bp, Artificial sequence
  SiRNA target sequence
cgcaaaagacagaactcagaaagaa

SEQ ID NO: 191433 - DNA, 25 bp, Artificial sequence
  SiRNA target sequence
gcaaaagacagaactcagaaagaag

SEQ ID NO: 191434 - DNA, 25 bp, Artificial sequence
  SiRNA target sequence
caaaagacagaactcagaaagaaga

SEQ ID NO: 191435 - DNA, 25 bp, Artificial sequence
  SiRNA target sequence
aaaagacagaactcagaaagaagag

SEQ ID NO: 191436 - DNA, 25 bp, Artificial sequence
  SiRNA target sequence
aaagacagaactcagaaagaagaga

SEQ ID NO: 191437 - DNA, 25 bp, Artificial sequence
  SiRNA target sequence
aagacagaactcagaaagaagagaa

SEQ ID NO: 191438 - DNA, 25 bp, Artificial sequence
  SiRNA target sequence
agacagaactcagaaagaagagaat

SEQ ID NO: 191439 - DNA, 25 bp, Artificial sequence
  SiRNA target sequence
gacagaactcagaaagaagagaata

SEQ ID NO: 191440 - DNA, 25 bp, Artificial sequence
  SiRNA target sequence
acagaactcagaaagaagagaataa

SEQ ID NO: 191441 - DNA, 25 bp, Artificial sequence
  SiRNA target sequence
cagaactcagaaagaagagaataaa

SEQ ID NO: 191442 - DNA, 25 bp, Artificial sequence
  SiRNA target sequence
agaactcagaaagaagagaataaat

SEQ ID NO: 191443 - DNA, 25 bp, Artificial sequence
  SiRNA target sequence
gaactcagaaagaagagaataaata

SEQ ID NO: 191444 - DNA, 25 bp, Artificial sequence
  SiRNA target sequence
aactcagaaagaagagaataaatat

SEQ ID NO: 191445 - DNA, 25 bp, Artificial sequence
  SiRNA target sequence
actcagaaagaagagaataaatatt

SEQ ID NO: 191446 - DNA, 25 bp, Artificial sequence
  SiRNA target sequence
ctcagaaagaagagaataaatattt

SEQ ID NO: 191447 - DNA, 25 bp, Artificial sequence
  SiRNA target sequence
tcagaaagaagagaataaatatttt

SEQ ID NO: 191448 - DNA, 25 bp, Artificial sequence
  SiRNA target sequence
cagaaagaagagaataaatattttt

SEQ ID NO: 191449 - DNA, 25 bp, Artificial sequence
  SiRNA target sequence
agaaagaagagaataaatatttttt

SEQ ID NO: 191450 - DNA, 25 bp, Artificial sequence
  SiRNA target sequence
gaaagaagagaataaatattttttt

SEQ ID NO: 191451 - DNA, 25 bp, Artificial sequence
  SiRNA target sequence
aaagaagagaataaatatttttttt

SEQ ID NO: 191452 - DNA, 25 bp, Artificial sequence
  SiRNA target sequence
aagaagagaataaatattttttttg

SEQ ID NO: 191453 - DNA, 25 bp, Artificial sequence
  SiRNA target sequence
agaagagaataaatattttttttga

SEQ ID NO: 191454 - DNA, 26 bp, Artificial sequence
  SiRNA target sequence
atggccaagaatgaatctaataaaat

SEQ ID NO: 191455 - DNA, 26 bp, Artificial sequence
  SiRNA target sequence
tggccaagaatgaatctaataaaata

SEQ ID NO: 191456 - DNA, 26 bp, Artificial sequence
  SiRNA target sequence
ggccaagaatgaatctaataaaataa

SEQ ID NO: 191457 - DNA, 26 bp, Artificial sequence
  SiRNA target sequence
gccaagaatgaatctaataaaataac

SEQ ID NO: 191458 - DNA, 26 bp, Artificial sequence
  SiRNA target sequence
ccaagaatgaatctaataaaataacg

SEQ ID NO: 191459 - DNA, 26 bp, Artificial sequence
  SiRNA target sequence
caagaatgaatctaataaaataacga

SEQ ID NO: 191460 - DNA, 26 bp, Artificial sequence
  SiRNA target sequence
aagaatgaatctaataaaataacgag

SEQ ID NO: 191461 - DNA, 26 bp, Artificial sequence
  SiRNA target sequence
agaatgaatctaataaaataacgaga

SEQ ID NO: 191462 - DNA, 26 bp, Artificial sequence
  SiRNA target sequence
gaatgaatctaataaaataacgagac

SEQ ID NO: 191463 - DNA, 26 bp, Artificial sequence
  SiRNA target sequence
aatgaatctaataaaataacgagact

SEQ ID NO: 191464 - DNA, 26 bp, Artificial sequence
  SiRNA target sequence
atgaatctaataaaataacgagactg

SEQ ID NO: 191465 - DNA, 26 bp, Artificial sequence
  SiRNA target sequence
tgaatctaataaaataacgagactgg

SEQ ID NO: 191466 - DNA, 26 bp, Artificial sequence
  SiRNA target sequence
gaatctaataaaataacgagactggc

SEQ ID NO: 191467 - DNA, 26 bp, Artificial sequence
  SiRNA target sequence
aatctaataaaataacgagactggca

SEQ ID NO: 191468 - DNA, 26 bp, Artificial sequence
  SiRNA target sequence
atctaataaaataacgagactggcaa

SEQ ID NO: 191469 - DNA, 26 bp, Artificial sequence
  SiRNA target sequence
tctaataaaataacgagactggcaat

SEQ ID NO: 191470 - DNA, 26 bp, Artificial sequence
  SiRNA target sequence
ctaataaaataacgagactggcaatt

SEQ ID NO: 191471 - DNA, 26 bp, Artificial sequence
  SiRNA target sequence
taataaaataacgagactggcaattg

SEQ ID NO: 191472 - DNA, 26 bp, Artificial sequence
  SiRNA target sequence
aataaaataacgagactggcaattgt

SEQ ID NO: 191473 - DNA, 26 bp, Artificial sequence
  SiRNA target sequence
ataaaataacgagactggcaattgtt

SEQ ID NO: 191474 - DNA, 26 bp, Artificial sequence
  SiRNA target sequence
taaaataacgagactggcaattgtta

SEQ ID NO: 191475 - DNA, 26 bp, Artificial sequence
  SiRNA target sequence
aaaataacgagactggcaattgttaa

SEQ ID NO: 191476 - DNA, 26 bp, Artificial sequence
  SiRNA target sequence
aaataacgagactggcaattgttaat

SEQ ID NO: 191477 - DNA, 26 bp, Artificial sequence
  SiRNA target sequence
aataacgagactggcaattgttaatt

SEQ ID NO: 191478 - DNA, 26 bp, Artificial sequence
  SiRNA target sequence
ataacgagactggcaattgttaatta

SEQ ID NO: 191479 - DNA, 26 bp, Artificial sequence
  SiRNA target sequence
taacgagactggcaattgttaattat

SEQ ID NO: 191480 - DNA, 26 bp, Artificial sequence
  SiRNA target sequence
aacgagactggcaattgttaattatg

SEQ ID NO: 191481 - DNA, 26 bp, Artificial sequence
  SiRNA target sequence
acgagactggcaattgttaattatga

SEQ ID NO: 191482 - DNA, 26 bp, Artificial sequence
  SiRNA target sequence
cgagactggcaattgttaattatgaa

SEQ ID NO: 191483 - DNA, 26 bp, Artificial sequence
  SiRNA target sequence
gagactggcaattgttaattatgaac

SEQ ID NO: 191484 - DNA, 26 bp, Artificial sequence
  SiRNA target sequence
agactggcaattgttaattatgaact

SEQ ID NO: 191485 - DNA, 26 bp, Artificial sequence
  SiRNA target sequence
gactggcaattgttaattatgaacta

SEQ ID NO: 191486 - DNA, 26 bp, Artificial sequence
  SiRNA target sequence
actggcaattgttaattatgaactat

SEQ ID NO: 191487 - DNA, 26 bp, Artificial sequence
  SiRNA target sequence
ctggcaattgttaattatgaactatg

SEQ ID NO: 191488 - DNA, 26 bp, Artificial sequence
  SiRNA target sequence
tggcaattgttaattatgaactatgt

SEQ ID NO: 191489 - DNA, 26 bp, Artificial sequence
  SiRNA target sequence
ggcaattgttaattatgaactatgta

SEQ ID NO: 191490 - DNA, 26 bp, Artificial sequence
  SiRNA target sequence
gcaattgttaattatgaactatgtaa

SEQ ID NO: 191491 - DNA, 26 bp, Artificial sequence
  SiRNA target sequence
caattgttaattatgaactatgtaaa

SEQ ID NO: 191492 - DNA, 26 bp, Artificial sequence
  SiRNA target sequence
aattgttaattatgaactatgtaaac

SEQ ID NO: 191493 - DNA, 26 bp, Artificial sequence
  SiRNA target sequence
attgttaattatgaactatgtaaacc

SEQ ID NO: 191494 - DNA, 26 bp, Artificial sequence
  SiRNA target sequence
ttgttaattatgaactatgtaaaccg

SEQ ID NO: 191495 - DNA, 26 bp, Artificial sequence
  SiRNA target sequence
tgttaattatgaactatgtaaaccga

SEQ ID NO: 191496 - DNA, 26 bp, Artificial sequence
  SiRNA target sequence
gttaattatgaactatgtaaaccgaa

SEQ ID NO: 191497 - DNA, 26 bp, Artificial sequence
  SiRNA target sequence
ttaattatgaactatgtaaaccgaag

SEQ ID NO: 191498 - DNA, 26 bp, Artificial sequence
  SiRNA target sequence
taattatgaactatgtaaaccgaagg

SEQ ID NO: 191499 - DNA, 26 bp, Artificial sequence
  SiRNA target sequence
aattatgaactatgtaaaccgaagga

SEQ ID NO: 191500 - DNA, 26 bp, Artificial sequence
  SiRNA target sequence
attatgaactatgtaaaccgaaggaa

SEQ ID NO: 191501 - DNA, 26 bp, Artificial sequence
  SiRNA target sequence
ttatgaactatgtaaaccgaaggaat

SEQ ID NO: 191502 - DNA, 26 bp, Artificial sequence
  SiRNA target sequence
tatgaactatgtaaaccgaaggaatg

SEQ ID NO: 191503 - DNA, 26 bp, Artificial sequence
  SiRNA target sequence
atgaactatgtaaaccgaaggaatgt

SEQ ID NO: 191504 - DNA, 26 bp, Artificial sequence
  SiRNA target sequence
tgaactatgtaaaccgaaggaatgta

SEQ ID NO: 191505 - DNA, 26 bp, Artificial sequence
  SiRNA target sequence
gaactatgtaaaccgaaggaatgtat

SEQ ID NO: 191506 - DNA, 26 bp, Artificial sequence
  SiRNA target sequence
aactatgtaaaccgaaggaatgtatg

SEQ ID NO: 191507 - DNA, 26 bp, Artificial sequence
  SiRNA target sequence
actatgtaaaccgaaggaatgtatgt

SEQ ID NO: 191508 - DNA, 26 bp, Artificial sequence
  SiRNA target sequence
ctatgtaaaccgaaggaatgtatgtc

SEQ ID NO: 191509 - DNA, 26 bp, Artificial sequence
  SiRNA target sequence
tatgtaaaccgaaggaatgtatgtca

SEQ ID NO: 191510 - DNA, 26 bp, Artificial sequence
  SiRNA target sequence
atgtaaaccgaaggaatgtatgtcag

SEQ ID NO: 191511 - DNA, 26 bp, Artificial sequence
  SiRNA target sequence
tgtaaaccgaaggaatgtatgtcaga

SEQ ID NO: 191512 - DNA, 26 bp, Artificial sequence
  SiRNA target sequence
gtaaaccgaaggaatgtatgtcagaa

SEQ ID NO: 191513 - DNA, 26 bp, Artificial sequence
  SiRNA target sequence
taaaccgaaggaatgtatgtcagaat

SEQ ID NO: 191514 - DNA, 26 bp, Artificial sequence
  SiRNA target sequence
aaaccgaaggaatgtatgtcagaatg

SEQ ID NO: 191515 - DNA, 26 bp, Artificial sequence
  SiRNA target sequence
aaccgaaggaatgtatgtcagaatgt

SEQ ID NO: 191516 - DNA, 26 bp, Artificial sequence
  SiRNA target sequence
accgaaggaatgtatgtcagaatgta

SEQ ID NO: 191517 - DNA, 26 bp, Artificial sequence
  SiRNA target sequence
ccgaaggaatgtatgtcagaatgtaa

SEQ ID NO: 191518 - DNA, 26 bp, Artificial sequence
  SiRNA target sequence
cgaaggaatgtatgtcagaatgtaaa

SEQ ID NO: 191519 - DNA, 26 bp, Artificial sequence
  SiRNA target sequence
gaaggaatgtatgtcagaatgtaaaa

SEQ ID NO: 191520 - DNA, 26 bp, Artificial sequence
  SiRNA target sequence
aaggaatgtatgtcagaatgtaaaaa

SEQ ID NO: 191521 - DNA, 26 bp, Artificial sequence
  SiRNA target sequence
aggaatgtatgtcagaatgtaaaaag

SEQ ID NO: 191522 - DNA, 26 bp, Artificial sequence
  SiRNA target sequence
ggaatgtatgtcagaatgtaaaaagg

SEQ ID NO: 191523 - DNA, 26 bp, Artificial sequence
  SiRNA target sequence
gaatgtatgtcagaatgtaaaaaggc

SEQ ID NO: 191524 - DNA, 26 bp, Artificial sequence
  SiRNA target sequence
aatgtatgtcagaatgtaaaaaggcg

SEQ ID NO: 191525 - DNA, 26 bp, Artificial sequence
  SiRNA target sequence
atgtatgtcagaatgtaaaaaggcgt

SEQ ID NO: 191526 - DNA, 26 bp, Artificial sequence
  SiRNA target sequence
tgtatgtcagaatgtaaaaaggcgtg

SEQ ID NO: 191527 - DNA, 26 bp, Artificial sequence
  SiRNA target sequence
gtatgtcagaatgtaaaaaggcgtgt

SEQ ID NO: 191528 - DNA, 26 bp, Artificial sequence
  SiRNA target sequence
tatgtcagaatgtaaaaaggcgtgtc

SEQ ID NO: 191529 - DNA, 26 bp, Artificial sequence
  SiRNA target sequence
atgtcagaatgtaaaaaggcgtgtcc

SEQ ID NO: 191530 - DNA, 26 bp, Artificial sequence
  SiRNA target sequence
tgtcagaatgtaaaaaggcgtgtcct

SEQ ID NO: 191531 - DNA, 26 bp, Artificial sequence
  SiRNA target sequence
gtcagaatgtaaaaaggcgtgtcctg

SEQ ID NO: 191532 - DNA, 26 bp, Artificial sequence
  SiRNA target sequence
tcagaatgtaaaaaggcgtgtcctgt

SEQ ID NO: 191533 - DNA, 26 bp, Artificial sequence
  SiRNA target sequence
cagaatgtaaaaaggcgtgtcctgtt

SEQ ID NO: 191534 - DNA, 26 bp, Artificial sequence
  SiRNA target sequence
agaatgtaaaaaggcgtgtcctgtta

SEQ ID NO: 191535 - DNA, 26 bp, Artificial sequence
  SiRNA target sequence
gaatgtaaaaaggcgtgtcctgttaa

SEQ ID NO: 191536 - DNA, 26 bp, Artificial sequence
  SiRNA target sequence
aatgtaaaaaggcgtgtcctgttaat

SEQ ID NO: 191537 - DNA, 26 bp, Artificial sequence
  SiRNA target sequence
atgtaaaaaggcgtgtcctgttaata

SEQ ID NO: 191538 - DNA, 26 bp, Artificial sequence
  SiRNA target sequence
tgtaaaaaggcgtgtcctgttaataa

SEQ ID NO: 191539 - DNA, 26 bp, Artificial sequence
  SiRNA target sequence
gtaaaaaggcgtgtcctgttaataaa

SEQ ID NO: 191540 - DNA, 26 bp, Artificial sequence
  SiRNA target sequence
taaaaaggcgtgtcctgttaataaaa

SEQ ID NO: 191541 - DNA, 26 bp, Artificial sequence
  SiRNA target sequence
aaaaaggcgtgtcctgttaataaaac

SEQ ID NO: 191542 - DNA, 26 bp, Artificial sequence
  SiRNA target sequence
aaaaggcgtgtcctgttaataaaaca

SEQ ID NO: 191543 - DNA, 26 bp, Artificial sequence
  SiRNA target sequence
aaaggcgtgtcctgttaataaaacag

SEQ ID NO: 191544 - DNA, 26 bp, Artificial sequence
  SiRNA target sequence
aaggcgtgtcctgttaataaaacagg

SEQ ID NO: 191545 - DNA, 26 bp, Artificial sequence
  SiRNA target sequence
aggcgtgtcctgttaataaaacagga

SEQ ID NO: 191546 - DNA, 26 bp, Artificial sequence
  SiRNA target sequence
ggcgtgtcctgttaataaaacaggaa

SEQ ID NO: 191547 - DNA, 26 bp, Artificial sequence
  SiRNA target sequence
gcgtgtcctgttaataaaacaggaaa

SEQ ID NO: 191548 - DNA, 26 bp, Artificial sequence
  SiRNA target sequence
cgtgtcctgttaataaaacaggaaag

SEQ ID NO: 191549 - DNA, 26 bp, Artificial sequence
  SiRNA target sequence
gtgtcctgttaataaaacaggaaagg

SEQ ID NO: 191550 - DNA, 26 bp, Artificial sequence
  SiRNA target sequence
tgtcctgttaataaaacaggaaagga

SEQ ID NO: 191551 - DNA, 26 bp, Artificial sequence
  SiRNA target sequence
gtcctgttaataaaacaggaaaggag

SEQ ID NO: 191552 - DNA, 26 bp, Artificial sequence
  SiRNA target sequence
tcctgttaataaaacaggaaaggagt

SEQ ID NO: 191553 - DNA, 26 bp, Artificial sequence
  SiRNA target sequence
cctgttaataaaacaggaaaggagtg

SEQ ID NO: 191554 - DNA, 26 bp, Artificial sequence
  SiRNA target sequence
ctgttaataaaacaggaaaggagtgt

SEQ ID NO: 191555 - DNA, 26 bp, Artificial sequence
  SiRNA target sequence
tgttaataaaacaggaaaggagtgta

SEQ ID NO: 191556 - DNA, 26 bp, Artificial sequence
  SiRNA target sequence
gttaataaaacaggaaaggagtgtat

SEQ ID NO: 191557 - DNA, 26 bp, Artificial sequence
  SiRNA target sequence
ttaataaaacaggaaaggagtgtatt

SEQ ID NO: 191558 - DNA, 26 bp, Artificial sequence
  SiRNA target sequence
taataaaacaggaaaggagtgtatta

SEQ ID NO: 191559 - DNA, 26 bp, Artificial sequence
  SiRNA target sequence
aataaaacaggaaaggagtgtattac

SEQ ID NO: 191560 - DNA, 26 bp, Artificial sequence
  SiRNA target sequence
ataaaacaggaaaggagtgtattaca

SEQ ID NO: 191561 - DNA, 26 bp, Artificial sequence
  SiRNA target sequence
taaaacaggaaaggagtgtattacaa

SEQ ID NO: 191562 - DNA, 26 bp, Artificial sequence
  SiRNA target sequence
aaaacaggaaaggagtgtattacaat

SEQ ID NO: 191563 - DNA, 26 bp, Artificial sequence
  SiRNA target sequence
aaacaggaaaggagtgtattacaatt

SEQ ID NO: 191564 - DNA, 26 bp, Artificial sequence
  SiRNA target sequence
aacaggaaaggagtgtattacaattg

SEQ ID NO: 191565 - DNA, 26 bp, Artificial sequence
  SiRNA target sequence
acaggaaaggagtgtattacaattga

SEQ ID NO: 191566 - DNA, 26 bp, Artificial sequence
  SiRNA target sequence
caggaaaggagtgtattacaattgat

SEQ ID NO: 191567 - DNA, 26 bp, Artificial sequence
  SiRNA target sequence
aggaaaggagtgtattacaattgata

SEQ ID NO: 191568 - DNA, 26 bp, Artificial sequence
  SiRNA target sequence
ggaaaggagtgtattacaattgatac

SEQ ID NO: 191569 - DNA, 26 bp, Artificial sequence
  SiRNA target sequence
gaaaggagtgtattacaattgatact

SEQ ID NO: 191570 - DNA, 26 bp, Artificial sequence
  SiRNA target sequence
aaaggagtgtattacaattgatacta

SEQ ID NO: 191571 - DNA, 26 bp, Artificial sequence
  SiRNA target sequence
aaggagtgtattacaattgatactaa

SEQ ID NO: 191572 - DNA, 26 bp, Artificial sequence
  SiRNA target sequence
aggagtgtattacaattgatactaaa

SEQ ID NO: 191573 - DNA, 26 bp, Artificial sequence
  SiRNA target sequence
ggagtgtattacaattgatactaaat

SEQ ID NO: 191574 - DNA, 26 bp, Artificial sequence
  SiRNA target sequence
gagtgtattacaattgatactaaatc

SEQ ID NO: 191575 - DNA, 26 bp, Artificial sequence
  SiRNA target sequence
agtgtattacaattgatactaaatca

SEQ ID NO: 191576 - DNA, 26 bp, Artificial sequence
  SiRNA target sequence
gtgtattacaattgatactaaatcac

SEQ ID NO: 191577 - DNA, 26 bp, Artificial sequence
  SiRNA target sequence
tgtattacaattgatactaaatcaca

SEQ ID NO: 191578 - DNA, 26 bp, Artificial sequence
  SiRNA target sequence
gtattacaattgatactaaatcacat

SEQ ID NO: 191579 - DNA, 26 bp, Artificial sequence
  SiRNA target sequence
tattacaattgatactaaatcacata

SEQ ID NO: 191580 - DNA, 26 bp, Artificial sequence
  SiRNA target sequence
attacaattgatactaaatcacatat

SEQ ID NO: 191581 - DNA, 26 bp, Artificial sequence
  SiRNA target sequence
ttacaattgatactaaatcacatatc

SEQ ID NO: 191582 - DNA, 26 bp, Artificial sequence
  SiRNA target sequence
tacaattgatactaaatcacatatct

SEQ ID NO: 191583 - DNA, 26 bp, Artificial sequence
  SiRNA target sequence
acaattgatactaaatcacatatctc

SEQ ID NO: 191584 - DNA, 26 bp, Artificial sequence
  SiRNA target sequence
caattgatactaaatcacatatctca

SEQ ID NO: 191585 - DNA, 26 bp, Artificial sequence
  SiRNA target sequence
aattgatactaaatcacatatctcag

SEQ ID NO: 191586 - DNA, 26 bp, Artificial sequence
  SiRNA target sequence
attgatactaaatcacatatctcaga

SEQ ID NO: 191587 - DNA, 26 bp, Artificial sequence
  SiRNA target sequence
ttgatactaaatcacatatctcagaa

SEQ ID NO: 191588 - DNA, 26 bp, Artificial sequence
  SiRNA target sequence
tgatactaaatcacatatctcagaaa

SEQ ID NO: 191589 - DNA, 26 bp, Artificial sequence
  SiRNA target sequence
gatactaaatcacatatctcagaaat

SEQ ID NO: 191590 - DNA, 26 bp, Artificial sequence
  SiRNA target sequence
atactaaatcacatatctcagaaatt

SEQ ID NO: 191591 - DNA, 26 bp, Artificial sequence
  SiRNA target sequence
tactaaatcacatatctcagaaattc

SEQ ID NO: 191592 - DNA, 26 bp, Artificial sequence
  SiRNA target sequence
actaaatcacatatctcagaaattct

SEQ ID NO: 191593 - DNA, 26 bp, Artificial sequence
  SiRNA target sequence
ctaaatcacatatctcagaaattctg

SEQ ID NO: 191594 - DNA, 26 bp, Artificial sequence
  SiRNA target sequence
taaatcacatatctcagaaattctgt

SEQ ID NO: 191595 - DNA, 26 bp, Artificial sequence
  SiRNA target sequence
aaatcacatatctcagaaattctgtg

SEQ ID NO: 191596 - DNA, 26 bp, Artificial sequence
  SiRNA target sequence
aatcacatatctcagaaattctgtgt

SEQ ID NO: 191597 - DNA, 26 bp, Artificial sequence
  SiRNA target sequence
atcacatatctcagaaattctgtgta

SEQ ID NO: 191598 - DNA, 26 bp, Artificial sequence
  SiRNA target sequence
tcacatatctcagaaattctgtgtat

SEQ ID NO: 191599 - DNA, 26 bp, Artificial sequence
  SiRNA target sequence
cacatatctcagaaattctgtgtata

SEQ ID NO: 191600 - DNA, 26 bp, Artificial sequence
  SiRNA target sequence
acatatctcagaaattctgtgtatag

SEQ ID NO: 191601 - DNA, 26 bp, Artificial sequence
  SiRNA target sequence
catatctcagaaattctgtgtatagg

SEQ ID NO: 191602 - DNA, 26 bp, Artificial sequence
  SiRNA target sequence
atatctcagaaattctgtgtatagga

SEQ ID NO: 191603 - DNA, 26 bp, Artificial sequence
  SiRNA target sequence
tatctcagaaattctgtgtataggat

SEQ ID NO: 191604 - DNA, 26 bp, Artificial sequence
  SiRNA target sequence
atctcagaaattctgtgtataggatg

SEQ ID NO: 191605 - DNA, 26 bp, Artificial sequence
  SiRNA target sequence
tctcagaaattctgtgtataggatgt

SEQ ID NO: 191606 - DNA, 26 bp, Artificial sequence
  SiRNA target sequence
ctcagaaattctgtgtataggatgtt

SEQ ID NO: 191607 - DNA, 26 bp, Artificial sequence
  SiRNA target sequence
tcagaaattctgtgtataggatgttc

SEQ ID NO: 191608 - DNA, 26 bp, Artificial sequence
  SiRNA target sequence
cagaaattctgtgtataggatgttct

SEQ ID NO: 191609 - DNA, 26 bp, Artificial sequence
  SiRNA target sequence
agaaattctgtgtataggatgttctg

SEQ ID NO: 191610 - DNA, 26 bp, Artificial sequence
  SiRNA target sequence
gaaattctgtgtataggatgttctgc

SEQ ID NO: 191611 - DNA, 26 bp, Artificial sequence
  SiRNA target sequence
aaattctgtgtataggatgttctgcg

SEQ ID NO: 191612 - DNA, 26 bp, Artificial sequence
  SiRNA target sequence
aattctgtgtataggatgttctgcgt

SEQ ID NO: 191613 - DNA, 26 bp, Artificial sequence
  SiRNA target sequence
attctgtgtataggatgttctgcgtg

SEQ ID NO: 191614 - DNA, 26 bp, Artificial sequence
  SiRNA target sequence
ttctgtgtataggatgttctgcgtgt

SEQ ID NO: 191615 - DNA, 26 bp, Artificial sequence
  SiRNA target sequence
tctgtgtataggatgttctgcgtgtc

SEQ ID NO: 191616 - DNA, 26 bp, Artificial sequence
  SiRNA target sequence
ctgtgtataggatgttctgcgtgtca

SEQ ID NO: 191617 - DNA, 26 bp, Artificial sequence
  SiRNA target sequence
tgtgtataggatgttctgcgtgtcaa

SEQ ID NO: 191618 - DNA, 26 bp, Artificial sequence
  SiRNA target sequence
gtgtataggatgttctgcgtgtcaaa

SEQ ID NO: 191619 - DNA, 26 bp, Artificial sequence
  SiRNA target sequence
tgtataggatgttctgcgtgtcaaaa

SEQ ID NO: 191620 - DNA, 26 bp, Artificial sequence
  SiRNA target sequence
gtataggatgttctgcgtgtcaaaag

SEQ ID NO: 191621 - DNA, 26 bp, Artificial sequence
  SiRNA target sequence
tataggatgttctgcgtgtcaaaaga

SEQ ID NO: 191622 - DNA, 26 bp, Artificial sequence
  SiRNA target sequence
ataggatgttctgcgtgtcaaaagaa

SEQ ID NO: 191623 - DNA, 26 bp, Artificial sequence
  SiRNA target sequence
taggatgttctgcgtgtcaaaagaaa

SEQ ID NO: 191624 - DNA, 26 bp, Artificial sequence
  SiRNA target sequence
aggatgttctgcgtgtcaaaagaaat

SEQ ID NO: 191625 - DNA, 26 bp, Artificial sequence
  SiRNA target sequence
ggatgttctgcgtgtcaaaagaaatg

SEQ ID NO: 191626 - DNA, 26 bp, Artificial sequence
  SiRNA target sequence
gatgttctgcgtgtcaaaagaaatgt

SEQ ID NO: 191627 - DNA, 26 bp, Artificial sequence
  SiRNA target sequence
atgttctgcgtgtcaaaagaaatgtc

SEQ ID NO: 191628 - DNA, 26 bp, Artificial sequence
  SiRNA target sequence
tgttctgcgtgtcaaaagaaatgtcc

SEQ ID NO: 191629 - DNA, 26 bp, Artificial sequence
  SiRNA target sequence
gttctgcgtgtcaaaagaaatgtcct

SEQ ID NO: 191630 - DNA, 26 bp, Artificial sequence
  SiRNA target sequence
ttctgcgtgtcaaaagaaatgtcctt

SEQ ID NO: 191631 - DNA, 26 bp, Artificial sequence
  SiRNA target sequence
tctgcgtgtcaaaagaaatgtccttt

SEQ ID NO: 191632 - DNA, 26 bp, Artificial sequence
  SiRNA target sequence
ctgcgtgtcaaaagaaatgtcctttt

SEQ ID NO: 191633 - DNA, 26 bp, Artificial sequence
  SiRNA target sequence
tgcgtgtcaaaagaaatgtcctttta

SEQ ID NO: 191634 - DNA, 26 bp, Artificial sequence
  SiRNA target sequence
gcgtgtcaaaagaaatgtccttttaa

SEQ ID NO: 191635 - DNA, 26 bp, Artificial sequence
  SiRNA target sequence
cgtgtcaaaagaaatgtccttttaag

SEQ ID NO: 191636 - DNA, 26 bp, Artificial sequence
  SiRNA target sequence
gtgtcaaaagaaatgtccttttaagg

SEQ ID NO: 191637 - DNA, 26 bp, Artificial sequence
  SiRNA target sequence
tgtcaaaagaaatgtccttttaaggc

SEQ ID NO: 191638 - DNA, 26 bp, Artificial sequence
  SiRNA target sequence
gtcaaaagaaatgtccttttaaggcg

SEQ ID NO: 191639 - DNA, 26 bp, Artificial sequence
  SiRNA target sequence
tcaaaagaaatgtccttttaaggcga

SEQ ID NO: 191640 - DNA, 26 bp, Artificial sequence
  SiRNA target sequence
caaaagaaatgtccttttaaggcgat

SEQ ID NO: 191641 - DNA, 26 bp, Artificial sequence
  SiRNA target sequence
aaaagaaatgtccttttaaggcgatt

SEQ ID NO: 191642 - DNA, 26 bp, Artificial sequence
  SiRNA target sequence
aaagaaatgtccttttaaggcgatta

SEQ ID NO: 191643 - DNA, 26 bp, Artificial sequence
  SiRNA target sequence
aagaaatgtccttttaaggcgattac

SEQ ID NO: 191644 - DNA, 26 bp, Artificial sequence
  SiRNA target sequence
agaaatgtccttttaaggcgattaca

SEQ ID NO: 191645 - DNA, 26 bp, Artificial sequence
  SiRNA target sequence
gaaatgtccttttaaggcgattacaa

SEQ ID NO: 191646 - DNA, 26 bp, Artificial sequence
  SiRNA target sequence
aaatgtccttttaaggcgattacaat

SEQ ID NO: 191647 - DNA, 26 bp, Artificial sequence
  SiRNA target sequence
aatgtccttttaaggcgattacaatt

SEQ ID NO: 191648 - DNA, 26 bp, Artificial sequence
  SiRNA target sequence
atgtccttttaaggcgattacaattg

SEQ ID NO: 191649 - DNA, 26 bp, Artificial sequence
  SiRNA target sequence
tgtccttttaaggcgattacaattgt

SEQ ID NO: 191650 - DNA, 26 bp, Artificial sequence
  SiRNA target sequence
gtccttttaaggcgattacaattgta

SEQ ID NO: 191651 - DNA, 26 bp, Artificial sequence
  SiRNA target sequence
tccttttaaggcgattacaattgtaa

SEQ ID NO: 191652 - DNA, 26 bp, Artificial sequence
  SiRNA target sequence
ccttttaaggcgattacaattgtaaa

SEQ ID NO: 191653 - DNA, 26 bp, Artificial sequence
  SiRNA target sequence
cttttaaggcgattacaattgtaaat

SEQ ID NO: 191654 - DNA, 26 bp, Artificial sequence
  SiRNA target sequence
ttttaaggcgattacaattgtaaatt

SEQ ID NO: 191655 - DNA, 26 bp, Artificial sequence
  SiRNA target sequence
tttaaggcgattacaattgtaaattt

SEQ ID NO: 191656 - DNA, 26 bp, Artificial sequence
  SiRNA target sequence
ttaaggcgattacaattgtaaattta

SEQ ID NO: 191657 - DNA, 26 bp, Artificial sequence
  SiRNA target sequence
taaggcgattacaattgtaaatttac

SEQ ID NO: 191658 - DNA, 26 bp, Artificial sequence
  SiRNA target sequence
aaggcgattacaattgtaaatttacc

SEQ ID NO: 191659 - DNA, 26 bp, Artificial sequence
  SiRNA target sequence
aggcgattacaattgtaaatttacct

SEQ ID NO: 191660 - DNA, 26 bp, Artificial sequence
  SiRNA target sequence
ggcgattacaattgtaaatttaccta

SEQ ID NO: 191661 - DNA, 26 bp, Artificial sequence
  SiRNA target sequence
gcgattacaattgtaaatttacctac

SEQ ID NO: 191662 - DNA, 26 bp, Artificial sequence
  SiRNA target sequence
cgattacaattgtaaatttacctaca

SEQ ID NO: 191663 - DNA, 26 bp, Artificial sequence
  SiRNA target sequence
gattacaattgtaaatttacctacaa

SEQ ID NO: 191664 - DNA, 26 bp, Artificial sequence
  SiRNA target sequence
attacaattgtaaatttacctacaaa

SEQ ID NO: 191665 - DNA, 26 bp, Artificial sequence
  SiRNA target sequence
ttacaattgtaaatttacctacaaat

SEQ ID NO: 191666 - DNA, 26 bp, Artificial sequence
  SiRNA target sequence
tacaattgtaaatttacctacaaatc

SEQ ID NO: 191667 - DNA, 26 bp, Artificial sequence
  SiRNA target sequence
acaattgtaaatttacctacaaatct

SEQ ID NO: 191668 - DNA, 26 bp, Artificial sequence
  SiRNA target sequence
caattgtaaatttacctacaaatcta

SEQ ID NO: 191669 - DNA, 26 bp, Artificial sequence
  SiRNA target sequence
aattgtaaatttacctacaaatctag

SEQ ID NO: 191670 - DNA, 26 bp, Artificial sequence
  SiRNA target sequence
attgtaaatttacctacaaatctaga

SEQ ID NO: 191671 - DNA, 26 bp, Artificial sequence
  SiRNA target sequence
ttgtaaatttacctacaaatctagat

SEQ ID NO: 191672 - DNA, 26 bp, Artificial sequence
  SiRNA target sequence
tgtaaatttacctacaaatctagata

SEQ ID NO: 191673 - DNA, 26 bp, Artificial sequence
  SiRNA target sequence
gtaaatttacctacaaatctagataa

SEQ ID NO: 191674 - DNA, 26 bp, Artificial sequence
  SiRNA target sequence
taaatttacctacaaatctagataaa

SEQ ID NO: 191675 - DNA, 26 bp, Artificial sequence
  SiRNA target sequence
aaatttacctacaaatctagataaag

SEQ ID NO: 191676 - DNA, 26 bp, Artificial sequence
  SiRNA target sequence
aatttacctacaaatctagataaaga

SEQ ID NO: 191677 - DNA, 26 bp, Artificial sequence
  SiRNA target sequence
atttacctacaaatctagataaagac

SEQ ID NO: 191678 - DNA, 26 bp, Artificial sequence
  SiRNA target sequence
tttacctacaaatctagataaagaca

SEQ ID NO: 191679 - DNA, 26 bp, Artificial sequence
  SiRNA target sequence
ttacctacaaatctagataaagacat

SEQ ID NO: 191680 - DNA, 26 bp, Artificial sequence
  SiRNA target sequence
tacctacaaatctagataaagacatt

SEQ ID NO: 191681 - DNA, 26 bp, Artificial sequence
  SiRNA target sequence
acctacaaatctagataaagacattt

SEQ ID NO: 191682 - DNA, 26 bp, Artificial sequence
  SiRNA target sequence
cctacaaatctagataaagacatttc

SEQ ID NO: 191683 - DNA, 26 bp, Artificial sequence
  SiRNA target sequence
ctacaaatctagataaagacatttca

SEQ ID NO: 191684 - DNA, 26 bp, Artificial sequence
  SiRNA target sequence
tacaaatctagataaagacatttcac

SEQ ID NO: 191685 - DNA, 26 bp, Artificial sequence
  SiRNA target sequence
acaaatctagataaagacatttcaca

SEQ ID NO: 191686 - DNA, 26 bp, Artificial sequence
  SiRNA target sequence
caaatctagataaagacatttcacat

SEQ ID NO: 191687 - DNA, 26 bp, Artificial sequence
  SiRNA target sequence
aaatctagataaagacatttcacata

SEQ ID NO: 191688 - DNA, 26 bp, Artificial sequence
  SiRNA target sequence
aatctagataaagacatttcacatag

SEQ ID NO: 191689 - DNA, 26 bp, Artificial sequence
  SiRNA target sequence
atctagataaagacatttcacataga

SEQ ID NO: 191690 - DNA, 26 bp, Artificial sequence
  SiRNA target sequence
tctagataaagacatttcacatagat

SEQ ID NO: 191691 - DNA, 26 bp, Artificial sequence
  SiRNA target sequence
ctagataaagacatttcacatagata

SEQ ID NO: 191692 - DNA, 26 bp, Artificial sequence
  SiRNA target sequence
tagataaagacatttcacatagatat

SEQ ID NO: 191693 - DNA, 26 bp, Artificial sequence
  SiRNA target sequence
agataaagacatttcacatagatatt

SEQ ID NO: 191694 - DNA, 26 bp, Artificial sequence
  SiRNA target sequence
gataaagacatttcacatagatattc

SEQ ID NO: 191695 - DNA, 26 bp, Artificial sequence
  SiRNA target sequence
ataaagacatttcacatagatattcg

SEQ ID NO: 191696 - DNA, 26 bp, Artificial sequence
  SiRNA target sequence
taaagacatttcacatagatattcgg

SEQ ID NO: 191697 - DNA, 26 bp, Artificial sequence
  SiRNA target sequence
aaagacatttcacatagatattcggc

SEQ ID NO: 191698 - DNA, 26 bp, Artificial sequence
  SiRNA target sequence
aagacatttcacatagatattcggca

SEQ ID NO: 191699 - DNA, 26 bp, Artificial sequence
  SiRNA target sequence
agacatttcacatagatattcggcaa

SEQ ID NO: 191700 - DNA, 26 bp, Artificial sequence
  SiRNA target sequence
gacatttcacatagatattcggcaaa

SEQ ID NO: 191701 - DNA, 26 bp, Artificial sequence
  SiRNA target sequence
acatttcacatagatattcggcaaat

SEQ ID NO: 191702 - DNA, 26 bp, Artificial sequence
  SiRNA target sequence
catttcacatagatattcggcaaatg

SEQ ID NO: 191703 - DNA, 26 bp, Artificial sequence
  SiRNA target sequence
atttcacatagatattcggcaaatgg

SEQ ID NO: 191704 - DNA, 26 bp, Artificial sequence
  SiRNA target sequence
tttcacatagatattcggcaaatggt

SEQ ID NO: 191705 - DNA, 26 bp, Artificial sequence
  SiRNA target sequence
ttcacatagatattcggcaaatggtt

SEQ ID NO: 191706 - DNA, 26 bp, Artificial sequence
  SiRNA target sequence
tcacatagatattcggcaaatggttt

SEQ ID NO: 191707 - DNA, 26 bp, Artificial sequence
  SiRNA target sequence
cacatagatattcggcaaatggtttt

SEQ ID NO: 191708 - DNA, 26 bp, Artificial sequence
  SiRNA target sequence
acatagatattcggcaaatggtttta

SEQ ID NO: 191709 - DNA, 26 bp, Artificial sequence
  SiRNA target sequence
catagatattcggcaaatggttttaa

SEQ ID NO: 191710 - DNA, 26 bp, Artificial sequence
  SiRNA target sequence
atagatattcggcaaatggttttaaa

SEQ ID NO: 191711 - DNA, 26 bp, Artificial sequence
  SiRNA target sequence
tagatattcggcaaatggttttaaac

SEQ ID NO: 191712 - DNA, 26 bp, Artificial sequence
  SiRNA target sequence
agatattcggcaaatggttttaaact

SEQ ID NO: 191713 - DNA, 26 bp, Artificial sequence
  SiRNA target sequence
gatattcggcaaatggttttaaactt

SEQ ID NO: 191714 - DNA, 26 bp, Artificial sequence
  SiRNA target sequence
atattcggcaaatggttttaaacttc

SEQ ID NO: 191715 - DNA, 26 bp, Artificial sequence
  SiRNA target sequence
tattcggcaaatggttttaaacttca

SEQ ID NO: 191716 - DNA, 26 bp, Artificial sequence
  SiRNA target sequence
attcggcaaatggttttaaacttcac

SEQ ID NO: 191717 - DNA, 26 bp, Artificial sequence
  SiRNA target sequence
ttcggcaaatggttttaaacttcaca

SEQ ID NO: 191718 - DNA, 26 bp, Artificial sequence
  SiRNA target sequence
tcggcaaatggttttaaacttcacag

SEQ ID NO: 191719 - DNA, 26 bp, Artificial sequence
  SiRNA target sequence
cggcaaatggttttaaacttcacaga

SEQ ID NO: 191720 - DNA, 26 bp, Artificial sequence
  SiRNA target sequence
ggcaaatggttttaaacttcacagat

SEQ ID NO: 191721 - DNA, 26 bp, Artificial sequence
  SiRNA target sequence
gcaaatggttttaaacttcacagatt

SEQ ID NO: 191722 - DNA, 26 bp, Artificial sequence
  SiRNA target sequence
caaatggttttaaacttcacagatta

SEQ ID NO: 191723 - DNA, 26 bp, Artificial sequence
  SiRNA target sequence
aaatggttttaaacttcacagattac

SEQ ID NO: 191724 - DNA, 26 bp, Artificial sequence
  SiRNA target sequence
aatggttttaaacttcacagattacc

SEQ ID NO: 191725 - DNA, 26 bp, Artificial sequence
  SiRNA target sequence
atggttttaaacttcacagattacca

SEQ ID NO: 191726 - DNA, 26 bp, Artificial sequence
  SiRNA target sequence
tggttttaaacttcacagattaccaa

SEQ ID NO: 191727 - DNA, 26 bp, Artificial sequence
  SiRNA target sequence
ggttttaaacttcacagattaccaat

SEQ ID NO: 191728 - DNA, 26 bp, Artificial sequence
  SiRNA target sequence
gttttaaacttcacagattaccaatc

SEQ ID NO: 191729 - DNA, 26 bp, Artificial sequence
  SiRNA target sequence
ttttaaacttcacagattaccaatcc

SEQ ID NO: 191730 - DNA, 26 bp, Artificial sequence
  SiRNA target sequence
tttaaacttcacagattaccaatccc

SEQ ID NO: 191731 - DNA, 26 bp, Artificial sequence
  SiRNA target sequence
ttaaacttcacagattaccaatccct

SEQ ID NO: 191732 - DNA, 26 bp, Artificial sequence
  SiRNA target sequence
taaacttcacagattaccaatcccta

SEQ ID NO: 191733 - DNA, 26 bp, Artificial sequence
  SiRNA target sequence
aaacttcacagattaccaatccctaa

SEQ ID NO: 191734 - DNA, 26 bp, Artificial sequence
  SiRNA target sequence
aacttcacagattaccaatccctaaa

SEQ ID NO: 191735 - DNA, 26 bp, Artificial sequence
  SiRNA target sequence
acttcacagattaccaatccctaaat

SEQ ID NO: 191736 - DNA, 26 bp, Artificial sequence
  SiRNA target sequence
cttcacagattaccaatccctaaata

SEQ ID NO: 191737 - DNA, 26 bp, Artificial sequence
  SiRNA target sequence
ttcacagattaccaatccctaaatat

SEQ ID NO: 191738 - DNA, 26 bp, Artificial sequence
  SiRNA target sequence
tcacagattaccaatccctaaatatg

SEQ ID NO: 191739 - DNA, 26 bp, Artificial sequence
  SiRNA target sequence
cacagattaccaatccctaaatatgg

SEQ ID NO: 191740 - DNA, 26 bp, Artificial sequence
  SiRNA target sequence
acagattaccaatccctaaatatggt

SEQ ID NO: 191741 - DNA, 26 bp, Artificial sequence
  SiRNA target sequence
cagattaccaatccctaaatatggta

SEQ ID NO: 191742 - DNA, 26 bp, Artificial sequence
  SiRNA target sequence
agattaccaatccctaaatatggtaa

SEQ ID NO: 191743 - DNA, 26 bp, Artificial sequence
  SiRNA target sequence
gattaccaatccctaaatatggtaag

SEQ ID NO: 191744 - DNA, 26 bp, Artificial sequence
  SiRNA target sequence
attaccaatccctaaatatggtaagg

SEQ ID NO: 191745 - DNA, 26 bp, Artificial sequence
  SiRNA target sequence
ttaccaatccctaaatatggtaaggt

SEQ ID NO: 191746 - DNA, 26 bp, Artificial sequence
  SiRNA target sequence
taccaatccctaaatatggtaaggtt

SEQ ID NO: 191747 - DNA, 26 bp, Artificial sequence
  SiRNA target sequence
accaatccctaaatatggtaaggttt

SEQ ID NO: 191748 - DNA, 26 bp, Artificial sequence
  SiRNA target sequence
ccaatccctaaatatggtaaggtttt

SEQ ID NO: 191749 - DNA, 26 bp, Artificial sequence
  SiRNA target sequence
caatccctaaatatggtaaggtttta

SEQ ID NO: 191750 - DNA, 26 bp, Artificial sequence
  SiRNA target sequence
aatccctaaatatggtaaggttttag

SEQ ID NO: 191751 - DNA, 26 bp, Artificial sequence
  SiRNA target sequence
atccctaaatatggtaaggttttagg

SEQ ID NO: 191752 - DNA, 26 bp, Artificial sequence
  SiRNA target sequence
tccctaaatatggtaaggttttaggg

SEQ ID NO: 191753 - DNA, 26 bp, Artificial sequence
  SiRNA target sequence
ccctaaatatggtaaggttttagggc

SEQ ID NO: 191754 - DNA, 26 bp, Artificial sequence
  SiRNA target sequence
cctaaatatggtaaggttttagggct

SEQ ID NO: 191755 - DNA, 26 bp, Artificial sequence
  SiRNA target sequence
ctaaatatggtaaggttttagggcta

SEQ ID NO: 191756 - DNA, 26 bp, Artificial sequence
  SiRNA target sequence
taaatatggtaaggttttagggctag

SEQ ID NO: 191757 - DNA, 26 bp, Artificial sequence
  SiRNA target sequence
aaatatggtaaggttttagggctagt

SEQ ID NO: 191758 - DNA, 26 bp, Artificial sequence
  SiRNA target sequence
aatatggtaaggttttagggctagta

SEQ ID NO: 191759 - DNA, 26 bp, Artificial sequence
  SiRNA target sequence
atatggtaaggttttagggctagtag

SEQ ID NO: 191760 - DNA, 26 bp, Artificial sequence
  SiRNA target sequence
tatggtaaggttttagggctagtagg

SEQ ID NO: 191761 - DNA, 26 bp, Artificial sequence
  SiRNA target sequence
atggtaaggttttagggctagtaggc

SEQ ID NO: 191762 - DNA, 26 bp, Artificial sequence
  SiRNA target sequence
tggtaaggttttagggctagtaggca

SEQ ID NO: 191763 - DNA, 26 bp, Artificial sequence
  SiRNA target sequence
ggtaaggttttagggctagtaggcac

SEQ ID NO: 191764 - DNA, 26 bp, Artificial sequence
  SiRNA target sequence
gtaaggttttagggctagtaggcact

SEQ ID NO: 191765 - DNA, 26 bp, Artificial sequence
  SiRNA target sequence
taaggttttagggctagtaggcacta

SEQ ID NO: 191766 - DNA, 26 bp, Artificial sequence
  SiRNA target sequence
aaggttttagggctagtaggcactaa

SEQ ID NO: 191767 - DNA, 26 bp, Artificial sequence
  SiRNA target sequence
aggttttagggctagtaggcactaat

SEQ ID NO: 191768 - DNA, 26 bp, Artificial sequence
  SiRNA target sequence
ggttttagggctagtaggcactaatg

SEQ ID NO: 191769 - DNA, 26 bp, Artificial sequence
  SiRNA target sequence
gttttagggctagtaggcactaatgg

SEQ ID NO: 191770 - DNA, 26 bp, Artificial sequence
  SiRNA target sequence
ttttagggctagtaggcactaatggt

SEQ ID NO: 191771 - DNA, 26 bp, Artificial sequence
  SiRNA target sequence
tttagggctagtaggcactaatggta

SEQ ID NO: 191772 - DNA, 26 bp, Artificial sequence
  SiRNA target sequence
ttagggctagtaggcactaatggtat

SEQ ID NO: 191773 - DNA, 26 bp, Artificial sequence
  SiRNA target sequence
tagggctagtaggcactaatggtata

SEQ ID NO: 191774 - DNA, 26 bp, Artificial sequence
  SiRNA target sequence
agggctagtaggcactaatggtatag

SEQ ID NO: 191775 - DNA, 26 bp, Artificial sequence
  SiRNA target sequence
gggctagtaggcactaatggtatagg

SEQ ID NO: 191776 - DNA, 26 bp, Artificial sequence
  SiRNA target sequence
ggctagtaggcactaatggtatagga

SEQ ID NO: 191777 - DNA, 26 bp, Artificial sequence
  SiRNA target sequence
gctagtaggcactaatggtataggaa

SEQ ID NO: 191778 - DNA, 26 bp, Artificial sequence
  SiRNA target sequence
ctagtaggcactaatggtataggaaa

SEQ ID NO: 191779 - DNA, 26 bp, Artificial sequence
  SiRNA target sequence
tagtaggcactaatggtataggaaaa

SEQ ID NO: 191780 - DNA, 26 bp, Artificial sequence
  SiRNA target sequence
agtaggcactaatggtataggaaaaa

SEQ ID NO: 191781 - DNA, 26 bp, Artificial sequence
  SiRNA target sequence
gtaggcactaatggtataggaaaaag

SEQ ID NO: 191782 - DNA, 26 bp, Artificial sequence
  SiRNA target sequence
taggcactaatggtataggaaaaagt

SEQ ID NO: 191783 - DNA, 26 bp, Artificial sequence
  SiRNA target sequence
aggcactaatggtataggaaaaagta

SEQ ID NO: 191784 - DNA, 26 bp, Artificial sequence
  SiRNA target sequence
ggcactaatggtataggaaaaagtac

SEQ ID NO: 191785 - DNA, 26 bp, Artificial sequence
  SiRNA target sequence
gcactaatggtataggaaaaagtact

SEQ ID NO: 191786 - DNA, 26 bp, Artificial sequence
  SiRNA target sequence
cactaatggtataggaaaaagtactg

SEQ ID NO: 191787 - DNA, 26 bp, Artificial sequence
  SiRNA target sequence
actaatggtataggaaaaagtactgc

SEQ ID NO: 191788 - DNA, 26 bp, Artificial sequence
  SiRNA target sequence
ctaatggtataggaaaaagtactgca

SEQ ID NO: 191789 - DNA, 26 bp, Artificial sequence
  SiRNA target sequence
taatggtataggaaaaagtactgcac

SEQ ID NO: 191790 - DNA, 26 bp, Artificial sequence
  SiRNA target sequence
aatggtataggaaaaagtactgcact

SEQ ID NO: 191791 - DNA, 26 bp, Artificial sequence
  SiRNA target sequence
atggtataggaaaaagtactgcactt

SEQ ID NO: 191792 - DNA, 26 bp, Artificial sequence
  SiRNA target sequence
tggtataggaaaaagtactgcactta

SEQ ID NO: 191793 - DNA, 26 bp, Artificial sequence
  SiRNA target sequence
ggtataggaaaaagtactgcacttaa

SEQ ID NO: 191794 - DNA, 26 bp, Artificial sequence
  SiRNA target sequence
gtataggaaaaagtactgcacttaaa

SEQ ID NO: 191795 - DNA, 26 bp, Artificial sequence
  SiRNA target sequence
tataggaaaaagtactgcacttaaaa

SEQ ID NO: 191796 - DNA, 26 bp, Artificial sequence
  SiRNA target sequence
ataggaaaaagtactgcacttaaaat

SEQ ID NO: 191797 - DNA, 26 bp, Artificial sequence
  SiRNA target sequence
taggaaaaagtactgcacttaaaata

SEQ ID NO: 191798 - DNA, 26 bp, Artificial sequence
  SiRNA target sequence
aggaaaaagtactgcacttaaaatat

SEQ ID NO: 191799 - DNA, 26 bp, Artificial sequence
  SiRNA target sequence
ggaaaaagtactgcacttaaaatatt

SEQ ID NO: 191800 - DNA, 26 bp, Artificial sequence
  SiRNA target sequence
gaaaaagtactgcacttaaaatatta

SEQ ID NO: 191801 - DNA, 26 bp, Artificial sequence
  SiRNA target sequence
aaaaagtactgcacttaaaatattat

SEQ ID NO: 191802 - DNA, 26 bp, Artificial sequence
  SiRNA target sequence
aaaagtactgcacttaaaatattatc

SEQ ID NO: 191803 - DNA, 26 bp, Artificial sequence
  SiRNA target sequence
aaagtactgcacttaaaatattatcg

SEQ ID NO: 191804 - DNA, 26 bp, Artificial sequence
  SiRNA target sequence
aagtactgcacttaaaatattatcgg

SEQ ID NO: 191805 - DNA, 26 bp, Artificial sequence
  SiRNA target sequence
agtactgcacttaaaatattatcggg

SEQ ID NO: 191806 - DNA, 26 bp, Artificial sequence
  SiRNA target sequence
gtactgcacttaaaatattatcgggc

SEQ ID NO: 191807 - DNA, 26 bp, Artificial sequence
  SiRNA target sequence
tactgcacttaaaatattatcgggca

SEQ ID NO: 191808 - DNA, 26 bp, Artificial sequence
  SiRNA target sequence
actgcacttaaaatattatcgggcaa

SEQ ID NO: 191809 - DNA, 26 bp, Artificial sequence
  SiRNA target sequence
ctgcacttaaaatattatcgggcaat

SEQ ID NO: 191810 - DNA, 26 bp, Artificial sequence
  SiRNA target sequence
tgcacttaaaatattatcgggcaatc

SEQ ID NO: 191811 - DNA, 26 bp, Artificial sequence
  SiRNA target sequence
gcacttaaaatattatcgggcaatct

SEQ ID NO: 191812 - DNA, 26 bp, Artificial sequence
  SiRNA target sequence
cacttaaaatattatcgggcaatctt

SEQ ID NO: 191813 - DNA, 26 bp, Artificial sequence
  SiRNA target sequence
acttaaaatattatcgggcaatctta

SEQ ID NO: 191814 - DNA, 26 bp, Artificial sequence
  SiRNA target sequence
cttaaaatattatcgggcaatcttaa

SEQ ID NO: 191815 - DNA, 26 bp, Artificial sequence
  SiRNA target sequence
ttaaaatattatcgggcaatcttaaa

SEQ ID NO: 191816 - DNA, 26 bp, Artificial sequence
  SiRNA target sequence
taaaatattatcgggcaatcttaaac

SEQ ID NO: 191817 - DNA, 26 bp, Artificial sequence
  SiRNA target sequence
aaaatattatcgggcaatcttaaacc

SEQ ID NO: 191818 - DNA, 26 bp, Artificial sequence
  SiRNA target sequence
aaatattatcgggcaatcttaaacca

SEQ ID NO: 191819 - DNA, 26 bp, Artificial sequence
  SiRNA target sequence
aatattatcgggcaatcttaaaccaa

SEQ ID NO: 191820 - DNA, 26 bp, Artificial sequence
  SiRNA target sequence
atattatcgggcaatcttaaaccaaa

SEQ ID NO: 191821 - DNA, 26 bp, Artificial sequence
  SiRNA target sequence
tattatcgggcaatcttaaaccaaac

SEQ ID NO: 191822 - DNA, 26 bp, Artificial sequence
  SiRNA target sequence
attatcgggcaatcttaaaccaaact

SEQ ID NO: 191823 - DNA, 26 bp, Artificial sequence
  SiRNA target sequence
ttatcgggcaatcttaaaccaaactt

SEQ ID NO: 191824 - DNA, 26 bp, Artificial sequence
  SiRNA target sequence
tatcgggcaatcttaaaccaaactta

SEQ ID NO: 191825 - DNA, 26 bp, Artificial sequence
  SiRNA target sequence
atcgggcaatcttaaaccaaacttag

SEQ ID NO: 191826 - DNA, 26 bp, Artificial sequence
  SiRNA target sequence
tcgggcaatcttaaaccaaacttagg

SEQ ID NO: 191827 - DNA, 26 bp, Artificial sequence
  SiRNA target sequence
cgggcaatcttaaaccaaacttagga

SEQ ID NO: 191828 - DNA, 26 bp, Artificial sequence
  SiRNA target sequence
gggcaatcttaaaccaaacttaggaa

SEQ ID NO: 191829 - DNA, 26 bp, Artificial sequence
  SiRNA target sequence
ggcaatcttaaaccaaacttaggaaa

SEQ ID NO: 191830 - DNA, 26 bp, Artificial sequence
  SiRNA target sequence
gcaatcttaaaccaaacttaggaaag

SEQ ID NO: 191831 - DNA, 26 bp, Artificial sequence
  SiRNA target sequence
caatcttaaaccaaacttaggaaagt

SEQ ID NO: 191832 - DNA, 26 bp, Artificial sequence
  SiRNA target sequence
aatcttaaaccaaacttaggaaagtt

SEQ ID NO: 191833 - DNA, 26 bp, Artificial sequence
  SiRNA target sequence
atcttaaaccaaacttaggaaagttc

SEQ ID NO: 191834 - DNA, 26 bp, Artificial sequence
  SiRNA target sequence
tcttaaaccaaacttaggaaagttcg

SEQ ID NO: 191835 - DNA, 26 bp, Artificial sequence
  SiRNA target sequence
cttaaaccaaacttaggaaagttcga

SEQ ID NO: 191836 - DNA, 26 bp, Artificial sequence
  SiRNA target sequence
ttaaaccaaacttaggaaagttcgac

SEQ ID NO: 191837 - DNA, 26 bp, Artificial sequence
  SiRNA target sequence
taaaccaaacttaggaaagttcgacg

SEQ ID NO: 191838 - DNA, 26 bp, Artificial sequence
  SiRNA target sequence
aaaccaaacttaggaaagttcgacgt

SEQ ID NO: 191839 - DNA, 26 bp, Artificial sequence
  SiRNA target sequence
aaccaaacttaggaaagttcgacgtt

SEQ ID NO: 191840 - DNA, 26 bp, Artificial sequence
  SiRNA target sequence
accaaacttaggaaagttcgacgtta

SEQ ID NO: 191841 - DNA, 26 bp, Artificial sequence
  SiRNA target sequence
ccaaacttaggaaagttcgacgttac

SEQ ID NO: 191842 - DNA, 26 bp, Artificial sequence
  SiRNA target sequence
caaacttaggaaagttcgacgttacg

SEQ ID NO: 191843 - DNA, 26 bp, Artificial sequence
  SiRNA target sequence
aaacttaggaaagttcgacgttacgc

SEQ ID NO: 191844 - DNA, 26 bp, Artificial sequence
  SiRNA target sequence
aacttaggaaagttcgacgttacgcc

SEQ ID NO: 191845 - DNA, 26 bp, Artificial sequence
  SiRNA target sequence
acttaggaaagttcgacgttacgccc

SEQ ID NO: 191846 - DNA, 26 bp, Artificial sequence
  SiRNA target sequence
cttaggaaagttcgacgttacgcccg

SEQ ID NO: 191847 - DNA, 26 bp, Artificial sequence
  SiRNA target sequence
ttaggaaagttcgacgttacgcccga

SEQ ID NO: 191848 - DNA, 26 bp, Artificial sequence
  SiRNA target sequence
taggaaagttcgacgttacgcccgac

SEQ ID NO: 191849 - DNA, 26 bp, Artificial sequence
  SiRNA target sequence
aggaaagttcgacgttacgcccgact

SEQ ID NO: 191850 - DNA, 26 bp, Artificial sequence
  SiRNA target sequence
ggaaagttcgacgttacgcccgactg

SEQ ID NO: 191851 - DNA, 26 bp, Artificial sequence
  SiRNA target sequence
gaaagttcgacgttacgcccgactgg

SEQ ID NO: 191852 - DNA, 26 bp, Artificial sequence
  SiRNA target sequence
aaagttcgacgttacgcccgactggg

SEQ ID NO: 191853 - DNA, 26 bp, Artificial sequence
  SiRNA target sequence
aagttcgacgttacgcccgactgggc

SEQ ID NO: 191854 - DNA, 26 bp, Artificial sequence
  SiRNA target sequence
agttcgacgttacgcccgactgggca

SEQ ID NO: 191855 - DNA, 26 bp, Artificial sequence
  SiRNA target sequence
gttcgacgttacgcccgactgggcag

SEQ ID NO: 191856 - DNA, 26 bp, Artificial sequence
  SiRNA target sequence
ttcgacgttacgcccgactgggcagc

SEQ ID NO: 191857 - DNA, 26 bp, Artificial sequence
  SiRNA target sequence
tcgacgttacgcccgactgggcagca

SEQ ID NO: 191858 - DNA, 26 bp, Artificial sequence
  SiRNA target sequence
cgacgttacgcccgactgggcagcaa

SEQ ID NO: 191859 - DNA, 26 bp, Artificial sequence
  SiRNA target sequence
gacgttacgcccgactgggcagcaat

SEQ ID NO: 191860 - DNA, 26 bp, Artificial sequence
  SiRNA target sequence
acgttacgcccgactgggcagcaatt

SEQ ID NO: 191861 - DNA, 26 bp, Artificial sequence
  SiRNA target sequence
cgttacgcccgactgggcagcaattc

SEQ ID NO: 191862 - DNA, 26 bp, Artificial sequence
  SiRNA target sequence
gttacgcccgactgggcagcaattct

SEQ ID NO: 191863 - DNA, 26 bp, Artificial sequence
  SiRNA target sequence
ttacgcccgactgggcagcaattcta

SEQ ID NO: 191864 - DNA, 26 bp, Artificial sequence
  SiRNA target sequence
tacgcccgactgggcagcaattctaa

SEQ ID NO: 191865 - DNA, 26 bp, Artificial sequence
  SiRNA target sequence
acgcccgactgggcagcaattctaaa

SEQ ID NO: 191866 - DNA, 26 bp, Artificial sequence
  SiRNA target sequence
cgcccgactgggcagcaattctaaat

SEQ ID NO: 191867 - DNA, 26 bp, Artificial sequence
  SiRNA target sequence
gcccgactgggcagcaattctaaata

SEQ ID NO: 191868 - DNA, 26 bp, Artificial sequence
  SiRNA target sequence
cccgactgggcagcaattctaaataa

SEQ ID NO: 191869 - DNA, 26 bp, Artificial sequence
  SiRNA target sequence
ccgactgggcagcaattctaaataat

SEQ ID NO: 191870 - DNA, 26 bp, Artificial sequence
  SiRNA target sequence
cgactgggcagcaattctaaataatt

SEQ ID NO: 191871 - DNA, 26 bp, Artificial sequence
  SiRNA target sequence
gactgggcagcaattctaaataatta

SEQ ID NO: 191872 - DNA, 26 bp, Artificial sequence
  SiRNA target sequence
actgggcagcaattctaaataattat

SEQ ID NO: 191873 - DNA, 26 bp, Artificial sequence
  SiRNA target sequence
ctgggcagcaattctaaataattata

SEQ ID NO: 191874 - DNA, 26 bp, Artificial sequence
  SiRNA target sequence
tgggcagcaattctaaataattataa

SEQ ID NO: 191875 - DNA, 26 bp, Artificial sequence
  SiRNA target sequence
gggcagcaattctaaataattataaa

SEQ ID NO: 191876 - DNA, 26 bp, Artificial sequence
  SiRNA target sequence
ggcagcaattctaaataattataaag

SEQ ID NO: 191877 - DNA, 26 bp, Artificial sequence
  SiRNA target sequence
gcagcaattctaaataattataaagg

SEQ ID NO: 191878 - DNA, 26 bp, Artificial sequence
  SiRNA target sequence
cagcaattctaaataattataaagga

SEQ ID NO: 191879 - DNA, 26 bp, Artificial sequence
  SiRNA target sequence
agcaattctaaataattataaaggat

SEQ ID NO: 191880 - DNA, 26 bp, Artificial sequence
  SiRNA target sequence
gcaattctaaataattataaaggatc

SEQ ID NO: 191881 - DNA, 26 bp, Artificial sequence
  SiRNA target sequence
caattctaaataattataaaggatct

SEQ ID NO: 191882 - DNA, 26 bp, Artificial sequence
  SiRNA target sequence
aattctaaataattataaaggatctg

SEQ ID NO: 191883 - DNA, 26 bp, Artificial sequence
  SiRNA target sequence
attctaaataattataaaggatctga

SEQ ID NO: 191884 - DNA, 26 bp, Artificial sequence
  SiRNA target sequence
ttctaaataattataaaggatctgaa

SEQ ID NO: 191885 - DNA, 26 bp, Artificial sequence
  SiRNA target sequence
tctaaataattataaaggatctgaac

SEQ ID NO: 191886 - DNA, 26 bp, Artificial sequence
  SiRNA target sequence
ctaaataattataaaggatctgaact

SEQ ID NO: 191887 - DNA, 26 bp, Artificial sequence
  SiRNA target sequence
taaataattataaaggatctgaactt

SEQ ID NO: 191888 - DNA, 26 bp, Artificial sequence
  SiRNA target sequence
aaataattataaaggatctgaacttc

SEQ ID NO: 191889 - DNA, 26 bp, Artificial sequence
  SiRNA target sequence
aataattataaaggatctgaacttca

SEQ ID NO: 191890 - DNA, 26 bp, Artificial sequence
  SiRNA target sequence
ataattataaaggatctgaacttcat

SEQ ID NO: 191891 - DNA, 26 bp, Artificial sequence
  SiRNA target sequence
taattataaaggatctgaacttcatg

SEQ ID NO: 191892 - DNA, 26 bp, Artificial sequence
  SiRNA target sequence
aattataaaggatctgaacttcatgg

SEQ ID NO: 191893 - DNA, 26 bp, Artificial sequence
  SiRNA target sequence
attataaaggatctgaacttcatgga

SEQ ID NO: 191894 - DNA, 26 bp, Artificial sequence
  SiRNA target sequence
ttataaaggatctgaacttcatggat

SEQ ID NO: 191895 - DNA, 26 bp, Artificial sequence
  SiRNA target sequence
tataaaggatctgaacttcatggatt

SEQ ID NO: 191896 - DNA, 26 bp, Artificial sequence
  SiRNA target sequence
ataaaggatctgaacttcatggattt

SEQ ID NO: 191897 - DNA, 26 bp, Artificial sequence
  SiRNA target sequence
taaaggatctgaacttcatggatttt

SEQ ID NO: 191898 - DNA, 26 bp, Artificial sequence
  SiRNA target sequence
aaaggatctgaacttcatggattttt

SEQ ID NO: 191899 - DNA, 26 bp, Artificial sequence
  SiRNA target sequence
aaggatctgaacttcatggatttttt

SEQ ID NO: 191900 - DNA, 26 bp, Artificial sequence
  SiRNA target sequence
aggatctgaacttcatggatttttta

SEQ ID NO: 191901 - DNA, 26 bp, Artificial sequence
  SiRNA target sequence
ggatctgaacttcatggattttttac

SEQ ID NO: 191902 - DNA, 26 bp, Artificial sequence
  SiRNA target sequence
gatctgaacttcatggattttttact

SEQ ID NO: 191903 - DNA, 26 bp, Artificial sequence
  SiRNA target sequence
atctgaacttcatggattttttacta

SEQ ID NO: 191904 - DNA, 26 bp, Artificial sequence
  SiRNA target sequence
tctgaacttcatggattttttactaa

SEQ ID NO: 191905 - DNA, 26 bp, Artificial sequence
  SiRNA target sequence
ctgaacttcatggattttttactaaa

SEQ ID NO: 191906 - DNA, 26 bp, Artificial sequence
  SiRNA target sequence
tgaacttcatggattttttactaaaa

SEQ ID NO: 191907 - DNA, 26 bp, Artificial sequence
  SiRNA target sequence
gaacttcatggattttttactaaaat

SEQ ID NO: 191908 - DNA, 26 bp, Artificial sequence
  SiRNA target sequence
aacttcatggattttttactaaaatt

SEQ ID NO: 191909 - DNA, 26 bp, Artificial sequence
  SiRNA target sequence
acttcatggattttttactaaaattt

SEQ ID NO: 191910 - DNA, 26 bp, Artificial sequence
  SiRNA target sequence
cttcatggattttttactaaaatttt

SEQ ID NO: 191911 - DNA, 26 bp, Artificial sequence
  SiRNA target sequence
ttcatggattttttactaaaatttta

SEQ ID NO: 191912 - DNA, 26 bp, Artificial sequence
  SiRNA target sequence
tcatggattttttactaaaattttag

SEQ ID NO: 191913 - DNA, 26 bp, Artificial sequence
  SiRNA target sequence
catggattttttactaaaattttaga

SEQ ID NO: 191914 - DNA, 26 bp, Artificial sequence
  SiRNA target sequence
atggattttttactaaaattttagaa

SEQ ID NO: 191915 - DNA, 26 bp, Artificial sequence
  SiRNA target sequence
tggattttttactaaaattttagaag

SEQ ID NO: 191916 - DNA, 26 bp, Artificial sequence
  SiRNA target sequence
ggattttttactaaaattttagaagg

SEQ ID NO: 191917 - DNA, 26 bp, Artificial sequence
  SiRNA target sequence
gattttttactaaaattttagaaggg

SEQ ID NO: 191918 - DNA, 26 bp, Artificial sequence
  SiRNA target sequence
attttttactaaaattttagaagggt

SEQ ID NO: 191919 - DNA, 26 bp, Artificial sequence
  SiRNA target sequence
ttttttactaaaattttagaagggtc

SEQ ID NO: 191920 - DNA, 26 bp, Artificial sequence
  SiRNA target sequence
tttttactaaaattttagaagggtct

SEQ ID NO: 191921 - DNA, 26 bp, Artificial sequence
  SiRNA target sequence
ttttactaaaattttagaagggtcta

SEQ ID NO: 191922 - DNA, 26 bp, Artificial sequence
  SiRNA target sequence
tttactaaaattttagaagggtctat

SEQ ID NO: 191923 - DNA, 26 bp, Artificial sequence
  SiRNA target sequence
ttactaaaattttagaagggtctatt

SEQ ID NO: 191924 - DNA, 26 bp, Artificial sequence
  SiRNA target sequence
tactaaaattttagaagggtctatta

SEQ ID NO: 191925 - DNA, 26 bp, Artificial sequence
  SiRNA target sequence
actaaaattttagaagggtctattaa

SEQ ID NO: 191926 - DNA, 26 bp, Artificial sequence
  SiRNA target sequence
ctaaaattttagaagggtctattaaa

SEQ ID NO: 191927 - DNA, 26 bp, Artificial sequence
  SiRNA target sequence
taaaattttagaagggtctattaaag

SEQ ID NO: 191928 - DNA, 26 bp, Artificial sequence
  SiRNA target sequence
aaaattttagaagggtctattaaagc

SEQ ID NO: 191929 - DNA, 26 bp, Artificial sequence
  SiRNA target sequence
aaattttagaagggtctattaaagct

SEQ ID NO: 191930 - DNA, 26 bp, Artificial sequence
  SiRNA target sequence
aattttagaagggtctattaaagcta

SEQ ID NO: 191931 - DNA, 26 bp, Artificial sequence
  SiRNA target sequence
attttagaagggtctattaaagctat

SEQ ID NO: 191932 - DNA, 26 bp, Artificial sequence
  SiRNA target sequence
ttttagaagggtctattaaagctatt

SEQ ID NO: 191933 - DNA, 26 bp, Artificial sequence
  SiRNA target sequence
tttagaagggtctattaaagctattt

SEQ ID NO: 191934 - DNA, 26 bp, Artificial sequence
  SiRNA target sequence
ttagaagggtctattaaagctatttc

SEQ ID NO: 191935 - DNA, 26 bp, Artificial sequence
  SiRNA target sequence
tagaagggtctattaaagctatttct

SEQ ID NO: 191936 - DNA, 26 bp, Artificial sequence
  SiRNA target sequence
agaagggtctattaaagctatttcta

SEQ ID NO: 191937 - DNA, 26 bp, Artificial sequence
  SiRNA target sequence
gaagggtctattaaagctatttctaa

SEQ ID NO: 191938 - DNA, 26 bp, Artificial sequence
  SiRNA target sequence
aagggtctattaaagctatttctaag

SEQ ID NO: 191939 - DNA, 26 bp, Artificial sequence
  SiRNA target sequence
agggtctattaaagctatttctaaga

SEQ ID NO: 191940 - DNA, 26 bp, Artificial sequence
  SiRNA target sequence
gggtctattaaagctatttctaagat

SEQ ID NO: 191941 - DNA, 26 bp, Artificial sequence
  SiRNA target sequence
ggtctattaaagctatttctaagata

SEQ ID NO: 191942 - DNA, 26 bp, Artificial sequence
  SiRNA target sequence
gtctattaaagctatttctaagatac

SEQ ID NO: 191943 - DNA, 26 bp, Artificial sequence
  SiRNA target sequence
tctattaaagctatttctaagataca

SEQ ID NO: 191944 - DNA, 26 bp, Artificial sequence
  SiRNA target sequence
ctattaaagctatttctaagatacag

SEQ ID NO: 191945 - DNA, 26 bp, Artificial sequence
  SiRNA target sequence
tattaaagctatttctaagatacagt

SEQ ID NO: 191946 - DNA, 26 bp, Artificial sequence
  SiRNA target sequence
attaaagctatttctaagatacagta

SEQ ID NO: 191947 - DNA, 26 bp, Artificial sequence
  SiRNA target sequence
ttaaagctatttctaagatacagtat

SEQ ID NO: 191948 - DNA, 26 bp, Artificial sequence
  SiRNA target sequence
taaagctatttctaagatacagtata

SEQ ID NO: 191949 - DNA, 26 bp, Artificial sequence
  SiRNA target sequence
aaagctatttctaagatacagtatat

SEQ ID NO: 191950 - DNA, 26 bp, Artificial sequence
  SiRNA target sequence
aagctatttctaagatacagtatata

SEQ ID NO: 191951 - DNA, 26 bp, Artificial sequence
  SiRNA target sequence
agctatttctaagatacagtatatag

SEQ ID NO: 191952 - DNA, 26 bp, Artificial sequence
  SiRNA target sequence
gctatttctaagatacagtatataga

SEQ ID NO: 191953 - DNA, 26 bp, Artificial sequence
  SiRNA target sequence
ctatttctaagatacagtatatagat

SEQ ID NO: 191954 - DNA, 26 bp, Artificial sequence
  SiRNA target sequence
tatttctaagatacagtatatagata

SEQ ID NO: 191955 - DNA, 26 bp, Artificial sequence
  SiRNA target sequence
atttctaagatacagtatatagataa

SEQ ID NO: 191956 - DNA, 26 bp, Artificial sequence
  SiRNA target sequence
tttctaagatacagtatatagataaa

SEQ ID NO: 191957 - DNA, 26 bp, Artificial sequence
  SiRNA target sequence
ttctaagatacagtatatagataaaa

SEQ ID NO: 191958 - DNA, 26 bp, Artificial sequence
  SiRNA target sequence
tctaagatacagtatatagataaaat

SEQ ID NO: 191959 - DNA, 26 bp, Artificial sequence
  SiRNA target sequence
ctaagatacagtatatagataaaatg

SEQ ID NO: 191960 - DNA, 26 bp, Artificial sequence
  SiRNA target sequence
taagatacagtatatagataaaatgc

SEQ ID NO: 191961 - DNA, 26 bp, Artificial sequence
  SiRNA target sequence
aagatacagtatatagataaaatgcc

SEQ ID NO: 191962 - DNA, 26 bp, Artificial sequence
  SiRNA target sequence
agatacagtatatagataaaatgcct

SEQ ID NO: 191963 - DNA, 26 bp, Artificial sequence
  SiRNA target sequence
gatacagtatatagataaaatgccta

SEQ ID NO: 191964 - DNA, 26 bp, Artificial sequence
  SiRNA target sequence
atacagtatatagataaaatgcctaa

SEQ ID NO: 191965 - DNA, 26 bp, Artificial sequence
  SiRNA target sequence
tacagtatatagataaaatgcctaaa

SEQ ID NO: 191966 - DNA, 26 bp, Artificial sequence
  SiRNA target sequence
acagtatatagataaaatgcctaaat

SEQ ID NO: 191967 - DNA, 26 bp, Artificial sequence
  SiRNA target sequence
cagtatatagataaaatgcctaaatt

SEQ ID NO: 191968 - DNA, 26 bp, Artificial sequence
  SiRNA target sequence
agtatatagataaaatgcctaaattt

SEQ ID NO: 191969 - DNA, 26 bp, Artificial sequence
  SiRNA target sequence
gtatatagataaaatgcctaaatttt

SEQ ID NO: 191970 - DNA, 26 bp, Artificial sequence
  SiRNA target sequence
tatatagataaaatgcctaaattttt

SEQ ID NO: 191971 - DNA, 26 bp, Artificial sequence
  SiRNA target sequence
atatagataaaatgcctaaattttta

SEQ ID NO: 191972 - DNA, 26 bp, Artificial sequence
  SiRNA target sequence
tatagataaaatgcctaaatttttaa

SEQ ID NO: 191973 - DNA, 26 bp, Artificial sequence
  SiRNA target sequence
atagataaaatgcctaaatttttaaa

SEQ ID NO: 191974 - DNA, 26 bp, Artificial sequence
  SiRNA target sequence
tagataaaatgcctaaatttttaaaa

SEQ ID NO: 191975 - DNA, 26 bp, Artificial sequence
  SiRNA target sequence
agataaaatgcctaaatttttaaaag

SEQ ID NO: 191976 - DNA, 26 bp, Artificial sequence
  SiRNA target sequence
gataaaatgcctaaatttttaaaagg

SEQ ID NO: 191977 - DNA, 26 bp, Artificial sequence
  SiRNA target sequence
ataaaatgcctaaatttttaaaagga

SEQ ID NO: 191978 - DNA, 26 bp, Artificial sequence
  SiRNA target sequence
taaaatgcctaaatttttaaaaggac

SEQ ID NO: 191979 - DNA, 26 bp, Artificial sequence
  SiRNA target sequence
aaaatgcctaaatttttaaaaggacg

SEQ ID NO: 191980 - DNA, 26 bp, Artificial sequence
  SiRNA target sequence
aaatgcctaaatttttaaaaggacgc

SEQ ID NO: 191981 - DNA, 26 bp, Artificial sequence
  SiRNA target sequence
aatgcctaaatttttaaaaggacgct

SEQ ID NO: 191982 - DNA, 26 bp, Artificial sequence
  SiRNA target sequence
atgcctaaatttttaaaaggacgcta

SEQ ID NO: 191983 - DNA, 26 bp, Artificial sequence
  SiRNA target sequence
tgcctaaatttttaaaaggacgctat

SEQ ID NO: 191984 - DNA, 26 bp, Artificial sequence
  SiRNA target sequence
gcctaaatttttaaaaggacgctata

SEQ ID NO: 191985 - DNA, 26 bp, Artificial sequence
  SiRNA target sequence
cctaaatttttaaaaggacgctataa

SEQ ID NO: 191986 - DNA, 26 bp, Artificial sequence
  SiRNA target sequence
ctaaatttttaaaaggacgctataag

SEQ ID NO: 191987 - DNA, 26 bp, Artificial sequence
  SiRNA target sequence
taaatttttaaaaggacgctataagt

SEQ ID NO: 191988 - DNA, 26 bp, Artificial sequence
  SiRNA target sequence
aaatttttaaaaggacgctataagtc

SEQ ID NO: 191989 - DNA, 26 bp, Artificial sequence
  SiRNA target sequence
aatttttaaaaggacgctataagtca

SEQ ID NO: 191990 - DNA, 26 bp, Artificial sequence
  SiRNA target sequence
atttttaaaaggacgctataagtcag

SEQ ID NO: 191991 - DNA, 26 bp, Artificial sequence
  SiRNA target sequence
tttttaaaaggacgctataagtcaga

SEQ ID NO: 191992 - DNA, 26 bp, Artificial sequence
  SiRNA target sequence
ttttaaaaggacgctataagtcagaa

SEQ ID NO: 191993 - DNA, 26 bp, Artificial sequence
  SiRNA target sequence
tttaaaaggacgctataagtcagaaa

SEQ ID NO: 191994 - DNA, 26 bp, Artificial sequence
  SiRNA target sequence
ttaaaaggacgctataagtcagaaat

SEQ ID NO: 191995 - DNA, 26 bp, Artificial sequence
  SiRNA target sequence
taaaaggacgctataagtcagaaatc

SEQ ID NO: 191996 - DNA, 26 bp, Artificial sequence
  SiRNA target sequence
aaaaggacgctataagtcagaaatcg

SEQ ID NO: 191997 - DNA, 26 bp, Artificial sequence
  SiRNA target sequence
aaaggacgctataagtcagaaatcgc

SEQ ID NO: 191998 - DNA, 26 bp, Artificial sequence
  SiRNA target sequence
aaggacgctataagtcagaaatcgcc

SEQ ID NO: 191999 - DNA, 26 bp, Artificial sequence
  SiRNA target sequence
aggacgctataagtcagaaatcgcct

SEQ ID NO: 192000 - DNA, 26 bp, Artificial sequence
  SiRNA target sequence
ggacgctataagtcagaaatcgcctc

SEQ ID NO: 192001 - DNA, 26 bp, Artificial sequence
  SiRNA target sequence
gacgctataagtcagaaatcgcctcc

SEQ ID NO: 192002 - DNA, 26 bp, Artificial sequence
  SiRNA target sequence
acgctataagtcagaaatcgcctccg

SEQ ID NO: 192003 - DNA, 26 bp, Artificial sequence
  SiRNA target sequence
cgctataagtcagaaatcgcctccgg

SEQ ID NO: 192004 - DNA, 26 bp, Artificial sequence
  SiRNA target sequence
gctataagtcagaaatcgcctccgga

SEQ ID NO: 192005 - DNA, 26 bp, Artificial sequence
  SiRNA target sequence
ctataagtcagaaatcgcctccggaa

SEQ ID NO: 192006 - DNA, 26 bp, Artificial sequence
  SiRNA target sequence
tataagtcagaaatcgcctccggaaa

SEQ ID NO: 192007 - DNA, 26 bp, Artificial sequence
  SiRNA target sequence
ataagtcagaaatcgcctccggaaaa

SEQ ID NO: 192008 - DNA, 26 bp, Artificial sequence
  SiRNA target sequence
taagtcagaaatcgcctccggaaaaa

SEQ ID NO: 192009 - DNA, 26 bp, Artificial sequence
  SiRNA target sequence
aagtcagaaatcgcctccggaaaaat

SEQ ID NO: 192010 - DNA, 26 bp, Artificial sequence
  SiRNA target sequence
agtcagaaatcgcctccggaaaaatg

SEQ ID NO: 192011 - DNA, 26 bp, Artificial sequence
  SiRNA target sequence
gtcagaaatcgcctccggaaaaatgt

SEQ ID NO: 192012 - DNA, 26 bp, Artificial sequence
  SiRNA target sequence
tcagaaatcgcctccggaaaaatgtt

SEQ ID NO: 192013 - DNA, 26 bp, Artificial sequence
  SiRNA target sequence
cagaaatcgcctccggaaaaatgttg

SEQ ID NO: 192014 - DNA, 26 bp, Artificial sequence
  SiRNA target sequence
agaaatcgcctccggaaaaatgttgt

SEQ ID NO: 192015 - DNA, 26 bp, Artificial sequence
  SiRNA target sequence
gaaatcgcctccggaaaaatgttgtt

SEQ ID NO: 192016 - DNA, 26 bp, Artificial sequence
  SiRNA target sequence
aaatcgcctccggaaaaatgttgttt

SEQ ID NO: 192017 - DNA, 26 bp, Artificial sequence
  SiRNA target sequence
aatcgcctccggaaaaatgttgttta

SEQ ID NO: 192018 - DNA, 26 bp, Artificial sequence
  SiRNA target sequence
atcgcctccggaaaaatgttgtttac

SEQ ID NO: 192019 - DNA, 26 bp, Artificial sequence
  SiRNA target sequence
tcgcctccggaaaaatgttgtttact

SEQ ID NO: 192020 - DNA, 26 bp, Artificial sequence
  SiRNA target sequence
cgcctccggaaaaatgttgtttactg

SEQ ID NO: 192021 - DNA, 26 bp, Artificial sequence
  SiRNA target sequence
gcctccggaaaaatgttgtttactgt

SEQ ID NO: 192022 - DNA, 26 bp, Artificial sequence
  SiRNA target sequence
cctccggaaaaatgttgtttactgtt

SEQ ID NO: 192023 - DNA, 26 bp, Artificial sequence
  SiRNA target sequence
ctccggaaaaatgttgtttactgtta

SEQ ID NO: 192024 - DNA, 26 bp, Artificial sequence
  SiRNA target sequence
tccggaaaaatgttgtttactgttaa

SEQ ID NO: 192025 - DNA, 26 bp, Artificial sequence
  SiRNA target sequence
ccggaaaaatgttgtttactgttaat

SEQ ID NO: 192026 - DNA, 26 bp, Artificial sequence
  SiRNA target sequence
cggaaaaatgttgtttactgttaatg

SEQ ID NO: 192027 - DNA, 26 bp, Artificial sequence
  SiRNA target sequence
ggaaaaatgttgtttactgttaatga

SEQ ID NO: 192028 - DNA, 26 bp, Artificial sequence
  SiRNA target sequence
gaaaaatgttgtttactgttaatgat

SEQ ID NO: 192029 - DNA, 26 bp, Artificial sequence
  SiRNA target sequence
aaaaatgttgtttactgttaatgata

SEQ ID NO: 192030 - DNA, 26 bp, Artificial sequence
  SiRNA target sequence
aaaatgttgtttactgttaatgatat

SEQ ID NO: 192031 - DNA, 26 bp, Artificial sequence
  SiRNA target sequence
aaatgttgtttactgttaatgatata

SEQ ID NO: 192032 - DNA, 26 bp, Artificial sequence
  SiRNA target sequence
aatgttgtttactgttaatgatatat

SEQ ID NO: 192033 - DNA, 26 bp, Artificial sequence
  SiRNA target sequence
atgttgtttactgttaatgatatatt

SEQ ID NO: 192034 - DNA, 26 bp, Artificial sequence
  SiRNA target sequence
tgttgtttactgttaatgatatatta

SEQ ID NO: 192035 - DNA, 26 bp, Artificial sequence
  SiRNA target sequence
gttgtttactgttaatgatatattaa

SEQ ID NO: 192036 - DNA, 26 bp, Artificial sequence
  SiRNA target sequence
ttgtttactgttaatgatatattaaa

SEQ ID NO: 192037 - DNA, 26 bp, Artificial sequence
  SiRNA target sequence
tgtttactgttaatgatatattaaaa

SEQ ID NO: 192038 - DNA, 26 bp, Artificial sequence
  SiRNA target sequence
gtttactgttaatgatatattaaaaa

SEQ ID NO: 192039 - DNA, 26 bp, Artificial sequence
  SiRNA target sequence
tttactgttaatgatatattaaaaaa

SEQ ID NO: 192040 - DNA, 26 bp, Artificial sequence
  SiRNA target sequence
ttactgttaatgatatattaaaaaaa

SEQ ID NO: 192041 - DNA, 26 bp, Artificial sequence
  SiRNA target sequence
tactgttaatgatatattaaaaaaag

SEQ ID NO: 192042 - DNA, 26 bp, Artificial sequence
  SiRNA target sequence
actgttaatgatatattaaaaaaagt

SEQ ID NO: 192043 - DNA, 26 bp, Artificial sequence
  SiRNA target sequence
ctgttaatgatatattaaaaaaagtt

SEQ ID NO: 192044 - DNA, 26 bp, Artificial sequence
  SiRNA target sequence
tgttaatgatatattaaaaaaagttg

SEQ ID NO: 192045 - DNA, 26 bp, Artificial sequence
  SiRNA target sequence
gttaatgatatattaaaaaaagttga

SEQ ID NO: 192046 - DNA, 26 bp, Artificial sequence
  SiRNA target sequence
ttaatgatatattaaaaaaagttgat

SEQ ID NO: 192047 - DNA, 26 bp, Artificial sequence
  SiRNA target sequence
taatgatatattaaaaaaagttgatg

SEQ ID NO: 192048 - DNA, 26 bp, Artificial sequence
  SiRNA target sequence
aatgatatattaaaaaaagttgatga

SEQ ID NO: 192049 - DNA, 26 bp, Artificial sequence
  SiRNA target sequence
atgatatattaaaaaaagttgatgaa

SEQ ID NO: 192050 - DNA, 26 bp, Artificial sequence
  SiRNA target sequence
tgatatattaaaaaaagttgatgaaa

SEQ ID NO: 192051 - DNA, 26 bp, Artificial sequence
  SiRNA target sequence
gatatattaaaaaaagttgatgaaaa

SEQ ID NO: 192052 - DNA, 26 bp, Artificial sequence
  SiRNA target sequence
atatattaaaaaaagttgatgaaaaa

SEQ ID NO: 192053 - DNA, 26 bp, Artificial sequence
  SiRNA target sequence
tatattaaaaaaagttgatgaaaaaa

SEQ ID NO: 192054 - DNA, 26 bp, Artificial sequence
  SiRNA target sequence
atattaaaaaaagttgatgaaaaaaa

SEQ ID NO: 192055 - DNA, 26 bp, Artificial sequence
  SiRNA target sequence
tattaaaaaaagttgatgaaaaaaat

SEQ ID NO: 192056 - DNA, 26 bp, Artificial sequence
  SiRNA target sequence
attaaaaaaagttgatgaaaaaaata

SEQ ID NO: 192057 - DNA, 26 bp, Artificial sequence
  SiRNA target sequence
ttaaaaaaagttgatgaaaaaaataa

SEQ ID NO: 192058 - DNA, 26 bp, Artificial sequence
  SiRNA target sequence
taaaaaaagttgatgaaaaaaataaa

SEQ ID NO: 192059 - DNA, 26 bp, Artificial sequence
  SiRNA target sequence
aaaaaaagttgatgaaaaaaataaat

SEQ ID NO: 192060 - DNA, 26 bp, Artificial sequence
  SiRNA target sequence
aaaaaagttgatgaaaaaaataaatt

SEQ ID NO: 192061 - DNA, 26 bp, Artificial sequence
  SiRNA target sequence
aaaaagttgatgaaaaaaataaattt

SEQ ID NO: 192062 - DNA, 26 bp, Artificial sequence
  SiRNA target sequence
aaaagttgatgaaaaaaataaatttg

SEQ ID NO: 192063 - DNA, 26 bp, Artificial sequence
  SiRNA target sequence
aaagttgatgaaaaaaataaatttga

SEQ ID NO: 192064 - DNA, 26 bp, Artificial sequence
  SiRNA target sequence
aagttgatgaaaaaaataaatttgac

SEQ ID NO: 192065 - DNA, 26 bp, Artificial sequence
  SiRNA target sequence
agttgatgaaaaaaataaatttgact

SEQ ID NO: 192066 - DNA, 26 bp, Artificial sequence
  SiRNA target sequence
gttgatgaaaaaaataaatttgacta

SEQ ID NO: 192067 - DNA, 26 bp, Artificial sequence
  SiRNA target sequence
ttgatgaaaaaaataaatttgactat

SEQ ID NO: 192068 - DNA, 26 bp, Artificial sequence
  SiRNA target sequence
tgatgaaaaaaataaatttgactatt

SEQ ID NO: 192069 - DNA, 26 bp, Artificial sequence
  SiRNA target sequence
gatgaaaaaaataaatttgactatta

SEQ ID NO: 192070 - DNA, 26 bp, Artificial sequence
  SiRNA target sequence
atgaaaaaaataaatttgactattac

SEQ ID NO: 192071 - DNA, 26 bp, Artificial sequence
  SiRNA target sequence
tgaaaaaaataaatttgactattacg

SEQ ID NO: 192072 - DNA, 26 bp, Artificial sequence
  SiRNA target sequence
gaaaaaaataaatttgactattacgt

SEQ ID NO: 192073 - DNA, 26 bp, Artificial sequence
  SiRNA target sequence
aaaaaaataaatttgactattacgta

SEQ ID NO: 192074 - DNA, 26 bp, Artificial sequence
  SiRNA target sequence
aaaaaataaatttgactattacgtag

SEQ ID NO: 192075 - DNA, 26 bp, Artificial sequence
  SiRNA target sequence
aaaaataaatttgactattacgtaga

SEQ ID NO: 192076 - DNA, 26 bp, Artificial sequence
  SiRNA target sequence
aaaataaatttgactattacgtagat

SEQ ID NO: 192077 - DNA, 26 bp, Artificial sequence
  SiRNA target sequence
aaataaatttgactattacgtagata

SEQ ID NO: 192078 - DNA, 26 bp, Artificial sequence
  SiRNA target sequence
aataaatttgactattacgtagataa

SEQ ID NO: 192079 - DNA, 26 bp, Artificial sequence
  SiRNA target sequence
ataaatttgactattacgtagataaa

SEQ ID NO: 192080 - DNA, 26 bp, Artificial sequence
  SiRNA target sequence
taaatttgactattacgtagataaaa

SEQ ID NO: 192081 - DNA, 26 bp, Artificial sequence
  SiRNA target sequence
aaatttgactattacgtagataaaat

SEQ ID NO: 192082 - DNA, 26 bp, Artificial sequence
  SiRNA target sequence
aatttgactattacgtagataaaatg

SEQ ID NO: 192083 - DNA, 26 bp, Artificial sequence
  SiRNA target sequence
atttgactattacgtagataaaatgg

SEQ ID NO: 192084 - DNA, 26 bp, Artificial sequence
  SiRNA target sequence
tttgactattacgtagataaaatggc

SEQ ID NO: 192085 - DNA, 26 bp, Artificial sequence
  SiRNA target sequence
ttgactattacgtagataaaatggca

SEQ ID NO: 192086 - DNA, 26 bp, Artificial sequence
  SiRNA target sequence
tgactattacgtagataaaatggcac

SEQ ID NO: 192087 - DNA, 26 bp, Artificial sequence
  SiRNA target sequence
gactattacgtagataaaatggcact

SEQ ID NO: 192088 - DNA, 26 bp, Artificial sequence
  SiRNA target sequence
actattacgtagataaaatggcactt

SEQ ID NO: 192089 - DNA, 26 bp, Artificial sequence
  SiRNA target sequence
ctattacgtagataaaatggcactta

SEQ ID NO: 192090 - DNA, 26 bp, Artificial sequence
  SiRNA target sequence
tattacgtagataaaatggcacttaa

SEQ ID NO: 192091 - DNA, 26 bp, Artificial sequence
  SiRNA target sequence
attacgtagataaaatggcacttaaa

SEQ ID NO: 192092 - DNA, 26 bp, Artificial sequence
  SiRNA target sequence
ttacgtagataaaatggcacttaaaa

SEQ ID NO: 192093 - DNA, 26 bp, Artificial sequence
  SiRNA target sequence
tacgtagataaaatggcacttaaaaa

SEQ ID NO: 192094 - DNA, 26 bp, Artificial sequence
  SiRNA target sequence
acgtagataaaatggcacttaaaaat

SEQ ID NO: 192095 - DNA, 26 bp, Artificial sequence
  SiRNA target sequence
cgtagataaaatggcacttaaaaatg

SEQ ID NO: 192096 - DNA, 26 bp, Artificial sequence
  SiRNA target sequence
gtagataaaatggcacttaaaaatgt

SEQ ID NO: 192097 - DNA, 26 bp, Artificial sequence
  SiRNA target sequence
tagataaaatggcacttaaaaatgta

SEQ ID NO: 192098 - DNA, 26 bp, Artificial sequence
  SiRNA target sequence
agataaaatggcacttaaaaatgtat

SEQ ID NO: 192099 - DNA, 26 bp, Artificial sequence
  SiRNA target sequence
gataaaatggcacttaaaaatgtatt

SEQ ID NO: 192100 - DNA, 26 bp, Artificial sequence
  SiRNA target sequence
ataaaatggcacttaaaaatgtatta

SEQ ID NO: 192101 - DNA, 26 bp, Artificial sequence
  SiRNA target sequence
taaaatggcacttaaaaatgtattaa

SEQ ID NO: 192102 - DNA, 26 bp, Artificial sequence
  SiRNA target sequence
aaaatggcacttaaaaatgtattaac

SEQ ID NO: 192103 - DNA, 26 bp, Artificial sequence
  SiRNA target sequence
aaatggcacttaaaaatgtattaaca

SEQ ID NO: 192104 - DNA, 26 bp, Artificial sequence
  SiRNA target sequence
aatggcacttaaaaatgtattaacaa

SEQ ID NO: 192105 - DNA, 26 bp, Artificial sequence
  SiRNA target sequence
atggcacttaaaaatgtattaacaag

SEQ ID NO: 192106 - DNA, 26 bp, Artificial sequence
  SiRNA target sequence
tggcacttaaaaatgtattaacaaga

SEQ ID NO: 192107 - DNA, 26 bp, Artificial sequence
  SiRNA target sequence
ggcacttaaaaatgtattaacaagag

SEQ ID NO: 192108 - DNA, 26 bp, Artificial sequence
  SiRNA target sequence
gcacttaaaaatgtattaacaagaga

SEQ ID NO: 192109 - DNA, 26 bp, Artificial sequence
  SiRNA target sequence
cacttaaaaatgtattaacaagagaa

SEQ ID NO: 192110 - DNA, 26 bp, Artificial sequence
  SiRNA target sequence
acttaaaaatgtattaacaagagaat

SEQ ID NO: 192111 - DNA, 26 bp, Artificial sequence
  SiRNA target sequence
cttaaaaatgtattaacaagagaatt

SEQ ID NO: 192112 - DNA, 26 bp, Artificial sequence
  SiRNA target sequence
ttaaaaatgtattaacaagagaatta

SEQ ID NO: 192113 - DNA, 26 bp, Artificial sequence
  SiRNA target sequence
taaaaatgtattaacaagagaattag

SEQ ID NO: 192114 - DNA, 26 bp, Artificial sequence
  SiRNA target sequence
aaaaatgtattaacaagagaattaga

SEQ ID NO: 192115 - DNA, 26 bp, Artificial sequence
  SiRNA target sequence
aaaatgtattaacaagagaattagag

SEQ ID NO: 192116 - DNA, 26 bp, Artificial sequence
  SiRNA target sequence
aaatgtattaacaagagaattagagc

SEQ ID NO: 192117 - DNA, 26 bp, Artificial sequence
  SiRNA target sequence
aatgtattaacaagagaattagagca

SEQ ID NO: 192118 - DNA, 26 bp, Artificial sequence
  SiRNA target sequence
atgtattaacaagagaattagagcaa

SEQ ID NO: 192119 - DNA, 26 bp, Artificial sequence
  SiRNA target sequence
tgtattaacaagagaattagagcaat

SEQ ID NO: 192120 - DNA, 26 bp, Artificial sequence
  SiRNA target sequence
gtattaacaagagaattagagcaatt

SEQ ID NO: 192121 - DNA, 26 bp, Artificial sequence
  SiRNA target sequence
tattaacaagagaattagagcaatta

SEQ ID NO: 192122 - DNA, 26 bp, Artificial sequence
  SiRNA target sequence
attaacaagagaattagagcaattaa

SEQ ID NO: 192123 - DNA, 26 bp, Artificial sequence
  SiRNA target sequence
ttaacaagagaattagagcaattaag

SEQ ID NO: 192124 - DNA, 26 bp, Artificial sequence
  SiRNA target sequence
taacaagagaattagagcaattaagt

SEQ ID NO: 192125 - DNA, 26 bp, Artificial sequence
  SiRNA target sequence
aacaagagaattagagcaattaagtg

SEQ ID NO: 192126 - DNA, 26 bp, Artificial sequence
  SiRNA target sequence
acaagagaattagagcaattaagtgg

SEQ ID NO: 192127 - DNA, 26 bp, Artificial sequence
  SiRNA target sequence
caagagaattagagcaattaagtggt

SEQ ID NO: 192128 - DNA, 26 bp, Artificial sequence
  SiRNA target sequence
aagagaattagagcaattaagtggtg

SEQ ID NO: 192129 - DNA, 26 bp, Artificial sequence
  SiRNA target sequence
agagaattagagcaattaagtggtgg

SEQ ID NO: 192130 - DNA, 26 bp, Artificial sequence
  SiRNA target sequence
gagaattagagcaattaagtggtggt

SEQ ID NO: 192131 - DNA, 26 bp, Artificial sequence
  SiRNA target sequence
agaattagagcaattaagtggtggtg

SEQ ID NO: 192132 - DNA, 26 bp, Artificial sequence
  SiRNA target sequence
gaattagagcaattaagtggtggtga

SEQ ID NO: 192133 - DNA, 26 bp, Artificial sequence
  SiRNA target sequence
aattagagcaattaagtggtggtgaa

SEQ ID NO: 192134 - DNA, 26 bp, Artificial sequence
  SiRNA target sequence
attagagcaattaagtggtggtgaac

SEQ ID NO: 192135 - DNA, 26 bp, Artificial sequence
  SiRNA target sequence
ttagagcaattaagtggtggtgaact

SEQ ID NO: 192136 - DNA, 26 bp, Artificial sequence
  SiRNA target sequence
tagagcaattaagtggtggtgaactt

SEQ ID NO: 192137 - DNA, 26 bp, Artificial sequence
  SiRNA target sequence
agagcaattaagtggtggtgaacttc

SEQ ID NO: 192138 - DNA, 26 bp, Artificial sequence
  SiRNA target sequence
gagcaattaagtggtggtgaacttca

SEQ ID NO: 192139 - DNA, 26 bp, Artificial sequence
  SiRNA target sequence
agcaattaagtggtggtgaacttcaa

SEQ ID NO: 192140 - DNA, 26 bp, Artificial sequence
  SiRNA target sequence
gcaattaagtggtggtgaacttcaaa

SEQ ID NO: 192141 - DNA, 26 bp, Artificial sequence
  SiRNA target sequence
caattaagtggtggtgaacttcaaag

SEQ ID NO: 192142 - DNA, 26 bp, Artificial sequence
  SiRNA target sequence
aattaagtggtggtgaacttcaaaga

SEQ ID NO: 192143 - DNA, 26 bp, Artificial sequence
  SiRNA target sequence
attaagtggtggtgaacttcaaagat

SEQ ID NO: 192144 - DNA, 26 bp, Artificial sequence
  SiRNA target sequence
ttaagtggtggtgaacttcaaagatt

SEQ ID NO: 192145 - DNA, 26 bp, Artificial sequence
  SiRNA target sequence
taagtggtggtgaacttcaaagattt

SEQ ID NO: 192146 - DNA, 26 bp, Artificial sequence
  SiRNA target sequence
aagtggtggtgaacttcaaagatttt

SEQ ID NO: 192147 - DNA, 26 bp, Artificial sequence
  SiRNA target sequence
agtggtggtgaacttcaaagattttg

SEQ ID NO: 192148 - DNA, 26 bp, Artificial sequence
  SiRNA target sequence
gtggtggtgaacttcaaagattttgt

SEQ ID NO: 192149 - DNA, 26 bp, Artificial sequence
  SiRNA target sequence
tggtggtgaacttcaaagattttgta

SEQ ID NO: 192150 - DNA, 26 bp, Artificial sequence
  SiRNA target sequence
ggtggtgaacttcaaagattttgtat

SEQ ID NO: 192151 - DNA, 26 bp, Artificial sequence
  SiRNA target sequence
gtggtgaacttcaaagattttgtatt

SEQ ID NO: 192152 - DNA, 26 bp, Artificial sequence
  SiRNA target sequence
tggtgaacttcaaagattttgtattg

SEQ ID NO: 192153 - DNA, 26 bp, Artificial sequence
  SiRNA target sequence
ggtgaacttcaaagattttgtattgc

SEQ ID NO: 192154 - DNA, 26 bp, Artificial sequence
  SiRNA target sequence
gtgaacttcaaagattttgtattgca

SEQ ID NO: 192155 - DNA, 26 bp, Artificial sequence
  SiRNA target sequence
tgaacttcaaagattttgtattgcat

SEQ ID NO: 192156 - DNA, 26 bp, Artificial sequence
  SiRNA target sequence
gaacttcaaagattttgtattgcata

SEQ ID NO: 192157 - DNA, 26 bp, Artificial sequence
  SiRNA target sequence
aacttcaaagattttgtattgcatac

SEQ ID NO: 192158 - DNA, 26 bp, Artificial sequence
  SiRNA target sequence
acttcaaagattttgtattgcataca

SEQ ID NO: 192159 - DNA, 26 bp, Artificial sequence
  SiRNA target sequence
cttcaaagattttgtattgcatacac

SEQ ID NO: 192160 - DNA, 26 bp, Artificial sequence
  SiRNA target sequence
ttcaaagattttgtattgcatacaca

SEQ ID NO: 192161 - DNA, 26 bp, Artificial sequence
  SiRNA target sequence
tcaaagattttgtattgcatacacat

SEQ ID NO: 192162 - DNA, 26 bp, Artificial sequence
  SiRNA target sequence
caaagattttgtattgcatacacatg

SEQ ID NO: 192163 - DNA, 26 bp, Artificial sequence
  SiRNA target sequence
aaagattttgtattgcatacacatgt

SEQ ID NO: 192164 - DNA, 26 bp, Artificial sequence
  SiRNA target sequence
aagattttgtattgcatacacatgtt

SEQ ID NO: 192165 - DNA, 26 bp, Artificial sequence
  SiRNA target sequence
agattttgtattgcatacacatgttt

SEQ ID NO: 192166 - DNA, 26 bp, Artificial sequence
  SiRNA target sequence
gattttgtattgcatacacatgttta

SEQ ID NO: 192167 - DNA, 26 bp, Artificial sequence
  SiRNA target sequence
attttgtattgcatacacatgtttac

SEQ ID NO: 192168 - DNA, 26 bp, Artificial sequence
  SiRNA target sequence
ttttgtattgcatacacatgtttaca

SEQ ID NO: 192169 - DNA, 26 bp, Artificial sequence
  SiRNA target sequence
tttgtattgcatacacatgtttacaa

SEQ ID NO: 192170 - DNA, 26 bp, Artificial sequence
  SiRNA target sequence
ttgtattgcatacacatgtttacaag

SEQ ID NO: 192171 - DNA, 26 bp, Artificial sequence
  SiRNA target sequence
tgtattgcatacacatgtttacaaga

SEQ ID NO: 192172 - DNA, 26 bp, Artificial sequence
  SiRNA target sequence
gtattgcatacacatgtttacaagaa

SEQ ID NO: 192173 - DNA, 26 bp, Artificial sequence
  SiRNA target sequence
tattgcatacacatgtttacaagaag

SEQ ID NO: 192174 - DNA, 26 bp, Artificial sequence
  SiRNA target sequence
attgcatacacatgtttacaagaagg

SEQ ID NO: 192175 - DNA, 26 bp, Artificial sequence
  SiRNA target sequence
ttgcatacacatgtttacaagaagga

SEQ ID NO: 192176 - DNA, 26 bp, Artificial sequence
  SiRNA target sequence
tgcatacacatgtttacaagaaggaa

SEQ ID NO: 192177 - DNA, 26 bp, Artificial sequence
  SiRNA target sequence
gcatacacatgtttacaagaaggaaa

SEQ ID NO: 192178 - DNA, 26 bp, Artificial sequence
  SiRNA target sequence
catacacatgtttacaagaaggaaat

SEQ ID NO: 192179 - DNA, 26 bp, Artificial sequence
  SiRNA target sequence
atacacatgtttacaagaaggaaatg

SEQ ID NO: 192180 - DNA, 26 bp, Artificial sequence
  SiRNA target sequence
tacacatgtttacaagaaggaaatgt

SEQ ID NO: 192181 - DNA, 26 bp, Artificial sequence
  SiRNA target sequence
acacatgtttacaagaaggaaatgtt

SEQ ID NO: 192182 - DNA, 26 bp, Artificial sequence
  SiRNA target sequence
cacatgtttacaagaaggaaatgttt

SEQ ID NO: 192183 - DNA, 26 bp, Artificial sequence
  SiRNA target sequence
acatgtttacaagaaggaaatgttta

SEQ ID NO: 192184 - DNA, 26 bp, Artificial sequence
  SiRNA target sequence
catgtttacaagaaggaaatgtttat

SEQ ID NO: 192185 - DNA, 26 bp, Artificial sequence
  SiRNA target sequence
atgtttacaagaaggaaatgtttata

SEQ ID NO: 192186 - DNA, 26 bp, Artificial sequence
  SiRNA target sequence
tgtttacaagaaggaaatgtttatat

SEQ ID NO: 192187 - DNA, 26 bp, Artificial sequence
  SiRNA target sequence
gtttacaagaaggaaatgtttatatt

SEQ ID NO: 192188 - DNA, 26 bp, Artificial sequence
  SiRNA target sequence
tttacaagaaggaaatgtttatattt

SEQ ID NO: 192189 - DNA, 26 bp, Artificial sequence
  SiRNA target sequence
ttacaagaaggaaatgtttatatttt

SEQ ID NO: 192190 - DNA, 26 bp, Artificial sequence
  SiRNA target sequence
tacaagaaggaaatgtttatattttt

SEQ ID NO: 192191 - DNA, 26 bp, Artificial sequence
  SiRNA target sequence
acaagaaggaaatgtttatatttttg

SEQ ID NO: 192192 - DNA, 26 bp, Artificial sequence
  SiRNA target sequence
caagaaggaaatgtttatatttttga

SEQ ID NO: 192193 - DNA, 26 bp, Artificial sequence
  SiRNA target sequence
aagaaggaaatgtttatatttttgat

SEQ ID NO: 192194 - DNA, 26 bp, Artificial sequence
  SiRNA target sequence
agaaggaaatgtttatatttttgatg

SEQ ID NO: 192195 - DNA, 26 bp, Artificial sequence
  SiRNA target sequence
gaaggaaatgtttatatttttgatga

SEQ ID NO: 192196 - DNA, 26 bp, Artificial sequence
  SiRNA target sequence
aaggaaatgtttatatttttgatgaa

SEQ ID NO: 192197 - DNA, 26 bp, Artificial sequence
  SiRNA target sequence
aggaaatgtttatatttttgatgaac

SEQ ID NO: 192198 - DNA, 26 bp, Artificial sequence
  SiRNA target sequence
ggaaatgtttatatttttgatgaacc

SEQ ID NO: 192199 - DNA, 26 bp, Artificial sequence
  SiRNA target sequence
gaaatgtttatatttttgatgaaccc

SEQ ID NO: 192200 - DNA, 26 bp, Artificial sequence
  SiRNA target sequence
aaatgtttatatttttgatgaaccca

SEQ ID NO: 192201 - DNA, 26 bp, Artificial sequence
  SiRNA target sequence
aatgtttatatttttgatgaacccac

SEQ ID NO: 192202 - DNA, 26 bp, Artificial sequence
  SiRNA target sequence
atgtttatatttttgatgaacccact

SEQ ID NO: 192203 - DNA, 26 bp, Artificial sequence
  SiRNA target sequence
tgtttatatttttgatgaacccacta

SEQ ID NO: 192204 - DNA, 26 bp, Artificial sequence
  SiRNA target sequence
gtttatatttttgatgaacccactag

SEQ ID NO: 192205 - DNA, 26 bp, Artificial sequence
  SiRNA target sequence
tttatatttttgatgaacccactagt

SEQ ID NO: 192206 - DNA, 26 bp, Artificial sequence
  SiRNA target sequence
ttatatttttgatgaacccactagtt

SEQ ID NO: 192207 - DNA, 26 bp, Artificial sequence
  SiRNA target sequence
tatatttttgatgaacccactagttt

SEQ ID NO: 192208 - DNA, 26 bp, Artificial sequence
  SiRNA target sequence
atatttttgatgaacccactagtttt

SEQ ID NO: 192209 - DNA, 26 bp, Artificial sequence
  SiRNA target sequence
tatttttgatgaacccactagttttt

SEQ ID NO: 192210 - DNA, 26 bp, Artificial sequence
  SiRNA target sequence
atttttgatgaacccactagtttttt

SEQ ID NO: 192211 - DNA, 26 bp, Artificial sequence
  SiRNA target sequence
tttttgatgaacccactagttttttg

SEQ ID NO: 192212 - DNA, 26 bp, Artificial sequence
  SiRNA target sequence
ttttgatgaacccactagttttttgg

SEQ ID NO: 192213 - DNA, 26 bp, Artificial sequence
  SiRNA target sequence
tttgatgaacccactagttttttgga

SEQ ID NO: 192214 - DNA, 26 bp, Artificial sequence
  SiRNA target sequence
ttgatgaacccactagttttttggat

SEQ ID NO: 192215 - DNA, 26 bp, Artificial sequence
  SiRNA target sequence
tgatgaacccactagttttttggatg

SEQ ID NO: 192216 - DNA, 26 bp, Artificial sequence
  SiRNA target sequence
gatgaacccactagttttttggatgt

SEQ ID NO: 192217 - DNA, 26 bp, Artificial sequence
  SiRNA target sequence
atgaacccactagttttttggatgtt

SEQ ID NO: 192218 - DNA, 26 bp, Artificial sequence
  SiRNA target sequence
tgaacccactagttttttggatgtta

SEQ ID NO: 192219 - DNA, 26 bp, Artificial sequence
  SiRNA target sequence
gaacccactagttttttggatgttaa

SEQ ID NO: 192220 - DNA, 26 bp, Artificial sequence
  SiRNA target sequence
aacccactagttttttggatgttaag

SEQ ID NO: 192221 - DNA, 26 bp, Artificial sequence
  SiRNA target sequence
acccactagttttttggatgttaagc

SEQ ID NO: 192222 - DNA, 26 bp, Artificial sequence
  SiRNA target sequence
cccactagttttttggatgttaagca

SEQ ID NO: 192223 - DNA, 26 bp, Artificial sequence
  SiRNA target sequence
ccactagttttttggatgttaagcag

SEQ ID NO: 192224 - DNA, 26 bp, Artificial sequence
  SiRNA target sequence
cactagttttttggatgttaagcagc

SEQ ID NO: 192225 - DNA, 26 bp, Artificial sequence
  SiRNA target sequence
actagttttttggatgttaagcagcg

SEQ ID NO: 192226 - DNA, 26 bp, Artificial sequence
  SiRNA target sequence
ctagttttttggatgttaagcagcga

SEQ ID NO: 192227 - DNA, 26 bp, Artificial sequence
  SiRNA target sequence
tagttttttggatgttaagcagcgac

SEQ ID NO: 192228 - DNA, 26 bp, Artificial sequence
  SiRNA target sequence
agttttttggatgttaagcagcgact

SEQ ID NO: 192229 - DNA, 26 bp, Artificial sequence
  SiRNA target sequence
gttttttggatgttaagcagcgacta

SEQ ID NO: 192230 - DNA, 26 bp, Artificial sequence
  SiRNA target sequence
ttttttggatgttaagcagcgactag

SEQ ID NO: 192231 - DNA, 26 bp, Artificial sequence
  SiRNA target sequence
tttttggatgttaagcagcgactagc

SEQ ID NO: 192232 - DNA, 26 bp, Artificial sequence
  SiRNA target sequence
ttttggatgttaagcagcgactagca

SEQ ID NO: 192233 - DNA, 26 bp, Artificial sequence
  SiRNA target sequence
tttggatgttaagcagcgactagcag

SEQ ID NO: 192234 - DNA, 26 bp, Artificial sequence
  SiRNA target sequence
ttggatgttaagcagcgactagcagc

SEQ ID NO: 192235 - DNA, 26 bp, Artificial sequence
  SiRNA target sequence
tggatgttaagcagcgactagcagct

SEQ ID NO: 192236 - DNA, 26 bp, Artificial sequence
  SiRNA target sequence
ggatgttaagcagcgactagcagctg

SEQ ID NO: 192237 - DNA, 26 bp, Artificial sequence
  SiRNA target sequence
gatgttaagcagcgactagcagctgc

SEQ ID NO: 192238 - DNA, 26 bp, Artificial sequence
  SiRNA target sequence
atgttaagcagcgactagcagctgct

SEQ ID NO: 192239 - DNA, 26 bp, Artificial sequence
  SiRNA target sequence
tgttaagcagcgactagcagctgcta

SEQ ID NO: 192240 - DNA, 26 bp, Artificial sequence
  SiRNA target sequence
gttaagcagcgactagcagctgctaa

SEQ ID NO: 192241 - DNA, 26 bp, Artificial sequence
  SiRNA target sequence
ttaagcagcgactagcagctgctaag

SEQ ID NO: 192242 - DNA, 26 bp, Artificial sequence
  SiRNA target sequence
taagcagcgactagcagctgctaagg

SEQ ID NO: 192243 - DNA, 26 bp, Artificial sequence
  SiRNA target sequence
aagcagcgactagcagctgctaagga

SEQ ID NO: 192244 - DNA, 26 bp, Artificial sequence
  SiRNA target sequence
agcagcgactagcagctgctaaggaa

SEQ ID NO: 192245 - DNA, 26 bp, Artificial sequence
  SiRNA target sequence
gcagcgactagcagctgctaaggaaa

SEQ ID NO: 192246 - DNA, 26 bp, Artificial sequence
  SiRNA target sequence
cagcgactagcagctgctaaggaaat

SEQ ID NO: 192247 - DNA, 26 bp, Artificial sequence
  SiRNA target sequence
agcgactagcagctgctaaggaaata

SEQ ID NO: 192248 - DNA, 26 bp, Artificial sequence
  SiRNA target sequence
gcgactagcagctgctaaggaaataa

SEQ ID NO: 192249 - DNA, 26 bp, Artificial sequence
  SiRNA target sequence
cgactagcagctgctaaggaaataag

SEQ ID NO: 192250 - DNA, 26 bp, Artificial sequence
  SiRNA target sequence
gactagcagctgctaaggaaataaga

SEQ ID NO: 192251 - DNA, 26 bp, Artificial sequence
  SiRNA target sequence
actagcagctgctaaggaaataagaa

SEQ ID NO: 192252 - DNA, 26 bp, Artificial sequence
  SiRNA target sequence
ctagcagctgctaaggaaataagaaa

SEQ ID NO: 192253 - DNA, 26 bp, Artificial sequence
  SiRNA target sequence
tagcagctgctaaggaaataagaaat

SEQ ID NO: 192254 - DNA, 26 bp, Artificial sequence
  SiRNA target sequence
agcagctgctaaggaaataagaaatt

SEQ ID NO: 192255 - DNA, 26 bp, Artificial sequence
  SiRNA target sequence
gcagctgctaaggaaataagaaattt

SEQ ID NO: 192256 - DNA, 26 bp, Artificial sequence
  SiRNA target sequence
cagctgctaaggaaataagaaatttg

SEQ ID NO: 192257 - DNA, 26 bp, Artificial sequence
  SiRNA target sequence
agctgctaaggaaataagaaatttgt

SEQ ID NO: 192258 - DNA, 26 bp, Artificial sequence
  SiRNA target sequence
gctgctaaggaaataagaaatttgtg

SEQ ID NO: 192259 - DNA, 26 bp, Artificial sequence
  SiRNA target sequence
ctgctaaggaaataagaaatttgtgt

SEQ ID NO: 192260 - DNA, 26 bp, Artificial sequence
  SiRNA target sequence
tgctaaggaaataagaaatttgtgtg

SEQ ID NO: 192261 - DNA, 26 bp, Artificial sequence
  SiRNA target sequence
gctaaggaaataagaaatttgtgtga

SEQ ID NO: 192262 - DNA, 26 bp, Artificial sequence
  SiRNA target sequence
ctaaggaaataagaaatttgtgtgaa

SEQ ID NO: 192263 - DNA, 26 bp, Artificial sequence
  SiRNA target sequence
taaggaaataagaaatttgtgtgaag

SEQ ID NO: 192264 - DNA, 26 bp, Artificial sequence
  SiRNA target sequence
aaggaaataagaaatttgtgtgaaga

SEQ ID NO: 192265 - DNA, 26 bp, Artificial sequence
  SiRNA target sequence
aggaaataagaaatttgtgtgaagaa

SEQ ID NO: 192266 - DNA, 26 bp, Artificial sequence
  SiRNA target sequence
ggaaataagaaatttgtgtgaagaaa

SEQ ID NO: 192267 - DNA, 26 bp, Artificial sequence
  SiRNA target sequence
gaaataagaaatttgtgtgaagaaaa

SEQ ID NO: 192268 - DNA, 26 bp, Artificial sequence
  SiRNA target sequence
aaataagaaatttgtgtgaagaaaat

SEQ ID NO: 192269 - DNA, 26 bp, Artificial sequence
  SiRNA target sequence
aataagaaatttgtgtgaagaaaata

SEQ ID NO: 192270 - DNA, 26 bp, Artificial sequence
  SiRNA target sequence
ataagaaatttgtgtgaagaaaataa

SEQ ID NO: 192271 - DNA, 26 bp, Artificial sequence
  SiRNA target sequence
taagaaatttgtgtgaagaaaataaa

SEQ ID NO: 192272 - DNA, 26 bp, Artificial sequence
  SiRNA target sequence
aagaaatttgtgtgaagaaaataaat

SEQ ID NO: 192273 - DNA, 26 bp, Artificial sequence
  SiRNA target sequence
agaaatttgtgtgaagaaaataaata

SEQ ID NO: 192274 - DNA, 26 bp, Artificial sequence
  SiRNA target sequence
gaaatttgtgtgaagaaaataaatat

SEQ ID NO: 192275 - DNA, 26 bp, Artificial sequence
  SiRNA target sequence
aaatttgtgtgaagaaaataaatatg

SEQ ID NO: 192276 - DNA, 26 bp, Artificial sequence
  SiRNA target sequence
aatttgtgtgaagaaaataaatatgt

SEQ ID NO: 192277 - DNA, 26 bp, Artificial sequence
  SiRNA target sequence
atttgtgtgaagaaaataaatatgtt

SEQ ID NO: 192278 - DNA, 26 bp, Artificial sequence
  SiRNA target sequence
tttgtgtgaagaaaataaatatgttg

SEQ ID NO: 192279 - DNA, 26 bp, Artificial sequence
  SiRNA target sequence
ttgtgtgaagaaaataaatatgttgt

SEQ ID NO: 192280 - DNA, 26 bp, Artificial sequence
  SiRNA target sequence
tgtgtgaagaaaataaatatgttgta

SEQ ID NO: 192281 - DNA, 26 bp, Artificial sequence
  SiRNA target sequence
gtgtgaagaaaataaatatgttgtag

SEQ ID NO: 192282 - DNA, 26 bp, Artificial sequence
  SiRNA target sequence
tgtgaagaaaataaatatgttgtagt

SEQ ID NO: 192283 - DNA, 26 bp, Artificial sequence
  SiRNA target sequence
gtgaagaaaataaatatgttgtagtt

SEQ ID NO: 192284 - DNA, 26 bp, Artificial sequence
  SiRNA target sequence
tgaagaaaataaatatgttgtagttg

SEQ ID NO: 192285 - DNA, 26 bp, Artificial sequence
  SiRNA target sequence
gaagaaaataaatatgttgtagttgt

SEQ ID NO: 192286 - DNA, 26 bp, Artificial sequence
  SiRNA target sequence
aagaaaataaatatgttgtagttgtc

SEQ ID NO: 192287 - DNA, 26 bp, Artificial sequence
  SiRNA target sequence
agaaaataaatatgttgtagttgtcg

SEQ ID NO: 192288 - DNA, 26 bp, Artificial sequence
  SiRNA target sequence
gaaaataaatatgttgtagttgtcga

SEQ ID NO: 192289 - DNA, 26 bp, Artificial sequence
  SiRNA target sequence
aaaataaatatgttgtagttgtcgaa

SEQ ID NO: 192290 - DNA, 26 bp, Artificial sequence
  SiRNA target sequence
aaataaatatgttgtagttgtcgaac

SEQ ID NO: 192291 - DNA, 26 bp, Artificial sequence
  SiRNA target sequence
aataaatatgttgtagttgtcgaaca

SEQ ID NO: 192292 - DNA, 26 bp, Artificial sequence
  SiRNA target sequence
ataaatatgttgtagttgtcgaacac

SEQ ID NO: 192293 - DNA, 26 bp, Artificial sequence
  SiRNA target sequence
taaatatgttgtagttgtcgaacacg

SEQ ID NO: 192294 - DNA, 26 bp, Artificial sequence
  SiRNA target sequence
aaatatgttgtagttgtcgaacacga

SEQ ID NO: 192295 - DNA, 26 bp, Artificial sequence
  SiRNA target sequence
aatatgttgtagttgtcgaacacgat

SEQ ID NO: 192296 - DNA, 26 bp, Artificial sequence
  SiRNA target sequence
atatgttgtagttgtcgaacacgatt

SEQ ID NO: 192297 - DNA, 26 bp, Artificial sequence
  SiRNA target sequence
tatgttgtagttgtcgaacacgattt

SEQ ID NO: 192298 - DNA, 26 bp, Artificial sequence
  SiRNA target sequence
atgttgtagttgtcgaacacgattta

SEQ ID NO: 192299 - DNA, 26 bp, Artificial sequence
  SiRNA target sequence
tgttgtagttgtcgaacacgatttag

SEQ ID NO: 192300 - DNA, 26 bp, Artificial sequence
  SiRNA target sequence
gttgtagttgtcgaacacgatttagc

SEQ ID NO: 192301 - DNA, 26 bp, Artificial sequence
  SiRNA target sequence
ttgtagttgtcgaacacgatttagcc

SEQ ID NO: 192302 - DNA, 26 bp, Artificial sequence
  SiRNA target sequence
tgtagttgtcgaacacgatttagcca

SEQ ID NO: 192303 - DNA, 26 bp, Artificial sequence
  SiRNA target sequence
gtagttgtcgaacacgatttagccat

SEQ ID NO: 192304 - DNA, 26 bp, Artificial sequence
  SiRNA target sequence
tagttgtcgaacacgatttagccatt

SEQ ID NO: 192305 - DNA, 26 bp, Artificial sequence
  SiRNA target sequence
agttgtcgaacacgatttagccattt

SEQ ID NO: 192306 - DNA, 26 bp, Artificial sequence
  SiRNA target sequence
gttgtcgaacacgatttagccatttt

SEQ ID NO: 192307 - DNA, 26 bp, Artificial sequence
  SiRNA target sequence
ttgtcgaacacgatttagccatttta

SEQ ID NO: 192308 - DNA, 26 bp, Artificial sequence
  SiRNA target sequence
tgtcgaacacgatttagccattttag

SEQ ID NO: 192309 - DNA, 26 bp, Artificial sequence
  SiRNA target sequence
gtcgaacacgatttagccattttaga

SEQ ID NO: 192310 - DNA, 26 bp, Artificial sequence
  SiRNA target sequence
tcgaacacgatttagccattttagat

SEQ ID NO: 192311 - DNA, 26 bp, Artificial sequence
  SiRNA target sequence
cgaacacgatttagccattttagatt

SEQ ID NO: 192312 - DNA, 26 bp, Artificial sequence
  SiRNA target sequence
gaacacgatttagccattttagattt

SEQ ID NO: 192313 - DNA, 26 bp, Artificial sequence
  SiRNA target sequence
aacacgatttagccattttagatttg

SEQ ID NO: 192314 - DNA, 26 bp, Artificial sequence
  SiRNA target sequence
acacgatttagccattttagatttga

SEQ ID NO: 192315 - DNA, 26 bp, Artificial sequence
  SiRNA target sequence
cacgatttagccattttagatttgat

SEQ ID NO: 192316 - DNA, 26 bp, Artificial sequence
  SiRNA target sequence
acgatttagccattttagatttgatg

SEQ ID NO: 192317 - DNA, 26 bp, Artificial sequence
  SiRNA target sequence
cgatttagccattttagatttgatgt

SEQ ID NO: 192318 - DNA, 26 bp, Artificial sequence
  SiRNA target sequence
gatttagccattttagatttgatgtg

SEQ ID NO: 192319 - DNA, 26 bp, Artificial sequence
  SiRNA target sequence
atttagccattttagatttgatgtgt

SEQ ID NO: 192320 - DNA, 26 bp, Artificial sequence
  SiRNA target sequence
tttagccattttagatttgatgtgtg

SEQ ID NO: 192321 - DNA, 26 bp, Artificial sequence
  SiRNA target sequence
ttagccattttagatttgatgtgtga

SEQ ID NO: 192322 - DNA, 26 bp, Artificial sequence
  SiRNA target sequence
tagccattttagatttgatgtgtgat

SEQ ID NO: 192323 - DNA, 26 bp, Artificial sequence
  SiRNA target sequence
agccattttagatttgatgtgtgatt

SEQ ID NO: 192324 - DNA, 26 bp, Artificial sequence
  SiRNA target sequence
gccattttagatttgatgtgtgattt

SEQ ID NO: 192325 - DNA, 26 bp, Artificial sequence
  SiRNA target sequence
ccattttagatttgatgtgtgatttt

SEQ ID NO: 192326 - DNA, 26 bp, Artificial sequence
  SiRNA target sequence
cattttagatttgatgtgtgattttg

SEQ ID NO: 192327 - DNA, 26 bp, Artificial sequence
  SiRNA target sequence
attttagatttgatgtgtgattttgg

SEQ ID NO: 192328 - DNA, 26 bp, Artificial sequence
  SiRNA target sequence
ttttagatttgatgtgtgattttgga

SEQ ID NO: 192329 - DNA, 26 bp, Artificial sequence
  SiRNA target sequence
tttagatttgatgtgtgattttggat

SEQ ID NO: 192330 - DNA, 26 bp, Artificial sequence
  SiRNA target sequence
ttagatttgatgtgtgattttggatg

SEQ ID NO: 192331 - DNA, 26 bp, Artificial sequence
  SiRNA target sequence
tagatttgatgtgtgattttggatgt

SEQ ID NO: 192332 - DNA, 26 bp, Artificial sequence
  SiRNA target sequence
agatttgatgtgtgattttggatgtg

SEQ ID NO: 192333 - DNA, 26 bp, Artificial sequence
  SiRNA target sequence
gatttgatgtgtgattttggatgtgt

SEQ ID NO: 192334 - DNA, 26 bp, Artificial sequence
  SiRNA target sequence
atttgatgtgtgattttggatgtgtt

SEQ ID NO: 192335 - DNA, 26 bp, Artificial sequence
  SiRNA target sequence
tttgatgtgtgattttggatgtgttc

SEQ ID NO: 192336 - DNA, 26 bp, Artificial sequence
  SiRNA target sequence
ttgatgtgtgattttggatgtgttct

SEQ ID NO: 192337 - DNA, 26 bp, Artificial sequence
  SiRNA target sequence
tgatgtgtgattttggatgtgttcta

SEQ ID NO: 192338 - DNA, 26 bp, Artificial sequence
  SiRNA target sequence
gatgtgtgattttggatgtgttctat

SEQ ID NO: 192339 - DNA, 26 bp, Artificial sequence
  SiRNA target sequence
atgtgtgattttggatgtgttctata

SEQ ID NO: 192340 - DNA, 26 bp, Artificial sequence
  SiRNA target sequence
tgtgtgattttggatgtgttctatac

SEQ ID NO: 192341 - DNA, 26 bp, Artificial sequence
  SiRNA target sequence
gtgtgattttggatgtgttctatacg

SEQ ID NO: 192342 - DNA, 26 bp, Artificial sequence
  SiRNA target sequence
tgtgattttggatgtgttctatacgg

SEQ ID NO: 192343 - DNA, 26 bp, Artificial sequence
  SiRNA target sequence
gtgattttggatgtgttctatacgga

SEQ ID NO: 192344 - DNA, 26 bp, Artificial sequence
  SiRNA target sequence
tgattttggatgtgttctatacggac

SEQ ID NO: 192345 - DNA, 26 bp, Artificial sequence
  SiRNA target sequence
gattttggatgtgttctatacggaca

SEQ ID NO: 192346 - DNA, 26 bp, Artificial sequence
  SiRNA target sequence
attttggatgtgttctatacggacaa

SEQ ID NO: 192347 - DNA, 26 bp, Artificial sequence
  SiRNA target sequence
ttttggatgtgttctatacggacaat

SEQ ID NO: 192348 - DNA, 26 bp, Artificial sequence
  SiRNA target sequence
tttggatgtgttctatacggacaatc

SEQ ID NO: 192349 - DNA, 26 bp, Artificial sequence
  SiRNA target sequence
ttggatgtgttctatacggacaatct

SEQ ID NO: 192350 - DNA, 26 bp, Artificial sequence
  SiRNA target sequence
tggatgtgttctatacggacaatctg

SEQ ID NO: 192351 - DNA, 26 bp, Artificial sequence
  SiRNA target sequence
ggatgtgttctatacggacaatctgg

SEQ ID NO: 192352 - DNA, 26 bp, Artificial sequence
  SiRNA target sequence
gatgtgttctatacggacaatctggg

SEQ ID NO: 192353 - DNA, 26 bp, Artificial sequence
  SiRNA target sequence
atgtgttctatacggacaatctgggg

SEQ ID NO: 192354 - DNA, 26 bp, Artificial sequence
  SiRNA target sequence
tgtgttctatacggacaatctggggc

SEQ ID NO: 192355 - DNA, 26 bp, Artificial sequence
  SiRNA target sequence
gtgttctatacggacaatctggggca

SEQ ID NO: 192356 - DNA, 26 bp, Artificial sequence
  SiRNA target sequence
tgttctatacggacaatctggggcat

SEQ ID NO: 192357 - DNA, 26 bp, Artificial sequence
  SiRNA target sequence
gttctatacggacaatctggggcata

SEQ ID NO: 192358 - DNA, 26 bp, Artificial sequence
  SiRNA target sequence
ttctatacggacaatctggggcatac

SEQ ID NO: 192359 - DNA, 26 bp, Artificial sequence
  SiRNA target sequence
tctatacggacaatctggggcatacg

SEQ ID NO: 192360 - DNA, 26 bp, Artificial sequence
  SiRNA target sequence
ctatacggacaatctggggcatacgg

SEQ ID NO: 192361 - DNA, 26 bp, Artificial sequence
  SiRNA target sequence
tatacggacaatctggggcatacggt

SEQ ID NO: 192362 - DNA, 26 bp, Artificial sequence
  SiRNA target sequence
atacggacaatctggggcatacggtg

SEQ ID NO: 192363 - DNA, 26 bp, Artificial sequence
  SiRNA target sequence
tacggacaatctggggcatacggtgt

SEQ ID NO: 192364 - DNA, 26 bp, Artificial sequence
  SiRNA target sequence
acggacaatctggggcatacggtgta

SEQ ID NO: 192365 - DNA, 26 bp, Artificial sequence
  SiRNA target sequence
cggacaatctggggcatacggtgtaa

SEQ ID NO: 192366 - DNA, 26 bp, Artificial sequence
  SiRNA target sequence
ggacaatctggggcatacggtgtaat

SEQ ID NO: 192367 - DNA, 26 bp, Artificial sequence
  SiRNA target sequence
gacaatctggggcatacggtgtaata

SEQ ID NO: 192368 - DNA, 26 bp, Artificial sequence
  SiRNA target sequence
acaatctggggcatacggtgtaataa

SEQ ID NO: 192369 - DNA, 26 bp, Artificial sequence
  SiRNA target sequence
caatctggggcatacggtgtaataag

SEQ ID NO: 192370 - DNA, 26 bp, Artificial sequence
  SiRNA target sequence
aatctggggcatacggtgtaataagc

SEQ ID NO: 192371 - DNA, 26 bp, Artificial sequence
  SiRNA target sequence
atctggggcatacggtgtaataagcg

SEQ ID NO: 192372 - DNA, 26 bp, Artificial sequence
  SiRNA target sequence
tctggggcatacggtgtaataagcgc

SEQ ID NO: 192373 - DNA, 26 bp, Artificial sequence
  SiRNA target sequence
ctggggcatacggtgtaataagcgca

SEQ ID NO: 192374 - DNA, 26 bp, Artificial sequence
  SiRNA target sequence
tggggcatacggtgtaataagcgcac

SEQ ID NO: 192375 - DNA, 26 bp, Artificial sequence
  SiRNA target sequence
ggggcatacggtgtaataagcgcacc

SEQ ID NO: 192376 - DNA, 26 bp, Artificial sequence
  SiRNA target sequence
gggcatacggtgtaataagcgcacca

SEQ ID NO: 192377 - DNA, 26 bp, Artificial sequence
  SiRNA target sequence
ggcatacggtgtaataagcgcaccat

SEQ ID NO: 192378 - DNA, 26 bp, Artificial sequence
  SiRNA target sequence
gcatacggtgtaataagcgcaccata

SEQ ID NO: 192379 - DNA, 26 bp, Artificial sequence
  SiRNA target sequence
catacggtgtaataagcgcaccatac

SEQ ID NO: 192380 - DNA, 26 bp, Artificial sequence
  SiRNA target sequence
atacggtgtaataagcgcaccatacg

SEQ ID NO: 192381 - DNA, 26 bp, Artificial sequence
  SiRNA target sequence
tacggtgtaataagcgcaccatacgt

SEQ ID NO: 192382 - DNA, 26 bp, Artificial sequence
  SiRNA target sequence
acggtgtaataagcgcaccatacgtt

SEQ ID NO: 192383 - DNA, 26 bp, Artificial sequence
  SiRNA target sequence
cggtgtaataagcgcaccatacgtta

SEQ ID NO: 192384 - DNA, 26 bp, Artificial sequence
  SiRNA target sequence
ggtgtaataagcgcaccatacgttat

SEQ ID NO: 192385 - DNA, 26 bp, Artificial sequence
  SiRNA target sequence
gtgtaataagcgcaccatacgttatt

SEQ ID NO: 192386 - DNA, 26 bp, Artificial sequence
  SiRNA target sequence
tgtaataagcgcaccatacgttatta

SEQ ID NO: 192387 - DNA, 26 bp, Artificial sequence
  SiRNA target sequence
gtaataagcgcaccatacgttattaa

SEQ ID NO: 192388 - DNA, 26 bp, Artificial sequence
  SiRNA target sequence
taataagcgcaccatacgttattaaa

SEQ ID NO: 192389 - DNA, 26 bp, Artificial sequence
  SiRNA target sequence
aataagcgcaccatacgttattaaat

SEQ ID NO: 192390 - DNA, 26 bp, Artificial sequence
  SiRNA target sequence
ataagcgcaccatacgttattaaatc

SEQ ID NO: 192391 - DNA, 26 bp, Artificial sequence
  SiRNA target sequence
taagcgcaccatacgttattaaatca

SEQ ID NO: 192392 - DNA, 26 bp, Artificial sequence
  SiRNA target sequence
aagcgcaccatacgttattaaatcag

SEQ ID NO: 192393 - DNA, 26 bp, Artificial sequence
  SiRNA target sequence
agcgcaccatacgttattaaatcagc

SEQ ID NO: 192394 - DNA, 26 bp, Artificial sequence
  SiRNA target sequence
gcgcaccatacgttattaaatcagca

SEQ ID NO: 192395 - DNA, 26 bp, Artificial sequence
  SiRNA target sequence
cgcaccatacgttattaaatcagcaa

SEQ ID NO: 192396 - DNA, 26 bp, Artificial sequence
  SiRNA target sequence
gcaccatacgttattaaatcagcaat

SEQ ID NO: 192397 - DNA, 26 bp, Artificial sequence
  SiRNA target sequence
caccatacgttattaaatcagcaata

SEQ ID NO: 192398 - DNA, 26 bp, Artificial sequence
  SiRNA target sequence
accatacgttattaaatcagcaataa

SEQ ID NO: 192399 - DNA, 26 bp, Artificial sequence
  SiRNA target sequence
ccatacgttattaaatcagcaataaa

SEQ ID NO: 192400 - DNA, 26 bp, Artificial sequence
  SiRNA target sequence
catacgttattaaatcagcaataaat

SEQ ID NO: 192401 - DNA, 26 bp, Artificial sequence
  SiRNA target sequence
atacgttattaaatcagcaataaata

SEQ ID NO: 192402 - DNA, 26 bp, Artificial sequence
  SiRNA target sequence
tacgttattaaatcagcaataaatat

SEQ ID NO: 192403 - DNA, 26 bp, Artificial sequence
  SiRNA target sequence
acgttattaaatcagcaataaatata

SEQ ID NO: 192404 - DNA, 26 bp, Artificial sequence
  SiRNA target sequence
cgttattaaatcagcaataaatatat

SEQ ID NO: 192405 - DNA, 26 bp, Artificial sequence
  SiRNA target sequence
gttattaaatcagcaataaatatatt

SEQ ID NO: 192406 - DNA, 26 bp, Artificial sequence
  SiRNA target sequence
ttattaaatcagcaataaatatattt

SEQ ID NO: 192407 - DNA, 26 bp, Artificial sequence
  SiRNA target sequence
tattaaatcagcaataaatatatttc

SEQ ID NO: 192408 - DNA, 26 bp, Artificial sequence
  SiRNA target sequence
attaaatcagcaataaatatatttct

SEQ ID NO: 192409 - DNA, 26 bp, Artificial sequence
  SiRNA target sequence
ttaaatcagcaataaatatatttctt

SEQ ID NO: 192410 - DNA, 26 bp, Artificial sequence
  SiRNA target sequence
taaatcagcaataaatatatttcttg

SEQ ID NO: 192411 - DNA, 26 bp, Artificial sequence
  SiRNA target sequence
aaatcagcaataaatatatttcttga

SEQ ID NO: 192412 - DNA, 26 bp, Artificial sequence
  SiRNA target sequence
aatcagcaataaatatatttcttgat

SEQ ID NO: 192413 - DNA, 26 bp, Artificial sequence
  SiRNA target sequence
atcagcaataaatatatttcttgatg

SEQ ID NO: 192414 - DNA, 26 bp, Artificial sequence
  SiRNA target sequence
tcagcaataaatatatttcttgatgg

SEQ ID NO: 192415 - DNA, 26 bp, Artificial sequence
  SiRNA target sequence
cagcaataaatatatttcttgatgga

SEQ ID NO: 192416 - DNA, 26 bp, Artificial sequence
  SiRNA target sequence
agcaataaatatatttcttgatggat

SEQ ID NO: 192417 - DNA, 26 bp, Artificial sequence
  SiRNA target sequence
gcaataaatatatttcttgatggatt

SEQ ID NO: 192418 - DNA, 26 bp, Artificial sequence
  SiRNA target sequence
caataaatatatttcttgatggattt

SEQ ID NO: 192419 - DNA, 26 bp, Artificial sequence
  SiRNA target sequence
aataaatatatttcttgatggatttt

SEQ ID NO: 192420 - DNA, 26 bp, Artificial sequence
  SiRNA target sequence
ataaatatatttcttgatggattttt

SEQ ID NO: 192421 - DNA, 26 bp, Artificial sequence
  SiRNA target sequence
taaatatatttcttgatggatttttg

SEQ ID NO: 192422 - DNA, 26 bp, Artificial sequence
  SiRNA target sequence
aaatatatttcttgatggatttttgc

SEQ ID NO: 192423 - DNA, 26 bp, Artificial sequence
  SiRNA target sequence
aatatatttcttgatggatttttgcc

SEQ ID NO: 192424 - DNA, 26 bp, Artificial sequence
  SiRNA target sequence
atatatttcttgatggatttttgcct

SEQ ID NO: 192425 - DNA, 26 bp, Artificial sequence
  SiRNA target sequence
tatatttcttgatggatttttgccta

SEQ ID NO: 192426 - DNA, 26 bp, Artificial sequence
  SiRNA target sequence
atatttcttgatggatttttgcctac

SEQ ID NO: 192427 - DNA, 26 bp, Artificial sequence
  SiRNA target sequence
tatttcttgatggatttttgcctaca

SEQ ID NO: 192428 - DNA, 26 bp, Artificial sequence
  SiRNA target sequence
atttcttgatggatttttgcctacag

SEQ ID NO: 192429 - DNA, 26 bp, Artificial sequence
  SiRNA target sequence
tttcttgatggatttttgcctacaga

SEQ ID NO: 192430 - DNA, 26 bp, Artificial sequence
  SiRNA target sequence
ttcttgatggatttttgcctacagaa

SEQ ID NO: 192431 - DNA, 26 bp, Artificial sequence
  SiRNA target sequence
tcttgatggatttttgcctacagaaa

SEQ ID NO: 192432 - DNA, 26 bp, Artificial sequence
  SiRNA target sequence
cttgatggatttttgcctacagaaaa

SEQ ID NO: 192433 - DNA, 26 bp, Artificial sequence
  SiRNA target sequence
ttgatggatttttgcctacagaaaac

SEQ ID NO: 192434 - DNA, 26 bp, Artificial sequence
  SiRNA target sequence
tgatggatttttgcctacagaaaaca

SEQ ID NO: 192435 - DNA, 26 bp, Artificial sequence
  SiRNA target sequence
gatggatttttgcctacagaaaacat

SEQ ID NO: 192436 - DNA, 26 bp, Artificial sequence
  SiRNA target sequence
atggatttttgcctacagaaaacatg

SEQ ID NO: 192437 - DNA, 26 bp, Artificial sequence
  SiRNA target sequence
tggatttttgcctacagaaaacatga

SEQ ID NO: 192438 - DNA, 26 bp, Artificial sequence
  SiRNA target sequence
ggatttttgcctacagaaaacatgaa

SEQ ID NO: 192439 - DNA, 26 bp, Artificial sequence
  SiRNA target sequence
gatttttgcctacagaaaacatgaaa

SEQ ID NO: 192440 - DNA, 26 bp, Artificial sequence
  SiRNA target sequence
atttttgcctacagaaaacatgaaat

SEQ ID NO: 192441 - DNA, 26 bp, Artificial sequence
  SiRNA target sequence
tttttgcctacagaaaacatgaaatt

SEQ ID NO: 192442 - DNA, 26 bp, Artificial sequence
  SiRNA target sequence
ttttgcctacagaaaacatgaaattt

SEQ ID NO: 192443 - DNA, 26 bp, Artificial sequence
  SiRNA target sequence
tttgcctacagaaaacatgaaattta

SEQ ID NO: 192444 - DNA, 26 bp, Artificial sequence
  SiRNA target sequence
ttgcctacagaaaacatgaaatttag

SEQ ID NO: 192445 - DNA, 26 bp, Artificial sequence
  SiRNA target sequence
tgcctacagaaaacatgaaatttaga

SEQ ID NO: 192446 - DNA, 26 bp, Artificial sequence
  SiRNA target sequence
gcctacagaaaacatgaaatttagaa

SEQ ID NO: 192447 - DNA, 26 bp, Artificial sequence
  SiRNA target sequence
cctacagaaaacatgaaatttagaaa

SEQ ID NO: 192448 - DNA, 26 bp, Artificial sequence
  SiRNA target sequence
ctacagaaaacatgaaatttagaaat

SEQ ID NO: 192449 - DNA, 26 bp, Artificial sequence
  SiRNA target sequence
tacagaaaacatgaaatttagaaatt

SEQ ID NO: 192450 - DNA, 26 bp, Artificial sequence
  SiRNA target sequence
acagaaaacatgaaatttagaaattc

SEQ ID NO: 192451 - DNA, 26 bp, Artificial sequence
  SiRNA target sequence
cagaaaacatgaaatttagaaattca

SEQ ID NO: 192452 - DNA, 26 bp, Artificial sequence
  SiRNA target sequence
agaaaacatgaaatttagaaattcag

SEQ ID NO: 192453 - DNA, 26 bp, Artificial sequence
  SiRNA target sequence
gaaaacatgaaatttagaaattcaga

SEQ ID NO: 192454 - DNA, 26 bp, Artificial sequence
  SiRNA target sequence
aaaacatgaaatttagaaattcagag

SEQ ID NO: 192455 - DNA, 26 bp, Artificial sequence
  SiRNA target sequence
aaacatgaaatttagaaattcagagt

SEQ ID NO: 192456 - DNA, 26 bp, Artificial sequence
  SiRNA target sequence
aacatgaaatttagaaattcagagtt

SEQ ID NO: 192457 - DNA, 26 bp, Artificial sequence
  SiRNA target sequence
acatgaaatttagaaattcagagtta

SEQ ID NO: 192458 - DNA, 26 bp, Artificial sequence
  SiRNA target sequence
catgaaatttagaaattcagagttaa

SEQ ID NO: 192459 - DNA, 26 bp, Artificial sequence
  SiRNA target sequence
atgaaatttagaaattcagagttaaa

SEQ ID NO: 192460 - DNA, 26 bp, Artificial sequence
  SiRNA target sequence
tgaaatttagaaattcagagttaaag

SEQ ID NO: 192461 - DNA, 26 bp, Artificial sequence
  SiRNA target sequence
gaaatttagaaattcagagttaaagt

SEQ ID NO: 192462 - DNA, 26 bp, Artificial sequence
  SiRNA target sequence
aaatttagaaattcagagttaaagtt

SEQ ID NO: 192463 - DNA, 26 bp, Artificial sequence
  SiRNA target sequence
aatttagaaattcagagttaaagttt

SEQ ID NO: 192464 - DNA, 26 bp, Artificial sequence
  SiRNA target sequence
atttagaaattcagagttaaagttta

SEQ ID NO: 192465 - DNA, 26 bp, Artificial sequence
  SiRNA target sequence
tttagaaattcagagttaaagtttaa

SEQ ID NO: 192466 - DNA, 26 bp, Artificial sequence
  SiRNA target sequence
ttagaaattcagagttaaagtttaat

SEQ ID NO: 192467 - DNA, 26 bp, Artificial sequence
  SiRNA target sequence
tagaaattcagagttaaagtttaata

SEQ ID NO: 192468 - DNA, 26 bp, Artificial sequence
  SiRNA target sequence
agaaattcagagttaaagtttaatat

SEQ ID NO: 192469 - DNA, 26 bp, Artificial sequence
  SiRNA target sequence
gaaattcagagttaaagtttaatatt

SEQ ID NO: 192470 - DNA, 26 bp, Artificial sequence
  SiRNA target sequence
aaattcagagttaaagtttaatattt

SEQ ID NO: 192471 - DNA, 26 bp, Artificial sequence
  SiRNA target sequence
aattcagagttaaagtttaatatttc

SEQ ID NO: 192472 - DNA, 26 bp, Artificial sequence
  SiRNA target sequence
attcagagttaaagtttaatatttcg

SEQ ID NO: 192473 - DNA, 26 bp, Artificial sequence
  SiRNA target sequence
ttcagagttaaagtttaatatttcgg

SEQ ID NO: 192474 - DNA, 26 bp, Artificial sequence
  SiRNA target sequence
tcagagttaaagtttaatatttcgga

SEQ ID NO: 192475 - DNA, 26 bp, Artificial sequence
  SiRNA target sequence
cagagttaaagtttaatatttcggaa

SEQ ID NO: 192476 - DNA, 26 bp, Artificial sequence
  SiRNA target sequence
agagttaaagtttaatatttcggaaa

SEQ ID NO: 192477 - DNA, 26 bp, Artificial sequence
  SiRNA target sequence
gagttaaagtttaatatttcggaaac

SEQ ID NO: 192478 - DNA, 26 bp, Artificial sequence
  SiRNA target sequence
agttaaagtttaatatttcggaaaca

SEQ ID NO: 192479 - DNA, 26 bp, Artificial sequence
  SiRNA target sequence
gttaaagtttaatatttcggaaacac

SEQ ID NO: 192480 - DNA, 26 bp, Artificial sequence
  SiRNA target sequence
ttaaagtttaatatttcggaaacact

SEQ ID NO: 192481 - DNA, 26 bp, Artificial sequence
  SiRNA target sequence
taaagtttaatatttcggaaacactt

SEQ ID NO: 192482 - DNA, 26 bp, Artificial sequence
  SiRNA target sequence
aaagtttaatatttcggaaacacttg

SEQ ID NO: 192483 - DNA, 26 bp, Artificial sequence
  SiRNA target sequence
aagtttaatatttcggaaacacttga

SEQ ID NO: 192484 - DNA, 26 bp, Artificial sequence
  SiRNA target sequence
agtttaatatttcggaaacacttgat

SEQ ID NO: 192485 - DNA, 26 bp, Artificial sequence
  SiRNA target sequence
gtttaatatttcggaaacacttgata

SEQ ID NO: 192486 - DNA, 26 bp, Artificial sequence
  SiRNA target sequence
tttaatatttcggaaacacttgatag

SEQ ID NO: 192487 - DNA, 26 bp, Artificial sequence
  SiRNA target sequence
ttaatatttcggaaacacttgatagt

SEQ ID NO: 192488 - DNA, 26 bp, Artificial sequence
  SiRNA target sequence
taatatttcggaaacacttgatagta

SEQ ID NO: 192489 - DNA, 26 bp, Artificial sequence
  SiRNA target sequence
aatatttcggaaacacttgatagtat

SEQ ID NO: 192490 - DNA, 26 bp, Artificial sequence
  SiRNA target sequence
atatttcggaaacacttgatagtatt

SEQ ID NO: 192491 - DNA, 26 bp, Artificial sequence
  SiRNA target sequence
tatttcggaaacacttgatagtatta

SEQ ID NO: 192492 - DNA, 26 bp, Artificial sequence
  SiRNA target sequence
atttcggaaacacttgatagtattat

SEQ ID NO: 192493 - DNA, 26 bp, Artificial sequence
  SiRNA target sequence
tttcggaaacacttgatagtattata

SEQ ID NO: 192494 - DNA, 26 bp, Artificial sequence
  SiRNA target sequence
ttcggaaacacttgatagtattatat

SEQ ID NO: 192495 - DNA, 26 bp, Artificial sequence
  SiRNA target sequence
tcggaaacacttgatagtattatatc

SEQ ID NO: 192496 - DNA, 26 bp, Artificial sequence
  SiRNA target sequence
cggaaacacttgatagtattatatct

SEQ ID NO: 192497 - DNA, 26 bp, Artificial sequence
  SiRNA target sequence
ggaaacacttgatagtattatatcta

SEQ ID NO: 192498 - DNA, 26 bp, Artificial sequence
  SiRNA target sequence
gaaacacttgatagtattatatctac

SEQ ID NO: 192499 - DNA, 26 bp, Artificial sequence
  SiRNA target sequence
aaacacttgatagtattatatctacc

SEQ ID NO: 192500 - DNA, 26 bp, Artificial sequence
  SiRNA target sequence
aacacttgatagtattatatctacca

SEQ ID NO: 192501 - DNA, 26 bp, Artificial sequence
  SiRNA target sequence
acacttgatagtattatatctaccag

SEQ ID NO: 192502 - DNA, 26 bp, Artificial sequence
  SiRNA target sequence
cacttgatagtattatatctaccaga

SEQ ID NO: 192503 - DNA, 26 bp, Artificial sequence
  SiRNA target sequence
acttgatagtattatatctaccagag

SEQ ID NO: 192504 - DNA, 26 bp, Artificial sequence
  SiRNA target sequence
cttgatagtattatatctaccagaga

SEQ ID NO: 192505 - DNA, 26 bp, Artificial sequence
  SiRNA target sequence
ttgatagtattatatctaccagagac

SEQ ID NO: 192506 - DNA, 26 bp, Artificial sequence
  SiRNA target sequence
tgatagtattatatctaccagagacc

SEQ ID NO: 192507 - DNA, 26 bp, Artificial sequence
  SiRNA target sequence
gatagtattatatctaccagagacca

SEQ ID NO: 192508 - DNA, 26 bp, Artificial sequence
  SiRNA target sequence
atagtattatatctaccagagaccag

SEQ ID NO: 192509 - DNA, 26 bp, Artificial sequence
  SiRNA target sequence
tagtattatatctaccagagaccagt

SEQ ID NO: 192510 - DNA, 26 bp, Artificial sequence
  SiRNA target sequence
agtattatatctaccagagaccagta

SEQ ID NO: 192511 - DNA, 26 bp, Artificial sequence
  SiRNA target sequence
gtattatatctaccagagaccagtat

SEQ ID NO: 192512 - DNA, 26 bp, Artificial sequence
  SiRNA target sequence
tattatatctaccagagaccagtatc

SEQ ID NO: 192513 - DNA, 26 bp, Artificial sequence
  SiRNA target sequence
attatatctaccagagaccagtatca

SEQ ID NO: 192514 - DNA, 26 bp, Artificial sequence
  SiRNA target sequence
ttatatctaccagagaccagtatcat

SEQ ID NO: 192515 - DNA, 26 bp, Artificial sequence
  SiRNA target sequence
tatatctaccagagaccagtatcatt

SEQ ID NO: 192516 - DNA, 26 bp, Artificial sequence
  SiRNA target sequence
atatctaccagagaccagtatcatta

SEQ ID NO: 192517 - DNA, 26 bp, Artificial sequence
  SiRNA target sequence
tatctaccagagaccagtatcattat

SEQ ID NO: 192518 - DNA, 26 bp, Artificial sequence
  SiRNA target sequence
atctaccagagaccagtatcattatc

SEQ ID NO: 192519 - DNA, 26 bp, Artificial sequence
  SiRNA target sequence
tctaccagagaccagtatcattatcc

SEQ ID NO: 192520 - DNA, 26 bp, Artificial sequence
  SiRNA target sequence
ctaccagagaccagtatcattatccc

SEQ ID NO: 192521 - DNA, 26 bp, Artificial sequence
  SiRNA target sequence
taccagagaccagtatcattatccca

SEQ ID NO: 192522 - DNA, 26 bp, Artificial sequence
  SiRNA target sequence
accagagaccagtatcattatcccaa

SEQ ID NO: 192523 - DNA, 26 bp, Artificial sequence
  SiRNA target sequence
ccagagaccagtatcattatcccaat

SEQ ID NO: 192524 - DNA, 26 bp, Artificial sequence
  SiRNA target sequence
cagagaccagtatcattatcccaatt

SEQ ID NO: 192525 - DNA, 26 bp, Artificial sequence
  SiRNA target sequence
agagaccagtatcattatcccaattt

SEQ ID NO: 192526 - DNA, 26 bp, Artificial sequence
  SiRNA target sequence
gagaccagtatcattatcccaatttg

SEQ ID NO: 192527 - DNA, 26 bp, Artificial sequence
  SiRNA target sequence
agaccagtatcattatcccaatttga

SEQ ID NO: 192528 - DNA, 26 bp, Artificial sequence
  SiRNA target sequence
gaccagtatcattatcccaatttgat

SEQ ID NO: 192529 - DNA, 26 bp, Artificial sequence
  SiRNA target sequence
accagtatcattatcccaatttgata

SEQ ID NO: 192530 - DNA, 26 bp, Artificial sequence
  SiRNA target sequence
ccagtatcattatcccaatttgataa

SEQ ID NO: 192531 - DNA, 26 bp, Artificial sequence
  SiRNA target sequence
cagtatcattatcccaatttgataaa

SEQ ID NO: 192532 - DNA, 26 bp, Artificial sequence
  SiRNA target sequence
agtatcattatcccaatttgataaaa

SEQ ID NO: 192533 - DNA, 26 bp, Artificial sequence
  SiRNA target sequence
gtatcattatcccaatttgataaaaa

SEQ ID NO: 192534 - DNA, 26 bp, Artificial sequence
  SiRNA target sequence
tatcattatcccaatttgataaaaac

SEQ ID NO: 192535 - DNA, 26 bp, Artificial sequence
  SiRNA target sequence
atcattatcccaatttgataaaaaca

SEQ ID NO: 192536 - DNA, 26 bp, Artificial sequence
  SiRNA target sequence
tcattatcccaatttgataaaaacat

SEQ ID NO: 192537 - DNA, 26 bp, Artificial sequence
  SiRNA target sequence
cattatcccaatttgataaaaacata

SEQ ID NO: 192538 - DNA, 26 bp, Artificial sequence
  SiRNA target sequence
attatcccaatttgataaaaacatat

SEQ ID NO: 192539 - DNA, 26 bp, Artificial sequence
  SiRNA target sequence
ttatcccaatttgataaaaacatatc

SEQ ID NO: 192540 - DNA, 26 bp, Artificial sequence
  SiRNA target sequence
tatcccaatttgataaaaacatatcc

SEQ ID NO: 192541 - DNA, 26 bp, Artificial sequence
  SiRNA target sequence
atcccaatttgataaaaacatatcca

SEQ ID NO: 192542 - DNA, 26 bp, Artificial sequence
  SiRNA target sequence
tcccaatttgataaaaacatatccaa

SEQ ID NO: 192543 - DNA, 26 bp, Artificial sequence
  SiRNA target sequence
cccaatttgataaaaacatatccaaa

SEQ ID NO: 192544 - DNA, 26 bp, Artificial sequence
  SiRNA target sequence
ccaatttgataaaaacatatccaaat

SEQ ID NO: 192545 - DNA, 26 bp, Artificial sequence
  SiRNA target sequence
caatttgataaaaacatatccaaatt

SEQ ID NO: 192546 - DNA, 26 bp, Artificial sequence
  SiRNA target sequence
aatttgataaaaacatatccaaattt

SEQ ID NO: 192547 - DNA, 26 bp, Artificial sequence
  SiRNA target sequence
atttgataaaaacatatccaaatttt

SEQ ID NO: 192548 - DNA, 26 bp, Artificial sequence
  SiRNA target sequence
tttgataaaaacatatccaaatttta

SEQ ID NO: 192549 - DNA, 26 bp, Artificial sequence
  SiRNA target sequence
ttgataaaaacatatccaaattttac

SEQ ID NO: 192550 - DNA, 26 bp, Artificial sequence
  SiRNA target sequence
tgataaaaacatatccaaattttacg

SEQ ID NO: 192551 - DNA, 26 bp, Artificial sequence
  SiRNA target sequence
gataaaaacatatccaaattttacgc

SEQ ID NO: 192552 - DNA, 26 bp, Artificial sequence
  SiRNA target sequence
ataaaaacatatccaaattttacgct

SEQ ID NO: 192553 - DNA, 26 bp, Artificial sequence
  SiRNA target sequence
taaaaacatatccaaattttacgctt

SEQ ID NO: 192554 - DNA, 26 bp, Artificial sequence
  SiRNA target sequence
aaaaacatatccaaattttacgctta

SEQ ID NO: 192555 - DNA, 26 bp, Artificial sequence
  SiRNA target sequence
aaaacatatccaaattttacgcttaa

SEQ ID NO: 192556 - DNA, 26 bp, Artificial sequence
  SiRNA target sequence
aaacatatccaaattttacgcttaaa

SEQ ID NO: 192557 - DNA, 26 bp, Artificial sequence
  SiRNA target sequence
aacatatccaaattttacgcttaaag

SEQ ID NO: 192558 - DNA, 26 bp, Artificial sequence
  SiRNA target sequence
acatatccaaattttacgcttaaagt

SEQ ID NO: 192559 - DNA, 26 bp, Artificial sequence
  SiRNA target sequence
catatccaaattttacgcttaaagtt

SEQ ID NO: 192560 - DNA, 26 bp, Artificial sequence
  SiRNA target sequence
atatccaaattttacgcttaaagttg

SEQ ID NO: 192561 - DNA, 26 bp, Artificial sequence
  SiRNA target sequence
tatccaaattttacgcttaaagttga

SEQ ID NO: 192562 - DNA, 26 bp, Artificial sequence
  SiRNA target sequence
atccaaattttacgcttaaagttgaa

SEQ ID NO: 192563 - DNA, 26 bp, Artificial sequence
  SiRNA target sequence
tccaaattttacgcttaaagttgaag

SEQ ID NO: 192564 - DNA, 26 bp, Artificial sequence
  SiRNA target sequence
ccaaattttacgcttaaagttgaagg

SEQ ID NO: 192565 - DNA, 26 bp, Artificial sequence
  SiRNA target sequence
caaattttacgcttaaagttgaaggc

SEQ ID NO: 192566 - DNA, 26 bp, Artificial sequence
  SiRNA target sequence
aaattttacgcttaaagttgaaggcg

SEQ ID NO: 192567 - DNA, 26 bp, Artificial sequence
  SiRNA target sequence
aattttacgcttaaagttgaaggcgg

SEQ ID NO: 192568 - DNA, 26 bp, Artificial sequence
  SiRNA target sequence
attttacgcttaaagttgaaggcggt

SEQ ID NO: 192569 - DNA, 26 bp, Artificial sequence
  SiRNA target sequence
ttttacgcttaaagttgaaggcggta

SEQ ID NO: 192570 - DNA, 26 bp, Artificial sequence
  SiRNA target sequence
tttacgcttaaagttgaaggcggtaa

SEQ ID NO: 192571 - DNA, 26 bp, Artificial sequence
  SiRNA target sequence
ttacgcttaaagttgaaggcggtaac

SEQ ID NO: 192572 - DNA, 26 bp, Artificial sequence
  SiRNA target sequence
tacgcttaaagttgaaggcggtaact

SEQ ID NO: 192573 - DNA, 26 bp, Artificial sequence
  SiRNA target sequence
acgcttaaagttgaaggcggtaactt

SEQ ID NO: 192574 - DNA, 26 bp, Artificial sequence
  SiRNA target sequence
cgcttaaagttgaaggcggtaacttt

SEQ ID NO: 192575 - DNA, 26 bp, Artificial sequence
  SiRNA target sequence
gcttaaagttgaaggcggtaactttt

SEQ ID NO: 192576 - DNA, 26 bp, Artificial sequence
  SiRNA target sequence
cttaaagttgaaggcggtaacttttc

SEQ ID NO: 192577 - DNA, 26 bp, Artificial sequence
  SiRNA target sequence
ttaaagttgaaggcggtaacttttca

SEQ ID NO: 192578 - DNA, 26 bp, Artificial sequence
  SiRNA target sequence
taaagttgaaggcggtaacttttcag

SEQ ID NO: 192579 - DNA, 26 bp, Artificial sequence
  SiRNA target sequence
aaagttgaaggcggtaacttttcaga

SEQ ID NO: 192580 - DNA, 26 bp, Artificial sequence
  SiRNA target sequence
aagttgaaggcggtaacttttcagat

SEQ ID NO: 192581 - DNA, 26 bp, Artificial sequence
  SiRNA target sequence
agttgaaggcggtaacttttcagatt

SEQ ID NO: 192582 - DNA, 26 bp, Artificial sequence
  SiRNA target sequence
gttgaaggcggtaacttttcagattc

SEQ ID NO: 192583 - DNA, 26 bp, Artificial sequence
  SiRNA target sequence
ttgaaggcggtaacttttcagattct

SEQ ID NO: 192584 - DNA, 26 bp, Artificial sequence
  SiRNA target sequence
tgaaggcggtaacttttcagattctg

SEQ ID NO: 192585 - DNA, 26 bp, Artificial sequence
  SiRNA target sequence
gaaggcggtaacttttcagattctga

SEQ ID NO: 192586 - DNA, 26 bp, Artificial sequence
  SiRNA target sequence
aaggcggtaacttttcagattctgaa

SEQ ID NO: 192587 - DNA, 26 bp, Artificial sequence
  SiRNA target sequence
aggcggtaacttttcagattctgaaa

SEQ ID NO: 192588 - DNA, 26 bp, Artificial sequence
  SiRNA target sequence
ggcggtaacttttcagattctgaaat

SEQ ID NO: 192589 - DNA, 26 bp, Artificial sequence
  SiRNA target sequence
gcggtaacttttcagattctgaaatt

SEQ ID NO: 192590 - DNA, 26 bp, Artificial sequence
  SiRNA target sequence
cggtaacttttcagattctgaaattg

SEQ ID NO: 192591 - DNA, 26 bp, Artificial sequence
  SiRNA target sequence
ggtaacttttcagattctgaaattgt

SEQ ID NO: 192592 - DNA, 26 bp, Artificial sequence
  SiRNA target sequence
gtaacttttcagattctgaaattgtt

SEQ ID NO: 192593 - DNA, 26 bp, Artificial sequence
  SiRNA target sequence
taacttttcagattctgaaattgttg

SEQ ID NO: 192594 - DNA, 26 bp, Artificial sequence
  SiRNA target sequence
aacttttcagattctgaaattgttgt

SEQ ID NO: 192595 - DNA, 26 bp, Artificial sequence
  SiRNA target sequence
acttttcagattctgaaattgttgta

SEQ ID NO: 192596 - DNA, 26 bp, Artificial sequence
  SiRNA target sequence
cttttcagattctgaaattgttgtat

SEQ ID NO: 192597 - DNA, 26 bp, Artificial sequence
  SiRNA target sequence
ttttcagattctgaaattgttgtatt

SEQ ID NO: 192598 - DNA, 26 bp, Artificial sequence
  SiRNA target sequence
tttcagattctgaaattgttgtattt

SEQ ID NO: 192599 - DNA, 26 bp, Artificial sequence
  SiRNA target sequence
ttcagattctgaaattgttgtatttc

SEQ ID NO: 192600 - DNA, 26 bp, Artificial sequence
  SiRNA target sequence
tcagattctgaaattgttgtatttct

SEQ ID NO: 192601 - DNA, 26 bp, Artificial sequence
  SiRNA target sequence
cagattctgaaattgttgtatttctt

SEQ ID NO: 192602 - DNA, 26 bp, Artificial sequence
  SiRNA target sequence
agattctgaaattgttgtatttcttg

SEQ ID NO: 192603 - DNA, 26 bp, Artificial sequence
  SiRNA target sequence
gattctgaaattgttgtatttcttgg

SEQ ID NO: 192604 - DNA, 26 bp, Artificial sequence
  SiRNA target sequence
attctgaaattgttgtatttcttggt

SEQ ID NO: 192605 - DNA, 26 bp, Artificial sequence
  SiRNA target sequence
ttctgaaattgttgtatttcttggtg

SEQ ID NO: 192606 - DNA, 26 bp, Artificial sequence
  SiRNA target sequence
tctgaaattgttgtatttcttggtga

SEQ ID NO: 192607 - DNA, 26 bp, Artificial sequence
  SiRNA target sequence
ctgaaattgttgtatttcttggtgaa

SEQ ID NO: 192608 - DNA, 26 bp, Artificial sequence
  SiRNA target sequence
tgaaattgttgtatttcttggtgaaa

SEQ ID NO: 192609 - DNA, 26 bp, Artificial sequence
  SiRNA target sequence
gaaattgttgtatttcttggtgaaaa

SEQ ID NO: 192610 - DNA, 26 bp, Artificial sequence
  SiRNA target sequence
aaattgttgtatttcttggtgaaaat

SEQ ID NO: 192611 - DNA, 26 bp, Artificial sequence
  SiRNA target sequence
aattgttgtatttcttggtgaaaatg

SEQ ID NO: 192612 - DNA, 26 bp, Artificial sequence
  SiRNA target sequence
attgttgtatttcttggtgaaaatgg

SEQ ID NO: 192613 - DNA, 26 bp, Artificial sequence
  SiRNA target sequence
ttgttgtatttcttggtgaaaatgga

SEQ ID NO: 192614 - DNA, 26 bp, Artificial sequence
  SiRNA target sequence
tgttgtatttcttggtgaaaatggaa

SEQ ID NO: 192615 - DNA, 26 bp, Artificial sequence
  SiRNA target sequence
gttgtatttcttggtgaaaatggaat

SEQ ID NO: 192616 - DNA, 26 bp, Artificial sequence
  SiRNA target sequence
ttgtatttcttggtgaaaatggaatg

SEQ ID NO: 192617 - DNA, 26 bp, Artificial sequence
  SiRNA target sequence
tgtatttcttggtgaaaatggaatgg

SEQ ID NO: 192618 - DNA, 26 bp, Artificial sequence
  SiRNA target sequence
gtatttcttggtgaaaatggaatggg

SEQ ID NO: 192619 - DNA, 26 bp, Artificial sequence
  SiRNA target sequence
tatttcttggtgaaaatggaatgggc

SEQ ID NO: 192620 - DNA, 26 bp, Artificial sequence
  SiRNA target sequence
atttcttggtgaaaatggaatgggca

SEQ ID NO: 192621 - DNA, 26 bp, Artificial sequence
  SiRNA target sequence
tttcttggtgaaaatggaatgggcaa

SEQ ID NO: 192622 - DNA, 26 bp, Artificial sequence
  SiRNA target sequence
ttcttggtgaaaatggaatgggcaaa

SEQ ID NO: 192623 - DNA, 26 bp, Artificial sequence
  SiRNA target sequence
tcttggtgaaaatggaatgggcaaaa

SEQ ID NO: 192624 - DNA, 26 bp, Artificial sequence
  SiRNA target sequence
cttggtgaaaatggaatgggcaaaac

SEQ ID NO: 192625 - DNA, 26 bp, Artificial sequence
  SiRNA target sequence
ttggtgaaaatggaatgggcaaaact

SEQ ID NO: 192626 - DNA, 26 bp, Artificial sequence
  SiRNA target sequence
tggtgaaaatggaatgggcaaaacta

SEQ ID NO: 192627 - DNA, 26 bp, Artificial sequence
  SiRNA target sequence
ggtgaaaatggaatgggcaaaactac

SEQ ID NO: 192628 - DNA, 26 bp, Artificial sequence
  SiRNA target sequence
gtgaaaatggaatgggcaaaactact

SEQ ID NO: 192629 - DNA, 26 bp, Artificial sequence
  SiRNA target sequence
tgaaaatggaatgggcaaaactactt

SEQ ID NO: 192630 - DNA, 26 bp, Artificial sequence
  SiRNA target sequence
gaaaatggaatgggcaaaactacttt

SEQ ID NO: 192631 - DNA, 26 bp, Artificial sequence
  SiRNA target sequence
aaaatggaatgggcaaaactacttta

SEQ ID NO: 192632 - DNA, 26 bp, Artificial sequence
  SiRNA target sequence
aaatggaatgggcaaaactactttag

SEQ ID NO: 192633 - DNA, 26 bp, Artificial sequence
  SiRNA target sequence
aatggaatgggcaaaactactttagt

SEQ ID NO: 192634 - DNA, 26 bp, Artificial sequence
  SiRNA target sequence
atggaatgggcaaaactactttagta

SEQ ID NO: 192635 - DNA, 26 bp, Artificial sequence
  SiRNA target sequence
tggaatgggcaaaactactttagtag

SEQ ID NO: 192636 - DNA, 26 bp, Artificial sequence
  SiRNA target sequence
ggaatgggcaaaactactttagtagg

SEQ ID NO: 192637 - DNA, 26 bp, Artificial sequence
  SiRNA target sequence
gaatgggcaaaactactttagtaggt

SEQ ID NO: 192638 - DNA, 26 bp, Artificial sequence
  SiRNA target sequence
aatgggcaaaactactttagtaggtt

SEQ ID NO: 192639 - DNA, 26 bp, Artificial sequence
  SiRNA target sequence
atgggcaaaactactttagtaggttt

SEQ ID NO: 192640 - DNA, 26 bp, Artificial sequence
  SiRNA target sequence
tgggcaaaactactttagtaggtttg

SEQ ID NO: 192641 - DNA, 26 bp, Artificial sequence
  SiRNA target sequence
gggcaaaactactttagtaggtttga

SEQ ID NO: 192642 - DNA, 26 bp, Artificial sequence
  SiRNA target sequence
ggcaaaactactttagtaggtttgat

SEQ ID NO: 192643 - DNA, 26 bp, Artificial sequence
  SiRNA target sequence
gcaaaactactttagtaggtttgatt

SEQ ID NO: 192644 - DNA, 26 bp, Artificial sequence
  SiRNA target sequence
caaaactactttagtaggtttgattt

SEQ ID NO: 192645 - DNA, 26 bp, Artificial sequence
  SiRNA target sequence
aaaactactttagtaggtttgatttc

SEQ ID NO: 192646 - DNA, 26 bp, Artificial sequence
  SiRNA target sequence
aaactactttagtaggtttgatttcg

SEQ ID NO: 192647 - DNA, 26 bp, Artificial sequence
  SiRNA target sequence
aactactttagtaggtttgatttcgg

SEQ ID NO: 192648 - DNA, 26 bp, Artificial sequence
  SiRNA target sequence
actactttagtaggtttgatttcggg

SEQ ID NO: 192649 - DNA, 26 bp, Artificial sequence
  SiRNA target sequence
ctactttagtaggtttgatttcgggg

SEQ ID NO: 192650 - DNA, 26 bp, Artificial sequence
  SiRNA target sequence
tactttagtaggtttgatttcggggt

SEQ ID NO: 192651 - DNA, 26 bp, Artificial sequence
  SiRNA target sequence
actttagtaggtttgatttcggggtt

SEQ ID NO: 192652 - DNA, 26 bp, Artificial sequence
  SiRNA target sequence
ctttagtaggtttgatttcggggtta

SEQ ID NO: 192653 - DNA, 26 bp, Artificial sequence
  SiRNA target sequence
tttagtaggtttgatttcggggttaa

SEQ ID NO: 192654 - DNA, 26 bp, Artificial sequence
  SiRNA target sequence
ttagtaggtttgatttcggggttaat

SEQ ID NO: 192655 - DNA, 26 bp, Artificial sequence
  SiRNA target sequence
tagtaggtttgatttcggggttaatt

SEQ ID NO: 192656 - DNA, 26 bp, Artificial sequence
  SiRNA target sequence
agtaggtttgatttcggggttaatta

SEQ ID NO: 192657 - DNA, 26 bp, Artificial sequence
  SiRNA target sequence
gtaggtttgatttcggggttaattaa

SEQ ID NO: 192658 - DNA, 26 bp, Artificial sequence
  SiRNA target sequence
taggtttgatttcggggttaattaaa

SEQ ID NO: 192659 - DNA, 26 bp, Artificial sequence
  SiRNA target sequence
aggtttgatttcggggttaattaaag

SEQ ID NO: 192660 - DNA, 26 bp, Artificial sequence
  SiRNA target sequence
ggtttgatttcggggttaattaaaga

SEQ ID NO: 192661 - DNA, 26 bp, Artificial sequence
  SiRNA target sequence
gtttgatttcggggttaattaaagat

SEQ ID NO: 192662 - DNA, 26 bp, Artificial sequence
  SiRNA target sequence
tttgatttcggggttaattaaagatg

SEQ ID NO: 192663 - DNA, 26 bp, Artificial sequence
  SiRNA target sequence
ttgatttcggggttaattaaagatga

SEQ ID NO: 192664 - DNA, 26 bp, Artificial sequence
  SiRNA target sequence
tgatttcggggttaattaaagatgat

SEQ ID NO: 192665 - DNA, 26 bp, Artificial sequence
  SiRNA target sequence
gatttcggggttaattaaagatgata

SEQ ID NO: 192666 - DNA, 26 bp, Artificial sequence
  SiRNA target sequence
atttcggggttaattaaagatgataa

SEQ ID NO: 192667 - DNA, 26 bp, Artificial sequence
  SiRNA target sequence
tttcggggttaattaaagatgataac

SEQ ID NO: 192668 - DNA, 26 bp, Artificial sequence
  SiRNA target sequence
ttcggggttaattaaagatgataacg

SEQ ID NO: 192669 - DNA, 26 bp, Artificial sequence
  SiRNA target sequence
tcggggttaattaaagatgataacgg

SEQ ID NO: 192670 - DNA, 26 bp, Artificial sequence
  SiRNA target sequence
cggggttaattaaagatgataacggg

SEQ ID NO: 192671 - DNA, 26 bp, Artificial sequence
  SiRNA target sequence
ggggttaattaaagatgataacgggg

SEQ ID NO: 192672 - DNA, 26 bp, Artificial sequence
  SiRNA target sequence
gggttaattaaagatgataacgggga

SEQ ID NO: 192673 - DNA, 26 bp, Artificial sequence
  SiRNA target sequence
ggttaattaaagatgataacggggaa

SEQ ID NO: 192674 - DNA, 26 bp, Artificial sequence
  SiRNA target sequence
gttaattaaagatgataacggggaag

SEQ ID NO: 192675 - DNA, 26 bp, Artificial sequence
  SiRNA target sequence
ttaattaaagatgataacggggaaga

SEQ ID NO: 192676 - DNA, 26 bp, Artificial sequence
  SiRNA target sequence
taattaaagatgataacggggaagag

SEQ ID NO: 192677 - DNA, 26 bp, Artificial sequence
  SiRNA target sequence
aattaaagatgataacggggaagagt

SEQ ID NO: 192678 - DNA, 26 bp, Artificial sequence
  SiRNA target sequence
attaaagatgataacggggaagagtt

SEQ ID NO: 192679 - DNA, 26 bp, Artificial sequence
  SiRNA target sequence
ttaaagatgataacggggaagagttc

SEQ ID NO: 192680 - DNA, 26 bp, Artificial sequence
  SiRNA target sequence
taaagatgataacggggaagagttcg

SEQ ID NO: 192681 - DNA, 26 bp, Artificial sequence
  SiRNA target sequence
aaagatgataacggggaagagttcgg

SEQ ID NO: 192682 - DNA, 26 bp, Artificial sequence
  SiRNA target sequence
aagatgataacggggaagagttcggt

SEQ ID NO: 192683 - DNA, 26 bp, Artificial sequence
  SiRNA target sequence
agatgataacggggaagagttcggtt

SEQ ID NO: 192684 - DNA, 26 bp, Artificial sequence
  SiRNA target sequence
gatgataacggggaagagttcggttt

SEQ ID NO: 192685 - DNA, 26 bp, Artificial sequence
  SiRNA target sequence
atgataacggggaagagttcggtttg

SEQ ID NO: 192686 - DNA, 26 bp, Artificial sequence
  SiRNA target sequence
tgataacggggaagagttcggtttgt

SEQ ID NO: 192687 - DNA, 26 bp, Artificial sequence
  SiRNA target sequence
gataacggggaagagttcggtttgtt

SEQ ID NO: 192688 - DNA, 26 bp, Artificial sequence
  SiRNA target sequence
ataacggggaagagttcggtttgttg

SEQ ID NO: 192689 - DNA, 26 bp, Artificial sequence
  SiRNA target sequence
taacggggaagagttcggtttgttgt

SEQ ID NO: 192690 - DNA, 26 bp, Artificial sequence
  SiRNA target sequence
aacggggaagagttcggtttgttgtc

SEQ ID NO: 192691 - DNA, 26 bp, Artificial sequence
  SiRNA target sequence
acggggaagagttcggtttgttgtca

SEQ ID NO: 192692 - DNA, 26 bp, Artificial sequence
  SiRNA target sequence
cggggaagagttcggtttgttgtcat

SEQ ID NO: 192693 - DNA, 26 bp, Artificial sequence
  SiRNA target sequence
ggggaagagttcggtttgttgtcata

SEQ ID NO: 192694 - DNA, 26 bp, Artificial sequence
  SiRNA target sequence
gggaagagttcggtttgttgtcatat

SEQ ID NO: 192695 - DNA, 26 bp, Artificial sequence
  SiRNA target sequence
ggaagagttcggtttgttgtcatata

SEQ ID NO: 192696 - DNA, 26 bp, Artificial sequence
  SiRNA target sequence
gaagagttcggtttgttgtcatatag

SEQ ID NO: 192697 - DNA, 26 bp, Artificial sequence
  SiRNA target sequence
aagagttcggtttgttgtcatatagt

SEQ ID NO: 192698 - DNA, 26 bp, Artificial sequence
  SiRNA target sequence
agagttcggtttgttgtcatatagtc

SEQ ID NO: 192699 - DNA, 26 bp, Artificial sequence
  SiRNA target sequence
gagttcggtttgttgtcatatagtct

SEQ ID NO: 192700 - DNA, 26 bp, Artificial sequence
  SiRNA target sequence
agttcggtttgttgtcatatagtctt

SEQ ID NO: 192701 - DNA, 26 bp, Artificial sequence
  SiRNA target sequence
gttcggtttgttgtcatatagtctta

SEQ ID NO: 192702 - DNA, 26 bp, Artificial sequence
  SiRNA target sequence
ttcggtttgttgtcatatagtcttaa

SEQ ID NO: 192703 - DNA, 26 bp, Artificial sequence
  SiRNA target sequence
tcggtttgttgtcatatagtcttaaa

SEQ ID NO: 192704 - DNA, 26 bp, Artificial sequence
  SiRNA target sequence
cggtttgttgtcatatagtcttaaac

SEQ ID NO: 192705 - DNA, 26 bp, Artificial sequence
  SiRNA target sequence
ggtttgttgtcatatagtcttaaacc

SEQ ID NO: 192706 - DNA, 26 bp, Artificial sequence
  SiRNA target sequence
gtttgttgtcatatagtcttaaaccg

SEQ ID NO: 192707 - DNA, 26 bp, Artificial sequence
  SiRNA target sequence
tttgttgtcatatagtcttaaaccgc

SEQ ID NO: 192708 - DNA, 26 bp, Artificial sequence
  SiRNA target sequence
ttgttgtcatatagtcttaaaccgca

SEQ ID NO: 192709 - DNA, 26 bp, Artificial sequence
  SiRNA target sequence
tgttgtcatatagtcttaaaccgcaa

SEQ ID NO: 192710 - DNA, 26 bp, Artificial sequence
  SiRNA target sequence
gttgtcatatagtcttaaaccgcaaa

SEQ ID NO: 192711 - DNA, 26 bp, Artificial sequence
  SiRNA target sequence
ttgtcatatagtcttaaaccgcaaaa

SEQ ID NO: 192712 - DNA, 26 bp, Artificial sequence
  SiRNA target sequence
tgtcatatagtcttaaaccgcaaaaa

SEQ ID NO: 192713 - DNA, 26 bp, Artificial sequence
  SiRNA target sequence
gtcatatagtcttaaaccgcaaaaaa

SEQ ID NO: 192714 - DNA, 26 bp, Artificial sequence
  SiRNA target sequence
tcatatagtcttaaaccgcaaaaaat

SEQ ID NO: 192715 - DNA, 26 bp, Artificial sequence
  SiRNA target sequence
catatagtcttaaaccgcaaaaaatc

SEQ ID NO: 192716 - DNA, 26 bp, Artificial sequence
  SiRNA target sequence
atatagtcttaaaccgcaaaaaatca

SEQ ID NO: 192717 - DNA, 26 bp, Artificial sequence
  SiRNA target sequence
tatagtcttaaaccgcaaaaaatcat

SEQ ID NO: 192718 - DNA, 26 bp, Artificial sequence
  SiRNA target sequence
atagtcttaaaccgcaaaaaatcata

SEQ ID NO: 192719 - DNA, 26 bp, Artificial sequence
  SiRNA target sequence
tagtcttaaaccgcaaaaaatcatac

SEQ ID NO: 192720 - DNA, 26 bp, Artificial sequence
  SiRNA target sequence
agtcttaaaccgcaaaaaatcatacc

SEQ ID NO: 192721 - DNA, 26 bp, Artificial sequence
  SiRNA target sequence
gtcttaaaccgcaaaaaatcataccg

SEQ ID NO: 192722 - DNA, 26 bp, Artificial sequence
  SiRNA target sequence
tcttaaaccgcaaaaaatcataccga

SEQ ID NO: 192723 - DNA, 26 bp, Artificial sequence
  SiRNA target sequence
cttaaaccgcaaaaaatcataccgaa

SEQ ID NO: 192724 - DNA, 26 bp, Artificial sequence
  SiRNA target sequence
ttaaaccgcaaaaaatcataccgaaa

SEQ ID NO: 192725 - DNA, 26 bp, Artificial sequence
  SiRNA target sequence
taaaccgcaaaaaatcataccgaaat

SEQ ID NO: 192726 - DNA, 26 bp, Artificial sequence
  SiRNA target sequence
aaaccgcaaaaaatcataccgaaata

SEQ ID NO: 192727 - DNA, 26 bp, Artificial sequence
  SiRNA target sequence
aaccgcaaaaaatcataccgaaatac

SEQ ID NO: 192728 - DNA, 26 bp, Artificial sequence
  SiRNA target sequence
accgcaaaaaatcataccgaaataca

SEQ ID NO: 192729 - DNA, 26 bp, Artificial sequence
  SiRNA target sequence
ccgcaaaaaatcataccgaaatacaa

SEQ ID NO: 192730 - DNA, 26 bp, Artificial sequence
  SiRNA target sequence
cgcaaaaaatcataccgaaatacaaa

SEQ ID NO: 192731 - DNA, 26 bp, Artificial sequence
  SiRNA target sequence
gcaaaaaatcataccgaaatacaaag

SEQ ID NO: 192732 - DNA, 26 bp, Artificial sequence
  SiRNA target sequence
caaaaaatcataccgaaatacaaagg

SEQ ID NO: 192733 - DNA, 26 bp, Artificial sequence
  SiRNA target sequence
aaaaaatcataccgaaatacaaagga

SEQ ID NO: 192734 - DNA, 26 bp, Artificial sequence
  SiRNA target sequence
aaaaatcataccgaaatacaaaggaa

SEQ ID NO: 192735 - DNA, 26 bp, Artificial sequence
  SiRNA target sequence
aaaatcataccgaaatacaaaggaac

SEQ ID NO: 192736 - DNA, 26 bp, Artificial sequence
  SiRNA target sequence
aaatcataccgaaatacaaaggaaca

SEQ ID NO: 192737 - DNA, 26 bp, Artificial sequence
  SiRNA target sequence
aatcataccgaaatacaaaggaacag

SEQ ID NO: 192738 - DNA, 26 bp, Artificial sequence
  SiRNA target sequence
atcataccgaaatacaaaggaacagt

SEQ ID NO: 192739 - DNA, 26 bp, Artificial sequence
  SiRNA target sequence
tcataccgaaatacaaaggaacagtt

SEQ ID NO: 192740 - DNA, 26 bp, Artificial sequence
  SiRNA target sequence
cataccgaaatacaaaggaacagtta

SEQ ID NO: 192741 - DNA, 26 bp, Artificial sequence
  SiRNA target sequence
ataccgaaatacaaaggaacagttag

SEQ ID NO: 192742 - DNA, 26 bp, Artificial sequence
  SiRNA target sequence
taccgaaatacaaaggaacagttaga

SEQ ID NO: 192743 - DNA, 26 bp, Artificial sequence
  SiRNA target sequence
accgaaatacaaaggaacagttagag

SEQ ID NO: 192744 - DNA, 26 bp, Artificial sequence
  SiRNA target sequence
ccgaaatacaaaggaacagttagaga

SEQ ID NO: 192745 - DNA, 26 bp, Artificial sequence
  SiRNA target sequence
cgaaatacaaaggaacagttagagat

SEQ ID NO: 192746 - DNA, 26 bp, Artificial sequence
  SiRNA target sequence
gaaatacaaaggaacagttagagatc

SEQ ID NO: 192747 - DNA, 26 bp, Artificial sequence
  SiRNA target sequence
aaatacaaaggaacagttagagatct

SEQ ID NO: 192748 - DNA, 26 bp, Artificial sequence
  SiRNA target sequence
aatacaaaggaacagttagagatctt

SEQ ID NO: 192749 - DNA, 26 bp, Artificial sequence
  SiRNA target sequence
atacaaaggaacagttagagatcttt

SEQ ID NO: 192750 - DNA, 26 bp, Artificial sequence
  SiRNA target sequence
tacaaaggaacagttagagatctttt

SEQ ID NO: 192751 - DNA, 26 bp, Artificial sequence
  SiRNA target sequence
acaaaggaacagttagagatcttttt

SEQ ID NO: 192752 - DNA, 26 bp, Artificial sequence
  SiRNA target sequence
caaaggaacagttagagatcttttta

SEQ ID NO: 192753 - DNA, 26 bp, Artificial sequence
  SiRNA target sequence
aaaggaacagttagagatctttttat

SEQ ID NO: 192754 - DNA, 26 bp, Artificial sequence
  SiRNA target sequence
aaggaacagttagagatctttttatg

SEQ ID NO: 192755 - DNA, 26 bp, Artificial sequence
  SiRNA target sequence
aggaacagttagagatctttttatgt

SEQ ID NO: 192756 - DNA, 26 bp, Artificial sequence
  SiRNA target sequence
ggaacagttagagatctttttatgtc

SEQ ID NO: 192757 - DNA, 26 bp, Artificial sequence
  SiRNA target sequence
gaacagttagagatctttttatgtca

SEQ ID NO: 192758 - DNA, 26 bp, Artificial sequence
  SiRNA target sequence
aacagttagagatctttttatgtcaa

SEQ ID NO: 192759 - DNA, 26 bp, Artificial sequence
  SiRNA target sequence
acagttagagatctttttatgtcaaa

SEQ ID NO: 192760 - DNA, 26 bp, Artificial sequence
  SiRNA target sequence
cagttagagatctttttatgtcaaaa

SEQ ID NO: 192761 - DNA, 26 bp, Artificial sequence
  SiRNA target sequence
agttagagatctttttatgtcaaaaa

SEQ ID NO: 192762 - DNA, 26 bp, Artificial sequence
  SiRNA target sequence
gttagagatctttttatgtcaaaaat

SEQ ID NO: 192763 - DNA, 26 bp, Artificial sequence
  SiRNA target sequence
ttagagatctttttatgtcaaaaatt

SEQ ID NO: 192764 - DNA, 26 bp, Artificial sequence
  SiRNA target sequence
tagagatctttttatgtcaaaaattc

SEQ ID NO: 192765 - DNA, 26 bp, Artificial sequence
  SiRNA target sequence
agagatctttttatgtcaaaaattcg

SEQ ID NO: 192766 - DNA, 26 bp, Artificial sequence
  SiRNA target sequence
gagatctttttatgtcaaaaattcgt

SEQ ID NO: 192767 - DNA, 26 bp, Artificial sequence
  SiRNA target sequence
agatctttttatgtcaaaaattcgtt

SEQ ID NO: 192768 - DNA, 26 bp, Artificial sequence
  SiRNA target sequence
gatctttttatgtcaaaaattcgttc

SEQ ID NO: 192769 - DNA, 26 bp, Artificial sequence
  SiRNA target sequence
atctttttatgtcaaaaattcgttct

SEQ ID NO: 192770 - DNA, 26 bp, Artificial sequence
  SiRNA target sequence
tctttttatgtcaaaaattcgttctt

SEQ ID NO: 192771 - DNA, 26 bp, Artificial sequence
  SiRNA target sequence
ctttttatgtcaaaaattcgttcttc

SEQ ID NO: 192772 - DNA, 26 bp, Artificial sequence
  SiRNA target sequence
tttttatgtcaaaaattcgttcttcc

SEQ ID NO: 192773 - DNA, 26 bp, Artificial sequence
  SiRNA target sequence
ttttatgtcaaaaattcgttcttcct

SEQ ID NO: 192774 - DNA, 26 bp, Artificial sequence
  SiRNA target sequence
tttatgtcaaaaattcgttcttcctt

SEQ ID NO: 192775 - DNA, 26 bp, Artificial sequence
  SiRNA target sequence
ttatgtcaaaaattcgttcttccttt

SEQ ID NO: 192776 - DNA, 26 bp, Artificial sequence
  SiRNA target sequence
tatgtcaaaaattcgttcttcctttt

SEQ ID NO: 192777 - DNA, 26 bp, Artificial sequence
  SiRNA target sequence
atgtcaaaaattcgttcttccttttt

SEQ ID NO: 192778 - DNA, 26 bp, Artificial sequence
  SiRNA target sequence
tgtcaaaaattcgttcttccttttta

SEQ ID NO: 192779 - DNA, 26 bp, Artificial sequence
  SiRNA target sequence
gtcaaaaattcgttcttcctttttag

SEQ ID NO: 192780 - DNA, 26 bp, Artificial sequence
  SiRNA target sequence
tcaaaaattcgttcttcctttttaga

SEQ ID NO: 192781 - DNA, 26 bp, Artificial sequence
  SiRNA target sequence
caaaaattcgttcttcctttttagac

SEQ ID NO: 192782 - DNA, 26 bp, Artificial sequence
  SiRNA target sequence
aaaaattcgttcttcctttttagacg

SEQ ID NO: 192783 - DNA, 26 bp, Artificial sequence
  SiRNA target sequence
aaaattcgttcttcctttttagacgc

SEQ ID NO: 192784 - DNA, 26 bp, Artificial sequence
  SiRNA target sequence
aaattcgttcttcctttttagacgct

SEQ ID NO: 192785 - DNA, 26 bp, Artificial sequence
  SiRNA target sequence
aattcgttcttcctttttagacgcta

SEQ ID NO: 192786 - DNA, 26 bp, Artificial sequence
  SiRNA target sequence
attcgttcttcctttttagacgctaa

SEQ ID NO: 192787 - DNA, 26 bp, Artificial sequence
  SiRNA target sequence
ttcgttcttcctttttagacgctaat

SEQ ID NO: 192788 - DNA, 26 bp, Artificial sequence
  SiRNA target sequence
tcgttcttcctttttagacgctaatt

SEQ ID NO: 192789 - DNA, 26 bp, Artificial sequence
  SiRNA target sequence
cgttcttcctttttagacgctaattt

SEQ ID NO: 192790 - DNA, 26 bp, Artificial sequence
  SiRNA target sequence
gttcttcctttttagacgctaatttt

SEQ ID NO: 192791 - DNA, 26 bp, Artificial sequence
  SiRNA target sequence
ttcttcctttttagacgctaattttg

SEQ ID NO: 192792 - DNA, 26 bp, Artificial sequence
  SiRNA target sequence
tcttcctttttagacgctaattttgt

SEQ ID NO: 192793 - DNA, 26 bp, Artificial sequence
  SiRNA target sequence
cttcctttttagacgctaattttgtt

SEQ ID NO: 192794 - DNA, 26 bp, Artificial sequence
  SiRNA target sequence
ttcctttttagacgctaattttgtta

SEQ ID NO: 192795 - DNA, 26 bp, Artificial sequence
  SiRNA target sequence
tcctttttagacgctaattttgttaa

SEQ ID NO: 192796 - DNA, 26 bp, Artificial sequence
  SiRNA target sequence
cctttttagacgctaattttgttaat

SEQ ID NO: 192797 - DNA, 26 bp, Artificial sequence
  SiRNA target sequence
ctttttagacgctaattttgttaatg

SEQ ID NO: 192798 - DNA, 26 bp, Artificial sequence
  SiRNA target sequence
tttttagacgctaattttgttaatga

SEQ ID NO: 192799 - DNA, 26 bp, Artificial sequence
  SiRNA target sequence
ttttagacgctaattttgttaatgaa

SEQ ID NO: 192800 - DNA, 26 bp, Artificial sequence
  SiRNA target sequence
tttagacgctaattttgttaatgaag

SEQ ID NO: 192801 - DNA, 26 bp, Artificial sequence
  SiRNA target sequence
ttagacgctaattttgttaatgaagc

SEQ ID NO: 192802 - DNA, 26 bp, Artificial sequence
  SiRNA target sequence
tagacgctaattttgttaatgaagct

SEQ ID NO: 192803 - DNA, 26 bp, Artificial sequence
  SiRNA target sequence
agacgctaattttgttaatgaagcta

SEQ ID NO: 192804 - DNA, 26 bp, Artificial sequence
  SiRNA target sequence
gacgctaattttgttaatgaagctat

SEQ ID NO: 192805 - DNA, 26 bp, Artificial sequence
  SiRNA target sequence
acgctaattttgttaatgaagctatt

SEQ ID NO: 192806 - DNA, 26 bp, Artificial sequence
  SiRNA target sequence
cgctaattttgttaatgaagctatta

SEQ ID NO: 192807 - DNA, 26 bp, Artificial sequence
  SiRNA target sequence
gctaattttgttaatgaagctattaa

SEQ ID NO: 192808 - DNA, 26 bp, Artificial sequence
  SiRNA target sequence
ctaattttgttaatgaagctattaaa

SEQ ID NO: 192809 - DNA, 26 bp, Artificial sequence
  SiRNA target sequence
taattttgttaatgaagctattaaac

SEQ ID NO: 192810 - DNA, 26 bp, Artificial sequence
  SiRNA target sequence
aattttgttaatgaagctattaaacc

SEQ ID NO: 192811 - DNA, 26 bp, Artificial sequence
  SiRNA target sequence
attttgttaatgaagctattaaacct

SEQ ID NO: 192812 - DNA, 26 bp, Artificial sequence
  SiRNA target sequence
ttttgttaatgaagctattaaacctt

SEQ ID NO: 192813 - DNA, 26 bp, Artificial sequence
  SiRNA target sequence
tttgttaatgaagctattaaaccttt

SEQ ID NO: 192814 - DNA, 26 bp, Artificial sequence
  SiRNA target sequence
ttgttaatgaagctattaaaccttta

SEQ ID NO: 192815 - DNA, 26 bp, Artificial sequence
  SiRNA target sequence
tgttaatgaagctattaaacctttag

SEQ ID NO: 192816 - DNA, 26 bp, Artificial sequence
  SiRNA target sequence
gttaatgaagctattaaacctttaga

SEQ ID NO: 192817 - DNA, 26 bp, Artificial sequence
  SiRNA target sequence
ttaatgaagctattaaacctttagat

SEQ ID NO: 192818 - DNA, 26 bp, Artificial sequence
  SiRNA target sequence
taatgaagctattaaacctttagata

SEQ ID NO: 192819 - DNA, 26 bp, Artificial sequence
  SiRNA target sequence
aatgaagctattaaacctttagatat

SEQ ID NO: 192820 - DNA, 26 bp, Artificial sequence
  SiRNA target sequence
atgaagctattaaacctttagatatt

SEQ ID NO: 192821 - DNA, 26 bp, Artificial sequence
  SiRNA target sequence
tgaagctattaaacctttagatattc

SEQ ID NO: 192822 - DNA, 26 bp, Artificial sequence
  SiRNA target sequence
gaagctattaaacctttagatattca

SEQ ID NO: 192823 - DNA, 26 bp, Artificial sequence
  SiRNA target sequence
aagctattaaacctttagatattcat

SEQ ID NO: 192824 - DNA, 26 bp, Artificial sequence
  SiRNA target sequence
agctattaaacctttagatattcatc

SEQ ID NO: 192825 - DNA, 26 bp, Artificial sequence
  SiRNA target sequence
gctattaaacctttagatattcatca

SEQ ID NO: 192826 - DNA, 26 bp, Artificial sequence
  SiRNA target sequence
ctattaaacctttagatattcatcat

SEQ ID NO: 192827 - DNA, 26 bp, Artificial sequence
  SiRNA target sequence
tattaaacctttagatattcatcatt

SEQ ID NO: 192828 - DNA, 26 bp, Artificial sequence
  SiRNA target sequence
attaaacctttagatattcatcattt

SEQ ID NO: 192829 - DNA, 26 bp, Artificial sequence
  SiRNA target sequence
ttaaacctttagatattcatcattta

SEQ ID NO: 192830 - DNA, 26 bp, Artificial sequence
  SiRNA target sequence
taaacctttagatattcatcatttat

SEQ ID NO: 192831 - DNA, 26 bp, Artificial sequence
  SiRNA target sequence
aaacctttagatattcatcatttata

SEQ ID NO: 192832 - DNA, 26 bp, Artificial sequence
  SiRNA target sequence
aacctttagatattcatcatttatac

SEQ ID NO: 192833 - DNA, 26 bp, Artificial sequence
  SiRNA target sequence
acctttagatattcatcatttatacg

SEQ ID NO: 192834 - DNA, 26 bp, Artificial sequence
  SiRNA target sequence
cctttagatattcatcatttatacga

SEQ ID NO: 192835 - DNA, 26 bp, Artificial sequence
  SiRNA target sequence
ctttagatattcatcatttatacgac

SEQ ID NO: 192836 - DNA, 26 bp, Artificial sequence
  SiRNA target sequence
tttagatattcatcatttatacgacc

SEQ ID NO: 192837 - DNA, 26 bp, Artificial sequence
  SiRNA target sequence
ttagatattcatcatttatacgacca

SEQ ID NO: 192838 - DNA, 26 bp, Artificial sequence
  SiRNA target sequence
tagatattcatcatttatacgaccaa

SEQ ID NO: 192839 - DNA, 26 bp, Artificial sequence
  SiRNA target sequence
agatattcatcatttatacgaccaac

SEQ ID NO: 192840 - DNA, 26 bp, Artificial sequence
  SiRNA target sequence
gatattcatcatttatacgaccaact

SEQ ID NO: 192841 - DNA, 26 bp, Artificial sequence
  SiRNA target sequence
atattcatcatttatacgaccaactt

SEQ ID NO: 192842 - DNA, 26 bp, Artificial sequence
  SiRNA target sequence
tattcatcatttatacgaccaacttg

SEQ ID NO: 192843 - DNA, 26 bp, Artificial sequence
  SiRNA target sequence
attcatcatttatacgaccaacttgt

SEQ ID NO: 192844 - DNA, 26 bp, Artificial sequence
  SiRNA target sequence
ttcatcatttatacgaccaacttgta

SEQ ID NO: 192845 - DNA, 26 bp, Artificial sequence
  SiRNA target sequence
tcatcatttatacgaccaacttgtag

SEQ ID NO: 192846 - DNA, 26 bp, Artificial sequence
  SiRNA target sequence
catcatttatacgaccaacttgtaga

SEQ ID NO: 192847 - DNA, 26 bp, Artificial sequence
  SiRNA target sequence
atcatttatacgaccaacttgtagaa

SEQ ID NO: 192848 - DNA, 26 bp, Artificial sequence
  SiRNA target sequence
tcatttatacgaccaacttgtagaaa

SEQ ID NO: 192849 - DNA, 26 bp, Artificial sequence
  SiRNA target sequence
catttatacgaccaacttgtagaaaa

SEQ ID NO: 192850 - DNA, 26 bp, Artificial sequence
  SiRNA target sequence
atttatacgaccaacttgtagaaaac

SEQ ID NO: 192851 - DNA, 26 bp, Artificial sequence
  SiRNA target sequence
tttatacgaccaacttgtagaaaact

SEQ ID NO: 192852 - DNA, 26 bp, Artificial sequence
  SiRNA target sequence
ttatacgaccaacttgtagaaaactt

SEQ ID NO: 192853 - DNA, 26 bp, Artificial sequence
  SiRNA target sequence
tatacgaccaacttgtagaaaacttg

SEQ ID NO: 192854 - DNA, 26 bp, Artificial sequence
  SiRNA target sequence
atacgaccaacttgtagaaaacttga

SEQ ID NO: 192855 - DNA, 26 bp, Artificial sequence
  SiRNA target sequence
tacgaccaacttgtagaaaacttgag

SEQ ID NO: 192856 - DNA, 26 bp, Artificial sequence
  SiRNA target sequence
acgaccaacttgtagaaaacttgagt

SEQ ID NO: 192857 - DNA, 26 bp, Artificial sequence
  SiRNA target sequence
cgaccaacttgtagaaaacttgagtg

SEQ ID NO: 192858 - DNA, 26 bp, Artificial sequence
  SiRNA target sequence
gaccaacttgtagaaaacttgagtgg

SEQ ID NO: 192859 - DNA, 26 bp, Artificial sequence
  SiRNA target sequence
accaacttgtagaaaacttgagtggt

SEQ ID NO: 192860 - DNA, 26 bp, Artificial sequence
  SiRNA target sequence
ccaacttgtagaaaacttgagtggtg

SEQ ID NO: 192861 - DNA, 26 bp, Artificial sequence
  SiRNA target sequence
caacttgtagaaaacttgagtggtgg

SEQ ID NO: 192862 - DNA, 26 bp, Artificial sequence
  SiRNA target sequence
aacttgtagaaaacttgagtggtgga

SEQ ID NO: 192863 - DNA, 26 bp, Artificial sequence
  SiRNA target sequence
acttgtagaaaacttgagtggtggag

SEQ ID NO: 192864 - DNA, 26 bp, Artificial sequence
  SiRNA target sequence
cttgtagaaaacttgagtggtggaga

SEQ ID NO: 192865 - DNA, 26 bp, Artificial sequence
  SiRNA target sequence
ttgtagaaaacttgagtggtggagaa

SEQ ID NO: 192866 - DNA, 26 bp, Artificial sequence
  SiRNA target sequence
tgtagaaaacttgagtggtggagaat

SEQ ID NO: 192867 - DNA, 26 bp, Artificial sequence
  SiRNA target sequence
gtagaaaacttgagtggtggagaatt

SEQ ID NO: 192868 - DNA, 26 bp, Artificial sequence
  SiRNA target sequence
tagaaaacttgagtggtggagaatta

SEQ ID NO: 192869 - DNA, 26 bp, Artificial sequence
  SiRNA target sequence
agaaaacttgagtggtggagaattac

SEQ ID NO: 192870 - DNA, 26 bp, Artificial sequence
  SiRNA target sequence
gaaaacttgagtggtggagaattaca

SEQ ID NO: 192871 - DNA, 26 bp, Artificial sequence
  SiRNA target sequence
aaaacttgagtggtggagaattacaa

SEQ ID NO: 192872 - DNA, 26 bp, Artificial sequence
  SiRNA target sequence
aaacttgagtggtggagaattacaaa

SEQ ID NO: 192873 - DNA, 26 bp, Artificial sequence
  SiRNA target sequence
aacttgagtggtggagaattacaaag

SEQ ID NO: 192874 - DNA, 26 bp, Artificial sequence
  SiRNA target sequence
acttgagtggtggagaattacaaaga

SEQ ID NO: 192875 - DNA, 26 bp, Artificial sequence
  SiRNA target sequence
cttgagtggtggagaattacaaagaa

SEQ ID NO: 192876 - DNA, 26 bp, Artificial sequence
  SiRNA target sequence
ttgagtggtggagaattacaaagaat

SEQ ID NO: 192877 - DNA, 26 bp, Artificial sequence
  SiRNA target sequence
tgagtggtggagaattacaaagaatt

SEQ ID NO: 192878 - DNA, 26 bp, Artificial sequence
  SiRNA target sequence
gagtggtggagaattacaaagaattg

SEQ ID NO: 192879 - DNA, 26 bp, Artificial sequence
  SiRNA target sequence
agtggtggagaattacaaagaattgc

SEQ ID NO: 192880 - DNA, 26 bp, Artificial sequence
  SiRNA target sequence
gtggtggagaattacaaagaattgca

SEQ ID NO: 192881 - DNA, 26 bp, Artificial sequence
  SiRNA target sequence
tggtggagaattacaaagaattgcaa

SEQ ID NO: 192882 - DNA, 26 bp, Artificial sequence
  SiRNA target sequence
ggtggagaattacaaagaattgcaat

SEQ ID NO: 192883 - DNA, 26 bp, Artificial sequence
  SiRNA target sequence
gtggagaattacaaagaattgcaata

SEQ ID NO: 192884 - DNA, 26 bp, Artificial sequence
  SiRNA target sequence
tggagaattacaaagaattgcaataa

SEQ ID NO: 192885 - DNA, 26 bp, Artificial sequence
  SiRNA target sequence
ggagaattacaaagaattgcaataat

SEQ ID NO: 192886 - DNA, 26 bp, Artificial sequence
  SiRNA target sequence
gagaattacaaagaattgcaataata

SEQ ID NO: 192887 - DNA, 26 bp, Artificial sequence
  SiRNA target sequence
agaattacaaagaattgcaataataa

SEQ ID NO: 192888 - DNA, 26 bp, Artificial sequence
  SiRNA target sequence
gaattacaaagaattgcaataataat

SEQ ID NO: 192889 - DNA, 26 bp, Artificial sequence
  SiRNA target sequence
aattacaaagaattgcaataataata

SEQ ID NO: 192890 - DNA, 26 bp, Artificial sequence
  SiRNA target sequence
attacaaagaattgcaataataatat

SEQ ID NO: 192891 - DNA, 26 bp, Artificial sequence
  SiRNA target sequence
ttacaaagaattgcaataataatatg

SEQ ID NO: 192892 - DNA, 26 bp, Artificial sequence
  SiRNA target sequence
tacaaagaattgcaataataatatgt

SEQ ID NO: 192893 - DNA, 26 bp, Artificial sequence
  SiRNA target sequence
acaaagaattgcaataataatatgtt

SEQ ID NO: 192894 - DNA, 26 bp, Artificial sequence
  SiRNA target sequence
caaagaattgcaataataatatgttt

SEQ ID NO: 192895 - DNA, 26 bp, Artificial sequence
  SiRNA target sequence
aaagaattgcaataataatatgttta

SEQ ID NO: 192896 - DNA, 26 bp, Artificial sequence
  SiRNA target sequence
aagaattgcaataataatatgtttag

SEQ ID NO: 192897 - DNA, 26 bp, Artificial sequence
  SiRNA target sequence
agaattgcaataataatatgtttagg

SEQ ID NO: 192898 - DNA, 26 bp, Artificial sequence
  SiRNA target sequence
gaattgcaataataatatgtttagga

SEQ ID NO: 192899 - DNA, 26 bp, Artificial sequence
  SiRNA target sequence
aattgcaataataatatgtttaggaa

SEQ ID NO: 192900 - DNA, 26 bp, Artificial sequence
  SiRNA target sequence
attgcaataataatatgtttaggaaa

SEQ ID NO: 192901 - DNA, 26 bp, Artificial sequence
  SiRNA target sequence
ttgcaataataatatgtttaggaaaa

SEQ ID NO: 192902 - DNA, 26 bp, Artificial sequence
  SiRNA target sequence
tgcaataataatatgtttaggaaaag

SEQ ID NO: 192903 - DNA, 26 bp, Artificial sequence
  SiRNA target sequence
gcaataataatatgtttaggaaaaga

SEQ ID NO: 192904 - DNA, 26 bp, Artificial sequence
  SiRNA target sequence
caataataatatgtttaggaaaagat

SEQ ID NO: 192905 - DNA, 26 bp, Artificial sequence
  SiRNA target sequence
aataataatatgtttaggaaaagatg

SEQ ID NO: 192906 - DNA, 26 bp, Artificial sequence
  SiRNA target sequence
ataataatatgtttaggaaaagatgc

SEQ ID NO: 192907 - DNA, 26 bp, Artificial sequence
  SiRNA target sequence
taataatatgtttaggaaaagatgct

SEQ ID NO: 192908 - DNA, 26 bp, Artificial sequence
  SiRNA target sequence
aataatatgtttaggaaaagatgcta

SEQ ID NO: 192909 - DNA, 26 bp, Artificial sequence
  SiRNA target sequence
ataatatgtttaggaaaagatgctaa

SEQ ID NO: 192910 - DNA, 26 bp, Artificial sequence
  SiRNA target sequence
taatatgtttaggaaaagatgctaac

SEQ ID NO: 192911 - DNA, 26 bp, Artificial sequence
  SiRNA target sequence
aatatgtttaggaaaagatgctaacc

SEQ ID NO: 192912 - DNA, 26 bp, Artificial sequence
  SiRNA target sequence
atatgtttaggaaaagatgctaacct

SEQ ID NO: 192913 - DNA, 26 bp, Artificial sequence
  SiRNA target sequence
tatgtttaggaaaagatgctaacctt

SEQ ID NO: 192914 - DNA, 26 bp, Artificial sequence
  SiRNA target sequence
atgtttaggaaaagatgctaaccttt

SEQ ID NO: 192915 - DNA, 26 bp, Artificial sequence
  SiRNA target sequence
tgtttaggaaaagatgctaaccttta

SEQ ID NO: 192916 - DNA, 26 bp, Artificial sequence
  SiRNA target sequence
gtttaggaaaagatgctaacctttat

SEQ ID NO: 192917 - DNA, 26 bp, Artificial sequence
  SiRNA target sequence
tttaggaaaagatgctaacctttatt

SEQ ID NO: 192918 - DNA, 26 bp, Artificial sequence
  SiRNA target sequence
ttaggaaaagatgctaacctttattt

SEQ ID NO: 192919 - DNA, 26 bp, Artificial sequence
  SiRNA target sequence
taggaaaagatgctaacctttattta

SEQ ID NO: 192920 - DNA, 26 bp, Artificial sequence
  SiRNA target sequence
aggaaaagatgctaacctttatttat

SEQ ID NO: 192921 - DNA, 26 bp, Artificial sequence
  SiRNA target sequence
ggaaaagatgctaacctttatttatt

SEQ ID NO: 192922 - DNA, 26 bp, Artificial sequence
  SiRNA target sequence
gaaaagatgctaacctttatttatta

SEQ ID NO: 192923 - DNA, 26 bp, Artificial sequence
  SiRNA target sequence
aaaagatgctaacctttatttattag

SEQ ID NO: 192924 - DNA, 26 bp, Artificial sequence
  SiRNA target sequence
aaagatgctaacctttatttattaga

SEQ ID NO: 192925 - DNA, 26 bp, Artificial sequence
  SiRNA target sequence
aagatgctaacctttatttattagat

SEQ ID NO: 192926 - DNA, 26 bp, Artificial sequence
  SiRNA target sequence
agatgctaacctttatttattagatg

SEQ ID NO: 192927 - DNA, 26 bp, Artificial sequence
  SiRNA target sequence
gatgctaacctttatttattagatga

SEQ ID NO: 192928 - DNA, 26 bp, Artificial sequence
  SiRNA target sequence
atgctaacctttatttattagatgaa

SEQ ID NO: 192929 - DNA, 26 bp, Artificial sequence
  SiRNA target sequence
tgctaacctttatttattagatgaac

SEQ ID NO: 192930 - DNA, 26 bp, Artificial sequence
  SiRNA target sequence
gctaacctttatttattagatgaacc

SEQ ID NO: 192931 - DNA, 26 bp, Artificial sequence
  SiRNA target sequence
ctaacctttatttattagatgaacct

SEQ ID NO: 192932 - DNA, 26 bp, Artificial sequence
  SiRNA target sequence
taacctttatttattagatgaacctt

SEQ ID NO: 192933 - DNA, 26 bp, Artificial sequence
  SiRNA target sequence
aacctttatttattagatgaaccttc

SEQ ID NO: 192934 - DNA, 26 bp, Artificial sequence
  SiRNA target sequence
acctttatttattagatgaaccttct

SEQ ID NO: 192935 - DNA, 26 bp, Artificial sequence
  SiRNA target sequence
cctttatttattagatgaaccttctg

SEQ ID NO: 192936 - DNA, 26 bp, Artificial sequence
  SiRNA target sequence
ctttatttattagatgaaccttctgc

SEQ ID NO: 192937 - DNA, 26 bp, Artificial sequence
  SiRNA target sequence
tttatttattagatgaaccttctgcg

SEQ ID NO: 192938 - DNA, 26 bp, Artificial sequence
  SiRNA target sequence
ttatttattagatgaaccttctgcgt

SEQ ID NO: 192939 - DNA, 26 bp, Artificial sequence
  SiRNA target sequence
tatttattagatgaaccttctgcgta

SEQ ID NO: 192940 - DNA, 26 bp, Artificial sequence
  SiRNA target sequence
atttattagatgaaccttctgcgtat

SEQ ID NO: 192941 - DNA, 26 bp, Artificial sequence
  SiRNA target sequence
tttattagatgaaccttctgcgtatc

SEQ ID NO: 192942 - DNA, 26 bp, Artificial sequence
  SiRNA target sequence
ttattagatgaaccttctgcgtatct

SEQ ID NO: 192943 - DNA, 26 bp, Artificial sequence
  SiRNA target sequence
tattagatgaaccttctgcgtatcta

SEQ ID NO: 192944 - DNA, 26 bp, Artificial sequence
  SiRNA target sequence
attagatgaaccttctgcgtatctag

SEQ ID NO: 192945 - DNA, 26 bp, Artificial sequence
  SiRNA target sequence
ttagatgaaccttctgcgtatctaga

SEQ ID NO: 192946 - DNA, 26 bp, Artificial sequence
  SiRNA target sequence
tagatgaaccttctgcgtatctagat

SEQ ID NO: 192947 - DNA, 26 bp, Artificial sequence
  SiRNA target sequence
agatgaaccttctgcgtatctagatt

SEQ ID NO: 192948 - DNA, 26 bp, Artificial sequence
  SiRNA target sequence
gatgaaccttctgcgtatctagattc

SEQ ID NO: 192949 - DNA, 26 bp, Artificial sequence
  SiRNA target sequence
atgaaccttctgcgtatctagattca

SEQ ID NO: 192950 - DNA, 26 bp, Artificial sequence
  SiRNA target sequence
tgaaccttctgcgtatctagattcag

SEQ ID NO: 192951 - DNA, 26 bp, Artificial sequence
  SiRNA target sequence
gaaccttctgcgtatctagattcaga

SEQ ID NO: 192952 - DNA, 26 bp, Artificial sequence
  SiRNA target sequence
aaccttctgcgtatctagattcagat

SEQ ID NO: 192953 - DNA, 26 bp, Artificial sequence
  SiRNA target sequence
accttctgcgtatctagattcagatc

SEQ ID NO: 192954 - DNA, 26 bp, Artificial sequence
  SiRNA target sequence
ccttctgcgtatctagattcagatca

SEQ ID NO: 192955 - DNA, 26 bp, Artificial sequence
  SiRNA target sequence
cttctgcgtatctagattcagatcag

SEQ ID NO: 192956 - DNA, 26 bp, Artificial sequence
  SiRNA target sequence
ttctgcgtatctagattcagatcaga

SEQ ID NO: 192957 - DNA, 26 bp, Artificial sequence
  SiRNA target sequence
tctgcgtatctagattcagatcagag

SEQ ID NO: 192958 - DNA, 26 bp, Artificial sequence
  SiRNA target sequence
ctgcgtatctagattcagatcagaga

SEQ ID NO: 192959 - DNA, 26 bp, Artificial sequence
  SiRNA target sequence
tgcgtatctagattcagatcagagaa

SEQ ID NO: 192960 - DNA, 26 bp, Artificial sequence
  SiRNA target sequence
gcgtatctagattcagatcagagaat

SEQ ID NO: 192961 - DNA, 26 bp, Artificial sequence
  SiRNA target sequence
cgtatctagattcagatcagagaata

SEQ ID NO: 192962 - DNA, 26 bp, Artificial sequence
  SiRNA target sequence
gtatctagattcagatcagagaatag

SEQ ID NO: 192963 - DNA, 26 bp, Artificial sequence
  SiRNA target sequence
tatctagattcagatcagagaatagc

SEQ ID NO: 192964 - DNA, 26 bp, Artificial sequence
  SiRNA target sequence
atctagattcagatcagagaatagcg

SEQ ID NO: 192965 - DNA, 26 bp, Artificial sequence
  SiRNA target sequence
tctagattcagatcagagaatagcga

SEQ ID NO: 192966 - DNA, 26 bp, Artificial sequence
  SiRNA target sequence
ctagattcagatcagagaatagcgat

SEQ ID NO: 192967 - DNA, 26 bp, Artificial sequence
  SiRNA target sequence
tagattcagatcagagaatagcgatt

SEQ ID NO: 192968 - DNA, 26 bp, Artificial sequence
  SiRNA target sequence
agattcagatcagagaatagcgattt

SEQ ID NO: 192969 - DNA, 26 bp, Artificial sequence
  SiRNA target sequence
gattcagatcagagaatagcgatttc

SEQ ID NO: 192970 - DNA, 26 bp, Artificial sequence
  SiRNA target sequence
attcagatcagagaatagcgatttca

SEQ ID NO: 192971 - DNA, 26 bp, Artificial sequence
  SiRNA target sequence
ttcagatcagagaatagcgatttcaa

SEQ ID NO: 192972 - DNA, 26 bp, Artificial sequence
  SiRNA target sequence
tcagatcagagaatagcgatttcaaa

SEQ ID NO: 192973 - DNA, 26 bp, Artificial sequence
  SiRNA target sequence
cagatcagagaatagcgatttcaaaa

SEQ ID NO: 192974 - DNA, 26 bp, Artificial sequence
  SiRNA target sequence
agatcagagaatagcgatttcaaaag

SEQ ID NO: 192975 - DNA, 26 bp, Artificial sequence
  SiRNA target sequence
gatcagagaatagcgatttcaaaagt

SEQ ID NO: 192976 - DNA, 26 bp, Artificial sequence
  SiRNA target sequence
atcagagaatagcgatttcaaaagtt

SEQ ID NO: 192977 - DNA, 26 bp, Artificial sequence
  SiRNA target sequence
tcagagaatagcgatttcaaaagtta

SEQ ID NO: 192978 - DNA, 26 bp, Artificial sequence
  SiRNA target sequence
cagagaatagcgatttcaaaagttat

SEQ ID NO: 192979 - DNA, 26 bp, Artificial sequence
  SiRNA target sequence
agagaatagcgatttcaaaagttata

SEQ ID NO: 192980 - DNA, 26 bp, Artificial sequence
  SiRNA target sequence
gagaatagcgatttcaaaagttataa

SEQ ID NO: 192981 - DNA, 26 bp, Artificial sequence
  SiRNA target sequence
agaatagcgatttcaaaagttataaa

SEQ ID NO: 192982 - DNA, 26 bp, Artificial sequence
  SiRNA target sequence
gaatagcgatttcaaaagttataaaa

SEQ ID NO: 192983 - DNA, 26 bp, Artificial sequence
  SiRNA target sequence
aatagcgatttcaaaagttataaaaa

SEQ ID NO: 192984 - DNA, 26 bp, Artificial sequence
  SiRNA target sequence
atagcgatttcaaaagttataaaaag

SEQ ID NO: 192985 - DNA, 26 bp, Artificial sequence
  SiRNA target sequence
tagcgatttcaaaagttataaaaagg

SEQ ID NO: 192986 - DNA, 26 bp, Artificial sequence
  SiRNA target sequence
agcgatttcaaaagttataaaaaggt

SEQ ID NO: 192987 - DNA, 26 bp, Artificial sequence
  SiRNA target sequence
gcgatttcaaaagttataaaaaggtt

SEQ ID NO: 192988 - DNA, 26 bp, Artificial sequence
  SiRNA target sequence
cgatttcaaaagttataaaaaggttt

SEQ ID NO: 192989 - DNA, 26 bp, Artificial sequence
  SiRNA target sequence
gatttcaaaagttataaaaaggttta

SEQ ID NO: 192990 - DNA, 26 bp, Artificial sequence
  SiRNA target sequence
atttcaaaagttataaaaaggtttat

SEQ ID NO: 192991 - DNA, 26 bp, Artificial sequence
  SiRNA target sequence
tttcaaaagttataaaaaggtttatt

SEQ ID NO: 192992 - DNA, 26 bp, Artificial sequence
  SiRNA target sequence
ttcaaaagttataaaaaggtttattt

SEQ ID NO: 192993 - DNA, 26 bp, Artificial sequence
  SiRNA target sequence
tcaaaagttataaaaaggtttattta

SEQ ID NO: 192994 - DNA, 26 bp, Artificial sequence
  SiRNA target sequence
caaaagttataaaaaggtttatttat

SEQ ID NO: 192995 - DNA, 26 bp, Artificial sequence
  SiRNA target sequence
aaaagttataaaaaggtttatttatg

SEQ ID NO: 192996 - DNA, 26 bp, Artificial sequence
  SiRNA target sequence
aaagttataaaaaggtttatttatgg

SEQ ID NO: 192997 - DNA, 26 bp, Artificial sequence
  SiRNA target sequence
aagttataaaaaggtttatttatggg

SEQ ID NO: 192998 - DNA, 26 bp, Artificial sequence
  SiRNA target sequence
agttataaaaaggtttatttatggga

SEQ ID NO: 192999 - DNA, 26 bp, Artificial sequence
  SiRNA target sequence
gttataaaaaggtttatttatgggaa

SEQ ID NO: 193000 - DNA, 26 bp, Artificial sequence
  SiRNA target sequence
ttataaaaaggtttatttatgggaag

SEQ ID NO: 193001 - DNA, 26 bp, Artificial sequence
  SiRNA target sequence
tataaaaaggtttatttatgggaaga

SEQ ID NO: 193002 - DNA, 26 bp, Artificial sequence
  SiRNA target sequence
ataaaaaggtttatttatgggaagaa

SEQ ID NO: 193003 - DNA, 26 bp, Artificial sequence
  SiRNA target sequence
taaaaaggtttatttatgggaagaag

SEQ ID NO: 193004 - DNA, 26 bp, Artificial sequence
  SiRNA target sequence
aaaaaggtttatttatgggaagaagc

SEQ ID NO: 193005 - DNA, 26 bp, Artificial sequence
  SiRNA target sequence
aaaaggtttatttatgggaagaagcg

SEQ ID NO: 193006 - DNA, 26 bp, Artificial sequence
  SiRNA target sequence
aaaggtttatttatgggaagaagcga

SEQ ID NO: 193007 - DNA, 26 bp, Artificial sequence
  SiRNA target sequence
aaggtttatttatgggaagaagcgaa

SEQ ID NO: 193008 - DNA, 26 bp, Artificial sequence
  SiRNA target sequence
aggtttatttatgggaagaagcgaac

SEQ ID NO: 193009 - DNA, 26 bp, Artificial sequence
  SiRNA target sequence
ggtttatttatgggaagaagcgaaca

SEQ ID NO: 193010 - DNA, 26 bp, Artificial sequence
  SiRNA target sequence
gtttatttatgggaagaagcgaacag

SEQ ID NO: 193011 - DNA, 26 bp, Artificial sequence
  SiRNA target sequence
tttatttatgggaagaagcgaacagc

SEQ ID NO: 193012 - DNA, 26 bp, Artificial sequence
  SiRNA target sequence
ttatttatgggaagaagcgaacagcc

SEQ ID NO: 193013 - DNA, 26 bp, Artificial sequence
  SiRNA target sequence
tatttatgggaagaagcgaacagcct

SEQ ID NO: 193014 - DNA, 26 bp, Artificial sequence
  SiRNA target sequence
atttatgggaagaagcgaacagcctt

SEQ ID NO: 193015 - DNA, 26 bp, Artificial sequence
  SiRNA target sequence
tttatgggaagaagcgaacagccttt

SEQ ID NO: 193016 - DNA, 26 bp, Artificial sequence
  SiRNA target sequence
ttatgggaagaagcgaacagcctttg

SEQ ID NO: 193017 - DNA, 26 bp, Artificial sequence
  SiRNA target sequence
tatgggaagaagcgaacagcctttgt

SEQ ID NO: 193018 - DNA, 26 bp, Artificial sequence
  SiRNA target sequence
atgggaagaagcgaacagcctttgtg

SEQ ID NO: 193019 - DNA, 26 bp, Artificial sequence
  SiRNA target sequence
tgggaagaagcgaacagcctttgtgg

SEQ ID NO: 193020 - DNA, 26 bp, Artificial sequence
  SiRNA target sequence
gggaagaagcgaacagcctttgtggt

SEQ ID NO: 193021 - DNA, 26 bp, Artificial sequence
  SiRNA target sequence
ggaagaagcgaacagcctttgtggtt

SEQ ID NO: 193022 - DNA, 26 bp, Artificial sequence
  SiRNA target sequence
gaagaagcgaacagcctttgtggttg

SEQ ID NO: 193023 - DNA, 26 bp, Artificial sequence
  SiRNA target sequence
aagaagcgaacagcctttgtggttga

SEQ ID NO: 193024 - DNA, 26 bp, Artificial sequence
  SiRNA target sequence
agaagcgaacagcctttgtggttgaa

SEQ ID NO: 193025 - DNA, 26 bp, Artificial sequence
  SiRNA target sequence
gaagcgaacagcctttgtggttgaac

SEQ ID NO: 193026 - DNA, 26 bp, Artificial sequence
  SiRNA target sequence
aagcgaacagcctttgtggttgaaca

SEQ ID NO: 193027 - DNA, 26 bp, Artificial sequence
  SiRNA target sequence
agcgaacagcctttgtggttgaacat

SEQ ID NO: 193028 - DNA, 26 bp, Artificial sequence
  SiRNA target sequence
gcgaacagcctttgtggttgaacatg

SEQ ID NO: 193029 - DNA, 26 bp, Artificial sequence
  SiRNA target sequence
cgaacagcctttgtggttgaacatga

SEQ ID NO: 193030 - DNA, 26 bp, Artificial sequence
  SiRNA target sequence
gaacagcctttgtggttgaacatgat

SEQ ID NO: 193031 - DNA, 26 bp, Artificial sequence
  SiRNA target sequence
aacagcctttgtggttgaacatgatt

SEQ ID NO: 193032 - DNA, 26 bp, Artificial sequence
  SiRNA target sequence
acagcctttgtggttgaacatgattt

SEQ ID NO: 193033 - DNA, 26 bp, Artificial sequence
  SiRNA target sequence
cagcctttgtggttgaacatgattta

SEQ ID NO: 193034 - DNA, 26 bp, Artificial sequence
  SiRNA target sequence
agcctttgtggttgaacatgatttaa

SEQ ID NO: 193035 - DNA, 26 bp, Artificial sequence
  SiRNA target sequence
gcctttgtggttgaacatgatttaat

SEQ ID NO: 193036 - DNA, 26 bp, Artificial sequence
  SiRNA target sequence
cctttgtggttgaacatgatttaatt

SEQ ID NO: 193037 - DNA, 26 bp, Artificial sequence
  SiRNA target sequence
ctttgtggttgaacatgatttaattg

SEQ ID NO: 193038 - DNA, 26 bp, Artificial sequence
  SiRNA target sequence
tttgtggttgaacatgatttaattgt

SEQ ID NO: 193039 - DNA, 26 bp, Artificial sequence
  SiRNA target sequence
ttgtggttgaacatgatttaattgta

SEQ ID NO: 193040 - DNA, 26 bp, Artificial sequence
  SiRNA target sequence
tgtggttgaacatgatttaattgtag

SEQ ID NO: 193041 - DNA, 26 bp, Artificial sequence
  SiRNA target sequence
gtggttgaacatgatttaattgtagg

SEQ ID NO: 193042 - DNA, 26 bp, Artificial sequence
  SiRNA target sequence
tggttgaacatgatttaattgtaggt

SEQ ID NO: 193043 - DNA, 26 bp, Artificial sequence
  SiRNA target sequence
ggttgaacatgatttaattgtaggta

SEQ ID NO: 193044 - DNA, 26 bp, Artificial sequence
  SiRNA target sequence
gttgaacatgatttaattgtaggtac

SEQ ID NO: 193045 - DNA, 26 bp, Artificial sequence
  SiRNA target sequence
ttgaacatgatttaattgtaggtaca

SEQ ID NO: 193046 - DNA, 26 bp, Artificial sequence
  SiRNA target sequence
tgaacatgatttaattgtaggtacat

SEQ ID NO: 193047 - DNA, 26 bp, Artificial sequence
  SiRNA target sequence
gaacatgatttaattgtaggtacata

SEQ ID NO: 193048 - DNA, 26 bp, Artificial sequence
  SiRNA target sequence
aacatgatttaattgtaggtacatat

SEQ ID NO: 193049 - DNA, 26 bp, Artificial sequence
  SiRNA target sequence
acatgatttaattgtaggtacatatt

SEQ ID NO: 193050 - DNA, 26 bp, Artificial sequence
  SiRNA target sequence
catgatttaattgtaggtacatattt

SEQ ID NO: 193051 - DNA, 26 bp, Artificial sequence
  SiRNA target sequence
atgatttaattgtaggtacatatttg

SEQ ID NO: 193052 - DNA, 26 bp, Artificial sequence
  SiRNA target sequence
tgatttaattgtaggtacatatttgg

SEQ ID NO: 193053 - DNA, 26 bp, Artificial sequence
  SiRNA target sequence
gatttaattgtaggtacatatttggc

SEQ ID NO: 193054 - DNA, 26 bp, Artificial sequence
  SiRNA target sequence
atttaattgtaggtacatatttggct

SEQ ID NO: 193055 - DNA, 26 bp, Artificial sequence
  SiRNA target sequence
tttaattgtaggtacatatttggctg

SEQ ID NO: 193056 - DNA, 26 bp, Artificial sequence
  SiRNA target sequence
ttaattgtaggtacatatttggctga

SEQ ID NO: 193057 - DNA, 26 bp, Artificial sequence
  SiRNA target sequence
taattgtaggtacatatttggctgat

SEQ ID NO: 193058 - DNA, 26 bp, Artificial sequence
  SiRNA target sequence
aattgtaggtacatatttggctgata

SEQ ID NO: 193059 - DNA, 26 bp, Artificial sequence
  SiRNA target sequence
attgtaggtacatatttggctgataa

SEQ ID NO: 193060 - DNA, 26 bp, Artificial sequence
  SiRNA target sequence
ttgtaggtacatatttggctgataaa

SEQ ID NO: 193061 - DNA, 26 bp, Artificial sequence
  SiRNA target sequence
tgtaggtacatatttggctgataaag

SEQ ID NO: 193062 - DNA, 26 bp, Artificial sequence
  SiRNA target sequence
gtaggtacatatttggctgataaagt

SEQ ID NO: 193063 - DNA, 26 bp, Artificial sequence
  SiRNA target sequence
taggtacatatttggctgataaagtt

SEQ ID NO: 193064 - DNA, 26 bp, Artificial sequence
  SiRNA target sequence
aggtacatatttggctgataaagttg

SEQ ID NO: 193065 - DNA, 26 bp, Artificial sequence
  SiRNA target sequence
ggtacatatttggctgataaagttgt

SEQ ID NO: 193066 - DNA, 26 bp, Artificial sequence
  SiRNA target sequence
gtacatatttggctgataaagttgtt

SEQ ID NO: 193067 - DNA, 26 bp, Artificial sequence
  SiRNA target sequence
tacatatttggctgataaagttgttg

SEQ ID NO: 193068 - DNA, 26 bp, Artificial sequence
  SiRNA target sequence
acatatttggctgataaagttgttgt

SEQ ID NO: 193069 - DNA, 26 bp, Artificial sequence
  SiRNA target sequence
catatttggctgataaagttgttgtt

SEQ ID NO: 193070 - DNA, 26 bp, Artificial sequence
  SiRNA target sequence
atatttggctgataaagttgttgttt

SEQ ID NO: 193071 - DNA, 26 bp, Artificial sequence
  SiRNA target sequence
tatttggctgataaagttgttgtttt

SEQ ID NO: 193072 - DNA, 26 bp, Artificial sequence
  SiRNA target sequence
atttggctgataaagttgttgttttt

SEQ ID NO: 193073 - DNA, 26 bp, Artificial sequence
  SiRNA target sequence
tttggctgataaagttgttgtttttg

SEQ ID NO: 193074 - DNA, 26 bp, Artificial sequence
  SiRNA target sequence
ttggctgataaagttgttgtttttga

SEQ ID NO: 193075 - DNA, 26 bp, Artificial sequence
  SiRNA target sequence
tggctgataaagttgttgtttttgag

SEQ ID NO: 193076 - DNA, 26 bp, Artificial sequence
  SiRNA target sequence
ggctgataaagttgttgtttttgagg

SEQ ID NO: 193077 - DNA, 26 bp, Artificial sequence
  SiRNA target sequence
gctgataaagttgttgtttttgaggg

SEQ ID NO: 193078 - DNA, 26 bp, Artificial sequence
  SiRNA target sequence
ctgataaagttgttgtttttgaggga

SEQ ID NO: 193079 - DNA, 26 bp, Artificial sequence
  SiRNA target sequence
tgataaagttgttgtttttgagggaa

SEQ ID NO: 193080 - DNA, 26 bp, Artificial sequence
  SiRNA target sequence
gataaagttgttgtttttgagggaag

SEQ ID NO: 193081 - DNA, 26 bp, Artificial sequence
  SiRNA target sequence
ataaagttgttgtttttgagggaagc

SEQ ID NO: 193082 - DNA, 26 bp, Artificial sequence
  SiRNA target sequence
taaagttgttgtttttgagggaagcc

SEQ ID NO: 193083 - DNA, 26 bp, Artificial sequence
  SiRNA target sequence
aaagttgttgtttttgagggaagccc

SEQ ID NO: 193084 - DNA, 26 bp, Artificial sequence
  SiRNA target sequence
aagttgttgtttttgagggaagccct

SEQ ID NO: 193085 - DNA, 26 bp, Artificial sequence
  SiRNA target sequence
agttgttgtttttgagggaagcccta

SEQ ID NO: 193086 - DNA, 26 bp, Artificial sequence
  SiRNA target sequence
gttgttgtttttgagggaagccctag

SEQ ID NO: 193087 - DNA, 26 bp, Artificial sequence
  SiRNA target sequence
ttgttgtttttgagggaagccctagt

SEQ ID NO: 193088 - DNA, 26 bp, Artificial sequence
  SiRNA target sequence
tgttgtttttgagggaagccctagtg

SEQ ID NO: 193089 - DNA, 26 bp, Artificial sequence
  SiRNA target sequence
gttgtttttgagggaagccctagtgt

SEQ ID NO: 193090 - DNA, 26 bp, Artificial sequence
  SiRNA target sequence
ttgtttttgagggaagccctagtgtt

SEQ ID NO: 193091 - DNA, 26 bp, Artificial sequence
  SiRNA target sequence
tgtttttgagggaagccctagtgttc

SEQ ID NO: 193092 - DNA, 26 bp, Artificial sequence
  SiRNA target sequence
gtttttgagggaagccctagtgttca

SEQ ID NO: 193093 - DNA, 26 bp, Artificial sequence
  SiRNA target sequence
tttttgagggaagccctagtgttcat

SEQ ID NO: 193094 - DNA, 26 bp, Artificial sequence
  SiRNA target sequence
ttttgagggaagccctagtgttcata

SEQ ID NO: 193095 - DNA, 26 bp, Artificial sequence
  SiRNA target sequence
tttgagggaagccctagtgttcatag

SEQ ID NO: 193096 - DNA, 26 bp, Artificial sequence
  SiRNA target sequence
ttgagggaagccctagtgttcatagc

SEQ ID NO: 193097 - DNA, 26 bp, Artificial sequence
  SiRNA target sequence
tgagggaagccctagtgttcatagca

SEQ ID NO: 193098 - DNA, 26 bp, Artificial sequence
  SiRNA target sequence
gagggaagccctagtgttcatagcac

SEQ ID NO: 193099 - DNA, 26 bp, Artificial sequence
  SiRNA target sequence
agggaagccctagtgttcatagcact

SEQ ID NO: 193100 - DNA, 26 bp, Artificial sequence
  SiRNA target sequence
gggaagccctagtgttcatagcactg

SEQ ID NO: 193101 - DNA, 26 bp, Artificial sequence
  SiRNA target sequence
ggaagccctagtgttcatagcactgc

SEQ ID NO: 193102 - DNA, 26 bp, Artificial sequence
  SiRNA target sequence
gaagccctagtgttcatagcactgct

SEQ ID NO: 193103 - DNA, 26 bp, Artificial sequence
  SiRNA target sequence
aagccctagtgttcatagcactgctc

SEQ ID NO: 193104 - DNA, 26 bp, Artificial sequence
  SiRNA target sequence
agccctagtgttcatagcactgctca

SEQ ID NO: 193105 - DNA, 26 bp, Artificial sequence
  SiRNA target sequence
gccctagtgttcatagcactgctcat

SEQ ID NO: 193106 - DNA, 26 bp, Artificial sequence
  SiRNA target sequence
ccctagtgttcatagcactgctcata

SEQ ID NO: 193107 - DNA, 26 bp, Artificial sequence
  SiRNA target sequence
cctagtgttcatagcactgctcataa

SEQ ID NO: 193108 - DNA, 26 bp, Artificial sequence
  SiRNA target sequence
ctagtgttcatagcactgctcataaa

SEQ ID NO: 193109 - DNA, 26 bp, Artificial sequence
  SiRNA target sequence
tagtgttcatagcactgctcataaac

SEQ ID NO: 193110 - DNA, 26 bp, Artificial sequence
  SiRNA target sequence
agtgttcatagcactgctcataaacc

SEQ ID NO: 193111 - DNA, 26 bp, Artificial sequence
  SiRNA target sequence
gtgttcatagcactgctcataaaccg

SEQ ID NO: 193112 - DNA, 26 bp, Artificial sequence
  SiRNA target sequence
tgttcatagcactgctcataaaccga

SEQ ID NO: 193113 - DNA, 26 bp, Artificial sequence
  SiRNA target sequence
gttcatagcactgctcataaaccgat

SEQ ID NO: 193114 - DNA, 26 bp, Artificial sequence
  SiRNA target sequence
ttcatagcactgctcataaaccgatg

SEQ ID NO: 193115 - DNA, 26 bp, Artificial sequence
  SiRNA target sequence
tcatagcactgctcataaaccgatgg

SEQ ID NO: 193116 - DNA, 26 bp, Artificial sequence
  SiRNA target sequence
catagcactgctcataaaccgatgga

SEQ ID NO: 193117 - DNA, 26 bp, Artificial sequence
  SiRNA target sequence
atagcactgctcataaaccgatggat

SEQ ID NO: 193118 - DNA, 26 bp, Artificial sequence
  SiRNA target sequence
tagcactgctcataaaccgatggatt

SEQ ID NO: 193119 - DNA, 26 bp, Artificial sequence
  SiRNA target sequence
agcactgctcataaaccgatggattt

SEQ ID NO: 193120 - DNA, 26 bp, Artificial sequence
  SiRNA target sequence
gcactgctcataaaccgatggatttg

SEQ ID NO: 193121 - DNA, 26 bp, Artificial sequence
  SiRNA target sequence
cactgctcataaaccgatggatttgc

SEQ ID NO: 193122 - DNA, 26 bp, Artificial sequence
  SiRNA target sequence
actgctcataaaccgatggatttgca

SEQ ID NO: 193123 - DNA, 26 bp, Artificial sequence
  SiRNA target sequence
ctgctcataaaccgatggatttgcat

SEQ ID NO: 193124 - DNA, 26 bp, Artificial sequence
  SiRNA target sequence
tgctcataaaccgatggatttgcata

SEQ ID NO: 193125 - DNA, 26 bp, Artificial sequence
  SiRNA target sequence
gctcataaaccgatggatttgcatag

SEQ ID NO: 193126 - DNA, 26 bp, Artificial sequence
  SiRNA target sequence
ctcataaaccgatggatttgcatagt

SEQ ID NO: 193127 - DNA, 26 bp, Artificial sequence
  SiRNA target sequence
tcataaaccgatggatttgcatagtg

SEQ ID NO: 193128 - DNA, 26 bp, Artificial sequence
  SiRNA target sequence
cataaaccgatggatttgcatagtgg

SEQ ID NO: 193129 - DNA, 26 bp, Artificial sequence
  SiRNA target sequence
ataaaccgatggatttgcatagtgga

SEQ ID NO: 193130 - DNA, 26 bp, Artificial sequence
  SiRNA target sequence
taaaccgatggatttgcatagtggaa

SEQ ID NO: 193131 - DNA, 26 bp, Artificial sequence
  SiRNA target sequence
aaaccgatggatttgcatagtggaat

SEQ ID NO: 193132 - DNA, 26 bp, Artificial sequence
  SiRNA target sequence
aaccgatggatttgcatagtggaatg

SEQ ID NO: 193133 - DNA, 26 bp, Artificial sequence
  SiRNA target sequence
accgatggatttgcatagtggaatga

SEQ ID NO: 193134 - DNA, 26 bp, Artificial sequence
  SiRNA target sequence
ccgatggatttgcatagtggaatgaa

SEQ ID NO: 193135 - DNA, 26 bp, Artificial sequence
  SiRNA target sequence
cgatggatttgcatagtggaatgaat

SEQ ID NO: 193136 - DNA, 26 bp, Artificial sequence
  SiRNA target sequence
gatggatttgcatagtggaatgaata

SEQ ID NO: 193137 - DNA, 26 bp, Artificial sequence
  SiRNA target sequence
atggatttgcatagtggaatgaatat

SEQ ID NO: 193138 - DNA, 26 bp, Artificial sequence
  SiRNA target sequence
tggatttgcatagtggaatgaatatt

SEQ ID NO: 193139 - DNA, 26 bp, Artificial sequence
  SiRNA target sequence
ggatttgcatagtggaatgaatattt

SEQ ID NO: 193140 - DNA, 26 bp, Artificial sequence
  SiRNA target sequence
gatttgcatagtggaatgaatatttt

SEQ ID NO: 193141 - DNA, 26 bp, Artificial sequence
  SiRNA target sequence
atttgcatagtggaatgaatattttt

SEQ ID NO: 193142 - DNA, 26 bp, Artificial sequence
  SiRNA target sequence
tttgcatagtggaatgaatatttttt

SEQ ID NO: 193143 - DNA, 26 bp, Artificial sequence
  SiRNA target sequence
ttgcatagtggaatgaatattttttt

SEQ ID NO: 193144 - DNA, 26 bp, Artificial sequence
  SiRNA target sequence
tgcatagtggaatgaatattttttta

SEQ ID NO: 193145 - DNA, 26 bp, Artificial sequence
  SiRNA target sequence
gcatagtggaatgaatatttttttaa

SEQ ID NO: 193146 - DNA, 26 bp, Artificial sequence
  SiRNA target sequence
catagtggaatgaatatttttttaaa

SEQ ID NO: 193147 - DNA, 26 bp, Artificial sequence
  SiRNA target sequence
atagtggaatgaatatttttttaaag

SEQ ID NO: 193148 - DNA, 26 bp, Artificial sequence
  SiRNA target sequence
tagtggaatgaatatttttttaaaga

SEQ ID NO: 193149 - DNA, 26 bp, Artificial sequence
  SiRNA target sequence
agtggaatgaatatttttttaaagaa

SEQ ID NO: 193150 - DNA, 26 bp, Artificial sequence
  SiRNA target sequence
gtggaatgaatatttttttaaagaat

SEQ ID NO: 193151 - DNA, 26 bp, Artificial sequence
  SiRNA target sequence
tggaatgaatatttttttaaagaatc

SEQ ID NO: 193152 - DNA, 26 bp, Artificial sequence
  SiRNA target sequence
ggaatgaatatttttttaaagaatct

SEQ ID NO: 193153 - DNA, 26 bp, Artificial sequence
  SiRNA target sequence
gaatgaatatttttttaaagaatctt

SEQ ID NO: 193154 - DNA, 26 bp, Artificial sequence
  SiRNA target sequence
aatgaatatttttttaaagaatcttg

SEQ ID NO: 193155 - DNA, 26 bp, Artificial sequence
  SiRNA target sequence
atgaatatttttttaaagaatcttga

SEQ ID NO: 193156 - DNA, 26 bp, Artificial sequence
  SiRNA target sequence
tgaatatttttttaaagaatcttgat

SEQ ID NO: 193157 - DNA, 26 bp, Artificial sequence
  SiRNA target sequence
gaatatttttttaaagaatcttgata

SEQ ID NO: 193158 - DNA, 26 bp, Artificial sequence
  SiRNA target sequence
aatatttttttaaagaatcttgatat

SEQ ID NO: 193159 - DNA, 26 bp, Artificial sequence
  SiRNA target sequence
atatttttttaaagaatcttgatatt

SEQ ID NO: 193160 - DNA, 26 bp, Artificial sequence
  SiRNA target sequence
tatttttttaaagaatcttgatatta

SEQ ID NO: 193161 - DNA, 26 bp, Artificial sequence
  SiRNA target sequence
atttttttaaagaatcttgatattac

SEQ ID NO: 193162 - DNA, 26 bp, Artificial sequence
  SiRNA target sequence
tttttttaaagaatcttgatattact

SEQ ID NO: 193163 - DNA, 26 bp, Artificial sequence
  SiRNA target sequence
ttttttaaagaatcttgatattactt

SEQ ID NO: 193164 - DNA, 26 bp, Artificial sequence
  SiRNA target sequence
tttttaaagaatcttgatattacttt

SEQ ID NO: 193165 - DNA, 26 bp, Artificial sequence
  SiRNA target sequence
ttttaaagaatcttgatattactttt

SEQ ID NO: 193166 - DNA, 26 bp, Artificial sequence
  SiRNA target sequence
tttaaagaatcttgatattactttta

SEQ ID NO: 193167 - DNA, 26 bp, Artificial sequence
  SiRNA target sequence
ttaaagaatcttgatattacttttag

SEQ ID NO: 193168 - DNA, 26 bp, Artificial sequence
  SiRNA target sequence
taaagaatcttgatattacttttaga

SEQ ID NO: 193169 - DNA, 26 bp, Artificial sequence
  SiRNA target sequence
aaagaatcttgatattacttttagaa

SEQ ID NO: 193170 - DNA, 26 bp, Artificial sequence
  SiRNA target sequence
aagaatcttgatattacttttagaag

SEQ ID NO: 193171 - DNA, 26 bp, Artificial sequence
  SiRNA target sequence
agaatcttgatattacttttagaaga

SEQ ID NO: 193172 - DNA, 26 bp, Artificial sequence
  SiRNA target sequence
gaatcttgatattacttttagaagag

SEQ ID NO: 193173 - DNA, 26 bp, Artificial sequence
  SiRNA target sequence
aatcttgatattacttttagaagaga

SEQ ID NO: 193174 - DNA, 26 bp, Artificial sequence
  SiRNA target sequence
atcttgatattacttttagaagagac

SEQ ID NO: 193175 - DNA, 26 bp, Artificial sequence
  SiRNA target sequence
tcttgatattacttttagaagagact

SEQ ID NO: 193176 - DNA, 26 bp, Artificial sequence
  SiRNA target sequence
cttgatattacttttagaagagactc

SEQ ID NO: 193177 - DNA, 26 bp, Artificial sequence
  SiRNA target sequence
ttgatattacttttagaagagactct

SEQ ID NO: 193178 - DNA, 26 bp, Artificial sequence
  SiRNA target sequence
tgatattacttttagaagagactctt

SEQ ID NO: 193179 - DNA, 26 bp, Artificial sequence
  SiRNA target sequence
gatattacttttagaagagactcttc

SEQ ID NO: 193180 - DNA, 26 bp, Artificial sequence
  SiRNA target sequence
atattacttttagaagagactcttcc

SEQ ID NO: 193181 - DNA, 26 bp, Artificial sequence
  SiRNA target sequence
tattacttttagaagagactcttcca

SEQ ID NO: 193182 - DNA, 26 bp, Artificial sequence
  SiRNA target sequence
attacttttagaagagactcttccaa

SEQ ID NO: 193183 - DNA, 26 bp, Artificial sequence
  SiRNA target sequence
ttacttttagaagagactcttccaat

SEQ ID NO: 193184 - DNA, 26 bp, Artificial sequence
  SiRNA target sequence
tacttttagaagagactcttccaatt

SEQ ID NO: 193185 - DNA, 26 bp, Artificial sequence
  SiRNA target sequence
acttttagaagagactcttccaattt

SEQ ID NO: 193186 - DNA, 26 bp, Artificial sequence
  SiRNA target sequence
cttttagaagagactcttccaatttt

SEQ ID NO: 193187 - DNA, 26 bp, Artificial sequence
  SiRNA target sequence
ttttagaagagactcttccaatttta

SEQ ID NO: 193188 - DNA, 26 bp, Artificial sequence
  SiRNA target sequence
tttagaagagactcttccaattttag

SEQ ID NO: 193189 - DNA, 26 bp, Artificial sequence
  SiRNA target sequence
ttagaagagactcttccaattttaga

SEQ ID NO: 193190 - DNA, 26 bp, Artificial sequence
  SiRNA target sequence
tagaagagactcttccaattttagac

SEQ ID NO: 193191 - DNA, 26 bp, Artificial sequence
  SiRNA target sequence
agaagagactcttccaattttagacc

SEQ ID NO: 193192 - DNA, 26 bp, Artificial sequence
  SiRNA target sequence
gaagagactcttccaattttagacca

SEQ ID NO: 193193 - DNA, 26 bp, Artificial sequence
  SiRNA target sequence
aagagactcttccaattttagaccaa

SEQ ID NO: 193194 - DNA, 26 bp, Artificial sequence
  SiRNA target sequence
agagactcttccaattttagaccaag

SEQ ID NO: 193195 - DNA, 26 bp, Artificial sequence
  SiRNA target sequence
gagactcttccaattttagaccaaga

SEQ ID NO: 193196 - DNA, 26 bp, Artificial sequence
  SiRNA target sequence
agactcttccaattttagaccaagag

SEQ ID NO: 193197 - DNA, 26 bp, Artificial sequence
  SiRNA target sequence
gactcttccaattttagaccaagagt

SEQ ID NO: 193198 - DNA, 26 bp, Artificial sequence
  SiRNA target sequence
actcttccaattttagaccaagagtt

SEQ ID NO: 193199 - DNA, 26 bp, Artificial sequence
  SiRNA target sequence
ctcttccaattttagaccaagagtta

SEQ ID NO: 193200 - DNA, 26 bp, Artificial sequence
  SiRNA target sequence
tcttccaattttagaccaagagttaa

SEQ ID NO: 193201 - DNA, 26 bp, Artificial sequence
  SiRNA target sequence
cttccaattttagaccaagagttaat

SEQ ID NO: 193202 - DNA, 26 bp, Artificial sequence
  SiRNA target sequence
ttccaattttagaccaagagttaata

SEQ ID NO: 193203 - DNA, 26 bp, Artificial sequence
  SiRNA target sequence
tccaattttagaccaagagttaataa

SEQ ID NO: 193204 - DNA, 26 bp, Artificial sequence
  SiRNA target sequence
ccaattttagaccaagagttaataag

SEQ ID NO: 193205 - DNA, 26 bp, Artificial sequence
  SiRNA target sequence
caattttagaccaagagttaataagc

SEQ ID NO: 193206 - DNA, 26 bp, Artificial sequence
  SiRNA target sequence
aattttagaccaagagttaataagcc

SEQ ID NO: 193207 - DNA, 26 bp, Artificial sequence
  SiRNA target sequence
attttagaccaagagttaataagccg

SEQ ID NO: 193208 - DNA, 26 bp, Artificial sequence
  SiRNA target sequence
ttttagaccaagagttaataagccga

SEQ ID NO: 193209 - DNA, 26 bp, Artificial sequence
  SiRNA target sequence
tttagaccaagagttaataagccgaa

SEQ ID NO: 193210 - DNA, 26 bp, Artificial sequence
  SiRNA target sequence
ttagaccaagagttaataagccgaat

SEQ ID NO: 193211 - DNA, 26 bp, Artificial sequence
  SiRNA target sequence
tagaccaagagttaataagccgaatt

SEQ ID NO: 193212 - DNA, 26 bp, Artificial sequence
  SiRNA target sequence
agaccaagagttaataagccgaattc

SEQ ID NO: 193213 - DNA, 26 bp, Artificial sequence
  SiRNA target sequence
gaccaagagttaataagccgaattcc

SEQ ID NO: 193214 - DNA, 26 bp, Artificial sequence
  SiRNA target sequence
accaagagttaataagccgaattccg

SEQ ID NO: 193215 - DNA, 26 bp, Artificial sequence
  SiRNA target sequence
ccaagagttaataagccgaattccgc

SEQ ID NO: 193216 - DNA, 26 bp, Artificial sequence
  SiRNA target sequence
caagagttaataagccgaattccgca

SEQ ID NO: 193217 - DNA, 26 bp, Artificial sequence
  SiRNA target sequence
aagagttaataagccgaattccgcaa

SEQ ID NO: 193218 - DNA, 26 bp, Artificial sequence
  SiRNA target sequence
agagttaataagccgaattccgcaaa

SEQ ID NO: 193219 - DNA, 26 bp, Artificial sequence
  SiRNA target sequence
gagttaataagccgaattccgcaaaa

SEQ ID NO: 193220 - DNA, 26 bp, Artificial sequence
  SiRNA target sequence
agttaataagccgaattccgcaaaag

SEQ ID NO: 193221 - DNA, 26 bp, Artificial sequence
  SiRNA target sequence
gttaataagccgaattccgcaaaaga

SEQ ID NO: 193222 - DNA, 26 bp, Artificial sequence
  SiRNA target sequence
ttaataagccgaattccgcaaaagac

SEQ ID NO: 193223 - DNA, 26 bp, Artificial sequence
  SiRNA target sequence
taataagccgaattccgcaaaagaca

SEQ ID NO: 193224 - DNA, 26 bp, Artificial sequence
  SiRNA target sequence
aataagccgaattccgcaaaagacag

SEQ ID NO: 193225 - DNA, 26 bp, Artificial sequence
  SiRNA target sequence
ataagccgaattccgcaaaagacaga

SEQ ID NO: 193226 - DNA, 26 bp, Artificial sequence
  SiRNA target sequence
taagccgaattccgcaaaagacagaa

SEQ ID NO: 193227 - DNA, 26 bp, Artificial sequence
  SiRNA target sequence
aagccgaattccgcaaaagacagaac

SEQ ID NO: 193228 - DNA, 26 bp, Artificial sequence
  SiRNA target sequence
agccgaattccgcaaaagacagaact

SEQ ID NO: 193229 - DNA, 26 bp, Artificial sequence
  SiRNA target sequence
gccgaattccgcaaaagacagaactc

SEQ ID NO: 193230 - DNA, 26 bp, Artificial sequence
  SiRNA target sequence
ccgaattccgcaaaagacagaactca

SEQ ID NO: 193231 - DNA, 26 bp, Artificial sequence
  SiRNA target sequence
cgaattccgcaaaagacagaactcag

SEQ ID NO: 193232 - DNA, 26 bp, Artificial sequence
  SiRNA target sequence
gaattccgcaaaagacagaactcaga

SEQ ID NO: 193233 - DNA, 26 bp, Artificial sequence
  SiRNA target sequence
aattccgcaaaagacagaactcagaa

SEQ ID NO: 193234 - DNA, 26 bp, Artificial sequence
  SiRNA target sequence
attccgcaaaagacagaactcagaaa

SEQ ID NO: 193235 - DNA, 26 bp, Artificial sequence
  SiRNA target sequence
ttccgcaaaagacagaactcagaaag

SEQ ID NO: 193236 - DNA, 26 bp, Artificial sequence
  SiRNA target sequence
tccgcaaaagacagaactcagaaaga

SEQ ID NO: 193237 - DNA, 26 bp, Artificial sequence
  SiRNA target sequence
ccgcaaaagacagaactcagaaagaa

SEQ ID NO: 193238 - DNA, 26 bp, Artificial sequence
  SiRNA target sequence
cgcaaaagacagaactcagaaagaag

SEQ ID NO: 193239 - DNA, 26 bp, Artificial sequence
  SiRNA target sequence
gcaaaagacagaactcagaaagaaga

SEQ ID NO: 193240 - DNA, 26 bp, Artificial sequence
  SiRNA target sequence
caaaagacagaactcagaaagaagag

SEQ ID NO: 193241 - DNA, 26 bp, Artificial sequence
  SiRNA target sequence
aaaagacagaactcagaaagaagaga

SEQ ID NO: 193242 - DNA, 26 bp, Artificial sequence
  SiRNA target sequence
aaagacagaactcagaaagaagagaa

SEQ ID NO: 193243 - DNA, 26 bp, Artificial sequence
  SiRNA target sequence
aagacagaactcagaaagaagagaat

SEQ ID NO: 193244 - DNA, 26 bp, Artificial sequence
  SiRNA target sequence
agacagaactcagaaagaagagaata

SEQ ID NO: 193245 - DNA, 26 bp, Artificial sequence
  SiRNA target sequence
gacagaactcagaaagaagagaataa

SEQ ID NO: 193246 - DNA, 26 bp, Artificial sequence
  SiRNA target sequence
acagaactcagaaagaagagaataaa

SEQ ID NO: 193247 - DNA, 26 bp, Artificial sequence
  SiRNA target sequence
cagaactcagaaagaagagaataaat

SEQ ID NO: 193248 - DNA, 26 bp, Artificial sequence
  SiRNA target sequence
agaactcagaaagaagagaataaata

SEQ ID NO: 193249 - DNA, 26 bp, Artificial sequence
  SiRNA target sequence
gaactcagaaagaagagaataaatat

SEQ ID NO: 193250 - DNA, 26 bp, Artificial sequence
  SiRNA target sequence
aactcagaaagaagagaataaatatt

SEQ ID NO: 193251 - DNA, 26 bp, Artificial sequence
  SiRNA target sequence
actcagaaagaagagaataaatattt

SEQ ID NO: 193252 - DNA, 26 bp, Artificial sequence
  SiRNA target sequence
ctcagaaagaagagaataaatatttt

SEQ ID NO: 193253 - DNA, 26 bp, Artificial sequence
  SiRNA target sequence
tcagaaagaagagaataaatattttt

SEQ ID NO: 193254 - DNA, 26 bp, Artificial sequence
  SiRNA target sequence
cagaaagaagagaataaatatttttt

SEQ ID NO: 193255 - DNA, 26 bp, Artificial sequence
  SiRNA target sequence
agaaagaagagaataaatattttttt

SEQ ID NO: 193256 - DNA, 26 bp, Artificial sequence
  SiRNA target sequence
gaaagaagagaataaatatttttttt

SEQ ID NO: 193257 - DNA, 26 bp, Artificial sequence
  SiRNA target sequence
aaagaagagaataaatattttttttg

SEQ ID NO: 193258 - DNA, 26 bp, Artificial sequence
  SiRNA target sequence
aagaagagaataaatattttttttga

SEQ ID NO: 193259 - DNA, 27 bp, Artificial sequence
  SiRNA target sequence
atggccaagaatgaatctaataaaata

SEQ ID NO: 193260 - DNA, 27 bp, Artificial sequence
  SiRNA target sequence
tggccaagaatgaatctaataaaataa

SEQ ID NO: 193261 - DNA, 27 bp, Artificial sequence
  SiRNA target sequence
ggccaagaatgaatctaataaaataac

SEQ ID NO: 193262 - DNA, 27 bp, Artificial sequence
  SiRNA target sequence
gccaagaatgaatctaataaaataacg

SEQ ID NO: 193263 - DNA, 27 bp, Artificial sequence
  SiRNA target sequence
ccaagaatgaatctaataaaataacga

SEQ ID NO: 193264 - DNA, 27 bp, Artificial sequence
  SiRNA target sequence
caagaatgaatctaataaaataacgag

SEQ ID NO: 193265 - DNA, 27 bp, Artificial sequence
  SiRNA target sequence
aagaatgaatctaataaaataacgaga

SEQ ID NO: 193266 - DNA, 27 bp, Artificial sequence
  SiRNA target sequence
agaatgaatctaataaaataacgagac

SEQ ID NO: 193267 - DNA, 27 bp, Artificial sequence
  SiRNA target sequence
gaatgaatctaataaaataacgagact

SEQ ID NO: 193268 - DNA, 27 bp, Artificial sequence
  SiRNA target sequence
aatgaatctaataaaataacgagactg

SEQ ID NO: 193269 - DNA, 27 bp, Artificial sequence
  SiRNA target sequence
atgaatctaataaaataacgagactgg

SEQ ID NO: 193270 - DNA, 27 bp, Artificial sequence
  SiRNA target sequence
tgaatctaataaaataacgagactggc

SEQ ID NO: 193271 - DNA, 27 bp, Artificial sequence
  SiRNA target sequence
gaatctaataaaataacgagactggca

SEQ ID NO: 193272 - DNA, 27 bp, Artificial sequence
  SiRNA target sequence
aatctaataaaataacgagactggcaa

SEQ ID NO: 193273 - DNA, 27 bp, Artificial sequence
  SiRNA target sequence
atctaataaaataacgagactggcaat

SEQ ID NO: 193274 - DNA, 27 bp, Artificial sequence
  SiRNA target sequence
tctaataaaataacgagactggcaatt

SEQ ID NO: 193275 - DNA, 27 bp, Artificial sequence
  SiRNA target sequence
ctaataaaataacgagactggcaattg

SEQ ID NO: 193276 - DNA, 27 bp, Artificial sequence
  SiRNA target sequence
taataaaataacgagactggcaattgt

SEQ ID NO: 193277 - DNA, 27 bp, Artificial sequence
  SiRNA target sequence
aataaaataacgagactggcaattgtt

SEQ ID NO: 193278 - DNA, 27 bp, Artificial sequence
  SiRNA target sequence
ataaaataacgagactggcaattgtta

SEQ ID NO: 193279 - DNA, 27 bp, Artificial sequence
  SiRNA target sequence
taaaataacgagactggcaattgttaa

SEQ ID NO: 193280 - DNA, 27 bp, Artificial sequence
  SiRNA target sequence
aaaataacgagactggcaattgttaat

SEQ ID NO: 193281 - DNA, 27 bp, Artificial sequence
  SiRNA target sequence
aaataacgagactggcaattgttaatt

SEQ ID NO: 193282 - DNA, 27 bp, Artificial sequence
  SiRNA target sequence
aataacgagactggcaattgttaatta

SEQ ID NO: 193283 - DNA, 27 bp, Artificial sequence
  SiRNA target sequence
ataacgagactggcaattgttaattat

SEQ ID NO: 193284 - DNA, 27 bp, Artificial sequence
  SiRNA target sequence
taacgagactggcaattgttaattatg

SEQ ID NO: 193285 - DNA, 27 bp, Artificial sequence
  SiRNA target sequence
aacgagactggcaattgttaattatga

SEQ ID NO: 193286 - DNA, 27 bp, Artificial sequence
  SiRNA target sequence
acgagactggcaattgttaattatgaa

SEQ ID NO: 193287 - DNA, 27 bp, Artificial sequence
  SiRNA target sequence
cgagactggcaattgttaattatgaac

SEQ ID NO: 193288 - DNA, 27 bp, Artificial sequence
  SiRNA target sequence
gagactggcaattgttaattatgaact

SEQ ID NO: 193289 - DNA, 27 bp, Artificial sequence
  SiRNA target sequence
agactggcaattgttaattatgaacta

SEQ ID NO: 193290 - DNA, 27 bp, Artificial sequence
  SiRNA target sequence
gactggcaattgttaattatgaactat

SEQ ID NO: 193291 - DNA, 27 bp, Artificial sequence
  SiRNA target sequence
actggcaattgttaattatgaactatg

SEQ ID NO: 193292 - DNA, 27 bp, Artificial sequence
  SiRNA target sequence
ctggcaattgttaattatgaactatgt

SEQ ID NO: 193293 - DNA, 27 bp, Artificial sequence
  SiRNA target sequence
tggcaattgttaattatgaactatgta

SEQ ID NO: 193294 - DNA, 27 bp, Artificial sequence
  SiRNA target sequence
ggcaattgttaattatgaactatgtaa

SEQ ID NO: 193295 - DNA, 27 bp, Artificial sequence
  SiRNA target sequence
gcaattgttaattatgaactatgtaaa

SEQ ID NO: 193296 - DNA, 27 bp, Artificial sequence
  SiRNA target sequence
caattgttaattatgaactatgtaaac

SEQ ID NO: 193297 - DNA, 27 bp, Artificial sequence
  SiRNA target sequence
aattgttaattatgaactatgtaaacc

SEQ ID NO: 193298 - DNA, 27 bp, Artificial sequence
  SiRNA target sequence
attgttaattatgaactatgtaaaccg

SEQ ID NO: 193299 - DNA, 27 bp, Artificial sequence
  SiRNA target sequence
ttgttaattatgaactatgtaaaccga

SEQ ID NO: 193300 - DNA, 27 bp, Artificial sequence
  SiRNA target sequence
tgttaattatgaactatgtaaaccgaa

SEQ ID NO: 193301 - DNA, 27 bp, Artificial sequence
  SiRNA target sequence
gttaattatgaactatgtaaaccgaag

SEQ ID NO: 193302 - DNA, 27 bp, Artificial sequence
  SiRNA target sequence
ttaattatgaactatgtaaaccgaagg

SEQ ID NO: 193303 - DNA, 27 bp, Artificial sequence
  SiRNA target sequence
taattatgaactatgtaaaccgaagga

SEQ ID NO: 193304 - DNA, 27 bp, Artificial sequence
  SiRNA target sequence
aattatgaactatgtaaaccgaaggaa

SEQ ID NO: 193305 - DNA, 27 bp, Artificial sequence
  SiRNA target sequence
attatgaactatgtaaaccgaaggaat

SEQ ID NO: 193306 - DNA, 27 bp, Artificial sequence
  SiRNA target sequence
ttatgaactatgtaaaccgaaggaatg

SEQ ID NO: 193307 - DNA, 27 bp, Artificial sequence
  SiRNA target sequence
tatgaactatgtaaaccgaaggaatgt

SEQ ID NO: 193308 - DNA, 27 bp, Artificial sequence
  SiRNA target sequence
atgaactatgtaaaccgaaggaatgta

SEQ ID NO: 193309 - DNA, 27 bp, Artificial sequence
  SiRNA target sequence
tgaactatgtaaaccgaaggaatgtat

SEQ ID NO: 193310 - DNA, 27 bp, Artificial sequence
  SiRNA target sequence
gaactatgtaaaccgaaggaatgtatg

SEQ ID NO: 193311 - DNA, 27 bp, Artificial sequence
  SiRNA target sequence
aactatgtaaaccgaaggaatgtatgt

SEQ ID NO: 193312 - DNA, 27 bp, Artificial sequence
  SiRNA target sequence
actatgtaaaccgaaggaatgtatgtc

SEQ ID NO: 193313 - DNA, 27 bp, Artificial sequence
  SiRNA target sequence
ctatgtaaaccgaaggaatgtatgtca

SEQ ID NO: 193314 - DNA, 27 bp, Artificial sequence
  SiRNA target sequence
tatgtaaaccgaaggaatgtatgtcag

SEQ ID NO: 193315 - DNA, 27 bp, Artificial sequence
  SiRNA target sequence
atgtaaaccgaaggaatgtatgtcaga

SEQ ID NO: 193316 - DNA, 27 bp, Artificial sequence
  SiRNA target sequence
tgtaaaccgaaggaatgtatgtcagaa

SEQ ID NO: 193317 - DNA, 27 bp, Artificial sequence
  SiRNA target sequence
gtaaaccgaaggaatgtatgtcagaat

SEQ ID NO: 193318 - DNA, 27 bp, Artificial sequence
  SiRNA target sequence
taaaccgaaggaatgtatgtcagaatg

SEQ ID NO: 193319 - DNA, 27 bp, Artificial sequence
  SiRNA target sequence
aaaccgaaggaatgtatgtcagaatgt

SEQ ID NO: 193320 - DNA, 27 bp, Artificial sequence
  SiRNA target sequence
aaccgaaggaatgtatgtcagaatgta

SEQ ID NO: 193321 - DNA, 27 bp, Artificial sequence
  SiRNA target sequence
accgaaggaatgtatgtcagaatgtaa

SEQ ID NO: 193322 - DNA, 27 bp, Artificial sequence
  SiRNA target sequence
ccgaaggaatgtatgtcagaatgtaaa

SEQ ID NO: 193323 - DNA, 27 bp, Artificial sequence
  SiRNA target sequence
cgaaggaatgtatgtcagaatgtaaaa

SEQ ID NO: 193324 - DNA, 27 bp, Artificial sequence
  SiRNA target sequence
gaaggaatgtatgtcagaatgtaaaaa

SEQ ID NO: 193325 - DNA, 27 bp, Artificial sequence
  SiRNA target sequence
aaggaatgtatgtcagaatgtaaaaag

SEQ ID NO: 193326 - DNA, 27 bp, Artificial sequence
  SiRNA target sequence
aggaatgtatgtcagaatgtaaaaagg

SEQ ID NO: 193327 - DNA, 27 bp, Artificial sequence
  SiRNA target sequence
ggaatgtatgtcagaatgtaaaaaggc

SEQ ID NO: 193328 - DNA, 27 bp, Artificial sequence
  SiRNA target sequence
gaatgtatgtcagaatgtaaaaaggcg

SEQ ID NO: 193329 - DNA, 27 bp, Artificial sequence
  SiRNA target sequence
aatgtatgtcagaatgtaaaaaggcgt

SEQ ID NO: 193330 - DNA, 27 bp, Artificial sequence
  SiRNA target sequence
atgtatgtcagaatgtaaaaaggcgtg

SEQ ID NO: 193331 - DNA, 27 bp, Artificial sequence
  SiRNA target sequence
tgtatgtcagaatgtaaaaaggcgtgt

SEQ ID NO: 193332 - DNA, 27 bp, Artificial sequence
  SiRNA target sequence
gtatgtcagaatgtaaaaaggcgtgtc

SEQ ID NO: 193333 - DNA, 27 bp, Artificial sequence
  SiRNA target sequence
tatgtcagaatgtaaaaaggcgtgtcc

SEQ ID NO: 193334 - DNA, 27 bp, Artificial sequence
  SiRNA target sequence
atgtcagaatgtaaaaaggcgtgtcct

SEQ ID NO: 193335 - DNA, 27 bp, Artificial sequence
  SiRNA target sequence
tgtcagaatgtaaaaaggcgtgtcctg

SEQ ID NO: 193336 - DNA, 27 bp, Artificial sequence
  SiRNA target sequence
gtcagaatgtaaaaaggcgtgtcctgt

SEQ ID NO: 193337 - DNA, 27 bp, Artificial sequence
  SiRNA target sequence
tcagaatgtaaaaaggcgtgtcctgtt

SEQ ID NO: 193338 - DNA, 27 bp, Artificial sequence
  SiRNA target sequence
cagaatgtaaaaaggcgtgtcctgtta

SEQ ID NO: 193339 - DNA, 27 bp, Artificial sequence
  SiRNA target sequence
agaatgtaaaaaggcgtgtcctgttaa

SEQ ID NO: 193340 - DNA, 27 bp, Artificial sequence
  SiRNA target sequence
gaatgtaaaaaggcgtgtcctgttaat

SEQ ID NO: 193341 - DNA, 27 bp, Artificial sequence
  SiRNA target sequence
aatgtaaaaaggcgtgtcctgttaata

SEQ ID NO: 193342 - DNA, 27 bp, Artificial sequence
  SiRNA target sequence
atgtaaaaaggcgtgtcctgttaataa

SEQ ID NO: 193343 - DNA, 27 bp, Artificial sequence
  SiRNA target sequence
tgtaaaaaggcgtgtcctgttaataaa

SEQ ID NO: 193344 - DNA, 27 bp, Artificial sequence
  SiRNA target sequence
gtaaaaaggcgtgtcctgttaataaaa

SEQ ID NO: 193345 - DNA, 27 bp, Artificial sequence
  SiRNA target sequence
taaaaaggcgtgtcctgttaataaaac

SEQ ID NO: 193346 - DNA, 27 bp, Artificial sequence
  SiRNA target sequence
aaaaaggcgtgtcctgttaataaaaca

SEQ ID NO: 193347 - DNA, 27 bp, Artificial sequence
  SiRNA target sequence
aaaaggcgtgtcctgttaataaaacag

SEQ ID NO: 193348 - DNA, 27 bp, Artificial sequence
  SiRNA target sequence
aaaggcgtgtcctgttaataaaacagg

SEQ ID NO: 193349 - DNA, 27 bp, Artificial sequence
  SiRNA target sequence
aaggcgtgtcctgttaataaaacagga

SEQ ID NO: 193350 - DNA, 27 bp, Artificial sequence
  SiRNA target sequence
aggcgtgtcctgttaataaaacaggaa

SEQ ID NO: 193351 - DNA, 27 bp, Artificial sequence
  SiRNA target sequence
ggcgtgtcctgttaataaaacaggaaa

SEQ ID NO: 193352 - DNA, 27 bp, Artificial sequence
  SiRNA target sequence
gcgtgtcctgttaataaaacaggaaag

SEQ ID NO: 193353 - DNA, 27 bp, Artificial sequence
  SiRNA target sequence
cgtgtcctgttaataaaacaggaaagg

SEQ ID NO: 193354 - DNA, 27 bp, Artificial sequence
  SiRNA target sequence
gtgtcctgttaataaaacaggaaagga

SEQ ID NO: 193355 - DNA, 27 bp, Artificial sequence
  SiRNA target sequence
tgtcctgttaataaaacaggaaaggag

SEQ ID NO: 193356 - DNA, 27 bp, Artificial sequence
  SiRNA target sequence
gtcctgttaataaaacaggaaaggagt

SEQ ID NO: 193357 - DNA, 27 bp, Artificial sequence
  SiRNA target sequence
tcctgttaataaaacaggaaaggagtg

SEQ ID NO: 193358 - DNA, 27 bp, Artificial sequence
  SiRNA target sequence
cctgttaataaaacaggaaaggagtgt

SEQ ID NO: 193359 - DNA, 27 bp, Artificial sequence
  SiRNA target sequence
ctgttaataaaacaggaaaggagtgta

SEQ ID NO: 193360 - DNA, 27 bp, Artificial sequence
  SiRNA target sequence
tgttaataaaacaggaaaggagtgtat

SEQ ID NO: 193361 - DNA, 27 bp, Artificial sequence
  SiRNA target sequence
gttaataaaacaggaaaggagtgtatt

SEQ ID NO: 193362 - DNA, 27 bp, Artificial sequence
  SiRNA target sequence
ttaataaaacaggaaaggagtgtatta

SEQ ID NO: 193363 - DNA, 27 bp, Artificial sequence
  SiRNA target sequence
taataaaacaggaaaggagtgtattac

SEQ ID NO: 193364 - DNA, 27 bp, Artificial sequence
  SiRNA target sequence
aataaaacaggaaaggagtgtattaca

SEQ ID NO: 193365 - DNA, 27 bp, Artificial sequence
  SiRNA target sequence
ataaaacaggaaaggagtgtattacaa

SEQ ID NO: 193366 - DNA, 27 bp, Artificial sequence
  SiRNA target sequence
taaaacaggaaaggagtgtattacaat

SEQ ID NO: 193367 - DNA, 27 bp, Artificial sequence
  SiRNA target sequence
aaaacaggaaaggagtgtattacaatt

SEQ ID NO: 193368 - DNA, 27 bp, Artificial sequence
  SiRNA target sequence
aaacaggaaaggagtgtattacaattg

SEQ ID NO: 193369 - DNA, 27 bp, Artificial sequence
  SiRNA target sequence
aacaggaaaggagtgtattacaattga

SEQ ID NO: 193370 - DNA, 27 bp, Artificial sequence
  SiRNA target sequence
acaggaaaggagtgtattacaattgat

SEQ ID NO: 193371 - DNA, 27 bp, Artificial sequence
  SiRNA target sequence
caggaaaggagtgtattacaattgata

SEQ ID NO: 193372 - DNA, 27 bp, Artificial sequence
  SiRNA target sequence
aggaaaggagtgtattacaattgatac

SEQ ID NO: 193373 - DNA, 27 bp, Artificial sequence
  SiRNA target sequence
ggaaaggagtgtattacaattgatact

SEQ ID NO: 193374 - DNA, 27 bp, Artificial sequence
  SiRNA target sequence
gaaaggagtgtattacaattgatacta

SEQ ID NO: 193375 - DNA, 27 bp, Artificial sequence
  SiRNA target sequence
aaaggagtgtattacaattgatactaa

SEQ ID NO: 193376 - DNA, 27 bp, Artificial sequence
  SiRNA target sequence
aaggagtgtattacaattgatactaaa

SEQ ID NO: 193377 - DNA, 27 bp, Artificial sequence
  SiRNA target sequence
aggagtgtattacaattgatactaaat

SEQ ID NO: 193378 - DNA, 27 bp, Artificial sequence
  SiRNA target sequence
ggagtgtattacaattgatactaaatc

SEQ ID NO: 193379 - DNA, 27 bp, Artificial sequence
  SiRNA target sequence
gagtgtattacaattgatactaaatca

SEQ ID NO: 193380 - DNA, 27 bp, Artificial sequence
  SiRNA target sequence
agtgtattacaattgatactaaatcac

SEQ ID NO: 193381 - DNA, 27 bp, Artificial sequence
  SiRNA target sequence
gtgtattacaattgatactaaatcaca

SEQ ID NO: 193382 - DNA, 27 bp, Artificial sequence
  SiRNA target sequence
tgtattacaattgatactaaatcacat

SEQ ID NO: 193383 - DNA, 27 bp, Artificial sequence
  SiRNA target sequence
gtattacaattgatactaaatcacata

SEQ ID NO: 193384 - DNA, 27 bp, Artificial sequence
  SiRNA target sequence
tattacaattgatactaaatcacatat

SEQ ID NO: 193385 - DNA, 27 bp, Artificial sequence
  SiRNA target sequence
attacaattgatactaaatcacatatc

SEQ ID NO: 193386 - DNA, 27 bp, Artificial sequence
  SiRNA target sequence
ttacaattgatactaaatcacatatct

SEQ ID NO: 193387 - DNA, 27 bp, Artificial sequence
  SiRNA target sequence
tacaattgatactaaatcacatatctc

SEQ ID NO: 193388 - DNA, 27 bp, Artificial sequence
  SiRNA target sequence
acaattgatactaaatcacatatctca

SEQ ID NO: 193389 - DNA, 27 bp, Artificial sequence
  SiRNA target sequence
caattgatactaaatcacatatctcag

SEQ ID NO: 193390 - DNA, 27 bp, Artificial sequence
  SiRNA target sequence
aattgatactaaatcacatatctcaga

SEQ ID NO: 193391 - DNA, 27 bp, Artificial sequence
  SiRNA target sequence
attgatactaaatcacatatctcagaa

SEQ ID NO: 193392 - DNA, 27 bp, Artificial sequence
  SiRNA target sequence
ttgatactaaatcacatatctcagaaa

SEQ ID NO: 193393 - DNA, 27 bp, Artificial sequence
  SiRNA target sequence
tgatactaaatcacatatctcagaaat

SEQ ID NO: 193394 - DNA, 27 bp, Artificial sequence
  SiRNA target sequence
gatactaaatcacatatctcagaaatt

SEQ ID NO: 193395 - DNA, 27 bp, Artificial sequence
  SiRNA target sequence
atactaaatcacatatctcagaaattc

SEQ ID NO: 193396 - DNA, 27 bp, Artificial sequence
  SiRNA target sequence
tactaaatcacatatctcagaaattct

SEQ ID NO: 193397 - DNA, 27 bp, Artificial sequence
  SiRNA target sequence
actaaatcacatatctcagaaattctg

SEQ ID NO: 193398 - DNA, 27 bp, Artificial sequence
  SiRNA target sequence
ctaaatcacatatctcagaaattctgt

SEQ ID NO: 193399 - DNA, 27 bp, Artificial sequence
  SiRNA target sequence
taaatcacatatctcagaaattctgtg

SEQ ID NO: 193400 - DNA, 27 bp, Artificial sequence
  SiRNA target sequence
aaatcacatatctcagaaattctgtgt

SEQ ID NO: 193401 - DNA, 27 bp, Artificial sequence
  SiRNA target sequence
aatcacatatctcagaaattctgtgta

SEQ ID NO: 193402 - DNA, 27 bp, Artificial sequence
  SiRNA target sequence
atcacatatctcagaaattctgtgtat

SEQ ID NO: 193403 - DNA, 27 bp, Artificial sequence
  SiRNA target sequence
tcacatatctcagaaattctgtgtata

SEQ ID NO: 193404 - DNA, 27 bp, Artificial sequence
  SiRNA target sequence
cacatatctcagaaattctgtgtatag

SEQ ID NO: 193405 - DNA, 27 bp, Artificial sequence
  SiRNA target sequence
acatatctcagaaattctgtgtatagg

SEQ ID NO: 193406 - DNA, 27 bp, Artificial sequence
  SiRNA target sequence
catatctcagaaattctgtgtatagga

SEQ ID NO: 193407 - DNA, 27 bp, Artificial sequence
  SiRNA target sequence
atatctcagaaattctgtgtataggat

SEQ ID NO: 193408 - DNA, 27 bp, Artificial sequence
  SiRNA target sequence
tatctcagaaattctgtgtataggatg

SEQ ID NO: 193409 - DNA, 27 bp, Artificial sequence
  SiRNA target sequence
atctcagaaattctgtgtataggatgt

SEQ ID NO: 193410 - DNA, 27 bp, Artificial sequence
  SiRNA target sequence
tctcagaaattctgtgtataggatgtt

SEQ ID NO: 193411 - DNA, 27 bp, Artificial sequence
  SiRNA target sequence
ctcagaaattctgtgtataggatgttc

SEQ ID NO: 193412 - DNA, 27 bp, Artificial sequence
  SiRNA target sequence
tcagaaattctgtgtataggatgttct

SEQ ID NO: 193413 - DNA, 27 bp, Artificial sequence
  SiRNA target sequence
cagaaattctgtgtataggatgttctg

SEQ ID NO: 193414 - DNA, 27 bp, Artificial sequence
  SiRNA target sequence
agaaattctgtgtataggatgttctgc

SEQ ID NO: 193415 - DNA, 27 bp, Artificial sequence
  SiRNA target sequence
gaaattctgtgtataggatgttctgcg

SEQ ID NO: 193416 - DNA, 27 bp, Artificial sequence
  SiRNA target sequence
aaattctgtgtataggatgttctgcgt

SEQ ID NO: 193417 - DNA, 27 bp, Artificial sequence
  SiRNA target sequence
aattctgtgtataggatgttctgcgtg

SEQ ID NO: 193418 - DNA, 27 bp, Artificial sequence
  SiRNA target sequence
attctgtgtataggatgttctgcgtgt

SEQ ID NO: 193419 - DNA, 27 bp, Artificial sequence
  SiRNA target sequence
ttctgtgtataggatgttctgcgtgtc

SEQ ID NO: 193420 - DNA, 27 bp, Artificial sequence
  SiRNA target sequence
tctgtgtataggatgttctgcgtgtca

SEQ ID NO: 193421 - DNA, 27 bp, Artificial sequence
  SiRNA target sequence
ctgtgtataggatgttctgcgtgtcaa

SEQ ID NO: 193422 - DNA, 27 bp, Artificial sequence
  SiRNA target sequence
tgtgtataggatgttctgcgtgtcaaa

SEQ ID NO: 193423 - DNA, 27 bp, Artificial sequence
  SiRNA target sequence
gtgtataggatgttctgcgtgtcaaaa

SEQ ID NO: 193424 - DNA, 27 bp, Artificial sequence
  SiRNA target sequence
tgtataggatgttctgcgtgtcaaaag

SEQ ID NO: 193425 - DNA, 27 bp, Artificial sequence
  SiRNA target sequence
gtataggatgttctgcgtgtcaaaaga

SEQ ID NO: 193426 - DNA, 27 bp, Artificial sequence
  SiRNA target sequence
tataggatgttctgcgtgtcaaaagaa

SEQ ID NO: 193427 - DNA, 27 bp, Artificial sequence
  SiRNA target sequence
ataggatgttctgcgtgtcaaaagaaa

SEQ ID NO: 193428 - DNA, 27 bp, Artificial sequence
  SiRNA target sequence
taggatgttctgcgtgtcaaaagaaat

SEQ ID NO: 193429 - DNA, 27 bp, Artificial sequence
  SiRNA target sequence
aggatgttctgcgtgtcaaaagaaatg

SEQ ID NO: 193430 - DNA, 27 bp, Artificial sequence
  SiRNA target sequence
ggatgttctgcgtgtcaaaagaaatgt

SEQ ID NO: 193431 - DNA, 27 bp, Artificial sequence
  SiRNA target sequence
gatgttctgcgtgtcaaaagaaatgtc

SEQ ID NO: 193432 - DNA, 27 bp, Artificial sequence
  SiRNA target sequence
atgttctgcgtgtcaaaagaaatgtcc

SEQ ID NO: 193433 - DNA, 27 bp, Artificial sequence
  SiRNA target sequence
tgttctgcgtgtcaaaagaaatgtcct

SEQ ID NO: 193434 - DNA, 27 bp, Artificial sequence
  SiRNA target sequence
gttctgcgtgtcaaaagaaatgtcctt

SEQ ID NO: 193435 - DNA, 27 bp, Artificial sequence
  SiRNA target sequence
ttctgcgtgtcaaaagaaatgtccttt

SEQ ID NO: 193436 - DNA, 27 bp, Artificial sequence
  SiRNA target sequence
tctgcgtgtcaaaagaaatgtcctttt

SEQ ID NO: 193437 - DNA, 27 bp, Artificial sequence
  SiRNA target sequence
ctgcgtgtcaaaagaaatgtcctttta

SEQ ID NO: 193438 - DNA, 27 bp, Artificial sequence
  SiRNA target sequence
tgcgtgtcaaaagaaatgtccttttaa

SEQ ID NO: 193439 - DNA, 27 bp, Artificial sequence
  SiRNA target sequence
gcgtgtcaaaagaaatgtccttttaag

SEQ ID NO: 193440 - DNA, 27 bp, Artificial sequence
  SiRNA target sequence
cgtgtcaaaagaaatgtccttttaagg

SEQ ID NO: 193441 - DNA, 27 bp, Artificial sequence
  SiRNA target sequence
gtgtcaaaagaaatgtccttttaaggc

SEQ ID NO: 193442 - DNA, 27 bp, Artificial sequence
  SiRNA target sequence
tgtcaaaagaaatgtccttttaaggcg

SEQ ID NO: 193443 - DNA, 27 bp, Artificial sequence
  SiRNA target sequence
gtcaaaagaaatgtccttttaaggcga

SEQ ID NO: 193444 - DNA, 27 bp, Artificial sequence
  SiRNA target sequence
tcaaaagaaatgtccttttaaggcgat

SEQ ID NO: 193445 - DNA, 27 bp, Artificial sequence
  SiRNA target sequence
caaaagaaatgtccttttaaggcgatt

SEQ ID NO: 193446 - DNA, 27 bp, Artificial sequence
  SiRNA target sequence
aaaagaaatgtccttttaaggcgatta

SEQ ID NO: 193447 - DNA, 27 bp, Artificial sequence
  SiRNA target sequence
aaagaaatgtccttttaaggcgattac

SEQ ID NO: 193448 - DNA, 27 bp, Artificial sequence
  SiRNA target sequence
aagaaatgtccttttaaggcgattaca

SEQ ID NO: 193449 - DNA, 27 bp, Artificial sequence
  SiRNA target sequence
agaaatgtccttttaaggcgattacaa

SEQ ID NO: 193450 - DNA, 27 bp, Artificial sequence
  SiRNA target sequence
gaaatgtccttttaaggcgattacaat

SEQ ID NO: 193451 - DNA, 27 bp, Artificial sequence
  SiRNA target sequence
aaatgtccttttaaggcgattacaatt

SEQ ID NO: 193452 - DNA, 27 bp, Artificial sequence
  SiRNA target sequence
aatgtccttttaaggcgattacaattg

SEQ ID NO: 193453 - DNA, 27 bp, Artificial sequence
  SiRNA target sequence
atgtccttttaaggcgattacaattgt

SEQ ID NO: 193454 - DNA, 27 bp, Artificial sequence
  SiRNA target sequence
tgtccttttaaggcgattacaattgta

SEQ ID NO: 193455 - DNA, 27 bp, Artificial sequence
  SiRNA target sequence
gtccttttaaggcgattacaattgtaa

SEQ ID NO: 193456 - DNA, 27 bp, Artificial sequence
  SiRNA target sequence
tccttttaaggcgattacaattgtaaa

SEQ ID NO: 193457 - DNA, 27 bp, Artificial sequence
  SiRNA target sequence
ccttttaaggcgattacaattgtaaat

SEQ ID NO: 193458 - DNA, 27 bp, Artificial sequence
  SiRNA target sequence
cttttaaggcgattacaattgtaaatt

SEQ ID NO: 193459 - DNA, 27 bp, Artificial sequence
  SiRNA target sequence
ttttaaggcgattacaattgtaaattt

SEQ ID NO: 193460 - DNA, 27 bp, Artificial sequence
  SiRNA target sequence
tttaaggcgattacaattgtaaattta

SEQ ID NO: 193461 - DNA, 27 bp, Artificial sequence
  SiRNA target sequence
ttaaggcgattacaattgtaaatttac

SEQ ID NO: 193462 - DNA, 27 bp, Artificial sequence
  SiRNA target sequence
taaggcgattacaattgtaaatttacc

SEQ ID NO: 193463 - DNA, 27 bp, Artificial sequence
  SiRNA target sequence
aaggcgattacaattgtaaatttacct

SEQ ID NO: 193464 - DNA, 27 bp, Artificial sequence
  SiRNA target sequence
aggcgattacaattgtaaatttaccta

SEQ ID NO: 193465 - DNA, 27 bp, Artificial sequence
  SiRNA target sequence
ggcgattacaattgtaaatttacctac

SEQ ID NO: 193466 - DNA, 27 bp, Artificial sequence
  SiRNA target sequence
gcgattacaattgtaaatttacctaca

SEQ ID NO: 193467 - DNA, 27 bp, Artificial sequence
  SiRNA target sequence
cgattacaattgtaaatttacctacaa

SEQ ID NO: 193468 - DNA, 27 bp, Artificial sequence
  SiRNA target sequence
gattacaattgtaaatttacctacaaa

SEQ ID NO: 193469 - DNA, 27 bp, Artificial sequence
  SiRNA target sequence
attacaattgtaaatttacctacaaat

SEQ ID NO: 193470 - DNA, 27 bp, Artificial sequence
  SiRNA target sequence
ttacaattgtaaatttacctacaaatc

SEQ ID NO: 193471 - DNA, 27 bp, Artificial sequence
  SiRNA target sequence
tacaattgtaaatttacctacaaatct

SEQ ID NO: 193472 - DNA, 27 bp, Artificial sequence
  SiRNA target sequence
acaattgtaaatttacctacaaatcta

SEQ ID NO: 193473 - DNA, 27 bp, Artificial sequence
  SiRNA target sequence
caattgtaaatttacctacaaatctag

SEQ ID NO: 193474 - DNA, 27 bp, Artificial sequence
  SiRNA target sequence
aattgtaaatttacctacaaatctaga

SEQ ID NO: 193475 - DNA, 27 bp, Artificial sequence
  SiRNA target sequence
attgtaaatttacctacaaatctagat

SEQ ID NO: 193476 - DNA, 27 bp, Artificial sequence
  SiRNA target sequence
ttgtaaatttacctacaaatctagata

SEQ ID NO: 193477 - DNA, 27 bp, Artificial sequence
  SiRNA target sequence
tgtaaatttacctacaaatctagataa

SEQ ID NO: 193478 - DNA, 27 bp, Artificial sequence
  SiRNA target sequence
gtaaatttacctacaaatctagataaa

SEQ ID NO: 193479 - DNA, 27 bp, Artificial sequence
  SiRNA target sequence
taaatttacctacaaatctagataaag

SEQ ID NO: 193480 - DNA, 27 bp, Artificial sequence
  SiRNA target sequence
aaatttacctacaaatctagataaaga

SEQ ID NO: 193481 - DNA, 27 bp, Artificial sequence
  SiRNA target sequence
aatttacctacaaatctagataaagac

SEQ ID NO: 193482 - DNA, 27 bp, Artificial sequence
  SiRNA target sequence
atttacctacaaatctagataaagaca

SEQ ID NO: 193483 - DNA, 27 bp, Artificial sequence
  SiRNA target sequence
tttacctacaaatctagataaagacat

SEQ ID NO: 193484 - DNA, 27 bp, Artificial sequence
  SiRNA target sequence
ttacctacaaatctagataaagacatt

SEQ ID NO: 193485 - DNA, 27 bp, Artificial sequence
  SiRNA target sequence
tacctacaaatctagataaagacattt

SEQ ID NO: 193486 - DNA, 27 bp, Artificial sequence
  SiRNA target sequence
acctacaaatctagataaagacatttc

SEQ ID NO: 193487 - DNA, 27 bp, Artificial sequence
  SiRNA target sequence
cctacaaatctagataaagacatttca

SEQ ID NO: 193488 - DNA, 27 bp, Artificial sequence
  SiRNA target sequence
ctacaaatctagataaagacatttcac

SEQ ID NO: 193489 - DNA, 27 bp, Artificial sequence
  SiRNA target sequence
tacaaatctagataaagacatttcaca

SEQ ID NO: 193490 - DNA, 27 bp, Artificial sequence
  SiRNA target sequence
acaaatctagataaagacatttcacat

SEQ ID NO: 193491 - DNA, 27 bp, Artificial sequence
  SiRNA target sequence
caaatctagataaagacatttcacata

SEQ ID NO: 193492 - DNA, 27 bp, Artificial sequence
  SiRNA target sequence
aaatctagataaagacatttcacatag

SEQ ID NO: 193493 - DNA, 27 bp, Artificial sequence
  SiRNA target sequence
aatctagataaagacatttcacataga

SEQ ID NO: 193494 - DNA, 27 bp, Artificial sequence
  SiRNA target sequence
atctagataaagacatttcacatagat

SEQ ID NO: 193495 - DNA, 27 bp, Artificial sequence
  SiRNA target sequence
tctagataaagacatttcacatagata

SEQ ID NO: 193496 - DNA, 27 bp, Artificial sequence
  SiRNA target sequence
ctagataaagacatttcacatagatat

SEQ ID NO: 193497 - DNA, 27 bp, Artificial sequence
  SiRNA target sequence
tagataaagacatttcacatagatatt

SEQ ID NO: 193498 - DNA, 27 bp, Artificial sequence
  SiRNA target sequence
agataaagacatttcacatagatattc

SEQ ID NO: 193499 - DNA, 27 bp, Artificial sequence
  SiRNA target sequence
gataaagacatttcacatagatattcg

SEQ ID NO: 193500 - DNA, 27 bp, Artificial sequence
  SiRNA target sequence
ataaagacatttcacatagatattcgg

SEQ ID NO: 193501 - DNA, 27 bp, Artificial sequence
  SiRNA target sequence
taaagacatttcacatagatattcggc

SEQ ID NO: 193502 - DNA, 27 bp, Artificial sequence
  SiRNA target sequence
aaagacatttcacatagatattcggca

SEQ ID NO: 193503 - DNA, 27 bp, Artificial sequence
  SiRNA target sequence
aagacatttcacatagatattcggcaa

SEQ ID NO: 193504 - DNA, 27 bp, Artificial sequence
  SiRNA target sequence
agacatttcacatagatattcggcaaa

SEQ ID NO: 193505 - DNA, 27 bp, Artificial sequence
  SiRNA target sequence
gacatttcacatagatattcggcaaat

SEQ ID NO: 193506 - DNA, 27 bp, Artificial sequence
  SiRNA target sequence
acatttcacatagatattcggcaaatg

SEQ ID NO: 193507 - DNA, 27 bp, Artificial sequence
  SiRNA target sequence
catttcacatagatattcggcaaatgg

SEQ ID NO: 193508 - DNA, 27 bp, Artificial sequence
  SiRNA target sequence
atttcacatagatattcggcaaatggt

SEQ ID NO: 193509 - DNA, 27 bp, Artificial sequence
  SiRNA target sequence
tttcacatagatattcggcaaatggtt

SEQ ID NO: 193510 - DNA, 27 bp, Artificial sequence
  SiRNA target sequence
ttcacatagatattcggcaaatggttt

SEQ ID NO: 193511 - DNA, 27 bp, Artificial sequence
  SiRNA target sequence
tcacatagatattcggcaaatggtttt

SEQ ID NO: 193512 - DNA, 27 bp, Artificial sequence
  SiRNA target sequence
cacatagatattcggcaaatggtttta

SEQ ID NO: 193513 - DNA, 27 bp, Artificial sequence
  SiRNA target sequence
acatagatattcggcaaatggttttaa

SEQ ID NO: 193514 - DNA, 27 bp, Artificial sequence
  SiRNA target sequence
catagatattcggcaaatggttttaaa

SEQ ID NO: 193515 - DNA, 27 bp, Artificial sequence
  SiRNA target sequence
atagatattcggcaaatggttttaaac

SEQ ID NO: 193516 - DNA, 27 bp, Artificial sequence
  SiRNA target sequence
tagatattcggcaaatggttttaaact

SEQ ID NO: 193517 - DNA, 27 bp, Artificial sequence
  SiRNA target sequence
agatattcggcaaatggttttaaactt

SEQ ID NO: 193518 - DNA, 27 bp, Artificial sequence
  SiRNA target sequence
gatattcggcaaatggttttaaacttc

SEQ ID NO: 193519 - DNA, 27 bp, Artificial sequence
  SiRNA target sequence
atattcggcaaatggttttaaacttca

SEQ ID NO: 193520 - DNA, 27 bp, Artificial sequence
  SiRNA target sequence
tattcggcaaatggttttaaacttcac

SEQ ID NO: 193521 - DNA, 27 bp, Artificial sequence
  SiRNA target sequence
attcggcaaatggttttaaacttcaca

SEQ ID NO: 193522 - DNA, 27 bp, Artificial sequence
  SiRNA target sequence
ttcggcaaatggttttaaacttcacag

SEQ ID NO: 193523 - DNA, 27 bp, Artificial sequence
  SiRNA target sequence
tcggcaaatggttttaaacttcacaga

SEQ ID NO: 193524 - DNA, 27 bp, Artificial sequence
  SiRNA target sequence
cggcaaatggttttaaacttcacagat

SEQ ID NO: 193525 - DNA, 27 bp, Artificial sequence
  SiRNA target sequence
ggcaaatggttttaaacttcacagatt

SEQ ID NO: 193526 - DNA, 27 bp, Artificial sequence
  SiRNA target sequence
gcaaatggttttaaacttcacagatta

SEQ ID NO: 193527 - DNA, 27 bp, Artificial sequence
  SiRNA target sequence
caaatggttttaaacttcacagattac

SEQ ID NO: 193528 - DNA, 27 bp, Artificial sequence
  SiRNA target sequence
aaatggttttaaacttcacagattacc

SEQ ID NO: 193529 - DNA, 27 bp, Artificial sequence
  SiRNA target sequence
aatggttttaaacttcacagattacca

SEQ ID NO: 193530 - DNA, 27 bp, Artificial sequence
  SiRNA target sequence
atggttttaaacttcacagattaccaa

SEQ ID NO: 193531 - DNA, 27 bp, Artificial sequence
  SiRNA target sequence
tggttttaaacttcacagattaccaat

SEQ ID NO: 193532 - DNA, 27 bp, Artificial sequence
  SiRNA target sequence
ggttttaaacttcacagattaccaatc

SEQ ID NO: 193533 - DNA, 27 bp, Artificial sequence
  SiRNA target sequence
gttttaaacttcacagattaccaatcc

SEQ ID NO: 193534 - DNA, 27 bp, Artificial sequence
  SiRNA target sequence
ttttaaacttcacagattaccaatccc

SEQ ID NO: 193535 - DNA, 27 bp, Artificial sequence
  SiRNA target sequence
tttaaacttcacagattaccaatccct

SEQ ID NO: 193536 - DNA, 27 bp, Artificial sequence
  SiRNA target sequence
ttaaacttcacagattaccaatcccta

SEQ ID NO: 193537 - DNA, 27 bp, Artificial sequence
  SiRNA target sequence
taaacttcacagattaccaatccctaa

SEQ ID NO: 193538 - DNA, 27 bp, Artificial sequence
  SiRNA target sequence
aaacttcacagattaccaatccctaaa

SEQ ID NO: 193539 - DNA, 27 bp, Artificial sequence
  SiRNA target sequence
aacttcacagattaccaatccctaaat

SEQ ID NO: 193540 - DNA, 27 bp, Artificial sequence
  SiRNA target sequence
acttcacagattaccaatccctaaata

SEQ ID NO: 193541 - DNA, 27 bp, Artificial sequence
  SiRNA target sequence
cttcacagattaccaatccctaaatat

SEQ ID NO: 193542 - DNA, 27 bp, Artificial sequence
  SiRNA target sequence
ttcacagattaccaatccctaaatatg

SEQ ID NO: 193543 - DNA, 27 bp, Artificial sequence
  SiRNA target sequence
tcacagattaccaatccctaaatatgg

SEQ ID NO: 193544 - DNA, 27 bp, Artificial sequence
  SiRNA target sequence
cacagattaccaatccctaaatatggt

SEQ ID NO: 193545 - DNA, 27 bp, Artificial sequence
  SiRNA target sequence
acagattaccaatccctaaatatggta

SEQ ID NO: 193546 - DNA, 27 bp, Artificial sequence
  SiRNA target sequence
cagattaccaatccctaaatatggtaa

SEQ ID NO: 193547 - DNA, 27 bp, Artificial sequence
  SiRNA target sequence
agattaccaatccctaaatatggtaag

SEQ ID NO: 193548 - DNA, 27 bp, Artificial sequence
  SiRNA target sequence
gattaccaatccctaaatatggtaagg

SEQ ID NO: 193549 - DNA, 27 bp, Artificial sequence
  SiRNA target sequence
attaccaatccctaaatatggtaaggt

SEQ ID NO: 193550 - DNA, 27 bp, Artificial sequence
  SiRNA target sequence
ttaccaatccctaaatatggtaaggtt

SEQ ID NO: 193551 - DNA, 27 bp, Artificial sequence
  SiRNA target sequence
taccaatccctaaatatggtaaggttt

SEQ ID NO: 193552 - DNA, 27 bp, Artificial sequence
  SiRNA target sequence
accaatccctaaatatggtaaggtttt

SEQ ID NO: 193553 - DNA, 27 bp, Artificial sequence
  SiRNA target sequence
ccaatccctaaatatggtaaggtttta

SEQ ID NO: 193554 - DNA, 27 bp, Artificial sequence
  SiRNA target sequence
caatccctaaatatggtaaggttttag

SEQ ID NO: 193555 - DNA, 27 bp, Artificial sequence
  SiRNA target sequence
aatccctaaatatggtaaggttttagg

SEQ ID NO: 193556 - DNA, 27 bp, Artificial sequence
  SiRNA target sequence
atccctaaatatggtaaggttttaggg

SEQ ID NO: 193557 - DNA, 27 bp, Artificial sequence
  SiRNA target sequence
tccctaaatatggtaaggttttagggc

SEQ ID NO: 193558 - DNA, 27 bp, Artificial sequence
  SiRNA target sequence
ccctaaatatggtaaggttttagggct

SEQ ID NO: 193559 - DNA, 27 bp, Artificial sequence
  SiRNA target sequence
cctaaatatggtaaggttttagggcta

SEQ ID NO: 193560 - DNA, 27 bp, Artificial sequence
  SiRNA target sequence
ctaaatatggtaaggttttagggctag

SEQ ID NO: 193561 - DNA, 27 bp, Artificial sequence
  SiRNA target sequence
taaatatggtaaggttttagggctagt

SEQ ID NO: 193562 - DNA, 27 bp, Artificial sequence
  SiRNA target sequence
aaatatggtaaggttttagggctagta

SEQ ID NO: 193563 - DNA, 27 bp, Artificial sequence
  SiRNA target sequence
aatatggtaaggttttagggctagtag

SEQ ID NO: 193564 - DNA, 27 bp, Artificial sequence
  SiRNA target sequence
atatggtaaggttttagggctagtagg

SEQ ID NO: 193565 - DNA, 27 bp, Artificial sequence
  SiRNA target sequence
tatggtaaggttttagggctagtaggc

SEQ ID NO: 193566 - DNA, 27 bp, Artificial sequence
  SiRNA target sequence
atggtaaggttttagggctagtaggca

SEQ ID NO: 193567 - DNA, 27 bp, Artificial sequence
  SiRNA target sequence
tggtaaggttttagggctagtaggcac

SEQ ID NO: 193568 - DNA, 27 bp, Artificial sequence
  SiRNA target sequence
ggtaaggttttagggctagtaggcact

SEQ ID NO: 193569 - DNA, 27 bp, Artificial sequence
  SiRNA target sequence
gtaaggttttagggctagtaggcacta

SEQ ID NO: 193570 - DNA, 27 bp, Artificial sequence
  SiRNA target sequence
taaggttttagggctagtaggcactaa

SEQ ID NO: 193571 - DNA, 27 bp, Artificial sequence
  SiRNA target sequence
aaggttttagggctagtaggcactaat

SEQ ID NO: 193572 - DNA, 27 bp, Artificial sequence
  SiRNA target sequence
aggttttagggctagtaggcactaatg

SEQ ID NO: 193573 - DNA, 27 bp, Artificial sequence
  SiRNA target sequence
ggttttagggctagtaggcactaatgg

SEQ ID NO: 193574 - DNA, 27 bp, Artificial sequence
  SiRNA target sequence
gttttagggctagtaggcactaatggt

SEQ ID NO: 193575 - DNA, 27 bp, Artificial sequence
  SiRNA target sequence
ttttagggctagtaggcactaatggta

SEQ ID NO: 193576 - DNA, 27 bp, Artificial sequence
  SiRNA target sequence
tttagggctagtaggcactaatggtat

SEQ ID NO: 193577 - DNA, 27 bp, Artificial sequence
  SiRNA target sequence
ttagggctagtaggcactaatggtata

SEQ ID NO: 193578 - DNA, 27 bp, Artificial sequence
  SiRNA target sequence
tagggctagtaggcactaatggtatag

SEQ ID NO: 193579 - DNA, 27 bp, Artificial sequence
  SiRNA target sequence
agggctagtaggcactaatggtatagg

SEQ ID NO: 193580 - DNA, 27 bp, Artificial sequence
  SiRNA target sequence
gggctagtaggcactaatggtatagga

SEQ ID NO: 193581 - DNA, 27 bp, Artificial sequence
  SiRNA target sequence
ggctagtaggcactaatggtataggaa

SEQ ID NO: 193582 - DNA, 27 bp, Artificial sequence
  SiRNA target sequence
gctagtaggcactaatggtataggaaa

SEQ ID NO: 193583 - DNA, 27 bp, Artificial sequence
  SiRNA target sequence
ctagtaggcactaatggtataggaaaa

SEQ ID NO: 193584 - DNA, 27 bp, Artificial sequence
  SiRNA target sequence
tagtaggcactaatggtataggaaaaa

SEQ ID NO: 193585 - DNA, 27 bp, Artificial sequence
  SiRNA target sequence
agtaggcactaatggtataggaaaaag

SEQ ID NO: 193586 - DNA, 27 bp, Artificial sequence
  SiRNA target sequence
gtaggcactaatggtataggaaaaagt

SEQ ID NO: 193587 - DNA, 27 bp, Artificial sequence
  SiRNA target sequence
taggcactaatggtataggaaaaagta

SEQ ID NO: 193588 - DNA, 27 bp, Artificial sequence
  SiRNA target sequence
aggcactaatggtataggaaaaagtac

SEQ ID NO: 193589 - DNA, 27 bp, Artificial sequence
  SiRNA target sequence
ggcactaatggtataggaaaaagtact

SEQ ID NO: 193590 - DNA, 27 bp, Artificial sequence
  SiRNA target sequence
gcactaatggtataggaaaaagtactg

SEQ ID NO: 193591 - DNA, 27 bp, Artificial sequence
  SiRNA target sequence
cactaatggtataggaaaaagtactgc

SEQ ID NO: 193592 - DNA, 27 bp, Artificial sequence
  SiRNA target sequence
actaatggtataggaaaaagtactgca

SEQ ID NO: 193593 - DNA, 27 bp, Artificial sequence
  SiRNA target sequence
ctaatggtataggaaaaagtactgcac

SEQ ID NO: 193594 - DNA, 27 bp, Artificial sequence
  SiRNA target sequence
taatggtataggaaaaagtactgcact

SEQ ID NO: 193595 - DNA, 27 bp, Artificial sequence
  SiRNA target sequence
aatggtataggaaaaagtactgcactt

SEQ ID NO: 193596 - DNA, 27 bp, Artificial sequence
  SiRNA target sequence
atggtataggaaaaagtactgcactta

SEQ ID NO: 193597 - DNA, 27 bp, Artificial sequence
  SiRNA target sequence
tggtataggaaaaagtactgcacttaa

SEQ ID NO: 193598 - DNA, 27 bp, Artificial sequence
  SiRNA target sequence
ggtataggaaaaagtactgcacttaaa

SEQ ID NO: 193599 - DNA, 27 bp, Artificial sequence
  SiRNA target sequence
gtataggaaaaagtactgcacttaaaa

SEQ ID NO: 193600 - DNA, 27 bp, Artificial sequence
  SiRNA target sequence
tataggaaaaagtactgcacttaaaat

SEQ ID NO: 193601 - DNA, 27 bp, Artificial sequence
  SiRNA target sequence
ataggaaaaagtactgcacttaaaata

SEQ ID NO: 193602 - DNA, 27 bp, Artificial sequence
  SiRNA target sequence
taggaaaaagtactgcacttaaaatat

SEQ ID NO: 193603 - DNA, 27 bp, Artificial sequence
  SiRNA target sequence
aggaaaaagtactgcacttaaaatatt

SEQ ID NO: 193604 - DNA, 27 bp, Artificial sequence
  SiRNA target sequence
ggaaaaagtactgcacttaaaatatta

SEQ ID NO: 193605 - DNA, 27 bp, Artificial sequence
  SiRNA target sequence
gaaaaagtactgcacttaaaatattat

SEQ ID NO: 193606 - DNA, 27 bp, Artificial sequence
  SiRNA target sequence
aaaaagtactgcacttaaaatattatc

SEQ ID NO: 193607 - DNA, 27 bp, Artificial sequence
  SiRNA target sequence
aaaagtactgcacttaaaatattatcg

SEQ ID NO: 193608 - DNA, 27 bp, Artificial sequence
  SiRNA target sequence
aaagtactgcacttaaaatattatcgg

SEQ ID NO: 193609 - DNA, 27 bp, Artificial sequence
  SiRNA target sequence
aagtactgcacttaaaatattatcggg

SEQ ID NO: 193610 - DNA, 27 bp, Artificial sequence
  SiRNA target sequence
agtactgcacttaaaatattatcgggc

SEQ ID NO: 193611 - DNA, 27 bp, Artificial sequence
  SiRNA target sequence
gtactgcacttaaaatattatcgggca

SEQ ID NO: 193612 - DNA, 27 bp, Artificial sequence
  SiRNA target sequence
tactgcacttaaaatattatcgggcaa

SEQ ID NO: 193613 - DNA, 27 bp, Artificial sequence
  SiRNA target sequence
actgcacttaaaatattatcgggcaat

SEQ ID NO: 193614 - DNA, 27 bp, Artificial sequence
  SiRNA target sequence
ctgcacttaaaatattatcgggcaatc

SEQ ID NO: 193615 - DNA, 27 bp, Artificial sequence
  SiRNA target sequence
tgcacttaaaatattatcgggcaatct

SEQ ID NO: 193616 - DNA, 27 bp, Artificial sequence
  SiRNA target sequence
gcacttaaaatattatcgggcaatctt

SEQ ID NO: 193617 - DNA, 27 bp, Artificial sequence
  SiRNA target sequence
cacttaaaatattatcgggcaatctta

SEQ ID NO: 193618 - DNA, 27 bp, Artificial sequence
  SiRNA target sequence
acttaaaatattatcgggcaatcttaa

SEQ ID NO: 193619 - DNA, 27 bp, Artificial sequence
  SiRNA target sequence
cttaaaatattatcgggcaatcttaaa

SEQ ID NO: 193620 - DNA, 27 bp, Artificial sequence
  SiRNA target sequence
ttaaaatattatcgggcaatcttaaac

SEQ ID NO: 193621 - DNA, 27 bp, Artificial sequence
  SiRNA target sequence
taaaatattatcgggcaatcttaaacc

SEQ ID NO: 193622 - DNA, 27 bp, Artificial sequence
  SiRNA target sequence
aaaatattatcgggcaatcttaaacca

SEQ ID NO: 193623 - DNA, 27 bp, Artificial sequence
  SiRNA target sequence
aaatattatcgggcaatcttaaaccaa

SEQ ID NO: 193624 - DNA, 27 bp, Artificial sequence
  SiRNA target sequence
aatattatcgggcaatcttaaaccaaa

SEQ ID NO: 193625 - DNA, 27 bp, Artificial sequence
  SiRNA target sequence
atattatcgggcaatcttaaaccaaac

SEQ ID NO: 193626 - DNA, 27 bp, Artificial sequence
  SiRNA target sequence
tattatcgggcaatcttaaaccaaact

SEQ ID NO: 193627 - DNA, 27 bp, Artificial sequence
  SiRNA target sequence
attatcgggcaatcttaaaccaaactt

SEQ ID NO: 193628 - DNA, 27 bp, Artificial sequence
  SiRNA target sequence
ttatcgggcaatcttaaaccaaactta

SEQ ID NO: 193629 - DNA, 27 bp, Artificial sequence
  SiRNA target sequence
tatcgggcaatcttaaaccaaacttag

SEQ ID NO: 193630 - DNA, 27 bp, Artificial sequence
  SiRNA target sequence
atcgggcaatcttaaaccaaacttagg

SEQ ID NO: 193631 - DNA, 27 bp, Artificial sequence
  SiRNA target sequence
tcgggcaatcttaaaccaaacttagga

SEQ ID NO: 193632 - DNA, 27 bp, Artificial sequence
  SiRNA target sequence
cgggcaatcttaaaccaaacttaggaa

SEQ ID NO: 193633 - DNA, 27 bp, Artificial sequence
  SiRNA target sequence
gggcaatcttaaaccaaacttaggaaa

SEQ ID NO: 193634 - DNA, 27 bp, Artificial sequence
  SiRNA target sequence
ggcaatcttaaaccaaacttaggaaag

SEQ ID NO: 193635 - DNA, 27 bp, Artificial sequence
  SiRNA target sequence
gcaatcttaaaccaaacttaggaaagt

SEQ ID NO: 193636 - DNA, 27 bp, Artificial sequence
  SiRNA target sequence
caatcttaaaccaaacttaggaaagtt

SEQ ID NO: 193637 - DNA, 27 bp, Artificial sequence
  SiRNA target sequence
aatcttaaaccaaacttaggaaagttc

SEQ ID NO: 193638 - DNA, 27 bp, Artificial sequence
  SiRNA target sequence
atcttaaaccaaacttaggaaagttcg

SEQ ID NO: 193639 - DNA, 27 bp, Artificial sequence
  SiRNA target sequence
tcttaaaccaaacttaggaaagttcga

SEQ ID NO: 193640 - DNA, 27 bp, Artificial sequence
  SiRNA target sequence
cttaaaccaaacttaggaaagttcgac

SEQ ID NO: 193641 - DNA, 27 bp, Artificial sequence
  SiRNA target sequence
ttaaaccaaacttaggaaagttcgacg

SEQ ID NO: 193642 - DNA, 27 bp, Artificial sequence
  SiRNA target sequence
taaaccaaacttaggaaagttcgacgt

SEQ ID NO: 193643 - DNA, 27 bp, Artificial sequence
  SiRNA target sequence
aaaccaaacttaggaaagttcgacgtt

SEQ ID NO: 193644 - DNA, 27 bp, Artificial sequence
  SiRNA target sequence
aaccaaacttaggaaagttcgacgtta

SEQ ID NO: 193645 - DNA, 27 bp, Artificial sequence
  SiRNA target sequence
accaaacttaggaaagttcgacgttac

SEQ ID NO: 193646 - DNA, 27 bp, Artificial sequence
  SiRNA target sequence
ccaaacttaggaaagttcgacgttacg

SEQ ID NO: 193647 - DNA, 27 bp, Artificial sequence
  SiRNA target sequence
caaacttaggaaagttcgacgttacgc

SEQ ID NO: 193648 - DNA, 27 bp, Artificial sequence
  SiRNA target sequence
aaacttaggaaagttcgacgttacgcc

SEQ ID NO: 193649 - DNA, 27 bp, Artificial sequence
  SiRNA target sequence
aacttaggaaagttcgacgttacgccc

SEQ ID NO: 193650 - DNA, 27 bp, Artificial sequence
  SiRNA target sequence
acttaggaaagttcgacgttacgcccg

SEQ ID NO: 193651 - DNA, 27 bp, Artificial sequence
  SiRNA target sequence
cttaggaaagttcgacgttacgcccga

SEQ ID NO: 193652 - DNA, 27 bp, Artificial sequence
  SiRNA target sequence
ttaggaaagttcgacgttacgcccgac

SEQ ID NO: 193653 - DNA, 27 bp, Artificial sequence
  SiRNA target sequence
taggaaagttcgacgttacgcccgact

SEQ ID NO: 193654 - DNA, 27 bp, Artificial sequence
  SiRNA target sequence
aggaaagttcgacgttacgcccgactg

SEQ ID NO: 193655 - DNA, 27 bp, Artificial sequence
  SiRNA target sequence
ggaaagttcgacgttacgcccgactgg

SEQ ID NO: 193656 - DNA, 27 bp, Artificial sequence
  SiRNA target sequence
gaaagttcgacgttacgcccgactggg

SEQ ID NO: 193657 - DNA, 27 bp, Artificial sequence
  SiRNA target sequence
aaagttcgacgttacgcccgactgggc

SEQ ID NO: 193658 - DNA, 27 bp, Artificial sequence
  SiRNA target sequence
aagttcgacgttacgcccgactgggca

SEQ ID NO: 193659 - DNA, 27 bp, Artificial sequence
  SiRNA target sequence
agttcgacgttacgcccgactgggcag

SEQ ID NO: 193660 - DNA, 27 bp, Artificial sequence
  SiRNA target sequence
gttcgacgttacgcccgactgggcagc

SEQ ID NO: 193661 - DNA, 27 bp, Artificial sequence
  SiRNA target sequence
ttcgacgttacgcccgactgggcagca

SEQ ID NO: 193662 - DNA, 27 bp, Artificial sequence
  SiRNA target sequence
tcgacgttacgcccgactgggcagcaa

SEQ ID NO: 193663 - DNA, 27 bp, Artificial sequence
  SiRNA target sequence
cgacgttacgcccgactgggcagcaat

SEQ ID NO: 193664 - DNA, 27 bp, Artificial sequence
  SiRNA target sequence
gacgttacgcccgactgggcagcaatt

SEQ ID NO: 193665 - DNA, 27 bp, Artificial sequence
  SiRNA target sequence
acgttacgcccgactgggcagcaattc

SEQ ID NO: 193666 - DNA, 27 bp, Artificial sequence
  SiRNA target sequence
cgttacgcccgactgggcagcaattct

SEQ ID NO: 193667 - DNA, 27 bp, Artificial sequence
  SiRNA target sequence
gttacgcccgactgggcagcaattcta

SEQ ID NO: 193668 - DNA, 27 bp, Artificial sequence
  SiRNA target sequence
ttacgcccgactgggcagcaattctaa

SEQ ID NO: 193669 - DNA, 27 bp, Artificial sequence
  SiRNA target sequence
tacgcccgactgggcagcaattctaaa

SEQ ID NO: 193670 - DNA, 27 bp, Artificial sequence
  SiRNA target sequence
acgcccgactgggcagcaattctaaat

SEQ ID NO: 193671 - DNA, 27 bp, Artificial sequence
  SiRNA target sequence
cgcccgactgggcagcaattctaaata

SEQ ID NO: 193672 - DNA, 27 bp, Artificial sequence
  SiRNA target sequence
gcccgactgggcagcaattctaaataa

SEQ ID NO: 193673 - DNA, 27 bp, Artificial sequence
  SiRNA target sequence
cccgactgggcagcaattctaaataat

SEQ ID NO: 193674 - DNA, 27 bp, Artificial sequence
  SiRNA target sequence
ccgactgggcagcaattctaaataatt

SEQ ID NO: 193675 - DNA, 27 bp, Artificial sequence
  SiRNA target sequence
cgactgggcagcaattctaaataatta

SEQ ID NO: 193676 - DNA, 27 bp, Artificial sequence
  SiRNA target sequence
gactgggcagcaattctaaataattat

SEQ ID NO: 193677 - DNA, 27 bp, Artificial sequence
  SiRNA target sequence
actgggcagcaattctaaataattata

SEQ ID NO: 193678 - DNA, 27 bp, Artificial sequence
  SiRNA target sequence
ctgggcagcaattctaaataattataa

SEQ ID NO: 193679 - DNA, 27 bp, Artificial sequence
  SiRNA target sequence
tgggcagcaattctaaataattataaa

SEQ ID NO: 193680 - DNA, 27 bp, Artificial sequence
  SiRNA target sequence
gggcagcaattctaaataattataaag

SEQ ID NO: 193681 - DNA, 27 bp, Artificial sequence
  SiRNA target sequence
ggcagcaattctaaataattataaagg

SEQ ID NO: 193682 - DNA, 27 bp, Artificial sequence
  SiRNA target sequence
gcagcaattctaaataattataaagga

SEQ ID NO: 193683 - DNA, 27 bp, Artificial sequence
  SiRNA target sequence
cagcaattctaaataattataaaggat

SEQ ID NO: 193684 - DNA, 27 bp, Artificial sequence
  SiRNA target sequence
agcaattctaaataattataaaggatc

SEQ ID NO: 193685 - DNA, 27 bp, Artificial sequence
  SiRNA target sequence
gcaattctaaataattataaaggatct

SEQ ID NO: 193686 - DNA, 27 bp, Artificial sequence
  SiRNA target sequence
caattctaaataattataaaggatctg

SEQ ID NO: 193687 - DNA, 27 bp, Artificial sequence
  SiRNA target sequence
aattctaaataattataaaggatctga

SEQ ID NO: 193688 - DNA, 27 bp, Artificial sequence
  SiRNA target sequence
attctaaataattataaaggatctgaa

SEQ ID NO: 193689 - DNA, 27 bp, Artificial sequence
  SiRNA target sequence
ttctaaataattataaaggatctgaac

SEQ ID NO: 193690 - DNA, 27 bp, Artificial sequence
  SiRNA target sequence
tctaaataattataaaggatctgaact

SEQ ID NO: 193691 - DNA, 27 bp, Artificial sequence
  SiRNA target sequence
ctaaataattataaaggatctgaactt

SEQ ID NO: 193692 - DNA, 27 bp, Artificial sequence
  SiRNA target sequence
taaataattataaaggatctgaacttc

SEQ ID NO: 193693 - DNA, 27 bp, Artificial sequence
  SiRNA target sequence
aaataattataaaggatctgaacttca

SEQ ID NO: 193694 - DNA, 27 bp, Artificial sequence
  SiRNA target sequence
aataattataaaggatctgaacttcat

SEQ ID NO: 193695 - DNA, 27 bp, Artificial sequence
  SiRNA target sequence
ataattataaaggatctgaacttcatg

SEQ ID NO: 193696 - DNA, 27 bp, Artificial sequence
  SiRNA target sequence
taattataaaggatctgaacttcatgg

SEQ ID NO: 193697 - DNA, 27 bp, Artificial sequence
  SiRNA target sequence
aattataaaggatctgaacttcatgga

SEQ ID NO: 193698 - DNA, 27 bp, Artificial sequence
  SiRNA target sequence
attataaaggatctgaacttcatggat

SEQ ID NO: 193699 - DNA, 27 bp, Artificial sequence
  SiRNA target sequence
ttataaaggatctgaacttcatggatt

SEQ ID NO: 193700 - DNA, 27 bp, Artificial sequence
  SiRNA target sequence
tataaaggatctgaacttcatggattt

SEQ ID NO: 193701 - DNA, 27 bp, Artificial sequence
  SiRNA target sequence
ataaaggatctgaacttcatggatttt

SEQ ID NO: 193702 - DNA, 27 bp, Artificial sequence
  SiRNA target sequence
taaaggatctgaacttcatggattttt

SEQ ID NO: 193703 - DNA, 27 bp, Artificial sequence
  SiRNA target sequence
aaaggatctgaacttcatggatttttt

SEQ ID NO: 193704 - DNA, 27 bp, Artificial sequence
  SiRNA target sequence
aaggatctgaacttcatggatttttta

SEQ ID NO: 193705 - DNA, 27 bp, Artificial sequence
  SiRNA target sequence
aggatctgaacttcatggattttttac

SEQ ID NO: 193706 - DNA, 27 bp, Artificial sequence
  SiRNA target sequence
ggatctgaacttcatggattttttact

SEQ ID NO: 193707 - DNA, 27 bp, Artificial sequence
  SiRNA target sequence
gatctgaacttcatggattttttacta

SEQ ID NO: 193708 - DNA, 27 bp, Artificial sequence
  SiRNA target sequence
atctgaacttcatggattttttactaa

SEQ ID NO: 193709 - DNA, 27 bp, Artificial sequence
  SiRNA target sequence
tctgaacttcatggattttttactaaa

SEQ ID NO: 193710 - DNA, 27 bp, Artificial sequence
  SiRNA target sequence
ctgaacttcatggattttttactaaaa

SEQ ID NO: 193711 - DNA, 27 bp, Artificial sequence
  SiRNA target sequence
tgaacttcatggattttttactaaaat

SEQ ID NO: 193712 - DNA, 27 bp, Artificial sequence
  SiRNA target sequence
gaacttcatggattttttactaaaatt

SEQ ID NO: 193713 - DNA, 27 bp, Artificial sequence
  SiRNA target sequence
aacttcatggattttttactaaaattt

SEQ ID NO: 193714 - DNA, 27 bp, Artificial sequence
  SiRNA target sequence
acttcatggattttttactaaaatttt

SEQ ID NO: 193715 - DNA, 27 bp, Artificial sequence
  SiRNA target sequence
cttcatggattttttactaaaatttta

SEQ ID NO: 193716 - DNA, 27 bp, Artificial sequence
  SiRNA target sequence
ttcatggattttttactaaaattttag

SEQ ID NO: 193717 - DNA, 27 bp, Artificial sequence
  SiRNA target sequence
tcatggattttttactaaaattttaga

SEQ ID NO: 193718 - DNA, 27 bp, Artificial sequence
  SiRNA target sequence
catggattttttactaaaattttagaa

SEQ ID NO: 193719 - DNA, 27 bp, Artificial sequence
  SiRNA target sequence
atggattttttactaaaattttagaag

SEQ ID NO: 193720 - DNA, 27 bp, Artificial sequence
  SiRNA target sequence
tggattttttactaaaattttagaagg

SEQ ID NO: 193721 - DNA, 27 bp, Artificial sequence
  SiRNA target sequence
ggattttttactaaaattttagaaggg

SEQ ID NO: 193722 - DNA, 27 bp, Artificial sequence
  SiRNA target sequence
gattttttactaaaattttagaagggt

SEQ ID NO: 193723 - DNA, 27 bp, Artificial sequence
  SiRNA target sequence
attttttactaaaattttagaagggtc

SEQ ID NO: 193724 - DNA, 27 bp, Artificial sequence
  SiRNA target sequence
ttttttactaaaattttagaagggtct

SEQ ID NO: 193725 - DNA, 27 bp, Artificial sequence
  SiRNA target sequence
tttttactaaaattttagaagggtcta

SEQ ID NO: 193726 - DNA, 27 bp, Artificial sequence
  SiRNA target sequence
ttttactaaaattttagaagggtctat

SEQ ID NO: 193727 - DNA, 27 bp, Artificial sequence
  SiRNA target sequence
tttactaaaattttagaagggtctatt

SEQ ID NO: 193728 - DNA, 27 bp, Artificial sequence
  SiRNA target sequence
ttactaaaattttagaagggtctatta

SEQ ID NO: 193729 - DNA, 27 bp, Artificial sequence
  SiRNA target sequence
tactaaaattttagaagggtctattaa

SEQ ID NO: 193730 - DNA, 27 bp, Artificial sequence
  SiRNA target sequence
actaaaattttagaagggtctattaaa

SEQ ID NO: 193731 - DNA, 27 bp, Artificial sequence
  SiRNA target sequence
ctaaaattttagaagggtctattaaag

SEQ ID NO: 193732 - DNA, 27 bp, Artificial sequence
  SiRNA target sequence
taaaattttagaagggtctattaaagc

SEQ ID NO: 193733 - DNA, 27 bp, Artificial sequence
  SiRNA target sequence
aaaattttagaagggtctattaaagct

SEQ ID NO: 193734 - DNA, 27 bp, Artificial sequence
  SiRNA target sequence
aaattttagaagggtctattaaagcta

SEQ ID NO: 193735 - DNA, 27 bp, Artificial sequence
  SiRNA target sequence
aattttagaagggtctattaaagctat

SEQ ID NO: 193736 - DNA, 27 bp, Artificial sequence
  SiRNA target sequence
attttagaagggtctattaaagctatt

SEQ ID NO: 193737 - DNA, 27 bp, Artificial sequence
  SiRNA target sequence
ttttagaagggtctattaaagctattt

SEQ ID NO: 193738 - DNA, 27 bp, Artificial sequence
  SiRNA target sequence
tttagaagggtctattaaagctatttc

SEQ ID NO: 193739 - DNA, 27 bp, Artificial sequence
  SiRNA target sequence
ttagaagggtctattaaagctatttct

SEQ ID NO: 193740 - DNA, 27 bp, Artificial sequence
  SiRNA target sequence
tagaagggtctattaaagctatttcta

SEQ ID NO: 193741 - DNA, 27 bp, Artificial sequence
  SiRNA target sequence
agaagggtctattaaagctatttctaa

SEQ ID NO: 193742 - DNA, 27 bp, Artificial sequence
  SiRNA target sequence
gaagggtctattaaagctatttctaag

SEQ ID NO: 193743 - DNA, 27 bp, Artificial sequence
  SiRNA target sequence
aagggtctattaaagctatttctaaga

SEQ ID NO: 193744 - DNA, 27 bp, Artificial sequence
  SiRNA target sequence
agggtctattaaagctatttctaagat

SEQ ID NO: 193745 - DNA, 27 bp, Artificial sequence
  SiRNA target sequence
gggtctattaaagctatttctaagata

SEQ ID NO: 193746 - DNA, 27 bp, Artificial sequence
  SiRNA target sequence
ggtctattaaagctatttctaagatac

SEQ ID NO: 193747 - DNA, 27 bp, Artificial sequence
  SiRNA target sequence
gtctattaaagctatttctaagataca

SEQ ID NO: 193748 - DNA, 27 bp, Artificial sequence
  SiRNA target sequence
tctattaaagctatttctaagatacag

SEQ ID NO: 193749 - DNA, 27 bp, Artificial sequence
  SiRNA target sequence
ctattaaagctatttctaagatacagt

SEQ ID NO: 193750 - DNA, 27 bp, Artificial sequence
  SiRNA target sequence
tattaaagctatttctaagatacagta

SEQ ID NO: 193751 - DNA, 27 bp, Artificial sequence
  SiRNA target sequence
attaaagctatttctaagatacagtat

SEQ ID NO: 193752 - DNA, 27 bp, Artificial sequence
  SiRNA target sequence
ttaaagctatttctaagatacagtata

SEQ ID NO: 193753 - DNA, 27 bp, Artificial sequence
  SiRNA target sequence
taaagctatttctaagatacagtatat

SEQ ID NO: 193754 - DNA, 27 bp, Artificial sequence
  SiRNA target sequence
aaagctatttctaagatacagtatata

SEQ ID NO: 193755 - DNA, 27 bp, Artificial sequence
  SiRNA target sequence
aagctatttctaagatacagtatatag

SEQ ID NO: 193756 - DNA, 27 bp, Artificial sequence
  SiRNA target sequence
agctatttctaagatacagtatataga

SEQ ID NO: 193757 - DNA, 27 bp, Artificial sequence
  SiRNA target sequence
gctatttctaagatacagtatatagat

SEQ ID NO: 193758 - DNA, 27 bp, Artificial sequence
  SiRNA target sequence
ctatttctaagatacagtatatagata

SEQ ID NO: 193759 - DNA, 27 bp, Artificial sequence
  SiRNA target sequence
tatttctaagatacagtatatagataa

SEQ ID NO: 193760 - DNA, 27 bp, Artificial sequence
  SiRNA target sequence
atttctaagatacagtatatagataaa

SEQ ID NO: 193761 - DNA, 27 bp, Artificial sequence
  SiRNA target sequence
tttctaagatacagtatatagataaaa

SEQ ID NO: 193762 - DNA, 27 bp, Artificial sequence
  SiRNA target sequence
ttctaagatacagtatatagataaaat

SEQ ID NO: 193763 - DNA, 27 bp, Artificial sequence
  SiRNA target sequence
tctaagatacagtatatagataaaatg

SEQ ID NO: 193764 - DNA, 27 bp, Artificial sequence
  SiRNA target sequence
ctaagatacagtatatagataaaatgc

SEQ ID NO: 193765 - DNA, 27 bp, Artificial sequence
  SiRNA target sequence
taagatacagtatatagataaaatgcc

SEQ ID NO: 193766 - DNA, 27 bp, Artificial sequence
  SiRNA target sequence
aagatacagtatatagataaaatgcct

SEQ ID NO: 193767 - DNA, 27 bp, Artificial sequence
  SiRNA target sequence
agatacagtatatagataaaatgccta

SEQ ID NO: 193768 - DNA, 27 bp, Artificial sequence
  SiRNA target sequence
gatacagtatatagataaaatgcctaa

SEQ ID NO: 193769 - DNA, 27 bp, Artificial sequence
  SiRNA target sequence
atacagtatatagataaaatgcctaaa

SEQ ID NO: 193770 - DNA, 27 bp, Artificial sequence
  SiRNA target sequence
tacagtatatagataaaatgcctaaat

SEQ ID NO: 193771 - DNA, 27 bp, Artificial sequence
  SiRNA target sequence
acagtatatagataaaatgcctaaatt

SEQ ID NO: 193772 - DNA, 27 bp, Artificial sequence
  SiRNA target sequence
cagtatatagataaaatgcctaaattt

SEQ ID NO: 193773 - DNA, 27 bp, Artificial sequence
  SiRNA target sequence
agtatatagataaaatgcctaaatttt

SEQ ID NO: 193774 - DNA, 27 bp, Artificial sequence
  SiRNA target sequence
gtatatagataaaatgcctaaattttt

SEQ ID NO: 193775 - DNA, 27 bp, Artificial sequence
  SiRNA target sequence
tatatagataaaatgcctaaattttta

SEQ ID NO: 193776 - DNA, 27 bp, Artificial sequence
  SiRNA target sequence
atatagataaaatgcctaaatttttaa

SEQ ID NO: 193777 - DNA, 27 bp, Artificial sequence
  SiRNA target sequence
tatagataaaatgcctaaatttttaaa

SEQ ID NO: 193778 - DNA, 27 bp, Artificial sequence
  SiRNA target sequence
atagataaaatgcctaaatttttaaaa

SEQ ID NO: 193779 - DNA, 27 bp, Artificial sequence
  SiRNA target sequence
tagataaaatgcctaaatttttaaaag

SEQ ID NO: 193780 - DNA, 27 bp, Artificial sequence
  SiRNA target sequence
agataaaatgcctaaatttttaaaagg

SEQ ID NO: 193781 - DNA, 27 bp, Artificial sequence
  SiRNA target sequence
gataaaatgcctaaatttttaaaagga

SEQ ID NO: 193782 - DNA, 27 bp, Artificial sequence
  SiRNA target sequence
ataaaatgcctaaatttttaaaaggac

SEQ ID NO: 193783 - DNA, 27 bp, Artificial sequence
  SiRNA target sequence
taaaatgcctaaatttttaaaaggacg

SEQ ID NO: 193784 - DNA, 27 bp, Artificial sequence
  SiRNA target sequence
aaaatgcctaaatttttaaaaggacgc

SEQ ID NO: 193785 - DNA, 27 bp, Artificial sequence
  SiRNA target sequence
aaatgcctaaatttttaaaaggacgct

SEQ ID NO: 193786 - DNA, 27 bp, Artificial sequence
  SiRNA target sequence
aatgcctaaatttttaaaaggacgcta

SEQ ID NO: 193787 - DNA, 27 bp, Artificial sequence
  SiRNA target sequence
atgcctaaatttttaaaaggacgctat

SEQ ID NO: 193788 - DNA, 27 bp, Artificial sequence
  SiRNA target sequence
tgcctaaatttttaaaaggacgctata

SEQ ID NO: 193789 - DNA, 27 bp, Artificial sequence
  SiRNA target sequence
gcctaaatttttaaaaggacgctataa

SEQ ID NO: 193790 - DNA, 27 bp, Artificial sequence
  SiRNA target sequence
cctaaatttttaaaaggacgctataag

SEQ ID NO: 193791 - DNA, 27 bp, Artificial sequence
  SiRNA target sequence
ctaaatttttaaaaggacgctataagt

SEQ ID NO: 193792 - DNA, 27 bp, Artificial sequence
  SiRNA target sequence
taaatttttaaaaggacgctataagtc

SEQ ID NO: 193793 - DNA, 27 bp, Artificial sequence
  SiRNA target sequence
aaatttttaaaaggacgctataagtca

SEQ ID NO: 193794 - DNA, 27 bp, Artificial sequence
  SiRNA target sequence
aatttttaaaaggacgctataagtcag

SEQ ID NO: 193795 - DNA, 27 bp, Artificial sequence
  SiRNA target sequence
atttttaaaaggacgctataagtcaga

SEQ ID NO: 193796 - DNA, 27 bp, Artificial sequence
  SiRNA target sequence
tttttaaaaggacgctataagtcagaa

SEQ ID NO: 193797 - DNA, 27 bp, Artificial sequence
  SiRNA target sequence
ttttaaaaggacgctataagtcagaaa

SEQ ID NO: 193798 - DNA, 27 bp, Artificial sequence
  SiRNA target sequence
tttaaaaggacgctataagtcagaaat

SEQ ID NO: 193799 - DNA, 27 bp, Artificial sequence
  SiRNA target sequence
ttaaaaggacgctataagtcagaaatc

SEQ ID NO: 193800 - DNA, 27 bp, Artificial sequence
  SiRNA target sequence
taaaaggacgctataagtcagaaatcg

SEQ ID NO: 193801 - DNA, 27 bp, Artificial sequence
  SiRNA target sequence
aaaaggacgctataagtcagaaatcgc

SEQ ID NO: 193802 - DNA, 27 bp, Artificial sequence
  SiRNA target sequence
aaaggacgctataagtcagaaatcgcc

SEQ ID NO: 193803 - DNA, 27 bp, Artificial sequence
  SiRNA target sequence
aaggacgctataagtcagaaatcgcct

SEQ ID NO: 193804 - DNA, 27 bp, Artificial sequence
  SiRNA target sequence
aggacgctataagtcagaaatcgcctc

SEQ ID NO: 193805 - DNA, 27 bp, Artificial sequence
  SiRNA target sequence
ggacgctataagtcagaaatcgcctcc

SEQ ID NO: 193806 - DNA, 27 bp, Artificial sequence
  SiRNA target sequence
gacgctataagtcagaaatcgcctccg

SEQ ID NO: 193807 - DNA, 27 bp, Artificial sequence
  SiRNA target sequence
acgctataagtcagaaatcgcctccgg

SEQ ID NO: 193808 - DNA, 27 bp, Artificial sequence
  SiRNA target sequence
cgctataagtcagaaatcgcctccgga

SEQ ID NO: 193809 - DNA, 27 bp, Artificial sequence
  SiRNA target sequence
gctataagtcagaaatcgcctccggaa

SEQ ID NO: 193810 - DNA, 27 bp, Artificial sequence
  SiRNA target sequence
ctataagtcagaaatcgcctccggaaa

SEQ ID NO: 193811 - DNA, 27 bp, Artificial sequence
  SiRNA target sequence
tataagtcagaaatcgcctccggaaaa

SEQ ID NO: 193812 - DNA, 27 bp, Artificial sequence
  SiRNA target sequence
ataagtcagaaatcgcctccggaaaaa

SEQ ID NO: 193813 - DNA, 27 bp, Artificial sequence
  SiRNA target sequence
taagtcagaaatcgcctccggaaaaat

SEQ ID NO: 193814 - DNA, 27 bp, Artificial sequence
  SiRNA target sequence
aagtcagaaatcgcctccggaaaaatg

SEQ ID NO: 193815 - DNA, 27 bp, Artificial sequence
  SiRNA target sequence
agtcagaaatcgcctccggaaaaatgt

SEQ ID NO: 193816 - DNA, 27 bp, Artificial sequence
  SiRNA target sequence
gtcagaaatcgcctccggaaaaatgtt

SEQ ID NO: 193817 - DNA, 27 bp, Artificial sequence
  SiRNA target sequence
tcagaaatcgcctccggaaaaatgttg

SEQ ID NO: 193818 - DNA, 27 bp, Artificial sequence
  SiRNA target sequence
cagaaatcgcctccggaaaaatgttgt

SEQ ID NO: 193819 - DNA, 27 bp, Artificial sequence
  SiRNA target sequence
agaaatcgcctccggaaaaatgttgtt

SEQ ID NO: 193820 - DNA, 27 bp, Artificial sequence
  SiRNA target sequence
gaaatcgcctccggaaaaatgttgttt

SEQ ID NO: 193821 - DNA, 27 bp, Artificial sequence
  SiRNA target sequence
aaatcgcctccggaaaaatgttgttta

SEQ ID NO: 193822 - DNA, 27 bp, Artificial sequence
  SiRNA target sequence
aatcgcctccggaaaaatgttgtttac

SEQ ID NO: 193823 - DNA, 27 bp, Artificial sequence
  SiRNA target sequence
atcgcctccggaaaaatgttgtttact

SEQ ID NO: 193824 - DNA, 27 bp, Artificial sequence
  SiRNA target sequence
tcgcctccggaaaaatgttgtttactg

SEQ ID NO: 193825 - DNA, 27 bp, Artificial sequence
  SiRNA target sequence
cgcctccggaaaaatgttgtttactgt

SEQ ID NO: 193826 - DNA, 27 bp, Artificial sequence
  SiRNA target sequence
gcctccggaaaaatgttgtttactgtt

SEQ ID NO: 193827 - DNA, 27 bp, Artificial sequence
  SiRNA target sequence
cctccggaaaaatgttgtttactgtta

SEQ ID NO: 193828 - DNA, 27 bp, Artificial sequence
  SiRNA target sequence
ctccggaaaaatgttgtttactgttaa

SEQ ID NO: 193829 - DNA, 27 bp, Artificial sequence
  SiRNA target sequence
tccggaaaaatgttgtttactgttaat

SEQ ID NO: 193830 - DNA, 27 bp, Artificial sequence
  SiRNA target sequence
ccggaaaaatgttgtttactgttaatg

SEQ ID NO: 193831 - DNA, 27 bp, Artificial sequence
  SiRNA target sequence
cggaaaaatgttgtttactgttaatga

SEQ ID NO: 193832 - DNA, 27 bp, Artificial sequence
  SiRNA target sequence
ggaaaaatgttgtttactgttaatgat

SEQ ID NO: 193833 - DNA, 27 bp, Artificial sequence
  SiRNA target sequence
gaaaaatgttgtttactgttaatgata

SEQ ID NO: 193834 - DNA, 27 bp, Artificial sequence
  SiRNA target sequence
aaaaatgttgtttactgttaatgatat

SEQ ID NO: 193835 - DNA, 27 bp, Artificial sequence
  SiRNA target sequence
aaaatgttgtttactgttaatgatata

SEQ ID NO: 193836 - DNA, 27 bp, Artificial sequence
  SiRNA target sequence
aaatgttgtttactgttaatgatatat

SEQ ID NO: 193837 - DNA, 27 bp, Artificial sequence
  SiRNA target sequence
aatgttgtttactgttaatgatatatt

SEQ ID NO: 193838 - DNA, 27 bp, Artificial sequence
  SiRNA target sequence
atgttgtttactgttaatgatatatta

SEQ ID NO: 193839 - DNA, 27 bp, Artificial sequence
  SiRNA target sequence
tgttgtttactgttaatgatatattaa

SEQ ID NO: 193840 - DNA, 27 bp, Artificial sequence
  SiRNA target sequence
gttgtttactgttaatgatatattaaa

SEQ ID NO: 193841 - DNA, 27 bp, Artificial sequence
  SiRNA target sequence
ttgtttactgttaatgatatattaaaa

SEQ ID NO: 193842 - DNA, 27 bp, Artificial sequence
  SiRNA target sequence
tgtttactgttaatgatatattaaaaa

SEQ ID NO: 193843 - DNA, 27 bp, Artificial sequence
  SiRNA target sequence
gtttactgttaatgatatattaaaaaa

SEQ ID NO: 193844 - DNA, 27 bp, Artificial sequence
  SiRNA target sequence
tttactgttaatgatatattaaaaaaa

SEQ ID NO: 193845 - DNA, 27 bp, Artificial sequence
  SiRNA target sequence
ttactgttaatgatatattaaaaaaag

SEQ ID NO: 193846 - DNA, 27 bp, Artificial sequence
  SiRNA target sequence
tactgttaatgatatattaaaaaaagt

SEQ ID NO: 193847 - DNA, 27 bp, Artificial sequence
  SiRNA target sequence
actgttaatgatatattaaaaaaagtt

SEQ ID NO: 193848 - DNA, 27 bp, Artificial sequence
  SiRNA target sequence
ctgttaatgatatattaaaaaaagttg

SEQ ID NO: 193849 - DNA, 27 bp, Artificial sequence
  SiRNA target sequence
tgttaatgatatattaaaaaaagttga

SEQ ID NO: 193850 - DNA, 27 bp, Artificial sequence
  SiRNA target sequence
gttaatgatatattaaaaaaagttgat

SEQ ID NO: 193851 - DNA, 27 bp, Artificial sequence
  SiRNA target sequence
ttaatgatatattaaaaaaagttgatg

SEQ ID NO: 193852 - DNA, 27 bp, Artificial sequence
  SiRNA target sequence
taatgatatattaaaaaaagttgatga

SEQ ID NO: 193853 - DNA, 27 bp, Artificial sequence
  SiRNA target sequence
aatgatatattaaaaaaagttgatgaa

SEQ ID NO: 193854 - DNA, 27 bp, Artificial sequence
  SiRNA target sequence
atgatatattaaaaaaagttgatgaaa

SEQ ID NO: 193855 - DNA, 27 bp, Artificial sequence
  SiRNA target sequence
tgatatattaaaaaaagttgatgaaaa

SEQ ID NO: 193856 - DNA, 27 bp, Artificial sequence
  SiRNA target sequence
gatatattaaaaaaagttgatgaaaaa

SEQ ID NO: 193857 - DNA, 27 bp, Artificial sequence
  SiRNA target sequence
atatattaaaaaaagttgatgaaaaaa

SEQ ID NO: 193858 - DNA, 27 bp, Artificial sequence
  SiRNA target sequence
tatattaaaaaaagttgatgaaaaaaa

SEQ ID NO: 193859 - DNA, 27 bp, Artificial sequence
  SiRNA target sequence
atattaaaaaaagttgatgaaaaaaat

SEQ ID NO: 193860 - DNA, 27 bp, Artificial sequence
  SiRNA target sequence
tattaaaaaaagttgatgaaaaaaata

SEQ ID NO: 193861 - DNA, 27 bp, Artificial sequence
  SiRNA target sequence
attaaaaaaagttgatgaaaaaaataa

SEQ ID NO: 193862 - DNA, 27 bp, Artificial sequence
  SiRNA target sequence
ttaaaaaaagttgatgaaaaaaataaa

SEQ ID NO: 193863 - DNA, 27 bp, Artificial sequence
  SiRNA target sequence
taaaaaaagttgatgaaaaaaataaat

SEQ ID NO: 193864 - DNA, 27 bp, Artificial sequence
  SiRNA target sequence
aaaaaaagttgatgaaaaaaataaatt

SEQ ID NO: 193865 - DNA, 27 bp, Artificial sequence
  SiRNA target sequence
aaaaaagttgatgaaaaaaataaattt

SEQ ID NO: 193866 - DNA, 27 bp, Artificial sequence
  SiRNA target sequence
aaaaagttgatgaaaaaaataaatttg

SEQ ID NO: 193867 - DNA, 27 bp, Artificial sequence
  SiRNA target sequence
aaaagttgatgaaaaaaataaatttga

SEQ ID NO: 193868 - DNA, 27 bp, Artificial sequence
  SiRNA target sequence
aaagttgatgaaaaaaataaatttgac

SEQ ID NO: 193869 - DNA, 27 bp, Artificial sequence
  SiRNA target sequence
aagttgatgaaaaaaataaatttgact

SEQ ID NO: 193870 - DNA, 27 bp, Artificial sequence
  SiRNA target sequence
agttgatgaaaaaaataaatttgacta

SEQ ID NO: 193871 - DNA, 27 bp, Artificial sequence
  SiRNA target sequence
gttgatgaaaaaaataaatttgactat

SEQ ID NO: 193872 - DNA, 27 bp, Artificial sequence
  SiRNA target sequence
ttgatgaaaaaaataaatttgactatt

SEQ ID NO: 193873 - DNA, 27 bp, Artificial sequence
  SiRNA target sequence
tgatgaaaaaaataaatttgactatta

SEQ ID NO: 193874 - DNA, 27 bp, Artificial sequence
  SiRNA target sequence
gatgaaaaaaataaatttgactattac

SEQ ID NO: 193875 - DNA, 27 bp, Artificial sequence
  SiRNA target sequence
atgaaaaaaataaatttgactattacg

SEQ ID NO: 193876 - DNA, 27 bp, Artificial sequence
  SiRNA target sequence
tgaaaaaaataaatttgactattacgt

SEQ ID NO: 193877 - DNA, 27 bp, Artificial sequence
  SiRNA target sequence
gaaaaaaataaatttgactattacgta

SEQ ID NO: 193878 - DNA, 27 bp, Artificial sequence
  SiRNA target sequence
aaaaaaataaatttgactattacgtag

SEQ ID NO: 193879 - DNA, 27 bp, Artificial sequence
  SiRNA target sequence
aaaaaataaatttgactattacgtaga

SEQ ID NO: 193880 - DNA, 27 bp, Artificial sequence
  SiRNA target sequence
aaaaataaatttgactattacgtagat

SEQ ID NO: 193881 - DNA, 27 bp, Artificial sequence
  SiRNA target sequence
aaaataaatttgactattacgtagata

SEQ ID NO: 193882 - DNA, 27 bp, Artificial sequence
  SiRNA target sequence
aaataaatttgactattacgtagataa

SEQ ID NO: 193883 - DNA, 27 bp, Artificial sequence
  SiRNA target sequence
aataaatttgactattacgtagataaa

SEQ ID NO: 193884 - DNA, 27 bp, Artificial sequence
  SiRNA target sequence
ataaatttgactattacgtagataaaa

SEQ ID NO: 193885 - DNA, 27 bp, Artificial sequence
  SiRNA target sequence
taaatttgactattacgtagataaaat

SEQ ID NO: 193886 - DNA, 27 bp, Artificial sequence
  SiRNA target sequence
aaatttgactattacgtagataaaatg

SEQ ID NO: 193887 - DNA, 27 bp, Artificial sequence
  SiRNA target sequence
aatttgactattacgtagataaaatgg

SEQ ID NO: 193888 - DNA, 27 bp, Artificial sequence
  SiRNA target sequence
atttgactattacgtagataaaatggc

SEQ ID NO: 193889 - DNA, 27 bp, Artificial sequence
  SiRNA target sequence
tttgactattacgtagataaaatggca

SEQ ID NO: 193890 - DNA, 27 bp, Artificial sequence
  SiRNA target sequence
ttgactattacgtagataaaatggcac

SEQ ID NO: 193891 - DNA, 27 bp, Artificial sequence
  SiRNA target sequence
tgactattacgtagataaaatggcact

SEQ ID NO: 193892 - DNA, 27 bp, Artificial sequence
  SiRNA target sequence
gactattacgtagataaaatggcactt

SEQ ID NO: 193893 - DNA, 27 bp, Artificial sequence
  SiRNA target sequence
actattacgtagataaaatggcactta

SEQ ID NO: 193894 - DNA, 27 bp, Artificial sequence
  SiRNA target sequence
ctattacgtagataaaatggcacttaa

SEQ ID NO: 193895 - DNA, 27 bp, Artificial sequence
  SiRNA target sequence
tattacgtagataaaatggcacttaaa

SEQ ID NO: 193896 - DNA, 27 bp, Artificial sequence
  SiRNA target sequence
attacgtagataaaatggcacttaaaa

SEQ ID NO: 193897 - DNA, 27 bp, Artificial sequence
  SiRNA target sequence
ttacgtagataaaatggcacttaaaaa

SEQ ID NO: 193898 - DNA, 27 bp, Artificial sequence
  SiRNA target sequence
tacgtagataaaatggcacttaaaaat

SEQ ID NO: 193899 - DNA, 27 bp, Artificial sequence
  SiRNA target sequence
acgtagataaaatggcacttaaaaatg

SEQ ID NO: 193900 - DNA, 27 bp, Artificial sequence
  SiRNA target sequence
cgtagataaaatggcacttaaaaatgt

SEQ ID NO: 193901 - DNA, 27 bp, Artificial sequence
  SiRNA target sequence
gtagataaaatggcacttaaaaatgta

SEQ ID NO: 193902 - DNA, 27 bp, Artificial sequence
  SiRNA target sequence
tagataaaatggcacttaaaaatgtat

SEQ ID NO: 193903 - DNA, 27 bp, Artificial sequence
  SiRNA target sequence
agataaaatggcacttaaaaatgtatt

SEQ ID NO: 193904 - DNA, 27 bp, Artificial sequence
  SiRNA target sequence
gataaaatggcacttaaaaatgtatta

SEQ ID NO: 193905 - DNA, 27 bp, Artificial sequence
  SiRNA target sequence
ataaaatggcacttaaaaatgtattaa

SEQ ID NO: 193906 - DNA, 27 bp, Artificial sequence
  SiRNA target sequence
taaaatggcacttaaaaatgtattaac

SEQ ID NO: 193907 - DNA, 27 bp, Artificial sequence
  SiRNA target sequence
aaaatggcacttaaaaatgtattaaca

SEQ ID NO: 193908 - DNA, 27 bp, Artificial sequence
  SiRNA target sequence
aaatggcacttaaaaatgtattaacaa

SEQ ID NO: 193909 - DNA, 27 bp, Artificial sequence
  SiRNA target sequence
aatggcacttaaaaatgtattaacaag

SEQ ID NO: 193910 - DNA, 27 bp, Artificial sequence
  SiRNA target sequence
atggcacttaaaaatgtattaacaaga

SEQ ID NO: 193911 - DNA, 27 bp, Artificial sequence
  SiRNA target sequence
tggcacttaaaaatgtattaacaagag

SEQ ID NO: 193912 - DNA, 27 bp, Artificial sequence
  SiRNA target sequence
ggcacttaaaaatgtattaacaagaga

SEQ ID NO: 193913 - DNA, 27 bp, Artificial sequence
  SiRNA target sequence
gcacttaaaaatgtattaacaagagaa

SEQ ID NO: 193914 - DNA, 27 bp, Artificial sequence
  SiRNA target sequence
cacttaaaaatgtattaacaagagaat

SEQ ID NO: 193915 - DNA, 27 bp, Artificial sequence
  SiRNA target sequence
acttaaaaatgtattaacaagagaatt

SEQ ID NO: 193916 - DNA, 27 bp, Artificial sequence
  SiRNA target sequence
cttaaaaatgtattaacaagagaatta

SEQ ID NO: 193917 - DNA, 27 bp, Artificial sequence
  SiRNA target sequence
ttaaaaatgtattaacaagagaattag

SEQ ID NO: 193918 - DNA, 27 bp, Artificial sequence
  SiRNA target sequence
taaaaatgtattaacaagagaattaga

SEQ ID NO: 193919 - DNA, 27 bp, Artificial sequence
  SiRNA target sequence
aaaaatgtattaacaagagaattagag

SEQ ID NO: 193920 - DNA, 27 bp, Artificial sequence
  SiRNA target sequence
aaaatgtattaacaagagaattagagc

SEQ ID NO: 193921 - DNA, 27 bp, Artificial sequence
  SiRNA target sequence
aaatgtattaacaagagaattagagca

SEQ ID NO: 193922 - DNA, 27 bp, Artificial sequence
  SiRNA target sequence
aatgtattaacaagagaattagagcaa

SEQ ID NO: 193923 - DNA, 27 bp, Artificial sequence
  SiRNA target sequence
atgtattaacaagagaattagagcaat

SEQ ID NO: 193924 - DNA, 27 bp, Artificial sequence
  SiRNA target sequence
tgtattaacaagagaattagagcaatt

SEQ ID NO: 193925 - DNA, 27 bp, Artificial sequence
  SiRNA target sequence
gtattaacaagagaattagagcaatta

SEQ ID NO: 193926 - DNA, 27 bp, Artificial sequence
  SiRNA target sequence
tattaacaagagaattagagcaattaa

SEQ ID NO: 193927 - DNA, 27 bp, Artificial sequence
  SiRNA target sequence
attaacaagagaattagagcaattaag

SEQ ID NO: 193928 - DNA, 27 bp, Artificial sequence
  SiRNA target sequence
ttaacaagagaattagagcaattaagt

SEQ ID NO: 193929 - DNA, 27 bp, Artificial sequence
  SiRNA target sequence
taacaagagaattagagcaattaagtg

SEQ ID NO: 193930 - DNA, 27 bp, Artificial sequence
  SiRNA target sequence
aacaagagaattagagcaattaagtgg

SEQ ID NO: 193931 - DNA, 27 bp, Artificial sequence
  SiRNA target sequence
acaagagaattagagcaattaagtggt

SEQ ID NO: 193932 - DNA, 27 bp, Artificial sequence
  SiRNA target sequence
caagagaattagagcaattaagtggtg

SEQ ID NO: 193933 - DNA, 27 bp, Artificial sequence
  SiRNA target sequence
aagagaattagagcaattaagtggtgg

SEQ ID NO: 193934 - DNA, 27 bp, Artificial sequence
  SiRNA target sequence
agagaattagagcaattaagtggtggt

SEQ ID NO: 193935 - DNA, 27 bp, Artificial sequence
  SiRNA target sequence
gagaattagagcaattaagtggtggtg

SEQ ID NO: 193936 - DNA, 27 bp, Artificial sequence
  SiRNA target sequence
agaattagagcaattaagtggtggtga

SEQ ID NO: 193937 - DNA, 27 bp, Artificial sequence
  SiRNA target sequence
gaattagagcaattaagtggtggtgaa

SEQ ID NO: 193938 - DNA, 27 bp, Artificial sequence
  SiRNA target sequence
aattagagcaattaagtggtggtgaac

SEQ ID NO: 193939 - DNA, 27 bp, Artificial sequence
  SiRNA target sequence
attagagcaattaagtggtggtgaact

SEQ ID NO: 193940 - DNA, 27 bp, Artificial sequence
  SiRNA target sequence
ttagagcaattaagtggtggtgaactt

SEQ ID NO: 193941 - DNA, 27 bp, Artificial sequence
  SiRNA target sequence
tagagcaattaagtggtggtgaacttc

SEQ ID NO: 193942 - DNA, 27 bp, Artificial sequence
  SiRNA target sequence
agagcaattaagtggtggtgaacttca

SEQ ID NO: 193943 - DNA, 27 bp, Artificial sequence
  SiRNA target sequence
gagcaattaagtggtggtgaacttcaa

SEQ ID NO: 193944 - DNA, 27 bp, Artificial sequence
  SiRNA target sequence
agcaattaagtggtggtgaacttcaaa

SEQ ID NO: 193945 - DNA, 27 bp, Artificial sequence
  SiRNA target sequence
gcaattaagtggtggtgaacttcaaag

SEQ ID NO: 193946 - DNA, 27 bp, Artificial sequence
  SiRNA target sequence
caattaagtggtggtgaacttcaaaga

SEQ ID NO: 193947 - DNA, 27 bp, Artificial sequence
  SiRNA target sequence
aattaagtggtggtgaacttcaaagat

SEQ ID NO: 193948 - DNA, 27 bp, Artificial sequence
  SiRNA target sequence
attaagtggtggtgaacttcaaagatt

SEQ ID NO: 193949 - DNA, 27 bp, Artificial sequence
  SiRNA target sequence
ttaagtggtggtgaacttcaaagattt

SEQ ID NO: 193950 - DNA, 27 bp, Artificial sequence
  SiRNA target sequence
taagtggtggtgaacttcaaagatttt

SEQ ID NO: 193951 - DNA, 27 bp, Artificial sequence
  SiRNA target sequence
aagtggtggtgaacttcaaagattttg

SEQ ID NO: 193952 - DNA, 27 bp, Artificial sequence
  SiRNA target sequence
agtggtggtgaacttcaaagattttgt

SEQ ID NO: 193953 - DNA, 27 bp, Artificial sequence
  SiRNA target sequence
gtggtggtgaacttcaaagattttgta

SEQ ID NO: 193954 - DNA, 27 bp, Artificial sequence
  SiRNA target sequence
tggtggtgaacttcaaagattttgtat

SEQ ID NO: 193955 - DNA, 27 bp, Artificial sequence
  SiRNA target sequence
ggtggtgaacttcaaagattttgtatt

SEQ ID NO: 193956 - DNA, 27 bp, Artificial sequence
  SiRNA target sequence
gtggtgaacttcaaagattttgtattg

SEQ ID NO: 193957 - DNA, 27 bp, Artificial sequence
  SiRNA target sequence
tggtgaacttcaaagattttgtattgc

SEQ ID NO: 193958 - DNA, 27 bp, Artificial sequence
  SiRNA target sequence
ggtgaacttcaaagattttgtattgca

SEQ ID NO: 193959 - DNA, 27 bp, Artificial sequence
  SiRNA target sequence
gtgaacttcaaagattttgtattgcat

SEQ ID NO: 193960 - DNA, 27 bp, Artificial sequence
  SiRNA target sequence
tgaacttcaaagattttgtattgcata

SEQ ID NO: 193961 - DNA, 27 bp, Artificial sequence
  SiRNA target sequence
gaacttcaaagattttgtattgcatac

SEQ ID NO: 193962 - DNA, 27 bp, Artificial sequence
  SiRNA target sequence
aacttcaaagattttgtattgcataca

SEQ ID NO: 193963 - DNA, 27 bp, Artificial sequence
  SiRNA target sequence
acttcaaagattttgtattgcatacac

SEQ ID NO: 193964 - DNA, 27 bp, Artificial sequence
  SiRNA target sequence
cttcaaagattttgtattgcatacaca

SEQ ID NO: 193965 - DNA, 27 bp, Artificial sequence
  SiRNA target sequence
ttcaaagattttgtattgcatacacat

SEQ ID NO: 193966 - DNA, 27 bp, Artificial sequence
  SiRNA target sequence
tcaaagattttgtattgcatacacatg

SEQ ID NO: 193967 - DNA, 27 bp, Artificial sequence
  SiRNA target sequence
caaagattttgtattgcatacacatgt

SEQ ID NO: 193968 - DNA, 27 bp, Artificial sequence
  SiRNA target sequence
aaagattttgtattgcatacacatgtt

SEQ ID NO: 193969 - DNA, 27 bp, Artificial sequence
  SiRNA target sequence
aagattttgtattgcatacacatgttt

SEQ ID NO: 193970 - DNA, 27 bp, Artificial sequence
  SiRNA target sequence
agattttgtattgcatacacatgttta

SEQ ID NO: 193971 - DNA, 27 bp, Artificial sequence
  SiRNA target sequence
gattttgtattgcatacacatgtttac

SEQ ID NO: 193972 - DNA, 27 bp, Artificial sequence
  SiRNA target sequence
attttgtattgcatacacatgtttaca

SEQ ID NO: 193973 - DNA, 27 bp, Artificial sequence
  SiRNA target sequence
ttttgtattgcatacacatgtttacaa

SEQ ID NO: 193974 - DNA, 27 bp, Artificial sequence
  SiRNA target sequence
tttgtattgcatacacatgtttacaag

SEQ ID NO: 193975 - DNA, 27 bp, Artificial sequence
  SiRNA target sequence
ttgtattgcatacacatgtttacaaga

SEQ ID NO: 193976 - DNA, 27 bp, Artificial sequence
  SiRNA target sequence
tgtattgcatacacatgtttacaagaa

SEQ ID NO: 193977 - DNA, 27 bp, Artificial sequence
  SiRNA target sequence
gtattgcatacacatgtttacaagaag

SEQ ID NO: 193978 - DNA, 27 bp, Artificial sequence
  SiRNA target sequence
tattgcatacacatgtttacaagaagg

SEQ ID NO: 193979 - DNA, 27 bp, Artificial sequence
  SiRNA target sequence
attgcatacacatgtttacaagaagga

SEQ ID NO: 193980 - DNA, 27 bp, Artificial sequence
  SiRNA target sequence
ttgcatacacatgtttacaagaaggaa

SEQ ID NO: 193981 - DNA, 27 bp, Artificial sequence
  SiRNA target sequence
tgcatacacatgtttacaagaaggaaa

SEQ ID NO: 193982 - DNA, 27 bp, Artificial sequence
  SiRNA target sequence
gcatacacatgtttacaagaaggaaat

SEQ ID NO: 193983 - DNA, 27 bp, Artificial sequence
  SiRNA target sequence
catacacatgtttacaagaaggaaatg

SEQ ID NO: 193984 - DNA, 27 bp, Artificial sequence
  SiRNA target sequence
atacacatgtttacaagaaggaaatgt

SEQ ID NO: 193985 - DNA, 27 bp, Artificial sequence
  SiRNA target sequence
tacacatgtttacaagaaggaaatgtt

SEQ ID NO: 193986 - DNA, 27 bp, Artificial sequence
  SiRNA target sequence
acacatgtttacaagaaggaaatgttt

SEQ ID NO: 193987 - DNA, 27 bp, Artificial sequence
  SiRNA target sequence
cacatgtttacaagaaggaaatgttta

SEQ ID NO: 193988 - DNA, 27 bp, Artificial sequence
  SiRNA target sequence
acatgtttacaagaaggaaatgtttat

SEQ ID NO: 193989 - DNA, 27 bp, Artificial sequence
  SiRNA target sequence
catgtttacaagaaggaaatgtttata

SEQ ID NO: 193990 - DNA, 27 bp, Artificial sequence
  SiRNA target sequence
atgtttacaagaaggaaatgtttatat

SEQ ID NO: 193991 - DNA, 27 bp, Artificial sequence
  SiRNA target sequence
tgtttacaagaaggaaatgtttatatt

SEQ ID NO: 193992 - DNA, 27 bp, Artificial sequence
  SiRNA target sequence
gtttacaagaaggaaatgtttatattt

SEQ ID NO: 193993 - DNA, 27 bp, Artificial sequence
  SiRNA target sequence
tttacaagaaggaaatgtttatatttt

SEQ ID NO: 193994 - DNA, 27 bp, Artificial sequence
  SiRNA target sequence
ttacaagaaggaaatgtttatattttt

SEQ ID NO: 193995 - DNA, 27 bp, Artificial sequence
  SiRNA target sequence
tacaagaaggaaatgtttatatttttg

SEQ ID NO: 193996 - DNA, 27 bp, Artificial sequence
  SiRNA target sequence
acaagaaggaaatgtttatatttttga

SEQ ID NO: 193997 - DNA, 27 bp, Artificial sequence
  SiRNA target sequence
caagaaggaaatgtttatatttttgat

SEQ ID NO: 193998 - DNA, 27 bp, Artificial sequence
  SiRNA target sequence
aagaaggaaatgtttatatttttgatg

SEQ ID NO: 193999 - DNA, 27 bp, Artificial sequence
  SiRNA target sequence
agaaggaaatgtttatatttttgatga

SEQ ID NO: 194000 - DNA, 27 bp, Artificial sequence
  SiRNA target sequence
gaaggaaatgtttatatttttgatgaa

SEQ ID NO: 194001 - DNA, 27 bp, Artificial sequence
  SiRNA target sequence
aaggaaatgtttatatttttgatgaac

SEQ ID NO: 194002 - DNA, 27 bp, Artificial sequence
  SiRNA target sequence
aggaaatgtttatatttttgatgaacc

SEQ ID NO: 194003 - DNA, 27 bp, Artificial sequence
  SiRNA target sequence
ggaaatgtttatatttttgatgaaccc

SEQ ID NO: 194004 - DNA, 27 bp, Artificial sequence
  SiRNA target sequence
gaaatgtttatatttttgatgaaccca

SEQ ID NO: 194005 - DNA, 27 bp, Artificial sequence
  SiRNA target sequence
aaatgtttatatttttgatgaacccac

SEQ ID NO: 194006 - DNA, 27 bp, Artificial sequence
  SiRNA target sequence
aatgtttatatttttgatgaacccact

SEQ ID NO: 194007 - DNA, 27 bp, Artificial sequence
  SiRNA target sequence
atgtttatatttttgatgaacccacta

SEQ ID NO: 194008 - DNA, 27 bp, Artificial sequence
  SiRNA target sequence
tgtttatatttttgatgaacccactag

SEQ ID NO: 194009 - DNA, 27 bp, Artificial sequence
  SiRNA target sequence
gtttatatttttgatgaacccactagt

SEQ ID NO: 194010 - DNA, 27 bp, Artificial sequence
  SiRNA target sequence
tttatatttttgatgaacccactagtt

SEQ ID NO: 194011 - DNA, 27 bp, Artificial sequence
  SiRNA target sequence
ttatatttttgatgaacccactagttt

SEQ ID NO: 194012 - DNA, 27 bp, Artificial sequence
  SiRNA target sequence
tatatttttgatgaacccactagtttt

SEQ ID NO: 194013 - DNA, 27 bp, Artificial sequence
  SiRNA target sequence
atatttttgatgaacccactagttttt

SEQ ID NO: 194014 - DNA, 27 bp, Artificial sequence
  SiRNA target sequence
tatttttgatgaacccactagtttttt

SEQ ID NO: 194015 - DNA, 27 bp, Artificial sequence
  SiRNA target sequence
atttttgatgaacccactagttttttg

SEQ ID NO: 194016 - DNA, 27 bp, Artificial sequence
  SiRNA target sequence
tttttgatgaacccactagttttttgg

SEQ ID NO: 194017 - DNA, 27 bp, Artificial sequence
  SiRNA target sequence
ttttgatgaacccactagttttttgga

SEQ ID NO: 194018 - DNA, 27 bp, Artificial sequence
  SiRNA target sequence
tttgatgaacccactagttttttggat

SEQ ID NO: 194019 - DNA, 27 bp, Artificial sequence
  SiRNA target sequence
ttgatgaacccactagttttttggatg

SEQ ID NO: 194020 - DNA, 27 bp, Artificial sequence
  SiRNA target sequence
tgatgaacccactagttttttggatgt

SEQ ID NO: 194021 - DNA, 27 bp, Artificial sequence
  SiRNA target sequence
gatgaacccactagttttttggatgtt

SEQ ID NO: 194022 - DNA, 27 bp, Artificial sequence
  SiRNA target sequence
atgaacccactagttttttggatgtta

SEQ ID NO: 194023 - DNA, 27 bp, Artificial sequence
  SiRNA target sequence
tgaacccactagttttttggatgttaa

SEQ ID NO: 194024 - DNA, 27 bp, Artificial sequence
  SiRNA target sequence
gaacccactagttttttggatgttaag

SEQ ID NO: 194025 - DNA, 27 bp, Artificial sequence
  SiRNA target sequence
aacccactagttttttggatgttaagc

SEQ ID NO: 194026 - DNA, 27 bp, Artificial sequence
  SiRNA target sequence
acccactagttttttggatgttaagca

SEQ ID NO: 194027 - DNA, 27 bp, Artificial sequence
  SiRNA target sequence
cccactagttttttggatgttaagcag

SEQ ID NO: 194028 - DNA, 27 bp, Artificial sequence
  SiRNA target sequence
ccactagttttttggatgttaagcagc

SEQ ID NO: 194029 - DNA, 27 bp, Artificial sequence
  SiRNA target sequence
cactagttttttggatgttaagcagcg

SEQ ID NO: 194030 - DNA, 27 bp, Artificial sequence
  SiRNA target sequence
actagttttttggatgttaagcagcga

SEQ ID NO: 194031 - DNA, 27 bp, Artificial sequence
  SiRNA target sequence
ctagttttttggatgttaagcagcgac

SEQ ID NO: 194032 - DNA, 27 bp, Artificial sequence
  SiRNA target sequence
tagttttttggatgttaagcagcgact

SEQ ID NO: 194033 - DNA, 27 bp, Artificial sequence
  SiRNA target sequence
agttttttggatgttaagcagcgacta

SEQ ID NO: 194034 - DNA, 27 bp, Artificial sequence
  SiRNA target sequence
gttttttggatgttaagcagcgactag

SEQ ID NO: 194035 - DNA, 27 bp, Artificial sequence
  SiRNA target sequence
ttttttggatgttaagcagcgactagc

SEQ ID NO: 194036 - DNA, 27 bp, Artificial sequence
  SiRNA target sequence
tttttggatgttaagcagcgactagca

SEQ ID NO: 194037 - DNA, 27 bp, Artificial sequence
  SiRNA target sequence
ttttggatgttaagcagcgactagcag

SEQ ID NO: 194038 - DNA, 27 bp, Artificial sequence
  SiRNA target sequence
tttggatgttaagcagcgactagcagc

SEQ ID NO: 194039 - DNA, 27 bp, Artificial sequence
  SiRNA target sequence
ttggatgttaagcagcgactagcagct

SEQ ID NO: 194040 - DNA, 27 bp, Artificial sequence
  SiRNA target sequence
tggatgttaagcagcgactagcagctg

SEQ ID NO: 194041 - DNA, 27 bp, Artificial sequence
  SiRNA target sequence
ggatgttaagcagcgactagcagctgc

SEQ ID NO: 194042 - DNA, 27 bp, Artificial sequence
  SiRNA target sequence
gatgttaagcagcgactagcagctgct

SEQ ID NO: 194043 - DNA, 27 bp, Artificial sequence
  SiRNA target sequence
atgttaagcagcgactagcagctgcta

SEQ ID NO: 194044 - DNA, 27 bp, Artificial sequence
  SiRNA target sequence
tgttaagcagcgactagcagctgctaa

SEQ ID NO: 194045 - DNA, 27 bp, Artificial sequence
  SiRNA target sequence
gttaagcagcgactagcagctgctaag

SEQ ID NO: 194046 - DNA, 27 bp, Artificial sequence
  SiRNA target sequence
ttaagcagcgactagcagctgctaagg

SEQ ID NO: 194047 - DNA, 27 bp, Artificial sequence
  SiRNA target sequence
taagcagcgactagcagctgctaagga

SEQ ID NO: 194048 - DNA, 27 bp, Artificial sequence
  SiRNA target sequence
aagcagcgactagcagctgctaaggaa

SEQ ID NO: 194049 - DNA, 27 bp, Artificial sequence
  SiRNA target sequence
agcagcgactagcagctgctaaggaaa

SEQ ID NO: 194050 - DNA, 27 bp, Artificial sequence
  SiRNA target sequence
gcagcgactagcagctgctaaggaaat

SEQ ID NO: 194051 - DNA, 27 bp, Artificial sequence
  SiRNA target sequence
cagcgactagcagctgctaaggaaata

SEQ ID NO: 194052 - DNA, 27 bp, Artificial sequence
  SiRNA target sequence
agcgactagcagctgctaaggaaataa

SEQ ID NO: 194053 - DNA, 27 bp, Artificial sequence
  SiRNA target sequence
gcgactagcagctgctaaggaaataag

SEQ ID NO: 194054 - DNA, 27 bp, Artificial sequence
  SiRNA target sequence
cgactagcagctgctaaggaaataaga

SEQ ID NO: 194055 - DNA, 27 bp, Artificial sequence
  SiRNA target sequence
gactagcagctgctaaggaaataagaa

SEQ ID NO: 194056 - DNA, 27 bp, Artificial sequence
  SiRNA target sequence
actagcagctgctaaggaaataagaaa

SEQ ID NO: 194057 - DNA, 27 bp, Artificial sequence
  SiRNA target sequence
ctagcagctgctaaggaaataagaaat

SEQ ID NO: 194058 - DNA, 27 bp, Artificial sequence
  SiRNA target sequence
tagcagctgctaaggaaataagaaatt

SEQ ID NO: 194059 - DNA, 27 bp, Artificial sequence
  SiRNA target sequence
agcagctgctaaggaaataagaaattt

SEQ ID NO: 194060 - DNA, 27 bp, Artificial sequence
  SiRNA target sequence
gcagctgctaaggaaataagaaatttg

SEQ ID NO: 194061 - DNA, 27 bp, Artificial sequence
  SiRNA target sequence
cagctgctaaggaaataagaaatttgt

SEQ ID NO: 194062 - DNA, 27 bp, Artificial sequence
  SiRNA target sequence
agctgctaaggaaataagaaatttgtg

SEQ ID NO: 194063 - DNA, 27 bp, Artificial sequence
  SiRNA target sequence
gctgctaaggaaataagaaatttgtgt

SEQ ID NO: 194064 - DNA, 27 bp, Artificial sequence
  SiRNA target sequence
ctgctaaggaaataagaaatttgtgtg

SEQ ID NO: 194065 - DNA, 27 bp, Artificial sequence
  SiRNA target sequence
tgctaaggaaataagaaatttgtgtga

SEQ ID NO: 194066 - DNA, 27 bp, Artificial sequence
  SiRNA target sequence
gctaaggaaataagaaatttgtgtgaa

SEQ ID NO: 194067 - DNA, 27 bp, Artificial sequence
  SiRNA target sequence
ctaaggaaataagaaatttgtgtgaag

SEQ ID NO: 194068 - DNA, 27 bp, Artificial sequence
  SiRNA target sequence
taaggaaataagaaatttgtgtgaaga

SEQ ID NO: 194069 - DNA, 27 bp, Artificial sequence
  SiRNA target sequence
aaggaaataagaaatttgtgtgaagaa

SEQ ID NO: 194070 - DNA, 27 bp, Artificial sequence
  SiRNA target sequence
aggaaataagaaatttgtgtgaagaaa

SEQ ID NO: 194071 - DNA, 27 bp, Artificial sequence
  SiRNA target sequence
ggaaataagaaatttgtgtgaagaaaa

SEQ ID NO: 194072 - DNA, 27 bp, Artificial sequence
  SiRNA target sequence
gaaataagaaatttgtgtgaagaaaat

SEQ ID NO: 194073 - DNA, 27 bp, Artificial sequence
  SiRNA target sequence
aaataagaaatttgtgtgaagaaaata

SEQ ID NO: 194074 - DNA, 27 bp, Artificial sequence
  SiRNA target sequence
aataagaaatttgtgtgaagaaaataa

SEQ ID NO: 194075 - DNA, 27 bp, Artificial sequence
  SiRNA target sequence
ataagaaatttgtgtgaagaaaataaa

SEQ ID NO: 194076 - DNA, 27 bp, Artificial sequence
  SiRNA target sequence
taagaaatttgtgtgaagaaaataaat

SEQ ID NO: 194077 - DNA, 27 bp, Artificial sequence
  SiRNA target sequence
aagaaatttgtgtgaagaaaataaata

SEQ ID NO: 194078 - DNA, 27 bp, Artificial sequence
  SiRNA target sequence
agaaatttgtgtgaagaaaataaatat

SEQ ID NO: 194079 - DNA, 27 bp, Artificial sequence
  SiRNA target sequence
gaaatttgtgtgaagaaaataaatatg

SEQ ID NO: 194080 - DNA, 27 bp, Artificial sequence
  SiRNA target sequence
aaatttgtgtgaagaaaataaatatgt

SEQ ID NO: 194081 - DNA, 27 bp, Artificial sequence
  SiRNA target sequence
aatttgtgtgaagaaaataaatatgtt

SEQ ID NO: 194082 - DNA, 27 bp, Artificial sequence
  SiRNA target sequence
atttgtgtgaagaaaataaatatgttg

SEQ ID NO: 194083 - DNA, 27 bp, Artificial sequence
  SiRNA target sequence
tttgtgtgaagaaaataaatatgttgt

SEQ ID NO: 194084 - DNA, 27 bp, Artificial sequence
  SiRNA target sequence
ttgtgtgaagaaaataaatatgttgta

SEQ ID NO: 194085 - DNA, 27 bp, Artificial sequence
  SiRNA target sequence
tgtgtgaagaaaataaatatgttgtag

SEQ ID NO: 194086 - DNA, 27 bp, Artificial sequence
  SiRNA target sequence
gtgtgaagaaaataaatatgttgtagt

SEQ ID NO: 194087 - DNA, 27 bp, Artificial sequence
  SiRNA target sequence
tgtgaagaaaataaatatgttgtagtt

SEQ ID NO: 194088 - DNA, 27 bp, Artificial sequence
  SiRNA target sequence
gtgaagaaaataaatatgttgtagttg

SEQ ID NO: 194089 - DNA, 27 bp, Artificial sequence
  SiRNA target sequence
tgaagaaaataaatatgttgtagttgt

SEQ ID NO: 194090 - DNA, 27 bp, Artificial sequence
  SiRNA target sequence
gaagaaaataaatatgttgtagttgtc

SEQ ID NO: 194091 - DNA, 27 bp, Artificial sequence
  SiRNA target sequence
aagaaaataaatatgttgtagttgtcg

SEQ ID NO: 194092 - DNA, 27 bp, Artificial sequence
  SiRNA target sequence
agaaaataaatatgttgtagttgtcga

SEQ ID NO: 194093 - DNA, 27 bp, Artificial sequence
  SiRNA target sequence
gaaaataaatatgttgtagttgtcgaa

SEQ ID NO: 194094 - DNA, 27 bp, Artificial sequence
  SiRNA target sequence
aaaataaatatgttgtagttgtcgaac

SEQ ID NO: 194095 - DNA, 27 bp, Artificial sequence
  SiRNA target sequence
aaataaatatgttgtagttgtcgaaca

SEQ ID NO: 194096 - DNA, 27 bp, Artificial sequence
  SiRNA target sequence
aataaatatgttgtagttgtcgaacac

SEQ ID NO: 194097 - DNA, 27 bp, Artificial sequence
  SiRNA target sequence
ataaatatgttgtagttgtcgaacacg

SEQ ID NO: 194098 - DNA, 27 bp, Artificial sequence
  SiRNA target sequence
taaatatgttgtagttgtcgaacacga

SEQ ID NO: 194099 - DNA, 27 bp, Artificial sequence
  SiRNA target sequence
aaatatgttgtagttgtcgaacacgat

SEQ ID NO: 194100 - DNA, 27 bp, Artificial sequence
  SiRNA target sequence
aatatgttgtagttgtcgaacacgatt

SEQ ID NO: 194101 - DNA, 27 bp, Artificial sequence
  SiRNA target sequence
atatgttgtagttgtcgaacacgattt

SEQ ID NO: 194102 - DNA, 27 bp, Artificial sequence
  SiRNA target sequence
tatgttgtagttgtcgaacacgattta

SEQ ID NO: 194103 - DNA, 27 bp, Artificial sequence
  SiRNA target sequence
atgttgtagttgtcgaacacgatttag

SEQ ID NO: 194104 - DNA, 27 bp, Artificial sequence
  SiRNA target sequence
tgttgtagttgtcgaacacgatttagc

SEQ ID NO: 194105 - DNA, 27 bp, Artificial sequence
  SiRNA target sequence
gttgtagttgtcgaacacgatttagcc

SEQ ID NO: 194106 - DNA, 27 bp, Artificial sequence
  SiRNA target sequence
ttgtagttgtcgaacacgatttagcca

SEQ ID NO: 194107 - DNA, 27 bp, Artificial sequence
  SiRNA target sequence
tgtagttgtcgaacacgatttagccat

SEQ ID NO: 194108 - DNA, 27 bp, Artificial sequence
  SiRNA target sequence
gtagttgtcgaacacgatttagccatt

SEQ ID NO: 194109 - DNA, 27 bp, Artificial sequence
  SiRNA target sequence
tagttgtcgaacacgatttagccattt

SEQ ID NO: 194110 - DNA, 27 bp, Artificial sequence
  SiRNA target sequence
agttgtcgaacacgatttagccatttt

SEQ ID NO: 194111 - DNA, 27 bp, Artificial sequence
  SiRNA target sequence
gttgtcgaacacgatttagccatttta

SEQ ID NO: 194112 - DNA, 27 bp, Artificial sequence
  SiRNA target sequence
ttgtcgaacacgatttagccattttag

SEQ ID NO: 194113 - DNA, 27 bp, Artificial sequence
  SiRNA target sequence
tgtcgaacacgatttagccattttaga

SEQ ID NO: 194114 - DNA, 27 bp, Artificial sequence
  SiRNA target sequence
gtcgaacacgatttagccattttagat

SEQ ID NO: 194115 - DNA, 27 bp, Artificial sequence
  SiRNA target sequence
tcgaacacgatttagccattttagatt

SEQ ID NO: 194116 - DNA, 27 bp, Artificial sequence
  SiRNA target sequence
cgaacacgatttagccattttagattt

SEQ ID NO: 194117 - DNA, 27 bp, Artificial sequence
  SiRNA target sequence
gaacacgatttagccattttagatttg

SEQ ID NO: 194118 - DNA, 27 bp, Artificial sequence
  SiRNA target sequence
aacacgatttagccattttagatttga

SEQ ID NO: 194119 - DNA, 27 bp, Artificial sequence
  SiRNA target sequence
acacgatttagccattttagatttgat

SEQ ID NO: 194120 - DNA, 27 bp, Artificial sequence
  SiRNA target sequence
cacgatttagccattttagatttgatg

SEQ ID NO: 194121 - DNA, 27 bp, Artificial sequence
  SiRNA target sequence
acgatttagccattttagatttgatgt

SEQ ID NO: 194122 - DNA, 27 bp, Artificial sequence
  SiRNA target sequence
cgatttagccattttagatttgatgtg

SEQ ID NO: 194123 - DNA, 27 bp, Artificial sequence
  SiRNA target sequence
gatttagccattttagatttgatgtgt

SEQ ID NO: 194124 - DNA, 27 bp, Artificial sequence
  SiRNA target sequence
atttagccattttagatttgatgtgtg

SEQ ID NO: 194125 - DNA, 27 bp, Artificial sequence
  SiRNA target sequence
tttagccattttagatttgatgtgtga

SEQ ID NO: 194126 - DNA, 27 bp, Artificial sequence
  SiRNA target sequence
ttagccattttagatttgatgtgtgat

SEQ ID NO: 194127 - DNA, 27 bp, Artificial sequence
  SiRNA target sequence
tagccattttagatttgatgtgtgatt

SEQ ID NO: 194128 - DNA, 27 bp, Artificial sequence
  SiRNA target sequence
agccattttagatttgatgtgtgattt

SEQ ID NO: 194129 - DNA, 27 bp, Artificial sequence
  SiRNA target sequence
gccattttagatttgatgtgtgatttt

SEQ ID NO: 194130 - DNA, 27 bp, Artificial sequence
  SiRNA target sequence
ccattttagatttgatgtgtgattttg

SEQ ID NO: 194131 - DNA, 27 bp, Artificial sequence
  SiRNA target sequence
cattttagatttgatgtgtgattttgg

SEQ ID NO: 194132 - DNA, 27 bp, Artificial sequence
  SiRNA target sequence
attttagatttgatgtgtgattttgga

SEQ ID NO: 194133 - DNA, 27 bp, Artificial sequence
  SiRNA target sequence
ttttagatttgatgtgtgattttggat

SEQ ID NO: 194134 - DNA, 27 bp, Artificial sequence
  SiRNA target sequence
tttagatttgatgtgtgattttggatg

SEQ ID NO: 194135 - DNA, 27 bp, Artificial sequence
  SiRNA target sequence
ttagatttgatgtgtgattttggatgt

SEQ ID NO: 194136 - DNA, 27 bp, Artificial sequence
  SiRNA target sequence
tagatttgatgtgtgattttggatgtg

SEQ ID NO: 194137 - DNA, 27 bp, Artificial sequence
  SiRNA target sequence
agatttgatgtgtgattttggatgtgt

SEQ ID NO: 194138 - DNA, 27 bp, Artificial sequence
  SiRNA target sequence
gatttgatgtgtgattttggatgtgtt

SEQ ID NO: 194139 - DNA, 27 bp, Artificial sequence
  SiRNA target sequence
atttgatgtgtgattttggatgtgttc

SEQ ID NO: 194140 - DNA, 27 bp, Artificial sequence
  SiRNA target sequence
tttgatgtgtgattttggatgtgttct

SEQ ID NO: 194141 - DNA, 27 bp, Artificial sequence
  SiRNA target sequence
ttgatgtgtgattttggatgtgttcta

SEQ ID NO: 194142 - DNA, 27 bp, Artificial sequence
  SiRNA target sequence
tgatgtgtgattttggatgtgttctat

SEQ ID NO: 194143 - DNA, 27 bp, Artificial sequence
  SiRNA target sequence
gatgtgtgattttggatgtgttctata

SEQ ID NO: 194144 - DNA, 27 bp, Artificial sequence
  SiRNA target sequence
atgtgtgattttggatgtgttctatac

SEQ ID NO: 194145 - DNA, 27 bp, Artificial sequence
  SiRNA target sequence
tgtgtgattttggatgtgttctatacg

SEQ ID NO: 194146 - DNA, 27 bp, Artificial sequence
  SiRNA target sequence
gtgtgattttggatgtgttctatacgg

SEQ ID NO: 194147 - DNA, 27 bp, Artificial sequence
  SiRNA target sequence
tgtgattttggatgtgttctatacgga

SEQ ID NO: 194148 - DNA, 27 bp, Artificial sequence
  SiRNA target sequence
gtgattttggatgtgttctatacggac

SEQ ID NO: 194149 - DNA, 27 bp, Artificial sequence
  SiRNA target sequence
tgattttggatgtgttctatacggaca

SEQ ID NO: 194150 - DNA, 27 bp, Artificial sequence
  SiRNA target sequence
gattttggatgtgttctatacggacaa

SEQ ID NO: 194151 - DNA, 27 bp, Artificial sequence
  SiRNA target sequence
attttggatgtgttctatacggacaat

SEQ ID NO: 194152 - DNA, 27 bp, Artificial sequence
  SiRNA target sequence
ttttggatgtgttctatacggacaatc

SEQ ID NO: 194153 - DNA, 27 bp, Artificial sequence
  SiRNA target sequence
tttggatgtgttctatacggacaatct

SEQ ID NO: 194154 - DNA, 27 bp, Artificial sequence
  SiRNA target sequence
ttggatgtgttctatacggacaatctg

SEQ ID NO: 194155 - DNA, 27 bp, Artificial sequence
  SiRNA target sequence
tggatgtgttctatacggacaatctgg

SEQ ID NO: 194156 - DNA, 27 bp, Artificial sequence
  SiRNA target sequence
ggatgtgttctatacggacaatctggg

SEQ ID NO: 194157 - DNA, 27 bp, Artificial sequence
  SiRNA target sequence
gatgtgttctatacggacaatctgggg

SEQ ID NO: 194158 - DNA, 27 bp, Artificial sequence
  SiRNA target sequence
atgtgttctatacggacaatctggggc

SEQ ID NO: 194159 - DNA, 27 bp, Artificial sequence
  SiRNA target sequence
tgtgttctatacggacaatctggggca

SEQ ID NO: 194160 - DNA, 27 bp, Artificial sequence
  SiRNA target sequence
gtgttctatacggacaatctggggcat

SEQ ID NO: 194161 - DNA, 27 bp, Artificial sequence
  SiRNA target sequence
tgttctatacggacaatctggggcata

SEQ ID NO: 194162 - DNA, 27 bp, Artificial sequence
  SiRNA target sequence
gttctatacggacaatctggggcatac

SEQ ID NO: 194163 - DNA, 27 bp, Artificial sequence
  SiRNA target sequence
ttctatacggacaatctggggcatacg

SEQ ID NO: 194164 - DNA, 27 bp, Artificial sequence
  SiRNA target sequence
tctatacggacaatctggggcatacgg

SEQ ID NO: 194165 - DNA, 27 bp, Artificial sequence
  SiRNA target sequence
ctatacggacaatctggggcatacggt

SEQ ID NO: 194166 - DNA, 27 bp, Artificial sequence
  SiRNA target sequence
tatacggacaatctggggcatacggtg

SEQ ID NO: 194167 - DNA, 27 bp, Artificial sequence
  SiRNA target sequence
atacggacaatctggggcatacggtgt

SEQ ID NO: 194168 - DNA, 27 bp, Artificial sequence
  SiRNA target sequence
tacggacaatctggggcatacggtgta

SEQ ID NO: 194169 - DNA, 27 bp, Artificial sequence
  SiRNA target sequence
acggacaatctggggcatacggtgtaa

SEQ ID NO: 194170 - DNA, 27 bp, Artificial sequence
  SiRNA target sequence
cggacaatctggggcatacggtgtaat

SEQ ID NO: 194171 - DNA, 27 bp, Artificial sequence
  SiRNA target sequence
ggacaatctggggcatacggtgtaata

SEQ ID NO: 194172 - DNA, 27 bp, Artificial sequence
  SiRNA target sequence
gacaatctggggcatacggtgtaataa

SEQ ID NO: 194173 - DNA, 27 bp, Artificial sequence
  SiRNA target sequence
acaatctggggcatacggtgtaataag

SEQ ID NO: 194174 - DNA, 27 bp, Artificial sequence
  SiRNA target sequence
caatctggggcatacggtgtaataagc

SEQ ID NO: 194175 - DNA, 27 bp, Artificial sequence
  SiRNA target sequence
aatctggggcatacggtgtaataagcg

SEQ ID NO: 194176 - DNA, 27 bp, Artificial sequence
  SiRNA target sequence
atctggggcatacggtgtaataagcgc

SEQ ID NO: 194177 - DNA, 27 bp, Artificial sequence
  SiRNA target sequence
tctggggcatacggtgtaataagcgca

SEQ ID NO: 194178 - DNA, 27 bp, Artificial sequence
  SiRNA target sequence
ctggggcatacggtgtaataagcgcac

SEQ ID NO: 194179 - DNA, 27 bp, Artificial sequence
  SiRNA target sequence
tggggcatacggtgtaataagcgcacc

SEQ ID NO: 194180 - DNA, 27 bp, Artificial sequence
  SiRNA target sequence
ggggcatacggtgtaataagcgcacca

SEQ ID NO: 194181 - DNA, 27 bp, Artificial sequence
  SiRNA target sequence
gggcatacggtgtaataagcgcaccat

SEQ ID NO: 194182 - DNA, 27 bp, Artificial sequence
  SiRNA target sequence
ggcatacggtgtaataagcgcaccata

SEQ ID NO: 194183 - DNA, 27 bp, Artificial sequence
  SiRNA target sequence
gcatacggtgtaataagcgcaccatac

SEQ ID NO: 194184 - DNA, 27 bp, Artificial sequence
  SiRNA target sequence
catacggtgtaataagcgcaccatacg

SEQ ID NO: 194185 - DNA, 27 bp, Artificial sequence
  SiRNA target sequence
atacggtgtaataagcgcaccatacgt

SEQ ID NO: 194186 - DNA, 27 bp, Artificial sequence
  SiRNA target sequence
tacggtgtaataagcgcaccatacgtt

SEQ ID NO: 194187 - DNA, 27 bp, Artificial sequence
  SiRNA target sequence
acggtgtaataagcgcaccatacgtta

SEQ ID NO: 194188 - DNA, 27 bp, Artificial sequence
  SiRNA target sequence
cggtgtaataagcgcaccatacgttat

SEQ ID NO: 194189 - DNA, 27 bp, Artificial sequence
  SiRNA target sequence
ggtgtaataagcgcaccatacgttatt

SEQ ID NO: 194190 - DNA, 27 bp, Artificial sequence
  SiRNA target sequence
gtgtaataagcgcaccatacgttatta

SEQ ID NO: 194191 - DNA, 27 bp, Artificial sequence
  SiRNA target sequence
tgtaataagcgcaccatacgttattaa

SEQ ID NO: 194192 - DNA, 27 bp, Artificial sequence
  SiRNA target sequence
gtaataagcgcaccatacgttattaaa

SEQ ID NO: 194193 - DNA, 27 bp, Artificial sequence
  SiRNA target sequence
taataagcgcaccatacgttattaaat

SEQ ID NO: 194194 - DNA, 27 bp, Artificial sequence
  SiRNA target sequence
aataagcgcaccatacgttattaaatc

SEQ ID NO: 194195 - DNA, 27 bp, Artificial sequence
  SiRNA target sequence
ataagcgcaccatacgttattaaatca

SEQ ID NO: 194196 - DNA, 27 bp, Artificial sequence
  SiRNA target sequence
taagcgcaccatacgttattaaatcag

SEQ ID NO: 194197 - DNA, 27 bp, Artificial sequence
  SiRNA target sequence
aagcgcaccatacgttattaaatcagc

SEQ ID NO: 194198 - DNA, 27 bp, Artificial sequence
  SiRNA target sequence
agcgcaccatacgttattaaatcagca

SEQ ID NO: 194199 - DNA, 27 bp, Artificial sequence
  SiRNA target sequence
gcgcaccatacgttattaaatcagcaa

SEQ ID NO: 194200 - DNA, 27 bp, Artificial sequence
  SiRNA target sequence
cgcaccatacgttattaaatcagcaat

SEQ ID NO: 194201 - DNA, 27 bp, Artificial sequence
  SiRNA target sequence
gcaccatacgttattaaatcagcaata

SEQ ID NO: 194202 - DNA, 27 bp, Artificial sequence
  SiRNA target sequence
caccatacgttattaaatcagcaataa

SEQ ID NO: 194203 - DNA, 27 bp, Artificial sequence
  SiRNA target sequence
accatacgttattaaatcagcaataaa

SEQ ID NO: 194204 - DNA, 27 bp, Artificial sequence
  SiRNA target sequence
ccatacgttattaaatcagcaataaat

SEQ ID NO: 194205 - DNA, 27 bp, Artificial sequence
  SiRNA target sequence
catacgttattaaatcagcaataaata

SEQ ID NO: 194206 - DNA, 27 bp, Artificial sequence
  SiRNA target sequence
atacgttattaaatcagcaataaatat

SEQ ID NO: 194207 - DNA, 27 bp, Artificial sequence
  SiRNA target sequence
tacgttattaaatcagcaataaatata

SEQ ID NO: 194208 - DNA, 27 bp, Artificial sequence
  SiRNA target sequence
acgttattaaatcagcaataaatatat

SEQ ID NO: 194209 - DNA, 27 bp, Artificial sequence
  SiRNA target sequence
cgttattaaatcagcaataaatatatt

SEQ ID NO: 194210 - DNA, 27 bp, Artificial sequence
  SiRNA target sequence
gttattaaatcagcaataaatatattt

SEQ ID NO: 194211 - DNA, 27 bp, Artificial sequence
  SiRNA target sequence
ttattaaatcagcaataaatatatttc

SEQ ID NO: 194212 - DNA, 27 bp, Artificial sequence
  SiRNA target sequence
tattaaatcagcaataaatatatttct

SEQ ID NO: 194213 - DNA, 27 bp, Artificial sequence
  SiRNA target sequence
attaaatcagcaataaatatatttctt

SEQ ID NO: 194214 - DNA, 27 bp, Artificial sequence
  SiRNA target sequence
ttaaatcagcaataaatatatttcttg

SEQ ID NO: 194215 - DNA, 27 bp, Artificial sequence
  SiRNA target sequence
taaatcagcaataaatatatttcttga

SEQ ID NO: 194216 - DNA, 27 bp, Artificial sequence
  SiRNA target sequence
aaatcagcaataaatatatttcttgat

SEQ ID NO: 194217 - DNA, 27 bp, Artificial sequence
  SiRNA target sequence
aatcagcaataaatatatttcttgatg

SEQ ID NO: 194218 - DNA, 27 bp, Artificial sequence
  SiRNA target sequence
atcagcaataaatatatttcttgatgg

SEQ ID NO: 194219 - DNA, 27 bp, Artificial sequence
  SiRNA target sequence
tcagcaataaatatatttcttgatgga

SEQ ID NO: 194220 - DNA, 27 bp, Artificial sequence
  SiRNA target sequence
cagcaataaatatatttcttgatggat

SEQ ID NO: 194221 - DNA, 27 bp, Artificial sequence
  SiRNA target sequence
agcaataaatatatttcttgatggatt

SEQ ID NO: 194222 - DNA, 27 bp, Artificial sequence
  SiRNA target sequence
gcaataaatatatttcttgatggattt

SEQ ID NO: 194223 - DNA, 27 bp, Artificial sequence
  SiRNA target sequence
caataaatatatttcttgatggatttt

SEQ ID NO: 194224 - DNA, 27 bp, Artificial sequence
  SiRNA target sequence
aataaatatatttcttgatggattttt

SEQ ID NO: 194225 - DNA, 27 bp, Artificial sequence
  SiRNA target sequence
ataaatatatttcttgatggatttttg

SEQ ID NO: 194226 - DNA, 27 bp, Artificial sequence
  SiRNA target sequence
taaatatatttcttgatggatttttgc

SEQ ID NO: 194227 - DNA, 27 bp, Artificial sequence
  SiRNA target sequence
aaatatatttcttgatggatttttgcc

SEQ ID NO: 194228 - DNA, 27 bp, Artificial sequence
  SiRNA target sequence
aatatatttcttgatggatttttgcct

SEQ ID NO: 194229 - DNA, 27 bp, Artificial sequence
  SiRNA target sequence
atatatttcttgatggatttttgccta

SEQ ID NO: 194230 - DNA, 27 bp, Artificial sequence
  SiRNA target sequence
tatatttcttgatggatttttgcctac

SEQ ID NO: 194231 - DNA, 27 bp, Artificial sequence
  SiRNA target sequence
atatttcttgatggatttttgcctaca

SEQ ID NO: 194232 - DNA, 27 bp, Artificial sequence
  SiRNA target sequence
tatttcttgatggatttttgcctacag

SEQ ID NO: 194233 - DNA, 27 bp, Artificial sequence
  SiRNA target sequence
atttcttgatggatttttgcctacaga

SEQ ID NO: 194234 - DNA, 27 bp, Artificial sequence
  SiRNA target sequence
tttcttgatggatttttgcctacagaa

SEQ ID NO: 194235 - DNA, 27 bp, Artificial sequence
  SiRNA target sequence
ttcttgatggatttttgcctacagaaa

SEQ ID NO: 194236 - DNA, 27 bp, Artificial sequence
  SiRNA target sequence
tcttgatggatttttgcctacagaaaa

SEQ ID NO: 194237 - DNA, 27 bp, Artificial sequence
  SiRNA target sequence
cttgatggatttttgcctacagaaaac

SEQ ID NO: 194238 - DNA, 27 bp, Artificial sequence
  SiRNA target sequence
ttgatggatttttgcctacagaaaaca

SEQ ID NO: 194239 - DNA, 27 bp, Artificial sequence
  SiRNA target sequence
tgatggatttttgcctacagaaaacat

SEQ ID NO: 194240 - DNA, 27 bp, Artificial sequence
  SiRNA target sequence
gatggatttttgcctacagaaaacatg

SEQ ID NO: 194241 - DNA, 27 bp, Artificial sequence
  SiRNA target sequence
atggatttttgcctacagaaaacatga

SEQ ID NO: 194242 - DNA, 27 bp, Artificial sequence
  SiRNA target sequence
tggatttttgcctacagaaaacatgaa

SEQ ID NO: 194243 - DNA, 27 bp, Artificial sequence
  SiRNA target sequence
ggatttttgcctacagaaaacatgaaa

SEQ ID NO: 194244 - DNA, 27 bp, Artificial sequence
  SiRNA target sequence
gatttttgcctacagaaaacatgaaat

SEQ ID NO: 194245 - DNA, 27 bp, Artificial sequence
  SiRNA target sequence
atttttgcctacagaaaacatgaaatt

SEQ ID NO: 194246 - DNA, 27 bp, Artificial sequence
  SiRNA target sequence
tttttgcctacagaaaacatgaaattt

SEQ ID NO: 194247 - DNA, 27 bp, Artificial sequence
  SiRNA target sequence
ttttgcctacagaaaacatgaaattta

SEQ ID NO: 194248 - DNA, 27 bp, Artificial sequence
  SiRNA target sequence
tttgcctacagaaaacatgaaatttag

SEQ ID NO: 194249 - DNA, 27 bp, Artificial sequence
  SiRNA target sequence
ttgcctacagaaaacatgaaatttaga

SEQ ID NO: 194250 - DNA, 27 bp, Artificial sequence
  SiRNA target sequence
tgcctacagaaaacatgaaatttagaa

SEQ ID NO: 194251 - DNA, 27 bp, Artificial sequence
  SiRNA target sequence
gcctacagaaaacatgaaatttagaaa

SEQ ID NO: 194252 - DNA, 27 bp, Artificial sequence
  SiRNA target sequence
cctacagaaaacatgaaatttagaaat

SEQ ID NO: 194253 - DNA, 27 bp, Artificial sequence
  SiRNA target sequence
ctacagaaaacatgaaatttagaaatt

SEQ ID NO: 194254 - DNA, 27 bp, Artificial sequence
  SiRNA target sequence
tacagaaaacatgaaatttagaaattc

SEQ ID NO: 194255 - DNA, 27 bp, Artificial sequence
  SiRNA target sequence
acagaaaacatgaaatttagaaattca

SEQ ID NO: 194256 - DNA, 27 bp, Artificial sequence
  SiRNA target sequence
cagaaaacatgaaatttagaaattcag

SEQ ID NO: 194257 - DNA, 27 bp, Artificial sequence
  SiRNA target sequence
agaaaacatgaaatttagaaattcaga

SEQ ID NO: 194258 - DNA, 27 bp, Artificial sequence
  SiRNA target sequence
gaaaacatgaaatttagaaattcagag

SEQ ID NO: 194259 - DNA, 27 bp, Artificial sequence
  SiRNA target sequence
aaaacatgaaatttagaaattcagagt

SEQ ID NO: 194260 - DNA, 27 bp, Artificial sequence
  SiRNA target sequence
aaacatgaaatttagaaattcagagtt

SEQ ID NO: 194261 - DNA, 27 bp, Artificial sequence
  SiRNA target sequence
aacatgaaatttagaaattcagagtta

SEQ ID NO: 194262 - DNA, 27 bp, Artificial sequence
  SiRNA target sequence
acatgaaatttagaaattcagagttaa

SEQ ID NO: 194263 - DNA, 27 bp, Artificial sequence
  SiRNA target sequence
catgaaatttagaaattcagagttaaa

SEQ ID NO: 194264 - DNA, 27 bp, Artificial sequence
  SiRNA target sequence
atgaaatttagaaattcagagttaaag

SEQ ID NO: 194265 - DNA, 27 bp, Artificial sequence
  SiRNA target sequence
tgaaatttagaaattcagagttaaagt

SEQ ID NO: 194266 - DNA, 27 bp, Artificial sequence
  SiRNA target sequence
gaaatttagaaattcagagttaaagtt

SEQ ID NO: 194267 - DNA, 27 bp, Artificial sequence
  SiRNA target sequence
aaatttagaaattcagagttaaagttt

SEQ ID NO: 194268 - DNA, 27 bp, Artificial sequence
  SiRNA target sequence
aatttagaaattcagagttaaagttta

SEQ ID NO: 194269 - DNA, 27 bp, Artificial sequence
  SiRNA target sequence
atttagaaattcagagttaaagtttaa

SEQ ID NO: 194270 - DNA, 27 bp, Artificial sequence
  SiRNA target sequence
tttagaaattcagagttaaagtttaat

SEQ ID NO: 194271 - DNA, 27 bp, Artificial sequence
  SiRNA target sequence
ttagaaattcagagttaaagtttaata

SEQ ID NO: 194272 - DNA, 27 bp, Artificial sequence
  SiRNA target sequence
tagaaattcagagttaaagtttaatat

SEQ ID NO: 194273 - DNA, 27 bp, Artificial sequence
  SiRNA target sequence
agaaattcagagttaaagtttaatatt

SEQ ID NO: 194274 - DNA, 27 bp, Artificial sequence
  SiRNA target sequence
gaaattcagagttaaagtttaatattt

SEQ ID NO: 194275 - DNA, 27 bp, Artificial sequence
  SiRNA target sequence
aaattcagagttaaagtttaatatttc

SEQ ID NO: 194276 - DNA, 27 bp, Artificial sequence
  SiRNA target sequence
aattcagagttaaagtttaatatttcg

SEQ ID NO: 194277 - DNA, 27 bp, Artificial sequence
  SiRNA target sequence
attcagagttaaagtttaatatttcgg

SEQ ID NO: 194278 - DNA, 27 bp, Artificial sequence
  SiRNA target sequence
ttcagagttaaagtttaatatttcgga

SEQ ID NO: 194279 - DNA, 27 bp, Artificial sequence
  SiRNA target sequence
tcagagttaaagtttaatatttcggaa

SEQ ID NO: 194280 - DNA, 27 bp, Artificial sequence
  SiRNA target sequence
cagagttaaagtttaatatttcggaaa

SEQ ID NO: 194281 - DNA, 27 bp, Artificial sequence
  SiRNA target sequence
agagttaaagtttaatatttcggaaac

SEQ ID NO: 194282 - DNA, 27 bp, Artificial sequence
  SiRNA target sequence
gagttaaagtttaatatttcggaaaca

SEQ ID NO: 194283 - DNA, 27 bp, Artificial sequence
  SiRNA target sequence
agttaaagtttaatatttcggaaacac

SEQ ID NO: 194284 - DNA, 27 bp, Artificial sequence
  SiRNA target sequence
gttaaagtttaatatttcggaaacact

SEQ ID NO: 194285 - DNA, 27 bp, Artificial sequence
  SiRNA target sequence
ttaaagtttaatatttcggaaacactt

SEQ ID NO: 194286 - DNA, 27 bp, Artificial sequence
  SiRNA target sequence
taaagtttaatatttcggaaacacttg

SEQ ID NO: 194287 - DNA, 27 bp, Artificial sequence
  SiRNA target sequence
aaagtttaatatttcggaaacacttga

SEQ ID NO: 194288 - DNA, 27 bp, Artificial sequence
  SiRNA target sequence
aagtttaatatttcggaaacacttgat

SEQ ID NO: 194289 - DNA, 27 bp, Artificial sequence
  SiRNA target sequence
agtttaatatttcggaaacacttgata

SEQ ID NO: 194290 - DNA, 27 bp, Artificial sequence
  SiRNA target sequence
gtttaatatttcggaaacacttgatag

SEQ ID NO: 194291 - DNA, 27 bp, Artificial sequence
  SiRNA target sequence
tttaatatttcggaaacacttgatagt

SEQ ID NO: 194292 - DNA, 27 bp, Artificial sequence
  SiRNA target sequence
ttaatatttcggaaacacttgatagta

SEQ ID NO: 194293 - DNA, 27 bp, Artificial sequence
  SiRNA target sequence
taatatttcggaaacacttgatagtat

SEQ ID NO: 194294 - DNA, 27 bp, Artificial sequence
  SiRNA target sequence
aatatttcggaaacacttgatagtatt

SEQ ID NO: 194295 - DNA, 27 bp, Artificial sequence
  SiRNA target sequence
atatttcggaaacacttgatagtatta

SEQ ID NO: 194296 - DNA, 27 bp, Artificial sequence
  SiRNA target sequence
tatttcggaaacacttgatagtattat

SEQ ID NO: 194297 - DNA, 27 bp, Artificial sequence
  SiRNA target sequence
atttcggaaacacttgatagtattata

SEQ ID NO: 194298 - DNA, 27 bp, Artificial sequence
  SiRNA target sequence
tttcggaaacacttgatagtattatat

SEQ ID NO: 194299 - DNA, 27 bp, Artificial sequence
  SiRNA target sequence
ttcggaaacacttgatagtattatatc

SEQ ID NO: 194300 - DNA, 27 bp, Artificial sequence
  SiRNA target sequence
tcggaaacacttgatagtattatatct

SEQ ID NO: 194301 - DNA, 27 bp, Artificial sequence
  SiRNA target sequence
cggaaacacttgatagtattatatcta

SEQ ID NO: 194302 - DNA, 27 bp, Artificial sequence
  SiRNA target sequence
ggaaacacttgatagtattatatctac

SEQ ID NO: 194303 - DNA, 27 bp, Artificial sequence
  SiRNA target sequence
gaaacacttgatagtattatatctacc

SEQ ID NO: 194304 - DNA, 27 bp, Artificial sequence
  SiRNA target sequence
aaacacttgatagtattatatctacca

SEQ ID NO: 194305 - DNA, 27 bp, Artificial sequence
  SiRNA target sequence
aacacttgatagtattatatctaccag

SEQ ID NO: 194306 - DNA, 27 bp, Artificial sequence
  SiRNA target sequence
acacttgatagtattatatctaccaga

SEQ ID NO: 194307 - DNA, 27 bp, Artificial sequence
  SiRNA target sequence
cacttgatagtattatatctaccagag

SEQ ID NO: 194308 - DNA, 27 bp, Artificial sequence
  SiRNA target sequence
acttgatagtattatatctaccagaga

SEQ ID NO: 194309 - DNA, 27 bp, Artificial sequence
  SiRNA target sequence
cttgatagtattatatctaccagagac

SEQ ID NO: 194310 - DNA, 27 bp, Artificial sequence
  SiRNA target sequence
ttgatagtattatatctaccagagacc

SEQ ID NO: 194311 - DNA, 27 bp, Artificial sequence
  SiRNA target sequence
tgatagtattatatctaccagagacca

SEQ ID NO: 194312 - DNA, 27 bp, Artificial sequence
  SiRNA target sequence
gatagtattatatctaccagagaccag

SEQ ID NO: 194313 - DNA, 27 bp, Artificial sequence
  SiRNA target sequence
atagtattatatctaccagagaccagt

SEQ ID NO: 194314 - DNA, 27 bp, Artificial sequence
  SiRNA target sequence
tagtattatatctaccagagaccagta

SEQ ID NO: 194315 - DNA, 27 bp, Artificial sequence
  SiRNA target sequence
agtattatatctaccagagaccagtat

SEQ ID NO: 194316 - DNA, 27 bp, Artificial sequence
  SiRNA target sequence
gtattatatctaccagagaccagtatc

SEQ ID NO: 194317 - DNA, 27 bp, Artificial sequence
  SiRNA target sequence
tattatatctaccagagaccagtatca

SEQ ID NO: 194318 - DNA, 27 bp, Artificial sequence
  SiRNA target sequence
attatatctaccagagaccagtatcat

SEQ ID NO: 194319 - DNA, 27 bp, Artificial sequence
  SiRNA target sequence
ttatatctaccagagaccagtatcatt

SEQ ID NO: 194320 - DNA, 27 bp, Artificial sequence
  SiRNA target sequence
tatatctaccagagaccagtatcatta

SEQ ID NO: 194321 - DNA, 27 bp, Artificial sequence
  SiRNA target sequence
atatctaccagagaccagtatcattat

SEQ ID NO: 194322 - DNA, 27 bp, Artificial sequence
  SiRNA target sequence
tatctaccagagaccagtatcattatc

SEQ ID NO: 194323 - DNA, 27 bp, Artificial sequence
  SiRNA target sequence
atctaccagagaccagtatcattatcc

SEQ ID NO: 194324 - DNA, 27 bp, Artificial sequence
  SiRNA target sequence
tctaccagagaccagtatcattatccc

SEQ ID NO: 194325 - DNA, 27 bp, Artificial sequence
  SiRNA target sequence
ctaccagagaccagtatcattatccca

SEQ ID NO: 194326 - DNA, 27 bp, Artificial sequence
  SiRNA target sequence
taccagagaccagtatcattatcccaa

SEQ ID NO: 194327 - DNA, 27 bp, Artificial sequence
  SiRNA target sequence
accagagaccagtatcattatcccaat

SEQ ID NO: 194328 - DNA, 27 bp, Artificial sequence
  SiRNA target sequence
ccagagaccagtatcattatcccaatt

SEQ ID NO: 194329 - DNA, 27 bp, Artificial sequence
  SiRNA target sequence
cagagaccagtatcattatcccaattt

SEQ ID NO: 194330 - DNA, 27 bp, Artificial sequence
  SiRNA target sequence
agagaccagtatcattatcccaatttg

SEQ ID NO: 194331 - DNA, 27 bp, Artificial sequence
  SiRNA target sequence
gagaccagtatcattatcccaatttga

SEQ ID NO: 194332 - DNA, 27 bp, Artificial sequence
  SiRNA target sequence
agaccagtatcattatcccaatttgat

SEQ ID NO: 194333 - DNA, 27 bp, Artificial sequence
  SiRNA target sequence
gaccagtatcattatcccaatttgata

SEQ ID NO: 194334 - DNA, 27 bp, Artificial sequence
  SiRNA target sequence
accagtatcattatcccaatttgataa

SEQ ID NO: 194335 - DNA, 27 bp, Artificial sequence
  SiRNA target sequence
ccagtatcattatcccaatttgataaa

SEQ ID NO: 194336 - DNA, 27 bp, Artificial sequence
  SiRNA target sequence
cagtatcattatcccaatttgataaaa

SEQ ID NO: 194337 - DNA, 27 bp, Artificial sequence
  SiRNA target sequence
agtatcattatcccaatttgataaaaa

SEQ ID NO: 194338 - DNA, 27 bp, Artificial sequence
  SiRNA target sequence
gtatcattatcccaatttgataaaaac

SEQ ID NO: 194339 - DNA, 27 bp, Artificial sequence
  SiRNA target sequence
tatcattatcccaatttgataaaaaca

SEQ ID NO: 194340 - DNA, 27 bp, Artificial sequence
  SiRNA target sequence
atcattatcccaatttgataaaaacat

SEQ ID NO: 194341 - DNA, 27 bp, Artificial sequence
  SiRNA target sequence
tcattatcccaatttgataaaaacata

SEQ ID NO: 194342 - DNA, 27 bp, Artificial sequence
  SiRNA target sequence
cattatcccaatttgataaaaacatat

SEQ ID NO: 194343 - DNA, 27 bp, Artificial sequence
  SiRNA target sequence
attatcccaatttgataaaaacatatc

SEQ ID NO: 194344 - DNA, 27 bp, Artificial sequence
  SiRNA target sequence
ttatcccaatttgataaaaacatatcc

SEQ ID NO: 194345 - DNA, 27 bp, Artificial sequence
  SiRNA target sequence
tatcccaatttgataaaaacatatcca

SEQ ID NO: 194346 - DNA, 27 bp, Artificial sequence
  SiRNA target sequence
atcccaatttgataaaaacatatccaa

SEQ ID NO: 194347 - DNA, 27 bp, Artificial sequence
  SiRNA target sequence
tcccaatttgataaaaacatatccaaa

SEQ ID NO: 194348 - DNA, 27 bp, Artificial sequence
  SiRNA target sequence
cccaatttgataaaaacatatccaaat

SEQ ID NO: 194349 - DNA, 27 bp, Artificial sequence
  SiRNA target sequence
ccaatttgataaaaacatatccaaatt

SEQ ID NO: 194350 - DNA, 27 bp, Artificial sequence
  SiRNA target sequence
caatttgataaaaacatatccaaattt

SEQ ID NO: 194351 - DNA, 27 bp, Artificial sequence
  SiRNA target sequence
aatttgataaaaacatatccaaatttt

SEQ ID NO: 194352 - DNA, 27 bp, Artificial sequence
  SiRNA target sequence
atttgataaaaacatatccaaatttta

SEQ ID NO: 194353 - DNA, 27 bp, Artificial sequence
  SiRNA target sequence
tttgataaaaacatatccaaattttac

SEQ ID NO: 194354 - DNA, 27 bp, Artificial sequence
  SiRNA target sequence
ttgataaaaacatatccaaattttacg

SEQ ID NO: 194355 - DNA, 27 bp, Artificial sequence
  SiRNA target sequence
tgataaaaacatatccaaattttacgc

SEQ ID NO: 194356 - DNA, 27 bp, Artificial sequence
  SiRNA target sequence
gataaaaacatatccaaattttacgct

SEQ ID NO: 194357 - DNA, 27 bp, Artificial sequence
  SiRNA target sequence
ataaaaacatatccaaattttacgctt

SEQ ID NO: 194358 - DNA, 27 bp, Artificial sequence
  SiRNA target sequence
taaaaacatatccaaattttacgctta

SEQ ID NO: 194359 - DNA, 27 bp, Artificial sequence
  SiRNA target sequence
aaaaacatatccaaattttacgcttaa

SEQ ID NO: 194360 - DNA, 27 bp, Artificial sequence
  SiRNA target sequence
aaaacatatccaaattttacgcttaaa

SEQ ID NO: 194361 - DNA, 27 bp, Artificial sequence
  SiRNA target sequence
aaacatatccaaattttacgcttaaag

SEQ ID NO: 194362 - DNA, 27 bp, Artificial sequence
  SiRNA target sequence
aacatatccaaattttacgcttaaagt

SEQ ID NO: 194363 - DNA, 27 bp, Artificial sequence
  SiRNA target sequence
acatatccaaattttacgcttaaagtt

SEQ ID NO: 194364 - DNA, 27 bp, Artificial sequence
  SiRNA target sequence
catatccaaattttacgcttaaagttg

SEQ ID NO: 194365 - DNA, 27 bp, Artificial sequence
  SiRNA target sequence
atatccaaattttacgcttaaagttga

SEQ ID NO: 194366 - DNA, 27 bp, Artificial sequence
  SiRNA target sequence
tatccaaattttacgcttaaagttgaa

SEQ ID NO: 194367 - DNA, 27 bp, Artificial sequence
  SiRNA target sequence
atccaaattttacgcttaaagttgaag

SEQ ID NO: 194368 - DNA, 27 bp, Artificial sequence
  SiRNA target sequence
tccaaattttacgcttaaagttgaagg

SEQ ID NO: 194369 - DNA, 27 bp, Artificial sequence
  SiRNA target sequence
ccaaattttacgcttaaagttgaaggc

SEQ ID NO: 194370 - DNA, 27 bp, Artificial sequence
  SiRNA target sequence
caaattttacgcttaaagttgaaggcg

SEQ ID NO: 194371 - DNA, 27 bp, Artificial sequence
  SiRNA target sequence
aaattttacgcttaaagttgaaggcgg

SEQ ID NO: 194372 - DNA, 27 bp, Artificial sequence
  SiRNA target sequence
aattttacgcttaaagttgaaggcggt

SEQ ID NO: 194373 - DNA, 27 bp, Artificial sequence
  SiRNA target sequence
attttacgcttaaagttgaaggcggta

SEQ ID NO: 194374 - DNA, 27 bp, Artificial sequence
  SiRNA target sequence
ttttacgcttaaagttgaaggcggtaa

SEQ ID NO: 194375 - DNA, 27 bp, Artificial sequence
  SiRNA target sequence
tttacgcttaaagttgaaggcggtaac

SEQ ID NO: 194376 - DNA, 27 bp, Artificial sequence
  SiRNA target sequence
ttacgcttaaagttgaaggcggtaact

SEQ ID NO: 194377 - DNA, 27 bp, Artificial sequence
  SiRNA target sequence
tacgcttaaagttgaaggcggtaactt

SEQ ID NO: 194378 - DNA, 27 bp, Artificial sequence
  SiRNA target sequence
acgcttaaagttgaaggcggtaacttt

SEQ ID NO: 194379 - DNA, 27 bp, Artificial sequence
  SiRNA target sequence
cgcttaaagttgaaggcggtaactttt

SEQ ID NO: 194380 - DNA, 27 bp, Artificial sequence
  SiRNA target sequence
gcttaaagttgaaggcggtaacttttc

SEQ ID NO: 194381 - DNA, 27 bp, Artificial sequence
  SiRNA target sequence
cttaaagttgaaggcggtaacttttca

SEQ ID NO: 194382 - DNA, 27 bp, Artificial sequence
  SiRNA target sequence
ttaaagttgaaggcggtaacttttcag

SEQ ID NO: 194383 - DNA, 27 bp, Artificial sequence
  SiRNA target sequence
taaagttgaaggcggtaacttttcaga

SEQ ID NO: 194384 - DNA, 27 bp, Artificial sequence
  SiRNA target sequence
aaagttgaaggcggtaacttttcagat

SEQ ID NO: 194385 - DNA, 27 bp, Artificial sequence
  SiRNA target sequence
aagttgaaggcggtaacttttcagatt

SEQ ID NO: 194386 - DNA, 27 bp, Artificial sequence
  SiRNA target sequence
agttgaaggcggtaacttttcagattc

SEQ ID NO: 194387 - DNA, 27 bp, Artificial sequence
  SiRNA target sequence
gttgaaggcggtaacttttcagattct

SEQ ID NO: 194388 - DNA, 27 bp, Artificial sequence
  SiRNA target sequence
ttgaaggcggtaacttttcagattctg

SEQ ID NO: 194389 - DNA, 27 bp, Artificial sequence
  SiRNA target sequence
tgaaggcggtaacttttcagattctga

SEQ ID NO: 194390 - DNA, 27 bp, Artificial sequence
  SiRNA target sequence
gaaggcggtaacttttcagattctgaa

SEQ ID NO: 194391 - DNA, 27 bp, Artificial sequence
  SiRNA target sequence
aaggcggtaacttttcagattctgaaa

SEQ ID NO: 194392 - DNA, 27 bp, Artificial sequence
  SiRNA target sequence
aggcggtaacttttcagattctgaaat

SEQ ID NO: 194393 - DNA, 27 bp, Artificial sequence
  SiRNA target sequence
ggcggtaacttttcagattctgaaatt

SEQ ID NO: 194394 - DNA, 27 bp, Artificial sequence
  SiRNA target sequence
gcggtaacttttcagattctgaaattg

SEQ ID NO: 194395 - DNA, 27 bp, Artificial sequence
  SiRNA target sequence
cggtaacttttcagattctgaaattgt

SEQ ID NO: 194396 - DNA, 27 bp, Artificial sequence
  SiRNA target sequence
ggtaacttttcagattctgaaattgtt

SEQ ID NO: 194397 - DNA, 27 bp, Artificial sequence
  SiRNA target sequence
gtaacttttcagattctgaaattgttg

SEQ ID NO: 194398 - DNA, 27 bp, Artificial sequence
  SiRNA target sequence
taacttttcagattctgaaattgttgt

SEQ ID NO: 194399 - DNA, 27 bp, Artificial sequence
  SiRNA target sequence
aacttttcagattctgaaattgttgta

SEQ ID NO: 194400 - DNA, 27 bp, Artificial sequence
  SiRNA target sequence
acttttcagattctgaaattgttgtat

SEQ ID NO: 194401 - DNA, 27 bp, Artificial sequence
  SiRNA target sequence
cttttcagattctgaaattgttgtatt

SEQ ID NO: 194402 - DNA, 27 bp, Artificial sequence
  SiRNA target sequence
ttttcagattctgaaattgttgtattt

SEQ ID NO: 194403 - DNA, 27 bp, Artificial sequence
  SiRNA target sequence
tttcagattctgaaattgttgtatttc

SEQ ID NO: 194404 - DNA, 27 bp, Artificial sequence
  SiRNA target sequence
ttcagattctgaaattgttgtatttct

SEQ ID NO: 194405 - DNA, 27 bp, Artificial sequence
  SiRNA target sequence
tcagattctgaaattgttgtatttctt

SEQ ID NO: 194406 - DNA, 27 bp, Artificial sequence
  SiRNA target sequence
cagattctgaaattgttgtatttcttg

SEQ ID NO: 194407 - DNA, 27 bp, Artificial sequence
  SiRNA target sequence
agattctgaaattgttgtatttcttgg

SEQ ID NO: 194408 - DNA, 27 bp, Artificial sequence
  SiRNA target sequence
gattctgaaattgttgtatttcttggt

SEQ ID NO: 194409 - DNA, 27 bp, Artificial sequence
  SiRNA target sequence
attctgaaattgttgtatttcttggtg

SEQ ID NO: 194410 - DNA, 27 bp, Artificial sequence
  SiRNA target sequence
ttctgaaattgttgtatttcttggtga

SEQ ID NO: 194411 - DNA, 27 bp, Artificial sequence
  SiRNA target sequence
tctgaaattgttgtatttcttggtgaa

SEQ ID NO: 194412 - DNA, 27 bp, Artificial sequence
  SiRNA target sequence
ctgaaattgttgtatttcttggtgaaa

SEQ ID NO: 194413 - DNA, 27 bp, Artificial sequence
  SiRNA target sequence
tgaaattgttgtatttcttggtgaaaa

SEQ ID NO: 194414 - DNA, 27 bp, Artificial sequence
  SiRNA target sequence
gaaattgttgtatttcttggtgaaaat

SEQ ID NO: 194415 - DNA, 27 bp, Artificial sequence
  SiRNA target sequence
aaattgttgtatttcttggtgaaaatg

SEQ ID NO: 194416 - DNA, 27 bp, Artificial sequence
  SiRNA target sequence
aattgttgtatttcttggtgaaaatgg

SEQ ID NO: 194417 - DNA, 27 bp, Artificial sequence
  SiRNA target sequence
attgttgtatttcttggtgaaaatgga

SEQ ID NO: 194418 - DNA, 27 bp, Artificial sequence
  SiRNA target sequence
ttgttgtatttcttggtgaaaatggaa

SEQ ID NO: 194419 - DNA, 27 bp, Artificial sequence
  SiRNA target sequence
tgttgtatttcttggtgaaaatggaat

SEQ ID NO: 194420 - DNA, 27 bp, Artificial sequence
  SiRNA target sequence
gttgtatttcttggtgaaaatggaatg

SEQ ID NO: 194421 - DNA, 27 bp, Artificial sequence
  SiRNA target sequence
ttgtatttcttggtgaaaatggaatgg

SEQ ID NO: 194422 - DNA, 27 bp, Artificial sequence
  SiRNA target sequence
tgtatttcttggtgaaaatggaatggg

SEQ ID NO: 194423 - DNA, 27 bp, Artificial sequence
  SiRNA target sequence
gtatttcttggtgaaaatggaatgggc

SEQ ID NO: 194424 - DNA, 27 bp, Artificial sequence
  SiRNA target sequence
tatttcttggtgaaaatggaatgggca

SEQ ID NO: 194425 - DNA, 27 bp, Artificial sequence
  SiRNA target sequence
atttcttggtgaaaatggaatgggcaa

SEQ ID NO: 194426 - DNA, 27 bp, Artificial sequence
  SiRNA target sequence
tttcttggtgaaaatggaatgggcaaa

SEQ ID NO: 194427 - DNA, 27 bp, Artificial sequence
  SiRNA target sequence
ttcttggtgaaaatggaatgggcaaaa

SEQ ID NO: 194428 - DNA, 27 bp, Artificial sequence
  SiRNA target sequence
tcttggtgaaaatggaatgggcaaaac

SEQ ID NO: 194429 - DNA, 27 bp, Artificial sequence
  SiRNA target sequence
cttggtgaaaatggaatgggcaaaact

SEQ ID NO: 194430 - DNA, 27 bp, Artificial sequence
  SiRNA target sequence
ttggtgaaaatggaatgggcaaaacta

SEQ ID NO: 194431 - DNA, 27 bp, Artificial sequence
  SiRNA target sequence
tggtgaaaatggaatgggcaaaactac

SEQ ID NO: 194432 - DNA, 27 bp, Artificial sequence
  SiRNA target sequence
ggtgaaaatggaatgggcaaaactact

SEQ ID NO: 194433 - DNA, 27 bp, Artificial sequence
  SiRNA target sequence
gtgaaaatggaatgggcaaaactactt

SEQ ID NO: 194434 - DNA, 27 bp, Artificial sequence
  SiRNA target sequence
tgaaaatggaatgggcaaaactacttt

SEQ ID NO: 194435 - DNA, 27 bp, Artificial sequence
  SiRNA target sequence
gaaaatggaatgggcaaaactacttta

SEQ ID NO: 194436 - DNA, 27 bp, Artificial sequence
  SiRNA target sequence
aaaatggaatgggcaaaactactttag

SEQ ID NO: 194437 - DNA, 27 bp, Artificial sequence
  SiRNA target sequence
aaatggaatgggcaaaactactttagt

SEQ ID NO: 194438 - DNA, 27 bp, Artificial sequence
  SiRNA target sequence
aatggaatgggcaaaactactttagta

SEQ ID NO: 194439 - DNA, 27 bp, Artificial sequence
  SiRNA target sequence
atggaatgggcaaaactactttagtag

SEQ ID NO: 194440 - DNA, 27 bp, Artificial sequence
  SiRNA target sequence
tggaatgggcaaaactactttagtagg

SEQ ID NO: 194441 - DNA, 27 bp, Artificial sequence
  SiRNA target sequence
ggaatgggcaaaactactttagtaggt

SEQ ID NO: 194442 - DNA, 27 bp, Artificial sequence
  SiRNA target sequence
gaatgggcaaaactactttagtaggtt

SEQ ID NO: 194443 - DNA, 27 bp, Artificial sequence
  SiRNA target sequence
aatgggcaaaactactttagtaggttt

SEQ ID NO: 194444 - DNA, 27 bp, Artificial sequence
  SiRNA target sequence
atgggcaaaactactttagtaggtttg

SEQ ID NO: 194445 - DNA, 27 bp, Artificial sequence
  SiRNA target sequence
tgggcaaaactactttagtaggtttga

SEQ ID NO: 194446 - DNA, 27 bp, Artificial sequence
  SiRNA target sequence
gggcaaaactactttagtaggtttgat

SEQ ID NO: 194447 - DNA, 27 bp, Artificial sequence
  SiRNA target sequence
ggcaaaactactttagtaggtttgatt

SEQ ID NO: 194448 - DNA, 27 bp, Artificial sequence
  SiRNA target sequence
gcaaaactactttagtaggtttgattt

SEQ ID NO: 194449 - DNA, 27 bp, Artificial sequence
  SiRNA target sequence
caaaactactttagtaggtttgatttc

SEQ ID NO: 194450 - DNA, 27 bp, Artificial sequence
  SiRNA target sequence
aaaactactttagtaggtttgatttcg

SEQ ID NO: 194451 - DNA, 27 bp, Artificial sequence
  SiRNA target sequence
aaactactttagtaggtttgatttcgg

SEQ ID NO: 194452 - DNA, 27 bp, Artificial sequence
  SiRNA target sequence
aactactttagtaggtttgatttcggg

SEQ ID NO: 194453 - DNA, 27 bp, Artificial sequence
  SiRNA target sequence
actactttagtaggtttgatttcgggg

SEQ ID NO: 194454 - DNA, 27 bp, Artificial sequence
  SiRNA target sequence
ctactttagtaggtttgatttcggggt

SEQ ID NO: 194455 - DNA, 27 bp, Artificial sequence
  SiRNA target sequence
tactttagtaggtttgatttcggggtt

SEQ ID NO: 194456 - DNA, 27 bp, Artificial sequence
  SiRNA target sequence
actttagtaggtttgatttcggggtta

SEQ ID NO: 194457 - DNA, 27 bp, Artificial sequence
  SiRNA target sequence
ctttagtaggtttgatttcggggttaa

SEQ ID NO: 194458 - DNA, 27 bp, Artificial sequence
  SiRNA target sequence
tttagtaggtttgatttcggggttaat

SEQ ID NO: 194459 - DNA, 27 bp, Artificial sequence
  SiRNA target sequence
ttagtaggtttgatttcggggttaatt

SEQ ID NO: 194460 - DNA, 27 bp, Artificial sequence
  SiRNA target sequence
tagtaggtttgatttcggggttaatta

SEQ ID NO: 194461 - DNA, 27 bp, Artificial sequence
  SiRNA target sequence
agtaggtttgatttcggggttaattaa

SEQ ID NO: 194462 - DNA, 27 bp, Artificial sequence
  SiRNA target sequence
gtaggtttgatttcggggttaattaaa

SEQ ID NO: 194463 - DNA, 27 bp, Artificial sequence
  SiRNA target sequence
taggtttgatttcggggttaattaaag

SEQ ID NO: 194464 - DNA, 27 bp, Artificial sequence
  SiRNA target sequence
aggtttgatttcggggttaattaaaga

SEQ ID NO: 194465 - DNA, 27 bp, Artificial sequence
  SiRNA target sequence
ggtttgatttcggggttaattaaagat

SEQ ID NO: 194466 - DNA, 27 bp, Artificial sequence
  SiRNA target sequence
gtttgatttcggggttaattaaagatg

SEQ ID NO: 194467 - DNA, 27 bp, Artificial sequence
  SiRNA target sequence
tttgatttcggggttaattaaagatga

SEQ ID NO: 194468 - DNA, 27 bp, Artificial sequence
  SiRNA target sequence
ttgatttcggggttaattaaagatgat

SEQ ID NO: 194469 - DNA, 27 bp, Artificial sequence
  SiRNA target sequence
tgatttcggggttaattaaagatgata

SEQ ID NO: 194470 - DNA, 27 bp, Artificial sequence
  SiRNA target sequence
gatttcggggttaattaaagatgataa

SEQ ID NO: 194471 - DNA, 27 bp, Artificial sequence
  SiRNA target sequence
atttcggggttaattaaagatgataac

SEQ ID NO: 194472 - DNA, 27 bp, Artificial sequence
  SiRNA target sequence
tttcggggttaattaaagatgataacg

SEQ ID NO: 194473 - DNA, 27 bp, Artificial sequence
  SiRNA target sequence
ttcggggttaattaaagatgataacgg

SEQ ID NO: 194474 - DNA, 27 bp, Artificial sequence
  SiRNA target sequence
tcggggttaattaaagatgataacggg

SEQ ID NO: 194475 - DNA, 27 bp, Artificial sequence
  SiRNA target sequence
cggggttaattaaagatgataacgggg

SEQ ID NO: 194476 - DNA, 27 bp, Artificial sequence
  SiRNA target sequence
ggggttaattaaagatgataacgggga

SEQ ID NO: 194477 - DNA, 27 bp, Artificial sequence
  SiRNA target sequence
gggttaattaaagatgataacggggaa

SEQ ID NO: 194478 - DNA, 27 bp, Artificial sequence
  SiRNA target sequence
ggttaattaaagatgataacggggaag

SEQ ID NO: 194479 - DNA, 27 bp, Artificial sequence
  SiRNA target sequence
gttaattaaagatgataacggggaaga

SEQ ID NO: 194480 - DNA, 27 bp, Artificial sequence
  SiRNA target sequence
ttaattaaagatgataacggggaagag

SEQ ID NO: 194481 - DNA, 27 bp, Artificial sequence
  SiRNA target sequence
taattaaagatgataacggggaagagt

SEQ ID NO: 194482 - DNA, 27 bp, Artificial sequence
  SiRNA target sequence
aattaaagatgataacggggaagagtt

SEQ ID NO: 194483 - DNA, 27 bp, Artificial sequence
  SiRNA target sequence
attaaagatgataacggggaagagttc

SEQ ID NO: 194484 - DNA, 27 bp, Artificial sequence
  SiRNA target sequence
ttaaagatgataacggggaagagttcg

SEQ ID NO: 194485 - DNA, 27 bp, Artificial sequence
  SiRNA target sequence
taaagatgataacggggaagagttcgg

SEQ ID NO: 194486 - DNA, 27 bp, Artificial sequence
  SiRNA target sequence
aaagatgataacggggaagagttcggt

SEQ ID NO: 194487 - DNA, 27 bp, Artificial sequence
  SiRNA target sequence
aagatgataacggggaagagttcggtt

SEQ ID NO: 194488 - DNA, 27 bp, Artificial sequence
  SiRNA target sequence
agatgataacggggaagagttcggttt

SEQ ID NO: 194489 - DNA, 27 bp, Artificial sequence
  SiRNA target sequence
gatgataacggggaagagttcggtttg

SEQ ID NO: 194490 - DNA, 27 bp, Artificial sequence
  SiRNA target sequence
atgataacggggaagagttcggtttgt

SEQ ID NO: 194491 - DNA, 27 bp, Artificial sequence
  SiRNA target sequence
tgataacggggaagagttcggtttgtt

SEQ ID NO: 194492 - DNA, 27 bp, Artificial sequence
  SiRNA target sequence
gataacggggaagagttcggtttgttg

SEQ ID NO: 194493 - DNA, 27 bp, Artificial sequence
  SiRNA target sequence
ataacggggaagagttcggtttgttgt

SEQ ID NO: 194494 - DNA, 27 bp, Artificial sequence
  SiRNA target sequence
taacggggaagagttcggtttgttgtc

SEQ ID NO: 194495 - DNA, 27 bp, Artificial sequence
  SiRNA target sequence
aacggggaagagttcggtttgttgtca

SEQ ID NO: 194496 - DNA, 27 bp, Artificial sequence
  SiRNA target sequence
acggggaagagttcggtttgttgtcat

SEQ ID NO: 194497 - DNA, 27 bp, Artificial sequence
  SiRNA target sequence
cggggaagagttcggtttgttgtcata

SEQ ID NO: 194498 - DNA, 27 bp, Artificial sequence
  SiRNA target sequence
ggggaagagttcggtttgttgtcatat

SEQ ID NO: 194499 - DNA, 27 bp, Artificial sequence
  SiRNA target sequence
gggaagagttcggtttgttgtcatata

SEQ ID NO: 194500 - DNA, 27 bp, Artificial sequence
  SiRNA target sequence
ggaagagttcggtttgttgtcatatag

SEQ ID NO: 194501 - DNA, 27 bp, Artificial sequence
  SiRNA target sequence
gaagagttcggtttgttgtcatatagt

SEQ ID NO: 194502 - DNA, 27 bp, Artificial sequence
  SiRNA target sequence
aagagttcggtttgttgtcatatagtc

SEQ ID NO: 194503 - DNA, 27 bp, Artificial sequence
  SiRNA target sequence
agagttcggtttgttgtcatatagtct

SEQ ID NO: 194504 - DNA, 27 bp, Artificial sequence
  SiRNA target sequence
gagttcggtttgttgtcatatagtctt

SEQ ID NO: 194505 - DNA, 27 bp, Artificial sequence
  SiRNA target sequence
agttcggtttgttgtcatatagtctta

SEQ ID NO: 194506 - DNA, 27 bp, Artificial sequence
  SiRNA target sequence
gttcggtttgttgtcatatagtcttaa

SEQ ID NO: 194507 - DNA, 27 bp, Artificial sequence
  SiRNA target sequence
ttcggtttgttgtcatatagtcttaaa

SEQ ID NO: 194508 - DNA, 27 bp, Artificial sequence
  SiRNA target sequence
tcggtttgttgtcatatagtcttaaac

SEQ ID NO: 194509 - DNA, 27 bp, Artificial sequence
  SiRNA target sequence
cggtttgttgtcatatagtcttaaacc

SEQ ID NO: 194510 - DNA, 27 bp, Artificial sequence
  SiRNA target sequence
ggtttgttgtcatatagtcttaaaccg

SEQ ID NO: 194511 - DNA, 27 bp, Artificial sequence
  SiRNA target sequence
gtttgttgtcatatagtcttaaaccgc

SEQ ID NO: 194512 - DNA, 27 bp, Artificial sequence
  SiRNA target sequence
tttgttgtcatatagtcttaaaccgca

SEQ ID NO: 194513 - DNA, 27 bp, Artificial sequence
  SiRNA target sequence
ttgttgtcatatagtcttaaaccgcaa

SEQ ID NO: 194514 - DNA, 27 bp, Artificial sequence
  SiRNA target sequence
tgttgtcatatagtcttaaaccgcaaa

SEQ ID NO: 194515 - DNA, 27 bp, Artificial sequence
  SiRNA target sequence
gttgtcatatagtcttaaaccgcaaaa

SEQ ID NO: 194516 - DNA, 27 bp, Artificial sequence
  SiRNA target sequence
ttgtcatatagtcttaaaccgcaaaaa

SEQ ID NO: 194517 - DNA, 27 bp, Artificial sequence
  SiRNA target sequence
tgtcatatagtcttaaaccgcaaaaaa

SEQ ID NO: 194518 - DNA, 27 bp, Artificial sequence
  SiRNA target sequence
gtcatatagtcttaaaccgcaaaaaat

SEQ ID NO: 194519 - DNA, 27 bp, Artificial sequence
  SiRNA target sequence
tcatatagtcttaaaccgcaaaaaatc

SEQ ID NO: 194520 - DNA, 27 bp, Artificial sequence
  SiRNA target sequence
catatagtcttaaaccgcaaaaaatca

SEQ ID NO: 194521 - DNA, 27 bp, Artificial sequence
  SiRNA target sequence
atatagtcttaaaccgcaaaaaatcat

SEQ ID NO: 194522 - DNA, 27 bp, Artificial sequence
  SiRNA target sequence
tatagtcttaaaccgcaaaaaatcata

SEQ ID NO: 194523 - DNA, 27 bp, Artificial sequence
  SiRNA target sequence
atagtcttaaaccgcaaaaaatcatac

SEQ ID NO: 194524 - DNA, 27 bp, Artificial sequence
  SiRNA target sequence
tagtcttaaaccgcaaaaaatcatacc

SEQ ID NO: 194525 - DNA, 27 bp, Artificial sequence
  SiRNA target sequence
agtcttaaaccgcaaaaaatcataccg

SEQ ID NO: 194526 - DNA, 27 bp, Artificial sequence
  SiRNA target sequence
gtcttaaaccgcaaaaaatcataccga

SEQ ID NO: 194527 - DNA, 27 bp, Artificial sequence
  SiRNA target sequence
tcttaaaccgcaaaaaatcataccgaa

SEQ ID NO: 194528 - DNA, 27 bp, Artificial sequence
  SiRNA target sequence
cttaaaccgcaaaaaatcataccgaaa

SEQ ID NO: 194529 - DNA, 27 bp, Artificial sequence
  SiRNA target sequence
ttaaaccgcaaaaaatcataccgaaat

SEQ ID NO: 194530 - DNA, 27 bp, Artificial sequence
  SiRNA target sequence
taaaccgcaaaaaatcataccgaaata

SEQ ID NO: 194531 - DNA, 27 bp, Artificial sequence
  SiRNA target sequence
aaaccgcaaaaaatcataccgaaatac

SEQ ID NO: 194532 - DNA, 27 bp, Artificial sequence
  SiRNA target sequence
aaccgcaaaaaatcataccgaaataca

SEQ ID NO: 194533 - DNA, 27 bp, Artificial sequence
  SiRNA target sequence
accgcaaaaaatcataccgaaatacaa

SEQ ID NO: 194534 - DNA, 27 bp, Artificial sequence
  SiRNA target sequence
ccgcaaaaaatcataccgaaatacaaa

SEQ ID NO: 194535 - DNA, 27 bp, Artificial sequence
  SiRNA target sequence
cgcaaaaaatcataccgaaatacaaag

SEQ ID NO: 194536 - DNA, 27 bp, Artificial sequence
  SiRNA target sequence
gcaaaaaatcataccgaaatacaaagg

SEQ ID NO: 194537 - DNA, 27 bp, Artificial sequence
  SiRNA target sequence
caaaaaatcataccgaaatacaaagga

SEQ ID NO: 194538 - DNA, 27 bp, Artificial sequence
  SiRNA target sequence
aaaaaatcataccgaaatacaaaggaa

SEQ ID NO: 194539 - DNA, 27 bp, Artificial sequence
  SiRNA target sequence
aaaaatcataccgaaatacaaaggaac

SEQ ID NO: 194540 - DNA, 27 bp, Artificial sequence
  SiRNA target sequence
aaaatcataccgaaatacaaaggaaca

SEQ ID NO: 194541 - DNA, 27 bp, Artificial sequence
  SiRNA target sequence
aaatcataccgaaatacaaaggaacag

SEQ ID NO: 194542 - DNA, 27 bp, Artificial sequence
  SiRNA target sequence
aatcataccgaaatacaaaggaacagt

SEQ ID NO: 194543 - DNA, 27 bp, Artificial sequence
  SiRNA target sequence
atcataccgaaatacaaaggaacagtt

SEQ ID NO: 194544 - DNA, 27 bp, Artificial sequence
  SiRNA target sequence
tcataccgaaatacaaaggaacagtta

SEQ ID NO: 194545 - DNA, 27 bp, Artificial sequence
  SiRNA target sequence
cataccgaaatacaaaggaacagttag

SEQ ID NO: 194546 - DNA, 27 bp, Artificial sequence
  SiRNA target sequence
ataccgaaatacaaaggaacagttaga

SEQ ID NO: 194547 - DNA, 27 bp, Artificial sequence
  SiRNA target sequence
taccgaaatacaaaggaacagttagag

SEQ ID NO: 194548 - DNA, 27 bp, Artificial sequence
  SiRNA target sequence
accgaaatacaaaggaacagttagaga

SEQ ID NO: 194549 - DNA, 27 bp, Artificial sequence
  SiRNA target sequence
ccgaaatacaaaggaacagttagagat

SEQ ID NO: 194550 - DNA, 27 bp, Artificial sequence
  SiRNA target sequence
cgaaatacaaaggaacagttagagatc

SEQ ID NO: 194551 - DNA, 27 bp, Artificial sequence
  SiRNA target sequence
gaaatacaaaggaacagttagagatct

SEQ ID NO: 194552 - DNA, 27 bp, Artificial sequence
  SiRNA target sequence
aaatacaaaggaacagttagagatctt

SEQ ID NO: 194553 - DNA, 27 bp, Artificial sequence
  SiRNA target sequence
aatacaaaggaacagttagagatcttt

SEQ ID NO: 194554 - DNA, 27 bp, Artificial sequence
  SiRNA target sequence
atacaaaggaacagttagagatctttt

SEQ ID NO: 194555 - DNA, 27 bp, Artificial sequence
  SiRNA target sequence
tacaaaggaacagttagagatcttttt

SEQ ID NO: 194556 - DNA, 27 bp, Artificial sequence
  SiRNA target sequence
acaaaggaacagttagagatcttttta

SEQ ID NO: 194557 - DNA, 27 bp, Artificial sequence
  SiRNA target sequence
caaaggaacagttagagatctttttat

SEQ ID NO: 194558 - DNA, 27 bp, Artificial sequence
  SiRNA target sequence
aaaggaacagttagagatctttttatg

SEQ ID NO: 194559 - DNA, 27 bp, Artificial sequence
  SiRNA target sequence
aaggaacagttagagatctttttatgt

SEQ ID NO: 194560 - DNA, 27 bp, Artificial sequence
  SiRNA target sequence
aggaacagttagagatctttttatgtc

SEQ ID NO: 194561 - DNA, 27 bp, Artificial sequence
  SiRNA target sequence
ggaacagttagagatctttttatgtca

SEQ ID NO: 194562 - DNA, 27 bp, Artificial sequence
  SiRNA target sequence
gaacagttagagatctttttatgtcaa

SEQ ID NO: 194563 - DNA, 27 bp, Artificial sequence
  SiRNA target sequence
aacagttagagatctttttatgtcaaa

SEQ ID NO: 194564 - DNA, 27 bp, Artificial sequence
  SiRNA target sequence
acagttagagatctttttatgtcaaaa

SEQ ID NO: 194565 - DNA, 27 bp, Artificial sequence
  SiRNA target sequence
cagttagagatctttttatgtcaaaaa

SEQ ID NO: 194566 - DNA, 27 bp, Artificial sequence
  SiRNA target sequence
agttagagatctttttatgtcaaaaat

SEQ ID NO: 194567 - DNA, 27 bp, Artificial sequence
  SiRNA target sequence
gttagagatctttttatgtcaaaaatt

SEQ ID NO: 194568 - DNA, 27 bp, Artificial sequence
  SiRNA target sequence
ttagagatctttttatgtcaaaaattc

SEQ ID NO: 194569 - DNA, 27 bp, Artificial sequence
  SiRNA target sequence
tagagatctttttatgtcaaaaattcg

SEQ ID NO: 194570 - DNA, 27 bp, Artificial sequence
  SiRNA target sequence
agagatctttttatgtcaaaaattcgt

SEQ ID NO: 194571 - DNA, 27 bp, Artificial sequence
  SiRNA target sequence
gagatctttttatgtcaaaaattcgtt

SEQ ID NO: 194572 - DNA, 27 bp, Artificial sequence
  SiRNA target sequence
agatctttttatgtcaaaaattcgttc

SEQ ID NO: 194573 - DNA, 27 bp, Artificial sequence
  SiRNA target sequence
gatctttttatgtcaaaaattcgttct

SEQ ID NO: 194574 - DNA, 27 bp, Artificial sequence
  SiRNA target sequence
atctttttatgtcaaaaattcgttctt

SEQ ID NO: 194575 - DNA, 27 bp, Artificial sequence
  SiRNA target sequence
tctttttatgtcaaaaattcgttcttc

SEQ ID NO: 194576 - DNA, 27 bp, Artificial sequence
  SiRNA target sequence
ctttttatgtcaaaaattcgttcttcc

SEQ ID NO: 194577 - DNA, 27 bp, Artificial sequence
  SiRNA target sequence
tttttatgtcaaaaattcgttcttcct

SEQ ID NO: 194578 - DNA, 27 bp, Artificial sequence
  SiRNA target sequence
ttttatgtcaaaaattcgttcttcctt

SEQ ID NO: 194579 - DNA, 27 bp, Artificial sequence
  SiRNA target sequence
tttatgtcaaaaattcgttcttccttt

SEQ ID NO: 194580 - DNA, 27 bp, Artificial sequence
  SiRNA target sequence
ttatgtcaaaaattcgttcttcctttt

SEQ ID NO: 194581 - DNA, 27 bp, Artificial sequence
  SiRNA target sequence
tatgtcaaaaattcgttcttccttttt

SEQ ID NO: 194582 - DNA, 27 bp, Artificial sequence
  SiRNA target sequence
atgtcaaaaattcgttcttccttttta

SEQ ID NO: 194583 - DNA, 27 bp, Artificial sequence
  SiRNA target sequence
tgtcaaaaattcgttcttcctttttag

SEQ ID NO: 194584 - DNA, 27 bp, Artificial sequence
  SiRNA target sequence
gtcaaaaattcgttcttcctttttaga

SEQ ID NO: 194585 - DNA, 27 bp, Artificial sequence
  SiRNA target sequence
tcaaaaattcgttcttcctttttagac

SEQ ID NO: 194586 - DNA, 27 bp, Artificial sequence
  SiRNA target sequence
caaaaattcgttcttcctttttagacg

SEQ ID NO: 194587 - DNA, 27 bp, Artificial sequence
  SiRNA target sequence
aaaaattcgttcttcctttttagacgc

SEQ ID NO: 194588 - DNA, 27 bp, Artificial sequence
  SiRNA target sequence
aaaattcgttcttcctttttagacgct

SEQ ID NO: 194589 - DNA, 27 bp, Artificial sequence
  SiRNA target sequence
aaattcgttcttcctttttagacgcta

SEQ ID NO: 194590 - DNA, 27 bp, Artificial sequence
  SiRNA target sequence
aattcgttcttcctttttagacgctaa

SEQ ID NO: 194591 - DNA, 27 bp, Artificial sequence
  SiRNA target sequence
attcgttcttcctttttagacgctaat

SEQ ID NO: 194592 - DNA, 27 bp, Artificial sequence
  SiRNA target sequence
ttcgttcttcctttttagacgctaatt

SEQ ID NO: 194593 - DNA, 27 bp, Artificial sequence
  SiRNA target sequence
tcgttcttcctttttagacgctaattt

SEQ ID NO: 194594 - DNA, 27 bp, Artificial sequence
  SiRNA target sequence
cgttcttcctttttagacgctaatttt

SEQ ID NO: 194595 - DNA, 27 bp, Artificial sequence
  SiRNA target sequence
gttcttcctttttagacgctaattttg

SEQ ID NO: 194596 - DNA, 27 bp, Artificial sequence
  SiRNA target sequence
ttcttcctttttagacgctaattttgt

SEQ ID NO: 194597 - DNA, 27 bp, Artificial sequence
  SiRNA target sequence
tcttcctttttagacgctaattttgtt

SEQ ID NO: 194598 - DNA, 27 bp, Artificial sequence
  SiRNA target sequence
cttcctttttagacgctaattttgtta

SEQ ID NO: 194599 - DNA, 27 bp, Artificial sequence
  SiRNA target sequence
ttcctttttagacgctaattttgttaa

SEQ ID NO: 194600 - DNA, 27 bp, Artificial sequence
  SiRNA target sequence
tcctttttagacgctaattttgttaat

SEQ ID NO: 194601 - DNA, 27 bp, Artificial sequence
  SiRNA target sequence
cctttttagacgctaattttgttaatg

SEQ ID NO: 194602 - DNA, 27 bp, Artificial sequence
  SiRNA target sequence
ctttttagacgctaattttgttaatga

SEQ ID NO: 194603 - DNA, 27 bp, Artificial sequence
  SiRNA target sequence
tttttagacgctaattttgttaatgaa

SEQ ID NO: 194604 - DNA, 27 bp, Artificial sequence
  SiRNA target sequence
ttttagacgctaattttgttaatgaag

SEQ ID NO: 194605 - DNA, 27 bp, Artificial sequence
  SiRNA target sequence
tttagacgctaattttgttaatgaagc

SEQ ID NO: 194606 - DNA, 27 bp, Artificial sequence
  SiRNA target sequence
ttagacgctaattttgttaatgaagct

SEQ ID NO: 194607 - DNA, 27 bp, Artificial sequence
  SiRNA target sequence
tagacgctaattttgttaatgaagcta

SEQ ID NO: 194608 - DNA, 27 bp, Artificial sequence
  SiRNA target sequence
agacgctaattttgttaatgaagctat

SEQ ID NO: 194609 - DNA, 27 bp, Artificial sequence
  SiRNA target sequence
gacgctaattttgttaatgaagctatt

SEQ ID NO: 194610 - DNA, 27 bp, Artificial sequence
  SiRNA target sequence
acgctaattttgttaatgaagctatta

SEQ ID NO: 194611 - DNA, 27 bp, Artificial sequence
  SiRNA target sequence
cgctaattttgttaatgaagctattaa

SEQ ID NO: 194612 - DNA, 27 bp, Artificial sequence
  SiRNA target sequence
gctaattttgttaatgaagctattaaa

SEQ ID NO: 194613 - DNA, 27 bp, Artificial sequence
  SiRNA target sequence
ctaattttgttaatgaagctattaaac

SEQ ID NO: 194614 - DNA, 27 bp, Artificial sequence
  SiRNA target sequence
taattttgttaatgaagctattaaacc

SEQ ID NO: 194615 - DNA, 27 bp, Artificial sequence
  SiRNA target sequence
aattttgttaatgaagctattaaacct

SEQ ID NO: 194616 - DNA, 27 bp, Artificial sequence
  SiRNA target sequence
attttgttaatgaagctattaaacctt

SEQ ID NO: 194617 - DNA, 27 bp, Artificial sequence
  SiRNA target sequence
ttttgttaatgaagctattaaaccttt

SEQ ID NO: 194618 - DNA, 27 bp, Artificial sequence
  SiRNA target sequence
tttgttaatgaagctattaaaccttta

SEQ ID NO: 194619 - DNA, 27 bp, Artificial sequence
  SiRNA target sequence
ttgttaatgaagctattaaacctttag

SEQ ID NO: 194620 - DNA, 27 bp, Artificial sequence
  SiRNA target sequence
tgttaatgaagctattaaacctttaga

SEQ ID NO: 194621 - DNA, 27 bp, Artificial sequence
  SiRNA target sequence
gttaatgaagctattaaacctttagat

SEQ ID NO: 194622 - DNA, 27 bp, Artificial sequence
  SiRNA target sequence
ttaatgaagctattaaacctttagata

SEQ ID NO: 194623 - DNA, 27 bp, Artificial sequence
  SiRNA target sequence
taatgaagctattaaacctttagatat

SEQ ID NO: 194624 - DNA, 27 bp, Artificial sequence
  SiRNA target sequence
aatgaagctattaaacctttagatatt

SEQ ID NO: 194625 - DNA, 27 bp, Artificial sequence
  SiRNA target sequence
atgaagctattaaacctttagatattc

SEQ ID NO: 194626 - DNA, 27 bp, Artificial sequence
  SiRNA target sequence
tgaagctattaaacctttagatattca

SEQ ID NO: 194627 - DNA, 27 bp, Artificial sequence
  SiRNA target sequence
gaagctattaaacctttagatattcat

SEQ ID NO: 194628 - DNA, 27 bp, Artificial sequence
  SiRNA target sequence
aagctattaaacctttagatattcatc

SEQ ID NO: 194629 - DNA, 27 bp, Artificial sequence
  SiRNA target sequence
agctattaaacctttagatattcatca

SEQ ID NO: 194630 - DNA, 27 bp, Artificial sequence
  SiRNA target sequence
gctattaaacctttagatattcatcat

SEQ ID NO: 194631 - DNA, 27 bp, Artificial sequence
  SiRNA target sequence
ctattaaacctttagatattcatcatt

SEQ ID NO: 194632 - DNA, 27 bp, Artificial sequence
  SiRNA target sequence
tattaaacctttagatattcatcattt

SEQ ID NO: 194633 - DNA, 27 bp, Artificial sequence
  SiRNA target sequence
attaaacctttagatattcatcattta

SEQ ID NO: 194634 - DNA, 27 bp, Artificial sequence
  SiRNA target sequence
ttaaacctttagatattcatcatttat

SEQ ID NO: 194635 - DNA, 27 bp, Artificial sequence
  SiRNA target sequence
taaacctttagatattcatcatttata

SEQ ID NO: 194636 - DNA, 27 bp, Artificial sequence
  SiRNA target sequence
aaacctttagatattcatcatttatac

SEQ ID NO: 194637 - DNA, 27 bp, Artificial sequence
  SiRNA target sequence
aacctttagatattcatcatttatacg

SEQ ID NO: 194638 - DNA, 27 bp, Artificial sequence
  SiRNA target sequence
acctttagatattcatcatttatacga

SEQ ID NO: 194639 - DNA, 27 bp, Artificial sequence
  SiRNA target sequence
cctttagatattcatcatttatacgac

SEQ ID NO: 194640 - DNA, 27 bp, Artificial sequence
  SiRNA target sequence
ctttagatattcatcatttatacgacc

SEQ ID NO: 194641 - DNA, 27 bp, Artificial sequence
  SiRNA target sequence
tttagatattcatcatttatacgacca

SEQ ID NO: 194642 - DNA, 27 bp, Artificial sequence
  SiRNA target sequence
ttagatattcatcatttatacgaccaa

SEQ ID NO: 194643 - DNA, 27 bp, Artificial sequence
  SiRNA target sequence
tagatattcatcatttatacgaccaac

SEQ ID NO: 194644 - DNA, 27 bp, Artificial sequence
  SiRNA target sequence
agatattcatcatttatacgaccaact

SEQ ID NO: 194645 - DNA, 27 bp, Artificial sequence
  SiRNA target sequence
gatattcatcatttatacgaccaactt

SEQ ID NO: 194646 - DNA, 27 bp, Artificial sequence
  SiRNA target sequence
atattcatcatttatacgaccaacttg

SEQ ID NO: 194647 - DNA, 27 bp, Artificial sequence
  SiRNA target sequence
tattcatcatttatacgaccaacttgt

SEQ ID NO: 194648 - DNA, 27 bp, Artificial sequence
  SiRNA target sequence
attcatcatttatacgaccaacttgta

SEQ ID NO: 194649 - DNA, 27 bp, Artificial sequence
  SiRNA target sequence
ttcatcatttatacgaccaacttgtag

SEQ ID NO: 194650 - DNA, 27 bp, Artificial sequence
  SiRNA target sequence
tcatcatttatacgaccaacttgtaga

SEQ ID NO: 194651 - DNA, 27 bp, Artificial sequence
  SiRNA target sequence
catcatttatacgaccaacttgtagaa

SEQ ID NO: 194652 - DNA, 27 bp, Artificial sequence
  SiRNA target sequence
atcatttatacgaccaacttgtagaaa

SEQ ID NO: 194653 - DNA, 27 bp, Artificial sequence
  SiRNA target sequence
tcatttatacgaccaacttgtagaaaa

SEQ ID NO: 194654 - DNA, 27 bp, Artificial sequence
  SiRNA target sequence
catttatacgaccaacttgtagaaaac

SEQ ID NO: 194655 - DNA, 27 bp, Artificial sequence
  SiRNA target sequence
atttatacgaccaacttgtagaaaact

SEQ ID NO: 194656 - DNA, 27 bp, Artificial sequence
  SiRNA target sequence
tttatacgaccaacttgtagaaaactt

SEQ ID NO: 194657 - DNA, 27 bp, Artificial sequence
  SiRNA target sequence
ttatacgaccaacttgtagaaaacttg

SEQ ID NO: 194658 - DNA, 27 bp, Artificial sequence
  SiRNA target sequence
tatacgaccaacttgtagaaaacttga

SEQ ID NO: 194659 - DNA, 27 bp, Artificial sequence
  SiRNA target sequence
atacgaccaacttgtagaaaacttgag

SEQ ID NO: 194660 - DNA, 27 bp, Artificial sequence
  SiRNA target sequence
tacgaccaacttgtagaaaacttgagt

SEQ ID NO: 194661 - DNA, 27 bp, Artificial sequence
  SiRNA target sequence
acgaccaacttgtagaaaacttgagtg

SEQ ID NO: 194662 - DNA, 27 bp, Artificial sequence
  SiRNA target sequence
cgaccaacttgtagaaaacttgagtgg

SEQ ID NO: 194663 - DNA, 27 bp, Artificial sequence
  SiRNA target sequence
gaccaacttgtagaaaacttgagtggt

SEQ ID NO: 194664 - DNA, 27 bp, Artificial sequence
  SiRNA target sequence
accaacttgtagaaaacttgagtggtg

SEQ ID NO: 194665 - DNA, 27 bp, Artificial sequence
  SiRNA target sequence
ccaacttgtagaaaacttgagtggtgg

SEQ ID NO: 194666 - DNA, 27 bp, Artificial sequence
  SiRNA target sequence
caacttgtagaaaacttgagtggtgga

SEQ ID NO: 194667 - DNA, 27 bp, Artificial sequence
  SiRNA target sequence
aacttgtagaaaacttgagtggtggag

SEQ ID NO: 194668 - DNA, 27 bp, Artificial sequence
  SiRNA target sequence
acttgtagaaaacttgagtggtggaga

SEQ ID NO: 194669 - DNA, 27 bp, Artificial sequence
  SiRNA target sequence
cttgtagaaaacttgagtggtggagaa

SEQ ID NO: 194670 - DNA, 27 bp, Artificial sequence
  SiRNA target sequence
ttgtagaaaacttgagtggtggagaat

SEQ ID NO: 194671 - DNA, 27 bp, Artificial sequence
  SiRNA target sequence
tgtagaaaacttgagtggtggagaatt

SEQ ID NO: 194672 - DNA, 27 bp, Artificial sequence
  SiRNA target sequence
gtagaaaacttgagtggtggagaatta

SEQ ID NO: 194673 - DNA, 27 bp, Artificial sequence
  SiRNA target sequence
tagaaaacttgagtggtggagaattac

SEQ ID NO: 194674 - DNA, 27 bp, Artificial sequence
  SiRNA target sequence
agaaaacttgagtggtggagaattaca

SEQ ID NO: 194675 - DNA, 27 bp, Artificial sequence
  SiRNA target sequence
gaaaacttgagtggtggagaattacaa

SEQ ID NO: 194676 - DNA, 27 bp, Artificial sequence
  SiRNA target sequence
aaaacttgagtggtggagaattacaaa

SEQ ID NO: 194677 - DNA, 27 bp, Artificial sequence
  SiRNA target sequence
aaacttgagtggtggagaattacaaag

SEQ ID NO: 194678 - DNA, 27 bp, Artificial sequence
  SiRNA target sequence
aacttgagtggtggagaattacaaaga

SEQ ID NO: 194679 - DNA, 27 bp, Artificial sequence
  SiRNA target sequence
acttgagtggtggagaattacaaagaa

SEQ ID NO: 194680 - DNA, 27 bp, Artificial sequence
  SiRNA target sequence
cttgagtggtggagaattacaaagaat

SEQ ID NO: 194681 - DNA, 27 bp, Artificial sequence
  SiRNA target sequence
ttgagtggtggagaattacaaagaatt

SEQ ID NO: 194682 - DNA, 27 bp, Artificial sequence
  SiRNA target sequence
tgagtggtggagaattacaaagaattg

SEQ ID NO: 194683 - DNA, 27 bp, Artificial sequence
  SiRNA target sequence
gagtggtggagaattacaaagaattgc

SEQ ID NO: 194684 - DNA, 27 bp, Artificial sequence
  SiRNA target sequence
agtggtggagaattacaaagaattgca

SEQ ID NO: 194685 - DNA, 27 bp, Artificial sequence
  SiRNA target sequence
gtggtggagaattacaaagaattgcaa

SEQ ID NO: 194686 - DNA, 27 bp, Artificial sequence
  SiRNA target sequence
tggtggagaattacaaagaattgcaat

SEQ ID NO: 194687 - DNA, 27 bp, Artificial sequence
  SiRNA target sequence
ggtggagaattacaaagaattgcaata

SEQ ID NO: 194688 - DNA, 27 bp, Artificial sequence
  SiRNA target sequence
gtggagaattacaaagaattgcaataa

SEQ ID NO: 194689 - DNA, 27 bp, Artificial sequence
  SiRNA target sequence
tggagaattacaaagaattgcaataat

SEQ ID NO: 194690 - DNA, 27 bp, Artificial sequence
  SiRNA target sequence
ggagaattacaaagaattgcaataata

SEQ ID NO: 194691 - DNA, 27 bp, Artificial sequence
  SiRNA target sequence
gagaattacaaagaattgcaataataa

SEQ ID NO: 194692 - DNA, 27 bp, Artificial sequence
  SiRNA target sequence
agaattacaaagaattgcaataataat

SEQ ID NO: 194693 - DNA, 27 bp, Artificial sequence
  SiRNA target sequence
gaattacaaagaattgcaataataata

SEQ ID NO: 194694 - DNA, 27 bp, Artificial sequence
  SiRNA target sequence
aattacaaagaattgcaataataatat

SEQ ID NO: 194695 - DNA, 27 bp, Artificial sequence
  SiRNA target sequence
attacaaagaattgcaataataatatg

SEQ ID NO: 194696 - DNA, 27 bp, Artificial sequence
  SiRNA target sequence
ttacaaagaattgcaataataatatgt

SEQ ID NO: 194697 - DNA, 27 bp, Artificial sequence
  SiRNA target sequence
tacaaagaattgcaataataatatgtt

SEQ ID NO: 194698 - DNA, 27 bp, Artificial sequence
  SiRNA target sequence
acaaagaattgcaataataatatgttt

SEQ ID NO: 194699 - DNA, 27 bp, Artificial sequence
  SiRNA target sequence
caaagaattgcaataataatatgttta

SEQ ID NO: 194700 - DNA, 27 bp, Artificial sequence
  SiRNA target sequence
aaagaattgcaataataatatgtttag

SEQ ID NO: 194701 - DNA, 27 bp, Artificial sequence
  SiRNA target sequence
aagaattgcaataataatatgtttagg

SEQ ID NO: 194702 - DNA, 27 bp, Artificial sequence
  SiRNA target sequence
agaattgcaataataatatgtttagga

SEQ ID NO: 194703 - DNA, 27 bp, Artificial sequence
  SiRNA target sequence
gaattgcaataataatatgtttaggaa

SEQ ID NO: 194704 - DNA, 27 bp, Artificial sequence
  SiRNA target sequence
aattgcaataataatatgtttaggaaa

SEQ ID NO: 194705 - DNA, 27 bp, Artificial sequence
  SiRNA target sequence
attgcaataataatatgtttaggaaaa

SEQ ID NO: 194706 - DNA, 27 bp, Artificial sequence
  SiRNA target sequence
ttgcaataataatatgtttaggaaaag

SEQ ID NO: 194707 - DNA, 27 bp, Artificial sequence
  SiRNA target sequence
tgcaataataatatgtttaggaaaaga

SEQ ID NO: 194708 - DNA, 27 bp, Artificial sequence
  SiRNA target sequence
gcaataataatatgtttaggaaaagat

SEQ ID NO: 194709 - DNA, 27 bp, Artificial sequence
  SiRNA target sequence
caataataatatgtttaggaaaagatg

SEQ ID NO: 194710 - DNA, 27 bp, Artificial sequence
  SiRNA target sequence
aataataatatgtttaggaaaagatgc

SEQ ID NO: 194711 - DNA, 27 bp, Artificial sequence
  SiRNA target sequence
ataataatatgtttaggaaaagatgct

SEQ ID NO: 194712 - DNA, 27 bp, Artificial sequence
  SiRNA target sequence
taataatatgtttaggaaaagatgcta

SEQ ID NO: 194713 - DNA, 27 bp, Artificial sequence
  SiRNA target sequence
aataatatgtttaggaaaagatgctaa

SEQ ID NO: 194714 - DNA, 27 bp, Artificial sequence
  SiRNA target sequence
ataatatgtttaggaaaagatgctaac

SEQ ID NO: 194715 - DNA, 27 bp, Artificial sequence
  SiRNA target sequence
taatatgtttaggaaaagatgctaacc

SEQ ID NO: 194716 - DNA, 27 bp, Artificial sequence
  SiRNA target sequence
aatatgtttaggaaaagatgctaacct

SEQ ID NO: 194717 - DNA, 27 bp, Artificial sequence
  SiRNA target sequence
atatgtttaggaaaagatgctaacctt

SEQ ID NO: 194718 - DNA, 27 bp, Artificial sequence
  SiRNA target sequence
tatgtttaggaaaagatgctaaccttt

SEQ ID NO: 194719 - DNA, 27 bp, Artificial sequence
  SiRNA target sequence
atgtttaggaaaagatgctaaccttta

SEQ ID NO: 194720 - DNA, 27 bp, Artificial sequence
  SiRNA target sequence
tgtttaggaaaagatgctaacctttat

SEQ ID NO: 194721 - DNA, 27 bp, Artificial sequence
  SiRNA target sequence
gtttaggaaaagatgctaacctttatt

SEQ ID NO: 194722 - DNA, 27 bp, Artificial sequence
  SiRNA target sequence
tttaggaaaagatgctaacctttattt

SEQ ID NO: 194723 - DNA, 27 bp, Artificial sequence
  SiRNA target sequence
ttaggaaaagatgctaacctttattta

SEQ ID NO: 194724 - DNA, 27 bp, Artificial sequence
  SiRNA target sequence
taggaaaagatgctaacctttatttat

SEQ ID NO: 194725 - DNA, 27 bp, Artificial sequence
  SiRNA target sequence
aggaaaagatgctaacctttatttatt

SEQ ID NO: 194726 - DNA, 27 bp, Artificial sequence
  SiRNA target sequence
ggaaaagatgctaacctttatttatta

SEQ ID NO: 194727 - DNA, 27 bp, Artificial sequence
  SiRNA target sequence
gaaaagatgctaacctttatttattag

SEQ ID NO: 194728 - DNA, 27 bp, Artificial sequence
  SiRNA target sequence
aaaagatgctaacctttatttattaga

SEQ ID NO: 194729 - DNA, 27 bp, Artificial sequence
  SiRNA target sequence
aaagatgctaacctttatttattagat

SEQ ID NO: 194730 - DNA, 27 bp, Artificial sequence
  SiRNA target sequence
aagatgctaacctttatttattagatg

SEQ ID NO: 194731 - DNA, 27 bp, Artificial sequence
  SiRNA target sequence
agatgctaacctttatttattagatga

SEQ ID NO: 194732 - DNA, 27 bp, Artificial sequence
  SiRNA target sequence
gatgctaacctttatttattagatgaa

SEQ ID NO: 194733 - DNA, 27 bp, Artificial sequence
  SiRNA target sequence
atgctaacctttatttattagatgaac

SEQ ID NO: 194734 - DNA, 27 bp, Artificial sequence
  SiRNA target sequence
tgctaacctttatttattagatgaacc

SEQ ID NO: 194735 - DNA, 27 bp, Artificial sequence
  SiRNA target sequence
gctaacctttatttattagatgaacct

SEQ ID NO: 194736 - DNA, 27 bp, Artificial sequence
  SiRNA target sequence
ctaacctttatttattagatgaacctt

SEQ ID NO: 194737 - DNA, 27 bp, Artificial sequence
  SiRNA target sequence
taacctttatttattagatgaaccttc

SEQ ID NO: 194738 - DNA, 27 bp, Artificial sequence
  SiRNA target sequence
aacctttatttattagatgaaccttct

SEQ ID NO: 194739 - DNA, 27 bp, Artificial sequence
  SiRNA target sequence
acctttatttattagatgaaccttctg

SEQ ID NO: 194740 - DNA, 27 bp, Artificial sequence
  SiRNA target sequence
cctttatttattagatgaaccttctgc

SEQ ID NO: 194741 - DNA, 27 bp, Artificial sequence
  SiRNA target sequence
ctttatttattagatgaaccttctgcg

SEQ ID NO: 194742 - DNA, 27 bp, Artificial sequence
  SiRNA target sequence
tttatttattagatgaaccttctgcgt

SEQ ID NO: 194743 - DNA, 27 bp, Artificial sequence
  SiRNA target sequence
ttatttattagatgaaccttctgcgta

SEQ ID NO: 194744 - DNA, 27 bp, Artificial sequence
  SiRNA target sequence
tatttattagatgaaccttctgcgtat

SEQ ID NO: 194745 - DNA, 27 bp, Artificial sequence
  SiRNA target sequence
atttattagatgaaccttctgcgtatc

SEQ ID NO: 194746 - DNA, 27 bp, Artificial sequence
  SiRNA target sequence
tttattagatgaaccttctgcgtatct

SEQ ID NO: 194747 - DNA, 27 bp, Artificial sequence
  SiRNA target sequence
ttattagatgaaccttctgcgtatcta

SEQ ID NO: 194748 - DNA, 27 bp, Artificial sequence
  SiRNA target sequence
tattagatgaaccttctgcgtatctag

SEQ ID NO: 194749 - DNA, 27 bp, Artificial sequence
  SiRNA target sequence
attagatgaaccttctgcgtatctaga

SEQ ID NO: 194750 - DNA, 27 bp, Artificial sequence
  SiRNA target sequence
ttagatgaaccttctgcgtatctagat

SEQ ID NO: 194751 - DNA, 27 bp, Artificial sequence
  SiRNA target sequence
tagatgaaccttctgcgtatctagatt

SEQ ID NO: 194752 - DNA, 27 bp, Artificial sequence
  SiRNA target sequence
agatgaaccttctgcgtatctagattc

SEQ ID NO: 194753 - DNA, 27 bp, Artificial sequence
  SiRNA target sequence
gatgaaccttctgcgtatctagattca

SEQ ID NO: 194754 - DNA, 27 bp, Artificial sequence
  SiRNA target sequence
atgaaccttctgcgtatctagattcag

SEQ ID NO: 194755 - DNA, 27 bp, Artificial sequence
  SiRNA target sequence
tgaaccttctgcgtatctagattcaga

SEQ ID NO: 194756 - DNA, 27 bp, Artificial sequence
  SiRNA target sequence
gaaccttctgcgtatctagattcagat

SEQ ID NO: 194757 - DNA, 27 bp, Artificial sequence
  SiRNA target sequence
aaccttctgcgtatctagattcagatc

SEQ ID NO: 194758 - DNA, 27 bp, Artificial sequence
  SiRNA target sequence
accttctgcgtatctagattcagatca

SEQ ID NO: 194759 - DNA, 27 bp, Artificial sequence
  SiRNA target sequence
ccttctgcgtatctagattcagatcag

SEQ ID NO: 194760 - DNA, 27 bp, Artificial sequence
  SiRNA target sequence
cttctgcgtatctagattcagatcaga

SEQ ID NO: 194761 - DNA, 27 bp, Artificial sequence
  SiRNA target sequence
ttctgcgtatctagattcagatcagag

SEQ ID NO: 194762 - DNA, 27 bp, Artificial sequence
  SiRNA target sequence
tctgcgtatctagattcagatcagaga

SEQ ID NO: 194763 - DNA, 27 bp, Artificial sequence
  SiRNA target sequence
ctgcgtatctagattcagatcagagaa

SEQ ID NO: 194764 - DNA, 27 bp, Artificial sequence
  SiRNA target sequence
tgcgtatctagattcagatcagagaat

SEQ ID NO: 194765 - DNA, 27 bp, Artificial sequence
  SiRNA target sequence
gcgtatctagattcagatcagagaata

SEQ ID NO: 194766 - DNA, 27 bp, Artificial sequence
  SiRNA target sequence
cgtatctagattcagatcagagaatag

SEQ ID NO: 194767 - DNA, 27 bp, Artificial sequence
  SiRNA target sequence
gtatctagattcagatcagagaatagc

SEQ ID NO: 194768 - DNA, 27 bp, Artificial sequence
  SiRNA target sequence
tatctagattcagatcagagaatagcg

SEQ ID NO: 194769 - DNA, 27 bp, Artificial sequence
  SiRNA target sequence
atctagattcagatcagagaatagcga

SEQ ID NO: 194770 - DNA, 27 bp, Artificial sequence
  SiRNA target sequence
tctagattcagatcagagaatagcgat

SEQ ID NO: 194771 - DNA, 27 bp, Artificial sequence
  SiRNA target sequence
ctagattcagatcagagaatagcgatt

SEQ ID NO: 194772 - DNA, 27 bp, Artificial sequence
  SiRNA target sequence
tagattcagatcagagaatagcgattt

SEQ ID NO: 194773 - DNA, 27 bp, Artificial sequence
  SiRNA target sequence
agattcagatcagagaatagcgatttc

SEQ ID NO: 194774 - DNA, 27 bp, Artificial sequence
  SiRNA target sequence
gattcagatcagagaatagcgatttca

SEQ ID NO: 194775 - DNA, 27 bp, Artificial sequence
  SiRNA target sequence
attcagatcagagaatagcgatttcaa

SEQ ID NO: 194776 - DNA, 27 bp, Artificial sequence
  SiRNA target sequence
ttcagatcagagaatagcgatttcaaa

SEQ ID NO: 194777 - DNA, 27 bp, Artificial sequence
  SiRNA target sequence
tcagatcagagaatagcgatttcaaaa

SEQ ID NO: 194778 - DNA, 27 bp, Artificial sequence
  SiRNA target sequence
cagatcagagaatagcgatttcaaaag

SEQ ID NO: 194779 - DNA, 27 bp, Artificial sequence
  SiRNA target sequence
agatcagagaatagcgatttcaaaagt

SEQ ID NO: 194780 - DNA, 27 bp, Artificial sequence
  SiRNA target sequence
gatcagagaatagcgatttcaaaagtt

SEQ ID NO: 194781 - DNA, 27 bp, Artificial sequence
  SiRNA target sequence
atcagagaatagcgatttcaaaagtta

SEQ ID NO: 194782 - DNA, 27 bp, Artificial sequence
  SiRNA target sequence
tcagagaatagcgatttcaaaagttat

SEQ ID NO: 194783 - DNA, 27 bp, Artificial sequence
  SiRNA target sequence
cagagaatagcgatttcaaaagttata

SEQ ID NO: 194784 - DNA, 27 bp, Artificial sequence
  SiRNA target sequence
agagaatagcgatttcaaaagttataa

SEQ ID NO: 194785 - DNA, 27 bp, Artificial sequence
  SiRNA target sequence
gagaatagcgatttcaaaagttataaa

SEQ ID NO: 194786 - DNA, 27 bp, Artificial sequence
  SiRNA target sequence
agaatagcgatttcaaaagttataaaa

SEQ ID NO: 194787 - DNA, 27 bp, Artificial sequence
  SiRNA target sequence
gaatagcgatttcaaaagttataaaaa

SEQ ID NO: 194788 - DNA, 27 bp, Artificial sequence
  SiRNA target sequence
aatagcgatttcaaaagttataaaaag

SEQ ID NO: 194789 - DNA, 27 bp, Artificial sequence
  SiRNA target sequence
atagcgatttcaaaagttataaaaagg

SEQ ID NO: 194790 - DNA, 27 bp, Artificial sequence
  SiRNA target sequence
tagcgatttcaaaagttataaaaaggt

SEQ ID NO: 194791 - DNA, 27 bp, Artificial sequence
  SiRNA target sequence
agcgatttcaaaagttataaaaaggtt

SEQ ID NO: 194792 - DNA, 27 bp, Artificial sequence
  SiRNA target sequence
gcgatttcaaaagttataaaaaggttt

SEQ ID NO: 194793 - DNA, 27 bp, Artificial sequence
  SiRNA target sequence
cgatttcaaaagttataaaaaggttta

SEQ ID NO: 194794 - DNA, 27 bp, Artificial sequence
  SiRNA target sequence
gatttcaaaagttataaaaaggtttat

SEQ ID NO: 194795 - DNA, 27 bp, Artificial sequence
  SiRNA target sequence
atttcaaaagttataaaaaggtttatt

SEQ ID NO: 194796 - DNA, 27 bp, Artificial sequence
  SiRNA target sequence
tttcaaaagttataaaaaggtttattt

SEQ ID NO: 194797 - DNA, 27 bp, Artificial sequence
  SiRNA target sequence
ttcaaaagttataaaaaggtttattta

SEQ ID NO: 194798 - DNA, 27 bp, Artificial sequence
  SiRNA target sequence
tcaaaagttataaaaaggtttatttat

SEQ ID NO: 194799 - DNA, 27 bp, Artificial sequence
  SiRNA target sequence
caaaagttataaaaaggtttatttatg

SEQ ID NO: 194800 - DNA, 27 bp, Artificial sequence
  SiRNA target sequence
aaaagttataaaaaggtttatttatgg

SEQ ID NO: 194801 - DNA, 27 bp, Artificial sequence
  SiRNA target sequence
aaagttataaaaaggtttatttatggg

SEQ ID NO: 194802 - DNA, 27 bp, Artificial sequence
  SiRNA target sequence
aagttataaaaaggtttatttatggga

SEQ ID NO: 194803 - DNA, 27 bp, Artificial sequence
  SiRNA target sequence
agttataaaaaggtttatttatgggaa

SEQ ID NO: 194804 - DNA, 27 bp, Artificial sequence
  SiRNA target sequence
gttataaaaaggtttatttatgggaag

SEQ ID NO: 194805 - DNA, 27 bp, Artificial sequence
  SiRNA target sequence
ttataaaaaggtttatttatgggaaga

SEQ ID NO: 194806 - DNA, 27 bp, Artificial sequence
  SiRNA target sequence
tataaaaaggtttatttatgggaagaa

SEQ ID NO: 194807 - DNA, 27 bp, Artificial sequence
  SiRNA target sequence
ataaaaaggtttatttatgggaagaag

SEQ ID NO: 194808 - DNA, 27 bp, Artificial sequence
  SiRNA target sequence
taaaaaggtttatttatgggaagaagc

SEQ ID NO: 194809 - DNA, 27 bp, Artificial sequence
  SiRNA target sequence
aaaaaggtttatttatgggaagaagcg

SEQ ID NO: 194810 - DNA, 27 bp, Artificial sequence
  SiRNA target sequence
aaaaggtttatttatgggaagaagcga

SEQ ID NO: 194811 - DNA, 27 bp, Artificial sequence
  SiRNA target sequence
aaaggtttatttatgggaagaagcgaa

SEQ ID NO: 194812 - DNA, 27 bp, Artificial sequence
  SiRNA target sequence
aaggtttatttatgggaagaagcgaac

SEQ ID NO: 194813 - DNA, 27 bp, Artificial sequence
  SiRNA target sequence
aggtttatttatgggaagaagcgaaca

SEQ ID NO: 194814 - DNA, 27 bp, Artificial sequence
  SiRNA target sequence
ggtttatttatgggaagaagcgaacag

SEQ ID NO: 194815 - DNA, 27 bp, Artificial sequence
  SiRNA target sequence
gtttatttatgggaagaagcgaacagc

SEQ ID NO: 194816 - DNA, 27 bp, Artificial sequence
  SiRNA target sequence
tttatttatgggaagaagcgaacagcc

SEQ ID NO: 194817 - DNA, 27 bp, Artificial sequence
  SiRNA target sequence
ttatttatgggaagaagcgaacagcct

SEQ ID NO: 194818 - DNA, 27 bp, Artificial sequence
  SiRNA target sequence
tatttatgggaagaagcgaacagcctt

SEQ ID NO: 194819 - DNA, 27 bp, Artificial sequence
  SiRNA target sequence
atttatgggaagaagcgaacagccttt

SEQ ID NO: 194820 - DNA, 27 bp, Artificial sequence
  SiRNA target sequence
tttatgggaagaagcgaacagcctttg

SEQ ID NO: 194821 - DNA, 27 bp, Artificial sequence
  SiRNA target sequence
ttatgggaagaagcgaacagcctttgt

SEQ ID NO: 194822 - DNA, 27 bp, Artificial sequence
  SiRNA target sequence
tatgggaagaagcgaacagcctttgtg

SEQ ID NO: 194823 - DNA, 27 bp, Artificial sequence
  SiRNA target sequence
atgggaagaagcgaacagcctttgtgg

SEQ ID NO: 194824 - DNA, 27 bp, Artificial sequence
  SiRNA target sequence
tgggaagaagcgaacagcctttgtggt

SEQ ID NO: 194825 - DNA, 27 bp, Artificial sequence
  SiRNA target sequence
gggaagaagcgaacagcctttgtggtt

SEQ ID NO: 194826 - DNA, 27 bp, Artificial sequence
  SiRNA target sequence
ggaagaagcgaacagcctttgtggttg

SEQ ID NO: 194827 - DNA, 27 bp, Artificial sequence
  SiRNA target sequence
gaagaagcgaacagcctttgtggttga

SEQ ID NO: 194828 - DNA, 27 bp, Artificial sequence
  SiRNA target sequence
aagaagcgaacagcctttgtggttgaa

SEQ ID NO: 194829 - DNA, 27 bp, Artificial sequence
  SiRNA target sequence
agaagcgaacagcctttgtggttgaac

SEQ ID NO: 194830 - DNA, 27 bp, Artificial sequence
  SiRNA target sequence
gaagcgaacagcctttgtggttgaaca

SEQ ID NO: 194831 - DNA, 27 bp, Artificial sequence
  SiRNA target sequence
aagcgaacagcctttgtggttgaacat

SEQ ID NO: 194832 - DNA, 27 bp, Artificial sequence
  SiRNA target sequence
agcgaacagcctttgtggttgaacatg

SEQ ID NO: 194833 - DNA, 27 bp, Artificial sequence
  SiRNA target sequence
gcgaacagcctttgtggttgaacatga

SEQ ID NO: 194834 - DNA, 27 bp, Artificial sequence
  SiRNA target sequence
cgaacagcctttgtggttgaacatgat

SEQ ID NO: 194835 - DNA, 27 bp, Artificial sequence
  SiRNA target sequence
gaacagcctttgtggttgaacatgatt

SEQ ID NO: 194836 - DNA, 27 bp, Artificial sequence
  SiRNA target sequence
aacagcctttgtggttgaacatgattt

SEQ ID NO: 194837 - DNA, 27 bp, Artificial sequence
  SiRNA target sequence
acagcctttgtggttgaacatgattta

SEQ ID NO: 194838 - DNA, 27 bp, Artificial sequence
  SiRNA target sequence
cagcctttgtggttgaacatgatttaa

SEQ ID NO: 194839 - DNA, 27 bp, Artificial sequence
  SiRNA target sequence
agcctttgtggttgaacatgatttaat

SEQ ID NO: 194840 - DNA, 27 bp, Artificial sequence
  SiRNA target sequence
gcctttgtggttgaacatgatttaatt

SEQ ID NO: 194841 - DNA, 27 bp, Artificial sequence
  SiRNA target sequence
cctttgtggttgaacatgatttaattg

SEQ ID NO: 194842 - DNA, 27 bp, Artificial sequence
  SiRNA target sequence
ctttgtggttgaacatgatttaattgt

SEQ ID NO: 194843 - DNA, 27 bp, Artificial sequence
  SiRNA target sequence
tttgtggttgaacatgatttaattgta

SEQ ID NO: 194844 - DNA, 27 bp, Artificial sequence
  SiRNA target sequence
ttgtggttgaacatgatttaattgtag

SEQ ID NO: 194845 - DNA, 27 bp, Artificial sequence
  SiRNA target sequence
tgtggttgaacatgatttaattgtagg

SEQ ID NO: 194846 - DNA, 27 bp, Artificial sequence
  SiRNA target sequence
gtggttgaacatgatttaattgtaggt

SEQ ID NO: 194847 - DNA, 27 bp, Artificial sequence
  SiRNA target sequence
tggttgaacatgatttaattgtaggta

SEQ ID NO: 194848 - DNA, 27 bp, Artificial sequence
  SiRNA target sequence
ggttgaacatgatttaattgtaggtac

SEQ ID NO: 194849 - DNA, 27 bp, Artificial sequence
  SiRNA target sequence
gttgaacatgatttaattgtaggtaca

SEQ ID NO: 194850 - DNA, 27 bp, Artificial sequence
  SiRNA target sequence
ttgaacatgatttaattgtaggtacat

SEQ ID NO: 194851 - DNA, 27 bp, Artificial sequence
  SiRNA target sequence
tgaacatgatttaattgtaggtacata

SEQ ID NO: 194852 - DNA, 27 bp, Artificial sequence
  SiRNA target sequence
gaacatgatttaattgtaggtacatat

SEQ ID NO: 194853 - DNA, 27 bp, Artificial sequence
  SiRNA target sequence
aacatgatttaattgtaggtacatatt

SEQ ID NO: 194854 - DNA, 27 bp, Artificial sequence
  SiRNA target sequence
acatgatttaattgtaggtacatattt

SEQ ID NO: 194855 - DNA, 27 bp, Artificial sequence
  SiRNA target sequence
catgatttaattgtaggtacatatttg

SEQ ID NO: 194856 - DNA, 27 bp, Artificial sequence
  SiRNA target sequence
atgatttaattgtaggtacatatttgg

SEQ ID NO: 194857 - DNA, 27 bp, Artificial sequence
  SiRNA target sequence
tgatttaattgtaggtacatatttggc

SEQ ID NO: 194858 - DNA, 27 bp, Artificial sequence
  SiRNA target sequence
gatttaattgtaggtacatatttggct

SEQ ID NO: 194859 - DNA, 27 bp, Artificial sequence
  SiRNA target sequence
atttaattgtaggtacatatttggctg

SEQ ID NO: 194860 - DNA, 27 bp, Artificial sequence
  SiRNA target sequence
tttaattgtaggtacatatttggctga

SEQ ID NO: 194861 - DNA, 27 bp, Artificial sequence
  SiRNA target sequence
ttaattgtaggtacatatttggctgat

SEQ ID NO: 194862 - DNA, 27 bp, Artificial sequence
  SiRNA target sequence
taattgtaggtacatatttggctgata

SEQ ID NO: 194863 - DNA, 27 bp, Artificial sequence
  SiRNA target sequence
aattgtaggtacatatttggctgataa

SEQ ID NO: 194864 - DNA, 27 bp, Artificial sequence
  SiRNA target sequence
attgtaggtacatatttggctgataaa

SEQ ID NO: 194865 - DNA, 27 bp, Artificial sequence
  SiRNA target sequence
ttgtaggtacatatttggctgataaag

SEQ ID NO: 194866 - DNA, 27 bp, Artificial sequence
  SiRNA target sequence
tgtaggtacatatttggctgataaagt

SEQ ID NO: 194867 - DNA, 27 bp, Artificial sequence
  SiRNA target sequence
gtaggtacatatttggctgataaagtt

SEQ ID NO: 194868 - DNA, 27 bp, Artificial sequence
  SiRNA target sequence
taggtacatatttggctgataaagttg

SEQ ID NO: 194869 - DNA, 27 bp, Artificial sequence
  SiRNA target sequence
aggtacatatttggctgataaagttgt

SEQ ID NO: 194870 - DNA, 27 bp, Artificial sequence
  SiRNA target sequence
ggtacatatttggctgataaagttgtt

SEQ ID NO: 194871 - DNA, 27 bp, Artificial sequence
  SiRNA target sequence
gtacatatttggctgataaagttgttg

SEQ ID NO: 194872 - DNA, 27 bp, Artificial sequence
  SiRNA target sequence
tacatatttggctgataaagttgttgt

SEQ ID NO: 194873 - DNA, 27 bp, Artificial sequence
  SiRNA target sequence
acatatttggctgataaagttgttgtt

SEQ ID NO: 194874 - DNA, 27 bp, Artificial sequence
  SiRNA target sequence
catatttggctgataaagttgttgttt

SEQ ID NO: 194875 - DNA, 27 bp, Artificial sequence
  SiRNA target sequence
atatttggctgataaagttgttgtttt

SEQ ID NO: 194876 - DNA, 27 bp, Artificial sequence
  SiRNA target sequence
tatttggctgataaagttgttgttttt

SEQ ID NO: 194877 - DNA, 27 bp, Artificial sequence
  SiRNA target sequence
atttggctgataaagttgttgtttttg

SEQ ID NO: 194878 - DNA, 27 bp, Artificial sequence
  SiRNA target sequence
tttggctgataaagttgttgtttttga

SEQ ID NO: 194879 - DNA, 27 bp, Artificial sequence
  SiRNA target sequence
ttggctgataaagttgttgtttttgag

SEQ ID NO: 194880 - DNA, 27 bp, Artificial sequence
  SiRNA target sequence
tggctgataaagttgttgtttttgagg

SEQ ID NO: 194881 - DNA, 27 bp, Artificial sequence
  SiRNA target sequence
ggctgataaagttgttgtttttgaggg

SEQ ID NO: 194882 - DNA, 27 bp, Artificial sequence
  SiRNA target sequence
gctgataaagttgttgtttttgaggga

SEQ ID NO: 194883 - DNA, 27 bp, Artificial sequence
  SiRNA target sequence
ctgataaagttgttgtttttgagggaa

SEQ ID NO: 194884 - DNA, 27 bp, Artificial sequence
  SiRNA target sequence
tgataaagttgttgtttttgagggaag

SEQ ID NO: 194885 - DNA, 27 bp, Artificial sequence
  SiRNA target sequence
gataaagttgttgtttttgagggaagc

SEQ ID NO: 194886 - DNA, 27 bp, Artificial sequence
  SiRNA target sequence
ataaagttgttgtttttgagggaagcc

SEQ ID NO: 194887 - DNA, 27 bp, Artificial sequence
  SiRNA target sequence
taaagttgttgtttttgagggaagccc

SEQ ID NO: 194888 - DNA, 27 bp, Artificial sequence
  SiRNA target sequence
aaagttgttgtttttgagggaagccct

SEQ ID NO: 194889 - DNA, 27 bp, Artificial sequence
  SiRNA target sequence
aagttgttgtttttgagggaagcccta

SEQ ID NO: 194890 - DNA, 27 bp, Artificial sequence
  SiRNA target sequence
agttgttgtttttgagggaagccctag

SEQ ID NO: 194891 - DNA, 27 bp, Artificial sequence
  SiRNA target sequence
gttgttgtttttgagggaagccctagt

SEQ ID NO: 194892 - DNA, 27 bp, Artificial sequence
  SiRNA target sequence
ttgttgtttttgagggaagccctagtg

SEQ ID NO: 194893 - DNA, 27 bp, Artificial sequence
  SiRNA target sequence
tgttgtttttgagggaagccctagtgt

SEQ ID NO: 194894 - DNA, 27 bp, Artificial sequence
  SiRNA target sequence
gttgtttttgagggaagccctagtgtt

SEQ ID NO: 194895 - DNA, 27 bp, Artificial sequence
  SiRNA target sequence
ttgtttttgagggaagccctagtgttc

SEQ ID NO: 194896 - DNA, 27 bp, Artificial sequence
  SiRNA target sequence
tgtttttgagggaagccctagtgttca

SEQ ID NO: 194897 - DNA, 27 bp, Artificial sequence
  SiRNA target sequence
gtttttgagggaagccctagtgttcat

SEQ ID NO: 194898 - DNA, 27 bp, Artificial sequence
  SiRNA target sequence
tttttgagggaagccctagtgttcata

SEQ ID NO: 194899 - DNA, 27 bp, Artificial sequence
  SiRNA target sequence
ttttgagggaagccctagtgttcatag

SEQ ID NO: 194900 - DNA, 27 bp, Artificial sequence
  SiRNA target sequence
tttgagggaagccctagtgttcatagc

SEQ ID NO: 194901 - DNA, 27 bp, Artificial sequence
  SiRNA target sequence
ttgagggaagccctagtgttcatagca

SEQ ID NO: 194902 - DNA, 27 bp, Artificial sequence
  SiRNA target sequence
tgagggaagccctagtgttcatagcac

SEQ ID NO: 194903 - DNA, 27 bp, Artificial sequence
  SiRNA target sequence
gagggaagccctagtgttcatagcact

SEQ ID NO: 194904 - DNA, 27 bp, Artificial sequence
  SiRNA target sequence
agggaagccctagtgttcatagcactg

SEQ ID NO: 194905 - DNA, 27 bp, Artificial sequence
  SiRNA target sequence
gggaagccctagtgttcatagcactgc

SEQ ID NO: 194906 - DNA, 27 bp, Artificial sequence
  SiRNA target sequence
ggaagccctagtgttcatagcactgct

SEQ ID NO: 194907 - DNA, 27 bp, Artificial sequence
  SiRNA target sequence
gaagccctagtgttcatagcactgctc

SEQ ID NO: 194908 - DNA, 27 bp, Artificial sequence
  SiRNA target sequence
aagccctagtgttcatagcactgctca

SEQ ID NO: 194909 - DNA, 27 bp, Artificial sequence
  SiRNA target sequence
agccctagtgttcatagcactgctcat

SEQ ID NO: 194910 - DNA, 27 bp, Artificial sequence
  SiRNA target sequence
gccctagtgttcatagcactgctcata

SEQ ID NO: 194911 - DNA, 27 bp, Artificial sequence
  SiRNA target sequence
ccctagtgttcatagcactgctcataa

SEQ ID NO: 194912 - DNA, 27 bp, Artificial sequence
  SiRNA target sequence
cctagtgttcatagcactgctcataaa

SEQ ID NO: 194913 - DNA, 27 bp, Artificial sequence
  SiRNA target sequence
ctagtgttcatagcactgctcataaac

SEQ ID NO: 194914 - DNA, 27 bp, Artificial sequence
  SiRNA target sequence
tagtgttcatagcactgctcataaacc

SEQ ID NO: 194915 - DNA, 27 bp, Artificial sequence
  SiRNA target sequence
agtgttcatagcactgctcataaaccg

SEQ ID NO: 194916 - DNA, 27 bp, Artificial sequence
  SiRNA target sequence
gtgttcatagcactgctcataaaccga

SEQ ID NO: 194917 - DNA, 27 bp, Artificial sequence
  SiRNA target sequence
tgttcatagcactgctcataaaccgat

SEQ ID NO: 194918 - DNA, 27 bp, Artificial sequence
  SiRNA target sequence
gttcatagcactgctcataaaccgatg

SEQ ID NO: 194919 - DNA, 27 bp, Artificial sequence
  SiRNA target sequence
ttcatagcactgctcataaaccgatgg

SEQ ID NO: 194920 - DNA, 27 bp, Artificial sequence
  SiRNA target sequence
tcatagcactgctcataaaccgatgga

SEQ ID NO: 194921 - DNA, 27 bp, Artificial sequence
  SiRNA target sequence
catagcactgctcataaaccgatggat

SEQ ID NO: 194922 - DNA, 27 bp, Artificial sequence
  SiRNA target sequence
atagcactgctcataaaccgatggatt

SEQ ID NO: 194923 - DNA, 27 bp, Artificial sequence
  SiRNA target sequence
tagcactgctcataaaccgatggattt

SEQ ID NO: 194924 - DNA, 27 bp, Artificial sequence
  SiRNA target sequence
agcactgctcataaaccgatggatttg

SEQ ID NO: 194925 - DNA, 27 bp, Artificial sequence
  SiRNA target sequence
gcactgctcataaaccgatggatttgc

SEQ ID NO: 194926 - DNA, 27 bp, Artificial sequence
  SiRNA target sequence
cactgctcataaaccgatggatttgca

SEQ ID NO: 194927 - DNA, 27 bp, Artificial sequence
  SiRNA target sequence
actgctcataaaccgatggatttgcat

SEQ ID NO: 194928 - DNA, 27 bp, Artificial sequence
  SiRNA target sequence
ctgctcataaaccgatggatttgcata

SEQ ID NO: 194929 - DNA, 27 bp, Artificial sequence
  SiRNA target sequence
tgctcataaaccgatggatttgcatag

SEQ ID NO: 194930 - DNA, 27 bp, Artificial sequence
  SiRNA target sequence
gctcataaaccgatggatttgcatagt

SEQ ID NO: 194931 - DNA, 27 bp, Artificial sequence
  SiRNA target sequence
ctcataaaccgatggatttgcatagtg

SEQ ID NO: 194932 - DNA, 27 bp, Artificial sequence
  SiRNA target sequence
tcataaaccgatggatttgcatagtgg

SEQ ID NO: 194933 - DNA, 27 bp, Artificial sequence
  SiRNA target sequence
cataaaccgatggatttgcatagtgga

SEQ ID NO: 194934 - DNA, 27 bp, Artificial sequence
  SiRNA target sequence
ataaaccgatggatttgcatagtggaa

SEQ ID NO: 194935 - DNA, 27 bp, Artificial sequence
  SiRNA target sequence
taaaccgatggatttgcatagtggaat

SEQ ID NO: 194936 - DNA, 27 bp, Artificial sequence
  SiRNA target sequence
aaaccgatggatttgcatagtggaatg

SEQ ID NO: 194937 - DNA, 27 bp, Artificial sequence
  SiRNA target sequence
aaccgatggatttgcatagtggaatga

SEQ ID NO: 194938 - DNA, 27 bp, Artificial sequence
  SiRNA target sequence
accgatggatttgcatagtggaatgaa

SEQ ID NO: 194939 - DNA, 27 bp, Artificial sequence
  SiRNA target sequence
ccgatggatttgcatagtggaatgaat

SEQ ID NO: 194940 - DNA, 27 bp, Artificial sequence
  SiRNA target sequence
cgatggatttgcatagtggaatgaata

SEQ ID NO: 194941 - DNA, 27 bp, Artificial sequence
  SiRNA target sequence
gatggatttgcatagtggaatgaatat

SEQ ID NO: 194942 - DNA, 27 bp, Artificial sequence
  SiRNA target sequence
atggatttgcatagtggaatgaatatt

SEQ ID NO: 194943 - DNA, 27 bp, Artificial sequence
  SiRNA target sequence
tggatttgcatagtggaatgaatattt

SEQ ID NO: 194944 - DNA, 27 bp, Artificial sequence
  SiRNA target sequence
ggatttgcatagtggaatgaatatttt

SEQ ID NO: 194945 - DNA, 27 bp, Artificial sequence
  SiRNA target sequence
gatttgcatagtggaatgaatattttt

SEQ ID NO: 194946 - DNA, 27 bp, Artificial sequence
  SiRNA target sequence
atttgcatagtggaatgaatatttttt

SEQ ID NO: 194947 - DNA, 27 bp, Artificial sequence
  SiRNA target sequence
tttgcatagtggaatgaatattttttt

SEQ ID NO: 194948 - DNA, 27 bp, Artificial sequence
  SiRNA target sequence
ttgcatagtggaatgaatattttttta

SEQ ID NO: 194949 - DNA, 27 bp, Artificial sequence
  SiRNA target sequence
tgcatagtggaatgaatatttttttaa

SEQ ID NO: 194950 - DNA, 27 bp, Artificial sequence
  SiRNA target sequence
gcatagtggaatgaatatttttttaaa

SEQ ID NO: 194951 - DNA, 27 bp, Artificial sequence
  SiRNA target sequence
catagtggaatgaatatttttttaaag

SEQ ID NO: 194952 - DNA, 27 bp, Artificial sequence
  SiRNA target sequence
atagtggaatgaatatttttttaaaga

SEQ ID NO: 194953 - DNA, 27 bp, Artificial sequence
  SiRNA target sequence
tagtggaatgaatatttttttaaagaa

SEQ ID NO: 194954 - DNA, 27 bp, Artificial sequence
  SiRNA target sequence
agtggaatgaatatttttttaaagaat

SEQ ID NO: 194955 - DNA, 27 bp, Artificial sequence
  SiRNA target sequence
gtggaatgaatatttttttaaagaatc

SEQ ID NO: 194956 - DNA, 27 bp, Artificial sequence
  SiRNA target sequence
tggaatgaatatttttttaaagaatct

SEQ ID NO: 194957 - DNA, 27 bp, Artificial sequence
  SiRNA target sequence
ggaatgaatatttttttaaagaatctt

SEQ ID NO: 194958 - DNA, 27 bp, Artificial sequence
  SiRNA target sequence
gaatgaatatttttttaaagaatcttg

SEQ ID NO: 194959 - DNA, 27 bp, Artificial sequence
  SiRNA target sequence
aatgaatatttttttaaagaatcttga

SEQ ID NO: 194960 - DNA, 27 bp, Artificial sequence
  SiRNA target sequence
atgaatatttttttaaagaatcttgat

SEQ ID NO: 194961 - DNA, 27 bp, Artificial sequence
  SiRNA target sequence
tgaatatttttttaaagaatcttgata

SEQ ID NO: 194962 - DNA, 27 bp, Artificial sequence
  SiRNA target sequence
gaatatttttttaaagaatcttgatat

SEQ ID NO: 194963 - DNA, 27 bp, Artificial sequence
  SiRNA target sequence
aatatttttttaaagaatcttgatatt

SEQ ID NO: 194964 - DNA, 27 bp, Artificial sequence
  SiRNA target sequence
atatttttttaaagaatcttgatatta

SEQ ID NO: 194965 - DNA, 27 bp, Artificial sequence
  SiRNA target sequence
tatttttttaaagaatcttgatattac

SEQ ID NO: 194966 - DNA, 27 bp, Artificial sequence
  SiRNA target sequence
atttttttaaagaatcttgatattact

SEQ ID NO: 194967 - DNA, 27 bp, Artificial sequence
  SiRNA target sequence
tttttttaaagaatcttgatattactt

SEQ ID NO: 194968 - DNA, 27 bp, Artificial sequence
  SiRNA target sequence
ttttttaaagaatcttgatattacttt

SEQ ID NO: 194969 - DNA, 27 bp, Artificial sequence
  SiRNA target sequence
tttttaaagaatcttgatattactttt

SEQ ID NO: 194970 - DNA, 27 bp, Artificial sequence
  SiRNA target sequence
ttttaaagaatcttgatattactttta

SEQ ID NO: 194971 - DNA, 27 bp, Artificial sequence
  SiRNA target sequence
tttaaagaatcttgatattacttttag

SEQ ID NO: 194972 - DNA, 27 bp, Artificial sequence
  SiRNA target sequence
ttaaagaatcttgatattacttttaga

SEQ ID NO: 194973 - DNA, 27 bp, Artificial sequence
  SiRNA target sequence
taaagaatcttgatattacttttagaa

SEQ ID NO: 194974 - DNA, 27 bp, Artificial sequence
  SiRNA target sequence
aaagaatcttgatattacttttagaag

SEQ ID NO: 194975 - DNA, 27 bp, Artificial sequence
  SiRNA target sequence
aagaatcttgatattacttttagaaga

SEQ ID NO: 194976 - DNA, 27 bp, Artificial sequence
  SiRNA target sequence
agaatcttgatattacttttagaagag

SEQ ID NO: 194977 - DNA, 27 bp, Artificial sequence
  SiRNA target sequence
gaatcttgatattacttttagaagaga

SEQ ID NO: 194978 - DNA, 27 bp, Artificial sequence
  SiRNA target sequence
aatcttgatattacttttagaagagac

SEQ ID NO: 194979 - DNA, 27 bp, Artificial sequence
  SiRNA target sequence
atcttgatattacttttagaagagact

SEQ ID NO: 194980 - DNA, 27 bp, Artificial sequence
  SiRNA target sequence
tcttgatattacttttagaagagactc

SEQ ID NO: 194981 - DNA, 27 bp, Artificial sequence
  SiRNA target sequence
cttgatattacttttagaagagactct

SEQ ID NO: 194982 - DNA, 27 bp, Artificial sequence
  SiRNA target sequence
ttgatattacttttagaagagactctt

SEQ ID NO: 194983 - DNA, 27 bp, Artificial sequence
  SiRNA target sequence
tgatattacttttagaagagactcttc

SEQ ID NO: 194984 - DNA, 27 bp, Artificial sequence
  SiRNA target sequence
gatattacttttagaagagactcttcc

SEQ ID NO: 194985 - DNA, 27 bp, Artificial sequence
  SiRNA target sequence
atattacttttagaagagactcttcca

SEQ ID NO: 194986 - DNA, 27 bp, Artificial sequence
  SiRNA target sequence
tattacttttagaagagactcttccaa

SEQ ID NO: 194987 - DNA, 27 bp, Artificial sequence
  SiRNA target sequence
attacttttagaagagactcttccaat

SEQ ID NO: 194988 - DNA, 27 bp, Artificial sequence
  SiRNA target sequence
ttacttttagaagagactcttccaatt

SEQ ID NO: 194989 - DNA, 27 bp, Artificial sequence
  SiRNA target sequence
tacttttagaagagactcttccaattt

SEQ ID NO: 194990 - DNA, 27 bp, Artificial sequence
  SiRNA target sequence
acttttagaagagactcttccaatttt

SEQ ID NO: 194991 - DNA, 27 bp, Artificial sequence
  SiRNA target sequence
cttttagaagagactcttccaatttta

SEQ ID NO: 194992 - DNA, 27 bp, Artificial sequence
  SiRNA target sequence
ttttagaagagactcttccaattttag

SEQ ID NO: 194993 - DNA, 27 bp, Artificial sequence
  SiRNA target sequence
tttagaagagactcttccaattttaga

SEQ ID NO: 194994 - DNA, 27 bp, Artificial sequence
  SiRNA target sequence
ttagaagagactcttccaattttagac

SEQ ID NO: 194995 - DNA, 27 bp, Artificial sequence
  SiRNA target sequence
tagaagagactcttccaattttagacc

SEQ ID NO: 194996 - DNA, 27 bp, Artificial sequence
  SiRNA target sequence
agaagagactcttccaattttagacca

SEQ ID NO: 194997 - DNA, 27 bp, Artificial sequence
  SiRNA target sequence
gaagagactcttccaattttagaccaa

SEQ ID NO: 194998 - DNA, 27 bp, Artificial sequence
  SiRNA target sequence
aagagactcttccaattttagaccaag

SEQ ID NO: 194999 - DNA, 27 bp, Artificial sequence
  SiRNA target sequence
agagactcttccaattttagaccaaga

SEQ ID NO: 195000 - DNA, 27 bp, Artificial sequence
  SiRNA target sequence
gagactcttccaattttagaccaagag

SEQ ID NO: 195001 - DNA, 27 bp, Artificial sequence
  SiRNA target sequence
agactcttccaattttagaccaagagt

SEQ ID NO: 195002 - DNA, 27 bp, Artificial sequence
  SiRNA target sequence
gactcttccaattttagaccaagagtt

SEQ ID NO: 195003 - DNA, 27 bp, Artificial sequence
  SiRNA target sequence
actcttccaattttagaccaagagtta

SEQ ID NO: 195004 - DNA, 27 bp, Artificial sequence
  SiRNA target sequence
ctcttccaattttagaccaagagttaa

SEQ ID NO: 195005 - DNA, 27 bp, Artificial sequence
  SiRNA target sequence
tcttccaattttagaccaagagttaat

SEQ ID NO: 195006 - DNA, 27 bp, Artificial sequence
  SiRNA target sequence
cttccaattttagaccaagagttaata

SEQ ID NO: 195007 - DNA, 27 bp, Artificial sequence
  SiRNA target sequence
ttccaattttagaccaagagttaataa

SEQ ID NO: 195008 - DNA, 27 bp, Artificial sequence
  SiRNA target sequence
tccaattttagaccaagagttaataag

SEQ ID NO: 195009 - DNA, 27 bp, Artificial sequence
  SiRNA target sequence
ccaattttagaccaagagttaataagc

SEQ ID NO: 195010 - DNA, 27 bp, Artificial sequence
  SiRNA target sequence
caattttagaccaagagttaataagcc

SEQ ID NO: 195011 - DNA, 27 bp, Artificial sequence
  SiRNA target sequence
aattttagaccaagagttaataagccg

SEQ ID NO: 195012 - DNA, 27 bp, Artificial sequence
  SiRNA target sequence
attttagaccaagagttaataagccga

SEQ ID NO: 195013 - DNA, 27 bp, Artificial sequence
  SiRNA target sequence
ttttagaccaagagttaataagccgaa

SEQ ID NO: 195014 - DNA, 27 bp, Artificial sequence
  SiRNA target sequence
tttagaccaagagttaataagccgaat

SEQ ID NO: 195015 - DNA, 27 bp, Artificial sequence
  SiRNA target sequence
ttagaccaagagttaataagccgaatt

SEQ ID NO: 195016 - DNA, 27 bp, Artificial sequence
  SiRNA target sequence
tagaccaagagttaataagccgaattc

SEQ ID NO: 195017 - DNA, 27 bp, Artificial sequence
  SiRNA target sequence
agaccaagagttaataagccgaattcc

SEQ ID NO: 195018 - DNA, 27 bp, Artificial sequence
  SiRNA target sequence
gaccaagagttaataagccgaattccg

SEQ ID NO: 195019 - DNA, 27 bp, Artificial sequence
  SiRNA target sequence
accaagagttaataagccgaattccgc

SEQ ID NO: 195020 - DNA, 27 bp, Artificial sequence
  SiRNA target sequence
ccaagagttaataagccgaattccgca

SEQ ID NO: 195021 - DNA, 27 bp, Artificial sequence
  SiRNA target sequence
caagagttaataagccgaattccgcaa

SEQ ID NO: 195022 - DNA, 27 bp, Artificial sequence
  SiRNA target sequence
aagagttaataagccgaattccgcaaa

SEQ ID NO: 195023 - DNA, 27 bp, Artificial sequence
  SiRNA target sequence
agagttaataagccgaattccgcaaaa

SEQ ID NO: 195024 - DNA, 27 bp, Artificial sequence
  SiRNA target sequence
gagttaataagccgaattccgcaaaag

SEQ ID NO: 195025 - DNA, 27 bp, Artificial sequence
  SiRNA target sequence
agttaataagccgaattccgcaaaaga

SEQ ID NO: 195026 - DNA, 27 bp, Artificial sequence
  SiRNA target sequence
gttaataagccgaattccgcaaaagac

SEQ ID NO: 195027 - DNA, 27 bp, Artificial sequence
  SiRNA target sequence
ttaataagccgaattccgcaaaagaca

SEQ ID NO: 195028 - DNA, 27 bp, Artificial sequence
  SiRNA target sequence
taataagccgaattccgcaaaagacag

SEQ ID NO: 195029 - DNA, 27 bp, Artificial sequence
  SiRNA target sequence
aataagccgaattccgcaaaagacaga

SEQ ID NO: 195030 - DNA, 27 bp, Artificial sequence
  SiRNA target sequence
ataagccgaattccgcaaaagacagaa

SEQ ID NO: 195031 - DNA, 27 bp, Artificial sequence
  SiRNA target sequence
taagccgaattccgcaaaagacagaac

SEQ ID NO: 195032 - DNA, 27 bp, Artificial sequence
  SiRNA target sequence
aagccgaattccgcaaaagacagaact

SEQ ID NO: 195033 - DNA, 27 bp, Artificial sequence
  SiRNA target sequence
agccgaattccgcaaaagacagaactc

SEQ ID NO: 195034 - DNA, 27 bp, Artificial sequence
  SiRNA target sequence
gccgaattccgcaaaagacagaactca

SEQ ID NO: 195035 - DNA, 27 bp, Artificial sequence
  SiRNA target sequence
ccgaattccgcaaaagacagaactcag

SEQ ID NO: 195036 - DNA, 27 bp, Artificial sequence
  SiRNA target sequence
cgaattccgcaaaagacagaactcaga

SEQ ID NO: 195037 - DNA, 27 bp, Artificial sequence
  SiRNA target sequence
gaattccgcaaaagacagaactcagaa

SEQ ID NO: 195038 - DNA, 27 bp, Artificial sequence
  SiRNA target sequence
aattccgcaaaagacagaactcagaaa

SEQ ID NO: 195039 - DNA, 27 bp, Artificial sequence
  SiRNA target sequence
attccgcaaaagacagaactcagaaag

SEQ ID NO: 195040 - DNA, 27 bp, Artificial sequence
  SiRNA target sequence
ttccgcaaaagacagaactcagaaaga

SEQ ID NO: 195041 - DNA, 27 bp, Artificial sequence
  SiRNA target sequence
tccgcaaaagacagaactcagaaagaa

SEQ ID NO: 195042 - DNA, 27 bp, Artificial sequence
  SiRNA target sequence
ccgcaaaagacagaactcagaaagaag

SEQ ID NO: 195043 - DNA, 27 bp, Artificial sequence
  SiRNA target sequence
cgcaaaagacagaactcagaaagaaga

SEQ ID NO: 195044 - DNA, 27 bp, Artificial sequence
  SiRNA target sequence
gcaaaagacagaactcagaaagaagag

SEQ ID NO: 195045 - DNA, 27 bp, Artificial sequence
  SiRNA target sequence
caaaagacagaactcagaaagaagaga

SEQ ID NO: 195046 - DNA, 27 bp, Artificial sequence
  SiRNA target sequence
aaaagacagaactcagaaagaagagaa

SEQ ID NO: 195047 - DNA, 27 bp, Artificial sequence
  SiRNA target sequence
aaagacagaactcagaaagaagagaat

SEQ ID NO: 195048 - DNA, 27 bp, Artificial sequence
  SiRNA target sequence
aagacagaactcagaaagaagagaata

SEQ ID NO: 195049 - DNA, 27 bp, Artificial sequence
  SiRNA target sequence
agacagaactcagaaagaagagaataa

SEQ ID NO: 195050 - DNA, 27 bp, Artificial sequence
  SiRNA target sequence
gacagaactcagaaagaagagaataaa

SEQ ID NO: 195051 - DNA, 27 bp, Artificial sequence
  SiRNA target sequence
acagaactcagaaagaagagaataaat

SEQ ID NO: 195052 - DNA, 27 bp, Artificial sequence
  SiRNA target sequence
cagaactcagaaagaagagaataaata

SEQ ID NO: 195053 - DNA, 27 bp, Artificial sequence
  SiRNA target sequence
agaactcagaaagaagagaataaatat

SEQ ID NO: 195054 - DNA, 27 bp, Artificial sequence
  SiRNA target sequence
gaactcagaaagaagagaataaatatt

SEQ ID NO: 195055 - DNA, 27 bp, Artificial sequence
  SiRNA target sequence
aactcagaaagaagagaataaatattt

SEQ ID NO: 195056 - DNA, 27 bp, Artificial sequence
  SiRNA target sequence
actcagaaagaagagaataaatatttt

SEQ ID NO: 195057 - DNA, 27 bp, Artificial sequence
  SiRNA target sequence
ctcagaaagaagagaataaatattttt

SEQ ID NO: 195058 - DNA, 27 bp, Artificial sequence
  SiRNA target sequence
tcagaaagaagagaataaatatttttt

SEQ ID NO: 195059 - DNA, 27 bp, Artificial sequence
  SiRNA target sequence
cagaaagaagagaataaatattttttt

SEQ ID NO: 195060 - DNA, 27 bp, Artificial sequence
  SiRNA target sequence
agaaagaagagaataaatatttttttt

SEQ ID NO: 195061 - DNA, 27 bp, Artificial sequence
  SiRNA target sequence
gaaagaagagaataaatattttttttg

SEQ ID NO: 195062 - DNA, 27 bp, Artificial sequence
  SiRNA target sequence
aaagaagagaataaatattttttttga

SEQ ID NO: 195063 - DNA, 19 bp, Artificial sequence
  SiRNA target sequence
ttattctgcgttttctttt

SEQ ID NO: 195064 - DNA, 19 bp, Artificial sequence
  SiRNA target sequence
tattctgcgttttcttttt

SEQ ID NO: 195065 - DNA, 19 bp, Artificial sequence
  SiRNA target sequence
attctgcgttttctttttt

SEQ ID NO: 195066 - DNA, 19 bp, Artificial sequence
  SiRNA target sequence
ttctgcgttttcttttttg

SEQ ID NO: 195067 - DNA, 19 bp, Artificial sequence
  SiRNA target sequence
tctgcgttttcttttttgt

SEQ ID NO: 195068 - DNA, 19 bp, Artificial sequence
  SiRNA target sequence
ctgcgttttcttttttgtc

SEQ ID NO: 195069 - DNA, 19 bp, Artificial sequence
  SiRNA target sequence
tgcgttttcttttttgtcg

SEQ ID NO: 195070 - DNA, 19 bp, Artificial sequence
  SiRNA target sequence
gcgttttcttttttgtcgt

SEQ ID NO: 195071 - DNA, 19 bp, Artificial sequence
  SiRNA target sequence
cgttttcttttttgtcgtc

SEQ ID NO: 195072 - DNA, 19 bp, Artificial sequence
  SiRNA target sequence
gttttcttttttgtcgtct

SEQ ID NO: 195073 - DNA, 19 bp, Artificial sequence
  SiRNA target sequence
ttttcttttttgtcgtctt

SEQ ID NO: 195074 - DNA, 19 bp, Artificial sequence
  SiRNA target sequence
tttcttttttgtcgtcttt

SEQ ID NO: 195075 - DNA, 19 bp, Artificial sequence
  SiRNA target sequence
ttcttttttgtcgtctttt

SEQ ID NO: 195076 - DNA, 19 bp, Artificial sequence
  SiRNA target sequence
tcttttttgtcgtctttta

SEQ ID NO: 195077 - DNA, 19 bp, Artificial sequence
  SiRNA target sequence
cttttttgtcgtcttttat

SEQ ID NO: 195078 - DNA, 19 bp, Artificial sequence
  SiRNA target sequence
ttttttgtcgtcttttatt

SEQ ID NO: 195079 - DNA, 19 bp, Artificial sequence
  SiRNA target sequence
tttttgtcgtcttttatta

SEQ ID NO: 195080 - DNA, 19 bp, Artificial sequence
  SiRNA target sequence
ttttgtcgtcttttattaa

SEQ ID NO: 195081 - DNA, 19 bp, Artificial sequence
  SiRNA target sequence
tttgtcgtcttttattaaa

SEQ ID NO: 195082 - DNA, 19 bp, Artificial sequence
  SiRNA target sequence
ttgtcgtcttttattaaat

SEQ ID NO: 195083 - DNA, 19 bp, Artificial sequence
  SiRNA target sequence
tgtcgtcttttattaaatc

SEQ ID NO: 195084 - DNA, 19 bp, Artificial sequence
  SiRNA target sequence
gtcgtcttttattaaatct

SEQ ID NO: 195085 - DNA, 19 bp, Artificial sequence
  SiRNA target sequence
tcgtcttttattaaatcta

SEQ ID NO: 195086 - DNA, 19 bp, Artificial sequence
  SiRNA target sequence
cgtcttttattaaatctat

SEQ ID NO: 195087 - DNA, 19 bp, Artificial sequence
  SiRNA target sequence
gtcttttattaaatctatg

SEQ ID NO: 195088 - DNA, 19 bp, Artificial sequence
  SiRNA target sequence
tcttttattaaatctatgt

SEQ ID NO: 195089 - DNA, 19 bp, Artificial sequence
  SiRNA target sequence
cttttattaaatctatgtc

SEQ ID NO: 195090 - DNA, 19 bp, Artificial sequence
  SiRNA target sequence
ttttattaaatctatgtct

SEQ ID NO: 195091 - DNA, 19 bp, Artificial sequence
  SiRNA target sequence
tttattaaatctatgtcta

SEQ ID NO: 195092 - DNA, 19 bp, Artificial sequence
  SiRNA target sequence
ttattaaatctatgtctac

SEQ ID NO: 195093 - DNA, 19 bp, Artificial sequence
  SiRNA target sequence
tattaaatctatgtctaca

SEQ ID NO: 195094 - DNA, 19 bp, Artificial sequence
  SiRNA target sequence
attaaatctatgtctacac

SEQ ID NO: 195095 - DNA, 19 bp, Artificial sequence
  SiRNA target sequence
ttaaatctatgtctacact

SEQ ID NO: 195096 - DNA, 19 bp, Artificial sequence
  SiRNA target sequence
taaatctatgtctacactt

SEQ ID NO: 195097 - DNA, 19 bp, Artificial sequence
  SiRNA target sequence
aaatctatgtctacacttg

SEQ ID NO: 195098 - DNA, 19 bp, Artificial sequence
  SiRNA target sequence
aatctatgtctacacttgt

SEQ ID NO: 195099 - DNA, 19 bp, Artificial sequence
  SiRNA target sequence
atctatgtctacacttgta

SEQ ID NO: 195100 - DNA, 19 bp, Artificial sequence
  SiRNA target sequence
tctatgtctacacttgtat

SEQ ID NO: 195101 - DNA, 19 bp, Artificial sequence
  SiRNA target sequence
ctatgtctacacttgtatt

SEQ ID NO: 195102 - DNA, 19 bp, Artificial sequence
  SiRNA target sequence
tatgtctacacttgtatta

SEQ ID NO: 195103 - DNA, 19 bp, Artificial sequence
  SiRNA target sequence
atgtctacacttgtattat

SEQ ID NO: 195104 - DNA, 19 bp, Artificial sequence
  SiRNA target sequence
tgtctacacttgtattatt

SEQ ID NO: 195105 - DNA, 19 bp, Artificial sequence
  SiRNA target sequence
gtctacacttgtattattt

SEQ ID NO: 195106 - DNA, 19 bp, Artificial sequence
  SiRNA target sequence
tctacacttgtattatttt

SEQ ID NO: 195107 - DNA, 19 bp, Artificial sequence
  SiRNA target sequence
ctacacttgtattattttt

SEQ ID NO: 195108 - DNA, 19 bp, Artificial sequence
  SiRNA target sequence
tacacttgtattattttta

SEQ ID NO: 195109 - DNA, 19 bp, Artificial sequence
  SiRNA target sequence
acacttgtattatttttaa

SEQ ID NO: 195110 - DNA, 19 bp, Artificial sequence
  SiRNA target sequence
cacttgtattatttttaat

SEQ ID NO: 195111 - DNA, 19 bp, Artificial sequence
  SiRNA target sequence
acttgtattatttttaatt

SEQ ID NO: 195112 - DNA, 19 bp, Artificial sequence
  SiRNA target sequence
cttgtattatttttaattg

SEQ ID NO: 195113 - DNA, 19 bp, Artificial sequence
  SiRNA target sequence
ttgtattatttttaattga

SEQ ID NO: 195114 - DNA, 19 bp, Artificial sequence
  SiRNA target sequence
tgtattatttttaattgaa

SEQ ID NO: 195115 - DNA, 19 bp, Artificial sequence
  SiRNA target sequence
gtattatttttaattgaaa

SEQ ID NO: 195116 - DNA, 19 bp, Artificial sequence
  SiRNA target sequence
tattatttttaattgaaac

SEQ ID NO: 195117 - DNA, 19 bp, Artificial sequence
  SiRNA target sequence
attatttttaattgaaacg

SEQ ID NO: 195118 - DNA, 19 bp, Artificial sequence
  SiRNA target sequence
ttatttttaattgaaacgt

SEQ ID NO: 195119 - DNA, 19 bp, Artificial sequence
  SiRNA target sequence
tatttttaattgaaacgtt

SEQ ID NO: 195120 - DNA, 19 bp, Artificial sequence
  SiRNA target sequence
atttttaattgaaacgtta

SEQ ID NO: 195121 - DNA, 19 bp, Artificial sequence
  SiRNA target sequence
tttttaattgaaacgttat

SEQ ID NO: 195122 - DNA, 19 bp, Artificial sequence
  SiRNA target sequence
ttttaattgaaacgttata

SEQ ID NO: 195123 - DNA, 19 bp, Artificial sequence
  SiRNA target sequence
tttaattgaaacgttatat

SEQ ID NO: 195124 - DNA, 19 bp, Artificial sequence
  SiRNA target sequence
ttaattgaaacgttatatg

SEQ ID NO: 195125 - DNA, 19 bp, Artificial sequence
  SiRNA target sequence
taattgaaacgttatatgc

SEQ ID NO: 195126 - DNA, 19 bp, Artificial sequence
  SiRNA target sequence
aattgaaacgttatatgca

SEQ ID NO: 195127 - DNA, 19 bp, Artificial sequence
  SiRNA target sequence
attgaaacgttatatgcac

SEQ ID NO: 195128 - DNA, 19 bp, Artificial sequence
  SiRNA target sequence
ttgaaacgttatatgcacc

SEQ ID NO: 195129 - DNA, 19 bp, Artificial sequence
  SiRNA target sequence
tgaaacgttatatgcaccc

SEQ ID NO: 195130 - DNA, 19 bp, Artificial sequence
  SiRNA target sequence
gaaacgttatatgcacccg

SEQ ID NO: 195131 - DNA, 19 bp, Artificial sequence
  SiRNA target sequence
aaacgttatatgcacccgc

SEQ ID NO: 195132 - DNA, 19 bp, Artificial sequence
  SiRNA target sequence
aacgttatatgcacccgct

SEQ ID NO: 195133 - DNA, 19 bp, Artificial sequence
  SiRNA target sequence
acgttatatgcacccgcta

SEQ ID NO: 195134 - DNA, 19 bp, Artificial sequence
  SiRNA target sequence
cgttatatgcacccgctaa

SEQ ID NO: 195135 - DNA, 19 bp, Artificial sequence
  SiRNA target sequence
gttatatgcacccgctaaa

SEQ ID NO: 195136 - DNA, 19 bp, Artificial sequence
  SiRNA target sequence
ttatatgcacccgctaaat

SEQ ID NO: 195137 - DNA, 19 bp, Artificial sequence
  SiRNA target sequence
tatatgcacccgctaaata

SEQ ID NO: 195138 - DNA, 19 bp, Artificial sequence
  SiRNA target sequence
atatgcacccgctaaatag

SEQ ID NO: 195139 - DNA, 19 bp, Artificial sequence
  SiRNA target sequence
tatgcacccgctaaataga

SEQ ID NO: 195140 - DNA, 19 bp, Artificial sequence
  SiRNA target sequence
atgcacccgctaaatagat

SEQ ID NO: 195141 - DNA, 19 bp, Artificial sequence
  SiRNA target sequence
tgcacccgctaaatagatt

SEQ ID NO: 195142 - DNA, 19 bp, Artificial sequence
  SiRNA target sequence
gcacccgctaaatagatta

SEQ ID NO: 195143 - DNA, 19 bp, Artificial sequence
  SiRNA target sequence
cacccgctaaatagattat

SEQ ID NO: 195144 - DNA, 19 bp, Artificial sequence
  SiRNA target sequence
acccgctaaatagattata

SEQ ID NO: 195145 - DNA, 19 bp, Artificial sequence
  SiRNA target sequence
cccgctaaatagattatag

SEQ ID NO: 195146 - DNA, 19 bp, Artificial sequence
  SiRNA target sequence
ccgctaaatagattatagc

SEQ ID NO: 195147 - DNA, 19 bp, Artificial sequence
  SiRNA target sequence
cgctaaatagattatagct

SEQ ID NO: 195148 - DNA, 19 bp, Artificial sequence
  SiRNA target sequence
gctaaatagattatagctc

SEQ ID NO: 195149 - DNA, 19 bp, Artificial sequence
  SiRNA target sequence
ctaaatagattatagctct

SEQ ID NO: 195150 - DNA, 19 bp, Artificial sequence
  SiRNA target sequence
taaatagattatagctcta

SEQ ID NO: 195151 - DNA, 19 bp, Artificial sequence
  SiRNA target sequence
aaatagattatagctctaa

SEQ ID NO: 195152 - DNA, 19 bp, Artificial sequence
  SiRNA target sequence
aatagattatagctctaat

SEQ ID NO: 195153 - DNA, 19 bp, Artificial sequence
  SiRNA target sequence
atagattatagctctaatc

SEQ ID NO: 195154 - DNA, 19 bp, Artificial sequence
  SiRNA target sequence
tagattatagctctaatcc

SEQ ID NO: 195155 - DNA, 19 bp, Artificial sequence
  SiRNA target sequence
agattatagctctaatcca

SEQ ID NO: 195156 - DNA, 19 bp, Artificial sequence
  SiRNA target sequence
gattatagctctaatccaa

SEQ ID NO: 195157 - DNA, 19 bp, Artificial sequence
  SiRNA target sequence
attatagctctaatccaaa

SEQ ID NO: 195158 - DNA, 19 bp, Artificial sequence
  SiRNA target sequence
ttatagctctaatccaaat

SEQ ID NO: 195159 - DNA, 19 bp, Artificial sequence
  SiRNA target sequence
tatagctctaatccaaata

SEQ ID NO: 195160 - DNA, 19 bp, Artificial sequence
  SiRNA target sequence
atagctctaatccaaatat

SEQ ID NO: 195161 - DNA, 19 bp, Artificial sequence
  SiRNA target sequence
tagctctaatccaaatata

SEQ ID NO: 195162 - DNA, 19 bp, Artificial sequence
  SiRNA target sequence
agctctaatccaaatataa

SEQ ID NO: 195163 - DNA, 19 bp, Artificial sequence
  SiRNA target sequence
gctctaatccaaatataaa

SEQ ID NO: 195164 - DNA, 19 bp, Artificial sequence
  SiRNA target sequence
ctctaatccaaatataaat

SEQ ID NO: 195165 - DNA, 19 bp, Artificial sequence
  SiRNA target sequence
tctaatccaaatataaatc

SEQ ID NO: 195166 - DNA, 19 bp, Artificial sequence
  SiRNA target sequence
ctaatccaaatataaatca

SEQ ID NO: 195167 - DNA, 19 bp, Artificial sequence
  SiRNA target sequence
taatccaaatataaatcaa

SEQ ID NO: 195168 - DNA, 19 bp, Artificial sequence
  SiRNA target sequence
aatccaaatataaatcaat

SEQ ID NO: 195169 - DNA, 19 bp, Artificial sequence
  SiRNA target sequence
atccaaatataaatcaata

SEQ ID NO: 195170 - DNA, 19 bp, Artificial sequence
  SiRNA target sequence
tccaaatataaatcaatat

SEQ ID NO: 195171 - DNA, 19 bp, Artificial sequence
  SiRNA target sequence
ccaaatataaatcaatatt

SEQ ID NO: 195172 - DNA, 19 bp, Artificial sequence
  SiRNA target sequence
caaatataaatcaatatta

SEQ ID NO: 195173 - DNA, 19 bp, Artificial sequence
  SiRNA target sequence
aaatataaatcaatattat

SEQ ID NO: 195174 - DNA, 19 bp, Artificial sequence
  SiRNA target sequence
aatataaatcaatattatt

SEQ ID NO: 195175 - DNA, 19 bp, Artificial sequence
  SiRNA target sequence
atataaatcaatattattg

SEQ ID NO: 195176 - DNA, 19 bp, Artificial sequence
  SiRNA target sequence
tataaatcaatattattgc

SEQ ID NO: 195177 - DNA, 19 bp, Artificial sequence
  SiRNA target sequence
ataaatcaatattattgca

SEQ ID NO: 195178 - DNA, 19 bp, Artificial sequence
  SiRNA target sequence
taaatcaatattattgcaa

SEQ ID NO: 195179 - DNA, 19 bp, Artificial sequence
  SiRNA target sequence
aaatcaatattattgcaat

SEQ ID NO: 195180 - DNA, 19 bp, Artificial sequence
  SiRNA target sequence
aatcaatattattgcaatc

SEQ ID NO: 195181 - DNA, 19 bp, Artificial sequence
  SiRNA target sequence
atcaatattattgcaatcg

SEQ ID NO: 195182 - DNA, 19 bp, Artificial sequence
  SiRNA target sequence
tcaatattattgcaatcgt

SEQ ID NO: 195183 - DNA, 19 bp, Artificial sequence
  SiRNA target sequence
caatattattgcaatcgtt

SEQ ID NO: 195184 - DNA, 19 bp, Artificial sequence
  SiRNA target sequence
aatattattgcaatcgtta

SEQ ID NO: 195185 - DNA, 19 bp, Artificial sequence
  SiRNA target sequence
atattattgcaatcgttaa

SEQ ID NO: 195186 - DNA, 19 bp, Artificial sequence
  SiRNA target sequence
tattattgcaatcgttaat

SEQ ID NO: 195187 - DNA, 19 bp, Artificial sequence
  SiRNA target sequence
attattgcaatcgttaatg

SEQ ID NO: 195188 - DNA, 19 bp, Artificial sequence
  SiRNA target sequence
ttattgcaatcgttaatgt

SEQ ID NO: 195189 - DNA, 19 bp, Artificial sequence
  SiRNA target sequence
tattgcaatcgttaatgtg

SEQ ID NO: 195190 - DNA, 19 bp, Artificial sequence
  SiRNA target sequence
attgcaatcgttaatgtga

SEQ ID NO: 195191 - DNA, 19 bp, Artificial sequence
  SiRNA target sequence
ttgcaatcgttaatgtgat

SEQ ID NO: 195192 - DNA, 19 bp, Artificial sequence
  SiRNA target sequence
tgcaatcgttaatgtgatt

SEQ ID NO: 195193 - DNA, 19 bp, Artificial sequence
  SiRNA target sequence
gcaatcgttaatgtgattg

SEQ ID NO: 195194 - DNA, 19 bp, Artificial sequence
  SiRNA target sequence
caatcgttaatgtgattgg

SEQ ID NO: 195195 - DNA, 19 bp, Artificial sequence
  SiRNA target sequence
aatcgttaatgtgattgga

SEQ ID NO: 195196 - DNA, 19 bp, Artificial sequence
  SiRNA target sequence
atcgttaatgtgattggac

SEQ ID NO: 195197 - DNA, 19 bp, Artificial sequence
  SiRNA target sequence
tcgttaatgtgattggact

SEQ ID NO: 195198 - DNA, 19 bp, Artificial sequence
  SiRNA target sequence
cgttaatgtgattggacta

SEQ ID NO: 195199 - DNA, 19 bp, Artificial sequence
  SiRNA target sequence
gttaatgtgattggactac

SEQ ID NO: 195200 - DNA, 19 bp, Artificial sequence
  SiRNA target sequence
ttaatgtgattggactacc

SEQ ID NO: 195201 - DNA, 19 bp, Artificial sequence
  SiRNA target sequence
taatgtgattggactaccc

SEQ ID NO: 195202 - DNA, 19 bp, Artificial sequence
  SiRNA target sequence
aatgtgattggactaccct

SEQ ID NO: 195203 - DNA, 19 bp, Artificial sequence
  SiRNA target sequence
atgtgattggactaccctt

SEQ ID NO: 195204 - DNA, 19 bp, Artificial sequence
  SiRNA target sequence
tgtgattggactacccttc

SEQ ID NO: 195205 - DNA, 19 bp, Artificial sequence
  SiRNA target sequence
gtgattggactacccttcc

SEQ ID NO: 195206 - DNA, 19 bp, Artificial sequence
  SiRNA target sequence
tgattggactacccttcct

SEQ ID NO: 195207 - DNA, 19 bp, Artificial sequence
  SiRNA target sequence
gattggactacccttcctt

SEQ ID NO: 195208 - DNA, 19 bp, Artificial sequence
  SiRNA target sequence
attggactacccttcctta

SEQ ID NO: 195209 - DNA, 19 bp, Artificial sequence
  SiRNA target sequence
ttggactacccttccttac

SEQ ID NO: 195210 - DNA, 19 bp, Artificial sequence
  SiRNA target sequence
tggactacccttccttaca

SEQ ID NO: 195211 - DNA, 19 bp, Artificial sequence
  SiRNA target sequence
ggactacccttccttacat

SEQ ID NO: 195212 - DNA, 19 bp, Artificial sequence
  SiRNA target sequence
gactacccttccttacatt

SEQ ID NO: 195213 - DNA, 19 bp, Artificial sequence
  SiRNA target sequence
actacccttccttacatta

SEQ ID NO: 195214 - DNA, 19 bp, Artificial sequence
  SiRNA target sequence
ctacccttccttacattat

SEQ ID NO: 195215 - DNA, 19 bp, Artificial sequence
  SiRNA target sequence
tacccttccttacattatc

SEQ ID NO: 195216 - DNA, 19 bp, Artificial sequence
  SiRNA target sequence
acccttccttacattatca

SEQ ID NO: 195217 - DNA, 19 bp, Artificial sequence
  SiRNA target sequence
cccttccttacattatcag

SEQ ID NO: 195218 - DNA, 19 bp, Artificial sequence
  SiRNA target sequence
ccttccttacattatcagt

SEQ ID NO: 195219 - DNA, 19 bp, Artificial sequence
  SiRNA target sequence
cttccttacattatcagta

SEQ ID NO: 195220 - DNA, 19 bp, Artificial sequence
  SiRNA target sequence
ttccttacattatcagtat

SEQ ID NO: 195221 - DNA, 19 bp, Artificial sequence
  SiRNA target sequence
tccttacattatcagtatc

SEQ ID NO: 195222 - DNA, 19 bp, Artificial sequence
  SiRNA target sequence
ccttacattatcagtatca

SEQ ID NO: 195223 - DNA, 19 bp, Artificial sequence
  SiRNA target sequence
cttacattatcagtatcaa

SEQ ID NO: 195224 - DNA, 19 bp, Artificial sequence
  SiRNA target sequence
ttacattatcagtatcaag

SEQ ID NO: 195225 - DNA, 19 bp, Artificial sequence
  SiRNA target sequence
tacattatcagtatcaagt

SEQ ID NO: 195226 - DNA, 19 bp, Artificial sequence
  SiRNA target sequence
acattatcagtatcaagtg

SEQ ID NO: 195227 - DNA, 19 bp, Artificial sequence
  SiRNA target sequence
cattatcagtatcaagtgc

SEQ ID NO: 195228 - DNA, 19 bp, Artificial sequence
  SiRNA target sequence
attatcagtatcaagtgct

SEQ ID NO: 195229 - DNA, 19 bp, Artificial sequence
  SiRNA target sequence
ttatcagtatcaagtgcta

SEQ ID NO: 195230 - DNA, 19 bp, Artificial sequence
  SiRNA target sequence
tatcagtatcaagtgctac

SEQ ID NO: 195231 - DNA, 19 bp, Artificial sequence
  SiRNA target sequence
atcagtatcaagtgctact

SEQ ID NO: 195232 - DNA, 19 bp, Artificial sequence
  SiRNA target sequence
tcagtatcaagtgctacta

SEQ ID NO: 195233 - DNA, 19 bp, Artificial sequence
  SiRNA target sequence
cagtatcaagtgctactaa

SEQ ID NO: 195234 - DNA, 19 bp, Artificial sequence
  SiRNA target sequence
agtatcaagtgctactaat

SEQ ID NO: 195235 - DNA, 19 bp, Artificial sequence
  SiRNA target sequence
gtatcaagtgctactaata

SEQ ID NO: 195236 - DNA, 19 bp, Artificial sequence
  SiRNA target sequence
tatcaagtgctactaatat

SEQ ID NO: 195237 - DNA, 19 bp, Artificial sequence
  SiRNA target sequence
atcaagtgctactaatatg

SEQ ID NO: 195238 - DNA, 19 bp, Artificial sequence
  SiRNA target sequence
tcaagtgctactaatatgg

SEQ ID NO: 195239 - DNA, 19 bp, Artificial sequence
  SiRNA target sequence
caagtgctactaatatggc

SEQ ID NO: 195240 - DNA, 19 bp, Artificial sequence
  SiRNA target sequence
aagtgctactaatatggct

SEQ ID NO: 195241 - DNA, 19 bp, Artificial sequence
  SiRNA target sequence
agtgctactaatatggcta

SEQ ID NO: 195242 - DNA, 19 bp, Artificial sequence
  SiRNA target sequence
gtgctactaatatggctag

SEQ ID NO: 195243 - DNA, 19 bp, Artificial sequence
  SiRNA target sequence
tgctactaatatggctagt

SEQ ID NO: 195244 - DNA, 19 bp, Artificial sequence
  SiRNA target sequence
gctactaatatggctagtc

SEQ ID NO: 195245 - DNA, 19 bp, Artificial sequence
  SiRNA target sequence
ctactaatatggctagtcc

SEQ ID NO: 195246 - DNA, 19 bp, Artificial sequence
  SiRNA target sequence
tactaatatggctagtcca

SEQ ID NO: 195247 - DNA, 19 bp, Artificial sequence
  SiRNA target sequence
actaatatggctagtccat

SEQ ID NO: 195248 - DNA, 19 bp, Artificial sequence
  SiRNA target sequence
ctaatatggctagtccata

SEQ ID NO: 195249 - DNA, 19 bp, Artificial sequence
  SiRNA target sequence
taatatggctagtccatat

SEQ ID NO: 195250 - DNA, 19 bp, Artificial sequence
  SiRNA target sequence
aatatggctagtccatata

SEQ ID NO: 195251 - DNA, 19 bp, Artificial sequence
  SiRNA target sequence
atatggctagtccatataa

SEQ ID NO: 195252 - DNA, 19 bp, Artificial sequence
  SiRNA target sequence
tatggctagtccatataat

SEQ ID NO: 195253 - DNA, 19 bp, Artificial sequence
  SiRNA target sequence
atggctagtccatataatg

SEQ ID NO: 195254 - DNA, 19 bp, Artificial sequence
  SiRNA target sequence
tggctagtccatataatga

SEQ ID NO: 195255 - DNA, 19 bp, Artificial sequence
  SiRNA target sequence
ggctagtccatataatgaa

SEQ ID NO: 195256 - DNA, 19 bp, Artificial sequence
  SiRNA target sequence
gctagtccatataatgaac

SEQ ID NO: 195257 - DNA, 19 bp, Artificial sequence
  SiRNA target sequence
ctagtccatataatgaacc

SEQ ID NO: 195258 - DNA, 19 bp, Artificial sequence
  SiRNA target sequence
tagtccatataatgaacca

SEQ ID NO: 195259 - DNA, 19 bp, Artificial sequence
  SiRNA target sequence
agtccatataatgaaccaa

SEQ ID NO: 195260 - DNA, 19 bp, Artificial sequence
  SiRNA target sequence
gtccatataatgaaccaat

SEQ ID NO: 195261 - DNA, 19 bp, Artificial sequence
  SiRNA target sequence
tccatataatgaaccaata

SEQ ID NO: 195262 - DNA, 19 bp, Artificial sequence
  SiRNA target sequence
ccatataatgaaccaatag

SEQ ID NO: 195263 - DNA, 19 bp, Artificial sequence
  SiRNA target sequence
catataatgaaccaataga

SEQ ID NO: 195264 - DNA, 19 bp, Artificial sequence
  SiRNA target sequence
atataatgaaccaatagat

SEQ ID NO: 195265 - DNA, 19 bp, Artificial sequence
  SiRNA target sequence
tataatgaaccaatagatt

SEQ ID NO: 195266 - DNA, 19 bp, Artificial sequence
  SiRNA target sequence
ataatgaaccaatagattt

SEQ ID NO: 195267 - DNA, 19 bp, Artificial sequence
  SiRNA target sequence
taatgaaccaatagatttt

SEQ ID NO: 195268 - DNA, 19 bp, Artificial sequence
  SiRNA target sequence
aatgaaccaatagattttc

SEQ ID NO: 195269 - DNA, 19 bp, Artificial sequence
  SiRNA target sequence
atgaaccaatagattttcc

SEQ ID NO: 195270 - DNA, 19 bp, Artificial sequence
  SiRNA target sequence
tgaaccaatagattttcct

SEQ ID NO: 195271 - DNA, 19 bp, Artificial sequence
  SiRNA target sequence
gaaccaatagattttccta

SEQ ID NO: 195272 - DNA, 19 bp, Artificial sequence
  SiRNA target sequence
aaccaatagattttcctaa

SEQ ID NO: 195273 - DNA, 19 bp, Artificial sequence
  SiRNA target sequence
accaatagattttcctaat

SEQ ID NO: 195274 - DNA, 19 bp, Artificial sequence
  SiRNA target sequence
ccaatagattttcctaatt

SEQ ID NO: 195275 - DNA, 19 bp, Artificial sequence
  SiRNA target sequence
caatagattttcctaattt

SEQ ID NO: 195276 - DNA, 19 bp, Artificial sequence
  SiRNA target sequence
aatagattttcctaattta

SEQ ID NO: 195277 - DNA, 19 bp, Artificial sequence
  SiRNA target sequence
atagattttcctaatttat

SEQ ID NO: 195278 - DNA, 19 bp, Artificial sequence
  SiRNA target sequence
tagattttcctaatttatt

SEQ ID NO: 195279 - DNA, 19 bp, Artificial sequence
  SiRNA target sequence
agattttcctaatttatta

SEQ ID NO: 195280 - DNA, 19 bp, Artificial sequence
  SiRNA target sequence
gattttcctaatttattaa

SEQ ID NO: 195281 - DNA, 19 bp, Artificial sequence
  SiRNA target sequence
attttcctaatttattaaa

SEQ ID NO: 195282 - DNA, 19 bp, Artificial sequence
  SiRNA target sequence
ttttcctaatttattaaaa

SEQ ID NO: 195283 - DNA, 19 bp, Artificial sequence
  SiRNA target sequence
tttcctaatttattaaaaa

SEQ ID NO: 195284 - DNA, 19 bp, Artificial sequence
  SiRNA target sequence
ttcctaatttattaaaaat

SEQ ID NO: 195285 - DNA, 19 bp, Artificial sequence
  SiRNA target sequence
tcctaatttattaaaaata

SEQ ID NO: 195286 - DNA, 19 bp, Artificial sequence
  SiRNA target sequence
cctaatttattaaaaatac

SEQ ID NO: 195287 - DNA, 19 bp, Artificial sequence
  SiRNA target sequence
ctaatttattaaaaatacc

SEQ ID NO: 195288 - DNA, 19 bp, Artificial sequence
  SiRNA target sequence
taatttattaaaaatacca

SEQ ID NO: 195289 - DNA, 19 bp, Artificial sequence
  SiRNA target sequence
aatttattaaaaataccat

SEQ ID NO: 195290 - DNA, 19 bp, Artificial sequence
  SiRNA target sequence
atttattaaaaataccatc

SEQ ID NO: 195291 - DNA, 19 bp, Artificial sequence
  SiRNA target sequence
tttattaaaaataccatca

SEQ ID NO: 195292 - DNA, 19 bp, Artificial sequence
  SiRNA target sequence
ttattaaaaataccatcat

SEQ ID NO: 195293 - DNA, 19 bp, Artificial sequence
  SiRNA target sequence
tattaaaaataccatcata

SEQ ID NO: 195294 - DNA, 19 bp, Artificial sequence
  SiRNA target sequence
attaaaaataccatcataa

SEQ ID NO: 195295 - DNA, 19 bp, Artificial sequence
  SiRNA target sequence
ttaaaaataccatcataaa

SEQ ID NO: 195296 - DNA, 19 bp, Artificial sequence
  SiRNA target sequence
taaaaataccatcataaac

SEQ ID NO: 195297 - DNA, 19 bp, Artificial sequence
  SiRNA target sequence
aaaaataccatcataaaca

SEQ ID NO: 195298 - DNA, 19 bp, Artificial sequence
  SiRNA target sequence
aaaataccatcataaacac

SEQ ID NO: 195299 - DNA, 19 bp, Artificial sequence
  SiRNA target sequence
aaataccatcataaacact

SEQ ID NO: 195300 - DNA, 19 bp, Artificial sequence
  SiRNA target sequence
aataccatcataaacactt

SEQ ID NO: 195301 - DNA, 19 bp, Artificial sequence
  SiRNA target sequence
ataccatcataaacacttt

SEQ ID NO: 195302 - DNA, 19 bp, Artificial sequence
  SiRNA target sequence
taccatcataaacactttt

SEQ ID NO: 195303 - DNA, 19 bp, Artificial sequence
  SiRNA target sequence
accatcataaacactttta

SEQ ID NO: 195304 - DNA, 19 bp, Artificial sequence
  SiRNA target sequence
ccatcataaacacttttaa

SEQ ID NO: 195305 - DNA, 19 bp, Artificial sequence
  SiRNA target sequence
catcataaacacttttaaa

SEQ ID NO: 195306 - DNA, 19 bp, Artificial sequence
  SiRNA target sequence
atcataaacacttttaaac

SEQ ID NO: 195307 - DNA, 19 bp, Artificial sequence
  SiRNA target sequence
tcataaacacttttaaacc

SEQ ID NO: 195308 - DNA, 19 bp, Artificial sequence
  SiRNA target sequence
cataaacacttttaaaccg

SEQ ID NO: 195309 - DNA, 19 bp, Artificial sequence
  SiRNA target sequence
ataaacacttttaaaccgt

SEQ ID NO: 195310 - DNA, 19 bp, Artificial sequence
  SiRNA target sequence
taaacacttttaaaccgtg

SEQ ID NO: 195311 - DNA, 19 bp, Artificial sequence
  SiRNA target sequence
aaacacttttaaaccgtgc

SEQ ID NO: 195312 - DNA, 19 bp, Artificial sequence
  SiRNA target sequence
aacacttttaaaccgtgcc

SEQ ID NO: 195313 - DNA, 19 bp, Artificial sequence
  SiRNA target sequence
acacttttaaaccgtgccc

SEQ ID NO: 195314 - DNA, 19 bp, Artificial sequence
  SiRNA target sequence
cacttttaaaccgtgccct

SEQ ID NO: 195315 - DNA, 19 bp, Artificial sequence
  SiRNA target sequence
acttttaaaccgtgccctg

SEQ ID NO: 195316 - DNA, 19 bp, Artificial sequence
  SiRNA target sequence
cttttaaaccgtgccctgt

SEQ ID NO: 195317 - DNA, 19 bp, Artificial sequence
  SiRNA target sequence
ttttaaaccgtgccctgtg

SEQ ID NO: 195318 - DNA, 19 bp, Artificial sequence
  SiRNA target sequence
tttaaaccgtgccctgtgt

SEQ ID NO: 195319 - DNA, 19 bp, Artificial sequence
  SiRNA target sequence
ttaaaccgtgccctgtgtg

SEQ ID NO: 195320 - DNA, 19 bp, Artificial sequence
  SiRNA target sequence
taaaccgtgccctgtgtgc

SEQ ID NO: 195321 - DNA, 19 bp, Artificial sequence
  SiRNA target sequence
aaaccgtgccctgtgtgca

SEQ ID NO: 195322 - DNA, 19 bp, Artificial sequence
  SiRNA target sequence
aaccgtgccctgtgtgcag

SEQ ID NO: 195323 - DNA, 19 bp, Artificial sequence
  SiRNA target sequence
accgtgccctgtgtgcagg

SEQ ID NO: 195324 - DNA, 19 bp, Artificial sequence
  SiRNA target sequence
ccgtgccctgtgtgcagga

SEQ ID NO: 195325 - DNA, 19 bp, Artificial sequence
  SiRNA target sequence
cgtgccctgtgtgcaggat

SEQ ID NO: 195326 - DNA, 19 bp, Artificial sequence
  SiRNA target sequence
gtgccctgtgtgcaggatc

SEQ ID NO: 195327 - DNA, 19 bp, Artificial sequence
  SiRNA target sequence
tgccctgtgtgcaggatcg

SEQ ID NO: 195328 - DNA, 19 bp, Artificial sequence
  SiRNA target sequence
gccctgtgtgcaggatcga

SEQ ID NO: 195329 - DNA, 19 bp, Artificial sequence
  SiRNA target sequence
ccctgtgtgcaggatcgat

SEQ ID NO: 195330 - DNA, 19 bp, Artificial sequence
  SiRNA target sequence
cctgtgtgcaggatcgatt

SEQ ID NO: 195331 - DNA, 19 bp, Artificial sequence
  SiRNA target sequence
ctgtgtgcaggatcgattc

SEQ ID NO: 195332 - DNA, 19 bp, Artificial sequence
  SiRNA target sequence
tgtgtgcaggatcgattct

SEQ ID NO: 195333 - DNA, 19 bp, Artificial sequence
  SiRNA target sequence
gtgtgcaggatcgattctc

SEQ ID NO: 195334 - DNA, 19 bp, Artificial sequence
  SiRNA target sequence
tgtgcaggatcgattctca

SEQ ID NO: 195335 - DNA, 19 bp, Artificial sequence
  SiRNA target sequence
gtgcaggatcgattctcat

SEQ ID NO: 195336 - DNA, 19 bp, Artificial sequence
  SiRNA target sequence
tgcaggatcgattctcata

SEQ ID NO: 195337 - DNA, 19 bp, Artificial sequence
  SiRNA target sequence
gcaggatcgattctcatac

SEQ ID NO: 195338 - DNA, 19 bp, Artificial sequence
  SiRNA target sequence
caggatcgattctcatacc

SEQ ID NO: 195339 - DNA, 19 bp, Artificial sequence
  SiRNA target sequence
aggatcgattctcataccc

SEQ ID NO: 195340 - DNA, 19 bp, Artificial sequence
  SiRNA target sequence
ggatcgattctcataccca

SEQ ID NO: 195341 - DNA, 19 bp, Artificial sequence
  SiRNA target sequence
gatcgattctcatacccat

SEQ ID NO: 195342 - DNA, 19 bp, Artificial sequence
  SiRNA target sequence
atcgattctcatacccatt

SEQ ID NO: 195343 - DNA, 19 bp, Artificial sequence
  SiRNA target sequence
tcgattctcatacccattt

SEQ ID NO: 195344 - DNA, 19 bp, Artificial sequence
  SiRNA target sequence
cgattctcatacccatttt

SEQ ID NO: 195345 - DNA, 19 bp, Artificial sequence
  SiRNA target sequence
gattctcatacccattttc

SEQ ID NO: 195346 - DNA, 19 bp, Artificial sequence
  SiRNA target sequence
attctcatacccattttct

SEQ ID NO: 195347 - DNA, 19 bp, Artificial sequence
  SiRNA target sequence
ttctcatacccattttctc

SEQ ID NO: 195348 - DNA, 19 bp, Artificial sequence
  SiRNA target sequence
tctcatacccattttctct

SEQ ID NO: 195349 - DNA, 19 bp, Artificial sequence
  SiRNA target sequence
ctcatacccattttctctt

SEQ ID NO: 195350 - DNA, 19 bp, Artificial sequence
  SiRNA target sequence
tcatacccattttctcttt

SEQ ID NO: 195351 - DNA, 19 bp, Artificial sequence
  SiRNA target sequence
catacccattttctcttta

SEQ ID NO: 195352 - DNA, 19 bp, Artificial sequence
  SiRNA target sequence
atacccattttctctttac

SEQ ID NO: 195353 - DNA, 19 bp, Artificial sequence
  SiRNA target sequence
tacccattttctctttaca

SEQ ID NO: 195354 - DNA, 19 bp, Artificial sequence
  SiRNA target sequence
acccattttctctttacaa

SEQ ID NO: 195355 - DNA, 19 bp, Artificial sequence
  SiRNA target sequence
cccattttctctttacaaa

SEQ ID NO: 195356 - DNA, 19 bp, Artificial sequence
  SiRNA target sequence
ccattttctctttacaaat

SEQ ID NO: 195357 - DNA, 19 bp, Artificial sequence
  SiRNA target sequence
cattttctctttacaaata

SEQ ID NO: 195358 - DNA, 19 bp, Artificial sequence
  SiRNA target sequence
attttctctttacaaatat

SEQ ID NO: 195359 - DNA, 19 bp, Artificial sequence
  SiRNA target sequence
ttttctctttacaaatatc

SEQ ID NO: 195360 - DNA, 19 bp, Artificial sequence
  SiRNA target sequence
tttctctttacaaatatca

SEQ ID NO: 195361 - DNA, 19 bp, Artificial sequence
  SiRNA target sequence
ttctctttacaaatatcaa

SEQ ID NO: 195362 - DNA, 19 bp, Artificial sequence
  SiRNA target sequence
tctctttacaaatatcaaa

SEQ ID NO: 195363 - DNA, 19 bp, Artificial sequence
  SiRNA target sequence
ctctttacaaatatcaaag

SEQ ID NO: 195364 - DNA, 19 bp, Artificial sequence
  SiRNA target sequence
tctttacaaatatcaaagg

SEQ ID NO: 195365 - DNA, 19 bp, Artificial sequence
  SiRNA target sequence
ctttacaaatatcaaaggc

SEQ ID NO: 195366 - DNA, 19 bp, Artificial sequence
  SiRNA target sequence
tttacaaatatcaaaggct

SEQ ID NO: 195367 - DNA, 19 bp, Artificial sequence
  SiRNA target sequence
ttacaaatatcaaaggctg

SEQ ID NO: 195368 - DNA, 19 bp, Artificial sequence
  SiRNA target sequence
tacaaatatcaaaggctga

SEQ ID NO: 195369 - DNA, 19 bp, Artificial sequence
  SiRNA target sequence
acaaatatcaaaggctgaa

SEQ ID NO: 195370 - DNA, 19 bp, Artificial sequence
  SiRNA target sequence
caaatatcaaaggctgaat

SEQ ID NO: 195371 - DNA, 19 bp, Artificial sequence
  SiRNA target sequence
aaatatcaaaggctgaata

SEQ ID NO: 195372 - DNA, 19 bp, Artificial sequence
  SiRNA target sequence
aatatcaaaggctgaatat

SEQ ID NO: 195373 - DNA, 19 bp, Artificial sequence
  SiRNA target sequence
atatcaaaggctgaatatt

SEQ ID NO: 195374 - DNA, 19 bp, Artificial sequence
  SiRNA target sequence
tatcaaaggctgaatattt

SEQ ID NO: 195375 - DNA, 19 bp, Artificial sequence
  SiRNA target sequence
atcaaaggctgaatatttt

SEQ ID NO: 195376 - DNA, 19 bp, Artificial sequence
  SiRNA target sequence
tcaaaggctgaatatttta

SEQ ID NO: 195377 - DNA, 19 bp, Artificial sequence
  SiRNA target sequence
caaaggctgaatattttaa

SEQ ID NO: 195378 - DNA, 19 bp, Artificial sequence
  SiRNA target sequence
aaaggctgaatattttaat

SEQ ID NO: 195379 - DNA, 19 bp, Artificial sequence
  SiRNA target sequence
aaggctgaatattttaata

SEQ ID NO: 195380 - DNA, 19 bp, Artificial sequence
  SiRNA target sequence
aggctgaatattttaatac

SEQ ID NO: 195381 - DNA, 19 bp, Artificial sequence
  SiRNA target sequence
ggctgaatattttaatact

SEQ ID NO: 195382 - DNA, 19 bp, Artificial sequence
  SiRNA target sequence
gctgaatattttaatactt

SEQ ID NO: 195383 - DNA, 19 bp, Artificial sequence
  SiRNA target sequence
ctgaatattttaatacttt

SEQ ID NO: 195384 - DNA, 19 bp, Artificial sequence
  SiRNA target sequence
tgaatattttaatactttt

SEQ ID NO: 195385 - DNA, 19 bp, Artificial sequence
  SiRNA target sequence
gaatattttaatactttta

SEQ ID NO: 195386 - DNA, 19 bp, Artificial sequence
  SiRNA target sequence
aatattttaatacttttat

SEQ ID NO: 195387 - DNA, 19 bp, Artificial sequence
  SiRNA target sequence
atattttaatacttttatg

SEQ ID NO: 195388 - DNA, 19 bp, Artificial sequence
  SiRNA target sequence
tattttaatacttttatga

SEQ ID NO: 195389 - DNA, 19 bp, Artificial sequence
  SiRNA target sequence
attttaatacttttatgaa

SEQ ID NO: 195390 - DNA, 19 bp, Artificial sequence
  SiRNA target sequence
ttttaatacttttatgaat

SEQ ID NO: 195391 - DNA, 19 bp, Artificial sequence
  SiRNA target sequence
tttaatacttttatgaatg

SEQ ID NO: 195392 - DNA, 19 bp, Artificial sequence
  SiRNA target sequence
ttaatacttttatgaatgc

SEQ ID NO: 195393 - DNA, 19 bp, Artificial sequence
  SiRNA target sequence
taatacttttatgaatgct

SEQ ID NO: 195394 - DNA, 19 bp, Artificial sequence
  SiRNA target sequence
aatacttttatgaatgcta

SEQ ID NO: 195395 - DNA, 19 bp, Artificial sequence
  SiRNA target sequence
atacttttatgaatgctaa

SEQ ID NO: 195396 - DNA, 19 bp, Artificial sequence
  SiRNA target sequence
tacttttatgaatgctaaa

SEQ ID NO: 195397 - DNA, 19 bp, Artificial sequence
  SiRNA target sequence
acttttatgaatgctaaaa

SEQ ID NO: 195398 - DNA, 19 bp, Artificial sequence
  SiRNA target sequence
cttttatgaatgctaaaaa

SEQ ID NO: 195399 - DNA, 19 bp, Artificial sequence
  SiRNA target sequence
ttttatgaatgctaaaaag

SEQ ID NO: 195400 - DNA, 19 bp, Artificial sequence
  SiRNA target sequence
tttatgaatgctaaaaaga

SEQ ID NO: 195401 - DNA, 19 bp, Artificial sequence
  SiRNA target sequence
ttatgaatgctaaaaagaa

SEQ ID NO: 195402 - DNA, 19 bp, Artificial sequence
  SiRNA target sequence
tatgaatgctaaaaagaac

SEQ ID NO: 195403 - DNA, 19 bp, Artificial sequence
  SiRNA target sequence
atgaatgctaaaaagaaca

SEQ ID NO: 195404 - DNA, 19 bp, Artificial sequence
  SiRNA target sequence
tgaatgctaaaaagaacat

SEQ ID NO: 195405 - DNA, 19 bp, Artificial sequence
  SiRNA target sequence
gaatgctaaaaagaacatt

SEQ ID NO: 195406 - DNA, 19 bp, Artificial sequence
  SiRNA target sequence
aatgctaaaaagaacattc

SEQ ID NO: 195407 - DNA, 19 bp, Artificial sequence
  SiRNA target sequence
atgctaaaaagaacattcc

SEQ ID NO: 195408 - DNA, 19 bp, Artificial sequence
  SiRNA target sequence
tgctaaaaagaacattcca

SEQ ID NO: 195409 - DNA, 19 bp, Artificial sequence
  SiRNA target sequence
gctaaaaagaacattccac

SEQ ID NO: 195410 - DNA, 19 bp, Artificial sequence
  SiRNA target sequence
ctaaaaagaacattccact

SEQ ID NO: 195411 - DNA, 19 bp, Artificial sequence
  SiRNA target sequence
taaaaagaacattccactg

SEQ ID NO: 195412 - DNA, 19 bp, Artificial sequence
  SiRNA target sequence
aaaaagaacattccactgt

SEQ ID NO: 195413 - DNA, 19 bp, Artificial sequence
  SiRNA target sequence
aaaagaacattccactgta

SEQ ID NO: 195414 - DNA, 19 bp, Artificial sequence
  SiRNA target sequence
aaagaacattccactgtaa

SEQ ID NO: 195415 - DNA, 19 bp, Artificial sequence
  SiRNA target sequence
aagaacattccactgtaat

SEQ ID NO: 195416 - DNA, 19 bp, Artificial sequence
  SiRNA target sequence
agaacattccactgtaatt

SEQ ID NO: 195417 - DNA, 19 bp, Artificial sequence
  SiRNA target sequence
gaacattccactgtaattt

SEQ ID NO: 195418 - DNA, 19 bp, Artificial sequence
  SiRNA target sequence
aacattccactgtaatttt

SEQ ID NO: 195419 - DNA, 19 bp, Artificial sequence
  SiRNA target sequence
acattccactgtaattttc

SEQ ID NO: 195420 - DNA, 19 bp, Artificial sequence
  SiRNA target sequence
cattccactgtaattttcg

SEQ ID NO: 195421 - DNA, 19 bp, Artificial sequence
  SiRNA target sequence
attccactgtaattttcga

SEQ ID NO: 195422 - DNA, 19 bp, Artificial sequence
  SiRNA target sequence
ttccactgtaattttcgat

SEQ ID NO: 195423 - DNA, 19 bp, Artificial sequence
  SiRNA target sequence
tccactgtaattttcgatc

SEQ ID NO: 195424 - DNA, 19 bp, Artificial sequence
  SiRNA target sequence
ccactgtaattttcgatcg

SEQ ID NO: 195425 - DNA, 19 bp, Artificial sequence
  SiRNA target sequence
cactgtaattttcgatcgt

SEQ ID NO: 195426 - DNA, 19 bp, Artificial sequence
  SiRNA target sequence
actgtaattttcgatcgta

SEQ ID NO: 195427 - DNA, 19 bp, Artificial sequence
  SiRNA target sequence
ctgtaattttcgatcgtat

SEQ ID NO: 195428 - DNA, 19 bp, Artificial sequence
  SiRNA target sequence
tgtaattttcgatcgtata

SEQ ID NO: 195429 - DNA, 19 bp, Artificial sequence
  SiRNA target sequence
gtaattttcgatcgtataa

SEQ ID NO: 195430 - DNA, 19 bp, Artificial sequence
  SiRNA target sequence
taattttcgatcgtataaa

SEQ ID NO: 195431 - DNA, 19 bp, Artificial sequence
  SiRNA target sequence
aattttcgatcgtataaat

SEQ ID NO: 195432 - DNA, 19 bp, Artificial sequence
  SiRNA target sequence
attttcgatcgtataaatg

SEQ ID NO: 195433 - DNA, 19 bp, Artificial sequence
  SiRNA target sequence
ttttcgatcgtataaatgt

SEQ ID NO: 195434 - DNA, 19 bp, Artificial sequence
  SiRNA target sequence
tttcgatcgtataaatgta

SEQ ID NO: 195435 - DNA, 19 bp, Artificial sequence
  SiRNA target sequence
ttcgatcgtataaatgtac

SEQ ID NO: 195436 - DNA, 19 bp, Artificial sequence
  SiRNA target sequence
tcgatcgtataaatgtacg

SEQ ID NO: 195437 - DNA, 19 bp, Artificial sequence
  SiRNA target sequence
cgatcgtataaatgtacga

SEQ ID NO: 195438 - DNA, 19 bp, Artificial sequence
  SiRNA target sequence
gatcgtataaatgtacgac

SEQ ID NO: 195439 - DNA, 19 bp, Artificial sequence
  SiRNA target sequence
atcgtataaatgtacgaca

SEQ ID NO: 195440 - DNA, 19 bp, Artificial sequence
  SiRNA target sequence
tcgtataaatgtacgacat

SEQ ID NO: 195441 - DNA, 19 bp, Artificial sequence
  SiRNA target sequence
cgtataaatgtacgacatt

SEQ ID NO: 195442 - DNA, 19 bp, Artificial sequence
  SiRNA target sequence
gtataaatgtacgacattt

SEQ ID NO: 195443 - DNA, 19 bp, Artificial sequence
  SiRNA target sequence
tataaatgtacgacatttt

SEQ ID NO: 195444 - DNA, 19 bp, Artificial sequence
  SiRNA target sequence
ataaatgtacgacattttt

SEQ ID NO: 195445 - DNA, 19 bp, Artificial sequence
  SiRNA target sequence
taaatgtacgacatttttt

SEQ ID NO: 195446 - DNA, 19 bp, Artificial sequence
  SiRNA target sequence
aaatgtacgacattttttt

SEQ ID NO: 195447 - DNA, 19 bp, Artificial sequence
  SiRNA target sequence
aatgtacgacattttttta

SEQ ID NO: 195448 - DNA, 19 bp, Artificial sequence
  SiRNA target sequence
atgtacgacatttttttaa

SEQ ID NO: 195449 - DNA, 19 bp, Artificial sequence
  SiRNA target sequence
tgtacgacatttttttaaa

SEQ ID NO: 195450 - DNA, 19 bp, Artificial sequence
  SiRNA target sequence
gtacgacatttttttaaaa

SEQ ID NO: 195451 - DNA, 19 bp, Artificial sequence
  SiRNA target sequence
tacgacatttttttaaaaa

SEQ ID NO: 195452 - DNA, 19 bp, Artificial sequence
  SiRNA target sequence
acgacatttttttaaaaaa

SEQ ID NO: 195453 - DNA, 19 bp, Artificial sequence
  SiRNA target sequence
cgacatttttttaaaaaat

SEQ ID NO: 195454 - DNA, 19 bp, Artificial sequence
  SiRNA target sequence
gacatttttttaaaaaata

SEQ ID NO: 195455 - DNA, 19 bp, Artificial sequence
  SiRNA target sequence
acatttttttaaaaaatac

SEQ ID NO: 195456 - DNA, 19 bp, Artificial sequence
  SiRNA target sequence
catttttttaaaaaataca

SEQ ID NO: 195457 - DNA, 19 bp, Artificial sequence
  SiRNA target sequence
atttttttaaaaaatacag

SEQ ID NO: 195458 - DNA, 19 bp, Artificial sequence
  SiRNA target sequence
tttttttaaaaaatacaga

SEQ ID NO: 195459 - DNA, 19 bp, Artificial sequence
  SiRNA target sequence
ttttttaaaaaatacagaa

SEQ ID NO: 195460 - DNA, 19 bp, Artificial sequence
  SiRNA target sequence
tttttaaaaaatacagaaa

SEQ ID NO: 195461 - DNA, 19 bp, Artificial sequence
  SiRNA target sequence
ttttaaaaaatacagaaat

SEQ ID NO: 195462 - DNA, 19 bp, Artificial sequence
  SiRNA target sequence
tttaaaaaatacagaaatc

SEQ ID NO: 195463 - DNA, 19 bp, Artificial sequence
  SiRNA target sequence
ttaaaaaatacagaaatcc

SEQ ID NO: 195464 - DNA, 19 bp, Artificial sequence
  SiRNA target sequence
taaaaaatacagaaatcca

SEQ ID NO: 195465 - DNA, 19 bp, Artificial sequence
  SiRNA target sequence
aaaaaatacagaaatccat

SEQ ID NO: 195466 - DNA, 19 bp, Artificial sequence
  SiRNA target sequence
aaaaatacagaaatccatg

SEQ ID NO: 195467 - DNA, 19 bp, Artificial sequence
  SiRNA target sequence
aaaatacagaaatccatga

SEQ ID NO: 195468 - DNA, 19 bp, Artificial sequence
  SiRNA target sequence
aaatacagaaatccatgaa

SEQ ID NO: 195469 - DNA, 19 bp, Artificial sequence
  SiRNA target sequence
aatacagaaatccatgaaa

SEQ ID NO: 195470 - DNA, 19 bp, Artificial sequence
  SiRNA target sequence
atacagaaatccatgaaaa

SEQ ID NO: 195471 - DNA, 19 bp, Artificial sequence
  SiRNA target sequence
tacagaaatccatgaaaaa

SEQ ID NO: 195472 - DNA, 19 bp, Artificial sequence
  SiRNA target sequence
acagaaatccatgaaaaag

SEQ ID NO: 195473 - DNA, 19 bp, Artificial sequence
  SiRNA target sequence
cagaaatccatgaaaaagc

SEQ ID NO: 195474 - DNA, 19 bp, Artificial sequence
  SiRNA target sequence
agaaatccatgaaaaagca

SEQ ID NO: 195475 - DNA, 19 bp, Artificial sequence
  SiRNA target sequence
gaaatccatgaaaaagcaa

SEQ ID NO: 195476 - DNA, 19 bp, Artificial sequence
  SiRNA target sequence
aaatccatgaaaaagcaag

SEQ ID NO: 195477 - DNA, 19 bp, Artificial sequence
  SiRNA target sequence
aatccatgaaaaagcaagt

SEQ ID NO: 195478 - DNA, 19 bp, Artificial sequence
  SiRNA target sequence
atccatgaaaaagcaagtc

SEQ ID NO: 195479 - DNA, 19 bp, Artificial sequence
  SiRNA target sequence
tccatgaaaaagcaagtcc

SEQ ID NO: 195480 - DNA, 19 bp, Artificial sequence
  SiRNA target sequence
ccatgaaaaagcaagtcct

SEQ ID NO: 195481 - DNA, 19 bp, Artificial sequence
  SiRNA target sequence
catgaaaaagcaagtcctt

SEQ ID NO: 195482 - DNA, 19 bp, Artificial sequence
  SiRNA target sequence
atgaaaaagcaagtccttc

SEQ ID NO: 195483 - DNA, 19 bp, Artificial sequence
  SiRNA target sequence
tgaaaaagcaagtccttca

SEQ ID NO: 195484 - DNA, 19 bp, Artificial sequence
  SiRNA target sequence
gaaaaagcaagtccttcaa

SEQ ID NO: 195485 - DNA, 19 bp, Artificial sequence
  SiRNA target sequence
aaaaagcaagtccttcaat

SEQ ID NO: 195486 - DNA, 19 bp, Artificial sequence
  SiRNA target sequence
aaaagcaagtccttcaatg

SEQ ID NO: 195487 - DNA, 19 bp, Artificial sequence
  SiRNA target sequence
aaagcaagtccttcaatgg

SEQ ID NO: 195488 - DNA, 19 bp, Artificial sequence
  SiRNA target sequence
aagcaagtccttcaatggc

SEQ ID NO: 195489 - DNA, 19 bp, Artificial sequence
  SiRNA target sequence
agcaagtccttcaatggca

SEQ ID NO: 195490 - DNA, 19 bp, Artificial sequence
  SiRNA target sequence
gcaagtccttcaatggcag

SEQ ID NO: 195491 - DNA, 19 bp, Artificial sequence
  SiRNA target sequence
caagtccttcaatggcaga

SEQ ID NO: 195492 - DNA, 19 bp, Artificial sequence
  SiRNA target sequence
aagtccttcaatggcagaa

SEQ ID NO: 195493 - DNA, 19 bp, Artificial sequence
  SiRNA target sequence
agtccttcaatggcagaat

SEQ ID NO: 195494 - DNA, 19 bp, Artificial sequence
  SiRNA target sequence
gtccttcaatggcagaatt

SEQ ID NO: 195495 - DNA, 19 bp, Artificial sequence
  SiRNA target sequence
tccttcaatggcagaattg

SEQ ID NO: 195496 - DNA, 19 bp, Artificial sequence
  SiRNA target sequence
ccttcaatggcagaattgt

SEQ ID NO: 195497 - DNA, 19 bp, Artificial sequence
  SiRNA target sequence
cttcaatggcagaattgta

SEQ ID NO: 195498 - DNA, 19 bp, Artificial sequence
  SiRNA target sequence
ttcaatggcagaattgtag

SEQ ID NO: 195499 - DNA, 19 bp, Artificial sequence
  SiRNA target sequence
tcaatggcagaattgtaga

SEQ ID NO: 195500 - DNA, 19 bp, Artificial sequence
  SiRNA target sequence
caatggcagaattgtagat

SEQ ID NO: 195501 - DNA, 19 bp, Artificial sequence
  SiRNA target sequence
aatggcagaattgtagatt

SEQ ID NO: 195502 - DNA, 19 bp, Artificial sequence
  SiRNA target sequence
atggcagaattgtagattg

SEQ ID NO: 195503 - DNA, 19 bp, Artificial sequence
  SiRNA target sequence
tggcagaattgtagattga

SEQ ID NO: 195504 - DNA, 19 bp, Artificial sequence
  SiRNA target sequence
ggcagaattgtagattgat

SEQ ID NO: 195505 - DNA, 19 bp, Artificial sequence
  SiRNA target sequence
gcagaattgtagattgatg

SEQ ID NO: 195506 - DNA, 19 bp, Artificial sequence
  SiRNA target sequence
cagaattgtagattgatgc

SEQ ID NO: 195507 - DNA, 19 bp, Artificial sequence
  SiRNA target sequence
agaattgtagattgatgct

SEQ ID NO: 195508 - DNA, 19 bp, Artificial sequence
  SiRNA target sequence
gaattgtagattgatgctc

SEQ ID NO: 195509 - DNA, 19 bp, Artificial sequence
  SiRNA target sequence
aattgtagattgatgctcc

SEQ ID NO: 195510 - DNA, 19 bp, Artificial sequence
  SiRNA target sequence
attgtagattgatgctccc

SEQ ID NO: 195511 - DNA, 19 bp, Artificial sequence
  SiRNA target sequence
ttgtagattgatgctccca

SEQ ID NO: 195512 - DNA, 19 bp, Artificial sequence
  SiRNA target sequence
tgtagattgatgctcccat

SEQ ID NO: 195513 - DNA, 19 bp, Artificial sequence
  SiRNA target sequence
gtagattgatgctcccata

SEQ ID NO: 195514 - DNA, 19 bp, Artificial sequence
  SiRNA target sequence
tagattgatgctcccataa

SEQ ID NO: 195515 - DNA, 19 bp, Artificial sequence
  SiRNA target sequence
agattgatgctcccataac

SEQ ID NO: 195516 - DNA, 19 bp, Artificial sequence
  SiRNA target sequence
gattgatgctcccataacg

SEQ ID NO: 195517 - DNA, 19 bp, Artificial sequence
  SiRNA target sequence
attgatgctcccataacga

SEQ ID NO: 195518 - DNA, 19 bp, Artificial sequence
  SiRNA target sequence
ttgatgctcccataacgat

SEQ ID NO: 195519 - DNA, 19 bp, Artificial sequence
  SiRNA target sequence
tgatgctcccataacgatt

SEQ ID NO: 195520 - DNA, 19 bp, Artificial sequence
  SiRNA target sequence
gatgctcccataacgatta

SEQ ID NO: 195521 - DNA, 19 bp, Artificial sequence
  SiRNA target sequence
atgctcccataacgattat

SEQ ID NO: 195522 - DNA, 19 bp, Artificial sequence
  SiRNA target sequence
tgctcccataacgattatt

SEQ ID NO: 195523 - DNA, 19 bp, Artificial sequence
  SiRNA target sequence
gctcccataacgattattg

SEQ ID NO: 195524 - DNA, 19 bp, Artificial sequence
  SiRNA target sequence
ctcccataacgattattga

SEQ ID NO: 195525 - DNA, 19 bp, Artificial sequence
  SiRNA target sequence
tcccataacgattattgac

SEQ ID NO: 195526 - DNA, 19 bp, Artificial sequence
  SiRNA target sequence
cccataacgattattgacc

SEQ ID NO: 195527 - DNA, 19 bp, Artificial sequence
  SiRNA target sequence
ccataacgattattgaccc

SEQ ID NO: 195528 - DNA, 19 bp, Artificial sequence
  SiRNA target sequence
cataacgattattgacccc

SEQ ID NO: 195529 - DNA, 19 bp, Artificial sequence
  SiRNA target sequence
ataacgattattgacccca

SEQ ID NO: 195530 - DNA, 19 bp, Artificial sequence
  SiRNA target sequence
taacgattattgaccccaa

SEQ ID NO: 195531 - DNA, 19 bp, Artificial sequence
  SiRNA target sequence
aacgattattgaccccaac

SEQ ID NO: 195532 - DNA, 19 bp, Artificial sequence
  SiRNA target sequence
acgattattgaccccaaca

SEQ ID NO: 195533 - DNA, 19 bp, Artificial sequence
  SiRNA target sequence
cgattattgaccccaacaa

SEQ ID NO: 195534 - DNA, 19 bp, Artificial sequence
  SiRNA target sequence
gattattgaccccaacaac

SEQ ID NO: 195535 - DNA, 19 bp, Artificial sequence
  SiRNA target sequence
attattgaccccaacaaca

SEQ ID NO: 195536 - DNA, 19 bp, Artificial sequence
  SiRNA target sequence
ttattgaccccaacaacaa

SEQ ID NO: 195537 - DNA, 19 bp, Artificial sequence
  SiRNA target sequence
tattgaccccaacaacaag

SEQ ID NO: 195538 - DNA, 19 bp, Artificial sequence
  SiRNA target sequence
attgaccccaacaacaaga

SEQ ID NO: 195539 - DNA, 19 bp, Artificial sequence
  SiRNA target sequence
ttgaccccaacaacaagaa

SEQ ID NO: 195540 - DNA, 19 bp, Artificial sequence
  SiRNA target sequence
tgaccccaacaacaagaat

SEQ ID NO: 195541 - DNA, 19 bp, Artificial sequence
  SiRNA target sequence
gaccccaacaacaagaata

SEQ ID NO: 195542 - DNA, 19 bp, Artificial sequence
  SiRNA target sequence
accccaacaacaagaataa

SEQ ID NO: 195543 - DNA, 19 bp, Artificial sequence
  SiRNA target sequence
ccccaacaacaagaataaa

SEQ ID NO: 195544 - DNA, 19 bp, Artificial sequence
  SiRNA target sequence
cccaacaacaagaataaag

SEQ ID NO: 195545 - DNA, 19 bp, Artificial sequence
  SiRNA target sequence
ccaacaacaagaataaagg

SEQ ID NO: 195546 - DNA, 19 bp, Artificial sequence
  SiRNA target sequence
caacaacaagaataaaggt

SEQ ID NO: 195547 - DNA, 19 bp, Artificial sequence
  SiRNA target sequence
aacaacaagaataaaggtg

SEQ ID NO: 195548 - DNA, 19 bp, Artificial sequence
  SiRNA target sequence
acaacaagaataaaggtgt

SEQ ID NO: 195549 - DNA, 19 bp, Artificial sequence
  SiRNA target sequence
caacaagaataaaggtgtt

SEQ ID NO: 195550 - DNA, 19 bp, Artificial sequence
  SiRNA target sequence
aacaagaataaaggtgtta

SEQ ID NO: 195551 - DNA, 19 bp, Artificial sequence
  SiRNA target sequence
acaagaataaaggtgttaa

SEQ ID NO: 195552 - DNA, 19 bp, Artificial sequence
  SiRNA target sequence
caagaataaaggtgttaag

SEQ ID NO: 195553 - DNA, 19 bp, Artificial sequence
  SiRNA target sequence
aagaataaaggtgttaaga

SEQ ID NO: 195554 - DNA, 19 bp, Artificial sequence
  SiRNA target sequence
agaataaaggtgttaagag

SEQ ID NO: 195555 - DNA, 19 bp, Artificial sequence
  SiRNA target sequence
gaataaaggtgttaagagt

SEQ ID NO: 195556 - DNA, 19 bp, Artificial sequence
  SiRNA target sequence
aataaaggtgttaagagtc

SEQ ID NO: 195557 - DNA, 19 bp, Artificial sequence
  SiRNA target sequence
ataaaggtgttaagagtcc

SEQ ID NO: 195558 - DNA, 19 bp, Artificial sequence
  SiRNA target sequence
taaaggtgttaagagtccc

SEQ ID NO: 195559 - DNA, 19 bp, Artificial sequence
  SiRNA target sequence
aaaggtgttaagagtccca

SEQ ID NO: 195560 - DNA, 19 bp, Artificial sequence
  SiRNA target sequence
aaggtgttaagagtcccat

SEQ ID NO: 195561 - DNA, 19 bp, Artificial sequence
  SiRNA target sequence
aggtgttaagagtcccata

SEQ ID NO: 195562 - DNA, 19 bp, Artificial sequence
  SiRNA target sequence
ggtgttaagagtcccatag

SEQ ID NO: 195563 - DNA, 19 bp, Artificial sequence
  SiRNA target sequence
gtgttaagagtcccatagt

SEQ ID NO: 195564 - DNA, 19 bp, Artificial sequence
  SiRNA target sequence
tgttaagagtcccatagta

SEQ ID NO: 195565 - DNA, 19 bp, Artificial sequence
  SiRNA target sequence
gttaagagtcccatagtaa

SEQ ID NO: 195566 - DNA, 19 bp, Artificial sequence
  SiRNA target sequence
ttaagagtcccatagtaat

SEQ ID NO: 195567 - DNA, 19 bp, Artificial sequence
  SiRNA target sequence
taagagtcccatagtaatc

SEQ ID NO: 195568 - DNA, 19 bp, Artificial sequence
  SiRNA target sequence
aagagtcccatagtaatcc

SEQ ID NO: 195569 - DNA, 19 bp, Artificial sequence
  SiRNA target sequence
agagtcccatagtaatcca

SEQ ID NO: 195570 - DNA, 19 bp, Artificial sequence
  SiRNA target sequence
gagtcccatagtaatccat

SEQ ID NO: 195571 - DNA, 19 bp, Artificial sequence
  SiRNA target sequence
agtcccatagtaatccatc

SEQ ID NO: 195572 - DNA, 19 bp, Artificial sequence
  SiRNA target sequence
gtcccatagtaatccatcc

SEQ ID NO: 195573 - DNA, 19 bp, Artificial sequence
  SiRNA target sequence
tcccatagtaatccatcca

SEQ ID NO: 195574 - DNA, 19 bp, Artificial sequence
  SiRNA target sequence
cccatagtaatccatccac

SEQ ID NO: 195575 - DNA, 19 bp, Artificial sequence
  SiRNA target sequence
ccatagtaatccatccact

SEQ ID NO: 195576 - DNA, 19 bp, Artificial sequence
  SiRNA target sequence
catagtaatccatccacta

SEQ ID NO: 195577 - DNA, 19 bp, Artificial sequence
  SiRNA target sequence
atagtaatccatccactac

SEQ ID NO: 195578 - DNA, 19 bp, Artificial sequence
  SiRNA target sequence
tagtaatccatccactact

SEQ ID NO: 195579 - DNA, 19 bp, Artificial sequence
  SiRNA target sequence
agtaatccatccactactt

SEQ ID NO: 195580 - DNA, 19 bp, Artificial sequence
  SiRNA target sequence
gtaatccatccactacttt

SEQ ID NO: 195581 - DNA, 19 bp, Artificial sequence
  SiRNA target sequence
taatccatccactactttc

SEQ ID NO: 195582 - DNA, 19 bp, Artificial sequence
  SiRNA target sequence
aatccatccactactttct

SEQ ID NO: 195583 - DNA, 19 bp, Artificial sequence
  SiRNA target sequence
atccatccactactttcta

SEQ ID NO: 195584 - DNA, 19 bp, Artificial sequence
  SiRNA target sequence
tccatccactactttctac

SEQ ID NO: 195585 - DNA, 19 bp, Artificial sequence
  SiRNA target sequence
ccatccactactttctact

SEQ ID NO: 195586 - DNA, 19 bp, Artificial sequence
  SiRNA target sequence
catccactactttctacta

SEQ ID NO: 195587 - DNA, 19 bp, Artificial sequence
  SiRNA target sequence
atccactactttctactaa

SEQ ID NO: 195588 - DNA, 19 bp, Artificial sequence
  SiRNA target sequence
tccactactttctactaaa

SEQ ID NO: 195589 - DNA, 19 bp, Artificial sequence
  SiRNA target sequence
ccactactttctactaaag

SEQ ID NO: 195590 - DNA, 19 bp, Artificial sequence
  SiRNA target sequence
cactactttctactaaagt

SEQ ID NO: 195591 - DNA, 19 bp, Artificial sequence
  SiRNA target sequence
actactttctactaaagta

SEQ ID NO: 195592 - DNA, 19 bp, Artificial sequence
  SiRNA target sequence
ctactttctactaaagtag

SEQ ID NO: 195593 - DNA, 19 bp, Artificial sequence
  SiRNA target sequence
tactttctactaaagtaga

SEQ ID NO: 195594 - DNA, 19 bp, Artificial sequence
  SiRNA target sequence
actttctactaaagtagaa

SEQ ID NO: 195595 - DNA, 19 bp, Artificial sequence
  SiRNA target sequence
ctttctactaaagtagaaa

SEQ ID NO: 195596 - DNA, 19 bp, Artificial sequence
  SiRNA target sequence
tttctactaaagtagaaaa

SEQ ID NO: 195597 - DNA, 19 bp, Artificial sequence
  SiRNA target sequence
ttctactaaagtagaaaat

SEQ ID NO: 195598 - DNA, 19 bp, Artificial sequence
  SiRNA target sequence
tctactaaagtagaaaatg

SEQ ID NO: 195599 - DNA, 19 bp, Artificial sequence
  SiRNA target sequence
ctactaaagtagaaaatgc

SEQ ID NO: 195600 - DNA, 19 bp, Artificial sequence
  SiRNA target sequence
tactaaagtagaaaatgct

SEQ ID NO: 195601 - DNA, 19 bp, Artificial sequence
  SiRNA target sequence
actaaagtagaaaatgctg

SEQ ID NO: 195602 - DNA, 19 bp, Artificial sequence
  SiRNA target sequence
ctaaagtagaaaatgctga

SEQ ID NO: 195603 - DNA, 19 bp, Artificial sequence
  SiRNA target sequence
taaagtagaaaatgctgac

SEQ ID NO: 195604 - DNA, 19 bp, Artificial sequence
  SiRNA target sequence
aaagtagaaaatgctgaca

SEQ ID NO: 195605 - DNA, 19 bp, Artificial sequence
  SiRNA target sequence
aagtagaaaatgctgacaa

SEQ ID NO: 195606 - DNA, 19 bp, Artificial sequence
  SiRNA target sequence
agtagaaaatgctgacaaa

SEQ ID NO: 195607 - DNA, 19 bp, Artificial sequence
  SiRNA target sequence
gtagaaaatgctgacaaat

SEQ ID NO: 195608 - DNA, 19 bp, Artificial sequence
  SiRNA target sequence
tagaaaatgctgacaaatt

SEQ ID NO: 195609 - DNA, 19 bp, Artificial sequence
  SiRNA target sequence
agaaaatgctgacaaatta

SEQ ID NO: 195610 - DNA, 19 bp, Artificial sequence
  SiRNA target sequence
gaaaatgctgacaaattaa

SEQ ID NO: 195611 - DNA, 19 bp, Artificial sequence
  SiRNA target sequence
aaaatgctgacaaattaag

SEQ ID NO: 195612 - DNA, 19 bp, Artificial sequence
  SiRNA target sequence
aaatgctgacaaattaagt

SEQ ID NO: 195613 - DNA, 19 bp, Artificial sequence
  SiRNA target sequence
aatgctgacaaattaagtg

SEQ ID NO: 195614 - DNA, 19 bp, Artificial sequence
  SiRNA target sequence
atgctgacaaattaagtgt

SEQ ID NO: 195615 - DNA, 19 bp, Artificial sequence
  SiRNA target sequence
tgctgacaaattaagtgtt

SEQ ID NO: 195616 - DNA, 19 bp, Artificial sequence
  SiRNA target sequence
gctgacaaattaagtgtta

SEQ ID NO: 195617 - DNA, 19 bp, Artificial sequence
  SiRNA target sequence
ctgacaaattaagtgttat

SEQ ID NO: 195618 - DNA, 19 bp, Artificial sequence
  SiRNA target sequence
tgacaaattaagtgttatt

SEQ ID NO: 195619 - DNA, 19 bp, Artificial sequence
  SiRNA target sequence
gacaaattaagtgttatta

SEQ ID NO: 195620 - DNA, 19 bp, Artificial sequence
  SiRNA target sequence
acaaattaagtgttattac

SEQ ID NO: 195621 - DNA, 19 bp, Artificial sequence
  SiRNA target sequence
caaattaagtgttattaca

SEQ ID NO: 195622 - DNA, 19 bp, Artificial sequence
  SiRNA target sequence
aaattaagtgttattacag

SEQ ID NO: 195623 - DNA, 19 bp, Artificial sequence
  SiRNA target sequence
aattaagtgttattacagt

SEQ ID NO: 195624 - DNA, 19 bp, Artificial sequence
  SiRNA target sequence
attaagtgttattacagta

SEQ ID NO: 195625 - DNA, 19 bp, Artificial sequence
  SiRNA target sequence
ttaagtgttattacagtaa

SEQ ID NO: 195626 - DNA, 19 bp, Artificial sequence
  SiRNA target sequence
taagtgttattacagtaac

SEQ ID NO: 195627 - DNA, 19 bp, Artificial sequence
  SiRNA target sequence
aagtgttattacagtaact

SEQ ID NO: 195628 - DNA, 19 bp, Artificial sequence
  SiRNA target sequence
agtgttattacagtaactg

SEQ ID NO: 195629 - DNA, 19 bp, Artificial sequence
  SiRNA target sequence
gtgttattacagtaactgc

SEQ ID NO: 195630 - DNA, 19 bp, Artificial sequence
  SiRNA target sequence
tgttattacagtaactgct

SEQ ID NO: 195631 - DNA, 19 bp, Artificial sequence
  SiRNA target sequence
gttattacagtaactgcta

SEQ ID NO: 195632 - DNA, 19 bp, Artificial sequence
  SiRNA target sequence
ttattacagtaactgctac

SEQ ID NO: 195633 - DNA, 19 bp, Artificial sequence
  SiRNA target sequence
tattacagtaactgctacc

SEQ ID NO: 195634 - DNA, 19 bp, Artificial sequence
  SiRNA target sequence
attacagtaactgctacca

SEQ ID NO: 195635 - DNA, 19 bp, Artificial sequence
  SiRNA target sequence
ttacagtaactgctaccaa

SEQ ID NO: 195636 - DNA, 19 bp, Artificial sequence
  SiRNA target sequence
tacagtaactgctaccaat

SEQ ID NO: 195637 - DNA, 19 bp, Artificial sequence
  SiRNA target sequence
acagtaactgctaccaata

SEQ ID NO: 195638 - DNA, 19 bp, Artificial sequence
  SiRNA target sequence
cagtaactgctaccaatat

SEQ ID NO: 195639 - DNA, 19 bp, Artificial sequence
  SiRNA target sequence
agtaactgctaccaatatt

SEQ ID NO: 195640 - DNA, 19 bp, Artificial sequence
  SiRNA target sequence
gtaactgctaccaatattt

SEQ ID NO: 195641 - DNA, 19 bp, Artificial sequence
  SiRNA target sequence
taactgctaccaatatttg

SEQ ID NO: 195642 - DNA, 19 bp, Artificial sequence
  SiRNA target sequence
aactgctaccaatatttga

SEQ ID NO: 195643 - DNA, 19 bp, Artificial sequence
  SiRNA target sequence
actgctaccaatatttgat

SEQ ID NO: 195644 - DNA, 19 bp, Artificial sequence
  SiRNA target sequence
ctgctaccaatatttgatc

SEQ ID NO: 195645 - DNA, 19 bp, Artificial sequence
  SiRNA target sequence
tgctaccaatatttgatct

SEQ ID NO: 195646 - DNA, 19 bp, Artificial sequence
  SiRNA target sequence
gctaccaatatttgatcta

SEQ ID NO: 195647 - DNA, 19 bp, Artificial sequence
  SiRNA target sequence
ctaccaatatttgatctat

SEQ ID NO: 195648 - DNA, 19 bp, Artificial sequence
  SiRNA target sequence
taccaatatttgatctatt

SEQ ID NO: 195649 - DNA, 19 bp, Artificial sequence
  SiRNA target sequence
accaatatttgatctattg

SEQ ID NO: 195650 - DNA, 19 bp, Artificial sequence
  SiRNA target sequence
ccaatatttgatctattgt

SEQ ID NO: 195651 - DNA, 19 bp, Artificial sequence
  SiRNA target sequence
caatatttgatctattgta

SEQ ID NO: 195652 - DNA, 19 bp, Artificial sequence
  SiRNA target sequence
aatatttgatctattgtat

SEQ ID NO: 195653 - DNA, 19 bp, Artificial sequence
  SiRNA target sequence
atatttgatctattgtatt

SEQ ID NO: 195654 - DNA, 19 bp, Artificial sequence
  SiRNA target sequence
tatttgatctattgtatta

SEQ ID NO: 195655 - DNA, 19 bp, Artificial sequence
  SiRNA target sequence
atttgatctattgtattaa

SEQ ID NO: 195656 - DNA, 19 bp, Artificial sequence
  SiRNA target sequence
tttgatctattgtattaaa

SEQ ID NO: 195657 - DNA, 19 bp, Artificial sequence
  SiRNA target sequence
ttgatctattgtattaaat

SEQ ID NO: 195658 - DNA, 19 bp, Artificial sequence
  SiRNA target sequence
tgatctattgtattaaatt

SEQ ID NO: 195659 - DNA, 19 bp, Artificial sequence
  SiRNA target sequence
gatctattgtattaaattt

SEQ ID NO: 195660 - DNA, 19 bp, Artificial sequence
  SiRNA target sequence
atctattgtattaaatttg

SEQ ID NO: 195661 - DNA, 19 bp, Artificial sequence
  SiRNA target sequence
tctattgtattaaatttgc

SEQ ID NO: 195662 - DNA, 19 bp, Artificial sequence
  SiRNA target sequence
ctattgtattaaatttgcc

SEQ ID NO: 195663 - DNA, 19 bp, Artificial sequence
  SiRNA target sequence
tattgtattaaatttgccg

SEQ ID NO: 195664 - DNA, 19 bp, Artificial sequence
  SiRNA target sequence
attgtattaaatttgccgg

SEQ ID NO: 195665 - DNA, 19 bp, Artificial sequence
  SiRNA target sequence
ttgtattaaatttgccgga

SEQ ID NO: 195666 - DNA, 19 bp, Artificial sequence
  SiRNA target sequence
tgtattaaatttgccggag

SEQ ID NO: 195667 - DNA, 19 bp, Artificial sequence
  SiRNA target sequence
gtattaaatttgccggagt

SEQ ID NO: 195668 - DNA, 19 bp, Artificial sequence
  SiRNA target sequence
tattaaatttgccggagta

SEQ ID NO: 195669 - DNA, 19 bp, Artificial sequence
  SiRNA target sequence
attaaatttgccggagtat

SEQ ID NO: 195670 - DNA, 19 bp, Artificial sequence
  SiRNA target sequence
ttaaatttgccggagtatt

SEQ ID NO: 195671 - DNA, 19 bp, Artificial sequence
  SiRNA target sequence
taaatttgccggagtattc

SEQ ID NO: 195672 - DNA, 19 bp, Artificial sequence
  SiRNA target sequence
aaatttgccggagtattct

SEQ ID NO: 195673 - DNA, 19 bp, Artificial sequence
  SiRNA target sequence
aatttgccggagtattctc

SEQ ID NO: 195674 - DNA, 19 bp, Artificial sequence
  SiRNA target sequence
atttgccggagtattctcc

SEQ ID NO: 195675 - DNA, 19 bp, Artificial sequence
  SiRNA target sequence
tttgccggagtattctcct

SEQ ID NO: 195676 - DNA, 19 bp, Artificial sequence
  SiRNA target sequence
ttgccggagtattctccta

SEQ ID NO: 195677 - DNA, 19 bp, Artificial sequence
  SiRNA target sequence
tgccggagtattctcctac

SEQ ID NO: 195678 - DNA, 19 bp, Artificial sequence
  SiRNA target sequence
gccggagtattctcctacc

SEQ ID NO: 195679 - DNA, 19 bp, Artificial sequence
  SiRNA target sequence
ccggagtattctcctacct

SEQ ID NO: 195680 - DNA, 19 bp, Artificial sequence
  SiRNA target sequence
cggagtattctcctacctc

SEQ ID NO: 195681 - DNA, 19 bp, Artificial sequence
  SiRNA target sequence
ggagtattctcctacctct

SEQ ID NO: 195682 - DNA, 19 bp, Artificial sequence
  SiRNA target sequence
gagtattctcctacctcta

SEQ ID NO: 195683 - DNA, 19 bp, Artificial sequence
  SiRNA target sequence
agtattctcctacctctaa

SEQ ID NO: 195684 - DNA, 19 bp, Artificial sequence
  SiRNA target sequence
gtattctcctacctctaat

SEQ ID NO: 195685 - DNA, 19 bp, Artificial sequence
  SiRNA target sequence
tattctcctacctctaatc

SEQ ID NO: 195686 - DNA, 19 bp, Artificial sequence
  SiRNA target sequence
attctcctacctctaatcc

SEQ ID NO: 195687 - DNA, 19 bp, Artificial sequence
  SiRNA target sequence
ttctcctacctctaatcct

SEQ ID NO: 195688 - DNA, 19 bp, Artificial sequence
  SiRNA target sequence
tctcctacctctaatccta

SEQ ID NO: 195689 - DNA, 19 bp, Artificial sequence
  SiRNA target sequence
ctcctacctctaatcctaa

SEQ ID NO: 195690 - DNA, 19 bp, Artificial sequence
  SiRNA target sequence
tcctacctctaatcctaaa

SEQ ID NO: 195691 - DNA, 19 bp, Artificial sequence
  SiRNA target sequence
cctacctctaatcctaaac

SEQ ID NO: 195692 - DNA, 19 bp, Artificial sequence
  SiRNA target sequence
ctacctctaatcctaaact

SEQ ID NO: 195693 - DNA, 19 bp, Artificial sequence
  SiRNA target sequence
tacctctaatcctaaactt

SEQ ID NO: 195694 - DNA, 19 bp, Artificial sequence
  SiRNA target sequence
acctctaatcctaaacttt

SEQ ID NO: 195695 - DNA, 19 bp, Artificial sequence
  SiRNA target sequence
cctctaatcctaaactttt

SEQ ID NO: 195696 - DNA, 19 bp, Artificial sequence
  SiRNA target sequence
ctctaatcctaaacttttt

SEQ ID NO: 195697 - DNA, 19 bp, Artificial sequence
  SiRNA target sequence
tctaatcctaaactttttg

SEQ ID NO: 195698 - DNA, 19 bp, Artificial sequence
  SiRNA target sequence
ctaatcctaaactttttga

SEQ ID NO: 195699 - DNA, 19 bp, Artificial sequence
  SiRNA target sequence
taatcctaaactttttgac

SEQ ID NO: 195700 - DNA, 19 bp, Artificial sequence
  SiRNA target sequence
aatcctaaactttttgacg

SEQ ID NO: 195701 - DNA, 19 bp, Artificial sequence
  SiRNA target sequence
atcctaaactttttgacgc

SEQ ID NO: 195702 - DNA, 19 bp, Artificial sequence
  SiRNA target sequence
tcctaaactttttgacgca

SEQ ID NO: 195703 - DNA, 19 bp, Artificial sequence
  SiRNA target sequence
cctaaactttttgacgcag

SEQ ID NO: 195704 - DNA, 19 bp, Artificial sequence
  SiRNA target sequence
ctaaactttttgacgcagc

SEQ ID NO: 195705 - DNA, 19 bp, Artificial sequence
  SiRNA target sequence
taaactttttgacgcagct

SEQ ID NO: 195706 - DNA, 19 bp, Artificial sequence
  SiRNA target sequence
aaactttttgacgcagctt

SEQ ID NO: 195707 - DNA, 19 bp, Artificial sequence
  SiRNA target sequence
aactttttgacgcagcttt

SEQ ID NO: 195708 - DNA, 19 bp, Artificial sequence
  SiRNA target sequence
actttttgacgcagcttta

SEQ ID NO: 195709 - DNA, 19 bp, Artificial sequence
  SiRNA target sequence
ctttttgacgcagctttaa

SEQ ID NO: 195710 - DNA, 19 bp, Artificial sequence
  SiRNA target sequence
tttttgacgcagctttaat

SEQ ID NO: 195711 - DNA, 19 bp, Artificial sequence
  SiRNA target sequence
ttttgacgcagctttaatt

SEQ ID NO: 195712 - DNA, 19 bp, Artificial sequence
  SiRNA target sequence
tttgacgcagctttaattc

SEQ ID NO: 195713 - DNA, 19 bp, Artificial sequence
  SiRNA target sequence
ttgacgcagctttaattcc

SEQ ID NO: 195714 - DNA, 19 bp, Artificial sequence
  SiRNA target sequence
tgacgcagctttaattcct

SEQ ID NO: 195715 - DNA, 19 bp, Artificial sequence
  SiRNA target sequence
gacgcagctttaattcctg

SEQ ID NO: 195716 - DNA, 19 bp, Artificial sequence
  SiRNA target sequence
acgcagctttaattcctgc

SEQ ID NO: 195717 - DNA, 19 bp, Artificial sequence
  SiRNA target sequence
cgcagctttaattcctgct

SEQ ID NO: 195718 - DNA, 19 bp, Artificial sequence
  SiRNA target sequence
gcagctttaattcctgctt

SEQ ID NO: 195719 - DNA, 19 bp, Artificial sequence
  SiRNA target sequence
cagctttaattcctgcttt

SEQ ID NO: 195720 - DNA, 19 bp, Artificial sequence
  SiRNA target sequence
agctttaattcctgcttta

SEQ ID NO: 195721 - DNA, 19 bp, Artificial sequence
  SiRNA target sequence
gctttaattcctgctttat

SEQ ID NO: 195722 - DNA, 19 bp, Artificial sequence
  SiRNA target sequence
ctttaattcctgctttata

SEQ ID NO: 195723 - DNA, 19 bp, Artificial sequence
  SiRNA target sequence
tttaattcctgctttatag

SEQ ID NO: 195724 - DNA, 19 bp, Artificial sequence
  SiRNA target sequence
ttaattcctgctttataga

SEQ ID NO: 195725 - DNA, 19 bp, Artificial sequence
  SiRNA target sequence
taattcctgctttatagac

SEQ ID NO: 195726 - DNA, 19 bp, Artificial sequence
  SiRNA target sequence
aattcctgctttatagaca

SEQ ID NO: 195727 - DNA, 19 bp, Artificial sequence
  SiRNA target sequence
attcctgctttatagacag

SEQ ID NO: 195728 - DNA, 19 bp, Artificial sequence
  SiRNA target sequence
ttcctgctttatagacaga

SEQ ID NO: 195729 - DNA, 19 bp, Artificial sequence
  SiRNA target sequence
tcctgctttatagacagat

SEQ ID NO: 195730 - DNA, 19 bp, Artificial sequence
  SiRNA target sequence
cctgctttatagacagatt

SEQ ID NO: 195731 - DNA, 19 bp, Artificial sequence
  SiRNA target sequence
ctgctttatagacagattc

SEQ ID NO: 195732 - DNA, 19 bp, Artificial sequence
  SiRNA target sequence
tgctttatagacagattca

SEQ ID NO: 195733 - DNA, 19 bp, Artificial sequence
  SiRNA target sequence
gctttatagacagattcaa

SEQ ID NO: 195734 - DNA, 19 bp, Artificial sequence
  SiRNA target sequence
ctttatagacagattcaat

SEQ ID NO: 195735 - DNA, 19 bp, Artificial sequence
  SiRNA target sequence
tttatagacagattcaatt

SEQ ID NO: 195736 - DNA, 19 bp, Artificial sequence
  SiRNA target sequence
ttatagacagattcaatta

SEQ ID NO: 195737 - DNA, 19 bp, Artificial sequence
  SiRNA target sequence
tatagacagattcaattaa

SEQ ID NO: 195738 - DNA, 19 bp, Artificial sequence
  SiRNA target sequence
atagacagattcaattaaa

SEQ ID NO: 195739 - DNA, 19 bp, Artificial sequence
  SiRNA target sequence
tagacagattcaattaaat

SEQ ID NO: 195740 - DNA, 19 bp, Artificial sequence
  SiRNA target sequence
agacagattcaattaaatt

SEQ ID NO: 195741 - DNA, 19 bp, Artificial sequence
  SiRNA target sequence
gacagattcaattaaatta

SEQ ID NO: 195742 - DNA, 19 bp, Artificial sequence
  SiRNA target sequence
acagattcaattaaattaa

SEQ ID NO: 195743 - DNA, 19 bp, Artificial sequence
  SiRNA target sequence
cagattcaattaaattaaa

SEQ ID NO: 195744 - DNA, 19 bp, Artificial sequence
  SiRNA target sequence
agattcaattaaattaaat

SEQ ID NO: 195745 - DNA, 19 bp, Artificial sequence
  SiRNA target sequence
gattcaattaaattaaatg

SEQ ID NO: 195746 - DNA, 19 bp, Artificial sequence
  SiRNA target sequence
attcaattaaattaaatgt

SEQ ID NO: 195747 - DNA, 19 bp, Artificial sequence
  SiRNA target sequence
ttcaattaaattaaatgtt

SEQ ID NO: 195748 - DNA, 19 bp, Artificial sequence
  SiRNA target sequence
tcaattaaattaaatgtta

SEQ ID NO: 195749 - DNA, 19 bp, Artificial sequence
  SiRNA target sequence
caattaaattaaatgttat

SEQ ID NO: 195750 - DNA, 19 bp, Artificial sequence
  SiRNA target sequence
aattaaattaaatgttata

SEQ ID NO: 195751 - DNA, 19 bp, Artificial sequence
  SiRNA target sequence
attaaattaaatgttatat

SEQ ID NO: 195752 - DNA, 19 bp, Artificial sequence
  SiRNA target sequence
ttaaattaaatgttatatt

SEQ ID NO: 195753 - DNA, 19 bp, Artificial sequence
  SiRNA target sequence
taaattaaatgttatattg

SEQ ID NO: 195754 - DNA, 19 bp, Artificial sequence
  SiRNA target sequence
aaattaaatgttatattgt

SEQ ID NO: 195755 - DNA, 19 bp, Artificial sequence
  SiRNA target sequence
aattaaatgttatattgta

SEQ ID NO: 195756 - DNA, 19 bp, Artificial sequence
  SiRNA target sequence
attaaatgttatattgtaa

SEQ ID NO: 195757 - DNA, 19 bp, Artificial sequence
  SiRNA target sequence
ttaaatgttatattgtaaa

SEQ ID NO: 195758 - DNA, 19 bp, Artificial sequence
  SiRNA target sequence
taaatgttatattgtaaaa

SEQ ID NO: 195759 - DNA, 19 bp, Artificial sequence
  SiRNA target sequence
aaatgttatattgtaaaaa

SEQ ID NO: 195760 - DNA, 19 bp, Artificial sequence
  SiRNA target sequence
aatgttatattgtaaaaaa

SEQ ID NO: 195761 - DNA, 19 bp, Artificial sequence
  SiRNA target sequence
atgttatattgtaaaaaaa

SEQ ID NO: 195762 - DNA, 19 bp, Artificial sequence
  SiRNA target sequence
tgttatattgtaaaaaaag

SEQ ID NO: 195763 - DNA, 19 bp, Artificial sequence
  SiRNA target sequence
gttatattgtaaaaaaaga

SEQ ID NO: 195764 - DNA, 19 bp, Artificial sequence
  SiRNA target sequence
ttatattgtaaaaaaagac

SEQ ID NO: 195765 - DNA, 19 bp, Artificial sequence
  SiRNA target sequence
tatattgtaaaaaaagact

SEQ ID NO: 195766 - DNA, 19 bp, Artificial sequence
  SiRNA target sequence
atattgtaaaaaaagacta

SEQ ID NO: 195767 - DNA, 19 bp, Artificial sequence
  SiRNA target sequence
tattgtaaaaaaagactat

SEQ ID NO: 195768 - DNA, 19 bp, Artificial sequence
  SiRNA target sequence
attgtaaaaaaagactatt

SEQ ID NO: 195769 - DNA, 19 bp, Artificial sequence
  SiRNA target sequence
ttgtaaaaaaagactatta

SEQ ID NO: 195770 - DNA, 19 bp, Artificial sequence
  SiRNA target sequence
tgtaaaaaaagactattat

SEQ ID NO: 195771 - DNA, 19 bp, Artificial sequence
  SiRNA target sequence
gtaaaaaaagactattata

SEQ ID NO: 195772 - DNA, 19 bp, Artificial sequence
  SiRNA target sequence
taaaaaaagactattatac

SEQ ID NO: 195773 - DNA, 19 bp, Artificial sequence
  SiRNA target sequence
aaaaaaagactattataca

SEQ ID NO: 195774 - DNA, 19 bp, Artificial sequence
  SiRNA target sequence
aaaaaagactattatacaa

SEQ ID NO: 195775 - DNA, 19 bp, Artificial sequence
  SiRNA target sequence
aaaaagactattatacaaa

SEQ ID NO: 195776 - DNA, 19 bp, Artificial sequence
  SiRNA target sequence
aaaagactattatacaaag

SEQ ID NO: 195777 - DNA, 19 bp, Artificial sequence
  SiRNA target sequence
aaagactattatacaaagt

SEQ ID NO: 195778 - DNA, 19 bp, Artificial sequence
  SiRNA target sequence
aagactattatacaaagtg

SEQ ID NO: 195779 - DNA, 19 bp, Artificial sequence
  SiRNA target sequence
agactattatacaaagtga

SEQ ID NO: 195780 - DNA, 19 bp, Artificial sequence
  SiRNA target sequence
gactattatacaaagtgac

SEQ ID NO: 195781 - DNA, 19 bp, Artificial sequence
  SiRNA target sequence
actattatacaaagtgaca

SEQ ID NO: 195782 - DNA, 19 bp, Artificial sequence
  SiRNA target sequence
ctattatacaaagtgacat

SEQ ID NO: 195783 - DNA, 19 bp, Artificial sequence
  SiRNA target sequence
tattatacaaagtgacatt

SEQ ID NO: 195784 - DNA, 19 bp, Artificial sequence
  SiRNA target sequence
attatacaaagtgacatta

SEQ ID NO: 195785 - DNA, 19 bp, Artificial sequence
  SiRNA target sequence
ttatacaaagtgacattaa

SEQ ID NO: 195786 - DNA, 19 bp, Artificial sequence
  SiRNA target sequence
tatacaaagtgacattaat

SEQ ID NO: 195787 - DNA, 19 bp, Artificial sequence
  SiRNA target sequence
atacaaagtgacattaata

SEQ ID NO: 195788 - DNA, 19 bp, Artificial sequence
  SiRNA target sequence
tacaaagtgacattaataa

SEQ ID NO: 195789 - DNA, 19 bp, Artificial sequence
  SiRNA target sequence
acaaagtgacattaataat

SEQ ID NO: 195790 - DNA, 19 bp, Artificial sequence
  SiRNA target sequence
caaagtgacattaataatt

SEQ ID NO: 195791 - DNA, 19 bp, Artificial sequence
  SiRNA target sequence
aaagtgacattaataattt

SEQ ID NO: 195792 - DNA, 19 bp, Artificial sequence
  SiRNA target sequence
aagtgacattaataatttt

SEQ ID NO: 195793 - DNA, 19 bp, Artificial sequence
  SiRNA target sequence
agtgacattaataattttg

SEQ ID NO: 195794 - DNA, 19 bp, Artificial sequence
  SiRNA target sequence
gtgacattaataattttga

SEQ ID NO: 195795 - DNA, 19 bp, Artificial sequence
  SiRNA target sequence
tgacattaataattttgat

SEQ ID NO: 195796 - DNA, 19 bp, Artificial sequence
  SiRNA target sequence
gacattaataattttgatt

SEQ ID NO: 195797 - DNA, 19 bp, Artificial sequence
  SiRNA target sequence
acattaataattttgattt

SEQ ID NO: 195798 - DNA, 19 bp, Artificial sequence
  SiRNA target sequence
cattaataattttgatttc

SEQ ID NO: 195799 - DNA, 19 bp, Artificial sequence
  SiRNA target sequence
attaataattttgatttca

SEQ ID NO: 195800 - DNA, 19 bp, Artificial sequence
  SiRNA target sequence
ttaataattttgatttcat

SEQ ID NO: 195801 - DNA, 19 bp, Artificial sequence
  SiRNA target sequence
taataattttgatttcatc

SEQ ID NO: 195802 - DNA, 19 bp, Artificial sequence
  SiRNA target sequence
aataattttgatttcatca

SEQ ID NO: 195803 - DNA, 19 bp, Artificial sequence
  SiRNA target sequence
ataattttgatttcatcat

SEQ ID NO: 195804 - DNA, 19 bp, Artificial sequence
  SiRNA target sequence
taattttgatttcatcatt

SEQ ID NO: 195805 - DNA, 19 bp, Artificial sequence
  SiRNA target sequence
aattttgatttcatcatta

SEQ ID NO: 195806 - DNA, 19 bp, Artificial sequence
  SiRNA target sequence
attttgatttcatcattat

SEQ ID NO: 195807 - DNA, 19 bp, Artificial sequence
  SiRNA target sequence
ttttgatttcatcattata

SEQ ID NO: 195808 - DNA, 19 bp, Artificial sequence
  SiRNA target sequence
tttgatttcatcattatac

SEQ ID NO: 195809 - DNA, 19 bp, Artificial sequence
  SiRNA target sequence
ttgatttcatcattatact

SEQ ID NO: 195810 - DNA, 19 bp, Artificial sequence
  SiRNA target sequence
tgatttcatcattatacta

SEQ ID NO: 195811 - DNA, 19 bp, Artificial sequence
  SiRNA target sequence
gatttcatcattatactaa

SEQ ID NO: 195812 - DNA, 19 bp, Artificial sequence
  SiRNA target sequence
atttcatcattatactaat

SEQ ID NO: 195813 - DNA, 19 bp, Artificial sequence
  SiRNA target sequence
tttcatcattatactaata

SEQ ID NO: 195814 - DNA, 19 bp, Artificial sequence
  SiRNA target sequence
ttcatcattatactaatac

SEQ ID NO: 195815 - DNA, 19 bp, Artificial sequence
  SiRNA target sequence
tcatcattatactaatacc

SEQ ID NO: 195816 - DNA, 19 bp, Artificial sequence
  SiRNA target sequence
catcattatactaatacct

SEQ ID NO: 195817 - DNA, 19 bp, Artificial sequence
  SiRNA target sequence
atcattatactaatacctt

SEQ ID NO: 195818 - DNA, 19 bp, Artificial sequence
  SiRNA target sequence
tcattatactaataccttc

SEQ ID NO: 195819 - DNA, 19 bp, Artificial sequence
  SiRNA target sequence
cattatactaataccttcg

SEQ ID NO: 195820 - DNA, 19 bp, Artificial sequence
  SiRNA target sequence
attatactaataccttcgg

SEQ ID NO: 195821 - DNA, 19 bp, Artificial sequence
  SiRNA target sequence
ttatactaataccttcgga

SEQ ID NO: 195822 - DNA, 19 bp, Artificial sequence
  SiRNA target sequence
tatactaataccttcggag

SEQ ID NO: 195823 - DNA, 19 bp, Artificial sequence
  SiRNA target sequence
atactaataccttcggaga

SEQ ID NO: 195824 - DNA, 19 bp, Artificial sequence
  SiRNA target sequence
tactaataccttcggagaa

SEQ ID NO: 195825 - DNA, 19 bp, Artificial sequence
  SiRNA target sequence
actaataccttcggagaaa

SEQ ID NO: 195826 - DNA, 19 bp, Artificial sequence
  SiRNA target sequence
ctaataccttcggagaaac

SEQ ID NO: 195827 - DNA, 19 bp, Artificial sequence
  SiRNA target sequence
taataccttcggagaaacc

SEQ ID NO: 195828 - DNA, 19 bp, Artificial sequence
  SiRNA target sequence
aataccttcggagaaacct

SEQ ID NO: 195829 - DNA, 19 bp, Artificial sequence
  SiRNA target sequence
ataccttcggagaaaccta

SEQ ID NO: 195830 - DNA, 19 bp, Artificial sequence
  SiRNA target sequence
taccttcggagaaacctac

SEQ ID NO: 195831 - DNA, 19 bp, Artificial sequence
  SiRNA target sequence
accttcggagaaacctaca

SEQ ID NO: 195832 - DNA, 19 bp, Artificial sequence
  SiRNA target sequence
ccttcggagaaacctacac

SEQ ID NO: 195833 - DNA, 19 bp, Artificial sequence
  SiRNA target sequence
cttcggagaaacctacact

SEQ ID NO: 195834 - DNA, 19 bp, Artificial sequence
  SiRNA target sequence
ttcggagaaacctacacta

SEQ ID NO: 195835 - DNA, 19 bp, Artificial sequence
  SiRNA target sequence
tcggagaaacctacactaa

SEQ ID NO: 195836 - DNA, 19 bp, Artificial sequence
  SiRNA target sequence
cggagaaacctacactaac

SEQ ID NO: 195837 - DNA, 19 bp, Artificial sequence
  SiRNA target sequence
ggagaaacctacactaact

SEQ ID NO: 195838 - DNA, 19 bp, Artificial sequence
  SiRNA target sequence
gagaaacctacactaactt

SEQ ID NO: 195839 - DNA, 19 bp, Artificial sequence
  SiRNA target sequence
agaaacctacactaacttt

SEQ ID NO: 195840 - DNA, 19 bp, Artificial sequence
  SiRNA target sequence
gaaacctacactaactttt

SEQ ID NO: 195841 - DNA, 19 bp, Artificial sequence
  SiRNA target sequence
aaacctacactaacttttt

SEQ ID NO: 195842 - DNA, 19 bp, Artificial sequence
  SiRNA target sequence
aacctacactaactttttg

SEQ ID NO: 195843 - DNA, 19 bp, Artificial sequence
  SiRNA target sequence
acctacactaactttttgt

SEQ ID NO: 195844 - DNA, 19 bp, Artificial sequence
  SiRNA target sequence
cctacactaactttttgtt

SEQ ID NO: 195845 - DNA, 19 bp, Artificial sequence
  SiRNA target sequence
ctacactaactttttgttt

SEQ ID NO: 195846 - DNA, 19 bp, Artificial sequence
  SiRNA target sequence
tacactaactttttgtttc

SEQ ID NO: 195847 - DNA, 19 bp, Artificial sequence
  SiRNA target sequence
acactaactttttgtttct

SEQ ID NO: 195848 - DNA, 19 bp, Artificial sequence
  SiRNA target sequence
cactaactttttgtttctt

SEQ ID NO: 195849 - DNA, 19 bp, Artificial sequence
  SiRNA target sequence
actaactttttgtttcttt

SEQ ID NO: 195850 - DNA, 19 bp, Artificial sequence
  SiRNA target sequence
ctaactttttgtttctttt

SEQ ID NO: 195851 - DNA, 19 bp, Artificial sequence
  SiRNA target sequence
taactttttgtttcttttt

SEQ ID NO: 195852 - DNA, 19 bp, Artificial sequence
  SiRNA target sequence
aactttttgtttctttttt

SEQ ID NO: 195853 - DNA, 19 bp, Artificial sequence
  SiRNA target sequence
actttttgtttctttttta

SEQ ID NO: 195854 - DNA, 19 bp, Artificial sequence
  SiRNA target sequence
ctttttgtttcttttttat

SEQ ID NO: 195855 - DNA, 19 bp, Artificial sequence
  SiRNA target sequence
tttttgtttcttttttatc

SEQ ID NO: 195856 - DNA, 19 bp, Artificial sequence
  SiRNA target sequence
ttttgtttcttttttatcg

SEQ ID NO: 195857 - DNA, 19 bp, Artificial sequence
  SiRNA target sequence
tttgtttcttttttatcgt

SEQ ID NO: 195858 - DNA, 19 bp, Artificial sequence
  SiRNA target sequence
ttgtttcttttttatcgta

SEQ ID NO: 195859 - DNA, 19 bp, Artificial sequence
  SiRNA target sequence
tgtttcttttttatcgtat

SEQ ID NO: 195860 - DNA, 19 bp, Artificial sequence
  SiRNA target sequence
gtttcttttttatcgtatt

SEQ ID NO: 195861 - DNA, 19 bp, Artificial sequence
  SiRNA target sequence
tttcttttttatcgtatta

SEQ ID NO: 195862 - DNA, 19 bp, Artificial sequence
  SiRNA target sequence
ttcttttttatcgtattag

SEQ ID NO: 195863 - DNA, 19 bp, Artificial sequence
  SiRNA target sequence
tcttttttatcgtattaga

SEQ ID NO: 195864 - DNA, 19 bp, Artificial sequence
  SiRNA target sequence
cttttttatcgtattagaa

SEQ ID NO: 195865 - DNA, 19 bp, Artificial sequence
  SiRNA target sequence
ttttttatcgtattagaag

SEQ ID NO: 195866 - DNA, 19 bp, Artificial sequence
  SiRNA target sequence
tttttatcgtattagaagg

SEQ ID NO: 195867 - DNA, 19 bp, Artificial sequence
  SiRNA target sequence
ttttatcgtattagaaggt

SEQ ID NO: 195868 - DNA, 19 bp, Artificial sequence
  SiRNA target sequence
tttatcgtattagaaggta

SEQ ID NO: 195869 - DNA, 19 bp, Artificial sequence
  SiRNA target sequence
ttatcgtattagaaggtat

SEQ ID NO: 195870 - DNA, 19 bp, Artificial sequence
  SiRNA target sequence
tatcgtattagaaggtata

SEQ ID NO: 195871 - DNA, 19 bp, Artificial sequence
  SiRNA target sequence
atcgtattagaaggtataa

SEQ ID NO: 195872 - DNA, 19 bp, Artificial sequence
  SiRNA target sequence
tcgtattagaaggtataaa

SEQ ID NO: 195873 - DNA, 19 bp, Artificial sequence
  SiRNA target sequence
cgtattagaaggtataaat

SEQ ID NO: 195874 - DNA, 19 bp, Artificial sequence
  SiRNA target sequence
gtattagaaggtataaata

SEQ ID NO: 195875 - DNA, 19 bp, Artificial sequence
  SiRNA target sequence
tattagaaggtataaatat

SEQ ID NO: 195876 - DNA, 19 bp, Artificial sequence
  SiRNA target sequence
attagaaggtataaatatt

SEQ ID NO: 195877 - DNA, 19 bp, Artificial sequence
  SiRNA target sequence
ttagaaggtataaatattg

SEQ ID NO: 195878 - DNA, 19 bp, Artificial sequence
  SiRNA target sequence
tagaaggtataaatattgg

SEQ ID NO: 195879 - DNA, 19 bp, Artificial sequence
  SiRNA target sequence
agaaggtataaatattggt

SEQ ID NO: 195880 - DNA, 19 bp, Artificial sequence
  SiRNA target sequence
gaaggtataaatattggta

SEQ ID NO: 195881 - DNA, 19 bp, Artificial sequence
  SiRNA target sequence
aaggtataaatattggtac

SEQ ID NO: 195882 - DNA, 19 bp, Artificial sequence
  SiRNA target sequence
aggtataaatattggtaca

SEQ ID NO: 195883 - DNA, 19 bp, Artificial sequence
  SiRNA target sequence
ggtataaatattggtacac

SEQ ID NO: 195884 - DNA, 19 bp, Artificial sequence
  SiRNA target sequence
gtataaatattggtacact

SEQ ID NO: 195885 - DNA, 19 bp, Artificial sequence
  SiRNA target sequence
tataaatattggtacactc

SEQ ID NO: 195886 - DNA, 19 bp, Artificial sequence
  SiRNA target sequence
ataaatattggtacactca

SEQ ID NO: 195887 - DNA, 19 bp, Artificial sequence
  SiRNA target sequence
taaatattggtacactcat

SEQ ID NO: 195888 - DNA, 19 bp, Artificial sequence
  SiRNA target sequence
aaatattggtacactcatt

SEQ ID NO: 195889 - DNA, 19 bp, Artificial sequence
  SiRNA target sequence
aatattggtacactcatta

SEQ ID NO: 195890 - DNA, 19 bp, Artificial sequence
  SiRNA target sequence
atattggtacactcattat

SEQ ID NO: 195891 - DNA, 19 bp, Artificial sequence
  SiRNA target sequence
tattggtacactcattatt

SEQ ID NO: 195892 - DNA, 19 bp, Artificial sequence
  SiRNA target sequence
attggtacactcattattt

SEQ ID NO: 195893 - DNA, 19 bp, Artificial sequence
  SiRNA target sequence
ttggtacactcattatttt

SEQ ID NO: 195894 - DNA, 19 bp, Artificial sequence
  SiRNA target sequence
tggtacactcattatttta

SEQ ID NO: 195895 - DNA, 19 bp, Artificial sequence
  SiRNA target sequence
ggtacactcattattttat

SEQ ID NO: 195896 - DNA, 19 bp, Artificial sequence
  SiRNA target sequence
gtacactcattattttatt

SEQ ID NO: 195897 - DNA, 19 bp, Artificial sequence
  SiRNA target sequence
tacactcattattttattc

SEQ ID NO: 195898 - DNA, 19 bp, Artificial sequence
  SiRNA target sequence
acactcattattttattct

SEQ ID NO: 195899 - DNA, 19 bp, Artificial sequence
  SiRNA target sequence
cactcattattttattctc

SEQ ID NO: 195900 - DNA, 19 bp, Artificial sequence
  SiRNA target sequence
actcattattttattctcg

SEQ ID NO: 195901 - DNA, 19 bp, Artificial sequence
  SiRNA target sequence
ctcattattttattctcga

SEQ ID NO: 195902 - DNA, 19 bp, Artificial sequence
  SiRNA target sequence
tcattattttattctcgaa

SEQ ID NO: 195903 - DNA, 19 bp, Artificial sequence
  SiRNA target sequence
cattattttattctcgaaa

SEQ ID NO: 195904 - DNA, 19 bp, Artificial sequence
  SiRNA target sequence
attattttattctcgaaat

SEQ ID NO: 195905 - DNA, 19 bp, Artificial sequence
  SiRNA target sequence
ttattttattctcgaaata

SEQ ID NO: 195906 - DNA, 19 bp, Artificial sequence
  SiRNA target sequence
tattttattctcgaaataa

SEQ ID NO: 195907 - DNA, 19 bp, Artificial sequence
  SiRNA target sequence
attttattctcgaaataat

SEQ ID NO: 195908 - DNA, 19 bp, Artificial sequence
  SiRNA target sequence
ttttattctcgaaataata

SEQ ID NO: 195909 - DNA, 19 bp, Artificial sequence
  SiRNA target sequence
tttattctcgaaataatat

SEQ ID NO: 195910 - DNA, 19 bp, Artificial sequence
  SiRNA target sequence
ttattctcgaaataatatt

SEQ ID NO: 195911 - DNA, 19 bp, Artificial sequence
  SiRNA target sequence
tattctcgaaataatattt

SEQ ID NO: 195912 - DNA, 19 bp, Artificial sequence
  SiRNA target sequence
attctcgaaataatatttc

SEQ ID NO: 195913 - DNA, 19 bp, Artificial sequence
  SiRNA target sequence
ttctcgaaataatatttca

SEQ ID NO: 195914 - DNA, 19 bp, Artificial sequence
  SiRNA target sequence
tctcgaaataatatttcat

SEQ ID NO: 195915 - DNA, 19 bp, Artificial sequence
  SiRNA target sequence
ctcgaaataatatttcatg

SEQ ID NO: 195916 - DNA, 19 bp, Artificial sequence
  SiRNA target sequence
tcgaaataatatttcatgt

SEQ ID NO: 195917 - DNA, 19 bp, Artificial sequence
  SiRNA target sequence
cgaaataatatttcatgta

SEQ ID NO: 195918 - DNA, 19 bp, Artificial sequence
  SiRNA target sequence
gaaataatatttcatgtac

SEQ ID NO: 195919 - DNA, 19 bp, Artificial sequence
  SiRNA target sequence
aaataatatttcatgtaca

SEQ ID NO: 195920 - DNA, 19 bp, Artificial sequence
  SiRNA target sequence
aataatatttcatgtacat

SEQ ID NO: 195921 - DNA, 19 bp, Artificial sequence
  SiRNA target sequence
ataatatttcatgtacatt

SEQ ID NO: 195922 - DNA, 19 bp, Artificial sequence
  SiRNA target sequence
taatatttcatgtacatta

SEQ ID NO: 195923 - DNA, 19 bp, Artificial sequence
  SiRNA target sequence
aatatttcatgtacattaa

SEQ ID NO: 195924 - DNA, 19 bp, Artificial sequence
  SiRNA target sequence
atatttcatgtacattaat

SEQ ID NO: 195925 - DNA, 19 bp, Artificial sequence
  SiRNA target sequence
tatttcatgtacattaata

SEQ ID NO: 195926 - DNA, 19 bp, Artificial sequence
  SiRNA target sequence
atttcatgtacattaatat

SEQ ID NO: 195927 - DNA, 19 bp, Artificial sequence
  SiRNA target sequence
tttcatgtacattaatatt

SEQ ID NO: 195928 - DNA, 19 bp, Artificial sequence
  SiRNA target sequence
ttcatgtacattaatatta

SEQ ID NO: 195929 - DNA, 19 bp, Artificial sequence
  SiRNA target sequence
tcatgtacattaatattag

SEQ ID NO: 195930 - DNA, 19 bp, Artificial sequence
  SiRNA target sequence
catgtacattaatattaga

SEQ ID NO: 195931 - DNA, 19 bp, Artificial sequence
  SiRNA target sequence
atgtacattaatattagac

SEQ ID NO: 195932 - DNA, 19 bp, Artificial sequence
  SiRNA target sequence
tgtacattaatattagaca

SEQ ID NO: 195933 - DNA, 19 bp, Artificial sequence
  SiRNA target sequence
gtacattaatattagacat

SEQ ID NO: 195934 - DNA, 19 bp, Artificial sequence
  SiRNA target sequence
tacattaatattagacata

SEQ ID NO: 195935 - DNA, 19 bp, Artificial sequence
  SiRNA target sequence
acattaatattagacatat

SEQ ID NO: 195936 - DNA, 19 bp, Artificial sequence
  SiRNA target sequence
cattaatattagacatata

SEQ ID NO: 195937 - DNA, 19 bp, Artificial sequence
  SiRNA target sequence
attaatattagacatatac

SEQ ID NO: 195938 - DNA, 19 bp, Artificial sequence
  SiRNA target sequence
ttaatattagacatatacc

SEQ ID NO: 195939 - DNA, 19 bp, Artificial sequence
  SiRNA target sequence
taatattagacatataccg

SEQ ID NO: 195940 - DNA, 19 bp, Artificial sequence
  SiRNA target sequence
aatattagacatataccgc

SEQ ID NO: 195941 - DNA, 19 bp, Artificial sequence
  SiRNA target sequence
atattagacatataccgcc

SEQ ID NO: 195942 - DNA, 19 bp, Artificial sequence
  SiRNA target sequence
tattagacatataccgccc

SEQ ID NO: 195943 - DNA, 19 bp, Artificial sequence
  SiRNA target sequence
attagacatataccgccca

SEQ ID NO: 195944 - DNA, 19 bp, Artificial sequence
  SiRNA target sequence
ttagacatataccgcccat

SEQ ID NO: 195945 - DNA, 19 bp, Artificial sequence
  SiRNA target sequence
tagacatataccgcccatg

SEQ ID NO: 195946 - DNA, 19 bp, Artificial sequence
  SiRNA target sequence
agacatataccgcccatgg

SEQ ID NO: 195947 - DNA, 19 bp, Artificial sequence
  SiRNA target sequence
gacatataccgcccatggc

SEQ ID NO: 195948 - DNA, 19 bp, Artificial sequence
  SiRNA target sequence
acatataccgcccatggca

SEQ ID NO: 195949 - DNA, 19 bp, Artificial sequence
  SiRNA target sequence
catataccgcccatggcaa

SEQ ID NO: 195950 - DNA, 19 bp, Artificial sequence
  SiRNA target sequence
atataccgcccatggcaat

SEQ ID NO: 195951 - DNA, 19 bp, Artificial sequence
  SiRNA target sequence
tataccgcccatggcaata

SEQ ID NO: 195952 - DNA, 19 bp, Artificial sequence
  SiRNA target sequence
ataccgcccatggcaataa

SEQ ID NO: 195953 - DNA, 19 bp, Artificial sequence
  SiRNA target sequence
taccgcccatggcaataaa

SEQ ID NO: 195954 - DNA, 19 bp, Artificial sequence
  SiRNA target sequence
accgcccatggcaataaaa

SEQ ID NO: 195955 - DNA, 19 bp, Artificial sequence
  SiRNA target sequence
ccgcccatggcaataaaaa

SEQ ID NO: 195956 - DNA, 19 bp, Artificial sequence
  SiRNA target sequence
cgcccatggcaataaaaac

SEQ ID NO: 195957 - DNA, 19 bp, Artificial sequence
  SiRNA target sequence
gcccatggcaataaaaacc

SEQ ID NO: 195958 - DNA, 19 bp, Artificial sequence
  SiRNA target sequence
cccatggcaataaaaaccg

SEQ ID NO: 195959 - DNA, 19 bp, Artificial sequence
  SiRNA target sequence
ccatggcaataaaaaccga

SEQ ID NO: 195960 - DNA, 19 bp, Artificial sequence
  SiRNA target sequence
catggcaataaaaaccgaa

SEQ ID NO: 195961 - DNA, 19 bp, Artificial sequence
  SiRNA target sequence
atggcaataaaaaccgaag

SEQ ID NO: 195962 - DNA, 19 bp, Artificial sequence
  SiRNA target sequence
tggcaataaaaaccgaaga

SEQ ID NO: 195963 - DNA, 19 bp, Artificial sequence
  SiRNA target sequence
ggcaataaaaaccgaagaa

SEQ ID NO: 195964 - DNA, 19 bp, Artificial sequence
  SiRNA target sequence
gcaataaaaaccgaagaat

SEQ ID NO: 195965 - DNA, 19 bp, Artificial sequence
  SiRNA target sequence
caataaaaaccgaagaata

SEQ ID NO: 195966 - DNA, 19 bp, Artificial sequence
  SiRNA target sequence
aataaaaaccgaagaatat

SEQ ID NO: 195967 - DNA, 19 bp, Artificial sequence
  SiRNA target sequence
ataaaaaccgaagaatata

SEQ ID NO: 195968 - DNA, 19 bp, Artificial sequence
  SiRNA target sequence
taaaaaccgaagaatataa

SEQ ID NO: 195969 - DNA, 19 bp, Artificial sequence
  SiRNA target sequence
aaaaaccgaagaatataat

SEQ ID NO: 195970 - DNA, 19 bp, Artificial sequence
  SiRNA target sequence
aaaaccgaagaatataata

SEQ ID NO: 195971 - DNA, 19 bp, Artificial sequence
  SiRNA target sequence
aaaccgaagaatataataa

SEQ ID NO: 195972 - DNA, 19 bp, Artificial sequence
  SiRNA target sequence
aaccgaagaatataataac

SEQ ID NO: 195973 - DNA, 19 bp, Artificial sequence
  SiRNA target sequence
accgaagaatataataact

SEQ ID NO: 195974 - DNA, 19 bp, Artificial sequence
  SiRNA target sequence
ccgaagaatataataactg

SEQ ID NO: 195975 - DNA, 19 bp, Artificial sequence
  SiRNA target sequence
cgaagaatataataactga

SEQ ID NO: 195976 - DNA, 19 bp, Artificial sequence
  SiRNA target sequence
gaagaatataataactgat

SEQ ID NO: 195977 - DNA, 19 bp, Artificial sequence
  SiRNA target sequence
aagaatataataactgatt

SEQ ID NO: 195978 - DNA, 19 bp, Artificial sequence
  SiRNA target sequence
agaatataataactgattt

SEQ ID NO: 195979 - DNA, 19 bp, Artificial sequence
  SiRNA target sequence
gaatataataactgatttt

SEQ ID NO: 195980 - DNA, 19 bp, Artificial sequence
  SiRNA target sequence
aatataataactgattttg

SEQ ID NO: 195981 - DNA, 19 bp, Artificial sequence
  SiRNA target sequence
atataataactgattttgc

SEQ ID NO: 195982 - DNA, 19 bp, Artificial sequence
  SiRNA target sequence
tataataactgattttgct

SEQ ID NO: 195983 - DNA, 19 bp, Artificial sequence
  SiRNA target sequence
ataataactgattttgctc

SEQ ID NO: 195984 - DNA, 19 bp, Artificial sequence
  SiRNA target sequence
taataactgattttgctca

SEQ ID NO: 195985 - DNA, 19 bp, Artificial sequence
  SiRNA target sequence
aataactgattttgctcat

SEQ ID NO: 195986 - DNA, 19 bp, Artificial sequence
  SiRNA target sequence
ataactgattttgctcata

SEQ ID NO: 195987 - DNA, 19 bp, Artificial sequence
  SiRNA target sequence
taactgattttgctcatag

SEQ ID NO: 195988 - DNA, 19 bp, Artificial sequence
  SiRNA target sequence
aactgattttgctcatagc

SEQ ID NO: 195989 - DNA, 19 bp, Artificial sequence
  SiRNA target sequence
actgattttgctcatagct

SEQ ID NO: 195990 - DNA, 19 bp, Artificial sequence
  SiRNA target sequence
ctgattttgctcatagcta

SEQ ID NO: 195991 - DNA, 19 bp, Artificial sequence
  SiRNA target sequence
tgattttgctcatagctaa

SEQ ID NO: 195992 - DNA, 19 bp, Artificial sequence
  SiRNA target sequence
gattttgctcatagctaaa

SEQ ID NO: 195993 - DNA, 19 bp, Artificial sequence
  SiRNA target sequence
attttgctcatagctaaat

SEQ ID NO: 195994 - DNA, 19 bp, Artificial sequence
  SiRNA target sequence
ttttgctcatagctaaatc

SEQ ID NO: 195995 - DNA, 19 bp, Artificial sequence
  SiRNA target sequence
tttgctcatagctaaatcc

SEQ ID NO: 195996 - DNA, 19 bp, Artificial sequence
  SiRNA target sequence
ttgctcatagctaaatcct

SEQ ID NO: 195997 - DNA, 19 bp, Artificial sequence
  SiRNA target sequence
tgctcatagctaaatcctt

SEQ ID NO: 195998 - DNA, 19 bp, Artificial sequence
  SiRNA target sequence
gctcatagctaaatccttt

SEQ ID NO: 195999 - DNA, 19 bp, Artificial sequence
  SiRNA target sequence
ctcatagctaaatcctttt

SEQ ID NO: 196000 - DNA, 19 bp, Artificial sequence
  SiRNA target sequence
tcatagctaaatccttttc

SEQ ID NO: 196001 - DNA, 19 bp, Artificial sequence
  SiRNA target sequence
catagctaaatccttttcg

SEQ ID NO: 196002 - DNA, 19 bp, Artificial sequence
  SiRNA target sequence
atagctaaatccttttcgc

SEQ ID NO: 196003 - DNA, 19 bp, Artificial sequence
  SiRNA target sequence
tagctaaatccttttcgca

SEQ ID NO: 196004 - DNA, 19 bp, Artificial sequence
  SiRNA target sequence
agctaaatccttttcgcaa

SEQ ID NO: 196005 - DNA, 19 bp, Artificial sequence
  SiRNA target sequence
gctaaatccttttcgcaat

SEQ ID NO: 196006 - DNA, 19 bp, Artificial sequence
  SiRNA target sequence
ctaaatccttttcgcaatt

SEQ ID NO: 196007 - DNA, 19 bp, Artificial sequence
  SiRNA target sequence
taaatccttttcgcaattc

SEQ ID NO: 196008 - DNA, 19 bp, Artificial sequence
  SiRNA target sequence
aaatccttttcgcaattct

SEQ ID NO: 196009 - DNA, 19 bp, Artificial sequence
  SiRNA target sequence
aatccttttcgcaattctc

SEQ ID NO: 196010 - DNA, 19 bp, Artificial sequence
  SiRNA target sequence
atccttttcgcaattctct

SEQ ID NO: 196011 - DNA, 19 bp, Artificial sequence
  SiRNA target sequence
tccttttcgcaattctctg

SEQ ID NO: 196012 - DNA, 19 bp, Artificial sequence
  SiRNA target sequence
ccttttcgcaattctctga

SEQ ID NO: 196013 - DNA, 19 bp, Artificial sequence
  SiRNA target sequence
cttttcgcaattctctgaa

SEQ ID NO: 196014 - DNA, 19 bp, Artificial sequence
  SiRNA target sequence
ttttcgcaattctctgaaa

SEQ ID NO: 196015 - DNA, 19 bp, Artificial sequence
  SiRNA target sequence
tttcgcaattctctgaaag

SEQ ID NO: 196016 - DNA, 19 bp, Artificial sequence
  SiRNA target sequence
ttcgcaattctctgaaaga

SEQ ID NO: 196017 - DNA, 19 bp, Artificial sequence
  SiRNA target sequence
tcgcaattctctgaaagaa

SEQ ID NO: 196018 - DNA, 19 bp, Artificial sequence
  SiRNA target sequence
cgcaattctctgaaagaac

SEQ ID NO: 196019 - DNA, 19 bp, Artificial sequence
  SiRNA target sequence
gcaattctctgaaagaact

SEQ ID NO: 196020 - DNA, 19 bp, Artificial sequence
  SiRNA target sequence
caattctctgaaagaacta

SEQ ID NO: 196021 - DNA, 19 bp, Artificial sequence
  SiRNA target sequence
aattctctgaaagaactac

SEQ ID NO: 196022 - DNA, 19 bp, Artificial sequence
  SiRNA target sequence
attctctgaaagaactact
